United States Patent 11,421,016 (CANCER NEOEPITOPES) - sequence listing, part 3

SEQ ID NO: 91987 - protein, 9 aa, Homo Sapiens
EKHEGGNDR

SEQ ID NO: 91988 - protein, 9 aa, Homo Sapiens
VPQQGVELP

SEQ ID NO: 91989 - protein, 9 aa, Homo Sapiens
YELKNLEHL

SEQ ID NO: 91990 - protein, 9 aa, Homo Sapiens
PIFWNFMFF

SEQ ID NO: 91991 - protein, 9 aa, Homo Sapiens
KEDKEINSH

SEQ ID NO: 91992 - protein, 9 aa, Homo Sapiens
VNLCLRFPA

SEQ ID NO: 91993 - protein, 9 aa, Homo Sapiens
LNEHFSQFG

SEQ ID NO: 91994 - protein, 9 aa, Homo Sapiens
LYIRDYGEI

SEQ ID NO: 91995 - protein, 9 aa, Homo Sapiens
NGCGKRSLF

SEQ ID NO: 91996 - protein, 9 aa, Homo Sapiens
RSDAIPIVV

SEQ ID NO: 91997 - protein, 9 aa, Homo Sapiens
QILGLMGLT

SEQ ID NO: 91998 - protein, 9 aa, Homo Sapiens
KDFQKLMAD

SEQ ID NO: 91999 - protein, 9 aa, Homo Sapiens
GGHPLDTSH

SEQ ID NO: 92000 - protein, 9 aa, Homo Sapiens
RNSLKHQER

SEQ ID NO: 92001 - protein, 9 aa, Homo Sapiens
VIYKNFNPV

SEQ ID NO: 92002 - protein, 9 aa, Homo Sapiens
MKNIGGIPA

SEQ ID NO: 92003 - protein, 9 aa, Homo Sapiens
NTEMEEVIN

SEQ ID NO: 92004 - protein, 9 aa, Homo Sapiens
CWGTHSKPL

SEQ ID NO: 92005 - protein, 9 aa, Homo Sapiens
INFIFRTKH

SEQ ID NO: 92006 - protein, 9 aa, Homo Sapiens
RKAAHKNGM

SEQ ID NO: 92007 - protein, 9 aa, Homo Sapiens
LTVHPETPE

SEQ ID NO: 92008 - protein, 9 aa, Homo Sapiens
AHGSTALIL

SEQ ID NO: 92009 - protein, 9 aa, Homo Sapiens
CMELYKPND

SEQ ID NO: 92010 - protein, 9 aa, Homo Sapiens
PVCGPAPPS

SEQ ID NO: 92011 - protein, 9 aa, Homo Sapiens
ESQYFKRQS

SEQ ID NO: 92012 - protein, 9 aa, Homo Sapiens
PNTTAVPVD

SEQ ID NO: 92013 - protein, 9 aa, Homo Sapiens
QYRTLMCIS

SEQ ID NO: 92014 - protein, 9 aa, Homo Sapiens
TKYINLSLH

SEQ ID NO: 92015 - protein, 9 aa, Homo Sapiens
VKLRCPCKI

SEQ ID NO: 92016 - protein, 9 aa, Homo Sapiens
LEIRTINFI

SEQ ID NO: 92017 - protein, 9 aa, Homo Sapiens
DLAESLSND

SEQ ID NO: 92018 - protein, 9 aa, Homo Sapiens
TCILLCSSH

SEQ ID NO: 92019 - protein, 9 aa, Homo Sapiens
PLDTSHLPQ

SEQ ID NO: 92020 - protein, 9 aa, Homo Sapiens
REKKERLEQ

SEQ ID NO: 92021 - protein, 9 aa, Homo Sapiens
RQLQQITYS

SEQ ID NO: 92022 - protein, 9 aa, Homo Sapiens
MRQRRPPLC

SEQ ID NO: 92023 - protein, 9 aa, Homo Sapiens
ISGDRKINR

SEQ ID NO: 92024 - protein, 9 aa, Homo Sapiens
IMKLPHKFH

SEQ ID NO: 92025 - protein, 9 aa, Homo Sapiens
PKIINGKHT

SEQ ID NO: 92026 - protein, 9 aa, Homo Sapiens
AENEQILNV

SEQ ID NO: 92027 - protein, 9 aa, Homo Sapiens
ELEQQKEED

SEQ ID NO: 92028 - protein, 9 aa, Homo Sapiens
TLTTHKAIY

SEQ ID NO: 92029 - protein, 9 aa, Homo Sapiens
LITGIISLK

SEQ ID NO: 92030 - protein, 9 aa, Homo Sapiens
LRTIVLKMP

SEQ ID NO: 92031 - protein, 9 aa, Homo Sapiens
KYCLGTKKY

SEQ ID NO: 92032 - protein, 9 aa, Homo Sapiens
TIERYTYPH

SEQ ID NO: 92033 - protein, 9 aa, Homo Sapiens
YQRALHIRK

SEQ ID NO: 92034 - protein, 9 aa, Homo Sapiens
PSSNSFQNN

SEQ ID NO: 92035 - protein, 9 aa, Homo Sapiens
KKTHEKLRQ

SEQ ID NO: 92036 - protein, 9 aa, Homo Sapiens
SHNDVMMTQ

SEQ ID NO: 92037 - protein, 9 aa, Homo Sapiens
LNVLQAVGE

SEQ ID NO: 92038 - protein, 9 aa, Homo Sapiens
RSADDSQRL

SEQ ID NO: 92039 - protein, 9 aa, Homo Sapiens
ARFGAGATP

SEQ ID NO: 92040 - protein, 9 aa, Homo Sapiens
KLITGIISL

SEQ ID NO: 92041 - protein, 9 aa, Homo Sapiens
EFQFILDVS

SEQ ID NO: 92042 - protein, 9 aa, Homo Sapiens
IAQTQNGIS

SEQ ID NO: 92043 - protein, 9 aa, Homo Sapiens
LKFIAQYGN

SEQ ID NO: 92044 - protein, 9 aa, Homo Sapiens
YKTYLRPIT

SEQ ID NO: 92045 - protein, 9 aa, Homo Sapiens
LHTPHKPIS

SEQ ID NO: 92046 - protein, 9 aa, Homo Sapiens
HRLIEQEEY

SEQ ID NO: 92047 - protein, 9 aa, Homo Sapiens
TKKGQVPGP

SEQ ID NO: 92048 - protein, 9 aa, Homo Sapiens
GHTRLAFPS

SEQ ID NO: 92049 - protein, 9 aa, Homo Sapiens
SVILSVKFC

SEQ ID NO: 92050 - protein, 9 aa, Homo Sapiens
NDKTLQTDS

SEQ ID NO: 92051 - protein, 9 aa, Homo Sapiens
KCKTMQSDG

SEQ ID NO: 92052 - protein, 9 aa, Homo Sapiens
KCDECGKIL

SEQ ID NO: 92053 - protein, 9 aa, Homo Sapiens
YKEERILKH

SEQ ID NO: 92054 - protein, 9 aa, Homo Sapiens
AAHKNGMKN

SEQ ID NO: 92055 - protein, 9 aa, Homo Sapiens
GTNDENEYV

SEQ ID NO: 92056 - protein, 9 aa, Homo Sapiens
SKAKADTLS

SEQ ID NO: 92057 - protein, 9 aa, Homo Sapiens
DTSFFLTLL

SEQ ID NO: 92058 - protein, 9 aa, Homo Sapiens
MVLTAGPNW

SEQ ID NO: 92059 - protein, 9 aa, Homo Sapiens
KFHYIFNFR

SEQ ID NO: 92060 - protein, 9 aa, Homo Sapiens
RLMELFPTN

SEQ ID NO: 92061 - protein, 9 aa, Homo Sapiens
LHVESDFDD

SEQ ID NO: 92062 - protein, 9 aa, Homo Sapiens
NLYNNGVDV

SEQ ID NO: 92063 - protein, 9 aa, Homo Sapiens
PSESKAKAI

SEQ ID NO: 92064 - protein, 9 aa, Homo Sapiens
KRLRIQSKQ

SEQ ID NO: 92065 - protein, 9 aa, Homo Sapiens
RDDLSQHQV

SEQ ID NO: 92066 - protein, 9 aa, Homo Sapiens
DLFTENENK

SEQ ID NO: 92067 - protein, 9 aa, Homo Sapiens
EDDDLHVES

SEQ ID NO: 92068 - protein, 9 aa, Homo Sapiens
AYVNENQAR

SEQ ID NO: 92069 - protein, 9 aa, Homo Sapiens
GECVEDITN

SEQ ID NO: 92070 - protein, 9 aa, Homo Sapiens
VLANSYDTA

SEQ ID NO: 92071 - protein, 9 aa, Homo Sapiens
AVVSVFLQA

SEQ ID NO: 92072 - protein, 9 aa, Homo Sapiens
VALADYYIK

SEQ ID NO: 92073 - protein, 9 aa, Homo Sapiens
RLRIQSKQN

SEQ ID NO: 92074 - protein, 9 aa, Homo Sapiens
KRRREQEER

SEQ ID NO: 92075 - protein, 9 aa, Homo Sapiens
KSSYASACS

SEQ ID NO: 92076 - protein, 9 aa, Homo Sapiens
LRQEIEVQH

SEQ ID NO: 92077 - protein, 9 aa, Homo Sapiens
RTINFIFRT

SEQ ID NO: 92078 - protein, 9 aa, Homo Sapiens
QPEQLAELW

SEQ ID NO: 92079 - protein, 9 aa, Homo Sapiens
QDTCILLCS

SEQ ID NO: 92080 - protein, 9 aa, Homo Sapiens
GNTIYFTCR

SEQ ID NO: 92081 - protein, 9 aa, Homo Sapiens
YKNFNPVWD

SEQ ID NO: 92082 - protein, 9 aa, Homo Sapiens
SEGGDGKAS

SEQ ID NO: 92083 - protein, 9 aa, Homo Sapiens
ENLLTRLLK

SEQ ID NO: 92084 - protein, 9 aa, Homo Sapiens
RFGAGATPG

SEQ ID NO: 92085 - protein, 9 aa, Homo Sapiens
GKILSQSSA

SEQ ID NO: 92086 - protein, 9 aa, Homo Sapiens
AIVKLATKD

SEQ ID NO: 92087 - protein, 9 aa, Homo Sapiens
DSFHPQITK

SEQ ID NO: 92088 - protein, 9 aa, Homo Sapiens
KTAKESTAE

SEQ ID NO: 92089 - protein, 9 aa, Homo Sapiens
FHYIFNFRD

SEQ ID NO: 92090 - protein, 9 aa, Homo Sapiens
RDVRGQEGT

SEQ ID NO: 92091 - protein, 9 aa, Homo Sapiens
GATPGNIPP

SEQ ID NO: 92092 - protein, 9 aa, Homo Sapiens
PQITKDEVL

SEQ ID NO: 92093 - protein, 9 aa, Homo Sapiens
CSKDVTFHP

SEQ ID NO: 92094 - protein, 9 aa, Homo Sapiens
KEVTIPFLF

SEQ ID NO: 92095 - protein, 9 aa, Homo Sapiens
GATPGNIPV

SEQ ID NO: 92096 - protein, 9 aa, Homo Sapiens
TAILNKSIR

SEQ ID NO: 92097 - protein, 9 aa, Homo Sapiens
FCISGDRKI

SEQ ID NO: 92098 - protein, 9 aa, Homo Sapiens
LPEEVQELY

SEQ ID NO: 92099 - protein, 9 aa, Homo Sapiens
LDRFEKAGP

SEQ ID NO: 92100 - protein, 9 aa, Homo Sapiens
EKESAAYSQ

SEQ ID NO: 92101 - protein, 9 aa, Homo Sapiens
EHELCWLKH

SEQ ID NO: 92102 - protein, 9 aa, Homo Sapiens
YVEEDGYIK

SEQ ID NO: 92103 - protein, 9 aa, Homo Sapiens
KDIISLKCK

SEQ ID NO: 92104 - protein, 9 aa, Homo Sapiens
KIYDLHKKT

SEQ ID NO: 92105 - protein, 9 aa, Homo Sapiens
KVIYKNFNP

SEQ ID NO: 92106 - protein, 9 aa, Homo Sapiens
VEEMPSESK

SEQ ID NO: 92107 - protein, 9 aa, Homo Sapiens
QTVKQALVL

SEQ ID NO: 92108 - protein, 9 aa, Homo Sapiens
LYINIVAYD

SEQ ID NO: 92109 - protein, 9 aa, Homo Sapiens
DCSGPALKR

SEQ ID NO: 92110 - protein, 9 aa, Homo Sapiens
FSFSKTSSG

SEQ ID NO: 92111 - protein, 9 aa, Homo Sapiens
PMQQKQKYK

SEQ ID NO: 92112 - protein, 9 aa, Homo Sapiens
QPVCGPAPP

SEQ ID NO: 92113 - protein, 9 aa, Homo Sapiens
TSLKYTNEP

SEQ ID NO: 92114 - protein, 9 aa, Homo Sapiens
TRKLSRDGS

SEQ ID NO: 92115 - protein, 9 aa, Homo Sapiens
PNWSATFDV

SEQ ID NO: 92116 - protein, 9 aa, Homo Sapiens
DTEKHEGGN

SEQ ID NO: 92117 - protein, 9 aa, Homo Sapiens
DDLHVESDF

SEQ ID NO: 92118 - protein, 9 aa, Homo Sapiens
SDHLGLHMK

SEQ ID NO: 92119 - protein, 9 aa, Homo Sapiens
TNLFFIVTP

SEQ ID NO: 92120 - protein, 9 aa, Homo Sapiens
QFMIEAQPP

SEQ ID NO: 92121 - protein, 9 aa, Homo Sapiens
LLCSKDVTF

SEQ ID NO: 92122 - protein, 9 aa, Homo Sapiens
TVHPETPEG

SEQ ID NO: 92123 - protein, 9 aa, Homo Sapiens
FTASIHRLI

SEQ ID NO: 92124 - protein, 9 aa, Homo Sapiens
ISPGGKSQI

SEQ ID NO: 92125 - protein, 9 aa, Homo Sapiens
SGTQKSQRT

SEQ ID NO: 92126 - protein, 9 aa, Homo Sapiens
KLESVAEKH

SEQ ID NO: 92127 - protein, 9 aa, Homo Sapiens
SDTNQSGGS

SEQ ID NO: 92128 - protein, 9 aa, Homo Sapiens
SKEQAKATI

SEQ ID NO: 92129 - protein, 9 aa, Homo Sapiens
CGKVFCYRS

SEQ ID NO: 92130 - protein, 9 aa, Homo Sapiens
RLSTLKFIA

SEQ ID NO: 92131 - protein, 9 aa, Homo Sapiens
GCTFVAFSP

SEQ ID NO: 92132 - protein, 9 aa, Homo Sapiens
HIKQVADQP

SEQ ID NO: 92133 - protein, 9 aa, Homo Sapiens
LDDKKIKKK

SEQ ID NO: 92134 - protein, 9 aa, Homo Sapiens
SEAEGRRKA

SEQ ID NO: 92135 - protein, 9 aa, Homo Sapiens
FHLDTPEER

SEQ ID NO: 92136 - protein, 9 aa, Homo Sapiens
EKNNAALAR

SEQ ID NO: 92137 - protein, 9 aa, Homo Sapiens
LEPILYFIV

SEQ ID NO: 92138 - protein, 9 aa, Homo Sapiens
INMPNTSVF

SEQ ID NO: 92139 - protein, 9 aa, Homo Sapiens
VEAKKTAIG

SEQ ID NO: 92140 - protein, 9 aa, Homo Sapiens
KHSKCGPCN

SEQ ID NO: 92141 - protein, 9 aa, Homo Sapiens
QAKATILED

SEQ ID NO: 92142 - protein, 9 aa, Homo Sapiens
PEGEEWDEE

SEQ ID NO: 92143 - protein, 9 aa, Homo Sapiens
MDAENEQIL

SEQ ID NO: 92144 - protein, 9 aa, Homo Sapiens
KISPGGKSQ

SEQ ID NO: 92145 - protein, 9 aa, Homo Sapiens
RKEANSSEE

SEQ ID NO: 92146 - protein, 9 aa, Homo Sapiens
KTKKGQVPG

SEQ ID NO: 92147 - protein, 9 aa, Homo Sapiens
VCTRCGKAF

SEQ ID NO: 92148 - protein, 9 aa, Homo Sapiens
RPTALINGY

SEQ ID NO: 92149 - protein, 9 aa, Homo Sapiens
PNRAHGSWA

SEQ ID NO: 92150 - protein, 9 aa, Homo Sapiens
ATPGNIPVK

SEQ ID NO: 92151 - protein, 9 aa, Homo Sapiens
KAGGVTGKG

SEQ ID NO: 92152 - protein, 9 aa, Homo Sapiens
FSRSDHLGL

SEQ ID NO: 92153 - protein, 9 aa, Homo Sapiens
EIFLAAVST

SEQ ID NO: 92154 - protein, 9 aa, Homo Sapiens
QENPYGPQT

SEQ ID NO: 92155 - protein, 9 aa, Homo Sapiens
PFRVNAEFV

SEQ ID NO: 92156 - protein, 9 aa, Homo Sapiens
YRFLICMLH

SEQ ID NO: 92157 - protein, 9 aa, Homo Sapiens
FPTNKQSVE

SEQ ID NO: 92158 - protein, 9 aa, Homo Sapiens
EIEHFQQAI

SEQ ID NO: 92159 - protein, 9 aa, Homo Sapiens
EPILYFIVS

SEQ ID NO: 92160 - protein, 9 aa, Homo Sapiens
QPMQQKQKY

SEQ ID NO: 92161 - protein, 9 aa, Homo Sapiens
NDILKESNI

SEQ ID NO: 92162 - protein, 9 aa, Homo Sapiens
NEKNRNNLI

SEQ ID NO: 92163 - protein, 9 aa, Homo Sapiens
RCDGINDCF

SEQ ID NO: 92164 - protein, 9 aa, Homo Sapiens
WAEYIEKYC

SEQ ID NO: 92165 - protein, 9 aa, Homo Sapiens
WEGKEKTFT

SEQ ID NO: 92166 - protein, 9 aa, Homo Sapiens
KHKNLYINI

SEQ ID NO: 92167 - protein, 9 aa, Homo Sapiens
MEIAQTQNG

SEQ ID NO: 92168 - protein, 9 aa, Homo Sapiens
DLHVESDFD

SEQ ID NO: 92169 - protein, 9 aa, Homo Sapiens
FSKTSSGQS

SEQ ID NO: 92170 - protein, 9 aa, Homo Sapiens
LRRLGDCSG

SEQ ID NO: 92171 - protein, 9 aa, Homo Sapiens
LTSDSLSHN

SEQ ID NO: 92172 - protein, 9 aa, Homo Sapiens
GQDTCILLC

SEQ ID NO: 92173 - protein, 9 aa, Homo Sapiens
PLAEIDIKN

SEQ ID NO: 92174 - protein, 9 aa, Homo Sapiens
EVNLCLRFP

SEQ ID NO: 92175 - protein, 9 aa, Homo Sapiens
RLIQMLACP

SEQ ID NO: 92176 - protein, 9 aa, Homo Sapiens
KDINGTAVV

SEQ ID NO: 92177 - protein, 9 aa, Homo Sapiens
RITKDEIFP

SEQ ID NO: 92178 - protein, 9 aa, Homo Sapiens
IETEERERL

SEQ ID NO: 92179 - protein, 9 aa, Homo Sapiens
MTINEKHMY

SEQ ID NO: 92180 - protein, 9 aa, Homo Sapiens
DRFIEDKTL

SEQ ID NO: 92181 - protein, 9 aa, Homo Sapiens
REQEERLRR

SEQ ID NO: 92182 - protein, 9 aa, Homo Sapiens
CGADGTMKI

SEQ ID NO: 92183 - protein, 9 aa, Homo Sapiens
MSRKNYQSF

SEQ ID NO: 92184 - protein, 9 aa, Homo Sapiens
RHLLGFPPQ

SEQ ID NO: 92185 - protein, 9 aa, Homo Sapiens
EKHMYPSIQ

SEQ ID NO: 92186 - protein, 9 aa, Homo Sapiens
FLVALADYY

SEQ ID NO: 92187 - protein, 9 aa, Homo Sapiens
TQEKEEIMQ

SEQ ID NO: 92188 - protein, 9 aa, Homo Sapiens
ELDDKKIKK

SEQ ID NO: 92189 - protein, 9 aa, Homo Sapiens
WMLTPAFHF

SEQ ID NO: 92190 - protein, 9 aa, Homo Sapiens
KVDYELKNL

SEQ ID NO: 92191 - protein, 9 aa, Homo Sapiens
SDLAESLSN

SEQ ID NO: 92192 - protein, 9 aa, Homo Sapiens
KTMMEKNEL

SEQ ID NO: 92193 - protein, 9 aa, Homo Sapiens
LPTTAQFMI

SEQ ID NO: 92194 - protein, 9 aa, Homo Sapiens
GYKTYLRPI

SEQ ID NO: 92195 - protein, 9 aa, Homo Sapiens
LARDIYDKE

SEQ ID NO: 92196 - protein, 9 aa, Homo Sapiens
IGHYAQNVS

SEQ ID NO: 92197 - protein, 9 aa, Homo Sapiens
WNEIIKNTN

SEQ ID NO: 92198 - protein, 9 aa, Homo Sapiens
YRTEKNNAA

SEQ ID NO: 92199 - protein, 9 aa, Homo Sapiens
HSSPASTTK

SEQ ID NO: 92200 - protein, 9 aa, Homo Sapiens
GPNGCGKRS

SEQ ID NO: 92201 - protein, 9 aa, Homo Sapiens
PTAQNIRVL

SEQ ID NO: 92202 - protein, 9 aa, Homo Sapiens
GVSVSCIVN

SEQ ID NO: 92203 - protein, 9 aa, Homo Sapiens
QELATFKSQ

SEQ ID NO: 92204 - protein, 9 aa, Homo Sapiens
KCGPCNYKA

SEQ ID NO: 92205 - protein, 9 aa, Homo Sapiens
YGHTYVEVN

SEQ ID NO: 92206 - protein, 9 aa, Homo Sapiens
HELCWLKHK

SEQ ID NO: 92207 - protein, 9 aa, Homo Sapiens
PILLQQKPR

SEQ ID NO: 92208 - protein, 9 aa, Homo Sapiens
QELYIRDYG

SEQ ID NO: 92209 - protein, 9 aa, Homo Sapiens
VTTKFHRFP

SEQ ID NO: 92210 - protein, 9 aa, Homo Sapiens
DSQRLTAMA

SEQ ID NO: 92211 - protein, 9 aa, Homo Sapiens
PIILGFTID

SEQ ID NO: 92212 - protein, 9 aa, Homo Sapiens
TNQSGGSDI

SEQ ID NO: 92213 - protein, 9 aa, Homo Sapiens
NAKIADFVL

SEQ ID NO: 92214 - protein, 9 aa, Homo Sapiens
IEDKTLLLA

SEQ ID NO: 92215 - protein, 9 aa, Homo Sapiens
RMAHGSTAL

SEQ ID NO: 92216 - protein, 9 aa, Homo Sapiens
MAHPSQGNA

SEQ ID NO: 92217 - protein, 9 aa, Homo Sapiens
DVGTDEEEK

SEQ ID NO: 92218 - protein, 9 aa, Homo Sapiens
ASPKQRCSI

SEQ ID NO: 92219 - protein, 9 aa, Homo Sapiens
EKHEILTKS

SEQ ID NO: 92220 - protein, 9 aa, Homo Sapiens
SLKRDSTEV

SEQ ID NO: 92221 - protein, 9 aa, Homo Sapiens
ALVNSQVDF

SEQ ID NO: 92222 - protein, 9 aa, Homo Sapiens
CQIFIENKI

SEQ ID NO: 92223 - protein, 9 aa, Homo Sapiens
EIIKNTNLG

SEQ ID NO: 92224 - protein, 9 aa, Homo Sapiens
DDIGRSENE

SEQ ID NO: 92225 - protein, 9 aa, Homo Sapiens
QLYAFCYCG

SEQ ID NO: 92226 - protein, 9 aa, Homo Sapiens
PSQVELLEV

SEQ ID NO: 92227 - protein, 9 aa, Homo Sapiens
DHLGLHMKR

SEQ ID NO: 92228 - protein, 9 aa, Homo Sapiens
LANSYDTAW

SEQ ID NO: 92229 - protein, 9 aa, Homo Sapiens
GDLQLEPIL

SEQ ID NO: 92230 - protein, 9 aa, Homo Sapiens
IAVVSVFLQ

SEQ ID NO: 92231 - protein, 9 aa, Homo Sapiens
KIPELADHL

SEQ ID NO: 92232 - protein, 9 aa, Homo Sapiens
TNDENEYVE

SEQ ID NO: 92233 - protein, 9 aa, Homo Sapiens
NNERTTDLK

SEQ ID NO: 92234 - protein, 9 aa, Homo Sapiens
YTNEPPQGV

SEQ ID NO: 92235 - protein, 9 aa, Homo Sapiens
PVRKHFEMP

SEQ ID NO: 92236 - protein, 9 aa, Homo Sapiens
HKKTSCNLD

SEQ ID NO: 92237 - protein, 9 aa, Homo Sapiens
LVQGGGLAV

SEQ ID NO: 92238 - protein, 9 aa, Homo Sapiens
EDSEEKDVL

SEQ ID NO: 92239 - protein, 9 aa, Homo Sapiens
IGAQQSFHL

SEQ ID NO: 92240 - protein, 9 aa, Homo Sapiens
ICKPDSDCQ

SEQ ID NO: 92241 - protein, 9 aa, Homo Sapiens
DIGRSENEK

SEQ ID NO: 92242 - protein, 9 aa, Homo Sapiens
EKFTASIHR

SEQ ID NO: 92243 - protein, 9 aa, Homo Sapiens
FRNYFNEKN

SEQ ID NO: 92244 - protein, 9 aa, Homo Sapiens
QLQGPWMFP

SEQ ID NO: 92245 - protein, 9 aa, Homo Sapiens
RPMDPPRPC

SEQ ID NO: 92246 - protein, 9 aa, Homo Sapiens
DHHLHTSVY

SEQ ID NO: 92247 - protein, 9 aa, Homo Sapiens
LSLEDSTMC

SEQ ID NO: 92248 - protein, 9 aa, Homo Sapiens
NLSCPKRLR

SEQ ID NO: 92249 - protein, 9 aa, Homo Sapiens
TPDDLYVSS

SEQ ID NO: 92250 - protein, 9 aa, Homo Sapiens
LETSKATAS

SEQ ID NO: 92251 - protein, 9 aa, Homo Sapiens
DTLSIIRLS

SEQ ID NO: 92252 - protein, 9 aa, Homo Sapiens
PCNYKAECD

SEQ ID NO: 92253 - protein, 9 aa, Homo Sapiens
EDPPIGAQQ

SEQ ID NO: 92254 - protein, 9 aa, Homo Sapiens
TLITDGMRT

SEQ ID NO: 92255 - protein, 9 aa, Homo Sapiens
DVPSQCEIS

SEQ ID NO: 92256 - protein, 9 aa, Homo Sapiens
TAQPLWNNR

SEQ ID NO: 92257 - protein, 9 aa, Homo Sapiens
KIKKKTHKV

SEQ ID NO: 92258 - protein, 9 aa, Homo Sapiens
IYYFKQLHT

SEQ ID NO: 92259 - protein, 9 aa, Homo Sapiens
EEGKKIKKR

SEQ ID NO: 92260 - protein, 9 aa, Homo Sapiens
VFEAIHKAK

SEQ ID NO: 92261 - protein, 9 aa, Homo Sapiens
AFSPAFALF

SEQ ID NO: 92262 - protein, 9 aa, Homo Sapiens
NKIAMKNIG

SEQ ID NO: 92263 - protein, 9 aa, Homo Sapiens
AVLPWPFRN

SEQ ID NO: 92264 - protein, 9 aa, Homo Sapiens
IENHQKMIK

SEQ ID NO: 92265 - protein, 9 aa, Homo Sapiens
DPELSYEFK

SEQ ID NO: 92266 - protein, 9 aa, Homo Sapiens
DPFRVNAEF

SEQ ID NO: 92267 - protein, 9 aa, Homo Sapiens
PSLCTIQHD

SEQ ID NO: 92268 - protein, 9 aa, Homo Sapiens
SVVVPCEPP

SEQ ID NO: 92269 - protein, 9 aa, Homo Sapiens
FPKRMVLLP

SEQ ID NO: 92270 - protein, 9 aa, Homo Sapiens
GPWMFPLTS

SEQ ID NO: 92271 - protein, 9 aa, Homo Sapiens
RGRSRMQER

SEQ ID NO: 92272 - protein, 9 aa, Homo Sapiens
DLFTLIAGC

SEQ ID NO: 92273 - protein, 9 aa, Homo Sapiens
SSEDDDLHV

SEQ ID NO: 92274 - protein, 9 aa, Homo Sapiens
MCISVADPM

SEQ ID NO: 92275 - protein, 9 aa, Homo Sapiens
QQELEQQKE

SEQ ID NO: 92276 - protein, 9 aa, Homo Sapiens
KWKQSIGQY

SEQ ID NO: 92277 - protein, 9 aa, Homo Sapiens
DIVRITKDE

SEQ ID NO: 92278 - protein, 9 aa, Homo Sapiens
KKHNSSKEK

SEQ ID NO: 92279 - protein, 9 aa, Homo Sapiens
DLSHSSKII

SEQ ID NO: 92280 - protein, 9 aa, Homo Sapiens
LVALADYYI

SEQ ID NO: 92281 - protein, 9 aa, Homo Sapiens
NSHNLLKMI

SEQ ID NO: 92282 - protein, 9 aa, Homo Sapiens
IPLLVQCSE

SEQ ID NO: 92283 - protein, 9 aa, Homo Sapiens
SSEDDIGRS

SEQ ID NO: 92284 - protein, 9 aa, Homo Sapiens
FWSLKPENL

SEQ ID NO: 92285 - protein, 9 aa, Homo Sapiens
FTLIAGCKE

SEQ ID NO: 92286 - protein, 9 aa, Homo Sapiens
LYLNFQSAI

SEQ ID NO: 92287 - protein, 9 aa, Homo Sapiens
KRKRRKMTQ

SEQ ID NO: 92288 - protein, 9 aa, Homo Sapiens
DERQENPYG

SEQ ID NO: 92289 - protein, 9 aa, Homo Sapiens
NSPSDKVDY

SEQ ID NO: 92290 - protein, 9 aa, Homo Sapiens
ERYTYPHKY

SEQ ID NO: 92291 - protein, 9 aa, Homo Sapiens
HHAAKAKFF

SEQ ID NO: 92292 - protein, 9 aa, Homo Sapiens
ARDGPGVLC

SEQ ID NO: 92293 - protein, 9 aa, Homo Sapiens
AGDKLTPRK

SEQ ID NO: 92294 - protein, 9 aa, Homo Sapiens
SRDGSGSPS

SEQ ID NO: 92295 - protein, 9 aa, Homo Sapiens
RRLSPPPSL

SEQ ID NO: 92296 - protein, 9 aa, Homo Sapiens
TWEGKEKTF

SEQ ID NO: 92297 - protein, 9 aa, Homo Sapiens
RCSIIRDRG

SEQ ID NO: 92298 - protein, 9 aa, Homo Sapiens
LFPTMSADT

SEQ ID NO: 92299 - protein, 9 aa, Homo Sapiens
PPKIINGKH

SEQ ID NO: 92300 - protein, 9 aa, Homo Sapiens
SQRLTAMAF

SEQ ID NO: 92301 - protein, 9 aa, Homo Sapiens
MPSESKAKA

SEQ ID NO: 92302 - protein, 9 aa, Homo Sapiens
FFGGTEFFL

SEQ ID NO: 92303 - protein, 9 aa, Homo Sapiens
TKRVPMGPI

SEQ ID NO: 92304 - protein, 9 aa, Homo Sapiens
KKERLEQDL

SEQ ID NO: 92305 - protein, 9 aa, Homo Sapiens
RNRQKNGSW

SEQ ID NO: 92306 - protein, 9 aa, Homo Sapiens
FCPFGQWWA

SEQ ID NO: 92307 - protein, 9 aa, Homo Sapiens
SVYFFLKNL

SEQ ID NO: 92308 - protein, 9 aa, Homo Sapiens
SGDRKINRY

SEQ ID NO: 92309 - protein, 9 aa, Homo Sapiens
IYFAARALQ

SEQ ID NO: 92310 - protein, 9 aa, Homo Sapiens
QSHRGRSRM

SEQ ID NO: 92311 - protein, 9 aa, Homo Sapiens
SFHPQITKD

SEQ ID NO: 92312 - protein, 9 aa, Homo Sapiens
EKNDILKES

SEQ ID NO: 92313 - protein, 9 aa, Homo Sapiens
PQYFLLSCG

SEQ ID NO: 92314 - protein, 9 aa, Homo Sapiens
HPQTVKQAL

SEQ ID NO: 92315 - protein, 9 aa, Homo Sapiens
ETQEEINKA

SEQ ID NO: 92316 - protein, 9 aa, Homo Sapiens
ITYSLIEWR

SEQ ID NO: 92317 - protein, 9 aa, Homo Sapiens
FPPPSSNSF

SEQ ID NO: 92318 - protein, 9 aa, Homo Sapiens
QQAPSETPR

SEQ ID NO: 92319 - protein, 9 aa, Homo Sapiens
IISIYYFKQ

SEQ ID NO: 92320 - protein, 9 aa, Homo Sapiens
TASIHRLIE

SEQ ID NO: 92321 - protein, 9 aa, Homo Sapiens
PTNKQSVEH

SEQ ID NO: 92322 - protein, 9 aa, Homo Sapiens
RDSISRLHV

SEQ ID NO: 92323 - protein, 9 aa, Homo Sapiens
GDCSGPALK

SEQ ID NO: 92324 - protein, 9 aa, Homo Sapiens
ATSFQSMEV

SEQ ID NO: 92325 - protein, 9 aa, Homo Sapiens
DPSQVELLE

SEQ ID NO: 92326 - protein, 9 aa, Homo Sapiens
EAIENHQKM

SEQ ID NO: 92327 - protein, 9 aa, Homo Sapiens
FLTVHPETP

SEQ ID NO: 92328 - protein, 9 aa, Homo Sapiens
GKTICQDSK

SEQ ID NO: 92329 - protein, 9 aa, Homo Sapiens
LKVIPETSL

SEQ ID NO: 92330 - protein, 9 aa, Homo Sapiens
KASSQIRVP

SEQ ID NO: 92331 - protein, 9 aa, Homo Sapiens
QLWAFLHIK

SEQ ID NO: 92332 - protein, 9 aa, Homo Sapiens
SSFQWLLST

SEQ ID NO: 92333 - protein, 9 aa, Homo Sapiens
VGYLLIGDK

SEQ ID NO: 92334 - protein, 9 aa, Homo Sapiens
LDTSHLPQE

SEQ ID NO: 92335 - protein, 9 aa, Homo Sapiens
LDNDKTLQT

SEQ ID NO: 92336 - protein, 9 aa, Homo Sapiens
SFREMVFRK

SEQ ID NO: 92337 - protein, 9 aa, Homo Sapiens
DLSLEDSTM

SEQ ID NO: 92338 - protein, 9 aa, Homo Sapiens
KSKVIYKNF

SEQ ID NO: 92339 - protein, 9 aa, Homo Sapiens
EKLDVNCQK

SEQ ID NO: 92340 - protein, 9 aa, Homo Sapiens
GNNNERTTD

SEQ ID NO: 92341 - protein, 9 aa, Homo Sapiens
LCLRFPAES

SEQ ID NO: 92342 - protein, 9 aa, Homo Sapiens
KESLDAKAT

SEQ ID NO: 92343 - protein, 9 aa, Homo Sapiens
LPTMLPDEI

SEQ ID NO: 92344 - protein, 9 aa, Homo Sapiens
GDGKASSQI

SEQ ID NO: 92345 - protein, 9 aa, Homo Sapiens
WIHWDPELS

SEQ ID NO: 92346 - protein, 9 aa, Homo Sapiens
SEDDDLHVE

SEQ ID NO: 92347 - protein, 9 aa, Homo Sapiens
DKTLLLAVR

SEQ ID NO: 92348 - protein, 9 aa, Homo Sapiens
VNENQARVS

SEQ ID NO: 92349 - protein, 9 aa, Homo Sapiens
WEDPPIGAQ

SEQ ID NO: 92350 - protein, 9 aa, Homo Sapiens
QNIRVLLGK

SEQ ID NO: 92351 - protein, 9 aa, Homo Sapiens
TTAQFMIEA

SEQ ID NO: 92352 - protein, 9 aa, Homo Sapiens
ASILKGYKT

SEQ ID NO: 92353 - protein, 9 aa, Homo Sapiens
SQHQVQEEQ

SEQ ID NO: 92354 - protein, 9 aa, Homo Sapiens
KFTASIHRL

SEQ ID NO: 92355 - protein, 9 aa, Homo Sapiens
DKEQYHKIL

SEQ ID NO: 92356 - protein, 9 aa, Homo Sapiens
GQKNKILEE

SEQ ID NO: 92357 - protein, 9 aa, Homo Sapiens
EFDINSNSS

SEQ ID NO: 92358 - protein, 9 aa, Homo Sapiens
NFPNKGYSV

SEQ ID NO: 92359 - protein, 9 aa, Homo Sapiens
DEISMNLSH

SEQ ID NO: 92360 - protein, 9 aa, Homo Sapiens
PETSLTNNS

SEQ ID NO: 92361 - protein, 9 aa, Homo Sapiens
EKTFTLINV

SEQ ID NO: 92362 - protein, 9 aa, Homo Sapiens
ESKAKAIEK

SEQ ID NO: 92363 - protein, 9 aa, Homo Sapiens
KRKRDVRGQ

SEQ ID NO: 92364 - protein, 9 aa, Homo Sapiens
WMFPLTSLF

SEQ ID NO: 92365 - protein, 9 aa, Homo Sapiens
SPTYRHLLG

SEQ ID NO: 92366 - protein, 9 aa, Homo Sapiens
KEKDLCIKS

SEQ ID NO: 92367 - protein, 9 aa, Homo Sapiens
RSKGRSRHQ

SEQ ID NO: 92368 - protein, 9 aa, Homo Sapiens
WAFLHIKQV

SEQ ID NO: 92369 - protein, 9 aa, Homo Sapiens
TGIISLKTR

SEQ ID NO: 92370 - protein, 9 aa, Homo Sapiens
EQMSRKNYQ

SEQ ID NO: 92371 - protein, 9 aa, Homo Sapiens
IYAGEKPYK

SEQ ID NO: 92372 - protein, 9 aa, Homo Sapiens
SQQPVCGPA

SEQ ID NO: 92373 - protein, 9 aa, Homo Sapiens
VGTDEEEKT

SEQ ID NO: 92374 - protein, 9 aa, Homo Sapiens
GKSQILDLV

SEQ ID NO: 92375 - protein, 9 aa, Homo Sapiens
SKDERQENP

SEQ ID NO: 92376 - protein, 9 aa, Homo Sapiens
LRAVLGRKG

SEQ ID NO: 92377 - protein, 9 aa, Homo Sapiens
SVGFVKAIE

SEQ ID NO: 92378 - protein, 9 aa, Homo Sapiens
PESQLQGPW

SEQ ID NO: 92379 - protein, 9 aa, Homo Sapiens
SVKFCPFGQ

SEQ ID NO: 92380 - protein, 9 aa, Homo Sapiens
RNDDHDLPT

SEQ ID NO: 92381 - protein, 9 aa, Homo Sapiens
SLDLKNKRI

SEQ ID NO: 92382 - protein, 9 aa, Homo Sapiens
LEDMSEYSD

SEQ ID NO: 92383 - protein, 9 aa, Homo Sapiens
WLSLVKIKI

SEQ ID NO: 92384 - protein, 9 aa, Homo Sapiens
TDLSLEDST

SEQ ID NO: 92385 - protein, 9 aa, Homo Sapiens
LLEWFNYPS

SEQ ID NO: 92386 - protein, 9 aa, Homo Sapiens
GASADEIIY

SEQ ID NO: 92387 - protein, 9 aa, Homo Sapiens
LDHHLHTSV

SEQ ID NO: 92388 - protein, 9 aa, Homo Sapiens
PGQGKAQQA

SEQ ID NO: 92389 - protein, 9 aa, Homo Sapiens
HYLKKHNSS

SEQ ID NO: 92390 - protein, 9 aa, Homo Sapiens
AKATILEDQ

SEQ ID NO: 92391 - protein, 9 aa, Homo Sapiens
IYFTCRAEG

SEQ ID NO: 92392 - protein, 9 aa, Homo Sapiens
CSKLATSFQ

SEQ ID NO: 92393 - protein, 9 aa, Homo Sapiens
AILNKSIRN

SEQ ID NO: 92394 - protein, 9 aa, Homo Sapiens
MGLSRKSSY

SEQ ID NO: 92395 - protein, 9 aa, Homo Sapiens
LAQNTGQDT

SEQ ID NO: 92396 - protein, 9 aa, Homo Sapiens
WSLKPENLL

SEQ ID NO: 92397 - protein, 9 aa, Homo Sapiens
SEQLYAFCY

SEQ ID NO: 92398 - protein, 9 aa, Homo Sapiens
PGPNTTAVP

SEQ ID NO: 92399 - protein, 9 aa, Homo Sapiens
NSSETTDLL

SEQ ID NO: 92400 - protein, 9 aa, Homo Sapiens
ANKSKTNEL

SEQ ID NO: 92401 - protein, 9 aa, Homo Sapiens
WTVNYGLQE

SEQ ID NO: 92402 - protein, 9 aa, Homo Sapiens
GLAVLSERF

SEQ ID NO: 92403 - protein, 9 aa, Homo Sapiens
ADDSQRLTA

SEQ ID NO: 92404 - protein, 9 aa, Homo Sapiens
QQLQSLQVQ

SEQ ID NO: 92405 - protein, 9 aa, Homo Sapiens
ILEQGWKLI

SEQ ID NO: 92406 - protein, 9 aa, Homo Sapiens
QKNKILEEM

SEQ ID NO: 92407 - protein, 9 aa, Homo Sapiens
EKKRTAAIA

SEQ ID NO: 92408 - protein, 9 aa, Homo Sapiens
QIAKALVNS

SEQ ID NO: 92409 - protein, 9 aa, Homo Sapiens
KLLRTDQLE

SEQ ID NO: 92410 - protein, 9 aa, Homo Sapiens
NSHCPRVVL

SEQ ID NO: 92411 - protein, 9 aa, Homo Sapiens
KSKANFEKM

SEQ ID NO: 92412 - protein, 9 aa, Homo Sapiens
EANSSEEPR

SEQ ID NO: 92413 - protein, 9 aa, Homo Sapiens
SNSFQNNPS

SEQ ID NO: 92414 - protein, 9 aa, Homo Sapiens
RKHFEMPHD

SEQ ID NO: 92415 - protein, 9 aa, Homo Sapiens
DEEEKWAAE

SEQ ID NO: 92416 - protein, 9 aa, Homo Sapiens
TIYFTCRAE

SEQ ID NO: 92417 - protein, 9 aa, Homo Sapiens
NLAMIISIY

SEQ ID NO: 92418 - protein, 9 aa, Homo Sapiens
KMIKQFKGV

SEQ ID NO: 92419 - protein, 9 aa, Homo Sapiens
SKAKAIEKI

SEQ ID NO: 92420 - protein, 9 aa, Homo Sapiens
EIFDFRGMR

SEQ ID NO: 92421 - protein, 9 aa, Homo Sapiens
YDLHKKTSC

SEQ ID NO: 92422 - protein, 9 aa, Homo Sapiens
EMPHDIVAS

SEQ ID NO: 92423 - protein, 9 aa, Homo Sapiens
LKELLNETQ

SEQ ID NO: 92424 - protein, 9 aa, Homo Sapiens
ALVLSQGSF

SEQ ID NO: 92425 - protein, 9 aa, Homo Sapiens
EIRTINFIF

SEQ ID NO: 92426 - protein, 9 aa, Homo Sapiens
SLKCKTMQS

SEQ ID NO: 92427 - protein, 9 aa, Homo Sapiens
LAEIDIKNV

SEQ ID NO: 92428 - protein, 9 aa, Homo Sapiens
VFCYRSGLA

SEQ ID NO: 92429 - protein, 9 aa, Homo Sapiens
QISFDLYES

SEQ ID NO: 92430 - protein, 9 aa, Homo Sapiens
QKMIKQFKG

SEQ ID NO: 92431 - protein, 9 aa, Homo Sapiens
LAELWGRGD

SEQ ID NO: 92432 - protein, 9 aa, Homo Sapiens
GSFKGNHLC

SEQ ID NO: 92433 - protein, 9 aa, Homo Sapiens
ERTFHLDTP

SEQ ID NO: 92434 - protein, 9 aa, Homo Sapiens
MKMSGDKSS

SEQ ID NO: 92435 - protein, 9 aa, Homo Sapiens
MVNQNTIHV

SEQ ID NO: 92436 - protein, 9 aa, Homo Sapiens
SHVMLQIIN

SEQ ID NO: 92437 - protein, 9 aa, Homo Sapiens
DGDSFHPQI

SEQ ID NO: 92438 - protein, 9 aa, Homo Sapiens
NWSATFDVP

SEQ ID NO: 92439 - protein, 9 aa, Homo Sapiens
KEQAKATIL

SEQ ID NO: 92440 - protein, 9 aa, Homo Sapiens
WFCPESQLQ

SEQ ID NO: 92441 - protein, 9 aa, Homo Sapiens
VIPETSLTN

SEQ ID NO: 92442 - protein, 9 aa, Homo Sapiens
YKEQMAYLQ

SEQ ID NO: 92443 - protein, 9 aa, Homo Sapiens
YLNWQDIPL

SEQ ID NO: 92444 - protein, 9 aa, Homo Sapiens
HRGRSRMQE

SEQ ID NO: 92445 - protein, 9 aa, Homo Sapiens
SSVSSPDHA

SEQ ID NO: 92446 - protein, 9 aa, Homo Sapiens
APAYGFPKR

SEQ ID NO: 92447 - protein, 9 aa, Homo Sapiens
GEKDFQKLM

SEQ ID NO: 92448 - protein, 9 aa, Homo Sapiens
SQGTIERYT

SEQ ID NO: 92449 - protein, 9 aa, Homo Sapiens
KGLHRGHTR

SEQ ID NO: 92450 - protein, 9 aa, Homo Sapiens
LSVKFCPFG

SEQ ID NO: 92451 - protein, 9 aa, Homo Sapiens
FDSLHVYGQ

SEQ ID NO: 92452 - protein, 9 aa, Homo Sapiens
AVDWVNNKM

SEQ ID NO: 92453 - protein, 9 aa, Homo Sapiens
ETVSKSKAN

SEQ ID NO: 92454 - protein, 9 aa, Homo Sapiens
MRPMDPPRP

SEQ ID NO: 92455 - protein, 9 aa, Homo Sapiens
CKIIKKELQ

SEQ ID NO: 92456 - protein, 9 aa, Homo Sapiens
QETQESDLS

SEQ ID NO: 92457 - protein, 9 aa, Homo Sapiens
NMSKIAEAR

SEQ ID NO: 92458 - protein, 9 aa, Homo Sapiens
EPGKEDEKK

SEQ ID NO: 92459 - protein, 9 aa, Homo Sapiens
SFDSLHVYG

SEQ ID NO: 92460 - protein, 9 aa, Homo Sapiens
NFMFFICLF

SEQ ID NO: 92461 - protein, 9 aa, Homo Sapiens
VKLDFLWHP

SEQ ID NO: 92462 - protein, 9 aa, Homo Sapiens
YLGKYRGQL

SEQ ID NO: 92463 - protein, 9 aa, Homo Sapiens
KTHEKLRQE

SEQ ID NO: 92464 - protein, 9 aa, Homo Sapiens
WGTHSKPLY

SEQ ID NO: 92465 - protein, 9 aa, Homo Sapiens
WRLFVNIYF

SEQ ID NO: 92466 - protein, 9 aa, Homo Sapiens
VEVPSGNTI

SEQ ID NO: 92467 - protein, 9 aa, Homo Sapiens
ELRHRLRLE

SEQ ID NO: 92468 - protein, 9 aa, Homo Sapiens
AAQAGSLET

SEQ ID NO: 92469 - protein, 9 aa, Homo Sapiens
IVLKMPMKL

SEQ ID NO: 92470 - protein, 9 aa, Homo Sapiens
PSGNTIYFT

SEQ ID NO: 92471 - protein, 9 aa, Homo Sapiens
YQISFDLYE

SEQ ID NO: 92472 - protein, 9 aa, Homo Sapiens
CACIYFAAR

SEQ ID NO: 92473 - protein, 9 aa, Homo Sapiens
VRITKDEIF

SEQ ID NO: 92474 - protein, 9 aa, Homo Sapiens
QEEINKALN

SEQ ID NO: 92475 - protein, 9 aa, Homo Sapiens
KGMSSHLNS

SEQ ID NO: 92476 - protein, 9 aa, Homo Sapiens
RVNAEFVLL

SEQ ID NO: 92477 - protein, 9 aa, Homo Sapiens
FLDTDAEFV

SEQ ID NO: 92478 - protein, 9 aa, Homo Sapiens
FEFDINSNS

SEQ ID NO: 92479 - protein, 9 aa, Homo Sapiens
DARMAHGST

SEQ ID NO: 92480 - protein, 9 aa, Homo Sapiens
GAGATPGNI

SEQ ID NO: 92481 - protein, 9 aa, Homo Sapiens
LKAGECVED

SEQ ID NO: 92482 - protein, 9 aa, Homo Sapiens
ASTTKRVPM

SEQ ID NO: 92483 - protein, 9 aa, Homo Sapiens
TEKHEGGND

SEQ ID NO: 92484 - protein, 9 aa, Homo Sapiens
KLVQGGGLA

SEQ ID NO: 92485 - protein, 9 aa, Homo Sapiens
CNECGKVFC

SEQ ID NO: 92486 - protein, 9 aa, Homo Sapiens
GGKSQILDL

SEQ ID NO: 92487 - protein, 9 aa, Homo Sapiens
TNKQSVEHF

SEQ ID NO: 92488 - protein, 9 aa, Homo Sapiens
PTNKEFQFI

SEQ ID NO: 92489 - protein, 9 aa, Homo Sapiens
GVELPSVLR

SEQ ID NO: 92490 - protein, 9 aa, Homo Sapiens
LFPYQSLLQ

SEQ ID NO: 92491 - protein, 9 aa, Homo Sapiens
KRDSTEVEI

SEQ ID NO: 92492 - protein, 9 aa, Homo Sapiens
RAVLMRPMD

SEQ ID NO: 92493 - protein, 9 aa, Homo Sapiens
KLNEHFSQF

SEQ ID NO: 92494 - protein, 9 aa, Homo Sapiens
HAIHNHRTI

SEQ ID NO: 92495 - protein, 9 aa, Homo Sapiens
EAKISEQLY

SEQ ID NO: 92496 - protein, 9 aa, Homo Sapiens
FCPESQLQG

SEQ ID NO: 92497 - protein, 9 aa, Homo Sapiens
IERYTYPHK

SEQ ID NO: 92498 - protein, 9 aa, Homo Sapiens
TGDLQLEPI

SEQ ID NO: 92499 - protein, 9 aa, Homo Sapiens
KLLNSSCSV

SEQ ID NO: 92500 - protein, 9 aa, Homo Sapiens
LLNIFFGGG

SEQ ID NO: 92501 - protein, 9 aa, Homo Sapiens
GTDEEEKTA

SEQ ID NO: 92502 - protein, 9 aa, Homo Sapiens
RYTYPHKYK

SEQ ID NO: 92503 - protein, 9 aa, Homo Sapiens
KAAHKNGMK

SEQ ID NO: 92504 - protein, 9 aa, Homo Sapiens
TEEEYRFLI

SEQ ID NO: 92505 - protein, 9 aa, Homo Sapiens
NKMYLVETK

SEQ ID NO: 92506 - protein, 9 aa, Homo Sapiens
AVPEKKVPP

SEQ ID NO: 92507 - protein, 9 aa, Homo Sapiens
SKLDRFEKA

SEQ ID NO: 92508 - protein, 9 aa, Homo Sapiens
KLVWAINVT

SEQ ID NO: 92509 - protein, 9 aa, Homo Sapiens
SGNTIYFTC

SEQ ID NO: 92510 - protein, 9 aa, Homo Sapiens
LKIIHQANK

SEQ ID NO: 92511 - protein, 9 aa, Homo Sapiens
FVDKEEKYA

SEQ ID NO: 92512 - protein, 9 aa, Homo Sapiens
VKQVEDGEI

SEQ ID NO: 92513 - protein, 9 aa, Homo Sapiens
AVLMRPMDP

SEQ ID NO: 92514 - protein, 9 aa, Homo Sapiens
ASKHKFLDR

SEQ ID NO: 92515 - protein, 9 aa, Homo Sapiens
AQVPQQGVE

SEQ ID NO: 92516 - protein, 9 aa, Homo Sapiens
FEMPHDIVA

SEQ ID NO: 92517 - protein, 9 aa, Homo Sapiens
TFTLINVYC

SEQ ID NO: 92518 - protein, 9 aa, Homo Sapiens
IVRITKDEI

SEQ ID NO: 92519 - protein, 9 aa, Homo Sapiens
KNVLKLSTK

SEQ ID NO: 92520 - protein, 9 aa, Homo Sapiens
QANKSKTNE

SEQ ID NO: 92521 - protein, 9 aa, Homo Sapiens
GAQQSFHLA

SEQ ID NO: 92522 - protein, 9 aa, Homo Sapiens
PPPSLCTIQ

SEQ ID NO: 92523 - protein, 9 aa, Homo Sapiens
RLERFEKYM

SEQ ID NO: 92524 - protein, 9 aa, Homo Sapiens
KLSCSKLAT

SEQ ID NO: 92525 - protein, 9 aa, Homo Sapiens
TEERERLKE

SEQ ID NO: 92526 - protein, 9 aa, Homo Sapiens
IISLKTRMV

SEQ ID NO: 92527 - protein, 9 aa, Homo Sapiens
ITMTINEKH

SEQ ID NO: 92528 - protein, 9 aa, Homo Sapiens
SSPDHAMVS

SEQ ID NO: 92529 - protein, 9 aa, Homo Sapiens
KGILEQGWK

SEQ ID NO: 92530 - protein, 9 aa, Homo Sapiens
SQGNAAYLP

SEQ ID NO: 92531 - protein, 9 aa, Homo Sapiens
NGYYISEIP

SEQ ID NO: 92532 - protein, 9 aa, Homo Sapiens
LPLQSEKRL

SEQ ID NO: 92533 - protein, 9 aa, Homo Sapiens
LDLKNKRIE

SEQ ID NO: 92534 - protein, 9 aa, Homo Sapiens
EKLRQEIEV

SEQ ID NO: 92535 - protein, 9 aa, Homo Sapiens
FIKGVHGKA

SEQ ID NO: 92536 - protein, 9 aa, Homo Sapiens
ITPEDLLNI

SEQ ID NO: 92537 - protein, 9 aa, Homo Sapiens
KGNNNERTT

SEQ ID NO: 92538 - protein, 9 aa, Homo Sapiens
AQTQNGISE

SEQ ID NO: 92539 - protein, 9 aa, Homo Sapiens
IIYIGKRSL

SEQ ID NO: 92540 - protein, 9 aa, Homo Sapiens
SLASLTASG

SEQ ID NO: 92541 - protein, 9 aa, Homo Sapiens
PGKEDEKKE

SEQ ID NO: 92542 - protein, 9 aa, Homo Sapiens
SNPGPPGPK

SEQ ID NO: 92543 - protein, 9 aa, Homo Sapiens
RTHWTPFLN

SEQ ID NO: 92544 - protein, 9 aa, Homo Sapiens
SKIAEARKT

SEQ ID NO: 92545 - protein, 9 aa, Homo Sapiens
KDPATSLPM

SEQ ID NO: 92546 - protein, 9 aa, Homo Sapiens
RLRRLGDCS

SEQ ID NO: 92547 - protein, 9 aa, Homo Sapiens
DIISLKCKT

SEQ ID NO: 92548 - protein, 9 aa, Homo Sapiens
VYNNTARCV

SEQ ID NO: 92549 - protein, 9 aa, Homo Sapiens
DTNQSGGSD

SEQ ID NO: 92550 - protein, 9 aa, Homo Sapiens
FHYPQDLTR

SEQ ID NO: 92551 - protein, 9 aa, Homo Sapiens
RIEMLEHKY

SEQ ID NO: 92552 - protein, 9 aa, Homo Sapiens
TETKYINLS

SEQ ID NO: 92553 - protein, 9 aa, Homo Sapiens
CLRFPAESD

SEQ ID NO: 92554 - protein, 9 aa, Homo Sapiens
RATVLANSY

SEQ ID NO: 92555 - protein, 9 aa, Homo Sapiens
IVNLAVCLL

SEQ ID NO: 92556 - protein, 9 aa, Homo Sapiens
LLQTSLKYT

SEQ ID NO: 92557 - protein, 9 aa, Homo Sapiens
TVRAFHFDK

SEQ ID NO: 92558 - protein, 9 aa, Homo Sapiens
NKRMRTASS

SEQ ID NO: 92559 - protein, 9 aa, Homo Sapiens
ALADYYIKC

SEQ ID NO: 92560 - protein, 9 aa, Homo Sapiens
IYDLHKKTS

SEQ ID NO: 92561 - protein, 9 aa, Homo Sapiens
FRVNAEFVL

SEQ ID NO: 92562 - protein, 9 aa, Homo Sapiens
RTEKNNAAL

SEQ ID NO: 92563 - protein, 9 aa, Homo Sapiens
YHLILLTSL

SEQ ID NO: 92564 - protein, 9 aa, Homo Sapiens
IGDVSLVKE

SEQ ID NO: 92565 - protein, 9 aa, Homo Sapiens
KGFKQCSHL

SEQ ID NO: 92566 - protein, 9 aa, Homo Sapiens
LNKSIRNLQ

SEQ ID NO: 92567 - protein, 9 aa, Homo Sapiens
LDAQLQARR

SEQ ID NO: 92568 - protein, 9 aa, Homo Sapiens
CTFVAFSPA

SEQ ID NO: 92569 - protein, 9 aa, Homo Sapiens
KCSHRNSLK

SEQ ID NO: 92570 - protein, 9 aa, Homo Sapiens
HEKLRQEIE

SEQ ID NO: 92571 - protein, 9 aa, Homo Sapiens
SRLYESNPM

SEQ ID NO: 92572 - protein, 9 aa, Homo Sapiens
EMPSESKAK

SEQ ID NO: 92573 - protein, 9 aa, Homo Sapiens
YGFPKRMVL

SEQ ID NO: 92574 - protein, 9 aa, Homo Sapiens
LSYGRDLSH

SEQ ID NO: 92575 - protein, 9 aa, Homo Sapiens
RDGSGSPSK

SEQ ID NO: 92576 - protein, 9 aa, Homo Sapiens
VQELYIRDY

SEQ ID NO: 92577 - protein, 9 aa, Homo Sapiens
VASAWTVNY

SEQ ID NO: 92578 - protein, 9 aa, Homo Sapiens
GNTSQQLQS

SEQ ID NO: 92579 - protein, 9 aa, Homo Sapiens
KEAYVNENQ

SEQ ID NO: 92580 - protein, 9 aa, Homo Sapiens
KEIQKSKGQ

SEQ ID NO: 92581 - protein, 9 aa, Homo Sapiens
RLAFPSPFG

SEQ ID NO: 92582 - protein, 9 aa, Homo Sapiens
HGCLENLYN

SEQ ID NO: 92583 - protein, 9 aa, Homo Sapiens
IPETSLTNN

SEQ ID NO: 92584 - protein, 9 aa, Homo Sapiens
VYLGKYRGQ

SEQ ID NO: 92585 - protein, 9 aa, Homo Sapiens
KIADFVLSN

SEQ ID NO: 92586 - protein, 9 aa, Homo Sapiens
KYRGQLYLQ

SEQ ID NO: 92587 - protein, 9 aa, Homo Sapiens
QTSLKYTNE

SEQ ID NO: 92588 - protein, 9 aa, Homo Sapiens
VNGYYISEI

SEQ ID NO: 92589 - protein, 9 aa, Homo Sapiens
IFDFRGMRL

SEQ ID NO: 92590 - protein, 9 aa, Homo Sapiens
YLNSLQSNP

SEQ ID NO: 92591 - protein, 9 aa, Homo Sapiens
RPEEENVYS

SEQ ID NO: 92592 - protein, 9 aa, Homo Sapiens
EDKGSLTEG

SEQ ID NO: 92593 - protein, 9 aa, Homo Sapiens
QDYPTYTIV

SEQ ID NO: 92594 - protein, 9 aa, Homo Sapiens
YRLFVYLHL

SEQ ID NO: 92595 - protein, 9 aa, Homo Sapiens
VENWNADHS

SEQ ID NO: 92596 - protein, 9 aa, Homo Sapiens
SADTMELKW

SEQ ID NO: 92597 - protein, 9 aa, Homo Sapiens
AHGSWATPP

SEQ ID NO: 92598 - protein, 9 aa, Homo Sapiens
GEYDAVLPW

SEQ ID NO: 92599 - protein, 9 aa, Homo Sapiens
QSSDNSDTN

SEQ ID NO: 92600 - protein, 9 aa, Homo Sapiens
EKGAMDLEK

SEQ ID NO: 92601 - protein, 9 aa, Homo Sapiens
VDKEEKYAI

SEQ ID NO: 92602 - protein, 9 aa, Homo Sapiens
MTIMNSPMG

SEQ ID NO: 92603 - protein, 9 aa, Homo Sapiens
TVNYGLQEK

SEQ ID NO: 92604 - protein, 9 aa, Homo Sapiens
RREQEERLR

SEQ ID NO: 92605 - protein, 9 aa, Homo Sapiens
DINSNSSET

SEQ ID NO: 92606 - protein, 9 aa, Homo Sapiens
GGGLAVLSE

SEQ ID NO: 92607 - protein, 9 aa, Homo Sapiens
FNFRDFANI

SEQ ID NO: 92608 - protein, 9 aa, Homo Sapiens
CGELFRCFS

SEQ ID NO: 92609 - protein, 9 aa, Homo Sapiens
KAMINAGQL

SEQ ID NO: 92610 - protein, 9 aa, Homo Sapiens
ELADHLEEP

SEQ ID NO: 92611 - protein, 9 aa, Homo Sapiens
YGFVKAMIN

SEQ ID NO: 92612 - protein, 9 aa, Homo Sapiens
IREEPGCCI

SEQ ID NO: 92613 - protein, 9 aa, Homo Sapiens
GRNNMIQQK

SEQ ID NO: 92614 - protein, 9 aa, Homo Sapiens
EFEKKRTAA

SEQ ID NO: 92615 - protein, 9 aa, Homo Sapiens
SKLKVIPET

SEQ ID NO: 92616 - protein, 9 aa, Homo Sapiens
AEGRRKAVA

SEQ ID NO: 92617 - protein, 9 aa, Homo Sapiens
HKILDLIES

SEQ ID NO: 92618 - protein, 9 aa, Homo Sapiens
AGPGRKDSQ

SEQ ID NO: 92619 - protein, 9 aa, Homo Sapiens
ADHLEEPDD

SEQ ID NO: 92620 - protein, 9 aa, Homo Sapiens
TKFHRFPNV

SEQ ID NO: 92621 - protein, 9 aa, Homo Sapiens
EIMKMSGDK

SEQ ID NO: 92622 - protein, 9 aa, Homo Sapiens
SEQFQRISK

SEQ ID NO: 92623 - protein, 9 aa, Homo Sapiens
QNVSMWIFA

SEQ ID NO: 92624 - protein, 9 aa, Homo Sapiens
VYKPILLQQ

SEQ ID NO: 92625 - protein, 9 aa, Homo Sapiens
DFQKLMADP

SEQ ID NO: 92626 - protein, 9 aa, Homo Sapiens
QYYSNVIAN

SEQ ID NO: 92627 - protein, 9 aa, Homo Sapiens
MLVSNFPNK

SEQ ID NO: 92628 - protein, 9 aa, Homo Sapiens
VELPSVLRQ

SEQ ID NO: 92629 - protein, 9 aa, Homo Sapiens
ANHVQRLIQ

SEQ ID NO: 92630 - protein, 9 aa, Homo Sapiens
GDIVRITKD

SEQ ID NO: 92631 - protein, 9 aa, Homo Sapiens
QYHKILDLI

SEQ ID NO: 92632 - protein, 9 aa, Homo Sapiens
QITYSLIEW

SEQ ID NO: 92633 - protein, 9 aa, Homo Sapiens
WFNYPSLRD

SEQ ID NO: 92634 - protein, 9 aa, Homo Sapiens
KKLLEWFNY

SEQ ID NO: 92635 - protein, 9 aa, Homo Sapiens
QNEKNRNNL

SEQ ID NO: 92636 - protein, 9 aa, Homo Sapiens
MSGTQKSQR

SEQ ID NO: 92637 - protein, 9 aa, Homo Sapiens
FIHMSGTQK

SEQ ID NO: 92638 - protein, 9 aa, Homo Sapiens
CKPDSDCQG

SEQ ID NO: 92639 - protein, 9 aa, Homo Sapiens
IRSSVEKEI

SEQ ID NO: 92640 - protein, 9 aa, Homo Sapiens
TEEGCGELF

SEQ ID NO: 92641 - protein, 9 aa, Homo Sapiens
VVLGSQETQ

SEQ ID NO: 92642 - protein, 9 aa, Homo Sapiens
PELSYEFKH

SEQ ID NO: 92643 - protein, 9 aa, Homo Sapiens
TKDEIFPAD

SEQ ID NO: 92644 - protein, 9 aa, Homo Sapiens
TFHPDPSQV

SEQ ID NO: 92645 - protein, 9 aa, Homo Sapiens
AESLSNDNE

SEQ ID NO: 92646 - protein, 9 aa, Homo Sapiens
LVSDEMVSL

SEQ ID NO: 92647 - protein, 9 aa, Homo Sapiens
HVYGQEESL

SEQ ID NO: 92648 - protein, 9 aa, Homo Sapiens
NFRDFANIF

SEQ ID NO: 92649 - protein, 9 aa, Homo Sapiens
HYPQDLTRP

SEQ ID NO: 92650 - protein, 9 aa, Homo Sapiens
NNMSKIAEA

SEQ ID NO: 92651 - protein, 9 aa, Homo Sapiens
QLQARRPIE

SEQ ID NO: 92652 - protein, 9 aa, Homo Sapiens
IAQYGNGLK

SEQ ID NO: 92653 - protein, 9 aa, Homo Sapiens
MELYKPNDL

SEQ ID NO: 92654 - protein, 9 aa, Homo Sapiens
VHWNEIIKN

SEQ ID NO: 92655 - protein, 9 aa, Homo Sapiens
EDEKKEDVE

SEQ ID NO: 92656 - protein, 9 aa, Homo Sapiens
ELYIRDYGE

SEQ ID NO: 92657 - protein, 9 aa, Homo Sapiens
VNLAVCLLC

SEQ ID NO: 92658 - protein, 9 aa, Homo Sapiens
DPATSLPMS

SEQ ID NO: 92659 - protein, 9 aa, Homo Sapiens
PNHSLYVFV

SEQ ID NO: 92660 - protein, 9 aa, Homo Sapiens
AHLFAMTIM

SEQ ID NO: 92661 - protein, 9 aa, Homo Sapiens
DAVLPWPFR

SEQ ID NO: 92662 - protein, 9 aa, Homo Sapiens
DINGTAVVM

SEQ ID NO: 92663 - protein, 9 aa, Homo Sapiens
LSDLAESLS

SEQ ID NO: 92664 - protein, 9 aa, Homo Sapiens
AHPSQGNAA

SEQ ID NO: 92665 - protein, 9 aa, Homo Sapiens
PRFRLIVRH

SEQ ID NO: 92666 - protein, 9 aa, Homo Sapiens
CCPNVPSTP

SEQ ID NO: 92667 - protein, 9 aa, Homo Sapiens
LPMSLASLT

SEQ ID NO: 92668 - protein, 9 aa, Homo Sapiens
ATILEDQQD

SEQ ID NO: 92669 - protein, 9 aa, Homo Sapiens
SDCQGRGIF

SEQ ID NO: 92670 - protein, 9 aa, Homo Sapiens
YRHLLGFPP

SEQ ID NO: 92671 - protein, 9 aa, Homo Sapiens
RCPCKIIKK

SEQ ID NO: 92672 - protein, 9 aa, Homo Sapiens
YIRDYGEIF

SEQ ID NO: 92673 - protein, 9 aa, Homo Sapiens
HFSQFGTLV

SEQ ID NO: 92674 - protein, 9 aa, Homo Sapiens
KVEAKKTAI

SEQ ID NO: 92675 - protein, 9 aa, Homo Sapiens
RRKMTQRSK

SEQ ID NO: 92676 - protein, 9 aa, Homo Sapiens
NRLMELFPT

SEQ ID NO: 92677 - protein, 9 aa, Homo Sapiens
NHSLYVFVR

SEQ ID NO: 92678 - protein, 9 aa, Homo Sapiens
IGKRSLRKQ

SEQ ID NO: 92679 - protein, 9 aa, Homo Sapiens
KKCVELGVS

SEQ ID NO: 92680 - protein, 9 aa, Homo Sapiens
PTMSADTME

SEQ ID NO: 92681 - protein, 9 aa, Homo Sapiens
DRLEDKGSL

SEQ ID NO: 92682 - protein, 9 aa, Homo Sapiens
MQQKQKYKP

SEQ ID NO: 92683 - protein, 9 aa, Homo Sapiens
STKTKKGQV

SEQ ID NO: 92684 - protein, 9 aa, Homo Sapiens
RHSVVVPCE

SEQ ID NO: 92685 - protein, 9 aa, Homo Sapiens
SSPNHSLYV

SEQ ID NO: 92686 - protein, 9 aa, Homo Sapiens
QYCLLASHR

SEQ ID NO: 92687 - protein, 9 aa, Homo Sapiens
PNGCGKRSL

SEQ ID NO: 92688 - protein, 9 aa, Homo Sapiens
PGGKSQILD

SEQ ID NO: 92689 - protein, 9 aa, Homo Sapiens
ADITPEDLL

SEQ ID NO: 92690 - protein, 9 aa, Homo Sapiens
ASSFQWLLS

SEQ ID NO: 92691 - protein, 9 aa, Homo Sapiens
EVTIPFLFT

SEQ ID NO: 92692 - protein, 9 aa, Homo Sapiens
GPCNYKAEC

SEQ ID NO: 92693 - protein, 9 aa, Homo Sapiens
LYGLPPIAS

SEQ ID NO: 92694 - protein, 9 aa, Homo Sapiens
ILSQSSALI

SEQ ID NO: 92695 - protein, 9 aa, Homo Sapiens
SDNSDTNQS

SEQ ID NO: 92696 - protein, 9 aa, Homo Sapiens
FWTMLAKDI

SEQ ID NO: 92697 - protein, 9 aa, Homo Sapiens
CYRSGLARH

SEQ ID NO: 92698 - protein, 9 aa, Homo Sapiens
HYIFNFRDF

SEQ ID NO: 92699 - protein, 9 aa, Homo Sapiens
RLLRAVLGR

SEQ ID NO: 92700 - protein, 9 aa, Homo Sapiens
LHFFGGTEF

SEQ ID NO: 92701 - protein, 9 aa, Homo Sapiens
IVKLATKDI

SEQ ID NO: 92702 - protein, 9 aa, Homo Sapiens
AVLSERFPP

SEQ ID NO: 92703 - protein, 9 aa, Homo Sapiens
KIINGKHTF

SEQ ID NO: 92704 - protein, 9 aa, Homo Sapiens
PWVLLCSKD

SEQ ID NO: 92705 - protein, 9 aa, Homo Sapiens
QVPQQGVEL

SEQ ID NO: 92706 - protein, 9 aa, Homo Sapiens
TRPLFPSTG

SEQ ID NO: 92707 - protein, 9 aa, Homo Sapiens
DKWSRHRWM

SEQ ID NO: 92708 - protein, 9 aa, Homo Sapiens
IMRGEYDAV

SEQ ID NO: 92709 - protein, 9 aa, Homo Sapiens
VKEAYVNEN

SEQ ID NO: 92710 - protein, 9 aa, Homo Sapiens
NTSVFLDTD

SEQ ID NO: 92711 - protein, 9 aa, Homo Sapiens
IQSKQNIQV

SEQ ID NO: 92712 - protein, 9 aa, Homo Sapiens
TSFFLTLLP

SEQ ID NO: 92713 - protein, 9 aa, Homo Sapiens
DKEEKYAIE

SEQ ID NO: 92714 - protein, 9 aa, Homo Sapiens
LKPENLLTR

SEQ ID NO: 92715 - protein, 9 aa, Homo Sapiens
CIRIDNLYQ

SEQ ID NO: 92716 - protein, 9 aa, Homo Sapiens
RSYTKAYYR

SEQ ID NO: 92717 - protein, 9 aa, Homo Sapiens
FHDVSERTH

SEQ ID NO: 92718 - protein, 9 aa, Homo Sapiens
EEKWAAESC

SEQ ID NO: 92719 - protein, 9 aa, Homo Sapiens
AMTIMNSPM

SEQ ID NO: 92720 - protein, 9 aa, Homo Sapiens
HLLGFPPQR

SEQ ID NO: 92721 - protein, 9 aa, Homo Sapiens
VRGQEGTLA

SEQ ID NO: 92722 - protein, 9 aa, Homo Sapiens
LFVNIYFLQ

SEQ ID NO: 92723 - protein, 9 aa, Homo Sapiens
ILKHSSQNS

SEQ ID NO: 92724 - protein, 9 aa, Homo Sapiens
DSISRLHVS

SEQ ID NO: 92725 - protein, 9 aa, Homo Sapiens
LFWSLKPEN

SEQ ID NO: 92726 - protein, 9 aa, Homo Sapiens
KIREEPGCC

SEQ ID NO: 92727 - protein, 9 aa, Homo Sapiens
FLHIKQVAD

SEQ ID NO: 92728 - protein, 9 aa, Homo Sapiens
KPDSDCQGR

SEQ ID NO: 92729 - protein, 9 aa, Homo Sapiens
RKGGEASRV

SEQ ID NO: 92730 - protein, 9 aa, Homo Sapiens
PPSLCTIQH

SEQ ID NO: 92731 - protein, 9 aa, Homo Sapiens
ISFDSLHVY

SEQ ID NO: 92732 - protein, 9 aa, Homo Sapiens
EELQPEQLA

SEQ ID NO: 92733 - protein, 9 aa, Homo Sapiens
YIEKYCLGT

SEQ ID NO: 92734 - protein, 9 aa, Homo Sapiens
PPSSNSFQN

SEQ ID NO: 92735 - protein, 9 aa, Homo Sapiens
LSYEFKHSR

SEQ ID NO: 92736 - protein, 9 aa, Homo Sapiens
RDIYDKEYY

SEQ ID NO: 92737 - protein, 9 aa, Homo Sapiens
DTSHLPQEL

SEQ ID NO: 92738 - protein, 9 aa, Homo Sapiens
LLEVFGGSL

SEQ ID NO: 92739 - protein, 9 aa, Homo Sapiens
RLFVYLHLN

SEQ ID NO: 92740 - protein, 9 aa, Homo Sapiens
RMSEAEGRR

SEQ ID NO: 92741 - protein, 9 aa, Homo Sapiens
EKEIQKSKG

SEQ ID NO: 92742 - protein, 9 aa, Homo Sapiens
GHPLDTSHL

SEQ ID NO: 92743 - protein, 9 aa, Homo Sapiens
LIGDKDNAK

SEQ ID NO: 92744 - protein, 9 aa, Homo Sapiens
GCLENLYNN

SEQ ID NO: 92745 - protein, 9 aa, Homo Sapiens
GFHYPQDLT

SEQ ID NO: 92746 - protein, 9 aa, Homo Sapiens
KLATKDIRV

SEQ ID NO: 92747 - protein, 9 aa, Homo Sapiens
EMEEVINDY

SEQ ID NO: 92748 - protein, 9 aa, Homo Sapiens
ELLEVFGGS

SEQ ID NO: 92749 - protein, 9 aa, Homo Sapiens
DGPGVLCIF

SEQ ID NO: 92750 - protein, 9 aa, Homo Sapiens
DVTFHPDPS

SEQ ID NO: 92751 - protein, 9 aa, Homo Sapiens
KALVNSQVD

SEQ ID NO: 92752 - protein, 9 aa, Homo Sapiens
ISIYYFKQL

SEQ ID NO: 92753 - protein, 9 aa, Homo Sapiens
PTMLPDEIL

SEQ ID NO: 92754 - protein, 9 aa, Homo Sapiens
QPGPNTTAV

SEQ ID NO: 92755 - protein, 9 aa, Homo Sapiens
IDNLYQRAL

SEQ ID NO: 92756 - protein, 9 aa, Homo Sapiens
ERHLPLQSE

SEQ ID NO: 92757 - protein, 9 aa, Homo Sapiens
TTKFHRFPN

SEQ ID NO: 92758 - protein, 9 aa, Homo Sapiens
AQNIRVLLG

SEQ ID NO: 92759 - protein, 9 aa, Homo Sapiens
KKRRKEANS

SEQ ID NO: 92760 - protein, 9 aa, Homo Sapiens
LTETKYINL

SEQ ID NO: 92761 - protein, 9 aa, Homo Sapiens
AISVSAAGF

SEQ ID NO: 92762 - protein, 9 aa, Homo Sapiens
VRNRQKNGS

SEQ ID NO: 92763 - protein, 9 aa, Homo Sapiens
QGSFKGNHL

SEQ ID NO: 92764 - protein, 9 aa, Homo Sapiens
GVTTKFHRF

SEQ ID NO: 92765 - protein, 9 aa, Homo Sapiens
MSADTMELK

SEQ ID NO: 92766 - protein, 9 aa, Homo Sapiens
ENVYSKLTI

SEQ ID NO: 92767 - protein, 9 aa, Homo Sapiens
GNADVCQIF

SEQ ID NO: 92768 - protein, 9 aa, Homo Sapiens
SIIRLSHSA

SEQ ID NO: 92769 - protein, 9 aa, Homo Sapiens
KNKILEEME

SEQ ID NO: 92770 - protein, 9 aa, Homo Sapiens
GRPNSGSGE

SEQ ID NO: 92771 - protein, 9 aa, Homo Sapiens
GDRFIEDKT

SEQ ID NO: 92772 - protein, 9 aa, Homo Sapiens
GMPGTSNPG

SEQ ID NO: 92773 - protein, 9 aa, Homo Sapiens
TFKSQLNSQ

SEQ ID NO: 92774 - protein, 9 aa, Homo Sapiens
DSEEKDVLN

SEQ ID NO: 92775 - protein, 9 aa, Homo Sapiens
FLLSCGEVV

SEQ ID NO: 92776 - protein, 9 aa, Homo Sapiens
VFLDTDAEF

SEQ ID NO: 92777 - protein, 9 aa, Homo Sapiens
KKTAKAGGV

SEQ ID NO: 92778 - protein, 9 aa, Homo Sapiens
TLEKLDVNC

SEQ ID NO: 92779 - protein, 9 aa, Homo Sapiens
ELPSVLRQQ

SEQ ID NO: 92780 - protein, 9 aa, Homo Sapiens
ISTPDDLYV

SEQ ID NO: 92781 - protein, 9 aa, Homo Sapiens
LAESLSNDN

SEQ ID NO: 92782 - protein, 9 aa, Homo Sapiens
NSNSSETTD

SEQ ID NO: 92783 - protein, 9 aa, Homo Sapiens
KQGEIPNEV

SEQ ID NO: 92784 - protein, 9 aa, Homo Sapiens
KLDFLWHPE

SEQ ID NO: 92785 - protein, 9 aa, Homo Sapiens
PGYLGKMFS

SEQ ID NO: 92786 - protein, 9 aa, Homo Sapiens
TLDHHLHTS

SEQ ID NO: 92787 - protein, 9 aa, Homo Sapiens
AYSEGGDGK

SEQ ID NO: 92788 - protein, 9 aa, Homo Sapiens
LQFPQYPMN

SEQ ID NO: 92789 - protein, 9 aa, Homo Sapiens
IKEEKTTNT

SEQ ID NO: 92790 - protein, 9 aa, Homo Sapiens
LQARRPIER

SEQ ID NO: 92791 - protein, 9 aa, Homo Sapiens
SLCTIQHDH

SEQ ID NO: 92792 - protein, 9 aa, Homo Sapiens
QSFSFSKTS

SEQ ID NO: 92793 - protein, 9 aa, Homo Sapiens
KEANSSEEP

SEQ ID NO: 92794 - protein, 9 aa, Homo Sapiens
SHLESQYFK

SEQ ID NO: 92795 - protein, 9 aa, Homo Sapiens
GDKWSRHRW

SEQ ID NO: 92796 - protein, 9 aa, Homo Sapiens
YAGEKPYKC

SEQ ID NO: 92797 - protein, 9 aa, Homo Sapiens
KQELATFKS

SEQ ID NO: 92798 - protein, 9 aa, Homo Sapiens
SDKVDYELK

SEQ ID NO: 92799 - protein, 9 aa, Homo Sapiens
GFYVFEAIH

SEQ ID NO: 92800 - protein, 9 aa, Homo Sapiens
SQVDFQAMW

SEQ ID NO: 92801 - protein, 9 aa, Homo Sapiens
LKHKAKQIA

SEQ ID NO: 92802 - protein, 9 aa, Homo Sapiens
ANDVPSQCE

SEQ ID NO: 92803 - protein, 9 aa, Homo Sapiens
FPAESDSSE

SEQ ID NO: 92804 - protein, 9 aa, Homo Sapiens
GDSFHPQIT

SEQ ID NO: 92805 - protein, 9 aa, Homo Sapiens
NEDKMSLLK

SEQ ID NO: 92806 - protein, 9 aa, Homo Sapiens
TYRHLLGFP

SEQ ID NO: 92807 - protein, 9 aa, Homo Sapiens
EDDIGRSEN

SEQ ID NO: 92808 - protein, 9 aa, Homo Sapiens
YICKPDSDC

SEQ ID NO: 92809 - protein, 9 aa, Homo Sapiens
WVKEAYVNE

SEQ ID NO: 92810 - protein, 9 aa, Homo Sapiens
KIAMKNIGG

SEQ ID NO: 92811 - protein, 9 aa, Homo Sapiens
FMFFICLFI

SEQ ID NO: 92812 - protein, 9 aa, Homo Sapiens
LCWLKHKAK

SEQ ID NO: 92813 - protein, 9 aa, Homo Sapiens
YNRLTLSKR

SEQ ID NO: 92814 - protein, 9 aa, Homo Sapiens
INAGQLKNG

SEQ ID NO: 92815 - protein, 9 aa, Homo Sapiens
QYFKRQSFH

SEQ ID NO: 92816 - protein, 9 aa, Homo Sapiens
SKANFEKMC

SEQ ID NO: 92817 - protein, 9 aa, Homo Sapiens
DHLEEPDDC

SEQ ID NO: 92818 - protein, 9 aa, Homo Sapiens
GQGKAQQAP

SEQ ID NO: 92819 - protein, 9 aa, Homo Sapiens
MSEAEGRRK

SEQ ID NO: 92820 - protein, 9 aa, Homo Sapiens
SDSLSHNDV

SEQ ID NO: 92821 - protein, 9 aa, Homo Sapiens
GFVPGKKLI

SEQ ID NO: 92822 - protein, 9 aa, Homo Sapiens
ARDIYDKEY

SEQ ID NO: 92823 - protein, 9 aa, Homo Sapiens
SVIEKPYQK

SEQ ID NO: 92824 - protein, 9 aa, Homo Sapiens
YVSSSNFTD

SEQ ID NO: 92825 - protein, 9 aa, Homo Sapiens
EAELRHRLR

SEQ ID NO: 92826 - protein, 9 aa, Homo Sapiens
APSKKKYNR

SEQ ID NO: 92827 - protein, 9 aa, Homo Sapiens
ELKQELATF

SEQ ID NO: 92828 - protein, 9 aa, Homo Sapiens
SADDSQRLT

SEQ ID NO: 92829 - protein, 9 aa, Homo Sapiens
ASVKLDFLW

SEQ ID NO: 92830 - protein, 9 aa, Homo Sapiens
VTRDSISRL

SEQ ID NO: 92831 - protein, 9 aa, Homo Sapiens
SKTSSGQSS

SEQ ID NO: 92832 - protein, 9 aa, Homo Sapiens
LIPPQEWFC

SEQ ID NO: 92833 - protein, 9 aa, Homo Sapiens
VFGGSLHSS

SEQ ID NO: 92834 - protein, 9 aa, Homo Sapiens
ERILKHSSQ

SEQ ID NO: 92835 - protein, 9 aa, Homo Sapiens
NTFDSSRQR

SEQ ID NO: 92836 - protein, 9 aa, Homo Sapiens
HNFPPPSSN

SEQ ID NO: 92837 - protein, 9 aa, Homo Sapiens
KTYLRPITE

SEQ ID NO: 92838 - protein, 9 aa, Homo Sapiens
EDKTASVKL

SEQ ID NO: 92839 - protein, 9 aa, Homo Sapiens
NSDTNQSGG

SEQ ID NO: 92840 - protein, 9 aa, Homo Sapiens
ILGFTIDST

SEQ ID NO: 92841 - protein, 9 aa, Homo Sapiens
TEFFLLTVM

SEQ ID NO: 92842 - protein, 9 aa, Homo Sapiens
DLKNKRIEM

SEQ ID NO: 92843 - protein, 9 aa, Homo Sapiens
LAKDINGTA

SEQ ID NO: 92844 - protein, 9 aa, Homo Sapiens
LHIKQVADQ

SEQ ID NO: 92845 - protein, 9 aa, Homo Sapiens
KLIETEERE

SEQ ID NO: 92846 - protein, 9 aa, Homo Sapiens
SDRLEDKGS

SEQ ID NO: 92847 - protein, 9 aa, Homo Sapiens
FLDNDKTLQ

SEQ ID NO: 92848 - protein, 9 aa, Homo Sapiens
SFEASKHKF

SEQ ID NO: 92849 - protein, 9 aa, Homo Sapiens
FRKVQKSIE

SEQ ID NO: 92850 - protein, 9 aa, Homo Sapiens
MAYQISFDL

SEQ ID NO: 92851 - protein, 9 aa, Homo Sapiens
EWSFTTVRM

SEQ ID NO: 92852 - protein, 9 aa, Homo Sapiens
LPASQQPVC

SEQ ID NO: 92853 - protein, 9 aa, Homo Sapiens
MYLVETKVN

SEQ ID NO: 92854 - protein, 9 aa, Homo Sapiens
SRMQERDKE

SEQ ID NO: 92855 - protein, 9 aa, Homo Sapiens
RMQERDKEP

SEQ ID NO: 92856 - protein, 9 aa, Homo Sapiens
VTFHPDPSQ

SEQ ID NO: 92857 - protein, 9 aa, Homo Sapiens
TVKQALVLV

SEQ ID NO: 92858 - protein, 9 aa, Homo Sapiens
NKSKTNELV

SEQ ID NO: 92859 - protein, 9 aa, Homo Sapiens
CVMLVSNFP

SEQ ID NO: 92860 - protein, 9 aa, Homo Sapiens
EPPNWSATF

SEQ ID NO: 92861 - protein, 9 aa, Homo Sapiens
STTEEGKKI

SEQ ID NO: 92862 - protein, 9 aa, Homo Sapiens
EEEKRRREQ

SEQ ID NO: 92863 - protein, 9 aa, Homo Sapiens
AGATPGNIP

SEQ ID NO: 92864 - protein, 9 aa, Homo Sapiens
KKTSCNLDE

SEQ ID NO: 92865 - protein, 9 aa, Homo Sapiens
WAGDQILGL

SEQ ID NO: 92866 - protein, 9 aa, Homo Sapiens
SSDPEGEEW

SEQ ID NO: 92867 - protein, 9 aa, Homo Sapiens
LVKELLDSG

SEQ ID NO: 92868 - protein, 9 aa, Homo Sapiens
GSLHSSLYH

SEQ ID NO: 92869 - protein, 9 aa, Homo Sapiens
FIENKINPN

SEQ ID NO: 92870 - protein, 9 aa, Homo Sapiens
KIRILPDQF

SEQ ID NO: 92871 - protein, 9 aa, Homo Sapiens
DKTASVKLD

SEQ ID NO: 92872 - protein, 9 aa, Homo Sapiens
VQKHHPQTV

SEQ ID NO: 92873 - protein, 9 aa, Homo Sapiens
GQDGFYVFE

SEQ ID NO: 92874 - protein, 9 aa, Homo Sapiens
IFRKVQKSI

SEQ ID NO: 92875 - protein, 9 aa, Homo Sapiens
DPAPSKKKY

SEQ ID NO: 92876 - protein, 9 aa, Homo Sapiens
NTGQDTCIL

SEQ ID NO: 92877 - protein, 9 aa, Homo Sapiens
YTEEEYRFL

SEQ ID NO: 92878 - protein, 9 aa, Homo Sapiens
EDKTLLLAV

SEQ ID NO: 92879 - protein, 9 aa, Homo Sapiens
ACACIYFAA

SEQ ID NO: 92880 - protein, 9 aa, Homo Sapiens
HNSSKEKVL

SEQ ID NO: 92881 - protein, 9 aa, Homo Sapiens
FPTMSADTM

SEQ ID NO: 92882 - protein, 9 aa, Homo Sapiens
KNVAELLVD

SEQ ID NO: 92883 - protein, 9 aa, Homo Sapiens
VPSQCEISP

SEQ ID NO: 92884 - protein, 9 aa, Homo Sapiens
NEGQKNKIL

SEQ ID NO: 92885 - protein, 9 aa, Homo Sapiens
KTASVKLDF

SEQ ID NO: 92886 - protein, 9 aa, Homo Sapiens
AFLHIKQVA

SEQ ID NO: 92887 - protein, 9 aa, Homo Sapiens
KPVRKHFEM

SEQ ID NO: 92888 - protein, 9 aa, Homo Sapiens
SKCGPCNYK

SEQ ID NO: 92889 - protein, 9 aa, Homo Sapiens
CGKGFKQCS

SEQ ID NO: 92890 - protein, 9 aa, Homo Sapiens
HDVSERTHW

SEQ ID NO: 92891 - protein, 9 aa, Homo Sapiens
AIPIVVAKA

SEQ ID NO: 92892 - protein, 9 aa, Homo Sapiens
DWVNNKMYL

SEQ ID NO: 92893 - protein, 9 aa, Homo Sapiens
RNSGPNRAH

SEQ ID NO: 92894 - protein, 9 aa, Homo Sapiens
LTKQQQSPT

SEQ ID NO: 92895 - protein, 9 aa, Homo Sapiens
PIGAQQSFH

SEQ ID NO: 92896 - protein, 9 aa, Homo Sapiens
ISLKTRMVN

SEQ ID NO: 92897 - protein, 9 aa, Homo Sapiens
YFLLSCGEV

SEQ ID NO: 92898 - protein, 9 aa, Homo Sapiens
GDQILGLMG

SEQ ID NO: 92899 - protein, 9 aa, Homo Sapiens
HWNEIIKNT

SEQ ID NO: 92900 - protein, 9 aa, Homo Sapiens
YKPILLQQK

SEQ ID NO: 92901 - protein, 9 aa, Homo Sapiens
RTERKDPAT

SEQ ID NO: 92902 - protein, 9 aa, Homo Sapiens
SGFPWVLLC

SEQ ID NO: 92903 - protein, 9 aa, Homo Sapiens
PEEENVYSK

SEQ ID NO: 92904 - protein, 9 aa, Homo Sapiens
YAFCYCGEK

SEQ ID NO: 92905 - protein, 9 aa, Homo Sapiens
VIEKPYQKS

SEQ ID NO: 92906 - protein, 9 aa, Homo Sapiens
HGSWATPPQ

SEQ ID NO: 92907 - protein, 9 aa, Homo Sapiens
DMSEYSDDY

SEQ ID NO: 92908 - protein, 9 aa, Homo Sapiens
APAESQYCL

SEQ ID NO: 92909 - protein, 9 aa, Homo Sapiens
QDIPLLVQC

SEQ ID NO: 92910 - protein, 9 aa, Homo Sapiens
LQTSLKYTN

SEQ ID NO: 92911 - protein, 9 aa, Homo Sapiens
VSERTHWTP

SEQ ID NO: 92912 - protein, 9 aa, Homo Sapiens
QICREYGHT

SEQ ID NO: 92913 - protein, 9 aa, Homo Sapiens
SAISVSAAG

SEQ ID NO: 92914 - protein, 9 aa, Homo Sapiens
AMWRLFVNI

SEQ ID NO: 92915 - protein, 9 aa, Homo Sapiens
DPREKGDVK

SEQ ID NO: 92916 - protein, 9 aa, Homo Sapiens
SSCSVEKTL

SEQ ID NO: 92917 - protein, 9 aa, Homo Sapiens
LCTPPPKII

SEQ ID NO: 92918 - protein, 9 aa, Homo Sapiens
GNAAYLPDM

SEQ ID NO: 92919 - protein, 9 aa, Homo Sapiens
AYYRRGAAR

SEQ ID NO: 92920 - protein, 9 aa, Homo Sapiens
LATSFQSME

SEQ ID NO: 92921 - protein, 9 aa, Homo Sapiens
QKYKPMQKV

SEQ ID NO: 92922 - protein, 9 aa, Homo Sapiens
GMSSHLNSQ

SEQ ID NO: 92923 - protein, 9 aa, Homo Sapiens
KARARVENW

SEQ ID NO: 92924 - protein, 9 aa, Homo Sapiens
RKIPELADH

SEQ ID NO: 92925 - protein, 9 aa, Homo Sapiens
GFPWVLLCS

SEQ ID NO: 92926 - protein, 9 aa, Homo Sapiens
GDKDNAKKV

SEQ ID NO: 92927 - protein, 9 aa, Homo Sapiens
VLGSQETQE

SEQ ID NO: 92928 - protein, 9 aa, Homo Sapiens
SSSEDDDLH

SEQ ID NO: 92929 - protein, 9 aa, Homo Sapiens
QALTKQQQS

SEQ ID NO: 92930 - protein, 9 aa, Homo Sapiens
ICREYGHTY

SEQ ID NO: 92931 - protein, 9 aa, Homo Sapiens
RPGYLGKMF

SEQ ID NO: 92932 - protein, 9 aa, Homo Sapiens
ILSVKFCPF

SEQ ID NO: 92933 - protein, 9 aa, Homo Sapiens
QEIEVQHKR

SEQ ID NO: 92934 - protein, 9 aa, Homo Sapiens
SMFTAILNK

SEQ ID NO: 92935 - protein, 9 aa, Homo Sapiens
EVFGGSLHS

SEQ ID NO: 92936 - protein, 9 aa, Homo Sapiens
LMAYQISFD

SEQ ID NO: 92937 - protein, 9 aa, Homo Sapiens
KTSCNLDEQ

SEQ ID NO: 92938 - protein, 9 aa, Homo Sapiens
KYAIEELVK

SEQ ID NO: 92939 - protein, 9 aa, Homo Sapiens
NYECRPGYL

SEQ ID NO: 92940 - protein, 9 aa, Homo Sapiens
GWKLIPPQE

SEQ ID NO: 92941 - protein, 9 aa, Homo Sapiens
NELVSDEMV

SEQ ID NO: 92942 - protein, 9 aa, Homo Sapiens
ADEIIYKIT

SEQ ID NO: 92943 - protein, 9 aa, Homo Sapiens
VYSKLTIVH

SEQ ID NO: 92944 - protein, 9 aa, Homo Sapiens
IEKYCLGTK

SEQ ID NO: 92945 - protein, 9 aa, Homo Sapiens
MFIGEKDFQ

SEQ ID NO: 92946 - protein, 9 aa, Homo Sapiens
MIISIYYFK

SEQ ID NO: 92947 - protein, 9 aa, Homo Sapiens
PPIGAQQSF

SEQ ID NO: 92948 - protein, 9 aa, Homo Sapiens
GSGEDSKGL

SEQ ID NO: 92949 - protein, 9 aa, Homo Sapiens
RAHGSWATP

SEQ ID NO: 92950 - protein, 9 aa, Homo Sapiens
RLRSADDSQ

SEQ ID NO: 92951 - protein, 9 aa, Homo Sapiens
ASQGTIERY

SEQ ID NO: 92952 - protein, 9 aa, Homo Sapiens
AESQYCLLA

SEQ ID NO: 92953 - protein, 9 aa, Homo Sapiens
KHHHQNEKN

SEQ ID NO: 92954 - protein, 9 aa, Homo Sapiens
MAIVKLATK

SEQ ID NO: 92955 - protein, 9 aa, Homo Sapiens
LHWAEYIEK

SEQ ID NO: 92956 - protein, 9 aa, Homo Sapiens
NGDRFIEDK

SEQ ID NO: 92957 - protein, 9 aa, Homo Sapiens
SQYFKRQSF

SEQ ID NO: 92958 - protein, 9 aa, Homo Sapiens
EMEPNLSCP

SEQ ID NO: 92959 - protein, 9 aa, Homo Sapiens
SPLAEIDIK

SEQ ID NO: 92960 - protein, 9 aa, Homo Sapiens
ETNKMLREK

SEQ ID NO: 92961 - protein, 9 aa, Homo Sapiens
NMFIGEKDF

SEQ ID NO: 92962 - protein, 9 aa, Homo Sapiens
IPQYFLLSC

SEQ ID NO: 92963 - protein, 9 aa, Homo Sapiens
VKAIEFVYV

SEQ ID NO: 92964 - protein, 9 aa, Homo Sapiens
HVEDTSFFL

SEQ ID NO: 92965 - protein, 9 aa, Homo Sapiens
FTENENKDT

SEQ ID NO: 92966 - protein, 9 aa, Homo Sapiens
GTSNPGPPG

SEQ ID NO: 92967 - protein, 9 aa, Homo Sapiens
QLAELWGRG

SEQ ID NO: 92968 - protein, 9 aa, Homo Sapiens
MQERDKEPL

SEQ ID NO: 92969 - protein, 9 aa, Homo Sapiens
AEAPGASAD

SEQ ID NO: 92970 - protein, 9 aa, Homo Sapiens
YLEQPSRSE

SEQ ID NO: 92971 - protein, 9 aa, Homo Sapiens
SILKGYKTY

SEQ ID NO: 92972 - protein, 9 aa, Homo Sapiens
NLYLNFQSA

SEQ ID NO: 92973 - protein, 9 aa, Homo Sapiens
KHNSSKEKV

SEQ ID NO: 92974 - protein, 9 aa, Homo Sapiens
MRGEYDAVL

SEQ ID NO: 92975 - protein, 9 aa, Homo Sapiens
RSEFSKHLK

SEQ ID NO: 92976 - protein, 9 aa, Homo Sapiens
VEKLFSLTA

SEQ ID NO: 92977 - protein, 9 aa, Homo Sapiens
YGKTICQDS

SEQ ID NO: 92978 - protein, 9 aa, Homo Sapiens
NENQARVSP

SEQ ID NO: 92979 - protein, 9 aa, Homo Sapiens
HAMVSPLKP

SEQ ID NO: 92980 - protein, 9 aa, Homo Sapiens
QDGFYVFEA

SEQ ID NO: 92981 - protein, 9 aa, Homo Sapiens
QELEQQKEE

SEQ ID NO: 92982 - protein, 9 aa, Homo Sapiens
QKSQRTERK

SEQ ID NO: 92983 - protein, 9 aa, Homo Sapiens
VYEGFVPGK

SEQ ID NO: 92984 - protein, 9 aa, Homo Sapiens
VCMELYKPN

SEQ ID NO: 92985 - protein, 9 aa, Homo Sapiens
KPENLLTRL

SEQ ID NO: 92986 - protein, 9 aa, Homo Sapiens
PGASADEII

SEQ ID NO: 92987 - protein, 9 aa, Homo Sapiens
HPETPEGVA

SEQ ID NO: 92988 - protein, 9 aa, Homo Sapiens
FNYPSLRDK

SEQ ID NO: 92989 - protein, 9 aa, Homo Sapiens
WNLPTTAQF

SEQ ID NO: 92990 - protein, 9 aa, Homo Sapiens
VKKTDELPA

SEQ ID NO: 92991 - protein, 9 aa, Homo Sapiens
VDYELKNLE

SEQ ID NO: 92992 - protein, 9 aa, Homo Sapiens
KTFTLINVY

SEQ ID NO: 92993 - protein, 9 aa, Homo Sapiens
EQKYKEQMA

SEQ ID NO: 92994 - protein, 9 aa, Homo Sapiens
FTAILNKSI

SEQ ID NO: 92995 - protein, 9 aa, Homo Sapiens
QEKEEIMQT

SEQ ID NO: 92996 - protein, 9 aa, Homo Sapiens
VLQNAWQLY

SEQ ID NO: 92997 - protein, 9 aa, Homo Sapiens
LLNSSCSVE

SEQ ID NO: 92998 - protein, 9 aa, Homo Sapiens
SSLYHLILL

SEQ ID NO: 92999 - protein, 9 aa, Homo Sapiens
LRVYEGFVP

SEQ ID NO: 93000 - protein, 9 aa, Homo Sapiens
TRLAFPSPF

SEQ ID NO: 93001 - protein, 9 aa, Homo Sapiens
GKEKTFTLI

SEQ ID NO: 93002 - protein, 9 aa, Homo Sapiens
FSLTAQPLW

SEQ ID NO: 93003 - protein, 9 aa, Homo Sapiens
NADVCQIFI

SEQ ID NO: 93004 - protein, 9 aa, Homo Sapiens
ATKDIRVNK

SEQ ID NO: 93005 - protein, 9 aa, Homo Sapiens
QVQALTKQQ

SEQ ID NO: 93006 - protein, 9 aa, Homo Sapiens
ESSTKTKKG

SEQ ID NO: 93007 - protein, 9 aa, Homo Sapiens
VPVDSGPKA

SEQ ID NO: 93008 - protein, 9 aa, Homo Sapiens
KQICREYGH

SEQ ID NO: 93009 - protein, 9 aa, Homo Sapiens
EEENVYSKL

SEQ ID NO: 93010 - protein, 9 aa, Homo Sapiens
EENVYSKLT

SEQ ID NO: 93011 - protein, 9 aa, Homo Sapiens
SEFSKHLKE

SEQ ID NO: 93012 - protein, 9 aa, Homo Sapiens
SECTEQTLF

SEQ ID NO: 93013 - protein, 9 aa, Homo Sapiens
LLHAIHNHR

SEQ ID NO: 93014 - protein, 9 aa, Homo Sapiens
FEKAGPGRK

SEQ ID NO: 93015 - protein, 9 aa, Homo Sapiens
VKKTAKAGG

SEQ ID NO: 93016 - protein, 9 aa, Homo Sapiens
RMVNQNTIH

SEQ ID NO: 93017 - protein, 9 aa, Homo Sapiens
LEKESAAYS

SEQ ID NO: 93018 - protein, 9 aa, Homo Sapiens
TSLPMSLAS

SEQ ID NO: 93019 - protein, 9 aa, Homo Sapiens
RKAVATCSS

SEQ ID NO: 93020 - protein, 9 aa, Homo Sapiens
GCGELFRCF

SEQ ID NO: 93021 - protein, 9 aa, Homo Sapiens
YLGKMFSIS

SEQ ID NO: 93022 - protein, 9 aa, Homo Sapiens
SSEQMSRKN

SEQ ID NO: 93023 - protein, 9 aa, Homo Sapiens
FSQFGTLVN

SEQ ID NO: 93024 - protein, 9 aa, Homo Sapiens
NPYGPQTKE

SEQ ID NO: 93025 - protein, 9 aa, Homo Sapiens
KKEVTIPFL

SEQ ID NO: 93026 - protein, 9 aa, Homo Sapiens
SGEKPYVCT

SEQ ID NO: 93027 - protein, 9 aa, Homo Sapiens
FYVFEAIHK

SEQ ID NO: 93028 - protein, 9 aa, Homo Sapiens
ETEERERLK

SEQ ID NO: 93029 - protein, 9 aa, Homo Sapiens
VRKHFEMPH

SEQ ID NO: 93030 - protein, 9 aa, Homo Sapiens
QRCSIIRDR

SEQ ID NO: 93031 - protein, 9 aa, Homo Sapiens
WVHWNEIIK

SEQ ID NO: 93032 - protein, 9 aa, Homo Sapiens
LLRTDQLEV

SEQ ID NO: 93033 - protein, 9 aa, Homo Sapiens
QIPQYFLLS

SEQ ID NO: 93034 - protein, 9 aa, Homo Sapiens
FHPDPSQVE

SEQ ID NO: 93035 - protein, 9 aa, Homo Sapiens
LYAFCYCGE

SEQ ID NO: 93036 - protein, 9 aa, Homo Sapiens
VPGKKLIAS

SEQ ID NO: 93037 - protein, 9 aa, Homo Sapiens
TVLANSYDT

SEQ ID NO: 93038 - protein, 9 aa, Homo Sapiens
RLFVNIYFL

SEQ ID NO: 93039 - protein, 9 aa, Homo Sapiens
PAPSKKKYN

SEQ ID NO: 93040 - protein, 9 aa, Homo Sapiens
EQFQRISKR

SEQ ID NO: 93041 - protein, 9 aa, Homo Sapiens
ELGVSVGLI

SEQ ID NO: 93042 - protein, 9 aa, Homo Sapiens
RFEKAGPGR

SEQ ID NO: 93043 - protein, 9 aa, Homo Sapiens
SVYLGKYRG

SEQ ID NO: 93044 - protein, 9 aa, Homo Sapiens
FGGTEFFLL

SEQ ID NO: 93045 - protein, 9 aa, Homo Sapiens
ESDRLEDKG

SEQ ID NO: 93046 - protein, 9 aa, Homo Sapiens
AHSKKCVEL

SEQ ID NO: 93047 - protein, 9 aa, Homo Sapiens
KEAIENHQK

SEQ ID NO: 93048 - protein, 9 aa, Homo Sapiens
NNAALARET

SEQ ID NO: 93049 - protein, 9 aa, Homo Sapiens
AWQLYKTYD

SEQ ID NO: 93050 - protein, 9 aa, Homo Sapiens
CVRMDKTPP

SEQ ID NO: 93051 - protein, 9 aa, Homo Sapiens
EEYRFLICM

SEQ ID NO: 93052 - protein, 9 aa, Homo Sapiens
GCCNLICSD

SEQ ID NO: 93053 - protein, 9 aa, Homo Sapiens
FKGNHLCGS

SEQ ID NO: 93054 - protein, 9 aa, Homo Sapiens
KEERILKHS

SEQ ID NO: 93055 - protein, 9 aa, Homo Sapiens
LQGPWMFPL

SEQ ID NO: 93056 - protein, 9 aa, Homo Sapiens
YTKAYYRRG

SEQ ID NO: 93057 - protein, 9 aa, Homo Sapiens
IVGQNQYQA

SEQ ID NO: 93058 - protein, 9 aa, Homo Sapiens
KRIEMLEHK

SEQ ID NO: 93059 - protein, 9 aa, Homo Sapiens
KQKYKPMQK

SEQ ID NO: 93060 - protein, 9 aa, Homo Sapiens
DKGSLTEGA

SEQ ID NO: 93061 - protein, 9 aa, Homo Sapiens
YYIKCFDTV

SEQ ID NO: 93062 - protein, 9 aa, Homo Sapiens
NGYLNSLQS

SEQ ID NO: 93063 - protein, 9 aa, Homo Sapiens
ANSYDTAWK

SEQ ID NO: 93064 - protein, 9 aa, Homo Sapiens
EKAGPGRKD

SEQ ID NO: 93065 - protein, 9 aa, Homo Sapiens
DSSEDDIGR

SEQ ID NO: 93066 - protein, 9 aa, Homo Sapiens
IEKPYQKSE

SEQ ID NO: 93067 - protein, 9 aa, Homo Sapiens
NECGKVFCY

SEQ ID NO: 93068 - protein, 9 aa, Homo Sapiens
AQQSFHLAL

SEQ ID NO: 93069 - protein, 9 aa, Homo Sapiens
FRLSYGRDL

SEQ ID NO: 93070 - protein, 9 aa, Homo Sapiens
PGPEKGAMD

SEQ ID NO: 93071 - protein, 9 aa, Homo Sapiens
NFQSAISVS

SEQ ID NO: 93072 - protein, 9 aa, Homo Sapiens
STTKRVPMG

SEQ ID NO: 93073 - protein, 9 aa, Homo Sapiens
DYELKNLEH

SEQ ID NO: 93074 - protein, 9 aa, Homo Sapiens
IINGKHTFS

SEQ ID NO: 93075 - protein, 9 aa, Homo Sapiens
LYHLILLTS

SEQ ID NO: 93076 - protein, 9 aa, Homo Sapiens
SQLQGPWMF

SEQ ID NO: 93077 - protein, 9 aa, Homo Sapiens
IEHFQQAIE

SEQ ID NO: 93078 - protein, 9 aa, Homo Sapiens
FIGEKDFQK

SEQ ID NO: 93079 - protein, 9 aa, Homo Sapiens
IVVAKASRD

SEQ ID NO: 93080 - protein, 9 aa, Homo Sapiens
SLTAQPLWN

SEQ ID NO: 93081 - protein, 9 aa, Homo Sapiens
EYDAVLPWP

SEQ ID NO: 93082 - protein, 9 aa, Homo Sapiens
DVKKTDELP

SEQ ID NO: 93083 - protein, 9 aa, Homo Sapiens
KAPFGLKPR

SEQ ID NO: 93084 - protein, 9 aa, Homo Sapiens
KAVPEKKVP

SEQ ID NO: 93085 - protein, 9 aa, Homo Sapiens
GTKRKRDVR

SEQ ID NO: 93086 - protein, 9 aa, Homo Sapiens
TEMEEVIND

SEQ ID NO: 93087 - protein, 9 aa, Homo Sapiens
DWGLEDMSE

SEQ ID NO: 93088 - protein, 9 aa, Homo Sapiens
RHRLRLEEA

SEQ ID NO: 93089 - protein, 9 aa, Homo Sapiens
HRFPNVYHE

SEQ ID NO: 93090 - protein, 9 aa, Homo Sapiens
YHKILDLIE

SEQ ID NO: 93091 - protein, 9 aa, Homo Sapiens
LMCISVADP

SEQ ID NO: 93092 - protein, 9 aa, Homo Sapiens
NSSKEKVLQ

SEQ ID NO: 93093 - protein, 9 aa, Homo Sapiens
LPLEGKEFG

SEQ ID NO: 93094 - protein, 9 aa, Homo Sapiens
LGKYRGQLY

SEQ ID NO: 93095 - protein, 9 aa, Homo Sapiens
RGHTRLAFP

SEQ ID NO: 93096 - protein, 9 aa, Homo Sapiens
NDVMMTQSD

SEQ ID NO: 93097 - protein, 9 aa, Homo Sapiens
KSSQLTKMN

SEQ ID NO: 93098 - protein, 9 aa, Homo Sapiens
HLLTETKYI

SEQ ID NO: 93099 - protein, 9 aa, Homo Sapiens
GILEQGWKL

SEQ ID NO: 93100 - protein, 9 aa, Homo Sapiens
ELRKAAHKN

SEQ ID NO: 93101 - protein, 9 aa, Homo Sapiens
LYVSSSNFT

SEQ ID NO: 93102 - protein, 9 aa, Homo Sapiens
PIQKGNNNE

SEQ ID NO: 93103 - protein, 9 aa, Homo Sapiens
RKNYQSFHF

SEQ ID NO: 93104 - protein, 9 aa, Homo Sapiens
SNNMSKIAE

SEQ ID NO: 93105 - protein, 9 aa, Homo Sapiens
QQPMQQKQK

SEQ ID NO: 93106 - protein, 9 aa, Homo Sapiens
DIYDKEYYS

SEQ ID NO: 93107 - protein, 9 aa, Homo Sapiens
LVKIKIREE

SEQ ID NO: 93108 - protein, 9 aa, Homo Sapiens
TIVLKMPMK

SEQ ID NO: 93109 - protein, 9 aa, Homo Sapiens
LKEEIEKLI

SEQ ID NO: 93110 - protein, 9 aa, Homo Sapiens
CIVNLAVCL

SEQ ID NO: 93111 - protein, 9 aa, Homo Sapiens
EEKDVLNVL

SEQ ID NO: 93112 - protein, 9 aa, Homo Sapiens
RNNSHCPRV

SEQ ID NO: 93113 - protein, 9 aa, Homo Sapiens
FRKTKGKDD

SEQ ID NO: 93114 - protein, 9 aa, Homo Sapiens
EERILKHSS

SEQ ID NO: 93115 - protein, 9 aa, Homo Sapiens
ISECTEQTL

SEQ ID NO: 93116 - protein, 9 aa, Homo Sapiens
DDQYRTLMC

SEQ ID NO: 93117 - protein, 9 aa, Homo Sapiens
LKQICREYG

SEQ ID NO: 93118 - protein, 9 aa, Homo Sapiens
SMNLSHVML

SEQ ID NO: 93119 - protein, 9 aa, Homo Sapiens
PTTAQFMIE

SEQ ID NO: 93120 - protein, 9 aa, Homo Sapiens
SGDKSSQLT

SEQ ID NO: 93121 - protein, 9 aa, Homo Sapiens
SRSEFSKHL

SEQ ID NO: 93122 - protein, 9 aa, Homo Sapiens
RARVENWNA

SEQ ID NO: 93123 - protein, 9 aa, Homo Sapiens
PQQGVELPS

SEQ ID NO: 93124 - protein, 9 aa, Homo Sapiens
MHSSVILLY

SEQ ID NO: 93125 - protein, 9 aa, Homo Sapiens
SSDNSDTNQ

SEQ ID NO: 93126 - protein, 9 aa, Homo Sapiens
ITDGMRTVR

SEQ ID NO: 93127 - protein, 9 aa, Homo Sapiens
QLQSLQVQN

SEQ ID NO: 93128 - protein, 9 aa, Homo Sapiens
ATKKRNTFD

SEQ ID NO: 93129 - protein, 9 aa, Homo Sapiens
DDDLHVESD

SEQ ID NO: 93130 - protein, 9 aa, Homo Sapiens
PLTSLFPYQ

SEQ ID NO: 93131 - protein, 9 aa, Homo Sapiens
SQVELLEVF

SEQ ID NO: 93132 - protein, 9 aa, Homo Sapiens
QGGGLAVLS

SEQ ID NO: 93133 - protein, 9 aa, Homo Sapiens
MEEVINDYN

SEQ ID NO: 93134 - protein, 9 aa, Homo Sapiens
HKAKQIAQK

SEQ ID NO: 93135 - protein, 9 aa, Homo Sapiens
RRLGDCSGP

SEQ ID NO: 93136 - protein, 9 aa, Homo Sapiens
NSSCSVEKT

SEQ ID NO: 93137 - protein, 9 aa, Homo Sapiens
LLIGDKDNA

SEQ ID NO: 93138 - protein, 9 aa, Homo Sapiens
SSSKRSKGR

SEQ ID NO: 93139 - protein, 9 aa, Homo Sapiens
DTMELKWVS

SEQ ID NO: 93140 - protein, 9 aa, Homo Sapiens
QARRPIERE

SEQ ID NO: 93141 - protein, 9 aa, Homo Sapiens
LEQGWKLIP

SEQ ID NO: 93142 - protein, 9 aa, Homo Sapiens
INSNSSETT

SEQ ID NO: 93143 - protein, 9 aa, Homo Sapiens
DNSDTNQSG

SEQ ID NO: 93144 - protein, 9 aa, Homo Sapiens
VLKMPMKLT

SEQ ID NO: 93145 - protein, 9 aa, Homo Sapiens
ILDAQLQAR

SEQ ID NO: 93146 - protein, 9 aa, Homo Sapiens
IACACIYFA

SEQ ID NO: 93147 - protein, 9 aa, Homo Sapiens
GSVKESLDA

SEQ ID NO: 93148 - protein, 9 aa, Homo Sapiens
DNDKTLQTD

SEQ ID NO: 93149 - protein, 9 aa, Homo Sapiens
ECVEDITNK

SEQ ID NO: 93150 - protein, 9 aa, Homo Sapiens
PPNWSATFD

SEQ ID NO: 93151 - protein, 9 aa, Homo Sapiens
YPTYTIVGQ

SEQ ID NO: 93152 - protein, 9 aa, Homo Sapiens
SGEDSKGLA

SEQ ID NO: 93153 - protein, 9 aa, Homo Sapiens
SADEIIYKI

SEQ ID NO: 93154 - protein, 9 aa, Homo Sapiens
TQEEINKAL

SEQ ID NO: 93155 - protein, 9 aa, Homo Sapiens
KFHRFPNVY

SEQ ID NO: 93156 - protein, 9 aa, Homo Sapiens
EQQKEEDEL

SEQ ID NO: 93157 - protein, 9 aa, Homo Sapiens
MKIRILPDQ

SEQ ID NO: 93158 - protein, 9 aa, Homo Sapiens
YAQNVSMWI

SEQ ID NO: 93159 - protein, 9 aa, Homo Sapiens
KQSIGQYYS

SEQ ID NO: 93160 - protein, 9 aa, Homo Sapiens
LYNNGVDVT

SEQ ID NO: 93161 - protein, 9 aa, Homo Sapiens
CPNVPSTPQ

SEQ ID NO: 93162 - protein, 9 aa, Homo Sapiens
PSRSEFSKH

SEQ ID NO: 93163 - protein, 9 aa, Homo Sapiens
NSQVDFQAM

SEQ ID NO: 93164 - protein, 9 aa, Homo Sapiens
LKVEAKKTA

SEQ ID NO: 93165 - protein, 9 aa, Homo Sapiens
SEQMSRKNY

SEQ ID NO: 93166 - protein, 9 aa, Homo Sapiens
YIKCFDTVT

SEQ ID NO: 93167 - protein, 9 aa, Homo Sapiens
PKKAVPEKK

SEQ ID NO: 93168 - protein, 9 aa, Homo Sapiens
ERLLHTPHK

SEQ ID NO: 93169 - protein, 9 aa, Homo Sapiens
ESQYCLLAS

SEQ ID NO: 93170 - protein, 9 aa, Homo Sapiens
HSKKCVELG

SEQ ID NO: 93171 - protein, 9 aa, Homo Sapiens
APGASADEI

SEQ ID NO: 93172 - protein, 9 aa, Homo Sapiens
IFNFRDFAN

SEQ ID NO: 93173 - protein, 9 aa, Homo Sapiens
TARNNSHCP

SEQ ID NO: 93174 - protein, 9 aa, Homo Sapiens
EDLLNIFFG

SEQ ID NO: 93175 - protein, 9 aa, Homo Sapiens
LMMALLVLS

SEQ ID NO: 93176 - protein, 9 aa, Homo Sapiens
VEKTLQCSC

SEQ ID NO: 93177 - protein, 9 aa, Homo Sapiens
PENLLTRLL

SEQ ID NO: 93178 - protein, 9 aa, Homo Sapiens
INDYNMLKA

SEQ ID NO: 93179 - protein, 9 aa, Homo Sapiens
KTSSGQSSK

SEQ ID NO: 93180 - protein, 9 aa, Homo Sapiens
EILTEMISE

SEQ ID NO: 93181 - protein, 9 aa, Homo Sapiens
KHKFLDRMS

SEQ ID NO: 93182 - protein, 9 aa, Homo Sapiens
PMVLTAGPN

SEQ ID NO: 93183 - protein, 9 aa, Homo Sapiens
THKAIYAGE

SEQ ID NO: 93184 - protein, 9 aa, Homo Sapiens
TENENKDTP

SEQ ID NO: 93185 - protein, 9 aa, Homo Sapiens
HLHTSVYFF

SEQ ID NO: 93186 - protein, 9 aa, Homo Sapiens
KTQVQLKKM

SEQ ID NO: 93187 - protein, 9 aa, Homo Sapiens
VRMKPDPKK

SEQ ID NO: 93188 - protein, 9 aa, Homo Sapiens
GYLLIGDKD

SEQ ID NO: 93189 - protein, 9 aa, Homo Sapiens
ADFVLSNMM

SEQ ID NO: 93190 - protein, 9 aa, Homo Sapiens
EIEKLIKQV

SEQ ID NO: 93191 - protein, 9 aa, Homo Sapiens
LPHKFHTLV

SEQ ID NO: 93192 - protein, 9 aa, Homo Sapiens
EKDVLNVLQ

SEQ ID NO: 93193 - protein, 9 aa, Homo Sapiens
RNNMIQQKN

SEQ ID NO: 93194 - protein, 9 aa, Homo Sapiens
IGQYYSNVI

SEQ ID NO: 93195 - protein, 9 aa, Homo Sapiens
FHPQITKDE

SEQ ID NO: 93196 - protein, 9 aa, Homo Sapiens
ASAWTVNYG

SEQ ID NO: 93197 - protein, 9 aa, Homo Sapiens
EEKTTNTEL

SEQ ID NO: 93198 - protein, 9 aa, Homo Sapiens
LGKDWGLED

SEQ ID NO: 93199 - protein, 9 aa, Homo Sapiens
SHRNSLKHQ

SEQ ID NO: 93200 - protein, 9 aa, Homo Sapiens
IPFLFTPFK

SEQ ID NO: 93201 - protein, 9 aa, Homo Sapiens
MMALLVLSC

SEQ ID NO: 93202 - protein, 9 aa, Homo Sapiens
ELVSDEMVS

SEQ ID NO: 93203 - protein, 9 aa, Homo Sapiens
VFRKTKGKD

SEQ ID NO: 93204 - protein, 9 aa, Homo Sapiens
EPGPTAQNI

SEQ ID NO: 93205 - protein, 9 aa, Homo Sapiens
KLKVEAKKT

SEQ ID NO: 93206 - protein, 9 aa, Homo Sapiens
IFCISGDRK

SEQ ID NO: 93207 - protein, 9 aa, Homo Sapiens
GFPKRMVLL

SEQ ID NO: 93208 - protein, 9 aa, Homo Sapiens
TQKKEVTIP

SEQ ID NO: 93209 - protein, 9 aa, Homo Sapiens
LKMPMKLTV

SEQ ID NO: 93210 - protein, 9 aa, Homo Sapiens
AKALVNSQV

SEQ ID NO: 93211 - protein, 9 aa, Homo Sapiens
LSCGEVVFS

SEQ ID NO: 93212 - protein, 9 aa, Homo Sapiens
SPPPSLCTI

SEQ ID NO: 93213 - protein, 9 aa, Homo Sapiens
AESTTEEGK

SEQ ID NO: 93214 - protein, 9 aa, Homo Sapiens
SSPASTTKR

SEQ ID NO: 93215 - protein, 9 aa, Homo Sapiens
SQLWAFLHI

SEQ ID NO: 93216 - protein, 9 aa, Homo Sapiens
SLRESVIEK

SEQ ID NO: 93217 - protein, 9 aa, Homo Sapiens
FVYFLTVHP

SEQ ID NO: 93218 - protein, 9 aa, Homo Sapiens
AIENHQKMI

SEQ ID NO: 93219 - protein, 9 aa, Homo Sapiens
VELGVSVGL

SEQ ID NO: 93220 - protein, 9 aa, Homo Sapiens
PCEPPEVGS

SEQ ID NO: 93221 - protein, 9 aa, Homo Sapiens
NKEFQFILD

SEQ ID NO: 93222 - protein, 9 aa, Homo Sapiens
AIHNHRTIL

SEQ ID NO: 93223 - protein, 9 aa, Homo Sapiens
ASIHRLIEQ

SEQ ID NO: 93224 - protein, 9 aa, Homo Sapiens
TSCNLDEQQ

SEQ ID NO: 93225 - protein, 9 aa, Homo Sapiens
KVQKSIEVP

SEQ ID NO: 93226 - protein, 9 aa, Homo Sapiens
KLIKQVTES

SEQ ID NO: 93227 - protein, 9 aa, Homo Sapiens
KPYKCNDCH

SEQ ID NO: 93228 - protein, 9 aa, Homo Sapiens
ILNKSIRNL

SEQ ID NO: 93229 - protein, 9 aa, Homo Sapiens
RFPNVYHEL

SEQ ID NO: 93230 - protein, 9 aa, Homo Sapiens
LDARMAHGS

SEQ ID NO: 93231 - protein, 9 aa, Homo Sapiens
EGGDGKASS

SEQ ID NO: 93232 - protein, 9 aa, Homo Sapiens
ILKGYKTYL

SEQ ID NO: 93233 - protein, 9 aa, Homo Sapiens
KNNAALARE

SEQ ID NO: 93234 - protein, 9 aa, Homo Sapiens
KHEGGNDRY

SEQ ID NO: 93235 - protein, 9 aa, Homo Sapiens
CISGDRKIN

SEQ ID NO: 93236 - protein, 9 aa, Homo Sapiens
FIAQYGNGL

SEQ ID NO: 93237 - protein, 9 aa, Homo Sapiens
QEAELRHRL

SEQ ID NO: 93238 - protein, 9 aa, Homo Sapiens
WVLLCSKDV

SEQ ID NO: 93239 - protein, 9 aa, Homo Sapiens
LKKQGEIPN

SEQ ID NO: 93240 - protein, 9 aa, Homo Sapiens
GKYRGQLYL

SEQ ID NO: 93241 - protein, 9 aa, Homo Sapiens
LVSNFPNKG

SEQ ID NO: 93242 - protein, 9 aa, Homo Sapiens
IMQTLNKMK

SEQ ID NO: 93243 - protein, 9 aa, Homo Sapiens
HSKPLYETI

SEQ ID NO: 93244 - protein, 9 aa, Homo Sapiens
DVLNVLQAV

SEQ ID NO: 93245 - protein, 9 aa, Homo Sapiens
FGGSLHSSL

SEQ ID NO: 93246 - protein, 9 aa, Homo Sapiens
DFRLSYGRD

SEQ ID NO: 93247 - protein, 9 aa, Homo Sapiens
LSTLKFIAQ

SEQ ID NO: 93248 - protein, 9 aa, Homo Sapiens
SHCPRVVLP

SEQ ID NO: 93249 - protein, 9 aa, Homo Sapiens
AAPAYGFPK

SEQ ID NO: 93250 - protein, 9 aa, Homo Sapiens
LLRAVLGRK

SEQ ID NO: 93251 - protein, 9 aa, Homo Sapiens
TMLAKDING

SEQ ID NO: 93252 - protein, 9 aa, Homo Sapiens
LYRLFVYLH

SEQ ID NO: 93253 - protein, 9 aa, Homo Sapiens
EGRIDNMKW

SEQ ID NO: 93254 - protein, 9 aa, Homo Sapiens
PEKIQNAFD

SEQ ID NO: 93255 - protein, 9 aa, Homo Sapiens
FGLVRPLPL

SEQ ID NO: 93256 - protein, 9 aa, Homo Sapiens
GLRSPAASA

SEQ ID NO: 93257 - protein, 9 aa, Homo Sapiens
QEFPPRPTS

SEQ ID NO: 93258 - protein, 9 aa, Homo Sapiens
GVRRGWQHV

SEQ ID NO: 93259 - protein, 9 aa, Homo Sapiens
LRARVLPGG

SEQ ID NO: 93260 - protein, 9 aa, Homo Sapiens
GLVRPLPLH

SEQ ID NO: 93261 - protein, 9 aa, Homo Sapiens
ADTDDHRVE

SEQ ID NO: 93262 - protein, 9 aa, Homo Sapiens
LHSTETQLA

SEQ ID NO: 93263 - protein, 9 aa, Homo Sapiens
IGHFQNRVH

SEQ ID NO: 93264 - protein, 9 aa, Homo Sapiens
QRQLDCVSG

SEQ ID NO: 93265 - protein, 9 aa, Homo Sapiens
GVPGQEFPP

SEQ ID NO: 93266 - protein, 9 aa, Homo Sapiens
LASHILSKL

SEQ ID NO: 93267 - protein, 9 aa, Homo Sapiens
TPLKRNELS

SEQ ID NO: 93268 - protein, 9 aa, Homo Sapiens
GCGESTTSR

SEQ ID NO: 93269 - protein, 9 aa, Homo Sapiens
HSTTSGCGE

SEQ ID NO: 93270 - protein, 9 aa, Homo Sapiens
VQTKRKDSI

SEQ ID NO: 93271 - protein, 9 aa, Homo Sapiens
VVDKNNFNC

SEQ ID NO: 93272 - protein, 9 aa, Homo Sapiens
PSYHHHFGQ

SEQ ID NO: 93273 - protein, 9 aa, Homo Sapiens
GVRQKRRNV

SEQ ID NO: 93274 - protein, 9 aa, Homo Sapiens
GLPGPSGSP

SEQ ID NO: 93275 - protein, 9 aa, Homo Sapiens
FLRLGVPQV

SEQ ID NO: 93276 - protein, 9 aa, Homo Sapiens
SQFSSRSRS

SEQ ID NO: 93277 - protein, 9 aa, Homo Sapiens
HVFAALSDS

SEQ ID NO: 93278 - protein, 9 aa, Homo Sapiens
EDYKYTYWA

SEQ ID NO: 93279 - protein, 9 aa, Homo Sapiens
VRLYYILLA

SEQ ID NO: 93280 - protein, 9 aa, Homo Sapiens
STPLKRNEL

SEQ ID NO: 93281 - protein, 9 aa, Homo Sapiens
FVLILIMYV

SEQ ID NO: 93282 - protein, 9 aa, Homo Sapiens
EGVPGQEFP

SEQ ID NO: 93283 - protein, 9 aa, Homo Sapiens
VMCIPYLLR

SEQ ID NO: 93284 - protein, 9 aa, Homo Sapiens
LRLGVPQVV

SEQ ID NO: 93285 - protein, 9 aa, Homo Sapiens
LILIMYVVI

SEQ ID NO: 93286 - protein, 9 aa, Homo Sapiens
RIDNMKWCG

SEQ ID NO: 93287 - protein, 9 aa, Homo Sapiens
RLGVPQVVP

SEQ ID NO: 93288 - protein, 9 aa, Homo Sapiens
ARENKVKNL

SEQ ID NO: 93289 - protein, 9 aa, Homo Sapiens
GPKLASHIL

SEQ ID NO: 93290 - protein, 9 aa, Homo Sapiens
MNDARHGGW

SEQ ID NO: 93291 - protein, 9 aa, Homo Sapiens
STETQLAAD

SEQ ID NO: 93292 - protein, 9 aa, Homo Sapiens
EVHFDGWNN

SEQ ID NO: 93293 - protein, 9 aa, Homo Sapiens
KNGGRKVRL

SEQ ID NO: 93294 - protein, 9 aa, Homo Sapiens
KVRLFLKRG

SEQ ID NO: 93295 - protein, 9 aa, Homo Sapiens
EAEAQVPHL

SEQ ID NO: 93296 - protein, 9 aa, Homo Sapiens
RMFLRLGVP

SEQ ID NO: 93297 - protein, 9 aa, Homo Sapiens
NFGLVRPLP

SEQ ID NO: 93298 - protein, 9 aa, Homo Sapiens
HILSKLTDI

SEQ ID NO: 93299 - protein, 9 aa, Homo Sapiens
TTSGCGEST

SEQ ID NO: 93300 - protein, 9 aa, Homo Sapiens
HLRARVLPG

SEQ ID NO: 93301 - protein, 9 aa, Homo Sapiens
HSLRQPPFG

SEQ ID NO: 93302 - protein, 9 aa, Homo Sapiens
HLQFPSFPA

SEQ ID NO: 93303 - protein, 9 aa, Homo Sapiens
FLHPHRLKA

SEQ ID NO: 93304 - protein, 9 aa, Homo Sapiens
RLLFLHPHR

SEQ ID NO: 93305 - protein, 9 aa, Homo Sapiens
QPPFGRLLF

SEQ ID NO: 93306 - protein, 9 aa, Homo Sapiens
EITEGVPGQ

SEQ ID NO: 93307 - protein, 9 aa, Homo Sapiens
DCTSEGRID

SEQ ID NO: 93308 - protein, 9 aa, Homo Sapiens
GAIDLALST

SEQ ID NO: 93309 - protein, 9 aa, Homo Sapiens
ETQLAADLL

SEQ ID NO: 93310 - protein, 9 aa, Homo Sapiens
DMYEDYKYT

SEQ ID NO: 93311 - protein, 9 aa, Homo Sapiens
QQLVVDKNN

SEQ ID NO: 93312 - protein, 9 aa, Homo Sapiens
KHARENKVK

SEQ ID NO: 93313 - protein, 9 aa, Homo Sapiens
PTSAVRERG

SEQ ID NO: 93314 - protein, 9 aa, Homo Sapiens
NHLQFPSFP

SEQ ID NO: 93315 - protein, 9 aa, Homo Sapiens
VGLRSPAAS

SEQ ID NO: 93316 - protein, 9 aa, Homo Sapiens
GLRMFLRLG

SEQ ID NO: 93317 - protein, 9 aa, Homo Sapiens
SGGPEVQTK

SEQ ID NO: 93318 - protein, 9 aa, Homo Sapiens
QKLEVTQTT

SEQ ID NO: 93319 - protein, 9 aa, Homo Sapiens
RVMCIPYLL

SEQ ID NO: 93320 - protein, 9 aa, Homo Sapiens
QNAFDDIAK

SEQ ID NO: 93321 - protein, 9 aa, Homo Sapiens
APSLPRVMC

SEQ ID NO: 93322 - protein, 9 aa, Homo Sapiens
TRMEGGAPL

SEQ ID NO: 93323 - protein, 9 aa, Homo Sapiens
RSKSRSQFS

SEQ ID NO: 93324 - protein, 9 aa, Homo Sapiens
EKHARENKV

SEQ ID NO: 93325 - protein, 9 aa, Homo Sapiens
RVLPGGAEE

SEQ ID NO: 93326 - protein, 9 aa, Homo Sapiens
ARSQRTCSC

SEQ ID NO: 93327 - protein, 9 aa, Homo Sapiens
PHLRARVLP

SEQ ID NO: 93328 - protein, 9 aa, Homo Sapiens
QVVPNHLQF

SEQ ID NO: 93329 - protein, 9 aa, Homo Sapiens
ELHSTETQL

SEQ ID NO: 93330 - protein, 9 aa, Homo Sapiens
CCLRIVERS

SEQ ID NO: 93331 - protein, 9 aa, Homo Sapiens
AQIPEKIQN

SEQ ID NO: 93332 - protein, 9 aa, Homo Sapiens
SGSPGPPGQ

SEQ ID NO: 93333 - protein, 9 aa, Homo Sapiens
DARHGGWTT

SEQ ID NO: 93334 - protein, 9 aa, Homo Sapiens
GEVDYKKKI

SEQ ID NO: 93335 - protein, 9 aa, Homo Sapiens
YEELLDNQK

SEQ ID NO: 93336 - protein, 9 aa, Homo Sapiens
YRPGLRMFL

SEQ ID NO: 93337 - protein, 9 aa, Homo Sapiens
MKQMNDARH

SEQ ID NO: 93338 - protein, 9 aa, Homo Sapiens
LVRPLPLHF

SEQ ID NO: 93339 - protein, 9 aa, Homo Sapiens
SRSQFSSRS

SEQ ID NO: 93340 - protein, 9 aa, Homo Sapiens
RVEVHFDGW

SEQ ID NO: 93341 - protein, 9 aa, Homo Sapiens
RRCCLRIVE

SEQ ID NO: 93342 - protein, 9 aa, Homo Sapiens
NGPKLASHI

SEQ ID NO: 93343 - protein, 9 aa, Homo Sapiens
HRLKAPSLP

SEQ ID NO: 93344 - protein, 9 aa, Homo Sapiens
HKGVRQKRR

SEQ ID NO: 93345 - protein, 9 aa, Homo Sapiens
LQQLVVDKN

SEQ ID NO: 93346 - protein, 9 aa, Homo Sapiens
EGYISALQR

SEQ ID NO: 93347 - protein, 9 aa, Homo Sapiens
HRVEVHFDG

SEQ ID NO: 93348 - protein, 9 aa, Homo Sapiens
VIQAKNMGG

SEQ ID NO: 93349 - protein, 9 aa, Homo Sapiens
IGKERTWEE

SEQ ID NO: 93350 - protein, 9 aa, Homo Sapiens
QVPHLRARV

SEQ ID NO: 93351 - protein, 9 aa, Homo Sapiens
EVQTKRKDS

SEQ ID NO: 93352 - protein, 9 aa, Homo Sapiens
DGRDHVRLY

SEQ ID NO: 93353 - protein, 9 aa, Homo Sapiens
NIIKLLGAC

SEQ ID NO: 93354 - protein, 9 aa, Homo Sapiens
LRCHVLTSG

SEQ ID NO: 93355 - protein, 9 aa, Homo Sapiens
ERRCCLRIV

SEQ ID NO: 93356 - protein, 9 aa, Homo Sapiens
GPSGSPGPP

SEQ ID NO: 93357 - protein, 9 aa, Homo Sapiens
LGRLNDMYE

SEQ ID NO: 93358 - protein, 9 aa, Homo Sapiens
PDGRDHVRL

SEQ ID NO: 93359 - protein, 9 aa, Homo Sapiens
TSGCGESTT

SEQ ID NO: 93360 - protein, 9 aa, Homo Sapiens
MCIPYLLRD

SEQ ID NO: 93361 - protein, 9 aa, Homo Sapiens
SGVRRGWQH

SEQ ID NO: 93362 - protein, 9 aa, Homo Sapiens
LFFVLILIM

SEQ ID NO: 93363 - protein, 9 aa, Homo Sapiens
ESAKEITEG

SEQ ID NO: 93364 - protein, 9 aa, Homo Sapiens
LGAIDLALS

SEQ ID NO: 93365 - protein, 9 aa, Homo Sapiens
DHVRLYYIL

SEQ ID NO: 93366 - protein, 9 aa, Homo Sapiens
ITFDSFKTE

SEQ ID NO: 93367 - protein, 9 aa, Homo Sapiens
GRDGLPGPS

SEQ ID NO: 93368 - protein, 9 aa, Homo Sapiens
FGRLLFLHP

SEQ ID NO: 93369 - protein, 9 aa, Homo Sapiens
RGWQHVFAA

SEQ ID NO: 93370 - protein, 9 aa, Homo Sapiens
DNQKLEVTQ

SEQ ID NO: 93371 - protein, 9 aa, Homo Sapiens
EKEKHAREN

SEQ ID NO: 93372 - protein, 9 aa, Homo Sapiens
IQAKNMGGQ

SEQ ID NO: 93373 - protein, 9 aa, Homo Sapiens
PSLPRVMCI

SEQ ID NO: 93374 - protein, 9 aa, Homo Sapiens
SVPIGHFQN

SEQ ID NO: 93375 - protein, 9 aa, Homo Sapiens
GQEFPPRPT

SEQ ID NO: 93376 - protein, 9 aa, Homo Sapiens
RDDTQQHQE

SEQ ID NO: 93377 - protein, 9 aa, Homo Sapiens
IIKLLGACT

SEQ ID NO: 93378 - protein, 9 aa, Homo Sapiens
KQMNDARHG

SEQ ID NO: 93379 - protein, 9 aa, Homo Sapiens
KRRNVWLGI

SEQ ID NO: 93380 - protein, 9 aa, Homo Sapiens
FCKCERRCC

SEQ ID NO: 93381 - protein, 9 aa, Homo Sapiens
KIQNAFDDI

SEQ ID NO: 93382 - protein, 9 aa, Homo Sapiens
RDHVRLYYI

SEQ ID NO: 93383 - protein, 9 aa, Homo Sapiens
GCHSLRQPP

SEQ ID NO: 93384 - protein, 9 aa, Homo Sapiens
QQCKLAYYG

SEQ ID NO: 93385 - protein, 9 aa, Homo Sapiens
IDGYETLAL

SEQ ID NO: 93386 - protein, 9 aa, Homo Sapiens
QMNDARHGG

SEQ ID NO: 93387 - protein, 9 aa, Homo Sapiens
DTQQHQEEQ

SEQ ID NO: 93388 - protein, 9 aa, Homo Sapiens
LFLHPHRLK

SEQ ID NO: 93389 - protein, 9 aa, Homo Sapiens
AQVPHLRAR

SEQ ID NO: 93390 - protein, 9 aa, Homo Sapiens
DYKKKIPES

SEQ ID NO: 93391 - protein, 9 aa, Homo Sapiens
AEESAKEIT

SEQ ID NO: 93392 - protein, 9 aa, Homo Sapiens
KGVRQKRRN

SEQ ID NO: 93393 - protein, 9 aa, Homo Sapiens
SLRQPPFGR

SEQ ID NO: 93394 - protein, 9 aa, Homo Sapiens
KLASHILSK

SEQ ID NO: 93395 - protein, 9 aa, Homo Sapiens
SALQRQLDC

SEQ ID NO: 93396 - protein, 9 aa, Homo Sapiens
LNDMYEDYK

SEQ ID NO: 93397 - protein, 9 aa, Homo Sapiens
LKRNELSSS

SEQ ID NO: 93398 - protein, 9 aa, Homo Sapiens
GRLLFLHPH

SEQ ID NO: 93399 - protein, 9 aa, Homo Sapiens
RCCLRIVER

SEQ ID NO: 93400 - protein, 9 aa, Homo Sapiens
FGQQCKLAY

SEQ ID NO: 93401 - protein, 9 aa, Homo Sapiens
RQKRRNVWL

SEQ ID NO: 93402 - protein, 9 aa, Homo Sapiens
ENGPKLASH

SEQ ID NO: 93403 - protein, 9 aa, Homo Sapiens
PWGCHSLRQ

SEQ ID NO: 93404 - protein, 9 aa, Homo Sapiens
SLQQLVVDK

SEQ ID NO: 93405 - protein, 9 aa, Homo Sapiens
GKERTWEES

SEQ ID NO: 93406 - protein, 9 aa, Homo Sapiens
LVVDKNNFN

SEQ ID NO: 93407 - protein, 9 aa, Homo Sapiens
PRVMCIPYL

SEQ ID NO: 93408 - protein, 9 aa, Homo Sapiens
LQRQLDCVS

SEQ ID NO: 93409 - protein, 9 aa, Homo Sapiens
RDGLPGPSG

SEQ ID NO: 93410 - protein, 9 aa, Homo Sapiens
VRPLPLHFL

SEQ ID NO: 93411 - protein, 9 aa, Homo Sapiens
GVPQVVPNH

SEQ ID NO: 93412 - protein, 9 aa, Homo Sapiens
AASASASPH

SEQ ID NO: 93413 - protein, 9 aa, Homo Sapiens
GQQCKLAYY

SEQ ID NO: 93414 - protein, 9 aa, Homo Sapiens
LRSPAASAS

SEQ ID NO: 93415 - protein, 9 aa, Homo Sapiens
KRNELSSSV

SEQ ID NO: 93416 - protein, 9 aa, Homo Sapiens
QQHQEEQEE

SEQ ID NO: 93417 - protein, 9 aa, Homo Sapiens
IDNMKWCGT

SEQ ID NO: 93418 - protein, 9 aa, Homo Sapiens
RNELSSSVQ

SEQ ID NO: 93419 - protein, 9 aa, Homo Sapiens
LSSSVQNYF

SEQ ID NO: 93420 - protein, 9 aa, Homo Sapiens
RENKVKNLT

SEQ ID NO: 93421 - protein, 9 aa, Homo Sapiens
TSEGRIDNM

SEQ ID NO: 93422 - protein, 9 aa, Homo Sapiens
AYQWIDGYE

SEQ ID NO: 93423 - protein, 9 aa, Homo Sapiens
FFVLILIMY

SEQ ID NO: 93424 - protein, 9 aa, Homo Sapiens
NMGGQMGGL

SEQ ID NO: 93425 - protein, 9 aa, Homo Sapiens
VVPNHLQFP

SEQ ID NO: 93426 - protein, 9 aa, Homo Sapiens
AHSTTSGCG

SEQ ID NO: 93427 - protein, 9 aa, Homo Sapiens
MEGGAPLSP

SEQ ID NO: 93428 - protein, 9 aa, Homo Sapiens
GRDHVRLYY

SEQ ID NO: 93429 - protein, 9 aa, Homo Sapiens
GYISALQRQ

SEQ ID NO: 93430 - protein, 9 aa, Homo Sapiens
CHSLRQPPF

SEQ ID NO: 93431 - protein, 9 aa, Homo Sapiens
KLLGACTQD

SEQ ID NO: 93432 - protein, 9 aa, Homo Sapiens
LLRCHVLTS

SEQ ID NO: 93433 - protein, 9 aa, Homo Sapiens
PRPTSAVRE

SEQ ID NO: 93434 - protein, 9 aa, Homo Sapiens
WQHVFAALS

SEQ ID NO: 93435 - protein, 9 aa, Homo Sapiens
EELLDNQKL

SEQ ID NO: 93436 - protein, 9 aa, Homo Sapiens
SHILSKLTD

SEQ ID NO: 93437 - protein, 9 aa, Homo Sapiens
SEAEAQVPH

SEQ ID NO: 93438 - protein, 9 aa, Homo Sapiens
EVDYKKKIP

SEQ ID NO: 93439 - protein, 9 aa, Homo Sapiens
QLVVDKNNF

SEQ ID NO: 93440 - protein, 9 aa, Homo Sapiens
HKNIIKLLG

SEQ ID NO: 93441 - protein, 9 aa, Homo Sapiens
MFLRLGVPQ

SEQ ID NO: 93442 - protein, 9 aa, Homo Sapiens
SNLSVPIGH

SEQ ID NO: 93443 - protein, 9 aa, Homo Sapiens
KKELHSTET

SEQ ID NO: 93444 - protein, 9 aa, Homo Sapiens
GSKLRDDTQ

SEQ ID NO: 93445 - protein, 9 aa, Homo Sapiens
ALNFGLVRP

SEQ ID NO: 93446 - protein, 9 aa, Homo Sapiens
HFPAYQWID

SEQ ID NO: 93447 - protein, 9 aa, Homo Sapiens
LPRVMCIPY

SEQ ID NO: 93448 - protein, 9 aa, Homo Sapiens
FMKQMNDAR

SEQ ID NO: 93449 - protein, 9 aa, Homo Sapiens
ARHGGWTTK

SEQ ID NO: 93450 - protein, 9 aa, Homo Sapiens
PPFGRLLFL

SEQ ID NO: 93451 - protein, 9 aa, Homo Sapiens
KEKHARENK

SEQ ID NO: 93452 - protein, 9 aa, Homo Sapiens
KKIPESEAE

SEQ ID NO: 93453 - protein, 9 aa, Homo Sapiens
GAPLSPWGC

SEQ ID NO: 93454 - protein, 9 aa, Homo Sapiens
DKNNFNCTR

SEQ ID NO: 93455 - protein, 9 aa, Homo Sapiens
LLFFVLILI

SEQ ID NO: 93456 - protein, 9 aa, Homo Sapiens
PAPSLVTRM

SEQ ID NO: 93457 - protein, 9 aa, Homo Sapiens
SAHSTTSGC

SEQ ID NO: 93458 - protein, 9 aa, Homo Sapiens
NGGRKVRLF

SEQ ID NO: 93459 - protein, 9 aa, Homo Sapiens
NAFDDIAKY

SEQ ID NO: 93460 - protein, 9 aa, Homo Sapiens
SAKEITEGV

SEQ ID NO: 93461 - protein, 9 aa, Homo Sapiens
KNIIKLLGA

SEQ ID NO: 93462 - protein, 9 aa, Homo Sapiens
YKKKIPESE

SEQ ID NO: 93463 - protein, 9 aa, Homo Sapiens
YQVVIQAKN

SEQ ID NO: 93464 - protein, 9 aa, Homo Sapiens
VEVHFDGWN

SEQ ID NO: 93465 - protein, 9 aa, Homo Sapiens
VPNHLQFPS

SEQ ID NO: 93466 - protein, 9 aa, Homo Sapiens
SLPRVMCIP

SEQ ID NO: 93467 - protein, 9 aa, Homo Sapiens
QAKNMGGQM

SEQ ID NO: 93468 - protein, 9 aa, Homo Sapiens
LLDNQKLEV

SEQ ID NO: 93469 - protein, 9 aa, Homo Sapiens
DGLPGPSGS

SEQ ID NO: 93470 - protein, 9 aa, Homo Sapiens
HVGLRSPAA

SEQ ID NO: 93471 - protein, 9 aa, Homo Sapiens
LGVPQVVPN

SEQ ID NO: 93472 - protein, 9 aa, Homo Sapiens
QMTKDPGAL

SEQ ID NO: 93473 - protein, 9 aa, Homo Sapiens
GHFQNRVHL

SEQ ID NO: 93474 - protein, 9 aa, Homo Sapiens
VPIGHFQNR

SEQ ID NO: 93475 - protein, 9 aa, Homo Sapiens
HARENKVKN

SEQ ID NO: 93476 - protein, 9 aa, Homo Sapiens
IPYLLRDTI

SEQ ID NO: 93477 - protein, 9 aa, Homo Sapiens
FSSRSRSRS

SEQ ID NO: 93478 - protein, 9 aa, Homo Sapiens
SGCGESTTS

SEQ ID NO: 93479 - protein, 9 aa, Homo Sapiens
QVVIQAKNM

SEQ ID NO: 93480 - protein, 9 aa, Homo Sapiens
PSFPAPSLV

SEQ ID NO: 93481 - protein, 9 aa, Homo Sapiens
RSPAASASA

SEQ ID NO: 93482 - protein, 9 aa, Homo Sapiens
MYEDYKYTY

SEQ ID NO: 93483 - protein, 9 aa, Homo Sapiens
TQQHQEEQE

SEQ ID NO: 93484 - protein, 9 aa, Homo Sapiens
EDPDGRDHV

SEQ ID NO: 93485 - protein, 9 aa, Homo Sapiens
LRALNFGLV

SEQ ID NO: 93486 - protein, 9 aa, Homo Sapiens
VRQKRRNVW

SEQ ID NO: 93487 - protein, 9 aa, Homo Sapiens
AKEITEGVP

SEQ ID NO: 93488 - protein, 9 aa, Homo Sapiens
ISALQRQLD

SEQ ID NO: 93489 - protein, 9 aa, Homo Sapiens
TETQLAADL

SEQ ID NO: 93490 - protein, 9 aa, Homo Sapiens
RKVRLFLKR

SEQ ID NO: 93491 - protein, 9 aa, Homo Sapiens
EGGAPLSPW

SEQ ID NO: 93492 - protein, 9 aa, Homo Sapiens
ELSSSVQNY

SEQ ID NO: 93493 - protein, 9 aa, Homo Sapiens
NELSSSVQN

SEQ ID NO: 93494 - protein, 9 aa, Homo Sapiens
QDLLRCHVL

SEQ ID NO: 93495 - protein, 9 aa, Homo Sapiens
LFCKCERRC

SEQ ID NO: 93496 - protein, 9 aa, Homo Sapiens
LKKELHSTE

SEQ ID NO: 93497 - protein, 9 aa, Homo Sapiens
GWQHVFAAL

SEQ ID NO: 93498 - protein, 9 aa, Homo Sapiens
YIGKERTWE

SEQ ID NO: 93499 - protein, 9 aa, Homo Sapiens
KITFDSFKT

SEQ ID NO: 93500 - protein, 9 aa, Homo Sapiens
TEGVPGQEF

SEQ ID NO: 93501 - protein, 9 aa, Homo Sapiens
SKLRDDTQQ

SEQ ID NO: 93502 - protein, 9 aa, Homo Sapiens
CHVLTSGIF

SEQ ID NO: 93503 - protein, 9 aa, Homo Sapiens
APLSPWGCH

SEQ ID NO: 93504 - protein, 9 aa, Homo Sapiens
ILIMYVVIL

SEQ ID NO: 93505 - protein, 9 aa, Homo Sapiens
PKLASHILS

SEQ ID NO: 93506 - protein, 9 aa, Homo Sapiens
LPGGAEESA

SEQ ID NO: 93507 - protein, 9 aa, Homo Sapiens
APSLVTRME

SEQ ID NO: 93508 - protein, 9 aa, Homo Sapiens
IGKHKNIIK

SEQ ID NO: 93509 - protein, 9 aa, Homo Sapiens
RLNDMYEDY

SEQ ID NO: 93510 - protein, 9 aa, Homo Sapiens
ELLDNQKLE

SEQ ID NO: 93511 - protein, 9 aa, Homo Sapiens
IPEKIQNAF

SEQ ID NO: 93512 - protein, 9 aa, Homo Sapiens
KCERRCCLR

SEQ ID NO: 93513 - protein, 9 aa, Homo Sapiens
KAPSLPRVM

SEQ ID NO: 93514 - protein, 9 aa, Homo Sapiens
GRKVRLFLK

SEQ ID NO: 93515 - protein, 9 aa, Homo Sapiens
PAASASASP

SEQ ID NO: 93516 - protein, 9 aa, Homo Sapiens
RSQFSSRSR

SEQ ID NO: 93517 - protein, 9 aa, Homo Sapiens
RARVLPGGA

SEQ ID NO: 93518 - protein, 9 aa, Homo Sapiens
DHRVEVHFD

SEQ ID NO: 93519 - protein, 9 aa, Homo Sapiens
HHHFGQQCK

SEQ ID NO: 93520 - protein, 9 aa, Homo Sapiens
YKARSQRTC

SEQ ID NO: 93521 - protein, 9 aa, Homo Sapiens
DSFKTEVNY

SEQ ID NO: 93522 - protein, 9 aa, Homo Sapiens
KHKNIIKLL

SEQ ID NO: 93523 - protein, 9 aa, Homo Sapiens
PGLRMFLRL

SEQ ID NO: 93524 - protein, 9 aa, Homo Sapiens
GGAPLSPWG

SEQ ID NO: 93525 - protein, 9 aa, Homo Sapiens
FPPRPTSAV

SEQ ID NO: 93526 - protein, 9 aa, Homo Sapiens
KERTWEESL

SEQ ID NO: 93527 - protein, 9 aa, Homo Sapiens
SPWGCHSLR

SEQ ID NO: 93528 - protein, 9 aa, Homo Sapiens
PAYQWIDGY

SEQ ID NO: 93529 - protein, 9 aa, Homo Sapiens
QWIDGYETL

SEQ ID NO: 93530 - protein, 9 aa, Homo Sapiens
IKNGGRKVR

SEQ ID NO: 93531 - protein, 9 aa, Homo Sapiens
KIQMTKDPG

SEQ ID NO: 93532 - protein, 9 aa, Homo Sapiens
LQFPSFPAP

SEQ ID NO: 93533 - protein, 9 aa, Homo Sapiens
HHFGQQCKL

SEQ ID NO: 93534 - protein, 9 aa, Homo Sapiens
EAQVPHLRA

SEQ ID NO: 93535 - protein, 9 aa, Homo Sapiens
RNVWLGIKN

SEQ ID NO: 93536 - protein, 9 aa, Homo Sapiens
KARSQRTCS

SEQ ID NO: 93537 - protein, 9 aa, Homo Sapiens
KELHSTETQ

SEQ ID NO: 93538 - protein, 9 aa, Homo Sapiens
LLFLHPHRL

SEQ ID NO: 93539 - protein, 9 aa, Homo Sapiens
PIKITFDSF

SEQ ID NO: 93540 - protein, 9 aa, Homo Sapiens
PSGSPGPPG

SEQ ID NO: 93541 - protein, 9 aa, Homo Sapiens
KEITEGVPG

SEQ ID NO: 93542 - protein, 9 aa, Homo Sapiens
LRQPPFGRL

SEQ ID NO: 93543 - protein, 9 aa, Homo Sapiens
LVTRMEGGA

SEQ ID NO: 93544 - protein, 9 aa, Homo Sapiens
QFSSRSRSR

SEQ ID NO: 93545 - protein, 9 aa, Homo Sapiens
GGPEVQTKR

SEQ ID NO: 93546 - protein, 9 aa, Homo Sapiens
VPHLRARVL

SEQ ID NO: 93547 - protein, 9 aa, Homo Sapiens
EESAKEITE

SEQ ID NO: 93548 - protein, 9 aa, Homo Sapiens
AEAQVPHLR

SEQ ID NO: 93549 - protein, 9 aa, Homo Sapiens
TDCTSEGRI

SEQ ID NO: 93550 - protein, 9 aa, Homo Sapiens
HSTETQLAA

SEQ ID NO: 93551 - protein, 9 aa, Homo Sapiens
VEKEKHARE

SEQ ID NO: 93552 - protein, 9 aa, Homo Sapiens
CKCERRCCL

SEQ ID NO: 93553 - protein, 9 aa, Homo Sapiens
MTKDPGALL

SEQ ID NO: 93554 - protein, 9 aa, Homo Sapiens
PSLVTRMEG

SEQ ID NO: 93555 - protein, 9 aa, Homo Sapiens
LRMFLRLGV

SEQ ID NO: 93556 - protein, 9 aa, Homo Sapiens
SIKIQMTKD

SEQ ID NO: 93557 - protein, 9 aa, Homo Sapiens
SDQDLLRCH

SEQ ID NO: 93558 - protein, 9 aa, Homo Sapiens
ELIKNGGRK

SEQ ID NO: 93559 - protein, 9 aa, Homo Sapiens
SPAASASAS

SEQ ID NO: 93560 - protein, 9 aa, Homo Sapiens
GRIDNMKWC

SEQ ID NO: 93561 - protein, 9 aa, Homo Sapiens
GPEVQTKRK

SEQ ID NO: 93562 - protein, 9 aa, Homo Sapiens
YHFPAYQWI

SEQ ID NO: 93563 - protein, 9 aa, Homo Sapiens
PPRPTSAVR

SEQ ID NO: 93564 - protein, 9 aa, Homo Sapiens
PLSPWGCHS

SEQ ID NO: 93565 - protein, 9 aa, Homo Sapiens
KLRDDTQQH

SEQ ID NO: 93566 - protein, 9 aa, Homo Sapiens
NDARHGGWT

SEQ ID NO: 93567 - protein, 9 aa, Homo Sapiens
WIDGYETLA

SEQ ID NO: 93568 - protein, 9 aa, Homo Sapiens
YPIKITFDS

SEQ ID NO: 93569 - protein, 9 aa, Homo Sapiens
ELLFFVLIL

SEQ ID NO: 93570 - protein, 9 aa, Homo Sapiens
FPAPSLVTR

SEQ ID NO: 93571 - protein, 9 aa, Homo Sapiens
QFPSFPAPS

SEQ ID NO: 93572 - protein, 9 aa, Homo Sapiens
PGQEFPPRP

SEQ ID NO: 93573 - protein, 9 aa, Homo Sapiens
WGCHSLRQP

SEQ ID NO: 93574 - protein, 9 aa, Homo Sapiens
KNMGGQMGG

SEQ ID NO: 93575 - protein, 9 aa, Homo Sapiens
KIPESEAEA

SEQ ID NO: 93576 - protein, 9 aa, Homo Sapiens
IQMTKDPGA

SEQ ID NO: 93577 - protein, 9 aa, Homo Sapiens
QHVFAALSD

SEQ ID NO: 93578 - protein, 9 aa, Homo Sapiens
PQVVPNHLQ

SEQ ID NO: 93579 - protein, 9 aa, Homo Sapiens
TDDHRVEVH

SEQ ID NO: 93580 - protein, 9 aa, Homo Sapiens
SYHHHFGQQ

SEQ ID NO: 93581 - protein, 9 aa, Homo Sapiens
IKITFDSFK

SEQ ID NO: 93582 - protein, 9 aa, Homo Sapiens
QSGGPEVQT

SEQ ID NO: 93583 - protein, 9 aa, Homo Sapiens
AKNMGGQMG

SEQ ID NO: 93584 - protein, 9 aa, Homo Sapiens
VLPGGAEES

SEQ ID NO: 93585 - protein, 9 aa, Homo Sapiens
EKIQNAFDD

SEQ ID NO: 93586 - protein, 9 aa, Homo Sapiens
GAEESAKEI

SEQ ID NO: 93587 - protein, 9 aa, Homo Sapiens
DDHRVEVHF

SEQ ID NO: 93588 - protein, 9 aa, Homo Sapiens
PLKRNELSS

SEQ ID NO: 93589 - protein, 9 aa, Homo Sapiens
CMLGAIDLA

SEQ ID NO: 93590 - protein, 9 aa, Homo Sapiens
CIPYLLRDT

SEQ ID NO: 93591 - protein, 9 aa, Homo Sapiens
LFLCMLGAI

SEQ ID NO: 93592 - protein, 9 aa, Homo Sapiens
SRSKSRSQF

SEQ ID NO: 93593 - protein, 9 aa, Homo Sapiens
QIPEKIQNA

SEQ ID NO: 93594 - protein, 9 aa, Homo Sapiens
EFPPRPTSA

SEQ ID NO: 93595 - protein, 9 aa, Homo Sapiens
IKIQMTKDP

SEQ ID NO: 93596 - protein, 9 aa, Homo Sapiens
CGESTTSRI

SEQ ID NO: 93597 - protein, 9 aa, Homo Sapiens
TFDSFKTEV

SEQ ID NO: 93598 - protein, 9 aa, Homo Sapiens
DLLRCHVLT

SEQ ID NO: 93599 - protein, 9 aa, Homo Sapiens
RMEGGAPLS

SEQ ID NO: 93600 - protein, 9 aa, Homo Sapiens
LPGPSGSPG

SEQ ID NO: 93601 - protein, 9 aa, Homo Sapiens
KVEKEKHAR

SEQ ID NO: 93602 - protein, 9 aa, Homo Sapiens
VDYKKKIPE

SEQ ID NO: 93603 - protein, 9 aa, Homo Sapiens
NQKLEVTQT

SEQ ID NO: 93604 - protein, 9 aa, Homo Sapiens
LRDDTQQHQ

SEQ ID NO: 93605 - protein, 9 aa, Homo Sapiens
VLILIMYVV

SEQ ID NO: 93606 - protein, 9 aa, Homo Sapiens
DQDLLRCHV

SEQ ID NO: 93607 - protein, 9 aa, Homo Sapiens
CTSEGRIDN

SEQ ID NO: 93608 - protein, 9 aa, Homo Sapiens
GRLNDMYED

SEQ ID NO: 93609 - protein, 9 aa, Homo Sapiens
YQWIDGYET

SEQ ID NO: 93610 - protein, 9 aa, Homo Sapiens
LKAPSLPRV

SEQ ID NO: 93611 - protein, 9 aa, Homo Sapiens
YISALQRQL

SEQ ID NO: 93612 - protein, 9 aa, Homo Sapiens
RRGWQHVFA

SEQ ID NO: 93613 - protein, 9 aa, Homo Sapiens
GGRKVRLFL

SEQ ID NO: 93614 - protein, 9 aa, Homo Sapiens
CERRCCLRI

SEQ ID NO: 93615 - protein, 9 aa, Homo Sapiens
VDKNNFNCT

SEQ ID NO: 93616 - protein, 9 aa, Homo Sapiens
FDSFKTEVN

SEQ ID NO: 93617 - protein, 9 aa, Homo Sapiens
VPGQEFPPR

SEQ ID NO: 93618 - protein, 9 aa, Homo Sapiens
RCHVLTSGI

SEQ ID NO: 93619 - protein, 9 aa, Homo Sapiens
HVLTSGIFE

SEQ ID NO: 93620 - protein, 9 aa, Homo Sapiens
YHHHFGQQC

SEQ ID NO: 93621 - protein, 9 aa, Homo Sapiens
HFQNRVHLM

SEQ ID NO: 93622 - protein, 9 aa, Homo Sapiens
PYLLRDTIR

SEQ ID NO: 93623 - protein, 9 aa, Homo Sapiens
ARVLPGGAE

SEQ ID NO: 93624 - protein, 9 aa, Homo Sapiens
GKHKNIIKL

SEQ ID NO: 93625 - protein, 9 aa, Homo Sapiens
FEGYISALQ

SEQ ID NO: 93626 - protein, 9 aa, Homo Sapiens
CYYIGKERT

SEQ ID NO: 93627 - protein, 9 aa, Homo Sapiens
RPGLRMFLR

SEQ ID NO: 93628 - protein, 9 aa, Homo Sapiens
SLVTRMEGG

SEQ ID NO: 93629 - protein, 9 aa, Homo Sapiens
DTDDHRVEV

SEQ ID NO: 93630 - protein, 9 aa, Homo Sapiens
DDTQQHQEE

SEQ ID NO: 93631 - protein, 9 aa, Homo Sapiens
PNHLQFPSF

SEQ ID NO: 93632 - protein, 9 aa, Homo Sapiens
LDNQKLEVT

SEQ ID NO: 93633 - protein, 9 aa, Homo Sapiens
LNFGLVRPL

SEQ ID NO: 93634 - protein, 9 aa, Homo Sapiens
RQPPFGRLL

SEQ ID NO: 93635 - protein, 9 aa, Homo Sapiens
LIMYVVILL

SEQ ID NO: 93636 - protein, 9 aa, Homo Sapiens
LCMLGAIDL

SEQ ID NO: 93637 - protein, 9 aa, Homo Sapiens
QKRRNVWLG

SEQ ID NO: 93638 - protein, 9 aa, Homo Sapiens
ASHILSKLT

SEQ ID NO: 93639 - protein, 9 aa, Homo Sapiens
PIGHFQNRV

SEQ ID NO: 93640 - protein, 9 aa, Homo Sapiens
IPESEAEAQ

SEQ ID NO: 93641 - protein, 9 aa, Homo Sapiens
ITEGVPGQE

SEQ ID NO: 93642 - protein, 9 aa, Homo Sapiens
RHGGWTTKM

SEQ ID NO: 93643 - protein, 9 aa, Homo Sapiens
STTSGCGES

SEQ ID NO: 93644 - protein, 9 aa, Homo Sapiens
PHRLKAPSL

SEQ ID NO: 93645 - protein, 9 aa, Homo Sapiens
VPQVVPNHL

SEQ ID NO: 93646 - protein, 9 aa, Homo Sapiens
YLFLCMLGA

SEQ ID NO: 93647 - protein, 9 aa, Homo Sapiens
LSPWGCHSL

SEQ ID NO: 93648 - protein, 9 aa, Homo Sapiens
PSLQQLVVD

SEQ ID NO: 93649 - protein, 9 aa, Homo Sapiens
RRNVWLGIK

SEQ ID NO: 93650 - protein, 9 aa, Homo Sapiens
QTKRKDSIL

SEQ ID NO: 93651 - protein, 9 aa, Homo Sapiens
HVRLYYILL

SEQ ID NO: 93652 - protein, 9 aa, Homo Sapiens
NLSVPIGHF

SEQ ID NO: 93653 - protein, 9 aa, Homo Sapiens
QQSGGPEVQ

SEQ ID NO: 93654 - protein, 9 aa, Homo Sapiens
ALQRQLDCV

SEQ ID NO: 93655 - protein, 9 aa, Homo Sapiens
PFGRLLFLH

SEQ ID NO: 93656 - protein, 9 aa, Homo Sapiens
LSVPIGHFQ

SEQ ID NO: 93657 - protein, 9 aa, Homo Sapiens
VRRGWQHVF

SEQ ID NO: 93658 - protein, 9 aa, Homo Sapiens
PEVQTKRKD

SEQ ID NO: 93659 - protein, 9 aa, Homo Sapiens
FPAYQWIDG

SEQ ID NO: 93660 - protein, 9 aa, Homo Sapiens
FLCMLGAID

SEQ ID NO: 93661 - protein, 9 aa, Homo Sapiens
ESEAEAQVP

SEQ ID NO: 93662 - protein, 9 aa, Homo Sapiens
GGAEESAKE

SEQ ID NO: 93663 - protein, 9 aa, Homo Sapiens
AHVGLRSPA

SEQ ID NO: 93664 - protein, 9 aa, Homo Sapiens
SKSRSQFSS

SEQ ID NO: 93665 - protein, 9 aa, Homo Sapiens
NDMYEDYKY

SEQ ID NO: 93666 - protein, 9 aa, Homo Sapiens
LIKNGGRKV

SEQ ID NO: 93667 - protein, 9 aa, Homo Sapiens
YEDYKYTYW

SEQ ID NO: 93668 - protein, 9 aa, Homo Sapiens
RALNFGLVR

SEQ ID NO: 93669 - protein, 9 aa, Homo Sapiens
KKKIPESEA

SEQ ID NO: 93670 - protein, 9 aa, Homo Sapiens
SFPAPSLVT

SEQ ID NO: 93671 - protein, 9 aa, Homo Sapiens
PESEAEAQV

SEQ ID NO: 93672 - protein, 9 aa, Homo Sapiens
LHPHRLKAP

SEQ ID NO: 93673 - protein, 9 aa, Homo Sapiens
MYLFLCMLG

SEQ ID NO: 93674 - protein, 9 aa, Homo Sapiens
AYEELLDNQ

SEQ ID NO: 93675 - protein, 9 aa, Homo Sapiens
SFKTEVNYD

SEQ ID NO: 93676 - protein, 9 aa, Homo Sapiens
IQNAFDDIA

SEQ ID NO: 93677 - protein, 9 aa, Homo Sapiens
KSRSQFSSR

SEQ ID NO: 93678 - protein, 9 aa, Homo Sapiens
HPHRLKAPS

SEQ ID NO: 93679 - protein, 9 aa, Homo Sapiens
MLGAIDLAL

SEQ ID NO: 93680 - protein, 9 aa, Homo Sapiens
PGGAEESAK

SEQ ID NO: 93681 - protein, 9 aa, Homo Sapiens
VTRMEGGAP

SEQ ID NO: 93682 - protein, 9 aa, Homo Sapiens
HFGQQCKLA

SEQ ID NO: 93683 - protein, 9 aa, Homo Sapiens
ERTWEESLL

SEQ ID NO: 93684 - protein, 9 aa, Homo Sapiens
RLKAPSLPR

SEQ ID NO: 93685 - protein, 9 aa, Homo Sapiens
DPDGRDHVR

SEQ ID NO: 93686 - protein, 9 aa, Homo Sapiens
SEGRIDNMK

SEQ ID NO: 93687 - protein, 9 aa, Homo Sapiens
RPTSAVRER

SEQ ID NO: 93688 - protein, 9 aa, Homo Sapiens
YYIGKERTW

SEQ ID NO: 93689 - protein, 9 aa, Homo Sapiens
VVIQAKNMG

SEQ ID NO: 93690 - protein, 9 aa, Homo Sapiens
IKLLGACTQ

SEQ ID NO: 93691 - protein, 9 aa, Homo Sapiens
FPSFPAPSL

SEQ ID NO: 93692 - protein, 9 aa, Homo Sapiens
SLRAKCEGY

SEQ ID NO: 93693 - protein, 9 aa, Homo Sapiens
LHSSVLHMD

SEQ ID NO: 93694 - protein, 9 aa, Homo Sapiens
LWTTPPLQH

SEQ ID NO: 93695 - protein, 9 aa, Homo Sapiens
DLRHLQCSH

SEQ ID NO: 93696 - protein, 9 aa, Homo Sapiens
PLLKEFALI

SEQ ID NO: 93697 - protein, 9 aa, Homo Sapiens
ALTGHRNSA

SEQ ID NO: 93698 - protein, 9 aa, Homo Sapiens
TDGPGLKRT

SEQ ID NO: 93699 - protein, 9 aa, Homo Sapiens
RRSSVISQL

SEQ ID NO: 93700 - protein, 9 aa, Homo Sapiens
HQQQQQEPW

SEQ ID NO: 93701 - protein, 9 aa, Homo Sapiens
PKPTVKWMV

SEQ ID NO: 93702 - protein, 9 aa, Homo Sapiens
AMPEPLRVA

SEQ ID NO: 93703 - protein, 9 aa, Homo Sapiens
KGPKQLKEL

SEQ ID NO: 93704 - protein, 9 aa, Homo Sapiens
ESAENPRPV

SEQ ID NO: 93705 - protein, 9 aa, Homo Sapiens
DGPGLKRTA

SEQ ID NO: 93706 - protein, 9 aa, Homo Sapiens
KCEGYALFV

SEQ ID NO: 93707 - protein, 9 aa, Homo Sapiens
ANLGSLEPS

SEQ ID NO: 93708 - protein, 9 aa, Homo Sapiens
DGPHSDYRG

SEQ ID NO: 93709 - protein, 9 aa, Homo Sapiens
TSVSSKPNS

SEQ ID NO: 93710 - protein, 9 aa, Homo Sapiens
SEDEDSDNE

SEQ ID NO: 93711 - protein, 9 aa, Homo Sapiens
SAENPRPVG

SEQ ID NO: 93712 - protein, 9 aa, Homo Sapiens
ADRSFNDLM

SEQ ID NO: 93713 - protein, 9 aa, Homo Sapiens
YDVIMHPMD

SEQ ID NO: 93714 - protein, 9 aa, Homo Sapiens
QDLSSELQV

SEQ ID NO: 93715 - protein, 9 aa, Homo Sapiens
KITLIIKWL

SEQ ID NO: 93716 - protein, 9 aa, Homo Sapiens
TGHRNSAPV

SEQ ID NO: 93717 - protein, 9 aa, Homo Sapiens
AHRTCYHTI

SEQ ID NO: 93718 - protein, 9 aa, Homo Sapiens
SLMITRARK

SEQ ID NO: 93719 - protein, 9 aa, Homo Sapiens
CTSLCLHFL

SEQ ID NO: 93720 - protein, 9 aa, Homo Sapiens
LEMELKNLA

SEQ ID NO: 93721 - protein, 9 aa, Homo Sapiens
EGGPAGGAV

SEQ ID NO: 93722 - protein, 9 aa, Homo Sapiens
DAMPEPLRV

SEQ ID NO: 93723 - protein, 9 aa, Homo Sapiens
KEFALILLQ

SEQ ID NO: 93724 - protein, 9 aa, Homo Sapiens
RVLNGLHNE

SEQ ID NO: 93725 - protein, 9 aa, Homo Sapiens
LSQMQNHVS

SEQ ID NO: 93726 - protein, 9 aa, Homo Sapiens
YISALRWQL

SEQ ID NO: 93727 - protein, 9 aa, Homo Sapiens
LLPPSPSPS

SEQ ID NO: 93728 - protein, 9 aa, Homo Sapiens
VPLGGRSGR

SEQ ID NO: 93729 - protein, 9 aa, Homo Sapiens
NKSLSVLVS

SEQ ID NO: 93730 - protein, 9 aa, Homo Sapiens
FGVIYYDTN

SEQ ID NO: 93731 - protein, 9 aa, Homo Sapiens
RRRSSVISQ

SEQ ID NO: 93732 - protein, 9 aa, Homo Sapiens
VLTHVQGGA

SEQ ID NO: 93733 - protein, 9 aa, Homo Sapiens
LTLKDNLNG

SEQ ID NO: 93734 - protein, 9 aa, Homo Sapiens
SPAHPASTA

SEQ ID NO: 93735 - protein, 9 aa, Homo Sapiens
QTPASLMIT

SEQ ID NO: 93736 - protein, 9 aa, Homo Sapiens
YGTLKQHKE

SEQ ID NO: 93737 - protein, 9 aa, Homo Sapiens
VDGVYAASG

SEQ ID NO: 93738 - protein, 9 aa, Homo Sapiens
CCDGFVLTH

SEQ ID NO: 93739 - protein, 9 aa, Homo Sapiens
FDSRNLAHV

SEQ ID NO: 93740 - protein, 9 aa, Homo Sapiens
EGSYGALDT

SEQ ID NO: 93741 - protein, 9 aa, Homo Sapiens
DSRMAHAMI

SEQ ID NO: 93742 - protein, 9 aa, Homo Sapiens
LPTSQTCLF

SEQ ID NO: 93743 - protein, 9 aa, Homo Sapiens
SKPFFWNLM

SEQ ID NO: 93744 - protein, 9 aa, Homo Sapiens
SRNLAHVEK

SEQ ID NO: 93745 - protein, 9 aa, Homo Sapiens
EEEYGTLKQ

SEQ ID NO: 93746 - protein, 9 aa, Homo Sapiens
NEDKDRGRC

SEQ ID NO: 93747 - protein, 9 aa, Homo Sapiens
DILANLGSL

SEQ ID NO: 93748 - protein, 9 aa, Homo Sapiens
AKCEGYALF

SEQ ID NO: 93749 - protein, 9 aa, Homo Sapiens
MTSDSLAPR

SEQ ID NO: 93750 - protein, 9 aa, Homo Sapiens
TPDSRMAHA

SEQ ID NO: 93751 - protein, 9 aa, Homo Sapiens
PEPHLALQP

SEQ ID NO: 93752 - protein, 9 aa, Homo Sapiens
SLPTSQTCL

SEQ ID NO: 93753 - protein, 9 aa, Homo Sapiens
VLVSPEAIQ

SEQ ID NO: 93754 - protein, 9 aa, Homo Sapiens
ACWSLGYAY

SEQ ID NO: 93755 - protein, 9 aa, Homo Sapiens
CLFQLRLPP

SEQ ID NO: 93756 - protein, 9 aa, Homo Sapiens
WMNDLAKGP

SEQ ID NO: 93757 - protein, 9 aa, Homo Sapiens
ACPQTSKVA

SEQ ID NO: 93758 - protein, 9 aa, Homo Sapiens
KDYLLEMEL

SEQ ID NO: 93759 - protein, 9 aa, Homo Sapiens
EAKGLSYES

SEQ ID NO: 93760 - protein, 9 aa, Homo Sapiens
KWMVNGEPL

SEQ ID NO: 93761 - protein, 9 aa, Homo Sapiens
VAGVEAANQ

SEQ ID NO: 93762 - protein, 9 aa, Homo Sapiens
FADHIVFTA

SEQ ID NO: 93763 - protein, 9 aa, Homo Sapiens
GLSYESAEN

SEQ ID NO: 93764 - protein, 9 aa, Homo Sapiens
NCTSVSSKP

SEQ ID NO: 93765 - protein, 9 aa, Homo Sapiens
FFWNLMFFI

SEQ ID NO: 93766 - protein, 9 aa, Homo Sapiens
PRNTAFQKQ

SEQ ID NO: 93767 - protein, 9 aa, Homo Sapiens
VFNYSGILS

SEQ ID NO: 93768 - protein, 9 aa, Homo Sapiens
DHYVILQLS

SEQ ID NO: 93769 - protein, 9 aa, Homo Sapiens
DAASMLDNG

SEQ ID NO: 93770 - protein, 9 aa, Homo Sapiens
DEVSSLDTF

SEQ ID NO: 93771 - protein, 9 aa, Homo Sapiens
AQTMKGLEK

SEQ ID NO: 93772 - protein, 9 aa, Homo Sapiens
GLIPRNTAF

SEQ ID NO: 93773 - protein, 9 aa, Homo Sapiens
ELKNLAQME

SEQ ID NO: 93774 - protein, 9 aa, Homo Sapiens
MICQESSGS

SEQ ID NO: 93775 - protein, 9 aa, Homo Sapiens
GSPRTGQVF

SEQ ID NO: 93776 - protein, 9 aa, Homo Sapiens
PCSPAHPAS

SEQ ID NO: 93777 - protein, 9 aa, Homo Sapiens
EEEKQINEK

SEQ ID NO: 93778 - protein, 9 aa, Homo Sapiens
DSRNLAHVE

SEQ ID NO: 93779 - protein, 9 aa, Homo Sapiens
AAAIAAAVA

SEQ ID NO: 93780 - protein, 9 aa, Homo Sapiens
IAAAVAAAA

SEQ ID NO: 93781 - protein, 9 aa, Homo Sapiens
ALAVAAIPK

SEQ ID NO: 93782 - protein, 9 aa, Homo Sapiens
ILANLGSLE

SEQ ID NO: 93783 - protein, 9 aa, Homo Sapiens
MHPMDFQTV

SEQ ID NO: 93784 - protein, 9 aa, Homo Sapiens
DYYDVIMHP

SEQ ID NO: 93785 - protein, 9 aa, Homo Sapiens
LSTPPLLPP

SEQ ID NO: 93786 - protein, 9 aa, Homo Sapiens
LEDYPLIIF

SEQ ID NO: 93787 - protein, 9 aa, Homo Sapiens
QSYELVTHE

SEQ ID NO: 93788 - protein, 9 aa, Homo Sapiens
QTMKGLEKA

SEQ ID NO: 93789 - protein, 9 aa, Homo Sapiens
VISQLHDVT

SEQ ID NO: 93790 - protein, 9 aa, Homo Sapiens
SKVAGLSRG

SEQ ID NO: 93791 - protein, 9 aa, Homo Sapiens
PLIIFFMVM

SEQ ID NO: 93792 - protein, 9 aa, Homo Sapiens
DSETMKKPH

SEQ ID NO: 93793 - protein, 9 aa, Homo Sapiens
SVISQLHDV

SEQ ID NO: 93794 - protein, 9 aa, Homo Sapiens
VTHERTHTG

SEQ ID NO: 93795 - protein, 9 aa, Homo Sapiens
EDYYDVIMH

SEQ ID NO: 93796 - protein, 9 aa, Homo Sapiens
EYGTLKQHK

SEQ ID NO: 93797 - protein, 9 aa, Homo Sapiens
WTTPPLQHG

SEQ ID NO: 93798 - protein, 9 aa, Homo Sapiens
AGDTQAGPG

SEQ ID NO: 93799 - protein, 9 aa, Homo Sapiens
TIEAQPLKV

SEQ ID NO: 93800 - protein, 9 aa, Homo Sapiens
ARKGREERR

SEQ ID NO: 93801 - protein, 9 aa, Homo Sapiens
LMITRARKG

SEQ ID NO: 93802 - protein, 9 aa, Homo Sapiens
VLQSTPAPI

SEQ ID NO: 93803 - protein, 9 aa, Homo Sapiens
LIPAQTYLY

SEQ ID NO: 93804 - protein, 9 aa, Homo Sapiens
LIPELNGKL

SEQ ID NO: 93805 - protein, 9 aa, Homo Sapiens
VGKLIPELN

SEQ ID NO: 93806 - protein, 9 aa, Homo Sapiens
SVLGTALHG

SEQ ID NO: 93807 - protein, 9 aa, Homo Sapiens
NDEVSSLDT

SEQ ID NO: 93808 - protein, 9 aa, Homo Sapiens
VDLNRITCR

SEQ ID NO: 93809 - protein, 9 aa, Homo Sapiens
AVGKLIPEL

SEQ ID NO: 93810 - protein, 9 aa, Homo Sapiens
CMAHRTCYH

SEQ ID NO: 93811 - protein, 9 aa, Homo Sapiens
IMTSDSLAP

SEQ ID NO: 93812 - protein, 9 aa, Homo Sapiens
RARKGREER

SEQ ID NO: 93813 - protein, 9 aa, Homo Sapiens
IVFTAQKPY

SEQ ID NO: 93814 - protein, 9 aa, Homo Sapiens
EFTCSVVRP

SEQ ID NO: 93815 - protein, 9 aa, Homo Sapiens
LIEKRQGSK

SEQ ID NO: 93816 - protein, 9 aa, Homo Sapiens
MLDNGLAGE

SEQ ID NO: 93817 - protein, 9 aa, Homo Sapiens
AEEEKQINE

SEQ ID NO: 93818 - protein, 9 aa, Homo Sapiens
IAQFSAQFS

SEQ ID NO: 93819 - protein, 9 aa, Homo Sapiens
EMELKNLAQ

SEQ ID NO: 93820 - protein, 9 aa, Homo Sapiens
ADHAHADAP

SEQ ID NO: 93821 - protein, 9 aa, Homo Sapiens
DNEDKDRGR

SEQ ID NO: 93822 - protein, 9 aa, Homo Sapiens
YVEHQVDDV

SEQ ID NO: 93823 - protein, 9 aa, Homo Sapiens
TPPLLPPSP

SEQ ID NO: 93824 - protein, 9 aa, Homo Sapiens
AENAPTNIV

SEQ ID NO: 93825 - protein, 9 aa, Homo Sapiens
DLKEKRKQF

SEQ ID NO: 93826 - protein, 9 aa, Homo Sapiens
AVAAIPKGL

SEQ ID NO: 93827 - protein, 9 aa, Homo Sapiens
AIFAFAPCG

SEQ ID NO: 93828 - protein, 9 aa, Homo Sapiens
DTFLDLIRN

SEQ ID NO: 93829 - protein, 9 aa, Homo Sapiens
ETMKKPHTT

SEQ ID NO: 93830 - protein, 9 aa, Homo Sapiens
AACPQTSKV

SEQ ID NO: 93831 - protein, 9 aa, Homo Sapiens
CPQTSKVAG

SEQ ID NO: 93832 - protein, 9 aa, Homo Sapiens
NNNGSWTPY

SEQ ID NO: 93833 - protein, 9 aa, Homo Sapiens
TALHGDVCT

SEQ ID NO: 93834 - protein, 9 aa, Homo Sapiens
GSKTVFNKF

SEQ ID NO: 93835 - protein, 9 aa, Homo Sapiens
KDPTHITSP

SEQ ID NO: 93836 - protein, 9 aa, Homo Sapiens
ADHYVILQL

SEQ ID NO: 93837 - protein, 9 aa, Homo Sapiens
GIIRHAENA

SEQ ID NO: 93838 - protein, 9 aa, Homo Sapiens
EEKQINEKQ

SEQ ID NO: 93839 - protein, 9 aa, Homo Sapiens
DVAGVEAAN

SEQ ID NO: 93840 - protein, 9 aa, Homo Sapiens
ELSQMQNHV

SEQ ID NO: 93841 - protein, 9 aa, Homo Sapiens
FLQPSVKII

SEQ ID NO: 93842 - protein, 9 aa, Homo Sapiens
CWSLGYAYV

SEQ ID NO: 93843 - protein, 9 aa, Homo Sapiens
TVSVHARSL

SEQ ID NO: 93844 - protein, 9 aa, Homo Sapiens
HADHAHADA

SEQ ID NO: 93845 - protein, 9 aa, Homo Sapiens
ETCLWAKTV

SEQ ID NO: 93846 - protein, 9 aa, Homo Sapiens
LVSPEAIQI

SEQ ID NO: 93847 - protein, 9 aa, Homo Sapiens
GRRVLNGLH

SEQ ID NO: 93848 - protein, 9 aa, Homo Sapiens
PAIQPVLWT

SEQ ID NO: 93849 - protein, 9 aa, Homo Sapiens
SRFDSRNLA

SEQ ID NO: 93850 - protein, 9 aa, Homo Sapiens
ILLLDEAMS

SEQ ID NO: 93851 - protein, 9 aa, Homo Sapiens
GYVQDLSSE

SEQ ID NO: 93852 - protein, 9 aa, Homo Sapiens
SLKSKPFFW

SEQ ID NO: 93853 - protein, 9 aa, Homo Sapiens
VLGTALHGD

SEQ ID NO: 93854 - protein, 9 aa, Homo Sapiens
QDGVLHSSV

SEQ ID NO: 93855 - protein, 9 aa, Homo Sapiens
MHTGEKPYN

SEQ ID NO: 93856 - protein, 9 aa, Homo Sapiens
ALSRHVLPE

SEQ ID NO: 93857 - protein, 9 aa, Homo Sapiens
QLWWCGGGQ

SEQ ID NO: 93858 - protein, 9 aa, Homo Sapiens
ADAPAIQPV

SEQ ID NO: 93859 - protein, 9 aa, Homo Sapiens
QCSHDDTDM

SEQ ID NO: 93860 - protein, 9 aa, Homo Sapiens
RRQEERLCE

SEQ ID NO: 93861 - protein, 9 aa, Homo Sapiens
GGTVSVHAR

SEQ ID NO: 93862 - protein, 9 aa, Homo Sapiens
GYISALRWQ

SEQ ID NO: 93863 - protein, 9 aa, Homo Sapiens
ESSVRDPAH

SEQ ID NO: 93864 - protein, 9 aa, Homo Sapiens
VISQLHDIR

SEQ ID NO: 93865 - protein, 9 aa, Homo Sapiens
SYEEDRASE

SEQ ID NO: 93866 - protein, 9 aa, Homo Sapiens
VLCTRIYEK

SEQ ID NO: 93867 - protein, 9 aa, Homo Sapiens
DFGMSREEV

SEQ ID NO: 93868 - protein, 9 aa, Homo Sapiens
TQFCDFDSL

SEQ ID NO: 93869 - protein, 9 aa, Homo Sapiens
GLLIPAQTY

SEQ ID NO: 93870 - protein, 9 aa, Homo Sapiens
RQDSETMKK

SEQ ID NO: 93871 - protein, 9 aa, Homo Sapiens
KLIPELNGK

SEQ ID NO: 93872 - protein, 9 aa, Homo Sapiens
VFAIFAFAP

SEQ ID NO: 93873 - protein, 9 aa, Homo Sapiens
HTILQLAGY

SEQ ID NO: 93874 - protein, 9 aa, Homo Sapiens
IQPVLWTTP

SEQ ID NO: 93875 - protein, 9 aa, Homo Sapiens
ASTAEGLSL

SEQ ID NO: 93876 - protein, 9 aa, Homo Sapiens
LQHKVFILF

SEQ ID NO: 93877 - protein, 9 aa, Homo Sapiens
LPLSLYLFS

SEQ ID NO: 93878 - protein, 9 aa, Homo Sapiens
FISRLNVFP

SEQ ID NO: 93879 - protein, 9 aa, Homo Sapiens
FAPCGSYSG

SEQ ID NO: 93880 - protein, 9 aa, Homo Sapiens
TFGFTEYQY

SEQ ID NO: 93881 - protein, 9 aa, Homo Sapiens
TLIIKWLQE

SEQ ID NO: 93882 - protein, 9 aa, Homo Sapiens
LQVEAVRLG

SEQ ID NO: 93883 - protein, 9 aa, Homo Sapiens
KEKDPPPPL

SEQ ID NO: 93884 - protein, 9 aa, Homo Sapiens
GHRNSAPVS

SEQ ID NO: 93885 - protein, 9 aa, Homo Sapiens
SIMTSDSLA

SEQ ID NO: 93886 - protein, 9 aa, Homo Sapiens
DGTFLQPSV

SEQ ID NO: 93887 - protein, 9 aa, Homo Sapiens
RALTLKDNL

SEQ ID NO: 93888 - protein, 9 aa, Homo Sapiens
NPAALSRHV

SEQ ID NO: 93889 - protein, 9 aa, Homo Sapiens
EEEDNHSYE

SEQ ID NO: 93890 - protein, 9 aa, Homo Sapiens
DPCKDPTHI

SEQ ID NO: 93891 - protein, 9 aa, Homo Sapiens
NSSSNCTSV

SEQ ID NO: 93892 - protein, 9 aa, Homo Sapiens
RRVLNGLHN

SEQ ID NO: 93893 - protein, 9 aa, Homo Sapiens
VTSNKEKDP

SEQ ID NO: 93894 - protein, 9 aa, Homo Sapiens
PAQTYLYIE

SEQ ID NO: 93895 - protein, 9 aa, Homo Sapiens
GRSGRKDRE

SEQ ID NO: 93896 - protein, 9 aa, Homo Sapiens
HHTVTQTVS

SEQ ID NO: 93897 - protein, 9 aa, Homo Sapiens
EERREVWVS

SEQ ID NO: 93898 - protein, 9 aa, Homo Sapiens
EKQINEKQE

SEQ ID NO: 93899 - protein, 9 aa, Homo Sapiens
EKDPPPPLT

SEQ ID NO: 93900 - protein, 9 aa, Homo Sapiens
AELSQMQNH

SEQ ID NO: 93901 - protein, 9 aa, Homo Sapiens
GVVWEWENN

SEQ ID NO: 93902 - protein, 9 aa, Homo Sapiens
DEAMSALDT

SEQ ID NO: 93903 - protein, 9 aa, Homo Sapiens
HSDYRGGEG

SEQ ID NO: 93904 - protein, 9 aa, Homo Sapiens
HQVDDVMMA

SEQ ID NO: 93905 - protein, 9 aa, Homo Sapiens
LPPSPSPSP

SEQ ID NO: 93906 - protein, 9 aa, Homo Sapiens
SSRFDSRNL

SEQ ID NO: 93907 - protein, 9 aa, Homo Sapiens
EAEEEKQIN

SEQ ID NO: 93908 - protein, 9 aa, Homo Sapiens
EFALILLQT

SEQ ID NO: 93909 - protein, 9 aa, Homo Sapiens
DRISDILAN

SEQ ID NO: 93910 - protein, 9 aa, Homo Sapiens
VVYEEEEEY

SEQ ID NO: 93911 - protein, 9 aa, Homo Sapiens
PLSLYLFSS

SEQ ID NO: 93912 - protein, 9 aa, Homo Sapiens
PHLALQPLQ

SEQ ID NO: 93913 - protein, 9 aa, Homo Sapiens
IKWLQEALS

SEQ ID NO: 93914 - protein, 9 aa, Homo Sapiens
KGLSYESAE

SEQ ID NO: 93915 - protein, 9 aa, Homo Sapiens
VNSPGQKHR

SEQ ID NO: 93916 - protein, 9 aa, Homo Sapiens
RHLQCSHDD

SEQ ID NO: 93917 - protein, 9 aa, Homo Sapiens
KPYNCNECG

SEQ ID NO: 93918 - protein, 9 aa, Homo Sapiens
ITLIIKWLQ

SEQ ID NO: 93919 - protein, 9 aa, Homo Sapiens
VAGLSRGLS

SEQ ID NO: 93920 - protein, 9 aa, Homo Sapiens
TCNVIEVDL

SEQ ID NO: 93921 - protein, 9 aa, Homo Sapiens
DGRRVLNGL

SEQ ID NO: 93922 - protein, 9 aa, Homo Sapiens
QVTIEAQPL

SEQ ID NO: 93923 - protein, 9 aa, Homo Sapiens
FGHFHKSKG

SEQ ID NO: 93924 - protein, 9 aa, Homo Sapiens
NSPGQKHRI

SEQ ID NO: 93925 - protein, 9 aa, Homo Sapiens
REGSYGALD

SEQ ID NO: 93926 - protein, 9 aa, Homo Sapiens
QTTVVEGSQ

SEQ ID NO: 93927 - protein, 9 aa, Homo Sapiens
KFGVIYYDT

SEQ ID NO: 93928 - protein, 9 aa, Homo Sapiens
YFKHTLQHK

SEQ ID NO: 93929 - protein, 9 aa, Homo Sapiens
IEAQPLKVS

SEQ ID NO: 93930 - protein, 9 aa, Homo Sapiens
LTGHRNSAP

SEQ ID NO: 93931 - protein, 9 aa, Homo Sapiens
QVPLGGRSG

SEQ ID NO: 93932 - protein, 9 aa, Homo Sapiens
ANFQLHCKS

SEQ ID NO: 93933 - protein, 9 aa, Homo Sapiens
GPISPPATC

SEQ ID NO: 93934 - protein, 9 aa, Homo Sapiens
EVQERIHRA

SEQ ID NO: 93935 - protein, 9 aa, Homo Sapiens
ADDTPLPER

SEQ ID NO: 93936 - protein, 9 aa, Homo Sapiens
PHADHAHAD

SEQ ID NO: 93937 - protein, 9 aa, Homo Sapiens
CKDPTHITS

SEQ ID NO: 93938 - protein, 9 aa, Homo Sapiens
ISDILANLG

SEQ ID NO: 93939 - protein, 9 aa, Homo Sapiens
YTWTKDGTF

SEQ ID NO: 93940 - protein, 9 aa, Homo Sapiens
GTALHGDVC

SEQ ID NO: 93941 - protein, 9 aa, Homo Sapiens
RQEERLCEQ

SEQ ID NO: 93942 - protein, 9 aa, Homo Sapiens
QTSKVAGLS

SEQ ID NO: 93943 - protein, 9 aa, Homo Sapiens
WQLDCVSGD

SEQ ID NO: 93944 - protein, 9 aa, Homo Sapiens
SGTFGFTEY

SEQ ID NO: 93945 - protein, 9 aa, Homo Sapiens
KMKGVLCTR

SEQ ID NO: 93946 - protein, 9 aa, Homo Sapiens
DTGISSKAL

SEQ ID NO: 93947 - protein, 9 aa, Homo Sapiens
DDVAGVEAA

SEQ ID NO: 93948 - protein, 9 aa, Homo Sapiens
QVEAVRLGI

SEQ ID NO: 93949 - protein, 9 aa, Homo Sapiens
TPLPERRNK

SEQ ID NO: 93950 - protein, 9 aa, Homo Sapiens
ALQPLQPHA

SEQ ID NO: 93951 - protein, 9 aa, Homo Sapiens
DHIVFTAQK

SEQ ID NO: 93952 - protein, 9 aa, Homo Sapiens
GARDGPHSD

SEQ ID NO: 93953 - protein, 9 aa, Homo Sapiens
WWCGGGQTP

SEQ ID NO: 93954 - protein, 9 aa, Homo Sapiens
HLALQPLQP

SEQ ID NO: 93955 - protein, 9 aa, Homo Sapiens
QMQNHVSDT

SEQ ID NO: 93956 - protein, 9 aa, Homo Sapiens
TGKRQDSET

SEQ ID NO: 93957 - protein, 9 aa, Homo Sapiens
SKTVFNKFS

SEQ ID NO: 93958 - protein, 9 aa, Homo Sapiens
VQDLSSELQ

SEQ ID NO: 93959 - protein, 9 aa, Homo Sapiens
LTLEDYPLI

SEQ ID NO: 93960 - protein, 9 aa, Homo Sapiens
GTFGFTEYQ

SEQ ID NO: 93961 - protein, 9 aa, Homo Sapiens
LKSKPFFWN

SEQ ID NO: 93962 - protein, 9 aa, Homo Sapiens
TTAQTMKGL

SEQ ID NO: 93963 - protein, 9 aa, Homo Sapiens
LNKHADRSF

SEQ ID NO: 93964 - protein, 9 aa, Homo Sapiens
YSGILSIHK

SEQ ID NO: 93965 - protein, 9 aa, Homo Sapiens
VSSKPNSPS

SEQ ID NO: 93966 - protein, 9 aa, Homo Sapiens
VLWTTPPLQ

SEQ ID NO: 93967 - protein, 9 aa, Homo Sapiens
PTSQTCLFQ

SEQ ID NO: 93968 - protein, 9 aa, Homo Sapiens
APAIQPVLW

SEQ ID NO: 93969 - protein, 9 aa, Homo Sapiens
SGILSIHKR

SEQ ID NO: 93970 - protein, 9 aa, Homo Sapiens
ASMLDNGLA

SEQ ID NO: 93971 - protein, 9 aa, Homo Sapiens
PASLMITRA

SEQ ID NO: 93972 - protein, 9 aa, Homo Sapiens
QFGEVCMGY

SEQ ID NO: 93973 - protein, 9 aa, Homo Sapiens
FCDFDSLSC

SEQ ID NO: 93974 - protein, 9 aa, Homo Sapiens
SKGRREGSY

SEQ ID NO: 93975 - protein, 9 aa, Homo Sapiens
PTVKWMVNG

SEQ ID NO: 93976 - protein, 9 aa, Homo Sapiens
GFVLTHVQG

SEQ ID NO: 93977 - protein, 9 aa, Homo Sapiens
VEMICQESS

SEQ ID NO: 93978 - protein, 9 aa, Homo Sapiens
FHKSKGHIW

SEQ ID NO: 93979 - protein, 9 aa, Homo Sapiens
TQTVSCQVQ

SEQ ID NO: 93980 - protein, 9 aa, Homo Sapiens
AVRRRSSVI

SEQ ID NO: 93981 - protein, 9 aa, Homo Sapiens
ISRLNVFPF

SEQ ID NO: 93982 - protein, 9 aa, Homo Sapiens
PDSRMAHAM

SEQ ID NO: 93983 - protein, 9 aa, Homo Sapiens
TVHYEGGTV

SEQ ID NO: 93984 - protein, 9 aa, Homo Sapiens
FGMSREEVD

SEQ ID NO: 93985 - protein, 9 aa, Homo Sapiens
IPAQTYLYI

SEQ ID NO: 93986 - protein, 9 aa, Homo Sapiens
HAHADAPAI

SEQ ID NO: 93987 - protein, 9 aa, Homo Sapiens
PLPERRNKS

SEQ ID NO: 93988 - protein, 9 aa, Homo Sapiens
LRHLQCSHD

SEQ ID NO: 93989 - protein, 9 aa, Homo Sapiens
SYESAENPR

SEQ ID NO: 93990 - protein, 9 aa, Homo Sapiens
VYEEEEEYG

SEQ ID NO: 93991 - protein, 9 aa, Homo Sapiens
HPCSPAHPA

SEQ ID NO: 93992 - protein, 9 aa, Homo Sapiens
KQINEKQEP

SEQ ID NO: 93993 - protein, 9 aa, Homo Sapiens
LCTRIYEKV

SEQ ID NO: 93994 - protein, 9 aa, Homo Sapiens
KPKVLYELM

SEQ ID NO: 93995 - protein, 9 aa, Homo Sapiens
KWLQEALSS

SEQ ID NO: 93996 - protein, 9 aa, Homo Sapiens
VKWMVNGEP

SEQ ID NO: 93997 - protein, 9 aa, Homo Sapiens
GVEAANQGF

SEQ ID NO: 93998 - protein, 9 aa, Homo Sapiens
KHTLQHKVF

SEQ ID NO: 93999 - protein, 9 aa, Homo Sapiens
KPTVKWMVN

SEQ ID NO: 94000 - protein, 9 aa, Homo Sapiens
EVSSLDTFL

SEQ ID NO: 94001 - protein, 9 aa, Homo Sapiens
IVAHALTGH

SEQ ID NO: 94002 - protein, 9 aa, Homo Sapiens
YEGGTVSVH

SEQ ID NO: 94003 - protein, 9 aa, Homo Sapiens
TKITLIIKW

SEQ ID NO: 94004 - protein, 9 aa, Homo Sapiens
VGIIRHAEN

SEQ ID NO: 94005 - protein, 9 aa, Homo Sapiens
LVTHERTHT

SEQ ID NO: 94006 - protein, 9 aa, Homo Sapiens
LSSELQVGV

SEQ ID NO: 94007 - protein, 9 aa, Homo Sapiens
GQTPASLMI

SEQ ID NO: 94008 - protein, 9 aa, Homo Sapiens
PGDAADQNF

SEQ ID NO: 94009 - protein, 9 aa, Homo Sapiens
GGAVYAPIA

SEQ ID NO: 94010 - protein, 9 aa, Homo Sapiens
QKHRIKQLL

SEQ ID NO: 94011 - protein, 9 aa, Homo Sapiens
QDDVAGVEA

SEQ ID NO: 94012 - protein, 9 aa, Homo Sapiens
QHKVFILFL

SEQ ID NO: 94013 - protein, 9 aa, Homo Sapiens
AKAVGKLIP

SEQ ID NO: 94014 - protein, 9 aa, Homo Sapiens
CNVIEVDLN

SEQ ID NO: 94015 - protein, 9 aa, Homo Sapiens
MPEPLRVAK

SEQ ID NO: 94016 - protein, 9 aa, Homo Sapiens
EGYISALRW

SEQ ID NO: 94017 - protein, 9 aa, Homo Sapiens
RNLAHVEKV

SEQ ID NO: 94018 - protein, 9 aa, Homo Sapiens
KDLKEKRKQ

SEQ ID NO: 94019 - protein, 9 aa, Homo Sapiens
DYPLIIFFM

SEQ ID NO: 94020 - protein, 9 aa, Homo Sapiens
SRMAHAMIM

SEQ ID NO: 94021 - protein, 9 aa, Homo Sapiens
HEQEYMEVQ

SEQ ID NO: 94022 - protein, 9 aa, Homo Sapiens
PAGGAVYAP

SEQ ID NO: 94023 - protein, 9 aa, Homo Sapiens
VVEGSQTDL

SEQ ID NO: 94024 - protein, 9 aa, Homo Sapiens
CDFDSLSCS

SEQ ID NO: 94025 - protein, 9 aa, Homo Sapiens
GQFGEVCMG

SEQ ID NO: 94026 - protein, 9 aa, Homo Sapiens
CSHDDTDMS

SEQ ID NO: 94027 - protein, 9 aa, Homo Sapiens
MSREEVDGV

SEQ ID NO: 94028 - protein, 9 aa, Homo Sapiens
KGREERREV

SEQ ID NO: 94029 - protein, 9 aa, Homo Sapiens
PLKVSEGKD

SEQ ID NO: 94030 - protein, 9 aa, Homo Sapiens
GVIYYDTNQ

SEQ ID NO: 94031 - protein, 9 aa, Homo Sapiens
GEDSSGTFG

SEQ ID NO: 94032 - protein, 9 aa, Homo Sapiens
PYNCNECGK

SEQ ID NO: 94033 - protein, 9 aa, Homo Sapiens
LQPLQPHAD

SEQ ID NO: 94034 - protein, 9 aa, Homo Sapiens
IESKPKVLY

SEQ ID NO: 94035 - protein, 9 aa, Homo Sapiens
LPMSPSSSR

SEQ ID NO: 94036 - protein, 9 aa, Homo Sapiens
LSYESAENP

SEQ ID NO: 94037 - protein, 9 aa, Homo Sapiens
VFKQTYSKF

SEQ ID NO: 94038 - protein, 9 aa, Homo Sapiens
STPPLLPPS

SEQ ID NO: 94039 - protein, 9 aa, Homo Sapiens
LDEAMSALD

SEQ ID NO: 94040 - protein, 9 aa, Homo Sapiens
RTGQVFKQT

SEQ ID NO: 94041 - protein, 9 aa, Homo Sapiens
WCHHTVTQT

SEQ ID NO: 94042 - protein, 9 aa, Homo Sapiens
AAIAAAVAA

SEQ ID NO: 94043 - protein, 9 aa, Homo Sapiens
LSQLQVEAV

SEQ ID NO: 94044 - protein, 9 aa, Homo Sapiens
LHCKSDKHM

SEQ ID NO: 94045 - protein, 9 aa, Homo Sapiens
SSRKDDRDL

SEQ ID NO: 94046 - protein, 9 aa, Homo Sapiens
NNGSWTPYD

SEQ ID NO: 94047 - protein, 9 aa, Homo Sapiens
SVLHMDQSH

SEQ ID NO: 94048 - protein, 9 aa, Homo Sapiens
VPYVNSPGQ

SEQ ID NO: 94049 - protein, 9 aa, Homo Sapiens
WTKDGTFLQ

SEQ ID NO: 94050 - protein, 9 aa, Homo Sapiens
DVIMHPMDF

SEQ ID NO: 94051 - protein, 9 aa, Homo Sapiens
LKVSEGKDV

SEQ ID NO: 94052 - protein, 9 aa, Homo Sapiens
FTCSVVRPL

SEQ ID NO: 94053 - protein, 9 aa, Homo Sapiens
AIPKGLPAV

SEQ ID NO: 94054 - protein, 9 aa, Homo Sapiens
AGCAGESSV

SEQ ID NO: 94055 - protein, 9 aa, Homo Sapiens
TQTTVVEGS

SEQ ID NO: 94056 - protein, 9 aa, Homo Sapiens
PISPPATCV

SEQ ID NO: 94057 - protein, 9 aa, Homo Sapiens
SRAKSIMTS

SEQ ID NO: 94058 - protein, 9 aa, Homo Sapiens
AHAMIMQDF

SEQ ID NO: 94059 - protein, 9 aa, Homo Sapiens
WEWENNNGS

SEQ ID NO: 94060 - protein, 9 aa, Homo Sapiens
TMKGLEKAL

SEQ ID NO: 94061 - protein, 9 aa, Homo Sapiens
KDPPPPLTR

SEQ ID NO: 94062 - protein, 9 aa, Homo Sapiens
GTGKVTVEY

SEQ ID NO: 94063 - protein, 9 aa, Homo Sapiens
LRWQLDCVS

SEQ ID NO: 94064 - protein, 9 aa, Homo Sapiens
PPLLPPSPS

SEQ ID NO: 94065 - protein, 9 aa, Homo Sapiens
APCGSYSGE

SEQ ID NO: 94066 - protein, 9 aa, Homo Sapiens
SLSVLVSPE

SEQ ID NO: 94067 - protein, 9 aa, Homo Sapiens
SVSSKPNSP

SEQ ID NO: 94068 - protein, 9 aa, Homo Sapiens
QFCDFDSLS

SEQ ID NO: 94069 - protein, 9 aa, Homo Sapiens
AGPGDAADQ

SEQ ID NO: 94070 - protein, 9 aa, Homo Sapiens
ARDGPHSDY

SEQ ID NO: 94071 - protein, 9 aa, Homo Sapiens
GLEKALSNI

SEQ ID NO: 94072 - protein, 9 aa, Homo Sapiens
EDEDSDNED

SEQ ID NO: 94073 - protein, 9 aa, Homo Sapiens
KRQDSETMK

SEQ ID NO: 94074 - protein, 9 aa, Homo Sapiens
GRACWSLGY

SEQ ID NO: 94075 - protein, 9 aa, Homo Sapiens
DTNQIITTA

SEQ ID NO: 94076 - protein, 9 aa, Homo Sapiens
IIFFMVMCI

SEQ ID NO: 94077 - protein, 9 aa, Homo Sapiens
NVIEVDLNR

SEQ ID NO: 94078 - protein, 9 aa, Homo Sapiens
KGRREGSYG

SEQ ID NO: 94079 - protein, 9 aa, Homo Sapiens
EEYGTLKQH

SEQ ID NO: 94080 - protein, 9 aa, Homo Sapiens
LQLWWCGGG

SEQ ID NO: 94081 - protein, 9 aa, Homo Sapiens
GYAYVSMGR

SEQ ID NO: 94082 - protein, 9 aa, Homo Sapiens
ALRWQLDCV

SEQ ID NO: 94083 - protein, 9 aa, Homo Sapiens
EEEEEYGTL

SEQ ID NO: 94084 - protein, 9 aa, Homo Sapiens
DVGTGKVTV

SEQ ID NO: 94085 - protein, 9 aa, Homo Sapiens
KGLEKALSN

SEQ ID NO: 94086 - protein, 9 aa, Homo Sapiens
RACWSLGYA

SEQ ID NO: 94087 - protein, 9 aa, Homo Sapiens
PVLWTTPPL

SEQ ID NO: 94088 - protein, 9 aa, Homo Sapiens
KTVTIRSGA

SEQ ID NO: 94089 - protein, 9 aa, Homo Sapiens
TLQRVSGIF

SEQ ID NO: 94090 - protein, 9 aa, Homo Sapiens
FGEVCMGYY

SEQ ID NO: 94091 - protein, 9 aa, Homo Sapiens
KVAGLSRGL

SEQ ID NO: 94092 - protein, 9 aa, Homo Sapiens
LAVAAIPKG

SEQ ID NO: 94093 - protein, 9 aa, Homo Sapiens
RAKCEGYAL

SEQ ID NO: 94094 - protein, 9 aa, Homo Sapiens
ENEDRNAER

SEQ ID NO: 94095 - protein, 9 aa, Homo Sapiens
IFFPTTELL

SEQ ID NO: 94096 - protein, 9 aa, Homo Sapiens
ESSGSPPIT

SEQ ID NO: 94097 - protein, 9 aa, Homo Sapiens
ESLRAKCEG

SEQ ID NO: 94098 - protein, 9 aa, Homo Sapiens
VSPEAIQID

SEQ ID NO: 94099 - protein, 9 aa, Homo Sapiens
ENNNGSWTP

SEQ ID NO: 94100 - protein, 9 aa, Homo Sapiens
CYHTILQLA

SEQ ID NO: 94101 - protein, 9 aa, Homo Sapiens
SYGALDTLS

SEQ ID NO: 94102 - protein, 9 aa, Homo Sapiens
FMFADHIVF

SEQ ID NO: 94103 - protein, 9 aa, Homo Sapiens
LQRVSGIFF

SEQ ID NO: 94104 - protein, 9 aa, Homo Sapiens
SKALGIMNS

SEQ ID NO: 94105 - protein, 9 aa, Homo Sapiens
PHSDYRGGE

SEQ ID NO: 94106 - protein, 9 aa, Homo Sapiens
LSRHVLPEP

SEQ ID NO: 94107 - protein, 9 aa, Homo Sapiens
DPTHITSPN

SEQ ID NO: 94108 - protein, 9 aa, Homo Sapiens
VRDPAHTIS

SEQ ID NO: 94109 - protein, 9 aa, Homo Sapiens
GREERREVW

SEQ ID NO: 94110 - protein, 9 aa, Homo Sapiens
LKKTVTIRS

SEQ ID NO: 94111 - protein, 9 aa, Homo Sapiens
ECKMKGVLC

SEQ ID NO: 94112 - protein, 9 aa, Homo Sapiens
AMSALDTES

SEQ ID NO: 94113 - protein, 9 aa, Homo Sapiens
ESKPKVLYE

SEQ ID NO: 94114 - protein, 9 aa, Homo Sapiens
GPAGGAVYA

SEQ ID NO: 94115 - protein, 9 aa, Homo Sapiens
FENEDRNAE

SEQ ID NO: 94116 - protein, 9 aa, Homo Sapiens
DEEKEEEEK

SEQ ID NO: 94117 - protein, 9 aa, Homo Sapiens
QTVSCQVQN

SEQ ID NO: 94118 - protein, 9 aa, Homo Sapiens
RLNVFPFWI

SEQ ID NO: 94119 - protein, 9 aa, Homo Sapiens
TPAPIAQFS

SEQ ID NO: 94120 - protein, 9 aa, Homo Sapiens
THLNKHADR

SEQ ID NO: 94121 - protein, 9 aa, Homo Sapiens
WENNNGSWT

SEQ ID NO: 94122 - protein, 9 aa, Homo Sapiens
PAALSRHVL

SEQ ID NO: 94123 - protein, 9 aa, Homo Sapiens
GAVYAPIAP

SEQ ID NO: 94124 - protein, 9 aa, Homo Sapiens
SSGTDAASM

SEQ ID NO: 94125 - protein, 9 aa, Homo Sapiens
LQSTPAPIA

SEQ ID NO: 94126 - protein, 9 aa, Homo Sapiens
RTCYHTILQ

SEQ ID NO: 94127 - protein, 9 aa, Homo Sapiens
HADAPAIQP

SEQ ID NO: 94128 - protein, 9 aa, Homo Sapiens
HKVFILFLT

SEQ ID NO: 94129 - protein, 9 aa, Homo Sapiens
TLQHKVFIL

SEQ ID NO: 94130 - protein, 9 aa, Homo Sapiens
NPKPTVKWM

SEQ ID NO: 94131 - protein, 9 aa, Homo Sapiens
APSACTSLC

SEQ ID NO: 94132 - protein, 9 aa, Homo Sapiens
KTVLRWPSR

SEQ ID NO: 94133 - protein, 9 aa, Homo Sapiens
ISQLHDIRV

SEQ ID NO: 94134 - protein, 9 aa, Homo Sapiens
NGNPKPTVK

SEQ ID NO: 94135 - protein, 9 aa, Homo Sapiens
LTHLNKHAD

SEQ ID NO: 94136 - protein, 9 aa, Homo Sapiens
NVFPFWILY

SEQ ID NO: 94137 - protein, 9 aa, Homo Sapiens
LIIFFMVMC

SEQ ID NO: 94138 - protein, 9 aa, Homo Sapiens
LGLIPRNTA

SEQ ID NO: 94139 - protein, 9 aa, Homo Sapiens
QVDDVMMAN

SEQ ID NO: 94140 - protein, 9 aa, Homo Sapiens
SSVTSNKEK

SEQ ID NO: 94141 - protein, 9 aa, Homo Sapiens
DVDQEHFSN

SEQ ID NO: 94142 - protein, 9 aa, Homo Sapiens
LHGDVCTHS

SEQ ID NO: 94143 - protein, 9 aa, Homo Sapiens
KALGIMNSF

SEQ ID NO: 94144 - protein, 9 aa, Homo Sapiens
MEAEEEKQI

SEQ ID NO: 94145 - protein, 9 aa, Homo Sapiens
GCAGESSVR

SEQ ID NO: 94146 - protein, 9 aa, Homo Sapiens
PLQHGHRHG

SEQ ID NO: 94147 - protein, 9 aa, Homo Sapiens
HYEGGTVSV

SEQ ID NO: 94148 - protein, 9 aa, Homo Sapiens
GESSVRDPA

SEQ ID NO: 94149 - protein, 9 aa, Homo Sapiens
EHQVDDVMM

SEQ ID NO: 94150 - protein, 9 aa, Homo Sapiens
QTCLFQLRL

SEQ ID NO: 94151 - protein, 9 aa, Homo Sapiens
QRVSGIFFP

SEQ ID NO: 94152 - protein, 9 aa, Homo Sapiens
RVEMICQES

SEQ ID NO: 94153 - protein, 9 aa, Homo Sapiens
HSVLGTALH

SEQ ID NO: 94154 - protein, 9 aa, Homo Sapiens
FSSRFDSRN

SEQ ID NO: 94155 - protein, 9 aa, Homo Sapiens
SNKEKDPPP

SEQ ID NO: 94156 - protein, 9 aa, Homo Sapiens
KPFFWNLMF

SEQ ID NO: 94157 - protein, 9 aa, Homo Sapiens
GVLCTRIYE

SEQ ID NO: 94158 - protein, 9 aa, Homo Sapiens
EVCMGYYKN

SEQ ID NO: 94159 - protein, 9 aa, Homo Sapiens
YPLLKEFAL

SEQ ID NO: 94160 - protein, 9 aa, Homo Sapiens
LTHVQGGAI

SEQ ID NO: 94161 - protein, 9 aa, Homo Sapiens
ADHIVFTAQ

SEQ ID NO: 94162 - protein, 9 aa, Homo Sapiens
FDGRRVLNG

SEQ ID NO: 94163 - protein, 9 aa, Homo Sapiens
FFPTTELLR

SEQ ID NO: 94164 - protein, 9 aa, Homo Sapiens
KGVLCTRIY

SEQ ID NO: 94165 - protein, 9 aa, Homo Sapiens
GWNCLRDEF

SEQ ID NO: 94166 - protein, 9 aa, Homo Sapiens
RSGASLRLM

SEQ ID NO: 94167 - protein, 9 aa, Homo Sapiens
TTVVEGSQT

SEQ ID NO: 94168 - protein, 9 aa, Homo Sapiens
YELVTHERT

SEQ ID NO: 94169 - protein, 9 aa, Homo Sapiens
NLGSLEPSA

SEQ ID NO: 94170 - protein, 9 aa, Homo Sapiens
LLKEFALIL

SEQ ID NO: 94171 - protein, 9 aa, Homo Sapiens
YYDVIMHPM

SEQ ID NO: 94172 - protein, 9 aa, Homo Sapiens
GHFHKSKGH

SEQ ID NO: 94173 - protein, 9 aa, Homo Sapiens
PKGLPAVIT

SEQ ID NO: 94174 - protein, 9 aa, Homo Sapiens
FAIFAFAPC

SEQ ID NO: 94175 - protein, 9 aa, Homo Sapiens
AHALTGHRN

SEQ ID NO: 94176 - protein, 9 aa, Homo Sapiens
DKDLKEKRK

SEQ ID NO: 94177 - protein, 9 aa, Homo Sapiens
LANLGSLEP

SEQ ID NO: 94178 - protein, 9 aa, Homo Sapiens
IFFISRLNV

SEQ ID NO: 94179 - protein, 9 aa, Homo Sapiens
RSGRKDRER

SEQ ID NO: 94180 - protein, 9 aa, Homo Sapiens
YVQDLSSEL

SEQ ID NO: 94181 - protein, 9 aa, Homo Sapiens
SREEVDGVY

SEQ ID NO: 94182 - protein, 9 aa, Homo Sapiens
GPKQLKELK

SEQ ID NO: 94183 - protein, 9 aa, Homo Sapiens
PPLQHGHRH

SEQ ID NO: 94184 - protein, 9 aa, Homo Sapiens
LGTALHGDV

SEQ ID NO: 94185 - protein, 9 aa, Homo Sapiens
KAVGKLIPE

SEQ ID NO: 94186 - protein, 9 aa, Homo Sapiens
TSLCLHFLL

SEQ ID NO: 94187 - protein, 9 aa, Homo Sapiens
CGGGQTPAS

SEQ ID NO: 94188 - protein, 9 aa, Homo Sapiens
TCYHTILQL

SEQ ID NO: 94189 - protein, 9 aa, Homo Sapiens
DRSFNDLMQ

SEQ ID NO: 94190 - protein, 9 aa, Homo Sapiens
GGQTPASLM

SEQ ID NO: 94191 - protein, 9 aa, Homo Sapiens
DGVLHSSVL

SEQ ID NO: 94192 - protein, 9 aa, Homo Sapiens
SRKDDRDLT

SEQ ID NO: 94193 - protein, 9 aa, Homo Sapiens
GVLHSSVLH

SEQ ID NO: 94194 - protein, 9 aa, Homo Sapiens
ADLLSEADH

SEQ ID NO: 94195 - protein, 9 aa, Homo Sapiens
EKRQGSKTV

SEQ ID NO: 94196 - protein, 9 aa, Homo Sapiens
VHYEGGTVS

SEQ ID NO: 94197 - protein, 9 aa, Homo Sapiens
SDILANLGS

SEQ ID NO: 94198 - protein, 9 aa, Homo Sapiens
TDAASMLDN

SEQ ID NO: 94199 - protein, 9 aa, Homo Sapiens
NDVDQEHFS

SEQ ID NO: 94200 - protein, 9 aa, Homo Sapiens
EAMSALDTE

SEQ ID NO: 94201 - protein, 9 aa, Homo Sapiens
EDNHSYEED

SEQ ID NO: 94202 - protein, 9 aa, Homo Sapiens
GPGDAADQN

SEQ ID NO: 94203 - protein, 9 aa, Homo Sapiens
KNERKHVKY

SEQ ID NO: 94204 - protein, 9 aa, Homo Sapiens
HVLPEPHLA

SEQ ID NO: 94205 - protein, 9 aa, Homo Sapiens
HWCHHTVTQ

SEQ ID NO: 94206 - protein, 9 aa, Homo Sapiens
HAMIMQDFV

SEQ ID NO: 94207 - protein, 9 aa, Homo Sapiens
GPGLKRTAS

SEQ ID NO: 94208 - protein, 9 aa, Homo Sapiens
VEAANQGFP

SEQ ID NO: 94209 - protein, 9 aa, Homo Sapiens
ALHGDVCTH

SEQ ID NO: 94210 - protein, 9 aa, Homo Sapiens
LYLFSSLLH

SEQ ID NO: 94211 - protein, 9 aa, Homo Sapiens
CSPAHPAST

SEQ ID NO: 94212 - protein, 9 aa, Homo Sapiens
SVADDTPLP

SEQ ID NO: 94213 - protein, 9 aa, Homo Sapiens
LFSSLLHFQ

SEQ ID NO: 94214 - protein, 9 aa, Homo Sapiens
YNETQFCDF

SEQ ID NO: 94215 - protein, 9 aa, Homo Sapiens
KGLPAVITT

SEQ ID NO: 94216 - protein, 9 aa, Homo Sapiens
SVISQLHDI

SEQ ID NO: 94217 - protein, 9 aa, Homo Sapiens
VYAPIAPGA

SEQ ID NO: 94218 - protein, 9 aa, Homo Sapiens
QESSGSPPI

SEQ ID NO: 94219 - protein, 9 aa, Homo Sapiens
TFLDLIRNL

SEQ ID NO: 94220 - protein, 9 aa, Homo Sapiens
CTSVSSKPN

SEQ ID NO: 94221 - protein, 9 aa, Homo Sapiens
NYSGILSIH

SEQ ID NO: 94222 - protein, 9 aa, Homo Sapiens
ASRAKSIMT

SEQ ID NO: 94223 - protein, 9 aa, Homo Sapiens
VAAIPKGLP

SEQ ID NO: 94224 - protein, 9 aa, Homo Sapiens
QGSKTVFNK

SEQ ID NO: 94225 - protein, 9 aa, Homo Sapiens
AIQPVLWTT

SEQ ID NO: 94226 - protein, 9 aa, Homo Sapiens
EMICQESSG

SEQ ID NO: 94227 - protein, 9 aa, Homo Sapiens
KRQGSKTVF

SEQ ID NO: 94228 - protein, 9 aa, Homo Sapiens
AHADAPAIQ

SEQ ID NO: 94229 - protein, 9 aa, Homo Sapiens
SSKALGIMN

SEQ ID NO: 94230 - protein, 9 aa, Homo Sapiens
TSNKEKDPP

SEQ ID NO: 94231 - protein, 9 aa, Homo Sapiens
IEKRQGSKT

SEQ ID NO: 94232 - protein, 9 aa, Homo Sapiens
TRARKGREE

SEQ ID NO: 94233 - protein, 9 aa, Homo Sapiens
DEDSDNEDK

SEQ ID NO: 94234 - protein, 9 aa, Homo Sapiens
AASMLDNGL

SEQ ID NO: 94235 - protein, 9 aa, Homo Sapiens
LGIMNSFVN

SEQ ID NO: 94236 - protein, 9 aa, Homo Sapiens
SSGTFGFTE

SEQ ID NO: 94237 - protein, 9 aa, Homo Sapiens
RTVHYEGGT

SEQ ID NO: 94238 - protein, 9 aa, Homo Sapiens
ELQVGVIKP

SEQ ID NO: 94239 - protein, 9 aa, Homo Sapiens
LGYAYVSMG

SEQ ID NO: 94240 - protein, 9 aa, Homo Sapiens
TIFFISRLN

SEQ ID NO: 94241 - protein, 9 aa, Homo Sapiens
LFQLRLPPY

SEQ ID NO: 94242 - protein, 9 aa, Homo Sapiens
VIMHPMDFQ

SEQ ID NO: 94243 - protein, 9 aa, Homo Sapiens
GKDYLLEME

SEQ ID NO: 94244 - protein, 9 aa, Homo Sapiens
DGSPRTGQV

SEQ ID NO: 94245 - protein, 9 aa, Homo Sapiens
YVNSPGQKH

SEQ ID NO: 94246 - protein, 9 aa, Homo Sapiens
SVLVSPEAI

SEQ ID NO: 94247 - protein, 9 aa, Homo Sapiens
SGIFFPTTE

SEQ ID NO: 94248 - protein, 9 aa, Homo Sapiens
QEYMEVQER

SEQ ID NO: 94249 - protein, 9 aa, Homo Sapiens
SETMKKPHT

SEQ ID NO: 94250 - protein, 9 aa, Homo Sapiens
TTYPLLKEF

SEQ ID NO: 94251 - protein, 9 aa, Homo Sapiens
WNCLRDEFT

SEQ ID NO: 94252 - protein, 9 aa, Homo Sapiens
LPEPHLALQ

SEQ ID NO: 94253 - protein, 9 aa, Homo Sapiens
CVLETSPLQ

SEQ ID NO: 94254 - protein, 9 aa, Homo Sapiens
QAGPGDAAD

SEQ ID NO: 94255 - protein, 9 aa, Homo Sapiens
RHVLPEPHL

SEQ ID NO: 94256 - protein, 9 aa, Homo Sapiens
KSKPFFWNL

SEQ ID NO: 94257 - protein, 9 aa, Homo Sapiens
WYNETQFCD

SEQ ID NO: 94258 - protein, 9 aa, Homo Sapiens
SNDVDQEHF

SEQ ID NO: 94259 - protein, 9 aa, Homo Sapiens
EQEYMEVQE

SEQ ID NO: 94260 - protein, 9 aa, Homo Sapiens
TSKVAGLSR

SEQ ID NO: 94261 - protein, 9 aa, Homo Sapiens
DRNAERCAR

SEQ ID NO: 94262 - protein, 9 aa, Homo Sapiens
SGASLRLMV

SEQ ID NO: 94263 - protein, 9 aa, Homo Sapiens
LSLYLFSSL

SEQ ID NO: 94264 - protein, 9 aa, Homo Sapiens
HITSPNDPC

SEQ ID NO: 94265 - protein, 9 aa, Homo Sapiens
VLPEPHLAL

SEQ ID NO: 94266 - protein, 9 aa, Homo Sapiens
RDEFTCSVV

SEQ ID NO: 94267 - protein, 9 aa, Homo Sapiens
NAPTNIVYK

SEQ ID NO: 94268 - protein, 9 aa, Homo Sapiens
PLQPHADHA

SEQ ID NO: 94269 - protein, 9 aa, Homo Sapiens
KDGTFLQPS

SEQ ID NO: 94270 - protein, 9 aa, Homo Sapiens
QETCLWAKT

SEQ ID NO: 94271 - protein, 9 aa, Homo Sapiens
PYVNSPGQK

SEQ ID NO: 94272 - protein, 9 aa, Homo Sapiens
GTVSVHARS

SEQ ID NO: 94273 - protein, 9 aa, Homo Sapiens
TPPLQHGHR

SEQ ID NO: 94274 - protein, 9 aa, Homo Sapiens
AAKAVGKLI

SEQ ID NO: 94275 - protein, 9 aa, Homo Sapiens
QASRAKSIM

SEQ ID NO: 94276 - protein, 9 aa, Homo Sapiens
VEAVRLGIL

SEQ ID NO: 94277 - protein, 9 aa, Homo Sapiens
WAKTVLRWP

SEQ ID NO: 94278 - protein, 9 aa, Homo Sapiens
TCLFQLRLP

SEQ ID NO: 94279 - protein, 9 aa, Homo Sapiens
HPASTAEGL

SEQ ID NO: 94280 - protein, 9 aa, Homo Sapiens
CHHTVTQTV

SEQ ID NO: 94281 - protein, 9 aa, Homo Sapiens
AGGAVYAPI

SEQ ID NO: 94282 - protein, 9 aa, Homo Sapiens
QNHVSDTSV

SEQ ID NO: 94283 - protein, 9 aa, Homo Sapiens
RTASQDFEY

SEQ ID NO: 94284 - protein, 9 aa, Homo Sapiens
AKGLSYESA

SEQ ID NO: 94285 - protein, 9 aa, Homo Sapiens
DTKITLIIK

SEQ ID NO: 94286 - protein, 9 aa, Homo Sapiens
AIAAAVAAA

SEQ ID NO: 94287 - protein, 9 aa, Homo Sapiens
KSDKHMQKY

SEQ ID NO: 94288 - protein, 9 aa, Homo Sapiens
LNGLHNELQ

SEQ ID NO: 94289 - protein, 9 aa, Homo Sapiens
GQKHRIKQL

SEQ ID NO: 94290 - protein, 9 aa, Homo Sapiens
AGVEAANQG

SEQ ID NO: 94291 - protein, 9 aa, Homo Sapiens
PLGGRSGRK

SEQ ID NO: 94292 - protein, 9 aa, Homo Sapiens
VIEVDLNRI

SEQ ID NO: 94293 - protein, 9 aa, Homo Sapiens
GKRQDSETM

SEQ ID NO: 94294 - protein, 9 aa, Homo Sapiens
SQTCLFQLR

SEQ ID NO: 94295 - protein, 9 aa, Homo Sapiens
ETQFCDFDS

SEQ ID NO: 94296 - protein, 9 aa, Homo Sapiens
EDYPLIIFF

SEQ ID NO: 94297 - protein, 9 aa, Homo Sapiens
HRNSAPVSV

SEQ ID NO: 94298 - protein, 9 aa, Homo Sapiens
DVMMANAAQ

SEQ ID NO: 94299 - protein, 9 aa, Homo Sapiens
IMHPMDFQT

SEQ ID NO: 94300 - protein, 9 aa, Homo Sapiens
NGLHNELQT

SEQ ID NO: 94301 - protein, 9 aa, Homo Sapiens
VLHMDQSHT

SEQ ID NO: 94302 - protein, 9 aa, Homo Sapiens
MKGVLCTRI

SEQ ID NO: 94303 - protein, 9 aa, Homo Sapiens
RKGREERRE

SEQ ID NO: 94304 - protein, 9 aa, Homo Sapiens
TNQIITTAV

SEQ ID NO: 94305 - protein, 9 aa, Homo Sapiens
AAIPKGLPA

SEQ ID NO: 94306 - protein, 9 aa, Homo Sapiens
CDGFVLTHV

SEQ ID NO: 94307 - protein, 9 aa, Homo Sapiens
YESAENPRP

SEQ ID NO: 94308 - protein, 9 aa, Homo Sapiens
SNCTSVSSK

SEQ ID NO: 94309 - protein, 9 aa, Homo Sapiens
EVDLNRITC

SEQ ID NO: 94310 - protein, 9 aa, Homo Sapiens
AEDYYDVIM

SEQ ID NO: 94311 - protein, 9 aa, Homo Sapiens
SSEDEDSDN

SEQ ID NO: 94312 - protein, 9 aa, Homo Sapiens
YAYVSMGRP

SEQ ID NO: 94313 - protein, 9 aa, Homo Sapiens
HDDTDMSCN

SEQ ID NO: 94314 - protein, 9 aa, Homo Sapiens
PIAQFSAQF

SEQ ID NO: 94315 - protein, 9 aa, Homo Sapiens
MAHAMIMQD

SEQ ID NO: 94316 - protein, 9 aa, Homo Sapiens
RDMEAEEEK

SEQ ID NO: 94317 - protein, 9 aa, Homo Sapiens
VMMANAAQK

SEQ ID NO: 94318 - protein, 9 aa, Homo Sapiens
LWWCGGGQT

SEQ ID NO: 94319 - protein, 9 aa, Homo Sapiens
VRRRSSVIS

SEQ ID NO: 94320 - protein, 9 aa, Homo Sapiens
LSVLVSPEA

SEQ ID NO: 94321 - protein, 9 aa, Homo Sapiens
SSVISQLHD

SEQ ID NO: 94322 - protein, 9 aa, Homo Sapiens
DDVMMANAA

SEQ ID NO: 94323 - protein, 9 aa, Homo Sapiens
ISALRWQLD

SEQ ID NO: 94324 - protein, 9 aa, Homo Sapiens
IIKWLQEAL

SEQ ID NO: 94325 - protein, 9 aa, Homo Sapiens
QEEEDNHSY

SEQ ID NO: 94326 - protein, 9 aa, Homo Sapiens
LIPRNTAFQ

SEQ ID NO: 94327 - protein, 9 aa, Homo Sapiens
MSALDTESE

SEQ ID NO: 94328 - protein, 9 aa, Homo Sapiens
LPERRNKSG

SEQ ID NO: 94329 - protein, 9 aa, Homo Sapiens
SDFADAMPE

SEQ ID NO: 94330 - protein, 9 aa, Homo Sapiens
SVTSNKEKD

SEQ ID NO: 94331 - protein, 9 aa, Homo Sapiens
VWEWENNNG

SEQ ID NO: 94332 - protein, 9 aa, Homo Sapiens
NLNGTFSYK

SEQ ID NO: 94333 - protein, 9 aa, Homo Sapiens
LLIPAQTYL

SEQ ID NO: 94334 - protein, 9 aa, Homo Sapiens
QLQVEAVRL

SEQ ID NO: 94335 - protein, 9 aa, Homo Sapiens
FQLHCKSDK

SEQ ID NO: 94336 - protein, 9 aa, Homo Sapiens
SLGYAYVSM

SEQ ID NO: 94337 - protein, 9 aa, Homo Sapiens
LLEMELKNL

SEQ ID NO: 94338 - protein, 9 aa, Homo Sapiens
HIVFTAQKP

SEQ ID NO: 94339 - protein, 9 aa, Homo Sapiens
DLHKNERKH

SEQ ID NO: 94340 - protein, 9 aa, Homo Sapiens
AHPASTAEG

SEQ ID NO: 94341 - protein, 9 aa, Homo Sapiens
KVFNYSGIL

SEQ ID NO: 94342 - protein, 9 aa, Homo Sapiens
AMIMQDFVA

SEQ ID NO: 94343 - protein, 9 aa, Homo Sapiens
GRREGSYGA

SEQ ID NO: 94344 - protein, 9 aa, Homo Sapiens
HADRSFNDL

SEQ ID NO: 94345 - protein, 9 aa, Homo Sapiens
QPVLWTTPP

SEQ ID NO: 94346 - protein, 9 aa, Homo Sapiens
ISPPATCVL

SEQ ID NO: 94347 - protein, 9 aa, Homo Sapiens
MGSSNDVDQ

SEQ ID NO: 94348 - protein, 9 aa, Homo Sapiens
STPAPIAQF

SEQ ID NO: 94349 - protein, 9 aa, Homo Sapiens
SDPCKDPTH

SEQ ID NO: 94350 - protein, 9 aa, Homo Sapiens
DLAKGPKQL

SEQ ID NO: 94351 - protein, 9 aa, Homo Sapiens
DAPAIQPVL

SEQ ID NO: 94352 - protein, 9 aa, Homo Sapiens
VQERIHRAI

SEQ ID NO: 94353 - protein, 9 aa, Homo Sapiens
STQTTVVEG

SEQ ID NO: 94354 - protein, 9 aa, Homo Sapiens
AECKMKGVL

SEQ ID NO: 94355 - protein, 9 aa, Homo Sapiens
ACTSLCLHF

SEQ ID NO: 94356 - protein, 9 aa, Homo Sapiens
PDLHKNERK

SEQ ID NO: 94357 - protein, 9 aa, Homo Sapiens
SSLDTFLDL

SEQ ID NO: 94358 - protein, 9 aa, Homo Sapiens
EEVDGVYAA

SEQ ID NO: 94359 - protein, 9 aa, Homo Sapiens
LKRTASQDF

SEQ ID NO: 94360 - protein, 9 aa, Homo Sapiens
SSSNCTSVS

SEQ ID NO: 94361 - protein, 9 aa, Homo Sapiens
YHTILQLAG

SEQ ID NO: 94362 - protein, 9 aa, Homo Sapiens
MAHRTCYHT

SEQ ID NO: 94363 - protein, 9 aa, Homo Sapiens
VLHSSVLHM

SEQ ID NO: 94364 - protein, 9 aa, Homo Sapiens
GILSIHKRI

SEQ ID NO: 94365 - protein, 9 aa, Homo Sapiens
HFHKSKGHI

SEQ ID NO: 94366 - protein, 9 aa, Homo Sapiens
GGGQTPASL

SEQ ID NO: 94367 - protein, 9 aa, Homo Sapiens
REEVDGVYA

SEQ ID NO: 94368 - protein, 9 aa, Homo Sapiens
LDTFLDLIR

SEQ ID NO: 94369 - protein, 9 aa, Homo Sapiens
YGALDTLSS

SEQ ID NO: 94370 - protein, 9 aa, Homo Sapiens
VLYELMPVI

SEQ ID NO: 94371 - protein, 9 aa, Homo Sapiens
ENAPTNIVY

SEQ ID NO: 94372 - protein, 9 aa, Homo Sapiens
TAQTMKGLE

SEQ ID NO: 94373 - protein, 9 aa, Homo Sapiens
FKHTLQHKV

SEQ ID NO: 94374 - protein, 9 aa, Homo Sapiens
VSSLDTFLD

SEQ ID NO: 94375 - protein, 9 aa, Homo Sapiens
SSNDVDQEH

SEQ ID NO: 94376 - protein, 9 aa, Homo Sapiens
PRVEMICQE

SEQ ID NO: 94377 - protein, 9 aa, Homo Sapiens
LLPLSLYLF

SEQ ID NO: 94378 - protein, 9 aa, Homo Sapiens
GNLGLIPRN

SEQ ID NO: 94379 - protein, 9 aa, Homo Sapiens
EWENNNGSW

SEQ ID NO: 94380 - protein, 9 aa, Homo Sapiens
TIRSGASLR

SEQ ID NO: 94381 - protein, 9 aa, Homo Sapiens
SSVRDPAHT

SEQ ID NO: 94382 - protein, 9 aa, Homo Sapiens
HAENAPTNI

SEQ ID NO: 94383 - protein, 9 aa, Homo Sapiens
SSVLHMDQS

SEQ ID NO: 94384 - protein, 9 aa, Homo Sapiens
SDYRGGEGP

SEQ ID NO: 94385 - protein, 9 aa, Homo Sapiens
GSGQFGEVC

SEQ ID NO: 94386 - protein, 9 aa, Homo Sapiens
KKTVTIRSG

SEQ ID NO: 94387 - protein, 9 aa, Homo Sapiens
GTDAASMLD

SEQ ID NO: 94388 - protein, 9 aa, Homo Sapiens
QLHCKSDKH

SEQ ID NO: 94389 - protein, 9 aa, Homo Sapiens
PGQKHRIKQ

SEQ ID NO: 94390 - protein, 9 aa, Homo Sapiens
GDAADQNFD

SEQ ID NO: 94391 - protein, 9 aa, Homo Sapiens
NKEKDPPPP

SEQ ID NO: 94392 - protein, 9 aa, Homo Sapiens
ILSIHKRIH

SEQ ID NO: 94393 - protein, 9 aa, Homo Sapiens
MNDLAKGPK

SEQ ID NO: 94394 - protein, 9 aa, Homo Sapiens
TKDGTFLQP

SEQ ID NO: 94395 - protein, 9 aa, Homo Sapiens
EAQPLKVSE

SEQ ID NO: 94396 - protein, 9 aa, Homo Sapiens
TGISSKALG

SEQ ID NO: 94397 - protein, 9 aa, Homo Sapiens
TCVLETSPL

SEQ ID NO: 94398 - protein, 9 aa, Homo Sapiens
SVRDPAHTI

SEQ ID NO: 94399 - protein, 9 aa, Homo Sapiens
IFDGRRVLN

SEQ ID NO: 94400 - protein, 9 aa, Homo Sapiens
RMAHAMIMQ

SEQ ID NO: 94401 - protein, 9 aa, Homo Sapiens
LRAKCEGYA

SEQ ID NO: 94402 - protein, 9 aa, Homo Sapiens
KESLRAKCE

SEQ ID NO: 94403 - protein, 9 aa, Homo Sapiens
SHDDTDMSC

SEQ ID NO: 94404 - protein, 9 aa, Homo Sapiens
AFFMFADHI

SEQ ID NO: 94405 - protein, 9 aa, Homo Sapiens
TQAGPGDAA

SEQ ID NO: 94406 - protein, 9 aa, Homo Sapiens
HKSKGHIWK

SEQ ID NO: 94407 - protein, 9 aa, Homo Sapiens
QPLKVSEGK

SEQ ID NO: 94408 - protein, 9 aa, Homo Sapiens
SPPATCVLE

SEQ ID NO: 94409 - protein, 9 aa, Homo Sapiens
GGPAGGAVY

SEQ ID NO: 94410 - protein, 9 aa, Homo Sapiens
SSSRKDDRD

SEQ ID NO: 94411 - protein, 9 aa, Homo Sapiens
GGRSGRKDR

SEQ ID NO: 94412 - protein, 9 aa, Homo Sapiens
MRALTLKDN

SEQ ID NO: 94413 - protein, 9 aa, Homo Sapiens
RFDSRNLAH

SEQ ID NO: 94414 - protein, 9 aa, Homo Sapiens
VQETCLWAK

SEQ ID NO: 94415 - protein, 9 aa, Homo Sapiens
AGESSVRDP

SEQ ID NO: 94416 - protein, 9 aa, Homo Sapiens
HVQGGAIIC

SEQ ID NO: 94417 - protein, 9 aa, Homo Sapiens
HTVTQTVSC

SEQ ID NO: 94418 - protein, 9 aa, Homo Sapiens
YEEEEEYGT

SEQ ID NO: 94419 - protein, 9 aa, Homo Sapiens
SLCLHFLLL

SEQ ID NO: 94420 - protein, 9 aa, Homo Sapiens
CNIMGSSND

SEQ ID NO: 94421 - protein, 9 aa, Homo Sapiens
REERREVWV

SEQ ID NO: 94422 - protein, 9 aa, Homo Sapiens
GKLIPELNG

SEQ ID NO: 94423 - protein, 9 aa, Homo Sapiens
NETCNVIEV

SEQ ID NO: 94424 - protein, 9 aa, Homo Sapiens
VAHALTGHR

SEQ ID NO: 94425 - protein, 9 aa, Homo Sapiens
VDDVMMANA

SEQ ID NO: 94426 - protein, 9 aa, Homo Sapiens
HGDVCTHSV

SEQ ID NO: 94427 - protein, 9 aa, Homo Sapiens
KHADRSFND

SEQ ID NO: 94428 - protein, 9 aa, Homo Sapiens
LQCSHDDTD

SEQ ID NO: 94429 - protein, 9 aa, Homo Sapiens
YLLEMELKN

SEQ ID NO: 94430 - protein, 9 aa, Homo Sapiens
PFFWNLMFF

SEQ ID NO: 94431 - protein, 9 aa, Homo Sapiens
CQESSGSPP

SEQ ID NO: 94432 - protein, 9 aa, Homo Sapiens
PGLKRTASQ

SEQ ID NO: 94433 - protein, 9 aa, Homo Sapiens
GMSREEVDG

SEQ ID NO: 94434 - protein, 9 aa, Homo Sapiens
IPRNTAFQK

SEQ ID NO: 94435 - protein, 9 aa, Homo Sapiens
HYVILQLST

SEQ ID NO: 94436 - protein, 9 aa, Homo Sapiens
RKHVKYCQY

SEQ ID NO: 94437 - protein, 9 aa, Homo Sapiens
MELKNLAQM

SEQ ID NO: 94438 - protein, 9 aa, Homo Sapiens
VTIEAQPLK

SEQ ID NO: 94439 - protein, 9 aa, Homo Sapiens
QPLQPHADH

SEQ ID NO: 94440 - protein, 9 aa, Homo Sapiens
AAAAIAAAV

SEQ ID NO: 94441 - protein, 9 aa, Homo Sapiens
YDTNQIITT

SEQ ID NO: 94442 - protein, 9 aa, Homo Sapiens
GIFFPTTEL

SEQ ID NO: 94443 - protein, 9 aa, Homo Sapiens
DAELSQMQN

SEQ ID NO: 94444 - protein, 9 aa, Homo Sapiens
TCLWAKTVL

SEQ ID NO: 94445 - protein, 9 aa, Homo Sapiens
TGQVFKQTY

SEQ ID NO: 94446 - protein, 9 aa, Homo Sapiens
LSEADHYVI

SEQ ID NO: 94447 - protein, 9 aa, Homo Sapiens
AKGPKQLKE

SEQ ID NO: 94448 - protein, 9 aa, Homo Sapiens
AQPLKVSEG

SEQ ID NO: 94449 - protein, 9 aa, Homo Sapiens
RVSGIFFPT

SEQ ID NO: 94450 - protein, 9 aa, Homo Sapiens
PRTGQVFKQ

SEQ ID NO: 94451 - protein, 9 aa, Homo Sapiens
AALSRHVLP

SEQ ID NO: 94452 - protein, 9 aa, Homo Sapiens
RISDILANL

SEQ ID NO: 94453 - protein, 9 aa, Homo Sapiens
THITSPNDP

SEQ ID NO: 94454 - protein, 9 aa, Homo Sapiens
DFENEDRNA

SEQ ID NO: 94455 - protein, 9 aa, Homo Sapiens
VVWEWENNN

SEQ ID NO: 94456 - protein, 9 aa, Homo Sapiens
VADDTPLPE

SEQ ID NO: 94457 - protein, 9 aa, Homo Sapiens
DTPLPERRN

SEQ ID NO: 94458 - protein, 9 aa, Homo Sapiens
SDNEDKDRG

SEQ ID NO: 94459 - protein, 9 aa, Homo Sapiens
PSACTSLCL

SEQ ID NO: 94460 - protein, 9 aa, Homo Sapiens
LFSSRFDSR

SEQ ID NO: 94461 - protein, 9 aa, Homo Sapiens
PATCVLETS

SEQ ID NO: 94462 - protein, 9 aa, Homo Sapiens
VCMGYYKNN

SEQ ID NO: 94463 - protein, 9 aa, Homo Sapiens
VRLGILPVG

SEQ ID NO: 94464 - protein, 9 aa, Homo Sapiens
VGTGKVTVE

SEQ ID NO: 94465 - protein, 9 aa, Homo Sapiens
VEHQVDDVM

SEQ ID NO: 94466 - protein, 9 aa, Homo Sapiens
FFGLLIPAQ

SEQ ID NO: 94467 - protein, 9 aa, Homo Sapiens
ALSDFADAM

SEQ ID NO: 94468 - protein, 9 aa, Homo Sapiens
THVQGGAII

SEQ ID NO: 94469 - protein, 9 aa, Homo Sapiens
HLNKHADRS

SEQ ID NO: 94470 - protein, 9 aa, Homo Sapiens
SPRTGQVFK

SEQ ID NO: 94471 - protein, 9 aa, Homo Sapiens
QERIHRAIN

SEQ ID NO: 94472 - protein, 9 aa, Homo Sapiens
KDNLNGTFS

SEQ ID NO: 94473 - protein, 9 aa, Homo Sapiens
PSSSRKDDR

SEQ ID NO: 94474 - protein, 9 aa, Homo Sapiens
YSAPSACTS

SEQ ID NO: 94475 - protein, 9 aa, Homo Sapiens
LQPHADHAH

SEQ ID NO: 94476 - protein, 9 aa, Homo Sapiens
NLGLIPRNT

SEQ ID NO: 94477 - protein, 9 aa, Homo Sapiens
FAFAPCGSY

SEQ ID NO: 94478 - protein, 9 aa, Homo Sapiens
WCGGGQTPA

SEQ ID NO: 94479 - protein, 9 aa, Homo Sapiens
SDKHMQKYQ

SEQ ID NO: 94480 - protein, 9 aa, Homo Sapiens
EAVRLGILP

SEQ ID NO: 94481 - protein, 9 aa, Homo Sapiens
QTYLYIEFV

SEQ ID NO: 94482 - protein, 9 aa, Homo Sapiens
SEADHYVIL

SEQ ID NO: 94483 - protein, 9 aa, Homo Sapiens
TLEDYPLII

SEQ ID NO: 94484 - protein, 9 aa, Homo Sapiens
EEDNHSYEE

SEQ ID NO: 94485 - protein, 9 aa, Homo Sapiens
FFISRLNVF

SEQ ID NO: 94486 - protein, 9 aa, Homo Sapiens
HLQCSHDDT

SEQ ID NO: 94487 - protein, 9 aa, Homo Sapiens
MQNHVSDTS

SEQ ID NO: 94488 - protein, 9 aa, Homo Sapiens
KLIEKRQGS

SEQ ID NO: 94489 - protein, 9 aa, Homo Sapiens
GNPKPTVKW

SEQ ID NO: 94490 - protein, 9 aa, Homo Sapiens
QLHQQQQQE

SEQ ID NO: 94491 - protein, 9 aa, Homo Sapiens
GQVFKQTYS

SEQ ID NO: 94492 - protein, 9 aa, Homo Sapiens
ITRARKGRE

SEQ ID NO: 94493 - protein, 9 aa, Homo Sapiens
NRRQEERLC

SEQ ID NO: 94494 - protein, 9 aa, Homo Sapiens
EGYALFVFS

SEQ ID NO: 94495 - protein, 9 aa, Homo Sapiens
LNVFPFWIL

SEQ ID NO: 94496 - protein, 9 aa, Homo Sapiens
DTQAGPGDA

SEQ ID NO: 94497 - protein, 9 aa, Homo Sapiens
SYELVTHER

SEQ ID NO: 94498 - protein, 9 aa, Homo Sapiens
RREGSYGAL

SEQ ID NO: 94499 - protein, 9 aa, Homo Sapiens
ATCVLETSP

SEQ ID NO: 94500 - protein, 9 aa, Homo Sapiens
YYDTNQIIT

SEQ ID NO: 94501 - protein, 9 aa, Homo Sapiens
LAKGPKQLK

SEQ ID NO: 94502 - protein, 9 aa, Homo Sapiens
LWAKTVLRW

SEQ ID NO: 94503 - protein, 9 aa, Homo Sapiens
NETQFCDFD

SEQ ID NO: 94504 - protein, 9 aa, Homo Sapiens
ADKDLKEKR

SEQ ID NO: 94505 - protein, 9 aa, Homo Sapiens
WPDLHKNER

SEQ ID NO: 94506 - protein, 9 aa, Homo Sapiens
QELDFENED

SEQ ID NO: 94507 - protein, 9 aa, Homo Sapiens
EDSSGTFGF

SEQ ID NO: 94508 - protein, 9 aa, Homo Sapiens
KSIMTSDSL

SEQ ID NO: 94509 - protein, 9 aa, Homo Sapiens
DGFVLTHVQ

SEQ ID NO: 94510 - protein, 9 aa, Homo Sapiens
FVLTHVQGG

SEQ ID NO: 94511 - protein, 9 aa, Homo Sapiens
LHKNERKHV

SEQ ID NO: 94512 - protein, 9 aa, Homo Sapiens
LRDEFTCSV

SEQ ID NO: 94513 - protein, 9 aa, Homo Sapiens
QPHADHAHA

SEQ ID NO: 94514 - protein, 9 aa, Homo Sapiens
EDSDNEDKD

SEQ ID NO: 94515 - protein, 9 aa, Homo Sapiens
ASLMITRAR

SEQ ID NO: 94516 - protein, 9 aa, Homo Sapiens
LSDFADAMP

SEQ ID NO: 94517 - protein, 9 aa, Homo Sapiens
ASVADDTPL

SEQ ID NO: 94518 - protein, 9 aa, Homo Sapiens
EFGHFHKSK

SEQ ID NO: 94519 - protein, 9 aa, Homo Sapiens
WTTAQTMKG

SEQ ID NO: 94520 - protein, 9 aa, Homo Sapiens
LTGKRQDSE

SEQ ID NO: 94521 - protein, 9 aa, Homo Sapiens
RSSVISQLH

SEQ ID NO: 94522 - protein, 9 aa, Homo Sapiens
IRHAENAPT

SEQ ID NO: 94523 - protein, 9 aa, Homo Sapiens
CAGESSVRD

SEQ ID NO: 94524 - protein, 9 aa, Homo Sapiens
TFLQPSVKI

SEQ ID NO: 94525 - protein, 9 aa, Homo Sapiens
GSTQTTVVE

SEQ ID NO: 94526 - protein, 9 aa, Homo Sapiens
EPHLALQPL

SEQ ID NO: 94527 - protein, 9 aa, Homo Sapiens
SELQVGVIK

SEQ ID NO: 94528 - protein, 9 aa, Homo Sapiens
DNLNGTFSY

SEQ ID NO: 94529 - protein, 9 aa, Homo Sapiens
TYPLLKEFA

SEQ ID NO: 94530 - protein, 9 aa, Homo Sapiens
GAAKAVGKL

SEQ ID NO: 94531 - protein, 9 aa, Homo Sapiens
NEDRNAERC

SEQ ID NO: 94532 - protein, 9 aa, Homo Sapiens
GEVCMGYYK

SEQ ID NO: 94533 - protein, 9 aa, Homo Sapiens
KEEEEKEEE

SEQ ID NO: 94534 - protein, 9 aa, Homo Sapiens
SPSSSRKDD

SEQ ID NO: 94535 - protein, 9 aa, Homo Sapiens
APEFGHFHK

SEQ ID NO: 94536 - protein, 9 aa, Homo Sapiens
ALGIMNSFV

SEQ ID NO: 94537 - protein, 9 aa, Homo Sapiens
LLDEAMSAL

SEQ ID NO: 94538 - protein, 9 aa, Homo Sapiens
GLKRTASQD

SEQ ID NO: 94539 - protein, 9 aa, Homo Sapiens
SQLQVEAVR

SEQ ID NO: 94540 - protein, 9 aa, Homo Sapiens
DLLSEADHY

SEQ ID NO: 94541 - protein, 9 aa, Homo Sapiens
FALILLQTV

SEQ ID NO: 94542 - protein, 9 aa, Homo Sapiens
NHVSDTSVV

SEQ ID NO: 94543 - protein, 9 aa, Homo Sapiens
VEGSQTDLT

SEQ ID NO: 94544 - protein, 9 aa, Homo Sapiens
PPSPSPSPS

SEQ ID NO: 94545 - protein, 9 aa, Homo Sapiens
PPATCVLET

SEQ ID NO: 94546 - protein, 9 aa, Homo Sapiens
ERKHVKYCQ

SEQ ID NO: 94547 - protein, 9 aa, Homo Sapiens
PQTSKVAGL

SEQ ID NO: 94548 - protein, 9 aa, Homo Sapiens
NDLAKGPKQ

SEQ ID NO: 94549 - protein, 9 aa, Homo Sapiens
PKQLKELKL

SEQ ID NO: 94550 - protein, 9 aa, Homo Sapiens
PAPIAQFSA

SEQ ID NO: 94551 - protein, 9 aa, Homo Sapiens
FFMFADHIV

SEQ ID NO: 94552 - protein, 9 aa, Homo Sapiens
HSSVLHMDQ

SEQ ID NO: 94553 - protein, 9 aa, Homo Sapiens
TPASLMITR

SEQ ID NO: 94554 - protein, 9 aa, Homo Sapiens
DNHSYEEDR

SEQ ID NO: 94555 - protein, 9 aa, Homo Sapiens
MFADHIVFT

SEQ ID NO: 94556 - protein, 9 aa, Homo Sapiens
YLFSSLLHF

SEQ ID NO: 94557 - protein, 9 aa, Homo Sapiens
AQTYLYIEF

SEQ ID NO: 94558 - protein, 9 aa, Homo Sapiens
TVTIRSGAS

SEQ ID NO: 94559 - protein, 9 aa, Homo Sapiens
DHAHADAPA

SEQ ID NO: 94560 - protein, 9 aa, Homo Sapiens
IIRHAENAP

SEQ ID NO: 94561 - protein, 9 aa, Homo Sapiens
IYYDTNQII

SEQ ID NO: 94562 - protein, 9 aa, Homo Sapiens
LKDNLNGTF

SEQ ID NO: 94563 - protein, 9 aa, Homo Sapiens
TVVEGSQTD

SEQ ID NO: 94564 - protein, 9 aa, Homo Sapiens
EEEEYGTLK

SEQ ID NO: 94565 - protein, 9 aa, Homo Sapiens
SPGQKHRIK

SEQ ID NO: 94566 - protein, 9 aa, Homo Sapiens
SSNCTSVSS

SEQ ID NO: 94567 - protein, 9 aa, Homo Sapiens
DLSSELQVG

SEQ ID NO: 94568 - protein, 9 aa, Homo Sapiens
HALTGHRNS

SEQ ID NO: 94569 - protein, 9 aa, Homo Sapiens
RKDDRDLTV

SEQ ID NO: 94570 - protein, 9 aa, Homo Sapiens
ADAMPEPLR

SEQ ID NO: 94571 - protein, 9 aa, Homo Sapiens
SLDTFLDLI

SEQ ID NO: 94572 - protein, 9 aa, Homo Sapiens
VSGIFFPTT

SEQ ID NO: 94573 - protein, 9 aa, Homo Sapiens
CLWAKTVLR

SEQ ID NO: 94574 - protein, 9 aa, Homo Sapiens
LQHGHRHGL

SEQ ID NO: 94575 - protein, 9 aa, Homo Sapiens
VIYYDTNQI

SEQ ID NO: 94576 - protein, 9 aa, Homo Sapiens
YMEVQERIH

SEQ ID NO: 94577 - protein, 9 aa, Homo Sapiens
DGSTQTTVV

SEQ ID NO: 94578 - protein, 9 aa, Homo Sapiens
IGEDSSGTF

SEQ ID NO: 94579 - protein, 9 aa, Homo Sapiens
IEVDLNRIT

SEQ ID NO: 94580 - protein, 9 aa, Homo Sapiens
SAPSACTSL

SEQ ID NO: 94581 - protein, 9 aa, Homo Sapiens
LIIKWLQEA

SEQ ID NO: 94582 - protein, 9 aa, Homo Sapiens
AVRLGILPV

SEQ ID NO: 94583 - protein, 9 aa, Homo Sapiens
KSLSVLVSP

SEQ ID NO: 94584 - protein, 9 aa, Homo Sapiens
KSKGHIWKL

SEQ ID NO: 94585 - protein, 9 aa, Homo Sapiens
PCGSYSGEL

SEQ ID NO: 94586 - protein, 9 aa, Homo Sapiens
ICQESSGSP

SEQ ID NO: 94587 - protein, 9 aa, Homo Sapiens
EADHYVILQ

SEQ ID NO: 94588 - protein, 9 aa, Homo Sapiens
SSELQVGVI

SEQ ID NO: 94589 - protein, 9 aa, Homo Sapiens
AANQGFPAV

SEQ ID NO: 94590 - protein, 9 aa, Homo Sapiens
PLLPPSPSP

SEQ ID NO: 94591 - protein, 9 aa, Homo Sapiens
SRHVLPEPH

SEQ ID NO: 94592 - protein, 9 aa, Homo Sapiens
MITRARKGR

SEQ ID NO: 94593 - protein, 9 aa, Homo Sapiens
CMGYYKNNM

SEQ ID NO: 94594 - protein, 9 aa, Homo Sapiens
NCLRDEFTC

SEQ ID NO: 94595 - protein, 9 aa, Homo Sapiens
DEFTCSVVR

SEQ ID NO: 94596 - protein, 9 aa, Homo Sapiens
SGTDAASML

SEQ ID NO: 94597 - protein, 9 aa, Homo Sapiens
DYLLEMELK

SEQ ID NO: 94598 - protein, 9 aa, Homo Sapiens
EVDGVYAAS

SEQ ID NO: 94599 - protein, 9 aa, Homo Sapiens
ELDFENEDR

SEQ ID NO: 94600 - protein, 9 aa, Homo Sapiens
TTPPLQHGH

SEQ ID NO: 94601 - protein, 9 aa, Homo Sapiens
FGLLIPAQT

SEQ ID NO: 94602 - protein, 9 aa, Homo Sapiens
VTIRSGASL

SEQ ID NO: 94603 - protein, 9 aa, Homo Sapiens
ETCNVIEVD

SEQ ID NO: 94604 - protein, 9 aa, Homo Sapiens
CKSDKHMQK

SEQ ID NO: 94605 - protein, 9 aa, Homo Sapiens
TLKDNLNGT

SEQ ID NO: 94606 - protein, 9 aa, Homo Sapiens
RAKSIMTSD

SEQ ID NO: 94607 - protein, 9 aa, Homo Sapiens
EAANQGFPA

SEQ ID NO: 94608 - protein, 9 aa, Homo Sapiens
AVYAPIAPG

SEQ ID NO: 94609 - protein, 9 aa, Homo Sapiens
LLSEADHYV

SEQ ID NO: 94610 - protein, 9 aa, Homo Sapiens
LHQQQQQEP

SEQ ID NO: 94611 - protein, 9 aa, Homo Sapiens
RDGPHSDYR

SEQ ID NO: 94612 - protein, 9 aa, Homo Sapiens
HKNERKHVK

SEQ ID NO: 94613 - protein, 9 aa, Homo Sapiens
PEFGHFHKS

SEQ ID NO: 94614 - protein, 9 aa, Homo Sapiens
LGGRSGRKD

SEQ ID NO: 94615 - protein, 9 aa, Homo Sapiens
KILLLDEAM

SEQ ID NO: 94616 - protein, 9 aa, Homo Sapiens
KVLYELMPV

SEQ ID NO: 94617 - protein, 9 aa, Homo Sapiens
SALRWQLDC

SEQ ID NO: 94618 - protein, 9 aa, Homo Sapiens
NFQLHCKSD

SEQ ID NO: 94619 - protein, 9 aa, Homo Sapiens
IFAFAPCGS

SEQ ID NO: 94620 - protein, 9 aa, Homo Sapiens
LKEFALILL

SEQ ID NO: 94621 - protein, 9 aa, Homo Sapiens
RNTAFQKQE

SEQ ID NO: 94622 - protein, 9 aa, Homo Sapiens
EGGTVSVHA

SEQ ID NO: 94623 - protein, 9 aa, Homo Sapiens
CKMKGVLCT

SEQ ID NO: 94624 - protein, 9 aa, Homo Sapiens
PAHPASTAE

SEQ ID NO: 94625 - protein, 9 aa, Homo Sapiens
DSDNEDKDR

SEQ ID NO: 94626 - protein, 9 aa, Homo Sapiens
IRSGASLRL

SEQ ID NO: 94627 - protein, 9 aa, Homo Sapiens
QSTPAPIAQ

SEQ ID NO: 94628 - protein, 9 aa, Homo Sapiens
FLLPLSLYL

SEQ ID NO: 94629 - protein, 9 aa, Homo Sapiens
NTAFQKQEG

SEQ ID NO: 94630 - protein, 9 aa, Homo Sapiens
GKVFNYSGI

SEQ ID NO: 94631 - protein, 9 aa, Homo Sapiens
LDFENEDRN

SEQ ID NO: 94632 - protein, 9 aa, Homo Sapiens
SIGEDSSGT

SEQ ID NO: 94633 - protein, 9 aa, Homo Sapiens
ISSKALGIM

SEQ ID NO: 94634 - protein, 9 aa, Homo Sapiens
KRTASQDFE

SEQ ID NO: 94635 - protein, 9 aa, Homo Sapiens
AFAPCGSYS

SEQ ID NO: 94636 - protein, 9 aa, Homo Sapiens
DSSGTFGFT

SEQ ID NO: 94637 - protein, 9 aa, Homo Sapiens
NKHADRSFN

SEQ ID NO: 94638 - protein, 9 aa, Homo Sapiens
LLLDEAMSA

SEQ ID NO: 94639 - protein, 9 aa, Homo Sapiens
PASTAEGLS

SEQ ID NO: 94640 - protein, 9 aa, Homo Sapiens
TWTKDGTFL

SEQ ID NO: 94641 - protein, 9 aa, Homo Sapiens
GISSKALGI

SEQ ID NO: 94642 - protein, 9 aa, Homo Sapiens
YPLIIFFMV

SEQ ID NO: 94643 - protein, 9 aa, Homo Sapiens
DDTPLPERR

SEQ ID NO: 94644 - protein, 9 aa, Homo Sapiens
YEEDRASEP

SEQ ID NO: 94645 - protein, 9 aa, Homo Sapiens
VLNGLHNEL

SEQ ID NO: 94646 - protein, 9 aa, Homo Sapiens
YELMPVIRI

SEQ ID NO: 94647 - protein, 9 aa, Homo Sapiens
VTQTVSCQV

SEQ ID NO: 94648 - protein, 9 aa, Homo Sapiens
MKGLEKALS

SEQ ID NO: 94649 - protein, 9 aa, Homo Sapiens
RQVPLGGRS

SEQ ID NO: 94650 - protein, 9 aa, Homo Sapiens
SQMQNHVSD

SEQ ID NO: 94651 - protein, 9 aa, Homo Sapiens
ISQLHDVTN

SEQ ID NO: 94652 - protein, 9 aa, Homo Sapiens
GSYGALDTL

SEQ ID NO: 94653 - protein, 9 aa, Homo Sapiens
RWQLDCVSG

SEQ ID NO: 94654 - protein, 9 aa, Homo Sapiens
QDSETMKKP

SEQ ID NO: 94655 - protein, 9 aa, Homo Sapiens
DMEAEEEKQ

SEQ ID NO: 94656 - protein, 9 aa, Homo Sapiens
LYELMPVIR

SEQ ID NO: 94657 - protein, 9 aa, Homo Sapiens
GTFLQPSVK

SEQ ID NO: 94658 - protein, 9 aa, Homo Sapiens
SGQFGEVCM

SEQ ID NO: 94659 - protein, 9 aa, Homo Sapiens
APIAQFSAQ

SEQ ID NO: 94660 - protein, 9 aa, Homo Sapiens
HRTCYHTIL

SEQ ID NO: 94661 - protein, 9 aa, Homo Sapiens
FADAMPEPL

SEQ ID NO: 94662 - protein, 9 aa, Homo Sapiens
IPKGLPAVI

SEQ ID NO: 94663 - protein, 9 aa, Homo Sapiens
TASQDFEYL

SEQ ID NO: 94664 - protein, 9 aa, Homo Sapiens
SMLDNGLAG

SEQ ID NO: 94665 - protein, 9 aa, Homo Sapiens
MEVQERIHR

SEQ ID NO: 94666 - protein, 9 aa, Homo Sapiens
GPHSDYRGG

SEQ ID NO: 94667 - protein, 9 aa, Homo Sapiens
NERKHVKYC

SEQ ID NO: 94668 - protein, 9 aa, Homo Sapiens
GDTQAGPGD

SEQ ID NO: 94669 - protein, 9 aa, Homo Sapiens
SACTSLCLH

SEQ ID NO: 94670 - protein, 9 aa, Homo Sapiens
GSSNDVDQE

SEQ ID NO: 94671 - protein, 9 aa, Homo Sapiens
AKSIMTSDS

SEQ ID NO: 94672 - protein, 9 aa, Homo Sapiens
HSYEEDRAS

SEQ ID NO: 94673 - protein, 9 aa, Homo Sapiens
FNYSGILSI

SEQ ID NO: 94674 - protein, 9 aa, Homo Sapiens
WSLGYAYVS

SEQ ID NO: 94675 - protein, 9 aa, Homo Sapiens
ELVTHERTH

SEQ ID NO: 94676 - protein, 9 aa, Homo Sapiens
ALTLKDNLN

SEQ ID NO: 94677 - protein, 9 aa, Homo Sapiens
SGRKDRERE

SEQ ID NO: 94678 - protein, 9 aa, Homo Sapiens
ADSLKSKPF

SEQ ID NO: 94679 - protein, 9 aa, Homo Sapiens
SLYLFSSLL

SEQ ID NO: 94680 - protein, 9 aa, Homo Sapiens
EDRNAERCA

SEQ ID NO: 94681 - protein, 9 aa, Homo Sapiens
SKPKVLYEL

SEQ ID NO: 94682 - protein, 9 aa, Homo Sapiens
IMGSSNDVD

SEQ ID NO: 94683 - protein, 9 aa, Homo Sapiens
AWYNETQFC

SEQ ID NO: 94684 - protein, 9 aa, Homo Sapiens
PTHITSPND

SEQ ID NO: 94685 - protein, 9 aa, Homo Sapiens
EYMEVQERI

SEQ ID NO: 94686 - protein, 9 aa, Homo Sapiens
PMSPSSSRK

SEQ ID NO: 94687 - protein, 9 aa, Homo Sapiens
DFADAMPEP

SEQ ID NO: 94688 - protein, 9 aa, Homo Sapiens
MSPSSSRKD

SEQ ID NO: 94689 - protein, 9 aa, Homo Sapiens
AKTVLRWPS

SEQ ID NO: 94690 - protein, 9 aa, Homo Sapiens
QVFKQTYSK

SEQ ID NO: 94691 - protein, 9 aa, Homo Sapiens
YGARDGPHS

SEQ ID NO: 94692 - protein, 9 aa, Homo Sapiens
PCKDPTHIT

SEQ ID NO: 94693 - protein, 9 aa, Homo Sapiens
TSQTCLFQL

SEQ ID NO: 94694 - protein, 9 aa, Homo Sapiens
SRLNVFPFW

SEQ ID NO: 94695 - protein, 9 aa, Homo Sapiens
DSLKSKPFF

SEQ ID NO: 94696 - protein, 9 aa, Homo Sapiens
MADKDLKEK

SEQ ID NO: 94697 - protein, 9 aa, Homo Sapiens
RHAENAPTN

SEQ ID NO: 94698 - protein, 9 aa, Homo Sapiens
HCKSDKHMQ

SEQ ID NO: 94699 - protein, 9 aa, Homo Sapiens
NHSYEEDRA

SEQ ID NO: 94700 - protein, 9 aa, Homo Sapiens
NIMGSSNDV

SEQ ID NO: 94701 - protein, 9 aa, Homo Sapiens
CYFKHTLQH

SEQ ID NO: 94702 - protein, 9 aa, Homo Sapiens
HTLQHKVFI

SEQ ID NO: 94703 - protein, 9 aa, Homo Sapiens
RQGSKTVFN

SEQ ID NO: 94704 - protein, 9 aa, Homo Sapiens
LALQPLQPH

SEQ ID NO: 94705 - protein, 9 aa, Homo Sapiens
TVTQTVSCQ

SEQ ID NO: 94706 - protein, 9 aa, Homo Sapiens
TVKWMVNGE

SEQ ID NO: 94707 - protein, 9 aa, Homo Sapiens
CEGYALFVF

SEQ ID NO: 94708 - protein, 9 aa, Homo Sapiens
PKVLYELMP

SEQ ID NO: 94709 - protein, 9 aa, Homo Sapiens
CLRDEFTCS

SEQ ID NO: 94710 - protein, 9 aa, Homo Sapiens
ELMPHVKSV

SEQ ID NO: 94711 - protein, 9 aa, Homo Sapiens
TSTQLEMQL

SEQ ID NO: 94712 - protein, 9 aa, Homo Sapiens
RAYHRLRLA

SEQ ID NO: 94713 - protein, 9 aa, Homo Sapiens
HRLRLALEF

SEQ ID NO: 94714 - protein, 9 aa, Homo Sapiens
REQHLRSRE

SEQ ID NO: 94715 - protein, 9 aa, Homo Sapiens
QQYVLKMNT

SEQ ID NO: 94716 - protein, 9 aa, Homo Sapiens
PLQPDHRGN

SEQ ID NO: 94717 - protein, 9 aa, Homo Sapiens
PAERRMEGN

SEQ ID NO: 94718 - protein, 9 aa, Homo Sapiens
RLRLALEFR

SEQ ID NO: 94719 - protein, 9 aa, Homo Sapiens
DLTRHDVGA

SEQ ID NO: 94720 - protein, 9 aa, Homo Sapiens
SWEKGFAME

SEQ ID NO: 94721 - protein, 9 aa, Homo Sapiens
QHKDTSTQL

SEQ ID NO: 94722 - protein, 9 aa, Homo Sapiens
PGYLHPGPH

SEQ ID NO: 94723 - protein, 9 aa, Homo Sapiens
TAFCYMGCL

SEQ ID NO: 94724 - protein, 9 aa, Homo Sapiens
LMGAEVASS

SEQ ID NO: 94725 - protein, 9 aa, Homo Sapiens
DVAGRGEHG

SEQ ID NO: 94726 - protein, 9 aa, Homo Sapiens
DTSTQLEMQ

SEQ ID NO: 94727 - protein, 9 aa, Homo Sapiens
LPGPLPASH

SEQ ID NO: 94728 - protein, 9 aa, Homo Sapiens
PQNQANSVQ

SEQ ID NO: 94729 - protein, 9 aa, Homo Sapiens
EQHLRSREE

SEQ ID NO: 94730 - protein, 9 aa, Homo Sapiens
LFQPPPASD

SEQ ID NO: 94731 - protein, 9 aa, Homo Sapiens
AKQVFISTR

SEQ ID NO: 94732 - protein, 9 aa, Homo Sapiens
NEEEGVMAA

SEQ ID NO: 94733 - protein, 9 aa, Homo Sapiens
AHGVTGRVE

SEQ ID NO: 94734 - protein, 9 aa, Homo Sapiens
PARMLYHVA

SEQ ID NO: 94735 - protein, 9 aa, Homo Sapiens
RDPLSKITE

SEQ ID NO: 94736 - protein, 9 aa, Homo Sapiens
KYVASSYLS

SEQ ID NO: 94737 - protein, 9 aa, Homo Sapiens
LAFPDDMDL

SEQ ID NO: 94738 - protein, 9 aa, Homo Sapiens
QIRQQYVLK

SEQ ID NO: 94739 - protein, 9 aa, Homo Sapiens
RGEHGPGYL

SEQ ID NO: 94740 - protein, 9 aa, Homo Sapiens
FQPPPASDV

SEQ ID NO: 94741 - protein, 9 aa, Homo Sapiens
ICFEDCTSE

SEQ ID NO: 94742 - protein, 9 aa, Homo Sapiens
DNRYWVSVV

SEQ ID NO: 94743 - protein, 9 aa, Homo Sapiens
GDGELLGGG

SEQ ID NO: 94744 - protein, 9 aa, Homo Sapiens
FGSVARMCA

SEQ ID NO: 94745 - protein, 9 aa, Homo Sapiens
AANRQKDGY

SEQ ID NO: 94746 - protein, 9 aa, Homo Sapiens
VAGLQTQAS

SEQ ID NO: 94747 - protein, 9 aa, Homo Sapiens
FNTYVILKV

SEQ ID NO: 94748 - protein, 9 aa, Homo Sapiens
NQANSVQLS

SEQ ID NO: 94749 - protein, 9 aa, Homo Sapiens
DDMDLRVYG

SEQ ID NO: 94750 - protein, 9 aa, Homo Sapiens
AERRMEGNM

SEQ ID NO: 94751 - protein, 9 aa, Homo Sapiens
GYSICFEDC

SEQ ID NO: 94752 - protein, 9 aa, Homo Sapiens
LAQHKDTST

SEQ ID NO: 94753 - protein, 9 aa, Homo Sapiens
ILKVQNVKS

SEQ ID NO: 94754 - protein, 9 aa, Homo Sapiens
RHDVGAIRA

SEQ ID NO: 94755 - protein, 9 aa, Homo Sapiens
MSESKAIHS

SEQ ID NO: 94756 - protein, 9 aa, Homo Sapiens
PDKFNTYVI

SEQ ID NO: 94757 - protein, 9 aa, Homo Sapiens
KQIRQQYVL

SEQ ID NO: 94758 - protein, 9 aa, Homo Sapiens
LEVAEGDVA

SEQ ID NO: 94759 - protein, 9 aa, Homo Sapiens
ISTRRGAWI

SEQ ID NO: 94760 - protein, 9 aa, Homo Sapiens
ARKDIVAGL

SEQ ID NO: 94761 - protein, 9 aa, Homo Sapiens
TYVILKVQN

SEQ ID NO: 94762 - protein, 9 aa, Homo Sapiens
KGDVVVPYV

SEQ ID NO: 94763 - protein, 9 aa, Homo Sapiens
SHPLFGRLV

SEQ ID NO: 94764 - protein, 9 aa, Homo Sapiens
GGGLLGDGE

SEQ ID NO: 94765 - protein, 9 aa, Homo Sapiens
LLFQPPPAS

SEQ ID NO: 94766 - protein, 9 aa, Homo Sapiens
SSGNPDSTT

SEQ ID NO: 94767 - protein, 9 aa, Homo Sapiens
LLGDGELLG

SEQ ID NO: 94768 - protein, 9 aa, Homo Sapiens
SKQSNNKYV

SEQ ID NO: 94769 - protein, 9 aa, Homo Sapiens
HALEVAEGD

SEQ ID NO: 94770 - protein, 9 aa, Homo Sapiens
DGELLGGGG

SEQ ID NO: 94771 - protein, 9 aa, Homo Sapiens
VASSGCMKT

SEQ ID NO: 94772 - protein, 9 aa, Homo Sapiens
NDRDNRYWV

SEQ ID NO: 94773 - protein, 9 aa, Homo Sapiens
SKYAHGVTG

SEQ ID NO: 94774 - protein, 9 aa, Homo Sapiens
QNQANSVQL

SEQ ID NO: 94775 - protein, 9 aa, Homo Sapiens
YVASSYLSL

SEQ ID NO: 94776 - protein, 9 aa, Homo Sapiens
SSKYAHGVT

SEQ ID NO: 94777 - protein, 9 aa, Homo Sapiens
CFEDCTSER

SEQ ID NO: 94778 - protein, 9 aa, Homo Sapiens
TANSVFQAV

SEQ ID NO: 94779 - protein, 9 aa, Homo Sapiens
MLGHRTLPL

SEQ ID NO: 94780 - protein, 9 aa, Homo Sapiens
KFNTYVILK

SEQ ID NO: 94781 - protein, 9 aa, Homo Sapiens
VLKMNTQEA

SEQ ID NO: 94782 - protein, 9 aa, Homo Sapiens
EEPFNCRCK

SEQ ID NO: 94783 - protein, 9 aa, Homo Sapiens
SVFQAVFLP

SEQ ID NO: 94784 - protein, 9 aa, Homo Sapiens
LMSSKYAHG

SEQ ID NO: 94785 - protein, 9 aa, Homo Sapiens
LYHVALLYD

SEQ ID NO: 94786 - protein, 9 aa, Homo Sapiens
EQKPAERRM

SEQ ID NO: 94787 - protein, 9 aa, Homo Sapiens
LHHKMSLLF

SEQ ID NO: 94788 - protein, 9 aa, Homo Sapiens
NMEREQKPA

SEQ ID NO: 94789 - protein, 9 aa, Homo Sapiens
MSLLFQPPP

SEQ ID NO: 94790 - protein, 9 aa, Homo Sapiens
EVGYSICFE

SEQ ID NO: 94791 - protein, 9 aa, Homo Sapiens
LAITAFCYM

SEQ ID NO: 94792 - protein, 9 aa, Homo Sapiens
RYWVSVVTP

SEQ ID NO: 94793 - protein, 9 aa, Homo Sapiens
HPGPHHLLT

SEQ ID NO: 94794 - protein, 9 aa, Homo Sapiens
SICFEDCTS

SEQ ID NO: 94795 - protein, 9 aa, Homo Sapiens
QYVLKMNTQ

SEQ ID NO: 94796 - protein, 9 aa, Homo Sapiens
VLPPLQPDH

SEQ ID NO: 94797 - protein, 9 aa, Homo Sapiens
ALRAGAAPM

SEQ ID NO: 94798 - protein, 9 aa, Homo Sapiens
SDQSHDDIV

SEQ ID NO: 94799 - protein, 9 aa, Homo Sapiens
DVVVPYVYV

SEQ ID NO: 94800 - protein, 9 aa, Homo Sapiens
YHVALLYDA

SEQ ID NO: 94801 - protein, 9 aa, Homo Sapiens
DRDNRYWVS

SEQ ID NO: 94802 - protein, 9 aa, Homo Sapiens
RQLERREQH

SEQ ID NO: 94803 - protein, 9 aa, Homo Sapiens
GIGPELMPH

SEQ ID NO: 94804 - protein, 9 aa, Homo Sapiens
FQAVFLPYS

SEQ ID NO: 94805 - protein, 9 aa, Homo Sapiens
MAENAPATF

SEQ ID NO: 94806 - protein, 9 aa, Homo Sapiens
RSLHLHHKM

SEQ ID NO: 94807 - protein, 9 aa, Homo Sapiens
NRYWVSVVT

SEQ ID NO: 94808 - protein, 9 aa, Homo Sapiens
SEASLLTMS

SEQ ID NO: 94809 - protein, 9 aa, Homo Sapiens
NTYVILKVQ

SEQ ID NO: 94810 - protein, 9 aa, Homo Sapiens
YWVSVVTPA

SEQ ID NO: 94811 - protein, 9 aa, Homo Sapiens
LMPHVKSVF

SEQ ID NO: 94812 - protein, 9 aa, Homo Sapiens
EEEGVMAAV

SEQ ID NO: 94813 - protein, 9 aa, Homo Sapiens
LILFDILRN

SEQ ID NO: 94814 - protein, 9 aa, Homo Sapiens
QANSVQLSL

SEQ ID NO: 94815 - protein, 9 aa, Homo Sapiens
GVMAAVGQD

SEQ ID NO: 94816 - protein, 9 aa, Homo Sapiens
EASLLTMSE

SEQ ID NO: 94817 - protein, 9 aa, Homo Sapiens
MDLRVYGPA

SEQ ID NO: 94818 - protein, 9 aa, Homo Sapiens
RREQHLRSR

SEQ ID NO: 94819 - protein, 9 aa, Homo Sapiens
VPYVYVEIH

SEQ ID NO: 94820 - protein, 9 aa, Homo Sapiens
KMSLLFQPP

SEQ ID NO: 94821 - protein, 9 aa, Homo Sapiens
HHLLTAGRS

SEQ ID NO: 94822 - protein, 9 aa, Homo Sapiens
PGPLPASHP

SEQ ID NO: 94823 - protein, 9 aa, Homo Sapiens
LKMNTQEAK

SEQ ID NO: 94824 - protein, 9 aa, Homo Sapiens
FNDRDNRYW

SEQ ID NO: 94825 - protein, 9 aa, Homo Sapiens
IGPELMPHV

SEQ ID NO: 94826 - protein, 9 aa, Homo Sapiens
VVVPYVYVE

SEQ ID NO: 94827 - protein, 9 aa, Homo Sapiens
PASDVLPPL

SEQ ID NO: 94828 - protein, 9 aa, Homo Sapiens
RGMAENAPA

SEQ ID NO: 94829 - protein, 9 aa, Homo Sapiens
PPPASDVLP

SEQ ID NO: 94830 - protein, 9 aa, Homo Sapiens
NFGSVARMC

SEQ ID NO: 94831 - protein, 9 aa, Homo Sapiens
HKMSLLFQP

SEQ ID NO: 94832 - protein, 9 aa, Homo Sapiens
YAHGVTGRV

SEQ ID NO: 94833 - protein, 9 aa, Homo Sapiens
PGPHHLLTA

SEQ ID NO: 94834 - protein, 9 aa, Homo Sapiens
TMSESKAIH

SEQ ID NO: 94835 - protein, 9 aa, Homo Sapiens
MAAVGQDCY

SEQ ID NO: 94836 - protein, 9 aa, Homo Sapiens
MESSGNPDS

SEQ ID NO: 94837 - protein, 9 aa, Homo Sapiens
SLILFDILR

SEQ ID NO: 94838 - protein, 9 aa, Homo Sapiens
KVEEPFNCR

SEQ ID NO: 94839 - protein, 9 aa, Homo Sapiens
LPASHPLFG

SEQ ID NO: 94840 - protein, 9 aa, Homo Sapiens
HGVTGRVEF

SEQ ID NO: 94841 - protein, 9 aa, Homo Sapiens
PLSKITEQE

SEQ ID NO: 94842 - protein, 9 aa, Homo Sapiens
HVNEEEGVM

SEQ ID NO: 94843 - protein, 9 aa, Homo Sapiens
HVALLYDAH

SEQ ID NO: 94844 - protein, 9 aa, Homo Sapiens
CKPARMLYH

SEQ ID NO: 94845 - protein, 9 aa, Homo Sapiens
ASGCPLAAN

SEQ ID NO: 94846 - protein, 9 aa, Homo Sapiens
TRHDVGAIR

SEQ ID NO: 94847 - protein, 9 aa, Homo Sapiens
QTAKQVFIS

SEQ ID NO: 94848 - protein, 9 aa, Homo Sapiens
HGPGYLHPG

SEQ ID NO: 94849 - protein, 9 aa, Homo Sapiens
ILRNQKDSL

SEQ ID NO: 94850 - protein, 9 aa, Homo Sapiens
PLAANRQKD

SEQ ID NO: 94851 - protein, 9 aa, Homo Sapiens
SDVLPPLQP

SEQ ID NO: 94852 - protein, 9 aa, Homo Sapiens
NNFGSVARM

SEQ ID NO: 94853 - protein, 9 aa, Homo Sapiens
RSLFFVESD

SEQ ID NO: 94854 - protein, 9 aa, Homo Sapiens
ARMLYHVAL

SEQ ID NO: 94855 - protein, 9 aa, Homo Sapiens
SLFFVESDD

SEQ ID NO: 94856 - protein, 9 aa, Homo Sapiens
AVLAFPDDM

SEQ ID NO: 94857 - protein, 9 aa, Homo Sapiens
PMLGHRTLP

SEQ ID NO: 94858 - protein, 9 aa, Homo Sapiens
VASWEKGFA

SEQ ID NO: 94859 - protein, 9 aa, Homo Sapiens
EEGVMAAVG

SEQ ID NO: 94860 - protein, 9 aa, Homo Sapiens
TAGRSLHLH

SEQ ID NO: 94861 - protein, 9 aa, Homo Sapiens
DILRNQKDS

SEQ ID NO: 94862 - protein, 9 aa, Homo Sapiens
PPASDVLPP

SEQ ID NO: 94863 - protein, 9 aa, Homo Sapiens
RVTANSVFQ

SEQ ID NO: 94864 - protein, 9 aa, Homo Sapiens
VSDQSHDDI

SEQ ID NO: 94865 - protein, 9 aa, Homo Sapiens
AITAFCYMG

SEQ ID NO: 94866 - protein, 9 aa, Homo Sapiens
VMAAVGQDC

SEQ ID NO: 94867 - protein, 9 aa, Homo Sapiens
AKGDVVVPY

SEQ ID NO: 94868 - protein, 9 aa, Homo Sapiens
VGYSICFED

SEQ ID NO: 94869 - protein, 9 aa, Homo Sapiens
WEKGFAMEK

SEQ ID NO: 94870 - protein, 9 aa, Homo Sapiens
ASDVLPPLQ

SEQ ID NO: 94871 - protein, 9 aa, Homo Sapiens
FDILRNQKD

SEQ ID NO: 94872 - protein, 9 aa, Homo Sapiens
GRSLHLHHK

SEQ ID NO: 94873 - protein, 9 aa, Homo Sapiens
KDTSTQLEM

SEQ ID NO: 94874 - protein, 9 aa, Homo Sapiens
VEEPFNCRC

SEQ ID NO: 94875 - protein, 9 aa, Homo Sapiens
TLRAYHRLR

SEQ ID NO: 94876 - protein, 9 aa, Homo Sapiens
MTGSLVSDQ

SEQ ID NO: 94877 - protein, 9 aa, Homo Sapiens
YVLKMNTQE

SEQ ID NO: 94878 - protein, 9 aa, Homo Sapiens
ETRRKVEEP

SEQ ID NO: 94879 - protein, 9 aa, Homo Sapiens
GAAPMLGHR

SEQ ID NO: 94880 - protein, 9 aa, Homo Sapiens
RKVEEPFNC

SEQ ID NO: 94881 - protein, 9 aa, Homo Sapiens
SQTAKQVFI

SEQ ID NO: 94882 - protein, 9 aa, Homo Sapiens
ASLLTMSES

SEQ ID NO: 94883 - protein, 9 aa, Homo Sapiens
EHGPGYLHP

SEQ ID NO: 94884 - protein, 9 aa, Homo Sapiens
YHRLRLALE

SEQ ID NO: 94885 - protein, 9 aa, Homo Sapiens
RQQYVLKMN

SEQ ID NO: 94886 - protein, 9 aa, Homo Sapiens
EREQKPAER

SEQ ID NO: 94887 - protein, 9 aa, Homo Sapiens
IVAGLQTQA

SEQ ID NO: 94888 - protein, 9 aa, Homo Sapiens
HTHRSLFFV

SEQ ID NO: 94889 - protein, 9 aa, Homo Sapiens
AGRGEHGPG

SEQ ID NO: 94890 - protein, 9 aa, Homo Sapiens
LLTAGRSLH

SEQ ID NO: 94891 - protein, 9 aa, Homo Sapiens
MPHVKSVFR

SEQ ID NO: 94892 - protein, 9 aa, Homo Sapiens
PELEDLTRH

SEQ ID NO: 94893 - protein, 9 aa, Homo Sapiens
HLHHKMSLL

SEQ ID NO: 94894 - protein, 9 aa, Homo Sapiens
LRAGAAPML

SEQ ID NO: 94895 - protein, 9 aa, Homo Sapiens
LRNQKDSLG

SEQ ID NO: 94896 - protein, 9 aa, Homo Sapiens
VNEEEGVMA

SEQ ID NO: 94897 - protein, 9 aa, Homo Sapiens
VLMSSKYAH

SEQ ID NO: 94898 - protein, 9 aa, Homo Sapiens
SGCPLAANR

SEQ ID NO: 94899 - protein, 9 aa, Homo Sapiens
ITNNFGSVA

SEQ ID NO: 94900 - protein, 9 aa, Homo Sapiens
NAPATFRQL

SEQ ID NO: 94901 - protein, 9 aa, Homo Sapiens
AGLQTQASA

SEQ ID NO: 94902 - protein, 9 aa, Homo Sapiens
NPDSTTFFY

SEQ ID NO: 94903 - protein, 9 aa, Homo Sapiens
VILKVQNVK

SEQ ID NO: 94904 - protein, 9 aa, Homo Sapiens
GYLHPGPHH

SEQ ID NO: 94905 - protein, 9 aa, Homo Sapiens
ESSGNPDST

SEQ ID NO: 94906 - protein, 9 aa, Homo Sapiens
QVFISTRRG

SEQ ID NO: 94907 - protein, 9 aa, Homo Sapiens
DGIGPELMP

SEQ ID NO: 94908 - protein, 9 aa, Homo Sapiens
VTANSVFQA

SEQ ID NO: 94909 - protein, 9 aa, Homo Sapiens
ILFDILRNQ

SEQ ID NO: 94910 - protein, 9 aa, Homo Sapiens
MGAEVASSG

SEQ ID NO: 94911 - protein, 9 aa, Homo Sapiens
APMLGHRTL

SEQ ID NO: 94912 - protein, 9 aa, Homo Sapiens
TAKQVFIST

SEQ ID NO: 94913 - protein, 9 aa, Homo Sapiens
AGRSLHLHH

SEQ ID NO: 94914 - protein, 9 aa, Homo Sapiens
RRKVEEPFN

SEQ ID NO: 94915 - protein, 9 aa, Homo Sapiens
DQSHDDIVT

SEQ ID NO: 94916 - protein, 9 aa, Homo Sapiens
LVTITNNFG

SEQ ID NO: 94917 - protein, 9 aa, Homo Sapiens
SNNKYVASS

SEQ ID NO: 94918 - protein, 9 aa, Homo Sapiens
KPAERRMEG

SEQ ID NO: 94919 - protein, 9 aa, Homo Sapiens
NSVFQAVFL

SEQ ID NO: 94920 - protein, 9 aa, Homo Sapiens
LLPGPLPAS

SEQ ID NO: 94921 - protein, 9 aa, Homo Sapiens
PELMPHVKS

SEQ ID NO: 94922 - protein, 9 aa, Homo Sapiens
GPLPASHPL

SEQ ID NO: 94923 - protein, 9 aa, Homo Sapiens
SLHLHHKMS

SEQ ID NO: 94924 - protein, 9 aa, Homo Sapiens
VVRRLKVNE

SEQ ID NO: 94925 - protein, 9 aa, Homo Sapiens
YSICFEDCT

SEQ ID NO: 94926 - protein, 9 aa, Homo Sapiens
PASHPLFGR

SEQ ID NO: 94927 - protein, 9 aa, Homo Sapiens
GLQTQASAT

SEQ ID NO: 94928 - protein, 9 aa, Homo Sapiens
GEHGPGYLH

SEQ ID NO: 94929 - protein, 9 aa, Homo Sapiens
PDDMDLRVY

SEQ ID NO: 94930 - protein, 9 aa, Homo Sapiens
PLPASHPLF

SEQ ID NO: 94931 - protein, 9 aa, Homo Sapiens
ENAPATFRQ

SEQ ID NO: 94932 - protein, 9 aa, Homo Sapiens
LLSRGMAEN

SEQ ID NO: 94933 - protein, 9 aa, Homo Sapiens
AQHKDTSTQ

SEQ ID NO: 94934 - protein, 9 aa, Homo Sapiens
VLAVASWEK

SEQ ID NO: 94935 - protein, 9 aa, Homo Sapiens
RKDIVAGLQ

SEQ ID NO: 94936 - protein, 9 aa, Homo Sapiens
GCPLAANRQ

SEQ ID NO: 94937 - protein, 9 aa, Homo Sapiens
ELLGGGGVL

SEQ ID NO: 94938 - protein, 9 aa, Homo Sapiens
CYMGCLRAL

SEQ ID NO: 94939 - protein, 9 aa, Homo Sapiens
MGCLRALAR

SEQ ID NO: 94940 - protein, 9 aa, Homo Sapiens
ISTRDPLSK

SEQ ID NO: 94941 - protein, 9 aa, Homo Sapiens
VASSYLSLT

SEQ ID NO: 94942 - protein, 9 aa, Homo Sapiens
SGNPDSTTF

SEQ ID NO: 94943 - protein, 9 aa, Homo Sapiens
HLRSREERL

SEQ ID NO: 94944 - protein, 9 aa, Homo Sapiens
FFVESDDTD

SEQ ID NO: 94945 - protein, 9 aa, Homo Sapiens
KYAHGVTGR

SEQ ID NO: 94946 - protein, 9 aa, Homo Sapiens
CPLAANRQK

SEQ ID NO: 94947 - protein, 9 aa, Homo Sapiens
THRSLFFVE

SEQ ID NO: 94948 - protein, 9 aa, Homo Sapiens
LERREQHLR

SEQ ID NO: 94949 - protein, 9 aa, Homo Sapiens
MVVRRLKVN

SEQ ID NO: 94950 - protein, 9 aa, Homo Sapiens
SLLFQPPPA

SEQ ID NO: 94951 - protein, 9 aa, Homo Sapiens
DSTTFFYYD

SEQ ID NO: 94952 - protein, 9 aa, Homo Sapiens
RDNRYWVSV

SEQ ID NO: 94953 - protein, 9 aa, Homo Sapiens
GSLVSDQSH

SEQ ID NO: 94954 - protein, 9 aa, Homo Sapiens
LSKITEQEK

SEQ ID NO: 94955 - protein, 9 aa, Homo Sapiens
GNEVGYSIC

SEQ ID NO: 94956 - protein, 9 aa, Homo Sapiens
FCYMGCLRA

SEQ ID NO: 94957 - protein, 9 aa, Homo Sapiens
GDVAGRGEH

SEQ ID NO: 94958 - protein, 9 aa, Homo Sapiens
VLAFPDDMD

SEQ ID NO: 94959 - protein, 9 aa, Homo Sapiens
LHLHHKMSL

SEQ ID NO: 94960 - protein, 9 aa, Homo Sapiens
GELLGGGGV

SEQ ID NO: 94961 - protein, 9 aa, Homo Sapiens
FISTRRGAW

SEQ ID NO: 94962 - protein, 9 aa, Homo Sapiens
KDIVAGLQT

SEQ ID NO: 94963 - protein, 9 aa, Homo Sapiens
GLLGDGELL

SEQ ID NO: 94964 - protein, 9 aa, Homo Sapiens
ANSVFQAVF

SEQ ID NO: 94965 - protein, 9 aa, Homo Sapiens
SLVSDQSHD

SEQ ID NO: 94966 - protein, 9 aa, Homo Sapiens
LQPDHRGNR

SEQ ID NO: 94967 - protein, 9 aa, Homo Sapiens
TLVTITNNF

SEQ ID NO: 94968 - protein, 9 aa, Homo Sapiens
ASHPLFGRL

SEQ ID NO: 94969 - protein, 9 aa, Homo Sapiens
QQPQNQANS

SEQ ID NO: 94970 - protein, 9 aa, Homo Sapiens
VRVTANSVF

SEQ ID NO: 94971 - protein, 9 aa, Homo Sapiens
DKFNTYVIL

SEQ ID NO: 94972 - protein, 9 aa, Homo Sapiens
SKITEQEKD

SEQ ID NO: 94973 - protein, 9 aa, Homo Sapiens
STRDPLSKI

SEQ ID NO: 94974 - protein, 9 aa, Homo Sapiens
NRQKDGYLN

SEQ ID NO: 94975 - protein, 9 aa, Homo Sapiens
EHALEVAEG

SEQ ID NO: 94976 - protein, 9 aa, Homo Sapiens
ANSVQLSLE

SEQ ID NO: 94977 - protein, 9 aa, Homo Sapiens
KQVFISTRR

SEQ ID NO: 94978 - protein, 9 aa, Homo Sapiens
GDVVVPYVY

SEQ ID NO: 94979 - protein, 9 aa, Homo Sapiens
ITAFCYMGC

SEQ ID NO: 94980 - protein, 9 aa, Homo Sapiens
HDVGAIRAH

SEQ ID NO: 94981 - protein, 9 aa, Homo Sapiens
YLHPGPHHL

SEQ ID NO: 94982 - protein, 9 aa, Homo Sapiens
TSEASLLTM

SEQ ID NO: 94983 - protein, 9 aa, Homo Sapiens
QHLRSREER

SEQ ID NO: 94984 - protein, 9 aa, Homo Sapiens
NEVGYSICF

SEQ ID NO: 94985 - protein, 9 aa, Homo Sapiens
QPDHRGNRV

SEQ ID NO: 94986 - protein, 9 aa, Homo Sapiens
TITNNFGSV

SEQ ID NO: 94987 - protein, 9 aa, Homo Sapiens
DMDLRVYGP

SEQ ID NO: 94988 - protein, 9 aa, Homo Sapiens
AAPMLGHRT

SEQ ID NO: 94989 - protein, 9 aa, Homo Sapiens
WYVLAVASW

SEQ ID NO: 94990 - protein, 9 aa, Homo Sapiens
QLERREQHL

SEQ ID NO: 94991 - protein, 9 aa, Homo Sapiens
LAANRQKDG

SEQ ID NO: 94992 - protein, 9 aa, Homo Sapiens
GPELMPHVK

SEQ ID NO: 94993 - protein, 9 aa, Homo Sapiens
GFNDRDNRY

SEQ ID NO: 94994 - protein, 9 aa, Homo Sapiens
SGCMKTGLW

SEQ ID NO: 94995 - protein, 9 aa, Homo Sapiens
SGAKGDVVV

SEQ ID NO: 94996 - protein, 9 aa, Homo Sapiens
LGDGELLGG

SEQ ID NO: 94997 - protein, 9 aa, Homo Sapiens
EGDVAGRGE

SEQ ID NO: 94998 - protein, 9 aa, Homo Sapiens
LLAQHKDTS

SEQ ID NO: 94999 - protein, 9 aa, Homo Sapiens
LVSDQSHDD

SEQ ID NO: 95000 - protein, 9 aa, Homo Sapiens
AENAPATFR

SEQ ID NO: 95001 - protein, 9 aa, Homo Sapiens
AGAAPMLGH

SEQ ID NO: 95002 - protein, 9 aa, Homo Sapiens
PDSTTFFYY

SEQ ID NO: 95003 - protein, 9 aa, Homo Sapiens
VVPYVYVEI

SEQ ID NO: 95004 - protein, 9 aa, Homo Sapiens
VFQAVFLPY

SEQ ID NO: 95005 - protein, 9 aa, Homo Sapiens
AEVASSGCM

SEQ ID NO: 95006 - protein, 9 aa, Homo Sapiens
GPGYLHPGP

SEQ ID NO: 95007 - protein, 9 aa, Homo Sapiens
SRGMAENAP

SEQ ID NO: 95008 - protein, 9 aa, Homo Sapiens
MSSKYAHGV

SEQ ID NO: 95009 - protein, 9 aa, Homo Sapiens
YMGCLRALA

SEQ ID NO: 95010 - protein, 9 aa, Homo Sapiens
ELEDLTRHD

SEQ ID NO: 95011 - protein, 9 aa, Homo Sapiens
QPQNQANSV

SEQ ID NO: 95012 - protein, 9 aa, Homo Sapiens
GPHHLLTAG

SEQ ID NO: 95013 - protein, 9 aa, Homo Sapiens
YVILKVQNV

SEQ ID NO: 95014 - protein, 9 aa, Homo Sapiens
REQKPAERR

SEQ ID NO: 95015 - protein, 9 aa, Homo Sapiens
PHHLLTAGR

SEQ ID NO: 95016 - protein, 9 aa, Homo Sapiens
LTRHDVGAI

SEQ ID NO: 95017 - protein, 9 aa, Homo Sapiens
AFCYMGCLR

SEQ ID NO: 95018 - protein, 9 aa, Homo Sapiens
LRAYHRLRL

SEQ ID NO: 95019 - protein, 9 aa, Homo Sapiens
AFPDDMDLR

SEQ ID NO: 95020 - protein, 9 aa, Homo Sapiens
LHPGPHHLL

SEQ ID NO: 95021 - protein, 9 aa, Homo Sapiens
HRSLFFVES

SEQ ID NO: 95022 - protein, 9 aa, Homo Sapiens
DPLSKITEQ

SEQ ID NO: 95023 - protein, 9 aa, Homo Sapiens
NKYVASSYL

SEQ ID NO: 95024 - protein, 9 aa, Homo Sapiens
DIVAGLQTQ

SEQ ID NO: 95025 - protein, 9 aa, Homo Sapiens
PFNCRCKEE

SEQ ID NO: 95026 - protein, 9 aa, Homo Sapiens
MEREQKPAE

SEQ ID NO: 95027 - protein, 9 aa, Homo Sapiens
PHVKSVFRH

SEQ ID NO: 95028 - protein, 9 aa, Homo Sapiens
QSNNKYVAS

SEQ ID NO: 95029 - protein, 9 aa, Homo Sapiens
AYHRLRLAL

SEQ ID NO: 95030 - protein, 9 aa, Homo Sapiens
LFDILRNQK

SEQ ID NO: 95031 - protein, 9 aa, Homo Sapiens
YQQPQNQAN

SEQ ID NO: 95032 - protein, 9 aa, Homo Sapiens
LEDLTRHDV

SEQ ID NO: 95033 - protein, 9 aa, Homo Sapiens
DVLPPLQPD

SEQ ID NO: 95034 - protein, 9 aa, Homo Sapiens
LPPLQPDHR

SEQ ID NO: 95035 - protein, 9 aa, Homo Sapiens
PPLQPDHRG

SEQ ID NO: 95036 - protein, 9 aa, Homo Sapiens
EGVMAAVGQ

SEQ ID NO: 95037 - protein, 9 aa, Homo Sapiens
PTLRAYHRL

SEQ ID NO: 95038 - protein, 9 aa, Homo Sapiens
FPDDMDLRV

SEQ ID NO: 95039 - protein, 9 aa, Homo Sapiens
LFFVESDDT

SEQ ID NO: 95040 - protein, 9 aa, Homo Sapiens
EVAEGDVAG

SEQ ID NO: 95041 - protein, 9 aa, Homo Sapiens
LLLAQHKDT

SEQ ID NO: 95042 - protein, 9 aa, Homo Sapiens
TGSLVSDQS

SEQ ID NO: 95043 - protein, 9 aa, Homo Sapiens
EPFNCRCKE

SEQ ID NO: 95044 - protein, 9 aa, Homo Sapiens
GMAENAPAT

SEQ ID NO: 95045 - protein, 9 aa, Homo Sapiens
VFISTRRGA

SEQ ID NO: 95046 - protein, 9 aa, Homo Sapiens
HLLTAGRSL

SEQ ID NO: 95047 - protein, 9 aa, Homo Sapiens
TRDPLSKIT

SEQ ID NO: 95048 - protein, 9 aa, Homo Sapiens
ALEVAEGDV

SEQ ID NO: 95049 - protein, 9 aa, Homo Sapiens
AVASWEKGF

SEQ ID NO: 95050 - protein, 9 aa, Homo Sapiens
NNKYVASSY

SEQ ID NO: 95051 - protein, 9 aa, Homo Sapiens
YVLAVASWE

SEQ ID NO: 95052 - protein, 9 aa, Homo Sapiens
LLTMSESKA

SEQ ID NO: 95053 - protein, 9 aa, Homo Sapiens
GAEVASSGC

SEQ ID NO: 95054 - protein, 9 aa, Homo Sapiens
ASWEKGFAM

SEQ ID NO: 95055 - protein, 9 aa, Homo Sapiens
EDLTRHDVG

SEQ ID NO: 95056 - protein, 9 aa, Homo Sapiens
RNQKDSLGD

SEQ ID NO: 95057 - protein, 9 aa, Homo Sapiens
LTAGRSLHL

SEQ ID NO: 95058 - protein, 9 aa, Homo Sapiens
EVASSGCMK

SEQ ID NO: 95059 - protein, 9 aa, Homo Sapiens
AEGDVAGRG

SEQ ID NO: 95060 - protein, 9 aa, Homo Sapiens
LSRGMAENA

SEQ ID NO: 95061 - protein, 9 aa, Homo Sapiens
SSGCMKTGL

SEQ ID NO: 95062 - protein, 9 aa, Homo Sapiens
QSHDDIVTR

SEQ ID NO: 95063 - protein, 9 aa, Homo Sapiens
GAKGDVVVP

SEQ ID NO: 95064 - protein, 9 aa, Homo Sapiens
QPPPASDVL

SEQ ID NO: 95065 - protein, 9 aa, Homo Sapiens
LTMSESKAI

SEQ ID NO: 95066 - protein, 9 aa, Homo Sapiens
VAGRGEHGP

SEQ ID NO: 95067 - protein, 9 aa, Homo Sapiens
HHKMSLLFQ

SEQ ID NO: 95068 - protein, 9 aa, Homo Sapiens
NHTHRSLFF

SEQ ID NO: 95069 - protein, 9 aa, Homo Sapiens
KPARMLYHV

SEQ ID NO: 95070 - protein, 9 aa, Homo Sapiens
RMLYHVALL

SEQ ID NO: 95071 - protein, 9 aa, Homo Sapiens
MLYHVALLY

SEQ ID NO: 95072 - protein, 9 aa, Homo Sapiens
SLLTMSESK

SEQ ID NO: 95073 - protein, 9 aa, Homo Sapiens
ASSGCMKTG

SEQ ID NO: 95074 - protein, 9 aa, Homo Sapiens
VTITNNFGS

SEQ ID NO: 95075 - protein, 9 aa, Homo Sapiens
TRRKVEEPF

SEQ ID NO: 95076 - protein, 9 aa, Homo Sapiens
RAGAAPMLG

SEQ ID NO: 95077 - protein, 9 aa, Homo Sapiens
KQSNNKYVA

SEQ ID NO: 95078 - protein, 9 aa, Homo Sapiens
GNPDSTTFF

SEQ ID NO: 95079 - protein, 9 aa, Homo Sapiens
GGLLGDGEL

SEQ ID NO: 95080 - protein, 9 aa, Homo Sapiens
QKPAERRME

SEQ ID NO: 95081 - protein, 9 aa, Homo Sapiens
KITEQEKDF

SEQ ID NO: 95082 - protein, 9 aa, Homo Sapiens
HKDTSTQLE

SEQ ID NO: 95083 - protein, 9 aa, Homo Sapiens
FVESDDTDT

SEQ ID NO: 95084 - protein, 9 aa, Homo Sapiens
TNNFGSVAR

SEQ ID NO: 95085 - protein, 9 aa, Homo Sapiens
ANRQKDGYL

SEQ ID NO: 95086 - protein, 9 aa, Homo Sapiens
ERREQHLRS

SEQ ID NO: 95087 - protein, 9 aa, Homo Sapiens
VAEGDVAGR

SEQ ID NO: 95088 - protein, 9 aa, Homo Sapiens
LAVASWEKG

SEQ ID NO: 95089 - protein, 9 aa, Homo Sapiens
IRQQYVLKM

SEQ ID NO: 95090 - protein, 9 aa, Homo Sapiens
KARKDIVAG

SEQ ID NO: 95091 - protein, 9 aa, Homo Sapiens
GRGEHGPGY

SEQ ID NO: 95092 - protein, 9 aa, Homo Sapiens
FPTLRAYHR

SEQ ID NO: 95093 - protein, 9 aa, Homo Sapiens
DFAALQEEE

SEQ ID NO: 95094 - protein, 9 aa, Homo Sapiens
EAFKPGSTH

SEQ ID NO: 95095 - protein, 9 aa, Homo Sapiens
EKDVKITLY

SEQ ID NO: 95096 - protein, 9 aa, Homo Sapiens
TEAPPCITT

SEQ ID NO: 95097 - protein, 9 aa, Homo Sapiens
STHKCRIID

SEQ ID NO: 95098 - protein, 9 aa, Homo Sapiens
TAVIFSATL

SEQ ID NO: 95099 - protein, 9 aa, Homo Sapiens
PEQDSKLTS

SEQ ID NO: 95100 - protein, 9 aa, Homo Sapiens
SEEELKTTV

SEQ ID NO: 95101 - protein, 9 aa, Homo Sapiens
WSAMPSQPP

SEQ ID NO: 95102 - protein, 9 aa, Homo Sapiens
SKLTSEEES

SEQ ID NO: 95103 - protein, 9 aa, Homo Sapiens
RCVQELLVS

SEQ ID NO: 95104 - protein, 9 aa, Homo Sapiens
HSEEELKTT

SEQ ID NO: 95105 - protein, 9 aa, Homo Sapiens
VKITLYDYD

SEQ ID NO: 95106 - protein, 9 aa, Homo Sapiens
KPGSTHKCR

SEQ ID NO: 95107 - protein, 9 aa, Homo Sapiens
VMPQGTAPL

SEQ ID NO: 95108 - protein, 9 aa, Homo Sapiens
NSNPEQDSK

SEQ ID NO: 95109 - protein, 9 aa, Homo Sapiens
HSSNFGPMK

SEQ ID NO: 95110 - protein, 9 aa, Homo Sapiens
ALQEEELIS

SEQ ID NO: 95111 - protein, 9 aa, Homo Sapiens
ASWSAMPSQ

SEQ ID NO: 95112 - protein, 9 aa, Homo Sapiens
RKVFKEWKE

SEQ ID NO: 95113 - protein, 9 aa, Homo Sapiens
SWSAMPSQP

SEQ ID NO: 95114 - protein, 9 aa, Homo Sapiens
ENSHMCKSP

SEQ ID NO: 95115 - protein, 9 aa, Homo Sapiens
MPSQPPAAA

SEQ ID NO: 95116 - protein, 9 aa, Homo Sapiens
LNVFVCIGY

SEQ ID NO: 95117 - protein, 9 aa, Homo Sapiens
LPFGNGYKF

SEQ ID NO: 95118 - protein, 9 aa, Homo Sapiens
HSWGDGVAA

SEQ ID NO: 95119 - protein, 9 aa, Homo Sapiens
GPLITAVIF

SEQ ID NO: 95120 - protein, 9 aa, Homo Sapiens
DTIRQETTR

SEQ ID NO: 95121 - protein, 9 aa, Homo Sapiens
SEDEDEEEW

SEQ ID NO: 95122 - protein, 9 aa, Homo Sapiens
READDAVYE

SEQ ID NO: 95123 - protein, 9 aa, Homo Sapiens
VFKEWKEEW

SEQ ID NO: 95124 - protein, 9 aa, Homo Sapiens
KKMMGSVIK

SEQ ID NO: 95125 - protein, 9 aa, Homo Sapiens
FEDSREADD

SEQ ID NO: 95126 - protein, 9 aa, Homo Sapiens
GKLLPAKCA

SEQ ID NO: 95127 - protein, 9 aa, Homo Sapiens
NSHMCKSPL

SEQ ID NO: 95128 - protein, 9 aa, Homo Sapiens
KRRRRRSKK

SEQ ID NO: 95129 - protein, 9 aa, Homo Sapiens
ATEAPPCIT

SEQ ID NO: 95130 - protein, 9 aa, Homo Sapiens
LEKDVKITL

SEQ ID NO: 95131 - protein, 9 aa, Homo Sapiens
YNNHSSNFG

SEQ ID NO: 95132 - protein, 9 aa, Homo Sapiens
TLNAIYRVT

SEQ ID NO: 95133 - protein, 9 aa, Homo Sapiens
CVQELLVSN

SEQ ID NO: 95134 - protein, 9 aa, Homo Sapiens
LLNVFVCIG

SEQ ID NO: 95135 - protein, 9 aa, Homo Sapiens
DAVDTLNAI

SEQ ID NO: 95136 - protein, 9 aa, Homo Sapiens
CKSPLAESS

SEQ ID NO: 95137 - protein, 9 aa, Homo Sapiens
FGNGYKFLS

SEQ ID NO: 95138 - protein, 9 aa, Homo Sapiens
DPVMPQGTA

SEQ ID NO: 95139 - protein, 9 aa, Homo Sapiens
ATQSSSHRG

SEQ ID NO: 95140 - protein, 9 aa, Homo Sapiens
TVCKLVLRI

SEQ ID NO: 95141 - protein, 9 aa, Homo Sapiens
LSRTATQSS

SEQ ID NO: 95142 - protein, 9 aa, Homo Sapiens
RWKHQVLDL

SEQ ID NO: 95143 - protein, 9 aa, Homo Sapiens
NHSSNFGPM

SEQ ID NO: 95144 - protein, 9 aa, Homo Sapiens
AALQEEELI

SEQ ID NO: 95145 - protein, 9 aa, Homo Sapiens
GKGKKRRRR

SEQ ID NO: 95146 - protein, 9 aa, Homo Sapiens
VDDVKVQEI

SEQ ID NO: 95147 - protein, 9 aa, Homo Sapiens
HMCKSPLAE

SEQ ID NO: 95148 - protein, 9 aa, Homo Sapiens
GSYGFRPGF

SEQ ID NO: 95149 - protein, 9 aa, Homo Sapiens
TATQSSSHR

SEQ ID NO: 95150 - protein, 9 aa, Homo Sapiens
FGPLITAVI

SEQ ID NO: 95151 - protein, 9 aa, Homo Sapiens
MPQGTAPLM

SEQ ID NO: 95152 - protein, 9 aa, Homo Sapiens
TLCDFAALQ

SEQ ID NO: 95153 - protein, 9 aa, Homo Sapiens
GSWDQTLKL

SEQ ID NO: 95154 - protein, 9 aa, Homo Sapiens
QETTRKSKK

SEQ ID NO: 95155 - protein, 9 aa, Homo Sapiens
SERFTSYQK

SEQ ID NO: 95156 - protein, 9 aa, Homo Sapiens
PFGNGYKFL

SEQ ID NO: 95157 - protein, 9 aa, Homo Sapiens
LLRKVFKEW

SEQ ID NO: 95158 - protein, 9 aa, Homo Sapiens
KTTVCKLVL

SEQ ID NO: 95159 - protein, 9 aa, Homo Sapiens
DSKLTSEEE

SEQ ID NO: 95160 - protein, 9 aa, Homo Sapiens
PCITTEVPS

SEQ ID NO: 95161 - protein, 9 aa, Homo Sapiens
VEFEDSREA

SEQ ID NO: 95162 - protein, 9 aa, Homo Sapiens
LCDFAALQE

SEQ ID NO: 95163 - protein, 9 aa, Homo Sapiens
VQEIADKIY

SEQ ID NO: 95164 - protein, 9 aa, Homo Sapiens
PGFLHSGTA

SEQ ID NO: 95165 - protein, 9 aa, Homo Sapiens
SNFEKARRA

SEQ ID NO: 95166 - protein, 9 aa, Homo Sapiens
GFRPGFLHS

SEQ ID NO: 95167 - protein, 9 aa, Homo Sapiens
FRPGFLHSG

SEQ ID NO: 95168 - protein, 9 aa, Homo Sapiens
KVQEIADKI

SEQ ID NO: 95169 - protein, 9 aa, Homo Sapiens
DTLNAIYRV

SEQ ID NO: 95170 - protein, 9 aa, Homo Sapiens
YGFRPGFLH

SEQ ID NO: 95171 - protein, 9 aa, Homo Sapiens
KGKKRRRRR

SEQ ID NO: 95172 - protein, 9 aa, Homo Sapiens
EDSREADDA

SEQ ID NO: 95173 - protein, 9 aa, Homo Sapiens
CTLCDFAAL

SEQ ID NO: 95174 - protein, 9 aa, Homo Sapiens
ERRLLTPKY

SEQ ID NO: 95175 - protein, 9 aa, Homo Sapiens
SPRPTTAGP

SEQ ID NO: 95176 - protein, 9 aa, Homo Sapiens
NRGLKKKKQ

SEQ ID NO: 95177 - protein, 9 aa, Homo Sapiens
RRRSKKERR

SEQ ID NO: 95178 - protein, 9 aa, Homo Sapiens
KLLPAKCAL

SEQ ID NO: 95179 - protein, 9 aa, Homo Sapiens
IENSHMCKS

SEQ ID NO: 95180 - protein, 9 aa, Homo Sapiens
LNAIYRVTF

SEQ ID NO: 95181 - protein, 9 aa, Homo Sapiens
LNRGLKKKK

SEQ ID NO: 95182 - protein, 9 aa, Homo Sapiens
PEAFKPGST

SEQ ID NO: 95183 - protein, 9 aa, Homo Sapiens
DQTLKLWDP

SEQ ID NO: 95184 - protein, 9 aa, Homo Sapiens
QRKTLSGYS

SEQ ID NO: 95185 - protein, 9 aa, Homo Sapiens
RRWKHQVLD

SEQ ID NO: 95186 - protein, 9 aa, Homo Sapiens
TQSSSHRGW

SEQ ID NO: 95187 - protein, 9 aa, Homo Sapiens
VCIGYVCSG

SEQ ID NO: 95188 - protein, 9 aa, Homo Sapiens
PAKCALMWL

SEQ ID NO: 95189 - protein, 9 aa, Homo Sapiens
LITAVIFSA

SEQ ID NO: 95190 - protein, 9 aa, Homo Sapiens
TSSLSRTAT

SEQ ID NO: 95191 - protein, 9 aa, Homo Sapiens
ELLVSNFEK

SEQ ID NO: 95192 - protein, 9 aa, Homo Sapiens
PLRLPFGNG

SEQ ID NO: 95193 - protein, 9 aa, Homo Sapiens
MCKSPLAES

SEQ ID NO: 95194 - protein, 9 aa, Homo Sapiens
RLLRKVFKE

SEQ ID NO: 95195 - protein, 9 aa, Homo Sapiens
IKPHLRNLF

SEQ ID NO: 95196 - protein, 9 aa, Homo Sapiens
MGSVIKPHL

SEQ ID NO: 95197 - protein, 9 aa, Homo Sapiens
RPTTAGPLL

SEQ ID NO: 95198 - protein, 9 aa, Homo Sapiens
MTLSERFTS

SEQ ID NO: 95199 - protein, 9 aa, Homo Sapiens
EEEWRGRGC

SEQ ID NO: 95200 - protein, 9 aa, Homo Sapiens
YQGSYGFRP

SEQ ID NO: 95201 - protein, 9 aa, Homo Sapiens
DEEEWRGRG

SEQ ID NO: 95202 - protein, 9 aa, Homo Sapiens
WRGRGCALQ

SEQ ID NO: 95203 - protein, 9 aa, Homo Sapiens
GVRPRRWKH

SEQ ID NO: 95204 - protein, 9 aa, Homo Sapiens
SGTPSSSPR

SEQ ID NO: 95205 - protein, 9 aa, Homo Sapiens
CIGYVCSGI

SEQ ID NO: 95206 - protein, 9 aa, Homo Sapiens
VKKMMGSVI

SEQ ID NO: 95207 - protein, 9 aa, Homo Sapiens
FKSAAMTLS

SEQ ID NO: 95208 - protein, 9 aa, Homo Sapiens
KEWKEEWWV

SEQ ID NO: 95209 - protein, 9 aa, Homo Sapiens
RRRRSKKER

SEQ ID NO: 95210 - protein, 9 aa, Homo Sapiens
DEDEEEWRG

SEQ ID NO: 95211 - protein, 9 aa, Homo Sapiens
EDEDEEEWR

SEQ ID NO: 95212 - protein, 9 aa, Homo Sapiens
ELKTTVCKL

SEQ ID NO: 95213 - protein, 9 aa, Homo Sapiens
EQDSKLTSE

SEQ ID NO: 95214 - protein, 9 aa, Homo Sapiens
RQETTRKSK

SEQ ID NO: 95215 - protein, 9 aa, Homo Sapiens
VQELLVSNF

SEQ ID NO: 95216 - protein, 9 aa, Homo Sapiens
EKLLNVFVC

SEQ ID NO: 95217 - protein, 9 aa, Homo Sapiens
FVEFEDSRE

SEQ ID NO: 95218 - protein, 9 aa, Homo Sapiens
TGSWDQTLK

SEQ ID NO: 95219 - protein, 9 aa, Homo Sapiens
IYRVTFDRT

SEQ ID NO: 95220 - protein, 9 aa, Homo Sapiens
LVSNFEKAR

SEQ ID NO: 95221 - protein, 9 aa, Homo Sapiens
VIKPHLRNL

SEQ ID NO: 95222 - protein, 9 aa, Homo Sapiens
TLPLEKDVK

SEQ ID NO: 95223 - protein, 9 aa, Homo Sapiens
SRTATQSSS

SEQ ID NO: 95224 - protein, 9 aa, Homo Sapiens
AAMTLSERF

SEQ ID NO: 95225 - protein, 9 aa, Homo Sapiens
SLSRTATQS

SEQ ID NO: 95226 - protein, 9 aa, Homo Sapiens
ETTRKSKKS

SEQ ID NO: 95227 - protein, 9 aa, Homo Sapiens
LRLPFGNGY

SEQ ID NO: 95228 - protein, 9 aa, Homo Sapiens
PVVDDVKVQ

SEQ ID NO: 95229 - protein, 9 aa, Homo Sapiens
VIFSATLSS

SEQ ID NO: 95230 - protein, 9 aa, Homo Sapiens
SEGVLHSWG

SEQ ID NO: 95231 - protein, 9 aa, Homo Sapiens
AVDTLNAIY

SEQ ID NO: 95232 - protein, 9 aa, Homo Sapiens
NDFGNYNNH

SEQ ID NO: 95233 - protein, 9 aa, Homo Sapiens
LPLEKDVKI

SEQ ID NO: 95234 - protein, 9 aa, Homo Sapiens
RKSKKSKKR

SEQ ID NO: 95235 - protein, 9 aa, Homo Sapiens
SIENSHMCK

SEQ ID NO: 95236 - protein, 9 aa, Homo Sapiens
LKLWDPRTP

SEQ ID NO: 95237 - protein, 9 aa, Homo Sapiens
KMMGSVIKP

SEQ ID NO: 95238 - protein, 9 aa, Homo Sapiens
PKYIFLGNL

SEQ ID NO: 95239 - protein, 9 aa, Homo Sapiens
SSLSRTATQ

SEQ ID NO: 95240 - protein, 9 aa, Homo Sapiens
AIYRVTFDR

SEQ ID NO: 95241 - protein, 9 aa, Homo Sapiens
LPAKCALMW

SEQ ID NO: 95242 - protein, 9 aa, Homo Sapiens
LGCPRLVLM

SEQ ID NO: 95243 - protein, 9 aa, Homo Sapiens
YSSTSVLPH

SEQ ID NO: 95244 - protein, 9 aa, Homo Sapiens
GNYNNHSSN

SEQ ID NO: 95245 - protein, 9 aa, Homo Sapiens
WDQTLKLWD

SEQ ID NO: 95246 - protein, 9 aa, Homo Sapiens
RRLLTPKYI

SEQ ID NO: 95247 - protein, 9 aa, Homo Sapiens
CPVVDDVKV

SEQ ID NO: 95248 - protein, 9 aa, Homo Sapiens
EAPPCITTE

SEQ ID NO: 95249 - protein, 9 aa, Homo Sapiens
SVIKPHLRN

SEQ ID NO: 95250 - protein, 9 aa, Homo Sapiens
GYSSTSVLP

SEQ ID NO: 95251 - protein, 9 aa, Homo Sapiens
FVCIGYVCS

SEQ ID NO: 95252 - protein, 9 aa, Homo Sapiens
LWLGCPRLV

SEQ ID NO: 95253 - protein, 9 aa, Homo Sapiens
HQVLDLQDV

SEQ ID NO: 95254 - protein, 9 aa, Homo Sapiens
FGNYNNHSS

SEQ ID NO: 95255 - protein, 9 aa, Homo Sapiens
CPRLVLMAK

SEQ ID NO: 95256 - protein, 9 aa, Homo Sapiens
LLPAKCALM

SEQ ID NO: 95257 - protein, 9 aa, Homo Sapiens
VVDDVKVQE

SEQ ID NO: 95258 - protein, 9 aa, Homo Sapiens
TLSERFTSY

SEQ ID NO: 95259 - protein, 9 aa, Homo Sapiens
NYNNHSSNF

SEQ ID NO: 95260 - protein, 9 aa, Homo Sapiens
RKTLSGYSS

SEQ ID NO: 95261 - protein, 9 aa, Homo Sapiens
RPLRLPFGN

SEQ ID NO: 95262 - protein, 9 aa, Homo Sapiens
SAAMTLSER

SEQ ID NO: 95263 - protein, 9 aa, Homo Sapiens
NAIYRVTFD

SEQ ID NO: 95264 - protein, 9 aa, Homo Sapiens
SYGFRPGFL

SEQ ID NO: 95265 - protein, 9 aa, Homo Sapiens
KKRRRRRSK

SEQ ID NO: 95266 - protein, 9 aa, Homo Sapiens
CTLPLEKDV

SEQ ID NO: 95267 - protein, 9 aa, Homo Sapiens
VDTLNAIYR

SEQ ID NO: 95268 - protein, 9 aa, Homo Sapiens
MMGSVIKPH

SEQ ID NO: 95269 - protein, 9 aa, Homo Sapiens
LSERFTSYQ

SEQ ID NO: 95270 - protein, 9 aa, Homo Sapiens
QELLVSNFE

SEQ ID NO: 95271 - protein, 9 aa, Homo Sapiens
VSNFEKARR

SEQ ID NO: 95272 - protein, 9 aa, Homo Sapiens
LHSWGDGVA

SEQ ID NO: 95273 - protein, 9 aa, Homo Sapiens
VLHSWGDGV

SEQ ID NO: 95274 - protein, 9 aa, Homo Sapiens
RPRRWKHQV

SEQ ID NO: 95275 - protein, 9 aa, Homo Sapiens
TPSSSPRPT

SEQ ID NO: 95276 - protein, 9 aa, Homo Sapiens
LSGYSSTSV

SEQ ID NO: 95277 - protein, 9 aa, Homo Sapiens
LRKVFKEWK

SEQ ID NO: 95278 - protein, 9 aa, Homo Sapiens
TLSGYSSTS

SEQ ID NO: 95279 - protein, 9 aa, Homo Sapiens
FKEWKEEWW

SEQ ID NO: 95280 - protein, 9 aa, Homo Sapiens
WLGCPRLVL

SEQ ID NO: 95281 - protein, 9 aa, Homo Sapiens
KGKGKKRRR

SEQ ID NO: 95282 - protein, 9 aa, Homo Sapiens
MPGKLLPAK

SEQ ID NO: 95283 - protein, 9 aa, Homo Sapiens
MATEAPPCI

SEQ ID NO: 95284 - protein, 9 aa, Homo Sapiens
GLWLGCPRL

SEQ ID NO: 95285 - protein, 9 aa, Homo Sapiens
PRLVLMAKL

SEQ ID NO: 95286 - protein, 9 aa, Homo Sapiens
TIRQETTRK

SEQ ID NO: 95287 - protein, 9 aa, Homo Sapiens
QDSKLTSEE

SEQ ID NO: 95288 - protein, 9 aa, Homo Sapiens
LLTPKYIFL

SEQ ID NO: 95289 - protein, 9 aa, Homo Sapiens
GVLHSWGDG

SEQ ID NO: 95290 - protein, 9 aa, Homo Sapiens
GTPSSSPRP

SEQ ID NO: 95291 - protein, 9 aa, Homo Sapiens
SREADDAVY

SEQ ID NO: 95292 - protein, 9 aa, Homo Sapiens
KKDPVMPQG

SEQ ID NO: 95293 - protein, 9 aa, Homo Sapiens
TTVCKLVLR

SEQ ID NO: 95294 - protein, 9 aa, Homo Sapiens
SWDQTLKLW

SEQ ID NO: 95295 - protein, 9 aa, Homo Sapiens
EEWRGRGCA

SEQ ID NO: 95296 - protein, 9 aa, Homo Sapiens
EELKTTVCK

SEQ ID NO: 95297 - protein, 9 aa, Homo Sapiens
LLVSNFEKA

SEQ ID NO: 95298 - protein, 9 aa, Homo Sapiens
RLVLMAKLL

SEQ ID NO: 95299 - protein, 9 aa, Homo Sapiens
DVKVQEIAD

SEQ ID NO: 95300 - protein, 9 aa, Homo Sapiens
VTGSWDQTL

SEQ ID NO: 95301 - protein, 9 aa, Homo Sapiens
PARPLRLPF

SEQ ID NO: 95302 - protein, 9 aa, Homo Sapiens
NNHSSNFGP

SEQ ID NO: 95303 - protein, 9 aa, Homo Sapiens
ITTEVPSIL

SEQ ID NO: 95304 - protein, 9 aa, Homo Sapiens
KDPVMPQGT

SEQ ID NO: 95305 - protein, 9 aa, Homo Sapiens
FAALQEEEL

SEQ ID NO: 95306 - protein, 9 aa, Homo Sapiens
RLLTPKYIF

SEQ ID NO: 95307 - protein, 9 aa, Homo Sapiens
GSVIKPHLR

SEQ ID NO: 95308 - protein, 9 aa, Homo Sapiens
FSASWSAMP

SEQ ID NO: 95309 - protein, 9 aa, Homo Sapiens
QRLLRKVFK

SEQ ID NO: 95310 - protein, 9 aa, Homo Sapiens
SASWSAMPS

SEQ ID NO: 95311 - protein, 9 aa, Homo Sapiens
EGVLHSWGD

SEQ ID NO: 95312 - protein, 9 aa, Homo Sapiens
TTRKSKKSK

SEQ ID NO: 95313 - protein, 9 aa, Homo Sapiens
PLEKDVKIT

SEQ ID NO: 95314 - protein, 9 aa, Homo Sapiens
PGKLLPAKC

SEQ ID NO: 95315 - protein, 9 aa, Homo Sapiens
KTLSGYSST

SEQ ID NO: 95316 - protein, 9 aa, Homo Sapiens
AMTLSERFT

SEQ ID NO: 95317 - protein, 9 aa, Homo Sapiens
KVFKEWKEE

SEQ ID NO: 95318 - protein, 9 aa, Homo Sapiens
SGYSSTSVL

SEQ ID NO: 95319 - protein, 9 aa, Homo Sapiens
GFGPLITAV

SEQ ID NO: 95320 - protein, 9 aa, Homo Sapiens
VRPRRWKHQ

SEQ ID NO: 95321 - protein, 9 aa, Homo Sapiens
PLITAVIFS

SEQ ID NO: 95322 - protein, 9 aa, Homo Sapiens
KSAAMTLSE

SEQ ID NO: 95323 - protein, 9 aa, Homo Sapiens
TPKYIFLGN

SEQ ID NO: 95324 - protein, 9 aa, Homo Sapiens
PPCITTEVP

SEQ ID NO: 95325 - protein, 9 aa, Homo Sapiens
WKHQVLDLQ

SEQ ID NO: 95326 - protein, 9 aa, Homo Sapiens
EFEDSREAD

SEQ ID NO: 95327 - protein, 9 aa, Homo Sapiens
GCPRLVLMA

SEQ ID NO: 95328 - protein, 9 aa, Homo Sapiens
AKCALMWLH

SEQ ID NO: 95329 - protein, 9 aa, Homo Sapiens
RRRRRSKKE

SEQ ID NO: 95330 - protein, 9 aa, Homo Sapiens
LTPKYIFLG

SEQ ID NO: 95331 - protein, 9 aa, Homo Sapiens
ITAVIFSAT

SEQ ID NO: 95332 - protein, 9 aa, Homo Sapiens
PVMPQGTAP

SEQ ID NO: 95333 - protein, 9 aa, Homo Sapiens
GSTHKCRII

SEQ ID NO: 95334 - protein, 9 aa, Homo Sapiens
SHMCKSPLA

SEQ ID NO: 95335 - protein, 9 aa, Homo Sapiens
KLLNVFVCI

SEQ ID NO: 95336 - protein, 9 aa, Homo Sapiens
APPCITTEV

SEQ ID NO: 95337 - protein, 9 aa, Homo Sapiens
RGLKKKKQY

SEQ ID NO: 95338 - protein, 9 aa, Homo Sapiens
QGSYGFRPG

SEQ ID NO: 95339 - protein, 9 aa, Homo Sapiens
ARPLRLPFG

SEQ ID NO: 95340 - protein, 9 aa, Homo Sapiens
EDEEEWRGR

SEQ ID NO: 95341 - protein, 9 aa, Homo Sapiens
EEELKTTVC

SEQ ID NO: 95342 - protein, 9 aa, Homo Sapiens
AVIFSATLS

SEQ ID NO: 95343 - protein, 9 aa, Homo Sapiens
TRKSKKSKK

SEQ ID NO: 95344 - protein, 9 aa, Homo Sapiens
DVKITLYDY

SEQ ID NO: 95345 - protein, 9 aa, Homo Sapiens
DFGNYNNHS

SEQ ID NO: 95346 - protein, 9 aa, Homo Sapiens
KYIFLGNLA

SEQ ID NO: 95347 - protein, 9 aa, Homo Sapiens
RLPFGNGYK

SEQ ID NO: 95348 - protein, 9 aa, Homo Sapiens
LKTTVCKLV

SEQ ID NO: 95349 - protein, 9 aa, Homo Sapiens
QTLKLWDPR

SEQ ID NO: 95350 - protein, 9 aa, Homo Sapiens
VERRLLTPK

SEQ ID NO: 95351 - protein, 9 aa, Homo Sapiens
KDVKITLYD

SEQ ID NO: 95352 - protein, 9 aa, Homo Sapiens
DDVKVQEIA

SEQ ID NO: 95353 - protein, 9 aa, Homo Sapiens
ENSNPEQDS

SEQ ID NO: 95354 - protein, 9 aa, Homo Sapiens
WGLWLGCPR

SEQ ID NO: 95355 - protein, 9 aa, Homo Sapiens
AQRKTLSGY

SEQ ID NO: 95356 - protein, 9 aa, Homo Sapiens
EWRGRGCAL

SEQ ID NO: 95357 - protein, 9 aa, Homo Sapiens
SSSPRPTTA

SEQ ID NO: 95358 - protein, 9 aa, Homo Sapiens
PRPTTAGPL

SEQ ID NO: 95359 - protein, 9 aa, Homo Sapiens
SNPEQDSKL

SEQ ID NO: 95360 - protein, 9 aa, Homo Sapiens
VFVCIGYVC

SEQ ID NO: 95361 - protein, 9 aa, Homo Sapiens
SSPRPTTAG

SEQ ID NO: 95362 - protein, 9 aa, Homo Sapiens
PGSTHKCRI

SEQ ID NO: 95363 - protein, 9 aa, Homo Sapiens
VKVQEIADK

SEQ ID NO: 95364 - protein, 9 aa, Homo Sapiens
TLKLWDPRT

SEQ ID NO: 95365 - protein, 9 aa, Homo Sapiens
YSEGVLHSW

SEQ ID NO: 95366 - protein, 9 aa, Homo Sapiens
GKKRRRRRS

SEQ ID NO: 95367 - protein, 9 aa, Homo Sapiens
NPEAFKPGS

SEQ ID NO: 95368 - protein, 9 aa, Homo Sapiens
FKPGSTHKC

SEQ ID NO: 95369 - protein, 9 aa, Homo Sapiens
KSPLAESSV

SEQ ID NO: 95370 - protein, 9 aa, Homo Sapiens
CITTEVPSI

SEQ ID NO: 95371 - protein, 9 aa, Homo Sapiens
AFKPGSTHK

SEQ ID NO: 95372 - protein, 9 aa, Homo Sapiens
AMPSQPPAA

SEQ ID NO: 95373 - protein, 9 aa, Homo Sapiens
DSREADDAV

SEQ ID NO: 95374 - protein, 9 aa, Homo Sapiens
CDFAALQEE

SEQ ID NO: 95375 - protein, 9 aa, Homo Sapiens
RPGFLHSGT

SEQ ID NO: 95376 - protein, 9 aa, Homo Sapiens
NPEQDSKLT

SEQ ID NO: 95377 - protein, 9 aa, Homo Sapiens
PSSSPRPTT

SEQ ID NO: 95378 - protein, 9 aa, Homo Sapiens
IRQETTRKS

SEQ ID NO: 95379 - protein, 9 aa, Homo Sapiens
PRRWKHQVL

SEQ ID NO: 95380 - protein, 9 aa, Homo Sapiens
LQEEELISH

SEQ ID NO: 95381 - protein, 9 aa, Homo Sapiens
SAMPSQPPA

SEQ ID NO: 95382 - protein, 9 aa, Homo Sapiens
ILYSEGVLH

SEQ ID NO: 95383 - protein, 9 aa, Homo Sapiens
EADDAVYEL

SEQ ID NO: 95384 - protein, 9 aa, Homo Sapiens
LYSEGVLHS

SEQ ID NO: 95385 - protein, 9 aa, Homo Sapiens
RTATQSSSH

SEQ ID NO: 95386 - protein, 9 aa, Homo Sapiens
NVFVCIGYV

SEQ ID NO: 95387 - protein, 9 aa, Homo Sapiens
KHQVLDLQD

SEQ ID NO: 95388 - protein, 9 aa, Homo Sapiens
VFSASWSAM

SEQ ID NO: 95389 - protein, 9 aa, Homo Sapiens
TNHMELFKK

SEQ ID NO: 95390 - protein, 9 aa, Homo Sapiens
YHHIRLWLL

SEQ ID NO: 95391 - protein, 9 aa, Homo Sapiens
AVFRKGKVL

SEQ ID NO: 95392 - protein, 9 aa, Homo Sapiens
LDRKIYIDL

SEQ ID NO: 95393 - protein, 9 aa, Homo Sapiens
PTLTESRIP

SEQ ID NO: 95394 - protein, 9 aa, Homo Sapiens
VFTPGLIPL

SEQ ID NO: 95395 - protein, 9 aa, Homo Sapiens
FSSAEGTVH

SEQ ID NO: 95396 - protein, 9 aa, Homo Sapiens
SREYKHVRR

SEQ ID NO: 95397 - protein, 9 aa, Homo Sapiens
IVCGFGAVL

SEQ ID NO: 95398 - protein, 9 aa, Homo Sapiens
EETIEPDKS

SEQ ID NO: 95399 - protein, 9 aa, Homo Sapiens
IEPDKSYEN

SEQ ID NO: 95400 - protein, 9 aa, Homo Sapiens
LHKHAEVTE

SEQ ID NO: 95401 - protein, 9 aa, Homo Sapiens
ISYCSYWKE

SEQ ID NO: 95402 - protein, 9 aa, Homo Sapiens
CSPHASCTK

SEQ ID NO: 95403 - protein, 9 aa, Homo Sapiens
ERKKPIYDT

SEQ ID NO: 95404 - protein, 9 aa, Homo Sapiens
DIRSIGVLW

SEQ ID NO: 95405 - protein, 9 aa, Homo Sapiens
ISWNSHHIR

SEQ ID NO: 95406 - protein, 9 aa, Homo Sapiens
LAMGALELQ

SEQ ID NO: 95407 - protein, 9 aa, Homo Sapiens
SSLQTSRGT

SEQ ID NO: 95408 - protein, 9 aa, Homo Sapiens
LESLSFYHN

SEQ ID NO: 95409 - protein, 9 aa, Homo Sapiens
QGLEQPHGV

SEQ ID NO: 95410 - protein, 9 aa, Homo Sapiens
LIQIHNLLQ

SEQ ID NO: 95411 - protein, 9 aa, Homo Sapiens
SGVHRCSLS

SEQ ID NO: 95412 - protein, 9 aa, Homo Sapiens
TPLSTTSST

SEQ ID NO: 95413 - protein, 9 aa, Homo Sapiens
CGRQFTSSS

SEQ ID NO: 95414 - protein, 9 aa, Homo Sapiens
SQVKQQPKE

SEQ ID NO: 95415 - protein, 9 aa, Homo Sapiens
LIRRPHLRY

SEQ ID NO: 95416 - protein, 9 aa, Homo Sapiens
ITVSVLRCV

SEQ ID NO: 95417 - protein, 9 aa, Homo Sapiens
QLPVCCPKK

SEQ ID NO: 95418 - protein, 9 aa, Homo Sapiens
AQSDGEERP

SEQ ID NO: 95419 - protein, 9 aa, Homo Sapiens
PSSGSSRQN

SEQ ID NO: 95420 - protein, 9 aa, Homo Sapiens
EKNSKQEKE

SEQ ID NO: 95421 - protein, 9 aa, Homo Sapiens
APGKPTRKI

SEQ ID NO: 95422 - protein, 9 aa, Homo Sapiens
MIADISPAS

SEQ ID NO: 95423 - protein, 9 aa, Homo Sapiens
GFEPLTDLV

SEQ ID NO: 95424 - protein, 9 aa, Homo Sapiens
QDPQKVTYA

SEQ ID NO: 95425 - protein, 9 aa, Homo Sapiens
HQQRIAEVR

SEQ ID NO: 95426 - protein, 9 aa, Homo Sapiens
PADTPSQEE

SEQ ID NO: 95427 - protein, 9 aa, Homo Sapiens
YPSPPLTPY

SEQ ID NO: 95428 - protein, 9 aa, Homo Sapiens
SRENKEQYQ

SEQ ID NO: 95429 - protein, 9 aa, Homo Sapiens
MPSPEARVL

SEQ ID NO: 95430 - protein, 9 aa, Homo Sapiens
IHGVIAQPV

SEQ ID NO: 95431 - protein, 9 aa, Homo Sapiens
LPTLTESRI

SEQ ID NO: 95432 - protein, 9 aa, Homo Sapiens
KTALSRDTV

SEQ ID NO: 95433 - protein, 9 aa, Homo Sapiens
YALRTGAFQ

SEQ ID NO: 95434 - protein, 9 aa, Homo Sapiens
HPVRPQDIE

SEQ ID NO: 95435 - protein, 9 aa, Homo Sapiens
SPFMAKVTG

SEQ ID NO: 95436 - protein, 9 aa, Homo Sapiens
KIFMENSKA

SEQ ID NO: 95437 - protein, 9 aa, Homo Sapiens
PKGEKVEER

SEQ ID NO: 95438 - protein, 9 aa, Homo Sapiens
FTLTWTKKD

SEQ ID NO: 95439 - protein, 9 aa, Homo Sapiens
TNGSSLFFE

SEQ ID NO: 95440 - protein, 9 aa, Homo Sapiens
GLEAQDDPL

SEQ ID NO: 95441 - protein, 9 aa, Homo Sapiens
CGLRAMPSP

SEQ ID NO: 95442 - protein, 9 aa, Homo Sapiens
YDTISKTKA

SEQ ID NO: 95443 - protein, 9 aa, Homo Sapiens
NDKEALMEE

SEQ ID NO: 95444 - protein, 9 aa, Homo Sapiens
FKEDKEDDL

SEQ ID NO: 95445 - protein, 9 aa, Homo Sapiens
VYVRGRLKQ

SEQ ID NO: 95446 - protein, 9 aa, Homo Sapiens
TLWHGFNML

SEQ ID NO: 95447 - protein, 9 aa, Homo Sapiens
DMSRENKEQ

SEQ ID NO: 95448 - protein, 9 aa, Homo Sapiens
LEAQDDPLA

SEQ ID NO: 95449 - protein, 9 aa, Homo Sapiens
WASSLENLL

SEQ ID NO: 95450 - protein, 9 aa, Homo Sapiens
SAVKRTEKK

SEQ ID NO: 95451 - protein, 9 aa, Homo Sapiens
HQKQKSTIM

SEQ ID NO: 95452 - protein, 9 aa, Homo Sapiens
RELTTLLHK

SEQ ID NO: 95453 - protein, 9 aa, Homo Sapiens
EVEEDHIDA

SEQ ID NO: 95454 - protein, 9 aa, Homo Sapiens
LRFLSVLFQ

SEQ ID NO: 95455 - protein, 9 aa, Homo Sapiens
TAHPVERSA

SEQ ID NO: 95456 - protein, 9 aa, Homo Sapiens
SLESLSFYH

SEQ ID NO: 95457 - protein, 9 aa, Homo Sapiens
CGSSNLTWP

SEQ ID NO: 95458 - protein, 9 aa, Homo Sapiens
SCQTSFLLL

SEQ ID NO: 95459 - protein, 9 aa, Homo Sapiens
EKPADTPSQ

SEQ ID NO: 95460 - protein, 9 aa, Homo Sapiens
RSNAITSWL

SEQ ID NO: 95461 - protein, 9 aa, Homo Sapiens
TTASGLSCL

SEQ ID NO: 95462 - protein, 9 aa, Homo Sapiens
GPNVINHNF

SEQ ID NO: 95463 - protein, 9 aa, Homo Sapiens
KLQKICISC

SEQ ID NO: 95464 - protein, 9 aa, Homo Sapiens
IKEKLTQDL

SEQ ID NO: 95465 - protein, 9 aa, Homo Sapiens
YRGVASTTA

SEQ ID NO: 95466 - protein, 9 aa, Homo Sapiens
KFQRAPPSS

SEQ ID NO: 95467 - protein, 9 aa, Homo Sapiens
CPQDGMEAM

SEQ ID NO: 95468 - protein, 9 aa, Homo Sapiens
SHMGLKITG

SEQ ID NO: 95469 - protein, 9 aa, Homo Sapiens
AVDNDKEAL

SEQ ID NO: 95470 - protein, 9 aa, Homo Sapiens
VFVYLKWFE

SEQ ID NO: 95471 - protein, 9 aa, Homo Sapiens
GPYSELSKR

SEQ ID NO: 95472 - protein, 9 aa, Homo Sapiens
DIGVPIVVV

SEQ ID NO: 95473 - protein, 9 aa, Homo Sapiens
STDCNGHLL

SEQ ID NO: 95474 - protein, 9 aa, Homo Sapiens
SSLFFEDFQ

SEQ ID NO: 95475 - protein, 9 aa, Homo Sapiens
SFYHNKLVK

SEQ ID NO: 95476 - protein, 9 aa, Homo Sapiens
SPKTWTSEW

SEQ ID NO: 95477 - protein, 9 aa, Homo Sapiens
MEEPVSIPD

SEQ ID NO: 95478 - protein, 9 aa, Homo Sapiens
AFYNDGKKI

SEQ ID NO: 95479 - protein, 9 aa, Homo Sapiens
EADGIKLHR

SEQ ID NO: 95480 - protein, 9 aa, Homo Sapiens
EYLLPDKVE

SEQ ID NO: 95481 - protein, 9 aa, Homo Sapiens
LTPYFSPSQ

SEQ ID NO: 95482 - protein, 9 aa, Homo Sapiens
LADNHITST

SEQ ID NO: 95483 - protein, 9 aa, Homo Sapiens
PRGKSIKRA

SEQ ID NO: 95484 - protein, 9 aa, Homo Sapiens
HKHAEVTEN

SEQ ID NO: 95485 - protein, 9 aa, Homo Sapiens
AEVKFKHFL

SEQ ID NO: 95486 - protein, 9 aa, Homo Sapiens
GLEQPHGVV

SEQ ID NO: 95487 - protein, 9 aa, Homo Sapiens
LEVSFSFAK

SEQ ID NO: 95488 - protein, 9 aa, Homo Sapiens
WMLKPTSTR

SEQ ID NO: 95489 - protein, 9 aa, Homo Sapiens
GPPKGEKVE

SEQ ID NO: 95490 - protein, 9 aa, Homo Sapiens
HCELKNLTE

SEQ ID NO: 95491 - protein, 9 aa, Homo Sapiens
LRRELERES

SEQ ID NO: 95492 - protein, 9 aa, Homo Sapiens
PLPHPVRPQ

SEQ ID NO: 95493 - protein, 9 aa, Homo Sapiens
KSFCFLSFD

SEQ ID NO: 95494 - protein, 9 aa, Homo Sapiens
KKSEKNSKQ

SEQ ID NO: 95495 - protein, 9 aa, Homo Sapiens
DVETVDRFN

SEQ ID NO: 95496 - protein, 9 aa, Homo Sapiens
GTYTMHAQK

SEQ ID NO: 95497 - protein, 9 aa, Homo Sapiens
IVVVRTEKN

SEQ ID NO: 95498 - protein, 9 aa, Homo Sapiens
IFRFLFLYF

SEQ ID NO: 95499 - protein, 9 aa, Homo Sapiens
AQAHHRAET

SEQ ID NO: 95500 - protein, 9 aa, Homo Sapiens
LYIVCGFGA

SEQ ID NO: 95501 - protein, 9 aa, Homo Sapiens
LSSKGGENV

SEQ ID NO: 95502 - protein, 9 aa, Homo Sapiens
DPILMFFMM

SEQ ID NO: 95503 - protein, 9 aa, Homo Sapiens
YGAQWARGK

SEQ ID NO: 95504 - protein, 9 aa, Homo Sapiens
LISMKKLQK

SEQ ID NO: 95505 - protein, 9 aa, Homo Sapiens
MVSERLRCI

SEQ ID NO: 95506 - protein, 9 aa, Homo Sapiens
LRRGCCVVA

SEQ ID NO: 95507 - protein, 9 aa, Homo Sapiens
NYSCLYYQT

SEQ ID NO: 95508 - protein, 9 aa, Homo Sapiens
IVAAILNIP

SEQ ID NO: 95509 - protein, 9 aa, Homo Sapiens
CTEVEEDHI

SEQ ID NO: 95510 - protein, 9 aa, Homo Sapiens
GLRAMPSPE

SEQ ID NO: 95511 - protein, 9 aa, Homo Sapiens
MYFSHFSKP

SEQ ID NO: 95512 - protein, 9 aa, Homo Sapiens
FQPAEASVN

SEQ ID NO: 95513 - protein, 9 aa, Homo Sapiens
NALTGTQSS

SEQ ID NO: 95514 - protein, 9 aa, Homo Sapiens
AAILNIPSA

SEQ ID NO: 95515 - protein, 9 aa, Homo Sapiens
QGNAKMMAP

SEQ ID NO: 95516 - protein, 9 aa, Homo Sapiens
IEQVFVLTT

SEQ ID NO: 95517 - protein, 9 aa, Homo Sapiens
SQNQRLKVP

SEQ ID NO: 95518 - protein, 9 aa, Homo Sapiens
PLAERTKNV

SEQ ID NO: 95519 - protein, 9 aa, Homo Sapiens
IKAVFRKGK

SEQ ID NO: 95520 - protein, 9 aa, Homo Sapiens
VLSFLFHEH

SEQ ID NO: 95521 - protein, 9 aa, Homo Sapiens
KGGENVDTC

SEQ ID NO: 95522 - protein, 9 aa, Homo Sapiens
WLRRELERE

SEQ ID NO: 95523 - protein, 9 aa, Homo Sapiens
PILKLKSIE

SEQ ID NO: 95524 - protein, 9 aa, Homo Sapiens
CDVETVDRF

SEQ ID NO: 95525 - protein, 9 aa, Homo Sapiens
YNDGKKIEQ

SEQ ID NO: 95526 - protein, 9 aa, Homo Sapiens
HWLLNGFPR

SEQ ID NO: 95527 - protein, 9 aa, Homo Sapiens
YTIITMTTL

SEQ ID NO: 95528 - protein, 9 aa, Homo Sapiens
IAGNHYPWL

SEQ ID NO: 95529 - protein, 9 aa, Homo Sapiens
SLSENAEGE

SEQ ID NO: 95530 - protein, 9 aa, Homo Sapiens
RVVMSIRDG

SEQ ID NO: 95531 - protein, 9 aa, Homo Sapiens
SSSYSFLKE

SEQ ID NO: 95532 - protein, 9 aa, Homo Sapiens
LKGPKMLHL

SEQ ID NO: 95533 - protein, 9 aa, Homo Sapiens
SFLLLVEQW

SEQ ID NO: 95534 - protein, 9 aa, Homo Sapiens
PSQEEDFGD

SEQ ID NO: 95535 - protein, 9 aa, Homo Sapiens
FLKVYEKHF

SEQ ID NO: 95536 - protein, 9 aa, Homo Sapiens
HFSKPRFVY

SEQ ID NO: 95537 - protein, 9 aa, Homo Sapiens
DGDEVILIV

SEQ ID NO: 95538 - protein, 9 aa, Homo Sapiens
RWAQESVTE

SEQ ID NO: 95539 - protein, 9 aa, Homo Sapiens
QLPICGNHR

SEQ ID NO: 95540 - protein, 9 aa, Homo Sapiens
TFQVFVFEY

SEQ ID NO: 95541 - protein, 9 aa, Homo Sapiens
ETIVWKGFS

SEQ ID NO: 95542 - protein, 9 aa, Homo Sapiens
SIIAPPPVM

SEQ ID NO: 95543 - protein, 9 aa, Homo Sapiens
LAIPPPDYS

SEQ ID NO: 95544 - protein, 9 aa, Homo Sapiens
ALIDDGDEV

SEQ ID NO: 95545 - protein, 9 aa, Homo Sapiens
LPYCSPSCW

SEQ ID NO: 95546 - protein, 9 aa, Homo Sapiens
AFWYTIITM

SEQ ID NO: 95547 - protein, 9 aa, Homo Sapiens
WQKALSWWP

SEQ ID NO: 95548 - protein, 9 aa, Homo Sapiens
KTTKDSFRW

SEQ ID NO: 95549 - protein, 9 aa, Homo Sapiens
SQSAAVTPL

SEQ ID NO: 95550 - protein, 9 aa, Homo Sapiens
TVLQKMNKI

SEQ ID NO: 95551 - protein, 9 aa, Homo Sapiens
IRCRGAHRI

SEQ ID NO: 95552 - protein, 9 aa, Homo Sapiens
PDEIIHQKQ

SEQ ID NO: 95553 - protein, 9 aa, Homo Sapiens
SRIPDPRMH

SEQ ID NO: 95554 - protein, 9 aa, Homo Sapiens
RRGCCVVAL

SEQ ID NO: 95555 - protein, 9 aa, Homo Sapiens
PLPPACNSS

SEQ ID NO: 95556 - protein, 9 aa, Homo Sapiens
YNTCGSSNL

SEQ ID NO: 95557 - protein, 9 aa, Homo Sapiens
GLIPLPRLL

SEQ ID NO: 95558 - protein, 9 aa, Homo Sapiens
ITTKCNIHS

SEQ ID NO: 95559 - protein, 9 aa, Homo Sapiens
AFIVAAILN

SEQ ID NO: 95560 - protein, 9 aa, Homo Sapiens
LPVCCPKKI

SEQ ID NO: 95561 - protein, 9 aa, Homo Sapiens
FMFEVVDLR

SEQ ID NO: 95562 - protein, 9 aa, Homo Sapiens
TAQAHHRAE

SEQ ID NO: 95563 - protein, 9 aa, Homo Sapiens
ELKNLTEKE

SEQ ID NO: 95564 - protein, 9 aa, Homo Sapiens
SSEHDEGLC

SEQ ID NO: 95565 - protein, 9 aa, Homo Sapiens
PRVVMSIRD

SEQ ID NO: 95566 - protein, 9 aa, Homo Sapiens
QPILKLKSI

SEQ ID NO: 95567 - protein, 9 aa, Homo Sapiens
GKPQGPTPQ

SEQ ID NO: 95568 - protein, 9 aa, Homo Sapiens
KMNKIQAIA

SEQ ID NO: 95569 - protein, 9 aa, Homo Sapiens
ELQSRNSTL

SEQ ID NO: 95570 - protein, 9 aa, Homo Sapiens
MSFCPVGLS

SEQ ID NO: 95571 - protein, 9 aa, Homo Sapiens
AHHRAETLI

SEQ ID NO: 95572 - protein, 9 aa, Homo Sapiens
FSHGNMGAY

SEQ ID NO: 95573 - protein, 9 aa, Homo Sapiens
KVYEKHFAQ

SEQ ID NO: 95574 - protein, 9 aa, Homo Sapiens
TESRIPDPR

SEQ ID NO: 95575 - protein, 9 aa, Homo Sapiens
DPSVRLIWD

SEQ ID NO: 95576 - protein, 9 aa, Homo Sapiens
PNQPNRLLI

SEQ ID NO: 95577 - protein, 9 aa, Homo Sapiens
KQEGEQIYQ

SEQ ID NO: 95578 - protein, 9 aa, Homo Sapiens
ALVQLGHPC

SEQ ID NO: 95579 - protein, 9 aa, Homo Sapiens
LRELTTLLH

SEQ ID NO: 95580 - protein, 9 aa, Homo Sapiens
AMGALELQS

SEQ ID NO: 95581 - protein, 9 aa, Homo Sapiens
ERLRCIGSI

SEQ ID NO: 95582 - protein, 9 aa, Homo Sapiens
DTPSQEEDF

SEQ ID NO: 95583 - protein, 9 aa, Homo Sapiens
ASSLENLLE

SEQ ID NO: 95584 - protein, 9 aa, Homo Sapiens
YNIGALRRG

SEQ ID NO: 95585 - protein, 9 aa, Homo Sapiens
LTQDLKDHN

SEQ ID NO: 95586 - protein, 9 aa, Homo Sapiens
DYLPLGAQQ

SEQ ID NO: 95587 - protein, 9 aa, Homo Sapiens
CLTSECGWG

SEQ ID NO: 95588 - protein, 9 aa, Homo Sapiens
IFSHGNMGA

SEQ ID NO: 95589 - protein, 9 aa, Homo Sapiens
FMKQMNDAR

SEQ ID NO: 95590 - protein, 9 aa, Homo Sapiens
VGVNITKLC

SEQ ID NO: 95591 - protein, 9 aa, Homo Sapiens
NFMTDFVCK

SEQ ID NO: 95592 - protein, 9 aa, Homo Sapiens
WLIQIHNLL

SEQ ID NO: 95593 - protein, 9 aa, Homo Sapiens
LGTPLQKLE

SEQ ID NO: 95594 - protein, 9 aa, Homo Sapiens
KQQPKEPAL

SEQ ID NO: 95595 - protein, 9 aa, Homo Sapiens
VYSFLNDIS

SEQ ID NO: 95596 - protein, 9 aa, Homo Sapiens
SLWMLKPTS

SEQ ID NO: 95597 - protein, 9 aa, Homo Sapiens
LDEVVSQNQ

SEQ ID NO: 95598 - protein, 9 aa, Homo Sapiens
LQKICISCQ

SEQ ID NO: 95599 - protein, 9 aa, Homo Sapiens
LRAMPSPEA

SEQ ID NO: 95600 - protein, 9 aa, Homo Sapiens
TVMIADISP

SEQ ID NO: 95601 - protein, 9 aa, Homo Sapiens
SYSFLKEEI

SEQ ID NO: 95602 - protein, 9 aa, Homo Sapiens
GIKLHRWKV

SEQ ID NO: 95603 - protein, 9 aa, Homo Sapiens
RPVGQKALL

SEQ ID NO: 95604 - protein, 9 aa, Homo Sapiens
RRRSRSRPP

SEQ ID NO: 95605 - protein, 9 aa, Homo Sapiens
AQPGVPLRV

SEQ ID NO: 95606 - protein, 9 aa, Homo Sapiens
LSVLFQMIF

SEQ ID NO: 95607 - protein, 9 aa, Homo Sapiens
QDDAHMFCT

SEQ ID NO: 95608 - protein, 9 aa, Homo Sapiens
QHWLLNGFP

SEQ ID NO: 95609 - protein, 9 aa, Homo Sapiens
CLRQLHKHA

SEQ ID NO: 95610 - protein, 9 aa, Homo Sapiens
TEKKTTRFC

SEQ ID NO: 95611 - protein, 9 aa, Homo Sapiens
GQKALLYST

SEQ ID NO: 95612 - protein, 9 aa, Homo Sapiens
QIVPRGKSI

SEQ ID NO: 95613 - protein, 9 aa, Homo Sapiens
LAERTKNVC

SEQ ID NO: 95614 - protein, 9 aa, Homo Sapiens
GNAKMMAPP

SEQ ID NO: 95615 - protein, 9 aa, Homo Sapiens
TRICLADMV

SEQ ID NO: 95616 - protein, 9 aa, Homo Sapiens
FMENSKAIS

SEQ ID NO: 95617 - protein, 9 aa, Homo Sapiens
QLYLDLLSQ

SEQ ID NO: 95618 - protein, 9 aa, Homo Sapiens
FQMIFRFLF

SEQ ID NO: 95619 - protein, 9 aa, Homo Sapiens
FHPLTPLVA

SEQ ID NO: 95620 - protein, 9 aa, Homo Sapiens
GASCFWYVM

SEQ ID NO: 95621 - protein, 9 aa, Homo Sapiens
KGPKMLHLL

SEQ ID NO: 95622 - protein, 9 aa, Homo Sapiens
SCFWYVMVT

SEQ ID NO: 95623 - protein, 9 aa, Homo Sapiens
EHDEGLCFS

SEQ ID NO: 95624 - protein, 9 aa, Homo Sapiens
QPQHPDKAQ

SEQ ID NO: 95625 - protein, 9 aa, Homo Sapiens
LLAEMYFSH

SEQ ID NO: 95626 - protein, 9 aa, Homo Sapiens
HIDAVTGLS

SEQ ID NO: 95627 - protein, 9 aa, Homo Sapiens
YCFKEKSRK

SEQ ID NO: 95628 - protein, 9 aa, Homo Sapiens
QVTALEIPN

SEQ ID NO: 95629 - protein, 9 aa, Homo Sapiens
YVWGFSATL

SEQ ID NO: 95630 - protein, 9 aa, Homo Sapiens
TPSQEEDFG

SEQ ID NO: 95631 - protein, 9 aa, Homo Sapiens
VETVDRFNN

SEQ ID NO: 95632 - protein, 9 aa, Homo Sapiens
ASCTKVAPG

SEQ ID NO: 95633 - protein, 9 aa, Homo Sapiens
NITTGTYTM

SEQ ID NO: 95634 - protein, 9 aa, Homo Sapiens
RRNKRHPEP

SEQ ID NO: 95635 - protein, 9 aa, Homo Sapiens
HFSEVFVYL

SEQ ID NO: 95636 - protein, 9 aa, Homo Sapiens
FVYLKWFES

SEQ ID NO: 95637 - protein, 9 aa, Homo Sapiens
SEVFVYLKW

SEQ ID NO: 95638 - protein, 9 aa, Homo Sapiens
RCSLSVTLE

SEQ ID NO: 95639 - protein, 9 aa, Homo Sapiens
YFSHFSKPR

SEQ ID NO: 95640 - protein, 9 aa, Homo Sapiens
RTVMIADIS

SEQ ID NO: 95641 - protein, 9 aa, Homo Sapiens
AMPSPEARV

SEQ ID NO: 95642 - protein, 9 aa, Homo Sapiens
PQGQGFHDG

SEQ ID NO: 95643 - protein, 9 aa, Homo Sapiens
VTAHPVERS

SEQ ID NO: 95644 - protein, 9 aa, Homo Sapiens
CSKSSSPAS

SEQ ID NO: 95645 - protein, 9 aa, Homo Sapiens
DPQKVTYAQ

SEQ ID NO: 95646 - protein, 9 aa, Homo Sapiens
SYWACELIL

SEQ ID NO: 95647 - protein, 9 aa, Homo Sapiens
TRFCSLWML

SEQ ID NO: 95648 - protein, 9 aa, Homo Sapiens
AGTPITVSV

SEQ ID NO: 95649 - protein, 9 aa, Homo Sapiens
GVLWTLHTW

SEQ ID NO: 95650 - protein, 9 aa, Homo Sapiens
RGSDTAIKP

SEQ ID NO: 95651 - protein, 9 aa, Homo Sapiens
HRPGKSSAP

SEQ ID NO: 95652 - protein, 9 aa, Homo Sapiens
IYDKFQRAP

SEQ ID NO: 95653 - protein, 9 aa, Homo Sapiens
EKHKSYQCF

SEQ ID NO: 95654 - protein, 9 aa, Homo Sapiens
GKPTRKISA

SEQ ID NO: 95655 - protein, 9 aa, Homo Sapiens
GLYTFQKQE

SEQ ID NO: 95656 - protein, 9 aa, Homo Sapiens
TDCNGHLLN

SEQ ID NO: 95657 - protein, 9 aa, Homo Sapiens
KLEVSFSFA

SEQ ID NO: 95658 - protein, 9 aa, Homo Sapiens
GFHDGSFGP

SEQ ID NO: 95659 - protein, 9 aa, Homo Sapiens
GHQDPSKTA

SEQ ID NO: 95660 - protein, 9 aa, Homo Sapiens
SRSNAITSW

SEQ ID NO: 95661 - protein, 9 aa, Homo Sapiens
HDEGLCFSG

SEQ ID NO: 95662 - protein, 9 aa, Homo Sapiens
PEPFGHFLD

SEQ ID NO: 95663 - protein, 9 aa, Homo Sapiens
RKSREYKHV

SEQ ID NO: 95664 - protein, 9 aa, Homo Sapiens
PDNIKAVFR

SEQ ID NO: 95665 - protein, 9 aa, Homo Sapiens
ASLTGALVP

SEQ ID NO: 95666 - protein, 9 aa, Homo Sapiens
FSEVFVYLK

SEQ ID NO: 95667 - protein, 9 aa, Homo Sapiens
NFPISNLCF

SEQ ID NO: 95668 - protein, 9 aa, Homo Sapiens
TQDLKDHNA

SEQ ID NO: 95669 - protein, 9 aa, Homo Sapiens
HGLVAGGII

SEQ ID NO: 95670 - protein, 9 aa, Homo Sapiens
PISNLCFVG

SEQ ID NO: 95671 - protein, 9 aa, Homo Sapiens
PYKAQVIRA

SEQ ID NO: 95672 - protein, 9 aa, Homo Sapiens
YKTTKDSFR

SEQ ID NO: 95673 - protein, 9 aa, Homo Sapiens
TKFIRCRGA

SEQ ID NO: 95674 - protein, 9 aa, Homo Sapiens
TTCGRQFTS

SEQ ID NO: 95675 - protein, 9 aa, Homo Sapiens
EQGRSYKEF

SEQ ID NO: 95676 - protein, 9 aa, Homo Sapiens
ESAVKRTEK

SEQ ID NO: 95677 - protein, 9 aa, Homo Sapiens
ASKLTNHME

SEQ ID NO: 95678 - protein, 9 aa, Homo Sapiens
WAQESVTED

SEQ ID NO: 95679 - protein, 9 aa, Homo Sapiens
SSARTASAR

SEQ ID NO: 95680 - protein, 9 aa, Homo Sapiens
IVYSFLNDI

SEQ ID NO: 95681 - protein, 9 aa, Homo Sapiens
TDYVLESFR

SEQ ID NO: 95682 - protein, 9 aa, Homo Sapiens
YIDLPNEQA

SEQ ID NO: 95683 - protein, 9 aa, Homo Sapiens
KSRKALKEL

SEQ ID NO: 95684 - protein, 9 aa, Homo Sapiens
PPPDYSAAS

SEQ ID NO: 95685 - protein, 9 aa, Homo Sapiens
HNAGFEPLT

SEQ ID NO: 95686 - protein, 9 aa, Homo Sapiens
TTGTYTMHA

SEQ ID NO: 95687 - protein, 9 aa, Homo Sapiens
LHVEKLPNQ

SEQ ID NO: 95688 - protein, 9 aa, Homo Sapiens
VRWAQESVT

SEQ ID NO: 95689 - protein, 9 aa, Homo Sapiens
LKILEHHQQ

SEQ ID NO: 95690 - protein, 9 aa, Homo Sapiens
GVHRCSLSV

SEQ ID NO: 95691 - protein, 9 aa, Homo Sapiens
PTSTRSNRL

SEQ ID NO: 95692 - protein, 9 aa, Homo Sapiens
PGFFRNKIL

SEQ ID NO: 95693 - protein, 9 aa, Homo Sapiens
DCARGDQNI

SEQ ID NO: 95694 - protein, 9 aa, Homo Sapiens
SSICSCQSS

SEQ ID NO: 95695 - protein, 9 aa, Homo Sapiens
VFVFEYLLP

SEQ ID NO: 95696 - protein, 9 aa, Homo Sapiens
FCPVGLSLT

SEQ ID NO: 95697 - protein, 9 aa, Homo Sapiens
GLTYKTTKD

SEQ ID NO: 95698 - protein, 9 aa, Homo Sapiens
APPSSGSSR

SEQ ID NO: 95699 - protein, 9 aa, Homo Sapiens
ECTFIDFGM

SEQ ID NO: 95700 - protein, 9 aa, Homo Sapiens
SRKALKELY

SEQ ID NO: 95701 - protein, 9 aa, Homo Sapiens
VHKALRLDL

SEQ ID NO: 95702 - protein, 9 aa, Homo Sapiens
DSDEQDPQK

SEQ ID NO: 95703 - protein, 9 aa, Homo Sapiens
RRSRSRPPP

SEQ ID NO: 95704 - protein, 9 aa, Homo Sapiens
TSECGWGCM

SEQ ID NO: 95705 - protein, 9 aa, Homo Sapiens
SLSVTLEQA

SEQ ID NO: 95706 - protein, 9 aa, Homo Sapiens
WGHQDPSKT

SEQ ID NO: 95707 - protein, 9 aa, Homo Sapiens
PKMLHLLPA

SEQ ID NO: 95708 - protein, 9 aa, Homo Sapiens
NEDTKIDFS

SEQ ID NO: 95709 - protein, 9 aa, Homo Sapiens
NDETMYVES

SEQ ID NO: 95710 - protein, 9 aa, Homo Sapiens
EEPVSIPDK

SEQ ID NO: 95711 - protein, 9 aa, Homo Sapiens
RQSFASDSC

SEQ ID NO: 95712 - protein, 9 aa, Homo Sapiens
QCGKAFRGQ

SEQ ID NO: 95713 - protein, 9 aa, Homo Sapiens
GINDTRETC

SEQ ID NO: 95714 - protein, 9 aa, Homo Sapiens
FITAIYGAQ

SEQ ID NO: 95715 - protein, 9 aa, Homo Sapiens
AGIALRSLL

SEQ ID NO: 95716 - protein, 9 aa, Homo Sapiens
LGPAVDNDK

SEQ ID NO: 95717 - protein, 9 aa, Homo Sapiens
NGFPRTLGQ

SEQ ID NO: 95718 - protein, 9 aa, Homo Sapiens
MLKPTSTRS

SEQ ID NO: 95719 - protein, 9 aa, Homo Sapiens
SSLDRRFDS

SEQ ID NO: 95720 - protein, 9 aa, Homo Sapiens
ALLTERGAS

SEQ ID NO: 95721 - protein, 9 aa, Homo Sapiens
MELFKKPQD

SEQ ID NO: 95722 - protein, 9 aa, Homo Sapiens
QERARCPKF

SEQ ID NO: 95723 - protein, 9 aa, Homo Sapiens
PPKGEKVEE

SEQ ID NO: 95724 - protein, 9 aa, Homo Sapiens
WYTIITMTT

SEQ ID NO: 95725 - protein, 9 aa, Homo Sapiens
QPGVPLRVL

SEQ ID NO: 95726 - protein, 9 aa, Homo Sapiens
LSKFNCCRE

SEQ ID NO: 95727 - protein, 9 aa, Homo Sapiens
KNLTEKEKQ

SEQ ID NO: 95728 - protein, 9 aa, Homo Sapiens
YHNKLVKVP

SEQ ID NO: 95729 - protein, 9 aa, Homo Sapiens
GIALRSLLC

SEQ ID NO: 95730 - protein, 9 aa, Homo Sapiens
KSREYKHVR

SEQ ID NO: 95731 - protein, 9 aa, Homo Sapiens
IRLWLLLRF

SEQ ID NO: 95732 - protein, 9 aa, Homo Sapiens
CTFIDFGMD

SEQ ID NO: 95733 - protein, 9 aa, Homo Sapiens
DGEERPAAE

SEQ ID NO: 95734 - protein, 9 aa, Homo Sapiens
FVLKITDYV

SEQ ID NO: 95735 - protein, 9 aa, Homo Sapiens
RNGRWQKAL

SEQ ID NO: 95736 - protein, 9 aa, Homo Sapiens
PQKVTYAQL

SEQ ID NO: 95737 - protein, 9 aa, Homo Sapiens
IDDGDEVIL

SEQ ID NO: 95738 - protein, 9 aa, Homo Sapiens
IPPPDYSAA

SEQ ID NO: 95739 - protein, 9 aa, Homo Sapiens
CGPNVINHN

SEQ ID NO: 95740 - protein, 9 aa, Homo Sapiens
KCLRQLHKH

SEQ ID NO: 95741 - protein, 9 aa, Homo Sapiens
VQTPSPRRT

SEQ ID NO: 95742 - protein, 9 aa, Homo Sapiens
FLFLYFLCK

SEQ ID NO: 95743 - protein, 9 aa, Homo Sapiens
FSYWACELI

SEQ ID NO: 95744 - protein, 9 aa, Homo Sapiens
LWLGQNEFN

SEQ ID NO: 95745 - protein, 9 aa, Homo Sapiens
KRVPGARGQ

SEQ ID NO: 95746 - protein, 9 aa, Homo Sapiens
TWTSEWAVP

SEQ ID NO: 95747 - protein, 9 aa, Homo Sapiens
SCTKVAPGQ

SEQ ID NO: 95748 - protein, 9 aa, Homo Sapiens
LADMVSLCS

SEQ ID NO: 95749 - protein, 9 aa, Homo Sapiens
CYSLSENAE

SEQ ID NO: 95750 - protein, 9 aa, Homo Sapiens
GSSLFFEDF

SEQ ID NO: 95751 - protein, 9 aa, Homo Sapiens
SSGTSSICS

SEQ ID NO: 95752 - protein, 9 aa, Homo Sapiens
MSRENKEQY

SEQ ID NO: 95753 - protein, 9 aa, Homo Sapiens
SNLTWPPAI

SEQ ID NO: 95754 - protein, 9 aa, Homo Sapiens
RHGFMFEVV

SEQ ID NO: 95755 - protein, 9 aa, Homo Sapiens
EVKFKHFLL

SEQ ID NO: 95756 - protein, 9 aa, Homo Sapiens
EDHIDAVTG

SEQ ID NO: 95757 - protein, 9 aa, Homo Sapiens
SSGVHRCSL

SEQ ID NO: 95758 - protein, 9 aa, Homo Sapiens
TVSVLRCVN

SEQ ID NO: 95759 - protein, 9 aa, Homo Sapiens
IDIRSIGVL

SEQ ID NO: 95760 - protein, 9 aa, Homo Sapiens
LTTLLHKLQ

SEQ ID NO: 95761 - protein, 9 aa, Homo Sapiens
NTIQALIDD

SEQ ID NO: 95762 - protein, 9 aa, Homo Sapiens
NKRHPEPFG

SEQ ID NO: 95763 - protein, 9 aa, Homo Sapiens
RCPKFADIV

SEQ ID NO: 95764 - protein, 9 aa, Homo Sapiens
CVWVGNPPF

SEQ ID NO: 95765 - protein, 9 aa, Homo Sapiens
SLLCGSPPP

SEQ ID NO: 95766 - protein, 9 aa, Homo Sapiens
LHGLVAGGI

SEQ ID NO: 95767 - protein, 9 aa, Homo Sapiens
QNEFNFMTD

SEQ ID NO: 95768 - protein, 9 aa, Homo Sapiens
ELSKRGPLS

SEQ ID NO: 95769 - protein, 9 aa, Homo Sapiens
KEKSRKALK

SEQ ID NO: 95770 - protein, 9 aa, Homo Sapiens
NQPNRLLIL

SEQ ID NO: 95771 - protein, 9 aa, Homo Sapiens
ASPSRDVSH

SEQ ID NO: 95772 - protein, 9 aa, Homo Sapiens
SIASVANTA

SEQ ID NO: 95773 - protein, 9 aa, Homo Sapiens
GQGQSAGSR

SEQ ID NO: 95774 - protein, 9 aa, Homo Sapiens
LNGFPRTLG

SEQ ID NO: 95775 - protein, 9 aa, Homo Sapiens
GLCFSGKVQ

SEQ ID NO: 95776 - protein, 9 aa, Homo Sapiens
KAVFRKGKV

SEQ ID NO: 95777 - protein, 9 aa, Homo Sapiens
GGSWPLQVT

SEQ ID NO: 95778 - protein, 9 aa, Homo Sapiens
FIVAAILNI

SEQ ID NO: 95779 - protein, 9 aa, Homo Sapiens
GTVHKDTTI

SEQ ID NO: 95780 - protein, 9 aa, Homo Sapiens
TRRRSRSRP

SEQ ID NO: 95781 - protein, 9 aa, Homo Sapiens
RQNWLETTI

SEQ ID NO: 95782 - protein, 9 aa, Homo Sapiens
WQQERARCP

SEQ ID NO: 95783 - protein, 9 aa, Homo Sapiens
MGALELQSR

SEQ ID NO: 95784 - protein, 9 aa, Homo Sapiens
HMELFKKPQ

SEQ ID NO: 95785 - protein, 9 aa, Homo Sapiens
YEVCSRTIG

SEQ ID NO: 95786 - protein, 9 aa, Homo Sapiens
AGNHYPWLI

SEQ ID NO: 95787 - protein, 9 aa, Homo Sapiens
GDPQGQGFH

SEQ ID NO: 95788 - protein, 9 aa, Homo Sapiens
EPLTDLVFA

SEQ ID NO: 95789 - protein, 9 aa, Homo Sapiens
QPLGALGGE

SEQ ID NO: 95790 - protein, 9 aa, Homo Sapiens
EEEEKVSEP

SEQ ID NO: 95791 - protein, 9 aa, Homo Sapiens
MTEIDRIAH

SEQ ID NO: 95792 - protein, 9 aa, Homo Sapiens
KTSLFKEDK

SEQ ID NO: 95793 - protein, 9 aa, Homo Sapiens
SDVTYTEDY

SEQ ID NO: 95794 - protein, 9 aa, Homo Sapiens
DVFVQTPSP

SEQ ID NO: 95795 - protein, 9 aa, Homo Sapiens
LVAGNGLCL

SEQ ID NO: 95796 - protein, 9 aa, Homo Sapiens
PVSIPDKPN

SEQ ID NO: 95797 - protein, 9 aa, Homo Sapiens
NKKLSEQES

SEQ ID NO: 95798 - protein, 9 aa, Homo Sapiens
EWLRRELER

SEQ ID NO: 95799 - protein, 9 aa, Homo Sapiens
CQSSGTSSI

SEQ ID NO: 95800 - protein, 9 aa, Homo Sapiens
DRIAHNIIK

SEQ ID NO: 95801 - protein, 9 aa, Homo Sapiens
VFLREEWPA

SEQ ID NO: 95802 - protein, 9 aa, Homo Sapiens
SPVIQGNAK

SEQ ID NO: 95803 - protein, 9 aa, Homo Sapiens
SWNSHHIRD

SEQ ID NO: 95804 - protein, 9 aa, Homo Sapiens
RGQPLGALG

SEQ ID NO: 95805 - protein, 9 aa, Homo Sapiens
SDFEWLRRE

SEQ ID NO: 95806 - protein, 9 aa, Homo Sapiens
LELQSRNST

SEQ ID NO: 95807 - protein, 9 aa, Homo Sapiens
GDAGNYSCL

SEQ ID NO: 95808 - protein, 9 aa, Homo Sapiens
TTKCNIHSS

SEQ ID NO: 95809 - protein, 9 aa, Homo Sapiens
IECTFIDFG

SEQ ID NO: 95810 - protein, 9 aa, Homo Sapiens
VPLRVLGQV

SEQ ID NO: 95811 - protein, 9 aa, Homo Sapiens
ENAEGEGLL

SEQ ID NO: 95812 - protein, 9 aa, Homo Sapiens
PSRDVSHMG

SEQ ID NO: 95813 - protein, 9 aa, Homo Sapiens
YRIHGVIAQ

SEQ ID NO: 95814 - protein, 9 aa, Homo Sapiens
FLKEEIIYE

SEQ ID NO: 95815 - protein, 9 aa, Homo Sapiens
LKSIEEVIK

SEQ ID NO: 95816 - protein, 9 aa, Homo Sapiens
HRAETLIFS

SEQ ID NO: 95817 - protein, 9 aa, Homo Sapiens
FEVQPQHPD

SEQ ID NO: 95818 - protein, 9 aa, Homo Sapiens
ALRTGAFQP

SEQ ID NO: 95819 - protein, 9 aa, Homo Sapiens
EIDRIAHNI

SEQ ID NO: 95820 - protein, 9 aa, Homo Sapiens
ADNSAPGKP

SEQ ID NO: 95821 - protein, 9 aa, Homo Sapiens
AGQGQSAGS

SEQ ID NO: 95822 - protein, 9 aa, Homo Sapiens
GSPFMAKVT

SEQ ID NO: 95823 - protein, 9 aa, Homo Sapiens
VEEDHIDAV

SEQ ID NO: 95824 - protein, 9 aa, Homo Sapiens
LNIPSAEGR

SEQ ID NO: 95825 - protein, 9 aa, Homo Sapiens
KIYIDLPNE

SEQ ID NO: 95826 - protein, 9 aa, Homo Sapiens
VLIRRPHLR

SEQ ID NO: 95827 - protein, 9 aa, Homo Sapiens
CPVGLSLTA

SEQ ID NO: 95828 - protein, 9 aa, Homo Sapiens
HKLQARVDQ

SEQ ID NO: 95829 - protein, 9 aa, Homo Sapiens
GAQQDAITL

SEQ ID NO: 95830 - protein, 9 aa, Homo Sapiens
RAKLLLENR

SEQ ID NO: 95831 - protein, 9 aa, Homo Sapiens
PAAFWYTII

SEQ ID NO: 95832 - protein, 9 aa, Homo Sapiens
IGQAAAESS

SEQ ID NO: 95833 - protein, 9 aa, Homo Sapiens
CCPKKIRHK

SEQ ID NO: 95834 - protein, 9 aa, Homo Sapiens
LTNHMELFK

SEQ ID NO: 95835 - protein, 9 aa, Homo Sapiens
LPGGCLTSE

SEQ ID NO: 95836 - protein, 9 aa, Homo Sapiens
AVKRTEKKT

SEQ ID NO: 95837 - protein, 9 aa, Homo Sapiens
IPLSECKIQ

SEQ ID NO: 95838 - protein, 9 aa, Homo Sapiens
EGLCFSGKV

SEQ ID NO: 95839 - protein, 9 aa, Homo Sapiens
EERPAAEEQ

SEQ ID NO: 95840 - protein, 9 aa, Homo Sapiens
IRRPHLRYQ

SEQ ID NO: 95841 - protein, 9 aa, Homo Sapiens
KEGIECTFI

SEQ ID NO: 95842 - protein, 9 aa, Homo Sapiens
TISRSNAIT

SEQ ID NO: 95843 - protein, 9 aa, Homo Sapiens
SAAVTPLST

SEQ ID NO: 95844 - protein, 9 aa, Homo Sapiens
PNVINHNFC

SEQ ID NO: 95845 - protein, 9 aa, Homo Sapiens
MFCTTDQLE

SEQ ID NO: 95846 - protein, 9 aa, Homo Sapiens
GTPLQKLEV

SEQ ID NO: 95847 - protein, 9 aa, Homo Sapiens
HPVERSAFP

SEQ ID NO: 95848 - protein, 9 aa, Homo Sapiens
ITKLCLGSV

SEQ ID NO: 95849 - protein, 9 aa, Homo Sapiens
TPLQKLEVS

SEQ ID NO: 95850 - protein, 9 aa, Homo Sapiens
FNCCRETVE

SEQ ID NO: 95851 - protein, 9 aa, Homo Sapiens
NRSLEQQNT

SEQ ID NO: 95852 - protein, 9 aa, Homo Sapiens
ELGPAVDND

SEQ ID NO: 95853 - protein, 9 aa, Homo Sapiens
VIQGNAKMM

SEQ ID NO: 95854 - protein, 9 aa, Homo Sapiens
SHFSKPRFV

SEQ ID NO: 95855 - protein, 9 aa, Homo Sapiens
TGTQSSHAS

SEQ ID NO: 95856 - protein, 9 aa, Homo Sapiens
LLLRVYVRG

SEQ ID NO: 95857 - protein, 9 aa, Homo Sapiens
LLRFEDQDC

SEQ ID NO: 95858 - protein, 9 aa, Homo Sapiens
VKLSPLQDR

SEQ ID NO: 95859 - protein, 9 aa, Homo Sapiens
KRKSREYKH

SEQ ID NO: 95860 - protein, 9 aa, Homo Sapiens
PHGVVVHPL

SEQ ID NO: 95861 - protein, 9 aa, Homo Sapiens
STAKWASSL

SEQ ID NO: 95862 - protein, 9 aa, Homo Sapiens
FLSVLFQMI

SEQ ID NO: 95863 - protein, 9 aa, Homo Sapiens
NRAVIHYRN

SEQ ID NO: 95864 - protein, 9 aa, Homo Sapiens
LDSTISRSN

SEQ ID NO: 95865 - protein, 9 aa, Homo Sapiens
DDAHMFCTT

SEQ ID NO: 95866 - protein, 9 aa, Homo Sapiens
FMEEPVSIP

SEQ ID NO: 95867 - protein, 9 aa, Homo Sapiens
PGKPTRKIS

SEQ ID NO: 95868 - protein, 9 aa, Homo Sapiens
VPAADMGPS

SEQ ID NO: 95869 - protein, 9 aa, Homo Sapiens
TTRFCSLWM

SEQ ID NO: 95870 - protein, 9 aa, Homo Sapiens
RFCSLWMLK

SEQ ID NO: 95871 - protein, 9 aa, Homo Sapiens
PLRVLGQVV

SEQ ID NO: 95872 - protein, 9 aa, Homo Sapiens
NFCDLVPLL

SEQ ID NO: 95873 - protein, 9 aa, Homo Sapiens
TKIDFSEFL

SEQ ID NO: 95874 - protein, 9 aa, Homo Sapiens
WIGLTYKTT

SEQ ID NO: 95875 - protein, 9 aa, Homo Sapiens
FFMMAAMLS

SEQ ID NO: 95876 - protein, 9 aa, Homo Sapiens
EMYFSHFSK

SEQ ID NO: 95877 - protein, 9 aa, Homo Sapiens
CWQQERARC

SEQ ID NO: 95878 - protein, 9 aa, Homo Sapiens
IQGNAKMMA

SEQ ID NO: 95879 - protein, 9 aa, Homo Sapiens
QDCARGDQN

SEQ ID NO: 95880 - protein, 9 aa, Homo Sapiens
NSRTVMIAD

SEQ ID NO: 95881 - protein, 9 aa, Homo Sapiens
ISVSQVKQQ

SEQ ID NO: 95882 - protein, 9 aa, Homo Sapiens
AIPPPDYSA

SEQ ID NO: 95883 - protein, 9 aa, Homo Sapiens
MTTCGRQFT

SEQ ID NO: 95884 - protein, 9 aa, Homo Sapiens
NPPFTLTWT

SEQ ID NO: 95885 - protein, 9 aa, Homo Sapiens
QSDGEERPA

SEQ ID NO: 95886 - protein, 9 aa, Homo Sapiens
LSGNSPKTW

SEQ ID NO: 95887 - protein, 9 aa, Homo Sapiens
ASVANTAEE

SEQ ID NO: 95888 - protein, 9 aa, Homo Sapiens
TSTDCNGHL

SEQ ID NO: 95889 - protein, 9 aa, Homo Sapiens
EREPTPEEN

SEQ ID NO: 95890 - protein, 9 aa, Homo Sapiens
NSPKTWTSE

SEQ ID NO: 95891 - protein, 9 aa, Homo Sapiens
GVNITKLCL

SEQ ID NO: 95892 - protein, 9 aa, Homo Sapiens
LGYRIHGVI

SEQ ID NO: 95893 - protein, 9 aa, Homo Sapiens
QDDPLAERT

SEQ ID NO: 95894 - protein, 9 aa, Homo Sapiens
VSEPEVGAA

SEQ ID NO: 95895 - protein, 9 aa, Homo Sapiens
VTTAASSLQ

SEQ ID NO: 95896 - protein, 9 aa, Homo Sapiens
SQEEDFGDP

SEQ ID NO: 95897 - protein, 9 aa, Homo Sapiens
PVCCPKKIR

SEQ ID NO: 95898 - protein, 9 aa, Homo Sapiens
QHPDKAQIP

SEQ ID NO: 95899 - protein, 9 aa, Homo Sapiens
SLVPTLSII

SEQ ID NO: 95900 - protein, 9 aa, Homo Sapiens
LLPALSGLV

SEQ ID NO: 95901 - protein, 9 aa, Homo Sapiens
VLESFRDLD

SEQ ID NO: 95902 - protein, 9 aa, Homo Sapiens
KVTAHPVER

SEQ ID NO: 95903 - protein, 9 aa, Homo Sapiens
EYKHVRRDL

SEQ ID NO: 95904 - protein, 9 aa, Homo Sapiens
SLFKEDKED

SEQ ID NO: 95905 - protein, 9 aa, Homo Sapiens
CARGDQNIA

SEQ ID NO: 95906 - protein, 9 aa, Homo Sapiens
STLSSKGGE

SEQ ID NO: 95907 - protein, 9 aa, Homo Sapiens
TPITVSVLR

SEQ ID NO: 95908 - protein, 9 aa, Homo Sapiens
QETVAPPEP

SEQ ID NO: 95909 - protein, 9 aa, Homo Sapiens
LTVEWSARS

SEQ ID NO: 95910 - protein, 9 aa, Homo Sapiens
YFSPSQPQN

SEQ ID NO: 95911 - protein, 9 aa, Homo Sapiens
KGEKVEERE

SEQ ID NO: 95912 - protein, 9 aa, Homo Sapiens
KGFSPTTVN

SEQ ID NO: 95913 - protein, 9 aa, Homo Sapiens
AAFWYTIIT

SEQ ID NO: 95914 - protein, 9 aa, Homo Sapiens
SKFNCCRET

SEQ ID NO: 95915 - protein, 9 aa, Homo Sapiens
QEREPTPEE

SEQ ID NO: 95916 - protein, 9 aa, Homo Sapiens
TERLNKKLS

SEQ ID NO: 95917 - protein, 9 aa, Homo Sapiens
IGVPIVVVR

SEQ ID NO: 95918 - protein, 9 aa, Homo Sapiens
KNEDTKIDF

SEQ ID NO: 95919 - protein, 9 aa, Homo Sapiens
CETIVWKGF

SEQ ID NO: 95920 - protein, 9 aa, Homo Sapiens
SAGSRTSRR

SEQ ID NO: 95921 - protein, 9 aa, Homo Sapiens
RICLADMVS

SEQ ID NO: 95922 - protein, 9 aa, Homo Sapiens
GAQLQSDVT

SEQ ID NO: 95923 - protein, 9 aa, Homo Sapiens
GQGFHDGSF

SEQ ID NO: 95924 - protein, 9 aa, Homo Sapiens
VIKEKLTQD

SEQ ID NO: 95925 - protein, 9 aa, Homo Sapiens
FCAPVIERL

SEQ ID NO: 95926 - protein, 9 aa, Homo Sapiens
RSRPPPVTR

SEQ ID NO: 95927 - protein, 9 aa, Homo Sapiens
SITTKCNIH

SEQ ID NO: 95928 - protein, 9 aa, Homo Sapiens
LSAFQPGFF

SEQ ID NO: 95929 - protein, 9 aa, Homo Sapiens
SPLQDRLVV

SEQ ID NO: 95930 - protein, 9 aa, Homo Sapiens
AVPAADMGP

SEQ ID NO: 95931 - protein, 9 aa, Homo Sapiens
SAFQPGFFR

SEQ ID NO: 95932 - protein, 9 aa, Homo Sapiens
MKQMNDARH

SEQ ID NO: 95933 - protein, 9 aa, Homo Sapiens
DRVAIMVSE

SEQ ID NO: 95934 - protein, 9 aa, Homo Sapiens
TAASSLQTS

SEQ ID NO: 95935 - protein, 9 aa, Homo Sapiens
MHAQKEHLY

SEQ ID NO: 95936 - protein, 9 aa, Homo Sapiens
VDSLPASLT

SEQ ID NO: 95937 - protein, 9 aa, Homo Sapiens
LVPTLSIIA

SEQ ID NO: 95938 - protein, 9 aa, Homo Sapiens
QLGHPCDCL

SEQ ID NO: 95939 - protein, 9 aa, Homo Sapiens
PTPQGGNQP

SEQ ID NO: 95940 - protein, 9 aa, Homo Sapiens
ENKEQYQVV

SEQ ID NO: 95941 - protein, 9 aa, Homo Sapiens
DKSYENVLS

SEQ ID NO: 95942 - protein, 9 aa, Homo Sapiens
AEVDVFLRE

SEQ ID NO: 95943 - protein, 9 aa, Homo Sapiens
DEIIHQKQK

SEQ ID NO: 95944 - protein, 9 aa, Homo Sapiens
SQAGQGQSA

SEQ ID NO: 95945 - protein, 9 aa, Homo Sapiens
KLLLENRSL

SEQ ID NO: 95946 - protein, 9 aa, Homo Sapiens
LPYKAQVIR

SEQ ID NO: 95947 - protein, 9 aa, Homo Sapiens
LRVYVRGRL

SEQ ID NO: 95948 - protein, 9 aa, Homo Sapiens
YFLCKSFCF

SEQ ID NO: 95949 - protein, 9 aa, Homo Sapiens
CKSFCFLSF

SEQ ID NO: 95950 - protein, 9 aa, Homo Sapiens
SMKKLQKIC

SEQ ID NO: 95951 - protein, 9 aa, Homo Sapiens
PYFSPSQPQ

SEQ ID NO: 95952 - protein, 9 aa, Homo Sapiens
FRINVGLHG

SEQ ID NO: 95953 - protein, 9 aa, Homo Sapiens
TGTYTMHAQ

SEQ ID NO: 95954 - protein, 9 aa, Homo Sapiens
KMLHLLPAL

SEQ ID NO: 95955 - protein, 9 aa, Homo Sapiens
ITSTDCNGH

SEQ ID NO: 95956 - protein, 9 aa, Homo Sapiens
IPLPRLLAS

SEQ ID NO: 95957 - protein, 9 aa, Homo Sapiens
SWPLQVTAL

SEQ ID NO: 95958 - protein, 9 aa, Homo Sapiens
FLSKFNCCR

SEQ ID NO: 95959 - protein, 9 aa, Homo Sapiens
LPICGNHRL

SEQ ID NO: 95960 - protein, 9 aa, Homo Sapiens
VIHYRNDET

SEQ ID NO: 95961 - protein, 9 aa, Homo Sapiens
TEIDRIAHN

SEQ ID NO: 95962 - protein, 9 aa, Homo Sapiens
MAKVTGPRL

SEQ ID NO: 95963 - protein, 9 aa, Homo Sapiens
NIPSAEGRN

SEQ ID NO: 95964 - protein, 9 aa, Homo Sapiens
LGLISYCSY

SEQ ID NO: 95965 - protein, 9 aa, Homo Sapiens
LQLPICGNH

SEQ ID NO: 95966 - protein, 9 aa, Homo Sapiens
RPAAEEQLL

SEQ ID NO: 95967 - protein, 9 aa, Homo Sapiens
VWKGFSPTT

SEQ ID NO: 95968 - protein, 9 aa, Homo Sapiens
VKSLGINDT

SEQ ID NO: 95969 - protein, 9 aa, Homo Sapiens
LDPILMFFM

SEQ ID NO: 95970 - protein, 9 aa, Homo Sapiens
QPKEPALSM

SEQ ID NO: 95971 - protein, 9 aa, Homo Sapiens
NIKAVFRKG

SEQ ID NO: 95972 - protein, 9 aa, Homo Sapiens
LQKMNKIQA

SEQ ID NO: 95973 - protein, 9 aa, Homo Sapiens
VFEYLLPDK

SEQ ID NO: 95974 - protein, 9 aa, Homo Sapiens
GEGLYTFQK

SEQ ID NO: 95975 - protein, 9 aa, Homo Sapiens
VGGRQMSFC

SEQ ID NO: 95976 - protein, 9 aa, Homo Sapiens
RAPPSSGSS

SEQ ID NO: 95977 - protein, 9 aa, Homo Sapiens
SRSRPPPVT

SEQ ID NO: 95978 - protein, 9 aa, Homo Sapiens
TPQKEEQET

SEQ ID NO: 95979 - protein, 9 aa, Homo Sapiens
SDSCSKSSS

SEQ ID NO: 95980 - protein, 9 aa, Homo Sapiens
SFASDSCSK

SEQ ID NO: 95981 - protein, 9 aa, Homo Sapiens
NIGALRRGC

SEQ ID NO: 95982 - protein, 9 aa, Homo Sapiens
VCPLKHFVL

SEQ ID NO: 95983 - protein, 9 aa, Homo Sapiens
RVHKALRLD

SEQ ID NO: 95984 - protein, 9 aa, Homo Sapiens
DGIKLHRWK

SEQ ID NO: 95985 - protein, 9 aa, Homo Sapiens
QPAEASVNP

SEQ ID NO: 95986 - protein, 9 aa, Homo Sapiens
CPKKIRHKS

SEQ ID NO: 95987 - protein, 9 aa, Homo Sapiens
NAGFEPLTD

SEQ ID NO: 95988 - protein, 9 aa, Homo Sapiens
DEQDPQKVT

SEQ ID NO: 95989 - protein, 9 aa, Homo Sapiens
WKGFSPTTV

SEQ ID NO: 95990 - protein, 9 aa, Homo Sapiens
MNKIQAIAA

SEQ ID NO: 95991 - protein, 9 aa, Homo Sapiens
LPASLTGAL

SEQ ID NO: 95992 - protein, 9 aa, Homo Sapiens
VPRGKSIKR

SEQ ID NO: 95993 - protein, 9 aa, Homo Sapiens
HNFCDLVPL

SEQ ID NO: 95994 - protein, 9 aa, Homo Sapiens
ALRRGCCVV

SEQ ID NO: 95995 - protein, 9 aa, Homo Sapiens
VLRCVNHRQ

SEQ ID NO: 95996 - protein, 9 aa, Homo Sapiens
ICISCQTSF

SEQ ID NO: 95997 - protein, 9 aa, Homo Sapiens
RNKRHPEPF

SEQ ID NO: 95998 - protein, 9 aa, Homo Sapiens
SSGSSRQNW

SEQ ID NO: 95999 - protein, 9 aa, Homo Sapiens
SEKNSKQEK

SEQ ID NO: 96000 - protein, 9 aa, Homo Sapiens
TVDRFNNYR

SEQ ID NO: 96001 - protein, 9 aa, Homo Sapiens
GPAVDNDKE

SEQ ID NO: 96002 - protein, 9 aa, Homo Sapiens
VSVLRCVNH

SEQ ID NO: 96003 - protein, 9 aa, Homo Sapiens
HNLLQVSVL

SEQ ID NO: 96004 - protein, 9 aa, Homo Sapiens
GHAMGASCF

SEQ ID NO: 96005 - protein, 9 aa, Homo Sapiens
SDTAIKPLP

SEQ ID NO: 96006 - protein, 9 aa, Homo Sapiens
PSVRLIWDL

SEQ ID NO: 96007 - protein, 9 aa, Homo Sapiens
AMGASCFWY

SEQ ID NO: 96008 - protein, 9 aa, Homo Sapiens
LQLYLDLLS

SEQ ID NO: 96009 - protein, 9 aa, Homo Sapiens
PPLTPYFSP

SEQ ID NO: 96010 - protein, 9 aa, Homo Sapiens
TIGQAAAES

SEQ ID NO: 96011 - protein, 9 aa, Homo Sapiens
YCSYWKEVL

SEQ ID NO: 96012 - protein, 9 aa, Homo Sapiens
KVTYAQLDH

SEQ ID NO: 96013 - protein, 9 aa, Homo Sapiens
SDEQDPQKV

SEQ ID NO: 96014 - protein, 9 aa, Homo Sapiens
VLLPYKAQV

SEQ ID NO: 96015 - protein, 9 aa, Homo Sapiens
AKIFMENSK

SEQ ID NO: 96016 - protein, 9 aa, Homo Sapiens
ESKHRPGKS

SEQ ID NO: 96017 - protein, 9 aa, Homo Sapiens
TALEIPNKH

SEQ ID NO: 96018 - protein, 9 aa, Homo Sapiens
KMMAPPTHA

SEQ ID NO: 96019 - protein, 9 aa, Homo Sapiens
ATERLNKKL

SEQ ID NO: 96020 - protein, 9 aa, Homo Sapiens
LCLGSVVVE

SEQ ID NO: 96021 - protein, 9 aa, Homo Sapiens
GSSNLTWPP

SEQ ID NO: 96022 - protein, 9 aa, Homo Sapiens
HASCTKVAP

SEQ ID NO: 96023 - protein, 9 aa, Homo Sapiens
RVAIMVSER

SEQ ID NO: 96024 - protein, 9 aa, Homo Sapiens
QSSGTSSIC

SEQ ID NO: 96025 - protein, 9 aa, Homo Sapiens
QALIDDGDE

SEQ ID NO: 96026 - protein, 9 aa, Homo Sapiens
TYEVCSRTI

SEQ ID NO: 96027 - protein, 9 aa, Homo Sapiens
VWVGNPPFT

SEQ ID NO: 96028 - protein, 9 aa, Homo Sapiens
AQVIRALAK

SEQ ID NO: 96029 - protein, 9 aa, Homo Sapiens
TFSMEKHKS

SEQ ID NO: 96030 - protein, 9 aa, Homo Sapiens
HRWKVQVTN

SEQ ID NO: 96031 - protein, 9 aa, Homo Sapiens
PPRVVMSIR

SEQ ID NO: 96032 - protein, 9 aa, Homo Sapiens
PAKVLCNIE

SEQ ID NO: 96033 - protein, 9 aa, Homo Sapiens
NDGKKIEQV

SEQ ID NO: 96034 - protein, 9 aa, Homo Sapiens
SKATERLNK

SEQ ID NO: 96035 - protein, 9 aa, Homo Sapiens
GNPPFTLTW

SEQ ID NO: 96036 - protein, 9 aa, Homo Sapiens
TKCNIHSSV

SEQ ID NO: 96037 - protein, 9 aa, Homo Sapiens
LTPLVAGNG

SEQ ID NO: 96038 - protein, 9 aa, Homo Sapiens
DAGNYSCLY

SEQ ID NO: 96039 - protein, 9 aa, Homo Sapiens
RTIGQAAAE

SEQ ID NO: 96040 - protein, 9 aa, Homo Sapiens
TERGASLEE

SEQ ID NO: 96041 - protein, 9 aa, Homo Sapiens
EKLPNQPNR

SEQ ID NO: 96042 - protein, 9 aa, Homo Sapiens
AVTPLSTTS

SEQ ID NO: 96043 - protein, 9 aa, Homo Sapiens
QGQGFHDGS

SEQ ID NO: 96044 - protein, 9 aa, Homo Sapiens
SEEQKRVTV

SEQ ID NO: 96045 - protein, 9 aa, Homo Sapiens
QIHNLLQVS

SEQ ID NO: 96046 - protein, 9 aa, Homo Sapiens
HVEKLPNQP

SEQ ID NO: 96047 - protein, 9 aa, Homo Sapiens
RENKEQYQV

SEQ ID NO: 96048 - protein, 9 aa, Homo Sapiens
KQSSSYSFL

SEQ ID NO: 96049 - protein, 9 aa, Homo Sapiens
FNFMTDFVC

SEQ ID NO: 96050 - protein, 9 aa, Homo Sapiens
LHRWKVQVT

SEQ ID NO: 96051 - protein, 9 aa, Homo Sapiens
SEHDEGLCF

SEQ ID NO: 96052 - protein, 9 aa, Homo Sapiens
LRVLGQVVE

SEQ ID NO: 96053 - protein, 9 aa, Homo Sapiens
GDSLDVFVQ

SEQ ID NO: 96054 - protein, 9 aa, Homo Sapiens
RFLSVLFQM

SEQ ID NO: 96055 - protein, 9 aa, Homo Sapiens
KKTSLFKED

SEQ ID NO: 96056 - protein, 9 aa, Homo Sapiens
KPADTPSQE

SEQ ID NO: 96057 - protein, 9 aa, Homo Sapiens
IVGSPFMAK

SEQ ID NO: 96058 - protein, 9 aa, Homo Sapiens
FCQRHGFMF

SEQ ID NO: 96059 - protein, 9 aa, Homo Sapiens
INVGLHGLV

SEQ ID NO: 96060 - protein, 9 aa, Homo Sapiens
HVELAALLT

SEQ ID NO: 96061 - protein, 9 aa, Homo Sapiens
LYFLCKSFC

SEQ ID NO: 96062 - protein, 9 aa, Homo Sapiens
YLLPDKVEK

SEQ ID NO: 96063 - protein, 9 aa, Homo Sapiens
EEQKRVTVI

SEQ ID NO: 96064 - protein, 9 aa, Homo Sapiens
PFTNGSSLF

SEQ ID NO: 96065 - protein, 9 aa, Homo Sapiens
ADISPASSA

SEQ ID NO: 96066 - protein, 9 aa, Homo Sapiens
AHPVERSAF

SEQ ID NO: 96067 - protein, 9 aa, Homo Sapiens
KKPIYDTIS

SEQ ID NO: 96068 - protein, 9 aa, Homo Sapiens
EQETVAPPE

SEQ ID NO: 96069 - protein, 9 aa, Homo Sapiens
TPGLIPLPR

SEQ ID NO: 96070 - protein, 9 aa, Homo Sapiens
GFSPTTVNT

SEQ ID NO: 96071 - protein, 9 aa, Homo Sapiens
QSIKLVYVW

SEQ ID NO: 96072 - protein, 9 aa, Homo Sapiens
LVYVWGFSA

SEQ ID NO: 96073 - protein, 9 aa, Homo Sapiens
EEQETVAPP

SEQ ID NO: 96074 - protein, 9 aa, Homo Sapiens
YALVQLGHP

SEQ ID NO: 96075 - protein, 9 aa, Homo Sapiens
AVTPQKEEQ

SEQ ID NO: 96076 - protein, 9 aa, Homo Sapiens
VAIMVSERL

SEQ ID NO: 96077 - protein, 9 aa, Homo Sapiens
RDVSHMGLK

SEQ ID NO: 96078 - protein, 9 aa, Homo Sapiens
YHCELKNLT

SEQ ID NO: 96079 - protein, 9 aa, Homo Sapiens
TALSRDTVQ

SEQ ID NO: 96080 - protein, 9 aa, Homo Sapiens
DYVLESFRD

SEQ ID NO: 96081 - protein, 9 aa, Homo Sapiens
DVNEALKKL

SEQ ID NO: 96082 - protein, 9 aa, Homo Sapiens
NGRWQKALS

SEQ ID NO: 96083 - protein, 9 aa, Homo Sapiens
DSAQEKLLE

SEQ ID NO: 96084 - protein, 9 aa, Homo Sapiens
TYTEDYEQQ

SEQ ID NO: 96085 - protein, 9 aa, Homo Sapiens
TIVWKGFSP

SEQ ID NO: 96086 - protein, 9 aa, Homo Sapiens
IDPSVRLIW

SEQ ID NO: 96087 - protein, 9 aa, Homo Sapiens
DNHITSTDC

SEQ ID NO: 96088 - protein, 9 aa, Homo Sapiens
TPYFSPSQP

SEQ ID NO: 96089 - protein, 9 aa, Homo Sapiens
QHIVGSPFM

SEQ ID NO: 96090 - protein, 9 aa, Homo Sapiens
LTTITQPCC

SEQ ID NO: 96091 - protein, 9 aa, Homo Sapiens
LEHHQQRIA

SEQ ID NO: 96092 - protein, 9 aa, Homo Sapiens
QQDAITLRE

SEQ ID NO: 96093 - protein, 9 aa, Homo Sapiens
PAVDNDKEA

SEQ ID NO: 96094 - protein, 9 aa, Homo Sapiens
AGNYSCLYY

SEQ ID NO: 96095 - protein, 9 aa, Homo Sapiens
GDIVYSFLN

SEQ ID NO: 96096 - protein, 9 aa, Homo Sapiens
TFQKQEGEQ

SEQ ID NO: 96097 - protein, 9 aa, Homo Sapiens
LAEMYFSHF

SEQ ID NO: 96098 - protein, 9 aa, Homo Sapiens
KTAKAAEPV

SEQ ID NO: 96099 - protein, 9 aa, Homo Sapiens
RKKPIYDTI

SEQ ID NO: 96100 - protein, 9 aa, Homo Sapiens
HGVVVHPLR

SEQ ID NO: 96101 - protein, 9 aa, Homo Sapiens
AEMYFSHFS

SEQ ID NO: 96102 - protein, 9 aa, Homo Sapiens
ENALTGTQS

SEQ ID NO: 96103 - protein, 9 aa, Homo Sapiens
HKSYQCFVS

SEQ ID NO: 96104 - protein, 9 aa, Homo Sapiens
VLFQMIFRF

SEQ ID NO: 96105 - protein, 9 aa, Homo Sapiens
LSFYHNKLV

SEQ ID NO: 96106 - protein, 9 aa, Homo Sapiens
FCTEVEEDH

SEQ ID NO: 96107 - protein, 9 aa, Homo Sapiens
TEVEEDHID

SEQ ID NO: 96108 - protein, 9 aa, Homo Sapiens
GAFQPAEAS

SEQ ID NO: 96109 - protein, 9 aa, Homo Sapiens
LDIPDQVIR

SEQ ID NO: 96110 - protein, 9 aa, Homo Sapiens
DMGPSALGQ

SEQ ID NO: 96111 - protein, 9 aa, Homo Sapiens
SICSCQSSG

SEQ ID NO: 96112 - protein, 9 aa, Homo Sapiens
EWSARSESA

SEQ ID NO: 96113 - protein, 9 aa, Homo Sapiens
GYRGVASTT

SEQ ID NO: 96114 - protein, 9 aa, Homo Sapiens
PILMFFMMA

SEQ ID NO: 96115 - protein, 9 aa, Homo Sapiens
PLSECKIQF

SEQ ID NO: 96116 - protein, 9 aa, Homo Sapiens
LYTFQKQEG

SEQ ID NO: 96117 - protein, 9 aa, Homo Sapiens
EFNFMTDFV

SEQ ID NO: 96118 - protein, 9 aa, Homo Sapiens
TPLVAGNGL

SEQ ID NO: 96119 - protein, 9 aa, Homo Sapiens
CQTSFLLLV

SEQ ID NO: 96120 - protein, 9 aa, Homo Sapiens
AIILGYRIH

SEQ ID NO: 96121 - protein, 9 aa, Homo Sapiens
PDIGVPIVV

SEQ ID NO: 96122 - protein, 9 aa, Homo Sapiens
TVEWSARSE

SEQ ID NO: 96123 - protein, 9 aa, Homo Sapiens
VEEREKAKK

SEQ ID NO: 96124 - protein, 9 aa, Homo Sapiens
SLDSTISRS

SEQ ID NO: 96125 - protein, 9 aa, Homo Sapiens
VCSRTIGQA

SEQ ID NO: 96126 - protein, 9 aa, Homo Sapiens
RKIYIDLPN

SEQ ID NO: 96127 - protein, 9 aa, Homo Sapiens
SYENVLSSR

SEQ ID NO: 96128 - protein, 9 aa, Homo Sapiens
WLISMKKLQ

SEQ ID NO: 96129 - protein, 9 aa, Homo Sapiens
ALLLRVYVR

SEQ ID NO: 96130 - protein, 9 aa, Homo Sapiens
FEPLTDLVF

SEQ ID NO: 96131 - protein, 9 aa, Homo Sapiens
RQLDEVVSQ

SEQ ID NO: 96132 - protein, 9 aa, Homo Sapiens
GNSPKTWTS

SEQ ID NO: 96133 - protein, 9 aa, Homo Sapiens
EPLQEREPT

SEQ ID NO: 96134 - protein, 9 aa, Homo Sapiens
TVHKDTTIM

SEQ ID NO: 96135 - protein, 9 aa, Homo Sapiens
MKKLQKICI

SEQ ID NO: 96136 - protein, 9 aa, Homo Sapiens
RFLSKFNCC

SEQ ID NO: 96137 - protein, 9 aa, Homo Sapiens
EGLYTFQKQ

SEQ ID NO: 96138 - protein, 9 aa, Homo Sapiens
AKSKMIPLS

SEQ ID NO: 96139 - protein, 9 aa, Homo Sapiens
RHPEPFGHF

SEQ ID NO: 96140 - protein, 9 aa, Homo Sapiens
FSHFSKPRF

SEQ ID NO: 96141 - protein, 9 aa, Homo Sapiens
PLQKLEVSF

SEQ ID NO: 96142 - protein, 9 aa, Homo Sapiens
AGSRTSRRQ

SEQ ID NO: 96143 - protein, 9 aa, Homo Sapiens
EPVCPLKHF

SEQ ID NO: 96144 - protein, 9 aa, Homo Sapiens
QKVTYAQLD

SEQ ID NO: 96145 - protein, 9 aa, Homo Sapiens
SGSSRQNWL

SEQ ID NO: 96146 - protein, 9 aa, Homo Sapiens
SLPFRGSDT

SEQ ID NO: 96147 - protein, 9 aa, Homo Sapiens
FIFSHGNMG

SEQ ID NO: 96148 - protein, 9 aa, Homo Sapiens
CNIHSSVMA

SEQ ID NO: 96149 - protein, 9 aa, Homo Sapiens
KSWQMPPLN

SEQ ID NO: 96150 - protein, 9 aa, Homo Sapiens
HIVGSPFMA

SEQ ID NO: 96151 - protein, 9 aa, Homo Sapiens
WACELILAQ

SEQ ID NO: 96152 - protein, 9 aa, Homo Sapiens
NSAPGKPTR

SEQ ID NO: 96153 - protein, 9 aa, Homo Sapiens
KPTRKISAS

SEQ ID NO: 96154 - protein, 9 aa, Homo Sapiens
LQTSRGTSG

SEQ ID NO: 96155 - protein, 9 aa, Homo Sapiens
YKAQVIRAL

SEQ ID NO: 96156 - protein, 9 aa, Homo Sapiens
ICSCQSSGT

SEQ ID NO: 96157 - protein, 9 aa, Homo Sapiens
TRTRICLAD

SEQ ID NO: 96158 - protein, 9 aa, Homo Sapiens
VGSPFMAKV

SEQ ID NO: 96159 - protein, 9 aa, Homo Sapiens
YQLPVCCPK

SEQ ID NO: 96160 - protein, 9 aa, Homo Sapiens
RELERESKV

SEQ ID NO: 96161 - protein, 9 aa, Homo Sapiens
QRRNKRHPE

SEQ ID NO: 96162 - protein, 9 aa, Homo Sapiens
PLTVEWSAR

SEQ ID NO: 96163 - protein, 9 aa, Homo Sapiens
REYKHVRRD

SEQ ID NO: 96164 - protein, 9 aa, Homo Sapiens
WVGNPPFTL

SEQ ID NO: 96165 - protein, 9 aa, Homo Sapiens
VANTAEEKF

SEQ ID NO: 96166 - protein, 9 aa, Homo Sapiens
DGFEVQPQH

SEQ ID NO: 96167 - protein, 9 aa, Homo Sapiens
VEWSARSES

SEQ ID NO: 96168 - protein, 9 aa, Homo Sapiens
SERLRCIGS

SEQ ID NO: 96169 - protein, 9 aa, Homo Sapiens
KEQYQVVIQ

SEQ ID NO: 96170 - protein, 9 aa, Homo Sapiens
SFLKEEIIY

SEQ ID NO: 96171 - protein, 9 aa, Homo Sapiens
KKDKNEDTK

SEQ ID NO: 96172 - protein, 9 aa, Homo Sapiens
LGINDTRET

SEQ ID NO: 96173 - protein, 9 aa, Homo Sapiens
WQMPPLNCS

SEQ ID NO: 96174 - protein, 9 aa, Homo Sapiens
TSPLTVEWS

SEQ ID NO: 96175 - protein, 9 aa, Homo Sapiens
IYIDLPNEQ

SEQ ID NO: 96176 - protein, 9 aa, Homo Sapiens
KEDKEDDLF

SEQ ID NO: 96177 - protein, 9 aa, Homo Sapiens
GQHWLLNGF

SEQ ID NO: 96178 - protein, 9 aa, Homo Sapiens
SKTALSRDT

SEQ ID NO: 96179 - protein, 9 aa, Homo Sapiens
RAHQAKIFM

SEQ ID NO: 96180 - protein, 9 aa, Homo Sapiens
TLSIIAPPP

SEQ ID NO: 96181 - protein, 9 aa, Homo Sapiens
ESLSFYHNK

SEQ ID NO: 96182 - protein, 9 aa, Homo Sapiens
ARNGRWQKA

SEQ ID NO: 96183 - protein, 9 aa, Homo Sapiens
LAKSKMIPL

SEQ ID NO: 96184 - protein, 9 aa, Homo Sapiens
FVQTPSPRR

SEQ ID NO: 96185 - protein, 9 aa, Homo Sapiens
SWQMPPLNC

SEQ ID NO: 96186 - protein, 9 aa, Homo Sapiens
RIPDPRMHY

SEQ ID NO: 96187 - protein, 9 aa, Homo Sapiens
DKFQRAPPS

SEQ ID NO: 96188 - protein, 9 aa, Homo Sapiens
IQIHNLLQV

SEQ ID NO: 96189 - protein, 9 aa, Homo Sapiens
FSNPLDIPD

SEQ ID NO: 96190 - protein, 9 aa, Homo Sapiens
SARSESAQS

SEQ ID NO: 96191 - protein, 9 aa, Homo Sapiens
LHKLQARVD

SEQ ID NO: 96192 - protein, 9 aa, Homo Sapiens
QLHKHAEVT

SEQ ID NO: 96193 - protein, 9 aa, Homo Sapiens
KVEEREKAK

SEQ ID NO: 96194 - protein, 9 aa, Homo Sapiens
ASTTASGLS

SEQ ID NO: 96195 - protein, 9 aa, Homo Sapiens
KIQAIAARL

SEQ ID NO: 96196 - protein, 9 aa, Homo Sapiens
PGVPLRVLG

SEQ ID NO: 96197 - protein, 9 aa, Homo Sapiens
ESRIPDPRM

SEQ ID NO: 96198 - protein, 9 aa, Homo Sapiens
KEFCAPVIE

SEQ ID NO: 96199 - protein, 9 aa, Homo Sapiens
GCLTSECGW

SEQ ID NO: 96200 - protein, 9 aa, Homo Sapiens
KKTTRFCSL

SEQ ID NO: 96201 - protein, 9 aa, Homo Sapiens
DFNRSILTP

SEQ ID NO: 96202 - protein, 9 aa, Homo Sapiens
PIYDTISKT

SEQ ID NO: 96203 - protein, 9 aa, Homo Sapiens
VTYTEDYEQ

SEQ ID NO: 96204 - protein, 9 aa, Homo Sapiens
TITQPCCEP

SEQ ID NO: 96205 - protein, 9 aa, Homo Sapiens
RNDETMYVE

SEQ ID NO: 96206 - protein, 9 aa, Homo Sapiens
VAPPRVVMS

SEQ ID NO: 96207 - protein, 9 aa, Homo Sapiens
KHVRRDLDP

SEQ ID NO: 96208 - protein, 9 aa, Homo Sapiens
RFEDQDCAR

SEQ ID NO: 96209 - protein, 9 aa, Homo Sapiens
PPACNSSAR

SEQ ID NO: 96210 - protein, 9 aa, Homo Sapiens
FQPGFFRNK

SEQ ID NO: 96211 - protein, 9 aa, Homo Sapiens
YTMHAQKEH

SEQ ID NO: 96212 - protein, 9 aa, Homo Sapiens
GNYSCLYYQ

SEQ ID NO: 96213 - protein, 9 aa, Homo Sapiens
KAQVIRALA

SEQ ID NO: 96214 - protein, 9 aa, Homo Sapiens
KITDYVLES

SEQ ID NO: 96215 - protein, 9 aa, Homo Sapiens
IYGAQWARG

SEQ ID NO: 96216 - protein, 9 aa, Homo Sapiens
TLLHKLQAR

SEQ ID NO: 96217 - protein, 9 aa, Homo Sapiens
ITDYVLESF

SEQ ID NO: 96218 - protein, 9 aa, Homo Sapiens
IKVTAHPVE

SEQ ID NO: 96219 - protein, 9 aa, Homo Sapiens
APPRVVMSI

SEQ ID NO: 96220 - protein, 9 aa, Homo Sapiens
QNKIASKLE

SEQ ID NO: 96221 - protein, 9 aa, Homo Sapiens
LSENAEGEG

SEQ ID NO: 96222 - protein, 9 aa, Homo Sapiens
PHLRYQLGF

SEQ ID NO: 96223 - protein, 9 aa, Homo Sapiens
RINVGLHGL

SEQ ID NO: 96224 - protein, 9 aa, Homo Sapiens
QESVTEDPE

SEQ ID NO: 96225 - protein, 9 aa, Homo Sapiens
VINHNFCDL

SEQ ID NO: 96226 - protein, 9 aa, Homo Sapiens
RQLHKHAEV

SEQ ID NO: 96227 - protein, 9 aa, Homo Sapiens
QNWLETTIR

SEQ ID NO: 96228 - protein, 9 aa, Homo Sapiens
PASLTGALV

SEQ ID NO: 96229 - protein, 9 aa, Homo Sapiens
TKDSFRWAT

SEQ ID NO: 96230 - protein, 9 aa, Homo Sapiens
FKEKSRKAL

SEQ ID NO: 96231 - protein, 9 aa, Homo Sapiens
KLKSIEEVI

SEQ ID NO: 96232 - protein, 9 aa, Homo Sapiens
PQHPDKAQI

SEQ ID NO: 96233 - protein, 9 aa, Homo Sapiens
ELAALLTER

SEQ ID NO: 96234 - protein, 9 aa, Homo Sapiens
IITFSMEKH

SEQ ID NO: 96235 - protein, 9 aa, Homo Sapiens
LPDMSRENK

SEQ ID NO: 96236 - protein, 9 aa, Homo Sapiens
NVGLHGLVA

SEQ ID NO: 96237 - protein, 9 aa, Homo Sapiens
VELAALLTE

SEQ ID NO: 96238 - protein, 9 aa, Homo Sapiens
TSFLLLVEQ

SEQ ID NO: 96239 - protein, 9 aa, Homo Sapiens
WPLQVTALE

SEQ ID NO: 96240 - protein, 9 aa, Homo Sapiens
ISMKKLQKI

SEQ ID NO: 96241 - protein, 9 aa, Homo Sapiens
LRFEDQDCA

SEQ ID NO: 96242 - protein, 9 aa, Homo Sapiens
FSMEKHKSY

SEQ ID NO: 96243 - protein, 9 aa, Homo Sapiens
RPGKSSAPA

SEQ ID NO: 96244 - protein, 9 aa, Homo Sapiens
EKSRKALKE

SEQ ID NO: 96245 - protein, 9 aa, Homo Sapiens
QDRLVVTEC

SEQ ID NO: 96246 - protein, 9 aa, Homo Sapiens
TTAASSLQT

SEQ ID NO: 96247 - protein, 9 aa, Homo Sapiens
YVRGRLKQR

SEQ ID NO: 96248 - protein, 9 aa, Homo Sapiens
RHGGWTTKM

SEQ ID NO: 96249 - protein, 9 aa, Homo Sapiens
EVFVYLKWF

SEQ ID NO: 96250 - protein, 9 aa, Homo Sapiens
EECLGAVIA

SEQ ID NO: 96251 - protein, 9 aa, Homo Sapiens
ICGLRAMPS

SEQ ID NO: 96252 - protein, 9 aa, Homo Sapiens
AHNIIKSHL

SEQ ID NO: 96253 - protein, 9 aa, Homo Sapiens
IRSIGVLWT

SEQ ID NO: 96254 - protein, 9 aa, Homo Sapiens
PVGQKALLY

SEQ ID NO: 96255 - protein, 9 aa, Homo Sapiens
RVPGARGQP

SEQ ID NO: 96256 - protein, 9 aa, Homo Sapiens
NQEKSWQMP

SEQ ID NO: 96257 - protein, 9 aa, Homo Sapiens
RPQVKSLGI

SEQ ID NO: 96258 - protein, 9 aa, Homo Sapiens
VKKTSLFKE

SEQ ID NO: 96259 - protein, 9 aa, Homo Sapiens
IFMENSKAI

SEQ ID NO: 96260 - protein, 9 aa, Homo Sapiens
ETVDRFNNY

SEQ ID NO: 96261 - protein, 9 aa, Homo Sapiens
AKLKILEHH

SEQ ID NO: 96262 - protein, 9 aa, Homo Sapiens
VAIKTAKAA

SEQ ID NO: 96263 - protein, 9 aa, Homo Sapiens
LLRFLSVLF

SEQ ID NO: 96264 - protein, 9 aa, Homo Sapiens
LGAQQDAIT

SEQ ID NO: 96265 - protein, 9 aa, Homo Sapiens
SFSKQIVPR

SEQ ID NO: 96266 - protein, 9 aa, Homo Sapiens
CRGAHRIHV

SEQ ID NO: 96267 - protein, 9 aa, Homo Sapiens
MMAAMLSMV

SEQ ID NO: 96268 - protein, 9 aa, Homo Sapiens
FEWLRRELE

SEQ ID NO: 96269 - protein, 9 aa, Homo Sapiens
FKHFLLSLK

SEQ ID NO: 96270 - protein, 9 aa, Homo Sapiens
TTVLIRRPH

SEQ ID NO: 96271 - protein, 9 aa, Homo Sapiens
LYALVQLGH

SEQ ID NO: 96272 - protein, 9 aa, Homo Sapiens
KLTQDLKDH

SEQ ID NO: 96273 - protein, 9 aa, Homo Sapiens
IYDTISKTK

SEQ ID NO: 96274 - protein, 9 aa, Homo Sapiens
EAQDDPLAE

SEQ ID NO: 96275 - protein, 9 aa, Homo Sapiens
NLLQVSVLV

SEQ ID NO: 96276 - protein, 9 aa, Homo Sapiens
SPLTVEWSA

SEQ ID NO: 96277 - protein, 9 aa, Homo Sapiens
TPEENLTWS

SEQ ID NO: 96278 - protein, 9 aa, Homo Sapiens
YKHVRRDLD

SEQ ID NO: 96279 - protein, 9 aa, Homo Sapiens
QKALSWWPL

SEQ ID NO: 96280 - protein, 9 aa, Homo Sapiens
SFLFHEHLK

SEQ ID NO: 96281 - protein, 9 aa, Homo Sapiens
SKQIVPRGK

SEQ ID NO: 96282 - protein, 9 aa, Homo Sapiens
SYCSYWKEV

SEQ ID NO: 96283 - protein, 9 aa, Homo Sapiens
EKVEEREKA

SEQ ID NO: 96284 - protein, 9 aa, Homo Sapiens
DTAIKPLPS

SEQ ID NO: 96285 - protein, 9 aa, Homo Sapiens
PFTLTWTKK

SEQ ID NO: 96286 - protein, 9 aa, Homo Sapiens
AVALDLPVF

SEQ ID NO: 96287 - protein, 9 aa, Homo Sapiens
LFHEHLKAG

SEQ ID NO: 96288 - protein, 9 aa, Homo Sapiens
LREEWPALG

SEQ ID NO: 96289 - protein, 9 aa, Homo Sapiens
WPDIGVPIV

SEQ ID NO: 96290 - protein, 9 aa, Homo Sapiens
TLQLPICGN

SEQ ID NO: 96291 - protein, 9 aa, Homo Sapiens
LIDDGDEVI

SEQ ID NO: 96292 - protein, 9 aa, Homo Sapiens
DISPASSAF

SEQ ID NO: 96293 - protein, 9 aa, Homo Sapiens
QPDNIKAVF

SEQ ID NO: 96294 - protein, 9 aa, Homo Sapiens
GLISYCSYW

SEQ ID NO: 96295 - protein, 9 aa, Homo Sapiens
KIASKLERP

SEQ ID NO: 96296 - protein, 9 aa, Homo Sapiens
SFCFLSFDN

SEQ ID NO: 96297 - protein, 9 aa, Homo Sapiens
KFNCCRETV

SEQ ID NO: 96298 - protein, 9 aa, Homo Sapiens
SRPPPVTRR

SEQ ID NO: 96299 - protein, 9 aa, Homo Sapiens
GMEAMPNPF

SEQ ID NO: 96300 - protein, 9 aa, Homo Sapiens
SNPLDIPDQ

SEQ ID NO: 96301 - protein, 9 aa, Homo Sapiens
PLVAGNGLC

SEQ ID NO: 96302 - protein, 9 aa, Homo Sapiens
IVWKGFSPT

SEQ ID NO: 96303 - protein, 9 aa, Homo Sapiens
CLYYQTKSP

SEQ ID NO: 96304 - protein, 9 aa, Homo Sapiens
DNDKEALME

SEQ ID NO: 96305 - protein, 9 aa, Homo Sapiens
GFEVQPQHP

SEQ ID NO: 96306 - protein, 9 aa, Homo Sapiens
MHNAGFEPL

SEQ ID NO: 96307 - protein, 9 aa, Homo Sapiens
VGQKALLYS

SEQ ID NO: 96308 - protein, 9 aa, Homo Sapiens
AGFEPLTDL

SEQ ID NO: 96309 - protein, 9 aa, Homo Sapiens
CSLSVTLEQ

SEQ ID NO: 96310 - protein, 9 aa, Homo Sapiens
LVDSLPASL

SEQ ID NO: 96311 - protein, 9 aa, Homo Sapiens
PGPPKGEKV

SEQ ID NO: 96312 - protein, 9 aa, Homo Sapiens
LFISWNSHH

SEQ ID NO: 96313 - protein, 9 aa, Homo Sapiens
SISTLSSKG

SEQ ID NO: 96314 - protein, 9 aa, Homo Sapiens
LKSTAKWAS

SEQ ID NO: 96315 - protein, 9 aa, Homo Sapiens
EPFGHFLDF

SEQ ID NO: 96316 - protein, 9 aa, Homo Sapiens
TSSLDRRFD

SEQ ID NO: 96317 - protein, 9 aa, Homo Sapiens
SLFFEDFQE

SEQ ID NO: 96318 - protein, 9 aa, Homo Sapiens
TSIASVANT

SEQ ID NO: 96319 - protein, 9 aa, Homo Sapiens
HIRLWLLLR

SEQ ID NO: 96320 - protein, 9 aa, Homo Sapiens
ICLADMVSL

SEQ ID NO: 96321 - protein, 9 aa, Homo Sapiens
RRELERESK

SEQ ID NO: 96322 - protein, 9 aa, Homo Sapiens
TSSICSCQS

SEQ ID NO: 96323 - protein, 9 aa, Homo Sapiens
EKKTTRFCS

SEQ ID NO: 96324 - protein, 9 aa, Homo Sapiens
RRVHKALRL

SEQ ID NO: 96325 - protein, 9 aa, Homo Sapiens
VPAKVLCNI

SEQ ID NO: 96326 - protein, 9 aa, Homo Sapiens
QSDVTYTED

SEQ ID NO: 96327 - protein, 9 aa, Homo Sapiens
GFMFEVVDL

SEQ ID NO: 96328 - protein, 9 aa, Homo Sapiens
SLGINDTRE

SEQ ID NO: 96329 - protein, 9 aa, Homo Sapiens
LRQLHKHAE

SEQ ID NO: 96330 - protein, 9 aa, Homo Sapiens
LCKSFCFLS

SEQ ID NO: 96331 - protein, 9 aa, Homo Sapiens
AASSLQTSR

SEQ ID NO: 96332 - protein, 9 aa, Homo Sapiens
YTFQKQEGE

SEQ ID NO: 96333 - protein, 9 aa, Homo Sapiens
LCGSPPPEA

SEQ ID NO: 96334 - protein, 9 aa, Homo Sapiens
GVPIVVVRT

SEQ ID NO: 96335 - protein, 9 aa, Homo Sapiens
AKLLLENRS

SEQ ID NO: 96336 - protein, 9 aa, Homo Sapiens
ISNLCFVGL

SEQ ID NO: 96337 - protein, 9 aa, Homo Sapiens
SLDRRFDSA

SEQ ID NO: 96338 - protein, 9 aa, Homo Sapiens
ITTGTYTMH

SEQ ID NO: 96339 - protein, 9 aa, Homo Sapiens
QQPKEPALS

SEQ ID NO: 96340 - protein, 9 aa, Homo Sapiens
QLDEVVSQN

SEQ ID NO: 96341 - protein, 9 aa, Homo Sapiens
SVSQVKQQP

SEQ ID NO: 96342 - protein, 9 aa, Homo Sapiens
GEKVEEREK

SEQ ID NO: 96343 - protein, 9 aa, Homo Sapiens
QTSRGTSGP

SEQ ID NO: 96344 - protein, 9 aa, Homo Sapiens
FLAKSKMIP

SEQ ID NO: 96345 - protein, 9 aa, Homo Sapiens
YSELSKRGP

SEQ ID NO: 96346 - protein, 9 aa, Homo Sapiens
AALLLRVYV

SEQ ID NO: 96347 - protein, 9 aa, Homo Sapiens
NTCGSSNLT

SEQ ID NO: 96348 - protein, 9 aa, Homo Sapiens
QQDDAHMFC

SEQ ID NO: 96349 - protein, 9 aa, Homo Sapiens
RAMPSPEAR

SEQ ID NO: 96350 - protein, 9 aa, Homo Sapiens
CLGSVVVEH

SEQ ID NO: 96351 - protein, 9 aa, Homo Sapiens
HMGLKITGA

SEQ ID NO: 96352 - protein, 9 aa, Homo Sapiens
KPTSTRSNR

SEQ ID NO: 96353 - protein, 9 aa, Homo Sapiens
DGKKIEQVF

SEQ ID NO: 96354 - protein, 9 aa, Homo Sapiens
LSTTSSTRA

SEQ ID NO: 96355 - protein, 9 aa, Homo Sapiens
TLSSKGGEN

SEQ ID NO: 96356 - protein, 9 aa, Homo Sapiens
PPSSGSSRQ

SEQ ID NO: 96357 - protein, 9 aa, Homo Sapiens
IGVLWTLHT

SEQ ID NO: 96358 - protein, 9 aa, Homo Sapiens
INVTDFNRS

SEQ ID NO: 96359 - protein, 9 aa, Homo Sapiens
KFKHFLLSL

SEQ ID NO: 96360 - protein, 9 aa, Homo Sapiens
GGRQMSFCP

SEQ ID NO: 96361 - protein, 9 aa, Homo Sapiens
TSITTKCNI

SEQ ID NO: 96362 - protein, 9 aa, Homo Sapiens
RSLLCGSPP

SEQ ID NO: 96363 - protein, 9 aa, Homo Sapiens
HQAKIFMEN

SEQ ID NO: 96364 - protein, 9 aa, Homo Sapiens
ITAIYGAQW

SEQ ID NO: 96365 - protein, 9 aa, Homo Sapiens
VILYIVCGF

SEQ ID NO: 96366 - protein, 9 aa, Homo Sapiens
LLTERGASL

SEQ ID NO: 96367 - protein, 9 aa, Homo Sapiens
ATVLQKMNK

SEQ ID NO: 96368 - protein, 9 aa, Homo Sapiens
VSIPDKPNS

SEQ ID NO: 96369 - protein, 9 aa, Homo Sapiens
ACYSLSENA

SEQ ID NO: 96370 - protein, 9 aa, Homo Sapiens
LRSLLCGSP

SEQ ID NO: 96371 - protein, 9 aa, Homo Sapiens
CSYWKEVLL

SEQ ID NO: 96372 - protein, 9 aa, Homo Sapiens
IASVANTAE

SEQ ID NO: 96373 - protein, 9 aa, Homo Sapiens
HGFNMLRLV

SEQ ID NO: 96374 - protein, 9 aa, Homo Sapiens
SAASRAFPA

SEQ ID NO: 96375 - protein, 9 aa, Homo Sapiens
IITMTTLGY

SEQ ID NO: 96376 - protein, 9 aa, Homo Sapiens
CNSSARTAS

SEQ ID NO: 96377 - protein, 9 aa, Homo Sapiens
FLNDISPNV

SEQ ID NO: 96378 - protein, 9 aa, Homo Sapiens
EPDKSYENV

SEQ ID NO: 96379 - protein, 9 aa, Homo Sapiens
GRQMSFCPV

SEQ ID NO: 96380 - protein, 9 aa, Homo Sapiens
KDVNEALKK

SEQ ID NO: 96381 - protein, 9 aa, Homo Sapiens
DVTYTEDYE

SEQ ID NO: 96382 - protein, 9 aa, Homo Sapiens
SCSKSSSPA

SEQ ID NO: 96383 - protein, 9 aa, Homo Sapiens
NGSSLFFED

SEQ ID NO: 96384 - protein, 9 aa, Homo Sapiens
NDARHGGWT

SEQ ID NO: 96385 - protein, 9 aa, Homo Sapiens
GHPCDCLPP

SEQ ID NO: 96386 - protein, 9 aa, Homo Sapiens
SSAEGTVHK

SEQ ID NO: 96387 - protein, 9 aa, Homo Sapiens
MIPLSECKI

SEQ ID NO: 96388 - protein, 9 aa, Homo Sapiens
DARHGGWTT

SEQ ID NO: 96389 - protein, 9 aa, Homo Sapiens
SKLTNHMEL

SEQ ID NO: 96390 - protein, 9 aa, Homo Sapiens
EGIECTFID

SEQ ID NO: 96391 - protein, 9 aa, Homo Sapiens
QRHGFMFEV

SEQ ID NO: 96392 - protein, 9 aa, Homo Sapiens
KTWTSEWAV

SEQ ID NO: 96393 - protein, 9 aa, Homo Sapiens
DNIKAVFRK

SEQ ID NO: 96394 - protein, 9 aa, Homo Sapiens
SIPDKPNSE

SEQ ID NO: 96395 - protein, 9 aa, Homo Sapiens
IIHQKQKST

SEQ ID NO: 96396 - protein, 9 aa, Homo Sapiens
LHLLPALSG

SEQ ID NO: 96397 - protein, 9 aa, Homo Sapiens
VLQKMNKIQ

SEQ ID NO: 96398 - protein, 9 aa, Homo Sapiens
EPEVGAAIK

SEQ ID NO: 96399 - protein, 9 aa, Homo Sapiens
KLRRVHKAL

SEQ ID NO: 96400 - protein, 9 aa, Homo Sapiens
GVASTTASG

SEQ ID NO: 96401 - protein, 9 aa, Homo Sapiens
PLSTTSSTR

SEQ ID NO: 96402 - protein, 9 aa, Homo Sapiens
TFTLQLPIC

SEQ ID NO: 96403 - protein, 9 aa, Homo Sapiens
ALLYSTAME

SEQ ID NO: 96404 - protein, 9 aa, Homo Sapiens
NSHHIRDGI

SEQ ID NO: 96405 - protein, 9 aa, Homo Sapiens
CEKCLRQLH

SEQ ID NO: 96406 - protein, 9 aa, Homo Sapiens
SGWIKVTAH

SEQ ID NO: 96407 - protein, 9 aa, Homo Sapiens
LQSDVTYTE

SEQ ID NO: 96408 - protein, 9 aa, Homo Sapiens
KFIRCRGAH

SEQ ID NO: 96409 - protein, 9 aa, Homo Sapiens
AMKLRRVHK

SEQ ID NO: 96410 - protein, 9 aa, Homo Sapiens
RAVIHYRND

SEQ ID NO: 96411 - protein, 9 aa, Homo Sapiens
QMNDARHGG

SEQ ID NO: 96412 - protein, 9 aa, Homo Sapiens
HITSTDCNG

SEQ ID NO: 96413 - protein, 9 aa, Homo Sapiens
YPWLISMKK

SEQ ID NO: 96414 - protein, 9 aa, Homo Sapiens
LLLRFLSVL

SEQ ID NO: 96415 - protein, 9 aa, Homo Sapiens
ETIEPDKSY

SEQ ID NO: 96416 - protein, 9 aa, Homo Sapiens
CPLKHFVLA

SEQ ID NO: 96417 - protein, 9 aa, Homo Sapiens
PSKTALSRD

SEQ ID NO: 96418 - protein, 9 aa, Homo Sapiens
KICISCQTS

SEQ ID NO: 96419 - protein, 9 aa, Homo Sapiens
LTESRIPDP

SEQ ID NO: 96420 - protein, 9 aa, Homo Sapiens
LLCGSPPPE

SEQ ID NO: 96421 - protein, 9 aa, Homo Sapiens
PGLIPLPRL

SEQ ID NO: 96422 - protein, 9 aa, Homo Sapiens
GQSAGSRTS

SEQ ID NO: 96423 - protein, 9 aa, Homo Sapiens
SHGNMGAYI

SEQ ID NO: 96424 - protein, 9 aa, Homo Sapiens
QKLEVSFSF

SEQ ID NO: 96425 - protein, 9 aa, Homo Sapiens
TKLCLGSVV

SEQ ID NO: 96426 - protein, 9 aa, Homo Sapiens
VIAGNHYPW

SEQ ID NO: 96427 - protein, 9 aa, Homo Sapiens
PLTPYFSPS

SEQ ID NO: 96428 - protein, 9 aa, Homo Sapiens
PPDYSAASR

SEQ ID NO: 96429 - protein, 9 aa, Homo Sapiens
EDQDCARGD

SEQ ID NO: 96430 - protein, 9 aa, Homo Sapiens
HAMGASCFW

SEQ ID NO: 96431 - protein, 9 aa, Homo Sapiens
SECGWGCML

SEQ ID NO: 96432 - protein, 9 aa, Homo Sapiens
DSLPASLTG

SEQ ID NO: 96433 - protein, 9 aa, Homo Sapiens
VQPILKLKS

SEQ ID NO: 96434 - protein, 9 aa, Homo Sapiens
GTQSSHASL

SEQ ID NO: 96435 - protein, 9 aa, Homo Sapiens
GESKHRPGK

SEQ ID NO: 96436 - protein, 9 aa, Homo Sapiens
VASTTASGL

SEQ ID NO: 96437 - protein, 9 aa, Homo Sapiens
QGFHDGSFG

SEQ ID NO: 96438 - protein, 9 aa, Homo Sapiens
VKQQPKEPA

SEQ ID NO: 96439 - protein, 9 aa, Homo Sapiens
CLGAVIAGN

SEQ ID NO: 96440 - protein, 9 aa, Homo Sapiens
GRLDRKIYI

SEQ ID NO: 96441 - protein, 9 aa, Homo Sapiens
SVRLIWDLA

SEQ ID NO: 96442 - protein, 9 aa, Homo Sapiens
DAMNFPISN

SEQ ID NO: 96443 - protein, 9 aa, Homo Sapiens
KLCLGSVVV

SEQ ID NO: 96444 - protein, 9 aa, Homo Sapiens
REEWPALGD

SEQ ID NO: 96445 - protein, 9 aa, Homo Sapiens
LRTGAFQPA

SEQ ID NO: 96446 - protein, 9 aa, Homo Sapiens
FMMAAMLSM

SEQ ID NO: 96447 - protein, 9 aa, Homo Sapiens
SYKEFCAPV

SEQ ID NO: 96448 - protein, 9 aa, Homo Sapiens
SSLENLLED

SEQ ID NO: 96449 - protein, 9 aa, Homo Sapiens
SKGGENVDT

SEQ ID NO: 96450 - protein, 9 aa, Homo Sapiens
VPIVVVRTE

SEQ ID NO: 96451 - protein, 9 aa, Homo Sapiens
YRSSEEQKR

SEQ ID NO: 96452 - protein, 9 aa, Homo Sapiens
CISCQTSFL

SEQ ID NO: 96453 - protein, 9 aa, Homo Sapiens
MKTAQAHHR

SEQ ID NO: 96454 - protein, 9 aa, Homo Sapiens
VVVRTEKNS

SEQ ID NO: 96455 - protein, 9 aa, Homo Sapiens
TSLFKEDKE

SEQ ID NO: 96456 - protein, 9 aa, Homo Sapiens
EVVSQNQRL

SEQ ID NO: 96457 - protein, 9 aa, Homo Sapiens
RVYVRGRLK

SEQ ID NO: 96458 - protein, 9 aa, Homo Sapiens
KRTEKKTTR

SEQ ID NO: 96459 - protein, 9 aa, Homo Sapiens
VAQSDGEER

SEQ ID NO: 96460 - protein, 9 aa, Homo Sapiens
AGTGGLGAA

SEQ ID NO: 96461 - protein, 9 aa, Homo Sapiens
DLPVFANNA

SEQ ID NO: 96462 - protein, 9 aa, Homo Sapiens
MENALTGTQ

SEQ ID NO: 96463 - protein, 9 aa, Homo Sapiens
PVCPLKHFV

SEQ ID NO: 96464 - protein, 9 aa, Homo Sapiens
KSTAKWASS

SEQ ID NO: 96465 - protein, 9 aa, Homo Sapiens
PVLLPYKAQ

SEQ ID NO: 96466 - protein, 9 aa, Homo Sapiens
KATERLNKK

SEQ ID NO: 96467 - protein, 9 aa, Homo Sapiens
SARTASARP

SEQ ID NO: 96468 - protein, 9 aa, Homo Sapiens
SSKGGENVD

SEQ ID NO: 96469 - protein, 9 aa, Homo Sapiens
NEFNFMTDF

SEQ ID NO: 96470 - protein, 9 aa, Homo Sapiens
RRGQHWLLN

SEQ ID NO: 96471 - protein, 9 aa, Homo Sapiens
CSRTIGQAA

SEQ ID NO: 96472 - protein, 9 aa, Homo Sapiens
VHKDTTIME

SEQ ID NO: 96473 - protein, 9 aa, Homo Sapiens
ECGWGCMLR

SEQ ID NO: 96474 - protein, 9 aa, Homo Sapiens
DKNEDTKID

SEQ ID NO: 96475 - protein, 9 aa, Homo Sapiens
DTKIDFSEF

SEQ ID NO: 96476 - protein, 9 aa, Homo Sapiens
PGARGQPLG

SEQ ID NO: 96477 - protein, 9 aa, Homo Sapiens
KACYSLSEN

SEQ ID NO: 96478 - protein, 9 aa, Homo Sapiens
PICGLRAMP

SEQ ID NO: 96479 - protein, 9 aa, Homo Sapiens
NVTDFNRSI

SEQ ID NO: 96480 - protein, 9 aa, Homo Sapiens
HIDPSVRLI

SEQ ID NO: 96481 - protein, 9 aa, Homo Sapiens
NHGHIDPSV

SEQ ID NO: 96482 - protein, 9 aa, Homo Sapiens
MPPLNCSHL

SEQ ID NO: 96483 - protein, 9 aa, Homo Sapiens
EEDHIDAVT

SEQ ID NO: 96484 - protein, 9 aa, Homo Sapiens
SPPLTPYFS

SEQ ID NO: 96485 - protein, 9 aa, Homo Sapiens
LQKLEVSFS

SEQ ID NO: 96486 - protein, 9 aa, Homo Sapiens
VALDLPVFA

SEQ ID NO: 96487 - protein, 9 aa, Homo Sapiens
QKEEQETVA

SEQ ID NO: 96488 - protein, 9 aa, Homo Sapiens
PPGKPQGPT

SEQ ID NO: 96489 - protein, 9 aa, Homo Sapiens
GTSSICSCQ

SEQ ID NO: 96490 - protein, 9 aa, Homo Sapiens
EHFSEVFVY

SEQ ID NO: 96491 - protein, 9 aa, Homo Sapiens
LKITDYVLE

SEQ ID NO: 96492 - protein, 9 aa, Homo Sapiens
SNAITSWLW

SEQ ID NO: 96493 - protein, 9 aa, Homo Sapiens
NNQEKSWQM

SEQ ID NO: 96494 - protein, 9 aa, Homo Sapiens
SSISTLSSK

SEQ ID NO: 96495 - protein, 9 aa, Homo Sapiens
GIECTFIDF

SEQ ID NO: 96496 - protein, 9 aa, Homo Sapiens
DSLDVFVQT

SEQ ID NO: 96497 - protein, 9 aa, Homo Sapiens
LSFLFHEHL

SEQ ID NO: 96498 - protein, 9 aa, Homo Sapiens
EVAPPRVVM

SEQ ID NO: 96499 - protein, 9 aa, Homo Sapiens
LLTSITTKC

SEQ ID NO: 96500 - protein, 9 aa, Homo Sapiens
MLFISWNSH

SEQ ID NO: 96501 - protein, 9 aa, Homo Sapiens
LMFFMMAAM

SEQ ID NO: 96502 - protein, 9 aa, Homo Sapiens
GGCSPHASC

SEQ ID NO: 96503 - protein, 9 aa, Homo Sapiens
KEEQETVAP

SEQ ID NO: 96504 - protein, 9 aa, Homo Sapiens
FMAKVTGPR

SEQ ID NO: 96505 - protein, 9 aa, Homo Sapiens
HYRNDETMY

SEQ ID NO: 96506 - protein, 9 aa, Homo Sapiens
CELKNLTEK

SEQ ID NO: 96507 - protein, 9 aa, Homo Sapiens
LLRVYVRGR

SEQ ID NO: 96508 - protein, 9 aa, Homo Sapiens
RPPPVTRRR

SEQ ID NO: 96509 - protein, 9 aa, Homo Sapiens
IGALRRGCC

SEQ ID NO: 96510 - protein, 9 aa, Homo Sapiens
VSQVKQQPK

SEQ ID NO: 96511 - protein, 9 aa, Homo Sapiens
YTNCLPYCS

SEQ ID NO: 96512 - protein, 9 aa, Homo Sapiens
TNCLPYCSP

SEQ ID NO: 96513 - protein, 9 aa, Homo Sapiens
VVMSIRDGI

SEQ ID NO: 96514 - protein, 9 aa, Homo Sapiens
SVTEDPELV

SEQ ID NO: 96515 - protein, 9 aa, Homo Sapiens
IPDPRMHYP

SEQ ID NO: 96516 - protein, 9 aa, Homo Sapiens
PLGAQQDAI

SEQ ID NO: 96517 - protein, 9 aa, Homo Sapiens
DCTCDVETV

SEQ ID NO: 96518 - protein, 9 aa, Homo Sapiens
AEPVCPLKH

SEQ ID NO: 96519 - protein, 9 aa, Homo Sapiens
DSCSKSSSP

SEQ ID NO: 96520 - protein, 9 aa, Homo Sapiens
GVPAKVLCN

SEQ ID NO: 96521 - protein, 9 aa, Homo Sapiens
IQALIDDGD

SEQ ID NO: 96522 - protein, 9 aa, Homo Sapiens
LQEREPTPE

SEQ ID NO: 96523 - protein, 9 aa, Homo Sapiens
LWMLKPTST

SEQ ID NO: 96524 - protein, 9 aa, Homo Sapiens
ERPAAEEQL

SEQ ID NO: 96525 - protein, 9 aa, Homo Sapiens
IKLVYVWGF

SEQ ID NO: 96526 - protein, 9 aa, Homo Sapiens
FPISNLCFV

SEQ ID NO: 96527 - protein, 9 aa, Homo Sapiens
NVINHNFCD

SEQ ID NO: 96528 - protein, 9 aa, Homo Sapiens
LQDRLVVTE

SEQ ID NO: 96529 - protein, 9 aa, Homo Sapiens
LIPLPRLLA

SEQ ID NO: 96530 - protein, 9 aa, Homo Sapiens
KSEKNSKQE

SEQ ID NO: 96531 - protein, 9 aa, Homo Sapiens
KLSPLQDRL

SEQ ID NO: 96532 - protein, 9 aa, Homo Sapiens
LWTLHTWLE

SEQ ID NO: 96533 - protein, 9 aa, Homo Sapiens
KQIVPRGKS

SEQ ID NO: 96534 - protein, 9 aa, Homo Sapiens
RTEKKTTRF

SEQ ID NO: 96535 - protein, 9 aa, Homo Sapiens
DHIDAVTGL

SEQ ID NO: 96536 - protein, 9 aa, Homo Sapiens
LERPPSVDS

SEQ ID NO: 96537 - protein, 9 aa, Homo Sapiens
IALRSLLCG

SEQ ID NO: 96538 - protein, 9 aa, Homo Sapiens
SSNLTWPPA

SEQ ID NO: 96539 - protein, 9 aa, Homo Sapiens
HGGCSPHAS

SEQ ID NO: 96540 - protein, 9 aa, Homo Sapiens
VQLGHPCDC

SEQ ID NO: 96541 - protein, 9 aa, Homo Sapiens
HQPDNIKAV

SEQ ID NO: 96542 - protein, 9 aa, Homo Sapiens
QRAPPSSGS

SEQ ID NO: 96543 - protein, 9 aa, Homo Sapiens
TYKTTKDSF

SEQ ID NO: 96544 - protein, 9 aa, Homo Sapiens
KPQGPTPQG

SEQ ID NO: 96545 - protein, 9 aa, Homo Sapiens
SRQNWLETT

SEQ ID NO: 96546 - protein, 9 aa, Homo Sapiens
FRGSDTAIK

SEQ ID NO: 96547 - protein, 9 aa, Homo Sapiens
PDMSRENKE

SEQ ID NO: 96548 - protein, 9 aa, Homo Sapiens
LENRSLEQQ

SEQ ID NO: 96549 - protein, 9 aa, Homo Sapiens
PPFTLTWTK

SEQ ID NO: 96550 - protein, 9 aa, Homo Sapiens
DNSAPGKPT

SEQ ID NO: 96551 - protein, 9 aa, Homo Sapiens
EWLIQIHNL

SEQ ID NO: 96552 - protein, 9 aa, Homo Sapiens
HHIRLWLLL

SEQ ID NO: 96553 - protein, 9 aa, Homo Sapiens
SMLDFSNPL

SEQ ID NO: 96554 - protein, 9 aa, Homo Sapiens
LFFHPLTPL

SEQ ID NO: 96555 - protein, 9 aa, Homo Sapiens
FQKQEGEQI

SEQ ID NO: 96556 - protein, 9 aa, Homo Sapiens
LPFRGSDTA

SEQ ID NO: 96557 - protein, 9 aa, Homo Sapiens
PAADMGPSA

SEQ ID NO: 96558 - protein, 9 aa, Homo Sapiens
SGTSSICSC

SEQ ID NO: 96559 - protein, 9 aa, Homo Sapiens
EQDPQKVTY

SEQ ID NO: 96560 - protein, 9 aa, Homo Sapiens
PFRGSDTAI

SEQ ID NO: 96561 - protein, 9 aa, Homo Sapiens
HGFMFEVVD

SEQ ID NO: 96562 - protein, 9 aa, Homo Sapiens
QVFVFEYLL

SEQ ID NO: 96563 - protein, 9 aa, Homo Sapiens
DIVYSFLND

SEQ ID NO: 96564 - protein, 9 aa, Homo Sapiens
HFLLSLKTM

SEQ ID NO: 96565 - protein, 9 aa, Homo Sapiens
ARGQPLGAL

SEQ ID NO: 96566 - protein, 9 aa, Homo Sapiens
LWHGFNMLR

SEQ ID NO: 96567 - protein, 9 aa, Homo Sapiens
LLHKLQARV

SEQ ID NO: 96568 - protein, 9 aa, Homo Sapiens
QSFASDSCS

SEQ ID NO: 96569 - protein, 9 aa, Homo Sapiens
NLTEKEKQL

SEQ ID NO: 96570 - protein, 9 aa, Homo Sapiens
DAHMFCTTD

SEQ ID NO: 96571 - protein, 9 aa, Homo Sapiens
ENRSLEQQN

SEQ ID NO: 96572 - protein, 9 aa, Homo Sapiens
LCFSGKVQC

SEQ ID NO: 96573 - protein, 9 aa, Homo Sapiens
WSARSESAQ

SEQ ID NO: 96574 - protein, 9 aa, Homo Sapiens
SAEGTVHKD

SEQ ID NO: 96575 - protein, 9 aa, Homo Sapiens
ADNHITSTD

SEQ ID NO: 96576 - protein, 9 aa, Homo Sapiens
YRNDETMYV

SEQ ID NO: 96577 - protein, 9 aa, Homo Sapiens
EVCSRTIGQ

SEQ ID NO: 96578 - protein, 9 aa, Homo Sapiens
SLPASLTGA

SEQ ID NO: 96579 - protein, 9 aa, Homo Sapiens
LGHPCDCLP

SEQ ID NO: 96580 - protein, 9 aa, Homo Sapiens
PLPRLLAST

SEQ ID NO: 96581 - protein, 9 aa, Homo Sapiens
SRTVMIADI

SEQ ID NO: 96582 - protein, 9 aa, Homo Sapiens
DVSHMGLKI

SEQ ID NO: 96583 - protein, 9 aa, Homo Sapiens
KVLCNIEAD

SEQ ID NO: 96584 - protein, 9 aa, Homo Sapiens
AEGTVHKDT

SEQ ID NO: 96585 - protein, 9 aa, Homo Sapiens
TEDPELVRA

SEQ ID NO: 96586 - protein, 9 aa, Homo Sapiens
LLYSTAMES

SEQ ID NO: 96587 - protein, 9 aa, Homo Sapiens
KHKSYQCFV

SEQ ID NO: 96588 - protein, 9 aa, Homo Sapiens
VTEDPELVR

SEQ ID NO: 96589 - protein, 9 aa, Homo Sapiens
GFNMLRLVQ

SEQ ID NO: 96590 - protein, 9 aa, Homo Sapiens
GRQFTSSSS

SEQ ID NO: 96591 - protein, 9 aa, Homo Sapiens
QNQRLKVPS

SEQ ID NO: 96592 - protein, 9 aa, Homo Sapiens
CSSGVHRCS

SEQ ID NO: 96593 - protein, 9 aa, Homo Sapiens
LFRINVGLH

SEQ ID NO: 96594 - protein, 9 aa, Homo Sapiens
DIDAMNFPI

SEQ ID NO: 96595 - protein, 9 aa, Homo Sapiens
NGDIVYSFL

SEQ ID NO: 96596 - protein, 9 aa, Homo Sapiens
GTPITVSVL

SEQ ID NO: 96597 - protein, 9 aa, Homo Sapiens
PITVSVLRC

SEQ ID NO: 96598 - protein, 9 aa, Homo Sapiens
KAAEPVILD

SEQ ID NO: 96599 - protein, 9 aa, Homo Sapiens
NQCGKAFRG

SEQ ID NO: 96600 - protein, 9 aa, Homo Sapiens
ITFSMEKHK

SEQ ID NO: 96601 - protein, 9 aa, Homo Sapiens
PHASCTKVA

SEQ ID NO: 96602 - protein, 9 aa, Homo Sapiens
LNLTTITQP

SEQ ID NO: 96603 - protein, 9 aa, Homo Sapiens
NEALKKLKN

SEQ ID NO: 96604 - protein, 9 aa, Homo Sapiens
NSSARTASA

SEQ ID NO: 96605 - protein, 9 aa, Homo Sapiens
QTFCQRHGF

SEQ ID NO: 96606 - protein, 9 aa, Homo Sapiens
GRSYKEFCA

SEQ ID NO: 96607 - protein, 9 aa, Homo Sapiens
WIKVTAHPV

SEQ ID NO: 96608 - protein, 9 aa, Homo Sapiens
IHQKQKSTI

SEQ ID NO: 96609 - protein, 9 aa, Homo Sapiens
KCNIHSSVM

SEQ ID NO: 96610 - protein, 9 aa, Homo Sapiens
GRWQKALSW

SEQ ID NO: 96611 - protein, 9 aa, Homo Sapiens
CLADMVSLC

SEQ ID NO: 96612 - protein, 9 aa, Homo Sapiens
RFDSAQEKL

SEQ ID NO: 96613 - protein, 9 aa, Homo Sapiens
FHDGSFGPA

SEQ ID NO: 96614 - protein, 9 aa, Homo Sapiens
LKPTSTRSN

SEQ ID NO: 96615 - protein, 9 aa, Homo Sapiens
FYHNKLVKV

SEQ ID NO: 96616 - protein, 9 aa, Homo Sapiens
DLKDHNATS

SEQ ID NO: 96617 - protein, 9 aa, Homo Sapiens
PTPEENLTW

SEQ ID NO: 96618 - protein, 9 aa, Homo Sapiens
KTTRFCSLW

SEQ ID NO: 96619 - protein, 9 aa, Homo Sapiens
YSAASRAFP

SEQ ID NO: 96620 - protein, 9 aa, Homo Sapiens
YKEFCAPVI

SEQ ID NO: 96621 - protein, 9 aa, Homo Sapiens
TPVLLPYKA

SEQ ID NO: 96622 - protein, 9 aa, Homo Sapiens
DEVVSQNQR

SEQ ID NO: 96623 - protein, 9 aa, Homo Sapiens
MIFRFLFLY

SEQ ID NO: 96624 - protein, 9 aa, Homo Sapiens
KNSKQEKEK

SEQ ID NO: 96625 - protein, 9 aa, Homo Sapiens
PHPVRPQDI

SEQ ID NO: 96626 - protein, 9 aa, Homo Sapiens
YIVCGFGAV

SEQ ID NO: 96627 - protein, 9 aa, Homo Sapiens
GVPLRVLGQ

SEQ ID NO: 96628 - protein, 9 aa, Homo Sapiens
ACNSSARTA

SEQ ID NO: 96629 - protein, 9 aa, Homo Sapiens
TCDVETVDR

SEQ ID NO: 96630 - protein, 9 aa, Homo Sapiens
FSKQIVPRG

SEQ ID NO: 96631 - protein, 9 aa, Homo Sapiens
QDPSKTALS

SEQ ID NO: 96632 - protein, 9 aa, Homo Sapiens
GSSRQNWLE

SEQ ID NO: 96633 - protein, 9 aa, Homo Sapiens
RCRGAHRIH

SEQ ID NO: 96634 - protein, 9 aa, Homo Sapiens
EPICGLRAM

SEQ ID NO: 96635 - protein, 9 aa, Homo Sapiens
VDNDKEALM

SEQ ID NO: 96636 - protein, 9 aa, Homo Sapiens
EKVSEPEVG

SEQ ID NO: 96637 - protein, 9 aa, Homo Sapiens
LTYKTTKDS

SEQ ID NO: 96638 - protein, 9 aa, Homo Sapiens
HNKLVKVPQ

SEQ ID NO: 96639 - protein, 9 aa, Homo Sapiens
LRTKFIRCR

SEQ ID NO: 96640 - protein, 9 aa, Homo Sapiens
KSLGINDTR

SEQ ID NO: 96641 - protein, 9 aa, Homo Sapiens
TQMHNAGFE

SEQ ID NO: 96642 - protein, 9 aa, Homo Sapiens
MKLRRVHKA

SEQ ID NO: 96643 - protein, 9 aa, Homo Sapiens
CELILAQQQ

SEQ ID NO: 96644 - protein, 9 aa, Homo Sapiens
AQWARGKTL

SEQ ID NO: 96645 - protein, 9 aa, Homo Sapiens
FVFEYLLPD

SEQ ID NO: 96646 - protein, 9 aa, Homo Sapiens
VNITKLCLG

SEQ ID NO: 96647 - protein, 9 aa, Homo Sapiens
SIKLVYVWG

SEQ ID NO: 96648 - protein, 9 aa, Homo Sapiens
CSLWMLKPT

SEQ ID NO: 96649 - protein, 9 aa, Homo Sapiens
TTITQPCCE

SEQ ID NO: 96650 - protein, 9 aa, Homo Sapiens
RIAHNIIKS

SEQ ID NO: 96651 - protein, 9 aa, Homo Sapiens
QWARGKTLP

SEQ ID NO: 96652 - protein, 9 aa, Homo Sapiens
FYNDGKKIE

SEQ ID NO: 96653 - protein, 9 aa, Homo Sapiens
IGLTYKTTK

SEQ ID NO: 96654 - protein, 9 aa, Homo Sapiens
TYTMHAQKE

SEQ ID NO: 96655 - protein, 9 aa, Homo Sapiens
DDGDEVILI

SEQ ID NO: 96656 - protein, 9 aa, Homo Sapiens
PQKEEQETV

SEQ ID NO: 96657 - protein, 9 aa, Homo Sapiens
QVKSLGIND

SEQ ID NO: 96658 - protein, 9 aa, Homo Sapiens
EVDVFLREE

SEQ ID NO: 96659 - protein, 9 aa, Homo Sapiens
SEWLIQIHN

SEQ ID NO: 96660 - protein, 9 aa, Homo Sapiens
SFLNDISPN

SEQ ID NO: 96661 - protein, 9 aa, Homo Sapiens
FFHPLTPLV

SEQ ID NO: 96662 - protein, 9 aa, Homo Sapiens
VSQNQRLKV

SEQ ID NO: 96663 - protein, 9 aa, Homo Sapiens
EFCAPVIER

SEQ ID NO: 96664 - protein, 9 aa, Homo Sapiens
QMKKSEKNS

SEQ ID NO: 96665 - protein, 9 aa, Homo Sapiens
LYYQTKSPF

SEQ ID NO: 96666 - protein, 9 aa, Homo Sapiens
MRAHQAKIF

SEQ ID NO: 96667 - protein, 9 aa, Homo Sapiens
KLKILEHHQ

SEQ ID NO: 96668 - protein, 9 aa, Homo Sapiens
WMLFISWNS

SEQ ID NO: 96669 - protein, 9 aa, Homo Sapiens
RSLEQQNTE

SEQ ID NO: 96670 - protein, 9 aa, Homo Sapiens
FEDQDCARG

SEQ ID NO: 96671 - protein, 9 aa, Homo Sapiens
VFVQTPSPR

SEQ ID NO: 96672 - protein, 9 aa, Homo Sapiens
AKMMAPPTH

SEQ ID NO: 96673 - protein, 9 aa, Homo Sapiens
LEQPHGVVV

SEQ ID NO: 96674 - protein, 9 aa, Homo Sapiens
VYVWGFSAT

SEQ ID NO: 96675 - protein, 9 aa, Homo Sapiens
KTAQAHHRA

SEQ ID NO: 96676 - protein, 9 aa, Homo Sapiens
VTALEIPNK

SEQ ID NO: 96677 - protein, 9 aa, Homo Sapiens
GQPLGALGG

SEQ ID NO: 96678 - protein, 9 aa, Homo Sapiens
CFSGKVQCY

SEQ ID NO: 96679 - protein, 9 aa, Homo Sapiens
KKEGIECTF

SEQ ID NO: 96680 - protein, 9 aa, Homo Sapiens
TRRLSAFQP

SEQ ID NO: 96681 - protein, 9 aa, Homo Sapiens
PGGCLTSEC

SEQ ID NO: 96682 - protein, 9 aa, Homo Sapiens
NKDVNEALK

SEQ ID NO: 96683 - protein, 9 aa, Homo Sapiens
TCGRQFTSS

SEQ ID NO: 96684 - protein, 9 aa, Homo Sapiens
FQRAPPSSG

SEQ ID NO: 96685 - protein, 9 aa, Homo Sapiens
ILNIPSAEG

SEQ ID NO: 96686 - protein, 9 aa, Homo Sapiens
EEEKVSEPE

SEQ ID NO: 96687 - protein, 9 aa, Homo Sapiens
CTCDVETVD

SEQ ID NO: 96688 - protein, 9 aa, Homo Sapiens
SLTGALVPD

SEQ ID NO: 96689 - protein, 9 aa, Homo Sapiens
LDLPVFANN

SEQ ID NO: 96690 - protein, 9 aa, Homo Sapiens
LPPACNSSA

SEQ ID NO: 96691 - protein, 9 aa, Homo Sapiens
NRSILTPRI

SEQ ID NO: 96692 - protein, 9 aa, Homo Sapiens
VFRKGKVLA

SEQ ID NO: 96693 - protein, 9 aa, Homo Sapiens
KHRPGKSSA

SEQ ID NO: 96694 - protein, 9 aa, Homo Sapiens
MLDFSNPLD

SEQ ID NO: 96695 - protein, 9 aa, Homo Sapiens
LFLYFLCKS

SEQ ID NO: 96696 - protein, 9 aa, Homo Sapiens
NHYPWLISM

SEQ ID NO: 96697 - protein, 9 aa, Homo Sapiens
QKALLYSTA

SEQ ID NO: 96698 - protein, 9 aa, Homo Sapiens
LQSRNSTLD

SEQ ID NO: 96699 - protein, 9 aa, Homo Sapiens
GNHYPWLIS

SEQ ID NO: 96700 - protein, 9 aa, Homo Sapiens
WLLNGFPRT

SEQ ID NO: 96701 - protein, 9 aa, Homo Sapiens
SVANTAEEK

SEQ ID NO: 96702 - protein, 9 aa, Homo Sapiens
QEKSWQMPP

SEQ ID NO: 96703 - protein, 9 aa, Homo Sapiens
LSIIAPPPV

SEQ ID NO: 96704 - protein, 9 aa, Homo Sapiens
MAVPAADMG

SEQ ID NO: 96705 - protein, 9 aa, Homo Sapiens
SVLRCVNHR

SEQ ID NO: 96706 - protein, 9 aa, Homo Sapiens
RSRSRPPPV

SEQ ID NO: 96707 - protein, 9 aa, Homo Sapiens
DFSNPLDIP

SEQ ID NO: 96708 - protein, 9 aa, Homo Sapiens
LPLGAQQDA

SEQ ID NO: 96709 - protein, 9 aa, Homo Sapiens
FQQDDAHMF

SEQ ID NO: 96710 - protein, 9 aa, Homo Sapiens
RVILYIVCG

SEQ ID NO: 96711 - protein, 9 aa, Homo Sapiens
PKKIRHKSL

SEQ ID NO: 96712 - protein, 9 aa, Homo Sapiens
GARGQPLGA

SEQ ID NO: 96713 - protein, 9 aa, Homo Sapiens
CCRETVEFK

SEQ ID NO: 96714 - protein, 9 aa, Homo Sapiens
NCCRETVEF

SEQ ID NO: 96715 - protein, 9 aa, Homo Sapiens
QAKIFMENS

SEQ ID NO: 96716 - protein, 9 aa, Homo Sapiens
DPQGQGFHD

SEQ ID NO: 96717 - protein, 9 aa, Homo Sapiens
PVQPILKLK

SEQ ID NO: 96718 - protein, 9 aa, Homo Sapiens
AQQDAITLR

SEQ ID NO: 96719 - protein, 9 aa, Homo Sapiens
DMVSLCSEA

SEQ ID NO: 96720 - protein, 9 aa, Homo Sapiens
ASSLQTSRG

SEQ ID NO: 96721 - protein, 9 aa, Homo Sapiens
LKLKSIEEV

SEQ ID NO: 96722 - protein, 9 aa, Homo Sapiens
RPHLRYQLG

SEQ ID NO: 96723 - protein, 9 aa, Homo Sapiens
QSAAVTPLS

SEQ ID NO: 96724 - protein, 9 aa, Homo Sapiens
KLERPPSVD

SEQ ID NO: 96725 - protein, 9 aa, Homo Sapiens
NKIASKLER

SEQ ID NO: 96726 - protein, 9 aa, Homo Sapiens
GYRIHGVIA

SEQ ID NO: 96727 - protein, 9 aa, Homo Sapiens
TVLIRRPHL

SEQ ID NO: 96728 - protein, 9 aa, Homo Sapiens
VCCPKKIRH

SEQ ID NO: 96729 - protein, 9 aa, Homo Sapiens
PQDGMEAMP

SEQ ID NO: 96730 - protein, 9 aa, Homo Sapiens
VKFKHFLLS

SEQ ID NO: 96731 - protein, 9 aa, Homo Sapiens
AVKKTSLFK

SEQ ID NO: 96732 - protein, 9 aa, Homo Sapiens
AMPNPFIQQ

SEQ ID NO: 96733 - protein, 9 aa, Homo Sapiens
QDGMEAMPN

SEQ ID NO: 96734 - protein, 9 aa, Homo Sapiens
PVFANNADQ

SEQ ID NO: 96735 - protein, 9 aa, Homo Sapiens
ASCFWYVMV

SEQ ID NO: 96736 - protein, 9 aa, Homo Sapiens
CRETVEFKC

SEQ ID NO: 96737 - protein, 9 aa, Homo Sapiens
ELTTLLHKL

SEQ ID NO: 96738 - protein, 9 aa, Homo Sapiens
VDVFLREEW

SEQ ID NO: 96739 - protein, 9 aa, Homo Sapiens
RWQKALSWW

SEQ ID NO: 96740 - protein, 9 aa, Homo Sapiens
SSRQNWLET

SEQ ID NO: 96741 - protein, 9 aa, Homo Sapiens
KILEHHQQR

SEQ ID NO: 96742 - protein, 9 aa, Homo Sapiens
QAHHRAETL

SEQ ID NO: 96743 - protein, 9 aa, Homo Sapiens
HPEPFGHFL

SEQ ID NO: 96744 - protein, 9 aa, Homo Sapiens
QTSFLLLVE

SEQ ID NO: 96745 - protein, 9 aa, Homo Sapiens
FMKTAQAHH

SEQ ID NO: 96746 - protein, 9 aa, Homo Sapiens
KERKKPIYD

SEQ ID NO: 96747 - protein, 9 aa, Homo Sapiens
DQDCARGDQ

SEQ ID NO: 96748 - protein, 9 aa, Homo Sapiens
GAQWARGKT

SEQ ID NO: 96749 - protein, 9 aa, Homo Sapiens
LFFEDFQEY

SEQ ID NO: 96750 - protein, 9 aa, Homo Sapiens
RSSEEQKRV

SEQ ID NO: 96751 - protein, 9 aa, Homo Sapiens
YSCLYYQTK

SEQ ID NO: 96752 - protein, 9 aa, Homo Sapiens
CFQQDDAHM

SEQ ID NO: 96753 - protein, 9 aa, Homo Sapiens
DVSGVPAKV

SEQ ID NO: 96754 - protein, 9 aa, Homo Sapiens
ECLGAVIAG

SEQ ID NO: 96755 - protein, 9 aa, Homo Sapiens
MVFTPGLIP

SEQ ID NO: 96756 - protein, 9 aa, Homo Sapiens
PWLISMKKL

SEQ ID NO: 96757 - protein, 9 aa, Homo Sapiens
KRHPEPFGH

SEQ ID NO: 96758 - protein, 9 aa, Homo Sapiens
VKRTEKKTT

SEQ ID NO: 96759 - protein, 9 aa, Homo Sapiens
EKLTQDLKD

SEQ ID NO: 96760 - protein, 9 aa, Homo Sapiens
ISCQTSFLL

SEQ ID NO: 96761 - protein, 9 aa, Homo Sapiens
MLRLVQCAN

SEQ ID NO: 96762 - protein, 9 aa, Homo Sapiens
EVQPQHPDK

SEQ ID NO: 96763 - protein, 9 aa, Homo Sapiens
MEADGIKLH

SEQ ID NO: 96764 - protein, 9 aa, Homo Sapiens
GPTPQGGNQ

SEQ ID NO: 96765 - protein, 9 aa, Homo Sapiens
REPTPEENL

SEQ ID NO: 96766 - protein, 9 aa, Homo Sapiens
HMFCTTDQL

SEQ ID NO: 96767 - protein, 9 aa, Homo Sapiens
EAMPNPFIQ

SEQ ID NO: 96768 - protein, 9 aa, Homo Sapiens
RFLFLYFLC

SEQ ID NO: 96769 - protein, 9 aa, Homo Sapiens
FEYLLPDKV

SEQ ID NO: 96770 - protein, 9 aa, Homo Sapiens
SVLFQMIFR

SEQ ID NO: 96771 - protein, 9 aa, Homo Sapiens
GFSYWACEL

SEQ ID NO: 96772 - protein, 9 aa, Homo Sapiens
SGVPAKVLC

SEQ ID NO: 96773 - protein, 9 aa, Homo Sapiens
SIGVLWTLH

SEQ ID NO: 96774 - protein, 9 aa, Homo Sapiens
VAAILNIPS

SEQ ID NO: 96775 - protein, 9 aa, Homo Sapiens
EQPHGVVVH

SEQ ID NO: 96776 - protein, 9 aa, Homo Sapiens
LFQMIFRFL

SEQ ID NO: 96777 - protein, 9 aa, Homo Sapiens
AQDDPLAER

SEQ ID NO: 96778 - protein, 9 aa, Homo Sapiens
DRRFDSAQE

SEQ ID NO: 96779 - protein, 9 aa, Homo Sapiens
YVLESFRDL

SEQ ID NO: 96780 - protein, 9 aa, Homo Sapiens
HQDPSKTAL

SEQ ID NO: 96781 - protein, 9 aa, Homo Sapiens
DFEWLRREL

SEQ ID NO: 96782 - protein, 9 aa, Homo Sapiens
KDKNEDTKI

SEQ ID NO: 96783 - protein, 9 aa, Homo Sapiens
TIQALIDDG

SEQ ID NO: 96784 - protein, 9 aa, Homo Sapiens
RLWLLLRFL

SEQ ID NO: 96785 - protein, 9 aa, Homo Sapiens
IASKLERPP

SEQ ID NO: 96786 - protein, 9 aa, Homo Sapiens
KVSEPEVGA

SEQ ID NO: 96787 - protein, 9 aa, Homo Sapiens
NKEQYQVVI

SEQ ID NO: 96788 - protein, 9 aa, Homo Sapiens
SKLERPPSV

SEQ ID NO: 96789 - protein, 9 aa, Homo Sapiens
DDPLAERTK

SEQ ID NO: 96790 - protein, 9 aa, Homo Sapiens
ICETIVWKG

SEQ ID NO: 96791 - protein, 9 aa, Homo Sapiens
PLDIPDQVI

SEQ ID NO: 96792 - protein, 9 aa, Homo Sapiens
RTRICLADM

SEQ ID NO: 96793 - protein, 9 aa, Homo Sapiens
KKIRHKSLS

SEQ ID NO: 96794 - protein, 9 aa, Homo Sapiens
KKIEQVFVL

SEQ ID NO: 96795 - protein, 9 aa, Homo Sapiens
RSIGVLWTL

SEQ ID NO: 96796 - protein, 9 aa, Homo Sapiens
SENAEGEGL

SEQ ID NO: 96797 - protein, 9 aa, Homo Sapiens
YLPLGAQQD

SEQ ID NO: 96798 - protein, 9 aa, Homo Sapiens
WHGFNMLRL

SEQ ID NO: 96799 - protein, 9 aa, Homo Sapiens
CFWYVMVTA

SEQ ID NO: 96800 - protein, 9 aa, Homo Sapiens
NITKLCLGS

SEQ ID NO: 96801 - protein, 9 aa, Homo Sapiens
DMENALTGT

SEQ ID NO: 96802 - protein, 9 aa, Homo Sapiens
EKSWQMPPL

SEQ ID NO: 96803 - protein, 9 aa, Homo Sapiens
SDLGLISYC

SEQ ID NO: 96804 - protein, 9 aa, Homo Sapiens
TAKAAEPVI

SEQ ID NO: 96805 - protein, 9 aa, Homo Sapiens
ENAEVKFKH

SEQ ID NO: 96806 - protein, 9 aa, Homo Sapiens
SSLVPTLSI

SEQ ID NO: 96807 - protein, 9 aa, Homo Sapiens
QKRVTVIKA

SEQ ID NO: 96808 - protein, 9 aa, Homo Sapiens
ITQPCCEPC

SEQ ID NO: 96809 - protein, 9 aa, Homo Sapiens
RGQHWLLNG

SEQ ID NO: 96810 - protein, 9 aa, Homo Sapiens
QMIFRFLFL

SEQ ID NO: 96811 - protein, 9 aa, Homo Sapiens
EIIHQKQKS

SEQ ID NO: 96812 - protein, 9 aa, Homo Sapiens
MGASCFWYV

SEQ ID NO: 96813 - protein, 9 aa, Homo Sapiens
DYSAASRAF

SEQ ID NO: 96814 - protein, 9 aa, Homo Sapiens
PGKPQGPTP

SEQ ID NO: 96815 - protein, 9 aa, Homo Sapiens
LGAVIAGNH

SEQ ID NO: 96816 - protein, 9 aa, Homo Sapiens
RTKFIRCRG

SEQ ID NO: 96817 - protein, 9 aa, Homo Sapiens
RKALKELYK

SEQ ID NO: 96818 - protein, 9 aa, Homo Sapiens
VEKLPNQPN

SEQ ID NO: 96819 - protein, 9 aa, Homo Sapiens
TVPDEIIHQ

SEQ ID NO: 96820 - protein, 9 aa, Homo Sapiens
ASDSCSKSS

SEQ ID NO: 96821 - protein, 9 aa, Homo Sapiens
HHRAETLIF

SEQ ID NO: 96822 - protein, 9 aa, Homo Sapiens
MFFMMAAML

SEQ ID NO: 96823 - protein, 9 aa, Homo Sapiens
PPQSIKLVY

SEQ ID NO: 96824 - protein, 9 aa, Homo Sapiens
VQPQHPDKA

SEQ ID NO: 96825 - protein, 9 aa, Homo Sapiens
PQGPTPQGG

SEQ ID NO: 96826 - protein, 9 aa, Homo Sapiens
SDGEERPAA

SEQ ID NO: 96827 - protein, 9 aa, Homo Sapiens
AALLTERGA

SEQ ID NO: 96828 - protein, 9 aa, Homo Sapiens
VRLIWDLAF

SEQ ID NO: 96829 - protein, 9 aa, Homo Sapiens
LTEKEKQLE

SEQ ID NO: 96830 - protein, 9 aa, Homo Sapiens
IKLHRWKVQ

SEQ ID NO: 96831 - protein, 9 aa, Homo Sapiens
LLNGFPRTL

SEQ ID NO: 96832 - protein, 9 aa, Homo Sapiens
SEPEVGAAI

SEQ ID NO: 96833 - protein, 9 aa, Homo Sapiens
RARCPKFAD

SEQ ID NO: 96834 - protein, 9 aa, Homo Sapiens
DGMEAMPNP

SEQ ID NO: 96835 - protein, 9 aa, Homo Sapiens
NLTWPPAIK

SEQ ID NO: 96836 - protein, 9 aa, Homo Sapiens
HKALRLDLV

SEQ ID NO: 96837 - protein, 9 aa, Homo Sapiens
WLGQNEFNF

SEQ ID NO: 96838 - protein, 9 aa, Homo Sapiens
QVKQQPKEP

SEQ ID NO: 96839 - protein, 9 aa, Homo Sapiens
MPNPFIQQQ

SEQ ID NO: 96840 - protein, 9 aa, Homo Sapiens
NKIQAIAAR

SEQ ID NO: 96841 - protein, 9 aa, Homo Sapiens
NWLETTIRS

SEQ ID NO: 96842 - protein, 9 aa, Homo Sapiens
MYAVALDLP

SEQ ID NO: 96843 - protein, 9 aa, Homo Sapiens
ADMGPSALG

SEQ ID NO: 96844 - protein, 9 aa, Homo Sapiens
SCLYYQTKS

SEQ ID NO: 96845 - protein, 9 aa, Homo Sapiens
GKKIEQVFV

SEQ ID NO: 96846 - protein, 9 aa, Homo Sapiens
PLQVTALEI

SEQ ID NO: 96847 - protein, 9 aa, Homo Sapiens
GLHGLVAGG

SEQ ID NO: 96848 - protein, 9 aa, Homo Sapiens
TPQGGNQPQ

SEQ ID NO: 96849 - protein, 9 aa, Homo Sapiens
EASKLTNHM

SEQ ID NO: 96850 - protein, 9 aa, Homo Sapiens
TDVLSFLFH

SEQ ID NO: 96851 - protein, 9 aa, Homo Sapiens
LGQNEFNFM

SEQ ID NO: 96852 - protein, 9 aa, Homo Sapiens
NHITSTDCN

SEQ ID NO: 96853 - protein, 9 aa, Homo Sapiens
MGINVTDFN

SEQ ID NO: 96854 - protein, 9 aa, Homo Sapiens
HKDTTIMEL

SEQ ID NO: 96855 - protein, 9 aa, Homo Sapiens
TIITMTTLG

SEQ ID NO: 96856 - protein, 9 aa, Homo Sapiens
HEVAPPRVV

SEQ ID NO: 96857 - protein, 9 aa, Homo Sapiens
ALELQSRNS

SEQ ID NO: 96858 - protein, 9 aa, Homo Sapiens
LWLLLRFLS

SEQ ID NO: 96859 - protein, 9 aa, Homo Sapiens
DRKIYIDLP

SEQ ID NO: 96860 - protein, 9 aa, Homo Sapiens
EKKDKNEDT

SEQ ID NO: 96861 - protein, 9 aa, Homo Sapiens
ALDLPVFAN

SEQ ID NO: 96862 - protein, 9 aa, Homo Sapiens
VGLHGLVAG

SEQ ID NO: 96863 - protein, 9 aa, Homo Sapiens
GCSPHASCT

SEQ ID NO: 96864 - protein, 9 aa, Homo Sapiens
NCLPYCSPS

SEQ ID NO: 96865 - protein, 9 aa, Homo Sapiens
EEKVSEPEV

SEQ ID NO: 96866 - protein, 9 aa, Homo Sapiens
LNKKLSEQE

SEQ ID NO: 96867 - protein, 9 aa, Homo Sapiens
QKMNKIQAI

SEQ ID NO: 96868 - protein, 9 aa, Homo Sapiens
EYKKEGIEC

SEQ ID NO: 96869 - protein, 9 aa, Homo Sapiens
SLRNKDVNE

SEQ ID NO: 96870 - protein, 9 aa, Homo Sapiens
TCGSSNLTW

SEQ ID NO: 96871 - protein, 9 aa, Homo Sapiens
KLPNQPNRL

SEQ ID NO: 96872 - protein, 9 aa, Homo Sapiens
PPPVTRRRS

SEQ ID NO: 96873 - protein, 9 aa, Homo Sapiens
FLFHEHLKA

SEQ ID NO: 96874 - protein, 9 aa, Homo Sapiens
QSRNSTLDP

SEQ ID NO: 96875 - protein, 9 aa, Homo Sapiens
EARNGRWQK

SEQ ID NO: 96876 - protein, 9 aa, Homo Sapiens
KALLYSTAM

SEQ ID NO: 96877 - protein, 9 aa, Homo Sapiens
TEKEKQLET

SEQ ID NO: 96878 - protein, 9 aa, Homo Sapiens
FLREEWPAL

SEQ ID NO: 96879 - protein, 9 aa, Homo Sapiens
KQMNDARHG

SEQ ID NO: 96880 - protein, 9 aa, Homo Sapiens
SPHASCTKV

SEQ ID NO: 96881 - protein, 9 aa, Homo Sapiens
VHRCSLSVT

SEQ ID NO: 96882 - protein, 9 aa, Homo Sapiens
KHFLLSLKT

SEQ ID NO: 96883 - protein, 9 aa, Homo Sapiens
KMIPLSECK

SEQ ID NO: 96884 - protein, 9 aa, Homo Sapiens
SSEEQKRVT

SEQ ID NO: 96885 - protein, 9 aa, Homo Sapiens
TAKWASSLE

SEQ ID NO: 96886 - protein, 9 aa, Homo Sapiens
RLNKKLSEQ

SEQ ID NO: 96887 - protein, 9 aa, Homo Sapiens
FLCKSFCFL

SEQ ID NO: 96888 - protein, 9 aa, Homo Sapiens
HLLPALSGL

SEQ ID NO: 96889 - protein, 9 aa, Homo Sapiens
PDYSAASRA

SEQ ID NO: 96890 - protein, 9 aa, Homo Sapiens
ILYIVCGFG

SEQ ID NO: 96891 - protein, 9 aa, Homo Sapiens
AIMVSERLR

SEQ ID NO: 96892 - protein, 9 aa, Homo Sapiens
FNRSILTPR

SEQ ID NO: 96893 - protein, 9 aa, Homo Sapiens
FTNGSSLFF

SEQ ID NO: 96894 - protein, 9 aa, Homo Sapiens
STTASGLSC

SEQ ID NO: 96895 - protein, 9 aa, Homo Sapiens
SKMIPLSEC

SEQ ID NO: 96896 - protein, 9 aa, Homo Sapiens
TLNLTTITQ

SEQ ID NO: 96897 - protein, 9 aa, Homo Sapiens
NAKMMAPPT

SEQ ID NO: 96898 - protein, 9 aa, Homo Sapiens
ASKLERPPS

SEQ ID NO: 96899 - protein, 9 aa, Homo Sapiens
SRTIGQAAA

SEQ ID NO: 96900 - protein, 9 aa, Homo Sapiens
SLDVFVQTP

SEQ ID NO: 96901 - protein, 9 aa, Homo Sapiens
QGRSYKEFC

SEQ ID NO: 96902 - protein, 9 aa, Homo Sapiens
PLQEREPTP

SEQ ID NO: 96903 - protein, 9 aa, Homo Sapiens
EEEEEKVSE

SEQ ID NO: 96904 - protein, 9 aa, Homo Sapiens
GPVQPILKL

SEQ ID NO: 96905 - protein, 9 aa, Homo Sapiens
KIEQVFVLT

SEQ ID NO: 96906 - protein, 9 aa, Homo Sapiens
AMNFPISNL

SEQ ID NO: 96907 - protein, 9 aa, Homo Sapiens
MAEVDVFLR

SEQ ID NO: 96908 - protein, 9 aa, Homo Sapiens
KLTNHMELF

SEQ ID NO: 96909 - protein, 9 aa, Homo Sapiens
LLENRSLEQ

SEQ ID NO: 96910 - protein, 9 aa, Homo Sapiens
NPLDIPDQV

SEQ ID NO: 96911 - protein, 9 aa, Homo Sapiens
FISWNSHHI

SEQ ID NO: 96912 - protein, 9 aa, Homo Sapiens
PTLSIIAPP

SEQ ID NO: 96913 - protein, 9 aa, Homo Sapiens
VGNPPFTLT

SEQ ID NO: 96914 - protein, 9 aa, Homo Sapiens
LTSITTKCN

SEQ ID NO: 96915 - protein, 9 aa, Homo Sapiens
AKWASSLEN

SEQ ID NO: 96916 - protein, 9 aa, Homo Sapiens
ERPPSVDSI

SEQ ID NO: 96917 - protein, 9 aa, Homo Sapiens
KEGPYSELS

SEQ ID NO: 96918 - protein, 9 aa, Homo Sapiens
EQKRVTVIK

SEQ ID NO: 96919 - protein, 9 aa, Homo Sapiens
LYRSSEEQK

SEQ ID NO: 96920 - protein, 9 aa, Homo Sapiens
HHQQRIAEV

SEQ ID NO: 96921 - protein, 9 aa, Homo Sapiens
VLWTLHTWL

SEQ ID NO: 96922 - protein, 9 aa, Homo Sapiens
LFIFSHGNM

SEQ ID NO: 96923 - protein, 9 aa, Homo Sapiens
LSPLQDRLV

SEQ ID NO: 96924 - protein, 9 aa, Homo Sapiens
VSERLRCIG

SEQ ID NO: 96925 - protein, 9 aa, Homo Sapiens
VTPQKEEQE

SEQ ID NO: 96926 - protein, 9 aa, Homo Sapiens
LLPYKAQVI

SEQ ID NO: 96927 - protein, 9 aa, Homo Sapiens
RVLGQVVEC

SEQ ID NO: 96928 - protein, 9 aa, Homo Sapiens
AQESVTEDP

SEQ ID NO: 96929 - protein, 9 aa, Homo Sapiens
RIHGVIAQP

SEQ ID NO: 96930 - protein, 9 aa, Homo Sapiens
VMIADISPA

SEQ ID NO: 96931 - protein, 9 aa, Homo Sapiens
RGVASTTAS

SEQ ID NO: 96932 - protein, 9 aa, Homo Sapiens
FWYVMVTAA

SEQ ID NO: 96933 - protein, 9 aa, Homo Sapiens
ISRSNAITS

SEQ ID NO: 96934 - protein, 9 aa, Homo Sapiens
VYNIGALRR

SEQ ID NO: 96935 - protein, 9 aa, Homo Sapiens
ILEHHQQRI

SEQ ID NO: 96936 - protein, 9 aa, Homo Sapiens
PWMLFISWN

SEQ ID NO: 96937 - protein, 9 aa, Homo Sapiens
RTGAFQPAE

SEQ ID NO: 96938 - protein, 9 aa, Homo Sapiens
WNSHHIRDG

SEQ ID NO: 96939 - protein, 9 aa, Homo Sapiens
KKLQKICIS

SEQ ID NO: 96940 - protein, 9 aa, Homo Sapiens
WTSEWAVPQ

SEQ ID NO: 96941 - protein, 9 aa, Homo Sapiens
MEAMPNPFI

SEQ ID NO: 96942 - protein, 9 aa, Homo Sapiens
AVIAGNHYP

SEQ ID NO: 96943 - protein, 9 aa, Homo Sapiens
AIKTAKAAE

SEQ ID NO: 96944 - protein, 9 aa, Homo Sapiens
LTERGASLE

SEQ ID NO: 96945 - protein, 9 aa, Homo Sapiens
FLYFLCKSF

SEQ ID NO: 96946 - protein, 9 aa, Homo Sapiens
SLQTSRGTS

SEQ ID NO: 96947 - protein, 9 aa, Homo Sapiens
FQVFVFEYL

SEQ ID NO: 96948 - protein, 9 aa, Homo Sapiens
FWYTIITMT

SEQ ID NO: 96949 - protein, 9 aa, Homo Sapiens
CFKEKSRKA

SEQ ID NO: 96950 - protein, 9 aa, Homo Sapiens
QPHGVVVHP

SEQ ID NO: 96951 - protein, 9 aa, Homo Sapiens
DVFLREEWP

SEQ ID NO: 96952 - protein, 9 aa, Homo Sapiens
AKVLCNIEA

SEQ ID NO: 96953 - protein, 9 aa, Homo Sapiens
YAVALDLPV

SEQ ID NO: 96954 - protein, 9 aa, Homo Sapiens
ARHGGWTTK

SEQ ID NO: 96955 - protein, 9 aa, Homo Sapiens
EPTPEENLT

SEQ ID NO: 96956 - protein, 9 aa, Homo Sapiens
LKEEIIYEC

SEQ ID NO: 96957 - protein, 9 aa, Homo Sapiens
KEKLTQDLK

SEQ ID NO: 96958 - protein, 9 aa, Homo Sapiens
FCSLWMLKP

SEQ ID NO: 96959 - protein, 9 aa, Homo Sapiens
IVKLSPLQD

SEQ ID NO: 96960 - protein, 9 aa, Homo Sapiens
VIGFSYWAC

SEQ ID NO: 96961 - protein, 9 aa, Homo Sapiens
NAEVKFKHF

SEQ ID NO: 96962 - protein, 9 aa, Homo Sapiens
EKRKSREYK

SEQ ID NO: 96963 - protein, 9 aa, Homo Sapiens
GGCLTSECG

SEQ ID NO: 96964 - protein, 9 aa, Homo Sapiens
LFLFIFSHG

SEQ ID NO: 96965 - protein, 9 aa, Homo Sapiens
GLQLYLDLL

SEQ ID NO: 96966 - protein, 9 aa, Homo Sapiens
KQMKKSEKN

SEQ ID NO: 96967 - protein, 9 aa, Homo Sapiens
RNKDVNEAL

SEQ ID NO: 96968 - protein, 9 aa, Homo Sapiens
EGTVHKDTT

SEQ ID NO: 96969 - protein, 9 aa, Homo Sapiens
AVIHYRNDE

SEQ ID NO: 96970 - protein, 9 aa, Homo Sapiens
RADNSAPGK

SEQ ID NO: 96971 - protein, 9 aa, Homo Sapiens
VDVSGVPAK

SEQ ID NO: 96972 - protein, 9 aa, Homo Sapiens
LDRRFDSAQ

SEQ ID NO: 96973 - protein, 9 aa, Homo Sapiens
IIVKLSPLQ

SEQ ID NO: 96974 - protein, 9 aa, Homo Sapiens
GHIDPSVRL

SEQ ID NO: 96975 - protein, 9 aa, Homo Sapiens
HNIIKSHLE

SEQ ID NO: 96976 - protein, 9 aa, Homo Sapiens
QEEDFGDPR

SEQ ID NO: 96977 - protein, 9 aa, Homo Sapiens
FASDSCSKS

SEQ ID NO: 96978 - protein, 9 aa, Homo Sapiens
VLKITDYVL

SEQ ID NO: 96979 - protein, 9 aa, Homo Sapiens
FVAIKTAKA

SEQ ID NO: 96980 - protein, 9 aa, Homo Sapiens
PFMAKVTGP

SEQ ID NO: 96981 - protein, 9 aa, Homo Sapiens
TTLLHKLQA

SEQ ID NO: 96982 - protein, 9 aa, Homo Sapiens
SLSFYHNKL

SEQ ID NO: 96983 - protein, 9 aa, Homo Sapiens
GSWPLQVTA

SEQ ID NO: 96984 - protein, 9 aa, Homo Sapiens
EVSFSFAKK

SEQ ID NO: 96985 - protein, 9 aa, Homo Sapiens
HRCSLSVTL

SEQ ID NO: 96986 - protein, 9 aa, Homo Sapiens
ADMVSLCSE

SEQ ID NO: 96987 - protein, 9 aa, Homo Sapiens
QSSSYSFLK

SEQ ID NO: 96988 - protein, 9 aa, Homo Sapiens
QLQSDVTYT

SEQ ID NO: 96989 - protein, 9 aa, Homo Sapiens
NHMELFKKP

SEQ ID NO: 96990 - protein, 9 aa, Homo Sapiens
IILGYRIHG

SEQ ID NO: 96991 - protein, 9 aa, Homo Sapiens
ESVTEDPEL

SEQ ID NO: 96992 - protein, 9 aa, Homo Sapiens
CHEVAPPRV

SEQ ID NO: 96993 - protein, 9 aa, Homo Sapiens
MNFPISNLC

SEQ ID NO: 96994 - protein, 9 aa, Homo Sapiens
PTDVLSFLF

SEQ ID NO: 96995 - protein, 9 aa, Homo Sapiens
DPSKTALSR

SEQ ID NO: 96996 - protein, 9 aa, Homo Sapiens
MAEPVCPLK

SEQ ID NO: 96997 - protein, 9 aa, Homo Sapiens
GINVTDFNR

SEQ ID NO: 96998 - protein, 9 aa, Homo Sapiens
SSYTNCLPY

SEQ ID NO: 96999 - protein, 9 aa, Homo Sapiens
EGDPQGQGF

SEQ ID NO: 97000 - protein, 9 aa, Homo Sapiens
KPIYDTISK

SEQ ID NO: 97001 - protein, 9 aa, Homo Sapiens
LFKEDKEDD

SEQ ID NO: 97002 - protein, 9 aa, Homo Sapiens
SPSRDVSHM

SEQ ID NO: 97003 - protein, 9 aa, Homo Sapiens
VAGTGGLGA

SEQ ID NO: 97004 - protein, 9 aa, Homo Sapiens
KSYENVLSS

SEQ ID NO: 97005 - protein, 9 aa, Homo Sapiens
ISTLSSKGG

SEQ ID NO: 97006 - protein, 9 aa, Homo Sapiens
QDLKDHNAT

SEQ ID NO: 97007 - protein, 9 aa, Homo Sapiens
PTVPDEIIH

SEQ ID NO: 97008 - protein, 9 aa, Homo Sapiens
PYCSPSCWD

SEQ ID NO: 97009 - protein, 9 aa, Homo Sapiens
PVIQGNAKM

SEQ ID NO: 97010 - protein, 9 aa, Homo Sapiens
IAHNIIKSH

SEQ ID NO: 97011 - protein, 9 aa, Homo Sapiens
QAGQGQSAG

SEQ ID NO: 97012 - protein, 9 aa, Homo Sapiens
NHNFCDLVP

SEQ ID NO: 97013 - protein, 9 aa, Homo Sapiens
TAMKLRRVH

SEQ ID NO: 97014 - protein, 9 aa, Homo Sapiens
TDFNRSILT

SEQ ID NO: 97015 - protein, 9 aa, Homo Sapiens
VTDFNRSIL

SEQ ID NO: 97016 - protein, 9 aa, Homo Sapiens
LPVFANNAD

SEQ ID NO: 97017 - protein, 9 aa, Homo Sapiens
VDRFNNYRL

SEQ ID NO: 97018 - protein, 9 aa, Homo Sapiens
PGDSLDVFV

SEQ ID NO: 97019 - protein, 9 aa, Homo Sapiens
MKKSEKNSK

SEQ ID NO: 97020 - protein, 9 aa, Homo Sapiens
EAFMEEPVS

SEQ ID NO: 97021 - protein, 9 aa, Homo Sapiens
VLGQVVECS

SEQ ID NO: 97022 - protein, 9 aa, Homo Sapiens
CLPYCSPSC

SEQ ID NO: 97023 - protein, 9 aa, Homo Sapiens
KALKELYKQ

SEQ ID NO: 97024 - protein, 9 aa, Homo Sapiens
HGNMGAYII

SEQ ID NO: 97025 - protein, 9 aa, Homo Sapiens
PQSIKLVYV

SEQ ID NO: 97026 - protein, 9 aa, Homo Sapiens
LPNQPNRLL

SEQ ID NO: 97027 - protein, 9 aa, Homo Sapiens
YCSPSCWDL

SEQ ID NO: 97028 - protein, 9 aa, Homo Sapiens
GALRRGCCV

SEQ ID NO: 97029 - protein, 9 aa, Homo Sapiens
LPHPVRPQD

SEQ ID NO: 97030 - protein, 9 aa, Homo Sapiens
YLKWFESKV

SEQ ID NO: 97031 - protein, 9 aa, Homo Sapiens
RRLSAFQPG

SEQ ID NO: 97032 - protein, 9 aa, Homo Sapiens
AQLQSDVTY

SEQ ID NO: 97033 - protein, 9 aa, Homo Sapiens
FTPGLIPLP

SEQ ID NO: 97034 - protein, 9 aa, Homo Sapiens
ITMTTLGYG

SEQ ID NO: 97035 - protein, 9 aa, Homo Sapiens
LPFTNGSSL

SEQ ID NO: 97036 - protein, 9 aa, Homo Sapiens
VPTLSIIAP

SEQ ID NO: 97037 - protein, 9 aa, Homo Sapiens
KSSAPAPPP

SEQ ID NO: 97038 - protein, 9 aa, Homo Sapiens
FIRCRGAHR

SEQ ID NO: 97039 - protein, 9 aa, Homo Sapiens
AILNIPSAE

SEQ ID NO: 97040 - protein, 9 aa, Homo Sapiens
LAALLTERG

SEQ ID NO: 97041 - protein, 9 aa, Homo Sapiens
PIVVVRTEK

SEQ ID NO: 97042 - protein, 9 aa, Homo Sapiens
PSPPLTPYF

SEQ ID NO: 97043 - protein, 9 aa, Homo Sapiens
LDVFVQTPS

SEQ ID NO: 97044 - protein, 9 aa, Homo Sapiens
ATFTLQLPI

SEQ ID NO: 97045 - protein, 9 aa, Homo Sapiens
HLRYQLGFS

SEQ ID NO: 97046 - protein, 9 aa, Homo Sapiens
IDRIAHNII

SEQ ID NO: 97047 - protein, 9 aa, Homo Sapiens
AFMEEPVSI

SEQ ID NO: 97048 - protein, 9 aa, Homo Sapiens
ILMFFMMAA

SEQ ID NO: 97049 - protein, 9 aa, Homo Sapiens
VCGFGAVLA

SEQ ID NO: 97050 - protein, 9 aa, Homo Sapiens
GPKMLHLLP

SEQ ID NO: 97051 - protein, 9 aa, Homo Sapiens
HGVIAQPVD

SEQ ID NO: 97052 - protein, 9 aa, Homo Sapiens
RLDRKIYID

SEQ ID NO: 97053 - protein, 9 aa, Homo Sapiens
YSFLNDISP

SEQ ID NO: 97054 - protein, 9 aa, Homo Sapiens
PLYRSSEEQ

SEQ ID NO: 97055 - protein, 9 aa, Homo Sapiens
YWACELILA

SEQ ID NO: 97056 - protein, 9 aa, Homo Sapiens
RLSAFQPGF

SEQ ID NO: 97057 - protein, 9 aa, Homo Sapiens
FRFLFLYFL

SEQ ID NO: 97058 - protein, 9 aa, Homo Sapiens
ACELILAQQ

SEQ ID NO: 97059 - protein, 9 aa, Homo Sapiens
PICGNHRLD

SEQ ID NO: 97060 - protein, 9 aa, Homo Sapiens
NSKQEKEKS

SEQ ID NO: 97061 - protein, 9 aa, Homo Sapiens
FDSAQEKLL

SEQ ID NO: 97062 - protein, 9 aa, Homo Sapiens
QPGFFRNKI

SEQ ID NO: 97063 - protein, 9 aa, Homo Sapiens
QELGPAVDN

SEQ ID NO: 97064 - protein, 9 aa, Homo Sapiens
FTLQLPICG

SEQ ID NO: 97065 - protein, 9 aa, Homo Sapiens
PGRLDRKIY

SEQ ID NO: 97066 - protein, 9 aa, Homo Sapiens
IGFSYWACE

SEQ ID NO: 97067 - protein, 9 aa, Homo Sapiens
ARCPKFADI

SEQ ID NO: 97068 - protein, 9 aa, Homo Sapiens
VPDEIIHQK

SEQ ID NO: 97069 - protein, 9 aa, Homo Sapiens
VNEALKKLK

SEQ ID NO: 97070 - protein, 9 aa, Homo Sapiens
PLQDRLVVT

SEQ ID NO: 97071 - protein, 9 aa, Homo Sapiens
IDAMNFPIS

SEQ ID NO: 97072 - protein, 9 aa, Homo Sapiens
VVVHPLRGK

SEQ ID NO: 97073 - protein, 9 aa, Homo Sapiens
LSKRGPLSK

SEQ ID NO: 97074 - protein, 9 aa, Homo Sapiens
SKHRPGKSS

SEQ ID NO: 97075 - protein, 9 aa, Homo Sapiens
DSTISRSNA

SEQ ID NO: 97076 - protein, 9 aa, Homo Sapiens
IKTAKAAEP

SEQ ID NO: 97077 - protein, 9 aa, Homo Sapiens
GAVIAGNHY

SEQ ID NO: 97078 - protein, 9 aa, Homo Sapiens
RRFDSAQEK

SEQ ID NO: 97079 - protein, 9 aa, Homo Sapiens
AFQPAEASV

SEQ ID NO: 97080 - protein, 9 aa, Homo Sapiens
NMLRLVQCA

SEQ ID NO: 97081 - protein, 9 aa, Homo Sapiens
LTGALVPDS

SEQ ID NO: 97082 - protein, 9 aa, Homo Sapiens
KSKMIPLSE

SEQ ID NO: 97083 - protein, 9 aa, Homo Sapiens
QMPPLNCSH

SEQ ID NO: 97084 - protein, 9 aa, Homo Sapiens
QKQEGEQIY

SEQ ID NO: 97085 - protein, 9 aa, Homo Sapiens
EHHQQRIAE

SEQ ID NO: 97086 - protein, 9 aa, Homo Sapiens
IVPRGKSIK

SEQ ID NO: 97087 - protein, 9 aa, Homo Sapiens
YKKEGIECT

SEQ ID NO: 97088 - protein, 9 aa, Homo Sapiens
ADGIKLHRW

SEQ ID NO: 97089 - protein, 9 aa, Homo Sapiens
PYSELSKRG

SEQ ID NO: 97090 - protein, 9 aa, Homo Sapiens
TLTESRIPD

SEQ ID NO: 97091 - protein, 9 aa, Homo Sapiens
VTPLSTTSS

SEQ ID NO: 97092 - protein, 9 aa, Homo Sapiens
MNDARHGGW

SEQ ID NO: 97093 - protein, 9 aa, Homo Sapiens
LKVYEKHFA

SEQ ID NO: 97094 - protein, 9 aa, Homo Sapiens
EKCLRQLHK

SEQ ID NO: 97095 - protein, 9 aa, Homo Sapiens
SFCPVGLSL

SEQ ID NO: 97096 - protein, 9 aa, Homo Sapiens
ALTGTQSSH

SEQ ID NO: 97097 - protein, 9 aa, Homo Sapiens
DLGLISYCS

SEQ ID NO: 97098 - protein, 9 aa, Homo Sapiens
ICGNHRLDH

SEQ ID NO: 97099 - protein, 9 aa, Homo Sapiens
WLRTKFIRC

SEQ ID NO: 97100 - protein, 9 aa, Homo Sapiens
GVVVHPLRG

SEQ ID NO: 97101 - protein, 9 aa, Homo Sapiens
STISRSNAI

SEQ ID NO: 97102 - protein, 9 aa, Homo Sapiens
ANTAEEKFV

SEQ ID NO: 97103 - protein, 9 aa, Homo Sapiens
LDFSNPLDI

SEQ ID NO: 97104 - protein, 9 aa, Homo Sapiens
AADMGPSAL

SEQ ID NO: 97105 - protein, 9 aa, Homo Sapiens
TMHAQKEHL

SEQ ID NO: 97106 - protein, 9 aa, Homo Sapiens
LRLVQCANV

SEQ ID NO: 97107 - protein, 9 aa, Homo Sapiens
QMHNAGFEP

SEQ ID NO: 97108 - protein, 9 aa, Homo Sapiens
PDKSYENVL

SEQ ID NO: 97109 - protein, 9 aa, Homo Sapiens
GSKATERLN

SEQ ID NO: 97110 - protein, 9 aa, Homo Sapiens
INDTRETCW

SEQ ID NO: 97111 - protein, 9 aa, Homo Sapiens
AFQPGFFRN

SEQ ID NO: 97112 - protein, 9 aa, Homo Sapiens
WLLLRFLSV

SEQ ID NO: 97113 - protein, 9 aa, Homo Sapiens
ADTPSQEED

SEQ ID NO: 97114 - protein, 9 aa, Homo Sapiens
GALELQSRN

SEQ ID NO: 97115 - protein, 9 aa, Homo Sapiens
AKAAEPVIL

SEQ ID NO: 97116 - protein, 9 aa, Homo Sapiens
VTSIASVAN

SEQ ID NO: 97117 - protein, 9 aa, Homo Sapiens
YSFLKEEII

SEQ ID NO: 97118 - protein, 9 aa, Homo Sapiens
LKNLTEKEK

SEQ ID NO: 97119 - protein, 9 aa, Homo Sapiens
AAVTPLSTT

SEQ ID NO: 97120 - protein, 9 aa, Homo Sapiens
IEECLGAVI

SEQ ID NO: 97121 - protein, 9 aa, Homo Sapiens
SGNSPKTWT

SEQ ID NO: 97122 - protein, 9 aa, Homo Sapiens
PGKSSAPAP

SEQ ID NO: 97123 - protein, 9 aa, Homo Sapiens
YSLSENAEG

SEQ ID NO: 97124 - protein, 9 aa, Homo Sapiens
TASGLSCLA

SEQ ID NO: 97125 - protein, 9 aa, Homo Sapiens
EGPYSELSK

SEQ ID NO: 97126 - protein, 9 aa, Homo Sapiens
QKICISCQT

SEQ ID NO: 97127 - protein, 9 aa, Homo Sapiens
PQVKSLGIN

SEQ ID NO: 97128 - protein, 9 aa, Homo Sapiens
TGAFQPAEA

SEQ ID NO: 97129 - protein, 9 aa, Homo Sapiens
GEERPAAEE

SEQ ID NO: 97130 - protein, 9 aa, Homo Sapiens
ERLNKKLSE

SEQ ID NO: 97131 - protein, 9 aa, Homo Sapiens
CQRHGFMFE

SEQ ID NO: 97132 - protein, 9 aa, Homo Sapiens
QSAGSRTSR

SEQ ID NO: 97133 - protein, 9 aa, Homo Sapiens
RRPHLRYQL

SEQ ID NO: 97134 - protein, 9 aa, Homo Sapiens
TFCQRHGFM

SEQ ID NO: 97135 - protein, 9 aa, Homo Sapiens
QGPTPQGGN

SEQ ID NO: 97136 - protein, 9 aa, Homo Sapiens
VSHMGLKIT

SEQ ID NO: 97137 - protein, 9 aa, Homo Sapiens
IMVSERLRC

SEQ ID NO: 97138 - protein, 9 aa, Homo Sapiens
TYNTCGSSN

SEQ ID NO: 97139 - protein, 9 aa, Homo Sapiens
DPLAERTKN

SEQ ID NO: 97140 - protein, 9 aa, Homo Sapiens
GKSSAPAPP

SEQ ID NO: 97141 - protein, 9 aa, Homo Sapiens
VPTDVLSFL

SEQ ID NO: 97142 - protein, 9 aa, Homo Sapiens
NTAEEKFVP

SEQ ID NO: 97143 - protein, 9 aa, Homo Sapiens
GWIKVTAHP

SEQ ID NO: 97144 - protein, 9 aa, Homo Sapiens
LTGTQSSHA

SEQ ID NO: 97145 - protein, 9 aa, Homo Sapiens
EDTKIDFSE

SEQ ID NO: 97146 - protein, 9 aa, Homo Sapiens
FNMLRLVQC

SEQ ID NO: 97147 - protein, 9 aa, Homo Sapiens
ALRSLLCGS

SEQ ID NO: 97148 - protein, 9 aa, Homo Sapiens
ILGYRIHGV

SEQ ID NO: 97149 - protein, 9 aa, Homo Sapiens
CGFGAVLAV

SEQ ID NO: 97150 - protein, 9 aa, Homo Sapiens
QGQSAGSRT

SEQ ID NO: 97151 - protein, 9 aa, Homo Sapiens
QMSFCPVGL

SEQ ID NO: 97152 - protein, 9 aa, Homo Sapiens
ETLNLTTIT

SEQ ID NO: 97153 - protein, 9 aa, Homo Sapiens
DVLSFLFHE

SEQ ID NO: 97154 - protein, 9 aa, Homo Sapiens
VYLKWFESK

SEQ ID NO: 97155 - protein, 9 aa, Homo Sapiens
NAEGEGLLL

SEQ ID NO: 97156 - protein, 9 aa, Homo Sapiens
HPLTPLVAG

SEQ ID NO: 97157 - protein, 9 aa, Homo Sapiens
MGLQLYLDL

SEQ ID NO: 97158 - protein, 9 aa, Homo Sapiens
RFVAIKTAK

SEQ ID NO: 97159 - protein, 9 aa, Homo Sapiens
QPNRLLILH

SEQ ID NO: 97160 - protein, 9 aa, Homo Sapiens
ERARCPKFA

SEQ ID NO: 97161 - protein, 9 aa, Homo Sapiens
QQERARCPK

SEQ ID NO: 97162 - protein, 9 aa, Homo Sapiens
KLHRWKVQV

SEQ ID NO: 97163 - protein, 9 aa, Homo Sapiens
IIAPPPVMA

SEQ ID NO: 97164 - protein, 9 aa, Homo Sapiens
INHNFCDLV

SEQ ID NO: 97165 - protein, 9 aa, Homo Sapiens
YDKFQRAPP

SEQ ID NO: 97166 - protein, 9 aa, Homo Sapiens
HPCDCLPPL

SEQ ID NO: 97167 - protein, 9 aa, Homo Sapiens
KLVYVWGFS

SEQ ID NO: 97168 - protein, 9 aa, Homo Sapiens
CPKFADIVS

SEQ ID NO: 97169 - protein, 9 aa, Homo Sapiens
VVSQNQRLK

SEQ ID NO: 97170 - protein, 9 aa, Homo Sapiens
VPGARGQPL

SEQ ID NO: 97171 - protein, 9 aa, Homo Sapiens
PLTPLVAGN

SEQ ID NO: 97172 - protein, 9 aa, Homo Sapiens
LRRVHKALR

SEQ ID NO: 97173 - protein, 9 aa, Homo Sapiens
SYTNCLPYC

SEQ ID NO: 97174 - protein, 9 aa, Homo Sapiens
SAPGKPTRK

SEQ ID NO: 97175 - protein, 9 aa, Homo Sapiens
GQNEFNFMT

SEQ ID NO: 97176 - protein, 9 aa, Homo Sapiens
SRVILYIVC

SEQ ID NO: 97177 - protein, 9 aa, Homo Sapiens
KWASSLENL

SEQ ID NO: 97178 - protein, 9 aa, Homo Sapiens
NLTTITQPC

SEQ ID NO: 97179 - protein, 9 aa, Homo Sapiens
SELSKRGPL

SEQ ID NO: 97180 - protein, 9 aa, Homo Sapiens
LETLNLTTI

SEQ ID NO: 97181 - protein, 9 aa, Homo Sapiens
AIYGAQWAR

SEQ ID NO: 97182 - protein, 9 aa, Homo Sapiens
PVYNIGALR

SEQ ID NO: 97183 - protein, 9 aa, Homo Sapiens
TIEPDKSYE

SEQ ID NO: 97184 - protein, 9 aa, Homo Sapiens
LLLENRSLE

SEQ ID NO: 97185 - protein, 9 aa, Homo Sapiens
SSYSFLKEE

SEQ ID NO: 97186 - protein, 9 aa, Homo Sapiens
DEGLCFSGK

SEQ ID NO: 97187 - protein, 9 aa, Homo Sapiens
MLHLLPALS

SEQ ID NO: 97188 - protein, 9 aa, Homo Sapiens
SRDVSHMGL

SEQ ID NO: 97189 - protein, 9 aa, Homo Sapiens
LVQLGHPCD

SEQ ID NO: 97190 - protein, 9 aa, Homo Sapiens
PACNSSART

SEQ ID NO: 97191 - protein, 9 aa, Homo Sapiens
FLFIFSHGN

SEQ ID NO: 97192 - protein, 9 aa, Homo Sapiens
HGHIDPSVR

SEQ ID NO: 97193 - protein, 9 aa, Homo Sapiens
VKERKKPIY

SEQ ID NO: 97194 - protein, 9 aa, Homo Sapiens
LISYCSYWK

SEQ ID NO: 97195 - protein, 9 aa, Homo Sapiens
TTKDSFRWA

SEQ ID NO: 97196 - protein, 9 aa, Homo Sapiens
PKTWTSEWA

SEQ ID NO: 97197 - protein, 9 aa, Homo Sapiens
TAIYGAQWA

SEQ ID NO: 97198 - protein, 9 aa, Homo Sapiens
EDGFEVQPQ

SEQ ID NO: 97199 - protein, 9 aa, Homo Sapiens
HYPWLISMK

SEQ ID NO: 97200 - protein, 9 aa, Homo Sapiens
GKEGPYSEL

SEQ ID NO: 97201 - protein, 9 aa, Homo Sapiens
SMEKHKSYQ

SEQ ID NO: 97202 - protein, 9 aa, Homo Sapiens
IHNLLQVSV

SEQ ID NO: 97203 - protein, 9 aa, Homo Sapiens
AHMFCTTDQ

SEQ ID NO: 97204 - protein, 9 aa, Homo Sapiens
VRGRLKQRG

SEQ ID NO: 97205 - protein, 9 aa, Homo Sapiens
LQVTALEIP

SEQ ID NO: 97206 - protein, 9 aa, Homo Sapiens
VSGVPAKVL

SEQ ID NO: 97207 - protein, 9 aa, Homo Sapiens
LTSECGWGC

SEQ ID NO: 97208 - protein, 9 aa, Homo Sapiens
IHYRNDETM

SEQ ID NO: 97209 - protein, 9 aa, Homo Sapiens
LNDISPNVK

SEQ ID NO: 97210 - protein, 9 aa, Homo Sapiens
YSDFEWLRR

SEQ ID NO: 97211 - protein, 9 aa, Homo Sapiens
LRNKDVNEA

SEQ ID NO: 97212 - protein, 9 aa, Homo Sapiens
GSDTAIKPL

SEQ ID NO: 97213 - protein, 9 aa, Homo Sapiens
ESLPFRGSD

SEQ ID NO: 97214 - protein, 9 aa, Homo Sapiens
ESFSKQIVP

SEQ ID NO: 97215 - protein, 9 aa, Homo Sapiens
RQMSFCPVG

SEQ ID NO: 97216 - protein, 9 aa, Homo Sapiens
ADYLPLGAQ

SEQ ID NO: 97217 - protein, 9 aa, Homo Sapiens
AHQAKIFME

SEQ ID NO: 97218 - protein, 9 aa, Homo Sapiens
RSYKEFCAP

SEQ ID NO: 97219 - protein, 9 aa, Homo Sapiens
MEKHKSYQC

SEQ ID NO: 97220 - protein, 9 aa, Homo Sapiens
IADISPASS

SEQ ID NO: 97221 - protein, 9 aa, Homo Sapiens
EPVSIPDKP

SEQ ID NO: 97222 - protein, 9 aa, Homo Sapiens
ILKLKSIEE

SEQ ID NO: 97223 - protein, 9 aa, Homo Sapiens
MSIWAEECK

SEQ ID NO: 97224 - protein, 9 aa, Homo Sapiens
HLGRTGPGR

SEQ ID NO: 97225 - protein, 9 aa, Homo Sapiens
FTGCNPTWQ

SEQ ID NO: 97226 - protein, 9 aa, Homo Sapiens
HTALPWAAM

SEQ ID NO: 97227 - protein, 9 aa, Homo Sapiens
RGRPPWLTL

SEQ ID NO: 97228 - protein, 9 aa, Homo Sapiens
GAWSGRSPA

SEQ ID NO: 97229 - protein, 9 aa, Homo Sapiens
NRRCPSEET

SEQ ID NO: 97230 - protein, 9 aa, Homo Sapiens
RGGGGRSGR

SEQ ID NO: 97231 - protein, 9 aa, Homo Sapiens
LDKLLKVKK

SEQ ID NO: 97232 - protein, 9 aa, Homo Sapiens
LLEERKYKD

SEQ ID NO: 97233 - protein, 9 aa, Homo Sapiens
NSCRRKRQA

SEQ ID NO: 97234 - protein, 9 aa, Homo Sapiens
GRRCLSHAS

SEQ ID NO: 97235 - protein, 9 aa, Homo Sapiens
RHRPLTQCS

SEQ ID NO: 97236 - protein, 9 aa, Homo Sapiens
HRPLTQCST

SEQ ID NO: 97237 - protein, 9 aa, Homo Sapiens
PPPRLRHRP

SEQ ID NO: 97238 - protein, 9 aa, Homo Sapiens
CASASSTLT

SEQ ID NO: 97239 - protein, 9 aa, Homo Sapiens
RDPLSKITE

SEQ ID NO: 97240 - protein, 9 aa, Homo Sapiens
RQAQGCLLG

SEQ ID NO: 97241 - protein, 9 aa, Homo Sapiens
GGGGRSGRS

SEQ ID NO: 97242 - protein, 9 aa, Homo Sapiens
KVKKSVEEV

SEQ ID NO: 97243 - protein, 9 aa, Homo Sapiens
AAMSRWSGG

SEQ ID NO: 97244 - protein, 9 aa, Homo Sapiens
PRLRHRPLT

SEQ ID NO: 97245 - protein, 9 aa, Homo Sapiens
RAEELPGGG

SEQ ID NO: 97246 - protein, 9 aa, Homo Sapiens
VKKSVEEVA

SEQ ID NO: 97247 - protein, 9 aa, Homo Sapiens
DRPSSIAIT

SEQ ID NO: 97248 - protein, 9 aa, Homo Sapiens
DKLLKVKKS

SEQ ID NO: 97249 - protein, 9 aa, Homo Sapiens
GGRSGRSQR

SEQ ID NO: 97250 - protein, 9 aa, Homo Sapiens
QAQGCLLGR

SEQ ID NO: 97251 - protein, 9 aa, Homo Sapiens
SGPPPVPPT

SEQ ID NO: 97252 - protein, 9 aa, Homo Sapiens
NFSPRFSGL

SEQ ID NO: 97253 - protein, 9 aa, Homo Sapiens
ERVVRAGEA

SEQ ID NO: 97254 - protein, 9 aa, Homo Sapiens
RPPWLTLWN

SEQ ID NO: 97255 - protein, 9 aa, Homo Sapiens
RSGRSQRST

SEQ ID NO: 97256 - protein, 9 aa, Homo Sapiens
YYSKLWLLY

SEQ ID NO: 97257 - protein, 9 aa, Homo Sapiens
LTLWNSCRR

SEQ ID NO: 97258 - protein, 9 aa, Homo Sapiens
PSEETWSRG

SEQ ID NO: 97259 - protein, 9 aa, Homo Sapiens
SIWAEECKE

SEQ ID NO: 97260 - protein, 9 aa, Homo Sapiens
AEECKEIEN

SEQ ID NO: 97261 - protein, 9 aa, Homo Sapiens
RTVCSRANN

SEQ ID NO: 97262 - protein, 9 aa, Homo Sapiens
SINPRRLRG

SEQ ID NO: 97263 - protein, 9 aa, Homo Sapiens
GKSQSINPR

SEQ ID NO: 97264 - protein, 9 aa, Homo Sapiens
GCLLGRRCL

SEQ ID NO: 97265 - protein, 9 aa, Homo Sapiens
LGRTGPGRG

SEQ ID NO: 97266 - protein, 9 aa, Homo Sapiens
LSGKSQSIN

SEQ ID NO: 97267 - protein, 9 aa, Homo Sapiens
MSRWSGGAS

SEQ ID NO: 97268 - protein, 9 aa, Homo Sapiens
RRERDEKKK

SEQ ID NO: 97269 - protein, 9 aa, Homo Sapiens
WSRGRPPWL

SEQ ID NO: 97270 - protein, 9 aa, Homo Sapiens
QSNRMLGVK

SEQ ID NO: 97271 - protein, 9 aa, Homo Sapiens
GLGVSSTTM

SEQ ID NO: 97272 - protein, 9 aa, Homo Sapiens
GGGRSGRSQ

SEQ ID NO: 97273 - protein, 9 aa, Homo Sapiens
LVQSNRMLG

SEQ ID NO: 97274 - protein, 9 aa, Homo Sapiens
LVLANRKEI

SEQ ID NO: 97275 - protein, 9 aa, Homo Sapiens
ACPTGLSCP

SEQ ID NO: 97276 - protein, 9 aa, Homo Sapiens
WAAMSRWSG

SEQ ID NO: 97277 - protein, 9 aa, Homo Sapiens
STRASYCAS

SEQ ID NO: 97278 - protein, 9 aa, Homo Sapiens
PSGHLGRTG

SEQ ID NO: 97279 - protein, 9 aa, Homo Sapiens
RTGPGRGTG

SEQ ID NO: 97280 - protein, 9 aa, Homo Sapiens
AGDLLPQGK

SEQ ID NO: 97281 - protein, 9 aa, Homo Sapiens
VITQVFHVL

SEQ ID NO: 97282 - protein, 9 aa, Homo Sapiens
SRGRPPWLT

SEQ ID NO: 97283 - protein, 9 aa, Homo Sapiens
LPGGGGLSG

SEQ ID NO: 97284 - protein, 9 aa, Homo Sapiens
GASGVSGAW

SEQ ID NO: 97285 - protein, 9 aa, Homo Sapiens
ASSTLTASR

SEQ ID NO: 97286 - protein, 9 aa, Homo Sapiens
EENGRGNFS

SEQ ID NO: 97287 - protein, 9 aa, Homo Sapiens
GAVQWLEGA

SEQ ID NO: 97288 - protein, 9 aa, Homo Sapiens
TGCNPTWQG

SEQ ID NO: 97289 - protein, 9 aa, Homo Sapiens
RERDEKKKC

SEQ ID NO: 97290 - protein, 9 aa, Homo Sapiens
CLLGRRCLS

SEQ ID NO: 97291 - protein, 9 aa, Homo Sapiens
VCSRANNTM

SEQ ID NO: 97292 - protein, 9 aa, Homo Sapiens
TGLSCPSGH

SEQ ID NO: 97293 - protein, 9 aa, Homo Sapiens
PTWQGADHM

SEQ ID NO: 97294 - protein, 9 aa, Homo Sapiens
RGTGPSRDG

SEQ ID NO: 97295 - protein, 9 aa, Homo Sapiens
ELYLVAHYL

SEQ ID NO: 97296 - protein, 9 aa, Homo Sapiens
RASYCASAS

SEQ ID NO: 97297 - protein, 9 aa, Homo Sapiens
TGPSRDGGR

SEQ ID NO: 97298 - protein, 9 aa, Homo Sapiens
SYCASASST

SEQ ID NO: 97299 - protein, 9 aa, Homo Sapiens
VENIGMDTS

SEQ ID NO: 97300 - protein, 9 aa, Homo Sapiens
TMGFVVPFT

SEQ ID NO: 97301 - protein, 9 aa, Homo Sapiens
TGDSGPPPV

SEQ ID NO: 97302 - protein, 9 aa, Homo Sapiens
NPTWQGADH

SEQ ID NO: 97303 - protein, 9 aa, Homo Sapiens
SCRRKRQAQ

SEQ ID NO: 97304 - protein, 9 aa, Homo Sapiens
APPPRLRHR

SEQ ID NO: 97305 - protein, 9 aa, Homo Sapiens
RGNFSPRFS

SEQ ID NO: 97306 - protein, 9 aa, Homo Sapiens
GRTGPGRGT

SEQ ID NO: 97307 - protein, 9 aa, Homo Sapiens
LTASRPTGR

SEQ ID NO: 97308 - protein, 9 aa, Homo Sapiens
AGAVQWLEG

SEQ ID NO: 97309 - protein, 9 aa, Homo Sapiens
QAYRKTQHQ

SEQ ID NO: 97310 - protein, 9 aa, Homo Sapiens
QMDRPSSIA

SEQ ID NO: 97311 - protein, 9 aa, Homo Sapiens
SGGASGVSG

SEQ ID NO: 97312 - protein, 9 aa, Homo Sapiens
RLRGGGGRS

SEQ ID NO: 97313 - protein, 9 aa, Homo Sapiens
GPGRGTGPS

SEQ ID NO: 97314 - protein, 9 aa, Homo Sapiens
FGQMDRPSS

SEQ ID NO: 97315 - protein, 9 aa, Homo Sapiens
ADRAEELPG

SEQ ID NO: 97316 - protein, 9 aa, Homo Sapiens
YSKLWLLYR

SEQ ID NO: 97317 - protein, 9 aa, Homo Sapiens
GCNPTWQGA

SEQ ID NO: 97318 - protein, 9 aa, Homo Sapiens
EILKRTVCS

SEQ ID NO: 97319 - protein, 9 aa, Homo Sapiens
VSGAWSGRS

SEQ ID NO: 97320 - protein, 9 aa, Homo Sapiens
PLSKITEQE

SEQ ID NO: 97321 - protein, 9 aa, Homo Sapiens
ILKRTVCSR

SEQ ID NO: 97322 - protein, 9 aa, Homo Sapiens
VAHYLEFQK

SEQ ID NO: 97323 - protein, 9 aa, Homo Sapiens
GGGLSGKSQ

SEQ ID NO: 97324 - protein, 9 aa, Homo Sapiens
AAPPPRLRH

SEQ ID NO: 97325 - protein, 9 aa, Homo Sapiens
RSPANRRCP

SEQ ID NO: 97326 - protein, 9 aa, Homo Sapiens
LGVSSTTMG

SEQ ID NO: 97327 - protein, 9 aa, Homo Sapiens
GPSRDGGRG

SEQ ID NO: 97328 - protein, 9 aa, Homo Sapiens
KEISSKLQL

SEQ ID NO: 97329 - protein, 9 aa, Homo Sapiens
VQSNRMLGV

SEQ ID NO: 97330 - protein, 9 aa, Homo Sapiens
PRAAPPPRL

SEQ ID NO: 97331 - protein, 9 aa, Homo Sapiens
FPQVACPTG

SEQ ID NO: 97332 - protein, 9 aa, Homo Sapiens
TRRHTALPW

SEQ ID NO: 97333 - protein, 9 aa, Homo Sapiens
LVAHYLEFQ

SEQ ID NO: 97334 - protein, 9 aa, Homo Sapiens
CRRKRQAQG

SEQ ID NO: 97335 - protein, 9 aa, Homo Sapiens
QVFHVLLEE

SEQ ID NO: 97336 - protein, 9 aa, Homo Sapiens
GRSPANRRC

SEQ ID NO: 97337 - protein, 9 aa, Homo Sapiens
RWSGGASGV

SEQ ID NO: 97338 - protein, 9 aa, Homo Sapiens
GRSGRSQRS

SEQ ID NO: 97339 - protein, 9 aa, Homo Sapiens
GDSGPPPVP

SEQ ID NO: 97340 - protein, 9 aa, Homo Sapiens
AQVASVFYM

SEQ ID NO: 97341 - protein, 9 aa, Homo Sapiens
PWLTLWNSC

SEQ ID NO: 97342 - protein, 9 aa, Homo Sapiens
RRCLSHASF

SEQ ID NO: 97343 - protein, 9 aa, Homo Sapiens
WSGGASGVS

SEQ ID NO: 97344 - protein, 9 aa, Homo Sapiens
SRDGGRGPE

SEQ ID NO: 97345 - protein, 9 aa, Homo Sapiens
ASFPQVACP

SEQ ID NO: 97346 - protein, 9 aa, Homo Sapiens
QVACPTGLS

SEQ ID NO: 97347 - protein, 9 aa, Homo Sapiens
ANRRCPSEE

SEQ ID NO: 97348 - protein, 9 aa, Homo Sapiens
IGMDTSLIL

SEQ ID NO: 97349 - protein, 9 aa, Homo Sapiens
IWAEECKEI

SEQ ID NO: 97350 - protein, 9 aa, Homo Sapiens
ASGVSGAWS

SEQ ID NO: 97351 - protein, 9 aa, Homo Sapiens
NFTGCNPTW

SEQ ID NO: 97352 - protein, 9 aa, Homo Sapiens
TLWNSCRRK

SEQ ID NO: 97353 - protein, 9 aa, Homo Sapiens
LLPQGKREG

SEQ ID NO: 97354 - protein, 9 aa, Homo Sapiens
TASRPTGRG

SEQ ID NO: 97355 - protein, 9 aa, Homo Sapiens
GDLLPQGKR

SEQ ID NO: 97356 - protein, 9 aa, Homo Sapiens
AHYLEFQKN

SEQ ID NO: 97357 - protein, 9 aa, Homo Sapiens
TTMGFVVPF

SEQ ID NO: 97358 - protein, 9 aa, Homo Sapiens
KLLKVKKSV

SEQ ID NO: 97359 - protein, 9 aa, Homo Sapiens
DLLPQGKRE

SEQ ID NO: 97360 - protein, 9 aa, Homo Sapiens
TALPWAAMS

SEQ ID NO: 97361 - protein, 9 aa, Homo Sapiens
GAGDLLPQG

SEQ ID NO: 97362 - protein, 9 aa, Homo Sapiens
RRKRQAQGC

SEQ ID NO: 97363 - protein, 9 aa, Homo Sapiens
SGKSQSINP

SEQ ID NO: 97364 - protein, 9 aa, Homo Sapiens
PPTGDSGPP

SEQ ID NO: 97365 - protein, 9 aa, Homo Sapiens
SAKIPIGIY

SEQ ID NO: 97366 - protein, 9 aa, Homo Sapiens
GARAPPRPR

SEQ ID NO: 97367 - protein, 9 aa, Homo Sapiens
SEETWSRGR

SEQ ID NO: 97368 - protein, 9 aa, Homo Sapiens
GRPPWLTLW

SEQ ID NO: 97369 - protein, 9 aa, Homo Sapiens
PLTQCSTRA

SEQ ID NO: 97370 - protein, 9 aa, Homo Sapiens
GPERVVRAG

SEQ ID NO: 97371 - protein, 9 aa, Homo Sapiens
KALVENIGM

SEQ ID NO: 97372 - protein, 9 aa, Homo Sapiens
VSGFPQAYR

SEQ ID NO: 97373 - protein, 9 aa, Homo Sapiens
ASVFYMIVI

SEQ ID NO: 97374 - protein, 9 aa, Homo Sapiens
NRKEISSKL

SEQ ID NO: 97375 - protein, 9 aa, Homo Sapiens
PGRGTGPSR

SEQ ID NO: 97376 - protein, 9 aa, Homo Sapiens
FPQAYRKTQ

SEQ ID NO: 97377 - protein, 9 aa, Homo Sapiens
GFPQAYRKT

SEQ ID NO: 97378 - protein, 9 aa, Homo Sapiens
PTGDSGPPP

SEQ ID NO: 97379 - protein, 9 aa, Homo Sapiens
ELPGGGGLS

SEQ ID NO: 97380 - protein, 9 aa, Homo Sapiens
GGLSGKSQS

SEQ ID NO: 97381 - protein, 9 aa, Homo Sapiens
LRGGGGRSG

SEQ ID NO: 97382 - protein, 9 aa, Homo Sapiens
LAGAVQWLE

SEQ ID NO: 97383 - protein, 9 aa, Homo Sapiens
GRGTGPSRD

SEQ ID NO: 97384 - protein, 9 aa, Homo Sapiens
RPSSIAITP

SEQ ID NO: 97385 - protein, 9 aa, Homo Sapiens
KVSRNYYSK

SEQ ID NO: 97386 - protein, 9 aa, Homo Sapiens
SRNYYSKLW

SEQ ID NO: 97387 - protein, 9 aa, Homo Sapiens
YLVAHYLEF

SEQ ID NO: 97388 - protein, 9 aa, Homo Sapiens
LALAGAVQW

SEQ ID NO: 97389 - protein, 9 aa, Homo Sapiens
FYMIVIPML

SEQ ID NO: 97390 - protein, 9 aa, Homo Sapiens
QKLCSSSAK

SEQ ID NO: 97391 - protein, 9 aa, Homo Sapiens
MSCGGGRSF

SEQ ID NO: 97392 - protein, 9 aa, Homo Sapiens
VPPTGDSGP

SEQ ID NO: 97393 - protein, 9 aa, Homo Sapiens
RKEISSKLQ

SEQ ID NO: 97394 - protein, 9 aa, Homo Sapiens
FHVLLEERK

SEQ ID NO: 97395 - protein, 9 aa, Homo Sapiens
RKRQAQGCL

SEQ ID NO: 97396 - protein, 9 aa, Homo Sapiens
RCPSEETWS

SEQ ID NO: 97397 - protein, 9 aa, Homo Sapiens
RAGEAGARA

SEQ ID NO: 97398 - protein, 9 aa, Homo Sapiens
VFYMIVIPM

SEQ ID NO: 97399 - protein, 9 aa, Homo Sapiens
VASVFYMIV

SEQ ID NO: 97400 - protein, 9 aa, Homo Sapiens
LLVLANRKE

SEQ ID NO: 97401 - protein, 9 aa, Homo Sapiens
VVRAGEAGA

SEQ ID NO: 97402 - protein, 9 aa, Homo Sapiens
RRHTALPWA

SEQ ID NO: 97403 - protein, 9 aa, Homo Sapiens
GTGPSRDGG

SEQ ID NO: 97404 - protein, 9 aa, Homo Sapiens
LPWAAMSRW

SEQ ID NO: 97405 - protein, 9 aa, Homo Sapiens
GEAGARAPP

SEQ ID NO: 97406 - protein, 9 aa, Homo Sapiens
SSIAITPDG

SEQ ID NO: 97407 - protein, 9 aa, Homo Sapiens
SGFPQAYRK

SEQ ID NO: 97408 - protein, 9 aa, Homo Sapiens
RGPERVVRA

SEQ ID NO: 97409 - protein, 9 aa, Homo Sapiens
RSTRRHTAL

SEQ ID NO: 97410 - protein, 9 aa, Homo Sapiens
CPTGLSCPS

SEQ ID NO: 97411 - protein, 9 aa, Homo Sapiens
ISTRDPLSK

SEQ ID NO: 97412 - protein, 9 aa, Homo Sapiens
PWAAMSRWS

SEQ ID NO: 97413 - protein, 9 aa, Homo Sapiens
PERVVRAGE

SEQ ID NO: 97414 - protein, 9 aa, Homo Sapiens
SSTTMGFVV

SEQ ID NO: 97415 - protein, 9 aa, Homo Sapiens
QSINPRRLR

SEQ ID NO: 97416 - protein, 9 aa, Homo Sapiens
PQVACPTGL

SEQ ID NO: 97417 - protein, 9 aa, Homo Sapiens
TWSRGRPPW

SEQ ID NO: 97418 - protein, 9 aa, Homo Sapiens
SPRFSGLQF

SEQ ID NO: 97419 - protein, 9 aa, Homo Sapiens
GGRSFCPPG

SEQ ID NO: 97420 - protein, 9 aa, Homo Sapiens
SVFYMIVIP

SEQ ID NO: 97421 - protein, 9 aa, Homo Sapiens
GGGGLSGKS

SEQ ID NO: 97422 - protein, 9 aa, Homo Sapiens
GGGRSFCPP

SEQ ID NO: 97423 - protein, 9 aa, Homo Sapiens
IKALVENIG

SEQ ID NO: 97424 - protein, 9 aa, Homo Sapiens
ENGRGNFSP

SEQ ID NO: 97425 - protein, 9 aa, Homo Sapiens
NYYSKLWLL

SEQ ID NO: 97426 - protein, 9 aa, Homo Sapiens
LSKITEQEK

SEQ ID NO: 97427 - protein, 9 aa, Homo Sapiens
GVSSTTMGF

SEQ ID NO: 97428 - protein, 9 aa, Homo Sapiens
CPSGHLGRT

SEQ ID NO: 97429 - protein, 9 aa, Homo Sapiens
SCPSGHLGR

SEQ ID NO: 97430 - protein, 9 aa, Homo Sapiens
ASASSTLTA

SEQ ID NO: 97431 - protein, 9 aa, Homo Sapiens
RRLRGGGGR

SEQ ID NO: 97432 - protein, 9 aa, Homo Sapiens
RDGGRGPER

SEQ ID NO: 97433 - protein, 9 aa, Homo Sapiens
SGRSQRSTR

SEQ ID NO: 97434 - protein, 9 aa, Homo Sapiens
APPRPRAAP

SEQ ID NO: 97435 - protein, 9 aa, Homo Sapiens
RPLTQCSTR

SEQ ID NO: 97436 - protein, 9 aa, Homo Sapiens
EETWSRGRP

SEQ ID NO: 97437 - protein, 9 aa, Homo Sapiens
WNSCRRKRQ

SEQ ID NO: 97438 - protein, 9 aa, Homo Sapiens
GRSQRSTRR

SEQ ID NO: 97439 - protein, 9 aa, Homo Sapiens
WLEGALWGL

SEQ ID NO: 97440 - protein, 9 aa, Homo Sapiens
LVENIGMDT

SEQ ID NO: 97441 - protein, 9 aa, Homo Sapiens
AQGCLLGRR

SEQ ID NO: 97442 - protein, 9 aa, Homo Sapiens
GNFSPRFSG

SEQ ID NO: 97443 - protein, 9 aa, Homo Sapiens
ARAPPRPRA

SEQ ID NO: 97444 - protein, 9 aa, Homo Sapiens
STRRHTALP

SEQ ID NO: 97445 - protein, 9 aa, Homo Sapiens
GQMDRPSSI

SEQ ID NO: 97446 - protein, 9 aa, Homo Sapiens
AWSGRSPAN

SEQ ID NO: 97447 - protein, 9 aa, Homo Sapiens
NPRRLRGGG

SEQ ID NO: 97448 - protein, 9 aa, Homo Sapiens
LWNSCRRKR

SEQ ID NO: 97449 - protein, 9 aa, Homo Sapiens
AGEAGARAP

SEQ ID NO: 97450 - protein, 9 aa, Homo Sapiens
DSGPPPVPP

SEQ ID NO: 97451 - protein, 9 aa, Homo Sapiens
SKITEQEKD

SEQ ID NO: 97452 - protein, 9 aa, Homo Sapiens
SCGGGRSFC

SEQ ID NO: 97453 - protein, 9 aa, Homo Sapiens
SSAKIPIGI

SEQ ID NO: 97454 - protein, 9 aa, Homo Sapiens
PSSIAITPD

SEQ ID NO: 97455 - protein, 9 aa, Homo Sapiens
LTQCSTRAS

SEQ ID NO: 97456 - protein, 9 aa, Homo Sapiens
GVSGAWSGR

SEQ ID NO: 97457 - protein, 9 aa, Homo Sapiens
AEELPGGGG

SEQ ID NO: 97458 - protein, 9 aa, Homo Sapiens
GRSFCPPGH

SEQ ID NO: 97459 - protein, 9 aa, Homo Sapiens
PGGGGLSGK

SEQ ID NO: 97460 - protein, 9 aa, Homo Sapiens
WLTLWNSCR

SEQ ID NO: 97461 - protein, 9 aa, Homo Sapiens
EAGARAPPR

SEQ ID NO: 97462 - protein, 9 aa, Homo Sapiens
RCLSHASFP

SEQ ID NO: 97463 - protein, 9 aa, Homo Sapiens
MVKVSRNYY

SEQ ID NO: 97464 - protein, 9 aa, Homo Sapiens
SGHLGRTGP

SEQ ID NO: 97465 - protein, 9 aa, Homo Sapiens
RRCPSEETW

SEQ ID NO: 97466 - protein, 9 aa, Homo Sapiens
SASSTLTAS

SEQ ID NO: 97467 - protein, 9 aa, Homo Sapiens
VKVSRNYYS

SEQ ID NO: 97468 - protein, 9 aa, Homo Sapiens
VSRNYYSKL

SEQ ID NO: 97469 - protein, 9 aa, Homo Sapiens
TGPGRGTGP

SEQ ID NO: 97470 - protein, 9 aa, Homo Sapiens
LPQGKREGF

SEQ ID NO: 97471 - protein, 9 aa, Homo Sapiens
KIPIGIYRT

SEQ ID NO: 97472 - protein, 9 aa, Homo Sapiens
WAEECKEIE

SEQ ID NO: 97473 - protein, 9 aa, Homo Sapiens
KLCSSSAKI

SEQ ID NO: 97474 - protein, 9 aa, Homo Sapiens
TLTASRPTG

SEQ ID NO: 97475 - protein, 9 aa, Homo Sapiens
TVNFTGCNP

SEQ ID NO: 97476 - protein, 9 aa, Homo Sapiens
RNYYSKLWL

SEQ ID NO: 97477 - protein, 9 aa, Homo Sapiens
LSCPSGHLG

SEQ ID NO: 97478 - protein, 9 aa, Homo Sapiens
NGRGNFSPR

SEQ ID NO: 97479 - protein, 9 aa, Homo Sapiens
ETWSRGRPP

SEQ ID NO: 97480 - protein, 9 aa, Homo Sapiens
TTKKLVNSV

SEQ ID NO: 97481 - protein, 9 aa, Homo Sapiens
RMLGVKRKI

SEQ ID NO: 97482 - protein, 9 aa, Homo Sapiens
FSPRFSGLQ

SEQ ID NO: 97483 - protein, 9 aa, Homo Sapiens
VNFTGCNPT

SEQ ID NO: 97484 - protein, 9 aa, Homo Sapiens
TVCSRANNT

SEQ ID NO: 97485 - protein, 9 aa, Homo Sapiens
LKRTVCSRA

SEQ ID NO: 97486 - protein, 9 aa, Homo Sapiens
ENIGMDTSL

SEQ ID NO: 97487 - protein, 9 aa, Homo Sapiens
GGRGPERVV

SEQ ID NO: 97488 - protein, 9 aa, Homo Sapiens
SQRSTRRHT

SEQ ID NO: 97489 - protein, 9 aa, Homo Sapiens
QVASVFYMI

SEQ ID NO: 97490 - protein, 9 aa, Homo Sapiens
MLGVKRKIP

SEQ ID NO: 97491 - protein, 9 aa, Homo Sapiens
VRAGEAGAR

SEQ ID NO: 97492 - protein, 9 aa, Homo Sapiens
SPANRRCPS

SEQ ID NO: 97493 - protein, 9 aa, Homo Sapiens
AMSRWSGGA

SEQ ID NO: 97494 - protein, 9 aa, Homo Sapiens
HVLLEERKY

SEQ ID NO: 97495 - protein, 9 aa, Homo Sapiens
RPRAAPPPR

SEQ ID NO: 97496 - protein, 9 aa, Homo Sapiens
CNPTWQGAD

SEQ ID NO: 97497 - protein, 9 aa, Homo Sapiens
RHTALPWAA

SEQ ID NO: 97498 - protein, 9 aa, Homo Sapiens
AVQWLEGAL

SEQ ID NO: 97499 - protein, 9 aa, Homo Sapiens
KRTVCSRAN

SEQ ID NO: 97500 - protein, 9 aa, Homo Sapiens
TTLDKLLKV

SEQ ID NO: 97501 - protein, 9 aa, Homo Sapiens
PPRPRAAPP

SEQ ID NO: 97502 - protein, 9 aa, Homo Sapiens
VHEILKRTV

SEQ ID NO: 97503 - protein, 9 aa, Homo Sapiens
LRHRPLTQC

SEQ ID NO: 97504 - protein, 9 aa, Homo Sapiens
DRAEELPGG

SEQ ID NO: 97505 - protein, 9 aa, Homo Sapiens
ALAGAVQWL

SEQ ID NO: 97506 - protein, 9 aa, Homo Sapiens
SFPQVACPT

SEQ ID NO: 97507 - protein, 9 aa, Homo Sapiens
SQSINPRRL

SEQ ID NO: 97508 - protein, 9 aa, Homo Sapiens
GGASGVSGA

SEQ ID NO: 97509 - protein, 9 aa, Homo Sapiens
RVVRAGEAG

SEQ ID NO: 97510 - protein, 9 aa, Homo Sapiens
PTGLSCPSG

SEQ ID NO: 97511 - protein, 9 aa, Homo Sapiens
YVELYLVAH

SEQ ID NO: 97512 - protein, 9 aa, Homo Sapiens
SGRSPANRR

SEQ ID NO: 97513 - protein, 9 aa, Homo Sapiens
LGRRCLSHA

SEQ ID NO: 97514 - protein, 9 aa, Homo Sapiens
MIVIPMLNP

SEQ ID NO: 97515 - protein, 9 aa, Homo Sapiens
SLVQSNRML

SEQ ID NO: 97516 - protein, 9 aa, Homo Sapiens
RMSCGGGRS

SEQ ID NO: 97517 - protein, 9 aa, Homo Sapiens
AGARAPPRP

SEQ ID NO: 97518 - protein, 9 aa, Homo Sapiens
TKKLVNSVA

SEQ ID NO: 97519 - protein, 9 aa, Homo Sapiens
TQVFHVLLE

SEQ ID NO: 97520 - protein, 9 aa, Homo Sapiens
LLLVLANRK

SEQ ID NO: 97521 - protein, 9 aa, Homo Sapiens
TRDPLSKIT

SEQ ID NO: 97522 - protein, 9 aa, Homo Sapiens
LKVKKSVEE

SEQ ID NO: 97523 - protein, 9 aa, Homo Sapiens
DPLSKITEQ

SEQ ID NO: 97524 - protein, 9 aa, Homo Sapiens
GLSCPSGHL

SEQ ID NO: 97525 - protein, 9 aa, Homo Sapiens
VLANRKEIS

SEQ ID NO: 97526 - protein, 9 aa, Homo Sapiens
TLDKLLKVK

SEQ ID NO: 97527 - protein, 9 aa, Homo Sapiens
MGFVVPFTI

SEQ ID NO: 97528 - protein, 9 aa, Homo Sapiens
CSSSAKIPI

SEQ ID NO: 97529 - protein, 9 aa, Homo Sapiens
GMDTSLILE

SEQ ID NO: 97530 - protein, 9 aa, Homo Sapiens
SGVSGAWSG

SEQ ID NO: 97531 - protein, 9 aa, Homo Sapiens
SIAITPDGM

SEQ ID NO: 97532 - protein, 9 aa, Homo Sapiens
RSQRSTRRH

SEQ ID NO: 97533 - protein, 9 aa, Homo Sapiens
PPRLRHRPL

SEQ ID NO: 97534 - protein, 9 aa, Homo Sapiens
TQCSTRASY

SEQ ID NO: 97535 - protein, 9 aa, Homo Sapiens
PQAYRKTQH

SEQ ID NO: 97536 - protein, 9 aa, Homo Sapiens
ISLVQSNRM

SEQ ID NO: 97537 - protein, 9 aa, Homo Sapiens
SSTLTASRP

SEQ ID NO: 97538 - protein, 9 aa, Homo Sapiens
YCASASSTL

SEQ ID NO: 97539 - protein, 9 aa, Homo Sapiens
DGGRGPERV

SEQ ID NO: 97540 - protein, 9 aa, Homo Sapiens
AKIPIGIYR

SEQ ID NO: 97541 - protein, 9 aa, Homo Sapiens
PRPRAAPPP

SEQ ID NO: 97542 - protein, 9 aa, Homo Sapiens
LSHASFPQV

SEQ ID NO: 97543 - protein, 9 aa, Homo Sapiens
ALPWAAMSR

SEQ ID NO: 97544 - protein, 9 aa, Homo Sapiens
RAPPRPRAA

SEQ ID NO: 97545 - protein, 9 aa, Homo Sapiens
HEILKRTVC

SEQ ID NO: 97546 - protein, 9 aa, Homo Sapiens
GRGNFSPRF

SEQ ID NO: 97547 - protein, 9 aa, Homo Sapiens
WSGRSPANR

SEQ ID NO: 97548 - protein, 9 aa, Homo Sapiens
KRQAQGCLL

SEQ ID NO: 97549 - protein, 9 aa, Homo Sapiens
GLSGKSQSI

SEQ ID NO: 97550 - protein, 9 aa, Homo Sapiens
SFCPPGHPL

SEQ ID NO: 97551 - protein, 9 aa, Homo Sapiens
STTMGFVVP

SEQ ID NO: 97552 - protein, 9 aa, Homo Sapiens
STLTASRPT

SEQ ID NO: 97553 - protein, 9 aa, Homo Sapiens
TRASYCASA

SEQ ID NO: 97554 - protein, 9 aa, Homo Sapiens
PVSGFPQAY

SEQ ID NO: 97555 - protein, 9 aa, Homo Sapiens
CPSEETWSR

SEQ ID NO: 97556 - protein, 9 aa, Homo Sapiens
VACPTGLSC

SEQ ID NO: 97557 - protein, 9 aa, Homo Sapiens
INPRRLRGG

SEQ ID NO: 97558 - protein, 9 aa, Homo Sapiens
STRDPLSKI

SEQ ID NO: 97559 - protein, 9 aa, Homo Sapiens
CSTRASYCA

SEQ ID NO: 97560 - protein, 9 aa, Homo Sapiens
PSRDGGRGP

SEQ ID NO: 97561 - protein, 9 aa, Homo Sapiens
NIGMDTSLI

SEQ ID NO: 97562 - protein, 9 aa, Homo Sapiens
GHLGRTGPG

SEQ ID NO: 97563 - protein, 9 aa, Homo Sapiens
SNRMLGVKR

SEQ ID NO: 97564 - protein, 9 aa, Homo Sapiens
MDRPSSIAI

SEQ ID NO: 97565 - protein, 9 aa, Homo Sapiens
LLKVKKSVE

SEQ ID NO: 97566 - protein, 9 aa, Homo Sapiens
PRRLRGGGG

SEQ ID NO: 97567 - protein, 9 aa, Homo Sapiens
CLSHASFPQ

SEQ ID NO: 97568 - protein, 9 aa, Homo Sapiens
QCSTRASYC

SEQ ID NO: 97569 - protein, 9 aa, Homo Sapiens
RAAPPPRLR

SEQ ID NO: 97570 - protein, 9 aa, Homo Sapiens
ALVENIGMD

SEQ ID NO: 97571 - protein, 9 aa, Homo Sapiens
LYLVAHYLE

SEQ ID NO: 97572 - protein, 9 aa, Homo Sapiens
ANRKEISSK

SEQ ID NO: 97573 - protein, 9 aa, Homo Sapiens
SRWSGGASG

SEQ ID NO: 97574 - protein, 9 aa, Homo Sapiens
MTTKKLVNS

SEQ ID NO: 97575 - protein, 9 aa, Homo Sapiens
HYLEFQKNR

SEQ ID NO: 97576 - protein, 9 aa, Homo Sapiens
VLLEERKYK

SEQ ID NO: 97577 - protein, 9 aa, Homo Sapiens
KGAGDLLPQ

SEQ ID NO: 97578 - protein, 9 aa, Homo Sapiens
QGCLLGRRC

SEQ ID NO: 97579 - protein, 9 aa, Homo Sapiens
LCSSSAKIP

SEQ ID NO: 97580 - protein, 9 aa, Homo Sapiens
YMIVIPMLN

SEQ ID NO: 97581 - protein, 9 aa, Homo Sapiens
VELYLVAHY

SEQ ID NO: 97582 - protein, 9 aa, Homo Sapiens
HASFPQVAC

SEQ ID NO: 97583 - protein, 9 aa, Homo Sapiens
LANRKEISS

SEQ ID NO: 97584 - protein, 9 aa, Homo Sapiens
VQWLEGALW

SEQ ID NO: 97585 - protein, 9 aa, Homo Sapiens
ITQVFHVLL

SEQ ID NO: 97586 - protein, 9 aa, Homo Sapiens
EECKEIENL

SEQ ID NO: 97587 - protein, 9 aa, Homo Sapiens
NRMLGVKRK

SEQ ID NO: 97588 - protein, 9 aa, Homo Sapiens
EELPGGGGL

SEQ ID NO: 97589 - protein, 9 aa, Homo Sapiens
QRSTRRHTA

SEQ ID NO: 97590 - protein, 9 aa, Homo Sapiens
SSSAKIPIG

SEQ ID NO: 97591 - protein, 9 aa, Homo Sapiens
ASYCASASS

SEQ ID NO: 97592 - protein, 9 aa, Homo Sapiens
GRGPERVVR

SEQ ID NO: 97593 - protein, 9 aa, Homo Sapiens
KSQSINPRR

SEQ ID NO: 97594 - protein, 9 aa, Homo Sapiens
PANRRCPSE

SEQ ID NO: 97595 - protein, 9 aa, Homo Sapiens
PPWLTLWNS

SEQ ID NO: 97596 - protein, 9 aa, Homo Sapiens
VSSTTMGFV

SEQ ID NO: 97597 - protein, 9 aa, Homo Sapiens
RSFCPPGHP

SEQ ID NO: 97598 - protein, 9 aa, Homo Sapiens
KITEQEKDF

SEQ ID NO: 97599 - protein, 9 aa, Homo Sapiens
SGAWSGRSP

SEQ ID NO: 97600 - protein, 9 aa, Homo Sapiens
RLRHRPLTQ

SEQ ID NO: 97601 - protein, 9 aa, Homo Sapiens
VFHVLLEER

SEQ ID NO: 97602 - protein, 9 aa, Homo Sapiens
QWLEGALWG

SEQ ID NO: 97603 - protein, 9 aa, Homo Sapiens
CGGGRSFCP

SEQ ID NO: 97604 - protein, 9 aa, Homo Sapiens
LLGRRCLSH

SEQ ID NO: 97605 - protein, 9 aa, Homo Sapiens
SHASFPQVA

SEQ ID NO: 97606 - protein, 9 aa, Homo Sapiens
AEVSTTSTG

SEQ ID NO: 97607 - protein, 9 aa, Homo Sapiens
TLVQPLPGP

SEQ ID NO: 97608 - protein, 9 aa, Homo Sapiens
TSREFDGIK

SEQ ID NO: 97609 - protein, 9 aa, Homo Sapiens
KALKKCSDL

SEQ ID NO: 97610 - protein, 9 aa, Homo Sapiens
DPSTASTLQ

SEQ ID NO: 97611 - protein, 9 aa, Homo Sapiens
DRSFYIGCY

SEQ ID NO: 97612 - protein, 9 aa, Homo Sapiens
GNSWWILRK

SEQ ID NO: 97613 - protein, 9 aa, Homo Sapiens
YNIEDHIES

SEQ ID NO: 97614 - protein, 9 aa, Homo Sapiens
VCQKAIEKL

SEQ ID NO: 97615 - protein, 9 aa, Homo Sapiens
LDIFFRPLN

SEQ ID NO: 97616 - protein, 9 aa, Homo Sapiens
SFPQEDGGA

SEQ ID NO: 97617 - protein, 9 aa, Homo Sapiens
SFYIGCYKC

SEQ ID NO: 97618 - protein, 9 aa, Homo Sapiens
ADMLQACKE

SEQ ID NO: 97619 - protein, 9 aa, Homo Sapiens
TVNPVYVSN

SEQ ID NO: 97620 - protein, 9 aa, Homo Sapiens
PGCRSRSRS

SEQ ID NO: 97621 - protein, 9 aa, Homo Sapiens
FHLCKDGAE

SEQ ID NO: 97622 - protein, 9 aa, Homo Sapiens
GPKSFLIGG

SEQ ID NO: 97623 - protein, 9 aa, Homo Sapiens
PSPGCRSRS

SEQ ID NO: 97624 - protein, 9 aa, Homo Sapiens
SGGGPRRGA

SEQ ID NO: 97625 - protein, 9 aa, Homo Sapiens
SLLVAPDNG

SEQ ID NO: 97626 - protein, 9 aa, Homo Sapiens
SPSPGCRSR

SEQ ID NO: 97627 - protein, 9 aa, Homo Sapiens
SVRLVAKQV

SEQ ID NO: 97628 - protein, 9 aa, Homo Sapiens
RVKELVSWE

SEQ ID NO: 97629 - protein, 9 aa, Homo Sapiens
PLTKRASQY

SEQ ID NO: 97630 - protein, 9 aa, Homo Sapiens
VSNLVKRFQ

SEQ ID NO: 97631 - protein, 9 aa, Homo Sapiens
LHSHCPRHC

SEQ ID NO: 97632 - protein, 9 aa, Homo Sapiens
HGTIFANAN

SEQ ID NO: 97633 - protein, 9 aa, Homo Sapiens
AKRMIHVQN

SEQ ID NO: 97634 - protein, 9 aa, Homo Sapiens
SREFDGIKV

SEQ ID NO: 97635 - protein, 9 aa, Homo Sapiens
IRNKDINAR

SEQ ID NO: 97636 - protein, 9 aa, Homo Sapiens
DVNGPKPQL

SEQ ID NO: 97637 - protein, 9 aa, Homo Sapiens
SVFTLKKGR

SEQ ID NO: 97638 - protein, 9 aa, Homo Sapiens
STMKYKVSI

SEQ ID NO: 97639 - protein, 9 aa, Homo Sapiens
DLTGFSCED

SEQ ID NO: 97640 - protein, 9 aa, Homo Sapiens
GSYPPGPLA

SEQ ID NO: 97641 - protein, 9 aa, Homo Sapiens
EEGWKEFVR

SEQ ID NO: 97642 - protein, 9 aa, Homo Sapiens
PWGRLHSHC

SEQ ID NO: 97643 - protein, 9 aa, Homo Sapiens
LCKDGAEPT

SEQ ID NO: 97644 - protein, 9 aa, Homo Sapiens
GGRSSLCLA

SEQ ID NO: 97645 - protein, 9 aa, Homo Sapiens
PPVSLYSPV

SEQ ID NO: 97646 - protein, 9 aa, Homo Sapiens
PDPSTASTL

SEQ ID NO: 97647 - protein, 9 aa, Homo Sapiens
LNNFPEAET

SEQ ID NO: 97648 - protein, 9 aa, Homo Sapiens
EVGPELLIP

SEQ ID NO: 97649 - protein, 9 aa, Homo Sapiens
LTMRQQLTL

SEQ ID NO: 97650 - protein, 9 aa, Homo Sapiens
SDGTLYFQV

SEQ ID NO: 97651 - protein, 9 aa, Homo Sapiens
YVAAVATPG

SEQ ID NO: 97652 - protein, 9 aa, Homo Sapiens
AACAGCAPS

SEQ ID NO: 97653 - protein, 9 aa, Homo Sapiens
PVQLSLSPR

SEQ ID NO: 97654 - protein, 9 aa, Homo Sapiens
KRVCQKAIE

SEQ ID NO: 97655 - protein, 9 aa, Homo Sapiens
EECAISCSN

SEQ ID NO: 97656 - protein, 9 aa, Homo Sapiens
IVALDRSFY

SEQ ID NO: 97657 - protein, 9 aa, Homo Sapiens
EWDYNIEDH

SEQ ID NO: 97658 - protein, 9 aa, Homo Sapiens
PKPQLMLRY

SEQ ID NO: 97659 - protein, 9 aa, Homo Sapiens
TRLYPSGIE

SEQ ID NO: 97660 - protein, 9 aa, Homo Sapiens
AVYAFHLCK

SEQ ID NO: 97661 - protein, 9 aa, Homo Sapiens
LKDERERTR

SEQ ID NO: 97662 - protein, 9 aa, Homo Sapiens
SLASCAPPQ

SEQ ID NO: 97663 - protein, 9 aa, Homo Sapiens
PPLYKEFFN

SEQ ID NO: 97664 - protein, 9 aa, Homo Sapiens
PPSGGGPRR

SEQ ID NO: 97665 - protein, 9 aa, Homo Sapiens
GAVSSLLVA

SEQ ID NO: 97666 - protein, 9 aa, Homo Sapiens
GATLIKEQW

SEQ ID NO: 97667 - protein, 9 aa, Homo Sapiens
LQACKEAAY

SEQ ID NO: 97668 - protein, 9 aa, Homo Sapiens
SNVAWAHIL

SEQ ID NO: 97669 - protein, 9 aa, Homo Sapiens
RAIADMLQA

SEQ ID NO: 97670 - protein, 9 aa, Homo Sapiens
TLLKTPLAL

SEQ ID NO: 97671 - protein, 9 aa, Homo Sapiens
EKRQLVYVF

SEQ ID NO: 97672 - protein, 9 aa, Homo Sapiens
VVTVFVQTP

SEQ ID NO: 97673 - protein, 9 aa, Homo Sapiens
VRFTNDDRH

SEQ ID NO: 97674 - protein, 9 aa, Homo Sapiens
PGGFDGSGG

SEQ ID NO: 97675 - protein, 9 aa, Homo Sapiens
VNPVYVSNV

SEQ ID NO: 97676 - protein, 9 aa, Homo Sapiens
AHYYGASLI

SEQ ID NO: 97677 - protein, 9 aa, Homo Sapiens
IRESTQNDV

SEQ ID NO: 97678 - protein, 9 aa, Homo Sapiens
EEEVLSFLY

SEQ ID NO: 97679 - protein, 9 aa, Homo Sapiens
IIPSVAEGV

SEQ ID NO: 97680 - protein, 9 aa, Homo Sapiens
LVSWELKDW

SEQ ID NO: 97681 - protein, 9 aa, Homo Sapiens
CKERLGPGD

SEQ ID NO: 97682 - protein, 9 aa, Homo Sapiens
EPAQPRPSL

SEQ ID NO: 97683 - protein, 9 aa, Homo Sapiens
GFSCEDLIP

SEQ ID NO: 97684 - protein, 9 aa, Homo Sapiens
PLTVYSSQL

SEQ ID NO: 97685 - protein, 9 aa, Homo Sapiens
AVSSLLVAP

SEQ ID NO: 97686 - protein, 9 aa, Homo Sapiens
EYFTEMFNI

SEQ ID NO: 97687 - protein, 9 aa, Homo Sapiens
SQRGPRGSY

SEQ ID NO: 97688 - protein, 9 aa, Homo Sapiens
EGRLLRQTM

SEQ ID NO: 97689 - protein, 9 aa, Homo Sapiens
LVNEGRLLR

SEQ ID NO: 97690 - protein, 9 aa, Homo Sapiens
YELREFRED

SEQ ID NO: 97691 - protein, 9 aa, Homo Sapiens
FFNPDCATG

SEQ ID NO: 97692 - protein, 9 aa, Homo Sapiens
TAPQGPSTA

SEQ ID NO: 97693 - protein, 9 aa, Homo Sapiens
KELVSWELK

SEQ ID NO: 97694 - protein, 9 aa, Homo Sapiens
DHEHTHGGY

SEQ ID NO: 97695 - protein, 9 aa, Homo Sapiens
CRNYIEIIP

SEQ ID NO: 97696 - protein, 9 aa, Homo Sapiens
VDGLQRGAS

SEQ ID NO: 97697 - protein, 9 aa, Homo Sapiens
VFTLKKGRS

SEQ ID NO: 97698 - protein, 9 aa, Homo Sapiens
ILHCLTNIW

SEQ ID NO: 97699 - protein, 9 aa, Homo Sapiens
TATTAQEYL

SEQ ID NO: 97700 - protein, 9 aa, Homo Sapiens
NPFNEEELT

SEQ ID NO: 97701 - protein, 9 aa, Homo Sapiens
NLDIAAGFA

SEQ ID NO: 97702 - protein, 9 aa, Homo Sapiens
SCEDLIPCV

SEQ ID NO: 97703 - protein, 9 aa, Homo Sapiens
TGATLIKEQ

SEQ ID NO: 97704 - protein, 9 aa, Homo Sapiens
SKQRVPTGM

SEQ ID NO: 97705 - protein, 9 aa, Homo Sapiens
PAYEPTRLY

SEQ ID NO: 97706 - protein, 9 aa, Homo Sapiens
LHCLTNIWK

SEQ ID NO: 97707 - protein, 9 aa, Homo Sapiens
VSVNELKVK

SEQ ID NO: 97708 - protein, 9 aa, Homo Sapiens
FLSHCREVI

SEQ ID NO: 97709 - protein, 9 aa, Homo Sapiens
VNEGRLLRQ

SEQ ID NO: 97710 - protein, 9 aa, Homo Sapiens
VNEWREHTK

SEQ ID NO: 97711 - protein, 9 aa, Homo Sapiens
HLEQCEANL

SEQ ID NO: 97712 - protein, 9 aa, Homo Sapiens
REDTCVQYV

SEQ ID NO: 97713 - protein, 9 aa, Homo Sapiens
YELPPPASS

SEQ ID NO: 97714 - protein, 9 aa, Homo Sapiens
RRCRSSASW

SEQ ID NO: 97715 - protein, 9 aa, Homo Sapiens
HVCKRVCQK

SEQ ID NO: 97716 - protein, 9 aa, Homo Sapiens
FSKSHSFSH

SEQ ID NO: 97717 - protein, 9 aa, Homo Sapiens
SEIIRNKDI

SEQ ID NO: 97718 - protein, 9 aa, Homo Sapiens
ISKQNVKQM

SEQ ID NO: 97719 - protein, 9 aa, Homo Sapiens
LCQPEAPDI

SEQ ID NO: 97720 - protein, 9 aa, Homo Sapiens
RRAIADMLQ

SEQ ID NO: 97721 - protein, 9 aa, Homo Sapiens
LRHVYSGSG

SEQ ID NO: 97722 - protein, 9 aa, Homo Sapiens
MRQQLTLPS

SEQ ID NO: 97723 - protein, 9 aa, Homo Sapiens
IEIIPSVAE

SEQ ID NO: 97724 - protein, 9 aa, Homo Sapiens
LEVVLNVAL

SEQ ID NO: 97725 - protein, 9 aa, Homo Sapiens
EAMQSFEKK

SEQ ID NO: 97726 - protein, 9 aa, Homo Sapiens
LRLSGMSNR

SEQ ID NO: 97727 - protein, 9 aa, Homo Sapiens
SVDNRDGSS

SEQ ID NO: 97728 - protein, 9 aa, Homo Sapiens
RTFSHHHAE

SEQ ID NO: 97729 - protein, 9 aa, Homo Sapiens
VALDRSFYI

SEQ ID NO: 97730 - protein, 9 aa, Homo Sapiens
DGKEYDFRL

SEQ ID NO: 97731 - protein, 9 aa, Homo Sapiens
TGLQKRNYS

SEQ ID NO: 97732 - protein, 9 aa, Homo Sapiens
GCRGQKGIP

SEQ ID NO: 97733 - protein, 9 aa, Homo Sapiens
LLEGKTREE

SEQ ID NO: 97734 - protein, 9 aa, Homo Sapiens
SNLVKRFQE

SEQ ID NO: 97735 - protein, 9 aa, Homo Sapiens
GQKGIPAAL

SEQ ID NO: 97736 - protein, 9 aa, Homo Sapiens
PEPAQPRPS

SEQ ID NO: 97737 - protein, 9 aa, Homo Sapiens
PELAQADKS

SEQ ID NO: 97738 - protein, 9 aa, Homo Sapiens
GGRPSVDNR

SEQ ID NO: 97739 - protein, 9 aa, Homo Sapiens
DHIESLHTD

SEQ ID NO: 97740 - protein, 9 aa, Homo Sapiens
PVTWSLKAG

SEQ ID NO: 97741 - protein, 9 aa, Homo Sapiens
YHEKAQKQE

SEQ ID NO: 97742 - protein, 9 aa, Homo Sapiens
SLKDEEAKV

SEQ ID NO: 97743 - protein, 9 aa, Homo Sapiens
VQPLPGPST

SEQ ID NO: 97744 - protein, 9 aa, Homo Sapiens
ILKRVADIA

SEQ ID NO: 97745 - protein, 9 aa, Homo Sapiens
AEEKKSRIS

SEQ ID NO: 97746 - protein, 9 aa, Homo Sapiens
SHHHAEMLM

SEQ ID NO: 97747 - protein, 9 aa, Homo Sapiens
ENISVPADP

SEQ ID NO: 97748 - protein, 9 aa, Homo Sapiens
IKKDNQLLR

SEQ ID NO: 97749 - protein, 9 aa, Homo Sapiens
RPGCPPKFI

SEQ ID NO: 97750 - protein, 9 aa, Homo Sapiens
EQTGHGQRG

SEQ ID NO: 97751 - protein, 9 aa, Homo Sapiens
PLKDERERT

SEQ ID NO: 97752 - protein, 9 aa, Homo Sapiens
RGRGRGHGR

SEQ ID NO: 97753 - protein, 9 aa, Homo Sapiens
FQEQQKNDV

SEQ ID NO: 97754 - protein, 9 aa, Homo Sapiens
GASLIFTSK

SEQ ID NO: 97755 - protein, 9 aa, Homo Sapiens
KEQWLLTTA

SEQ ID NO: 97756 - protein, 9 aa, Homo Sapiens
FTNDDRHRL

SEQ ID NO: 97757 - protein, 9 aa, Homo Sapiens
LEGIYKVPV

SEQ ID NO: 97758 - protein, 9 aa, Homo Sapiens
TLCQPEAPD

SEQ ID NO: 97759 - protein, 9 aa, Homo Sapiens
QKRNYSAHL

SEQ ID NO: 97760 - protein, 9 aa, Homo Sapiens
IKIKIERKH

SEQ ID NO: 97761 - protein, 9 aa, Homo Sapiens
ADHLTMRQQ

SEQ ID NO: 97762 - protein, 9 aa, Homo Sapiens
WNHITCGGD

SEQ ID NO: 97763 - protein, 9 aa, Homo Sapiens
GKKPYNSKE

SEQ ID NO: 97764 - protein, 9 aa, Homo Sapiens
EGKTREERT

SEQ ID NO: 97765 - protein, 9 aa, Homo Sapiens
FTNHSVDGL

SEQ ID NO: 97766 - protein, 9 aa, Homo Sapiens
FICQAMGDP

SEQ ID NO: 97767 - protein, 9 aa, Homo Sapiens
SSLLVAPDN

SEQ ID NO: 97768 - protein, 9 aa, Homo Sapiens
EAENEESCL

SEQ ID NO: 97769 - protein, 9 aa, Homo Sapiens
QEPNQKVSV

SEQ ID NO: 97770 - protein, 9 aa, Homo Sapiens
TRVFMKKLN

SEQ ID NO: 97771 - protein, 9 aa, Homo Sapiens
RLTELRTFS

SEQ ID NO: 97772 - protein, 9 aa, Homo Sapiens
PPWGRLHSH

SEQ ID NO: 97773 - protein, 9 aa, Homo Sapiens
CSAHAAYVA

SEQ ID NO: 97774 - protein, 9 aa, Homo Sapiens
VQAISKQNV

SEQ ID NO: 97775 - protein, 9 aa, Homo Sapiens
VCKRVCQKA

SEQ ID NO: 97776 - protein, 9 aa, Homo Sapiens
DSLEECAIS

SEQ ID NO: 97777 - protein, 9 aa, Homo Sapiens
NKDINARVS

SEQ ID NO: 97778 - protein, 9 aa, Homo Sapiens
LYSPVCLTA

SEQ ID NO: 97779 - protein, 9 aa, Homo Sapiens
PYNSKECGK

SEQ ID NO: 97780 - protein, 9 aa, Homo Sapiens
RPASKQRVP

SEQ ID NO: 97781 - protein, 9 aa, Homo Sapiens
ERERTRAGS

SEQ ID NO: 97782 - protein, 9 aa, Homo Sapiens
HFTYQDPVQ

SEQ ID NO: 97783 - protein, 9 aa, Homo Sapiens
KPSWMEEEV

SEQ ID NO: 97784 - protein, 9 aa, Homo Sapiens
EVCLLKSDN

SEQ ID NO: 97785 - protein, 9 aa, Homo Sapiens
KETLLKTPL

SEQ ID NO: 97786 - protein, 9 aa, Homo Sapiens
SVDGLQRGA

SEQ ID NO: 97787 - protein, 9 aa, Homo Sapiens
AFLTEPEPA

SEQ ID NO: 97788 - protein, 9 aa, Homo Sapiens
RQSHQDEQT

SEQ ID NO: 97789 - protein, 9 aa, Homo Sapiens
LSLLEERFW

SEQ ID NO: 97790 - protein, 9 aa, Homo Sapiens
WMEEEVLSF

SEQ ID NO: 97791 - protein, 9 aa, Homo Sapiens
KYKSQQSSD

SEQ ID NO: 97792 - protein, 9 aa, Homo Sapiens
DYVVTVFVQ

SEQ ID NO: 97793 - protein, 9 aa, Homo Sapiens
LVAKQVELE

SEQ ID NO: 97794 - protein, 9 aa, Homo Sapiens
NSWWILRKT

SEQ ID NO: 97795 - protein, 9 aa, Homo Sapiens
RGRGHGRGG

SEQ ID NO: 97796 - protein, 9 aa, Homo Sapiens
RLPGNPGLV

SEQ ID NO: 97797 - protein, 9 aa, Homo Sapiens
KDERERTRA

SEQ ID NO: 97798 - protein, 9 aa, Homo Sapiens
NQKVSVNEL

SEQ ID NO: 97799 - protein, 9 aa, Homo Sapiens
TLLEGKTRE

SEQ ID NO: 97800 - protein, 9 aa, Homo Sapiens
LTVYSSQLQ

SEQ ID NO: 97801 - protein, 9 aa, Homo Sapiens
LMEFSLKDE

SEQ ID NO: 97802 - protein, 9 aa, Homo Sapiens
GPRRGAGAE

SEQ ID NO: 97803 - protein, 9 aa, Homo Sapiens
CRGQKGIPA

SEQ ID NO: 97804 - protein, 9 aa, Homo Sapiens
DIFFRPLNV

SEQ ID NO: 97805 - protein, 9 aa, Homo Sapiens
ESQRGPRGS

SEQ ID NO: 97806 - protein, 9 aa, Homo Sapiens
QLKGRRDPP

SEQ ID NO: 97807 - protein, 9 aa, Homo Sapiens
ADVLRHVYS

SEQ ID NO: 97808 - protein, 9 aa, Homo Sapiens
AAEEKKSRI

SEQ ID NO: 97809 - protein, 9 aa, Homo Sapiens
EVALLLDIF

SEQ ID NO: 97810 - protein, 9 aa, Homo Sapiens
KATATTAQE

SEQ ID NO: 97811 - protein, 9 aa, Homo Sapiens
VGGAVSSLL

SEQ ID NO: 97812 - protein, 9 aa, Homo Sapiens
QDPVQLSLS

SEQ ID NO: 97813 - protein, 9 aa, Homo Sapiens
NEQSMPKCG

SEQ ID NO: 97814 - protein, 9 aa, Homo Sapiens
ELRTFSHHH

SEQ ID NO: 97815 - protein, 9 aa, Homo Sapiens
KALGFLCVV

SEQ ID NO: 97816 - protein, 9 aa, Homo Sapiens
VASFICQAM

SEQ ID NO: 97817 - protein, 9 aa, Homo Sapiens
ESTQNDVRK

SEQ ID NO: 97818 - protein, 9 aa, Homo Sapiens
LYPSGIEMA

SEQ ID NO: 97819 - protein, 9 aa, Homo Sapiens
QPRPSLSQD

SEQ ID NO: 97820 - protein, 9 aa, Homo Sapiens
QAISKQNVK

SEQ ID NO: 97821 - protein, 9 aa, Homo Sapiens
CCALCETEF

SEQ ID NO: 97822 - protein, 9 aa, Homo Sapiens
EIHSQVNDK

SEQ ID NO: 97823 - protein, 9 aa, Homo Sapiens
ASKDRFLAC

SEQ ID NO: 97824 - protein, 9 aa, Homo Sapiens
TAASKDRFL

SEQ ID NO: 97825 - protein, 9 aa, Homo Sapiens
GHDHEHTHG

SEQ ID NO: 97826 - protein, 9 aa, Homo Sapiens
TNDDRHRLA

SEQ ID NO: 97827 - protein, 9 aa, Homo Sapiens
CYCGIRRKT

SEQ ID NO: 97828 - protein, 9 aa, Homo Sapiens
ELAAVNYFT

SEQ ID NO: 97829 - protein, 9 aa, Homo Sapiens
KTLRLSGMS

SEQ ID NO: 97830 - protein, 9 aa, Homo Sapiens
VTQAPIAVV

SEQ ID NO: 97831 - protein, 9 aa, Homo Sapiens
QITVKVLTN

SEQ ID NO: 97832 - protein, 9 aa, Homo Sapiens
LCETEFPQQ

SEQ ID NO: 97833 - protein, 9 aa, Homo Sapiens
FREDTCVQY

SEQ ID NO: 97834 - protein, 9 aa, Homo Sapiens
KQNVKQMVF

SEQ ID NO: 97835 - protein, 9 aa, Homo Sapiens
HMRETSVFT

SEQ ID NO: 97836 - protein, 9 aa, Homo Sapiens
LLPVDVSYV

SEQ ID NO: 97837 - protein, 9 aa, Homo Sapiens
TVAVPMLNP

SEQ ID NO: 97838 - protein, 9 aa, Homo Sapiens
KKGLPGLKR

SEQ ID NO: 97839 - protein, 9 aa, Homo Sapiens
LSPDTDYVV

SEQ ID NO: 97840 - protein, 9 aa, Homo Sapiens
LKDEEAKVS

SEQ ID NO: 97841 - protein, 9 aa, Homo Sapiens
LKLKEEPLT

SEQ ID NO: 97842 - protein, 9 aa, Homo Sapiens
WSLKAGCHT

SEQ ID NO: 97843 - protein, 9 aa, Homo Sapiens
GGTSFSCEC

SEQ ID NO: 97844 - protein, 9 aa, Homo Sapiens
ACLRQSSGA

SEQ ID NO: 97845 - protein, 9 aa, Homo Sapiens
ANMEYFTEM

SEQ ID NO: 97846 - protein, 9 aa, Homo Sapiens
KEFFNPDCA

SEQ ID NO: 97847 - protein, 9 aa, Homo Sapiens
NEEELTAIL

SEQ ID NO: 97848 - protein, 9 aa, Homo Sapiens
ISCSNSHGP

SEQ ID NO: 97849 - protein, 9 aa, Homo Sapiens
RQLLLFHLE

SEQ ID NO: 97850 - protein, 9 aa, Homo Sapiens
NSKECGKSF

SEQ ID NO: 97851 - protein, 9 aa, Homo Sapiens
PGLKRLPGN

SEQ ID NO: 97852 - protein, 9 aa, Homo Sapiens
LLFHLEQCE

SEQ ID NO: 97853 - protein, 9 aa, Homo Sapiens
WKEFVRRSK

SEQ ID NO: 97854 - protein, 9 aa, Homo Sapiens
TLNNFPEAE

SEQ ID NO: 97855 - protein, 9 aa, Homo Sapiens
RTSMDQLFT

SEQ ID NO: 97856 - protein, 9 aa, Homo Sapiens
EFDGIKVNL

SEQ ID NO: 97857 - protein, 9 aa, Homo Sapiens
NEWREHTKY

SEQ ID NO: 97858 - protein, 9 aa, Homo Sapiens
EEELTAILK

SEQ ID NO: 97859 - protein, 9 aa, Homo Sapiens
RVNNGGRSS

SEQ ID NO: 97860 - protein, 9 aa, Homo Sapiens
YSYAKRMIH

SEQ ID NO: 97861 - protein, 9 aa, Homo Sapiens
LVQPLPGPS

SEQ ID NO: 97862 - protein, 9 aa, Homo Sapiens
PVLAEKYKS

SEQ ID NO: 97863 - protein, 9 aa, Homo Sapiens
RVADIAEAL

SEQ ID NO: 97864 - protein, 9 aa, Homo Sapiens
TNHSVDGLQ

SEQ ID NO: 97865 - protein, 9 aa, Homo Sapiens
ERKHAQQKL

SEQ ID NO: 97866 - protein, 9 aa, Homo Sapiens
ECCALCETE

SEQ ID NO: 97867 - protein, 9 aa, Homo Sapiens
HTHGGYGES

SEQ ID NO: 97868 - protein, 9 aa, Homo Sapiens
QEIILKRVA

SEQ ID NO: 97869 - protein, 9 aa, Homo Sapiens
VFSALIELA

SEQ ID NO: 97870 - protein, 9 aa, Homo Sapiens
VSNVAWAHI

SEQ ID NO: 97871 - protein, 9 aa, Homo Sapiens
FPQEDGGAE

SEQ ID NO: 97872 - protein, 9 aa, Homo Sapiens
VDVNEWREH

SEQ ID NO: 97873 - protein, 9 aa, Homo Sapiens
HCPRHCPPW

SEQ ID NO: 97874 - protein, 9 aa, Homo Sapiens
HPVTWSLKA

SEQ ID NO: 97875 - protein, 9 aa, Homo Sapiens
LKRLPGNPG

SEQ ID NO: 97876 - protein, 9 aa, Homo Sapiens
PVDVSYVLP

SEQ ID NO: 97877 - protein, 9 aa, Homo Sapiens
KIERKHAQQ

SEQ ID NO: 97878 - protein, 9 aa, Homo Sapiens
LQSAAHSND

SEQ ID NO: 97879 - protein, 9 aa, Homo Sapiens
GTLCQPEAP

SEQ ID NO: 97880 - protein, 9 aa, Homo Sapiens
TSFSCECTR

SEQ ID NO: 97881 - protein, 9 aa, Homo Sapiens
QQGTQEARN

SEQ ID NO: 97882 - protein, 9 aa, Homo Sapiens
YQDPVQLSL

SEQ ID NO: 97883 - protein, 9 aa, Homo Sapiens
VVLNVALRV

SEQ ID NO: 97884 - protein, 9 aa, Homo Sapiens
KQARRKVTL

SEQ ID NO: 97885 - protein, 9 aa, Homo Sapiens
GLGNSWWIL

SEQ ID NO: 97886 - protein, 9 aa, Homo Sapiens
RKFAAAASG

SEQ ID NO: 97887 - protein, 9 aa, Homo Sapiens
VELELEVVW

SEQ ID NO: 97888 - protein, 9 aa, Homo Sapiens
ASVKALKKC

SEQ ID NO: 97889 - protein, 9 aa, Homo Sapiens
KSGPPNDRF

SEQ ID NO: 97890 - protein, 9 aa, Homo Sapiens
FCRNYIEII

SEQ ID NO: 97891 - protein, 9 aa, Homo Sapiens
FGPGRRPGC

SEQ ID NO: 97892 - protein, 9 aa, Homo Sapiens
CRSSASWRT

SEQ ID NO: 97893 - protein, 9 aa, Homo Sapiens
KCRVNNGGR

SEQ ID NO: 97894 - protein, 9 aa, Homo Sapiens
KCTLAWSFP

SEQ ID NO: 97895 - protein, 9 aa, Homo Sapiens
VSSLLVAPD

SEQ ID NO: 97896 - protein, 9 aa, Homo Sapiens
LTNIWKLDG

SEQ ID NO: 97897 - protein, 9 aa, Homo Sapiens
LSHCREVIQ

SEQ ID NO: 97898 - protein, 9 aa, Homo Sapiens
EFFNPDCAT

SEQ ID NO: 97899 - protein, 9 aa, Homo Sapiens
SAPSEACLR

SEQ ID NO: 97900 - protein, 9 aa, Homo Sapiens
ALCETEFPQ

SEQ ID NO: 97901 - protein, 9 aa, Homo Sapiens
PTRLYPSGI

SEQ ID NO: 97902 - protein, 9 aa, Homo Sapiens
EAQQDKSGP

SEQ ID NO: 97903 - protein, 9 aa, Homo Sapiens
PRSSTVTQA

SEQ ID NO: 97904 - protein, 9 aa, Homo Sapiens
EFVRRSKKV

SEQ ID NO: 97905 - protein, 9 aa, Homo Sapiens
EDTEVKTLR

SEQ ID NO: 97906 - protein, 9 aa, Homo Sapiens
CFLSHCREV

SEQ ID NO: 97907 - protein, 9 aa, Homo Sapiens
TSAEVSTTS

SEQ ID NO: 97908 - protein, 9 aa, Homo Sapiens
PEGQVVPAK

SEQ ID NO: 97909 - protein, 9 aa, Homo Sapiens
GEKGNPCVG

SEQ ID NO: 97910 - protein, 9 aa, Homo Sapiens
LTEPEPAPH

SEQ ID NO: 97911 - protein, 9 aa, Homo Sapiens
TLYFQVPCK

SEQ ID NO: 97912 - protein, 9 aa, Homo Sapiens
SNSNPFNEE

SEQ ID NO: 97913 - protein, 9 aa, Homo Sapiens
PADHLTMRQ

SEQ ID NO: 97914 - protein, 9 aa, Homo Sapiens
LVKRFQEQQ

SEQ ID NO: 97915 - protein, 9 aa, Homo Sapiens
GRSSLCLAT

SEQ ID NO: 97916 - protein, 9 aa, Homo Sapiens
KGNPCVGTQ

SEQ ID NO: 97917 - protein, 9 aa, Homo Sapiens
AVPRVRFTN

SEQ ID NO: 97918 - protein, 9 aa, Homo Sapiens
ASNVHGTIF

SEQ ID NO: 97919 - protein, 9 aa, Homo Sapiens
QWVPAVRFN

SEQ ID NO: 97920 - protein, 9 aa, Homo Sapiens
EFREDTCVQ

SEQ ID NO: 97921 - protein, 9 aa, Homo Sapiens
SWRTTSRRQ

SEQ ID NO: 97922 - protein, 9 aa, Homo Sapiens
EWREHTKYK

SEQ ID NO: 97923 - protein, 9 aa, Homo Sapiens
DGTLYFQVP

SEQ ID NO: 97924 - protein, 9 aa, Homo Sapiens
KSILNSLYD

SEQ ID NO: 97925 - protein, 9 aa, Homo Sapiens
FPRKICGSA

SEQ ID NO: 97926 - protein, 9 aa, Homo Sapiens
VKVLTNDIE

SEQ ID NO: 97927 - protein, 9 aa, Homo Sapiens
PFDRRLYVL

SEQ ID NO: 97928 - protein, 9 aa, Homo Sapiens
GDVDVNEWR

SEQ ID NO: 97929 - protein, 9 aa, Homo Sapiens
AQADKSALA

SEQ ID NO: 97930 - protein, 9 aa, Homo Sapiens
WNAFPRKIC

SEQ ID NO: 97931 - protein, 9 aa, Homo Sapiens
LWNHITCGG

SEQ ID NO: 97932 - protein, 9 aa, Homo Sapiens
KKPYNSKEC

SEQ ID NO: 97933 - protein, 9 aa, Homo Sapiens
MQSFEKKVV

SEQ ID NO: 97934 - protein, 9 aa, Homo Sapiens
NGGTSFSCE

SEQ ID NO: 97935 - protein, 9 aa, Homo Sapiens
FNEEELTAI

SEQ ID NO: 97936 - protein, 9 aa, Homo Sapiens
ECSAHAAYV

SEQ ID NO: 97937 - protein, 9 aa, Homo Sapiens
DKSGPPNDR

SEQ ID NO: 97938 - protein, 9 aa, Homo Sapiens
YNSKECGKS

SEQ ID NO: 97939 - protein, 9 aa, Homo Sapiens
DYNIEDHIE

SEQ ID NO: 97940 - protein, 9 aa, Homo Sapiens
VLRHVYSGS

SEQ ID NO: 97941 - protein, 9 aa, Homo Sapiens
PATVAHTRL

SEQ ID NO: 97942 - protein, 9 aa, Homo Sapiens
FGGPGGFDG

SEQ ID NO: 97943 - protein, 9 aa, Homo Sapiens
ARGECCALC

SEQ ID NO: 97944 - protein, 9 aa, Homo Sapiens
LLGDASLQL

SEQ ID NO: 97945 - protein, 9 aa, Homo Sapiens
CRVNNGGRS

SEQ ID NO: 97946 - protein, 9 aa, Homo Sapiens
LFPPLYKEF

SEQ ID NO: 97947 - protein, 9 aa, Homo Sapiens
AAAASGRPS

SEQ ID NO: 97948 - protein, 9 aa, Homo Sapiens
NLPEPAQPR

SEQ ID NO: 97949 - protein, 9 aa, Homo Sapiens
SKYCYCGIR

SEQ ID NO: 97950 - protein, 9 aa, Homo Sapiens
NLVKRFQEQ

SEQ ID NO: 97951 - protein, 9 aa, Homo Sapiens
SRSSSTVLQ

SEQ ID NO: 97952 - protein, 9 aa, Homo Sapiens
LGMSILQRI

SEQ ID NO: 97953 - protein, 9 aa, Homo Sapiens
SRHFSKSHS

SEQ ID NO: 97954 - protein, 9 aa, Homo Sapiens
VADIAEALY

SEQ ID NO: 97955 - protein, 9 aa, Homo Sapiens
RKHAQQKLL

SEQ ID NO: 97956 - protein, 9 aa, Homo Sapiens
NHITCGGDS

SEQ ID NO: 97957 - protein, 9 aa, Homo Sapiens
RESLHPVTW

SEQ ID NO: 97958 - protein, 9 aa, Homo Sapiens
HGPEGQVVP

SEQ ID NO: 97959 - protein, 9 aa, Homo Sapiens
VLYEAMQSF

SEQ ID NO: 97960 - protein, 9 aa, Homo Sapiens
QSRENISVP

SEQ ID NO: 97961 - protein, 9 aa, Homo Sapiens
AQKQESELR

SEQ ID NO: 97962 - protein, 9 aa, Homo Sapiens
LQPLTVYSS

SEQ ID NO: 97963 - protein, 9 aa, Homo Sapiens
ETLNNFPEA

SEQ ID NO: 97964 - protein, 9 aa, Homo Sapiens
VVSLASCAP

SEQ ID NO: 97965 - protein, 9 aa, Homo Sapiens
DFRLLPSGI

SEQ ID NO: 97966 - protein, 9 aa, Homo Sapiens
FDRRLYVLN

SEQ ID NO: 97967 - protein, 9 aa, Homo Sapiens
VNGPKPQLM

SEQ ID NO: 97968 - protein, 9 aa, Homo Sapiens
LGDASLQLK

SEQ ID NO: 97969 - protein, 9 aa, Homo Sapiens
WLETHDLDL

SEQ ID NO: 97970 - protein, 9 aa, Homo Sapiens
KIKIERKHA

SEQ ID NO: 97971 - protein, 9 aa, Homo Sapiens
SQCCFLSHC

SEQ ID NO: 97972 - protein, 9 aa, Homo Sapiens
GLSPDTDYV

SEQ ID NO: 97973 - protein, 9 aa, Homo Sapiens
DLDLGLGGQ

SEQ ID NO: 97974 - protein, 9 aa, Homo Sapiens
GECCALCET

SEQ ID NO: 97975 - protein, 9 aa, Homo Sapiens
IAAGFAGPV

SEQ ID NO: 97976 - protein, 9 aa, Homo Sapiens
SRENISVPA

SEQ ID NO: 97977 - protein, 9 aa, Homo Sapiens
GCRSRSRSR

SEQ ID NO: 97978 - protein, 9 aa, Homo Sapiens
FNLPEPAQP

SEQ ID NO: 97979 - protein, 9 aa, Homo Sapiens
PLPGPSTQV

SEQ ID NO: 97980 - protein, 9 aa, Homo Sapiens
AAGFAGPVD

SEQ ID NO: 97981 - protein, 9 aa, Homo Sapiens
PRVRFTNDD

SEQ ID NO: 97982 - protein, 9 aa, Homo Sapiens
SAEVSTTST

SEQ ID NO: 97983 - protein, 9 aa, Homo Sapiens
FLACIEEPF

SEQ ID NO: 97984 - protein, 9 aa, Homo Sapiens
GPRGSYPPG

SEQ ID NO: 97985 - protein, 9 aa, Homo Sapiens
HEKAQKQES

SEQ ID NO: 97986 - protein, 9 aa, Homo Sapiens
NIEDHIESL

SEQ ID NO: 97987 - protein, 9 aa, Homo Sapiens
LFIPSGFRT

SEQ ID NO: 97988 - protein, 9 aa, Homo Sapiens
LGDVDVNEW

SEQ ID NO: 97989 - protein, 9 aa, Homo Sapiens
DPTCSICTC

SEQ ID NO: 97990 - protein, 9 aa, Homo Sapiens
EAPDICVAG

SEQ ID NO: 97991 - protein, 9 aa, Homo Sapiens
NAGNIIQQS

SEQ ID NO: 97992 - protein, 9 aa, Homo Sapiens
QIGPKSFLI

SEQ ID NO: 97993 - protein, 9 aa, Homo Sapiens
VYVSNVAWA

SEQ ID NO: 97994 - protein, 9 aa, Homo Sapiens
MPKCGLLII

SEQ ID NO: 97995 - protein, 9 aa, Homo Sapiens
DGSGGFGGP

SEQ ID NO: 97996 - protein, 9 aa, Homo Sapiens
SQQGTQEAR

SEQ ID NO: 97997 - protein, 9 aa, Homo Sapiens
QGRQQWVPA

SEQ ID NO: 97998 - protein, 9 aa, Homo Sapiens
QKQESELRA

SEQ ID NO: 97999 - protein, 9 aa, Homo Sapiens
FLAQFTFQV

SEQ ID NO: 98000 - protein, 9 aa, Homo Sapiens
QTGHGQRGS

SEQ ID NO: 98001 - protein, 9 aa, Homo Sapiens
GRGRGHGRG

SEQ ID NO: 98002 - protein, 9 aa, Homo Sapiens
ECAISCSNS

SEQ ID NO: 98003 - protein, 9 aa, Homo Sapiens
AWLSYELPP

SEQ ID NO: 98004 - protein, 9 aa, Homo Sapiens
ASVFYTVAV

SEQ ID NO: 98005 - protein, 9 aa, Homo Sapiens
DLRPASKQR

SEQ ID NO: 98006 - protein, 9 aa, Homo Sapiens
FLCVVTNCG

SEQ ID NO: 98007 - protein, 9 aa, Homo Sapiens
EVKTLRLSG

SEQ ID NO: 98008 - protein, 9 aa, Homo Sapiens
RSSLCLATP

SEQ ID NO: 98009 - protein, 9 aa, Homo Sapiens
TFKGNSSLN

SEQ ID NO: 98010 - protein, 9 aa, Homo Sapiens
AENEESCLL

SEQ ID NO: 98011 - protein, 9 aa, Homo Sapiens
DPAVLYEAM

SEQ ID NO: 98012 - protein, 9 aa, Homo Sapiens
EARNTTKPK

SEQ ID NO: 98013 - protein, 9 aa, Homo Sapiens
GPEGQVVPA

SEQ ID NO: 98014 - protein, 9 aa, Homo Sapiens
RRKFAAAAS

SEQ ID NO: 98015 - protein, 9 aa, Homo Sapiens
RSPSPGCRS

SEQ ID NO: 98016 - protein, 9 aa, Homo Sapiens
YKHVCKRVC

SEQ ID NO: 98017 - protein, 9 aa, Homo Sapiens
IHVQNRAYF

SEQ ID NO: 98018 - protein, 9 aa, Homo Sapiens
VQEPNQKVS

SEQ ID NO: 98019 - protein, 9 aa, Homo Sapiens
ETHDLDLGL

SEQ ID NO: 98020 - protein, 9 aa, Homo Sapiens
YTAHVRGEW

SEQ ID NO: 98021 - protein, 9 aa, Homo Sapiens
NSSLNNHQR

SEQ ID NO: 98022 - protein, 9 aa, Homo Sapiens
PPPASSARF

SEQ ID NO: 98023 - protein, 9 aa, Homo Sapiens
NEEEKKATA

SEQ ID NO: 98024 - protein, 9 aa, Homo Sapiens
KQVELELEV

SEQ ID NO: 98025 - protein, 9 aa, Homo Sapiens
RDGSSSEGI

SEQ ID NO: 98026 - protein, 9 aa, Homo Sapiens
YVVTVFVQT

SEQ ID NO: 98027 - protein, 9 aa, Homo Sapiens
RGPRGSYPP

SEQ ID NO: 98028 - protein, 9 aa, Homo Sapiens
EFSLKDEEA

SEQ ID NO: 98029 - protein, 9 aa, Homo Sapiens
VSLYSPVCL

SEQ ID NO: 98030 - protein, 9 aa, Homo Sapiens
LSYELPPPA

SEQ ID NO: 98031 - protein, 9 aa, Homo Sapiens
TVLQRRKRI

SEQ ID NO: 98032 - protein, 9 aa, Homo Sapiens
HFSKSHSFS

SEQ ID NO: 98033 - protein, 9 aa, Homo Sapiens
LLEERFWVA

SEQ ID NO: 98034 - protein, 9 aa, Homo Sapiens
VDVSYVLPQ

SEQ ID NO: 98035 - protein, 9 aa, Homo Sapiens
MPRYTAHVR

SEQ ID NO: 98036 - protein, 9 aa, Homo Sapiens
PTCSICTCQ

SEQ ID NO: 98037 - protein, 9 aa, Homo Sapiens
NPAFLTEPE

SEQ ID NO: 98038 - protein, 9 aa, Homo Sapiens
YLLQQIGPK

SEQ ID NO: 98039 - protein, 9 aa, Homo Sapiens
ELREFREDT

SEQ ID NO: 98040 - protein, 9 aa, Homo Sapiens
YGMCKERLG

SEQ ID NO: 98041 - protein, 9 aa, Homo Sapiens
PLYKEFFNP

SEQ ID NO: 98042 - protein, 9 aa, Homo Sapiens
DVSYVLPQS

SEQ ID NO: 98043 - protein, 9 aa, Homo Sapiens
ENPAFLTEP

SEQ ID NO: 98044 - protein, 9 aa, Homo Sapiens
AHVRGEWLA

SEQ ID NO: 98045 - protein, 9 aa, Homo Sapiens
CQPEAPDIC

SEQ ID NO: 98046 - protein, 9 aa, Homo Sapiens
NEGRLLRQT

SEQ ID NO: 98047 - protein, 9 aa, Homo Sapiens
RCRSSASWR

SEQ ID NO: 98048 - protein, 9 aa, Homo Sapiens
SVPADPVSP

SEQ ID NO: 98049 - protein, 9 aa, Homo Sapiens
IFANANIDV

SEQ ID NO: 98050 - protein, 9 aa, Homo Sapiens
SSQKAPVSG

SEQ ID NO: 98051 - protein, 9 aa, Homo Sapiens
VALLLDIFF

SEQ ID NO: 98052 - protein, 9 aa, Homo Sapiens
EKGNPCVGT

SEQ ID NO: 98053 - protein, 9 aa, Homo Sapiens
VLLFSLWNH

SEQ ID NO: 98054 - protein, 9 aa, Homo Sapiens
GLQRGASPR

SEQ ID NO: 98055 - protein, 9 aa, Homo Sapiens
THDLDLGLG

SEQ ID NO: 98056 - protein, 9 aa, Homo Sapiens
LLKSDNKVV

SEQ ID NO: 98057 - protein, 9 aa, Homo Sapiens
LDLGLGGQV

SEQ ID NO: 98058 - protein, 9 aa, Homo Sapiens
RPRSSTVTQ

SEQ ID NO: 98059 - protein, 9 aa, Homo Sapiens
PASKQRVPT

SEQ ID NO: 98060 - protein, 9 aa, Homo Sapiens
EQSMPKCGL

SEQ ID NO: 98061 - protein, 9 aa, Homo Sapiens
DASLQLKGR

SEQ ID NO: 98062 - protein, 9 aa, Homo Sapiens
QEVGPELLI

SEQ ID NO: 98063 - protein, 9 aa, Homo Sapiens
HCLTNIWKL

SEQ ID NO: 98064 - protein, 9 aa, Homo Sapiens
VLQRRKRIS

SEQ ID NO: 98065 - protein, 9 aa, Homo Sapiens
RLGPGDTTS

SEQ ID NO: 98066 - protein, 9 aa, Homo Sapiens
RKICGSALE

SEQ ID NO: 98067 - protein, 9 aa, Homo Sapiens
LYFQVPCKG

SEQ ID NO: 98068 - protein, 9 aa, Homo Sapiens
GMQSRENIS

SEQ ID NO: 98069 - protein, 9 aa, Homo Sapiens
GGVGEKRQL

SEQ ID NO: 98070 - protein, 9 aa, Homo Sapiens
AMGDPRPKI

SEQ ID NO: 98071 - protein, 9 aa, Homo Sapiens
GIYKVPVAA

SEQ ID NO: 98072 - protein, 9 aa, Homo Sapiens
RMRKNKQAR

SEQ ID NO: 98073 - protein, 9 aa, Homo Sapiens
FVFSALIEL

SEQ ID NO: 98074 - protein, 9 aa, Homo Sapiens
LNTSAEVST

SEQ ID NO: 98075 - protein, 9 aa, Homo Sapiens
PSTASTLQS

SEQ ID NO: 98076 - protein, 9 aa, Homo Sapiens
FSLWNHITC

SEQ ID NO: 98077 - protein, 9 aa, Homo Sapiens
PGCRGQKGI

SEQ ID NO: 98078 - protein, 9 aa, Homo Sapiens
TIRESTQND

SEQ ID NO: 98079 - protein, 9 aa, Homo Sapiens
HDHEHTHGG

SEQ ID NO: 98080 - protein, 9 aa, Homo Sapiens
KEKLEVVLN

SEQ ID NO: 98081 - protein, 9 aa, Homo Sapiens
CQAMGDPRP

SEQ ID NO: 98082 - protein, 9 aa, Homo Sapiens
GNIIQQSAA

SEQ ID NO: 98083 - protein, 9 aa, Homo Sapiens
DQEGPATVA

SEQ ID NO: 98084 - protein, 9 aa, Homo Sapiens
NKQARRKVT

SEQ ID NO: 98085 - protein, 9 aa, Homo Sapiens
RFLACIEEP

SEQ ID NO: 98086 - protein, 9 aa, Homo Sapiens
IELAAVNYF

SEQ ID NO: 98087 - protein, 9 aa, Homo Sapiens
REEGWKEFV

SEQ ID NO: 98088 - protein, 9 aa, Homo Sapiens
GQVVPAKRK

SEQ ID NO: 98089 - protein, 9 aa, Homo Sapiens
TVTQAPIAV

SEQ ID NO: 98090 - protein, 9 aa, Homo Sapiens
CALCETEFP

SEQ ID NO: 98091 - protein, 9 aa, Homo Sapiens
ASLIFTSKS

SEQ ID NO: 98092 - protein, 9 aa, Homo Sapiens
KDRFLACIE

SEQ ID NO: 98093 - protein, 9 aa, Homo Sapiens
ARSSRPFDR

SEQ ID NO: 98094 - protein, 9 aa, Homo Sapiens
EEGLGNSWW

SEQ ID NO: 98095 - protein, 9 aa, Homo Sapiens
PQLMLRYPD

SEQ ID NO: 98096 - protein, 9 aa, Homo Sapiens
LRTFSHHHA

SEQ ID NO: 98097 - protein, 9 aa, Homo Sapiens
KEFVRRSKK

SEQ ID NO: 98098 - protein, 9 aa, Homo Sapiens
AGCAPSALC

SEQ ID NO: 98099 - protein, 9 aa, Homo Sapiens
MSSQKAPVS

SEQ ID NO: 98100 - protein, 9 aa, Homo Sapiens
IIQQSAAKK

SEQ ID NO: 98101 - protein, 9 aa, Homo Sapiens
FYTVAVPML

SEQ ID NO: 98102 - protein, 9 aa, Homo Sapiens
WVPAVRFNS

SEQ ID NO: 98103 - protein, 9 aa, Homo Sapiens
HTGKKPYNS

SEQ ID NO: 98104 - protein, 9 aa, Homo Sapiens
GEKRQLVYV

SEQ ID NO: 98105 - protein, 9 aa, Homo Sapiens
DYGMCKERL

SEQ ID NO: 98106 - protein, 9 aa, Homo Sapiens
AVLFSYVGK

SEQ ID NO: 98107 - protein, 9 aa, Homo Sapiens
PAQPRPSLS

SEQ ID NO: 98108 - protein, 9 aa, Homo Sapiens
QKVSVNELK

SEQ ID NO: 98109 - protein, 9 aa, Homo Sapiens
KSHSFSHNN

SEQ ID NO: 98110 - protein, 9 aa, Homo Sapiens
LAACAGCAP

SEQ ID NO: 98111 - protein, 9 aa, Homo Sapiens
AGNIIQQSA

SEQ ID NO: 98112 - protein, 9 aa, Homo Sapiens
TKTSREFDG

SEQ ID NO: 98113 - protein, 9 aa, Homo Sapiens
AAYVAAVAT

SEQ ID NO: 98114 - protein, 9 aa, Homo Sapiens
LTELRTFSH

SEQ ID NO: 98115 - protein, 9 aa, Homo Sapiens
SILQRIAGE

SEQ ID NO: 98116 - protein, 9 aa, Homo Sapiens
KAQKQESEL

SEQ ID NO: 98117 - protein, 9 aa, Homo Sapiens
VYAFHLCKD

SEQ ID NO: 98118 - protein, 9 aa, Homo Sapiens
FPPLYKEFF

SEQ ID NO: 98119 - protein, 9 aa, Homo Sapiens
WSFPQEDGG

SEQ ID NO: 98120 - protein, 9 aa, Homo Sapiens
FDGSGGFGG

SEQ ID NO: 98121 - protein, 9 aa, Homo Sapiens
AFHLCKDGA

SEQ ID NO: 98122 - protein, 9 aa, Homo Sapiens
KSFLIGGDS

SEQ ID NO: 98123 - protein, 9 aa, Homo Sapiens
AKALGFLCV

SEQ ID NO: 98124 - protein, 9 aa, Homo Sapiens
GTIFANANI

SEQ ID NO: 98125 - protein, 9 aa, Homo Sapiens
GFRTSMDQL

SEQ ID NO: 98126 - protein, 9 aa, Homo Sapiens
LQQIGPKSF

SEQ ID NO: 98127 - protein, 9 aa, Homo Sapiens
RFWVAIKDK

SEQ ID NO: 98128 - protein, 9 aa, Homo Sapiens
LEAAEEKKS

SEQ ID NO: 98129 - protein, 9 aa, Homo Sapiens
AHAAYVAAV

SEQ ID NO: 98130 - protein, 9 aa, Homo Sapiens
EEKKSRISL

SEQ ID NO: 98131 - protein, 9 aa, Homo Sapiens
DEQTGHGQR

SEQ ID NO: 98132 - protein, 9 aa, Homo Sapiens
YEAMQSFEK

SEQ ID NO: 98133 - protein, 9 aa, Homo Sapiens
ARNTTKPKQ

SEQ ID NO: 98134 - protein, 9 aa, Homo Sapiens
FTYQDPVQL

SEQ ID NO: 98135 - protein, 9 aa, Homo Sapiens
SSTVLQRRK

SEQ ID NO: 98136 - protein, 9 aa, Homo Sapiens
SGFRTSMDQ

SEQ ID NO: 98137 - protein, 9 aa, Homo Sapiens
LNSLYDLLA

SEQ ID NO: 98138 - protein, 9 aa, Homo Sapiens
TSVFTLKKG

SEQ ID NO: 98139 - protein, 9 aa, Homo Sapiens
SVNELKVKM

SEQ ID NO: 98140 - protein, 9 aa, Homo Sapiens
FANANIDVV

SEQ ID NO: 98141 - protein, 9 aa, Homo Sapiens
KVPVAAVRT

SEQ ID NO: 98142 - protein, 9 aa, Homo Sapiens
NGPKPQLML

SEQ ID NO: 98143 - protein, 9 aa, Homo Sapiens
SYELPPPAS

SEQ ID NO: 98144 - protein, 9 aa, Homo Sapiens
RVRFTNDDR

SEQ ID NO: 98145 - protein, 9 aa, Homo Sapiens
KREEGWKEF

SEQ ID NO: 98146 - protein, 9 aa, Homo Sapiens
SEACLRQSS

SEQ ID NO: 98147 - protein, 9 aa, Homo Sapiens
RVCQKAIEK

SEQ ID NO: 98148 - protein, 9 aa, Homo Sapiens
LLLDIFFRP

SEQ ID NO: 98149 - protein, 9 aa, Homo Sapiens
NSNPFNEEE

SEQ ID NO: 98150 - protein, 9 aa, Homo Sapiens
IDWTLLEGK

SEQ ID NO: 98151 - protein, 9 aa, Homo Sapiens
ALGFLCVVT

SEQ ID NO: 98152 - protein, 9 aa, Homo Sapiens
SICTCQEGS

SEQ ID NO: 98153 - protein, 9 aa, Homo Sapiens
AKEKLEVVL

SEQ ID NO: 98154 - protein, 9 aa, Homo Sapiens
MGDPRPKIV

SEQ ID NO: 98155 - protein, 9 aa, Homo Sapiens
SLLEERFWV

SEQ ID NO: 98156 - protein, 9 aa, Homo Sapiens
SLYDLLAAL

SEQ ID NO: 98157 - protein, 9 aa, Homo Sapiens
IHSQVNDKG

SEQ ID NO: 98158 - protein, 9 aa, Homo Sapiens
KCKLRVSQE

SEQ ID NO: 98159 - protein, 9 aa, Homo Sapiens
LPGLKRLPG

SEQ ID NO: 98160 - protein, 9 aa, Homo Sapiens
REFDGIKVN

SEQ ID NO: 98161 - protein, 9 aa, Homo Sapiens
PAFLTEPEP

SEQ ID NO: 98162 - protein, 9 aa, Homo Sapiens
GNSSLNNHQ

SEQ ID NO: 98163 - protein, 9 aa, Homo Sapiens
NVTIRESTQ

SEQ ID NO: 98164 - protein, 9 aa, Homo Sapiens
FTFQVLSMK

SEQ ID NO: 98165 - protein, 9 aa, Homo Sapiens
LFSTMKYKV

SEQ ID NO: 98166 - protein, 9 aa, Homo Sapiens
NNFPEAETP

SEQ ID NO: 98167 - protein, 9 aa, Homo Sapiens
RSNSNPFNE

SEQ ID NO: 98168 - protein, 9 aa, Homo Sapiens
AFLGMSILQ

SEQ ID NO: 98169 - protein, 9 aa, Homo Sapiens
LKSDNKVVD

SEQ ID NO: 98170 - protein, 9 aa, Homo Sapiens
LAAVNYFTN

SEQ ID NO: 98171 - protein, 9 aa, Homo Sapiens
LEVALLLDI

SEQ ID NO: 98172 - protein, 9 aa, Homo Sapiens
DGLQRGASP

SEQ ID NO: 98173 - protein, 9 aa, Homo Sapiens
VNNGGRSSL

SEQ ID NO: 98174 - protein, 9 aa, Homo Sapiens
TVKVLTNDI

SEQ ID NO: 98175 - protein, 9 aa, Homo Sapiens
LKTPLALKM

SEQ ID NO: 98176 - protein, 9 aa, Homo Sapiens
YIGCYKCEE

SEQ ID NO: 98177 - protein, 9 aa, Homo Sapiens
KQESELRAA

SEQ ID NO: 98178 - protein, 9 aa, Homo Sapiens
TSMDQLFTP

SEQ ID NO: 98179 - protein, 9 aa, Homo Sapiens
EEEKKATAT

SEQ ID NO: 98180 - protein, 9 aa, Homo Sapiens
YTVAVPMLN

SEQ ID NO: 98181 - protein, 9 aa, Homo Sapiens
GPGRRPGCP

SEQ ID NO: 98182 - protein, 9 aa, Homo Sapiens
KHVCKRVCQ

SEQ ID NO: 98183 - protein, 9 aa, Homo Sapiens
RLLRQTMKD

SEQ ID NO: 98184 - protein, 9 aa, Homo Sapiens
NAFPRKICG

SEQ ID NO: 98185 - protein, 9 aa, Homo Sapiens
GKTFKGNSS

SEQ ID NO: 98186 - protein, 9 aa, Homo Sapiens
AYVAAVATP

SEQ ID NO: 98187 - protein, 9 aa, Homo Sapiens
NVNAGNIIQ

SEQ ID NO: 98188 - protein, 9 aa, Homo Sapiens
KRVADIAEA

SEQ ID NO: 98189 - protein, 9 aa, Homo Sapiens
WDLTGFSCE

SEQ ID NO: 98190 - protein, 9 aa, Homo Sapiens
PSQQGTQEA

SEQ ID NO: 98191 - protein, 9 aa, Homo Sapiens
LASCAPPQE

SEQ ID NO: 98192 - protein, 9 aa, Homo Sapiens
VKKCKLRVS

SEQ ID NO: 98193 - protein, 9 aa, Homo Sapiens
PSWMEEEVL

SEQ ID NO: 98194 - protein, 9 aa, Homo Sapiens
IMSSQKAPV

SEQ ID NO: 98195 - protein, 9 aa, Homo Sapiens
DMLQACKEA

SEQ ID NO: 98196 - protein, 9 aa, Homo Sapiens
LAWSFPQED

SEQ ID NO: 98197 - protein, 9 aa, Homo Sapiens
VTWSLKAGC

SEQ ID NO: 98198 - protein, 9 aa, Homo Sapiens
ASLQLKGRR

SEQ ID NO: 98199 - protein, 9 aa, Homo Sapiens
RPFDRRLYV

SEQ ID NO: 98200 - protein, 9 aa, Homo Sapiens
RETSVFTLK

SEQ ID NO: 98201 - protein, 9 aa, Homo Sapiens
VSWELKDWP

SEQ ID NO: 98202 - protein, 9 aa, Homo Sapiens
LPPPASSAR

SEQ ID NO: 98203 - protein, 9 aa, Homo Sapiens
SRSPSPGCR

SEQ ID NO: 98204 - protein, 9 aa, Homo Sapiens
ERFWVAIKD

SEQ ID NO: 98205 - protein, 9 aa, Homo Sapiens
LAEKYKSQQ

SEQ ID NO: 98206 - protein, 9 aa, Homo Sapiens
NRDGSSSEG

SEQ ID NO: 98207 - protein, 9 aa, Homo Sapiens
LYEAMQSFE

SEQ ID NO: 98208 - protein, 9 aa, Homo Sapiens
FTEMFNIGV

SEQ ID NO: 98209 - protein, 9 aa, Homo Sapiens
VNIEEGLGN

SEQ ID NO: 98210 - protein, 9 aa, Homo Sapiens
ARRKVTLIE

SEQ ID NO: 98211 - protein, 9 aa, Homo Sapiens
YMHLFSTMK

SEQ ID NO: 98212 - protein, 9 aa, Homo Sapiens
YLEGIYKVP

SEQ ID NO: 98213 - protein, 9 aa, Homo Sapiens
SHCREVIQN

SEQ ID NO: 98214 - protein, 9 aa, Homo Sapiens
TQNDVRKIV

SEQ ID NO: 98215 - protein, 9 aa, Homo Sapiens
KPQLMLRYP

SEQ ID NO: 98216 - protein, 9 aa, Homo Sapiens
YPSGIEMAR

SEQ ID NO: 98217 - protein, 9 aa, Homo Sapiens
TQTAPQGPS

SEQ ID NO: 98218 - protein, 9 aa, Homo Sapiens
TQAPIAVVT

SEQ ID NO: 98219 - protein, 9 aa, Homo Sapiens
GGPGCRGQK

SEQ ID NO: 98220 - protein, 9 aa, Homo Sapiens
SPPPSGGGP

SEQ ID NO: 98221 - protein, 9 aa, Homo Sapiens
YGASLIFTS

SEQ ID NO: 98222 - protein, 9 aa, Homo Sapiens
YFQVPCKGL

SEQ ID NO: 98223 - protein, 9 aa, Homo Sapiens
TEVPLNTSA

SEQ ID NO: 98224 - protein, 9 aa, Homo Sapiens
TGKKPYNSK

SEQ ID NO: 98225 - protein, 9 aa, Homo Sapiens
KTSREFDGI

SEQ ID NO: 98226 - protein, 9 aa, Homo Sapiens
LFHLEQCEA

SEQ ID NO: 98227 - protein, 9 aa, Homo Sapiens
IKEQWLLTT

SEQ ID NO: 98228 - protein, 9 aa, Homo Sapiens
YKEFFNPDC

SEQ ID NO: 98229 - protein, 9 aa, Homo Sapiens
WDYNIEDHI

SEQ ID NO: 98230 - protein, 9 aa, Homo Sapiens
PDLRPASKQ

SEQ ID NO: 98231 - protein, 9 aa, Homo Sapiens
RKNKQARRK

SEQ ID NO: 98232 - protein, 9 aa, Homo Sapiens
GKEYDFRLL

SEQ ID NO: 98233 - protein, 9 aa, Homo Sapiens
EKYKSQQSS

SEQ ID NO: 98234 - protein, 9 aa, Homo Sapiens
CLTNIWKLD

SEQ ID NO: 98235 - protein, 9 aa, Homo Sapiens
SKEELRRCR

SEQ ID NO: 98236 - protein, 9 aa, Homo Sapiens
SLEECAISC

SEQ ID NO: 98237 - protein, 9 aa, Homo Sapiens
VAKQVELEL

SEQ ID NO: 98238 - protein, 9 aa, Homo Sapiens
KVSVNELKV

SEQ ID NO: 98239 - protein, 9 aa, Homo Sapiens
NGGRSSLCL

SEQ ID NO: 98240 - protein, 9 aa, Homo Sapiens
DPLDPTCSI

SEQ ID NO: 98241 - protein, 9 aa, Homo Sapiens
PVSLYSPVC

SEQ ID NO: 98242 - protein, 9 aa, Homo Sapiens
ALKKCSDLE

SEQ ID NO: 98243 - protein, 9 aa, Homo Sapiens
LEIHSQVND

SEQ ID NO: 98244 - protein, 9 aa, Homo Sapiens
GRLLRQTMK

SEQ ID NO: 98245 - protein, 9 aa, Homo Sapiens
AFPRKICGS

SEQ ID NO: 98246 - protein, 9 aa, Homo Sapiens
GGAVSSLLV

SEQ ID NO: 98247 - protein, 9 aa, Homo Sapiens
YCGIRRKTL

SEQ ID NO: 98248 - protein, 9 aa, Homo Sapiens
LDPTCSICT

SEQ ID NO: 98249 - protein, 9 aa, Homo Sapiens
DLAKALGFL

SEQ ID NO: 98250 - protein, 9 aa, Homo Sapiens
EVLSFLYKS

SEQ ID NO: 98251 - protein, 9 aa, Homo Sapiens
HITCGGDSE

SEQ ID NO: 98252 - protein, 9 aa, Homo Sapiens
PRKICGSAL

SEQ ID NO: 98253 - protein, 9 aa, Homo Sapiens
IPSGFRTSM

SEQ ID NO: 98254 - protein, 9 aa, Homo Sapiens
TGEAENEES

SEQ ID NO: 98255 - protein, 9 aa, Homo Sapiens
PWNAFPRKI

SEQ ID NO: 98256 - protein, 9 aa, Homo Sapiens
APEAVLFSY

SEQ ID NO: 98257 - protein, 9 aa, Homo Sapiens
RSSRPFDRR

SEQ ID NO: 98258 - protein, 9 aa, Homo Sapiens
LWDLTGFSC

SEQ ID NO: 98259 - protein, 9 aa, Homo Sapiens
RLVAKQVEL

SEQ ID NO: 98260 - protein, 9 aa, Homo Sapiens
IFFRPLNVR

SEQ ID NO: 98261 - protein, 9 aa, Homo Sapiens
CPELAQADK

SEQ ID NO: 98262 - protein, 9 aa, Homo Sapiens
CSDGTLYFQ

SEQ ID NO: 98263 - protein, 9 aa, Homo Sapiens
LIFLAQFTF

SEQ ID NO: 98264 - protein, 9 aa, Homo Sapiens
NFPEAETPG

SEQ ID NO: 98265 - protein, 9 aa, Homo Sapiens
EACLRQSSG

SEQ ID NO: 98266 - protein, 9 aa, Homo Sapiens
RYELREFRE

SEQ ID NO: 98267 - protein, 9 aa, Homo Sapiens
SKECGKSFS

SEQ ID NO: 98268 - protein, 9 aa, Homo Sapiens
SNPFNEEEL

SEQ ID NO: 98269 - protein, 9 aa, Homo Sapiens
LRPASKQRV

SEQ ID NO: 98270 - protein, 9 aa, Homo Sapiens
MKKLNQRSR

SEQ ID NO: 98271 - protein, 9 aa, Homo Sapiens
FVGGAVSSL

SEQ ID NO: 98272 - protein, 9 aa, Homo Sapiens
KKATATTAQ

SEQ ID NO: 98273 - protein, 9 aa, Homo Sapiens
WGRLHSHCP

SEQ ID NO: 98274 - protein, 9 aa, Homo Sapiens
RYTAHVRGE

SEQ ID NO: 98275 - protein, 9 aa, Homo Sapiens
HEHTHGGYG

SEQ ID NO: 98276 - protein, 9 aa, Homo Sapiens
KLIFLAQFT

SEQ ID NO: 98277 - protein, 9 aa, Homo Sapiens
SKSHSFSHN

SEQ ID NO: 98278 - protein, 9 aa, Homo Sapiens
SFICQAMGD

SEQ ID NO: 98279 - protein, 9 aa, Homo Sapiens
YIEIIPSVA

SEQ ID NO: 98280 - protein, 9 aa, Homo Sapiens
SLEAAEEKK

SEQ ID NO: 98281 - protein, 9 aa, Homo Sapiens
NSLYDLLAA

SEQ ID NO: 98282 - protein, 9 aa, Homo Sapiens
YSPVCLTAD

SEQ ID NO: 98283 - protein, 9 aa, Homo Sapiens
TMKYKVSIS

SEQ ID NO: 98284 - protein, 9 aa, Homo Sapiens
TEVKTLRLS

SEQ ID NO: 98285 - protein, 9 aa, Homo Sapiens
VYHEKAQKQ

SEQ ID NO: 98286 - protein, 9 aa, Homo Sapiens
QEQQKNDVE

SEQ ID NO: 98287 - protein, 9 aa, Homo Sapiens
LQRRKRISS

SEQ ID NO: 98288 - protein, 9 aa, Homo Sapiens
SSASWRTTS

SEQ ID NO: 98289 - protein, 9 aa, Homo Sapiens
PSQTQTAPQ

SEQ ID NO: 98290 - protein, 9 aa, Homo Sapiens
CKLRVSQEP

SEQ ID NO: 98291 - protein, 9 aa, Homo Sapiens
SLIFTSKSE

SEQ ID NO: 98292 - protein, 9 aa, Homo Sapiens
SSRSSSTVL

SEQ ID NO: 98293 - protein, 9 aa, Homo Sapiens
DWTLLEGKT

SEQ ID NO: 98294 - protein, 9 aa, Homo Sapiens
ASKEELRRC

SEQ ID NO: 98295 - protein, 9 aa, Homo Sapiens
KTREERTFR

SEQ ID NO: 98296 - protein, 9 aa, Homo Sapiens
KRLPGNPGL

SEQ ID NO: 98297 - protein, 9 aa, Homo Sapiens
IIRNKDINA

SEQ ID NO: 98298 - protein, 9 aa, Homo Sapiens
QFTFQVLSM

SEQ ID NO: 98299 - protein, 9 aa, Homo Sapiens
LLKTPLALK

SEQ ID NO: 98300 - protein, 9 aa, Homo Sapiens
RGECCALCE

SEQ ID NO: 98301 - protein, 9 aa, Homo Sapiens
LDRSFYIGC

SEQ ID NO: 98302 - protein, 9 aa, Homo Sapiens
QEGPATVAH

SEQ ID NO: 98303 - protein, 9 aa, Homo Sapiens
DNKVVDNQA

SEQ ID NO: 98304 - protein, 9 aa, Homo Sapiens
AMQSFEKKV

SEQ ID NO: 98305 - protein, 9 aa, Homo Sapiens
DRRLYVLNS

SEQ ID NO: 98306 - protein, 9 aa, Homo Sapiens
HQEMMGLIK

SEQ ID NO: 98307 - protein, 9 aa, Homo Sapiens
GLKRLPGNP

SEQ ID NO: 98308 - protein, 9 aa, Homo Sapiens
QRGPRGSYP

SEQ ID NO: 98309 - protein, 9 aa, Homo Sapiens
YYGASLIFT

SEQ ID NO: 98310 - protein, 9 aa, Homo Sapiens
QQWVPAVRF

SEQ ID NO: 98311 - protein, 9 aa, Homo Sapiens
TCSICTCQE

SEQ ID NO: 98312 - protein, 9 aa, Homo Sapiens
PFNEEELTA

SEQ ID NO: 98313 - protein, 9 aa, Homo Sapiens
PKSFLIGGD

SEQ ID NO: 98314 - protein, 9 aa, Homo Sapiens
KRMIHVQNR

SEQ ID NO: 98315 - protein, 9 aa, Homo Sapiens
EMMGLIKKD

SEQ ID NO: 98316 - protein, 9 aa, Homo Sapiens
MCKERLGPG

SEQ ID NO: 98317 - protein, 9 aa, Homo Sapiens
EASFVKKCK

SEQ ID NO: 98318 - protein, 9 aa, Homo Sapiens
TGGVGEKRQ

SEQ ID NO: 98319 - protein, 9 aa, Homo Sapiens
PRRGAGAEL

SEQ ID NO: 98320 - protein, 9 aa, Homo Sapiens
TYQDPVQLS

SEQ ID NO: 98321 - protein, 9 aa, Homo Sapiens
NTGEAENEE

SEQ ID NO: 98322 - protein, 9 aa, Homo Sapiens
EKLEVVLNV

SEQ ID NO: 98323 - protein, 9 aa, Homo Sapiens
QVVPAKRKL

SEQ ID NO: 98324 - protein, 9 aa, Homo Sapiens
VPADVLRHV

SEQ ID NO: 98325 - protein, 9 aa, Homo Sapiens
QAMGDPRPK

SEQ ID NO: 98326 - protein, 9 aa, Homo Sapiens
AFNLPEPAQ

SEQ ID NO: 98327 - protein, 9 aa, Homo Sapiens
SFVKKCKLR

SEQ ID NO: 98328 - protein, 9 aa, Homo Sapiens
PKCGLLIIV

SEQ ID NO: 98329 - protein, 9 aa, Homo Sapiens
YAKRMIHVQ

SEQ ID NO: 98330 - protein, 9 aa, Homo Sapiens
QNVKQMVFK

SEQ ID NO: 98331 - protein, 9 aa, Homo Sapiens
FDGIKVNLQ

SEQ ID NO: 98332 - protein, 9 aa, Homo Sapiens
FNVNAGNII

SEQ ID NO: 98333 - protein, 9 aa, Homo Sapiens
MTLKLKEEP

SEQ ID NO: 98334 - protein, 9 aa, Homo Sapiens
RNYIEIIPS

SEQ ID NO: 98335 - protein, 9 aa, Homo Sapiens
NNVTIREST

SEQ ID NO: 98336 - protein, 9 aa, Homo Sapiens
LDIAAGFAG

SEQ ID NO: 98337 - protein, 9 aa, Homo Sapiens
AASKDRFLA

SEQ ID NO: 98338 - protein, 9 aa, Homo Sapiens
LIKKDNQLL

SEQ ID NO: 98339 - protein, 9 aa, Homo Sapiens
CPPKFIRLE

SEQ ID NO: 98340 - protein, 9 aa, Homo Sapiens
ICPELAQAD

SEQ ID NO: 98341 - protein, 9 aa, Homo Sapiens
LQLKGRRDP

SEQ ID NO: 98342 - protein, 9 aa, Homo Sapiens
LAGRAKSQR

SEQ ID NO: 98343 - protein, 9 aa, Homo Sapiens
QQDKSGPPN

SEQ ID NO: 98344 - protein, 9 aa, Homo Sapiens
EKKSRISLI

SEQ ID NO: 98345 - protein, 9 aa, Homo Sapiens
LLQQIGPKS

SEQ ID NO: 98346 - protein, 9 aa, Homo Sapiens
ENIKIKIER

SEQ ID NO: 98347 - protein, 9 aa, Homo Sapiens
FYIGCYKCE

SEQ ID NO: 98348 - protein, 9 aa, Homo Sapiens
VPVLAEKYK

SEQ ID NO: 98349 - protein, 9 aa, Homo Sapiens
YVSNVAWAH

SEQ ID NO: 98350 - protein, 9 aa, Homo Sapiens
EAVPRVRFT

SEQ ID NO: 98351 - protein, 9 aa, Homo Sapiens
VTGLQKRNY

SEQ ID NO: 98352 - protein, 9 aa, Homo Sapiens
QSSPSQTQT

SEQ ID NO: 98353 - protein, 9 aa, Homo Sapiens
ASAPSEACL

SEQ ID NO: 98354 - protein, 9 aa, Homo Sapiens
SQTQTAPQG

SEQ ID NO: 98355 - protein, 9 aa, Homo Sapiens
ALDRSFYIG

SEQ ID NO: 98356 - protein, 9 aa, Homo Sapiens
KGLPGLKRL

SEQ ID NO: 98357 - protein, 9 aa, Homo Sapiens
RSSSTVLQR

SEQ ID NO: 98358 - protein, 9 aa, Homo Sapiens
EELRRCRSS

SEQ ID NO: 98359 - protein, 9 aa, Homo Sapiens
NTAASKDRF

SEQ ID NO: 98360 - protein, 9 aa, Homo Sapiens
PCLNGGTSF

SEQ ID NO: 98361 - protein, 9 aa, Homo Sapiens
GRQQWVPAV

SEQ ID NO: 98362 - protein, 9 aa, Homo Sapiens
ISVPADPVS

SEQ ID NO: 98363 - protein, 9 aa, Homo Sapiens
CTLAWSFPQ

SEQ ID NO: 98364 - protein, 9 aa, Homo Sapiens
ELRRCRSSA

SEQ ID NO: 98365 - protein, 9 aa, Homo Sapiens
SYVGKAWEV

SEQ ID NO: 98366 - protein, 9 aa, Homo Sapiens
GFAGPVDLC

SEQ ID NO: 98367 - protein, 9 aa, Homo Sapiens
IADMLQACK

SEQ ID NO: 98368 - protein, 9 aa, Homo Sapiens
TDYGMCKER

SEQ ID NO: 98369 - protein, 9 aa, Homo Sapiens
RENISVPAD

SEQ ID NO: 98370 - protein, 9 aa, Homo Sapiens
KTPLALKMS

SEQ ID NO: 98371 - protein, 9 aa, Homo Sapiens
ELAQADKSA

SEQ ID NO: 98372 - protein, 9 aa, Homo Sapiens
ASFICQAMG

SEQ ID NO: 98373 - protein, 9 aa, Homo Sapiens
DGTLCQPEA

SEQ ID NO: 98374 - protein, 9 aa, Homo Sapiens
VLFSYVGKA

SEQ ID NO: 98375 - protein, 9 aa, Homo Sapiens
FRLLPSGII

SEQ ID NO: 98376 - protein, 9 aa, Homo Sapiens
ASWRTTSRR

SEQ ID NO: 98377 - protein, 9 aa, Homo Sapiens
SASWRTTSR

SEQ ID NO: 98378 - protein, 9 aa, Homo Sapiens
NGILHCLTN

SEQ ID NO: 98379 - protein, 9 aa, Homo Sapiens
RVFMKKLNQ

SEQ ID NO: 98380 - protein, 9 aa, Homo Sapiens
QDEQTGHGQ

SEQ ID NO: 98381 - protein, 9 aa, Homo Sapiens
LVPADVLRH

SEQ ID NO: 98382 - protein, 9 aa, Homo Sapiens
FKGNSSLNN

SEQ ID NO: 98383 - protein, 9 aa, Homo Sapiens
VFYTVAVPM

SEQ ID NO: 98384 - protein, 9 aa, Homo Sapiens
NYIEIIPSV

SEQ ID NO: 98385 - protein, 9 aa, Homo Sapiens
LIELAAVNY

SEQ ID NO: 98386 - protein, 9 aa, Homo Sapiens
LASVKALKK

SEQ ID NO: 98387 - protein, 9 aa, Homo Sapiens
FMKKLNQRS

SEQ ID NO: 98388 - protein, 9 aa, Homo Sapiens
PPPSGGGPR

SEQ ID NO: 98389 - protein, 9 aa, Homo Sapiens
QSMPKCGLL

SEQ ID NO: 98390 - protein, 9 aa, Homo Sapiens
STASTLQSA

SEQ ID NO: 98391 - protein, 9 aa, Homo Sapiens
RRPGCPPKF

SEQ ID NO: 98392 - protein, 9 aa, Homo Sapiens
PCVGTQGPR

SEQ ID NO: 98393 - protein, 9 aa, Homo Sapiens
MLQACKEAA

SEQ ID NO: 98394 - protein, 9 aa, Homo Sapiens
LQRGASPRL

SEQ ID NO: 98395 - protein, 9 aa, Homo Sapiens
VPLNTSAEV

SEQ ID NO: 98396 - protein, 9 aa, Homo Sapiens
MMGLIKKDN

SEQ ID NO: 98397 - protein, 9 aa, Homo Sapiens
SYAKRMIHV

SEQ ID NO: 98398 - protein, 9 aa, Homo Sapiens
NMEYFTEMF

SEQ ID NO: 98399 - protein, 9 aa, Homo Sapiens
TQEARNTTK

SEQ ID NO: 98400 - protein, 9 aa, Homo Sapiens
TLRLSGMSN

SEQ ID NO: 98401 - protein, 9 aa, Homo Sapiens
RGSYPPGPL

SEQ ID NO: 98402 - protein, 9 aa, Homo Sapiens
IFLAQFTFQ

SEQ ID NO: 98403 - protein, 9 aa, Homo Sapiens
IIMSSQKAP

SEQ ID NO: 98404 - protein, 9 aa, Homo Sapiens
NGNNTGEAE

SEQ ID NO: 98405 - protein, 9 aa, Homo Sapiens
ICTCQEGSM

SEQ ID NO: 98406 - protein, 9 aa, Homo Sapiens
THGGYGESG

SEQ ID NO: 98407 - protein, 9 aa, Homo Sapiens
VARGECCAL

SEQ ID NO: 98408 - protein, 9 aa, Homo Sapiens
HLCKDGAEP

SEQ ID NO: 98409 - protein, 9 aa, Homo Sapiens
RLLPSGIIN

SEQ ID NO: 98410 - protein, 9 aa, Homo Sapiens
HLFSTMKYK

SEQ ID NO: 98411 - protein, 9 aa, Homo Sapiens
RRRPPLKDE

SEQ ID NO: 98412 - protein, 9 aa, Homo Sapiens
PEAETPGAV

SEQ ID NO: 98413 - protein, 9 aa, Homo Sapiens
EYKHVCKRV

SEQ ID NO: 98414 - protein, 9 aa, Homo Sapiens
SLVQAISKQ

SEQ ID NO: 98415 - protein, 9 aa, Homo Sapiens
AISCSNSHG

SEQ ID NO: 98416 - protein, 9 aa, Homo Sapiens
GFNVNAGNI

SEQ ID NO: 98417 - protein, 9 aa, Homo Sapiens
LRQTMKDHL

SEQ ID NO: 98418 - protein, 9 aa, Homo Sapiens
QACKEAAYH

SEQ ID NO: 98419 - protein, 9 aa, Homo Sapiens
VQLQPLTVY

SEQ ID NO: 98420 - protein, 9 aa, Homo Sapiens
HSFSHNNPV

SEQ ID NO: 98421 - protein, 9 aa, Homo Sapiens
QSKYCYCGI

SEQ ID NO: 98422 - protein, 9 aa, Homo Sapiens
EPTRLYPSG

SEQ ID NO: 98423 - protein, 9 aa, Homo Sapiens
MHLFSTMKY

SEQ ID NO: 98424 - protein, 9 aa, Homo Sapiens
LEGKTREER

SEQ ID NO: 98425 - protein, 9 aa, Homo Sapiens
SEETLNNFP

SEQ ID NO: 98426 - protein, 9 aa, Homo Sapiens
SNVHGTIFA

SEQ ID NO: 98427 - protein, 9 aa, Homo Sapiens
QRIAGEEDH

SEQ ID NO: 98428 - protein, 9 aa, Homo Sapiens
GHGHDHEHT

SEQ ID NO: 98429 - protein, 9 aa, Homo Sapiens
CGKTFKGNS

SEQ ID NO: 98430 - protein, 9 aa, Homo Sapiens
NHSVDGLQR

SEQ ID NO: 98431 - protein, 9 aa, Homo Sapiens
GQSKYCYCG

SEQ ID NO: 98432 - protein, 9 aa, Homo Sapiens
RNKDINARV

SEQ ID NO: 98433 - protein, 9 aa, Homo Sapiens
SHSFSHNNP

SEQ ID NO: 98434 - protein, 9 aa, Homo Sapiens
GRRPGCPPK

SEQ ID NO: 98435 - protein, 9 aa, Homo Sapiens
HCREVIQNS

SEQ ID NO: 98436 - protein, 9 aa, Homo Sapiens
HGRGGAGAP

SEQ ID NO: 98437 - protein, 9 aa, Homo Sapiens
ELLPVDVSY

SEQ ID NO: 98438 - protein, 9 aa, Homo Sapiens
GEAENEESC

SEQ ID NO: 98439 - protein, 9 aa, Homo Sapiens
RYMHLFSTM

SEQ ID NO: 98440 - protein, 9 aa, Homo Sapiens
EAVLFSYVG

SEQ ID NO: 98441 - protein, 9 aa, Homo Sapiens
ILNSLYDLL

SEQ ID NO: 98442 - protein, 9 aa, Homo Sapiens
TLKLKEEPL

SEQ ID NO: 98443 - protein, 9 aa, Homo Sapiens
CGLLIIVLG

SEQ ID NO: 98444 - protein, 9 aa, Homo Sapiens
ATVAHTRLE

SEQ ID NO: 98445 - protein, 9 aa, Homo Sapiens
IEDHIESLH

SEQ ID NO: 98446 - protein, 9 aa, Homo Sapiens
ADKSALANL

SEQ ID NO: 98447 - protein, 9 aa, Homo Sapiens
EERFWVAIK

SEQ ID NO: 98448 - protein, 9 aa, Homo Sapiens
VQLSLSPRW

SEQ ID NO: 98449 - protein, 9 aa, Homo Sapiens
CCFLSHCRE

SEQ ID NO: 98450 - protein, 9 aa, Homo Sapiens
PSVDNRDGS

SEQ ID NO: 98451 - protein, 9 aa, Homo Sapiens
PSGGGPRRG

SEQ ID NO: 98452 - protein, 9 aa, Homo Sapiens
QQIGPKSFL

SEQ ID NO: 98453 - protein, 9 aa, Homo Sapiens
KKSRISLIP

SEQ ID NO: 98454 - protein, 9 aa, Homo Sapiens
VCLLKSDNK

SEQ ID NO: 98455 - protein, 9 aa, Homo Sapiens
IGPKSFLIG

SEQ ID NO: 98456 - protein, 9 aa, Homo Sapiens
NPCLNGGTS

SEQ ID NO: 98457 - protein, 9 aa, Homo Sapiens
VRLVAKQVE

SEQ ID NO: 98458 - protein, 9 aa, Homo Sapiens
ETLLKTPLA

SEQ ID NO: 98459 - protein, 9 aa, Homo Sapiens
YKVPVAAVR

SEQ ID NO: 98460 - protein, 9 aa, Homo Sapiens
SPVCLTADS

SEQ ID NO: 98461 - protein, 9 aa, Homo Sapiens
SLHPVTWSL

SEQ ID NO: 98462 - protein, 9 aa, Homo Sapiens
AISKQNVKQ

SEQ ID NO: 98463 - protein, 9 aa, Homo Sapiens
CVGTQGPRG

SEQ ID NO: 98464 - protein, 9 aa, Homo Sapiens
AAASGRPSS

SEQ ID NO: 98465 - protein, 9 aa, Homo Sapiens
ALLLDIFFR

SEQ ID NO: 98466 - protein, 9 aa, Homo Sapiens
LEECAISCS

SEQ ID NO: 98467 - protein, 9 aa, Homo Sapiens
ISLEAAEEK

SEQ ID NO: 98468 - protein, 9 aa, Homo Sapiens
REASFVKKC

SEQ ID NO: 98469 - protein, 9 aa, Homo Sapiens
VQGRQQWVP

SEQ ID NO: 98470 - protein, 9 aa, Homo Sapiens
LDQEGPATV

SEQ ID NO: 98471 - protein, 9 aa, Homo Sapiens
DVDVNEWRE

SEQ ID NO: 98472 - protein, 9 aa, Homo Sapiens
CLRQSSGAG

SEQ ID NO: 98473 - protein, 9 aa, Homo Sapiens
VGEKRQLVY

SEQ ID NO: 98474 - protein, 9 aa, Homo Sapiens
LKGRRDPPL

SEQ ID NO: 98475 - protein, 9 aa, Homo Sapiens
GIDVNGPKP

SEQ ID NO: 98476 - protein, 9 aa, Homo Sapiens
EIILKRVAD

SEQ ID NO: 98477 - protein, 9 aa, Homo Sapiens
RLYPSGIEM

SEQ ID NO: 98478 - protein, 9 aa, Homo Sapiens
KDLAKALGF

SEQ ID NO: 98479 - protein, 9 aa, Homo Sapiens
MLEIHSQVN

SEQ ID NO: 98480 - protein, 9 aa, Homo Sapiens
WVAIKDKQE

SEQ ID NO: 98481 - protein, 9 aa, Homo Sapiens
IKIERKHAQ

SEQ ID NO: 98482 - protein, 9 aa, Homo Sapiens
EKKATATTA

SEQ ID NO: 98483 - protein, 9 aa, Homo Sapiens
KGNSSLNNH

SEQ ID NO: 98484 - protein, 9 aa, Homo Sapiens
GRRKFAAAA

SEQ ID NO: 98485 - protein, 9 aa, Homo Sapiens
HRQSHQDEQ

SEQ ID NO: 98486 - protein, 9 aa, Homo Sapiens
YDLLAALIR

SEQ ID NO: 98487 - protein, 9 aa, Homo Sapiens
HVYSGSGLV

SEQ ID NO: 98488 - protein, 9 aa, Homo Sapiens
GGPGGFDGS

SEQ ID NO: 98489 - protein, 9 aa, Homo Sapiens
SGPPNDRFS

SEQ ID NO: 98490 - protein, 9 aa, Homo Sapiens
VNDKGYSEL

SEQ ID NO: 98491 - protein, 9 aa, Homo Sapiens
HVQNRAYFQ

SEQ ID NO: 98492 - protein, 9 aa, Homo Sapiens
ANEEEKKAT

SEQ ID NO: 98493 - protein, 9 aa, Homo Sapiens
LYDLLAALI

SEQ ID NO: 98494 - protein, 9 aa, Homo Sapiens
LETHDLDLG

SEQ ID NO: 98495 - protein, 9 aa, Homo Sapiens
RFTNDDRHR

SEQ ID NO: 98496 - protein, 9 aa, Homo Sapiens
IVYFLAGRA

SEQ ID NO: 98497 - protein, 9 aa, Homo Sapiens
QCCFLSHCR

SEQ ID NO: 98498 - protein, 9 aa, Homo Sapiens
NIEEGLGNS

SEQ ID NO: 98499 - protein, 9 aa, Homo Sapiens
AQPRPSLSQ

SEQ ID NO: 98500 - protein, 9 aa, Homo Sapiens
VAVPMLNPL

SEQ ID NO: 98501 - protein, 9 aa, Homo Sapiens
VKRFQEQQK

SEQ ID NO: 98502 - protein, 9 aa, Homo Sapiens
VDNRDGSSS

SEQ ID NO: 98503 - protein, 9 aa, Homo Sapiens
VRVQGRQQW

SEQ ID NO: 98504 - protein, 9 aa, Homo Sapiens
MHMRETSVF

SEQ ID NO: 98505 - protein, 9 aa, Homo Sapiens
MQSRENISV

SEQ ID NO: 98506 - protein, 9 aa, Homo Sapiens
PSEACLRQS

SEQ ID NO: 98507 - protein, 9 aa, Homo Sapiens
EEPLTKRAS

SEQ ID NO: 98508 - protein, 9 aa, Homo Sapiens
EVTRVFMKK

SEQ ID NO: 98509 - protein, 9 aa, Homo Sapiens
GMSILQRIA

SEQ ID NO: 98510 - protein, 9 aa, Homo Sapiens
NIKIKIERK

SEQ ID NO: 98511 - protein, 9 aa, Homo Sapiens
FAAAASGRP

SEQ ID NO: 98512 - protein, 9 aa, Homo Sapiens
GPGCRGQKG

SEQ ID NO: 98513 - protein, 9 aa, Homo Sapiens
KERLGPGDT

SEQ ID NO: 98514 - protein, 9 aa, Homo Sapiens
QEMMGLIKK

SEQ ID NO: 98515 - protein, 9 aa, Homo Sapiens
FSYVGKAWE

SEQ ID NO: 98516 - protein, 9 aa, Homo Sapiens
QLLLFHLEQ

SEQ ID NO: 98517 - protein, 9 aa, Homo Sapiens
KCGLLIIVL

SEQ ID NO: 98518 - protein, 9 aa, Homo Sapiens
STVLQRRKR

SEQ ID NO: 98519 - protein, 9 aa, Homo Sapiens
VDGKEYDFR

SEQ ID NO: 98520 - protein, 9 aa, Homo Sapiens
PPLKDERER

SEQ ID NO: 98521 - protein, 9 aa, Homo Sapiens
AQFTFQVLS

SEQ ID NO: 98522 - protein, 9 aa, Homo Sapiens
KPYNSKECG

SEQ ID NO: 98523 - protein, 9 aa, Homo Sapiens
NVHGTIFAN

SEQ ID NO: 98524 - protein, 9 aa, Homo Sapiens
VLSFLYKSS

SEQ ID NO: 98525 - protein, 9 aa, Homo Sapiens
PEPAPHAGL

SEQ ID NO: 98526 - protein, 9 aa, Homo Sapiens
YDFRLLPSG

SEQ ID NO: 98527 - protein, 9 aa, Homo Sapiens
KKCKLRVSQ

SEQ ID NO: 98528 - protein, 9 aa, Homo Sapiens
KTFKGNSSL

SEQ ID NO: 98529 - protein, 9 aa, Homo Sapiens
RGHGRGGAG

SEQ ID NO: 98530 - protein, 9 aa, Homo Sapiens
CLNGGTSFS

SEQ ID NO: 98531 - protein, 9 aa, Homo Sapiens
NEPEVVSLA

SEQ ID NO: 98532 - protein, 9 aa, Homo Sapiens
EGLGNSWWI

SEQ ID NO: 98533 - protein, 9 aa, Homo Sapiens
SYPPGPLAP

SEQ ID NO: 98534 - protein, 9 aa, Homo Sapiens
ELVSWELKD

SEQ ID NO: 98535 - protein, 9 aa, Homo Sapiens
ASGRPSSQP

SEQ ID NO: 98536 - protein, 9 aa, Homo Sapiens
SMPKCGLLI

SEQ ID NO: 98537 - protein, 9 aa, Homo Sapiens
QGTQEARNT

SEQ ID NO: 98538 - protein, 9 aa, Homo Sapiens
DIAAGFAGP

SEQ ID NO: 98539 - protein, 9 aa, Homo Sapiens
RSSTVTQAP

SEQ ID NO: 98540 - protein, 9 aa, Homo Sapiens
LQKRNYSAH

SEQ ID NO: 98541 - protein, 9 aa, Homo Sapiens
KSQCCFLSH

SEQ ID NO: 98542 - protein, 9 aa, Homo Sapiens
GPATVAHTR

SEQ ID NO: 98543 - protein, 9 aa, Homo Sapiens
CVEVTGLQK

SEQ ID NO: 98544 - protein, 9 aa, Homo Sapiens
ASFVKKCKL

SEQ ID NO: 98545 - protein, 9 aa, Homo Sapiens
SWMEEEVLS

SEQ ID NO: 98546 - protein, 9 aa, Homo Sapiens
KGEKGNPCV

SEQ ID NO: 98547 - protein, 9 aa, Homo Sapiens
QDGTLCQPE

SEQ ID NO: 98548 - protein, 9 aa, Homo Sapiens
LVPVLAEKY

SEQ ID NO: 98549 - protein, 9 aa, Homo Sapiens
GILHCLTNI

SEQ ID NO: 98550 - protein, 9 aa, Homo Sapiens
QLQPLTVYS

SEQ ID NO: 98551 - protein, 9 aa, Homo Sapiens
NNTGEAENE

SEQ ID NO: 98552 - protein, 9 aa, Homo Sapiens
YFQEVGPEL

SEQ ID NO: 98553 - protein, 9 aa, Homo Sapiens
LLNLDIAAG

SEQ ID NO: 98554 - protein, 9 aa, Homo Sapiens
LTTGATLIK

SEQ ID NO: 98555 - protein, 9 aa, Homo Sapiens
TDYVVTVFV

SEQ ID NO: 98556 - protein, 9 aa, Homo Sapiens
IERKHAQQK

SEQ ID NO: 98557 - protein, 9 aa, Homo Sapiens
RNYLEGIYK

SEQ ID NO: 98558 - protein, 9 aa, Homo Sapiens
MGLIKKDNQ

SEQ ID NO: 98559 - protein, 9 aa, Homo Sapiens
STVNPVYVS

SEQ ID NO: 98560 - protein, 9 aa, Homo Sapiens
QAPIAVVTS

SEQ ID NO: 98561 - protein, 9 aa, Homo Sapiens
SRELLPVDV

SEQ ID NO: 98562 - protein, 9 aa, Homo Sapiens
GLIKKDNQL

SEQ ID NO: 98563 - protein, 9 aa, Homo Sapiens
TELRTFSHH

SEQ ID NO: 98564 - protein, 9 aa, Homo Sapiens
SSSTVLQRR

SEQ ID NO: 98565 - protein, 9 aa, Homo Sapiens
GVYHEKAQK

SEQ ID NO: 98566 - protein, 9 aa, Homo Sapiens
NPCVGTQGP

SEQ ID NO: 98567 - protein, 9 aa, Homo Sapiens
NTSAEVSTT

SEQ ID NO: 98568 - protein, 9 aa, Homo Sapiens
MKYKVSISV

SEQ ID NO: 98569 - protein, 9 aa, Homo Sapiens
LARSSRPFD

SEQ ID NO: 98570 - protein, 9 aa, Homo Sapiens
EEYFQEVGP

SEQ ID NO: 98571 - protein, 9 aa, Homo Sapiens
FHLEQCEAN

SEQ ID NO: 98572 - protein, 9 aa, Homo Sapiens
IDVNGPKPQ

SEQ ID NO: 98573 - protein, 9 aa, Homo Sapiens
DTDYVVTVF

SEQ ID NO: 98574 - protein, 9 aa, Homo Sapiens
SSRPFDRRL

SEQ ID NO: 98575 - protein, 9 aa, Homo Sapiens
QEARNTTKP

SEQ ID NO: 98576 - protein, 9 aa, Homo Sapiens
QLSLSPRWG

SEQ ID NO: 98577 - protein, 9 aa, Homo Sapiens
GFDGSGGFG

SEQ ID NO: 98578 - protein, 9 aa, Homo Sapiens
EIIRNKDIN

SEQ ID NO: 98579 - protein, 9 aa, Homo Sapiens
PLAACAGCA

SEQ ID NO: 98580 - protein, 9 aa, Homo Sapiens
RAKSQRLWE

SEQ ID NO: 98581 - protein, 9 aa, Homo Sapiens
KNKQARRKV

SEQ ID NO: 98582 - protein, 9 aa, Homo Sapiens
LFSYVGKAW

SEQ ID NO: 98583 - protein, 9 aa, Homo Sapiens
VPRVRFTND

SEQ ID NO: 98584 - protein, 9 aa, Homo Sapiens
SQKAPVSGK

SEQ ID NO: 98585 - protein, 9 aa, Homo Sapiens
PSGFRTSMD

SEQ ID NO: 98586 - protein, 9 aa, Homo Sapiens
RERAFQITV

SEQ ID NO: 98587 - protein, 9 aa, Homo Sapiens
KKETLLKTP

SEQ ID NO: 98588 - protein, 9 aa, Homo Sapiens
FWVAIKDKQ

SEQ ID NO: 98589 - protein, 9 aa, Homo Sapiens
ICSDGTLYF

SEQ ID NO: 98590 - protein, 9 aa, Homo Sapiens
LLDIFFRPL

SEQ ID NO: 98591 - protein, 9 aa, Homo Sapiens
LIFTSKSEA

SEQ ID NO: 98592 - protein, 9 aa, Homo Sapiens
EETLNNFPE

SEQ ID NO: 98593 - protein, 9 aa, Homo Sapiens
CNEQSMPKC

SEQ ID NO: 98594 - protein, 9 aa, Homo Sapiens
LEVCLLKSD

SEQ ID NO: 98595 - protein, 9 aa, Homo Sapiens
CQPDLRPAS

SEQ ID NO: 98596 - protein, 9 aa, Homo Sapiens
EVTGLQKRN

SEQ ID NO: 98597 - protein, 9 aa, Homo Sapiens
RESTQNDVR

SEQ ID NO: 98598 - protein, 9 aa, Homo Sapiens
SPLAACAGC

SEQ ID NO: 98599 - protein, 9 aa, Homo Sapiens
APVSGKPAE

SEQ ID NO: 98600 - protein, 9 aa, Homo Sapiens
VTRVFMKKL

SEQ ID NO: 98601 - protein, 9 aa, Homo Sapiens
CLLKSDNKV

SEQ ID NO: 98602 - protein, 9 aa, Homo Sapiens
KEEPLTKRA

SEQ ID NO: 98603 - protein, 9 aa, Homo Sapiens
VSLASCAPP

SEQ ID NO: 98604 - protein, 9 aa, Homo Sapiens
QSHQDEQTG

SEQ ID NO: 98605 - protein, 9 aa, Homo Sapiens
ASTLQSAAH

SEQ ID NO: 98606 - protein, 9 aa, Homo Sapiens
CKRVCQKAI

SEQ ID NO: 98607 - protein, 9 aa, Homo Sapiens
REFREDTCV

SEQ ID NO: 98608 - protein, 9 aa, Homo Sapiens
GKTREERTF

SEQ ID NO: 98609 - protein, 9 aa, Homo Sapiens
LAKALGFLC

SEQ ID NO: 98610 - protein, 9 aa, Homo Sapiens
LGFLCVVTN

SEQ ID NO: 98611 - protein, 9 aa, Homo Sapiens
QTQTAPQGP

SEQ ID NO: 98612 - protein, 9 aa, Homo Sapiens
IAWLETHDL

SEQ ID NO: 98613 - protein, 9 aa, Homo Sapiens
ATATTAQEY

SEQ ID NO: 98614 - protein, 9 aa, Homo Sapiens
LLFSLWNHI

SEQ ID NO: 98615 - protein, 9 aa, Homo Sapiens
NPVYVSNVA

SEQ ID NO: 98616 - protein, 9 aa, Homo Sapiens
MSILQRIAG

SEQ ID NO: 98617 - protein, 9 aa, Homo Sapiens
EPNQKVSVN

SEQ ID NO: 98618 - protein, 9 aa, Homo Sapiens
GLPGLKRLP

SEQ ID NO: 98619 - protein, 9 aa, Homo Sapiens
CAGCAPSAL

SEQ ID NO: 98620 - protein, 9 aa, Homo Sapiens
CKDGAEPTS

SEQ ID NO: 98621 - protein, 9 aa, Homo Sapiens
AWGGPGCRG

SEQ ID NO: 98622 - protein, 9 aa, Homo Sapiens
TNGNNTGEA

SEQ ID NO: 98623 - protein, 9 aa, Homo Sapiens
TMRQQLTLP

SEQ ID NO: 98624 - protein, 9 aa, Homo Sapiens
GCAPSALCP

SEQ ID NO: 98625 - protein, 9 aa, Homo Sapiens
TWSLKAGCH

SEQ ID NO: 98626 - protein, 9 aa, Homo Sapiens
EVVSLASCA

SEQ ID NO: 98627 - protein, 9 aa, Homo Sapiens
PPNDRFSAE

SEQ ID NO: 98628 - protein, 9 aa, Homo Sapiens
SALIELAAV

SEQ ID NO: 98629 - protein, 9 aa, Homo Sapiens
VTIRESTQN

SEQ ID NO: 98630 - protein, 9 aa, Homo Sapiens
KLEVVLNVA

SEQ ID NO: 98631 - protein, 9 aa, Homo Sapiens
GRAKSQRLW

SEQ ID NO: 98632 - protein, 9 aa, Homo Sapiens
RFQEQQKND

SEQ ID NO: 98633 - protein, 9 aa, Homo Sapiens
HQDEQTGHG

SEQ ID NO: 98634 - protein, 9 aa, Homo Sapiens
PAVLYEAMQ

SEQ ID NO: 98635 - protein, 9 aa, Homo Sapiens
LHPVTWSLK

SEQ ID NO: 98636 - protein, 9 aa, Homo Sapiens
AGRAKSQRL

SEQ ID NO: 98637 - protein, 9 aa, Homo Sapiens
TRGTGGVGE

SEQ ID NO: 98638 - protein, 9 aa, Homo Sapiens
LYKEFFNPD

SEQ ID NO: 98639 - protein, 9 aa, Homo Sapiens
LEVTRVFMK

SEQ ID NO: 98640 - protein, 9 aa, Homo Sapiens
RPSVDNRDG

SEQ ID NO: 98641 - protein, 9 aa, Homo Sapiens
LLVAPDNGS

SEQ ID NO: 98642 - protein, 9 aa, Homo Sapiens
VGPELLIPC

SEQ ID NO: 98643 - protein, 9 aa, Homo Sapiens
PELLIPCSA

SEQ ID NO: 98644 - protein, 9 aa, Homo Sapiens
LKKCSDLEK

SEQ ID NO: 98645 - protein, 9 aa, Homo Sapiens
PEAVLFSYV

SEQ ID NO: 98646 - protein, 9 aa, Homo Sapiens
WLSYELPPP

SEQ ID NO: 98647 - protein, 9 aa, Homo Sapiens
PEAPDICVA

SEQ ID NO: 98648 - protein, 9 aa, Homo Sapiens
AVLYEAMQS

SEQ ID NO: 98649 - protein, 9 aa, Homo Sapiens
EMFNIGVAL

SEQ ID NO: 98650 - protein, 9 aa, Homo Sapiens
GGPRRGAGA

SEQ ID NO: 98651 - protein, 9 aa, Homo Sapiens
HYYGASLIF

SEQ ID NO: 98652 - protein, 9 aa, Homo Sapiens
SLQLKGRRD

SEQ ID NO: 98653 - protein, 9 aa, Homo Sapiens
AWLETHDLD

SEQ ID NO: 98654 - protein, 9 aa, Homo Sapiens
FLTEPEPAP

SEQ ID NO: 98655 - protein, 9 aa, Homo Sapiens
IDPADHLTM

SEQ ID NO: 98656 - protein, 9 aa, Homo Sapiens
PLDPTCSIC

SEQ ID NO: 98657 - protein, 9 aa, Homo Sapiens
GMCKERLGP

SEQ ID NO: 98658 - protein, 9 aa, Homo Sapiens
GHGRGGAGA

SEQ ID NO: 98659 - protein, 9 aa, Homo Sapiens
SSRHFSKSH

SEQ ID NO: 98660 - protein, 9 aa, Homo Sapiens
QANMEYFTE

SEQ ID NO: 98661 - protein, 9 aa, Homo Sapiens
IKKETLLKT

SEQ ID NO: 98662 - protein, 9 aa, Homo Sapiens
EVPLNTSAE

SEQ ID NO: 98663 - protein, 9 aa, Homo Sapiens
SDRQLLLFH

SEQ ID NO: 98664 - protein, 9 aa, Homo Sapiens
LNGGTSFSC

SEQ ID NO: 98665 - protein, 9 aa, Homo Sapiens
DPADHLTMR

SEQ ID NO: 98666 - protein, 9 aa, Homo Sapiens
SPGCRSRSR

SEQ ID NO: 98667 - protein, 9 aa, Homo Sapiens
GRPSVDNRD

SEQ ID NO: 98668 - protein, 9 aa, Homo Sapiens
MRETSVFTL

SEQ ID NO: 98669 - protein, 9 aa, Homo Sapiens
QKAPVSGKP

SEQ ID NO: 98670 - protein, 9 aa, Homo Sapiens
MEEEVLSFL

SEQ ID NO: 98671 - protein, 9 aa, Homo Sapiens
FQITVKVLT

SEQ ID NO: 98672 - protein, 9 aa, Homo Sapiens
GTLYFQVPC

SEQ ID NO: 98673 - protein, 9 aa, Homo Sapiens
CPTLVQPLP

SEQ ID NO: 98674 - protein, 9 aa, Homo Sapiens
GWKEFVRRS

SEQ ID NO: 98675 - protein, 9 aa, Homo Sapiens
FSTMKYKVS

SEQ ID NO: 98676 - protein, 9 aa, Homo Sapiens
PGCPPKFIR

SEQ ID NO: 98677 - protein, 9 aa, Homo Sapiens
LRQSSGAGA

SEQ ID NO: 98678 - protein, 9 aa, Homo Sapiens
RELLPVDVS

SEQ ID NO: 98679 - protein, 9 aa, Homo Sapiens
DLLAALIRG

SEQ ID NO: 98680 - protein, 9 aa, Homo Sapiens
SWELKDWPK

SEQ ID NO: 98681 - protein, 9 aa, Homo Sapiens
KDEEAKVSR

SEQ ID NO: 98682 - protein, 9 aa, Homo Sapiens
QADKSALAN

SEQ ID NO: 98683 - protein, 9 aa, Homo Sapiens
NQEIILKRV

SEQ ID NO: 98684 - protein, 9 aa, Homo Sapiens
LQRIAGEED

SEQ ID NO: 98685 - protein, 9 aa, Homo Sapiens
IASEIIRNK

SEQ ID NO: 98686 - protein, 9 aa, Homo Sapiens
SLYSPVCLT

SEQ ID NO: 98687 - protein, 9 aa, Homo Sapiens
SVFYTVAVP

SEQ ID NO: 98688 - protein, 9 aa, Homo Sapiens
FSLKDEEAK

SEQ ID NO: 98689 - protein, 9 aa, Homo Sapiens
KYCYCGIRR

SEQ ID NO: 98690 - protein, 9 aa, Homo Sapiens
PADVLRHVY

SEQ ID NO: 98691 - protein, 9 aa, Homo Sapiens
QLASVKALK

SEQ ID NO: 98692 - protein, 9 aa, Homo Sapiens
DNRDGSSSE

SEQ ID NO: 98693 - protein, 9 aa, Homo Sapiens
YSSQLQVHM

SEQ ID NO: 98694 - protein, 9 aa, Homo Sapiens
KFAAAASGR

SEQ ID NO: 98695 - protein, 9 aa, Homo Sapiens
FVRRSKKVS

SEQ ID NO: 98696 - protein, 9 aa, Homo Sapiens
YCYCGIRRK

SEQ ID NO: 98697 - protein, 9 aa, Homo Sapiens
VAAVATPGA

SEQ ID NO: 98698 - protein, 9 aa, Homo Sapiens
KAPVSGKPA

SEQ ID NO: 98699 - protein, 9 aa, Homo Sapiens
SAHAAYVAA

SEQ ID NO: 98700 - protein, 9 aa, Homo Sapiens
ITVKVLTND

SEQ ID NO: 98701 - protein, 9 aa, Homo Sapiens
TGFSCEDLI

SEQ ID NO: 98702 - protein, 9 aa, Homo Sapiens
GGFDGSGGF

SEQ ID NO: 98703 - protein, 9 aa, Homo Sapiens
RMIHVQNRA

SEQ ID NO: 98704 - protein, 9 aa, Homo Sapiens
TRYELREFR

SEQ ID NO: 98705 - protein, 9 aa, Homo Sapiens
GLVPVLAEK

SEQ ID NO: 98706 - protein, 9 aa, Homo Sapiens
QPEAPDICV

SEQ ID NO: 98707 - protein, 9 aa, Homo Sapiens
ATLIKEQWL

SEQ ID NO: 98708 - protein, 9 aa, Homo Sapiens
TPLALKMST

SEQ ID NO: 98709 - protein, 9 aa, Homo Sapiens
LKEEPLTKR

SEQ ID NO: 98710 - protein, 9 aa, Homo Sapiens
EIIPSVAEG

SEQ ID NO: 98711 - protein, 9 aa, Homo Sapiens
GPKPQLMLR

SEQ ID NO: 98712 - protein, 9 aa, Homo Sapiens
TASTLQSAA

SEQ ID NO: 98713 - protein, 9 aa, Homo Sapiens
AASGRPSSQ

SEQ ID NO: 98714 - protein, 9 aa, Homo Sapiens
LAQADKSAL

SEQ ID NO: 98715 - protein, 9 aa, Homo Sapiens
GVGEKRQLV

SEQ ID NO: 98716 - protein, 9 aa, Homo Sapiens
RPPLKDERE

SEQ ID NO: 98717 - protein, 9 aa, Homo Sapiens
RLSGMSNRS

SEQ ID NO: 98718 - protein, 9 aa, Homo Sapiens
AAKEKLEVV

SEQ ID NO: 98719 - protein, 9 aa, Homo Sapiens
AEKYKSQQS

SEQ ID NO: 98720 - protein, 9 aa, Homo Sapiens
MIHVQNRAY

SEQ ID NO: 98721 - protein, 9 aa, Homo Sapiens
EGIYKVPVA

SEQ ID NO: 98722 - protein, 9 aa, Homo Sapiens
RGCPTLVQP

SEQ ID NO: 98723 - protein, 9 aa, Homo Sapiens
SHCPRHCPP

SEQ ID NO: 98724 - protein, 9 aa, Homo Sapiens
QDKSGPPND

SEQ ID NO: 98725 - protein, 9 aa, Homo Sapiens
YAFHLCKDG

SEQ ID NO: 98726 - protein, 9 aa, Homo Sapiens
FIPSGFRTS

SEQ ID NO: 98727 - protein, 9 aa, Homo Sapiens
IRVKELVSW

SEQ ID NO: 98728 - protein, 9 aa, Homo Sapiens
SNEPEVVSL

SEQ ID NO: 98729 - protein, 9 aa, Homo Sapiens
KEELRRCRS

SEQ ID NO: 98730 - protein, 9 aa, Homo Sapiens
AKQVELELE

SEQ ID NO: 98731 - protein, 9 aa, Homo Sapiens
GNNTGEAEN

SEQ ID NO: 98732 - protein, 9 aa, Homo Sapiens
LIKEQWLLT

SEQ ID NO: 98733 - protein, 9 aa, Homo Sapiens
ALEVTRVFM

SEQ ID NO: 98734 - protein, 9 aa, Homo Sapiens
ETSVFTLKK

SEQ ID NO: 98735 - protein, 9 aa, Homo Sapiens
PGRRPGCPP

SEQ ID NO: 98736 - protein, 9 aa, Homo Sapiens
TLIKEQWLL

SEQ ID NO: 98737 - protein, 9 aa, Homo Sapiens
TEMFNIGVA

SEQ ID NO: 98738 - protein, 9 aa, Homo Sapiens
TFSHHHAEM

SEQ ID NO: 98739 - protein, 9 aa, Homo Sapiens
FQVPCKGLN

SEQ ID NO: 98740 - protein, 9 aa, Homo Sapiens
PEVVSLASC

SEQ ID NO: 98741 - protein, 9 aa, Homo Sapiens
QLTKTSREF

SEQ ID NO: 98742 - protein, 9 aa, Homo Sapiens
QTAPQGPST

SEQ ID NO: 98743 - protein, 9 aa, Homo Sapiens
AICPELAQA

SEQ ID NO: 98744 - protein, 9 aa, Homo Sapiens
STQNDVRKI

SEQ ID NO: 98745 - protein, 9 aa, Homo Sapiens
LFSLWNHIT

SEQ ID NO: 98746 - protein, 9 aa, Homo Sapiens
GNPCVGTQG

SEQ ID NO: 98747 - protein, 9 aa, Homo Sapiens
LGNSWWILR

SEQ ID NO: 98748 - protein, 9 aa, Homo Sapiens
LLLFHLEQC

SEQ ID NO: 98749 - protein, 9 aa, Homo Sapiens
EKCTLAWSF

SEQ ID NO: 98750 - protein, 9 aa, Homo Sapiens
RVQGRQQWV

SEQ ID NO: 98751 - protein, 9 aa, Homo Sapiens
IPWNAFPRK

SEQ ID NO: 98752 - protein, 9 aa, Homo Sapiens
KEYDFRLLP

SEQ ID NO: 98753 - protein, 9 aa, Homo Sapiens
PVSGKPAES

SEQ ID NO: 98754 - protein, 9 aa, Homo Sapiens
DRFLACIEE

SEQ ID NO: 98755 - protein, 9 aa, Homo Sapiens
HAAYVAAVA

SEQ ID NO: 98756 - protein, 9 aa, Homo Sapiens
YFTEMFNIG

SEQ ID NO: 98757 - protein, 9 aa, Homo Sapiens
EGQVVPAKR

SEQ ID NO: 98758 - protein, 9 aa, Homo Sapiens
EGPATVAHT

SEQ ID NO: 98759 - protein, 9 aa, Homo Sapiens
HSVDGLQRG

SEQ ID NO: 98760 - protein, 9 aa, Homo Sapiens
CGIRRKTLV

SEQ ID NO: 98761 - protein, 9 aa, Homo Sapiens
CEDLIPCVL

SEQ ID NO: 98762 - protein, 9 aa, Homo Sapiens
GPPNDRFSA

SEQ ID NO: 98763 - protein, 9 aa, Homo Sapiens
DERERTRAG

SEQ ID NO: 98764 - protein, 9 aa, Homo Sapiens
FPEAETPGA

SEQ ID NO: 98765 - protein, 9 aa, Homo Sapiens
IYKVPVAAV

SEQ ID NO: 98766 - protein, 9 aa, Homo Sapiens
AQQDKSGPP

SEQ ID NO: 98767 - protein, 9 aa, Homo Sapiens
DHLTMRQQL

SEQ ID NO: 98768 - protein, 9 aa, Homo Sapiens
HDLDLGLGG

SEQ ID NO: 98769 - protein, 9 aa, Homo Sapiens
NIIQQSAAK

SEQ ID NO: 98770 - protein, 9 aa, Homo Sapiens
WTLLEGKTR

SEQ ID NO: 98771 - protein, 9 aa, Homo Sapiens
SPDTDYVVT

SEQ ID NO: 98772 - protein, 9 aa, Homo Sapiens
RHVYSGSGL

SEQ ID NO: 98773 - protein, 9 aa, Homo Sapiens
LTGFSCEDL

SEQ ID NO: 98774 - protein, 9 aa, Homo Sapiens
EEVLSFLYK

SEQ ID NO: 98775 - protein, 9 aa, Homo Sapiens
TLQSAAHSN

SEQ ID NO: 98776 - protein, 9 aa, Homo Sapiens
RGQSKYCYC

SEQ ID NO: 98777 - protein, 9 aa, Homo Sapiens
SSTVTQAPI

SEQ ID NO: 98778 - protein, 9 aa, Homo Sapiens
GPGGFDGSG

SEQ ID NO: 98779 - protein, 9 aa, Homo Sapiens
VLAEKYKSQ

SEQ ID NO: 98780 - protein, 9 aa, Homo Sapiens
VKTLRLSGM

SEQ ID NO: 98781 - protein, 9 aa, Homo Sapiens
LTKTSREFD

SEQ ID NO: 98782 - protein, 9 aa, Homo Sapiens
IKGEKGNPC

SEQ ID NO: 98783 - protein, 9 aa, Homo Sapiens
VHGTIFANA

SEQ ID NO: 98784 - protein, 9 aa, Homo Sapiens
KKCSDLEKA

SEQ ID NO: 98785 - protein, 9 aa, Homo Sapiens
SDNKVVDNQ

SEQ ID NO: 98786 - protein, 9 aa, Homo Sapiens
QVELELEVV

SEQ ID NO: 98787 - protein, 9 aa, Homo Sapiens
TVYSSQLQV

SEQ ID NO: 98788 - protein, 9 aa, Homo Sapiens
CAPSALCPT

SEQ ID NO: 98789 - protein, 9 aa, Homo Sapiens
RHFSKSHSF

SEQ ID NO: 98790 - protein, 9 aa, Homo Sapiens
SKDRFLACI

SEQ ID NO: 98791 - protein, 9 aa, Homo Sapiens
PVYVSNVAW

SEQ ID NO: 98792 - protein, 9 aa, Homo Sapiens
QPLPGPSTQ

SEQ ID NO: 98793 - protein, 9 aa, Homo Sapiens
GFGGPGGFD

SEQ ID NO: 98794 - protein, 9 aa, Homo Sapiens
CSICTCQEG

SEQ ID NO: 98795 - protein, 9 aa, Homo Sapiens
CAISCSNSH

SEQ ID NO: 98796 - protein, 9 aa, Homo Sapiens
SPSQTQTAP

SEQ ID NO: 98797 - protein, 9 aa, Homo Sapiens
LAPEAVLFS

SEQ ID NO: 98798 - protein, 9 aa, Homo Sapiens
MEYFTEMFN

SEQ ID NO: 98799 - protein, 9 aa, Homo Sapiens
DPVQLSLSP

SEQ ID NO: 98800 - protein, 9 aa, Homo Sapiens
VKALKKCSD

SEQ ID NO: 98801 - protein, 9 aa, Homo Sapiens
GTQEARNTT

SEQ ID NO: 98802 - protein, 9 aa, Homo Sapiens
FLGMSILQR

SEQ ID NO: 98803 - protein, 9 aa, Homo Sapiens
EYFQEVGPE

SEQ ID NO: 98804 - protein, 9 aa, Homo Sapiens
EYDFRLLPS

SEQ ID NO: 98805 - protein, 9 aa, Homo Sapiens
DVNEWREHT

SEQ ID NO: 98806 - protein, 9 aa, Homo Sapiens
FSALIELAA

SEQ ID NO: 98807 - protein, 9 aa, Homo Sapiens
VSYVLPQSE

SEQ ID NO: 98808 - protein, 9 aa, Homo Sapiens
EKAQKQESE

SEQ ID NO: 98809 - protein, 9 aa, Homo Sapiens
SRPFDRRLY

SEQ ID NO: 98810 - protein, 9 aa, Homo Sapiens
STVTQAPIA

SEQ ID NO: 98811 - protein, 9 aa, Homo Sapiens
HSQVNDKGY

SEQ ID NO: 98812 - protein, 9 aa, Homo Sapiens
NAWLSYELP

SEQ ID NO: 98813 - protein, 9 aa, Homo Sapiens
KRFQEQQKN

SEQ ID NO: 98814 - protein, 9 aa, Homo Sapiens
EDHIESLHT

SEQ ID NO: 98815 - protein, 9 aa, Homo Sapiens
RLHSHCPRH

SEQ ID NO: 98816 - protein, 9 aa, Homo Sapiens
FRTSMDQLF

SEQ ID NO: 98817 - protein, 9 aa, Homo Sapiens
ELPPPASSA

SEQ ID NO: 98818 - protein, 9 aa, Homo Sapiens
DKLIFLAQF

SEQ ID NO: 98819 - protein, 9 aa, Homo Sapiens
ERAFQITVK

SEQ ID NO: 98820 - protein, 9 aa, Homo Sapiens
HGHDHEHTH

SEQ ID NO: 98821 - protein, 9 aa, Homo Sapiens
LAQFTFQVL

SEQ ID NO: 98822 - protein, 9 aa, Homo Sapiens
EEKKATATT

SEQ ID NO: 98823 - protein, 9 aa, Homo Sapiens
PTLVQPLPG

SEQ ID NO: 98824 - protein, 9 aa, Homo Sapiens
HSHCPRHCP

SEQ ID NO: 98825 - protein, 9 aa, Homo Sapiens
LEERFWVAI

SEQ ID NO: 98826 - protein, 9 aa, Homo Sapiens
YFLAGRAKS

SEQ ID NO: 98827 - protein, 9 aa, Homo Sapiens
EAAEEKKSR

SEQ ID NO: 98828 - protein, 9 aa, Homo Sapiens
RSSASWRTT

SEQ ID NO: 98829 - protein, 9 aa, Homo Sapiens
SSPSQTQTA

SEQ ID NO: 98830 - protein, 9 aa, Homo Sapiens
GCPTLVQPL

SEQ ID NO: 98831 - protein, 9 aa, Homo Sapiens
LKRVADIAE

SEQ ID NO: 98832 - protein, 9 aa, Homo Sapiens
QVNDKGYSE

SEQ ID NO: 98833 - protein, 9 aa, Homo Sapiens
RGQKGIPAA

SEQ ID NO: 98834 - protein, 9 aa, Homo Sapiens
FLAGRAKSQ

SEQ ID NO: 98835 - protein, 9 aa, Homo Sapiens
VEVTGLQKR

SEQ ID NO: 98836 - protein, 9 aa, Homo Sapiens
PNQKVSVNE

SEQ ID NO: 98837 - protein, 9 aa, Homo Sapiens
LREFREDTC

SEQ ID NO: 98838 - protein, 9 aa, Homo Sapiens
EVVLNVALR

SEQ ID NO: 98839 - protein, 9 aa, Homo Sapiens
YEPTRLYPS

SEQ ID NO: 98840 - protein, 9 aa, Homo Sapiens
LVQAISKQN

SEQ ID NO: 98841 - protein, 9 aa, Homo Sapiens
RGTGGVGEK

SEQ ID NO: 98842 - protein, 9 aa, Homo Sapiens
EGWKEFVRR

SEQ ID NO: 98843 - protein, 9 aa, Homo Sapiens
TEPEPAPHA

SEQ ID NO: 98844 - protein, 9 aa, Homo Sapiens
GRGHGRGGA

SEQ ID NO: 98845 - protein, 9 aa, Homo Sapiens
TLAWSFPQE

SEQ ID NO: 98846 - protein, 9 aa, Homo Sapiens
GGGPRRGAG

SEQ ID NO: 98847 - protein, 9 aa, Homo Sapiens
NNGGRSSLC

SEQ ID NO: 98848 - protein, 9 aa, Homo Sapiens
FQEVGPELL

SEQ ID NO: 98849 - protein, 9 aa, Homo Sapiens
SLWNHITCG

SEQ ID NO: 98850 - protein, 9 aa, Homo Sapiens
ICQAMGDPR

SEQ ID NO: 98851 - protein, 9 aa, Homo Sapiens
ILDQEGPAT

SEQ ID NO: 98852 - protein, 9 aa, Homo Sapiens
QARRKVTLI

SEQ ID NO: 98853 - protein, 9 aa, Homo Sapiens
NIWKLDGLR

SEQ ID NO: 98854 - protein, 9 aa, Homo Sapiens
FSCEDLIPC

SEQ ID NO: 98855 - protein, 9 aa, Homo Sapiens
AGFAGPVDL

SEQ ID NO: 98856 - protein, 9 aa, Homo Sapiens
RSFYIGCYK

SEQ ID NO: 98857 - protein, 9 aa, Homo Sapiens
AWSFPQEDG

SEQ ID NO: 98858 - protein, 9 aa, Homo Sapiens
AIADMLQAC

SEQ ID NO: 98859 - protein, 9 aa, Homo Sapiens
PVCLTADSS

SEQ ID NO: 98860 - protein, 9 aa, Homo Sapiens
GTSFSCECT

SEQ ID NO: 98861 - protein, 9 aa, Homo Sapiens
SQVNDKGYS

SEQ ID NO: 98862 - protein, 9 aa, Homo Sapiens
DEEAKVSRS

SEQ ID NO: 98863 - protein, 9 aa, Homo Sapiens
TVAHTRLET

SEQ ID NO: 98864 - protein, 9 aa, Homo Sapiens
NISVPADPV

SEQ ID NO: 98865 - protein, 9 aa, Homo Sapiens
SHQDEQTGH

SEQ ID NO: 98866 - protein, 9 aa, Homo Sapiens
IPSVAEGVK

SEQ ID NO: 98867 - protein, 9 aa, Homo Sapiens
TAHVRGEWL

SEQ ID NO: 98868 - protein, 9 aa, Homo Sapiens
NYLEGIYKV

SEQ ID NO: 98869 - protein, 9 aa, Homo Sapiens
GTGGVGEKR

SEQ ID NO: 98870 - protein, 9 aa, Homo Sapiens
KRNYSAHLG

SEQ ID NO: 98871 - protein, 9 aa, Homo Sapiens
AFQITVKVL

SEQ ID NO: 98872 - protein, 9 aa, Homo Sapiens
HIESLHTDG

SEQ ID NO: 98873 - protein, 9 aa, Homo Sapiens
IEEGLGNSW

SEQ ID NO: 98874 - protein, 9 aa, Homo Sapiens
ILQRIAGEE

SEQ ID NO: 98875 - protein, 9 aa, Homo Sapiens
RRPPLKDER

SEQ ID NO: 98876 - protein, 9 aa, Homo Sapiens
SCSNSHGPC

SEQ ID NO: 98877 - protein, 9 aa, Homo Sapiens
KDINARVSA

SEQ ID NO: 98878 - protein, 9 aa, Homo Sapiens
LLRQTMKDH

SEQ ID NO: 98879 - protein, 9 aa, Homo Sapiens
DTEVKTLRL

SEQ ID NO: 98880 - protein, 9 aa, Homo Sapiens
RQQWVPAVR

SEQ ID NO: 98881 - protein, 9 aa, Homo Sapiens
VKELVSWEL

SEQ ID NO: 98882 - protein, 9 aa, Homo Sapiens
MAAKEKLEV

SEQ ID NO: 98883 - protein, 9 aa, Homo Sapiens
VNAGNIIQQ

SEQ ID NO: 98884 - protein, 9 aa, Homo Sapiens
KKDNQLLRQ

SEQ ID NO: 98885 - protein, 9 aa, Homo Sapiens
FVKKCKLRV

SEQ ID NO: 98886 - protein, 9 aa, Homo Sapiens
TIFANANID

SEQ ID NO: 98887 - protein, 9 aa, Homo Sapiens
GRGRGRGHG

SEQ ID NO: 98888 - protein, 9 aa, Homo Sapiens
KDGAEPTSG

SEQ ID NO: 98889 - protein, 9 aa, Homo Sapiens
AYEPTRLYP

SEQ ID NO: 98890 - protein, 9 aa, Homo Sapiens
VYSSQLQVH

SEQ ID NO: 98891 - protein, 9 aa, Homo Sapiens
QPLTVYSSQ

SEQ ID NO: 98892 - protein, 9 aa, Homo Sapiens
VVPAKRKLD

SEQ ID NO: 98893 - protein, 9 aa, Homo Sapiens
EPEPAPHAG

SEQ ID NO: 98894 - protein, 9 aa, Homo Sapiens
EPLTKRASQ

SEQ ID NO: 98895 - protein, 9 aa, Homo Sapiens
SKQNVKQMV

SEQ ID NO: 98896 - protein, 9 aa, Homo Sapiens
EEAKVSRSG

SEQ ID NO: 98897 - protein, 9 aa, Homo Sapiens
ASEIIRNKD

SEQ ID NO: 98898 - protein, 9 aa, Homo Sapiens
GLGDVDVNE

SEQ ID NO: 98899 - protein, 9 aa, Homo Sapiens
LNLDIAAGF

SEQ ID NO: 98900 - protein, 9 aa, Homo Sapiens
STLQSAAHS

SEQ ID NO: 98901 - protein, 9 aa, Homo Sapiens
WGGPGCRGQ

SEQ ID NO: 98902 - protein, 9 aa, Homo Sapiens
KSDNKVVDN

SEQ ID NO: 98903 - protein, 9 aa, Homo Sapiens
GRLHSHCPR

SEQ ID NO: 98904 - protein, 9 aa, Homo Sapiens
EHTHGGYGE

SEQ ID NO: 98905 - protein, 9 aa, Homo Sapiens
ALIELAAVN

SEQ ID NO: 98906 - protein, 9 aa, Homo Sapiens
EPEVVSLAS

SEQ ID NO: 98907 - protein, 9 aa, Homo Sapiens
APSEACLRQ

SEQ ID NO: 98908 - protein, 9 aa, Homo Sapiens
TNIWKLDGL

SEQ ID NO: 98909 - protein, 9 aa, Homo Sapiens
AKSQRLWEP

SEQ ID NO: 98910 - protein, 9 aa, Homo Sapiens
WELKDWPKK

SEQ ID NO: 98911 - protein, 9 aa, Homo Sapiens
ACAGCAPSA

SEQ ID NO: 98912 - protein, 9 aa, Homo Sapiens
TTGATLIKE

SEQ ID NO: 98913 - protein, 9 aa, Homo Sapiens
VYFLAGRAK

SEQ ID NO: 98914 - protein, 9 aa, Homo Sapiens
IIPWNAFPR

SEQ ID NO: 98915 - protein, 9 aa, Homo Sapiens
HLTMRQQLT

SEQ ID NO: 98916 - protein, 9 aa, Homo Sapiens
RQTMKDHLV

SEQ ID NO: 98917 - protein, 9 aa, Homo Sapiens
LRRCRSSAS

SEQ ID NO: 98918 - protein, 9 aa, Homo Sapiens
SILNSLYDL

SEQ ID NO: 98919 - protein, 9 aa, Homo Sapiens
AVPMLNPLI

SEQ ID NO: 98920 - protein, 9 aa, Homo Sapiens
IFTSKSEAL

SEQ ID NO: 98921 - protein, 9 aa, Homo Sapiens
PDTDYVVTV

SEQ ID NO: 98922 - protein, 9 aa, Homo Sapiens
DRQLLLFHL

SEQ ID NO: 98923 - protein, 9 aa, Homo Sapiens
MRKNKQARR

SEQ ID NO: 98924 - protein, 9 aa, Homo Sapiens
GDASLQLKG

SEQ ID NO: 98925 - protein, 9 aa, Homo Sapiens
DVLRHVYSG

SEQ ID NO: 98926 - protein, 9 aa, Homo Sapiens
GPELLIPCS

SEQ ID NO: 98927 - protein, 9 aa, Homo Sapiens
ECGKTFKGN

SEQ ID NO: 98928 - protein, 9 aa, Homo Sapiens
NDKGYSELD

SEQ ID NO: 98929 - protein, 9 aa, Homo Sapiens
PLNTSAEVS

SEQ ID NO: 98930 - protein, 9 aa, Homo Sapiens
ASKQRVPTG

SEQ ID NO: 98931 - protein, 9 aa, Homo Sapiens
SSRSPSPGC

SEQ ID NO: 98932 - protein, 9 aa, Homo Sapiens
VPAKRKLDL

SEQ ID NO: 98933 - protein, 9 aa, Homo Sapiens
PRGSYPPGP

SEQ ID NO: 98934 - protein, 9 aa, Homo Sapiens
IILKRVADI

SEQ ID NO: 98935 - protein, 9 aa, Homo Sapiens
SVKALKKCS

SEQ ID NO: 98936 - protein, 9 aa, Homo Sapiens
GCPPKFIRL

SEQ ID NO: 98937 - protein, 9 aa, Homo Sapiens
RAFQITVKV

SEQ ID NO: 98938 - protein, 9 aa, Homo Sapiens
GLQKRNYSA

SEQ ID NO: 98939 - protein, 9 aa, Homo Sapiens
GFLCVVTNC

SEQ ID NO: 98940 - protein, 9 aa, Homo Sapiens
ERLGPGDTT

SEQ ID NO: 98941 - protein, 9 aa, Homo Sapiens
LPVDVSYVL

SEQ ID NO: 98942 - protein, 9 aa, Homo Sapiens
PRYTAHVRG

SEQ ID NO: 98943 - protein, 9 aa, Homo Sapiens
ESLHPVTWS

SEQ ID NO: 98944 - protein, 9 aa, Homo Sapiens
DASKEELRR

SEQ ID NO: 98945 - protein, 9 aa, Homo Sapiens
LPEPAQPRP

SEQ ID NO: 98946 - protein, 9 aa, Homo Sapiens
MEFSLKDEE

SEQ ID NO: 98947 - protein, 9 aa, Homo Sapiens
FSHHHAEML

SEQ ID NO: 98948 - protein, 9 aa, Homo Sapiens
KLKEEPLTK

SEQ ID NO: 98949 - protein, 9 aa, Homo Sapiens
VFMKKLNQR

SEQ ID NO: 98950 - protein, 9 aa, Homo Sapiens
QPDLRPASK

SEQ ID NO: 98951 - protein, 9 aa, Homo Sapiens
VKYLEENSN

SEQ ID NO: 98952 - protein, 9 aa, Homo Sapiens
LVNNTIFAL

SEQ ID NO: 98953 - protein, 9 aa, Homo Sapiens
DILGIALCL

SEQ ID NO: 98954 - protein, 9 aa, Homo Sapiens
VNNTIFALL

SEQ ID NO: 98955 - protein, 9 aa, Homo Sapiens
FKEKDRLGQ

SEQ ID NO: 98956 - protein, 9 aa, Homo Sapiens
HCMCPENEG

SEQ ID NO: 98957 - protein, 9 aa, Homo Sapiens
VCSCSEDWV

SEQ ID NO: 98958 - protein, 9 aa, Homo Sapiens
KLYIPLEYH

SEQ ID NO: 98959 - protein, 9 aa, Homo Sapiens
RQDSLSSDV

SEQ ID NO: 98960 - protein, 9 aa, Homo Sapiens
VSVHQKSTT

SEQ ID NO: 98961 - protein, 9 aa, Homo Sapiens
LIQKQLAAV

SEQ ID NO: 98962 - protein, 9 aa, Homo Sapiens
LALRETVYN

SEQ ID NO: 98963 - protein, 9 aa, Homo Sapiens
CCIFQDRGQ

SEQ ID NO: 98964 - protein, 9 aa, Homo Sapiens
MIFHVESMK

SEQ ID NO: 98965 - protein, 9 aa, Homo Sapiens
LRPKTFKSV

SEQ ID NO: 98966 - protein, 9 aa, Homo Sapiens
KSVKYLEEN

SEQ ID NO: 98967 - protein, 9 aa, Homo Sapiens
FPLPYTVPG

SEQ ID NO: 98968 - protein, 9 aa, Homo Sapiens
FNDFQCAAE

SEQ ID NO: 98969 - protein, 9 aa, Homo Sapiens
HSILSFGVK

SEQ ID NO: 98970 - protein, 9 aa, Homo Sapiens
NLWHRRHCE

SEQ ID NO: 98971 - protein, 9 aa, Homo Sapiens
GGVPLRSID

SEQ ID NO: 98972 - protein, 9 aa, Homo Sapiens
LRETVYNPS

SEQ ID NO: 98973 - protein, 9 aa, Homo Sapiens
HRSSVRKIR

SEQ ID NO: 98974 - protein, 9 aa, Homo Sapiens
LSSDVDTLK

SEQ ID NO: 98975 - protein, 9 aa, Homo Sapiens
CYPCNVCSP

SEQ ID NO: 98976 - protein, 9 aa, Homo Sapiens
FHVESMKKA

SEQ ID NO: 98977 - protein, 9 aa, Homo Sapiens
DLKEKQIKS

SEQ ID NO: 98978 - protein, 9 aa, Homo Sapiens
FGCRTGSES

SEQ ID NO: 98979 - protein, 9 aa, Homo Sapiens
FSCCIFQDR

SEQ ID NO: 98980 - protein, 9 aa, Homo Sapiens
TGSESHAGQ

SEQ ID NO: 98981 - protein, 9 aa, Homo Sapiens
GGFGCRTGS

SEQ ID NO: 98982 - protein, 9 aa, Homo Sapiens
NLKLKLIKR

SEQ ID NO: 98983 - protein, 9 aa, Homo Sapiens
ATAAVIVSV

SEQ ID NO: 98984 - protein, 9 aa, Homo Sapiens
HIGQLEAHQ

SEQ ID NO: 98985 - protein, 9 aa, Homo Sapiens
HACSQGIVI

SEQ ID NO: 98986 - protein, 9 aa, Homo Sapiens
RRHCEDEAE

SEQ ID NO: 98987 - protein, 9 aa, Homo Sapiens
DYTDFYSSW

SEQ ID NO: 98988 - protein, 9 aa, Homo Sapiens
QRRDWAAAQ

SEQ ID NO: 98989 - protein, 9 aa, Homo Sapiens
ERQNKRFRP

SEQ ID NO: 98990 - protein, 9 aa, Homo Sapiens
LVTRCYPCN

SEQ ID NO: 98991 - protein, 9 aa, Homo Sapiens
STQIDLWGV

SEQ ID NO: 98992 - protein, 9 aa, Homo Sapiens
QLEAHQRRD

SEQ ID NO: 98993 - protein, 9 aa, Homo Sapiens
MNDARHGGW

SEQ ID NO: 98994 - protein, 9 aa, Homo Sapiens
YNFLMDLCC

SEQ ID NO: 98995 - protein, 9 aa, Homo Sapiens
QWALESFTK

SEQ ID NO: 98996 - protein, 9 aa, Homo Sapiens
YNPSLPASH

SEQ ID NO: 98997 - protein, 9 aa, Homo Sapiens
PDVLHQNIQ

SEQ ID NO: 98998 - protein, 9 aa, Homo Sapiens
IGQLEAHQR

SEQ ID NO: 98999 - protein, 9 aa, Homo Sapiens
KTFKSVSHC

SEQ ID NO: 99000 - protein, 9 aa, Homo Sapiens
EYDKEFSPH

SEQ ID NO: 99001 - protein, 9 aa, Homo Sapiens
RLGQEVLFN

SEQ ID NO: 99002 - protein, 9 aa, Homo Sapiens
PSLLLFVNS

SEQ ID NO: 99003 - protein, 9 aa, Homo Sapiens
SREASCAKP

SEQ ID NO: 99004 - protein, 9 aa, Homo Sapiens
SVHQKSTTV

SEQ ID NO: 99005 - protein, 9 aa, Homo Sapiens
ITAHAYVVD

SEQ ID NO: 99006 - protein, 9 aa, Homo Sapiens
VHQKSTTVS

SEQ ID NO: 99007 - protein, 9 aa, Homo Sapiens
GITAHAYVV

SEQ ID NO: 99008 - protein, 9 aa, Homo Sapiens
TLHCMCPEN

SEQ ID NO: 99009 - protein, 9 aa, Homo Sapiens
FVLAKTGDS

SEQ ID NO: 99010 - protein, 9 aa, Homo Sapiens
SIDRLFSYT

SEQ ID NO: 99011 - protein, 9 aa, Homo Sapiens
LMKTLIHAC

SEQ ID NO: 99012 - protein, 9 aa, Homo Sapiens
AFPVPLTPL

SEQ ID NO: 99013 - protein, 9 aa, Homo Sapiens
EREREQERE

SEQ ID NO: 99014 - protein, 9 aa, Homo Sapiens
CLAETLENT

SEQ ID NO: 99015 - protein, 9 aa, Homo Sapiens
RDPWDNGSR

SEQ ID NO: 99016 - protein, 9 aa, Homo Sapiens
LIHACSQGI

SEQ ID NO: 99017 - protein, 9 aa, Homo Sapiens
TEGIFTFVD

SEQ ID NO: 99018 - protein, 9 aa, Homo Sapiens
AQAPLASHS

SEQ ID NO: 99019 - protein, 9 aa, Homo Sapiens
LLCNSNQDN

SEQ ID NO: 99020 - protein, 9 aa, Homo Sapiens
EYHSISLAI

SEQ ID NO: 99021 - protein, 9 aa, Homo Sapiens
RWFSCCIFQ

SEQ ID NO: 99022 - protein, 9 aa, Homo Sapiens
TEPGKQPCG

SEQ ID NO: 99023 - protein, 9 aa, Homo Sapiens
IFDVVNKGG

SEQ ID NO: 99024 - protein, 9 aa, Homo Sapiens
ENTLAPGSG

SEQ ID NO: 99025 - protein, 9 aa, Homo Sapiens
VPLRSIDRL

SEQ ID NO: 99026 - protein, 9 aa, Homo Sapiens
TMVRELVYN

SEQ ID NO: 99027 - protein, 9 aa, Homo Sapiens
DPWDNGSRS

SEQ ID NO: 99028 - protein, 9 aa, Homo Sapiens
TDFYSSWQH

SEQ ID NO: 99029 - protein, 9 aa, Homo Sapiens
EEESKQEQL

SEQ ID NO: 99030 - protein, 9 aa, Homo Sapiens
IQKQLAAVY

SEQ ID NO: 99031 - protein, 9 aa, Homo Sapiens
AVIVSVHQK

SEQ ID NO: 99032 - protein, 9 aa, Homo Sapiens
MSPVFRLKK

SEQ ID NO: 99033 - protein, 9 aa, Homo Sapiens
IKMIFHVES

SEQ ID NO: 99034 - protein, 9 aa, Homo Sapiens
LESFTKMIP

SEQ ID NO: 99035 - protein, 9 aa, Homo Sapiens
ASCAKPHYE

SEQ ID NO: 99036 - protein, 9 aa, Homo Sapiens
REARKKGHL

SEQ ID NO: 99037 - protein, 9 aa, Homo Sapiens
YMYNSSCMG

SEQ ID NO: 99038 - protein, 9 aa, Homo Sapiens
ECRKLGITA

SEQ ID NO: 99039 - protein, 9 aa, Homo Sapiens
AAECRKLGI

SEQ ID NO: 99040 - protein, 9 aa, Homo Sapiens
LASHSSSLR

SEQ ID NO: 99041 - protein, 9 aa, Homo Sapiens
EASCAKPHY

SEQ ID NO: 99042 - protein, 9 aa, Homo Sapiens
TQIDLWGVG

SEQ ID NO: 99043 - protein, 9 aa, Homo Sapiens
VTRCYPCNV

SEQ ID NO: 99044 - protein, 9 aa, Homo Sapiens
NPDVLHQNI

SEQ ID NO: 99045 - protein, 9 aa, Homo Sapiens
RKLGITAHA

SEQ ID NO: 99046 - protein, 9 aa, Homo Sapiens
HQRHHKEFK

SEQ ID NO: 99047 - protein, 9 aa, Homo Sapiens
DARHGGWTT

SEQ ID NO: 99048 - protein, 9 aa, Homo Sapiens
PKLIRRTAR

SEQ ID NO: 99049 - protein, 9 aa, Homo Sapiens
KEFSPHQRH

SEQ ID NO: 99050 - protein, 9 aa, Homo Sapiens
TRWFSCCIF

SEQ ID NO: 99051 - protein, 9 aa, Homo Sapiens
VEEESKQEQ

SEQ ID NO: 99052 - protein, 9 aa, Homo Sapiens
DKEFSPHQR

SEQ ID NO: 99053 - protein, 9 aa, Homo Sapiens
SPHQRHHKE

SEQ ID NO: 99054 - protein, 9 aa, Homo Sapiens
FNEDWCFRV

SEQ ID NO: 99055 - protein, 9 aa, Homo Sapiens
MKQMNDARH

SEQ ID NO: 99056 - protein, 9 aa, Homo Sapiens
LWGVGCIFY

SEQ ID NO: 99057 - protein, 9 aa, Homo Sapiens
LSDAGQYVC

SEQ ID NO: 99058 - protein, 9 aa, Homo Sapiens
SLSSDVDTL

SEQ ID NO: 99059 - protein, 9 aa, Homo Sapiens
LKFNEDWCF

SEQ ID NO: 99060 - protein, 9 aa, Homo Sapiens
LPKGEASRC

SEQ ID NO: 99061 - protein, 9 aa, Homo Sapiens
RCYPCNVCS

SEQ ID NO: 99062 - protein, 9 aa, Homo Sapiens
THRSSVRKI

SEQ ID NO: 99063 - protein, 9 aa, Homo Sapiens
KQPCGPSEE

SEQ ID NO: 99064 - protein, 9 aa, Homo Sapiens
RETVYNPSL

SEQ ID NO: 99065 - protein, 9 aa, Homo Sapiens
GVPLRSIDR

SEQ ID NO: 99066 - protein, 9 aa, Homo Sapiens
KYLEENSNL

SEQ ID NO: 99067 - protein, 9 aa, Homo Sapiens
TCSLTSTTT

SEQ ID NO: 99068 - protein, 9 aa, Homo Sapiens
MPSDSHVCS

SEQ ID NO: 99069 - protein, 9 aa, Homo Sapiens
ELRYSLIQK

SEQ ID NO: 99070 - protein, 9 aa, Homo Sapiens
QMNDARHGG

SEQ ID NO: 99071 - protein, 9 aa, Homo Sapiens
SILSFGVKS

SEQ ID NO: 99072 - protein, 9 aa, Homo Sapiens
VDPKLIRRT

SEQ ID NO: 99073 - protein, 9 aa, Homo Sapiens
GLLCNSNQD

SEQ ID NO: 99074 - protein, 9 aa, Homo Sapiens
YNYMYNSSC

SEQ ID NO: 99075 - protein, 9 aa, Homo Sapiens
PKGEASRCL

SEQ ID NO: 99076 - protein, 9 aa, Homo Sapiens
ILSREASCA

SEQ ID NO: 99077 - protein, 9 aa, Homo Sapiens
VGDRICYEE

SEQ ID NO: 99078 - protein, 9 aa, Homo Sapiens
NPSLPASHH

SEQ ID NO: 99079 - protein, 9 aa, Homo Sapiens
PLPYTVPGG

SEQ ID NO: 99080 - protein, 9 aa, Homo Sapiens
PTHRSSVRK

SEQ ID NO: 99081 - protein, 9 aa, Homo Sapiens
KTMVRELVY

SEQ ID NO: 99082 - protein, 9 aa, Homo Sapiens
LENTLAPGS

SEQ ID NO: 99083 - protein, 9 aa, Homo Sapiens
LWHRRHCED

SEQ ID NO: 99084 - protein, 9 aa, Homo Sapiens
CHGKRLPFT

SEQ ID NO: 99085 - protein, 9 aa, Homo Sapiens
WDRLVTRCY

SEQ ID NO: 99086 - protein, 9 aa, Homo Sapiens
PAPTCSLTS

SEQ ID NO: 99087 - protein, 9 aa, Homo Sapiens
DFYSSWQHA

SEQ ID NO: 99088 - protein, 9 aa, Homo Sapiens
RELVYNFLM

SEQ ID NO: 99089 - protein, 9 aa, Homo Sapiens
RHCEDEAEG

SEQ ID NO: 99090 - protein, 9 aa, Homo Sapiens
FKSVSHCRN

SEQ ID NO: 99091 - protein, 9 aa, Homo Sapiens
VRELVYNFL

SEQ ID NO: 99092 - protein, 9 aa, Homo Sapiens
ELVYNFLMD

SEQ ID NO: 99093 - protein, 9 aa, Homo Sapiens
GDRICYEEK

SEQ ID NO: 99094 - protein, 9 aa, Homo Sapiens
SHVCSCSED

SEQ ID NO: 99095 - protein, 9 aa, Homo Sapiens
REREREREQ

SEQ ID NO: 99096 - protein, 9 aa, Homo Sapiens
HCEDEAEGD

SEQ ID NO: 99097 - protein, 9 aa, Homo Sapiens
LKLKLIKRN

SEQ ID NO: 99098 - protein, 9 aa, Homo Sapiens
KQMNDARHG

SEQ ID NO: 99099 - protein, 9 aa, Homo Sapiens
KFLKFNEDW

SEQ ID NO: 99100 - protein, 9 aa, Homo Sapiens
LRSIDRLFS

SEQ ID NO: 99101 - protein, 9 aa, Homo Sapiens
LEAHQRRDW

SEQ ID NO: 99102 - protein, 9 aa, Homo Sapiens
PSDSHVCSC

SEQ ID NO: 99103 - protein, 9 aa, Homo Sapiens
AEREARKKG

SEQ ID NO: 99104 - protein, 9 aa, Homo Sapiens
PLTPLWFIL

SEQ ID NO: 99105 - protein, 9 aa, Homo Sapiens
WQHATNVGI

SEQ ID NO: 99106 - protein, 9 aa, Homo Sapiens
EGMTRWFSC

SEQ ID NO: 99107 - protein, 9 aa, Homo Sapiens
LANKQNCFN

SEQ ID NO: 99108 - protein, 9 aa, Homo Sapiens
LLAKVRLEL

SEQ ID NO: 99109 - protein, 9 aa, Homo Sapiens
VYNPSLPAS

SEQ ID NO: 99110 - protein, 9 aa, Homo Sapiens
KGEASRCLF

SEQ ID NO: 99111 - protein, 9 aa, Homo Sapiens
GQLEAHQRR

SEQ ID NO: 99112 - protein, 9 aa, Homo Sapiens
ALRETVYNP

SEQ ID NO: 99113 - protein, 9 aa, Homo Sapiens
PVFRLKKTW

SEQ ID NO: 99114 - protein, 9 aa, Homo Sapiens
WALESFTKM

SEQ ID NO: 99115 - protein, 9 aa, Homo Sapiens
TIHYNYMYN

SEQ ID NO: 99116 - protein, 9 aa, Homo Sapiens
FYSSWQHAT

SEQ ID NO: 99117 - protein, 9 aa, Homo Sapiens
ANKQNCFND

SEQ ID NO: 99118 - protein, 9 aa, Homo Sapiens
IFALLAVKY

SEQ ID NO: 99119 - protein, 9 aa, Homo Sapiens
SMPSDSHVC

SEQ ID NO: 99120 - protein, 9 aa, Homo Sapiens
ILSFGVKSS

SEQ ID NO: 99121 - protein, 9 aa, Homo Sapiens
CFNDFQCAA

SEQ ID NO: 99122 - protein, 9 aa, Homo Sapiens
DSHVCSCSE

SEQ ID NO: 99123 - protein, 9 aa, Homo Sapiens
AECRKLGIT

SEQ ID NO: 99124 - protein, 9 aa, Homo Sapiens
KSSDYDSSS

SEQ ID NO: 99125 - protein, 9 aa, Homo Sapiens
FSSHFVLAK

SEQ ID NO: 99126 - protein, 9 aa, Homo Sapiens
KFNEDWCFR

SEQ ID NO: 99127 - protein, 9 aa, Homo Sapiens
LILSREASC

SEQ ID NO: 99128 - protein, 9 aa, Homo Sapiens
KQIKSSDYD

SEQ ID NO: 99129 - protein, 9 aa, Homo Sapiens
VFRLKKTWA

SEQ ID NO: 99130 - protein, 9 aa, Homo Sapiens
NQQKPSGKL

SEQ ID NO: 99131 - protein, 9 aa, Homo Sapiens
RLSDAGQYV

SEQ ID NO: 99132 - protein, 9 aa, Homo Sapiens
ALCLNLIKT

SEQ ID NO: 99133 - protein, 9 aa, Homo Sapiens
VEEGERQNK

SEQ ID NO: 99134 - protein, 9 aa, Homo Sapiens
PRAQAPLAS

SEQ ID NO: 99135 - protein, 9 aa, Homo Sapiens
LLLFVNSFY

SEQ ID NO: 99136 - protein, 9 aa, Homo Sapiens
ETLENTLAP

SEQ ID NO: 99137 - protein, 9 aa, Homo Sapiens
HQNIQQVRD

SEQ ID NO: 99138 - protein, 9 aa, Homo Sapiens
FISRHNTEG

SEQ ID NO: 99139 - protein, 9 aa, Homo Sapiens
CAKPHYEFN

SEQ ID NO: 99140 - protein, 9 aa, Homo Sapiens
ANLKLKLIK

SEQ ID NO: 99141 - protein, 9 aa, Homo Sapiens
RSSVRKIRF

SEQ ID NO: 99142 - protein, 9 aa, Homo Sapiens
LGIALCLNL

SEQ ID NO: 99143 - protein, 9 aa, Homo Sapiens
VPQLPKGEA

SEQ ID NO: 99144 - protein, 9 aa, Homo Sapiens
SSWQHATNV

SEQ ID NO: 99145 - protein, 9 aa, Homo Sapiens
MEAITRIST

SEQ ID NO: 99146 - protein, 9 aa, Homo Sapiens
DYSTQIDLW

SEQ ID NO: 99147 - protein, 9 aa, Homo Sapiens
NTEGIFTFV

SEQ ID NO: 99148 - protein, 9 aa, Homo Sapiens
KGGEQEKME

SEQ ID NO: 99149 - protein, 9 aa, Homo Sapiens
RYSLIQKQL

SEQ ID NO: 99150 - protein, 9 aa, Homo Sapiens
LSDDKSKSN

SEQ ID NO: 99151 - protein, 9 aa, Homo Sapiens
REASCAKPH

SEQ ID NO: 99152 - protein, 9 aa, Homo Sapiens
RPRAQAPLA

SEQ ID NO: 99153 - protein, 9 aa, Homo Sapiens
YKTLTLHCM

SEQ ID NO: 99154 - protein, 9 aa, Homo Sapiens
QEREKDKKR

SEQ ID NO: 99155 - protein, 9 aa, Homo Sapiens
NNQQKPSGK

SEQ ID NO: 99156 - protein, 9 aa, Homo Sapiens
MVRELVYNF

SEQ ID NO: 99157 - protein, 9 aa, Homo Sapiens
PCGPSEESA

SEQ ID NO: 99158 - protein, 9 aa, Homo Sapiens
FRLKKTWAK

SEQ ID NO: 99159 - protein, 9 aa, Homo Sapiens
SSVRKIRFA

SEQ ID NO: 99160 - protein, 9 aa, Homo Sapiens
EARKKGHLE

SEQ ID NO: 99161 - protein, 9 aa, Homo Sapiens
REQEREKDK

SEQ ID NO: 99162 - protein, 9 aa, Homo Sapiens
FTKMIPLLR

SEQ ID NO: 99163 - protein, 9 aa, Homo Sapiens
DPKLIRRTA

SEQ ID NO: 99164 - protein, 9 aa, Homo Sapiens
PPVPQLPKG

SEQ ID NO: 99165 - protein, 9 aa, Homo Sapiens
KLIRRTARR

SEQ ID NO: 99166 - protein, 9 aa, Homo Sapiens
TAAVIVSVH

SEQ ID NO: 99167 - protein, 9 aa, Homo Sapiens
LHQNIQQVR

SEQ ID NO: 99168 - protein, 9 aa, Homo Sapiens
IDLWGVGCI

SEQ ID NO: 99169 - protein, 9 aa, Homo Sapiens
KQKSVKYLE

SEQ ID NO: 99170 - protein, 9 aa, Homo Sapiens
LCNSNQDNK

SEQ ID NO: 99171 - protein, 9 aa, Homo Sapiens
ENPDVLHQN

SEQ ID NO: 99172 - protein, 9 aa, Homo Sapiens
HVESMKKAM

SEQ ID NO: 99173 - protein, 9 aa, Homo Sapiens
NIQQVRDMI

SEQ ID NO: 99174 - protein, 9 aa, Homo Sapiens
PYTVPGGYL

SEQ ID NO: 99175 - protein, 9 aa, Homo Sapiens
TSMEAITRI

SEQ ID NO: 99176 - protein, 9 aa, Homo Sapiens
CGPSEESAE

SEQ ID NO: 99177 - protein, 9 aa, Homo Sapiens
WFSCCIFQD

SEQ ID NO: 99178 - protein, 9 aa, Homo Sapiens
RGIPTHRSS

SEQ ID NO: 99179 - protein, 9 aa, Homo Sapiens
YSTQIDLWG

SEQ ID NO: 99180 - protein, 9 aa, Homo Sapiens
GPFPLPYTV

SEQ ID NO: 99181 - protein, 9 aa, Homo Sapiens
GIALCLNLI

SEQ ID NO: 99182 - protein, 9 aa, Homo Sapiens
ELNVLRIIN

SEQ ID NO: 99183 - protein, 9 aa, Homo Sapiens
ALESFTKMI

SEQ ID NO: 99184 - protein, 9 aa, Homo Sapiens
RTRDPWDNG

SEQ ID NO: 99185 - protein, 9 aa, Homo Sapiens
YVCQAGDDS

SEQ ID NO: 99186 - protein, 9 aa, Homo Sapiens
QKQLAAVYA

SEQ ID NO: 99187 - protein, 9 aa, Homo Sapiens
MCPENEGSA

SEQ ID NO: 99188 - protein, 9 aa, Homo Sapiens
SRHNTEGIF

SEQ ID NO: 99189 - protein, 9 aa, Homo Sapiens
EFQVGDRIC

SEQ ID NO: 99190 - protein, 9 aa, Homo Sapiens
PKQKSVKYL

SEQ ID NO: 99191 - protein, 9 aa, Homo Sapiens
DHLPLLAKV

SEQ ID NO: 99192 - protein, 9 aa, Homo Sapiens
IFHVESMKK

SEQ ID NO: 99193 - protein, 9 aa, Homo Sapiens
GNLWHRRHC

SEQ ID NO: 99194 - protein, 9 aa, Homo Sapiens
RHNTEGIFT

SEQ ID NO: 99195 - protein, 9 aa, Homo Sapiens
FMKQMNDAR

SEQ ID NO: 99196 - protein, 9 aa, Homo Sapiens
ARHGGWTTK

SEQ ID NO: 99197 - protein, 9 aa, Homo Sapiens
QIDLWGVGC

SEQ ID NO: 99198 - protein, 9 aa, Homo Sapiens
LEYHSISLA

SEQ ID NO: 99199 - protein, 9 aa, Homo Sapiens
KFHPGEANL

SEQ ID NO: 99200 - protein, 9 aa, Homo Sapiens
KSSIKYSNS

SEQ ID NO: 99201 - protein, 9 aa, Homo Sapiens
QRQDSLSSD

SEQ ID NO: 99202 - protein, 9 aa, Homo Sapiens
VYNFLMDLC

SEQ ID NO: 99203 - protein, 9 aa, Homo Sapiens
PVPLTPLWF

SEQ ID NO: 99204 - protein, 9 aa, Homo Sapiens
KEKQIKSSD

SEQ ID NO: 99205 - protein, 9 aa, Homo Sapiens
TVPGGYLDV

SEQ ID NO: 99206 - protein, 9 aa, Homo Sapiens
GFSSHFVLA

SEQ ID NO: 99207 - protein, 9 aa, Homo Sapiens
QIKSSDYDS

SEQ ID NO: 99208 - protein, 9 aa, Homo Sapiens
EANLKLKLI

SEQ ID NO: 99209 - protein, 9 aa, Homo Sapiens
HNTEGIFTF

SEQ ID NO: 99210 - protein, 9 aa, Homo Sapiens
QVGDRICYE

SEQ ID NO: 99211 - protein, 9 aa, Homo Sapiens
KTLTLHCMC

SEQ ID NO: 99212 - protein, 9 aa, Homo Sapiens
SHFVLAKTG

SEQ ID NO: 99213 - protein, 9 aa, Homo Sapiens
YSSWQHATN

SEQ ID NO: 99214 - protein, 9 aa, Homo Sapiens
IPTHRSSVR

SEQ ID NO: 99215 - protein, 9 aa, Homo Sapiens
PLASHSSSL

SEQ ID NO: 99216 - protein, 9 aa, Homo Sapiens
RPKTFKSVS

SEQ ID NO: 99217 - protein, 9 aa, Homo Sapiens
GLMKTLIHA

SEQ ID NO: 99218 - protein, 9 aa, Homo Sapiens
DLWGVGCIF

SEQ ID NO: 99219 - protein, 9 aa, Homo Sapiens
MSSDTSMEA

SEQ ID NO: 99220 - protein, 9 aa, Homo Sapiens
VPLTPLWFI

SEQ ID NO: 99221 - protein, 9 aa, Homo Sapiens
MNMSPVFRL

SEQ ID NO: 99222 - protein, 9 aa, Homo Sapiens
GVKSSIKYS

SEQ ID NO: 99223 - protein, 9 aa, Homo Sapiens
NSNQDNKLD

SEQ ID NO: 99224 - protein, 9 aa, Homo Sapiens
CRTGSESHA

SEQ ID NO: 99225 - protein, 9 aa, Homo Sapiens
IHYNYMYNS

SEQ ID NO: 99226 - protein, 9 aa, Homo Sapiens
FPVPLTPLW

SEQ ID NO: 99227 - protein, 9 aa, Homo Sapiens
LTSTTTSLF

SEQ ID NO: 99228 - protein, 9 aa, Homo Sapiens
HFVLAKTGD

SEQ ID NO: 99229 - protein, 9 aa, Homo Sapiens
APLASHSSS

SEQ ID NO: 99230 - protein, 9 aa, Homo Sapiens
LPFTLFPSA

SEQ ID NO: 99231 - protein, 9 aa, Homo Sapiens
LKSKGLLCN

SEQ ID NO: 99232 - protein, 9 aa, Homo Sapiens
CEDEAEGDD

SEQ ID NO: 99233 - protein, 9 aa, Homo Sapiens
CSCSEDWVG

SEQ ID NO: 99234 - protein, 9 aa, Homo Sapiens
SCCIFQDRG

SEQ ID NO: 99235 - protein, 9 aa, Homo Sapiens
TEFISRHNT

SEQ ID NO: 99236 - protein, 9 aa, Homo Sapiens
EPGKQPCGP

SEQ ID NO: 99237 - protein, 9 aa, Homo Sapiens
EFISRHNTE

SEQ ID NO: 99238 - protein, 9 aa, Homo Sapiens
QDILGIALC

SEQ ID NO: 99239 - protein, 9 aa, Homo Sapiens
VPGGYLDVG

SEQ ID NO: 99240 - protein, 9 aa, Homo Sapiens
RSIDRLFSY

SEQ ID NO: 99241 - protein, 9 aa, Homo Sapiens
KEKDRLGQE

SEQ ID NO: 99242 - protein, 9 aa, Homo Sapiens
TVEEESKQE

SEQ ID NO: 99243 - protein, 9 aa, Homo Sapiens
SLLLFVNSF

SEQ ID NO: 99244 - protein, 9 aa, Homo Sapiens
DRLVTRCYP

SEQ ID NO: 99245 - protein, 9 aa, Homo Sapiens
HNFFKEKDR

SEQ ID NO: 99246 - protein, 9 aa, Homo Sapiens
PFPLPYTVP

SEQ ID NO: 99247 - protein, 9 aa, Homo Sapiens
SMEAITRIS

SEQ ID NO: 99248 - protein, 9 aa, Homo Sapiens
NEDWCFRVD

SEQ ID NO: 99249 - protein, 9 aa, Homo Sapiens
EKQIKSSDY

SEQ ID NO: 99250 - protein, 9 aa, Homo Sapiens
QFIFDVVNK

SEQ ID NO: 99251 - protein, 9 aa, Homo Sapiens
FIFDVVNKG

SEQ ID NO: 99252 - protein, 9 aa, Homo Sapiens
QYVCQAGDD

SEQ ID NO: 99253 - protein, 9 aa, Homo Sapiens
FSPHQRHHK

SEQ ID NO: 99254 - protein, 9 aa, Homo Sapiens
TPLWFILPD

SEQ ID NO: 99255 - protein, 9 aa, Homo Sapiens
FTLFPSANL

SEQ ID NO: 99256 - protein, 9 aa, Homo Sapiens
LVEEGERQN

SEQ ID NO: 99257 - protein, 9 aa, Homo Sapiens
NFFKEKDRL

SEQ ID NO: 99258 - protein, 9 aa, Homo Sapiens
KGLLCNSNQ

SEQ ID NO: 99259 - protein, 9 aa, Homo Sapiens
WHRRHCEDE

SEQ ID NO: 99260 - protein, 9 aa, Homo Sapiens
GEANLKLKL

SEQ ID NO: 99261 - protein, 9 aa, Homo Sapiens
PTCSLTSTT

SEQ ID NO: 99262 - protein, 9 aa, Homo Sapiens
LLFVNSFYK

SEQ ID NO: 99263 - protein, 9 aa, Homo Sapiens
HGKRLPFTL

SEQ ID NO: 99264 - protein, 9 aa, Homo Sapiens
VNSFYKEYL

SEQ ID NO: 99265 - protein, 9 aa, Homo Sapiens
ICYEEKQIQ

SEQ ID NO: 99266 - protein, 9 aa, Homo Sapiens
TPSLLLFVN

SEQ ID NO: 99267 - protein, 9 aa, Homo Sapiens
FGVKSSIKY

SEQ ID NO: 99268 - protein, 9 aa, Homo Sapiens
YDKEFSPHQ

SEQ ID NO: 99269 - protein, 9 aa, Homo Sapiens
THLVDPKLI

SEQ ID NO: 99270 - protein, 9 aa, Homo Sapiens
VNNQQKPSG

SEQ ID NO: 99271 - protein, 9 aa, Homo Sapiens
EKDRLGQEV

SEQ ID NO: 99272 - protein, 9 aa, Homo Sapiens
REREREQER

SEQ ID NO: 99273 - protein, 9 aa, Homo Sapiens
RICYEEKQI

SEQ ID NO: 99274 - protein, 9 aa, Homo Sapiens
TLTLHCMCP

SEQ ID NO: 99275 - protein, 9 aa, Homo Sapiens
TLENTLAPG

SEQ ID NO: 99276 - protein, 9 aa, Homo Sapiens
FHPGEANLK

SEQ ID NO: 99277 - protein, 9 aa, Homo Sapiens
GQYVCQAGD

SEQ ID NO: 99278 - protein, 9 aa, Homo Sapiens
AETLENTLA

SEQ ID NO: 99279 - protein, 9 aa, Homo Sapiens
EDWCFRVDM

SEQ ID NO: 99280 - protein, 9 aa, Homo Sapiens
SFGVKSSIK

SEQ ID NO: 99281 - protein, 9 aa, Homo Sapiens
KSVSHCRNL

SEQ ID NO: 99282 - protein, 9 aa, Homo Sapiens
NQWALESFT

SEQ ID NO: 99283 - protein, 9 aa, Homo Sapiens
SVKYLEENS

SEQ ID NO: 99284 - protein, 9 aa, Homo Sapiens
NNTIFALLA

SEQ ID NO: 99285 - protein, 9 aa, Homo Sapiens
FALLAVKYD

SEQ ID NO: 99286 - protein, 9 aa, Homo Sapiens
LTPLWFILP

SEQ ID NO: 99287 - protein, 9 aa, Homo Sapiens
ADLKEKQIK

SEQ ID NO: 99288 - protein, 9 aa, Homo Sapiens
SPKQKSVKY

SEQ ID NO: 99289 - protein, 9 aa, Homo Sapiens
SCAKPHYEF

SEQ ID NO: 99290 - protein, 9 aa, Homo Sapiens
DVVNKGGEQ

SEQ ID NO: 99291 - protein, 9 aa, Homo Sapiens
HHHRTRDPW

SEQ ID NO: 99292 - protein, 9 aa, Homo Sapiens
PLRSIDRLF

SEQ ID NO: 99293 - protein, 9 aa, Homo Sapiens
PLEYHSISL

SEQ ID NO: 99294 - protein, 9 aa, Homo Sapiens
DVDTLKQSC

SEQ ID NO: 99295 - protein, 9 aa, Homo Sapiens
LIRRTARRG

SEQ ID NO: 99296 - protein, 9 aa, Homo Sapiens
GFGCRTGSE

SEQ ID NO: 99297 - protein, 9 aa, Homo Sapiens
WDNGSRSGD

SEQ ID NO: 99298 - protein, 9 aa, Homo Sapiens
GIPTHRSSV

SEQ ID NO: 99299 - protein, 9 aa, Homo Sapiens
LTLHCMCPE

SEQ ID NO: 99300 - protein, 9 aa, Homo Sapiens
NTLAPGSGG

SEQ ID NO: 99301 - protein, 9 aa, Homo Sapiens
PLLAKVRLE

SEQ ID NO: 99302 - protein, 9 aa, Homo Sapiens
PGEANLKLK

SEQ ID NO: 99303 - protein, 9 aa, Homo Sapiens
SLTSTTTSL

SEQ ID NO: 99304 - protein, 9 aa, Homo Sapiens
YNSSCMGGM

SEQ ID NO: 99305 - protein, 9 aa, Homo Sapiens
LAKTGDSVF

SEQ ID NO: 99306 - protein, 9 aa, Homo Sapiens
TELNVLRII

SEQ ID NO: 99307 - protein, 9 aa, Homo Sapiens
SPVFRLKKT

SEQ ID NO: 99308 - protein, 9 aa, Homo Sapiens
PWDNGSRSG

SEQ ID NO: 99309 - protein, 9 aa, Homo Sapiens
LVDPKLIRR

SEQ ID NO: 99310 - protein, 9 aa, Homo Sapiens
DTHLVDPKL

SEQ ID NO: 99311 - protein, 9 aa, Homo Sapiens
SFENMTVEE

SEQ ID NO: 99312 - protein, 9 aa, Homo Sapiens
DTSMEAITR

SEQ ID NO: 99313 - protein, 9 aa, Homo Sapiens
LPLLAKVRL

SEQ ID NO: 99314 - protein, 9 aa, Homo Sapiens
TTIHYNYMY

SEQ ID NO: 99315 - protein, 9 aa, Homo Sapiens
DRLGQEVLF

SEQ ID NO: 99316 - protein, 9 aa, Homo Sapiens
TFKSVSHCR

SEQ ID NO: 99317 - protein, 9 aa, Homo Sapiens
ACSQGIVIF

SEQ ID NO: 99318 - protein, 9 aa, Homo Sapiens
ILGIALCLN

SEQ ID NO: 99319 - protein, 9 aa, Homo Sapiens
GTITELNVL

SEQ ID NO: 99320 - protein, 9 aa, Homo Sapiens
SGMNMSPVF

SEQ ID NO: 99321 - protein, 9 aa, Homo Sapiens
RLPFTLFPS

SEQ ID NO: 99322 - protein, 9 aa, Homo Sapiens
FFKEKDRLG

SEQ ID NO: 99323 - protein, 9 aa, Homo Sapiens
RLVTRCYPC

SEQ ID NO: 99324 - protein, 9 aa, Homo Sapiens
AGTITELNV

SEQ ID NO: 99325 - protein, 9 aa, Homo Sapiens
EVNNQQKPS

SEQ ID NO: 99326 - protein, 9 aa, Homo Sapiens
QNCFNDFQC

SEQ ID NO: 99327 - protein, 9 aa, Homo Sapiens
HSISLAIGL

SEQ ID NO: 99328 - protein, 9 aa, Homo Sapiens
QLPKGEASR

SEQ ID NO: 99329 - protein, 9 aa, Homo Sapiens
LCLNLIKTL

SEQ ID NO: 99330 - protein, 9 aa, Homo Sapiens
EAITRISTP

SEQ ID NO: 99331 - protein, 9 aa, Homo Sapiens
VIVSVHQKS

SEQ ID NO: 99332 - protein, 9 aa, Homo Sapiens
SLVEEGERQ

SEQ ID NO: 99333 - protein, 9 aa, Homo Sapiens
IHACSQGIV

SEQ ID NO: 99334 - protein, 9 aa, Homo Sapiens
KDRLGQEVL

SEQ ID NO: 99335 - protein, 9 aa, Homo Sapiens
KKGHLEPTE

SEQ ID NO: 99336 - protein, 9 aa, Homo Sapiens
YHSISLAIG

SEQ ID NO: 99337 - protein, 9 aa, Homo Sapiens
LPYTVPGGY

SEQ ID NO: 99338 - protein, 9 aa, Homo Sapiens
NDARHGGWT

SEQ ID NO: 99339 - protein, 9 aa, Homo Sapiens
IVSVHQKST

SEQ ID NO: 99340 - protein, 9 aa, Homo Sapiens
RRPRAQAPL

SEQ ID NO: 99341 - protein, 9 aa, Homo Sapiens
VCQAGDDSN

SEQ ID NO: 99342 - protein, 9 aa, Homo Sapiens
REREQEREK

SEQ ID NO: 99343 - protein, 9 aa, Homo Sapiens
GMTRWFSCC

SEQ ID NO: 99344 - protein, 9 aa, Homo Sapiens
ENMTVEEES

SEQ ID NO: 99345 - protein, 9 aa, Homo Sapiens
VSFENMTVE

SEQ ID NO: 99346 - protein, 9 aa, Homo Sapiens
SSDVDTLKQ

SEQ ID NO: 99347 - protein, 9 aa, Homo Sapiens
RAQAPLASH

SEQ ID NO: 99348 - protein, 9 aa, Homo Sapiens
EGERQNKRF

SEQ ID NO: 99349 - protein, 9 aa, Homo Sapiens
LSFGVKSSI

SEQ ID NO: 99350 - protein, 9 aa, Homo Sapiens
LQDILGIAL

SEQ ID NO: 99351 - protein, 9 aa, Homo Sapiens
LFVNSFYKE

SEQ ID NO: 99352 - protein, 9 aa, Homo Sapiens
LLAVKYDYH

SEQ ID NO: 99353 - protein, 9 aa, Homo Sapiens
DRICYEEKQ

SEQ ID NO: 99354 - protein, 9 aa, Homo Sapiens
KSKGLLCNS

SEQ ID NO: 99355 - protein, 9 aa, Homo Sapiens
LGITAHAYV

SEQ ID NO: 99356 - protein, 9 aa, Homo Sapiens
IPLEYHSIS

SEQ ID NO: 99357 - protein, 9 aa, Homo Sapiens
PTPAPTCSL

SEQ ID NO: 99358 - protein, 9 aa, Homo Sapiens
PQLPKGEAS

SEQ ID NO: 99359 - protein, 9 aa, Homo Sapiens
PVPQLPKGE

SEQ ID NO: 99360 - protein, 9 aa, Homo Sapiens
ARKKGHLEP

SEQ ID NO: 99361 - protein, 9 aa, Homo Sapiens
YLEENSNLR

SEQ ID NO: 99362 - protein, 9 aa, Homo Sapiens
SVRKIRFAP

SEQ ID NO: 99363 - protein, 9 aa, Homo Sapiens
TDYSTQIDL

SEQ ID NO: 99364 - protein, 9 aa, Homo Sapiens
SDVDTLKQS

SEQ ID NO: 99365 - protein, 9 aa, Homo Sapiens
CNSNQDNKL

SEQ ID NO: 99366 - protein, 9 aa, Homo Sapiens
NYMYNSSCM

SEQ ID NO: 99367 - protein, 9 aa, Homo Sapiens
DCLAETLEN

SEQ ID NO: 99368 - protein, 9 aa, Homo Sapiens
VLAKTGDSV

SEQ ID NO: 99369 - protein, 9 aa, Homo Sapiens
VCHGKRLPF

SEQ ID NO: 99370 - protein, 9 aa, Homo Sapiens
RTGSESHAG

SEQ ID NO: 99371 - protein, 9 aa, Homo Sapiens
KTLIHACSQ

SEQ ID NO: 99372 - protein, 9 aa, Homo Sapiens
LIAEVNNQQ

SEQ ID NO: 99373 - protein, 9 aa, Homo Sapiens
SWQHATNVG

SEQ ID NO: 99374 - protein, 9 aa, Homo Sapiens
IAEVNNQQK

SEQ ID NO: 99375 - protein, 9 aa, Homo Sapiens
HLPLLAKVR

SEQ ID NO: 99376 - protein, 9 aa, Homo Sapiens
IKSSDYDSS

SEQ ID NO: 99377 - protein, 9 aa, Homo Sapiens
RKKGHLEPT

SEQ ID NO: 99378 - protein, 9 aa, Homo Sapiens
WCFRVDMVQ

SEQ ID NO: 99379 - protein, 9 aa, Homo Sapiens
ITELNVLRI

SEQ ID NO: 99380 - protein, 9 aa, Homo Sapiens
TVYNPSLPA

SEQ ID NO: 99381 - protein, 9 aa, Homo Sapiens
VLHQNIQQV

SEQ ID NO: 99382 - protein, 9 aa, Homo Sapiens
DSLSSDVDT

SEQ ID NO: 99383 - protein, 9 aa, Homo Sapiens
TLIHACSQG

SEQ ID NO: 99384 - protein, 9 aa, Homo Sapiens
FQVGDRICY

SEQ ID NO: 99385 - protein, 9 aa, Homo Sapiens
EFSPHQRHH

SEQ ID NO: 99386 - protein, 9 aa, Homo Sapiens
KMIFHVESM

SEQ ID NO: 99387 - protein, 9 aa, Homo Sapiens
CLLRPKTFK

SEQ ID NO: 99388 - protein, 9 aa, Homo Sapiens
YPCNVCSPP

SEQ ID NO: 99389 - protein, 9 aa, Homo Sapiens
LKEKQIKSS

SEQ ID NO: 99390 - protein, 9 aa, Homo Sapiens
RGGGVPLRS

SEQ ID NO: 99391 - protein, 9 aa, Homo Sapiens
DWCFRVDMV

SEQ ID NO: 99392 - protein, 9 aa, Homo Sapiens
NGFSSHFVL

SEQ ID NO: 99393 - protein, 9 aa, Homo Sapiens
NKGGEQEKM

SEQ ID NO: 99394 - protein, 9 aa, Homo Sapiens
EEGERQNKR

SEQ ID NO: 99395 - protein, 9 aa, Homo Sapiens
NCFNDFQCA

SEQ ID NO: 99396 - protein, 9 aa, Homo Sapiens
LIKMIFHVE

SEQ ID NO: 99397 - protein, 9 aa, Homo Sapiens
EREQEREKD

SEQ ID NO: 99398 - protein, 9 aa, Homo Sapiens
GGGVPLRSI

SEQ ID NO: 99399 - protein, 9 aa, Homo Sapiens
TKMIPLLRE

SEQ ID NO: 99400 - protein, 9 aa, Homo Sapiens
AHQRRDWAA

SEQ ID NO: 99401 - protein, 9 aa, Homo Sapiens
DLIKMIFHV

SEQ ID NO: 99402 - protein, 9 aa, Homo Sapiens
FENMTVEEE

SEQ ID NO: 99403 - protein, 9 aa, Homo Sapiens
NSFYKEYLS

SEQ ID NO: 99404 - protein, 9 aa, Homo Sapiens
PAFPVPLTP

SEQ ID NO: 99405 - protein, 9 aa, Homo Sapiens
YSLIQKQLA

SEQ ID NO: 99406 - protein, 9 aa, Homo Sapiens
SKGLLCNSN

SEQ ID NO: 99407 - protein, 9 aa, Homo Sapiens
AITRISTPL

SEQ ID NO: 99408 - protein, 9 aa, Homo Sapiens
VKSSIKYSN

SEQ ID NO: 99409 - protein, 9 aa, Homo Sapiens
DVLHQNIQQ

SEQ ID NO: 99410 - protein, 9 aa, Homo Sapiens
PKTFKSVSH

SEQ ID NO: 99411 - protein, 9 aa, Homo Sapiens
NDFQCAAEY

SEQ ID NO: 99412 - protein, 9 aa, Homo Sapiens
FDGGFGCRT

SEQ ID NO: 99413 - protein, 9 aa, Homo Sapiens
EAAEREARK

SEQ ID NO: 99414 - protein, 9 aa, Homo Sapiens
TRCYPCNVC

SEQ ID NO: 99415 - protein, 9 aa, Homo Sapiens
QDSLSSDVD

SEQ ID NO: 99416 - protein, 9 aa, Homo Sapiens
CRKLGITAH

SEQ ID NO: 99417 - protein, 9 aa, Homo Sapiens
QPCGPSEES

SEQ ID NO: 99418 - protein, 9 aa, Homo Sapiens
SDAGQYVCQ

SEQ ID NO: 99419 - protein, 9 aa, Homo Sapiens
QAPLASHSS

SEQ ID NO: 99420 - protein, 9 aa, Homo Sapiens
HRTRDPWDN

SEQ ID NO: 99421 - protein, 9 aa, Homo Sapiens
NMSPVFRLK

SEQ ID NO: 99422 - protein, 9 aa, Homo Sapiens
VTEPGKQPC

SEQ ID NO: 99423 - protein, 9 aa, Homo Sapiens
ESFTKMIPL

SEQ ID NO: 99424 - protein, 9 aa, Homo Sapiens
GERQNKRFR

SEQ ID NO: 99425 - protein, 9 aa, Homo Sapiens
NMTVEEESK

SEQ ID NO: 99426 - protein, 9 aa, Homo Sapiens
GMNMSPVFR

SEQ ID NO: 99427 - protein, 9 aa, Homo Sapiens
FDVVNKGGE

SEQ ID NO: 99428 - protein, 9 aa, Homo Sapiens
YCLIAEVNN

SEQ ID NO: 99429 - protein, 9 aa, Homo Sapiens
EREARKKGH

SEQ ID NO: 99430 - protein, 9 aa, Homo Sapiens
RQNKRFRPS

SEQ ID NO: 99431 - protein, 9 aa, Homo Sapiens
TIFALLAVK

SEQ ID NO: 99432 - protein, 9 aa, Homo Sapiens
PGKQPCGPS

SEQ ID NO: 99433 - protein, 9 aa, Homo Sapiens
EQEREKDKK

SEQ ID NO: 99434 - protein, 9 aa, Homo Sapiens
HQRRDWAAA

SEQ ID NO: 99435 - protein, 9 aa, Homo Sapiens
VVNKGGEQE

SEQ ID NO: 99436 - protein, 9 aa, Homo Sapiens
KRLPFTLFP

SEQ ID NO: 99437 - protein, 9 aa, Homo Sapiens
HLVDPKLIR

SEQ ID NO: 99438 - protein, 9 aa, Homo Sapiens
AAEREARKK

SEQ ID NO: 99439 - protein, 9 aa, Homo Sapiens
PHQRHHKEF

SEQ ID NO: 99440 - protein, 9 aa, Homo Sapiens
EREREREQE

SEQ ID NO: 99441 - protein, 9 aa, Homo Sapiens
SDTSMEAIT

SEQ ID NO: 99442 - protein, 9 aa, Homo Sapiens
MYNSSCMGG

SEQ ID NO: 99443 - protein, 9 aa, Homo Sapiens
QPPVPQLPK

SEQ ID NO: 99444 - protein, 9 aa, Homo Sapiens
PFTLFPSAN

SEQ ID NO: 99445 - protein, 9 aa, Homo Sapiens
SLIQKQLAA

SEQ ID NO: 99446 - protein, 9 aa, Homo Sapiens
SSDTSMEAI

SEQ ID NO: 99447 - protein, 9 aa, Homo Sapiens
PLWFILPDI

SEQ ID NO: 99448 - protein, 9 aa, Homo Sapiens
VNKGGEQEK

SEQ ID NO: 99449 - protein, 9 aa, Homo Sapiens
DGGFGCRTG

SEQ ID NO: 99450 - protein, 9 aa, Homo Sapiens
ISRHNTEGI

SEQ ID NO: 99451 - protein, 9 aa, Homo Sapiens
KQNCFNDFQ

SEQ ID NO: 99452 - protein, 9 aa, Homo Sapiens
YIPLEYHSI

SEQ ID NO: 99453 - protein, 9 aa, Homo Sapiens
RHGGWTTKM

SEQ ID NO: 99454 - protein, 9 aa, Homo Sapiens
APTCSLTST

SEQ ID NO: 99455 - protein, 9 aa, Homo Sapiens
CLIAEVNNQ

SEQ ID NO: 99456 - protein, 9 aa, Homo Sapiens
QDLIKMIFH

SEQ ID NO: 99457 - protein, 9 aa, Homo Sapiens
MTVEEESKQ

SEQ ID NO: 99458 - protein, 9 aa, Homo Sapiens
HVCSCSEDW

SEQ ID NO: 99459 - protein, 9 aa, Homo Sapiens
FVNSFYKEY

SEQ ID NO: 99460 - protein, 9 aa, Homo Sapiens
SSHFVLAKT

SEQ ID NO: 99461 - protein, 9 aa, Homo Sapiens
QNIQQVRDM

SEQ ID NO: 99462 - protein, 9 aa, Homo Sapiens
LSREASCAK

SEQ ID NO: 99463 - protein, 9 aa, Homo Sapiens
MTRWFSCCI

SEQ ID NO: 99464 - protein, 9 aa, Homo Sapiens
HYNYMYNSS

SEQ ID NO: 99465 - protein, 9 aa, Homo Sapiens
MLSDDKSKS

SEQ ID NO: 99466 - protein, 9 aa, Homo Sapiens
GKQPCGPSE

SEQ ID NO: 99467 - protein, 9 aa, Homo Sapiens
EAHQRRDWA

SEQ ID NO: 99468 - protein, 9 aa, Homo Sapiens
KDAGTITEL

SEQ ID NO: 99469 - protein, 9 aa, Homo Sapiens
KLGITAHAY

SEQ ID NO: 99470 - protein, 9 aa, Homo Sapiens
HRRHCEDEA

SEQ ID NO: 99471 - protein, 9 aa, Homo Sapiens
IALCLNLIK

SEQ ID NO: 99472 - protein, 9 aa, Homo Sapiens
DAGQYVCQA

SEQ ID NO: 99473 - protein, 9 aa, Homo Sapiens
TPAPTCSLT

SEQ ID NO: 99474 - protein, 9 aa, Homo Sapiens
LVYNFLMDL

SEQ ID NO: 99475 - protein, 9 aa, Homo Sapiens
YTDFYSSWQ

SEQ ID NO: 99476 - protein, 9 aa, Homo Sapiens
LAETLENTL

SEQ ID NO: 99477 - protein, 9 aa, Homo Sapiens
NKQNCFNDF

SEQ ID NO: 99478 - protein, 9 aa, Homo Sapiens
GCRTGSESH

SEQ ID NO: 99479 - protein, 9 aa, Homo Sapiens
FLKFNEDWC

SEQ ID NO: 99480 - protein, 9 aa, Homo Sapiens
AEVNNQQKP

SEQ ID NO: 99481 - protein, 9 aa, Homo Sapiens
LHCMCPENE

SEQ ID NO: 99482 - protein, 9 aa, Homo Sapiens
TRDPWDNGS

SEQ ID NO: 99483 - protein, 9 aa, Homo Sapiens
SSLVEEGER

SEQ ID NO: 99484 - protein, 9 aa, Homo Sapiens
QKSVKYLEE

SEQ ID NO: 99485 - protein, 9 aa, Homo Sapiens
SFTKMIPLL

SEQ ID NO: 99486 - protein, 9 aa, Homo Sapiens
TKDAGTITE

SEQ ID NO: 99487 - protein, 9 aa, Homo Sapiens
ALLAVKYDY

SEQ ID NO: 99488 - protein, 9 aa, Homo Sapiens
DAGTITELN

SEQ ID NO: 99489 - protein, 9 aa, Homo Sapiens
ETVYNPSLP

SEQ ID NO: 99490 - protein, 9 aa, Homo Sapiens
LYIPLEYHS

SEQ ID NO: 99491 - protein, 9 aa, Homo Sapiens
YTVPGGYLD

SEQ ID NO: 99492 - protein, 9 aa, Homo Sapiens
TITELNVLR

SEQ ID NO: 99493 - protein, 9 aa, Homo Sapiens
AGQYVCQAG

SEQ ID NO: 99494 - protein, 9 aa, Homo Sapiens
LLRPKTFKS

SEQ ID NO: 99495 - protein, 9 aa, Homo Sapiens
LRYSLIQKQ

SEQ ID NO: 99496 - protein, 9 aa, Homo Sapiens
HHRTRDPWD

SEQ ID NO: 99497 - protein, 9 aa, Homo Sapiens
GKRLPFTLF

SEQ ID NO: 99498 - protein, 9 aa, Homo Sapiens
SDSHVCSCS

SEQ ID NO: 99499 - protein, 9 aa, Homo Sapiens
CSLTSTTTS

SEQ ID NO: 99500 - protein, 9 aa, Homo Sapiens
AELRYSLIQ

SEQ ID NO: 99501 - protein, 9 aa, Homo Sapiens
HPGEANLKL

SEQ ID NO: 99502 - protein, 9 aa, Homo Sapiens
NTIFALLAV

SEQ ID NO: 99503 - protein, 9 aa, Homo Sapiens
CMCPENEGS

SEQ ID NO: 99504 - protein, 9 aa, Homo Sapiens
AAVIVSVHQ

SEQ ID NO: 99505 - protein, 9 aa, Homo Sapiens
MKTLIHACS

SEQ ID NO: 99506 - protein, 9 aa, Homo Sapiens
RMIIIIIDI

SEQ ID NO: 99507 - protein, 9 aa, Homo Sapiens
KESSVTEPV

SEQ ID NO: 99508 - protein, 9 aa, Homo Sapiens
VSISAAKQG

SEQ ID NO: 99509 - protein, 9 aa, Homo Sapiens
FSPYLYMLY

SEQ ID NO: 99510 - protein, 9 aa, Homo Sapiens
GETLKPDPQ

SEQ ID NO: 99511 - protein, 9 aa, Homo Sapiens
GTYACQGDS

SEQ ID NO: 99512 - protein, 9 aa, Homo Sapiens
KTNMNGGAI

SEQ ID NO: 99513 - protein, 9 aa, Homo Sapiens
PSSTLGTTP

SEQ ID NO: 99514 - protein, 9 aa, Homo Sapiens
SRSEKDKLH

SEQ ID NO: 99515 - protein, 9 aa, Homo Sapiens
LMIHSPQIS

SEQ ID NO: 99516 - protein, 9 aa, Homo Sapiens
GNEFFCKVD

SEQ ID NO: 99517 - protein, 9 aa, Homo Sapiens
LSRSEKDKL

SEQ ID NO: 99518 - protein, 9 aa, Homo Sapiens
DLFIEAHLM

SEQ ID NO: 99519 - protein, 9 aa, Homo Sapiens
DKRMDERRQ

SEQ ID NO: 99520 - protein, 9 aa, Homo Sapiens
VYDLTPGKK

SEQ ID NO: 99521 - protein, 9 aa, Homo Sapiens
EMEFPQTRI

SEQ ID NO: 99522 - protein, 9 aa, Homo Sapiens
PRRKSRSPR

SEQ ID NO: 99523 - protein, 9 aa, Homo Sapiens
YHQNHRADK

SEQ ID NO: 99524 - protein, 9 aa, Homo Sapiens
RHNFSPYLY

SEQ ID NO: 99525 - protein, 9 aa, Homo Sapiens
QRTPAAQQS

SEQ ID NO: 99526 - protein, 9 aa, Homo Sapiens
DEITANRQK

SEQ ID NO: 99527 - protein, 9 aa, Homo Sapiens
AAHKINEGL

SEQ ID NO: 99528 - protein, 9 aa, Homo Sapiens
SGPVTRRRA

SEQ ID NO: 99529 - protein, 9 aa, Homo Sapiens
RQRRQDEKR

SEQ ID NO: 99530 - protein, 9 aa, Homo Sapiens
LEQYQKAIH

SEQ ID NO: 99531 - protein, 9 aa, Homo Sapiens
GYFPLTGLS

SEQ ID NO: 99532 - protein, 9 aa, Homo Sapiens
QKHLQECRN

SEQ ID NO: 99533 - protein, 9 aa, Homo Sapiens
ANRQKKGKQ

SEQ ID NO: 99534 - protein, 9 aa, Homo Sapiens
AMNLNKQTT

SEQ ID NO: 99535 - protein, 9 aa, Homo Sapiens
LDSDRVQEV

SEQ ID NO: 99536 - protein, 9 aa, Homo Sapiens
PLGQEKALQ

SEQ ID NO: 99537 - protein, 9 aa, Homo Sapiens
PYLYMLYLT

SEQ ID NO: 99538 - protein, 9 aa, Homo Sapiens
AKQGQALAS

SEQ ID NO: 99539 - protein, 9 aa, Homo Sapiens
VSAHGFKFG

SEQ ID NO: 99540 - protein, 9 aa, Homo Sapiens
KGVKELPLN

SEQ ID NO: 99541 - protein, 9 aa, Homo Sapiens
GSSGGYFPL

SEQ ID NO: 99542 - protein, 9 aa, Homo Sapiens
TFVRDPLSF

SEQ ID NO: 99543 - protein, 9 aa, Homo Sapiens
GLGTNASLG

SEQ ID NO: 99544 - protein, 9 aa, Homo Sapiens
GQYFTFVRD

SEQ ID NO: 99545 - protein, 9 aa, Homo Sapiens
MIIIIIDII

SEQ ID NO: 99546 - protein, 9 aa, Homo Sapiens
TPAAQQSQG

SEQ ID NO: 99547 - protein, 9 aa, Homo Sapiens
KHKRIHAAQ

SEQ ID NO: 99548 - protein, 9 aa, Homo Sapiens
FSICRDKND

SEQ ID NO: 99549 - protein, 9 aa, Homo Sapiens
NAKTEKFEA

SEQ ID NO: 99550 - protein, 9 aa, Homo Sapiens
AGLSMLLLA

SEQ ID NO: 99551 - protein, 9 aa, Homo Sapiens
EEQELSTAT

SEQ ID NO: 99552 - protein, 9 aa, Homo Sapiens
CRNDKEMLQ

SEQ ID NO: 99553 - protein, 9 aa, Homo Sapiens
NFPQAPWEN

SEQ ID NO: 99554 - protein, 9 aa, Homo Sapiens
KDAVRDMNG

SEQ ID NO: 99555 - protein, 9 aa, Homo Sapiens
PLTGLSVPA

SEQ ID NO: 99556 - protein, 9 aa, Homo Sapiens
LAANGTVPC

SEQ ID NO: 99557 - protein, 9 aa, Homo Sapiens
GFAEMPHSP

SEQ ID NO: 99558 - protein, 9 aa, Homo Sapiens
DIDLMEPQP

SEQ ID NO: 99559 - protein, 9 aa, Homo Sapiens
RDVDCYTIH

SEQ ID NO: 99560 - protein, 9 aa, Homo Sapiens
AHGFKFGIS

SEQ ID NO: 99561 - protein, 9 aa, Homo Sapiens
ERMIIIIID

SEQ ID NO: 99562 - protein, 9 aa, Homo Sapiens
FVRDPLSFG

SEQ ID NO: 99563 - protein, 9 aa, Homo Sapiens
QMVEKTVDH

SEQ ID NO: 99564 - protein, 9 aa, Homo Sapiens
RIYHQNHRA

SEQ ID NO: 99565 - protein, 9 aa, Homo Sapiens
GTNASLGST

SEQ ID NO: 99566 - protein, 9 aa, Homo Sapiens
DLDISKTNM

SEQ ID NO: 99567 - protein, 9 aa, Homo Sapiens
REVWLEKPW

SEQ ID NO: 99568 - protein, 9 aa, Homo Sapiens
SPQISQFQS

SEQ ID NO: 99569 - protein, 9 aa, Homo Sapiens
IYHQNHRAD

SEQ ID NO: 99570 - protein, 9 aa, Homo Sapiens
TINPYKWLQ

SEQ ID NO: 99571 - protein, 9 aa, Homo Sapiens
LWIESNFPQ

SEQ ID NO: 99572 - protein, 9 aa, Homo Sapiens
TKEMLTTNA

SEQ ID NO: 99573 - protein, 9 aa, Homo Sapiens
QHNGLDREE

SEQ ID NO: 99574 - protein, 9 aa, Homo Sapiens
GQEKALQQI

SEQ ID NO: 99575 - protein, 9 aa, Homo Sapiens
LNESYSEME

SEQ ID NO: 99576 - protein, 9 aa, Homo Sapiens
PDPQQNWAS

SEQ ID NO: 99577 - protein, 9 aa, Homo Sapiens
AIHIYEQVG

SEQ ID NO: 99578 - protein, 9 aa, Homo Sapiens
LEKPWYDAA

SEQ ID NO: 99579 - protein, 9 aa, Homo Sapiens
SRVEELKAI

SEQ ID NO: 99580 - protein, 9 aa, Homo Sapiens
LKPDPQQNW

SEQ ID NO: 99581 - protein, 9 aa, Homo Sapiens
EIRQYKQAP

SEQ ID NO: 99582 - protein, 9 aa, Homo Sapiens
TTNAKTEKF

SEQ ID NO: 99583 - protein, 9 aa, Homo Sapiens
IYVSNAGNN

SEQ ID NO: 99584 - protein, 9 aa, Homo Sapiens
THLHPADIN

SEQ ID NO: 99585 - protein, 9 aa, Homo Sapiens
SLGSTLGTS

SEQ ID NO: 99586 - protein, 9 aa, Homo Sapiens
RDLDRIAAQ

SEQ ID NO: 99587 - protein, 9 aa, Homo Sapiens
EFFCKVSSL

SEQ ID NO: 99588 - protein, 9 aa, Homo Sapiens
ICRDKNDRL

SEQ ID NO: 99589 - protein, 9 aa, Homo Sapiens
FVRCVYVLG

SEQ ID NO: 99590 - protein, 9 aa, Homo Sapiens
TCGIEEETV

SEQ ID NO: 99591 - protein, 9 aa, Homo Sapiens
RDERVREQR

SEQ ID NO: 99592 - protein, 9 aa, Homo Sapiens
ELDEITANR

SEQ ID NO: 99593 - protein, 9 aa, Homo Sapiens
QTCGIEEET

SEQ ID NO: 99594 - protein, 9 aa, Homo Sapiens
KNREEDPLL

SEQ ID NO: 99595 - protein, 9 aa, Homo Sapiens
QYKQAPPQP

SEQ ID NO: 99596 - protein, 9 aa, Homo Sapiens
AELVRPRCP

SEQ ID NO: 99597 - protein, 9 aa, Homo Sapiens
VELIDREQL

SEQ ID NO: 99598 - protein, 9 aa, Homo Sapiens
SEVITVFQY

SEQ ID NO: 99599 - protein, 9 aa, Homo Sapiens
IESNFPQAP

SEQ ID NO: 99600 - protein, 9 aa, Homo Sapiens
YQKALHLDS

SEQ ID NO: 99601 - protein, 9 aa, Homo Sapiens
NGKATSTQV

SEQ ID NO: 99602 - protein, 9 aa, Homo Sapiens
AGAGAGVSA

SEQ ID NO: 99603 - protein, 9 aa, Homo Sapiens
RRKSRSPRR

SEQ ID NO: 99604 - protein, 9 aa, Homo Sapiens
VVRATHLHP

SEQ ID NO: 99605 - protein, 9 aa, Homo Sapiens
GVYPSQNKP

SEQ ID NO: 99606 - protein, 9 aa, Homo Sapiens
HESVRRHTD

SEQ ID NO: 99607 - protein, 9 aa, Homo Sapiens
LMHTLPAAH

SEQ ID NO: 99608 - protein, 9 aa, Homo Sapiens
HSHESVRRH

SEQ ID NO: 99609 - protein, 9 aa, Homo Sapiens
ILKAMNLNK

SEQ ID NO: 99610 - protein, 9 aa, Homo Sapiens
PVSAHGFKF

SEQ ID NO: 99611 - protein, 9 aa, Homo Sapiens
TVHYGQCSS

SEQ ID NO: 99612 - protein, 9 aa, Homo Sapiens
SVLPVPLTH

SEQ ID NO: 99613 - protein, 9 aa, Homo Sapiens
SVYDLTPGK

SEQ ID NO: 99614 - protein, 9 aa, Homo Sapiens
IAAQVAAAN

SEQ ID NO: 99615 - protein, 9 aa, Homo Sapiens
LGGERGAQL

SEQ ID NO: 99616 - protein, 9 aa, Homo Sapiens
NRHLQTVYN

SEQ ID NO: 99617 - protein, 9 aa, Homo Sapiens
RHHAELVRP

SEQ ID NO: 99618 - protein, 9 aa, Homo Sapiens
SVIAVVQMV

SEQ ID NO: 99619 - protein, 9 aa, Homo Sapiens
QEILDSDRV

SEQ ID NO: 99620 - protein, 9 aa, Homo Sapiens
STTFSVTIN

SEQ ID NO: 99621 - protein, 9 aa, Homo Sapiens
TNMNGGAIA

SEQ ID NO: 99622 - protein, 9 aa, Homo Sapiens
DIPVKSHRT

SEQ ID NO: 99623 - protein, 9 aa, Homo Sapiens
STSPKKAAQ

SEQ ID NO: 99624 - protein, 9 aa, Homo Sapiens
AAGKEGAAE

SEQ ID NO: 99625 - protein, 9 aa, Homo Sapiens
CKLVMNATL

SEQ ID NO: 99626 - protein, 9 aa, Homo Sapiens
QCSSSKKQI

SEQ ID NO: 99627 - protein, 9 aa, Homo Sapiens
IFFLHHAFV

SEQ ID NO: 99628 - protein, 9 aa, Homo Sapiens
AICKQSQHM

SEQ ID NO: 99629 - protein, 9 aa, Homo Sapiens
LGTNASLGS

SEQ ID NO: 99630 - protein, 9 aa, Homo Sapiens
QEVTFLSLS

SEQ ID NO: 99631 - protein, 9 aa, Homo Sapiens
GSANDPIFF

SEQ ID NO: 99632 - protein, 9 aa, Homo Sapiens
GQCSSSKKQ

SEQ ID NO: 99633 - protein, 9 aa, Homo Sapiens
TQHKRIHTA

SEQ ID NO: 99634 - protein, 9 aa, Homo Sapiens
ARMQEDCDG

SEQ ID NO: 99635 - protein, 9 aa, Homo Sapiens
SSGGYFPLT

SEQ ID NO: 99636 - protein, 9 aa, Homo Sapiens
MAAAAAAGD

SEQ ID NO: 99637 - protein, 9 aa, Homo Sapiens
PSVLLLTNL

SEQ ID NO: 99638 - protein, 9 aa, Homo Sapiens
MAICKQSQH

SEQ ID NO: 99639 - protein, 9 aa, Homo Sapiens
KALHLDSSC

SEQ ID NO: 99640 - protein, 9 aa, Homo Sapiens
GSRCATPPR

SEQ ID NO: 99641 - protein, 9 aa, Homo Sapiens
FYLLKSHLV

SEQ ID NO: 99642 - protein, 9 aa, Homo Sapiens
WKIEDIAAN

SEQ ID NO: 99643 - protein, 9 aa, Homo Sapiens
KKNREEDPL

SEQ ID NO: 99644 - protein, 9 aa, Homo Sapiens
GQGHRVAEL

SEQ ID NO: 99645 - protein, 9 aa, Homo Sapiens
SGPSFETLS

SEQ ID NO: 99646 - protein, 9 aa, Homo Sapiens
INPYKWLQV

SEQ ID NO: 99647 - protein, 9 aa, Homo Sapiens
VRDMNGKSL

SEQ ID NO: 99648 - protein, 9 aa, Homo Sapiens
FREQAAALP

SEQ ID NO: 99649 - protein, 9 aa, Homo Sapiens
VCIKYMLTY

SEQ ID NO: 99650 - protein, 9 aa, Homo Sapiens
CVYVLGNLA

SEQ ID NO: 99651 - protein, 9 aa, Homo Sapiens
LTEIRQYKQ

SEQ ID NO: 99652 - protein, 9 aa, Homo Sapiens
QDEKRKAEE

SEQ ID NO: 99653 - protein, 9 aa, Homo Sapiens
VYPSQNKPW

SEQ ID NO: 99654 - protein, 9 aa, Homo Sapiens
YACQGDSGG

SEQ ID NO: 99655 - protein, 9 aa, Homo Sapiens
KSRSPRRRD

SEQ ID NO: 99656 - protein, 9 aa, Homo Sapiens
KYCKLVMNA

SEQ ID NO: 99657 - protein, 9 aa, Homo Sapiens
SPSSLGPKL

SEQ ID NO: 99658 - protein, 9 aa, Homo Sapiens
DLKGQMMYI

SEQ ID NO: 99659 - protein, 9 aa, Homo Sapiens
VRATHLHPA

SEQ ID NO: 99660 - protein, 9 aa, Homo Sapiens
VHYGQCSSS

SEQ ID NO: 99661 - protein, 9 aa, Homo Sapiens
HLQECRNDK

SEQ ID NO: 99662 - protein, 9 aa, Homo Sapiens
ASLCRAAAG

SEQ ID NO: 99663 - protein, 9 aa, Homo Sapiens
KPWIALIEK

SEQ ID NO: 99664 - protein, 9 aa, Homo Sapiens
QNHRADKRR

SEQ ID NO: 99665 - protein, 9 aa, Homo Sapiens
AQQSQGLAS

SEQ ID NO: 99666 - protein, 9 aa, Homo Sapiens
RRERDEKKK

SEQ ID NO: 99667 - protein, 9 aa, Homo Sapiens
TNPSSTLGT

SEQ ID NO: 99668 - protein, 9 aa, Homo Sapiens
NFSPYLYML

SEQ ID NO: 99669 - protein, 9 aa, Homo Sapiens
FFFFINALI

SEQ ID NO: 99670 - protein, 9 aa, Homo Sapiens
QRKDFIYNR

SEQ ID NO: 99671 - protein, 9 aa, Homo Sapiens
DPLLLWQVF

SEQ ID NO: 99672 - protein, 9 aa, Homo Sapiens
LVRPRCPAC

SEQ ID NO: 99673 - protein, 9 aa, Homo Sapiens
MVLVPSLLD

SEQ ID NO: 99674 - protein, 9 aa, Homo Sapiens
HIYEQVGTN

SEQ ID NO: 99675 - protein, 9 aa, Homo Sapiens
HKRIHAAQK

SEQ ID NO: 99676 - protein, 9 aa, Homo Sapiens
SSQKGVKEL

SEQ ID NO: 99677 - protein, 9 aa, Homo Sapiens
PQKFDTLGG

SEQ ID NO: 99678 - protein, 9 aa, Homo Sapiens
KATSTQVLP

SEQ ID NO: 99679 - protein, 9 aa, Homo Sapiens
DKENEFKCL

SEQ ID NO: 99680 - protein, 9 aa, Homo Sapiens
IEHEDLKLE

SEQ ID NO: 99681 - protein, 9 aa, Homo Sapiens
SNFPQAPWE

SEQ ID NO: 99682 - protein, 9 aa, Homo Sapiens
GRLMCQTRH

SEQ ID NO: 99683 - protein, 9 aa, Homo Sapiens
THELPGKKR

SEQ ID NO: 99684 - protein, 9 aa, Homo Sapiens
LEDKIKIIE

SEQ ID NO: 99685 - protein, 9 aa, Homo Sapiens
DFFLCHFFF

SEQ ID NO: 99686 - protein, 9 aa, Homo Sapiens
HHDHEATGA

SEQ ID NO: 99687 - protein, 9 aa, Homo Sapiens
HVKDLYRIP

SEQ ID NO: 99688 - protein, 9 aa, Homo Sapiens
MMYIVESSA

SEQ ID NO: 99689 - protein, 9 aa, Homo Sapiens
MCQTRHERY

SEQ ID NO: 99690 - protein, 9 aa, Homo Sapiens
AGFLEGGTY

SEQ ID NO: 99691 - protein, 9 aa, Homo Sapiens
DIIEKTEII

SEQ ID NO: 99692 - protein, 9 aa, Homo Sapiens
PGRLMCQTR

SEQ ID NO: 99693 - protein, 9 aa, Homo Sapiens
QTTQRKDFI

SEQ ID NO: 99694 - protein, 9 aa, Homo Sapiens
VKDLYRIPL

SEQ ID NO: 99695 - protein, 9 aa, Homo Sapiens
DPTQMAGLS

SEQ ID NO: 99696 - protein, 9 aa, Homo Sapiens
ALIEKGNCT

SEQ ID NO: 99697 - protein, 9 aa, Homo Sapiens
VNVGAPLIT

SEQ ID NO: 99698 - protein, 9 aa, Homo Sapiens
AVVQMVNKI

SEQ ID NO: 99699 - protein, 9 aa, Homo Sapiens
MVSISAAKQ

SEQ ID NO: 99700 - protein, 9 aa, Homo Sapiens
AQVAAANKK

SEQ ID NO: 99701 - protein, 9 aa, Homo Sapiens
DERVREQRI

SEQ ID NO: 99702 - protein, 9 aa, Homo Sapiens
ALHLDSSCK

SEQ ID NO: 99703 - protein, 9 aa, Homo Sapiens
YCKLVMNAT

SEQ ID NO: 99704 - protein, 9 aa, Homo Sapiens
PVKSHRTSE

SEQ ID NO: 99705 - protein, 9 aa, Homo Sapiens
PSQNKPWHQ

SEQ ID NO: 99706 - protein, 9 aa, Homo Sapiens
AWKIEDIAA

SEQ ID NO: 99707 - protein, 9 aa, Homo Sapiens
AVQSVNVGA

SEQ ID NO: 99708 - protein, 9 aa, Homo Sapiens
QGQALASDV

SEQ ID NO: 99709 - protein, 9 aa, Homo Sapiens
YSGEQGPPG

SEQ ID NO: 99710 - protein, 9 aa, Homo Sapiens
GQYVSRVEE

SEQ ID NO: 99711 - protein, 9 aa, Homo Sapiens
HHAELVRPR

SEQ ID NO: 99712 - protein, 9 aa, Homo Sapiens
AAAASLCRA

SEQ ID NO: 99713 - protein, 9 aa, Homo Sapiens
GAGAGAGVS

SEQ ID NO: 99714 - protein, 9 aa, Homo Sapiens
FVYYLTKTL

SEQ ID NO: 99715 - protein, 9 aa, Homo Sapiens
QLALHVEYL

SEQ ID NO: 99716 - protein, 9 aa, Homo Sapiens
LIDREQLTT

SEQ ID NO: 99717 - protein, 9 aa, Homo Sapiens
RRRGPKGYS

SEQ ID NO: 99718 - protein, 9 aa, Homo Sapiens
RGNEFFCKV

SEQ ID NO: 99719 - protein, 9 aa, Homo Sapiens
PVTRRRAVS

SEQ ID NO: 99720 - protein, 9 aa, Homo Sapiens
TQRKDFIYN

SEQ ID NO: 99721 - protein, 9 aa, Homo Sapiens
CFPVFLYMR

SEQ ID NO: 99722 - protein, 9 aa, Homo Sapiens
ALFDPLSKE

SEQ ID NO: 99723 - protein, 9 aa, Homo Sapiens
RLTHELPGK

SEQ ID NO: 99724 - protein, 9 aa, Homo Sapiens
CWPTAPVPS

SEQ ID NO: 99725 - protein, 9 aa, Homo Sapiens
RRQERREQR

SEQ ID NO: 99726 - protein, 9 aa, Homo Sapiens
KENEFKCLW

SEQ ID NO: 99727 - protein, 9 aa, Homo Sapiens
QQFVYYLTK

SEQ ID NO: 99728 - protein, 9 aa, Homo Sapiens
RSRSPRRKS

SEQ ID NO: 99729 - protein, 9 aa, Homo Sapiens
HGSRCATPP

SEQ ID NO: 99730 - protein, 9 aa, Homo Sapiens
ESQRCGFIS

SEQ ID NO: 99731 - protein, 9 aa, Homo Sapiens
NPSSTLGTT

SEQ ID NO: 99732 - protein, 9 aa, Homo Sapiens
ITVFQYYSY

SEQ ID NO: 99733 - protein, 9 aa, Homo Sapiens
TSQYVELID

SEQ ID NO: 99734 - protein, 9 aa, Homo Sapiens
DLNESYSEM

SEQ ID NO: 99735 - protein, 9 aa, Homo Sapiens
NTSKDKCEK

SEQ ID NO: 99736 - protein, 9 aa, Homo Sapiens
SHESVRRHT

SEQ ID NO: 99737 - protein, 9 aa, Homo Sapiens
ISQFQSLTH

SEQ ID NO: 99738 - protein, 9 aa, Homo Sapiens
TAVCLQLTE

SEQ ID NO: 99739 - protein, 9 aa, Homo Sapiens
SSLGPKLDK

SEQ ID NO: 99740 - protein, 9 aa, Homo Sapiens
VIMCTFQQF

SEQ ID NO: 99741 - protein, 9 aa, Homo Sapiens
RERDEKKKC

SEQ ID NO: 99742 - protein, 9 aa, Homo Sapiens
EQYQKAIHI

SEQ ID NO: 99743 - protein, 9 aa, Homo Sapiens
KVSSLQPPY

SEQ ID NO: 99744 - protein, 9 aa, Homo Sapiens
KKMKILHAL

SEQ ID NO: 99745 - protein, 9 aa, Homo Sapiens
RGPYPTMYA

SEQ ID NO: 99746 - protein, 9 aa, Homo Sapiens
VAVQSVNVG

SEQ ID NO: 99747 - protein, 9 aa, Homo Sapiens
PLMIHSPQI

SEQ ID NO: 99748 - protein, 9 aa, Homo Sapiens
ERTVNNESQ

SEQ ID NO: 99749 - protein, 9 aa, Homo Sapiens
ADAKDAVRD

SEQ ID NO: 99750 - protein, 9 aa, Homo Sapiens
RDKNDRLRN

SEQ ID NO: 99751 - protein, 9 aa, Homo Sapiens
FFCFPVFLY

SEQ ID NO: 99752 - protein, 9 aa, Homo Sapiens
CKVSSLQPP

SEQ ID NO: 99753 - protein, 9 aa, Homo Sapiens
SVPETRGKN

SEQ ID NO: 99754 - protein, 9 aa, Homo Sapiens
MSTVKQQLI

SEQ ID NO: 99755 - protein, 9 aa, Homo Sapiens
GKKMKILHA

SEQ ID NO: 99756 - protein, 9 aa, Homo Sapiens
KRMDERRQE

SEQ ID NO: 99757 - protein, 9 aa, Homo Sapiens
WLEKPWYDA

SEQ ID NO: 99758 - protein, 9 aa, Homo Sapiens
SDLSQHNGL

SEQ ID NO: 99759 - protein, 9 aa, Homo Sapiens
FSSQKGVKE

SEQ ID NO: 99760 - protein, 9 aa, Homo Sapiens
GKNKGSAAL

SEQ ID NO: 99761 - protein, 9 aa, Homo Sapiens
VLVPSLLDT

SEQ ID NO: 99762 - protein, 9 aa, Homo Sapiens
VLLLTNLYY

SEQ ID NO: 99763 - protein, 9 aa, Homo Sapiens
ESVRRHTDA

SEQ ID NO: 99764 - protein, 9 aa, Homo Sapiens
QQILEYELL

SEQ ID NO: 99765 - protein, 9 aa, Homo Sapiens
TDMMRCLIF

SEQ ID NO: 99766 - protein, 9 aa, Homo Sapiens
ELIDREQLT

SEQ ID NO: 99767 - protein, 9 aa, Homo Sapiens
AGYKRAQTC

SEQ ID NO: 99768 - protein, 9 aa, Homo Sapiens
PKGYSGEQG

SEQ ID NO: 99769 - protein, 9 aa, Homo Sapiens
FHLTKSLGV

SEQ ID NO: 99770 - protein, 9 aa, Homo Sapiens
TIHLLLVDI

SEQ ID NO: 99771 - protein, 9 aa, Homo Sapiens
CLWVERTSL

SEQ ID NO: 99772 - protein, 9 aa, Homo Sapiens
PYKWLQVYT

SEQ ID NO: 99773 - protein, 9 aa, Homo Sapiens
AAQPTVDLL

SEQ ID NO: 99774 - protein, 9 aa, Homo Sapiens
KLEYKYCKL

SEQ ID NO: 99775 - protein, 9 aa, Homo Sapiens
QVDCSDLSQ

SEQ ID NO: 99776 - protein, 9 aa, Homo Sapiens
GPSFETLSA

SEQ ID NO: 99777 - protein, 9 aa, Homo Sapiens
VGQYVSRVE

SEQ ID NO: 99778 - protein, 9 aa, Homo Sapiens
QFLEKESSV

SEQ ID NO: 99779 - protein, 9 aa, Homo Sapiens
VMGQGHRVA

SEQ ID NO: 99780 - protein, 9 aa, Homo Sapiens
CHHDHEATG

SEQ ID NO: 99781 - protein, 9 aa, Homo Sapiens
CTFQQFVYY

SEQ ID NO: 99782 - protein, 9 aa, Homo Sapiens
KNDRLRNKI

SEQ ID NO: 99783 - protein, 9 aa, Homo Sapiens
PLRHGSRCA

SEQ ID NO: 99784 - protein, 9 aa, Homo Sapiens
NTGVKKNAG

SEQ ID NO: 99785 - protein, 9 aa, Homo Sapiens
VSAGGVGAT

SEQ ID NO: 99786 - protein, 9 aa, Homo Sapiens
RLMCQTRHE

SEQ ID NO: 99787 - protein, 9 aa, Homo Sapiens
HLMSPLDRI

SEQ ID NO: 99788 - protein, 9 aa, Homo Sapiens
LFDPLSKEG

SEQ ID NO: 99789 - protein, 9 aa, Homo Sapiens
EQMVEKTVD

SEQ ID NO: 99790 - protein, 9 aa, Homo Sapiens
LTTNAKTEK

SEQ ID NO: 99791 - protein, 9 aa, Homo Sapiens
SVTEPVIVG

SEQ ID NO: 99792 - protein, 9 aa, Homo Sapiens
HISMLAMLF

SEQ ID NO: 99793 - protein, 9 aa, Homo Sapiens
FCKVDEDYI

SEQ ID NO: 99794 - protein, 9 aa, Homo Sapiens
VTFLSLSLS

SEQ ID NO: 99795 - protein, 9 aa, Homo Sapiens
ENEFKCLWV

SEQ ID NO: 99796 - protein, 9 aa, Homo Sapiens
DPIFFLHHA

SEQ ID NO: 99797 - protein, 9 aa, Homo Sapiens
DPGRLMCQT

SEQ ID NO: 99798 - protein, 9 aa, Homo Sapiens
AGAGVSAGG

SEQ ID NO: 99799 - protein, 9 aa, Homo Sapiens
IHAAQKPYK

SEQ ID NO: 99800 - protein, 9 aa, Homo Sapiens
NRHVKDLYR

SEQ ID NO: 99801 - protein, 9 aa, Homo Sapiens
DLDRIAAQV

SEQ ID NO: 99802 - protein, 9 aa, Homo Sapiens
QELSTATKK

SEQ ID NO: 99803 - protein, 9 aa, Homo Sapiens
MYAFRPWTI

SEQ ID NO: 99804 - protein, 9 aa, Homo Sapiens
QQLIEKLIE

SEQ ID NO: 99805 - protein, 9 aa, Homo Sapiens
CKQSQHMTE

SEQ ID NO: 99806 - protein, 9 aa, Homo Sapiens
ISKTNMNGG

SEQ ID NO: 99807 - protein, 9 aa, Homo Sapiens
MCTFQQFVY

SEQ ID NO: 99808 - protein, 9 aa, Homo Sapiens
FPLWSPEGS

SEQ ID NO: 99809 - protein, 9 aa, Homo Sapiens
MEQMVEKTV

SEQ ID NO: 99810 - protein, 9 aa, Homo Sapiens
QAADEEQEL

SEQ ID NO: 99811 - protein, 9 aa, Homo Sapiens
HNEQVWDPQ

SEQ ID NO: 99812 - protein, 9 aa, Homo Sapiens
LEEGEAIIV

SEQ ID NO: 99813 - protein, 9 aa, Homo Sapiens
FFLCHFFFF

SEQ ID NO: 99814 - protein, 9 aa, Homo Sapiens
LLSPRSCSD

SEQ ID NO: 99815 - protein, 9 aa, Homo Sapiens
TRGKNKGSA

SEQ ID NO: 99816 - protein, 9 aa, Homo Sapiens
PLTHIGPRT

SEQ ID NO: 99817 - protein, 9 aa, Homo Sapiens
TNASLGSTL

SEQ ID NO: 99818 - protein, 9 aa, Homo Sapiens
RRHTDAYSD

SEQ ID NO: 99819 - protein, 9 aa, Homo Sapiens
EEGEAIIVY

SEQ ID NO: 99820 - protein, 9 aa, Homo Sapiens
TNAKTEKFE

SEQ ID NO: 99821 - protein, 9 aa, Homo Sapiens
ERRRGPKGY

SEQ ID NO: 99822 - protein, 9 aa, Homo Sapiens
ALQQILEYE

SEQ ID NO: 99823 - protein, 9 aa, Homo Sapiens
KQGQALASD

SEQ ID NO: 99824 - protein, 9 aa, Homo Sapiens
LMCQTRHER

SEQ ID NO: 99825 - protein, 9 aa, Homo Sapiens
HRPTLDAFR

SEQ ID NO: 99826 - protein, 9 aa, Homo Sapiens
VHPHPAVRC

SEQ ID NO: 99827 - protein, 9 aa, Homo Sapiens
LQTTQRKDF

SEQ ID NO: 99828 - protein, 9 aa, Homo Sapiens
NDPIFFLHH

SEQ ID NO: 99829 - protein, 9 aa, Homo Sapiens
YKWLQVYTA

SEQ ID NO: 99830 - protein, 9 aa, Homo Sapiens
EDIAANKMS

SEQ ID NO: 99831 - protein, 9 aa, Homo Sapiens
YSFESDFHL

SEQ ID NO: 99832 - protein, 9 aa, Homo Sapiens
TVPCWPTAP

SEQ ID NO: 99833 - protein, 9 aa, Homo Sapiens
ILDSDRVQE

SEQ ID NO: 99834 - protein, 9 aa, Homo Sapiens
LQQILEYEL

SEQ ID NO: 99835 - protein, 9 aa, Homo Sapiens
AKDAVRDMN

SEQ ID NO: 99836 - protein, 9 aa, Homo Sapiens
RMQEDCDGS

SEQ ID NO: 99837 - protein, 9 aa, Homo Sapiens
EFFCKVDED

SEQ ID NO: 99838 - protein, 9 aa, Homo Sapiens
NMNGGAIAL

SEQ ID NO: 99839 - protein, 9 aa, Homo Sapiens
GVQTCRTSL

SEQ ID NO: 99840 - protein, 9 aa, Homo Sapiens
KSHRTSEIS

SEQ ID NO: 99841 - protein, 9 aa, Homo Sapiens
YDLSRSEKD

SEQ ID NO: 99842 - protein, 9 aa, Homo Sapiens
LTNTSKDKC

SEQ ID NO: 99843 - protein, 9 aa, Homo Sapiens
AVVMGQGHR

SEQ ID NO: 99844 - protein, 9 aa, Homo Sapiens
TPGHQSGPV

SEQ ID NO: 99845 - protein, 9 aa, Homo Sapiens
KIKIIEKRP

SEQ ID NO: 99846 - protein, 9 aa, Homo Sapiens
RDPLSFGSI

SEQ ID NO: 99847 - protein, 9 aa, Homo Sapiens
LYRGLSVVP

SEQ ID NO: 99848 - protein, 9 aa, Homo Sapiens
RAMAICKQS

SEQ ID NO: 99849 - protein, 9 aa, Homo Sapiens
DTLGGERGA

SEQ ID NO: 99850 - protein, 9 aa, Homo Sapiens
SSLSSEVIT

SEQ ID NO: 99851 - protein, 9 aa, Homo Sapiens
QSVLPVPLT

SEQ ID NO: 99852 - protein, 9 aa, Homo Sapiens
VEELKAIVS

SEQ ID NO: 99853 - protein, 9 aa, Homo Sapiens
PETRGKNKG

SEQ ID NO: 99854 - protein, 9 aa, Homo Sapiens
DAVRDMNGK

SEQ ID NO: 99855 - protein, 9 aa, Homo Sapiens
MERQRRQDE

SEQ ID NO: 99856 - protein, 9 aa, Homo Sapiens
SDTVHYGQC

SEQ ID NO: 99857 - protein, 9 aa, Homo Sapiens
HQNHRADKR

SEQ ID NO: 99858 - protein, 9 aa, Homo Sapiens
HELPGKKRG

SEQ ID NO: 99859 - protein, 9 aa, Homo Sapiens
VFEFRNEIY

SEQ ID NO: 99860 - protein, 9 aa, Homo Sapiens
ELALFDPLS

SEQ ID NO: 99861 - protein, 9 aa, Homo Sapiens
QKLEYKYCK

SEQ ID NO: 99862 - protein, 9 aa, Homo Sapiens
PGKKMKILH

SEQ ID NO: 99863 - protein, 9 aa, Homo Sapiens
DAKDAVRDM

SEQ ID NO: 99864 - protein, 9 aa, Homo Sapiens
TQKHLQECR

SEQ ID NO: 99865 - protein, 9 aa, Homo Sapiens
TNTSKDKCE

SEQ ID NO: 99866 - protein, 9 aa, Homo Sapiens
SKDKCEKDF

SEQ ID NO: 99867 - protein, 9 aa, Homo Sapiens
AFRPWTIRQ

SEQ ID NO: 99868 - protein, 9 aa, Homo Sapiens
RGSVIAVVQ

SEQ ID NO: 99869 - protein, 9 aa, Homo Sapiens
PCWPTAPVP

SEQ ID NO: 99870 - protein, 9 aa, Homo Sapiens
LLTNLYYQR

SEQ ID NO: 99871 - protein, 9 aa, Homo Sapiens
ANGTVPCWP

SEQ ID NO: 99872 - protein, 9 aa, Homo Sapiens
NESDIEHED

SEQ ID NO: 99873 - protein, 9 aa, Homo Sapiens
LIEKGNCTF

SEQ ID NO: 99874 - protein, 9 aa, Homo Sapiens
SQKGVKELP

SEQ ID NO: 99875 - protein, 9 aa, Homo Sapiens
GGEAVGTGE

SEQ ID NO: 99876 - protein, 9 aa, Homo Sapiens
YNYFLFSLA

SEQ ID NO: 99877 - protein, 9 aa, Homo Sapiens
RPTLDAFRE

SEQ ID NO: 99878 - protein, 9 aa, Homo Sapiens
IAVVQMVNK

SEQ ID NO: 99879 - protein, 9 aa, Homo Sapiens
LLLWQVFGS

SEQ ID NO: 99880 - protein, 9 aa, Homo Sapiens
DSDRVQEVK

SEQ ID NO: 99881 - protein, 9 aa, Homo Sapiens
FTFVRDPLS

SEQ ID NO: 99882 - protein, 9 aa, Homo Sapiens
VNRHLQTVY

SEQ ID NO: 99883 - protein, 9 aa, Homo Sapiens
QEMEFPQTR

SEQ ID NO: 99884 - protein, 9 aa, Homo Sapiens
VTINTGVKK

SEQ ID NO: 99885 - protein, 9 aa, Homo Sapiens
HLDSSCKEA

SEQ ID NO: 99886 - protein, 9 aa, Homo Sapiens
SDIEHEDLK

SEQ ID NO: 99887 - protein, 9 aa, Homo Sapiens
QQRTPAAQQ

SEQ ID NO: 99888 - protein, 9 aa, Homo Sapiens
AHISMLAML

SEQ ID NO: 99889 - protein, 9 aa, Homo Sapiens
IEDIAANKM

SEQ ID NO: 99890 - protein, 9 aa, Homo Sapiens
PLLTNTSKD

SEQ ID NO: 99891 - protein, 9 aa, Homo Sapiens
KRIHAAQKP

SEQ ID NO: 99892 - protein, 9 aa, Homo Sapiens
PSLLDTETT

SEQ ID NO: 99893 - protein, 9 aa, Homo Sapiens
CPFSWRVFH

SEQ ID NO: 99894 - protein, 9 aa, Homo Sapiens
WLQVYTASV

SEQ ID NO: 99895 - protein, 9 aa, Homo Sapiens
RDFFLCHFF

SEQ ID NO: 99896 - protein, 9 aa, Homo Sapiens
SNAGNNGPC

SEQ ID NO: 99897 - protein, 9 aa, Homo Sapiens
IHIYEQVGT

SEQ ID NO: 99898 - protein, 9 aa, Homo Sapiens
TTFSVTINT

SEQ ID NO: 99899 - protein, 9 aa, Homo Sapiens
DRVQEVKQK

SEQ ID NO: 99900 - protein, 9 aa, Homo Sapiens
QSVNVGAPL

SEQ ID NO: 99901 - protein, 9 aa, Homo Sapiens
ESDIEHEDL

SEQ ID NO: 99902 - protein, 9 aa, Homo Sapiens
CGIEEETVK

SEQ ID NO: 99903 - protein, 9 aa, Homo Sapiens
PLSKEGDPL

SEQ ID NO: 99904 - protein, 9 aa, Homo Sapiens
MNGGAIALG

SEQ ID NO: 99905 - protein, 9 aa, Homo Sapiens
VNGKATSTQ

SEQ ID NO: 99906 - protein, 9 aa, Homo Sapiens
HLTKSLGVH

SEQ ID NO: 99907 - protein, 9 aa, Homo Sapiens
PGKKRGRQA

SEQ ID NO: 99908 - protein, 9 aa, Homo Sapiens
RPPIIVFEF

SEQ ID NO: 99909 - protein, 9 aa, Homo Sapiens
VDCSDLSQH

SEQ ID NO: 99910 - protein, 9 aa, Homo Sapiens
ADPTQMAGL

SEQ ID NO: 99911 - protein, 9 aa, Homo Sapiens
SASDIPVKS

SEQ ID NO: 99912 - protein, 9 aa, Homo Sapiens
AADEEQELS

SEQ ID NO: 99913 - protein, 9 aa, Homo Sapiens
SDFHLTKSL

SEQ ID NO: 99914 - protein, 9 aa, Homo Sapiens
MHTLPAAHM

SEQ ID NO: 99915 - protein, 9 aa, Homo Sapiens
SSVPETRGK

SEQ ID NO: 99916 - protein, 9 aa, Homo Sapiens
VYRVRLPSG

SEQ ID NO: 99917 - protein, 9 aa, Homo Sapiens
EDCDGSCST

SEQ ID NO: 99918 - protein, 9 aa, Homo Sapiens
LSSEVITVF

SEQ ID NO: 99919 - protein, 9 aa, Homo Sapiens
HPGLGGEAV

SEQ ID NO: 99920 - protein, 9 aa, Homo Sapiens
KHNIIYVSN

SEQ ID NO: 99921 - protein, 9 aa, Homo Sapiens
LGSTLGTSA

SEQ ID NO: 99922 - protein, 9 aa, Homo Sapiens
YRVRLPSGA

SEQ ID NO: 99923 - protein, 9 aa, Homo Sapiens
SFESDFHLT

SEQ ID NO: 99924 - protein, 9 aa, Homo Sapiens
IIIIIDIIE

SEQ ID NO: 99925 - protein, 9 aa, Homo Sapiens
LDVMEQMVE

SEQ ID NO: 99926 - protein, 9 aa, Homo Sapiens
EEMERQRRQ

SEQ ID NO: 99927 - protein, 9 aa, Homo Sapiens
HVEYLGEQI

SEQ ID NO: 99928 - protein, 9 aa, Homo Sapiens
VYQKALHLD

SEQ ID NO: 99929 - protein, 9 aa, Homo Sapiens
EFKCLWVER

SEQ ID NO: 99930 - protein, 9 aa, Homo Sapiens
DHEATGAAS

SEQ ID NO: 99931 - protein, 9 aa, Homo Sapiens
MDERRQERR

SEQ ID NO: 99932 - protein, 9 aa, Homo Sapiens
APLLTNTSK

SEQ ID NO: 99933 - protein, 9 aa, Homo Sapiens
DEEQELSTA

SEQ ID NO: 99934 - protein, 9 aa, Homo Sapiens
SGDSLPSFP

SEQ ID NO: 99935 - protein, 9 aa, Homo Sapiens
GTGKVTVEY

SEQ ID NO: 99936 - protein, 9 aa, Homo Sapiens
TANRQKKGK

SEQ ID NO: 99937 - protein, 9 aa, Homo Sapiens
ADGFAEMPH

SEQ ID NO: 99938 - protein, 9 aa, Homo Sapiens
EYKYCKLVM

SEQ ID NO: 99939 - protein, 9 aa, Homo Sapiens
SAAKQGQAL

SEQ ID NO: 99940 - protein, 9 aa, Homo Sapiens
MAAQPLRHG

SEQ ID NO: 99941 - protein, 9 aa, Homo Sapiens
GGQYFTFVR

SEQ ID NO: 99942 - protein, 9 aa, Homo Sapiens
DCDGSCSTV

SEQ ID NO: 99943 - protein, 9 aa, Homo Sapiens
VPLTHIGPR

SEQ ID NO: 99944 - protein, 9 aa, Homo Sapiens
HAELVRPRC

SEQ ID NO: 99945 - protein, 9 aa, Homo Sapiens
SRIYHQNHR

SEQ ID NO: 99946 - protein, 9 aa, Homo Sapiens
SSPSSLGPK

SEQ ID NO: 99947 - protein, 9 aa, Homo Sapiens
PWIALIEKG

SEQ ID NO: 99948 - protein, 9 aa, Homo Sapiens
CHFFFFFIN

SEQ ID NO: 99949 - protein, 9 aa, Homo Sapiens
KPAKSAPAP

SEQ ID NO: 99950 - protein, 9 aa, Homo Sapiens
GAAGKEGAA

SEQ ID NO: 99951 - protein, 9 aa, Homo Sapiens
ASRALGPRG

SEQ ID NO: 99952 - protein, 9 aa, Homo Sapiens
RKSRSPRRR

SEQ ID NO: 99953 - protein, 9 aa, Homo Sapiens
SPKKAAQPT

SEQ ID NO: 99954 - protein, 9 aa, Homo Sapiens
VLPVPLTHI

SEQ ID NO: 99955 - protein, 9 aa, Homo Sapiens
LEGGTYACQ

SEQ ID NO: 99956 - protein, 9 aa, Homo Sapiens
LRGNEFFCK

SEQ ID NO: 99957 - protein, 9 aa, Homo Sapiens
CKVDEDYIQ

SEQ ID NO: 99958 - protein, 9 aa, Homo Sapiens
KQAPPQPFP

SEQ ID NO: 99959 - protein, 9 aa, Homo Sapiens
NGTVPCWPT

SEQ ID NO: 99960 - protein, 9 aa, Homo Sapiens
LGQEKALQQ

SEQ ID NO: 99961 - protein, 9 aa, Homo Sapiens
DVGTGKVTV

SEQ ID NO: 99962 - protein, 9 aa, Homo Sapiens
ETRGKNKGS

SEQ ID NO: 99963 - protein, 9 aa, Homo Sapiens
INTGVKKNA

SEQ ID NO: 99964 - protein, 9 aa, Homo Sapiens
PFFCFPVFL

SEQ ID NO: 99965 - protein, 9 aa, Homo Sapiens
IGPTAVCLQ

SEQ ID NO: 99966 - protein, 9 aa, Homo Sapiens
LYRIPLSAQ

SEQ ID NO: 99967 - protein, 9 aa, Homo Sapiens
HLLLVDIKD

SEQ ID NO: 99968 - protein, 9 aa, Homo Sapiens
HGFKFGISE

SEQ ID NO: 99969 - protein, 9 aa, Homo Sapiens
VQEVKQKYL

SEQ ID NO: 99970 - protein, 9 aa, Homo Sapiens
MEFPQTRIL

SEQ ID NO: 99971 - protein, 9 aa, Homo Sapiens
HKINEGLEH

SEQ ID NO: 99972 - protein, 9 aa, Homo Sapiens
FFFFFINAL

SEQ ID NO: 99973 - protein, 9 aa, Homo Sapiens
MASAHISML

SEQ ID NO: 99974 - protein, 9 aa, Homo Sapiens
IDREQLTTR

SEQ ID NO: 99975 - protein, 9 aa, Homo Sapiens
EVTDMMRCL

SEQ ID NO: 99976 - protein, 9 aa, Homo Sapiens
FSVTINTGV

SEQ ID NO: 99977 - protein, 9 aa, Homo Sapiens
MNLNKQTTT

SEQ ID NO: 99978 - protein, 9 aa, Homo Sapiens
RQFSICRDK

SEQ ID NO: 99979 - protein, 9 aa, Homo Sapiens
SGVYPSQNK

SEQ ID NO: 99980 - protein, 9 aa, Homo Sapiens
IRDLNESYS

SEQ ID NO: 99981 - protein, 9 aa, Homo Sapiens
FDTLGGERG

SEQ ID NO: 99982 - protein, 9 aa, Homo Sapiens
SISGVYPSQ

SEQ ID NO: 99983 - protein, 9 aa, Homo Sapiens
LPAAHMVIT

SEQ ID NO: 99984 - protein, 9 aa, Homo Sapiens
KAIHIYEQV

SEQ ID NO: 99985 - protein, 9 aa, Homo Sapiens
WGETLKPDP

SEQ ID NO: 99986 - protein, 9 aa, Homo Sapiens
PPQRPQRDE

SEQ ID NO: 99987 - protein, 9 aa, Homo Sapiens
SHNEQVWDP

SEQ ID NO: 99988 - protein, 9 aa, Homo Sapiens
LPLRADGFA

SEQ ID NO: 99989 - protein, 9 aa, Homo Sapiens
DPQQNWASK

SEQ ID NO: 99990 - protein, 9 aa, Homo Sapiens
IRHNFSPYL

SEQ ID NO: 99991 - protein, 9 aa, Homo Sapiens
FSWRVFHFR

SEQ ID NO: 99992 - protein, 9 aa, Homo Sapiens
LSQHNGLDR

SEQ ID NO: 99993 - protein, 9 aa, Homo Sapiens
AASLCRAAA

SEQ ID NO: 99994 - protein, 9 aa, Homo Sapiens
CSVNGKATS

SEQ ID NO: 99995 - protein, 9 aa, Homo Sapiens
QFSICRDKN

SEQ ID NO: 99996 - protein, 9 aa, Homo Sapiens
RVRLPSGAA

SEQ ID NO: 99997 - protein, 9 aa, Homo Sapiens
DPDPGRLMC

SEQ ID NO: 99998 - protein, 9 aa, Homo Sapiens
VRLPSGAAV

SEQ ID NO: 99999 - protein, 9 aa, Homo Sapiens
RGPKGYSGE

SEQ ID NO: 100000 - protein, 9 aa, Homo Sapiens
CSSSKKQIL

SEQ ID NO: 100001 - protein, 9 aa, Homo Sapiens
RILKAMNLN

SEQ ID NO: 100002 - protein, 9 aa, Homo Sapiens
YRIPLSAQD

SEQ ID NO: 100003 - protein, 9 aa, Homo Sapiens
SISAAKQGQ

SEQ ID NO: 100004 - protein, 9 aa, Homo Sapiens
STTNPSSTL

SEQ ID NO: 100005 - protein, 9 aa, Homo Sapiens
QSGPVTRRR

SEQ ID NO: 100006 - protein, 9 aa, Homo Sapiens
AFREQAAAL

SEQ ID NO: 100007 - protein, 9 aa, Homo Sapiens
GAGVSAGGV

SEQ ID NO: 100008 - protein, 9 aa, Homo Sapiens
GTLYRGLSV

SEQ ID NO: 100009 - protein, 9 aa, Homo Sapiens
KKAAQPTVD

SEQ ID NO: 100010 - protein, 9 aa, Homo Sapiens
EQELSTATK

SEQ ID NO: 100011 - protein, 9 aa, Homo Sapiens
PELWIESNF

SEQ ID NO: 100012 - protein, 9 aa, Homo Sapiens
EDPLLLWQV

SEQ ID NO: 100013 - protein, 9 aa, Homo Sapiens
TQMAGLSML

SEQ ID NO: 100014 - protein, 9 aa, Homo Sapiens
QEDCDGSCS

SEQ ID NO: 100015 - protein, 9 aa, Homo Sapiens
KPDPQQNWA

SEQ ID NO: 100016 - protein, 9 aa, Homo Sapiens
TNLYYQRLA

SEQ ID NO: 100017 - protein, 9 aa, Homo Sapiens
LPQKFDTLG

SEQ ID NO: 100018 - protein, 9 aa, Homo Sapiens
TVNNESQRC

SEQ ID NO: 100019 - protein, 9 aa, Homo Sapiens
TTQRKDFIY

SEQ ID NO: 100020 - protein, 9 aa, Homo Sapiens
ECRNDKEML

SEQ ID NO: 100021 - protein, 9 aa, Homo Sapiens
RHGSRCATP

SEQ ID NO: 100022 - protein, 9 aa, Homo Sapiens
YAFRPWTIR

SEQ ID NO: 100023 - protein, 9 aa, Homo Sapiens
YIQLGTLYR

SEQ ID NO: 100024 - protein, 9 aa, Homo Sapiens
GHQSGPVTR

SEQ ID NO: 100025 - protein, 9 aa, Homo Sapiens
RPQRDERVR

SEQ ID NO: 100026 - protein, 9 aa, Homo Sapiens
YFPLTGLSV

SEQ ID NO: 100027 - protein, 9 aa, Homo Sapiens
RHVKDLYRI

SEQ ID NO: 100028 - protein, 9 aa, Homo Sapiens
VPSLLDTET

SEQ ID NO: 100029 - protein, 9 aa, Homo Sapiens
ADPAAAASL

SEQ ID NO: 100030 - protein, 9 aa, Homo Sapiens
RQERREQRE

SEQ ID NO: 100031 - protein, 9 aa, Homo Sapiens
CYTIHLLLV

SEQ ID NO: 100032 - protein, 9 aa, Homo Sapiens
VNNESQRCG

SEQ ID NO: 100033 - protein, 9 aa, Homo Sapiens
WYDAAERGF

SEQ ID NO: 100034 - protein, 9 aa, Homo Sapiens
AQPTVDLLG

SEQ ID NO: 100035 - protein, 9 aa, Homo Sapiens
KGNCTFSEK

SEQ ID NO: 100036 - protein, 9 aa, Homo Sapiens
LCHFFFFFI

SEQ ID NO: 100037 - protein, 9 aa, Homo Sapiens
SRGSHNEQV

SEQ ID NO: 100038 - protein, 9 aa, Homo Sapiens
MADPTQMAG

SEQ ID NO: 100039 - protein, 9 aa, Homo Sapiens
NLSDIDLME

SEQ ID NO: 100040 - protein, 9 aa, Homo Sapiens
HLHPADING

SEQ ID NO: 100041 - protein, 9 aa, Homo Sapiens
MQEDCDGSC

SEQ ID NO: 100042 - protein, 9 aa, Homo Sapiens
SRGSVIAVV

SEQ ID NO: 100043 - protein, 9 aa, Homo Sapiens
VFHFRPISC

SEQ ID NO: 100044 - protein, 9 aa, Homo Sapiens
QCLQEMEFP

SEQ ID NO: 100045 - protein, 9 aa, Homo Sapiens
YVLGNLADQ

SEQ ID NO: 100046 - protein, 9 aa, Homo Sapiens
NLYYQRLAL

SEQ ID NO: 100047 - protein, 9 aa, Homo Sapiens
QYFTFVRDP

SEQ ID NO: 100048 - protein, 9 aa, Homo Sapiens
LTNLYYQRL

SEQ ID NO: 100049 - protein, 9 aa, Homo Sapiens
EEPGAAGKE

SEQ ID NO: 100050 - protein, 9 aa, Homo Sapiens
HLQTVYNYF

SEQ ID NO: 100051 - protein, 9 aa, Homo Sapiens
TFQQFVYYL

SEQ ID NO: 100052 - protein, 9 aa, Homo Sapiens
FFCKVSSLQ

SEQ ID NO: 100053 - protein, 9 aa, Homo Sapiens
HDPDPGRLM

SEQ ID NO: 100054 - protein, 9 aa, Homo Sapiens
HAAQKPYKC

SEQ ID NO: 100055 - protein, 9 aa, Homo Sapiens
SFPLWSPEG

SEQ ID NO: 100056 - protein, 9 aa, Homo Sapiens
ITANRQKKG

SEQ ID NO: 100057 - protein, 9 aa, Homo Sapiens
AAQPLRHGS

SEQ ID NO: 100058 - protein, 9 aa, Homo Sapiens
DDDADGDDD

SEQ ID NO: 100059 - protein, 9 aa, Homo Sapiens
LRADGFAEM

SEQ ID NO: 100060 - protein, 9 aa, Homo Sapiens
EHEDLKLEL

SEQ ID NO: 100061 - protein, 9 aa, Homo Sapiens
DKLHFPFFC

SEQ ID NO: 100062 - protein, 9 aa, Homo Sapiens
FLEGGTYAC

SEQ ID NO: 100063 - protein, 9 aa, Homo Sapiens
NEFKCLWVE

SEQ ID NO: 100064 - protein, 9 aa, Homo Sapiens
VRPRCPACD

SEQ ID NO: 100065 - protein, 9 aa, Homo Sapiens
EMERQRRQD

SEQ ID NO: 100066 - protein, 9 aa, Homo Sapiens
MPKPAKSAP

SEQ ID NO: 100067 - protein, 9 aa, Homo Sapiens
MDLKGQMMY

SEQ ID NO: 100068 - protein, 9 aa, Homo Sapiens
VIAVVQMVN

SEQ ID NO: 100069 - protein, 9 aa, Homo Sapiens
SLCRAAAGG

SEQ ID NO: 100070 - protein, 9 aa, Homo Sapiens
DSLPSFPLW

SEQ ID NO: 100071 - protein, 9 aa, Homo Sapiens
TLGTTPITP

SEQ ID NO: 100072 - protein, 9 aa, Homo Sapiens
DPAAAASLC

SEQ ID NO: 100073 - protein, 9 aa, Homo Sapiens
AGKEGAAEG

SEQ ID NO: 100074 - protein, 9 aa, Homo Sapiens
PQISQFQSL

SEQ ID NO: 100075 - protein, 9 aa, Homo Sapiens
GPRGQAGSR

SEQ ID NO: 100076 - protein, 9 aa, Homo Sapiens
AVRDMNGKS

SEQ ID NO: 100077 - protein, 9 aa, Homo Sapiens
LRHGSRCAT

SEQ ID NO: 100078 - protein, 9 aa, Homo Sapiens
TLGGERGAQ

SEQ ID NO: 100079 - protein, 9 aa, Homo Sapiens
HTLPAAHMV

SEQ ID NO: 100080 - protein, 9 aa, Homo Sapiens
DLSRSEKDK

SEQ ID NO: 100081 - protein, 9 aa, Homo Sapiens
VGAPLITST

SEQ ID NO: 100082 - protein, 9 aa, Homo Sapiens
HYGQCSSSK

SEQ ID NO: 100083 - protein, 9 aa, Homo Sapiens
NEQVWDPQC

SEQ ID NO: 100084 - protein, 9 aa, Homo Sapiens
ICKQSQHMT

SEQ ID NO: 100085 - protein, 9 aa, Homo Sapiens
DRIAAQVAA

SEQ ID NO: 100086 - protein, 9 aa, Homo Sapiens
EDAFVRCVY

SEQ ID NO: 100087 - protein, 9 aa, Homo Sapiens
GGTYACQGD

SEQ ID NO: 100088 - protein, 9 aa, Homo Sapiens
KIEDIAANK

SEQ ID NO: 100089 - protein, 9 aa, Homo Sapiens
LLKSHLVHP

SEQ ID NO: 100090 - protein, 9 aa, Homo Sapiens
LYMLYLTAE

SEQ ID NO: 100091 - protein, 9 aa, Homo Sapiens
SPRRCHHDH

SEQ ID NO: 100092 - protein, 9 aa, Homo Sapiens
HRVAELILH

SEQ ID NO: 100093 - protein, 9 aa, Homo Sapiens
AKTEKFEAD

SEQ ID NO: 100094 - protein, 9 aa, Homo Sapiens
GPVTRRRAV

SEQ ID NO: 100095 - protein, 9 aa, Homo Sapiens
GQMMYIVES

SEQ ID NO: 100096 - protein, 9 aa, Homo Sapiens
HLVHPHPAV

SEQ ID NO: 100097 - protein, 9 aa, Homo Sapiens
HYKNMIPEQ

SEQ ID NO: 100098 - protein, 9 aa, Homo Sapiens
RCHHDHEAT

SEQ ID NO: 100099 - protein, 9 aa, Homo Sapiens
SHRPTLDAF

SEQ ID NO: 100100 - protein, 9 aa, Homo Sapiens
PAAHMVITD

SEQ ID NO: 100101 - protein, 9 aa, Homo Sapiens
GYSGEQGPP

SEQ ID NO: 100102 - protein, 9 aa, Homo Sapiens
WIESNFPQA

SEQ ID NO: 100103 - protein, 9 aa, Homo Sapiens
FHFRPISCE

SEQ ID NO: 100104 - protein, 9 aa, Homo Sapiens
QHKRIHTAE

SEQ ID NO: 100105 - protein, 9 aa, Homo Sapiens
HDHEATGAA

SEQ ID NO: 100106 - protein, 9 aa, Homo Sapiens
FEFRNEIYD

SEQ ID NO: 100107 - protein, 9 aa, Homo Sapiens
DTVHYGQCS

SEQ ID NO: 100108 - protein, 9 aa, Homo Sapiens
GGYFPLTGL

SEQ ID NO: 100109 - protein, 9 aa, Homo Sapiens
NPYKWLQVY

SEQ ID NO: 100110 - protein, 9 aa, Homo Sapiens
KGYSGEQGP

SEQ ID NO: 100111 - protein, 9 aa, Homo Sapiens
VRCVYVLGN

SEQ ID NO: 100112 - protein, 9 aa, Homo Sapiens
LTSQYVELI

SEQ ID NO: 100113 - protein, 9 aa, Homo Sapiens
GGLGTNASL

SEQ ID NO: 100114 - protein, 9 aa, Homo Sapiens
EKDKLHDEA

SEQ ID NO: 100115 - protein, 9 aa, Homo Sapiens
KKDLFIEAH

SEQ ID NO: 100116 - protein, 9 aa, Homo Sapiens
LFIEAHLMS

SEQ ID NO: 100117 - protein, 9 aa, Homo Sapiens
DERRQERRE

SEQ ID NO: 100118 - protein, 9 aa, Homo Sapiens
PWYDAAERG

SEQ ID NO: 100119 - protein, 9 aa, Homo Sapiens
SKYITTIAK

SEQ ID NO: 100120 - protein, 9 aa, Homo Sapiens
AQKPYKCEE

SEQ ID NO: 100121 - protein, 9 aa, Homo Sapiens
QRPQRDERV

SEQ ID NO: 100122 - protein, 9 aa, Homo Sapiens
NAGNNGPCL

SEQ ID NO: 100123 - protein, 9 aa, Homo Sapiens
LDISKTNMN

SEQ ID NO: 100124 - protein, 9 aa, Homo Sapiens
KEMLTTNAK

SEQ ID NO: 100125 - protein, 9 aa, Homo Sapiens
RLPSGAAVA

SEQ ID NO: 100126 - protein, 9 aa, Homo Sapiens
HIQCLQEME

SEQ ID NO: 100127 - protein, 9 aa, Homo Sapiens
SLPSFPLWS

SEQ ID NO: 100128 - protein, 9 aa, Homo Sapiens
LGPKLDKGK

SEQ ID NO: 100129 - protein, 9 aa, Homo Sapiens
RVFHFRPIS

SEQ ID NO: 100130 - protein, 9 aa, Homo Sapiens
EILDSDRVQ

SEQ ID NO: 100131 - protein, 9 aa, Homo Sapiens
QMMYIVESS

SEQ ID NO: 100132 - protein, 9 aa, Homo Sapiens
QEKALQQIL

SEQ ID NO: 100133 - protein, 9 aa, Homo Sapiens
SVTINTGVK

SEQ ID NO: 100134 - protein, 9 aa, Homo Sapiens
SYSFESDFH

SEQ ID NO: 100135 - protein, 9 aa, Homo Sapiens
IHLLLVDIK

SEQ ID NO: 100136 - protein, 9 aa, Homo Sapiens
TSKDKCEKD

SEQ ID NO: 100137 - protein, 9 aa, Homo Sapiens
QKGVKELPL

SEQ ID NO: 100138 - protein, 9 aa, Homo Sapiens
ESYSEMEAA

SEQ ID NO: 100139 - protein, 9 aa, Homo Sapiens
HFFFFFINA

SEQ ID NO: 100140 - protein, 9 aa, Homo Sapiens
TVAVQSVNV

SEQ ID NO: 100141 - protein, 9 aa, Homo Sapiens
NKQTTTING

SEQ ID NO: 100142 - protein, 9 aa, Homo Sapiens
EIRDLNESY

SEQ ID NO: 100143 - protein, 9 aa, Homo Sapiens
PVPLTHIGP

SEQ ID NO: 100144 - protein, 9 aa, Homo Sapiens
AAHMVITDL

SEQ ID NO: 100145 - protein, 9 aa, Homo Sapiens
AASRALGPR

SEQ ID NO: 100146 - protein, 9 aa, Homo Sapiens
IIDIIEKTE

SEQ ID NO: 100147 - protein, 9 aa, Homo Sapiens
RERTVNNES

SEQ ID NO: 100148 - protein, 9 aa, Homo Sapiens
NHRADKRRA

SEQ ID NO: 100149 - protein, 9 aa, Homo Sapiens
QPTVDLLGL

SEQ ID NO: 100150 - protein, 9 aa, Homo Sapiens
DCSRGSHNE

SEQ ID NO: 100151 - protein, 9 aa, Homo Sapiens
EMLTTNAKT

SEQ ID NO: 100152 - protein, 9 aa, Homo Sapiens
AVYRVRLPS

SEQ ID NO: 100153 - protein, 9 aa, Homo Sapiens
SSTLGTTPI

SEQ ID NO: 100154 - protein, 9 aa, Homo Sapiens
DLSQHNGLD

SEQ ID NO: 100155 - protein, 9 aa, Homo Sapiens
MLEEGEAII

SEQ ID NO: 100156 - protein, 9 aa, Homo Sapiens
FQQFVYYLT

SEQ ID NO: 100157 - protein, 9 aa, Homo Sapiens
REEDPLLLW

SEQ ID NO: 100158 - protein, 9 aa, Homo Sapiens
EQVWDPQCA

SEQ ID NO: 100159 - protein, 9 aa, Homo Sapiens
LTHELPGKK

SEQ ID NO: 100160 - protein, 9 aa, Homo Sapiens
VKQQLIEKL

SEQ ID NO: 100161 - protein, 9 aa, Homo Sapiens
ATHLHPADI

SEQ ID NO: 100162 - protein, 9 aa, Homo Sapiens
IVSRGSVIA

SEQ ID NO: 100163 - protein, 9 aa, Homo Sapiens
EEEPGAAGK

SEQ ID NO: 100164 - protein, 9 aa, Homo Sapiens
AMAICKQSQ

SEQ ID NO: 100165 - protein, 9 aa, Homo Sapiens
YVVRATHLH

SEQ ID NO: 100166 - protein, 9 aa, Homo Sapiens
LDAFREQAA

SEQ ID NO: 100167 - protein, 9 aa, Homo Sapiens
YPTMYAFRP

SEQ ID NO: 100168 - protein, 9 aa, Homo Sapiens
DVDCYTIHL

SEQ ID NO: 100169 - protein, 9 aa, Homo Sapiens
FFCKVDEDY

SEQ ID NO: 100170 - protein, 9 aa, Homo Sapiens
SSVTEPVIV

SEQ ID NO: 100171 - protein, 9 aa, Homo Sapiens
NHLEDKIKI

SEQ ID NO: 100172 - protein, 9 aa, Homo Sapiens
FCKVSSLQP

SEQ ID NO: 100173 - protein, 9 aa, Homo Sapiens
RMDERRQER

SEQ ID NO: 100174 - protein, 9 aa, Homo Sapiens
LSLSWEEMF

SEQ ID NO: 100175 - protein, 9 aa, Homo Sapiens
MAVVMGQGH

SEQ ID NO: 100176 - protein, 9 aa, Homo Sapiens
LTGLSVPAA

SEQ ID NO: 100177 - protein, 9 aa, Homo Sapiens
PIIVFEFRN

SEQ ID NO: 100178 - protein, 9 aa, Homo Sapiens
PQRPQRDER

SEQ ID NO: 100179 - protein, 9 aa, Homo Sapiens
ELPGKKRGR

SEQ ID NO: 100180 - protein, 9 aa, Homo Sapiens
EDKIKIIEK

SEQ ID NO: 100181 - protein, 9 aa, Homo Sapiens
RLQLALHVE

SEQ ID NO: 100182 - protein, 9 aa, Homo Sapiens
RIAAQVAAA

SEQ ID NO: 100183 - protein, 9 aa, Homo Sapiens
TSPKKAAQP

SEQ ID NO: 100184 - protein, 9 aa, Homo Sapiens
TEIRQYKQA

SEQ ID NO: 100185 - protein, 9 aa, Homo Sapiens
IHSPQISQF

SEQ ID NO: 100186 - protein, 9 aa, Homo Sapiens
SDIPVKSHR

SEQ ID NO: 100187 - protein, 9 aa, Homo Sapiens
EKALQQILE

SEQ ID NO: 100188 - protein, 9 aa, Homo Sapiens
SRPPIIVFE

SEQ ID NO: 100189 - protein, 9 aa, Homo Sapiens
LPSFPLWSP

SEQ ID NO: 100190 - protein, 9 aa, Homo Sapiens
HRADKRRAQ

SEQ ID NO: 100191 - protein, 9 aa, Homo Sapiens
FAEMPHSPA

SEQ ID NO: 100192 - protein, 9 aa, Homo Sapiens
AQSIGPTAV

SEQ ID NO: 100193 - protein, 9 aa, Homo Sapiens
LPVPLTHIG

SEQ ID NO: 100194 - protein, 9 aa, Homo Sapiens
TLKPDPQQN

SEQ ID NO: 100195 - protein, 9 aa, Homo Sapiens
KYITTIAKS

SEQ ID NO: 100196 - protein, 9 aa, Homo Sapiens
ELWIESNFP

SEQ ID NO: 100197 - protein, 9 aa, Homo Sapiens
DFHLTKSLG

SEQ ID NO: 100198 - protein, 9 aa, Homo Sapiens
KDLYRIPLS

SEQ ID NO: 100199 - protein, 9 aa, Homo Sapiens
ESSVTEPVI

SEQ ID NO: 100200 - protein, 9 aa, Homo Sapiens
DCSDLSQHN

SEQ ID NO: 100201 - protein, 9 aa, Homo Sapiens
RQYKQAPPQ

SEQ ID NO: 100202 - protein, 9 aa, Homo Sapiens
YKQAPPQPF

SEQ ID NO: 100203 - protein, 9 aa, Homo Sapiens
NVGAPLITS

SEQ ID NO: 100204 - protein, 9 aa, Homo Sapiens
THYKNMIPE

SEQ ID NO: 100205 - protein, 9 aa, Homo Sapiens
SWRVFHFRP

SEQ ID NO: 100206 - protein, 9 aa, Homo Sapiens
TVYNYFLFS

SEQ ID NO: 100207 - protein, 9 aa, Homo Sapiens
GMADPTQMA

SEQ ID NO: 100208 - protein, 9 aa, Homo Sapiens
TINTGVKKN

SEQ ID NO: 100209 - protein, 9 aa, Homo Sapiens
RALGPRGQA

SEQ ID NO: 100210 - protein, 9 aa, Homo Sapiens
ERVREQRIN

SEQ ID NO: 100211 - protein, 9 aa, Homo Sapiens
GDSLPSFPL

SEQ ID NO: 100212 - protein, 9 aa, Homo Sapiens
HFPFFCFPV

SEQ ID NO: 100213 - protein, 9 aa, Homo Sapiens
GPKLDKGKI

SEQ ID NO: 100214 - protein, 9 aa, Homo Sapiens
ASAHISMLA

SEQ ID NO: 100215 - protein, 9 aa, Homo Sapiens
FIEAHLMSP

SEQ ID NO: 100216 - protein, 9 aa, Homo Sapiens
RRGPKGYSG

SEQ ID NO: 100217 - protein, 9 aa, Homo Sapiens
GSGDSLPSF

SEQ ID NO: 100218 - protein, 9 aa, Homo Sapiens
PTMYAFRPW

SEQ ID NO: 100219 - protein, 9 aa, Homo Sapiens
IEAHLMSPL

SEQ ID NO: 100220 - protein, 9 aa, Homo Sapiens
RCSVNGKAT

SEQ ID NO: 100221 - protein, 9 aa, Homo Sapiens
SQHNGLDRE

SEQ ID NO: 100222 - protein, 9 aa, Homo Sapiens
ETLKPDPQQ

SEQ ID NO: 100223 - protein, 9 aa, Homo Sapiens
GPYPTMYAF

SEQ ID NO: 100224 - protein, 9 aa, Homo Sapiens
EITANRQKK

SEQ ID NO: 100225 - protein, 9 aa, Homo Sapiens
AQPLRHGSR

SEQ ID NO: 100226 - protein, 9 aa, Homo Sapiens
GVSAGGVGA

SEQ ID NO: 100227 - protein, 9 aa, Homo Sapiens
SVNVGAPLI

SEQ ID NO: 100228 - protein, 9 aa, Homo Sapiens
GSHNEQVWD

SEQ ID NO: 100229 - protein, 9 aa, Homo Sapiens
LGGEAVGTG

SEQ ID NO: 100230 - protein, 9 aa, Homo Sapiens
TSRPPIIVF

SEQ ID NO: 100231 - protein, 9 aa, Homo Sapiens
YGQCSSSKK

SEQ ID NO: 100232 - protein, 9 aa, Homo Sapiens
PDPGRLMCQ

SEQ ID NO: 100233 - protein, 9 aa, Homo Sapiens
SLLDTETTE

SEQ ID NO: 100234 - protein, 9 aa, Homo Sapiens
DGFAEMPHS

SEQ ID NO: 100235 - protein, 9 aa, Homo Sapiens
CSRGSHNEQ

SEQ ID NO: 100236 - protein, 9 aa, Homo Sapiens
YSEMEAAMV

SEQ ID NO: 100237 - protein, 9 aa, Homo Sapiens
RSEKDKLHD

SEQ ID NO: 100238 - protein, 9 aa, Homo Sapiens
QYVELIDRE

SEQ ID NO: 100239 - protein, 9 aa, Homo Sapiens
ISAAKQGQA

SEQ ID NO: 100240 - protein, 9 aa, Homo Sapiens
NWGETLKPD

SEQ ID NO: 100241 - protein, 9 aa, Homo Sapiens
SQNKPWHQT

SEQ ID NO: 100242 - protein, 9 aa, Homo Sapiens
KELPLNIQV

SEQ ID NO: 100243 - protein, 9 aa, Homo Sapiens
QNKPWHQTT

SEQ ID NO: 100244 - protein, 9 aa, Homo Sapiens
ELPLNIQVD

SEQ ID NO: 100245 - protein, 9 aa, Homo Sapiens
SSASDIPVK

SEQ ID NO: 100246 - protein, 9 aa, Homo Sapiens
TMYAFRPWT

SEQ ID NO: 100247 - protein, 9 aa, Homo Sapiens
IDLMEPQPG

SEQ ID NO: 100248 - protein, 9 aa, Homo Sapiens
QAWKIEDIA

SEQ ID NO: 100249 - protein, 9 aa, Homo Sapiens
SPRRKSRSP

SEQ ID NO: 100250 - protein, 9 aa, Homo Sapiens
KNKGSAALG

SEQ ID NO: 100251 - protein, 9 aa, Homo Sapiens
RRSRSPRRK

SEQ ID NO: 100252 - protein, 9 aa, Homo Sapiens
TPQEHPGLG

SEQ ID NO: 100253 - protein, 9 aa, Homo Sapiens
AEMPHSPAQ

SEQ ID NO: 100254 - protein, 9 aa, Homo Sapiens
LQECRNDKE

SEQ ID NO: 100255 - protein, 9 aa, Homo Sapiens
SGAAVALKA

SEQ ID NO: 100256 - protein, 9 aa, Homo Sapiens
RAQTCGIEE

SEQ ID NO: 100257 - protein, 9 aa, Homo Sapiens
FPLTGLSVP

SEQ ID NO: 100258 - protein, 9 aa, Homo Sapiens
QYQKAIHIY

SEQ ID NO: 100259 - protein, 9 aa, Homo Sapiens
RRCHHDHEA

SEQ ID NO: 100260 - protein, 9 aa, Homo Sapiens
KALQQILEY

SEQ ID NO: 100261 - protein, 9 aa, Homo Sapiens
LSASGLNAA

SEQ ID NO: 100262 - protein, 9 aa, Homo Sapiens
VTHYKNMIP

SEQ ID NO: 100263 - protein, 9 aa, Homo Sapiens
PQRDERVRE

SEQ ID NO: 100264 - protein, 9 aa, Homo Sapiens
NILQTTQRK

SEQ ID NO: 100265 - protein, 9 aa, Homo Sapiens
SSGPSFETL

SEQ ID NO: 100266 - protein, 9 aa, Homo Sapiens
SIPVSAHGF

SEQ ID NO: 100267 - protein, 9 aa, Homo Sapiens
PSSLGPKLD

SEQ ID NO: 100268 - protein, 9 aa, Homo Sapiens
IIIDIIEKT

SEQ ID NO: 100269 - protein, 9 aa, Homo Sapiens
PLRADGFAE

SEQ ID NO: 100270 - protein, 9 aa, Homo Sapiens
ESNFPQAPW

SEQ ID NO: 100271 - protein, 9 aa, Homo Sapiens
PKKAAQPTV

SEQ ID NO: 100272 - protein, 9 aa, Homo Sapiens
QTVYNYFLF

SEQ ID NO: 100273 - protein, 9 aa, Homo Sapiens
KPWYDAAER

SEQ ID NO: 100274 - protein, 9 aa, Homo Sapiens
RQDEKRKAE

SEQ ID NO: 100275 - protein, 9 aa, Homo Sapiens
QRDERVREQ

SEQ ID NO: 100276 - protein, 9 aa, Homo Sapiens
ELVRPRCPA

SEQ ID NO: 100277 - protein, 9 aa, Homo Sapiens
NMIPEQDLQ

SEQ ID NO: 100278 - protein, 9 aa, Homo Sapiens
IALIEKGNC

SEQ ID NO: 100279 - protein, 9 aa, Homo Sapiens
QKAIHIYEQ

SEQ ID NO: 100280 - protein, 9 aa, Homo Sapiens
MDVYQKALH

SEQ ID NO: 100281 - protein, 9 aa, Homo Sapiens
SKTNMNGGA

SEQ ID NO: 100282 - protein, 9 aa, Homo Sapiens
IVFEFRNEI

SEQ ID NO: 100283 - protein, 9 aa, Homo Sapiens
LLDTETTEK

SEQ ID NO: 100284 - protein, 9 aa, Homo Sapiens
AAKQGQALA

SEQ ID NO: 100285 - protein, 9 aa, Homo Sapiens
ERQRRQDEK

SEQ ID NO: 100286 - protein, 9 aa, Homo Sapiens
GLGGEAVGT

SEQ ID NO: 100287 - protein, 9 aa, Homo Sapiens
VYVLGNLAD

SEQ ID NO: 100288 - protein, 9 aa, Homo Sapiens
VMDLKGQMM

SEQ ID NO: 100289 - protein, 9 aa, Homo Sapiens
DIAANKMSI

SEQ ID NO: 100290 - protein, 9 aa, Homo Sapiens
LGTTPITPV

SEQ ID NO: 100291 - protein, 9 aa, Homo Sapiens
FSQAADEEQ

SEQ ID NO: 100292 - protein, 9 aa, Homo Sapiens
QISQFQSLT

SEQ ID NO: 100293 - protein, 9 aa, Homo Sapiens
KSHLVHPHP

SEQ ID NO: 100294 - protein, 9 aa, Homo Sapiens
LQLALHVEY

SEQ ID NO: 100295 - protein, 9 aa, Homo Sapiens
QKALHLDSS

SEQ ID NO: 100296 - protein, 9 aa, Homo Sapiens
QQSQGLASG

SEQ ID NO: 100297 - protein, 9 aa, Homo Sapiens
SPYLYMLYL

SEQ ID NO: 100298 - protein, 9 aa, Homo Sapiens
PADAKDAVR

SEQ ID NO: 100299 - protein, 9 aa, Homo Sapiens
PYPTMYAFR

SEQ ID NO: 100300 - protein, 9 aa, Homo Sapiens
YKYCKLVMN

SEQ ID NO: 100301 - protein, 9 aa, Homo Sapiens
VTEPVIVGL

SEQ ID NO: 100302 - protein, 9 aa, Homo Sapiens
KCLWVERTS

SEQ ID NO: 100303 - protein, 9 aa, Homo Sapiens
KGQMMYIVE

SEQ ID NO: 100304 - protein, 9 aa, Homo Sapiens
NEFFCKVSS

SEQ ID NO: 100305 - protein, 9 aa, Homo Sapiens
RGQAGSRGL

SEQ ID NO: 100306 - protein, 9 aa, Homo Sapiens
NNESQRCGF

SEQ ID NO: 100307 - protein, 9 aa, Homo Sapiens
SAHISMLAM

SEQ ID NO: 100308 - protein, 9 aa, Homo Sapiens
ADDDADGDD

SEQ ID NO: 100309 - protein, 9 aa, Homo Sapiens
FDPLSKEGD

SEQ ID NO: 100310 - protein, 9 aa, Homo Sapiens
FSIPVSAHG

SEQ ID NO: 100311 - protein, 9 aa, Homo Sapiens
QEHPGLGGE

SEQ ID NO: 100312 - protein, 9 aa, Homo Sapiens
NREEDPLLL

SEQ ID NO: 100313 - protein, 9 aa, Homo Sapiens
TYACQGDSG

SEQ ID NO: 100314 - protein, 9 aa, Homo Sapiens
SDNESDIEH

SEQ ID NO: 100315 - protein, 9 aa, Homo Sapiens
DVYQKALHL

SEQ ID NO: 100316 - protein, 9 aa, Homo Sapiens
LPGKKRGRQ

SEQ ID NO: 100317 - protein, 9 aa, Homo Sapiens
PGLGGEAVG

SEQ ID NO: 100318 - protein, 9 aa, Homo Sapiens
STVKQQLIE

SEQ ID NO: 100319 - protein, 9 aa, Homo Sapiens
LLTNTSKDK

SEQ ID NO: 100320 - protein, 9 aa, Homo Sapiens
GFLEGGTYA

SEQ ID NO: 100321 - protein, 9 aa, Homo Sapiens
ALHVEYLGE

SEQ ID NO: 100322 - protein, 9 aa, Homo Sapiens
MIPEQDLQL

SEQ ID NO: 100323 - protein, 9 aa, Homo Sapiens
SFETLSASG

SEQ ID NO: 100324 - protein, 9 aa, Homo Sapiens
IRQYKQAPP

SEQ ID NO: 100325 - protein, 9 aa, Homo Sapiens
GFSIPVSAH

SEQ ID NO: 100326 - protein, 9 aa, Homo Sapiens
NESYSEMEA

SEQ ID NO: 100327 - protein, 9 aa, Homo Sapiens
VKEEEPGAA

SEQ ID NO: 100328 - protein, 9 aa, Homo Sapiens
EKPWYDAAE

SEQ ID NO: 100329 - protein, 9 aa, Homo Sapiens
RVRAMAICK

SEQ ID NO: 100330 - protein, 9 aa, Homo Sapiens
RGSHNEQVW

SEQ ID NO: 100331 - protein, 9 aa, Homo Sapiens
GYKRAQTCG

SEQ ID NO: 100332 - protein, 9 aa, Homo Sapiens
LKAMNLNKQ

SEQ ID NO: 100333 - protein, 9 aa, Homo Sapiens
VKELPLNIQ

SEQ ID NO: 100334 - protein, 9 aa, Homo Sapiens
DNESDIEHE

SEQ ID NO: 100335 - protein, 9 aa, Homo Sapiens
GKATSTQVL

SEQ ID NO: 100336 - protein, 9 aa, Homo Sapiens
SRSPRRKSR

SEQ ID NO: 100337 - protein, 9 aa, Homo Sapiens
EKESSVTEP

SEQ ID NO: 100338 - protein, 9 aa, Homo Sapiens
SRALGPRGQ

SEQ ID NO: 100339 - protein, 9 aa, Homo Sapiens
IPEQDLQLE

SEQ ID NO: 100340 - protein, 9 aa, Homo Sapiens
VAQSIGPTA

SEQ ID NO: 100341 - protein, 9 aa, Homo Sapiens
QFVYYLTKT

SEQ ID NO: 100342 - protein, 9 aa, Homo Sapiens
VTRRRAVSQ

SEQ ID NO: 100343 - protein, 9 aa, Homo Sapiens
ILQTTQRKD

SEQ ID NO: 100344 - protein, 9 aa, Homo Sapiens
DIEHEDLKL

SEQ ID NO: 100345 - protein, 9 aa, Homo Sapiens
DVMEQMVEK

SEQ ID NO: 100346 - protein, 9 aa, Homo Sapiens
HMVITDLSA

SEQ ID NO: 100347 - protein, 9 aa, Homo Sapiens
LTPGKKMKI

SEQ ID NO: 100348 - protein, 9 aa, Homo Sapiens
NASLGSTLG

SEQ ID NO: 100349 - protein, 9 aa, Homo Sapiens
RADGFAEMP

SEQ ID NO: 100350 - protein, 9 aa, Homo Sapiens
KWLQVYTAS

SEQ ID NO: 100351 - protein, 9 aa, Homo Sapiens
IMCTFQQFV

SEQ ID NO: 100352 - protein, 9 aa, Homo Sapiens
ANDPIFFLH

SEQ ID NO: 100353 - protein, 9 aa, Homo Sapiens
EVTFLSLSL

SEQ ID NO: 100354 - protein, 9 aa, Homo Sapiens
KHLQECRND

SEQ ID NO: 100355 - protein, 9 aa, Homo Sapiens
KGDADDDAD

SEQ ID NO: 100356 - protein, 9 aa, Homo Sapiens
FKCLWVERT

SEQ ID NO: 100357 - protein, 9 aa, Homo Sapiens
SDIDLMEPQ

SEQ ID NO: 100358 - protein, 9 aa, Homo Sapiens
LEYKYCKLV

SEQ ID NO: 100359 - protein, 9 aa, Homo Sapiens
PFSWRVFHF

SEQ ID NO: 100360 - protein, 9 aa, Homo Sapiens
DISKTNMNG

SEQ ID NO: 100361 - protein, 9 aa, Homo Sapiens
RKDFIYNRS

SEQ ID NO: 100362 - protein, 9 aa, Homo Sapiens
TLYRGLSVV

SEQ ID NO: 100363 - protein, 9 aa, Homo Sapiens
AHKINEGLE

SEQ ID NO: 100364 - protein, 9 aa, Homo Sapiens
GKKRGRQAE

SEQ ID NO: 100365 - protein, 9 aa, Homo Sapiens
YEVTDMMRC

SEQ ID NO: 100366 - protein, 9 aa, Homo Sapiens
MGQGHRVAE

SEQ ID NO: 100367 - protein, 9 aa, Homo Sapiens
LVPSLLDTE

SEQ ID NO: 100368 - protein, 9 aa, Homo Sapiens
KAMNLNKQT

SEQ ID NO: 100369 - protein, 9 aa, Homo Sapiens
LEKESSVTE

SEQ ID NO: 100370 - protein, 9 aa, Homo Sapiens
QNILQTTQR

SEQ ID NO: 100371 - protein, 9 aa, Homo Sapiens
IPVKSHRTS

SEQ ID NO: 100372 - protein, 9 aa, Homo Sapiens
LLLTNLYYQ

SEQ ID NO: 100373 - protein, 9 aa, Homo Sapiens
SYSEMEAAM

SEQ ID NO: 100374 - protein, 9 aa, Homo Sapiens
SAHGFKFGI

SEQ ID NO: 100375 - protein, 9 aa, Homo Sapiens
RHLQTVYNY

SEQ ID NO: 100376 - protein, 9 aa, Homo Sapiens
VGTGKVTVE

SEQ ID NO: 100377 - protein, 9 aa, Homo Sapiens
FPFFCFPVF

SEQ ID NO: 100378 - protein, 9 aa, Homo Sapiens
WIALIEKGN

SEQ ID NO: 100379 - protein, 9 aa, Homo Sapiens
KVDEDYIQD

SEQ ID NO: 100380 - protein, 9 aa, Homo Sapiens
MLTTNAKTE

SEQ ID NO: 100381 - protein, 9 aa, Homo Sapiens
PQEHPGLGG

SEQ ID NO: 100382 - protein, 9 aa, Homo Sapiens
VITVFQYYS

SEQ ID NO: 100383 - protein, 9 aa, Homo Sapiens
SICRDKNDR

SEQ ID NO: 100384 - protein, 9 aa, Homo Sapiens
LGAGAGAGV

SEQ ID NO: 100385 - protein, 9 aa, Homo Sapiens
KDKENEFKC

SEQ ID NO: 100386 - protein, 9 aa, Homo Sapiens
HNFSPYLYM

SEQ ID NO: 100387 - protein, 9 aa, Homo Sapiens
DADDDADGD

SEQ ID NO: 100388 - protein, 9 aa, Homo Sapiens
DAFVRCVYV

SEQ ID NO: 100389 - protein, 9 aa, Homo Sapiens
QRRQDEKRK

SEQ ID NO: 100390 - protein, 9 aa, Homo Sapiens
LCRAAAGGQ

SEQ ID NO: 100391 - protein, 9 aa, Homo Sapiens
NRQKKGKQE

SEQ ID NO: 100392 - protein, 9 aa, Homo Sapiens
GPTAVCLQL

SEQ ID NO: 100393 - protein, 9 aa, Homo Sapiens
PLLLWQVFG

SEQ ID NO: 100394 - protein, 9 aa, Homo Sapiens
EGGTYACQG

SEQ ID NO: 100395 - protein, 9 aa, Homo Sapiens
STLGTTPIT

SEQ ID NO: 100396 - protein, 9 aa, Homo Sapiens
AVARMQEDC

SEQ ID NO: 100397 - protein, 9 aa, Homo Sapiens
NQKLEYKYC

SEQ ID NO: 100398 - protein, 9 aa, Homo Sapiens
CDGSCSTVG

SEQ ID NO: 100399 - protein, 9 aa, Homo Sapiens
PTAVCLQLT

SEQ ID NO: 100400 - protein, 9 aa, Homo Sapiens
HLEDKIKII

SEQ ID NO: 100401 - protein, 9 aa, Homo Sapiens
YQKAIHIYE

SEQ ID NO: 100402 - protein, 9 aa, Homo Sapiens
VSRGSVIAV

SEQ ID NO: 100403 - protein, 9 aa, Homo Sapiens
LDRIAAQVA

SEQ ID NO: 100404 - protein, 9 aa, Homo Sapiens
KAAQPTVDL

SEQ ID NO: 100405 - protein, 9 aa, Homo Sapiens
KKRGRQAEE

SEQ ID NO: 100406 - protein, 9 aa, Homo Sapiens
MYIVESSAI

SEQ ID NO: 100407 - protein, 9 aa, Homo Sapiens
SLSSEVITV

SEQ ID NO: 100408 - protein, 9 aa, Homo Sapiens
GSVIAVVQM

SEQ ID NO: 100409 - protein, 9 aa, Homo Sapiens
ISGVYPSQN

SEQ ID NO: 100410 - protein, 9 aa, Homo Sapiens
AHLMSPLDR

SEQ ID NO: 100411 - protein, 9 aa, Homo Sapiens
VRAMAICKQ

SEQ ID NO: 100412 - protein, 9 aa, Homo Sapiens
LHFPFFCFP

SEQ ID NO: 100413 - protein, 9 aa, Homo Sapiens
SVNGKATST

SEQ ID NO: 100414 - protein, 9 aa, Homo Sapiens
SLGPKLDKG

SEQ ID NO: 100415 - protein, 9 aa, Homo Sapiens
SDRVQEVKQ

SEQ ID NO: 100416 - protein, 9 aa, Homo Sapiens
LVHPHPAVR

SEQ ID NO: 100417 - protein, 9 aa, Homo Sapiens
IAANKMSIA

SEQ ID NO: 100418 - protein, 9 aa, Homo Sapiens
FLCHFFFFF

SEQ ID NO: 100419 - protein, 9 aa, Homo Sapiens
TLSASGLNA

SEQ ID NO: 100420 - protein, 9 aa, Homo Sapiens
PTLDAFREQ

SEQ ID NO: 100421 - protein, 9 aa, Homo Sapiens
YLYMLYLTA

SEQ ID NO: 100422 - protein, 9 aa, Homo Sapiens
TVKQQLIEK

SEQ ID NO: 100423 - protein, 9 aa, Homo Sapiens
EVITVFQYY

SEQ ID NO: 100424 - protein, 9 aa, Homo Sapiens
RHIQCLQEM

SEQ ID NO: 100425 - protein, 9 aa, Homo Sapiens
PQEVTFLSL

SEQ ID NO: 100426 - protein, 9 aa, Homo Sapiens
DKNDRLRNK

SEQ ID NO: 100427 - protein, 9 aa, Homo Sapiens
PRGQAGSRG

SEQ ID NO: 100428 - protein, 9 aa, Homo Sapiens
CQSVLPVPL

SEQ ID NO: 100429 - protein, 9 aa, Homo Sapiens
AAQQSQGLA

SEQ ID NO: 100430 - protein, 9 aa, Homo Sapiens
ASLGSTLGT

SEQ ID NO: 100431 - protein, 9 aa, Homo Sapiens
GPKGYSGEQ

SEQ ID NO: 100432 - protein, 9 aa, Homo Sapiens
YFTFVRDPL

SEQ ID NO: 100433 - protein, 9 aa, Homo Sapiens
SSSLSSEVI

SEQ ID NO: 100434 - protein, 9 aa, Homo Sapiens
KELDEITAN

SEQ ID NO: 100435 - protein, 9 aa, Homo Sapiens
AAASLCRAA

SEQ ID NO: 100436 - protein, 9 aa, Homo Sapiens
AANKMSIAW

SEQ ID NO: 100437 - protein, 9 aa, Homo Sapiens
PSFETLSAS

SEQ ID NO: 100438 - protein, 9 aa, Homo Sapiens
QLGTLYRGL

SEQ ID NO: 100439 - protein, 9 aa, Homo Sapiens
LHVEYLGEQ

SEQ ID NO: 100440 - protein, 9 aa, Homo Sapiens
FLHHAFVDS

SEQ ID NO: 100441 - protein, 9 aa, Homo Sapiens
KFDTLGGER

SEQ ID NO: 100442 - protein, 9 aa, Homo Sapiens
VPCWPTAPV

SEQ ID NO: 100443 - protein, 9 aa, Homo Sapiens
LHLDSSCKE

SEQ ID NO: 100444 - protein, 9 aa, Homo Sapiens
FSRIYHQNH

SEQ ID NO: 100445 - protein, 9 aa, Homo Sapiens
EAHLMSPLD

SEQ ID NO: 100446 - protein, 9 aa, Homo Sapiens
VYVVRATHL

SEQ ID NO: 100447 - protein, 9 aa, Homo Sapiens
MKGDADDDA

SEQ ID NO: 100448 - protein, 9 aa, Homo Sapiens
GTVPCWPTA

SEQ ID NO: 100449 - protein, 9 aa, Homo Sapiens
AANGTVPCW

SEQ ID NO: 100450 - protein, 9 aa, Homo Sapiens
CSDLSQHNG

SEQ ID NO: 100451 - protein, 9 aa, Homo Sapiens
LGTLYRGLS

SEQ ID NO: 100452 - protein, 9 aa, Homo Sapiens
ERRQERREQ

SEQ ID NO: 100453 - protein, 9 aa, Homo Sapiens
RIPLSAQDP

SEQ ID NO: 100454 - protein, 9 aa, Homo Sapiens
GAGAGVSAG

SEQ ID NO: 100455 - protein, 9 aa, Homo Sapiens
CLQEMEFPQ

SEQ ID NO: 100456 - protein, 9 aa, Homo Sapiens
EKGNCTFSE

SEQ ID NO: 100457 - protein, 9 aa, Homo Sapiens
DPLSKEGDP

SEQ ID NO: 100458 - protein, 9 aa, Homo Sapiens
HNIIYVSNA

SEQ ID NO: 100459 - protein, 9 aa, Homo Sapiens
AQTCGIEEE

SEQ ID NO: 100460 - protein, 9 aa, Homo Sapiens
TLDAFREQA

SEQ ID NO: 100461 - protein, 9 aa, Homo Sapiens
DTETTEKGC

SEQ ID NO: 100462 - protein, 9 aa, Homo Sapiens
PGHQSGPVT

SEQ ID NO: 100463 - protein, 9 aa, Homo Sapiens
KIRLQLALH

SEQ ID NO: 100464 - protein, 9 aa, Homo Sapiens
PRRCHHDHE

SEQ ID NO: 100465 - protein, 9 aa, Homo Sapiens
RDLNESYSE

SEQ ID NO: 100466 - protein, 9 aa, Homo Sapiens
ALGPRGQAG

SEQ ID NO: 100467 - protein, 9 aa, Homo Sapiens
QERREQREK

SEQ ID NO: 100468 - protein, 9 aa, Homo Sapiens
LSDIDLMEP

SEQ ID NO: 100469 - protein, 9 aa, Homo Sapiens
KDLFIEAHL

SEQ ID NO: 100470 - protein, 9 aa, Homo Sapiens
GRHHAELVR

SEQ ID NO: 100471 - protein, 9 aa, Homo Sapiens
KDKCEKDFF

SEQ ID NO: 100472 - protein, 9 aa, Homo Sapiens
LDEITANRQ

SEQ ID NO: 100473 - protein, 9 aa, Homo Sapiens
VKSHRTSEI

SEQ ID NO: 100474 - protein, 9 aa, Homo Sapiens
GRERTVNNE

SEQ ID NO: 100475 - protein, 9 aa, Homo Sapiens
IQLGTLYRG

SEQ ID NO: 100476 - protein, 9 aa, Homo Sapiens
DLYRIPLSA

SEQ ID NO: 100477 - protein, 9 aa, Homo Sapiens
HLTEIRQYK

SEQ ID NO: 100478 - protein, 9 aa, Homo Sapiens
QGHRVAELI

SEQ ID NO: 100479 - protein, 9 aa, Homo Sapiens
IKIIEKRPE

SEQ ID NO: 100480 - protein, 9 aa, Homo Sapiens
SHLVHPHPA

SEQ ID NO: 100481 - protein, 9 aa, Homo Sapiens
QRDLDRIAA

SEQ ID NO: 100482 - protein, 9 aa, Homo Sapiens
LQTVYNYFL

SEQ ID NO: 100483 - protein, 9 aa, Homo Sapiens
PSGAAVALK

SEQ ID NO: 100484 - protein, 9 aa, Homo Sapiens
RTVNNESQR

SEQ ID NO: 100485 - protein, 9 aa, Homo Sapiens
NLNKQTTTI

SEQ ID NO: 100486 - protein, 9 aa, Homo Sapiens
YKNMIPEQD

SEQ ID NO: 100487 - protein, 9 aa, Homo Sapiens
KDKLHDEAV

SEQ ID NO: 100488 - protein, 9 aa, Homo Sapiens
YVSRVEELK

SEQ ID NO: 100489 - protein, 9 aa, Homo Sapiens
IDIIEKTEI

SEQ ID NO: 100490 - protein, 9 aa, Homo Sapiens
ESDFHLTKS

SEQ ID NO: 100491 - protein, 9 aa, Homo Sapiens
LALFDPLSK

SEQ ID NO: 100492 - protein, 9 aa, Homo Sapiens
IRLQLALHV

SEQ ID NO: 100493 - protein, 9 aa, Homo Sapiens
GGERGAQLS

SEQ ID NO: 100494 - protein, 9 aa, Homo Sapiens
LQEMEFPQT

SEQ ID NO: 100495 - protein, 9 aa, Homo Sapiens
PSPRRCHHD

SEQ ID NO: 100496 - protein, 9 aa, Homo Sapiens
IQCLQEMEF

SEQ ID NO: 100497 - protein, 9 aa, Homo Sapiens
TPGKKMKIL

SEQ ID NO: 100498 - protein, 9 aa, Homo Sapiens
MAAHKINEG

SEQ ID NO: 100499 - protein, 9 aa, Homo Sapiens
AHMVITDLS

SEQ ID NO: 100500 - protein, 9 aa, Homo Sapiens
KLHFPFFCF

SEQ ID NO: 100501 - protein, 9 aa, Homo Sapiens
YDLTPGKKM

SEQ ID NO: 100502 - protein, 9 aa, Homo Sapiens
LTHIGPRTT

SEQ ID NO: 100503 - protein, 9 aa, Homo Sapiens
TRVRAMAIC

SEQ ID NO: 100504 - protein, 9 aa, Homo Sapiens
WRVFHFRPI

SEQ ID NO: 100505 - protein, 9 aa, Homo Sapiens
ETLSASGLN

SEQ ID NO: 100506 - protein, 9 aa, Homo Sapiens
KQQLIEKLI

SEQ ID NO: 100507 - protein, 9 aa, Homo Sapiens
KRAQTCGIE

SEQ ID NO: 100508 - protein, 9 aa, Homo Sapiens
AAQKPYKCE

SEQ ID NO: 100509 - protein, 9 aa, Homo Sapiens
EPSVLLLTN

SEQ ID NO: 100510 - protein, 9 aa, Homo Sapiens
VMEQMVEKT

SEQ ID NO: 100511 - protein, 9 aa, Homo Sapiens
GHRVAELIL

SEQ ID NO: 100512 - protein, 9 aa, Homo Sapiens
SQYVELIDR

SEQ ID NO: 100513 - protein, 9 aa, Homo Sapiens
AAQVAAANK

SEQ ID NO: 100514 - protein, 9 aa, Homo Sapiens
CRDKNDRLR

SEQ ID NO: 100515 - protein, 9 aa, Homo Sapiens
ANHLEDKIK

SEQ ID NO: 100516 - protein, 9 aa, Homo Sapiens
ATSTQVLPV

SEQ ID NO: 100517 - protein, 9 aa, Homo Sapiens
VTDMMRCLI

SEQ ID NO: 100518 - protein, 9 aa, Homo Sapiens
EPGAAGKEG

SEQ ID NO: 100519 - protein, 9 aa, Homo Sapiens
ADEEQELST

SEQ ID NO: 100520 - protein, 9 aa, Homo Sapiens
IEKGNCTFS

SEQ ID NO: 100521 - protein, 9 aa, Homo Sapiens
GNEFFCKVS

SEQ ID NO: 100522 - protein, 9 aa, Homo Sapiens
IPVSAHGFK

SEQ ID NO: 100523 - protein, 9 aa, Homo Sapiens
SSEVITVFQ

SEQ ID NO: 100524 - protein, 9 aa, Homo Sapiens
VWLEKPWYD

SEQ ID NO: 100525 - protein, 9 aa, Homo Sapiens
NIIYVSNAG

SEQ ID NO: 100526 - protein, 9 aa, Homo Sapiens
PSFPLWSPE

SEQ ID NO: 100527 - protein, 9 aa, Homo Sapiens
YITTIAKSS

SEQ ID NO: 100528 - protein, 9 aa, Homo Sapiens
VRRHTDAYS

SEQ ID NO: 100529 - protein, 9 aa, Homo Sapiens
PKLDKGKII

SEQ ID NO: 100530 - protein, 9 aa, Homo Sapiens
SIGPTAVCL

SEQ ID NO: 100531 - protein, 9 aa, Homo Sapiens
EHPGLGGEA

SEQ ID NO: 100532 - protein, 9 aa, Homo Sapiens
FFLHHAFVD

SEQ ID NO: 100533 - protein, 9 aa, Homo Sapiens
VYNYFLFSL

SEQ ID NO: 100534 - protein, 9 aa, Homo Sapiens
QSIGPTAVC

SEQ ID NO: 100535 - protein, 9 aa, Homo Sapiens
HSPQISQFQ

SEQ ID NO: 100536 - protein, 9 aa, Homo Sapiens
TFSVTINTG

SEQ ID NO: 100537 - protein, 9 aa, Homo Sapiens
IIIIDIIEK

SEQ ID NO: 100538 - protein, 9 aa, Homo Sapiens
YTIHLLLVD

SEQ ID NO: 100539 - protein, 9 aa, Homo Sapiens
ASDIPVKSH

SEQ ID NO: 100540 - protein, 9 aa, Homo Sapiens
NESQRCGFI

SEQ ID NO: 100541 - protein, 9 aa, Homo Sapiens
AGVSAGGVG

SEQ ID NO: 100542 - protein, 9 aa, Homo Sapiens
FHYIQLGTL

SEQ ID NO: 100543 - protein, 9 aa, Homo Sapiens
QKFDTLGGE

SEQ ID NO: 100544 - protein, 9 aa, Homo Sapiens
QPLRHGSRC

SEQ ID NO: 100545 - protein, 9 aa, Homo Sapiens
SVRRHTDAY

SEQ ID NO: 100546 - protein, 9 aa, Homo Sapiens
DKLHDEAVA

SEQ ID NO: 100547 - protein, 9 aa, Homo Sapiens
FCFPVFLYM

SEQ ID NO: 100548 - protein, 9 aa, Homo Sapiens
RGKNKGSAA

SEQ ID NO: 100549 - protein, 9 aa, Homo Sapiens
LKGQMMYIV

SEQ ID NO: 100550 - protein, 9 aa, Homo Sapiens
LKSHLVHPH

SEQ ID NO: 100551 - protein, 9 aa, Homo Sapiens
VQSVNVGAP

SEQ ID NO: 100552 - protein, 9 aa, Homo Sapiens
NTQKHLQEC

SEQ ID NO: 100553 - protein, 9 aa, Homo Sapiens
SEKDKLHDE

SEQ ID NO: 100554 - protein, 9 aa, Homo Sapiens
VRDPLSFGS

SEQ ID NO: 100555 - protein, 9 aa, Homo Sapiens
LGPRGQAGS

SEQ ID NO: 100556 - protein, 9 aa, Homo Sapiens
RLDVMEQMV

SEQ ID NO: 100557 - protein, 9 aa, Homo Sapiens
IIVFEFRNE

SEQ ID NO: 100558 - protein, 9 aa, Homo Sapiens
DAFREQAAA

SEQ ID NO: 100559 - protein, 9 aa, Homo Sapiens
SLSLSWEEM

SEQ ID NO: 100560 - protein, 9 aa, Homo Sapiens
FETLSASGL

SEQ ID NO: 100561 - protein, 9 aa, Homo Sapiens
SVLLLTNLY

SEQ ID NO: 100562 - protein, 9 aa, Homo Sapiens
FLSLSLSWE

SEQ ID NO: 100563 - protein, 9 aa, Homo Sapiens
RSPRRKSRS

SEQ ID NO: 100564 - protein, 9 aa, Homo Sapiens
RRLDVMEQM

SEQ ID NO: 100565 - protein, 9 aa, Homo Sapiens
HYIQLGTLY

SEQ ID NO: 100566 - protein, 9 aa, Homo Sapiens
QECRNDKEM

SEQ ID NO: 100567 - protein, 9 aa, Homo Sapiens
RVEELKAIV

SEQ ID NO: 100568 - protein, 9 aa, Homo Sapiens
RATHLHPAD

SEQ ID NO: 100569 - protein, 9 aa, Homo Sapiens
RCVYVLGNL

SEQ ID NO: 100570 - protein, 9 aa, Homo Sapiens
VVMGQGHRV

SEQ ID NO: 100571 - protein, 9 aa, Homo Sapiens
LQVYTASVV

SEQ ID NO: 100572 - protein, 9 aa, Homo Sapiens
SPADAKDAV

SEQ ID NO: 100573 - protein, 9 aa, Homo Sapiens
DLMEPQPGV

SEQ ID NO: 100574 - protein, 9 aa, Homo Sapiens
PEQDLQLEE

SEQ ID NO: 100575 - protein, 9 aa, Homo Sapiens
HEDLKLELR

SEQ ID NO: 100576 - protein, 9 aa, Homo Sapiens
HQSGPVTRR

SEQ ID NO: 100577 - protein, 9 aa, Homo Sapiens
EVWLEKPWY

SEQ ID NO: 100578 - protein, 9 aa, Homo Sapiens
DKIKIIEKR

SEQ ID NO: 100579 - protein, 9 aa, Homo Sapiens
LALHVEYLG

SEQ ID NO: 100580 - protein, 9 aa, Homo Sapiens
AELALFDPL

SEQ ID NO: 100581 - protein, 9 aa, Homo Sapiens
LDTETTEKG

SEQ ID NO: 100582 - protein, 9 aa, Homo Sapiens
KNMIPEQDL

SEQ ID NO: 100583 - protein, 9 aa, Homo Sapiens
GYEVTDMMR

SEQ ID NO: 100584 - protein, 9 aa, Homo Sapiens
QMAGLSMLL

SEQ ID NO: 100585 - protein, 9 aa, Homo Sapiens
TFLSLSLSW

SEQ ID NO: 100586 - protein, 9 aa, Homo Sapiens
LPSGAAVAL

SEQ ID NO: 100587 - protein, 9 aa, Homo Sapiens
FLEKESSVT

SEQ ID NO: 100588 - protein, 9 aa, Homo Sapiens
SQAADEEQE

SEQ ID NO: 100589 - protein, 9 aa, Homo Sapiens
VDCYTIHLL

SEQ ID NO: 100590 - protein, 9 aa, Homo Sapiens
PAAAASLCR

SEQ ID NO: 100591 - protein, 9 aa, Homo Sapiens
RVYVVRATH

SEQ ID NO: 100592 - protein, 9 aa, Homo Sapiens
TLPAAHMVI

SEQ ID NO: 100593 - protein, 9 aa, Homo Sapiens
TTNPSSTLG

SEQ ID NO: 100594 - protein, 9 aa, Homo Sapiens
PTQMAGLSM

SEQ ID NO: 100595 - protein, 9 aa, Homo Sapiens
KLDKGKIIK

SEQ ID NO: 100596 - protein, 9 aa, Homo Sapiens
AVCLQLTEE

SEQ ID NO: 100597 - protein, 9 aa, Homo Sapiens
HFRPISCEP

SEQ ID NO: 100598 - protein, 9 aa, Homo Sapiens
QVYTASVVA

SEQ ID NO: 100599 - protein, 9 aa, Homo Sapiens
KEEEPGAAG

SEQ ID NO: 100600 - protein, 9 aa, Homo Sapiens
DCYTIHLLL

SEQ ID NO: 100601 - protein, 9 aa, Homo Sapiens
PKPAKSAPA

SEQ ID NO: 100602 - protein, 9 aa, Homo Sapiens
KVGQYVSRV

SEQ ID NO: 100603 - protein, 9 aa, Homo Sapiens
QSQGLASGE

SEQ ID NO: 100604 - protein, 9 aa, Homo Sapiens
RHTDAYSDL

SEQ ID NO: 100605 - protein, 9 aa, Homo Sapiens
LSKEGDPLP

SEQ ID NO: 100606 - protein, 9 aa, Homo Sapiens
DLTPGKKMK

SEQ ID NO: 100607 - protein, 9 aa, Homo Sapiens
HTDAYSDLS

SEQ ID NO: 100608 - protein, 9 aa, Homo Sapiens
SANDPIFFL

SEQ ID NO: 100609 - protein, 9 aa, Homo Sapiens
EEDPLLLWQ

SEQ ID NO: 100610 - protein, 9 aa, Homo Sapiens
NEFFCKVDE

SEQ ID NO: 100611 - protein, 9 aa, Homo Sapiens
GDADDDADG

SEQ ID NO: 100612 - protein, 9 aa, Homo Sapiens
PAAQQSQGL

SEQ ID NO: 100613 - protein, 9 aa, Homo Sapiens
YVELIDREQ

SEQ ID NO: 100614 - protein, 9 aa, Homo Sapiens
FPQAPWENI

SEQ ID NO: 100615 - protein, 9 aa, Homo Sapiens
LSLSLSWEE

SEQ ID NO: 100616 - protein, 9 aa, Homo Sapiens
CGRHHAELV

SEQ ID NO: 100617 - protein, 9 aa, Homo Sapiens
VARMQEDCD

SEQ ID NO: 100618 - protein, 9 aa, Homo Sapiens
QYVSRVEEL

SEQ ID NO: 100619 - protein, 9 aa, Homo Sapiens
PIFFLHHAF

SEQ ID NO: 100620 - protein, 9 aa, Homo Sapiens
MIHSPQISQ

SEQ ID NO: 100621 - protein, 9 aa, Homo Sapiens
PRCSVNGKA

SEQ ID NO: 100622 - protein, 9 aa, Homo Sapiens
YPSQNKPWH

SEQ ID NO: 100623 - protein, 9 aa, Homo Sapiens
VSNAGNNGP

SEQ ID NO: 100624 - protein, 9 aa, Homo Sapiens
MAGLSMLLL

SEQ ID NO: 100625 - protein, 9 aa, Homo Sapiens
RTPAAQQSQ

SEQ ID NO: 100626 - protein, 9 aa, Homo Sapiens
YLLKSHLVH

SEQ ID NO: 100627 - protein, 9 aa, Homo Sapiens
IIYVSNAGN

SEQ ID NO: 100628 - protein, 9 aa, Homo Sapiens
YKRAQTCGI

SEQ ID NO: 100629 - protein, 9 aa, Homo Sapiens
AFVRCVYVL

SEQ ID NO: 100630 - protein, 9 aa, Homo Sapiens
KIIEKRPEL

SEQ ID NO: 100631 - protein, 9 aa, Homo Sapiens
VSRVEELKA

SEQ ID NO: 100632 - protein, 9 aa, Homo Sapiens
FESDFHLTK

SEQ ID NO: 100633 - protein, 9 aa, Homo Sapiens
VPETRGKNK

SEQ ID NO: 100634 - protein, 9 aa, Homo Sapiens
SGGYFPLTG

SEQ ID NO: 100635 - protein, 9 aa, Homo Sapiens
PPIIVFEFR

SEQ ID NO: 100636 - protein, 9 aa, Homo Sapiens
LNKQTTTIN

SEQ ID NO: 100637 - protein, 9 aa, Homo Sapiens
GVKELPLNI

SEQ ID NO: 100638 - protein, 9 aa, Homo Sapiens
QRRLDVMEQ

SEQ ID NO: 100639 - protein, 9 aa, Homo Sapiens
RRQDEKRKA

SEQ ID NO: 100640 - protein, 9 aa, Homo Sapiens
YVSNAGNNG

SEQ ID NO: 100641 - protein, 9 aa, Homo Sapiens
RVQEVKQKY

SEQ ID NO: 100642 - protein, 9 aa, Homo Sapiens
FMEVPDLNP

SEQ ID NO: 100643 - protein, 9 aa, Homo Sapiens
RESPLEPED

SEQ ID NO: 100644 - protein, 9 aa, Homo Sapiens
SFFFFETES

SEQ ID NO: 100645 - protein, 9 aa, Homo Sapiens
VCLLKSDNK

SEQ ID NO: 100646 - protein, 9 aa, Homo Sapiens
STRGDQHSG

SEQ ID NO: 100647 - protein, 9 aa, Homo Sapiens
RREQHLRSR

SEQ ID NO: 100648 - protein, 9 aa, Homo Sapiens
MPSTLDAYV

SEQ ID NO: 100649 - protein, 9 aa, Homo Sapiens
CKSKISKFE

SEQ ID NO: 100650 - protein, 9 aa, Homo Sapiens
KQMNDARHG

SEQ ID NO: 100651 - protein, 9 aa, Homo Sapiens
MILSGVCVI

SEQ ID NO: 100652 - protein, 9 aa, Homo Sapiens
RLEELRATL

SEQ ID NO: 100653 - protein, 9 aa, Homo Sapiens
SYTPLAEVD

SEQ ID NO: 100654 - protein, 9 aa, Homo Sapiens
ACREAWWPL

SEQ ID NO: 100655 - protein, 9 aa, Homo Sapiens
ARFMEVPDL

SEQ ID NO: 100656 - protein, 9 aa, Homo Sapiens
PCLVGEIGL

SEQ ID NO: 100657 - protein, 9 aa, Homo Sapiens
REQHLRSRE

SEQ ID NO: 100658 - protein, 9 aa, Homo Sapiens
LGQCLVRNN

SEQ ID NO: 100659 - protein, 9 aa, Homo Sapiens
RYLGSLQPL

SEQ ID NO: 100660 - protein, 9 aa, Homo Sapiens
FKLPYIQPR

SEQ ID NO: 100661 - protein, 9 aa, Homo Sapiens
TSQFFFGDM

SEQ ID NO: 100662 - protein, 9 aa, Homo Sapiens
KISKFEEGD

SEQ ID NO: 100663 - protein, 9 aa, Homo Sapiens
TSYQCKLYN

SEQ ID NO: 100664 - protein, 9 aa, Homo Sapiens
ATEKRMNKY

SEQ ID NO: 100665 - protein, 9 aa, Homo Sapiens
MCLIECSQP

SEQ ID NO: 100666 - protein, 9 aa, Homo Sapiens
DHSPPKMEI

SEQ ID NO: 100667 - protein, 9 aa, Homo Sapiens
HSGGVTEAS

SEQ ID NO: 100668 - protein, 9 aa, Homo Sapiens
DSRLEELRA

SEQ ID NO: 100669 - protein, 9 aa, Homo Sapiens
LHQFLESGV

SEQ ID NO: 100670 - protein, 9 aa, Homo Sapiens
DARFMEVPD

SEQ ID NO: 100671 - protein, 9 aa, Homo Sapiens
FWRNAMHAH

SEQ ID NO: 100672 - protein, 9 aa, Homo Sapiens
NAMHAHQRL

SEQ ID NO: 100673 - protein, 9 aa, Homo Sapiens
LEELRATLP

SEQ ID NO: 100674 - protein, 9 aa, Homo Sapiens
SPPKMEICT

SEQ ID NO: 100675 - protein, 9 aa, Homo Sapiens
PYIQPRTQE

SEQ ID NO: 100676 - protein, 9 aa, Homo Sapiens
KRMNKYLGQ

SEQ ID NO: 100677 - protein, 9 aa, Homo Sapiens
LYNRTFASK

SEQ ID NO: 100678 - protein, 9 aa, Homo Sapiens
YSTRGDQHS

SEQ ID NO: 100679 - protein, 9 aa, Homo Sapiens
FAIVLLTHG

SEQ ID NO: 100680 - protein, 9 aa, Homo Sapiens
EAWWPLERR

SEQ ID NO: 100681 - protein, 9 aa, Homo Sapiens
VDLNALEEW

SEQ ID NO: 100682 - protein, 9 aa, Homo Sapiens
MNKYLGQCL

SEQ ID NO: 100683 - protein, 9 aa, Homo Sapiens
ASVTQAGVQ

SEQ ID NO: 100684 - protein, 9 aa, Homo Sapiens
HRESPLEPE

SEQ ID NO: 100685 - protein, 9 aa, Homo Sapiens
EQHLRSREE

SEQ ID NO: 100686 - protein, 9 aa, Homo Sapiens
DARHGGWTT

SEQ ID NO: 100687 - protein, 9 aa, Homo Sapiens
HCVKDIVGF

SEQ ID NO: 100688 - protein, 9 aa, Homo Sapiens
ELRATLPSP

SEQ ID NO: 100689 - protein, 9 aa, Homo Sapiens
VVPKFKLPY

SEQ ID NO: 100690 - protein, 9 aa, Homo Sapiens
EDWSCCPNP

SEQ ID NO: 100691 - protein, 9 aa, Homo Sapiens
LSHCVKDIV

SEQ ID NO: 100692 - protein, 9 aa, Homo Sapiens
MRNRFDFAI

SEQ ID NO: 100693 - protein, 9 aa, Homo Sapiens
HAHQRLHSE

SEQ ID NO: 100694 - protein, 9 aa, Homo Sapiens
KFKLPYIQP

SEQ ID NO: 100695 - protein, 9 aa, Homo Sapiens
GDPCLVGEI

SEQ ID NO: 100696 - protein, 9 aa, Homo Sapiens
GFFWRNAMH

SEQ ID NO: 100697 - protein, 9 aa, Homo Sapiens
ECSQPVYPL

SEQ ID NO: 100698 - protein, 9 aa, Homo Sapiens
LASSPLSYS

SEQ ID NO: 100699 - protein, 9 aa, Homo Sapiens
PDHSPPKME

SEQ ID NO: 100700 - protein, 9 aa, Homo Sapiens
CSQPVYPLD

SEQ ID NO: 100701 - protein, 9 aa, Homo Sapiens
ASSPLSYSC

SEQ ID NO: 100702 - protein, 9 aa, Homo Sapiens
SPLEPEDSE

SEQ ID NO: 100703 - protein, 9 aa, Homo Sapiens
REAWWPLER

SEQ ID NO: 100704 - protein, 9 aa, Homo Sapiens
SNEPDARFM

SEQ ID NO: 100705 - protein, 9 aa, Homo Sapiens
CSFFFFETE

SEQ ID NO: 100706 - protein, 9 aa, Homo Sapiens
ANEGLHKLM

SEQ ID NO: 100707 - protein, 9 aa, Homo Sapiens
TAMCLIECS

SEQ ID NO: 100708 - protein, 9 aa, Homo Sapiens
GQCLVRNNQ

SEQ ID NO: 100709 - protein, 9 aa, Homo Sapiens
FFWRNAMHA

SEQ ID NO: 100710 - protein, 9 aa, Homo Sapiens
RFMEVPDLN

SEQ ID NO: 100711 - protein, 9 aa, Homo Sapiens
LSNEPDARF

SEQ ID NO: 100712 - protein, 9 aa, Homo Sapiens
GLASLHQFL

SEQ ID NO: 100713 - protein, 9 aa, Homo Sapiens
KEDCKSKIS

SEQ ID NO: 100714 - protein, 9 aa, Homo Sapiens
PDARFMEVP

SEQ ID NO: 100715 - protein, 9 aa, Homo Sapiens
GDQHSGGVT

SEQ ID NO: 100716 - protein, 9 aa, Homo Sapiens
QCLVRNNQP

SEQ ID NO: 100717 - protein, 9 aa, Homo Sapiens
EPDARFMEV

SEQ ID NO: 100718 - protein, 9 aa, Homo Sapiens
SYSCTTPAL

SEQ ID NO: 100719 - protein, 9 aa, Homo Sapiens
PNPWTSFQS

SEQ ID NO: 100720 - protein, 9 aa, Homo Sapiens
KDAVSRIVV

SEQ ID NO: 100721 - protein, 9 aa, Homo Sapiens
PQRSVCEML

SEQ ID NO: 100722 - protein, 9 aa, Homo Sapiens
VPNMATEKR

SEQ ID NO: 100723 - protein, 9 aa, Homo Sapiens
GYSTRGDQH

SEQ ID NO: 100724 - protein, 9 aa, Homo Sapiens
SQFFFGDMP

SEQ ID NO: 100725 - protein, 9 aa, Homo Sapiens
DLNALEEWS

SEQ ID NO: 100726 - protein, 9 aa, Homo Sapiens
MHAHQRLHS

SEQ ID NO: 100727 - protein, 9 aa, Homo Sapiens
PNMATEKRM

SEQ ID NO: 100728 - protein, 9 aa, Homo Sapiens
FGDMPSTLD

SEQ ID NO: 100729 - protein, 9 aa, Homo Sapiens
MNDARHGGW

SEQ ID NO: 100730 - protein, 9 aa, Homo Sapiens
TQAGVQWRY

SEQ ID NO: 100731 - protein, 9 aa, Homo Sapiens
SPLSYSCTT

SEQ ID NO: 100732 - protein, 9 aa, Homo Sapiens
VACREAWWP

SEQ ID NO: 100733 - protein, 9 aa, Homo Sapiens
WHPLSANEG

SEQ ID NO: 100734 - protein, 9 aa, Homo Sapiens
RNAMHAHQR

SEQ ID NO: 100735 - protein, 9 aa, Homo Sapiens
QTLCSFFFF

SEQ ID NO: 100736 - protein, 9 aa, Homo Sapiens
LTFKPLVKR

SEQ ID NO: 100737 - protein, 9 aa, Homo Sapiens
LERREQHLR

SEQ ID NO: 100738 - protein, 9 aa, Homo Sapiens
ILSGVCVIW

SEQ ID NO: 100739 - protein, 9 aa, Homo Sapiens
LLKSDNKVV

SEQ ID NO: 100740 - protein, 9 aa, Homo Sapiens
RNRFDFAIV

SEQ ID NO: 100741 - protein, 9 aa, Homo Sapiens
DDSRLEELR

SEQ ID NO: 100742 - protein, 9 aa, Homo Sapiens
TVQPGCYLP

SEQ ID NO: 100743 - protein, 9 aa, Homo Sapiens
SKISKFEEG

SEQ ID NO: 100744 - protein, 9 aa, Homo Sapiens
PLVKRNIPS

SEQ ID NO: 100745 - protein, 9 aa, Homo Sapiens
RFDFAIVLL

SEQ ID NO: 100746 - protein, 9 aa, Homo Sapiens
QCKLYNRTF

SEQ ID NO: 100747 - protein, 9 aa, Homo Sapiens
EHRESPLEP

SEQ ID NO: 100748 - protein, 9 aa, Homo Sapiens
WPLERRAAE

SEQ ID NO: 100749 - protein, 9 aa, Homo Sapiens
PLSYSCTTP

SEQ ID NO: 100750 - protein, 9 aa, Homo Sapiens
SVCEMLKIH

SEQ ID NO: 100751 - protein, 9 aa, Homo Sapiens
NEPDARFME

SEQ ID NO: 100752 - protein, 9 aa, Homo Sapiens
FFETESASV

SEQ ID NO: 100753 - protein, 9 aa, Homo Sapiens
WWPLERRAA

SEQ ID NO: 100754 - protein, 9 aa, Homo Sapiens
HQFLESGVL

SEQ ID NO: 100755 - protein, 9 aa, Homo Sapiens
GGYGGGGYG

SEQ ID NO: 100756 - protein, 9 aa, Homo Sapiens
GGGGYGGGG

SEQ ID NO: 100757 - protein, 9 aa, Homo Sapiens
AMCLIECSQ

SEQ ID NO: 100758 - protein, 9 aa, Homo Sapiens
FFFGDMPST

SEQ ID NO: 100759 - protein, 9 aa, Homo Sapiens
RQLERREQH

SEQ ID NO: 100760 - protein, 9 aa, Homo Sapiens
TESASVTQA

SEQ ID NO: 100761 - protein, 9 aa, Homo Sapiens
PLAEVDLNA

SEQ ID NO: 100762 - protein, 9 aa, Homo Sapiens
DWSCCPNPW

SEQ ID NO: 100763 - protein, 9 aa, Homo Sapiens
NEGLHKLMW

SEQ ID NO: 100764 - protein, 9 aa, Homo Sapiens
PPKMEICTV

SEQ ID NO: 100765 - protein, 9 aa, Homo Sapiens
PKFKLPYIQ

SEQ ID NO: 100766 - protein, 9 aa, Homo Sapiens
GTSYQCKLY

SEQ ID NO: 100767 - protein, 9 aa, Homo Sapiens
VTWHPLSAN

SEQ ID NO: 100768 - protein, 9 aa, Homo Sapiens
CKLYNRTFA

SEQ ID NO: 100769 - protein, 9 aa, Homo Sapiens
WRNAMHAHQ

SEQ ID NO: 100770 - protein, 9 aa, Homo Sapiens
CLLKSDNKV

SEQ ID NO: 100771 - protein, 9 aa, Homo Sapiens
SSTLSHCVK

SEQ ID NO: 100772 - protein, 9 aa, Homo Sapiens
LCSFFFFET

SEQ ID NO: 100773 - protein, 9 aa, Homo Sapiens
YNRTFASKH

SEQ ID NO: 100774 - protein, 9 aa, Homo Sapiens
AMHAHQRLH

SEQ ID NO: 100775 - protein, 9 aa, Homo Sapiens
RSVCEMLKI

SEQ ID NO: 100776 - protein, 9 aa, Homo Sapiens
PLEPEDSET

SEQ ID NO: 100777 - protein, 9 aa, Homo Sapiens
LLASSPLSY

SEQ ID NO: 100778 - protein, 9 aa, Homo Sapiens
MGDPCLVGE

SEQ ID NO: 100779 - protein, 9 aa, Homo Sapiens
DQHSGGVTE

SEQ ID NO: 100780 - protein, 9 aa, Homo Sapiens
FFGDMPSTL

SEQ ID NO: 100781 - protein, 9 aa, Homo Sapiens
PPDHSPPKM

SEQ ID NO: 100782 - protein, 9 aa, Homo Sapiens
AKVMGDPCL

SEQ ID NO: 100783 - protein, 9 aa, Homo Sapiens
SYQCKLYNR

SEQ ID NO: 100784 - protein, 9 aa, Homo Sapiens
IEDWSCCPN

SEQ ID NO: 100785 - protein, 9 aa, Homo Sapiens
NMATEKRMN

SEQ ID NO: 100786 - protein, 9 aa, Homo Sapiens
KRNIPSSVT

SEQ ID NO: 100787 - protein, 9 aa, Homo Sapiens
KYLGQCLVR

SEQ ID NO: 100788 - protein, 9 aa, Homo Sapiens
ALTFKPLVK

SEQ ID NO: 100789 - protein, 9 aa, Homo Sapiens
PKEDCKSKI

SEQ ID NO: 100790 - protein, 9 aa, Homo Sapiens
HSPPKMEIC

SEQ ID NO: 100791 - protein, 9 aa, Homo Sapiens
LEHRESPLE

SEQ ID NO: 100792 - protein, 9 aa, Homo Sapiens
HPLSANEGL

SEQ ID NO: 100793 - protein, 9 aa, Homo Sapiens
KPLVKRNIP

SEQ ID NO: 100794 - protein, 9 aa, Homo Sapiens
TLCSFFFFE

SEQ ID NO: 100795 - protein, 9 aa, Homo Sapiens
VTVQPGCYL

SEQ ID NO: 100796 - protein, 9 aa, Homo Sapiens
SRLEELRAT

SEQ ID NO: 100797 - protein, 9 aa, Homo Sapiens
RHGGWTTKM

SEQ ID NO: 100798 - protein, 9 aa, Homo Sapiens
TLSHCVKDI

SEQ ID NO: 100799 - protein, 9 aa, Homo Sapiens
FKPLVKRNI

SEQ ID NO: 100800 - protein, 9 aa, Homo Sapiens
AVMRNRFDF

SEQ ID NO: 100801 - protein, 9 aa, Homo Sapiens
QLSSTLSHC

SEQ ID NO: 100802 - protein, 9 aa, Homo Sapiens
FETESASVT

SEQ ID NO: 100803 - protein, 9 aa, Homo Sapiens
RMNKYLGQC

SEQ ID NO: 100804 - protein, 9 aa, Homo Sapiens
ASLHQFLES

SEQ ID NO: 100805 - protein, 9 aa, Homo Sapiens
DPCLVGEIG

SEQ ID NO: 100806 - protein, 9 aa, Homo Sapiens
NPWTSFQSS

SEQ ID NO: 100807 - protein, 9 aa, Homo Sapiens
DMPSTLDAY

SEQ ID NO: 100808 - protein, 9 aa, Homo Sapiens
QRSVCEMLK

SEQ ID NO: 100809 - protein, 9 aa, Homo Sapiens
VCEMLKIHL

SEQ ID NO: 100810 - protein, 9 aa, Homo Sapiens
LPYIQPRTQ

SEQ ID NO: 100811 - protein, 9 aa, Homo Sapiens
KSDNKVVDN

SEQ ID NO: 100812 - protein, 9 aa, Homo Sapiens
DAVSRIVVE

SEQ ID NO: 100813 - protein, 9 aa, Homo Sapiens
GYGGGGYGG

SEQ ID NO: 100814 - protein, 9 aa, Homo Sapiens
VKRNIPSSV

SEQ ID NO: 100815 - protein, 9 aa, Homo Sapiens
LRATLPSPD

SEQ ID NO: 100816 - protein, 9 aa, Homo Sapiens
HIKDAVSRI

SEQ ID NO: 100817 - protein, 9 aa, Homo Sapiens
PLSANEGLH

SEQ ID NO: 100818 - protein, 9 aa, Homo Sapiens
FDFAIVLLT

SEQ ID NO: 100819 - protein, 9 aa, Homo Sapiens
EVTVQPGCY

SEQ ID NO: 100820 - protein, 9 aa, Homo Sapiens
TRGDQHSGG

SEQ ID NO: 100821 - protein, 9 aa, Homo Sapiens
LASLHQFLE

SEQ ID NO: 100822 - protein, 9 aa, Homo Sapiens
SASVTQAGV

SEQ ID NO: 100823 - protein, 9 aa, Homo Sapiens
PLEHRESPL

SEQ ID NO: 100824 - protein, 9 aa, Homo Sapiens
EGGGLASLH

SEQ ID NO: 100825 - protein, 9 aa, Homo Sapiens
DNKVVDNQA

SEQ ID NO: 100826 - protein, 9 aa, Homo Sapiens
APMILSGVC

SEQ ID NO: 100827 - protein, 9 aa, Homo Sapiens
FMKQMNDAR

SEQ ID NO: 100828 - protein, 9 aa, Homo Sapiens
LEVCLLKSD

SEQ ID NO: 100829 - protein, 9 aa, Homo Sapiens
LKSDNKVVD

SEQ ID NO: 100830 - protein, 9 aa, Homo Sapiens
SSPLSYSCT

SEQ ID NO: 100831 - protein, 9 aa, Homo Sapiens
ARHGGWTTK

SEQ ID NO: 100832 - protein, 9 aa, Homo Sapiens
CCPNPWTSF

SEQ ID NO: 100833 - protein, 9 aa, Homo Sapiens
KLYNRTFAS

SEQ ID NO: 100834 - protein, 9 aa, Homo Sapiens
VMGDPCLVG

SEQ ID NO: 100835 - protein, 9 aa, Homo Sapiens
PMILSGVCV

SEQ ID NO: 100836 - protein, 9 aa, Homo Sapiens
CLVGEIGLL

SEQ ID NO: 100837 - protein, 9 aa, Homo Sapiens
SDNKVVDNQ

SEQ ID NO: 100838 - protein, 9 aa, Homo Sapiens
TWHPLSANE

SEQ ID NO: 100839 - protein, 9 aa, Homo Sapiens
CLIECSQPV

SEQ ID NO: 100840 - protein, 9 aa, Homo Sapiens
NHIKDAVSR

SEQ ID NO: 100841 - protein, 9 aa, Homo Sapiens
RGDQHSGGV

SEQ ID NO: 100842 - protein, 9 aa, Homo Sapiens
YLGSLQPLP

SEQ ID NO: 100843 - protein, 9 aa, Homo Sapiens
MKQMNDARH

SEQ ID NO: 100844 - protein, 9 aa, Homo Sapiens
EELRATLPS

SEQ ID NO: 100845 - protein, 9 aa, Homo Sapiens
QHLRSREER

SEQ ID NO: 100846 - protein, 9 aa, Homo Sapiens
KMEICTVYL

SEQ ID NO: 100847 - protein, 9 aa, Homo Sapiens
EENHIKDAV

SEQ ID NO: 100848 - protein, 9 aa, Homo Sapiens
EVCLLKSDN

SEQ ID NO: 100849 - protein, 9 aa, Homo Sapiens
YQCKLYNRT

SEQ ID NO: 100850 - protein, 9 aa, Homo Sapiens
KAPMILSGV

SEQ ID NO: 100851 - protein, 9 aa, Homo Sapiens
NKYLGQCLV

SEQ ID NO: 100852 - protein, 9 aa, Homo Sapiens
LSSTLSHCV

SEQ ID NO: 100853 - protein, 9 aa, Homo Sapiens
GGGLASLHQ

SEQ ID NO: 100854 - protein, 9 aa, Homo Sapiens
NRFDFAIVL

SEQ ID NO: 100855 - protein, 9 aa, Homo Sapiens
NDARHGGWT

SEQ ID NO: 100856 - protein, 9 aa, Homo Sapiens
AVSRIVVEM

SEQ ID NO: 100857 - protein, 9 aa, Homo Sapiens
KVMGDPCLV

SEQ ID NO: 100858 - protein, 9 aa, Homo Sapiens
SCCPNPWTS

SEQ ID NO: 100859 - protein, 9 aa, Homo Sapiens
TPLAEVDLN

SEQ ID NO: 100860 - protein, 9 aa, Homo Sapiens
TEKRMNKYL

SEQ ID NO: 100861 - protein, 9 aa, Homo Sapiens
STLSHCVKD

SEQ ID NO: 100862 - protein, 9 aa, Homo Sapiens
HLRSREERL

SEQ ID NO: 100863 - protein, 9 aa, Homo Sapiens
LSYSCTTPA

SEQ ID NO: 100864 - protein, 9 aa, Homo Sapiens
SLHQFLESG

SEQ ID NO: 100865 - protein, 9 aa, Homo Sapiens
KLPYIQPRT

SEQ ID NO: 100866 - protein, 9 aa, Homo Sapiens
GGLASLHQF

SEQ ID NO: 100867 - protein, 9 aa, Homo Sapiens
SQPVYPLDI

SEQ ID NO: 100868 - protein, 9 aa, Homo Sapiens
SGVCVIWKG

SEQ ID NO: 100869 - protein, 9 aa, Homo Sapiens
EKRMNKYLG

SEQ ID NO: 100870 - protein, 9 aa, Homo Sapiens
CREAWWPLE

SEQ ID NO: 100871 - protein, 9 aa, Homo Sapiens
DCKSKISKF

SEQ ID NO: 100872 - protein, 9 aa, Homo Sapiens
QLERREQHL

SEQ ID NO: 100873 - protein, 9 aa, Homo Sapiens
LVKRNIPSS

SEQ ID NO: 100874 - protein, 9 aa, Homo Sapiens
QMNDARHGG

SEQ ID NO: 100875 - protein, 9 aa, Homo Sapiens
YLKAPMILS

SEQ ID NO: 100876 - protein, 9 aa, Homo Sapiens
GVACREAWW

SEQ ID NO: 100877 - protein, 9 aa, Homo Sapiens
VMRNRFDFA

SEQ ID NO: 100878 - protein, 9 aa, Homo Sapiens
FFFETESAS

SEQ ID NO: 100879 - protein, 9 aa, Homo Sapiens
KSKISKFEE

SEQ ID NO: 100880 - protein, 9 aa, Homo Sapiens
CPNPWTSFQ

SEQ ID NO: 100881 - protein, 9 aa, Homo Sapiens
MATEKRMNK

SEQ ID NO: 100882 - protein, 9 aa, Homo Sapiens
VPPDHSPPK

SEQ ID NO: 100883 - protein, 9 aa, Homo Sapiens
SANEGLHKL

SEQ ID NO: 100884 - protein, 9 aa, Homo Sapiens
ETESASVTQ

SEQ ID NO: 100885 - protein, 9 aa, Homo Sapiens
SHCVKDIVG

SEQ ID NO: 100886 - protein, 9 aa, Homo Sapiens
ESASVTQAG

SEQ ID NO: 100887 - protein, 9 aa, Homo Sapiens
SQLSSTLSH

SEQ ID NO: 100888 - protein, 9 aa, Homo Sapiens
QFFFGDMPS

SEQ ID NO: 100889 - protein, 9 aa, Homo Sapiens
QHSGGVTEA

SEQ ID NO: 100890 - protein, 9 aa, Homo Sapiens
FVVPKFKLP

SEQ ID NO: 100891 - protein, 9 aa, Homo Sapiens
LSANEGLHK

SEQ ID NO: 100892 - protein, 9 aa, Homo Sapiens
FFFFETESA

SEQ ID NO: 100893 - protein, 9 aa, Homo Sapiens
LKAPMILSG

SEQ ID NO: 100894 - protein, 9 aa, Homo Sapiens
EVDLNALEE

SEQ ID NO: 100895 - protein, 9 aa, Homo Sapiens
LSGVCVIWK

SEQ ID NO: 100896 - protein, 9 aa, Homo Sapiens
EDCKSKISK

SEQ ID NO: 100897 - protein, 9 aa, Homo Sapiens
AEVDLNALE

SEQ ID NO: 100898 - protein, 9 aa, Homo Sapiens
GDMPSTLDA

SEQ ID NO: 100899 - protein, 9 aa, Homo Sapiens
GGGYGGGGY

SEQ ID NO: 100900 - protein, 9 aa, Homo Sapiens
LAEVDLNAL

SEQ ID NO: 100901 - protein, 9 aa, Homo Sapiens
TFKPLVKRN

SEQ ID NO: 100902 - protein, 9 aa, Homo Sapiens
YGGGGYGGG

SEQ ID NO: 100903 - protein, 9 aa, Homo Sapiens
VSRIVVEMI

SEQ ID NO: 100904 - protein, 9 aa, Homo Sapiens
LIECSQPVY

SEQ ID NO: 100905 - protein, 9 aa, Homo Sapiens
RATLPSPDK

SEQ ID NO: 100906 - protein, 9 aa, Homo Sapiens
DFAIVLLTH

SEQ ID NO: 100907 - protein, 9 aa, Homo Sapiens
YSCTTPALA

SEQ ID NO: 100908 - protein, 9 aa, Homo Sapiens
ENHIKDAVS

SEQ ID NO: 100909 - protein, 9 aa, Homo Sapiens
VPKFKLPYI

SEQ ID NO: 100910 - protein, 9 aa, Homo Sapiens
LEPEDSETP

SEQ ID NO: 100911 - protein, 9 aa, Homo Sapiens
ERREQHLRS

SEQ ID NO: 100912 - protein, 9 aa, Homo Sapiens
IKDAVSRIV

SEQ ID NO: 100913 - protein, 9 aa, Homo Sapiens
IECSQPVYP

SEQ ID NO: 100914 - protein, 9 aa, Homo Sapiens
WSCCPNPWT

SEQ ID NO: 100915 - protein, 9 aa, Homo Sapiens
SAKVMGDPC

SEQ ID NO: 100916 - protein, 9 aa, Homo Sapiens
ISKFEEGDQ

SEQ ID NO: 100917 - protein, 9 aa, Homo Sapiens
YTPLAEVDL

SEQ ID NO: 100918 - protein, 9 aa, Homo Sapiens
AWWPLERRA

SEQ ID NO: 100919 - protein, 9 aa, Homo Sapiens
PKMEICTVY

SEQ ID NO: 100920 - protein, 9 aa, Homo Sapiens
ESPLEPEDS

SEQ ID NO: 100921 - protein, 9 aa, Homo Sapiens
YLGQCLVRN

SEQ ID NO: 100922 - protein, 9 aa, Homo Sapiens
HMKDQEEEQ

SEQ ID NO: 100923 - protein, 9 aa, Homo Sapiens
SWPKRGTCL

SEQ ID NO: 100924 - protein, 9 aa, Homo Sapiens
ASMSEPRKV

SEQ ID NO: 100925 - protein, 9 aa, Homo Sapiens
GSWDNQENY

SEQ ID NO: 100926 - protein, 9 aa, Homo Sapiens
EEMMVFATL

SEQ ID NO: 100927 - protein, 9 aa, Homo Sapiens
DISTKEGST

SEQ ID NO: 100928 - protein, 9 aa, Homo Sapiens
DNLFDISTK

SEQ ID NO: 100929 - protein, 9 aa, Homo Sapiens
KHCSPASFK

SEQ ID NO: 100930 - protein, 9 aa, Homo Sapiens
LEHVDKENS

SEQ ID NO: 100931 - protein, 9 aa, Homo Sapiens
AWATVSNIT

SEQ ID NO: 100932 - protein, 9 aa, Homo Sapiens
KGTSDPPSP

SEQ ID NO: 100933 - protein, 9 aa, Homo Sapiens
QHPDLGMSD

SEQ ID NO: 100934 - protein, 9 aa, Homo Sapiens
EIVKHVKQN

SEQ ID NO: 100935 - protein, 9 aa, Homo Sapiens
MRQIRKVLD

SEQ ID NO: 100936 - protein, 9 aa, Homo Sapiens
RQHATLVFN

SEQ ID NO: 100937 - protein, 9 aa, Homo Sapiens
RMQEGLNVS

SEQ ID NO: 100938 - protein, 9 aa, Homo Sapiens
EEIRQRLVA

SEQ ID NO: 100939 - protein, 9 aa, Homo Sapiens
HMVSVPYAL

SEQ ID NO: 100940 - protein, 9 aa, Homo Sapiens
ITGLCLPMA

SEQ ID NO: 100941 - protein, 9 aa, Homo Sapiens
PRFQEKPNR

SEQ ID NO: 100942 - protein, 9 aa, Homo Sapiens
FATLQYHIN

SEQ ID NO: 100943 - protein, 9 aa, Homo Sapiens
CVKEILREM

SEQ ID NO: 100944 - protein, 9 aa, Homo Sapiens
MESLPFDLQ

SEQ ID NO: 100945 - protein, 9 aa, Homo Sapiens
LTRHNKIHT

SEQ ID NO: 100946 - protein, 9 aa, Homo Sapiens
GLFLCFLCS

SEQ ID NO: 100947 - protein, 9 aa, Homo Sapiens
EFFRLLHDF

SEQ ID NO: 100948 - protein, 9 aa, Homo Sapiens
LEQLCGAPS

SEQ ID NO: 100949 - protein, 9 aa, Homo Sapiens
DTYPAWATV

SEQ ID NO: 100950 - protein, 9 aa, Homo Sapiens
CQKAFRCHW

SEQ ID NO: 100951 - protein, 9 aa, Homo Sapiens
QHLRQHITE

SEQ ID NO: 100952 - protein, 9 aa, Homo Sapiens
SNLAVCINP

SEQ ID NO: 100953 - protein, 9 aa, Homo Sapiens
SKYKAQGSL

SEQ ID NO: 100954 - protein, 9 aa, Homo Sapiens
HDFHLLAFA

SEQ ID NO: 100955 - protein, 9 aa, Homo Sapiens
LCFLCSRFP

SEQ ID NO: 100956 - protein, 9 aa, Homo Sapiens
NSLNRSPKS

SEQ ID NO: 100957 - protein, 9 aa, Homo Sapiens
RLVAEGHPD

SEQ ID NO: 100958 - protein, 9 aa, Homo Sapiens
ICVSALRRH

SEQ ID NO: 100959 - protein, 9 aa, Homo Sapiens
GTFSLLEEI

SEQ ID NO: 100960 - protein, 9 aa, Homo Sapiens
AFAPISMLA

SEQ ID NO: 100961 - protein, 9 aa, Homo Sapiens
LQQNGRNYY

SEQ ID NO: 100962 - protein, 9 aa, Homo Sapiens
NSLHTSPGL

SEQ ID NO: 100963 - protein, 9 aa, Homo Sapiens
CLPMAVGSY

SEQ ID NO: 100964 - protein, 9 aa, Homo Sapiens
NAALVPPTL

SEQ ID NO: 100965 - protein, 9 aa, Homo Sapiens
DNSLNRSPK

SEQ ID NO: 100966 - protein, 9 aa, Homo Sapiens
RTIICSCTK

SEQ ID NO: 100967 - protein, 9 aa, Homo Sapiens
PEAELPKRQ

SEQ ID NO: 100968 - protein, 9 aa, Homo Sapiens
RQHLQYLYE

SEQ ID NO: 100969 - protein, 9 aa, Homo Sapiens
TGLCLPMAV

SEQ ID NO: 100970 - protein, 9 aa, Homo Sapiens
PDRPRDVKL

SEQ ID NO: 100971 - protein, 9 aa, Homo Sapiens
NAPLEVTKE

SEQ ID NO: 100972 - protein, 9 aa, Homo Sapiens
YKAQGSLTK

SEQ ID NO: 100973 - protein, 9 aa, Homo Sapiens
KVMQTPCNC

SEQ ID NO: 100974 - protein, 9 aa, Homo Sapiens
QEGEEKQEK

SEQ ID NO: 100975 - protein, 9 aa, Homo Sapiens
TESPKYLFR

SEQ ID NO: 100976 - protein, 9 aa, Homo Sapiens
LPSLSKYKA

SEQ ID NO: 100977 - protein, 9 aa, Homo Sapiens
ILLRQTAND

SEQ ID NO: 100978 - protein, 9 aa, Homo Sapiens
RFQEKPNRR

SEQ ID NO: 100979 - protein, 9 aa, Homo Sapiens
YIINNKGID

SEQ ID NO: 100980 - protein, 9 aa, Homo Sapiens
LLEASCLRA

SEQ ID NO: 100981 - protein, 9 aa, Homo Sapiens
ESQSKKKID

SEQ ID NO: 100982 - protein, 9 aa, Homo Sapiens
CQSPASMSE

SEQ ID NO: 100983 - protein, 9 aa, Homo Sapiens
VQKQVTIPR

SEQ ID NO: 100984 - protein, 9 aa, Homo Sapiens
EPRFQEKPN

SEQ ID NO: 100985 - protein, 9 aa, Homo Sapiens
RLEHYAAPQ

SEQ ID NO: 100986 - protein, 9 aa, Homo Sapiens
IRQRLVAEG

SEQ ID NO: 100987 - protein, 9 aa, Homo Sapiens
PESMKAKLC

SEQ ID NO: 100988 - protein, 9 aa, Homo Sapiens
MHPLSVYLT

SEQ ID NO: 100989 - protein, 9 aa, Homo Sapiens
FSAHVPQVS

SEQ ID NO: 100990 - protein, 9 aa, Homo Sapiens
FICVSALRR

SEQ ID NO: 100991 - protein, 9 aa, Homo Sapiens
GLCLPMAVG

SEQ ID NO: 100992 - protein, 9 aa, Homo Sapiens
LVENQKSCE

SEQ ID NO: 100993 - protein, 9 aa, Homo Sapiens
SAGSAVVLT

SEQ ID NO: 100994 - protein, 9 aa, Homo Sapiens
RPVQVLLND

SEQ ID NO: 100995 - protein, 9 aa, Homo Sapiens
TCVVLIVVE

SEQ ID NO: 100996 - protein, 9 aa, Homo Sapiens
TTTCVVLIV

SEQ ID NO: 100997 - protein, 9 aa, Homo Sapiens
FQYIINNKG

SEQ ID NO: 100998 - protein, 9 aa, Homo Sapiens
ECGKSFISH

SEQ ID NO: 100999 - protein, 9 aa, Homo Sapiens
FTFRKVMQT

SEQ ID NO: 101000 - protein, 9 aa, Homo Sapiens
SVSCLGDSE

SEQ ID NO: 101001 - protein, 9 aa, Homo Sapiens
DTNTKNILH

SEQ ID NO: 101002 - protein, 9 aa, Homo Sapiens
PLIIVVPYT

SEQ ID NO: 101003 - protein, 9 aa, Homo Sapiens
LCKKGTIQQ

SEQ ID NO: 101004 - protein, 9 aa, Homo Sapiens
YYFQLRSQG

SEQ ID NO: 101005 - protein, 9 aa, Homo Sapiens
GKSFISHSS

SEQ ID NO: 101006 - protein, 9 aa, Homo Sapiens
EGRPLPLII

SEQ ID NO: 101007 - protein, 9 aa, Homo Sapiens
ITIGNEQFR

SEQ ID NO: 101008 - protein, 9 aa, Homo Sapiens
KAQGSLTKS

SEQ ID NO: 101009 - protein, 9 aa, Homo Sapiens
SMPIYVSGS

SEQ ID NO: 101010 - protein, 9 aa, Homo Sapiens
PSLSKYKAQ

SEQ ID NO: 101011 - protein, 9 aa, Homo Sapiens
VQRMKCYAL

SEQ ID NO: 101012 - protein, 9 aa, Homo Sapiens
QQVEGARPF

SEQ ID NO: 101013 - protein, 9 aa, Homo Sapiens
TRILARHQL

SEQ ID NO: 101014 - protein, 9 aa, Homo Sapiens
LVFNTALEQ

SEQ ID NO: 101015 - protein, 9 aa, Homo Sapiens
QAVEDAKWT

SEQ ID NO: 101016 - protein, 9 aa, Homo Sapiens
PCRRCPKMV

SEQ ID NO: 101017 - protein, 9 aa, Homo Sapiens
ANGGCIMAA

SEQ ID NO: 101018 - protein, 9 aa, Homo Sapiens
DSTEGTAKA

SEQ ID NO: 101019 - protein, 9 aa, Homo Sapiens
NTVDGGITE

SEQ ID NO: 101020 - protein, 9 aa, Homo Sapiens
SMSEPRKVS

SEQ ID NO: 101021 - protein, 9 aa, Homo Sapiens
EIKEDLVSS

SEQ ID NO: 101022 - protein, 9 aa, Homo Sapiens
VYVTPEYCL

SEQ ID NO: 101023 - protein, 9 aa, Homo Sapiens
KMLLRRSKL

SEQ ID NO: 101024 - protein, 9 aa, Homo Sapiens
QIEIKRLWT

SEQ ID NO: 101025 - protein, 9 aa, Homo Sapiens
CSSGHPGIK

SEQ ID NO: 101026 - protein, 9 aa, Homo Sapiens
EVDSFVAEL

SEQ ID NO: 101027 - protein, 9 aa, Homo Sapiens
SDAPQIQEI

SEQ ID NO: 101028 - protein, 9 aa, Homo Sapiens
NTRKKTKLI

SEQ ID NO: 101029 - protein, 9 aa, Homo Sapiens
KANKAAGAK

SEQ ID NO: 101030 - protein, 9 aa, Homo Sapiens
KLQKVQATK

SEQ ID NO: 101031 - protein, 9 aa, Homo Sapiens
TVGVVNTRK

SEQ ID NO: 101032 - protein, 9 aa, Homo Sapiens
KHEKAEALL

SEQ ID NO: 101033 - protein, 9 aa, Homo Sapiens
PILSISAGS

SEQ ID NO: 101034 - protein, 9 aa, Homo Sapiens
KVEVDSFVA

SEQ ID NO: 101035 - protein, 9 aa, Homo Sapiens
YRMTRILAR

SEQ ID NO: 101036 - protein, 9 aa, Homo Sapiens
TTIHCNYMC

SEQ ID NO: 101037 - protein, 9 aa, Homo Sapiens
PSPTACLLK

SEQ ID NO: 101038 - protein, 9 aa, Homo Sapiens
ELPKRQHLQ

SEQ ID NO: 101039 - protein, 9 aa, Homo Sapiens
EIDFAIGMP

SEQ ID NO: 101040 - protein, 9 aa, Homo Sapiens
FHGQPGQPS

SEQ ID NO: 101041 - protein, 9 aa, Homo Sapiens
SANLQQHLR

SEQ ID NO: 101042 - protein, 9 aa, Homo Sapiens
NLFDISTKE

SEQ ID NO: 101043 - protein, 9 aa, Homo Sapiens
CSLALGLYQ

SEQ ID NO: 101044 - protein, 9 aa, Homo Sapiens
HTSPGLART

SEQ ID NO: 101045 - protein, 9 aa, Homo Sapiens
HPDLGMSDS

SEQ ID NO: 101046 - protein, 9 aa, Homo Sapiens
SISAGSAVV

SEQ ID NO: 101047 - protein, 9 aa, Homo Sapiens
VTPEYCLGN

SEQ ID NO: 101048 - protein, 9 aa, Homo Sapiens
NEPESKDQV

SEQ ID NO: 101049 - protein, 9 aa, Homo Sapiens
FYFSAHVPQ

SEQ ID NO: 101050 - protein, 9 aa, Homo Sapiens
STTLKIISS

SEQ ID NO: 101051 - protein, 9 aa, Homo Sapiens
CLGLGNVQS

SEQ ID NO: 101052 - protein, 9 aa, Homo Sapiens
VKVCDEGED

SEQ ID NO: 101053 - protein, 9 aa, Homo Sapiens
SPFYFSAHV

SEQ ID NO: 101054 - protein, 9 aa, Homo Sapiens
SPASMSEPR

SEQ ID NO: 101055 - protein, 9 aa, Homo Sapiens
ACSALEVTI

SEQ ID NO: 101056 - protein, 9 aa, Homo Sapiens
ESPKYLFRK

SEQ ID NO: 101057 - protein, 9 aa, Homo Sapiens
KDQVETLRP

SEQ ID NO: 101058 - protein, 9 aa, Homo Sapiens
DEAIQDYKT

SEQ ID NO: 101059 - protein, 9 aa, Homo Sapiens
KDYDLRAHA

SEQ ID NO: 101060 - protein, 9 aa, Homo Sapiens
HMEKNTKLN

SEQ ID NO: 101061 - protein, 9 aa, Homo Sapiens
EKPNRRHEL

SEQ ID NO: 101062 - protein, 9 aa, Homo Sapiens
CSEGMSEHA

SEQ ID NO: 101063 - protein, 9 aa, Homo Sapiens
KDLCKKGTI

SEQ ID NO: 101064 - protein, 9 aa, Homo Sapiens
ILSISAGSA

SEQ ID NO: 101065 - protein, 9 aa, Homo Sapiens
YLTKQLCCC

SEQ ID NO: 101066 - protein, 9 aa, Homo Sapiens
LNRSPKSEN

SEQ ID NO: 101067 - protein, 9 aa, Homo Sapiens
NRSPKSENE

SEQ ID NO: 101068 - protein, 9 aa, Homo Sapiens
SAANGGCIM

SEQ ID NO: 101069 - protein, 9 aa, Homo Sapiens
APQIQEIKE

SEQ ID NO: 101070 - protein, 9 aa, Homo Sapiens
GSMPIYVSG

SEQ ID NO: 101071 - protein, 9 aa, Homo Sapiens
ERPLSPFYF

SEQ ID NO: 101072 - protein, 9 aa, Homo Sapiens
CCGCLGLGN

SEQ ID NO: 101073 - protein, 9 aa, Homo Sapiens
GSWPKRGTC

SEQ ID NO: 101074 - protein, 9 aa, Homo Sapiens
ILCVRKATR

SEQ ID NO: 101075 - protein, 9 aa, Homo Sapiens
TSPRLEHYA

SEQ ID NO: 101076 - protein, 9 aa, Homo Sapiens
QGKQMECPP

SEQ ID NO: 101077 - protein, 9 aa, Homo Sapiens
GVCVMRMQE

SEQ ID NO: 101078 - protein, 9 aa, Homo Sapiens
EECKQEGEE

SEQ ID NO: 101079 - protein, 9 aa, Homo Sapiens
GESPELSSS

SEQ ID NO: 101080 - protein, 9 aa, Homo Sapiens
ATLVFNTAL

SEQ ID NO: 101081 - protein, 9 aa, Homo Sapiens
KTTTCVVLI

SEQ ID NO: 101082 - protein, 9 aa, Homo Sapiens
HDIGIVAMD

SEQ ID NO: 101083 - protein, 9 aa, Homo Sapiens
EVTKENFFE

SEQ ID NO: 101084 - protein, 9 aa, Homo Sapiens
VSNGTWTPF

SEQ ID NO: 101085 - protein, 9 aa, Homo Sapiens
GKTVGVVNT

SEQ ID NO: 101086 - protein, 9 aa, Homo Sapiens
IEIKRLWTE

SEQ ID NO: 101087 - protein, 9 aa, Homo Sapiens
LGESPELSS

SEQ ID NO: 101088 - protein, 9 aa, Homo Sapiens
PLEVTKENF

SEQ ID NO: 101089 - protein, 9 aa, Homo Sapiens
SSSSVSCLG

SEQ ID NO: 101090 - protein, 9 aa, Homo Sapiens
TLACAVPSQ

SEQ ID NO: 101091 - protein, 9 aa, Homo Sapiens
VYLTKQLCC

SEQ ID NO: 101092 - protein, 9 aa, Homo Sapiens
RQRVDVSLR

SEQ ID NO: 101093 - protein, 9 aa, Homo Sapiens
RMHMVSVPY

SEQ ID NO: 101094 - protein, 9 aa, Homo Sapiens
PVKDSDEIR

SEQ ID NO: 101095 - protein, 9 aa, Homo Sapiens
ATPKKANKA

SEQ ID NO: 101096 - protein, 9 aa, Homo Sapiens
QVTSPRLEH

SEQ ID NO: 101097 - protein, 9 aa, Homo Sapiens
PDHVCNACD

SEQ ID NO: 101098 - protein, 9 aa, Homo Sapiens
QEKPNRRHE

SEQ ID NO: 101099 - protein, 9 aa, Homo Sapiens
SPGLARTET

SEQ ID NO: 101100 - protein, 9 aa, Homo Sapiens
GQAVEECKQ

SEQ ID NO: 101101 - protein, 9 aa, Homo Sapiens
HGPHVVLWT

SEQ ID NO: 101102 - protein, 9 aa, Homo Sapiens
IIKLLVQKQ

SEQ ID NO: 101103 - protein, 9 aa, Homo Sapiens
RVDVSLRGS

SEQ ID NO: 101104 - protein, 9 aa, Homo Sapiens
PPCQSPASM

SEQ ID NO: 101105 - protein, 9 aa, Homo Sapiens
ESMKAKLCV

SEQ ID NO: 101106 - protein, 9 aa, Homo Sapiens
MHMVSVPYA

SEQ ID NO: 101107 - protein, 9 aa, Homo Sapiens
GNYESAMVY

SEQ ID NO: 101108 - protein, 9 aa, Homo Sapiens
KVDGRRSPP

SEQ ID NO: 101109 - protein, 9 aa, Homo Sapiens
VGVVNTRKK

SEQ ID NO: 101110 - protein, 9 aa, Homo Sapiens
EKHGMQVLE

SEQ ID NO: 101111 - protein, 9 aa, Homo Sapiens
ASSGSMPIY

SEQ ID NO: 101112 - protein, 9 aa, Homo Sapiens
NEQFRCPEA

SEQ ID NO: 101113 - protein, 9 aa, Homo Sapiens
DNGLCQNTP

SEQ ID NO: 101114 - protein, 9 aa, Homo Sapiens
TEDPCVRSH

SEQ ID NO: 101115 - protein, 9 aa, Homo Sapiens
CASDHVKVV

SEQ ID NO: 101116 - protein, 9 aa, Homo Sapiens
LHDFHLLAF

SEQ ID NO: 101117 - protein, 9 aa, Homo Sapiens
KRLWTENRL

SEQ ID NO: 101118 - protein, 9 aa, Homo Sapiens
KCYALDQEV

SEQ ID NO: 101119 - protein, 9 aa, Homo Sapiens
SPYRMTRIL

SEQ ID NO: 101120 - protein, 9 aa, Homo Sapiens
ISHSSIRRH

SEQ ID NO: 101121 - protein, 9 aa, Homo Sapiens
YGTHTFHAA

SEQ ID NO: 101122 - protein, 9 aa, Homo Sapiens
VCDEGEDLR

SEQ ID NO: 101123 - protein, 9 aa, Homo Sapiens
IFQVKVCDE

SEQ ID NO: 101124 - protein, 9 aa, Homo Sapiens
SSQPSEKDQ

SEQ ID NO: 101125 - protein, 9 aa, Homo Sapiens
SHIKLVQEK

SEQ ID NO: 101126 - protein, 9 aa, Homo Sapiens
SSPIEKVLP

SEQ ID NO: 101127 - protein, 9 aa, Homo Sapiens
SYSLTFRRH

SEQ ID NO: 101128 - protein, 9 aa, Homo Sapiens
CKQEGEEKQ

SEQ ID NO: 101129 - protein, 9 aa, Homo Sapiens
SLTFRRHTI

SEQ ID NO: 101130 - protein, 9 aa, Homo Sapiens
GTSGPNPTT

SEQ ID NO: 101131 - protein, 9 aa, Homo Sapiens
SFTFRKVMQ

SEQ ID NO: 101132 - protein, 9 aa, Homo Sapiens
SMKAKLCVQ

SEQ ID NO: 101133 - protein, 9 aa, Homo Sapiens
SDTELQQAV

SEQ ID NO: 101134 - protein, 9 aa, Homo Sapiens
YDLNRGVNY

SEQ ID NO: 101135 - protein, 9 aa, Homo Sapiens
CIPSSVFLV

SEQ ID NO: 101136 - protein, 9 aa, Homo Sapiens
MKDQEEEQE

SEQ ID NO: 101137 - protein, 9 aa, Homo Sapiens
SLHTSPGLA

SEQ ID NO: 101138 - protein, 9 aa, Homo Sapiens
RQIRKVLDA

SEQ ID NO: 101139 - protein, 9 aa, Homo Sapiens
VRGYDLNRG

SEQ ID NO: 101140 - protein, 9 aa, Homo Sapiens
AVHRSGVSL

SEQ ID NO: 101141 - protein, 9 aa, Homo Sapiens
SLTRHNKIH

SEQ ID NO: 101142 - protein, 9 aa, Homo Sapiens
NDLYATVKN

SEQ ID NO: 101143 - protein, 9 aa, Homo Sapiens
GSGPLGPFF

SEQ ID NO: 101144 - protein, 9 aa, Homo Sapiens
ASDHVKVVT

SEQ ID NO: 101145 - protein, 9 aa, Homo Sapiens
CSALEVTIT

SEQ ID NO: 101146 - protein, 9 aa, Homo Sapiens
LSVYLTKQL

SEQ ID NO: 101147 - protein, 9 aa, Homo Sapiens
SKKKIDGKR

SEQ ID NO: 101148 - protein, 9 aa, Homo Sapiens
MTRILARHQ

SEQ ID NO: 101149 - protein, 9 aa, Homo Sapiens
KTVGVVNTR

SEQ ID NO: 101150 - protein, 9 aa, Homo Sapiens
QVLLNDDLI

SEQ ID NO: 101151 - protein, 9 aa, Homo Sapiens
KQNIGPVAA

SEQ ID NO: 101152 - protein, 9 aa, Homo Sapiens
QVKVCDEGE

SEQ ID NO: 101153 - protein, 9 aa, Homo Sapiens
IAGKASRLA

SEQ ID NO: 101154 - protein, 9 aa, Homo Sapiens
FRCHWSLSR

SEQ ID NO: 101155 - protein, 9 aa, Homo Sapiens
LRGSAGDCL

SEQ ID NO: 101156 - protein, 9 aa, Homo Sapiens
TSSKNKAPV

SEQ ID NO: 101157 - protein, 9 aa, Homo Sapiens
TAFQYIINN

SEQ ID NO: 101158 - protein, 9 aa, Homo Sapiens
SSSVSCLGD

SEQ ID NO: 101159 - protein, 9 aa, Homo Sapiens
LILLLEASC

SEQ ID NO: 101160 - protein, 9 aa, Homo Sapiens
KLCWRDYLR

SEQ ID NO: 101161 - protein, 9 aa, Homo Sapiens
AVEECKQEG

SEQ ID NO: 101162 - protein, 9 aa, Homo Sapiens
GPFFVYCNM

SEQ ID NO: 101163 - protein, 9 aa, Homo Sapiens
FSYSLTFRR

SEQ ID NO: 101164 - protein, 9 aa, Homo Sapiens
HVDKENSLC

SEQ ID NO: 101165 - protein, 9 aa, Homo Sapiens
VITIGNEQF

SEQ ID NO: 101166 - protein, 9 aa, Homo Sapiens
EKVLPSCLT

SEQ ID NO: 101167 - protein, 9 aa, Homo Sapiens
QKVQATKKH

SEQ ID NO: 101168 - protein, 9 aa, Homo Sapiens
FMKSGFAFG

SEQ ID NO: 101169 - protein, 9 aa, Homo Sapiens
VKANSAILT

SEQ ID NO: 101170 - protein, 9 aa, Homo Sapiens
CNYMCNSSC

SEQ ID NO: 101171 - protein, 9 aa, Homo Sapiens
NCEVMKMDL

SEQ ID NO: 101172 - protein, 9 aa, Homo Sapiens
RKVMQTPCN

SEQ ID NO: 101173 - protein, 9 aa, Homo Sapiens
VAKGGTAWL

SEQ ID NO: 101174 - protein, 9 aa, Homo Sapiens
QTTLPTHLP

SEQ ID NO: 101175 - protein, 9 aa, Homo Sapiens
PTACLLKQP

SEQ ID NO: 101176 - protein, 9 aa, Homo Sapiens
PSDPSCVKE

SEQ ID NO: 101177 - protein, 9 aa, Homo Sapiens
NYESAMVYY

SEQ ID NO: 101178 - protein, 9 aa, Homo Sapiens
GGTGSWPKR

SEQ ID NO: 101179 - protein, 9 aa, Homo Sapiens
EQKGTKVQA

SEQ ID NO: 101180 - protein, 9 aa, Homo Sapiens
RMKCYALDQ

SEQ ID NO: 101181 - protein, 9 aa, Homo Sapiens
GEILLRQTA

SEQ ID NO: 101182 - protein, 9 aa, Homo Sapiens
GNNFICVSA

SEQ ID NO: 101183 - protein, 9 aa, Homo Sapiens
ETMRLCTVE

SEQ ID NO: 101184 - protein, 9 aa, Homo Sapiens
VKQNIGPVA

SEQ ID NO: 101185 - protein, 9 aa, Homo Sapiens
LEVTKENFF

SEQ ID NO: 101186 - protein, 9 aa, Homo Sapiens
LHDIGIVAM

SEQ ID NO: 101187 - protein, 9 aa, Homo Sapiens
KSGFAFGRN

SEQ ID NO: 101188 - protein, 9 aa, Homo Sapiens
SHSSIRRHR

SEQ ID NO: 101189 - protein, 9 aa, Homo Sapiens
WDNQENYIS

SEQ ID NO: 101190 - protein, 9 aa, Homo Sapiens
CVMRMQEGL

SEQ ID NO: 101191 - protein, 9 aa, Homo Sapiens
RTETMRLCT

SEQ ID NO: 101192 - protein, 9 aa, Homo Sapiens
YYKPESMKA

SEQ ID NO: 101193 - protein, 9 aa, Homo Sapiens
RSPKSENEK

SEQ ID NO: 101194 - protein, 9 aa, Homo Sapiens
MDPNDMMRQ

SEQ ID NO: 101195 - protein, 9 aa, Homo Sapiens
GFPNYKDRR

SEQ ID NO: 101196 - protein, 9 aa, Homo Sapiens
DILCVRKAT

SEQ ID NO: 101197 - protein, 9 aa, Homo Sapiens
PTTEDPCVR

SEQ ID NO: 101198 - protein, 9 aa, Homo Sapiens
DLGMSDSVK

SEQ ID NO: 101199 - protein, 9 aa, Homo Sapiens
KQGEQKGTK

SEQ ID NO: 101200 - protein, 9 aa, Homo Sapiens
LLTLWPPRF

SEQ ID NO: 101201 - protein, 9 aa, Homo Sapiens
DPDHVCNAC

SEQ ID NO: 101202 - protein, 9 aa, Homo Sapiens
SRFVYEACG

SEQ ID NO: 101203 - protein, 9 aa, Homo Sapiens
DSFVAELPG

SEQ ID NO: 101204 - protein, 9 aa, Homo Sapiens
NFLGRPVQV

SEQ ID NO: 101205 - protein, 9 aa, Homo Sapiens
LGRKLCWRD

SEQ ID NO: 101206 - protein, 9 aa, Homo Sapiens
NLQQNGRNY

SEQ ID NO: 101207 - protein, 9 aa, Homo Sapiens
SPLVVAKGG

SEQ ID NO: 101208 - protein, 9 aa, Homo Sapiens
KTLNGFESN

SEQ ID NO: 101209 - protein, 9 aa, Homo Sapiens
ETKAAQYIA

SEQ ID NO: 101210 - protein, 9 aa, Homo Sapiens
TIGNEQFRC

SEQ ID NO: 101211 - protein, 9 aa, Homo Sapiens
VITWKTLNG

SEQ ID NO: 101212 - protein, 9 aa, Homo Sapiens
LPTHLPPFS

SEQ ID NO: 101213 - protein, 9 aa, Homo Sapiens
IKRLWTENR

SEQ ID NO: 101214 - protein, 9 aa, Homo Sapiens
HFMKSGFAF

SEQ ID NO: 101215 - protein, 9 aa, Homo Sapiens
DVSLRGSAG

SEQ ID NO: 101216 - protein, 9 aa, Homo Sapiens
PQNCEVMKM

SEQ ID NO: 101217 - protein, 9 aa, Homo Sapiens
ASAMDIKFQ

SEQ ID NO: 101218 - protein, 9 aa, Homo Sapiens
TLKIISSKE

SEQ ID NO: 101219 - protein, 9 aa, Homo Sapiens
CPMKCWNAA

SEQ ID NO: 101220 - protein, 9 aa, Homo Sapiens
AATEHSRCN

SEQ ID NO: 101221 - protein, 9 aa, Homo Sapiens
SGFAFGRNF

SEQ ID NO: 101222 - protein, 9 aa, Homo Sapiens
EIPKLPAVL

SEQ ID NO: 101223 - protein, 9 aa, Homo Sapiens
ECGNNFICV

SEQ ID NO: 101224 - protein, 9 aa, Homo Sapiens
QVTIPRPHQ

SEQ ID NO: 101225 - protein, 9 aa, Homo Sapiens
DDFLSQQPD

SEQ ID NO: 101226 - protein, 9 aa, Homo Sapiens
WLHGAAVHR

SEQ ID NO: 101227 - protein, 9 aa, Homo Sapiens
PNDMMRQIR

SEQ ID NO: 101228 - protein, 9 aa, Homo Sapiens
VIKHCSPAS

SEQ ID NO: 101229 - protein, 9 aa, Homo Sapiens
DLYATVKNF

SEQ ID NO: 101230 - protein, 9 aa, Homo Sapiens
QSPASMSEP

SEQ ID NO: 101231 - protein, 9 aa, Homo Sapiens
VASSGSMPI

SEQ ID NO: 101232 - protein, 9 aa, Homo Sapiens
FGRNFGNRD

SEQ ID NO: 101233 - protein, 9 aa, Homo Sapiens
VKNFEKTPN

SEQ ID NO: 101234 - protein, 9 aa, Homo Sapiens
LYIETKAAQ

SEQ ID NO: 101235 - protein, 9 aa, Homo Sapiens
KKHQDQAVT

SEQ ID NO: 101236 - protein, 9 aa, Homo Sapiens
LSQQPDRPR

SEQ ID NO: 101237 - protein, 9 aa, Homo Sapiens
VVNTRKKTK

SEQ ID NO: 101238 - protein, 9 aa, Homo Sapiens
ATSTTDTSS

SEQ ID NO: 101239 - protein, 9 aa, Homo Sapiens
SSKNKAPVP

SEQ ID NO: 101240 - protein, 9 aa, Homo Sapiens
LLLIGGVWF

SEQ ID NO: 101241 - protein, 9 aa, Homo Sapiens
KNFEKTPNS

SEQ ID NO: 101242 - protein, 9 aa, Homo Sapiens
TDTSSKNKA

SEQ ID NO: 101243 - protein, 9 aa, Homo Sapiens
RVPAEDKTQ

SEQ ID NO: 101244 - protein, 9 aa, Homo Sapiens
NPMYFLLRN

SEQ ID NO: 101245 - protein, 9 aa, Homo Sapiens
GYVQGMCDV

SEQ ID NO: 101246 - protein, 9 aa, Homo Sapiens
DFPLDLDIN

SEQ ID NO: 101247 - protein, 9 aa, Homo Sapiens
KKQGEQKGT

SEQ ID NO: 101248 - protein, 9 aa, Homo Sapiens
SRQHATLVF

SEQ ID NO: 101249 - protein, 9 aa, Homo Sapiens
IDSNGHTDA

SEQ ID NO: 101250 - protein, 9 aa, Homo Sapiens
ANKAAGAKK

SEQ ID NO: 101251 - protein, 9 aa, Homo Sapiens
LLSPVKDSD

SEQ ID NO: 101252 - protein, 9 aa, Homo Sapiens
SEKHGMQVL

SEQ ID NO: 101253 - protein, 9 aa, Homo Sapiens
IIVVPYTLP

SEQ ID NO: 101254 - protein, 9 aa, Homo Sapiens
WATVSNITD

SEQ ID NO: 101255 - protein, 9 aa, Homo Sapiens
QTANDAVEL

SEQ ID NO: 101256 - protein, 9 aa, Homo Sapiens
QLGSSSRFV

SEQ ID NO: 101257 - protein, 9 aa, Homo Sapiens
MAFIEQGKQ

SEQ ID NO: 101258 - protein, 9 aa, Homo Sapiens
SPTTEDPCV

SEQ ID NO: 101259 - protein, 9 aa, Homo Sapiens
SKVMSTPLL

SEQ ID NO: 101260 - protein, 9 aa, Homo Sapiens
SQIPLPYGT

SEQ ID NO: 101261 - protein, 9 aa, Homo Sapiens
TSGPNPTTV

SEQ ID NO: 101262 - protein, 9 aa, Homo Sapiens
PMKCWNAAL

SEQ ID NO: 101263 - protein, 9 aa, Homo Sapiens
TTLKIISSK

SEQ ID NO: 101264 - protein, 9 aa, Homo Sapiens
CHWSLSRHQ

SEQ ID NO: 101265 - protein, 9 aa, Homo Sapiens
PNRRHELYK

SEQ ID NO: 101266 - protein, 9 aa, Homo Sapiens
GLQQVEGAR

SEQ ID NO: 101267 - protein, 9 aa, Homo Sapiens
CQNTPGSYS

SEQ ID NO: 101268 - protein, 9 aa, Homo Sapiens
EDPCVRSHV

SEQ ID NO: 101269 - protein, 9 aa, Homo Sapiens
LQGTSGPNP

SEQ ID NO: 101270 - protein, 9 aa, Homo Sapiens
GSDCTTIHC

SEQ ID NO: 101271 - protein, 9 aa, Homo Sapiens
CQMGADHGP

SEQ ID NO: 101272 - protein, 9 aa, Homo Sapiens
NKDLCKKGT

SEQ ID NO: 101273 - protein, 9 aa, Homo Sapiens
GPLGPFFVY

SEQ ID NO: 101274 - protein, 9 aa, Homo Sapiens
AHAISIKSA

SEQ ID NO: 101275 - protein, 9 aa, Homo Sapiens
PAVLLLIGG

SEQ ID NO: 101276 - protein, 9 aa, Homo Sapiens
RDALKMLLR

SEQ ID NO: 101277 - protein, 9 aa, Homo Sapiens
CVVLIVVEQ

SEQ ID NO: 101278 - protein, 9 aa, Homo Sapiens
SQSKKKIDG

SEQ ID NO: 101279 - protein, 9 aa, Homo Sapiens
REIDFAIGM

SEQ ID NO: 101280 - protein, 9 aa, Homo Sapiens
PQILDEALN

SEQ ID NO: 101281 - protein, 9 aa, Homo Sapiens
LYHVETKVD

SEQ ID NO: 101282 - protein, 9 aa, Homo Sapiens
VSRQHATLV

SEQ ID NO: 101283 - protein, 9 aa, Homo Sapiens
VSSPIEKVL

SEQ ID NO: 101284 - protein, 9 aa, Homo Sapiens
MCDVLAPLL

SEQ ID NO: 101285 - protein, 9 aa, Homo Sapiens
ESAMVYYQG

SEQ ID NO: 101286 - protein, 9 aa, Homo Sapiens
WNEVDKVWP

SEQ ID NO: 101287 - protein, 9 aa, Homo Sapiens
CGKSFISHS

SEQ ID NO: 101288 - protein, 9 aa, Homo Sapiens
ESVTADARR

SEQ ID NO: 101289 - protein, 9 aa, Homo Sapiens
QRQLGSSSR

SEQ ID NO: 101290 - protein, 9 aa, Homo Sapiens
NICNYIFTV

SEQ ID NO: 101291 - protein, 9 aa, Homo Sapiens
LACMVKANS

SEQ ID NO: 101292 - protein, 9 aa, Homo Sapiens
YKPESMKAK

SEQ ID NO: 101293 - protein, 9 aa, Homo Sapiens
DIKFQQSVS

SEQ ID NO: 101294 - protein, 9 aa, Homo Sapiens
SPKSENEKP

SEQ ID NO: 101295 - protein, 9 aa, Homo Sapiens
ALHLACASD

SEQ ID NO: 101296 - protein, 9 aa, Homo Sapiens
MDILCVRKA

SEQ ID NO: 101297 - protein, 9 aa, Homo Sapiens
RLWTENRLL

SEQ ID NO: 101298 - protein, 9 aa, Homo Sapiens
VVLIVVEQM

SEQ ID NO: 101299 - protein, 9 aa, Homo Sapiens
LRFHGQPGQ

SEQ ID NO: 101300 - protein, 9 aa, Homo Sapiens
IVKHVKQNI

SEQ ID NO: 101301 - protein, 9 aa, Homo Sapiens
VSAATEHSR

SEQ ID NO: 101302 - protein, 9 aa, Homo Sapiens
RPLPLIIVV

SEQ ID NO: 101303 - protein, 9 aa, Homo Sapiens
LHLACASDH

SEQ ID NO: 101304 - protein, 9 aa, Homo Sapiens
DIFERIAGK

SEQ ID NO: 101305 - protein, 9 aa, Homo Sapiens
ERTGKKLLK

SEQ ID NO: 101306 - protein, 9 aa, Homo Sapiens
AKWTAAFNG

SEQ ID NO: 101307 - protein, 9 aa, Homo Sapiens
CESRLHNPM

SEQ ID NO: 101308 - protein, 9 aa, Homo Sapiens
CVRKATRFA

SEQ ID NO: 101309 - protein, 9 aa, Homo Sapiens
KLNMQFIKD

SEQ ID NO: 101310 - protein, 9 aa, Homo Sapiens
GFAFGRNFG

SEQ ID NO: 101311 - protein, 9 aa, Homo Sapiens
LPLIIVVPY

SEQ ID NO: 101312 - protein, 9 aa, Homo Sapiens
HRSGVSLGP

SEQ ID NO: 101313 - protein, 9 aa, Homo Sapiens
MEKNTKLNM

SEQ ID NO: 101314 - protein, 9 aa, Homo Sapiens
RGLQQVEGA

SEQ ID NO: 101315 - protein, 9 aa, Homo Sapiens
LLHDFHLLA

SEQ ID NO: 101316 - protein, 9 aa, Homo Sapiens
AKKGTSDPP

SEQ ID NO: 101317 - protein, 9 aa, Homo Sapiens
SLEHVDKEN

SEQ ID NO: 101318 - protein, 9 aa, Homo Sapiens
RLWPWPATQ

SEQ ID NO: 101319 - protein, 9 aa, Homo Sapiens
VQATKKHQD

SEQ ID NO: 101320 - protein, 9 aa, Homo Sapiens
VDSFVAELP

SEQ ID NO: 101321 - protein, 9 aa, Homo Sapiens
NQENYISLW

SEQ ID NO: 101322 - protein, 9 aa, Homo Sapiens
NQALKSHRD

SEQ ID NO: 101323 - protein, 9 aa, Homo Sapiens
EDAKWTAAF

SEQ ID NO: 101324 - protein, 9 aa, Homo Sapiens
KIMNLQQNG

SEQ ID NO: 101325 - protein, 9 aa, Homo Sapiens
EGYRLVENQ

SEQ ID NO: 101326 - protein, 9 aa, Homo Sapiens
RQLGSSSRF

SEQ ID NO: 101327 - protein, 9 aa, Homo Sapiens
VSCGGWIPC

SEQ ID NO: 101328 - protein, 9 aa, Homo Sapiens
SWDNQENYI

SEQ ID NO: 101329 - protein, 9 aa, Homo Sapiens
VCINPEMQY

SEQ ID NO: 101330 - protein, 9 aa, Homo Sapiens
MKDYDLRAH

SEQ ID NO: 101331 - protein, 9 aa, Homo Sapiens
QQQLHPQNC

SEQ ID NO: 101332 - protein, 9 aa, Homo Sapiens
LTLACAVPS

SEQ ID NO: 101333 - protein, 9 aa, Homo Sapiens
SFVAELPGS

SEQ ID NO: 101334 - protein, 9 aa, Homo Sapiens
QQHLRQHIT

SEQ ID NO: 101335 - protein, 9 aa, Homo Sapiens
TTAFQYIIN

SEQ ID NO: 101336 - protein, 9 aa, Homo Sapiens
VYDTNTKNI

SEQ ID NO: 101337 - protein, 9 aa, Homo Sapiens
ALACMVKAN

SEQ ID NO: 101338 - protein, 9 aa, Homo Sapiens
KQMECPPEC

SEQ ID NO: 101339 - protein, 9 aa, Homo Sapiens
SPVKDSDEI

SEQ ID NO: 101340 - protein, 9 aa, Homo Sapiens
TLWPPRFSH

SEQ ID NO: 101341 - protein, 9 aa, Homo Sapiens
HSAKLRWKI

SEQ ID NO: 101342 - protein, 9 aa, Homo Sapiens
VTEDKVEWM

SEQ ID NO: 101343 - protein, 9 aa, Homo Sapiens
VHRSGVSLG

SEQ ID NO: 101344 - protein, 9 aa, Homo Sapiens
CRRCPKMVY

SEQ ID NO: 101345 - protein, 9 aa, Homo Sapiens
NKIHTGEKP

SEQ ID NO: 101346 - protein, 9 aa, Homo Sapiens
GGWIPCRRC

SEQ ID NO: 101347 - protein, 9 aa, Homo Sapiens
EYALLGNYE

SEQ ID NO: 101348 - protein, 9 aa, Homo Sapiens
QGMCDVLAP

SEQ ID NO: 101349 - protein, 9 aa, Homo Sapiens
PYRMTRILA

SEQ ID NO: 101350 - protein, 9 aa, Homo Sapiens
VFLVSLTSR

SEQ ID NO: 101351 - protein, 9 aa, Homo Sapiens
NKAAGAKKA

SEQ ID NO: 101352 - protein, 9 aa, Homo Sapiens
ISPLVVAKG

SEQ ID NO: 101353 - protein, 9 aa, Homo Sapiens
PELSSSELL

SEQ ID NO: 101354 - protein, 9 aa, Homo Sapiens
RCHWSLSRH

SEQ ID NO: 101355 - protein, 9 aa, Homo Sapiens
TKKHQDQAV

SEQ ID NO: 101356 - protein, 9 aa, Homo Sapiens
LKSHRDQLS

SEQ ID NO: 101357 - protein, 9 aa, Homo Sapiens
QNCEVMKMD

SEQ ID NO: 101358 - protein, 9 aa, Homo Sapiens
MAAKRGAGQ

SEQ ID NO: 101359 - protein, 9 aa, Homo Sapiens
AFGRNFGNR

SEQ ID NO: 101360 - protein, 9 aa, Homo Sapiens
DQVETLRPH

SEQ ID NO: 101361 - protein, 9 aa, Homo Sapiens
IPCRRCPKM

SEQ ID NO: 101362 - protein, 9 aa, Homo Sapiens
DLGGFPNYK

SEQ ID NO: 101363 - protein, 9 aa, Homo Sapiens
KRGAGQQQS

SEQ ID NO: 101364 - protein, 9 aa, Homo Sapiens
DFAIGMPVC

SEQ ID NO: 101365 - protein, 9 aa, Homo Sapiens
LALACSALE

SEQ ID NO: 101366 - protein, 9 aa, Homo Sapiens
ENYSRYPPR

SEQ ID NO: 101367 - protein, 9 aa, Homo Sapiens
LPKRQHLQY

SEQ ID NO: 101368 - protein, 9 aa, Homo Sapiens
MSSPGSKVM

SEQ ID NO: 101369 - protein, 9 aa, Homo Sapiens
DDFPLTLAC

SEQ ID NO: 101370 - protein, 9 aa, Homo Sapiens
IICSCTKLS

SEQ ID NO: 101371 - protein, 9 aa, Homo Sapiens
EQFRCPEAL

SEQ ID NO: 101372 - protein, 9 aa, Homo Sapiens
GSKVMSTPL

SEQ ID NO: 101373 - protein, 9 aa, Homo Sapiens
FLYSGHPIK

SEQ ID NO: 101374 - protein, 9 aa, Homo Sapiens
KLLVQKQVT

SEQ ID NO: 101375 - protein, 9 aa, Homo Sapiens
MAVGSYLVP

SEQ ID NO: 101376 - protein, 9 aa, Homo Sapiens
HLPPFSTSL

SEQ ID NO: 101377 - protein, 9 aa, Homo Sapiens
KKKIDGKRV

SEQ ID NO: 101378 - protein, 9 aa, Homo Sapiens
KLPAVLLLI

SEQ ID NO: 101379 - protein, 9 aa, Homo Sapiens
EDYLDSMES

SEQ ID NO: 101380 - protein, 9 aa, Homo Sapiens
KHGMQVLEI

SEQ ID NO: 101381 - protein, 9 aa, Homo Sapiens
EHAAGCCLS

SEQ ID NO: 101382 - protein, 9 aa, Homo Sapiens
QHLQYLYEK

SEQ ID NO: 101383 - protein, 9 aa, Homo Sapiens
NLAVCINPE

SEQ ID NO: 101384 - protein, 9 aa, Homo Sapiens
SDCTTIHCN

SEQ ID NO: 101385 - protein, 9 aa, Homo Sapiens
DCCSASAAN

SEQ ID NO: 101386 - protein, 9 aa, Homo Sapiens
QKQVTIPRP

SEQ ID NO: 101387 - protein, 9 aa, Homo Sapiens
GMCDVLAPL

SEQ ID NO: 101388 - protein, 9 aa, Homo Sapiens
PATQPLPGG

SEQ ID NO: 101389 - protein, 9 aa, Homo Sapiens
TMRLCTVEA

SEQ ID NO: 101390 - protein, 9 aa, Homo Sapiens
LVKECYFVF

SEQ ID NO: 101391 - protein, 9 aa, Homo Sapiens
MMVFATLQY

SEQ ID NO: 101392 - protein, 9 aa, Homo Sapiens
PGYPGPWLV

SEQ ID NO: 101393 - protein, 9 aa, Homo Sapiens
CSCTKLSYE

SEQ ID NO: 101394 - protein, 9 aa, Homo Sapiens
YFYYFQLRS

SEQ ID NO: 101395 - protein, 9 aa, Homo Sapiens
KDQEEEQEK

SEQ ID NO: 101396 - protein, 9 aa, Homo Sapiens
DNLVITWKT

SEQ ID NO: 101397 - protein, 9 aa, Homo Sapiens
TCESRLHNP

SEQ ID NO: 101398 - protein, 9 aa, Homo Sapiens
GLEQLCGAP

SEQ ID NO: 101399 - protein, 9 aa, Homo Sapiens
RKLCWRDYL

SEQ ID NO: 101400 - protein, 9 aa, Homo Sapiens
KVCDEGEDL

SEQ ID NO: 101401 - protein, 9 aa, Homo Sapiens
LQQVEGARP

SEQ ID NO: 101402 - protein, 9 aa, Homo Sapiens
INNKGIDSD

SEQ ID NO: 101403 - protein, 9 aa, Homo Sapiens
IHCNYMCNS

SEQ ID NO: 101404 - protein, 9 aa, Homo Sapiens
INPEMQYVK

SEQ ID NO: 101405 - protein, 9 aa, Homo Sapiens
RRYEITAAN

SEQ ID NO: 101406 - protein, 9 aa, Homo Sapiens
TSPGLARTE

SEQ ID NO: 101407 - protein, 9 aa, Homo Sapiens
KSENEKPGL

SEQ ID NO: 101408 - protein, 9 aa, Homo Sapiens
ACQMGADHG

SEQ ID NO: 101409 - protein, 9 aa, Homo Sapiens
LRAHAISIK

SEQ ID NO: 101410 - protein, 9 aa, Homo Sapiens
ARRYEITAA

SEQ ID NO: 101411 - protein, 9 aa, Homo Sapiens
DYFYYFQLR

SEQ ID NO: 101412 - protein, 9 aa, Homo Sapiens
DINPKDANK

SEQ ID NO: 101413 - protein, 9 aa, Homo Sapiens
SFTVSQVGQ

SEQ ID NO: 101414 - protein, 9 aa, Homo Sapiens
LCWRDYLRL

SEQ ID NO: 101415 - protein, 9 aa, Homo Sapiens
LNREIDFAI

SEQ ID NO: 101416 - protein, 9 aa, Homo Sapiens
CINPEMQYV

SEQ ID NO: 101417 - protein, 9 aa, Homo Sapiens
DAPQIQEIK

SEQ ID NO: 101418 - protein, 9 aa, Homo Sapiens
GKYSQHPDL

SEQ ID NO: 101419 - protein, 9 aa, Homo Sapiens
IETKAAQYI

SEQ ID NO: 101420 - protein, 9 aa, Homo Sapiens
YSGHPIKQV

SEQ ID NO: 101421 - protein, 9 aa, Homo Sapiens
KQVTIPRPH

SEQ ID NO: 101422 - protein, 9 aa, Homo Sapiens
PGLARTETQ

SEQ ID NO: 101423 - protein, 9 aa, Homo Sapiens
AIQDYKTAQ

SEQ ID NO: 101424 - protein, 9 aa, Homo Sapiens
LFCSLLTLW

SEQ ID NO: 101425 - protein, 9 aa, Homo Sapiens
TNLNIDNEN

SEQ ID NO: 101426 - protein, 9 aa, Homo Sapiens
TGSWDNQEN

SEQ ID NO: 101427 - protein, 9 aa, Homo Sapiens
MLLRRSKLP

SEQ ID NO: 101428 - protein, 9 aa, Homo Sapiens
STKEGSTKR

SEQ ID NO: 101429 - protein, 9 aa, Homo Sapiens
KNTKLNMQF

SEQ ID NO: 101430 - protein, 9 aa, Homo Sapiens
NEVDKVWPN

SEQ ID NO: 101431 - protein, 9 aa, Homo Sapiens
YSQHPDLGM

SEQ ID NO: 101432 - protein, 9 aa, Homo Sapiens
ALEVTITKT

SEQ ID NO: 101433 - protein, 9 aa, Homo Sapiens
IYYKPESMK

SEQ ID NO: 101434 - protein, 9 aa, Homo Sapiens
LYSGHPIKQ

SEQ ID NO: 101435 - protein, 9 aa, Homo Sapiens
NSAILTDQT

SEQ ID NO: 101436 - protein, 9 aa, Homo Sapiens
YHLILLLEA

SEQ ID NO: 101437 - protein, 9 aa, Homo Sapiens
CTEGYRLVE

SEQ ID NO: 101438 - protein, 9 aa, Homo Sapiens
TLQYHINKL

SEQ ID NO: 101439 - protein, 9 aa, Homo Sapiens
PDLGMSDSV

SEQ ID NO: 101440 - protein, 9 aa, Homo Sapiens
ISANLQQHL

SEQ ID NO: 101441 - protein, 9 aa, Homo Sapiens
TETMRLCTV

SEQ ID NO: 101442 - protein, 9 aa, Homo Sapiens
QEEEQEKWD

SEQ ID NO: 101443 - protein, 9 aa, Homo Sapiens
KIKYSRGTF

SEQ ID NO: 101444 - protein, 9 aa, Homo Sapiens
ATGSWDNQE

SEQ ID NO: 101445 - protein, 9 aa, Homo Sapiens
ALLDLGGFP

SEQ ID NO: 101446 - protein, 9 aa, Homo Sapiens
EEEQEKWDA

SEQ ID NO: 101447 - protein, 9 aa, Homo Sapiens
SSRFVYEAC

SEQ ID NO: 101448 - protein, 9 aa, Homo Sapiens
SQPSEKDQS

SEQ ID NO: 101449 - protein, 9 aa, Homo Sapiens
SHRDQLSLQ

SEQ ID NO: 101450 - protein, 9 aa, Homo Sapiens
VTSPRLEHY

SEQ ID NO: 101451 - protein, 9 aa, Homo Sapiens
YIETKAAQY

SEQ ID NO: 101452 - protein, 9 aa, Homo Sapiens
ITESPKYLF

SEQ ID NO: 101453 - protein, 9 aa, Homo Sapiens
KPNRRHELY

SEQ ID NO: 101454 - protein, 9 aa, Homo Sapiens
TKENFFEIC

SEQ ID NO: 101455 - protein, 9 aa, Homo Sapiens
TYPAWATVS

SEQ ID NO: 101456 - protein, 9 aa, Homo Sapiens
TDIIKHLPF

SEQ ID NO: 101457 - protein, 9 aa, Homo Sapiens
HSRCNTTQG

SEQ ID NO: 101458 - protein, 9 aa, Homo Sapiens
WPATQPLPG

SEQ ID NO: 101459 - protein, 9 aa, Homo Sapiens
HPLSVYLTK

SEQ ID NO: 101460 - protein, 9 aa, Homo Sapiens
NREIDFAIG

SEQ ID NO: 101461 - protein, 9 aa, Homo Sapiens
SDHVKVVTL

SEQ ID NO: 101462 - protein, 9 aa, Homo Sapiens
HGRTETMRL

SEQ ID NO: 101463 - protein, 9 aa, Homo Sapiens
SQDEKHEKA

SEQ ID NO: 101464 - protein, 9 aa, Homo Sapiens
DPNDQIPGY

SEQ ID NO: 101465 - protein, 9 aa, Homo Sapiens
SSERTGKKL

SEQ ID NO: 101466 - protein, 9 aa, Homo Sapiens
VCNACDNTG

SEQ ID NO: 101467 - protein, 9 aa, Homo Sapiens
SMESLPFDL

SEQ ID NO: 101468 - protein, 9 aa, Homo Sapiens
PNDQIPGYP

SEQ ID NO: 101469 - protein, 9 aa, Homo Sapiens
VEVDSFVAE

SEQ ID NO: 101470 - protein, 9 aa, Homo Sapiens
KNILHTLTQ

SEQ ID NO: 101471 - protein, 9 aa, Homo Sapiens
VGVSAATEH

SEQ ID NO: 101472 - protein, 9 aa, Homo Sapiens
YVQGMCDVL

SEQ ID NO: 101473 - protein, 9 aa, Homo Sapiens
LPYGTHTFH

SEQ ID NO: 101474 - protein, 9 aa, Homo Sapiens
SSSRFVYEA

SEQ ID NO: 101475 - protein, 9 aa, Homo Sapiens
LEVTITKTL

SEQ ID NO: 101476 - protein, 9 aa, Homo Sapiens
EPESKDQVE

SEQ ID NO: 101477 - protein, 9 aa, Homo Sapiens
TGLFLCFLC

SEQ ID NO: 101478 - protein, 9 aa, Homo Sapiens
DVLYHVETK

SEQ ID NO: 101479 - protein, 9 aa, Homo Sapiens
QEIKEDLVS

SEQ ID NO: 101480 - protein, 9 aa, Homo Sapiens
MKCYALDQE

SEQ ID NO: 101481 - protein, 9 aa, Homo Sapiens
SASAANGGC

SEQ ID NO: 101482 - protein, 9 aa, Homo Sapiens
FYVDSFTVS

SEQ ID NO: 101483 - protein, 9 aa, Homo Sapiens
LEASCLRAN

SEQ ID NO: 101484 - protein, 9 aa, Homo Sapiens
SQSLEHVDK

SEQ ID NO: 101485 - protein, 9 aa, Homo Sapiens
LLMSSPGSK

SEQ ID NO: 101486 - protein, 9 aa, Homo Sapiens
FPFYVDSFT

SEQ ID NO: 101487 - protein, 9 aa, Homo Sapiens
VFLYSGHPI

SEQ ID NO: 101488 - protein, 9 aa, Homo Sapiens
SSSSSVSCL

SEQ ID NO: 101489 - protein, 9 aa, Homo Sapiens
PLSPFYFSA

SEQ ID NO: 101490 - protein, 9 aa, Homo Sapiens
YFVFTNRRP

SEQ ID NO: 101491 - protein, 9 aa, Homo Sapiens
AAQYIAKMT

SEQ ID NO: 101492 - protein, 9 aa, Homo Sapiens
KCSEGMSEH

SEQ ID NO: 101493 - protein, 9 aa, Homo Sapiens
QYIAKMTIN

SEQ ID NO: 101494 - protein, 9 aa, Homo Sapiens
WSLSRHQRV

SEQ ID NO: 101495 - protein, 9 aa, Homo Sapiens
PLTLACAVP

SEQ ID NO: 101496 - protein, 9 aa, Homo Sapiens
VRKATRFAA

SEQ ID NO: 101497 - protein, 9 aa, Homo Sapiens
GCHALRFHG

SEQ ID NO: 101498 - protein, 9 aa, Homo Sapiens
SERTGKKLL

SEQ ID NO: 101499 - protein, 9 aa, Homo Sapiens
VLYHVETKV

SEQ ID NO: 101500 - protein, 9 aa, Homo Sapiens
LRWKITTYV

SEQ ID NO: 101501 - protein, 9 aa, Homo Sapiens
LLDLGGFPN

SEQ ID NO: 101502 - protein, 9 aa, Homo Sapiens
MDIKFQQSV

SEQ ID NO: 101503 - protein, 9 aa, Homo Sapiens
LSISAGSAV

SEQ ID NO: 101504 - protein, 9 aa, Homo Sapiens
VPGVFLYSG

SEQ ID NO: 101505 - protein, 9 aa, Homo Sapiens
TSTTDTSSK

SEQ ID NO: 101506 - protein, 9 aa, Homo Sapiens
NNFICVSAL

SEQ ID NO: 101507 - protein, 9 aa, Homo Sapiens
SSVFLVSLT

SEQ ID NO: 101508 - protein, 9 aa, Homo Sapiens
KLRWKITTY

SEQ ID NO: 101509 - protein, 9 aa, Homo Sapiens
CHALRFHGQ

SEQ ID NO: 101510 - protein, 9 aa, Homo Sapiens
RKATRFAAA

SEQ ID NO: 101511 - protein, 9 aa, Homo Sapiens
DIIKHLPFI

SEQ ID NO: 101512 - protein, 9 aa, Homo Sapiens
DDVEIDSNG

SEQ ID NO: 101513 - protein, 9 aa, Homo Sapiens
VCVMRMQEG

SEQ ID NO: 101514 - protein, 9 aa, Homo Sapiens
CLQGTSGPN

SEQ ID NO: 101515 - protein, 9 aa, Homo Sapiens
QDDVEIDSN

SEQ ID NO: 101516 - protein, 9 aa, Homo Sapiens
TAKANWAKE

SEQ ID NO: 101517 - protein, 9 aa, Homo Sapiens
HEKAEALLK

SEQ ID NO: 101518 - protein, 9 aa, Homo Sapiens
YDLRAHAIS

SEQ ID NO: 101519 - protein, 9 aa, Homo Sapiens
AGSAVVLTP

SEQ ID NO: 101520 - protein, 9 aa, Homo Sapiens
NYSRYPPRE

SEQ ID NO: 101521 - protein, 9 aa, Homo Sapiens
QIPGYPGPW

SEQ ID NO: 101522 - protein, 9 aa, Homo Sapiens
IGNEQFRCP

SEQ ID NO: 101523 - protein, 9 aa, Homo Sapiens
CLGDSEEED

SEQ ID NO: 101524 - protein, 9 aa, Homo Sapiens
LPSNLAVCI

SEQ ID NO: 101525 - protein, 9 aa, Homo Sapiens
CSLTRHNKI

SEQ ID NO: 101526 - protein, 9 aa, Homo Sapiens
FISHSSIRR

SEQ ID NO: 101527 - protein, 9 aa, Homo Sapiens
PQIQEIKED

SEQ ID NO: 101528 - protein, 9 aa, Homo Sapiens
DHVCNACDN

SEQ ID NO: 101529 - protein, 9 aa, Homo Sapiens
FAPISMLAM

SEQ ID NO: 101530 - protein, 9 aa, Homo Sapiens
AANGGCIMA

SEQ ID NO: 101531 - protein, 9 aa, Homo Sapiens
TEHSRCNTT

SEQ ID NO: 101532 - protein, 9 aa, Homo Sapiens
WPKRGTCLA

SEQ ID NO: 101533 - protein, 9 aa, Homo Sapiens
GHPGIKVIF

SEQ ID NO: 101534 - protein, 9 aa, Homo Sapiens
ETKVDGRRS

SEQ ID NO: 101535 - protein, 9 aa, Homo Sapiens
NLVITWKTL

SEQ ID NO: 101536 - protein, 9 aa, Homo Sapiens
LYATVKNFE

SEQ ID NO: 101537 - protein, 9 aa, Homo Sapiens
TQPLPGGLL

SEQ ID NO: 101538 - protein, 9 aa, Homo Sapiens
PFYFSAHVP

SEQ ID NO: 101539 - protein, 9 aa, Homo Sapiens
LKMLLRRSK

SEQ ID NO: 101540 - protein, 9 aa, Homo Sapiens
APLEVTKEN

SEQ ID NO: 101541 - protein, 9 aa, Homo Sapiens
VSLRGSAGD

SEQ ID NO: 101542 - protein, 9 aa, Homo Sapiens
AKLRWKITT

SEQ ID NO: 101543 - protein, 9 aa, Homo Sapiens
LHPQNCEVM

SEQ ID NO: 101544 - protein, 9 aa, Homo Sapiens
KLGRKLCWR

SEQ ID NO: 101545 - protein, 9 aa, Homo Sapiens
GTGSWPKRG

SEQ ID NO: 101546 - protein, 9 aa, Homo Sapiens
PAEDKTQSI

SEQ ID NO: 101547 - protein, 9 aa, Homo Sapiens
DPNDMMRQI

SEQ ID NO: 101548 - protein, 9 aa, Homo Sapiens
VVAKGGTAW

SEQ ID NO: 101549 - protein, 9 aa, Homo Sapiens
PGSKVMSTP

SEQ ID NO: 101550 - protein, 9 aa, Homo Sapiens
DTELQQAVS

SEQ ID NO: 101551 - protein, 9 aa, Homo Sapiens
MVKANSAIL

SEQ ID NO: 101552 - protein, 9 aa, Homo Sapiens
EQKSSERTG

SEQ ID NO: 101553 - protein, 9 aa, Homo Sapiens
ATEHSRCNT

SEQ ID NO: 101554 - protein, 9 aa, Homo Sapiens
DQEEEQEKW

SEQ ID NO: 101555 - protein, 9 aa, Homo Sapiens
CDVLAPLLV

SEQ ID NO: 101556 - protein, 9 aa, Homo Sapiens
SSWATTDII

SEQ ID NO: 101557 - protein, 9 aa, Homo Sapiens
PKLPAVLLL

SEQ ID NO: 101558 - protein, 9 aa, Homo Sapiens
LSSSELLNL

SEQ ID NO: 101559 - protein, 9 aa, Homo Sapiens
PKKANKAAG

SEQ ID NO: 101560 - protein, 9 aa, Homo Sapiens
ILNREIDFA

SEQ ID NO: 101561 - protein, 9 aa, Homo Sapiens
VDGGITESP

SEQ ID NO: 101562 - protein, 9 aa, Homo Sapiens
RKVINTLAH

SEQ ID NO: 101563 - protein, 9 aa, Homo Sapiens
HLILLLEAS

SEQ ID NO: 101564 - protein, 9 aa, Homo Sapiens
RLVENQKSC

SEQ ID NO: 101565 - protein, 9 aa, Homo Sapiens
LQKVQATKK

SEQ ID NO: 101566 - protein, 9 aa, Homo Sapiens
SKGWSPLLT

SEQ ID NO: 101567 - protein, 9 aa, Homo Sapiens
HALRFHGQP

SEQ ID NO: 101568 - protein, 9 aa, Homo Sapiens
VTADARRYE

SEQ ID NO: 101569 - protein, 9 aa, Homo Sapiens
SPRLEHYAA

SEQ ID NO: 101570 - protein, 9 aa, Homo Sapiens
PKRGTCLAF

SEQ ID NO: 101571 - protein, 9 aa, Homo Sapiens
EYCLGNMGL

SEQ ID NO: 101572 - protein, 9 aa, Homo Sapiens
LGLGNVQST

SEQ ID NO: 101573 - protein, 9 aa, Homo Sapiens
VTKENFFEI

SEQ ID NO: 101574 - protein, 9 aa, Homo Sapiens
PRAKKGTSD

SEQ ID NO: 101575 - protein, 9 aa, Homo Sapiens
MRLCTVEAV

SEQ ID NO: 101576 - protein, 9 aa, Homo Sapiens
DARRYEITA

SEQ ID NO: 101577 - protein, 9 aa, Homo Sapiens
KWTAAFNGI

SEQ ID NO: 101578 - protein, 9 aa, Homo Sapiens
SQHPDLGMS

SEQ ID NO: 101579 - protein, 9 aa, Homo Sapiens
EQGKQMECP

SEQ ID NO: 101580 - protein, 9 aa, Homo Sapiens
KYIVCSLAL

SEQ ID NO: 101581 - protein, 9 aa, Homo Sapiens
TVDGGITES

SEQ ID NO: 101582 - protein, 9 aa, Homo Sapiens
PYGTHTFHA

SEQ ID NO: 101583 - protein, 9 aa, Homo Sapiens
RFHGQPGQP

SEQ ID NO: 101584 - protein, 9 aa, Homo Sapiens
KGWSPLLTW

SEQ ID NO: 101585 - protein, 9 aa, Homo Sapiens
LAHHHHRGT

SEQ ID NO: 101586 - protein, 9 aa, Homo Sapiens
TKVDGRRSP

SEQ ID NO: 101587 - protein, 9 aa, Homo Sapiens
AEDKTQSID

SEQ ID NO: 101588 - protein, 9 aa, Homo Sapiens
QKAFRCHWS

SEQ ID NO: 101589 - protein, 9 aa, Homo Sapiens
IEKVLPSCL

SEQ ID NO: 101590 - protein, 9 aa, Homo Sapiens
PEYCLGNMG

SEQ ID NO: 101591 - protein, 9 aa, Homo Sapiens
VDKVWPNVF

SEQ ID NO: 101592 - protein, 9 aa, Homo Sapiens
CDEGEDLRN

SEQ ID NO: 101593 - protein, 9 aa, Homo Sapiens
ATVSNITDQ

SEQ ID NO: 101594 - protein, 9 aa, Homo Sapiens
LTRTGLFLC

SEQ ID NO: 101595 - protein, 9 aa, Homo Sapiens
QAVSNGTWT

SEQ ID NO: 101596 - protein, 9 aa, Homo Sapiens
GVSAATEHS

SEQ ID NO: 101597 - protein, 9 aa, Homo Sapiens
PIYVSGSQV

SEQ ID NO: 101598 - protein, 9 aa, Homo Sapiens
FFVYCNMTA

SEQ ID NO: 101599 - protein, 9 aa, Homo Sapiens
LYRPASKGW

SEQ ID NO: 101600 - protein, 9 aa, Homo Sapiens
MQTPCNCSY

SEQ ID NO: 101601 - protein, 9 aa, Homo Sapiens
RLYRPASKG

SEQ ID NO: 101602 - protein, 9 aa, Homo Sapiens
PLDLDINPK

SEQ ID NO: 101603 - protein, 9 aa, Homo Sapiens
LEEIVKHVK

SEQ ID NO: 101604 - protein, 9 aa, Homo Sapiens
FRLLHDFHL

SEQ ID NO: 101605 - protein, 9 aa, Homo Sapiens
VPAEDKTQS

SEQ ID NO: 101606 - protein, 9 aa, Homo Sapiens
LRLYRPASK

SEQ ID NO: 101607 - protein, 9 aa, Homo Sapiens
DNPEQKSSE

SEQ ID NO: 101608 - protein, 9 aa, Homo Sapiens
IKHCSPASF

SEQ ID NO: 101609 - protein, 9 aa, Homo Sapiens
AFRCHWSLS

SEQ ID NO: 101610 - protein, 9 aa, Homo Sapiens
SQQPDRPRD

SEQ ID NO: 101611 - protein, 9 aa, Homo Sapiens
LCDNGLCQN

SEQ ID NO: 101612 - protein, 9 aa, Homo Sapiens
KANSAILTD

SEQ ID NO: 101613 - protein, 9 aa, Homo Sapiens
HGQPGQPSL

SEQ ID NO: 101614 - protein, 9 aa, Homo Sapiens
KNFLGRPVQ

SEQ ID NO: 101615 - protein, 9 aa, Homo Sapiens
ARVPAEDKT

SEQ ID NO: 101616 - protein, 9 aa, Homo Sapiens
YWSQIPLPY

SEQ ID NO: 101617 - protein, 9 aa, Homo Sapiens
QQNGRNYYN

SEQ ID NO: 101618 - protein, 9 aa, Homo Sapiens
PLVVAKGGT

SEQ ID NO: 101619 - protein, 9 aa, Homo Sapiens
YPGPWLVPS

SEQ ID NO: 101620 - protein, 9 aa, Homo Sapiens
KIISSKEPS

SEQ ID NO: 101621 - protein, 9 aa, Homo Sapiens
HSCSLTRHN

SEQ ID NO: 101622 - protein, 9 aa, Homo Sapiens
DGGITESPK

SEQ ID NO: 101623 - protein, 9 aa, Homo Sapiens
THLPPFSTS

SEQ ID NO: 101624 - protein, 9 aa, Homo Sapiens
IKLLVQKQV

SEQ ID NO: 101625 - protein, 9 aa, Homo Sapiens
DYKTAQEHN

SEQ ID NO: 101626 - protein, 9 aa, Homo Sapiens
DNQALKSHR

SEQ ID NO: 101627 - protein, 9 aa, Homo Sapiens
TALLDLGGF

SEQ ID NO: 101628 - protein, 9 aa, Homo Sapiens
SSPGSKVMS

SEQ ID NO: 101629 - protein, 9 aa, Homo Sapiens
FCSLLTLWP

SEQ ID NO: 101630 - protein, 9 aa, Homo Sapiens
DYDLRAHAI

SEQ ID NO: 101631 - protein, 9 aa, Homo Sapiens
TRRSPYRMT

SEQ ID NO: 101632 - protein, 9 aa, Homo Sapiens
LVQKQVTIP

SEQ ID NO: 101633 - protein, 9 aa, Homo Sapiens
EHVDKENSL

SEQ ID NO: 101634 - protein, 9 aa, Homo Sapiens
PTHLPPFST

SEQ ID NO: 101635 - protein, 9 aa, Homo Sapiens
KLVQEKSQI

SEQ ID NO: 101636 - protein, 9 aa, Homo Sapiens
KQEGEEKQE

SEQ ID NO: 101637 - protein, 9 aa, Homo Sapiens
FVYCNMTAD

SEQ ID NO: 101638 - protein, 9 aa, Homo Sapiens
YVEDYLDSM

SEQ ID NO: 101639 - protein, 9 aa, Homo Sapiens
RSPYRMTRI

SEQ ID NO: 101640 - protein, 9 aa, Homo Sapiens
FLCFLCSRF

SEQ ID NO: 101641 - protein, 9 aa, Homo Sapiens
FLGRPVQVL

SEQ ID NO: 101642 - protein, 9 aa, Homo Sapiens
VTCESRLHN

SEQ ID NO: 101643 - protein, 9 aa, Homo Sapiens
QVITIGNEQ

SEQ ID NO: 101644 - protein, 9 aa, Homo Sapiens
TLPTHLPPF

SEQ ID NO: 101645 - protein, 9 aa, Homo Sapiens
LPMAVGSYL

SEQ ID NO: 101646 - protein, 9 aa, Homo Sapiens
RHNKIHTGE

SEQ ID NO: 101647 - protein, 9 aa, Homo Sapiens
YPAWATVSN

SEQ ID NO: 101648 - protein, 9 aa, Homo Sapiens
KFQQSVSKS

SEQ ID NO: 101649 - protein, 9 aa, Homo Sapiens
SKDQVETLR

SEQ ID NO: 101650 - protein, 9 aa, Homo Sapiens
GRPLPLIIV

SEQ ID NO: 101651 - protein, 9 aa, Homo Sapiens
PCVRSHVSR

SEQ ID NO: 101652 - protein, 9 aa, Homo Sapiens
VNTRKKTKL

SEQ ID NO: 101653 - protein, 9 aa, Homo Sapiens
DFPLTLACA

SEQ ID NO: 101654 - protein, 9 aa, Homo Sapiens
DEKHEKAEA

SEQ ID NO: 101655 - protein, 9 aa, Homo Sapiens
TPKKANKAA

SEQ ID NO: 101656 - protein, 9 aa, Homo Sapiens
GYDLNRGVN

SEQ ID NO: 101657 - protein, 9 aa, Homo Sapiens
IIKHLPFIY

SEQ ID NO: 101658 - protein, 9 aa, Homo Sapiens
GMSEHAAGC

SEQ ID NO: 101659 - protein, 9 aa, Homo Sapiens
KVINTLAHH

SEQ ID NO: 101660 - protein, 9 aa, Homo Sapiens
LWPWPATQP

SEQ ID NO: 101661 - protein, 9 aa, Homo Sapiens
KCWNAALVP

SEQ ID NO: 101662 - protein, 9 aa, Homo Sapiens
SGRDALKML

SEQ ID NO: 101663 - protein, 9 aa, Homo Sapiens
CGGWIPCRR

SEQ ID NO: 101664 - protein, 9 aa, Homo Sapiens
KRQHLQYLY

SEQ ID NO: 101665 - protein, 9 aa, Homo Sapiens
IMNLQQNGR

SEQ ID NO: 101666 - protein, 9 aa, Homo Sapiens
KKGTSDPPS

SEQ ID NO: 101667 - protein, 9 aa, Homo Sapiens
CMHPLSVYL

SEQ ID NO: 101668 - protein, 9 aa, Homo Sapiens
LLRRSKLPK

SEQ ID NO: 101669 - protein, 9 aa, Homo Sapiens
WKPSPTACL

SEQ ID NO: 101670 - protein, 9 aa, Homo Sapiens
FHLLAFATK

SEQ ID NO: 101671 - protein, 9 aa, Homo Sapiens
MQEGLNVSK

SEQ ID NO: 101672 - protein, 9 aa, Homo Sapiens
KVMSTPLLS

SEQ ID NO: 101673 - protein, 9 aa, Homo Sapiens
LCSFVTEDK

SEQ ID NO: 101674 - protein, 9 aa, Homo Sapiens
MACQMGADH

SEQ ID NO: 101675 - protein, 9 aa, Homo Sapiens
SGHPGIKVI

SEQ ID NO: 101676 - protein, 9 aa, Homo Sapiens
EKHEKAEAL

SEQ ID NO: 101677 - protein, 9 aa, Homo Sapiens
LACAVPSQT

SEQ ID NO: 101678 - protein, 9 aa, Homo Sapiens
NTKNILHTL

SEQ ID NO: 101679 - protein, 9 aa, Homo Sapiens
NTLAHHHHR

SEQ ID NO: 101680 - protein, 9 aa, Homo Sapiens
HATLVFNTA

SEQ ID NO: 101681 - protein, 9 aa, Homo Sapiens
DFLSQQPDR

SEQ ID NO: 101682 - protein, 9 aa, Homo Sapiens
GATPKKANK

SEQ ID NO: 101683 - protein, 9 aa, Homo Sapiens
QPSEKDQST

SEQ ID NO: 101684 - protein, 9 aa, Homo Sapiens
TEGYRLVEN

SEQ ID NO: 101685 - protein, 9 aa, Homo Sapiens
FEHSAKLRW

SEQ ID NO: 101686 - protein, 9 aa, Homo Sapiens
ISSKEPSIS

SEQ ID NO: 101687 - protein, 9 aa, Homo Sapiens
LDQEVLDMH

SEQ ID NO: 101688 - protein, 9 aa, Homo Sapiens
TFSLLEEIN

SEQ ID NO: 101689 - protein, 9 aa, Homo Sapiens
SLNRSPKSE

SEQ ID NO: 101690 - protein, 9 aa, Homo Sapiens
CGNNFICVS

SEQ ID NO: 101691 - protein, 9 aa, Homo Sapiens
LHTSPGLAR

SEQ ID NO: 101692 - protein, 9 aa, Homo Sapiens
PMAVGSYLV

SEQ ID NO: 101693 - protein, 9 aa, Homo Sapiens
MNLQQNGRN

SEQ ID NO: 101694 - protein, 9 aa, Homo Sapiens
LCTVEAVRW

SEQ ID NO: 101695 - protein, 9 aa, Homo Sapiens
IDFAIGMPV

SEQ ID NO: 101696 - protein, 9 aa, Homo Sapiens
NGRNYYNPN

SEQ ID NO: 101697 - protein, 9 aa, Homo Sapiens
KKANKAAGA

SEQ ID NO: 101698 - protein, 9 aa, Homo Sapiens
GEQKGTKVQ

SEQ ID NO: 101699 - protein, 9 aa, Homo Sapiens
HVKQNIGPV

SEQ ID NO: 101700 - protein, 9 aa, Homo Sapiens
AFQYIINNK

SEQ ID NO: 101701 - protein, 9 aa, Homo Sapiens
KAAQYIAKM

SEQ ID NO: 101702 - protein, 9 aa, Homo Sapiens
IDGKRVTTS

SEQ ID NO: 101703 - protein, 9 aa, Homo Sapiens
QVRGYDLNR

SEQ ID NO: 101704 - protein, 9 aa, Homo Sapiens
CMVKANSAI

SEQ ID NO: 101705 - protein, 9 aa, Homo Sapiens
VLPSCLTRI

SEQ ID NO: 101706 - protein, 9 aa, Homo Sapiens
CYALDQEVL

SEQ ID NO: 101707 - protein, 9 aa, Homo Sapiens
SAKLRWKIT

SEQ ID NO: 101708 - protein, 9 aa, Homo Sapiens
DLRAHAISI

SEQ ID NO: 101709 - protein, 9 aa, Homo Sapiens
SALEVTITK

SEQ ID NO: 101710 - protein, 9 aa, Homo Sapiens
QMECPPECP

SEQ ID NO: 101711 - protein, 9 aa, Homo Sapiens
VLAPLLVIL

SEQ ID NO: 101712 - protein, 9 aa, Homo Sapiens
LSSQPSEKD

SEQ ID NO: 101713 - protein, 9 aa, Homo Sapiens
VKEILREMT

SEQ ID NO: 101714 - protein, 9 aa, Homo Sapiens
KSFISHSSI

SEQ ID NO: 101715 - protein, 9 aa, Homo Sapiens
DVEIDSNGH

SEQ ID NO: 101716 - protein, 9 aa, Homo Sapiens
IKYSRGTFS

SEQ ID NO: 101717 - protein, 9 aa, Homo Sapiens
PKRQHLQYL

SEQ ID NO: 101718 - protein, 9 aa, Homo Sapiens
NIPSQDEKH

SEQ ID NO: 101719 - protein, 9 aa, Homo Sapiens
KDQSTMPEV

SEQ ID NO: 101720 - protein, 9 aa, Homo Sapiens
PGVFLYSGH

SEQ ID NO: 101721 - protein, 9 aa, Homo Sapiens
QVETLRPHV

SEQ ID NO: 101722 - protein, 9 aa, Homo Sapiens
IEQGKQMEC

SEQ ID NO: 101723 - protein, 9 aa, Homo Sapiens
VKHVKQNIG

SEQ ID NO: 101724 - protein, 9 aa, Homo Sapiens
QIQEIKEDL

SEQ ID NO: 101725 - protein, 9 aa, Homo Sapiens
NRMHMVSVP

SEQ ID NO: 101726 - protein, 9 aa, Homo Sapiens
MKAKLCVQG

SEQ ID NO: 101727 - protein, 9 aa, Homo Sapiens
TLVFNTALE

SEQ ID NO: 101728 - protein, 9 aa, Homo Sapiens
TWKTLNGFE

SEQ ID NO: 101729 - protein, 9 aa, Homo Sapiens
FFRLLHDFH

SEQ ID NO: 101730 - protein, 9 aa, Homo Sapiens
VEECKQEGE

SEQ ID NO: 101731 - protein, 9 aa, Homo Sapiens
LFDISTKEG

SEQ ID NO: 101732 - protein, 9 aa, Homo Sapiens
IVCSLALGL

SEQ ID NO: 101733 - protein, 9 aa, Homo Sapiens
PSCVKEILR

SEQ ID NO: 101734 - protein, 9 aa, Homo Sapiens
KSHRDQLSL

SEQ ID NO: 101735 - protein, 9 aa, Homo Sapiens
DVIKHCSPA

SEQ ID NO: 101736 - protein, 9 aa, Homo Sapiens
GRGLQQVEG

SEQ ID NO: 101737 - protein, 9 aa, Homo Sapiens
DSFTVSQVG

SEQ ID NO: 101738 - protein, 9 aa, Homo Sapiens
RRSPYRMTR

SEQ ID NO: 101739 - protein, 9 aa, Homo Sapiens
KVLPSCLTR

SEQ ID NO: 101740 - protein, 9 aa, Homo Sapiens
FTVSQVGQN

SEQ ID NO: 101741 - protein, 9 aa, Homo Sapiens
PKVEVDSFV

SEQ ID NO: 101742 - protein, 9 aa, Homo Sapiens
LGRPVQVLL

SEQ ID NO: 101743 - protein, 9 aa, Homo Sapiens
QCMHPLSVY

SEQ ID NO: 101744 - protein, 9 aa, Homo Sapiens
LACASDHVK

SEQ ID NO: 101745 - protein, 9 aa, Homo Sapiens
RCPMKCWNA

SEQ ID NO: 101746 - protein, 9 aa, Homo Sapiens
CSLLTLWPP

SEQ ID NO: 101747 - protein, 9 aa, Homo Sapiens
EGTAKANWA

SEQ ID NO: 101748 - protein, 9 aa, Homo Sapiens
ANSAILTDQ

SEQ ID NO: 101749 - protein, 9 aa, Homo Sapiens
KPRAKKGTS

SEQ ID NO: 101750 - protein, 9 aa, Homo Sapiens
LCLPMAVGS

SEQ ID NO: 101751 - protein, 9 aa, Homo Sapiens
PNPTTVYVD

SEQ ID NO: 101752 - protein, 9 aa, Homo Sapiens
HVPILSISA

SEQ ID NO: 101753 - protein, 9 aa, Homo Sapiens
CSASAANGG

SEQ ID NO: 101754 - protein, 9 aa, Homo Sapiens
LGGFPNYKD

SEQ ID NO: 101755 - protein, 9 aa, Homo Sapiens
RVSVSEKHG

SEQ ID NO: 101756 - protein, 9 aa, Homo Sapiens
DPSCVKEIL

SEQ ID NO: 101757 - protein, 9 aa, Homo Sapiens
IKHLPFIYN

SEQ ID NO: 101758 - protein, 9 aa, Homo Sapiens
RGEILLRQT

SEQ ID NO: 101759 - protein, 9 aa, Homo Sapiens
AVSNGTWTP

SEQ ID NO: 101760 - protein, 9 aa, Homo Sapiens
MAFAPISML

SEQ ID NO: 101761 - protein, 9 aa, Homo Sapiens
KKGTIQQMI

SEQ ID NO: 101762 - protein, 9 aa, Homo Sapiens
VMQTPCNCS

SEQ ID NO: 101763 - protein, 9 aa, Homo Sapiens
PASKGWSPL

SEQ ID NO: 101764 - protein, 9 aa, Homo Sapiens
RPASKGWSP

SEQ ID NO: 101765 - protein, 9 aa, Homo Sapiens
QSLEHVDKE

SEQ ID NO: 101766 - protein, 9 aa, Homo Sapiens
QQLHPQNCE

SEQ ID NO: 101767 - protein, 9 aa, Homo Sapiens
ERIAGKASR

SEQ ID NO: 101768 - protein, 9 aa, Homo Sapiens
VNKDLCKKG

SEQ ID NO: 101769 - protein, 9 aa, Homo Sapiens
DHGPHVVLW

SEQ ID NO: 101770 - protein, 9 aa, Homo Sapiens
KVQATKKHQ

SEQ ID NO: 101771 - protein, 9 aa, Homo Sapiens
EQEKWDATS

SEQ ID NO: 101772 - protein, 9 aa, Homo Sapiens
CDNGLCQNT

SEQ ID NO: 101773 - protein, 9 aa, Homo Sapiens
LSKYKAQGS

SEQ ID NO: 101774 - protein, 9 aa, Homo Sapiens
NIDNENYSR

SEQ ID NO: 101775 - protein, 9 aa, Homo Sapiens
CGCLGLGNV

SEQ ID NO: 101776 - protein, 9 aa, Homo Sapiens
SLRGSAGDC

SEQ ID NO: 101777 - protein, 9 aa, Homo Sapiens
RNELLSPVK

SEQ ID NO: 101778 - protein, 9 aa, Homo Sapiens
PQTTLPTHL

SEQ ID NO: 101779 - protein, 9 aa, Homo Sapiens
QKSSERTGK

SEQ ID NO: 101780 - protein, 9 aa, Homo Sapiens
QQAVSNGTW

SEQ ID NO: 101781 - protein, 9 aa, Homo Sapiens
GNVQSTIEP

SEQ ID NO: 101782 - protein, 9 aa, Homo Sapiens
DFHLLAFAT

SEQ ID NO: 101783 - protein, 9 aa, Homo Sapiens
QEKSQIERE

SEQ ID NO: 101784 - protein, 9 aa, Homo Sapiens
KVWPNVFIA

SEQ ID NO: 101785 - protein, 9 aa, Homo Sapiens
QPDRPRDVK

SEQ ID NO: 101786 - protein, 9 aa, Homo Sapiens
HGAAVHRSG

SEQ ID NO: 101787 - protein, 9 aa, Homo Sapiens
EIDSNGHTD

SEQ ID NO: 101788 - protein, 9 aa, Homo Sapiens
FRKVMQTPC

SEQ ID NO: 101789 - protein, 9 aa, Homo Sapiens
LDLDINPKD

SEQ ID NO: 101790 - protein, 9 aa, Homo Sapiens
KSSERTGKK

SEQ ID NO: 101791 - protein, 9 aa, Homo Sapiens
MKCWNAALV

SEQ ID NO: 101792 - protein, 9 aa, Homo Sapiens
ALGESPELS

SEQ ID NO: 101793 - protein, 9 aa, Homo Sapiens
TVLVKECYF

SEQ ID NO: 101794 - protein, 9 aa, Homo Sapiens
EAPWNEVDK

SEQ ID NO: 101795 - protein, 9 aa, Homo Sapiens
VSCLGDSEE

SEQ ID NO: 101796 - protein, 9 aa, Homo Sapiens
PSEKDQSTM

SEQ ID NO: 101797 - protein, 9 aa, Homo Sapiens
ACAVPSQTS

SEQ ID NO: 101798 - protein, 9 aa, Homo Sapiens
EKDQSTMPE

SEQ ID NO: 101799 - protein, 9 aa, Homo Sapiens
GVFLYSGHP

SEQ ID NO: 101800 - protein, 9 aa, Homo Sapiens
LCIFDDVIK

SEQ ID NO: 101801 - protein, 9 aa, Homo Sapiens
HHHHRGTDF

SEQ ID NO: 101802 - protein, 9 aa, Homo Sapiens
EQIEIKRLW

SEQ ID NO: 101803 - protein, 9 aa, Homo Sapiens
ATKKHQDQA

SEQ ID NO: 101804 - protein, 9 aa, Homo Sapiens
QRLWPWPAT

SEQ ID NO: 101805 - protein, 9 aa, Homo Sapiens
FDDVIKHCS

SEQ ID NO: 101806 - protein, 9 aa, Homo Sapiens
VQEKSQIER

SEQ ID NO: 101807 - protein, 9 aa, Homo Sapiens
TTEDPCVRS

SEQ ID NO: 101808 - protein, 9 aa, Homo Sapiens
YADGLEQLC

SEQ ID NO: 101809 - protein, 9 aa, Homo Sapiens
RYHLILLLE

SEQ ID NO: 101810 - protein, 9 aa, Homo Sapiens
RAKKGTSDP

SEQ ID NO: 101811 - protein, 9 aa, Homo Sapiens
ALACSALEV

SEQ ID NO: 101812 - protein, 9 aa, Homo Sapiens
AVEDAKWTA

SEQ ID NO: 101813 - protein, 9 aa, Homo Sapiens
LEQAVEDAK

SEQ ID NO: 101814 - protein, 9 aa, Homo Sapiens
YIVCSLALG

SEQ ID NO: 101815 - protein, 9 aa, Homo Sapiens
QILDEALNI

SEQ ID NO: 101816 - protein, 9 aa, Homo Sapiens
VDNQALKSH

SEQ ID NO: 101817 - protein, 9 aa, Homo Sapiens
LVAEGHPDP

SEQ ID NO: 101818 - protein, 9 aa, Homo Sapiens
ECIPSSVFL

SEQ ID NO: 101819 - protein, 9 aa, Homo Sapiens
WSQIPLPYG

SEQ ID NO: 101820 - protein, 9 aa, Homo Sapiens
WATTDIIKH

SEQ ID NO: 101821 - protein, 9 aa, Homo Sapiens
FNAPLEVTK

SEQ ID NO: 101822 - protein, 9 aa, Homo Sapiens
RLCTVEAVR

SEQ ID NO: 101823 - protein, 9 aa, Homo Sapiens
NFICVSALR

SEQ ID NO: 101824 - protein, 9 aa, Homo Sapiens
NGLCQNTPG

SEQ ID NO: 101825 - protein, 9 aa, Homo Sapiens
DLNRGVNYR

SEQ ID NO: 101826 - protein, 9 aa, Homo Sapiens
YFSAHVPQV

SEQ ID NO: 101827 - protein, 9 aa, Homo Sapiens
QRGEILLRQ

SEQ ID NO: 101828 - protein, 9 aa, Homo Sapiens
KAFRCHWSL

SEQ ID NO: 101829 - protein, 9 aa, Homo Sapiens
VEDYLDSME

SEQ ID NO: 101830 - protein, 9 aa, Homo Sapiens
LGNMGLLQQ

SEQ ID NO: 101831 - protein, 9 aa, Homo Sapiens
YSLTFRRHT

SEQ ID NO: 101832 - protein, 9 aa, Homo Sapiens
DSMESLPFD

SEQ ID NO: 101833 - protein, 9 aa, Homo Sapiens
RPKPRAKKG

SEQ ID NO: 101834 - protein, 9 aa, Homo Sapiens
ALKSHRDQL

SEQ ID NO: 101835 - protein, 9 aa, Homo Sapiens
ACMVKANSA

SEQ ID NO: 101836 - protein, 9 aa, Homo Sapiens
NRRHELYKA

SEQ ID NO: 101837 - protein, 9 aa, Homo Sapiens
KATRFAAAY

SEQ ID NO: 101838 - protein, 9 aa, Homo Sapiens
VFATLQYHI

SEQ ID NO: 101839 - protein, 9 aa, Homo Sapiens
NELLSPVKD

SEQ ID NO: 101840 - protein, 9 aa, Homo Sapiens
LALGLYQWD

SEQ ID NO: 101841 - protein, 9 aa, Homo Sapiens
EGEDLRNCM

SEQ ID NO: 101842 - protein, 9 aa, Homo Sapiens
LDINPKDAN

SEQ ID NO: 101843 - protein, 9 aa, Homo Sapiens
MVFATLQYH

SEQ ID NO: 101844 - protein, 9 aa, Homo Sapiens
EWFGRTIIC

SEQ ID NO: 101845 - protein, 9 aa, Homo Sapiens
RIAGKASRL

SEQ ID NO: 101846 - protein, 9 aa, Homo Sapiens
IDNENYSRY

SEQ ID NO: 101847 - protein, 9 aa, Homo Sapiens
LPAVLLLIG

SEQ ID NO: 101848 - protein, 9 aa, Homo Sapiens
YVTPEYCLG

SEQ ID NO: 101849 - protein, 9 aa, Homo Sapiens
PKSENEKPG

SEQ ID NO: 101850 - protein, 9 aa, Homo Sapiens
VFNTALEQG

SEQ ID NO: 101851 - protein, 9 aa, Homo Sapiens
SFVTEDKVE

SEQ ID NO: 101852 - protein, 9 aa, Homo Sapiens
DKVEWMRQA

SEQ ID NO: 101853 - protein, 9 aa, Homo Sapiens
ANLQQHLRQ

SEQ ID NO: 101854 - protein, 9 aa, Homo Sapiens
HVCNACDNT

SEQ ID NO: 101855 - protein, 9 aa, Homo Sapiens
AVLLLIGGV

SEQ ID NO: 101856 - protein, 9 aa, Homo Sapiens
ELLSPVKDS

SEQ ID NO: 101857 - protein, 9 aa, Homo Sapiens
HWSLSRHQR

SEQ ID NO: 101858 - protein, 9 aa, Homo Sapiens
GLSSQPSEK

SEQ ID NO: 101859 - protein, 9 aa, Homo Sapiens
QPLDQLVWR

SEQ ID NO: 101860 - protein, 9 aa, Homo Sapiens
TNTKNILHT

SEQ ID NO: 101861 - protein, 9 aa, Homo Sapiens
QRLVAEGHP

SEQ ID NO: 101862 - protein, 9 aa, Homo Sapiens
DKTQSIDSE

SEQ ID NO: 101863 - protein, 9 aa, Homo Sapiens
MSTTLKIIS

SEQ ID NO: 101864 - protein, 9 aa, Homo Sapiens
CDNTGRYAY

SEQ ID NO: 101865 - protein, 9 aa, Homo Sapiens
SEHAAGCCL

SEQ ID NO: 101866 - protein, 9 aa, Homo Sapiens
LLGNYESAM

SEQ ID NO: 101867 - protein, 9 aa, Homo Sapiens
AMDIKFQQS

SEQ ID NO: 101868 - protein, 9 aa, Homo Sapiens
MKSGFAFGR

SEQ ID NO: 101869 - protein, 9 aa, Homo Sapiens
NGGCIMAAA

SEQ ID NO: 101870 - protein, 9 aa, Homo Sapiens
YFQLRSQGI

SEQ ID NO: 101871 - protein, 9 aa, Homo Sapiens
AAKRGAGQQ

SEQ ID NO: 101872 - protein, 9 aa, Homo Sapiens
DPCVRSHVS

SEQ ID NO: 101873 - protein, 9 aa, Homo Sapiens
WKTLNGFES

SEQ ID NO: 101874 - protein, 9 aa, Homo Sapiens
VMNRMHMVS

SEQ ID NO: 101875 - protein, 9 aa, Homo Sapiens
SFISHSSIR

SEQ ID NO: 101876 - protein, 9 aa, Homo Sapiens
HGMQVLEIH

SEQ ID NO: 101877 - protein, 9 aa, Homo Sapiens
IKEDLVSSW

SEQ ID NO: 101878 - protein, 9 aa, Homo Sapiens
QMGADHGPH

SEQ ID NO: 101879 - protein, 9 aa, Homo Sapiens
LEDYFYYFQ

SEQ ID NO: 101880 - protein, 9 aa, Homo Sapiens
VLIVVEQMN

SEQ ID NO: 101881 - protein, 9 aa, Homo Sapiens
CFPFYVDSF

SEQ ID NO: 101882 - protein, 9 aa, Homo Sapiens
SEGMSEHAA

SEQ ID NO: 101883 - protein, 9 aa, Homo Sapiens
LNRGVNYRA

SEQ ID NO: 101884 - protein, 9 aa, Homo Sapiens
EKILNREID

SEQ ID NO: 101885 - protein, 9 aa, Homo Sapiens
LNMQFIKDS

SEQ ID NO: 101886 - protein, 9 aa, Homo Sapiens
DNENYSRYP

SEQ ID NO: 101887 - protein, 9 aa, Homo Sapiens
ALLGNYESA

SEQ ID NO: 101888 - protein, 9 aa, Homo Sapiens
QIPLPYGTH

SEQ ID NO: 101889 - protein, 9 aa, Homo Sapiens
INSLHTSPG

SEQ ID NO: 101890 - protein, 9 aa, Homo Sapiens
TTLPTHLPP

SEQ ID NO: 101891 - protein, 9 aa, Homo Sapiens
IFDDVIKHC

SEQ ID NO: 101892 - protein, 9 aa, Homo Sapiens
HNPMYFLLR

SEQ ID NO: 101893 - protein, 9 aa, Homo Sapiens
KENFFEICD

SEQ ID NO: 101894 - protein, 9 aa, Homo Sapiens
PKPRAKKGT

SEQ ID NO: 101895 - protein, 9 aa, Homo Sapiens
HVETKVDGR

SEQ ID NO: 101896 - protein, 9 aa, Homo Sapiens
KYSQHPDLG

SEQ ID NO: 101897 - protein, 9 aa, Homo Sapiens
EKSQIEREE

SEQ ID NO: 101898 - protein, 9 aa, Homo Sapiens
QALGESPEL

SEQ ID NO: 101899 - protein, 9 aa, Homo Sapiens
GKQMECPPE

SEQ ID NO: 101900 - protein, 9 aa, Homo Sapiens
KTAQEHNEN

SEQ ID NO: 101901 - protein, 9 aa, Homo Sapiens
SEKDQSTMP

SEQ ID NO: 101902 - protein, 9 aa, Homo Sapiens
KYKAQGSLT

SEQ ID NO: 101903 - protein, 9 aa, Homo Sapiens
DAKWTAAFN

SEQ ID NO: 101904 - protein, 9 aa, Homo Sapiens
ACDNTGRYA

SEQ ID NO: 101905 - protein, 9 aa, Homo Sapiens
ARVSVSEKH

SEQ ID NO: 101906 - protein, 9 aa, Homo Sapiens
DGKRVTTSS

SEQ ID NO: 101907 - protein, 9 aa, Homo Sapiens
EVDKVWPNV

SEQ ID NO: 101908 - protein, 9 aa, Homo Sapiens
ILLLEASCL

SEQ ID NO: 101909 - protein, 9 aa, Homo Sapiens
ATTDIIKHL

SEQ ID NO: 101910 - protein, 9 aa, Homo Sapiens
KESVTADAR

SEQ ID NO: 101911 - protein, 9 aa, Homo Sapiens
ESPELSSSE

SEQ ID NO: 101912 - protein, 9 aa, Homo Sapiens
TFRKVMQTP

SEQ ID NO: 101913 - protein, 9 aa, Homo Sapiens
CAVPSQTSV

SEQ ID NO: 101914 - protein, 9 aa, Homo Sapiens
ATLQYHINK

SEQ ID NO: 101915 - protein, 9 aa, Homo Sapiens
EVTITKTLK

SEQ ID NO: 101916 - protein, 9 aa, Homo Sapiens
VLKKQGEQK

SEQ ID NO: 101917 - protein, 9 aa, Homo Sapiens
CLLKQPIQY

SEQ ID NO: 101918 - protein, 9 aa, Homo Sapiens
CWRDYLRLF

SEQ ID NO: 101919 - protein, 9 aa, Homo Sapiens
QLHPQNCEV

SEQ ID NO: 101920 - protein, 9 aa, Homo Sapiens
ELSSSELLN

SEQ ID NO: 101921 - protein, 9 aa, Homo Sapiens
TEDKVEWMR

SEQ ID NO: 101922 - protein, 9 aa, Homo Sapiens
TADARRYEI

SEQ ID NO: 101923 - protein, 9 aa, Homo Sapiens
YDEAIQDYK

SEQ ID NO: 101924 - protein, 9 aa, Homo Sapiens
VMRMQEGLN

SEQ ID NO: 101925 - protein, 9 aa, Homo Sapiens
YGQVTSPRL

SEQ ID NO: 101926 - protein, 9 aa, Homo Sapiens
SPGSKVMST

SEQ ID NO: 101927 - protein, 9 aa, Homo Sapiens
EAIQDYKTA

SEQ ID NO: 101928 - protein, 9 aa, Homo Sapiens
WKITTYVSF

SEQ ID NO: 101929 - protein, 9 aa, Homo Sapiens
FPNYKDRRG

SEQ ID NO: 101930 - protein, 9 aa, Homo Sapiens
RQRLVAEGH

SEQ ID NO: 101931 - protein, 9 aa, Homo Sapiens
LNICNYIFT

SEQ ID NO: 101932 - protein, 9 aa, Homo Sapiens
PSQDEKHEK

SEQ ID NO: 101933 - protein, 9 aa, Homo Sapiens
IKFQQSVSK

SEQ ID NO: 101934 - protein, 9 aa, Homo Sapiens
KSQIEREEK

SEQ ID NO: 101935 - protein, 9 aa, Homo Sapiens
QKGTKVQAK

SEQ ID NO: 101936 - protein, 9 aa, Homo Sapiens
FPLDLDINP

SEQ ID NO: 101937 - protein, 9 aa, Homo Sapiens
WTENRLLKQ

SEQ ID NO: 101938 - protein, 9 aa, Homo Sapiens
NLQQHLRQH

SEQ ID NO: 101939 - protein, 9 aa, Homo Sapiens
PLSVYLTKQ

SEQ ID NO: 101940 - protein, 9 aa, Homo Sapiens
AWKPSPTAC

SEQ ID NO: 101941 - protein, 9 aa, Homo Sapiens
QATKKHQDQ

SEQ ID NO: 101942 - protein, 9 aa, Homo Sapiens
IYVSGSQVV

SEQ ID NO: 101943 - protein, 9 aa, Homo Sapiens
LACSALEVT

SEQ ID NO: 101944 - protein, 9 aa, Homo Sapiens
IVAMDWLVR

SEQ ID NO: 101945 - protein, 9 aa, Homo Sapiens
SCLGDSEEE

SEQ ID NO: 101946 - protein, 9 aa, Homo Sapiens
AVGSYLVPP

SEQ ID NO: 101947 - protein, 9 aa, Homo Sapiens
KILNREIDF

SEQ ID NO: 101948 - protein, 9 aa, Homo Sapiens
SAATEHSRC

SEQ ID NO: 101949 - protein, 9 aa, Homo Sapiens
GNEQFRCPE

SEQ ID NO: 101950 - protein, 9 aa, Homo Sapiens
CLGNMGLLQ

SEQ ID NO: 101951 - protein, 9 aa, Homo Sapiens
QNGRNYYNP

SEQ ID NO: 101952 - protein, 9 aa, Homo Sapiens
QALKSHRDQ

SEQ ID NO: 101953 - protein, 9 aa, Homo Sapiens
LLLEASCLR

SEQ ID NO: 101954 - protein, 9 aa, Homo Sapiens
MNRMHMVSV

SEQ ID NO: 101955 - protein, 9 aa, Homo Sapiens
EDKTQSIDS

SEQ ID NO: 101956 - protein, 9 aa, Homo Sapiens
FATGSWDNQ

SEQ ID NO: 101957 - protein, 9 aa, Homo Sapiens
CKKGTIQQM

SEQ ID NO: 101958 - protein, 9 aa, Homo Sapiens
VQVLLNDDL

SEQ ID NO: 101959 - protein, 9 aa, Homo Sapiens
KAFSYSLTF

SEQ ID NO: 101960 - protein, 9 aa, Homo Sapiens
NENYSRYPP

SEQ ID NO: 101961 - protein, 9 aa, Homo Sapiens
WNAALVPPT

SEQ ID NO: 101962 - protein, 9 aa, Homo Sapiens
AQYIAKMTI

SEQ ID NO: 101963 - protein, 9 aa, Homo Sapiens
GKYIVCSLA

SEQ ID NO: 101964 - protein, 9 aa, Homo Sapiens
FQVKVCDEG

SEQ ID NO: 101965 - protein, 9 aa, Homo Sapiens
DYLDSMESL

SEQ ID NO: 101966 - protein, 9 aa, Homo Sapiens
PAQPLDQLV

SEQ ID NO: 101967 - protein, 9 aa, Homo Sapiens
LWTENRLLK

SEQ ID NO: 101968 - protein, 9 aa, Homo Sapiens
SAMDIKFQQ

SEQ ID NO: 101969 - protein, 9 aa, Homo Sapiens
KECYFVFTN

SEQ ID NO: 101970 - protein, 9 aa, Homo Sapiens
TKNILHTLT

SEQ ID NO: 101971 - protein, 9 aa, Homo Sapiens
QYIINNKGI

SEQ ID NO: 101972 - protein, 9 aa, Homo Sapiens
ECKQEGEEK

SEQ ID NO: 101973 - protein, 9 aa, Homo Sapiens
TELQQAVSN

SEQ ID NO: 101974 - protein, 9 aa, Homo Sapiens
IQDYKTAQE

SEQ ID NO: 101975 - protein, 9 aa, Homo Sapiens
IGIVAMDWL

SEQ ID NO: 101976 - protein, 9 aa, Homo Sapiens
NMQFIKDSR

SEQ ID NO: 101977 - protein, 9 aa, Homo Sapiens
GAAVHRSGV

SEQ ID NO: 101978 - protein, 9 aa, Homo Sapiens
VEDAKWTAA

SEQ ID NO: 101979 - protein, 9 aa, Homo Sapiens
GKAFSYSLT

SEQ ID NO: 101980 - protein, 9 aa, Homo Sapiens
GRPVQVLLN

SEQ ID NO: 101981 - protein, 9 aa, Homo Sapiens
DCTTIHCNY

SEQ ID NO: 101982 - protein, 9 aa, Homo Sapiens
AGATPKKAN

SEQ ID NO: 101983 - protein, 9 aa, Homo Sapiens
TVSNITDQA

SEQ ID NO: 101984 - protein, 9 aa, Homo Sapiens
PIEKVLPSC

SEQ ID NO: 101985 - protein, 9 aa, Homo Sapiens
TEGTAKANW

SEQ ID NO: 101986 - protein, 9 aa, Homo Sapiens
NPTTVYVDL

SEQ ID NO: 101987 - protein, 9 aa, Homo Sapiens
LDLGGFPNY

SEQ ID NO: 101988 - protein, 9 aa, Homo Sapiens
VIVYDTNTK

SEQ ID NO: 101989 - protein, 9 aa, Homo Sapiens
WPWPATQPL

SEQ ID NO: 101990 - protein, 9 aa, Homo Sapiens
CSFVTEDKV

SEQ ID NO: 101991 - protein, 9 aa, Homo Sapiens
DDVIKHCSP

SEQ ID NO: 101992 - protein, 9 aa, Homo Sapiens
TSFTFRKVM

SEQ ID NO: 101993 - protein, 9 aa, Homo Sapiens
MMRQIRKVL

SEQ ID NO: 101994 - protein, 9 aa, Homo Sapiens
LGPFFVYCN

SEQ ID NO: 101995 - protein, 9 aa, Homo Sapiens
TKAAQYIAK

SEQ ID NO: 101996 - protein, 9 aa, Homo Sapiens
DGLEQLCGA

SEQ ID NO: 101997 - protein, 9 aa, Homo Sapiens
VSEKHGMQV

SEQ ID NO: 101998 - protein, 9 aa, Homo Sapiens
HCNYMCNSS

SEQ ID NO: 101999 - protein, 9 aa, Homo Sapiens
ECYFVFTNR

SEQ ID NO: 102000 - protein, 9 aa, Homo Sapiens
EDSTEGTAK

SEQ ID NO: 102001 - protein, 9 aa, Homo Sapiens
LAVCINPEM

SEQ ID NO: 102002 - protein, 9 aa, Homo Sapiens
TGSWPKRGT

SEQ ID NO: 102003 - protein, 9 aa, Homo Sapiens
CIFDDVIKH

SEQ ID NO: 102004 - protein, 9 aa, Homo Sapiens
PLGPFFVYC

SEQ ID NO: 102005 - protein, 9 aa, Homo Sapiens
KVEWMRQAG

SEQ ID NO: 102006 - protein, 9 aa, Homo Sapiens
SGHPIKQVD

SEQ ID NO: 102007 - protein, 9 aa, Homo Sapiens
TIHCNYMCN

SEQ ID NO: 102008 - protein, 9 aa, Homo Sapiens
LGSSSRFVY

SEQ ID NO: 102009 - protein, 9 aa, Homo Sapiens
RQRQLGSSS

SEQ ID NO: 102010 - protein, 9 aa, Homo Sapiens
QVPGVFLYS

SEQ ID NO: 102011 - protein, 9 aa, Homo Sapiens
CGKAFSYSL

SEQ ID NO: 102012 - protein, 9 aa, Homo Sapiens
SGPLGPFFV

SEQ ID NO: 102013 - protein, 9 aa, Homo Sapiens
ACASDHVKV

SEQ ID NO: 102014 - protein, 9 aa, Homo Sapiens
KPSPTACLL

SEQ ID NO: 102015 - protein, 9 aa, Homo Sapiens
SPIEKVLPS

SEQ ID NO: 102016 - protein, 9 aa, Homo Sapiens
LNIDNENYS

SEQ ID NO: 102017 - protein, 9 aa, Homo Sapiens
RTGLFLCFL

SEQ ID NO: 102018 - protein, 9 aa, Homo Sapiens
DKVWPNVFI

SEQ ID NO: 102019 - protein, 9 aa, Homo Sapiens
MRMQEGLNV

SEQ ID NO: 102020 - protein, 9 aa, Homo Sapiens
FGRTIICSC

SEQ ID NO: 102021 - protein, 9 aa, Homo Sapiens
FDISTKEGS

SEQ ID NO: 102022 - protein, 9 aa, Homo Sapiens
GCLGLGNVQ

SEQ ID NO: 102023 - protein, 9 aa, Homo Sapiens
ALRFHGQPG

SEQ ID NO: 102024 - protein, 9 aa, Homo Sapiens
GMDILCVRK

SEQ ID NO: 102025 - protein, 9 aa, Homo Sapiens
ELEDYFYYF

SEQ ID NO: 102026 - protein, 9 aa, Homo Sapiens
ADHGPHVVL

SEQ ID NO: 102027 - protein, 9 aa, Homo Sapiens
SGPNPTTVY

SEQ ID NO: 102028 - protein, 9 aa, Homo Sapiens
QHATLVFNT

SEQ ID NO: 102029 - protein, 9 aa, Homo Sapiens
IPSSVFLVS

SEQ ID NO: 102030 - protein, 9 aa, Homo Sapiens
GITESPKYL

SEQ ID NO: 102031 - protein, 9 aa, Homo Sapiens
SPTACLLKQ

SEQ ID NO: 102032 - protein, 9 aa, Homo Sapiens
LQQHLRQHI

SEQ ID NO: 102033 - protein, 9 aa, Homo Sapiens
HSSIRRHRI

SEQ ID NO: 102034 - protein, 9 aa, Homo Sapiens
QEGLNVSKM

SEQ ID NO: 102035 - protein, 9 aa, Homo Sapiens
EHSRCNTTQ

SEQ ID NO: 102036 - protein, 9 aa, Homo Sapiens
GTAKANWAK

SEQ ID NO: 102037 - protein, 9 aa, Homo Sapiens
DHVKVVTLL

SEQ ID NO: 102038 - protein, 9 aa, Homo Sapiens
FQEKPNRRH

SEQ ID NO: 102039 - protein, 9 aa, Homo Sapiens
LKKQGEQKG

SEQ ID NO: 102040 - protein, 9 aa, Homo Sapiens
PRLEHYAAP

SEQ ID NO: 102041 - protein, 9 aa, Homo Sapiens
DGGTGSWPK

SEQ ID NO: 102042 - protein, 9 aa, Homo Sapiens
IPGYPGPWL

SEQ ID NO: 102043 - protein, 9 aa, Homo Sapiens
GIVAMDWLV

SEQ ID NO: 102044 - protein, 9 aa, Homo Sapiens
LTFRRHTIT

SEQ ID NO: 102045 - protein, 9 aa, Homo Sapiens
NVQSTIEPR

SEQ ID NO: 102046 - protein, 9 aa, Homo Sapiens
VENQKSCEP

SEQ ID NO: 102047 - protein, 9 aa, Homo Sapiens
HRDQLSLQL

SEQ ID NO: 102048 - protein, 9 aa, Homo Sapiens
PCQSPASMS

SEQ ID NO: 102049 - protein, 9 aa, Homo Sapiens
AQPLDQLVW

SEQ ID NO: 102050 - protein, 9 aa, Homo Sapiens
WEGRPLPLI

SEQ ID NO: 102051 - protein, 9 aa, Homo Sapiens
LSPFYFSAH

SEQ ID NO: 102052 - protein, 9 aa, Homo Sapiens
TRHNKIHTG

SEQ ID NO: 102053 - protein, 9 aa, Homo Sapiens
HLACASDHV

SEQ ID NO: 102054 - protein, 9 aa, Homo Sapiens
NTKLNMQFI

SEQ ID NO: 102055 - protein, 9 aa, Homo Sapiens
IKLVQEKSQ

SEQ ID NO: 102056 - protein, 9 aa, Homo Sapiens
TLAHHHHRG

SEQ ID NO: 102057 - protein, 9 aa, Homo Sapiens
TKLNMQFIK

SEQ ID NO: 102058 - protein, 9 aa, Homo Sapiens
CFLCSRFPQ

SEQ ID NO: 102059 - protein, 9 aa, Homo Sapiens
QIRKVLDAN

SEQ ID NO: 102060 - protein, 9 aa, Homo Sapiens
TISPLVVAK

SEQ ID NO: 102061 - protein, 9 aa, Homo Sapiens
ATQPLPGGL

SEQ ID NO: 102062 - protein, 9 aa, Homo Sapiens
QGEQKGTKV

SEQ ID NO: 102063 - protein, 9 aa, Homo Sapiens
ETVNKDLCK

SEQ ID NO: 102064 - protein, 9 aa, Homo Sapiens
DRPKPRAKK

SEQ ID NO: 102065 - protein, 9 aa, Homo Sapiens
AFSYSLTFR

SEQ ID NO: 102066 - protein, 9 aa, Homo Sapiens
CNECGNNFI

SEQ ID NO: 102067 - protein, 9 aa, Homo Sapiens
KEILREMTH

SEQ ID NO: 102068 - protein, 9 aa, Homo Sapiens
DLDINPKDA

SEQ ID NO: 102069 - protein, 9 aa, Homo Sapiens
PEQKSSERT

SEQ ID NO: 102070 - protein, 9 aa, Homo Sapiens
HLHDIGIVA

SEQ ID NO: 102071 - protein, 9 aa, Homo Sapiens
SLLTLWPPR

SEQ ID NO: 102072 - protein, 9 aa, Homo Sapiens
EEEMMVFAT

SEQ ID NO: 102073 - protein, 9 aa, Homo Sapiens
INPKDANKG

SEQ ID NO: 102074 - protein, 9 aa, Homo Sapiens
DEGEDLRNC

SEQ ID NO: 102075 - protein, 9 aa, Homo Sapiens
QEKWDATSP

SEQ ID NO: 102076 - protein, 9 aa, Homo Sapiens
YALLGNYES

SEQ ID NO: 102077 - protein, 9 aa, Homo Sapiens
VAMDWLVRN

SEQ ID NO: 102078 - protein, 9 aa, Homo Sapiens
VKECYFVFT

SEQ ID NO: 102079 - protein, 9 aa, Homo Sapiens
ADARRYEIT

SEQ ID NO: 102080 - protein, 9 aa, Homo Sapiens
YSRGTFSLL

SEQ ID NO: 102081 - protein, 9 aa, Homo Sapiens
EDYFYYFQL

SEQ ID NO: 102082 - protein, 9 aa, Homo Sapiens
HGKTVGVVN

SEQ ID NO: 102083 - protein, 9 aa, Homo Sapiens
AAVHRSGVS

SEQ ID NO: 102084 - protein, 9 aa, Homo Sapiens
KASRLAHYN

SEQ ID NO: 102085 - protein, 9 aa, Homo Sapiens
HPQNCEVMK

SEQ ID NO: 102086 - protein, 9 aa, Homo Sapiens
TVKNFEKTP

SEQ ID NO: 102087 - protein, 9 aa, Homo Sapiens
PRYHLILLL

SEQ ID NO: 102088 - protein, 9 aa, Homo Sapiens
RWLHGAAVH

SEQ ID NO: 102089 - protein, 9 aa, Homo Sapiens
VEGARPFSD

SEQ ID NO: 102090 - protein, 9 aa, Homo Sapiens
LRQTANDAV

SEQ ID NO: 102091 - protein, 9 aa, Homo Sapiens
SLSKYKAQG

SEQ ID NO: 102092 - protein, 9 aa, Homo Sapiens
LDSMESLPF

SEQ ID NO: 102093 - protein, 9 aa, Homo Sapiens
KTQSIDSED

SEQ ID NO: 102094 - protein, 9 aa, Homo Sapiens
GLCQNTPGS

SEQ ID NO: 102095 - protein, 9 aa, Homo Sapiens
WRDYLRLFG

SEQ ID NO: 102096 - protein, 9 aa, Homo Sapiens
PLPYGTHTF

SEQ ID NO: 102097 - protein, 9 aa, Homo Sapiens
DMMRQIRKV

SEQ ID NO: 102098 - protein, 9 aa, Homo Sapiens
ICSCTKLSY

SEQ ID NO: 102099 - protein, 9 aa, Homo Sapiens
QENYISLWS

SEQ ID NO: 102100 - protein, 9 aa, Homo Sapiens
LMSSPGSKV

SEQ ID NO: 102101 - protein, 9 aa, Homo Sapiens
MVSVPYALM

SEQ ID NO: 102102 - protein, 9 aa, Homo Sapiens
HAAGCCLSE

SEQ ID NO: 102103 - protein, 9 aa, Homo Sapiens
VKDSDEIRS

SEQ ID NO: 102104 - protein, 9 aa, Homo Sapiens
GLGNVQSTI

SEQ ID NO: 102105 - protein, 9 aa, Homo Sapiens
LDTYPAWAT

SEQ ID NO: 102106 - protein, 9 aa, Homo Sapiens
QQPDRPRDV

SEQ ID NO: 102107 - protein, 9 aa, Homo Sapiens
NLNIDNENY

SEQ ID NO: 102108 - protein, 9 aa, Homo Sapiens
NACDNTGRY

SEQ ID NO: 102109 - protein, 9 aa, Homo Sapiens
QGTSGPNPT

SEQ ID NO: 102110 - protein, 9 aa, Homo Sapiens
PLPSLSKYK

SEQ ID NO: 102111 - protein, 9 aa, Homo Sapiens
VCSLALGLY

SEQ ID NO: 102112 - protein, 9 aa, Homo Sapiens
QVEGARPFS

SEQ ID NO: 102113 - protein, 9 aa, Homo Sapiens
YDTNTKNIL

SEQ ID NO: 102114 - protein, 9 aa, Homo Sapiens
PWPATQPLP

SEQ ID NO: 102115 - protein, 9 aa, Homo Sapiens
FPLTLACAV

SEQ ID NO: 102116 - protein, 9 aa, Homo Sapiens
GRNELLSPV

SEQ ID NO: 102117 - protein, 9 aa, Homo Sapiens
VSVSEKHGM

SEQ ID NO: 102118 - protein, 9 aa, Homo Sapiens
EILLRQTAN

SEQ ID NO: 102119 - protein, 9 aa, Homo Sapiens
DGKYIVCSL

SEQ ID NO: 102120 - protein, 9 aa, Homo Sapiens
YVDSFTVSQ

SEQ ID NO: 102121 - protein, 9 aa, Homo Sapiens
CTTIHCNYM

SEQ ID NO: 102122 - protein, 9 aa, Homo Sapiens
GGFPNYKDR

SEQ ID NO: 102123 - protein, 9 aa, Homo Sapiens
ATVKNFEKT

SEQ ID NO: 102124 - protein, 9 aa, Homo Sapiens
LEHYAAPQL

SEQ ID NO: 102125 - protein, 9 aa, Homo Sapiens
ALNICNYIF

SEQ ID NO: 102126 - protein, 9 aa, Homo Sapiens
GRTETMRLC

SEQ ID NO: 102127 - protein, 9 aa, Homo Sapiens
PSNLAVCIN

SEQ ID NO: 102128 - protein, 9 aa, Homo Sapiens
VDVSLRGSA

SEQ ID NO: 102129 - protein, 9 aa, Homo Sapiens
LTLWPPRFS

SEQ ID NO: 102130 - protein, 9 aa, Homo Sapiens
FAFGRNFGN

SEQ ID NO: 102131 - protein, 9 aa, Homo Sapiens
VETKVDGRR

SEQ ID NO: 102132 - protein, 9 aa, Homo Sapiens
YRPASKGWS

SEQ ID NO: 102133 - protein, 9 aa, Homo Sapiens
ITWKTLNGF

SEQ ID NO: 102134 - protein, 9 aa, Homo Sapiens
LCQNTPGSY

SEQ ID NO: 102135 - protein, 9 aa, Homo Sapiens
NGHTDAFVA

SEQ ID NO: 102136 - protein, 9 aa, Homo Sapiens
FIEQGKQME

SEQ ID NO: 102137 - protein, 9 aa, Homo Sapiens
AGGRGLQQV

SEQ ID NO: 102138 - protein, 9 aa, Homo Sapiens
LIIVVPYTL

SEQ ID NO: 102139 - protein, 9 aa, Homo Sapiens
DRPRDVKLA

SEQ ID NO: 102140 - protein, 9 aa, Homo Sapiens
GSSSRFVYE

SEQ ID NO: 102141 - protein, 9 aa, Homo Sapiens
IPKLPAVLL

SEQ ID NO: 102142 - protein, 9 aa, Homo Sapiens
DEALNICNY

SEQ ID NO: 102143 - protein, 9 aa, Homo Sapiens
CWNAALVPP

SEQ ID NO: 102144 - protein, 9 aa, Homo Sapiens
AGKASRLAH

SEQ ID NO: 102145 - protein, 9 aa, Homo Sapiens
SCSLTRHNK

SEQ ID NO: 102146 - protein, 9 aa, Homo Sapiens
IINNKGIDS

SEQ ID NO: 102147 - protein, 9 aa, Homo Sapiens
KKIDGKRVT

SEQ ID NO: 102148 - protein, 9 aa, Homo Sapiens
VQGMCDVLA

SEQ ID NO: 102149 - protein, 9 aa, Homo Sapiens
STQVRGYDL

SEQ ID NO: 102150 - protein, 9 aa, Homo Sapiens
TIICSCTKL

SEQ ID NO: 102151 - protein, 9 aa, Homo Sapiens
MGADHGPHV

SEQ ID NO: 102152 - protein, 9 aa, Homo Sapiens
PASAMDIKF

SEQ ID NO: 102153 - protein, 9 aa, Homo Sapiens
SVYLTKQLC

SEQ ID NO: 102154 - protein, 9 aa, Homo Sapiens
TVNKDLCKK

SEQ ID NO: 102155 - protein, 9 aa, Homo Sapiens
TTDIIKHLP

SEQ ID NO: 102156 - protein, 9 aa, Homo Sapiens
TTDTSSKNK

SEQ ID NO: 102157 - protein, 9 aa, Homo Sapiens
GKASRLAHY

SEQ ID NO: 102158 - protein, 9 aa, Homo Sapiens
AVLKKQGEQ

SEQ ID NO: 102159 - protein, 9 aa, Homo Sapiens
SNGHTDAFV

SEQ ID NO: 102160 - protein, 9 aa, Homo Sapiens
AELPKRQHL

SEQ ID NO: 102161 - protein, 9 aa, Homo Sapiens
RPPAQPLDQ

SEQ ID NO: 102162 - protein, 9 aa, Homo Sapiens
QKIKYSRGT

SEQ ID NO: 102163 - protein, 9 aa, Homo Sapiens
SRGTFSLLE

SEQ ID NO: 102164 - protein, 9 aa, Homo Sapiens
AKGGTAWLE

SEQ ID NO: 102165 - protein, 9 aa, Homo Sapiens
HIKLVQEKS

SEQ ID NO: 102166 - protein, 9 aa, Homo Sapiens
YRLVENQKS

SEQ ID NO: 102167 - protein, 9 aa, Homo Sapiens
EQAVEDAKW

SEQ ID NO: 102168 - protein, 9 aa, Homo Sapiens
EALNICNYI

SEQ ID NO: 102169 - protein, 9 aa, Homo Sapiens
VAEGHPDPD

SEQ ID NO: 102170 - protein, 9 aa, Homo Sapiens
VARVPAEDK

SEQ ID NO: 102171 - protein, 9 aa, Homo Sapiens
PAWATVSNI

SEQ ID NO: 102172 - protein, 9 aa, Homo Sapiens
EDKVEWMRQ

SEQ ID NO: 102173 - protein, 9 aa, Homo Sapiens
NLRPPAQPL

SEQ ID NO: 102174 - protein, 9 aa, Homo Sapiens
VINTLAHHH

SEQ ID NO: 102175 - protein, 9 aa, Homo Sapiens
NPEQKSSER

SEQ ID NO: 102176 - protein, 9 aa, Homo Sapiens
DSNGHTDAF

SEQ ID NO: 102177 - protein, 9 aa, Homo Sapiens
LPSCLTRII

SEQ ID NO: 102178 - protein, 9 aa, Homo Sapiens
ALKMLLRRS

SEQ ID NO: 102179 - protein, 9 aa, Homo Sapiens
DNQENYISL

SEQ ID NO: 102180 - protein, 9 aa, Homo Sapiens
GYRLVENQK

SEQ ID NO: 102181 - protein, 9 aa, Homo Sapiens
WFGRTIICS

SEQ ID NO: 102182 - protein, 9 aa, Homo Sapiens
PSPTTEDPC

SEQ ID NO: 102183 - protein, 9 aa, Homo Sapiens
VPILSISAG

SEQ ID NO: 102184 - protein, 9 aa, Homo Sapiens
PSSVFLVSL

SEQ ID NO: 102185 - protein, 9 aa, Homo Sapiens
KGGTAWLEW

SEQ ID NO: 102186 - protein, 9 aa, Homo Sapiens
SDPSCVKEI

SEQ ID NO: 102187 - protein, 9 aa, Homo Sapiens
ESKDQVETL

SEQ ID NO: 102188 - protein, 9 aa, Homo Sapiens
HLRQHITEA

SEQ ID NO: 102189 - protein, 9 aa, Homo Sapiens
RAHAISIKS

SEQ ID NO: 102190 - protein, 9 aa, Homo Sapiens
QDYKTAQEH

SEQ ID NO: 102191 - protein, 9 aa, Homo Sapiens
DLCKKGTIQ

SEQ ID NO: 102192 - protein, 9 aa, Homo Sapiens
DIGIVAMDW

SEQ ID NO: 102193 - protein, 9 aa, Homo Sapiens
INTLAHHHH

SEQ ID NO: 102194 - protein, 9 aa, Homo Sapiens
PFFVYCNMT

SEQ ID NO: 102195 - protein, 9 aa, Homo Sapiens
KPESMKAKL

SEQ ID NO: 102196 - protein, 9 aa, Homo Sapiens
TTCVVLIVV

SEQ ID NO: 102197 - protein, 9 aa, Homo Sapiens
LDEALNICN

SEQ ID NO: 102198 - protein, 9 aa, Homo Sapiens
LGNVQSTIE

SEQ ID NO: 102199 - protein, 9 aa, Homo Sapiens
TRTGLFLCF

SEQ ID NO: 102200 - protein, 9 aa, Homo Sapiens
TSVMNRMHM

SEQ ID NO: 102201 - protein, 9 aa, Homo Sapiens
TPEYCLGNM

SEQ ID NO: 102202 - protein, 9 aa, Homo Sapiens
ASAANGGCI

SEQ ID NO: 102203 - protein, 9 aa, Homo Sapiens
LWPPRFSHL

SEQ ID NO: 102204 - protein, 9 aa, Homo Sapiens
HAISIKSAK

SEQ ID NO: 102205 - protein, 9 aa, Homo Sapiens
CNACDNTGR

SEQ ID NO: 102206 - protein, 9 aa, Homo Sapiens
VLVKECYFV

SEQ ID NO: 102207 - protein, 9 aa, Homo Sapiens
LCVRKATRF

SEQ ID NO: 102208 - protein, 9 aa, Homo Sapiens
AKRGAGQQQ

SEQ ID NO: 102209 - protein, 9 aa, Homo Sapiens
EKNTKLNMQ

SEQ ID NO: 102210 - protein, 9 aa, Homo Sapiens
YALDQEVLD

SEQ ID NO: 102211 - protein, 9 aa, Homo Sapiens
ISKTTTCVV

SEQ ID NO: 102212 - protein, 9 aa, Homo Sapiens
RQTANDAVE

SEQ ID NO: 102213 - protein, 9 aa, Homo Sapiens
YHVETKVDG

SEQ ID NO: 102214 - protein, 9 aa, Homo Sapiens
SCVKEILRE

SEQ ID NO: 102215 - protein, 9 aa, Homo Sapiens
GADHGPHVV

SEQ ID NO: 102216 - protein, 9 aa, Homo Sapiens
SVMNRMHMV

SEQ ID NO: 102217 - protein, 9 aa, Homo Sapiens
STEGTAKAN

SEQ ID NO: 102218 - protein, 9 aa, Homo Sapiens
IFERIAGKA

SEQ ID NO: 102219 - protein, 9 aa, Homo Sapiens
SSQSLEHVD

SEQ ID NO: 102220 - protein, 9 aa, Homo Sapiens
IPSQDEKHE

SEQ ID NO: 102221 - protein, 9 aa, Homo Sapiens
CVRSHVSRQ

SEQ ID NO: 102222 - protein, 9 aa, Homo Sapiens
LKIISSKEP

SEQ ID NO: 102223 - protein, 9 aa, Homo Sapiens
YCLGNMGLL

SEQ ID NO: 102224 - protein, 9 aa, Homo Sapiens
SCTEGYRLV

SEQ ID NO: 102225 - protein, 9 aa, Homo Sapiens
ILDEALNIC

SEQ ID NO: 102226 - protein, 9 aa, Homo Sapiens
FQLRSQGID

SEQ ID NO: 102227 - protein, 9 aa, Homo Sapiens
PLDQLVWRA

SEQ ID NO: 102228 - protein, 9 aa, Homo Sapiens
GLARTETQT

SEQ ID NO: 102229 - protein, 9 aa, Homo Sapiens
PECIPSSVF

SEQ ID NO: 102230 - protein, 9 aa, Homo Sapiens
KANWAKEHN

SEQ ID NO: 102231 - protein, 9 aa, Homo Sapiens
LQQAVSNGT

SEQ ID NO: 102232 - protein, 9 aa, Homo Sapiens
EGCHALRFH

SEQ ID NO: 102233 - protein, 9 aa, Homo Sapiens
EMMVFATLQ

SEQ ID NO: 102234 - protein, 9 aa, Homo Sapiens
LEEIRQRLV

SEQ ID NO: 102235 - protein, 9 aa, Homo Sapiens
KIDGKRVTT

SEQ ID NO: 102236 - protein, 9 aa, Homo Sapiens
QRMKCYALD

SEQ ID NO: 102237 - protein, 9 aa, Homo Sapiens
SVFLVSLTS

SEQ ID NO: 102238 - protein, 9 aa, Homo Sapiens
FYYFQLRSQ

SEQ ID NO: 102239 - protein, 9 aa, Homo Sapiens
SSGSMPIYV

SEQ ID NO: 102240 - protein, 9 aa, Homo Sapiens
GVVNTRKKT

SEQ ID NO: 102241 - protein, 9 aa, Homo Sapiens
FERIAGKAS

SEQ ID NO: 102242 - protein, 9 aa, Homo Sapiens
PPASAMDIK

SEQ ID NO: 102243 - protein, 9 aa, Homo Sapiens
NFEKTPNST

SEQ ID NO: 102244 - protein, 9 aa, Homo Sapiens
APWNEVDKV

SEQ ID NO: 102245 - protein, 9 aa, Homo Sapiens
LPSDPSCVK

SEQ ID NO: 102246 - protein, 9 aa, Homo Sapiens
DALKMLLRR

SEQ ID NO: 102247 - protein, 9 aa, Homo Sapiens
GRTIICSCT

SEQ ID NO: 102248 - protein, 9 aa, Homo Sapiens
GGRGLQQVE

SEQ ID NO: 102249 - protein, 9 aa, Homo Sapiens
LKIMNLQQN

SEQ ID NO: 102250 - protein, 9 aa, Homo Sapiens
SLALGLYQW

SEQ ID NO: 102251 - protein, 9 aa, Homo Sapiens
YKLGRKLCW

SEQ ID NO: 102252 - protein, 9 aa, Homo Sapiens
FLSQQPDRP

SEQ ID NO: 102253 - protein, 9 aa, Homo Sapiens
HPGIKVIFP

SEQ ID NO: 102254 - protein, 9 aa, Homo Sapiens
RLLHDFHLL

SEQ ID NO: 102255 - protein, 9 aa, Homo Sapiens
LLCDNGLCQ

SEQ ID NO: 102256 - protein, 9 aa, Homo Sapiens
GIKVIFPPG

SEQ ID NO: 102257 - protein, 9 aa, Homo Sapiens
LGNYESAMV

SEQ ID NO: 102258 - protein, 9 aa, Homo Sapiens
LRPPAQPLD

SEQ ID NO: 102259 - protein, 9 aa, Homo Sapiens
CEVMKMDLS

SEQ ID NO: 102260 - protein, 9 aa, Homo Sapiens
EIKRLWTEN

SEQ ID NO: 102261 - protein, 9 aa, Homo Sapiens
DTSSKNKAP

SEQ ID NO: 102262 - protein, 9 aa, Homo Sapiens
ISAGSAVVL

SEQ ID NO: 102263 - protein, 9 aa, Homo Sapiens
IKVIFPPGA

SEQ ID NO: 102264 - protein, 9 aa, Homo Sapiens
ESRLHNPMY

SEQ ID NO: 102265 - protein, 9 aa, Homo Sapiens
ALDQEVLDM

SEQ ID NO: 102266 - protein, 9 aa, Homo Sapiens
GYPGPWLVP

SEQ ID NO: 102267 - protein, 9 aa, Homo Sapiens
TQVRGYDLN

SEQ ID NO: 102268 - protein, 9 aa, Homo Sapiens
QRVDVSLRG

SEQ ID NO: 102269 - protein, 9 aa, Homo Sapiens
GWIPCRRCP

SEQ ID NO: 102270 - protein, 9 aa, Homo Sapiens
KHVKQNIGP

SEQ ID NO: 102271 - protein, 9 aa, Homo Sapiens
NECGNNFIC

SEQ ID NO: 102272 - protein, 9 aa, Homo Sapiens
LHGAAVHRS

SEQ ID NO: 102273 - protein, 9 aa, Homo Sapiens
LNEPESKDQ

SEQ ID NO: 102274 - protein, 9 aa, Homo Sapiens
YESAMVYYQ

SEQ ID NO: 102275 - protein, 9 aa, Homo Sapiens
PWNEVDKVW

SEQ ID NO: 102276 - protein, 9 aa, Homo Sapiens
LRQHITEAP

SEQ ID NO: 102277 - protein, 9 aa, Homo Sapiens
SSGHPGIKV

SEQ ID NO: 102278 - protein, 9 aa, Homo Sapiens
VLLLIGGVW

SEQ ID NO: 102279 - protein, 9 aa, Homo Sapiens
AKANWAKEH

SEQ ID NO: 102280 - protein, 9 aa, Homo Sapiens
FVFTNRRPF

SEQ ID NO: 102281 - protein, 9 aa, Homo Sapiens
WIPCRRCPK

SEQ ID NO: 102282 - protein, 9 aa, Homo Sapiens
SVSEKHGMQ

SEQ ID NO: 102283 - protein, 9 aa, Homo Sapiens
ISTKEGSTK

SEQ ID NO: 102284 - protein, 9 aa, Homo Sapiens
LCSSGHPGI

SEQ ID NO: 102285 - protein, 9 aa, Homo Sapiens
VDKENSLCG

SEQ ID NO: 102286 - protein, 9 aa, Homo Sapiens
LDQLVWRAA

SEQ ID NO: 102287 - protein, 9 aa, Homo Sapiens
RPLSPFYFS

SEQ ID NO: 102288 - protein, 9 aa, Homo Sapiens
NDMMRQIRK

SEQ ID NO: 102289 - protein, 9 aa, Homo Sapiens
GRDALKMLL

SEQ ID NO: 102290 - protein, 9 aa, Homo Sapiens
GPNPTTVYV

SEQ ID NO: 102291 - protein, 9 aa, Homo Sapiens
ASKGWSPLL

SEQ ID NO: 102292 - protein, 9 aa, Homo Sapiens
CCSASAANG

SEQ ID NO: 102293 - protein, 9 aa, Homo Sapiens
LFLCFLCSR

SEQ ID NO: 102294 - protein, 9 aa, Homo Sapiens
RGYDLNRGV

SEQ ID NO: 102295 - protein, 9 aa, Homo Sapiens
EEIVKHVKQ

SEQ ID NO: 102296 - protein, 9 aa, Homo Sapiens
EAELPKRQH

SEQ ID NO: 102297 - protein, 9 aa, Homo Sapiens
AVCINPEMQ

SEQ ID NO: 102298 - protein, 9 aa, Homo Sapiens
RGTFSLLEE

SEQ ID NO: 102299 - protein, 9 aa, Homo Sapiens
AFIEQGKQM

SEQ ID NO: 102300 - protein, 9 aa, Homo Sapiens
LSPVKDSDE

SEQ ID NO: 102301 - protein, 9 aa, Homo Sapiens
ELQQAVSNG

SEQ ID NO: 102302 - protein, 9 aa, Homo Sapiens
VAELPGSLS

SEQ ID NO: 102303 - protein, 9 aa, Homo Sapiens
DVLAPLLVI

SEQ ID NO: 102304 - protein, 9 aa, Homo Sapiens
GGITESPKY

SEQ ID NO: 102305 - protein, 9 aa, Homo Sapiens
YGVCVMRMQ

SEQ ID NO: 102306 - protein, 9 aa, Homo Sapiens
TRCPMKCWN

SEQ ID NO: 102307 - protein, 9 aa, Homo Sapiens
LLRQTANDA

SEQ ID NO: 102308 - protein, 9 aa, Homo Sapiens
QDEKHEKAE

SEQ ID NO: 102309 - protein, 9 aa, Homo Sapiens
QFRCPEALF

SEQ ID NO: 102310 - protein, 9 aa, Homo Sapiens
CYFVFTNRR

SEQ ID NO: 102311 - protein, 9 aa, Homo Sapiens
IISSKEPSI

SEQ ID NO: 102312 - protein, 9 aa, Homo Sapiens
QAVEECKQE

SEQ ID NO: 102313 - protein, 9 aa, Homo Sapiens
VEIDSNGHT

SEQ ID NO: 102314 - protein, 9 aa, Homo Sapiens
LVQEKSQIE

SEQ ID NO: 102315 - protein, 9 aa, Homo Sapiens
EHSAKLRWK

SEQ ID NO: 102316 - protein, 9 aa, Homo Sapiens
LPPFSTSLV

SEQ ID NO: 102317 - protein, 9 aa, Homo Sapiens
LLVQKQVTI

SEQ ID NO: 102318 - protein, 9 aa, Homo Sapiens
GIYYKPESM

SEQ ID NO: 102319 - protein, 9 aa, Homo Sapiens
PPAQPLDQL

SEQ ID NO: 102320 - protein, 9 aa, Homo Sapiens
KRGTCLAFP

SEQ ID NO: 102321 - protein, 9 aa, Homo Sapiens
TKEGSTKRK

SEQ ID NO: 102322 - protein, 9 aa, Homo Sapiens
CPECIPSSV

SEQ ID NO: 102323 - protein, 9 aa, Homo Sapiens
NPKDANKGT

SEQ ID NO: 102324 - protein, 9 aa, Homo Sapiens
DQIPGYPGP

SEQ ID NO: 102325 - protein, 9 aa, Homo Sapiens
GQVTSPRLE

SEQ ID NO: 102326 - protein, 9 aa, Homo Sapiens
PESKDQVET

SEQ ID NO: 102327 - protein, 9 aa, Homo Sapiens
AMDWLVRNV

SEQ ID NO: 102328 - protein, 9 aa, Homo Sapiens
TLNGFESNG

SEQ ID NO: 102329 - protein, 9 aa, Homo Sapiens
PLPLIIVVP

SEQ ID NO: 102330 - protein, 9 aa, Homo Sapiens
NDQIPGYPG

SEQ ID NO: 102331 - protein, 9 aa, Homo Sapiens
EGMSEHAAG

SEQ ID NO: 102332 - protein, 9 aa, Homo Sapiens
RMTRILARH

SEQ ID NO: 102333 - protein, 9 aa, Homo Sapiens
LGMSDSVKD

SEQ ID NO: 102334 - protein, 9 aa, Homo Sapiens
GRKLCWRDY

SEQ ID NO: 102335 - protein, 9 aa, Homo Sapiens
EIRQRLVAE

SEQ ID NO: 102336 - protein, 9 aa, Homo Sapiens
YLDSMESLP

SEQ ID NO: 102337 - protein, 9 aa, Homo Sapiens
DKENSLCGS

SEQ ID NO: 102338 - protein, 9 aa, Homo Sapiens
FVTEDKVEW

SEQ ID NO: 102339 - protein, 9 aa, Homo Sapiens
IVYDTNTKN

SEQ ID NO: 102340 - protein, 9 aa, Homo Sapiens
RWKITTYVS

SEQ ID NO: 102341 - protein, 9 aa, Homo Sapiens
PGIKVIFPP

SEQ ID NO: 102342 - protein, 9 aa, Homo Sapiens
FVAELPGSL

SEQ ID NO: 102343 - protein, 9 aa, Homo Sapiens
IQEIKEDLV

SEQ ID NO: 102344 - protein, 9 aa, Homo Sapiens
PVQVLLNDD

SEQ ID NO: 102345 - protein, 9 aa, Homo Sapiens
ADGLEQLCG

SEQ ID NO: 102346 - protein, 9 aa, Homo Sapiens
MSEPRKVSP

SEQ ID NO: 102347 - protein, 9 aa, Homo Sapiens
TLFCSLLTL

SEQ ID NO: 102348 - protein, 9 aa, Homo Sapiens
SKTTTCVVL

SEQ ID NO: 102349 - protein, 9 aa, Homo Sapiens
SWATTDIIK

SEQ ID NO: 102350 - protein, 9 aa, Homo Sapiens
EMSTTLKII

SEQ ID NO: 102351 - protein, 9 aa, Homo Sapiens
MSEHAAGCC

SEQ ID NO: 102352 - protein, 9 aa, Homo Sapiens
LVVAKGGTA

SEQ ID NO: 102353 - protein, 9 aa, Homo Sapiens
PASMSEPRK

SEQ ID NO: 102354 - protein, 9 aa, Homo Sapiens
KYSRGTFSL

SEQ ID NO: 102355 - protein, 9 aa, Homo Sapiens
LVITWKTLN

SEQ ID NO: 102356 - protein, 9 aa, Homo Sapiens
SRLHNPMYF

SEQ ID NO: 102357 - protein, 9 aa, Homo Sapiens
VDSFTVSQV

SEQ ID NO: 102358 - protein, 9 aa, Homo Sapiens
YKTAQEHNE

SEQ ID NO: 102359 - protein, 9 aa, Homo Sapiens
QNTPGSYSC

SEQ ID NO: 102360 - protein, 9 aa, Homo Sapiens
SCGGWIPCR

SEQ ID NO: 102361 - protein, 9 aa, Homo Sapiens
AHHHHRGTD

SEQ ID NO: 102362 - protein, 9 aa, Homo Sapiens
IPLPYGTHT

SEQ ID NO: 102363 - protein, 9 aa, Homo Sapiens
STTDTSSKN

SEQ ID NO: 102364 - protein, 9 aa, Homo Sapiens
SKNKAPVPS

SEQ ID NO: 102365 - protein, 9 aa, Homo Sapiens
SSVSCLGDS

SEQ ID NO: 102366 - protein, 9 aa, Homo Sapiens
EEQEKWDAT

SEQ ID NO: 102367 - protein, 9 aa, Homo Sapiens
RRQRVDVSL

SEQ ID NO: 102368 - protein, 9 aa, Homo Sapiens
YATVKNFEK

SEQ ID NO: 102369 - protein, 9 aa, Homo Sapiens
PFYVDSFTV

SEQ ID NO: 102370 - protein, 9 aa, Homo Sapiens
SVTADARRY

SEQ ID NO: 102371 - protein, 9 aa, Homo Sapiens
SGSMPIYVS

SEQ ID NO: 102372 - protein, 9 aa, Homo Sapiens
QSKKKIDGK

SEQ ID NO: 102373 - protein, 9 aa, Homo Sapiens
KEGSTKRKK

SEQ ID NO: 102374 - protein, 9 aa, Homo Sapiens
ACLLKQPIQ

SEQ ID NO: 102375 - protein, 9 aa, Homo Sapiens
NNKGIDSDA

SEQ ID NO: 102376 - protein, 9 aa, Homo Sapiens
MPIYVSGSQ

SEQ ID NO: 102377 - protein, 9 aa, Homo Sapiens
TACLLKQPI

SEQ ID NO: 102378 - protein, 9 aa, Homo Sapiens
KSIVICPLE

SEQ ID NO: 102379 - protein, 9 aa, Homo Sapiens
GGYYPGVYG

SEQ ID NO: 102380 - protein, 9 aa, Homo Sapiens
ILFRTTYAA

SEQ ID NO: 102381 - protein, 9 aa, Homo Sapiens
CTLLPSTSN

SEQ ID NO: 102382 - protein, 9 aa, Homo Sapiens
CPLEPQPAP

SEQ ID NO: 102383 - protein, 9 aa, Homo Sapiens
SGGGTQQDG

SEQ ID NO: 102384 - protein, 9 aa, Homo Sapiens
EQFYSHFCL

SEQ ID NO: 102385 - protein, 9 aa, Homo Sapiens
PPLSSGIIV

SEQ ID NO: 102386 - protein, 9 aa, Homo Sapiens
RSAPLAGAA

SEQ ID NO: 102387 - protein, 9 aa, Homo Sapiens
KQMNDARHG

SEQ ID NO: 102388 - protein, 9 aa, Homo Sapiens
FIIPIFEFS

SEQ ID NO: 102389 - protein, 9 aa, Homo Sapiens
DGLAPPQRL

SEQ ID NO: 102390 - protein, 9 aa, Homo Sapiens
KYNEAIHVE

SEQ ID NO: 102391 - protein, 9 aa, Homo Sapiens
RKPCTLLPS

SEQ ID NO: 102392 - protein, 9 aa, Homo Sapiens
SVPPFVRTH

SEQ ID NO: 102393 - protein, 9 aa, Homo Sapiens
KDKYNEAIH

SEQ ID NO: 102394 - protein, 9 aa, Homo Sapiens
AGLQVEFII

SEQ ID NO: 102395 - protein, 9 aa, Homo Sapiens
VYAHSGGGT

SEQ ID NO: 102396 - protein, 9 aa, Homo Sapiens
VEFPTGLIS

SEQ ID NO: 102397 - protein, 9 aa, Homo Sapiens
PYWPYFTAE

SEQ ID NO: 102398 - protein, 9 aa, Homo Sapiens
LKDKYNEAI

SEQ ID NO: 102399 - protein, 9 aa, Homo Sapiens
SRKPCTLLP

SEQ ID NO: 102400 - protein, 9 aa, Homo Sapiens
PCTLLPSTS

SEQ ID NO: 102401 - protein, 9 aa, Homo Sapiens
GLPYWPYFT

SEQ ID NO: 102402 - protein, 9 aa, Homo Sapiens
LSCKIKQYY

SEQ ID NO: 102403 - protein, 9 aa, Homo Sapiens
GKWKSKRCK

SEQ ID NO: 102404 - protein, 9 aa, Homo Sapiens
YYPGVYGGA

SEQ ID NO: 102405 - protein, 9 aa, Homo Sapiens
ICLVCTEIE

SEQ ID NO: 102406 - protein, 9 aa, Homo Sapiens
PPFVRTHGF

SEQ ID NO: 102407 - protein, 9 aa, Homo Sapiens
ARHGGWTTK

SEQ ID NO: 102408 - protein, 9 aa, Homo Sapiens
STSEQFYSH

SEQ ID NO: 102409 - protein, 9 aa, Homo Sapiens
PWADRSTHR

SEQ ID NO: 102410 - protein, 9 aa, Homo Sapiens
RLSPWADRS

SEQ ID NO: 102411 - protein, 9 aa, Homo Sapiens
QFYSHFCLY

SEQ ID NO: 102412 - protein, 9 aa, Homo Sapiens
FYSHFCLYT

SEQ ID NO: 102413 - protein, 9 aa, Homo Sapiens
AASRKPCTL

SEQ ID NO: 102414 - protein, 9 aa, Homo Sapiens
SAPLAGAAP

SEQ ID NO: 102415 - protein, 9 aa, Homo Sapiens
ADRSTHRGT

SEQ ID NO: 102416 - protein, 9 aa, Homo Sapiens
VEFIIPIFE

SEQ ID NO: 102417 - protein, 9 aa, Homo Sapiens
PSSCDSLKI

SEQ ID NO: 102418 - protein, 9 aa, Homo Sapiens
LPYWPYFTA

SEQ ID NO: 102419 - protein, 9 aa, Homo Sapiens
VQQETQGRF

SEQ ID NO: 102420 - protein, 9 aa, Homo Sapiens
FTAETLKNR

SEQ ID NO: 102421 - protein, 9 aa, Homo Sapiens
SSCDSLKIN

SEQ ID NO: 102422 - protein, 9 aa, Homo Sapiens
SLKINHLTP

SEQ ID NO: 102423 - protein, 9 aa, Homo Sapiens
ISKAQLPEE

SEQ ID NO: 102424 - protein, 9 aa, Homo Sapiens
YSHFCLYTR

SEQ ID NO: 102425 - protein, 9 aa, Homo Sapiens
QLPEEELEI

SEQ ID NO: 102426 - protein, 9 aa, Homo Sapiens
IIPIFEFSR

SEQ ID NO: 102427 - protein, 9 aa, Homo Sapiens
KGKWKSKRC

SEQ ID NO: 102428 - protein, 9 aa, Homo Sapiens
VCLPHHSMH

SEQ ID NO: 102429 - protein, 9 aa, Homo Sapiens
ENCNGHGEC

SEQ ID NO: 102430 - protein, 9 aa, Homo Sapiens
EAIHVEPVR

SEQ ID NO: 102431 - protein, 9 aa, Homo Sapiens
LICLVCTEI

SEQ ID NO: 102432 - protein, 9 aa, Homo Sapiens
INHLTPKKV

SEQ ID NO: 102433 - protein, 9 aa, Homo Sapiens
KFGILFRTT

SEQ ID NO: 102434 - protein, 9 aa, Homo Sapiens
EEELEIVVI

SEQ ID NO: 102435 - protein, 9 aa, Homo Sapiens
VPPFVRTHG

SEQ ID NO: 102436 - protein, 9 aa, Homo Sapiens
SSGIIVTLH

SEQ ID NO: 102437 - protein, 9 aa, Homo Sapiens
GIIVTLHIS

SEQ ID NO: 102438 - protein, 9 aa, Homo Sapiens
RDRLSPWAD

SEQ ID NO: 102439 - protein, 9 aa, Homo Sapiens
YWPYFTAET

SEQ ID NO: 102440 - protein, 9 aa, Homo Sapiens
FVRTHGFDG

SEQ ID NO: 102441 - protein, 9 aa, Homo Sapiens
NDARHGGWT

SEQ ID NO: 102442 - protein, 9 aa, Homo Sapiens
PGVYGGAPG

SEQ ID NO: 102443 - protein, 9 aa, Homo Sapiens
NKLDQEVQQ

SEQ ID NO: 102444 - protein, 9 aa, Homo Sapiens
KINHLTPKK

SEQ ID NO: 102445 - protein, 9 aa, Homo Sapiens
MSYFVDSAE

SEQ ID NO: 102446 - protein, 9 aa, Homo Sapiens
LQVEFIIPI

SEQ ID NO: 102447 - protein, 9 aa, Homo Sapiens
KIKQYYEAI

SEQ ID NO: 102448 - protein, 9 aa, Homo Sapiens
RCKYSFKCV

SEQ ID NO: 102449 - protein, 9 aa, Homo Sapiens
IKSVPPFVR

SEQ ID NO: 102450 - protein, 9 aa, Homo Sapiens
PVEFPTGLI

SEQ ID NO: 102451 - protein, 9 aa, Homo Sapiens
MNDARHGGW

SEQ ID NO: 102452 - protein, 9 aa, Homo Sapiens
LVYAHSGGG

SEQ ID NO: 102453 - protein, 9 aa, Homo Sapiens
FGILFRTTY

SEQ ID NO: 102454 - protein, 9 aa, Homo Sapiens
LFRTTYAAS

SEQ ID NO: 102455 - protein, 9 aa, Homo Sapiens
GVYGGAPGG

SEQ ID NO: 102456 - protein, 9 aa, Homo Sapiens
GGKPPLSSG

SEQ ID NO: 102457 - protein, 9 aa, Homo Sapiens
KPPLSSGII

SEQ ID NO: 102458 - protein, 9 aa, Homo Sapiens
GQLVYAHSG

SEQ ID NO: 102459 - protein, 9 aa, Homo Sapiens
PENCNGHGE

SEQ ID NO: 102460 - protein, 9 aa, Homo Sapiens
GLAPPQRLI

SEQ ID NO: 102461 - protein, 9 aa, Homo Sapiens
HHSMHPGPW

SEQ ID NO: 102462 - protein, 9 aa, Homo Sapiens
PLAGAAPST

SEQ ID NO: 102463 - protein, 9 aa, Homo Sapiens
IHVEPVRAS

SEQ ID NO: 102464 - protein, 9 aa, Homo Sapiens
VAASRKPCT

SEQ ID NO: 102465 - protein, 9 aa, Homo Sapiens
DTDTVPVEF

SEQ ID NO: 102466 - protein, 9 aa, Homo Sapiens
VCTEIEGEG

SEQ ID NO: 102467 - protein, 9 aa, Homo Sapiens
KKEVCLPHH

SEQ ID NO: 102468 - protein, 9 aa, Homo Sapiens
DKYNEAIHV

SEQ ID NO: 102469 - protein, 9 aa, Homo Sapiens
DRSTHRGTR

SEQ ID NO: 102470 - protein, 9 aa, Homo Sapiens
YPACPENCN

SEQ ID NO: 102471 - protein, 9 aa, Homo Sapiens
YAHSGGGTQ

SEQ ID NO: 102472 - protein, 9 aa, Homo Sapiens
SPWADRSTH

SEQ ID NO: 102473 - protein, 9 aa, Homo Sapiens
NEAIHVEPV

SEQ ID NO: 102474 - protein, 9 aa, Homo Sapiens
LKINHLTPK

SEQ ID NO: 102475 - protein, 9 aa, Homo Sapiens
LSSGIIVTL

SEQ ID NO: 102476 - protein, 9 aa, Homo Sapiens
YFVDSAESS

SEQ ID NO: 102477 - protein, 9 aa, Homo Sapiens
GYYPGVYGG

SEQ ID NO: 102478 - protein, 9 aa, Homo Sapiens
LAPPQRLIR

SEQ ID NO: 102479 - protein, 9 aa, Homo Sapiens
AQLPEEELE

SEQ ID NO: 102480 - protein, 9 aa, Homo Sapiens
PHHSMHPGP

SEQ ID NO: 102481 - protein, 9 aa, Homo Sapiens
VPVEFPTGL

SEQ ID NO: 102482 - protein, 9 aa, Homo Sapiens
LPHHSMHPG

SEQ ID NO: 102483 - protein, 9 aa, Homo Sapiens
SAESSPVPY

SEQ ID NO: 102484 - protein, 9 aa, Homo Sapiens
ELQLICLVC

SEQ ID NO: 102485 - protein, 9 aa, Homo Sapiens
EVCLPHHSM

SEQ ID NO: 102486 - protein, 9 aa, Homo Sapiens
AHSGGGTQQ

SEQ ID NO: 102487 - protein, 9 aa, Homo Sapiens
NIQGKFGIL

SEQ ID NO: 102488 - protein, 9 aa, Homo Sapiens
PACPENCNG

SEQ ID NO: 102489 - protein, 9 aa, Homo Sapiens
CLPHHSMHP

SEQ ID NO: 102490 - protein, 9 aa, Homo Sapiens
SDGLAPPQR

SEQ ID NO: 102491 - protein, 9 aa, Homo Sapiens
KWKSKRCKY

SEQ ID NO: 102492 - protein, 9 aa, Homo Sapiens
WADRSTHRG

SEQ ID NO: 102493 - protein, 9 aa, Homo Sapiens
KPCTLLPST

SEQ ID NO: 102494 - protein, 9 aa, Homo Sapiens
KEVCLPHHS

SEQ ID NO: 102495 - protein, 9 aa, Homo Sapiens
YKKEVCLPH

SEQ ID NO: 102496 - protein, 9 aa, Homo Sapiens
SYFVDSAES

SEQ ID NO: 102497 - protein, 9 aa, Homo Sapiens
CTEIEGEGL

SEQ ID NO: 102498 - protein, 9 aa, Homo Sapiens
DRLSPWADR

SEQ ID NO: 102499 - protein, 9 aa, Homo Sapiens
SKRCKYSFK

SEQ ID NO: 102500 - protein, 9 aa, Homo Sapiens
GILFRTTYA

SEQ ID NO: 102501 - protein, 9 aa, Homo Sapiens
TSEQFYSHF

SEQ ID NO: 102502 - protein, 9 aa, Homo Sapiens
ESSPVPYSA

SEQ ID NO: 102503 - protein, 9 aa, Homo Sapiens
LVCTEIEGE

SEQ ID NO: 102504 - protein, 9 aa, Homo Sapiens
YPGVYGGAP

SEQ ID NO: 102505 - protein, 9 aa, Homo Sapiens
RHGGWTTKM

SEQ ID NO: 102506 - protein, 9 aa, Homo Sapiens
PPQRLIRVE

SEQ ID NO: 102507 - protein, 9 aa, Homo Sapiens
DTVPVEFPT

SEQ ID NO: 102508 - protein, 9 aa, Homo Sapiens
KRCKYSFKC

SEQ ID NO: 102509 - protein, 9 aa, Homo Sapiens
VRSAPLAGA

SEQ ID NO: 102510 - protein, 9 aa, Homo Sapiens
ICPLEPQPA

SEQ ID NO: 102511 - protein, 9 aa, Homo Sapiens
VDSAESSPV

SEQ ID NO: 102512 - protein, 9 aa, Homo Sapiens
DSLKINHLT

SEQ ID NO: 102513 - protein, 9 aa, Homo Sapiens
NTKVRSAPL

SEQ ID NO: 102514 - protein, 9 aa, Homo Sapiens
SEQFYSHFC

SEQ ID NO: 102515 - protein, 9 aa, Homo Sapiens
NCNGHGECV

SEQ ID NO: 102516 - protein, 9 aa, Homo Sapiens
LDQEVQQET

SEQ ID NO: 102517 - protein, 9 aa, Homo Sapiens
HFCLYTRQG

SEQ ID NO: 102518 - protein, 9 aa, Homo Sapiens
EISKAQLPE

SEQ ID NO: 102519 - protein, 9 aa, Homo Sapiens
PFVRTHGFD

SEQ ID NO: 102520 - protein, 9 aa, Homo Sapiens
AVDLSCKIK

SEQ ID NO: 102521 - protein, 9 aa, Homo Sapiens
WKSKRCKYS

SEQ ID NO: 102522 - protein, 9 aa, Homo Sapiens
SGIIVTLHI

SEQ ID NO: 102523 - protein, 9 aa, Homo Sapiens
QEVQQETQG

SEQ ID NO: 102524 - protein, 9 aa, Homo Sapiens
VRTHGFDGL

SEQ ID NO: 102525 - protein, 9 aa, Homo Sapiens
IVICPLEPQ

SEQ ID NO: 102526 - protein, 9 aa, Homo Sapiens
YFTAETLKN

SEQ ID NO: 102527 - protein, 9 aa, Homo Sapiens
FMKQMNDAR

SEQ ID NO: 102528 - protein, 9 aa, Homo Sapiens
ASRKPCTLL

SEQ ID NO: 102529 - protein, 9 aa, Homo Sapiens
CNGHGECVR

SEQ ID NO: 102530 - protein, 9 aa, Homo Sapiens
PLDKSIVIC

SEQ ID NO: 102531 - protein, 9 aa, Homo Sapiens
QLVYAHSGG

SEQ ID NO: 102532 - protein, 9 aa, Homo Sapiens
SGLPYWPYF

SEQ ID NO: 102533 - protein, 9 aa, Homo Sapiens
DARHGGWTT

SEQ ID NO: 102534 - protein, 9 aa, Homo Sapiens
FIKSVPPFV

SEQ ID NO: 102535 - protein, 9 aa, Homo Sapiens
QRLIRVEGN

SEQ ID NO: 102536 - protein, 9 aa, Homo Sapiens
SCDSLKINH

SEQ ID NO: 102537 - protein, 9 aa, Homo Sapiens
MKQMNDARH

SEQ ID NO: 102538 - protein, 9 aa, Homo Sapiens
SCKIKQYYE

SEQ ID NO: 102539 - protein, 9 aa, Homo Sapiens
VDLSCKIKQ

SEQ ID NO: 102540 - protein, 9 aa, Homo Sapiens
IKQYYEAIL

SEQ ID NO: 102541 - protein, 9 aa, Homo Sapiens
APPQRLIRV

SEQ ID NO: 102542 - protein, 9 aa, Homo Sapiens
AIHVEPVRA

SEQ ID NO: 102543 - protein, 9 aa, Homo Sapiens
TDTVPVEFP

SEQ ID NO: 102544 - protein, 9 aa, Homo Sapiens
WPYFTAETL

SEQ ID NO: 102545 - protein, 9 aa, Homo Sapiens
KAQLPEEEL

SEQ ID NO: 102546 - protein, 9 aa, Homo Sapiens
EVQQETQGR

SEQ ID NO: 102547 - protein, 9 aa, Homo Sapiens
GKPPLSSGI

SEQ ID NO: 102548 - protein, 9 aa, Homo Sapiens
GKGKWKSKR

SEQ ID NO: 102549 - protein, 9 aa, Homo Sapiens
YNEAIHVEP

SEQ ID NO: 102550 - protein, 9 aa, Homo Sapiens
EFIIPIFEF

SEQ ID NO: 102551 - protein, 9 aa, Homo Sapiens
DQEVQQETQ

SEQ ID NO: 102552 - protein, 9 aa, Homo Sapiens
TKVRSAPLA

SEQ ID NO: 102553 - protein, 9 aa, Homo Sapiens
CKIKQYYEA

SEQ ID NO: 102554 - protein, 9 aa, Homo Sapiens
HSGGGTQQD

SEQ ID NO: 102555 - protein, 9 aa, Homo Sapiens
LAGAAPSTL

SEQ ID NO: 102556 - protein, 9 aa, Homo Sapiens
GDTDTVPVE

SEQ ID NO: 102557 - protein, 9 aa, Homo Sapiens
SIVICPLEP

SEQ ID NO: 102558 - protein, 9 aa, Homo Sapiens
CPENCNGHG

SEQ ID NO: 102559 - protein, 9 aa, Homo Sapiens
PYFTAETLK

SEQ ID NO: 102560 - protein, 9 aa, Homo Sapiens
AGGGYYPGV

SEQ ID NO: 102561 - protein, 9 aa, Homo Sapiens
QMNDARHGG

SEQ ID NO: 102562 - protein, 9 aa, Homo Sapiens
KQYYEAILA

SEQ ID NO: 102563 - protein, 9 aa, Homo Sapiens
PLSSGIIVT

SEQ ID NO: 102564 - protein, 9 aa, Homo Sapiens
QLICLVCTE

SEQ ID NO: 102565 - protein, 9 aa, Homo Sapiens
PQRLIRVEG

SEQ ID NO: 102566 - protein, 9 aa, Homo Sapiens
DLSCKIKQY

SEQ ID NO: 102567 - protein, 9 aa, Homo Sapiens
AGDTDTVPV

SEQ ID NO: 102568 - protein, 9 aa, Homo Sapiens
DKSIVICPL

SEQ ID NO: 102569 - protein, 9 aa, Homo Sapiens
KSKRCKYSF

SEQ ID NO: 102570 - protein, 9 aa, Homo Sapiens
IQGKFGILF

SEQ ID NO: 102571 - protein, 9 aa, Homo Sapiens
QVEFIIPIF

SEQ ID NO: 102572 - protein, 9 aa, Homo Sapiens
LDKSIVICP

SEQ ID NO: 102573 - protein, 9 aa, Homo Sapiens
KLDQEVQQE

SEQ ID NO: 102574 - protein, 9 aa, Homo Sapiens
SHFCLYTRQ

SEQ ID NO: 102575 - protein, 9 aa, Homo Sapiens
LPEEELEIV

SEQ ID NO: 102576 - protein, 9 aa, Homo Sapiens
CDSLKINHL

SEQ ID NO: 102577 - protein, 9 aa, Homo Sapiens
RLIRVEGNL

SEQ ID NO: 102578 - protein, 9 aa, Homo Sapiens
NGHGECVRG

SEQ ID NO: 102579 - protein, 9 aa, Homo Sapiens
SKAQLPEEE

SEQ ID NO: 102580 - protein, 9 aa, Homo Sapiens
IPIFEFSRA

SEQ ID NO: 102581 - protein, 9 aa, Homo Sapiens
ACPENCNGH

SEQ ID NO: 102582 - protein, 9 aa, Homo Sapiens
LSPWADRST

SEQ ID NO: 102583 - protein, 9 aa, Homo Sapiens
QETQGRFRL

SEQ ID NO: 102584 - protein, 9 aa, Homo Sapiens
QGKFGILFR

SEQ ID NO: 102585 - protein, 9 aa, Homo Sapiens
TVPVEFPTG

SEQ ID NO: 102586 - protein, 9 aa, Homo Sapiens
KSVPPFVRT

SEQ ID NO: 102587 - protein, 9 aa, Homo Sapiens
VICPLEPQP

SEQ ID NO: 102588 - protein, 9 aa, Homo Sapiens
FVDSAESSP

SEQ ID NO: 102589 - protein, 9 aa, Homo Sapiens
KVRSAPLAG

SEQ ID NO: 102590 - protein, 9 aa, Homo Sapiens
PEEELEIVV

SEQ ID NO: 102591 - protein, 9 aa, Homo Sapiens
AGQLVYAHS

SEQ ID NO: 102592 - protein, 9 aa, Homo Sapiens
GKFGILFRT

SEQ ID NO: 102593 - protein, 9 aa, Homo Sapiens
KVAASRKPC

SEQ ID NO: 102594 - protein, 9 aa, Homo Sapiens
VYGGAPGGP

SEQ ID NO: 102595 - protein, 9 aa, Homo Sapiens
AESSPVPYS

SEQ ID NO: 102596 - protein, 9 aa, Homo Sapiens
QQETQGRFR

SEQ ID NO: 102597 - protein, 9 aa, Homo Sapiens
GGGYYPGVY

SEQ ID NO: 102598 - protein, 9 aa, Homo Sapiens
CLVCTEIEG

SEQ ID NO: 102599 - protein, 9 aa, Homo Sapiens
GLQVEFIIP

SEQ ID NO: 102600 - protein, 9 aa, Homo Sapiens
DSAESSPVP

SEQ ID NO: 102601 - protein, 9 aa, Homo Sapiens
LQLICLVCT

SEQ ID NO: 102602 - protein, 9 aa, Homo Sapiens
ELEQELAQE

SEQ ID NO: 102603 - protein, 9 aa, Homo Sapiens
HVSFPLSGP

SEQ ID NO: 102604 - protein, 9 aa, Homo Sapiens
SSYHIESKG

SEQ ID NO: 102605 - protein, 9 aa, Homo Sapiens
VLFGTINLV

SEQ ID NO: 102606 - protein, 9 aa, Homo Sapiens
WRFYKLFLL

SEQ ID NO: 102607 - protein, 9 aa, Homo Sapiens
RQPMEGRPR

SEQ ID NO: 102608 - protein, 9 aa, Homo Sapiens
SRLIPRWSR

SEQ ID NO: 102609 - protein, 9 aa, Homo Sapiens
VTVCSRLIP

SEQ ID NO: 102610 - protein, 9 aa, Homo Sapiens
RLCTDEELI

SEQ ID NO: 102611 - protein, 9 aa, Homo Sapiens
RGQALQEKW

SEQ ID NO: 102612 - protein, 9 aa, Homo Sapiens
GNMTLQCGS

SEQ ID NO: 102613 - protein, 9 aa, Homo Sapiens
MSGKEIKKN

SEQ ID NO: 102614 - protein, 9 aa, Homo Sapiens
LHMEDSHCL

SEQ ID NO: 102615 - protein, 9 aa, Homo Sapiens
LAPSPRLYT

SEQ ID NO: 102616 - protein, 9 aa, Homo Sapiens
LIYMVMIMG

SEQ ID NO: 102617 - protein, 9 aa, Homo Sapiens
CCFLFTLTY

SEQ ID NO: 102618 - protein, 9 aa, Homo Sapiens
RVFRVFPIF

SEQ ID NO: 102619 - protein, 9 aa, Homo Sapiens
QCYVPLKKG

SEQ ID NO: 102620 - protein, 9 aa, Homo Sapiens
DTLLSSTTI

SEQ ID NO: 102621 - protein, 9 aa, Homo Sapiens
DHCTPIPGG

SEQ ID NO: 102622 - protein, 9 aa, Homo Sapiens
APILAPSPR

SEQ ID NO: 102623 - protein, 9 aa, Homo Sapiens
IPAPDPDAL

SEQ ID NO: 102624 - protein, 9 aa, Homo Sapiens
FPLSGPCHP

SEQ ID NO: 102625 - protein, 9 aa, Homo Sapiens
LEQELAQER

SEQ ID NO: 102626 - protein, 9 aa, Homo Sapiens
STPLPVTDA

SEQ ID NO: 102627 - protein, 9 aa, Homo Sapiens
AKHCNNARP

SEQ ID NO: 102628 - protein, 9 aa, Homo Sapiens
SFVDVKEAD

SEQ ID NO: 102629 - protein, 9 aa, Homo Sapiens
VLACVLSAF

SEQ ID NO: 102630 - protein, 9 aa, Homo Sapiens
GKEIKKNKH

SEQ ID NO: 102631 - protein, 9 aa, Homo Sapiens
SPQSPASGP

SEQ ID NO: 102632 - protein, 9 aa, Homo Sapiens
RLYTGPCTV

SEQ ID NO: 102633 - protein, 9 aa, Homo Sapiens
ADKVINENT

SEQ ID NO: 102634 - protein, 9 aa, Homo Sapiens
FTLAPLLAL

SEQ ID NO: 102635 - protein, 9 aa, Homo Sapiens
LLSSTTIPK

SEQ ID NO: 102636 - protein, 9 aa, Homo Sapiens
RLIPRWSRA

SEQ ID NO: 102637 - protein, 9 aa, Homo Sapiens
PLSGPCHPM

SEQ ID NO: 102638 - protein, 9 aa, Homo Sapiens
SDECVRMDK

SEQ ID NO: 102639 - protein, 9 aa, Homo Sapiens
VSRVCLYPS

SEQ ID NO: 102640 - protein, 9 aa, Homo Sapiens
IHTLAQLIA

SEQ ID NO: 102641 - protein, 9 aa, Homo Sapiens
AMSRNSTVA

SEQ ID NO: 102642 - protein, 9 aa, Homo Sapiens
ERLCTDEEL

SEQ ID NO: 102643 - protein, 9 aa, Homo Sapiens
ENIAYRILS

SEQ ID NO: 102644 - protein, 9 aa, Homo Sapiens
GVDQETCMI

SEQ ID NO: 102645 - protein, 9 aa, Homo Sapiens
AVGTPGSGP

SEQ ID NO: 102646 - protein, 9 aa, Homo Sapiens
ALPRLERAK

SEQ ID NO: 102647 - protein, 9 aa, Homo Sapiens
DALARASRL

SEQ ID NO: 102648 - protein, 9 aa, Homo Sapiens
CLAGCKSQV

SEQ ID NO: 102649 - protein, 9 aa, Homo Sapiens
YHIESKGIK

SEQ ID NO: 102650 - protein, 9 aa, Homo Sapiens
YVDISLLVY

SEQ ID NO: 102651 - protein, 9 aa, Homo Sapiens
KQQGEEPEG

SEQ ID NO: 102652 - protein, 9 aa, Homo Sapiens
LVYFNKMKK

SEQ ID NO: 102653 - protein, 9 aa, Homo Sapiens
SFKKETLGR

SEQ ID NO: 102654 - protein, 9 aa, Homo Sapiens
RSGNPNYTY

SEQ ID NO: 102655 - protein, 9 aa, Homo Sapiens
YVLRFNSSY

SEQ ID NO: 102656 - protein, 9 aa, Homo Sapiens
PRVWPYRIK

SEQ ID NO: 102657 - protein, 9 aa, Homo Sapiens
GDKLTPRKL

SEQ ID NO: 102658 - protein, 9 aa, Homo Sapiens
PLTATPPPQ

SEQ ID NO: 102659 - protein, 9 aa, Homo Sapiens
FPIFKFSRH

SEQ ID NO: 102660 - protein, 9 aa, Homo Sapiens
PRLRTIVLK

SEQ ID NO: 102661 - protein, 9 aa, Homo Sapiens
VAEQGIKHL

SEQ ID NO: 102662 - protein, 9 aa, Homo Sapiens
NENTRDSTF

SEQ ID NO: 102663 - protein, 9 aa, Homo Sapiens
VCSRLIPRW

SEQ ID NO: 102664 - protein, 9 aa, Homo Sapiens
AYRILSSSK

SEQ ID NO: 102665 - protein, 9 aa, Homo Sapiens
ALWLCCATP

SEQ ID NO: 102666 - protein, 9 aa, Homo Sapiens
QKQQGEEPE

SEQ ID NO: 102667 - protein, 9 aa, Homo Sapiens
ITRHSNLSK

SEQ ID NO: 102668 - protein, 9 aa, Homo Sapiens
STTIPKMLA

SEQ ID NO: 102669 - protein, 9 aa, Homo Sapiens
FKAGDKLTP

SEQ ID NO: 102670 - protein, 9 aa, Homo Sapiens
NKKTYEDLR

SEQ ID NO: 102671 - protein, 9 aa, Homo Sapiens
VLRFNSSYH

SEQ ID NO: 102672 - protein, 9 aa, Homo Sapiens
SVHAKHCNN

SEQ ID NO: 102673 - protein, 9 aa, Homo Sapiens
VTAIPESAD

SEQ ID NO: 102674 - protein, 9 aa, Homo Sapiens
TRHSNLSKI

SEQ ID NO: 102675 - protein, 9 aa, Homo Sapiens
VTTLVLPHN

SEQ ID NO: 102676 - protein, 9 aa, Homo Sapiens
PDPDALARA

SEQ ID NO: 102677 - protein, 9 aa, Homo Sapiens
EQGIKHLKQ

SEQ ID NO: 102678 - protein, 9 aa, Homo Sapiens
GSNSGQCYV

SEQ ID NO: 102679 - protein, 9 aa, Homo Sapiens
RTAVCHEIL

SEQ ID NO: 102680 - protein, 9 aa, Homo Sapiens
NLSKIHVAF

SEQ ID NO: 102681 - protein, 9 aa, Homo Sapiens
GKVADKVIN

SEQ ID NO: 102682 - protein, 9 aa, Homo Sapiens
EKEKIKKTN

SEQ ID NO: 102683 - protein, 9 aa, Homo Sapiens
GEKPYECMQ

SEQ ID NO: 102684 - protein, 9 aa, Homo Sapiens
LRHLVKHTG

SEQ ID NO: 102685 - protein, 9 aa, Homo Sapiens
DLESNENIA

SEQ ID NO: 102686 - protein, 9 aa, Homo Sapiens
IPKMLANIQ

SEQ ID NO: 102687 - protein, 9 aa, Homo Sapiens
PQFSQLQED

SEQ ID NO: 102688 - protein, 9 aa, Homo Sapiens
VSFNFLHWI

SEQ ID NO: 102689 - protein, 9 aa, Homo Sapiens
CMNPQTFKF

SEQ ID NO: 102690 - protein, 9 aa, Homo Sapiens
VHCCFLFTL

SEQ ID NO: 102691 - protein, 9 aa, Homo Sapiens
LMSIKLHQD

SEQ ID NO: 102692 - protein, 9 aa, Homo Sapiens
HKLISKTEA

SEQ ID NO: 102693 - protein, 9 aa, Homo Sapiens
CTDEELILD

SEQ ID NO: 102694 - protein, 9 aa, Homo Sapiens
DTTVHEDVL

SEQ ID NO: 102695 - protein, 9 aa, Homo Sapiens
HCCFLFTLT

SEQ ID NO: 102696 - protein, 9 aa, Homo Sapiens
MNPQTFKFD

SEQ ID NO: 102697 - protein, 9 aa, Homo Sapiens
PIFGKKPGI

SEQ ID NO: 102698 - protein, 9 aa, Homo Sapiens
EIKKNKHLF

SEQ ID NO: 102699 - protein, 9 aa, Homo Sapiens
DKHKLISKT

SEQ ID NO: 102700 - protein, 9 aa, Homo Sapiens
LNHIDDHTL

SEQ ID NO: 102701 - protein, 9 aa, Homo Sapiens
IPQFSQLQE

SEQ ID NO: 102702 - protein, 9 aa, Homo Sapiens
GCKSQVVLK

SEQ ID NO: 102703 - protein, 9 aa, Homo Sapiens
SFNFLHWIF

SEQ ID NO: 102704 - protein, 9 aa, Homo Sapiens
TFISKIPWR

SEQ ID NO: 102705 - protein, 9 aa, Homo Sapiens
TINLVYWAT

SEQ ID NO: 102706 - protein, 9 aa, Homo Sapiens
EPIFGKKPG

SEQ ID NO: 102707 - protein, 9 aa, Homo Sapiens
MVLTTLSLP

SEQ ID NO: 102708 - protein, 9 aa, Homo Sapiens
KAGDKLTPR

SEQ ID NO: 102709 - protein, 9 aa, Homo Sapiens
IDDHTLPGK

SEQ ID NO: 102710 - protein, 9 aa, Homo Sapiens
WWGPSPSEK

SEQ ID NO: 102711 - protein, 9 aa, Homo Sapiens
EDTTVHEDV

SEQ ID NO: 102712 - protein, 9 aa, Homo Sapiens
VKKIRKVQT

SEQ ID NO: 102713 - protein, 9 aa, Homo Sapiens
ESNENIAYR

SEQ ID NO: 102714 - protein, 9 aa, Homo Sapiens
TLRVFRVFP

SEQ ID NO: 102715 - protein, 9 aa, Homo Sapiens
LMPEKVKKI

SEQ ID NO: 102716 - protein, 9 aa, Homo Sapiens
SYGIKKGTP

SEQ ID NO: 102717 - protein, 9 aa, Homo Sapiens
KTPPPPTLS

SEQ ID NO: 102718 - protein, 9 aa, Homo Sapiens
CCATPAHAL

SEQ ID NO: 102719 - protein, 9 aa, Homo Sapiens
QLNHIDDHT

SEQ ID NO: 102720 - protein, 9 aa, Homo Sapiens
LVKQLIENV

SEQ ID NO: 102721 - protein, 9 aa, Homo Sapiens
GGKSITMEI

SEQ ID NO: 102722 - protein, 9 aa, Homo Sapiens
RAVGTPGSG

SEQ ID NO: 102723 - protein, 9 aa, Homo Sapiens
TLSLPSANS

SEQ ID NO: 102724 - protein, 9 aa, Homo Sapiens
KNCLVKNLG

SEQ ID NO: 102725 - protein, 9 aa, Homo Sapiens
RLRTIVLKM

SEQ ID NO: 102726 - protein, 9 aa, Homo Sapiens
VLPHNRLPL

SEQ ID NO: 102727 - protein, 9 aa, Homo Sapiens
LPHNRLPLA

SEQ ID NO: 102728 - protein, 9 aa, Homo Sapiens
ETLGRYGSC

SEQ ID NO: 102729 - protein, 9 aa, Homo Sapiens
LVKNLGAVE

SEQ ID NO: 102730 - protein, 9 aa, Homo Sapiens
KEKIKKTNN

SEQ ID NO: 102731 - protein, 9 aa, Homo Sapiens
CLVKNLGAV

SEQ ID NO: 102732 - protein, 9 aa, Homo Sapiens
LKVTAIPES

SEQ ID NO: 102733 - protein, 9 aa, Homo Sapiens
PGIEESITE

SEQ ID NO: 102734 - protein, 9 aa, Homo Sapiens
KIRKVQTDD

SEQ ID NO: 102735 - protein, 9 aa, Homo Sapiens
GLYERKLLS

SEQ ID NO: 102736 - protein, 9 aa, Homo Sapiens
KLKIGTNRS

SEQ ID NO: 102737 - protein, 9 aa, Homo Sapiens
IQDSFKKET

SEQ ID NO: 102738 - protein, 9 aa, Homo Sapiens
PVTTLVLPH

SEQ ID NO: 102739 - protein, 9 aa, Homo Sapiens
TNSVPEELS

SEQ ID NO: 102740 - protein, 9 aa, Homo Sapiens
SFTLAPLLA

SEQ ID NO: 102741 - protein, 9 aa, Homo Sapiens
GMVLTTLSL

SEQ ID NO: 102742 - protein, 9 aa, Homo Sapiens
CSPQSPASG

SEQ ID NO: 102743 - protein, 9 aa, Homo Sapiens
VVPGILMSI

SEQ ID NO: 102744 - protein, 9 aa, Homo Sapiens
VDELQIPVK

SEQ ID NO: 102745 - protein, 9 aa, Homo Sapiens
YSWVLCDHC

SEQ ID NO: 102746 - protein, 9 aa, Homo Sapiens
MEDSHCLHC

SEQ ID NO: 102747 - protein, 9 aa, Homo Sapiens
QGILSYGIK

SEQ ID NO: 102748 - protein, 9 aa, Homo Sapiens
MVEHHLGQK

SEQ ID NO: 102749 - protein, 9 aa, Homo Sapiens
SADQKTATP

SEQ ID NO: 102750 - protein, 9 aa, Homo Sapiens
SLLVYFNKM

SEQ ID NO: 102751 - protein, 9 aa, Homo Sapiens
FVASFTLAP

SEQ ID NO: 102752 - protein, 9 aa, Homo Sapiens
RLERAKGWS

SEQ ID NO: 102753 - protein, 9 aa, Homo Sapiens
CLPAWWGPS

SEQ ID NO: 102754 - protein, 9 aa, Homo Sapiens
KSCMNPQTF

SEQ ID NO: 102755 - protein, 9 aa, Homo Sapiens
VLQDFKPEE

SEQ ID NO: 102756 - protein, 9 aa, Homo Sapiens
DEELILDPV

SEQ ID NO: 102757 - protein, 9 aa, Homo Sapiens
TLAQLIAAY

SEQ ID NO: 102758 - protein, 9 aa, Homo Sapiens
YPSFVDVKE

SEQ ID NO: 102759 - protein, 9 aa, Homo Sapiens
EHHLGQKQQ

SEQ ID NO: 102760 - protein, 9 aa, Homo Sapiens
PILAPSPRL

SEQ ID NO: 102761 - protein, 9 aa, Homo Sapiens
LPRLERAKG

SEQ ID NO: 102762 - protein, 9 aa, Homo Sapiens
IQCFITVVV

SEQ ID NO: 102763 - protein, 9 aa, Homo Sapiens
FDFHAEYID

SEQ ID NO: 102764 - protein, 9 aa, Homo Sapiens
VWPYRIKVP

SEQ ID NO: 102765 - protein, 9 aa, Homo Sapiens
IAYRILSSS

SEQ ID NO: 102766 - protein, 9 aa, Homo Sapiens
EKPYECMQC

SEQ ID NO: 102767 - protein, 9 aa, Homo Sapiens
NSTVASDLH

SEQ ID NO: 102768 - protein, 9 aa, Homo Sapiens
AQNYVRFIV

SEQ ID NO: 102769 - protein, 9 aa, Homo Sapiens
HMEDSHCLH

SEQ ID NO: 102770 - protein, 9 aa, Homo Sapiens
RKVVVPGIL

SEQ ID NO: 102771 - protein, 9 aa, Homo Sapiens
NLPRGQALQ

SEQ ID NO: 102772 - protein, 9 aa, Homo Sapiens
KKNKHLFGL

SEQ ID NO: 102773 - protein, 9 aa, Homo Sapiens
YVRFIVDEL

SEQ ID NO: 102774 - protein, 9 aa, Homo Sapiens
NRSLHLQEE

SEQ ID NO: 102775 - protein, 9 aa, Homo Sapiens
QFSQLQEDV

SEQ ID NO: 102776 - protein, 9 aa, Homo Sapiens
PCHPSTAPW

SEQ ID NO: 102777 - protein, 9 aa, Homo Sapiens
TSVSWITAN

SEQ ID NO: 102778 - protein, 9 aa, Homo Sapiens
SQVVLKSIQ

SEQ ID NO: 102779 - protein, 9 aa, Homo Sapiens
RNEVLQDFK

SEQ ID NO: 102780 - protein, 9 aa, Homo Sapiens
SIQCFITVV

SEQ ID NO: 102781 - protein, 9 aa, Homo Sapiens
DQETCMIVF

SEQ ID NO: 102782 - protein, 9 aa, Homo Sapiens
QVVLKSIQC

SEQ ID NO: 102783 - protein, 9 aa, Homo Sapiens
VLSSSINEL

SEQ ID NO: 102784 - protein, 9 aa, Homo Sapiens
ANLVLHMED

SEQ ID NO: 102785 - protein, 9 aa, Homo Sapiens
MEGRPRDGG

SEQ ID NO: 102786 - protein, 9 aa, Homo Sapiens
YFNKMKKLT

SEQ ID NO: 102787 - protein, 9 aa, Homo Sapiens
FLLIYMVMI

SEQ ID NO: 102788 - protein, 9 aa, Homo Sapiens
RFNSSYHIE

SEQ ID NO: 102789 - protein, 9 aa, Homo Sapiens
HHLGQKQQG

SEQ ID NO: 102790 - protein, 9 aa, Homo Sapiens
LIAAYSLVD

SEQ ID NO: 102791 - protein, 9 aa, Homo Sapiens
IGTNRSLHL

SEQ ID NO: 102792 - protein, 9 aa, Homo Sapiens
AHVSFPLSG

SEQ ID NO: 102793 - protein, 9 aa, Homo Sapiens
QGVDQETCM

SEQ ID NO: 102794 - protein, 9 aa, Homo Sapiens
FHAEYIDSP

SEQ ID NO: 102795 - protein, 9 aa, Homo Sapiens
AFGICTSTV

SEQ ID NO: 102796 - protein, 9 aa, Homo Sapiens
SGPCHPMHN

SEQ ID NO: 102797 - protein, 9 aa, Homo Sapiens
PWRFYKLFL

SEQ ID NO: 102798 - protein, 9 aa, Homo Sapiens
PSACSPQSP

SEQ ID NO: 102799 - protein, 9 aa, Homo Sapiens
SKIPWRFYK

SEQ ID NO: 102800 - protein, 9 aa, Homo Sapiens
KKTNNRLNS

SEQ ID NO: 102801 - protein, 9 aa, Homo Sapiens
RSPCHPSTA

SEQ ID NO: 102802 - protein, 9 aa, Homo Sapiens
PNGCGKRSL

SEQ ID NO: 102803 - protein, 9 aa, Homo Sapiens
GCGKRSLFR

SEQ ID NO: 102804 - protein, 9 aa, Homo Sapiens
QETCMIVFK

SEQ ID NO: 102805 - protein, 9 aa, Homo Sapiens
LKSIQCFIT

SEQ ID NO: 102806 - protein, 9 aa, Homo Sapiens
LTATPPPQQ

SEQ ID NO: 102807 - protein, 9 aa, Homo Sapiens
EVLQDFKPE

SEQ ID NO: 102808 - protein, 9 aa, Homo Sapiens
PMEGRPRDG

SEQ ID NO: 102809 - protein, 9 aa, Homo Sapiens
FNSSYHIES

SEQ ID NO: 102810 - protein, 9 aa, Homo Sapiens
SAFGICTST

SEQ ID NO: 102811 - protein, 9 aa, Homo Sapiens
GRAPILAPS

SEQ ID NO: 102812 - protein, 9 aa, Homo Sapiens
WLCCATPAH

SEQ ID NO: 102813 - protein, 9 aa, Homo Sapiens
LRVFRVFPI

SEQ ID NO: 102814 - protein, 9 aa, Homo Sapiens
TKGEFLRHL

SEQ ID NO: 102815 - protein, 9 aa, Homo Sapiens
LSKIHVAFH

SEQ ID NO: 102816 - protein, 9 aa, Homo Sapiens
QELAQERSL

SEQ ID NO: 102817 - protein, 9 aa, Homo Sapiens
MDNLFKYII

SEQ ID NO: 102818 - protein, 9 aa, Homo Sapiens
SFPLSGPCH

SEQ ID NO: 102819 - protein, 9 aa, Homo Sapiens
KSITMEIVN

SEQ ID NO: 102820 - protein, 9 aa, Homo Sapiens
PGSNSGQCY

SEQ ID NO: 102821 - protein, 9 aa, Homo Sapiens
GKRSLFRIL

SEQ ID NO: 102822 - protein, 9 aa, Homo Sapiens
LPRGQALQE

SEQ ID NO: 102823 - protein, 9 aa, Homo Sapiens
PGRAPILAP

SEQ ID NO: 102824 - protein, 9 aa, Homo Sapiens
CLGEGGKSI

SEQ ID NO: 102825 - protein, 9 aa, Homo Sapiens
CATPAHALQ

SEQ ID NO: 102826 - protein, 9 aa, Homo Sapiens
FIVDELQIP

SEQ ID NO: 102827 - protein, 9 aa, Homo Sapiens
GLCLPAWWG

SEQ ID NO: 102828 - protein, 9 aa, Homo Sapiens
LAQLIAAYS

SEQ ID NO: 102829 - protein, 9 aa, Homo Sapiens
SKIHVAFHL

SEQ ID NO: 102830 - protein, 9 aa, Homo Sapiens
APDPDALAR

SEQ ID NO: 102831 - protein, 9 aa, Homo Sapiens
STAPWPGLC

SEQ ID NO: 102832 - protein, 9 aa, Homo Sapiens
LISKTEAKQ

SEQ ID NO: 102833 - protein, 9 aa, Homo Sapiens
EKIKKTNNR

SEQ ID NO: 102834 - protein, 9 aa, Homo Sapiens
QSPASGPGR

SEQ ID NO: 102835 - protein, 9 aa, Homo Sapiens
SCMNPQTFK

SEQ ID NO: 102836 - protein, 9 aa, Homo Sapiens
FRVFPIFKF

SEQ ID NO: 102837 - protein, 9 aa, Homo Sapiens
MDKTPPPPT

SEQ ID NO: 102838 - protein, 9 aa, Homo Sapiens
GFRPGFLHS

SEQ ID NO: 102839 - protein, 9 aa, Homo Sapiens
KIGTNRSLH

SEQ ID NO: 102840 - protein, 9 aa, Homo Sapiens
MVMIMGNLL

SEQ ID NO: 102841 - protein, 9 aa, Homo Sapiens
PSFVDVKEA

SEQ ID NO: 102842 - protein, 9 aa, Homo Sapiens
RIKVPQGFY

SEQ ID NO: 102843 - protein, 9 aa, Homo Sapiens
YQGSYGFRP

SEQ ID NO: 102844 - protein, 9 aa, Homo Sapiens
LALWLCCAT

SEQ ID NO: 102845 - protein, 9 aa, Homo Sapiens
GGMVLTTLS

SEQ ID NO: 102846 - protein, 9 aa, Homo Sapiens
PPLTATPPP

SEQ ID NO: 102847 - protein, 9 aa, Homo Sapiens
NSSLLTQKH

SEQ ID NO: 102848 - protein, 9 aa, Homo Sapiens
PPPQQPHAL

SEQ ID NO: 102849 - protein, 9 aa, Homo Sapiens
LYPSFVDVK

SEQ ID NO: 102850 - protein, 9 aa, Homo Sapiens
LGQKQQGEE

SEQ ID NO: 102851 - protein, 9 aa, Homo Sapiens
NNRLNSRIN

SEQ ID NO: 102852 - protein, 9 aa, Homo Sapiens
NGCGKRSLF

SEQ ID NO: 102853 - protein, 9 aa, Homo Sapiens
NKHLFGLRI

SEQ ID NO: 102854 - protein, 9 aa, Homo Sapiens
YMVMIMGNL

SEQ ID NO: 102855 - protein, 9 aa, Homo Sapiens
VEHHLGQKQ

SEQ ID NO: 102856 - protein, 9 aa, Homo Sapiens
ALQEKWNLI

SEQ ID NO: 102857 - protein, 9 aa, Homo Sapiens
GNPNYTYEF

SEQ ID NO: 102858 - protein, 9 aa, Homo Sapiens
IIGTLELLV

SEQ ID NO: 102859 - protein, 9 aa, Homo Sapiens
PPPLTATPP

SEQ ID NO: 102860 - protein, 9 aa, Homo Sapiens
ESADQKTAT

SEQ ID NO: 102861 - protein, 9 aa, Homo Sapiens
VLTTLSLPS

SEQ ID NO: 102862 - protein, 9 aa, Homo Sapiens
KETLGRYGS

SEQ ID NO: 102863 - protein, 9 aa, Homo Sapiens
VLHMEDSHC

SEQ ID NO: 102864 - protein, 9 aa, Homo Sapiens
QQRVQELEQ

SEQ ID NO: 102865 - protein, 9 aa, Homo Sapiens
SYTKGEFLR

SEQ ID NO: 102866 - protein, 9 aa, Homo Sapiens
DKIRESQEG

SEQ ID NO: 102867 - protein, 9 aa, Homo Sapiens
LIPRWSRAP

SEQ ID NO: 102868 - protein, 9 aa, Homo Sapiens
RPGFLHSGT

SEQ ID NO: 102869 - protein, 9 aa, Homo Sapiens
GTPGSGPRL

SEQ ID NO: 102870 - protein, 9 aa, Homo Sapiens
HEVHMREKS

SEQ ID NO: 102871 - protein, 9 aa, Homo Sapiens
VQELEQELA

SEQ ID NO: 102872 - protein, 9 aa, Homo Sapiens
IPESADQKT

SEQ ID NO: 102873 - protein, 9 aa, Homo Sapiens
VQLNHIDDH

SEQ ID NO: 102874 - protein, 9 aa, Homo Sapiens
TYEFSRKVP

SEQ ID NO: 102875 - protein, 9 aa, Homo Sapiens
DISLLVYFN

SEQ ID NO: 102876 - protein, 9 aa, Homo Sapiens
GPPPLTATP

SEQ ID NO: 102877 - protein, 9 aa, Homo Sapiens
SRAPPDLGR

SEQ ID NO: 102878 - protein, 9 aa, Homo Sapiens
SKTEAKQEY

SEQ ID NO: 102879 - protein, 9 aa, Homo Sapiens
PEELSLAQY

SEQ ID NO: 102880 - protein, 9 aa, Homo Sapiens
PRCLRTAVC

SEQ ID NO: 102881 - protein, 9 aa, Homo Sapiens
VLKSIQCFI

SEQ ID NO: 102882 - protein, 9 aa, Homo Sapiens
QTFKFDRPA

SEQ ID NO: 102883 - protein, 9 aa, Homo Sapiens
ILKRNEVLQ

SEQ ID NO: 102884 - protein, 9 aa, Homo Sapiens
KESHSRPSA

SEQ ID NO: 102885 - protein, 9 aa, Homo Sapiens
PNYTYEFSR

SEQ ID NO: 102886 - protein, 9 aa, Homo Sapiens
LRTIVLKMP

SEQ ID NO: 102887 - protein, 9 aa, Homo Sapiens
CHEILIGYL

SEQ ID NO: 102888 - protein, 9 aa, Homo Sapiens
LFVASFTLA

SEQ ID NO: 102889 - protein, 9 aa, Homo Sapiens
LLVYFNKMK

SEQ ID NO: 102890 - protein, 9 aa, Homo Sapiens
DKLTPRKLS

SEQ ID NO: 102891 - protein, 9 aa, Homo Sapiens
HSNLSKIHV

SEQ ID NO: 102892 - protein, 9 aa, Homo Sapiens
PRLERAKGW

SEQ ID NO: 102893 - protein, 9 aa, Homo Sapiens
AIPESADQK

SEQ ID NO: 102894 - protein, 9 aa, Homo Sapiens
VHEDVLSSS

SEQ ID NO: 102895 - protein, 9 aa, Homo Sapiens
ADDKHKLIS

SEQ ID NO: 102896 - protein, 9 aa, Homo Sapiens
HIDDHTLPG

SEQ ID NO: 102897 - protein, 9 aa, Homo Sapiens
GVALPRLER

SEQ ID NO: 102898 - protein, 9 aa, Homo Sapiens
RRKIPQFSQ

SEQ ID NO: 102899 - protein, 9 aa, Homo Sapiens
KKIRKVQTD

SEQ ID NO: 102900 - protein, 9 aa, Homo Sapiens
AVSLQGVDQ

SEQ ID NO: 102901 - protein, 9 aa, Homo Sapiens
CKSQVVLKS

SEQ ID NO: 102902 - protein, 9 aa, Homo Sapiens
LQEKWNLIP

SEQ ID NO: 102903 - protein, 9 aa, Homo Sapiens
FLFTLTYQG

SEQ ID NO: 102904 - protein, 9 aa, Homo Sapiens
SGNPNYTYE

SEQ ID NO: 102905 - protein, 9 aa, Homo Sapiens
GKSCMNPQT

SEQ ID NO: 102906 - protein, 9 aa, Homo Sapiens
YVPLKKGKD

SEQ ID NO: 102907 - protein, 9 aa, Homo Sapiens
TLVLPHNRL

SEQ ID NO: 102908 - protein, 9 aa, Homo Sapiens
TATPPPQQP

SEQ ID NO: 102909 - protein, 9 aa, Homo Sapiens
SEVQLNHID

SEQ ID NO: 102910 - protein, 9 aa, Homo Sapiens
EFLRHLVKH

SEQ ID NO: 102911 - protein, 9 aa, Homo Sapiens
NPQTFKFDR

SEQ ID NO: 102912 - protein, 9 aa, Homo Sapiens
ECVRMDKTP

SEQ ID NO: 102913 - protein, 9 aa, Homo Sapiens
LLTQKHEVH

SEQ ID NO: 102914 - protein, 9 aa, Homo Sapiens
CNNARPESR

SEQ ID NO: 102915 - protein, 9 aa, Homo Sapiens
PRLYTGPCT

SEQ ID NO: 102916 - protein, 9 aa, Homo Sapiens
FSQLQEDVD

SEQ ID NO: 102917 - protein, 9 aa, Homo Sapiens
ELVAEQGIK

SEQ ID NO: 102918 - protein, 9 aa, Homo Sapiens
QDSFKKETL

SEQ ID NO: 102919 - protein, 9 aa, Homo Sapiens
SWVLCDHCT

SEQ ID NO: 102920 - protein, 9 aa, Homo Sapiens
VGTPGSGPR

SEQ ID NO: 102921 - protein, 9 aa, Homo Sapiens
APWPGLCLP

SEQ ID NO: 102922 - protein, 9 aa, Homo Sapiens
SLQGVDQET

SEQ ID NO: 102923 - protein, 9 aa, Homo Sapiens
QNYVRFIVD

SEQ ID NO: 102924 - protein, 9 aa, Homo Sapiens
KLVKQLIEN

SEQ ID NO: 102925 - protein, 9 aa, Homo Sapiens
ISKIPWRFY

SEQ ID NO: 102926 - protein, 9 aa, Homo Sapiens
FPRLRTIVL

SEQ ID NO: 102927 - protein, 9 aa, Homo Sapiens
VHAKHCNNA

SEQ ID NO: 102928 - protein, 9 aa, Homo Sapiens
IRESQEGDE

SEQ ID NO: 102929 - protein, 9 aa, Homo Sapiens
LLIYMVMIM

SEQ ID NO: 102930 - protein, 9 aa, Homo Sapiens
IKKGTPPGV

SEQ ID NO: 102931 - protein, 9 aa, Homo Sapiens
YPRVWPYRI

SEQ ID NO: 102932 - protein, 9 aa, Homo Sapiens
EELSLAQYL

SEQ ID NO: 102933 - protein, 9 aa, Homo Sapiens
EGGKSITME

SEQ ID NO: 102934 - protein, 9 aa, Homo Sapiens
LSYGIKKGT

SEQ ID NO: 102935 - protein, 9 aa, Homo Sapiens
PAWWGPSPS

SEQ ID NO: 102936 - protein, 9 aa, Homo Sapiens
AGLYERKLL

SEQ ID NO: 102937 - protein, 9 aa, Homo Sapiens
SLLTQKHEV

SEQ ID NO: 102938 - protein, 9 aa, Homo Sapiens
HPSTAPWPG

SEQ ID NO: 102939 - protein, 9 aa, Homo Sapiens
DKTPPPPTL

SEQ ID NO: 102940 - protein, 9 aa, Homo Sapiens
QGSYGFRPG

SEQ ID NO: 102941 - protein, 9 aa, Homo Sapiens
DVLSSSINE

SEQ ID NO: 102942 - protein, 9 aa, Homo Sapiens
HAKHCNNAR

SEQ ID NO: 102943 - protein, 9 aa, Homo Sapiens
PYRIKVPQG

SEQ ID NO: 102944 - protein, 9 aa, Homo Sapiens
IPWRFYKLF

SEQ ID NO: 102945 - protein, 9 aa, Homo Sapiens
TLFVASFTL

SEQ ID NO: 102946 - protein, 9 aa, Homo Sapiens
IDKIRESQE

SEQ ID NO: 102947 - protein, 9 aa, Homo Sapiens
DFHAEYIDS

SEQ ID NO: 102948 - protein, 9 aa, Homo Sapiens
HAGLYERKL

SEQ ID NO: 102949 - protein, 9 aa, Homo Sapiens
DPVTTLVLP

SEQ ID NO: 102950 - protein, 9 aa, Homo Sapiens
SGPGRAPIL

SEQ ID NO: 102951 - protein, 9 aa, Homo Sapiens
GTNRSLHLQ

SEQ ID NO: 102952 - protein, 9 aa, Homo Sapiens
IYMVMIMGN

SEQ ID NO: 102953 - protein, 9 aa, Homo Sapiens
IPRWSRAPP

SEQ ID NO: 102954 - protein, 9 aa, Homo Sapiens
NSVPEELSL

SEQ ID NO: 102955 - protein, 9 aa, Homo Sapiens
GFKAGDKLT

SEQ ID NO: 102956 - protein, 9 aa, Homo Sapiens
NSSYHIESK

SEQ ID NO: 102957 - protein, 9 aa, Homo Sapiens
VCHEILIGY

SEQ ID NO: 102958 - protein, 9 aa, Homo Sapiens
DPDALARAS

SEQ ID NO: 102959 - protein, 9 aa, Homo Sapiens
HILKRNEVL

SEQ ID NO: 102960 - protein, 9 aa, Homo Sapiens
NIAYRILSS

SEQ ID NO: 102961 - protein, 9 aa, Homo Sapiens
FVHCCFLFT

SEQ ID NO: 102962 - protein, 9 aa, Homo Sapiens
PYECMQCGK

SEQ ID NO: 102963 - protein, 9 aa, Homo Sapiens
NQPIDKIRE

SEQ ID NO: 102964 - protein, 9 aa, Homo Sapiens
AQLIAAYSL

SEQ ID NO: 102965 - protein, 9 aa, Homo Sapiens
VASFTLAPL

SEQ ID NO: 102966 - protein, 9 aa, Homo Sapiens
PRDGGLRFG

SEQ ID NO: 102967 - protein, 9 aa, Homo Sapiens
MIMGNLLII

SEQ ID NO: 102968 - protein, 9 aa, Homo Sapiens
ACVLSAFGI

SEQ ID NO: 102969 - protein, 9 aa, Homo Sapiens
KTYEDLRRQ

SEQ ID NO: 102970 - protein, 9 aa, Homo Sapiens
RESQEGDEC

SEQ ID NO: 102971 - protein, 9 aa, Homo Sapiens
LKRNEVLQD

SEQ ID NO: 102972 - protein, 9 aa, Homo Sapiens
QRVQELEQE

SEQ ID NO: 102973 - protein, 9 aa, Homo Sapiens
TLQCGSQKG

SEQ ID NO: 102974 - protein, 9 aa, Homo Sapiens
WITANGTVM

SEQ ID NO: 102975 - protein, 9 aa, Homo Sapiens
EGFKAGDKL

SEQ ID NO: 102976 - protein, 9 aa, Homo Sapiens
PKAMSRNST

SEQ ID NO: 102977 - protein, 9 aa, Homo Sapiens
PQSPASGPG

SEQ ID NO: 102978 - protein, 9 aa, Homo Sapiens
SITMEIVNK

SEQ ID NO: 102979 - protein, 9 aa, Homo Sapiens
TVHEDVLSS

SEQ ID NO: 102980 - protein, 9 aa, Homo Sapiens
HEDVLSSSI

SEQ ID NO: 102981 - protein, 9 aa, Homo Sapiens
AWWGPSPSE

SEQ ID NO: 102982 - protein, 9 aa, Homo Sapiens
LCDHCTPIP

SEQ ID NO: 102983 - protein, 9 aa, Homo Sapiens
VPEELSLAQ

SEQ ID NO: 102984 - protein, 9 aa, Homo Sapiens
SKAKLHAGL

SEQ ID NO: 102985 - protein, 9 aa, Homo Sapiens
GGNMTLQCG

SEQ ID NO: 102986 - protein, 9 aa, Homo Sapiens
ASGGNMTLQ

SEQ ID NO: 102987 - protein, 9 aa, Homo Sapiens
TQKHEVHMR

SEQ ID NO: 102988 - protein, 9 aa, Homo Sapiens
MPEKVKKIR

SEQ ID NO: 102989 - protein, 9 aa, Homo Sapiens
HCTPIPGGP

SEQ ID NO: 102990 - protein, 9 aa, Homo Sapiens
NPNYTYEFS

SEQ ID NO: 102991 - protein, 9 aa, Homo Sapiens
RKIPQFSQL

SEQ ID NO: 102992 - protein, 9 aa, Homo Sapiens
RLETFDFHA

SEQ ID NO: 102993 - protein, 9 aa, Homo Sapiens
HGVALPRLE

SEQ ID NO: 102994 - protein, 9 aa, Homo Sapiens
GILMSIKLH

SEQ ID NO: 102995 - protein, 9 aa, Homo Sapiens
YECMQCGKA

SEQ ID NO: 102996 - protein, 9 aa, Homo Sapiens
KKETLGRYG

SEQ ID NO: 102997 - protein, 9 aa, Homo Sapiens
TYEDLRRQG

SEQ ID NO: 102998 - protein, 9 aa, Homo Sapiens
CMQCGKAFI

SEQ ID NO: 102999 - protein, 9 aa, Homo Sapiens
MSRNSTVAS

SEQ ID NO: 103000 - protein, 9 aa, Homo Sapiens
KRNEVLQDF

SEQ ID NO: 103001 - protein, 9 aa, Homo Sapiens
AKLHAGLYE

SEQ ID NO: 103002 - protein, 9 aa, Homo Sapiens
QELEQELAQ

SEQ ID NO: 103003 - protein, 9 aa, Homo Sapiens
VRMDKTPPP

SEQ ID NO: 103004 - protein, 9 aa, Homo Sapiens
SLPSANSPV

SEQ ID NO: 103005 - protein, 9 aa, Homo Sapiens
SGPRLSPLG

SEQ ID NO: 103006 - protein, 9 aa, Homo Sapiens
VMIMGNLLI

SEQ ID NO: 103007 - protein, 9 aa, Homo Sapiens
GQKQQGEEP

SEQ ID NO: 103008 - protein, 9 aa, Homo Sapiens
MMVSFNFLH

SEQ ID NO: 103009 - protein, 9 aa, Homo Sapiens
ILMSIKLHQ

SEQ ID NO: 103010 - protein, 9 aa, Homo Sapiens
PGFLHSGTA

SEQ ID NO: 103011 - protein, 9 aa, Homo Sapiens
LMDNLFKYI

SEQ ID NO: 103012 - protein, 9 aa, Homo Sapiens
IVDELQIPV

SEQ ID NO: 103013 - protein, 9 aa, Homo Sapiens
EGRPRDGGL

SEQ ID NO: 103014 - protein, 9 aa, Homo Sapiens
VLCDHCTPI

SEQ ID NO: 103015 - protein, 9 aa, Homo Sapiens
LIENVKSAI

SEQ ID NO: 103016 - protein, 9 aa, Homo Sapiens
VCYMMVSFN

SEQ ID NO: 103017 - protein, 9 aa, Homo Sapiens
SHSRPSACS

SEQ ID NO: 103018 - protein, 9 aa, Homo Sapiens
QKHEVHMRE

SEQ ID NO: 103019 - protein, 9 aa, Homo Sapiens
LSGPCHPMH

SEQ ID NO: 103020 - protein, 9 aa, Homo Sapiens
FRPGFLHSG

SEQ ID NO: 103021 - protein, 9 aa, Homo Sapiens
IKKNKHLFG

SEQ ID NO: 103022 - protein, 9 aa, Homo Sapiens
GRLETFDFH

SEQ ID NO: 103023 - protein, 9 aa, Homo Sapiens
ISYTKGEFL

SEQ ID NO: 103024 - protein, 9 aa, Homo Sapiens
PGLCLPAWW

SEQ ID NO: 103025 - protein, 9 aa, Homo Sapiens
KKPGIEESI

SEQ ID NO: 103026 - protein, 9 aa, Homo Sapiens
TKESHSRPS

SEQ ID NO: 103027 - protein, 9 aa, Homo Sapiens
VSWITANGT

SEQ ID NO: 103028 - protein, 9 aa, Homo Sapiens
QCFITVVVW

SEQ ID NO: 103029 - protein, 9 aa, Homo Sapiens
VKNLGAVET

SEQ ID NO: 103030 - protein, 9 aa, Homo Sapiens
AEQGIKHLK

SEQ ID NO: 103031 - protein, 9 aa, Homo Sapiens
FNFLHWIFA

SEQ ID NO: 103032 - protein, 9 aa, Homo Sapiens
INENTRDST

SEQ ID NO: 103033 - protein, 9 aa, Homo Sapiens
IRKVQTDDG

SEQ ID NO: 103034 - protein, 9 aa, Homo Sapiens
PPRRKIPQF

SEQ ID NO: 103035 - protein, 9 aa, Homo Sapiens
SNSGQCYVP

SEQ ID NO: 103036 - protein, 9 aa, Homo Sapiens
GPGRAPILA

SEQ ID NO: 103037 - protein, 9 aa, Homo Sapiens
NYTYEFSRK

SEQ ID NO: 103038 - protein, 9 aa, Homo Sapiens
PRWSRAPPD

SEQ ID NO: 103039 - protein, 9 aa, Homo Sapiens
AVCHEILIG

SEQ ID NO: 103040 - protein, 9 aa, Homo Sapiens
LHAGLYERK

SEQ ID NO: 103041 - protein, 9 aa, Homo Sapiens
VKQLIENVK

SEQ ID NO: 103042 - protein, 9 aa, Homo Sapiens
LTTLSLPSA

SEQ ID NO: 103043 - protein, 9 aa, Homo Sapiens
KIHVAFHLC

SEQ ID NO: 103044 - protein, 9 aa, Homo Sapiens
IKKTNNRLN

SEQ ID NO: 103045 - protein, 9 aa, Homo Sapiens
LFKYIIGTL

SEQ ID NO: 103046 - protein, 9 aa, Homo Sapiens
KRSLFRILS

SEQ ID NO: 103047 - protein, 9 aa, Homo Sapiens
ILAPSPRLY

SEQ ID NO: 103048 - protein, 9 aa, Homo Sapiens
LTSVSWITA

SEQ ID NO: 103049 - protein, 9 aa, Homo Sapiens
LAHVSFPLS

SEQ ID NO: 103050 - protein, 9 aa, Homo Sapiens
ATPPPQQPH

SEQ ID NO: 103051 - protein, 9 aa, Homo Sapiens
SGGNMTLQC

SEQ ID NO: 103052 - protein, 9 aa, Homo Sapiens
DKVINENTR

SEQ ID NO: 103053 - protein, 9 aa, Homo Sapiens
MTLQCGSQK

SEQ ID NO: 103054 - protein, 9 aa, Homo Sapiens
QGIKHLKQY

SEQ ID NO: 103055 - protein, 9 aa, Homo Sapiens
GEFLRHLVK

SEQ ID NO: 103056 - protein, 9 aa, Homo Sapiens
AVCYMMVSF

SEQ ID NO: 103057 - protein, 9 aa, Homo Sapiens
YTKGEFLRH

SEQ ID NO: 103058 - protein, 9 aa, Homo Sapiens
LVAEQGIKH

SEQ ID NO: 103059 - protein, 9 aa, Homo Sapiens
LWLCCATPA

SEQ ID NO: 103060 - protein, 9 aa, Homo Sapiens
TPGSGPRLS

SEQ ID NO: 103061 - protein, 9 aa, Homo Sapiens
HCNNARPES

SEQ ID NO: 103062 - protein, 9 aa, Homo Sapiens
LSAFGICTS

SEQ ID NO: 103063 - protein, 9 aa, Homo Sapiens
SSFSKVTVC

SEQ ID NO: 103064 - protein, 9 aa, Homo Sapiens
RPSACSPQS

SEQ ID NO: 103065 - protein, 9 aa, Homo Sapiens
CYVPLKKGK

SEQ ID NO: 103066 - protein, 9 aa, Homo Sapiens
LCTDEELIL

SEQ ID NO: 103067 - protein, 9 aa, Homo Sapiens
RAPILAPSP

SEQ ID NO: 103068 - protein, 9 aa, Homo Sapiens
DVTNSVPEE

SEQ ID NO: 103069 - protein, 9 aa, Homo Sapiens
PANLVLHME

SEQ ID NO: 103070 - protein, 9 aa, Homo Sapiens
PGILMSIKL

SEQ ID NO: 103071 - protein, 9 aa, Homo Sapiens
SRNSTVASD

SEQ ID NO: 103072 - protein, 9 aa, Homo Sapiens
EELVAEQGI

SEQ ID NO: 103073 - protein, 9 aa, Homo Sapiens
NMTLQCGSQ

SEQ ID NO: 103074 - protein, 9 aa, Homo Sapiens
NENIAYRIL

SEQ ID NO: 103075 - protein, 9 aa, Homo Sapiens
GILSYGIKK

SEQ ID NO: 103076 - protein, 9 aa, Homo Sapiens
GAVETLGST

SEQ ID NO: 103077 - protein, 9 aa, Homo Sapiens
RPRDGGLRF

SEQ ID NO: 103078 - protein, 9 aa, Homo Sapiens
TPAHALQCR

SEQ ID NO: 103079 - protein, 9 aa, Homo Sapiens
CGKRSLFRI

SEQ ID NO: 103080 - protein, 9 aa, Homo Sapiens
WVLCDHCTP

SEQ ID NO: 103081 - protein, 9 aa, Homo Sapiens
TIPKMLANI

SEQ ID NO: 103082 - protein, 9 aa, Homo Sapiens
KIPQFSQLQ

SEQ ID NO: 103083 - protein, 9 aa, Homo Sapiens
VVLKSIQCF

SEQ ID NO: 103084 - protein, 9 aa, Homo Sapiens
SPASGPGRA

SEQ ID NO: 103085 - protein, 9 aa, Homo Sapiens
VLSAFGICT

SEQ ID NO: 103086 - protein, 9 aa, Homo Sapiens
SGKEIKKNK

SEQ ID NO: 103087 - protein, 9 aa, Homo Sapiens
LCCATPAHA

SEQ ID NO: 103088 - protein, 9 aa, Homo Sapiens
GTINLVYWA

SEQ ID NO: 103089 - protein, 9 aa, Homo Sapiens
ASGPGRAPI

SEQ ID NO: 103090 - protein, 9 aa, Homo Sapiens
QALQEKWNL

SEQ ID NO: 103091 - protein, 9 aa, Homo Sapiens
SGQCYVPLK

SEQ ID NO: 103092 - protein, 9 aa, Homo Sapiens
PSPRLYTGP

SEQ ID NO: 103093 - protein, 9 aa, Homo Sapiens
GPNGCGKRS

SEQ ID NO: 103094 - protein, 9 aa, Homo Sapiens
FGKKPGIEE

SEQ ID NO: 103095 - protein, 9 aa, Homo Sapiens
LVLPHNRLP

SEQ ID NO: 103096 - protein, 9 aa, Homo Sapiens
RVHGVALPR

SEQ ID NO: 103097 - protein, 9 aa, Homo Sapiens
LVLHMEDSH

SEQ ID NO: 103098 - protein, 9 aa, Homo Sapiens
LACVLSAFG

SEQ ID NO: 103099 - protein, 9 aa, Homo Sapiens
CDHCTPIPG

SEQ ID NO: 103100 - protein, 9 aa, Homo Sapiens
SPCHPSTAP

SEQ ID NO: 103101 - protein, 9 aa, Homo Sapiens
TLAPLLALI

SEQ ID NO: 103102 - protein, 9 aa, Homo Sapiens
GIKHLKQYS

SEQ ID NO: 103103 - protein, 9 aa, Homo Sapiens
VPGILMSIK

SEQ ID NO: 103104 - protein, 9 aa, Homo Sapiens
GQCYVPLKK

SEQ ID NO: 103105 - protein, 9 aa, Homo Sapiens
KVADKVINE

SEQ ID NO: 103106 - protein, 9 aa, Homo Sapiens
HTLAQLIAA

SEQ ID NO: 103107 - protein, 9 aa, Homo Sapiens
ISKTEAKQE

SEQ ID NO: 103108 - protein, 9 aa, Homo Sapiens
PHILKRNEV

SEQ ID NO: 103109 - protein, 9 aa, Homo Sapiens
VHGVALPRL

SEQ ID NO: 103110 - protein, 9 aa, Homo Sapiens
SNENIAYRI

SEQ ID NO: 103111 - protein, 9 aa, Homo Sapiens
NLGAVETLG

SEQ ID NO: 103112 - protein, 9 aa, Homo Sapiens
LRTAVCHEI

SEQ ID NO: 103113 - protein, 9 aa, Homo Sapiens
LPAWWGPSP

SEQ ID NO: 103114 - protein, 9 aa, Homo Sapiens
LFVHCCFLF

SEQ ID NO: 103115 - protein, 9 aa, Homo Sapiens
VINENTRDS

SEQ ID NO: 103116 - protein, 9 aa, Homo Sapiens
TFKFDRPAL

SEQ ID NO: 103117 - protein, 9 aa, Homo Sapiens
SFSKVTVCS

SEQ ID NO: 103118 - protein, 9 aa, Homo Sapiens
MVSFNFLHW

SEQ ID NO: 103119 - protein, 9 aa, Homo Sapiens
NLFKYIIGT

SEQ ID NO: 103120 - protein, 9 aa, Homo Sapiens
RNSTVASDL

SEQ ID NO: 103121 - protein, 9 aa, Homo Sapiens
ECMQCGKAF

SEQ ID NO: 103122 - protein, 9 aa, Homo Sapiens
KLHAGLYER

SEQ ID NO: 103123 - protein, 9 aa, Homo Sapiens
VFPIFKFSR

SEQ ID NO: 103124 - protein, 9 aa, Homo Sapiens
SSLLTQKHE

SEQ ID NO: 103125 - protein, 9 aa, Homo Sapiens
RTIVLKMPM

SEQ ID NO: 103126 - protein, 9 aa, Homo Sapiens
CVLSAFGIC

SEQ ID NO: 103127 - protein, 9 aa, Homo Sapiens
TTLSLPSAN

SEQ ID NO: 103128 - protein, 9 aa, Homo Sapiens
LESNENIAY

SEQ ID NO: 103129 - protein, 9 aa, Homo Sapiens
QLIENVKSA

SEQ ID NO: 103130 - protein, 9 aa, Homo Sapiens
CHPSTAPWP

SEQ ID NO: 103131 - protein, 9 aa, Homo Sapiens
LETFDFHAE

SEQ ID NO: 103132 - protein, 9 aa, Homo Sapiens
YMMVSFNFL

SEQ ID NO: 103133 - protein, 9 aa, Homo Sapiens
VSFPLSGPC

SEQ ID NO: 103134 - protein, 9 aa, Homo Sapiens
KIRESQEGD

SEQ ID NO: 103135 - protein, 9 aa, Homo Sapiens
TAPWPGLCL

SEQ ID NO: 103136 - protein, 9 aa, Homo Sapiens
LRFNSSYHI

SEQ ID NO: 103137 - protein, 9 aa, Homo Sapiens
VRFIVDELQ

SEQ ID NO: 103138 - protein, 9 aa, Homo Sapiens
AGCKSQVVL

SEQ ID NO: 103139 - protein, 9 aa, Homo Sapiens
CFLFTLTYQ

SEQ ID NO: 103140 - protein, 9 aa, Homo Sapiens
LGEGGKSIT

SEQ ID NO: 103141 - protein, 9 aa, Homo Sapiens
RWSRAPPDL

SEQ ID NO: 103142 - protein, 9 aa, Homo Sapiens
KNKHLFGLR

SEQ ID NO: 103143 - protein, 9 aa, Homo Sapiens
DSFKKETLG

SEQ ID NO: 103144 - protein, 9 aa, Homo Sapiens
APPDLGRSP

SEQ ID NO: 103145 - protein, 9 aa, Homo Sapiens
STVASDLHG

SEQ ID NO: 103146 - protein, 9 aa, Homo Sapiens
NSKAKLHAG

SEQ ID NO: 103147 - protein, 9 aa, Homo Sapiens
TNNRLNSRI

SEQ ID NO: 103148 - protein, 9 aa, Homo Sapiens
PCLAGCKSQ

SEQ ID NO: 103149 - protein, 9 aa, Homo Sapiens
YTYEFSRKV

SEQ ID NO: 103150 - protein, 9 aa, Homo Sapiens
EDVLSSSIN

SEQ ID NO: 103151 - protein, 9 aa, Homo Sapiens
GKSITMEIV

SEQ ID NO: 103152 - protein, 9 aa, Homo Sapiens
GEGGKSITM

SEQ ID NO: 103153 - protein, 9 aa, Homo Sapiens
WGPSPSEKQ

SEQ ID NO: 103154 - protein, 9 aa, Homo Sapiens
KPYECMQCG

SEQ ID NO: 103155 - protein, 9 aa, Homo Sapiens
PGSGPRLSP

SEQ ID NO: 103156 - protein, 9 aa, Homo Sapiens
LQCGSQKGY

SEQ ID NO: 103157 - protein, 9 aa, Homo Sapiens
VTLFVASFT

SEQ ID NO: 103158 - protein, 9 aa, Homo Sapiens
ESHSRPSAC

SEQ ID NO: 103159 - protein, 9 aa, Homo Sapiens
NYVRFIVDE

SEQ ID NO: 103160 - protein, 9 aa, Homo Sapiens
GKKPGIEES

SEQ ID NO: 103161 - protein, 9 aa, Homo Sapiens
NIKLVKQLI

SEQ ID NO: 103162 - protein, 9 aa, Homo Sapiens
NHIDDHTLP

SEQ ID NO: 103163 - protein, 9 aa, Homo Sapiens
KPGIEESIT

SEQ ID NO: 103164 - protein, 9 aa, Homo Sapiens
CVRMDKTPP

SEQ ID NO: 103165 - protein, 9 aa, Homo Sapiens
VFPVLFGTI

SEQ ID NO: 103166 - protein, 9 aa, Homo Sapiens
FKYIIGTLE

SEQ ID NO: 103167 - protein, 9 aa, Homo Sapiens
SRVCLYPSF

SEQ ID NO: 103168 - protein, 9 aa, Homo Sapiens
KLTPRKLST

SEQ ID NO: 103169 - protein, 9 aa, Homo Sapiens
KQLIENVKS

SEQ ID NO: 103170 - protein, 9 aa, Homo Sapiens
SYHIESKGI

SEQ ID NO: 103171 - protein, 9 aa, Homo Sapiens
CYMMVSFNF

SEQ ID NO: 103172 - protein, 9 aa, Homo Sapiens
SRPSACSPQ

SEQ ID NO: 103173 - protein, 9 aa, Homo Sapiens
GSGPRLSPL

SEQ ID NO: 103174 - protein, 9 aa, Homo Sapiens
CLYPSFVDV

SEQ ID NO: 103175 - protein, 9 aa, Homo Sapiens
LAGCKSQVV

SEQ ID NO: 103176 - protein, 9 aa, Homo Sapiens
ASFTLAPLL

SEQ ID NO: 103177 - protein, 9 aa, Homo Sapiens
PASGPGRAP

SEQ ID NO: 103178 - protein, 9 aa, Homo Sapiens
KCLGEGGKS

SEQ ID NO: 103179 - protein, 9 aa, Homo Sapiens
NRQPMEGRP

SEQ ID NO: 103180 - protein, 9 aa, Homo Sapiens
PEKVKKIRK

SEQ ID NO: 103181 - protein, 9 aa, Homo Sapiens
TVCSRLIPR

SEQ ID NO: 103182 - protein, 9 aa, Homo Sapiens
PPDLGRSPC

SEQ ID NO: 103183 - protein, 9 aa, Homo Sapiens
SACSPQSPA

SEQ ID NO: 103184 - protein, 9 aa, Homo Sapiens
ISLLVYFNK

SEQ ID NO: 103185 - protein, 9 aa, Homo Sapiens
WPGLCLPAW

SEQ ID NO: 103186 - protein, 9 aa, Homo Sapiens
KEIKKNKHL

SEQ ID NO: 103187 - protein, 9 aa, Homo Sapiens
KHEVHMREK

SEQ ID NO: 103188 - protein, 9 aa, Homo Sapiens
PDLGRSPCH

SEQ ID NO: 103189 - protein, 9 aa, Homo Sapiens
AGDKLTPRK

SEQ ID NO: 103190 - protein, 9 aa, Homo Sapiens
NNARPESRR

SEQ ID NO: 103191 - protein, 9 aa, Homo Sapiens
RFYKLFLLI

SEQ ID NO: 103192 - protein, 9 aa, Homo Sapiens
TLLSSTTIP

SEQ ID NO: 103193 - protein, 9 aa, Homo Sapiens
NCLVKNLGA

SEQ ID NO: 103194 - protein, 9 aa, Homo Sapiens
EDLRRQGLL

SEQ ID NO: 103195 - protein, 9 aa, Homo Sapiens
APSPRLYTG

SEQ ID NO: 103196 - protein, 9 aa, Homo Sapiens
QPMEGRPRD

SEQ ID NO: 103197 - protein, 9 aa, Homo Sapiens
FGICTSTVG

SEQ ID NO: 103198 - protein, 9 aa, Homo Sapiens
PRGQALQEK

SEQ ID NO: 103199 - protein, 9 aa, Homo Sapiens
ELSLAQYLI

SEQ ID NO: 103200 - protein, 9 aa, Homo Sapiens
LCLPAWWGP

SEQ ID NO: 103201 - protein, 9 aa, Homo Sapiens
DECVRMDKT

SEQ ID NO: 103202 - protein, 9 aa, Homo Sapiens
SVSWITANG

SEQ ID NO: 103203 - protein, 9 aa, Homo Sapiens
LQGVDQETC

SEQ ID NO: 103204 - protein, 9 aa, Homo Sapiens
IKLVKQLIE

SEQ ID NO: 103205 - protein, 9 aa, Homo Sapiens
VALPRLERA

SEQ ID NO: 103206 - protein, 9 aa, Homo Sapiens
LGRSPCHPS

SEQ ID NO: 103207 - protein, 9 aa, Homo Sapiens
KEELVAEQG

SEQ ID NO: 103208 - protein, 9 aa, Homo Sapiens
PERLCTDEE

SEQ ID NO: 103209 - protein, 9 aa, Homo Sapiens
EDSHCLHCC

SEQ ID NO: 103210 - protein, 9 aa, Homo Sapiens
SLHLQEEKT

SEQ ID NO: 103211 - protein, 9 aa, Homo Sapiens
QPIDKIRES

SEQ ID NO: 103212 - protein, 9 aa, Homo Sapiens
YGFRPGFLH

SEQ ID NO: 103213 - protein, 9 aa, Homo Sapiens
RHSNLSKIH

SEQ ID NO: 103214 - protein, 9 aa, Homo Sapiens
DDKHKLISK

SEQ ID NO: 103215 - protein, 9 aa, Homo Sapiens
PVLFGTINL

SEQ ID NO: 103216 - protein, 9 aa, Homo Sapiens
VFRVFPIFK

SEQ ID NO: 103217 - protein, 9 aa, Homo Sapiens
LSEVQLNHI

SEQ ID NO: 103218 - protein, 9 aa, Homo Sapiens
ATPAHALQC

SEQ ID NO: 103219 - protein, 9 aa, Homo Sapiens
KAMSRNSTV

SEQ ID NO: 103220 - protein, 9 aa, Homo Sapiens
YRIKVPQGF

SEQ ID NO: 103221 - protein, 9 aa, Homo Sapiens
TIVLKMPMK

SEQ ID NO: 103222 - protein, 9 aa, Homo Sapiens
SPRLYTGPC

SEQ ID NO: 103223 - protein, 9 aa, Homo Sapiens
KVKKIRKVQ

SEQ ID NO: 103224 - protein, 9 aa, Homo Sapiens
KHCNNARPE

SEQ ID NO: 103225 - protein, 9 aa, Homo Sapiens
TTVHEDVLS

SEQ ID NO: 103226 - protein, 9 aa, Homo Sapiens
PHNRLPLAV

SEQ ID NO: 103227 - protein, 9 aa, Homo Sapiens
KKTYEDLRR

SEQ ID NO: 103228 - protein, 9 aa, Homo Sapiens
KSQVVLKSI

SEQ ID NO: 103229 - protein, 9 aa, Homo Sapiens
VYFNKMKKL

SEQ ID NO: 103230 - protein, 9 aa, Homo Sapiens
KSIQCFITV

SEQ ID NO: 103231 - protein, 9 aa, Homo Sapiens
LYTGPCTVR

SEQ ID NO: 103232 - protein, 9 aa, Homo Sapiens
TVASDLHGE

SEQ ID NO: 103233 - protein, 9 aa, Homo Sapiens
FTLTYQGLC

SEQ ID NO: 103234 - protein, 9 aa, Homo Sapiens
TTLVLPHNR

SEQ ID NO: 103235 - protein, 9 aa, Homo Sapiens
KIPWRFYKL

SEQ ID NO: 103236 - protein, 9 aa, Homo Sapiens
QCGSQKGYH

SEQ ID NO: 103237 - protein, 9 aa, Homo Sapiens
RSLFRILSG

SEQ ID NO: 103238 - protein, 9 aa, Homo Sapiens
KNLGAVETL

SEQ ID NO: 103239 - protein, 9 aa, Homo Sapiens
KGEFLRHLV

SEQ ID NO: 103240 - protein, 9 aa, Homo Sapiens
IRSGNPNYT

SEQ ID NO: 103241 - protein, 9 aa, Homo Sapiens
SVPEELSLA

SEQ ID NO: 103242 - protein, 9 aa, Homo Sapiens
ILSYGIKKG

SEQ ID NO: 103243 - protein, 9 aa, Homo Sapiens
VADKVINEN

SEQ ID NO: 103244 - protein, 9 aa, Homo Sapiens
ACSPQSPAS

SEQ ID NO: 103245 - protein, 9 aa, Homo Sapiens
CSRLIPRWS

SEQ ID NO: 103246 - protein, 9 aa, Homo Sapiens
RVWPYRIKV

SEQ ID NO: 103247 - protein, 9 aa, Homo Sapiens
RMDKTPPPP

SEQ ID NO: 103248 - protein, 9 aa, Homo Sapiens
ANGTVMTHG

SEQ ID NO: 103249 - protein, 9 aa, Homo Sapiens
PDALARASR

SEQ ID NO: 103250 - protein, 9 aa, Homo Sapiens
RFIVDELQI

SEQ ID NO: 103251 - protein, 9 aa, Homo Sapiens
NSGQCYVPL

SEQ ID NO: 103252 - protein, 9 aa, Homo Sapiens
LSLPSANSP

SEQ ID NO: 103253 - protein, 9 aa, Homo Sapiens
FKKETLGRY

SEQ ID NO: 103254 - protein, 9 aa, Homo Sapiens
KVTAIPESA

SEQ ID NO: 103255 - protein, 9 aa, Homo Sapiens
TANGTVMTH

SEQ ID NO: 103256 - protein, 9 aa, Homo Sapiens
SKVTVCSRL

SEQ ID NO: 103257 - protein, 9 aa, Homo Sapiens
PIDKIRESQ

SEQ ID NO: 103258 - protein, 9 aa, Homo Sapiens
VLKMPMKLT

SEQ ID NO: 103259 - protein, 9 aa, Homo Sapiens
RAPPDLGRS

SEQ ID NO: 103260 - protein, 9 aa, Homo Sapiens
VVVPGILMS

SEQ ID NO: 103261 - protein, 9 aa, Homo Sapiens
LSSTTIPKM

SEQ ID NO: 103262 - protein, 9 aa, Homo Sapiens
TAIPESADQ

SEQ ID NO: 103263 - protein, 9 aa, Homo Sapiens
NEVLQDFKP

SEQ ID NO: 103264 - protein, 9 aa, Homo Sapiens
TTIPKMLAN

SEQ ID NO: 103265 - protein, 9 aa, Homo Sapiens
SSTTIPKML

SEQ ID NO: 103266 - protein, 9 aa, Homo Sapiens
ITANGTVMT

SEQ ID NO: 103267 - protein, 9 aa, Homo Sapiens
YIIGTLELL

SEQ ID NO: 103268 - protein, 9 aa, Homo Sapiens
RSLHLQEEK

SEQ ID NO: 103269 - protein, 9 aa, Homo Sapiens
CFITVVVWK

SEQ ID NO: 103270 - protein, 9 aa, Homo Sapiens
PESADQKTA

SEQ ID NO: 103271 - protein, 9 aa, Homo Sapiens
HAEYIDSPV

SEQ ID NO: 103272 - protein, 9 aa, Homo Sapiens
KTNNRLNSR

SEQ ID NO: 103273 - protein, 9 aa, Homo Sapiens
LFGTINLVY

SEQ ID NO: 103274 - protein, 9 aa, Homo Sapiens
IKVPQGFYP

SEQ ID NO: 103275 - protein, 9 aa, Homo Sapiens
FPVLFGTIN

SEQ ID NO: 103276 - protein, 9 aa, Homo Sapiens
AAYSLVDPE

SEQ ID NO: 103277 - protein, 9 aa, Homo Sapiens
LARASRLAS

SEQ ID NO: 103278 - protein, 9 aa, Homo Sapiens
IFGKKPGIE

SEQ ID NO: 103279 - protein, 9 aa, Homo Sapiens
TGPNGCGKR

SEQ ID NO: 103280 - protein, 9 aa, Homo Sapiens
EQELAQERS

SEQ ID NO: 103281 - protein, 9 aa, Homo Sapiens
TFDFHAEYI

SEQ ID NO: 103282 - protein, 9 aa, Homo Sapiens
QEKWNLIPE

SEQ ID NO: 103283 - protein, 9 aa, Homo Sapiens
FISKIPWRF

SEQ ID NO: 103284 - protein, 9 aa, Homo Sapiens
YTGPCTVRW

SEQ ID NO: 103285 - protein, 9 aa, Homo Sapiens
FSKVTVCSR

SEQ ID NO: 103286 - protein, 9 aa, Homo Sapiens
SYGFRPGFL

SEQ ID NO: 103287 - protein, 9 aa, Homo Sapiens
INLVYWATY

SEQ ID NO: 103288 - protein, 9 aa, Homo Sapiens
KHKLISKTE

SEQ ID NO: 103289 - protein, 9 aa, Homo Sapiens
KVVVPGILM

SEQ ID NO: 103290 - protein, 9 aa, Homo Sapiens
CLRTAVCHE

SEQ ID NO: 103291 - protein, 9 aa, Homo Sapiens
KVINENTRD

SEQ ID NO: 103292 - protein, 9 aa, Homo Sapiens
VTNSVPEEL

SEQ ID NO: 103293 - protein, 9 aa, Homo Sapiens
RYSWVLCDH

SEQ ID NO: 103294 - protein, 9 aa, Homo Sapiens
KLISKTEAK

SEQ ID NO: 103295 - protein, 9 aa, Homo Sapiens
ETFDFHAEY

SEQ ID NO: 103296 - protein, 9 aa, Homo Sapiens
AQGILSYGI

SEQ ID NO: 103297 - protein, 9 aa, Homo Sapiens
VDQETCMIV

SEQ ID NO: 103298 - protein, 9 aa, Homo Sapiens
PQTFKFDRP

SEQ ID NO: 103299 - protein, 9 aa, Homo Sapiens
LSSASTGDS

SEQ ID NO: 103300 - protein, 9 aa, Homo Sapiens
SWITANGTV

SEQ ID NO: 103301 - protein, 9 aa, Homo Sapiens
FLRHLVKHT

SEQ ID NO: 103302 - protein, 9 aa, Homo Sapiens
SNLSKIHVA

SEQ ID NO: 103303 - protein, 9 aa, Homo Sapiens
PAPDPDALA

SEQ ID NO: 103304 - protein, 9 aa, Homo Sapiens
QLIAAYSLV

SEQ ID NO: 103305 - protein, 9 aa, Homo Sapiens
RCLRTAVCH

SEQ ID NO: 103306 - protein, 9 aa, Homo Sapiens
TNRSLHLQE

SEQ ID NO: 103307 - protein, 9 aa, Homo Sapiens
NARPESRRA

SEQ ID NO: 103308 - protein, 9 aa, Homo Sapiens
ALARASRLA

SEQ ID NO: 103309 - protein, 9 aa, Homo Sapiens
VSLQGVDQE

SEQ ID NO: 103310 - protein, 9 aa, Homo Sapiens
RVCLYPSFV

SEQ ID NO: 103311 - protein, 9 aa, Homo Sapiens
GQALQEKWN

SEQ ID NO: 103312 - protein, 9 aa, Homo Sapiens
IAAYSLVDP

SEQ ID NO: 103313 - protein, 9 aa, Homo Sapiens
EKVKKIRKV

SEQ ID NO: 103314 - protein, 9 aa, Homo Sapiens
LGAVETLGS

SEQ ID NO: 103315 - protein, 9 aa, Homo Sapiens
KIKKTNNRL

SEQ ID NO: 103316 - protein, 9 aa, Homo Sapiens
NLVLHMEDS

SEQ ID NO: 103317 - protein, 9 aa, Homo Sapiens
WPYRIKVPQ

SEQ ID NO: 103318 - protein, 9 aa, Homo Sapiens
GIQDSFKKE

SEQ ID NO: 103319 - protein, 9 aa, Homo Sapiens
VDISLLVYF

SEQ ID NO: 103320 - protein, 9 aa, Homo Sapiens
VCLYPSFVD

SEQ ID NO: 103321 - protein, 9 aa, Homo Sapiens
EPERLCTDE

SEQ ID NO: 103322 - protein, 9 aa, Homo Sapiens
GSYGFRPGF

SEQ ID NO: 103323 - protein, 9 aa, Homo Sapiens
LFTLTYQGL

SEQ ID NO: 103324 - protein, 9 aa, Homo Sapiens
TFLLIYMVM

SEQ ID NO: 103325 - protein, 9 aa, Homo Sapiens
KAKLHAGLY

SEQ ID NO: 103326 - protein, 9 aa, Homo Sapiens
EVQLNHIDD

SEQ ID NO: 103327 - protein, 9 aa, Homo Sapiens
IENVKSAID

SEQ ID NO: 103328 - protein, 9 aa, Homo Sapiens
TDEELILDP

SEQ ID NO: 103329 - protein, 9 aa, Homo Sapiens
KYIIGTLEL

SEQ ID NO: 103330 - protein, 9 aa, Homo Sapiens
ENQPIDKIR

SEQ ID NO: 103331 - protein, 9 aa, Homo Sapiens
GRSPCHPST

SEQ ID NO: 103332 - protein, 9 aa, Homo Sapiens
DLGRSPCHP

SEQ ID NO: 103333 - protein, 9 aa, Homo Sapiens
MQCGKAFIS

SEQ ID NO: 103334 - protein, 9 aa, Homo Sapiens
PRAVGTPGS

SEQ ID NO: 103335 - protein, 9 aa, Homo Sapiens
YEDLRRQGL

SEQ ID NO: 103336 - protein, 9 aa, Homo Sapiens
PIFKFSRHS

SEQ ID NO: 103337 - protein, 9 aa, Homo Sapiens
FGTINLVYW

SEQ ID NO: 103338 - protein, 9 aa, Homo Sapiens
TPPPQQPHA

SEQ ID NO: 103339 - protein, 9 aa, Homo Sapiens
GIEESITED

SEQ ID NO: 103340 - protein, 9 aa, Homo Sapiens
HLGQKQQGE

SEQ ID NO: 103341 - protein, 9 aa, Homo Sapiens
PWPGLCLPA

SEQ ID NO: 103342 - protein, 9 aa, Homo Sapiens
TAVCHEILI

SEQ ID NO: 103343 - protein, 9 aa, Homo Sapiens
KVTVCSRLI

SEQ ID NO: 103344 - protein, 9 aa, Homo Sapiens
PSTAPWPGL

SEQ ID NO: 103345 - protein, 9 aa, Homo Sapiens
DNLFKYIIG

SEQ ID NO: 103346 - protein, 9 aa, Homo Sapiens
GRPRDGGLR

SEQ ID NO: 103347 - protein, 9 aa, Homo Sapiens
LKMPMKLTV

SEQ ID NO: 103348 - protein, 9 aa, Homo Sapiens
WSRAPPDLG

SEQ ID NO: 103349 - protein, 9 aa, Homo Sapiens
RVFPIFKFS

SEQ ID NO: 103350 - protein, 9 aa, Homo Sapiens
YGIKKGTPP

SEQ ID NO: 103351 - protein, 9 aa, Homo Sapiens
EELILDPVL

SEQ ID NO: 103352 - protein, 9 aa, Homo Sapiens
RVQELEQEL

SEQ ID NO: 103353 - protein, 9 aa, Homo Sapiens
GIKKGTPPG

SEQ ID NO: 103354 - protein, 9 aa, Homo Sapiens
HSRPSACSP

SEQ ID NO: 103355 - protein, 9 aa, Homo Sapiens
PRRKIPQFS

SEQ ID NO: 103356 - protein, 9 aa, Homo Sapiens
LTQKHEVHM

SEQ ID NO: 103357 - protein, 9 aa, Homo Sapiens
IVLKMPMKL

SEQ ID NO: 103358 - protein, 9 aa, Homo Sapiens
LKIGTNRSL

SEQ ID NO: 103359 - protein, 9 aa, Homo Sapiens
PFQRSLCLL

SEQ ID NO: 103360 - protein, 9 aa, Homo Sapiens
NATAVTTVL

SEQ ID NO: 103361 - protein, 9 aa, Homo Sapiens
TIAEAGPHG

SEQ ID NO: 103362 - protein, 9 aa, Homo Sapiens
ESDYVSPNI

SEQ ID NO: 103363 - protein, 9 aa, Homo Sapiens
SALSEVGND

SEQ ID NO: 103364 - protein, 9 aa, Homo Sapiens
HEASALSEV

SEQ ID NO: 103365 - protein, 9 aa, Homo Sapiens
FTCPTLENT

SEQ ID NO: 103366 - protein, 9 aa, Homo Sapiens
SVERNASNM

SEQ ID NO: 103367 - protein, 9 aa, Homo Sapiens
TSHMDIPLD

SEQ ID NO: 103368 - protein, 9 aa, Homo Sapiens
NHCLDKATE

SEQ ID NO: 103369 - protein, 9 aa, Homo Sapiens
CAFLKTEFS

SEQ ID NO: 103370 - protein, 9 aa, Homo Sapiens
ASALSEVGN

SEQ ID NO: 103371 - protein, 9 aa, Homo Sapiens
ASVREGIMT

SEQ ID NO: 103372 - protein, 9 aa, Homo Sapiens
LDEDKIRGY

SEQ ID NO: 103373 - protein, 9 aa, Homo Sapiens
LQEWKKWQG

SEQ ID NO: 103374 - protein, 9 aa, Homo Sapiens
TASVREGIM

SEQ ID NO: 103375 - protein, 9 aa, Homo Sapiens
SIRFWRFAL

SEQ ID NO: 103376 - protein, 9 aa, Homo Sapiens
DGDSIRFWR

SEQ ID NO: 103377 - protein, 9 aa, Homo Sapiens
VSPNICQWI

SEQ ID NO: 103378 - protein, 9 aa, Homo Sapiens
IGSKNVDLL

SEQ ID NO: 103379 - protein, 9 aa, Homo Sapiens
KLRDHSVRT

SEQ ID NO: 103380 - protein, 9 aa, Homo Sapiens
TLQHVNSNH

SEQ ID NO: 103381 - protein, 9 aa, Homo Sapiens
DFTASVREG

SEQ ID NO: 103382 - protein, 9 aa, Homo Sapiens
WYRPRPQCL

SEQ ID NO: 103383 - protein, 9 aa, Homo Sapiens
DSIRFWRFA

SEQ ID NO: 103384 - protein, 9 aa, Homo Sapiens
IIGTVNQGV

SEQ ID NO: 103385 - protein, 9 aa, Homo Sapiens
ISNGRSTPA

SEQ ID NO: 103386 - protein, 9 aa, Homo Sapiens
SSLCNVTSN

SEQ ID NO: 103387 - protein, 9 aa, Homo Sapiens
FPLLVYAPA

SEQ ID NO: 103388 - protein, 9 aa, Homo Sapiens
EPIFQGYIN

SEQ ID NO: 103389 - protein, 9 aa, Homo Sapiens
YIIGTVNQG

SEQ ID NO: 103390 - protein, 9 aa, Homo Sapiens
MSLGSPHGS

SEQ ID NO: 103391 - protein, 9 aa, Homo Sapiens
NGRSTPAMM

SEQ ID NO: 103392 - protein, 9 aa, Homo Sapiens
YLDGRNTFR

SEQ ID NO: 103393 - protein, 9 aa, Homo Sapiens
VNSNHCLDK

SEQ ID NO: 103394 - protein, 9 aa, Homo Sapiens
HLFSKDIAL

SEQ ID NO: 103395 - protein, 9 aa, Homo Sapiens
PLLENGEFL

SEQ ID NO: 103396 - protein, 9 aa, Homo Sapiens
FQGYINSLK

SEQ ID NO: 103397 - protein, 9 aa, Homo Sapiens
NSNHCLDKA

SEQ ID NO: 103398 - protein, 9 aa, Homo Sapiens
GQMHPLHGS

SEQ ID NO: 103399 - protein, 9 aa, Homo Sapiens
DLLGRQERK

SEQ ID NO: 103400 - protein, 9 aa, Homo Sapiens
KMRKLRDHS

SEQ ID NO: 103401 - protein, 9 aa, Homo Sapiens
QGDRNEVRA

SEQ ID NO: 103402 - protein, 9 aa, Homo Sapiens
FLCEMEDIP

SEQ ID NO: 103403 - protein, 9 aa, Homo Sapiens
NEVRAVGQG

SEQ ID NO: 103404 - protein, 9 aa, Homo Sapiens
DEDKIRGYK

SEQ ID NO: 103405 - protein, 9 aa, Homo Sapiens
NSLKRYLDG

SEQ ID NO: 103406 - protein, 9 aa, Homo Sapiens
LEWLRVTTV

SEQ ID NO: 103407 - protein, 9 aa, Homo Sapiens
MAKNPVGLI

SEQ ID NO: 103408 - protein, 9 aa, Homo Sapiens
AVTTVLTNA

SEQ ID NO: 103409 - protein, 9 aa, Homo Sapiens
RVKELCHQW

SEQ ID NO: 103410 - protein, 9 aa, Homo Sapiens
SRMPHLFSK

SEQ ID NO: 103411 - protein, 9 aa, Homo Sapiens
LFTCPTLEN

SEQ ID NO: 103412 - protein, 9 aa, Homo Sapiens
IELQLKELG

SEQ ID NO: 103413 - protein, 9 aa, Homo Sapiens
HHWPFQRSL

SEQ ID NO: 103414 - protein, 9 aa, Homo Sapiens
ENGEFLIPG

SEQ ID NO: 103415 - protein, 9 aa, Homo Sapiens
PSFCHRFST

SEQ ID NO: 103416 - protein, 9 aa, Homo Sapiens
GRSNGAWSH

SEQ ID NO: 103417 - protein, 9 aa, Homo Sapiens
RDQVAFLTF

SEQ ID NO: 103418 - protein, 9 aa, Homo Sapiens
ALSRVKELC

SEQ ID NO: 103419 - protein, 9 aa, Homo Sapiens
ALESDYVSP

SEQ ID NO: 103420 - protein, 9 aa, Homo Sapiens
RPRKLTPAQ

SEQ ID NO: 103421 - protein, 9 aa, Homo Sapiens
RQFHRPPFG

SEQ ID NO: 103422 - protein, 9 aa, Homo Sapiens
HVNSNHCLD

SEQ ID NO: 103423 - protein, 9 aa, Homo Sapiens
ETSSLCNVT

SEQ ID NO: 103424 - protein, 9 aa, Homo Sapiens
IHEASALSE

SEQ ID NO: 103425 - protein, 9 aa, Homo Sapiens
MKQMNDAYH

SEQ ID NO: 103426 - protein, 9 aa, Homo Sapiens
AGPHGDCPC

SEQ ID NO: 103427 - protein, 9 aa, Homo Sapiens
GTPPLGPGV

SEQ ID NO: 103428 - protein, 9 aa, Homo Sapiens
PLLVYAPAS

SEQ ID NO: 103429 - protein, 9 aa, Homo Sapiens
SSHSTALAL

SEQ ID NO: 103430 - protein, 9 aa, Homo Sapiens
SFITAVPGG

SEQ ID NO: 103431 - protein, 9 aa, Homo Sapiens
LLDEDKIRG

SEQ ID NO: 103432 - protein, 9 aa, Homo Sapiens
DSRPRKLTP

SEQ ID NO: 103433 - protein, 9 aa, Homo Sapiens
HKYGVAAFC

SEQ ID NO: 103434 - protein, 9 aa, Homo Sapiens
APGLPPAVS

SEQ ID NO: 103435 - protein, 9 aa, Homo Sapiens
IAEAGPHGD

SEQ ID NO: 103436 - protein, 9 aa, Homo Sapiens
RSNGAWSHK

SEQ ID NO: 103437 - protein, 9 aa, Homo Sapiens
TISNGRSTP

SEQ ID NO: 103438 - protein, 9 aa, Homo Sapiens
INSLKRYLD

SEQ ID NO: 103439 - protein, 9 aa, Homo Sapiens
FWRFALETR

SEQ ID NO: 103440 - protein, 9 aa, Homo Sapiens
NASNMYEAR

SEQ ID NO: 103441 - protein, 9 aa, Homo Sapiens
PAQLQRMRG

SEQ ID NO: 103442 - protein, 9 aa, Homo Sapiens
RVRPSNQPS

SEQ ID NO: 103443 - protein, 9 aa, Homo Sapiens
RGQGTPPLG

SEQ ID NO: 103444 - protein, 9 aa, Homo Sapiens
CEMEDIPFN

SEQ ID NO: 103445 - protein, 9 aa, Homo Sapiens
EWKKWQGQM

SEQ ID NO: 103446 - protein, 9 aa, Homo Sapiens
KLLDEDKIR

SEQ ID NO: 103447 - protein, 9 aa, Homo Sapiens
GEMSSHSTA

SEQ ID NO: 103448 - protein, 9 aa, Homo Sapiens
EMEDIPFNP

SEQ ID NO: 103449 - protein, 9 aa, Homo Sapiens
EPIQHTSHM

SEQ ID NO: 103450 - protein, 9 aa, Homo Sapiens
LAETSSLCN

SEQ ID NO: 103451 - protein, 9 aa, Homo Sapiens
PSIVNDQYG

SEQ ID NO: 103452 - protein, 9 aa, Homo Sapiens
SVPRDQVAF

SEQ ID NO: 103453 - protein, 9 aa, Homo Sapiens
SRVKELCHQ

SEQ ID NO: 103454 - protein, 9 aa, Homo Sapiens
SFCHRFSTQ

SEQ ID NO: 103455 - protein, 9 aa, Homo Sapiens
DAYHGGWTT

SEQ ID NO: 103456 - protein, 9 aa, Homo Sapiens
WSHKPGSSP

SEQ ID NO: 103457 - protein, 9 aa, Homo Sapiens
AEAGPHGDC

SEQ ID NO: 103458 - protein, 9 aa, Homo Sapiens
AVSPPDSHV

SEQ ID NO: 103459 - protein, 9 aa, Homo Sapiens
DQVAFLTFF

SEQ ID NO: 103460 - protein, 9 aa, Homo Sapiens
EASALSEVG

SEQ ID NO: 103461 - protein, 9 aa, Homo Sapiens
HQEGMSLGS

SEQ ID NO: 103462 - protein, 9 aa, Homo Sapiens
PRKFPWEFV

SEQ ID NO: 103463 - protein, 9 aa, Homo Sapiens
HRFSTQEKT

SEQ ID NO: 103464 - protein, 9 aa, Homo Sapiens
CTALEWLRV

SEQ ID NO: 103465 - protein, 9 aa, Homo Sapiens
IVNDQYGRK

SEQ ID NO: 103466 - protein, 9 aa, Homo Sapiens
IMCEPIQHT

SEQ ID NO: 103467 - protein, 9 aa, Homo Sapiens
SDYVSPNIC

SEQ ID NO: 103468 - protein, 9 aa, Homo Sapiens
QMAKNPVGL

SEQ ID NO: 103469 - protein, 9 aa, Homo Sapiens
MPHLFSKDI

SEQ ID NO: 103470 - protein, 9 aa, Homo Sapiens
RKFPWEFVR

SEQ ID NO: 103471 - protein, 9 aa, Homo Sapiens
IFQGYINSL

SEQ ID NO: 103472 - protein, 9 aa, Homo Sapiens
PIFQGYINS

SEQ ID NO: 103473 - protein, 9 aa, Homo Sapiens
SKDIALVQQ

SEQ ID NO: 103474 - protein, 9 aa, Homo Sapiens
DDFTASVRE

SEQ ID NO: 103475 - protein, 9 aa, Homo Sapiens
QMHPLHGSV

SEQ ID NO: 103476 - protein, 9 aa, Homo Sapiens
LPPAVSPPD

SEQ ID NO: 103477 - protein, 9 aa, Homo Sapiens
SSYISRLLT

SEQ ID NO: 103478 - protein, 9 aa, Homo Sapiens
SNGAWSHKP

SEQ ID NO: 103479 - protein, 9 aa, Homo Sapiens
TCPTLENTN

SEQ ID NO: 103480 - protein, 9 aa, Homo Sapiens
TTVLTNASG

SEQ ID NO: 103481 - protein, 9 aa, Homo Sapiens
LFSKDIALV

SEQ ID NO: 103482 - protein, 9 aa, Homo Sapiens
NFLCEMEDI

SEQ ID NO: 103483 - protein, 9 aa, Homo Sapiens
NPCFRDPCK

SEQ ID NO: 103484 - protein, 9 aa, Homo Sapiens
NGEFLIPGR

SEQ ID NO: 103485 - protein, 9 aa, Homo Sapiens
AETSSLCNV

SEQ ID NO: 103486 - protein, 9 aa, Homo Sapiens
QRSLCLLCF

SEQ ID NO: 103487 - protein, 9 aa, Homo Sapiens
AWSHKPGSS

SEQ ID NO: 103488 - protein, 9 aa, Homo Sapiens
ASNMYEARK

SEQ ID NO: 103489 - protein, 9 aa, Homo Sapiens
VKSVERNAS

SEQ ID NO: 103490 - protein, 9 aa, Homo Sapiens
MNDAYHGGW

SEQ ID NO: 103491 - protein, 9 aa, Homo Sapiens
ISRLLTTNS

SEQ ID NO: 103492 - protein, 9 aa, Homo Sapiens
SVRTPSNLD

SEQ ID NO: 103493 - protein, 9 aa, Homo Sapiens
AAFCAFLKT

SEQ ID NO: 103494 - protein, 9 aa, Homo Sapiens
AYHGGWTTK

SEQ ID NO: 103495 - protein, 9 aa, Homo Sapiens
LDIELQLKE

SEQ ID NO: 103496 - protein, 9 aa, Homo Sapiens
QEWKKWQGQ

SEQ ID NO: 103497 - protein, 9 aa, Homo Sapiens
RDVIQETFK

SEQ ID NO: 103498 - protein, 9 aa, Homo Sapiens
HSVRTPSNL

SEQ ID NO: 103499 - protein, 9 aa, Homo Sapiens
DIELQLKEL

SEQ ID NO: 103500 - protein, 9 aa, Homo Sapiens
RTENGKYKG

SEQ ID NO: 103501 - protein, 9 aa, Homo Sapiens
GPHGDCPCQ

SEQ ID NO: 103502 - protein, 9 aa, Homo Sapiens
HGDCPCQQI

SEQ ID NO: 103503 - protein, 9 aa, Homo Sapiens
KNVDLLGRQ

SEQ ID NO: 103504 - protein, 9 aa, Homo Sapiens
DIHEASALS

SEQ ID NO: 103505 - protein, 9 aa, Homo Sapiens
RVEYLDGRN

SEQ ID NO: 103506 - protein, 9 aa, Homo Sapiens
QVAFLTFFK

SEQ ID NO: 103507 - protein, 9 aa, Homo Sapiens
GPREALSRV

SEQ ID NO: 103508 - protein, 9 aa, Homo Sapiens
ENTNFKVEF

SEQ ID NO: 103509 - protein, 9 aa, Homo Sapiens
CFRDPCKAF

SEQ ID NO: 103510 - protein, 9 aa, Homo Sapiens
VAAFCAFLK

SEQ ID NO: 103511 - protein, 9 aa, Homo Sapiens
HSTALALVR

SEQ ID NO: 103512 - protein, 9 aa, Homo Sapiens
DIPFNPVRS

SEQ ID NO: 103513 - protein, 9 aa, Homo Sapiens
QGYINSLKR

SEQ ID NO: 103514 - protein, 9 aa, Homo Sapiens
LENTNFKVE

SEQ ID NO: 103515 - protein, 9 aa, Homo Sapiens
VSPPDSHVL

SEQ ID NO: 103516 - protein, 9 aa, Homo Sapiens
EDGDSIRFW

SEQ ID NO: 103517 - protein, 9 aa, Homo Sapiens
RPSNQPSTS

SEQ ID NO: 103518 - protein, 9 aa, Homo Sapiens
RDPCKAFVE

SEQ ID NO: 103519 - protein, 9 aa, Homo Sapiens
QLKELGPVI

SEQ ID NO: 103520 - protein, 9 aa, Homo Sapiens
VNQGVSSSP

SEQ ID NO: 103521 - protein, 9 aa, Homo Sapiens
QFHRPPFGA

SEQ ID NO: 103522 - protein, 9 aa, Homo Sapiens
FLTFFKERS

SEQ ID NO: 103523 - protein, 9 aa, Homo Sapiens
HWPFQRSLC

SEQ ID NO: 103524 - protein, 9 aa, Homo Sapiens
LGSPHGSQP

SEQ ID NO: 103525 - protein, 9 aa, Homo Sapiens
PPIGQMHPL

SEQ ID NO: 103526 - protein, 9 aa, Homo Sapiens
FCVNPCFRD

SEQ ID NO: 103527 - protein, 9 aa, Homo Sapiens
ERASFITAV

SEQ ID NO: 103528 - protein, 9 aa, Homo Sapiens
QKKKKLQEW

SEQ ID NO: 103529 - protein, 9 aa, Homo Sapiens
EWPRKFPWE

SEQ ID NO: 103530 - protein, 9 aa, Homo Sapiens
SSRMPHLFS

SEQ ID NO: 103531 - protein, 9 aa, Homo Sapiens
HPLHGSVTP

SEQ ID NO: 103532 - protein, 9 aa, Homo Sapiens
GTWYRPRPQ

SEQ ID NO: 103533 - protein, 9 aa, Homo Sapiens
CVNPCFRDP

SEQ ID NO: 103534 - protein, 9 aa, Homo Sapiens
APRVRPSNQ

SEQ ID NO: 103535 - protein, 9 aa, Homo Sapiens
LLHQEGMSL

SEQ ID NO: 103536 - protein, 9 aa, Homo Sapiens
RCINCCLIM

SEQ ID NO: 103537 - protein, 9 aa, Homo Sapiens
KIRGYKLHV

SEQ ID NO: 103538 - protein, 9 aa, Homo Sapiens
FMKQMNDAY

SEQ ID NO: 103539 - protein, 9 aa, Homo Sapiens
GVRTENGKY

SEQ ID NO: 103540 - protein, 9 aa, Homo Sapiens
AQMAKNPVG

SEQ ID NO: 103541 - protein, 9 aa, Homo Sapiens
VDLLGRQER

SEQ ID NO: 103542 - protein, 9 aa, Homo Sapiens
PGLPPAVSP

SEQ ID NO: 103543 - protein, 9 aa, Homo Sapiens
REALSRVKE

SEQ ID NO: 103544 - protein, 9 aa, Homo Sapiens
SFPLLVYAP

SEQ ID NO: 103545 - protein, 9 aa, Homo Sapiens
LTNASGLEV

SEQ ID NO: 103546 - protein, 9 aa, Homo Sapiens
MEDIPFNPV

SEQ ID NO: 103547 - protein, 9 aa, Homo Sapiens
LRVEYLDGR

SEQ ID NO: 103548 - protein, 9 aa, Homo Sapiens
KCPYIIGTV

SEQ ID NO: 103549 - protein, 9 aa, Homo Sapiens
LDGRNTFRH

SEQ ID NO: 103550 - protein, 9 aa, Homo Sapiens
NTGEMSSHS

SEQ ID NO: 103551 - protein, 9 aa, Homo Sapiens
ENFLCEMED

SEQ ID NO: 103552 - protein, 9 aa, Homo Sapiens
VLTNASGLE

SEQ ID NO: 103553 - protein, 9 aa, Homo Sapiens
TAVTTVLTN

SEQ ID NO: 103554 - protein, 9 aa, Homo Sapiens
GDSIRFWRF

SEQ ID NO: 103555 - protein, 9 aa, Homo Sapiens
ITDIHEASA

SEQ ID NO: 103556 - protein, 9 aa, Homo Sapiens
ALKLLDEDK

SEQ ID NO: 103557 - protein, 9 aa, Homo Sapiens
RNASNMYEA

SEQ ID NO: 103558 - protein, 9 aa, Homo Sapiens
NGAWSHKPG

SEQ ID NO: 103559 - protein, 9 aa, Homo Sapiens
LKQSIEWPR

SEQ ID NO: 103560 - protein, 9 aa, Homo Sapiens
ASFITAVPG

SEQ ID NO: 103561 - protein, 9 aa, Homo Sapiens
SNMYEARKC

SEQ ID NO: 103562 - protein, 9 aa, Homo Sapiens
GYINSLKRY

SEQ ID NO: 103563 - protein, 9 aa, Homo Sapiens
DITSFPLLV

SEQ ID NO: 103564 - protein, 9 aa, Homo Sapiens
STPSFCHRF

SEQ ID NO: 103565 - protein, 9 aa, Homo Sapiens
SHHWPFQRS

SEQ ID NO: 103566 - protein, 9 aa, Homo Sapiens
CPTLENTNF

SEQ ID NO: 103567 - protein, 9 aa, Homo Sapiens
YISRLLTTN

SEQ ID NO: 103568 - protein, 9 aa, Homo Sapiens
REGIMTYAN

SEQ ID NO: 103569 - protein, 9 aa, Homo Sapiens
NVDLLGRQE

SEQ ID NO: 103570 - protein, 9 aa, Homo Sapiens
EDIPFNPVR

SEQ ID NO: 103571 - protein, 9 aa, Homo Sapiens
VEYLDGRNT

SEQ ID NO: 103572 - protein, 9 aa, Homo Sapiens
RSLCLLCFY

SEQ ID NO: 103573 - protein, 9 aa, Homo Sapiens
TDIHEASAL

SEQ ID NO: 103574 - protein, 9 aa, Homo Sapiens
SYISRLLTT

SEQ ID NO: 103575 - protein, 9 aa, Homo Sapiens
QHTSHMDIP

SEQ ID NO: 103576 - protein, 9 aa, Homo Sapiens
LQLKELGPV

SEQ ID NO: 103577 - protein, 9 aa, Homo Sapiens
IAQMAKNPV

SEQ ID NO: 103578 - protein, 9 aa, Homo Sapiens
FLIPGRGDC

SEQ ID NO: 103579 - protein, 9 aa, Homo Sapiens
MCEPIQHTS

SEQ ID NO: 103580 - protein, 9 aa, Homo Sapiens
ITSFPLLVY

SEQ ID NO: 103581 - protein, 9 aa, Homo Sapiens
PAVSPPDSH

SEQ ID NO: 103582 - protein, 9 aa, Homo Sapiens
TSFPLLVYA

SEQ ID NO: 103583 - protein, 9 aa, Homo Sapiens
CEPIQHTSH

SEQ ID NO: 103584 - protein, 9 aa, Homo Sapiens
LLDIELQLK

SEQ ID NO: 103585 - protein, 9 aa, Homo Sapiens
HRPPFGALS

SEQ ID NO: 103586 - protein, 9 aa, Homo Sapiens
KLAETSSLC

SEQ ID NO: 103587 - protein, 9 aa, Homo Sapiens
TPSFCHRFS

SEQ ID NO: 103588 - protein, 9 aa, Homo Sapiens
MICGRPPPD

SEQ ID NO: 103589 - protein, 9 aa, Homo Sapiens
KYGVAAFCA

SEQ ID NO: 103590 - protein, 9 aa, Homo Sapiens
MDVDSTISN

SEQ ID NO: 103591 - protein, 9 aa, Homo Sapiens
IQHTSHMDI

SEQ ID NO: 103592 - protein, 9 aa, Homo Sapiens
TWYRPRPQC

SEQ ID NO: 103593 - protein, 9 aa, Homo Sapiens
NLRVEYLDG

SEQ ID NO: 103594 - protein, 9 aa, Homo Sapiens
QKNLYRDVI

SEQ ID NO: 103595 - protein, 9 aa, Homo Sapiens
FQRSLCLLC

SEQ ID NO: 103596 - protein, 9 aa, Homo Sapiens
ICGRPPPDV

SEQ ID NO: 103597 - protein, 9 aa, Homo Sapiens
HGRSNGAWS

SEQ ID NO: 103598 - protein, 9 aa, Homo Sapiens
VRTENGKYK

SEQ ID NO: 103599 - protein, 9 aa, Homo Sapiens
DKIRGYKLH

SEQ ID NO: 103600 - protein, 9 aa, Homo Sapiens
TENGKYKGN

SEQ ID NO: 103601 - protein, 9 aa, Homo Sapiens
PPAVSPPDS

SEQ ID NO: 103602 - protein, 9 aa, Homo Sapiens
PPFGALSQP

SEQ ID NO: 103603 - protein, 9 aa, Homo Sapiens
RDHSVRTPS

SEQ ID NO: 103604 - protein, 9 aa, Homo Sapiens
VKKAPRVRP

SEQ ID NO: 103605 - protein, 9 aa, Homo Sapiens
LYRDVIQET

SEQ ID NO: 103606 - protein, 9 aa, Homo Sapiens
EAGPHGDCP

SEQ ID NO: 103607 - protein, 9 aa, Homo Sapiens
AFCAFLKTE

SEQ ID NO: 103608 - protein, 9 aa, Homo Sapiens
GTVNQGVSS

SEQ ID NO: 103609 - protein, 9 aa, Homo Sapiens
WKKWQGQML

SEQ ID NO: 103610 - protein, 9 aa, Homo Sapiens
LLGRQERKQ

SEQ ID NO: 103611 - protein, 9 aa, Homo Sapiens
QEGMSLGSP

SEQ ID NO: 103612 - protein, 9 aa, Homo Sapiens
DVDSTISNG

SEQ ID NO: 103613 - protein, 9 aa, Homo Sapiens
SCQGDGTWY

SEQ ID NO: 103614 - protein, 9 aa, Homo Sapiens
GAWSHKPGS

SEQ ID NO: 103615 - protein, 9 aa, Homo Sapiens
TGEMSSHST

SEQ ID NO: 103616 - protein, 9 aa, Homo Sapiens
PREALSRVK

SEQ ID NO: 103617 - protein, 9 aa, Homo Sapiens
LCNVTSNYD

SEQ ID NO: 103618 - protein, 9 aa, Homo Sapiens
SHSTALALV

SEQ ID NO: 103619 - protein, 9 aa, Homo Sapiens
CPYIIGTVN

SEQ ID NO: 103620 - protein, 9 aa, Homo Sapiens
FITAVPGGV

SEQ ID NO: 103621 - protein, 9 aa, Homo Sapiens
VRPSNQPST

SEQ ID NO: 103622 - protein, 9 aa, Homo Sapiens
RMPHLFSKD

SEQ ID NO: 103623 - protein, 9 aa, Homo Sapiens
VAFLTFFKE

SEQ ID NO: 103624 - protein, 9 aa, Homo Sapiens
TALEWLRVT

SEQ ID NO: 103625 - protein, 9 aa, Homo Sapiens
EDKIRGYKL

SEQ ID NO: 103626 - protein, 9 aa, Homo Sapiens
KVKKAPRVR

SEQ ID NO: 103627 - protein, 9 aa, Homo Sapiens
LIIAQMAKN

SEQ ID NO: 103628 - protein, 9 aa, Homo Sapiens
IQETFKNLT

SEQ ID NO: 103629 - protein, 9 aa, Homo Sapiens
NLYRDVIQE

SEQ ID NO: 103630 - protein, 9 aa, Homo Sapiens
MHPLHGSVT

SEQ ID NO: 103631 - protein, 9 aa, Homo Sapiens
LAQGDRNEV

SEQ ID NO: 103632 - protein, 9 aa, Homo Sapiens
LLENGEFLI

SEQ ID NO: 103633 - protein, 9 aa, Homo Sapiens
KKLQEWKKW

SEQ ID NO: 103634 - protein, 9 aa, Homo Sapiens
STISNGRST

SEQ ID NO: 103635 - protein, 9 aa, Homo Sapiens
KKAPRVRPS

SEQ ID NO: 103636 - protein, 9 aa, Homo Sapiens
QGDGTWYRP

SEQ ID NO: 103637 - protein, 9 aa, Homo Sapiens
PLGPGVVRA

SEQ ID NO: 103638 - protein, 9 aa, Homo Sapiens
VNPCFRDPC

SEQ ID NO: 103639 - protein, 9 aa, Homo Sapiens
FHRPPFGAL

SEQ ID NO: 103640 - protein, 9 aa, Homo Sapiens
YRDVIQETF

SEQ ID NO: 103641 - protein, 9 aa, Homo Sapiens
PLHGSVTPQ

SEQ ID NO: 103642 - protein, 9 aa, Homo Sapiens
CPNPSSYIS

SEQ ID NO: 103643 - protein, 9 aa, Homo Sapiens
HTSHMDIPL

SEQ ID NO: 103644 - protein, 9 aa, Homo Sapiens
KKKKLQEWK

SEQ ID NO: 103645 - protein, 9 aa, Homo Sapiens
VNDQYGRKV

SEQ ID NO: 103646 - protein, 9 aa, Homo Sapiens
PRVRPSNQP

SEQ ID NO: 103647 - protein, 9 aa, Homo Sapiens
FSKDIALVQ

SEQ ID NO: 103648 - protein, 9 aa, Homo Sapiens
CQGDGTWYR

SEQ ID NO: 103649 - protein, 9 aa, Homo Sapiens
RKLTPAQLQ

SEQ ID NO: 103650 - protein, 9 aa, Homo Sapiens
GLPPAVSPP

SEQ ID NO: 103651 - protein, 9 aa, Homo Sapiens
SPNICQWID

SEQ ID NO: 103652 - protein, 9 aa, Homo Sapiens
YINSLKRYL

SEQ ID NO: 103653 - protein, 9 aa, Homo Sapiens
LSRVKELCH

SEQ ID NO: 103654 - protein, 9 aa, Homo Sapiens
PIGQMHPLH

SEQ ID NO: 103655 - protein, 9 aa, Homo Sapiens
PNPSSYISR

SEQ ID NO: 103656 - protein, 9 aa, Homo Sapiens
RKLRDHSVR

SEQ ID NO: 103657 - protein, 9 aa, Homo Sapiens
IPLLENGEF

SEQ ID NO: 103658 - protein, 9 aa, Homo Sapiens
YRPRPQCLL

SEQ ID NO: 103659 - protein, 9 aa, Homo Sapiens
KQSIEWPRK

SEQ ID NO: 103660 - protein, 9 aa, Homo Sapiens
VTTVLTNAS

SEQ ID NO: 103661 - protein, 9 aa, Homo Sapiens
LHQEGMSLG

SEQ ID NO: 103662 - protein, 9 aa, Homo Sapiens
ITAVPGGVG

SEQ ID NO: 103663 - protein, 9 aa, Homo Sapiens
LHGSVTPQK

SEQ ID NO: 103664 - protein, 9 aa, Homo Sapiens
DYVSPNICQ

SEQ ID NO: 103665 - protein, 9 aa, Homo Sapiens
DSTISNGRS

SEQ ID NO: 103666 - protein, 9 aa, Homo Sapiens
GDRNEVRAV

SEQ ID NO: 103667 - protein, 9 aa, Homo Sapiens
ERNASNMYE

SEQ ID NO: 103668 - protein, 9 aa, Homo Sapiens
AFLTFFKER

SEQ ID NO: 103669 - protein, 9 aa, Homo Sapiens
PHLFSKDIA

SEQ ID NO: 103670 - protein, 9 aa, Homo Sapiens
FCAFLKTEF

SEQ ID NO: 103671 - protein, 9 aa, Homo Sapiens
LTPAQLQRM

SEQ ID NO: 103672 - protein, 9 aa, Homo Sapiens
PYIIGTVNQ

SEQ ID NO: 103673 - protein, 9 aa, Homo Sapiens
SHLIIAQMA

SEQ ID NO: 103674 - protein, 9 aa, Homo Sapiens
SLCLLCFYL

SEQ ID NO: 103675 - protein, 9 aa, Homo Sapiens
CHRFSTQEK

SEQ ID NO: 103676 - protein, 9 aa, Homo Sapiens
HCLDKATEE

SEQ ID NO: 103677 - protein, 9 aa, Homo Sapiens
PTLENTNFK

SEQ ID NO: 103678 - protein, 9 aa, Homo Sapiens
PCFRDPCKA

SEQ ID NO: 103679 - protein, 9 aa, Homo Sapiens
EALSRVKEL

SEQ ID NO: 103680 - protein, 9 aa, Homo Sapiens
NPSSYISRL

SEQ ID NO: 103681 - protein, 9 aa, Homo Sapiens
GMSLGSPHG

SEQ ID NO: 103682 - protein, 9 aa, Homo Sapiens
LCEMEDIPF

SEQ ID NO: 103683 - protein, 9 aa, Homo Sapiens
DFCVNPCFR

SEQ ID NO: 103684 - protein, 9 aa, Homo Sapiens
YHGGWTTKM

SEQ ID NO: 103685 - protein, 9 aa, Homo Sapiens
TLENTNFKV

SEQ ID NO: 103686 - protein, 9 aa, Homo Sapiens
FCHRFSTQE

SEQ ID NO: 103687 - protein, 9 aa, Homo Sapiens
WRFALETRA

SEQ ID NO: 103688 - protein, 9 aa, Homo Sapiens
SLPSIVNDQ

SEQ ID NO: 103689 - protein, 9 aa, Homo Sapiens
KLQEWKKWQ

SEQ ID NO: 103690 - protein, 9 aa, Homo Sapiens
RFWRFALET

SEQ ID NO: 103691 - protein, 9 aa, Homo Sapiens
DQYGRKVLL

SEQ ID NO: 103692 - protein, 9 aa, Homo Sapiens
SVREGIMTY

SEQ ID NO: 103693 - protein, 9 aa, Homo Sapiens
VPRDQVAFL

SEQ ID NO: 103694 - protein, 9 aa, Homo Sapiens
PRKLTPAQL

SEQ ID NO: 103695 - protein, 9 aa, Homo Sapiens
GQGTPPLGP

SEQ ID NO: 103696 - protein, 9 aa, Homo Sapiens
ATAVTTVLT

SEQ ID NO: 103697 - protein, 9 aa, Homo Sapiens
GRNTFRHSV

SEQ ID NO: 103698 - protein, 9 aa, Homo Sapiens
KELGPVIRS

SEQ ID NO: 103699 - protein, 9 aa, Homo Sapiens
HLIIAQMAK

SEQ ID NO: 103700 - protein, 9 aa, Homo Sapiens
NDQYGRKVL

SEQ ID NO: 103701 - protein, 9 aa, Homo Sapiens
ALEWLRVTT

SEQ ID NO: 103702 - protein, 9 aa, Homo Sapiens
LESDYVSPN

SEQ ID NO: 103703 - protein, 9 aa, Homo Sapiens
EYLDGRNTF

SEQ ID NO: 103704 - protein, 9 aa, Homo Sapiens
FRDPCKAFV

SEQ ID NO: 103705 - protein, 9 aa, Homo Sapiens
KKKLQEWKK

SEQ ID NO: 103706 - protein, 9 aa, Homo Sapiens
MSSHSTALA

SEQ ID NO: 103707 - protein, 9 aa, Homo Sapiens
GVAAFCAFL

SEQ ID NO: 103708 - protein, 9 aa, Homo Sapiens
GDITSFPLL

SEQ ID NO: 103709 - protein, 9 aa, Homo Sapiens
SRPRKLTPA

SEQ ID NO: 103710 - protein, 9 aa, Homo Sapiens
TAVPGGVGP

SEQ ID NO: 103711 - protein, 9 aa, Homo Sapiens
DRNEVRAVG

SEQ ID NO: 103712 - protein, 9 aa, Homo Sapiens
PPLGPGVVR

SEQ ID NO: 103713 - protein, 9 aa, Homo Sapiens
SNHCLDKAT

SEQ ID NO: 103714 - protein, 9 aa, Homo Sapiens
PIQHTSHMD

SEQ ID NO: 103715 - protein, 9 aa, Homo Sapiens
QGTPPLGPG

SEQ ID NO: 103716 - protein, 9 aa, Homo Sapiens
VIQETFKNL

SEQ ID NO: 103717 - protein, 9 aa, Homo Sapiens
IEWPRKFPW

SEQ ID NO: 103718 - protein, 9 aa, Homo Sapiens
PNICQWIDL

SEQ ID NO: 103719 - protein, 9 aa, Homo Sapiens
RASFITAVP

SEQ ID NO: 103720 - protein, 9 aa, Homo Sapiens
YGVAAFCAF

SEQ ID NO: 103721 - protein, 9 aa, Homo Sapiens
TSSLCNVTS

SEQ ID NO: 103722 - protein, 9 aa, Homo Sapiens
VKELCHQWL

SEQ ID NO: 103723 - protein, 9 aa, Homo Sapiens
KLTPAQLQR

SEQ ID NO: 103724 - protein, 9 aa, Homo Sapiens
PHGRSNGAW

SEQ ID NO: 103725 - protein, 9 aa, Homo Sapiens
LLVYAPASS

SEQ ID NO: 103726 - protein, 9 aa, Homo Sapiens
QSIEWPRKF

SEQ ID NO: 103727 - protein, 9 aa, Homo Sapiens
EFLIPGRGD

SEQ ID NO: 103728 - protein, 9 aa, Homo Sapiens
KNLYRDVIQ

SEQ ID NO: 103729 - protein, 9 aa, Homo Sapiens
GAPGLPPAV

SEQ ID NO: 103730 - protein, 9 aa, Homo Sapiens
LGRQERKQI

SEQ ID NO: 103731 - protein, 9 aa, Homo Sapiens
RPPFGALSQ

SEQ ID NO: 103732 - protein, 9 aa, Homo Sapiens
GDGTWYRPR

SEQ ID NO: 103733 - protein, 9 aa, Homo Sapiens
VDSTISNGR

SEQ ID NO: 103734 - protein, 9 aa, Homo Sapiens
VERNASNMY

SEQ ID NO: 103735 - protein, 9 aa, Homo Sapiens
IGTVNQGVS

SEQ ID NO: 103736 - protein, 9 aa, Homo Sapiens
GSKNVDLLG

SEQ ID NO: 103737 - protein, 9 aa, Homo Sapiens
NTNFKVEFE

SEQ ID NO: 103738 - protein, 9 aa, Homo Sapiens
SIEWPRKFP

SEQ ID NO: 103739 - protein, 9 aa, Homo Sapiens
DGRNTFRHS

SEQ ID NO: 103740 - protein, 9 aa, Homo Sapiens
KCTALEWLR

SEQ ID NO: 103741 - protein, 9 aa, Homo Sapiens
KSHLIIAQM

SEQ ID NO: 103742 - protein, 9 aa, Homo Sapiens
KQMNDAYHG

SEQ ID NO: 103743 - protein, 9 aa, Homo Sapiens
ELQLKELGP

SEQ ID NO: 103744 - protein, 9 aa, Homo Sapiens
SLCNVTSNY

SEQ ID NO: 103745 - protein, 9 aa, Homo Sapiens
CNVTSNYDF

SEQ ID NO: 103746 - protein, 9 aa, Homo Sapiens
WPRKFPWEF

SEQ ID NO: 103747 - protein, 9 aa, Homo Sapiens
IIAQMAKNP

SEQ ID NO: 103748 - protein, 9 aa, Homo Sapiens
HITDIHEAS

SEQ ID NO: 103749 - protein, 9 aa, Homo Sapiens
DVIQETFKN

SEQ ID NO: 103750 - protein, 9 aa, Homo Sapiens
NDAYHGGWT

SEQ ID NO: 103751 - protein, 9 aa, Homo Sapiens
KSVERNASN

SEQ ID NO: 103752 - protein, 9 aa, Homo Sapiens
RFSTQEKTP

SEQ ID NO: 103753 - protein, 9 aa, Homo Sapiens
DGTWYRPRP

SEQ ID NO: 103754 - protein, 9 aa, Homo Sapiens
LQHVNSNHC

SEQ ID NO: 103755 - protein, 9 aa, Homo Sapiens
MRKLRDHSV

SEQ ID NO: 103756 - protein, 9 aa, Homo Sapiens
SRLLTTNSD

SEQ ID NO: 103757 - protein, 9 aa, Homo Sapiens
PRGQGTPPL

SEQ ID NO: 103758 - protein, 9 aa, Homo Sapiens
TPAQLQRMR

SEQ ID NO: 103759 - protein, 9 aa, Homo Sapiens
LGPGVVRAG

SEQ ID NO: 103760 - protein, 9 aa, Homo Sapiens
SNGRSTPAM

SEQ ID NO: 103761 - protein, 9 aa, Homo Sapiens
GDCPCQQIW

SEQ ID NO: 103762 - protein, 9 aa, Homo Sapiens
SKNVDLLGR

SEQ ID NO: 103763 - protein, 9 aa, Homo Sapiens
PSSYISRLL

SEQ ID NO: 103764 - protein, 9 aa, Homo Sapiens
AVPGGVGPM

SEQ ID NO: 103765 - protein, 9 aa, Homo Sapiens
EGMSLGSPH

SEQ ID NO: 103766 - protein, 9 aa, Homo Sapiens
IRFWRFALE

SEQ ID NO: 103767 - protein, 9 aa, Homo Sapiens
AQGDRNEVR

SEQ ID NO: 103768 - protein, 9 aa, Homo Sapiens
WPFQRSLCL

SEQ ID NO: 103769 - protein, 9 aa, Homo Sapiens
QYGRKVLLY

SEQ ID NO: 103770 - protein, 9 aa, Homo Sapiens
PHGDCPCQQ

SEQ ID NO: 103771 - protein, 9 aa, Homo Sapiens
PDDFTASVR

SEQ ID NO: 103772 - protein, 9 aa, Homo Sapiens
RNTGEMSSH

SEQ ID NO: 103773 - protein, 9 aa, Homo Sapiens
MKCTALEWL

SEQ ID NO: 103774 - protein, 9 aa, Homo Sapiens
IGQMHPLHG

SEQ ID NO: 103775 - protein, 9 aa, Homo Sapiens
FTASVREGI

SEQ ID NO: 103776 - protein, 9 aa, Homo Sapiens
TPPLGPGVV

SEQ ID NO: 103777 - protein, 9 aa, Homo Sapiens
YVSPNICQW

SEQ ID NO: 103778 - protein, 9 aa, Homo Sapiens
TVLTNASGL

SEQ ID NO: 103779 - protein, 9 aa, Homo Sapiens
RNEVRAVGQ

SEQ ID NO: 103780 - protein, 9 aa, Homo Sapiens
LENGEFLIP

SEQ ID NO: 103781 - protein, 9 aa, Homo Sapiens
KERASFITA

SEQ ID NO: 103782 - protein, 9 aa, Homo Sapiens
QMNDAYHGG

SEQ ID NO: 103783 - protein, 9 aa, Homo Sapiens
GSTPSFCHR

SEQ ID NO: 103784 - protein, 9 aa, Homo Sapiens
LRDHSVRTP

SEQ ID NO: 103785 - protein, 9 aa, Homo Sapiens
LKLLDEDKI

SEQ ID NO: 103786 - protein, 9 aa, Homo Sapiens
LKELGPVIR

SEQ ID NO: 103787 - protein, 9 aa, Homo Sapiens
SIVNDQYGR

SEQ ID NO: 103788 - protein, 9 aa, Homo Sapiens
VREGIMTYA

SEQ ID NO: 103789 - protein, 9 aa, Homo Sapiens
LVYAPASSV

SEQ ID NO: 103790 - protein, 9 aa, Homo Sapiens
DHSVRTPSN

SEQ ID NO: 103791 - protein, 9 aa, Homo Sapiens
PFGALSQPG

SEQ ID NO: 103792 - protein, 9 aa, Homo Sapiens
LPSIVNDQY

SEQ ID NO: 103793 - protein, 9 aa, Homo Sapiens
GEFLIPGRG

SEQ ID NO: 103794 - protein, 9 aa, Homo Sapiens
PRDQVAFLT

SEQ ID NO: 103795 - protein, 9 aa, Homo Sapiens
LRQFHRPPF

SEQ ID NO: 103796 - protein, 9 aa, Homo Sapiens
EMSSHSTAL

SEQ ID NO: 103797 - protein, 9 aa, Homo Sapiens
KAPRVRPSN

SEQ ID NO: 103798 - protein, 9 aa, Homo Sapiens
SLGSPHGSQ

SEQ ID NO: 103799 - protein, 9 aa, Homo Sapiens
QHVNSNHCL

SEQ ID NO: 103800 - protein, 9 aa, Homo Sapiens
HYNDVHEYL

SEQ ID NO: 103801 - protein, 9 aa, Homo Sapiens
DRSGQIAMT

SEQ ID NO: 103802 - protein, 9 aa, Homo Sapiens
VPGPDGNNG

SEQ ID NO: 103803 - protein, 9 aa, Homo Sapiens
LEYLPTVEA

SEQ ID NO: 103804 - protein, 9 aa, Homo Sapiens
GSLKLEYLP

SEQ ID NO: 103805 - protein, 9 aa, Homo Sapiens
TEEERQALE

SEQ ID NO: 103806 - protein, 9 aa, Homo Sapiens
YLPTVEAPG

SEQ ID NO: 103807 - protein, 9 aa, Homo Sapiens
WPSCVQPLL

SEQ ID NO: 103808 - protein, 9 aa, Homo Sapiens
ANKYDRSGQ

SEQ ID NO: 103809 - protein, 9 aa, Homo Sapiens
NKIHNGQHG

SEQ ID NO: 103810 - protein, 9 aa, Homo Sapiens
RGVPGPDGN

SEQ ID NO: 103811 - protein, 9 aa, Homo Sapiens
DQYCHFNLG

SEQ ID NO: 103812 - protein, 9 aa, Homo Sapiens
DMTVHFMST

SEQ ID NO: 103813 - protein, 9 aa, Homo Sapiens
NESPHYNDV

SEQ ID NO: 103814 - protein, 9 aa, Homo Sapiens
LPPPWPSCV

SEQ ID NO: 103815 - protein, 9 aa, Homo Sapiens
VSLSLAQLL

SEQ ID NO: 103816 - protein, 9 aa, Homo Sapiens
CERFCELLE

SEQ ID NO: 103817 - protein, 9 aa, Homo Sapiens
DRQAVRSHW

SEQ ID NO: 103818 - protein, 9 aa, Homo Sapiens
VKTEEERQA

SEQ ID NO: 103819 - protein, 9 aa, Homo Sapiens
VSEMEPNDT

SEQ ID NO: 103820 - protein, 9 aa, Homo Sapiens
DTFSNNNSR

SEQ ID NO: 103821 - protein, 9 aa, Homo Sapiens
RIVGEASRL

SEQ ID NO: 103822 - protein, 9 aa, Homo Sapiens
LATIFRKEG

SEQ ID NO: 103823 - protein, 9 aa, Homo Sapiens
YDSAWPHEK

SEQ ID NO: 103824 - protein, 9 aa, Homo Sapiens
RKSPLLGTF

SEQ ID NO: 103825 - protein, 9 aa, Homo Sapiens
AQLLATIFR

SEQ ID NO: 103826 - protein, 9 aa, Homo Sapiens
DIFERIVGE

SEQ ID NO: 103827 - protein, 9 aa, Homo Sapiens
LADSLHMCF

SEQ ID NO: 103828 - protein, 9 aa, Homo Sapiens
ITNENPWGP

SEQ ID NO: 103829 - protein, 9 aa, Homo Sapiens
VPSEVNGQI

SEQ ID NO: 103830 - protein, 9 aa, Homo Sapiens
EPNDTFSNN

SEQ ID NO: 103831 - protein, 9 aa, Homo Sapiens
DSLHMCFLA

SEQ ID NO: 103832 - protein, 9 aa, Homo Sapiens
LKEELSEVQ

SEQ ID NO: 103833 - protein, 9 aa, Homo Sapiens
RLLPPPWPS

SEQ ID NO: 103834 - protein, 9 aa, Homo Sapiens
NFGSVARMC

SEQ ID NO: 103835 - protein, 9 aa, Homo Sapiens
LSLAQLLAT

SEQ ID NO: 103836 - protein, 9 aa, Homo Sapiens
SLHMCFLAP

SEQ ID NO: 103837 - protein, 9 aa, Homo Sapiens
MLGDRQAVR

SEQ ID NO: 103838 - protein, 9 aa, Homo Sapiens
EELSEVQTK

SEQ ID NO: 103839 - protein, 9 aa, Homo Sapiens
KLSKTKKRK

SEQ ID NO: 103840 - protein, 9 aa, Homo Sapiens
IYRANKYDR

SEQ ID NO: 103841 - protein, 9 aa, Homo Sapiens
KQLPGSWKF

SEQ ID NO: 103842 - protein, 9 aa, Homo Sapiens
LVPSEVNGQ

SEQ ID NO: 103843 - protein, 9 aa, Homo Sapiens
EKQLPGSWK

SEQ ID NO: 103844 - protein, 9 aa, Homo Sapiens
ILYKPNTAM

SEQ ID NO: 103845 - protein, 9 aa, Homo Sapiens
MTVHFMSTL

SEQ ID NO: 103846 - protein, 9 aa, Homo Sapiens
AAVDNPILY

SEQ ID NO: 103847 - protein, 9 aa, Homo Sapiens
KRPLVPSEV

SEQ ID NO: 103848 - protein, 9 aa, Homo Sapiens
NNFGSVARM

SEQ ID NO: 103849 - protein, 9 aa, Homo Sapiens
GVDQYCHFN

SEQ ID NO: 103850 - protein, 9 aa, Homo Sapiens
KLEYLPTVE

SEQ ID NO: 103851 - protein, 9 aa, Homo Sapiens
WVAGVDQYC

SEQ ID NO: 103852 - protein, 9 aa, Homo Sapiens
GESLEVANS

SEQ ID NO: 103853 - protein, 9 aa, Homo Sapiens
VVKTEEERQ

SEQ ID NO: 103854 - protein, 9 aa, Homo Sapiens
WRKSPLLGT

SEQ ID NO: 103855 - protein, 9 aa, Homo Sapiens
AKHPNSFIC

SEQ ID NO: 103856 - protein, 9 aa, Homo Sapiens
LEGNPIVLA

SEQ ID NO: 103857 - protein, 9 aa, Homo Sapiens
KSLGLGPGE

SEQ ID NO: 103858 - protein, 9 aa, Homo Sapiens
GLCTLAAQA

SEQ ID NO: 103859 - protein, 9 aa, Homo Sapiens
LLPPPWPSC

SEQ ID NO: 103860 - protein, 9 aa, Homo Sapiens
NEDMTVHFM

SEQ ID NO: 103861 - protein, 9 aa, Homo Sapiens
ARLLPPPWP

SEQ ID NO: 103862 - protein, 9 aa, Homo Sapiens
HNGQHGGIY

SEQ ID NO: 103863 - protein, 9 aa, Homo Sapiens
LLATIFRKE

SEQ ID NO: 103864 - protein, 9 aa, Homo Sapiens
AGARGVPGP

SEQ ID NO: 103865 - protein, 9 aa, Homo Sapiens
VLIGFKEDI

SEQ ID NO: 103866 - protein, 9 aa, Homo Sapiens
KIHNGQHGG

SEQ ID NO: 103867 - protein, 9 aa, Homo Sapiens
IVRHNKIHN

SEQ ID NO: 103868 - protein, 9 aa, Homo Sapiens
LHMCFLAPK

SEQ ID NO: 103869 - protein, 9 aa, Homo Sapiens
KTKKRKSLG

SEQ ID NO: 103870 - protein, 9 aa, Homo Sapiens
SLAQLLATI

SEQ ID NO: 103871 - protein, 9 aa, Homo Sapiens
TVVKTEEER

SEQ ID NO: 103872 - protein, 9 aa, Homo Sapiens
GTFCGDKLP

SEQ ID NO: 103873 - protein, 9 aa, Homo Sapiens
QTKYQHLKA

SEQ ID NO: 103874 - protein, 9 aa, Homo Sapiens
WTVVKTEEE

SEQ ID NO: 103875 - protein, 9 aa, Homo Sapiens
KKRKSLGLG

SEQ ID NO: 103876 - protein, 9 aa, Homo Sapiens
YRANKYDRS

SEQ ID NO: 103877 - protein, 9 aa, Homo Sapiens
LKLEYLPTV

SEQ ID NO: 103878 - protein, 9 aa, Homo Sapiens
DNPILYKPN

SEQ ID NO: 103879 - protein, 9 aa, Homo Sapiens
MEPNDTFSN

SEQ ID NO: 103880 - protein, 9 aa, Homo Sapiens
PPWPSCVQP

SEQ ID NO: 103881 - protein, 9 aa, Homo Sapiens
MCFLAPKIE

SEQ ID NO: 103882 - protein, 9 aa, Homo Sapiens
KEELSEVQT

SEQ ID NO: 103883 - protein, 9 aa, Homo Sapiens
ESPHYNDVH

SEQ ID NO: 103884 - protein, 9 aa, Homo Sapiens
RSGQIAMTT

SEQ ID NO: 103885 - protein, 9 aa, Homo Sapiens
EEGSLKLEY

SEQ ID NO: 103886 - protein, 9 aa, Homo Sapiens
ENESPHYND

SEQ ID NO: 103887 - protein, 9 aa, Homo Sapiens
QTITNENPW

SEQ ID NO: 103888 - protein, 9 aa, Homo Sapiens
YDIVLVQGE

SEQ ID NO: 103889 - protein, 9 aa, Homo Sapiens
VGEASRLAH

SEQ ID NO: 103890 - protein, 9 aa, Homo Sapiens
YCHFNLGQP

SEQ ID NO: 103891 - protein, 9 aa, Homo Sapiens
LSSKRPLVP

SEQ ID NO: 103892 - protein, 9 aa, Homo Sapiens
NPILYKPNT

SEQ ID NO: 103893 - protein, 9 aa, Homo Sapiens
ARGVPGPDG

SEQ ID NO: 103894 - protein, 9 aa, Homo Sapiens
VNDIFERIV

SEQ ID NO: 103895 - protein, 9 aa, Homo Sapiens
PSEVNGQII

SEQ ID NO: 103896 - protein, 9 aa, Homo Sapiens
EEERQALEP

SEQ ID NO: 103897 - protein, 9 aa, Homo Sapiens
PVDECERFC

SEQ ID NO: 103898 - protein, 9 aa, Homo Sapiens
ERQALEPLP

SEQ ID NO: 103899 - protein, 9 aa, Homo Sapiens
IVGEASRLA

SEQ ID NO: 103900 - protein, 9 aa, Homo Sapiens
GVMLGDRQA

SEQ ID NO: 103901 - protein, 9 aa, Homo Sapiens
SSKRPLVPS

SEQ ID NO: 103902 - protein, 9 aa, Homo Sapiens
WRGLCTLAA

SEQ ID NO: 103903 - protein, 9 aa, Homo Sapiens
GARGVPGPD

SEQ ID NO: 103904 - protein, 9 aa, Homo Sapiens
GLAGARGVP

SEQ ID NO: 103905 - protein, 9 aa, Homo Sapiens
KRKSLGLGP

SEQ ID NO: 103906 - protein, 9 aa, Homo Sapiens
SYDIVLVQG

SEQ ID NO: 103907 - protein, 9 aa, Homo Sapiens
RPLVPSEVN

SEQ ID NO: 103908 - protein, 9 aa, Homo Sapiens
EGNPIVLAK

SEQ ID NO: 103909 - protein, 9 aa, Homo Sapiens
VHFMSTLMA

SEQ ID NO: 103910 - protein, 9 aa, Homo Sapiens
ADSLHMCFL

SEQ ID NO: 103911 - protein, 9 aa, Homo Sapiens
SLSLAQLLA

SEQ ID NO: 103912 - protein, 9 aa, Homo Sapiens
GDRQAVRSH

SEQ ID NO: 103913 - protein, 9 aa, Homo Sapiens
FMSTLMALI

SEQ ID NO: 103914 - protein, 9 aa, Homo Sapiens
LCTLAAQAA

SEQ ID NO: 103915 - protein, 9 aa, Homo Sapiens
FCELLELKC

SEQ ID NO: 103916 - protein, 9 aa, Homo Sapiens
HEKQLPGSW

SEQ ID NO: 103917 - protein, 9 aa, Homo Sapiens
PNDTFSNNN

SEQ ID NO: 103918 - protein, 9 aa, Homo Sapiens
CFLAPKIEN

SEQ ID NO: 103919 - protein, 9 aa, Homo Sapiens
ENPWGPSLG

SEQ ID NO: 103920 - protein, 9 aa, Homo Sapiens
RVLIGFKED

SEQ ID NO: 103921 - protein, 9 aa, Homo Sapiens
MWRGLCTLA

SEQ ID NO: 103922 - protein, 9 aa, Homo Sapiens
EGSLKLEYL

SEQ ID NO: 103923 - protein, 9 aa, Homo Sapiens
NPWGPSLGT

SEQ ID NO: 103924 - protein, 9 aa, Homo Sapiens
AVDNPILYK

SEQ ID NO: 103925 - protein, 9 aa, Homo Sapiens
IHNGQHGGI

SEQ ID NO: 103926 - protein, 9 aa, Homo Sapiens
EVQTKYQHL

SEQ ID NO: 103927 - protein, 9 aa, Homo Sapiens
AGLAGARGV

SEQ ID NO: 103928 - protein, 9 aa, Homo Sapiens
HFMSTLMAL

SEQ ID NO: 103929 - protein, 9 aa, Homo Sapiens
QLLATIFRK

SEQ ID NO: 103930 - protein, 9 aa, Homo Sapiens
LYKPNTAML

SEQ ID NO: 103931 - protein, 9 aa, Homo Sapiens
QWVAGVDQY

SEQ ID NO: 103932 - protein, 9 aa, Homo Sapiens
WPHEKQLPG

SEQ ID NO: 103933 - protein, 9 aa, Homo Sapiens
SLKLEYLPT

SEQ ID NO: 103934 - protein, 9 aa, Homo Sapiens
TKKRKSLGL

SEQ ID NO: 103935 - protein, 9 aa, Homo Sapiens
VAGVDQYCH

SEQ ID NO: 103936 - protein, 9 aa, Homo Sapiens
TLVTITNNF

SEQ ID NO: 103937 - protein, 9 aa, Homo Sapiens
SKRPLVPSE

SEQ ID NO: 103938 - protein, 9 aa, Homo Sapiens
WGPSLGTIP

SEQ ID NO: 103939 - protein, 9 aa, Homo Sapiens
SKTKKRKSL

SEQ ID NO: 103940 - protein, 9 aa, Homo Sapiens
LSKTKKRKS

SEQ ID NO: 103941 - protein, 9 aa, Homo Sapiens
HNKIHNGQH

SEQ ID NO: 103942 - protein, 9 aa, Homo Sapiens
KYDRSGQIA

SEQ ID NO: 103943 - protein, 9 aa, Homo Sapiens
TVHFMSTLM

SEQ ID NO: 103944 - protein, 9 aa, Homo Sapiens
KTEEERQAL

SEQ ID NO: 103945 - protein, 9 aa, Homo Sapiens
KEDILIVSE

SEQ ID NO: 103946 - protein, 9 aa, Homo Sapiens
LIGFKEDIL

SEQ ID NO: 103947 - protein, 9 aa, Homo Sapiens
ERIVGEASR

SEQ ID NO: 103948 - protein, 9 aa, Homo Sapiens
VDECERFCE

SEQ ID NO: 103949 - protein, 9 aa, Homo Sapiens
NDVHEYLRP

SEQ ID NO: 103950 - protein, 9 aa, Homo Sapiens
FKEDILIVS

SEQ ID NO: 103951 - protein, 9 aa, Homo Sapiens
SPHYNDVHE

SEQ ID NO: 103952 - protein, 9 aa, Homo Sapiens
SAWPHEKQL

SEQ ID NO: 103953 - protein, 9 aa, Homo Sapiens
CELLELKCQ

SEQ ID NO: 103954 - protein, 9 aa, Homo Sapiens
LARLLPPPW

SEQ ID NO: 103955 - protein, 9 aa, Homo Sapiens
SGVMLGDRQ

SEQ ID NO: 103956 - protein, 9 aa, Homo Sapiens
EMEPNDTFS

SEQ ID NO: 103957 - protein, 9 aa, Homo Sapiens
EENESPHYN

SEQ ID NO: 103958 - protein, 9 aa, Homo Sapiens
QARVLIGFK

SEQ ID NO: 103959 - protein, 9 aa, Homo Sapiens
QGESLEVAN

SEQ ID NO: 103960 - protein, 9 aa, Homo Sapiens
GVPGPDGNN

SEQ ID NO: 103961 - protein, 9 aa, Homo Sapiens
ITNNFGSVA

SEQ ID NO: 103962 - protein, 9 aa, Homo Sapiens
VQGESLEVA

SEQ ID NO: 103963 - protein, 9 aa, Homo Sapiens
RKSLGLGPG

SEQ ID NO: 103964 - protein, 9 aa, Homo Sapiens
CTLAAQAAR

SEQ ID NO: 103965 - protein, 9 aa, Homo Sapiens
TFCGDKLPE

SEQ ID NO: 103966 - protein, 9 aa, Homo Sapiens
NPIVLAKHP

SEQ ID NO: 103967 - protein, 9 aa, Homo Sapiens
LGDRQAVRS

SEQ ID NO: 103968 - protein, 9 aa, Homo Sapiens
LAGARGVPG

SEQ ID NO: 103969 - protein, 9 aa, Homo Sapiens
TNENPWGPS

SEQ ID NO: 103970 - protein, 9 aa, Homo Sapiens
PWGPSLGTI

SEQ ID NO: 103971 - protein, 9 aa, Homo Sapiens
NKYDRSGQI

SEQ ID NO: 103972 - protein, 9 aa, Homo Sapiens
LVQGESLEV

SEQ ID NO: 103973 - protein, 9 aa, Homo Sapiens
EDMTVHFMS

SEQ ID NO: 103974 - protein, 9 aa, Homo Sapiens
EYLPTVEAP

SEQ ID NO: 103975 - protein, 9 aa, Homo Sapiens
LAQLLATIF

SEQ ID NO: 103976 - protein, 9 aa, Homo Sapiens
VLADSLHMC

SEQ ID NO: 103977 - protein, 9 aa, Homo Sapiens
RGLCTLAAQ

SEQ ID NO: 103978 - protein, 9 aa, Homo Sapiens
PLVPSEVNG

SEQ ID NO: 103979 - protein, 9 aa, Homo Sapiens
IGFKEDILI

SEQ ID NO: 103980 - protein, 9 aa, Homo Sapiens
PIVLAKHPN

SEQ ID NO: 103981 - protein, 9 aa, Homo Sapiens
TITNNFGSV

SEQ ID NO: 103982 - protein, 9 aa, Homo Sapiens
SPLLGTFCG

SEQ ID NO: 103983 - protein, 9 aa, Homo Sapiens
GFKEDILIV

SEQ ID NO: 103984 - protein, 9 aa, Homo Sapiens
PPPWPSCVQ

SEQ ID NO: 103985 - protein, 9 aa, Homo Sapiens
SVSEMEPND

SEQ ID NO: 103986 - protein, 9 aa, Homo Sapiens
VTITNNFGS

SEQ ID NO: 103987 - protein, 9 aa, Homo Sapiens
RFCELLELK

SEQ ID NO: 103988 - protein, 9 aa, Homo Sapiens
YNDVHEYLR

SEQ ID NO: 103989 - protein, 9 aa, Homo Sapiens
NDTFSNNNS

SEQ ID NO: 103990 - protein, 9 aa, Homo Sapiens
ERFCELLEL

SEQ ID NO: 103991 - protein, 9 aa, Homo Sapiens
VLVQGESLE

SEQ ID NO: 103992 - protein, 9 aa, Homo Sapiens
PHEKQLPGS

SEQ ID NO: 103993 - protein, 9 aa, Homo Sapiens
FERIVGEAS

SEQ ID NO: 103994 - protein, 9 aa, Homo Sapiens
PILYKPNTA

SEQ ID NO: 103995 - protein, 9 aa, Homo Sapiens
AWPHEKQLP

SEQ ID NO: 103996 - protein, 9 aa, Homo Sapiens
NENPWGPSL

SEQ ID NO: 103997 - protein, 9 aa, Homo Sapiens
GNPIVLAKH

SEQ ID NO: 103998 - protein, 9 aa, Homo Sapiens
VRHNKIHNG

SEQ ID NO: 103999 - protein, 9 aa, Homo Sapiens
IFERIVGEA

SEQ ID NO: 104000 - protein, 9 aa, Homo Sapiens
YDRSGQIAM

SEQ ID NO: 104001 - protein, 9 aa, Homo Sapiens
NGQHGGIYV

SEQ ID NO: 104002 - protein, 9 aa, Homo Sapiens
SEMEPNDTF

SEQ ID NO: 104003 - protein, 9 aa, Homo Sapiens
EERQALEPL

SEQ ID NO: 104004 - protein, 9 aa, Homo Sapiens
PLLGTFCGD

SEQ ID NO: 104005 - protein, 9 aa, Homo Sapiens
QAVRSHWGT

SEQ ID NO: 104006 - protein, 9 aa, Homo Sapiens
PHYNDVHEY

SEQ ID NO: 104007 - protein, 9 aa, Homo Sapiens
KSPLLGTFC

SEQ ID NO: 104008 - protein, 9 aa, Homo Sapiens
IVLVQGESL

SEQ ID NO: 104009 - protein, 9 aa, Homo Sapiens
DECERFCEL

SEQ ID NO: 104010 - protein, 9 aa, Homo Sapiens
RHNKIHNGQ

SEQ ID NO: 104011 - protein, 9 aa, Homo Sapiens
DSAWPHEKQ

SEQ ID NO: 104012 - protein, 9 aa, Homo Sapiens
NDIFERIVG

SEQ ID NO: 104013 - protein, 9 aa, Homo Sapiens
ECERFCELL

SEQ ID NO: 104014 - protein, 9 aa, Homo Sapiens
QYCHFNLGQ

SEQ ID NO: 104015 - protein, 9 aa, Homo Sapiens
LSEVQTKYQ

SEQ ID NO: 104016 - protein, 9 aa, Homo Sapiens
PWPSCVQPL

SEQ ID NO: 104017 - protein, 9 aa, Homo Sapiens
RANKYDRSG

SEQ ID NO: 104018 - protein, 9 aa, Homo Sapiens
LVTITNNFG

SEQ ID NO: 104019 - protein, 9 aa, Homo Sapiens
DIVLVQGES

SEQ ID NO: 104020 - protein, 9 aa, Homo Sapiens
VMLGDRQAV

SEQ ID NO: 104021 - protein, 9 aa, Homo Sapiens
VQTKYQHLK

SEQ ID NO: 104022 - protein, 9 aa, Homo Sapiens
TNNFGSVAR

SEQ ID NO: 104023 - protein, 9 aa, Homo Sapiens
ELSEVQTKY

SEQ ID NO: 104024 - protein, 9 aa, Homo Sapiens
SEVQTKYQH

SEQ ID NO: 104025 - protein, 9 aa, Homo Sapiens
VLAKHPNSF

SEQ ID NO: 104026 - protein, 9 aa, Homo Sapiens
TITNENPWG

SEQ ID NO: 104027 - protein, 9 aa, Homo Sapiens
MSTLMALIR

SEQ ID NO: 104028 - protein, 9 aa, Homo Sapiens
LGTFCGDKL

SEQ ID NO: 104029 - protein, 9 aa, Homo Sapiens
AGVDQYCHF

SEQ ID NO: 104030 - protein, 9 aa, Homo Sapiens
VDNPILYKP

SEQ ID NO: 104031 - protein, 9 aa, Homo Sapiens
LAKHPNSFI

SEQ ID NO: 104032 - protein, 9 aa, Homo Sapiens
HMCFLAPKI

SEQ ID NO: 104033 - protein, 9 aa, Homo Sapiens
YAAVDNPIL

SEQ ID NO: 104034 - protein, 9 aa, Homo Sapiens
VDQYCHFNL

SEQ ID NO: 104035 - protein, 9 aa, Homo Sapiens
IVLAKHPNS

SEQ ID NO: 104036 - protein, 9 aa, Homo Sapiens
FGSVARMCA

SEQ ID NO: 104037 - protein, 9 aa, Homo Sapiens
ARVLIGFKE

SEQ ID NO: 104038 - protein, 9 aa, Homo Sapiens
LLGTFCGDK

SEQ ID NO: 104039 - protein, 9 aa, Homo Sapiens
RQAVRSHWG

SEQ ID NO: 104040 - protein, 9 aa, Homo Sapiens
EEWKENSLL

SEQ ID NO: 104041 - protein, 9 aa, Homo Sapiens
DELALLQVT

SEQ ID NO: 104042 - protein, 9 aa, Homo Sapiens
FHLALPESN

SEQ ID NO: 104043 - protein, 9 aa, Homo Sapiens
PFPELRYRS

SEQ ID NO: 104044 - protein, 9 aa, Homo Sapiens
YPCSGAGRD

SEQ ID NO: 104045 - protein, 9 aa, Homo Sapiens
KQMNDARHG

SEQ ID NO: 104046 - protein, 9 aa, Homo Sapiens
NMYKHWIMQ

SEQ ID NO: 104047 - protein, 9 aa, Homo Sapiens
RTRLQGQRH

SEQ ID NO: 104048 - protein, 9 aa, Homo Sapiens
AKLKDFYQF

SEQ ID NO: 104049 - protein, 9 aa, Homo Sapiens
PAGDIVSQN

SEQ ID NO: 104050 - protein, 9 aa, Homo Sapiens
PELRYRSLA

SEQ ID NO: 104051 - protein, 9 aa, Homo Sapiens
CTIHIFAQQ

SEQ ID NO: 104052 - protein, 9 aa, Homo Sapiens
SASKTRLCW

SEQ ID NO: 104053 - protein, 9 aa, Homo Sapiens
TPSRGGQSG

SEQ ID NO: 104054 - protein, 9 aa, Homo Sapiens
KENSLLANV

SEQ ID NO: 104055 - protein, 9 aa, Homo Sapiens
FMKQMNDAR

SEQ ID NO: 104056 - protein, 9 aa, Homo Sapiens
IMPCILEAH

SEQ ID NO: 104057 - protein, 9 aa, Homo Sapiens
SSPPMVRST

SEQ ID NO: 104058 - protein, 9 aa, Homo Sapiens
PQSTHTHLD

SEQ ID NO: 104059 - protein, 9 aa, Homo Sapiens
YAPNMYKHW

SEQ ID NO: 104060 - protein, 9 aa, Homo Sapiens
LALLQVTMQ

SEQ ID NO: 104061 - protein, 9 aa, Homo Sapiens
LKDTAKLKD

SEQ ID NO: 104062 - protein, 9 aa, Homo Sapiens
QMNDARHGG

SEQ ID NO: 104063 - protein, 9 aa, Homo Sapiens
YLIMPCILE

SEQ ID NO: 104064 - protein, 9 aa, Homo Sapiens
WSPGEVLAL

SEQ ID NO: 104065 - protein, 9 aa, Homo Sapiens
IEALDELAL

SEQ ID NO: 104066 - protein, 9 aa, Homo Sapiens
KLKDFYQFT

SEQ ID NO: 104067 - protein, 9 aa, Homo Sapiens
LQRKRAQRG

SEQ ID NO: 104068 - protein, 9 aa, Homo Sapiens
FIHGERLRD

SEQ ID NO: 104069 - protein, 9 aa, Homo Sapiens
QLLPTPSDH

SEQ ID NO: 104070 - protein, 9 aa, Homo Sapiens
GAGRDGPLR

SEQ ID NO: 104071 - protein, 9 aa, Homo Sapiens
IPKAQIPQS

SEQ ID NO: 104072 - protein, 9 aa, Homo Sapiens
KAQIPQSTH

SEQ ID NO: 104073 - protein, 9 aa, Homo Sapiens
TRLCWSPGE

SEQ ID NO: 104074 - protein, 9 aa, Homo Sapiens
ARHGGWTTK

SEQ ID NO: 104075 - protein, 9 aa, Homo Sapiens
PPFPELRYR

SEQ ID NO: 104076 - protein, 9 aa, Homo Sapiens
HFLPAGDIV

SEQ ID NO: 104077 - protein, 9 aa, Homo Sapiens
TYLIMPCIL

SEQ ID NO: 104078 - protein, 9 aa, Homo Sapiens
EGLQRKRAQ

SEQ ID NO: 104079 - protein, 9 aa, Homo Sapiens
ARKSPPATG

SEQ ID NO: 104080 - protein, 9 aa, Homo Sapiens
SLSLNRFHL

SEQ ID NO: 104081 - protein, 9 aa, Homo Sapiens
GDIVSQNDF

SEQ ID NO: 104082 - protein, 9 aa, Homo Sapiens
DFFIHGERL

SEQ ID NO: 104083 - protein, 9 aa, Homo Sapiens
ARTRLQGQR

SEQ ID NO: 104084 - protein, 9 aa, Homo Sapiens
EGESSPPMV

SEQ ID NO: 104085 - protein, 9 aa, Homo Sapiens
LLQVTMQQA

SEQ ID NO: 104086 - protein, 9 aa, Homo Sapiens
SRQEARTRL

SEQ ID NO: 104087 - protein, 9 aa, Homo Sapiens
PTPSDHSRY

SEQ ID NO: 104088 - protein, 9 aa, Homo Sapiens
HGERLRDKM

SEQ ID NO: 104089 - protein, 9 aa, Homo Sapiens
LSEFVEGLQ

SEQ ID NO: 104090 - protein, 9 aa, Homo Sapiens
QHFLPAGDI

SEQ ID NO: 104091 - protein, 9 aa, Homo Sapiens
SLLANVLEP

SEQ ID NO: 104092 - protein, 9 aa, Homo Sapiens
AMGFSTTVK

SEQ ID NO: 104093 - protein, 9 aa, Homo Sapiens
GTYLIMPCI

SEQ ID NO: 104094 - protein, 9 aa, Homo Sapiens
LDELALLQV

SEQ ID NO: 104095 - protein, 9 aa, Homo Sapiens
AQIPQSTHT

SEQ ID NO: 104096 - protein, 9 aa, Homo Sapiens
VRSTPSQEL

SEQ ID NO: 104097 - protein, 9 aa, Homo Sapiens
PVSRQEART

SEQ ID NO: 104098 - protein, 9 aa, Homo Sapiens
ELALLQVTM

SEQ ID NO: 104099 - protein, 9 aa, Homo Sapiens
PGTYLIMPC

SEQ ID NO: 104100 - protein, 9 aa, Homo Sapiens
EWKENSLLA

SEQ ID NO: 104101 - protein, 9 aa, Homo Sapiens
QPAPWVRPP

SEQ ID NO: 104102 - protein, 9 aa, Homo Sapiens
LRYRSLAYN

SEQ ID NO: 104103 - protein, 9 aa, Homo Sapiens
VSYPCSGAG

SEQ ID NO: 104104 - protein, 9 aa, Homo Sapiens
SPPATGGVK

SEQ ID NO: 104105 - protein, 9 aa, Homo Sapiens
YRSLAYNKI

SEQ ID NO: 104106 - protein, 9 aa, Homo Sapiens
GCADFFIHG

SEQ ID NO: 104107 - protein, 9 aa, Homo Sapiens
QELKDTAKL

SEQ ID NO: 104108 - protein, 9 aa, Homo Sapiens
FLPAGDIVS

SEQ ID NO: 104109 - protein, 9 aa, Homo Sapiens
AARKSPPAT

SEQ ID NO: 104110 - protein, 9 aa, Homo Sapiens
FAPLTSQGS

SEQ ID NO: 104111 - protein, 9 aa, Homo Sapiens
DDCTIHIFA

SEQ ID NO: 104112 - protein, 9 aa, Homo Sapiens
LIMPCILEA

SEQ ID NO: 104113 - protein, 9 aa, Homo Sapiens
APWVRPPSP

SEQ ID NO: 104114 - protein, 9 aa, Homo Sapiens
QEARTRLQG

SEQ ID NO: 104115 - protein, 9 aa, Homo Sapiens
LACGNDDCT

SEQ ID NO: 104116 - protein, 9 aa, Homo Sapiens
WVRPPSPDG

SEQ ID NO: 104117 - protein, 9 aa, Homo Sapiens
APLTSQGSQ

SEQ ID NO: 104118 - protein, 9 aa, Homo Sapiens
SLNRFHLAL

SEQ ID NO: 104119 - protein, 9 aa, Homo Sapiens
GPVSRQEAR

SEQ ID NO: 104120 - protein, 9 aa, Homo Sapiens
HTQAMYQMM

SEQ ID NO: 104121 - protein, 9 aa, Homo Sapiens
SIVNQVYGY

SEQ ID NO: 104122 - protein, 9 aa, Homo Sapiens
ISIVNQVYG

SEQ ID NO: 104123 - protein, 9 aa, Homo Sapiens
KNMIIYPND

SEQ ID NO: 104124 - protein, 9 aa, Homo Sapiens
STRSDRLAM

SEQ ID NO: 104125 - protein, 9 aa, Homo Sapiens
NMIIYPNDN

SEQ ID NO: 104126 - protein, 9 aa, Homo Sapiens
AGRDGPLRL

SEQ ID NO: 104127 - protein, 9 aa, Homo Sapiens
ELRYRSLAY

SEQ ID NO: 104128 - protein, 9 aa, Homo Sapiens
HKNMIIYPN

SEQ ID NO: 104129 - protein, 9 aa, Homo Sapiens
SKTRLCWSP

SEQ ID NO: 104130 - protein, 9 aa, Homo Sapiens
EALDELALL

SEQ ID NO: 104131 - protein, 9 aa, Homo Sapiens
NYAPNMYKH

SEQ ID NO: 104132 - protein, 9 aa, Homo Sapiens
PGFAPLTSQ

SEQ ID NO: 104133 - protein, 9 aa, Homo Sapiens
IYPNDNRHS

SEQ ID NO: 104134 - protein, 9 aa, Homo Sapiens
HLALPESNR

SEQ ID NO: 104135 - protein, 9 aa, Homo Sapiens
PMVRSTPSQ

SEQ ID NO: 104136 - protein, 9 aa, Homo Sapiens
WPSHVDVHT

SEQ ID NO: 104137 - protein, 9 aa, Homo Sapiens
RGGQSGSNW

SEQ ID NO: 104138 - protein, 9 aa, Homo Sapiens
LPTPSDHSR

SEQ ID NO: 104139 - protein, 9 aa, Homo Sapiens
VHHKNMIIY

SEQ ID NO: 104140 - protein, 9 aa, Homo Sapiens
IIYPNDNRH

SEQ ID NO: 104141 - protein, 9 aa, Homo Sapiens
PPATGGVKK

SEQ ID NO: 104142 - protein, 9 aa, Homo Sapiens
CWSPGEVLA

SEQ ID NO: 104143 - protein, 9 aa, Homo Sapiens
MPCILEAHQ

SEQ ID NO: 104144 - protein, 9 aa, Homo Sapiens
TISIVNQVY

SEQ ID NO: 104145 - protein, 9 aa, Homo Sapiens
SPPMVRSTP

SEQ ID NO: 104146 - protein, 9 aa, Homo Sapiens
NSLLANVLE

SEQ ID NO: 104147 - protein, 9 aa, Homo Sapiens
LEPGTYLIM

SEQ ID NO: 104148 - protein, 9 aa, Homo Sapiens
GTQPAPWVR

SEQ ID NO: 104149 - protein, 9 aa, Homo Sapiens
PSHVDVHTQ

SEQ ID NO: 104150 - protein, 9 aa, Homo Sapiens
HVDVHTQAM

SEQ ID NO: 104151 - protein, 9 aa, Homo Sapiens
QTIPKAQIP

SEQ ID NO: 104152 - protein, 9 aa, Homo Sapiens
RHGGWTTKM

SEQ ID NO: 104153 - protein, 9 aa, Homo Sapiens
CSGAGRDGP

SEQ ID NO: 104154 - protein, 9 aa, Homo Sapiens
HSRYRLDLE

SEQ ID NO: 104155 - protein, 9 aa, Homo Sapiens
FVEGLQRKR

SEQ ID NO: 104156 - protein, 9 aa, Homo Sapiens
DCTIHIFAQ

SEQ ID NO: 104157 - protein, 9 aa, Homo Sapiens
ALLQVTMQQ

SEQ ID NO: 104158 - protein, 9 aa, Homo Sapiens
SGTPSRGGQ

SEQ ID NO: 104159 - protein, 9 aa, Homo Sapiens
LCWSPGEVL

SEQ ID NO: 104160 - protein, 9 aa, Homo Sapiens
LLPTPSDHS

SEQ ID NO: 104161 - protein, 9 aa, Homo Sapiens
GLQRKRAQR

SEQ ID NO: 104162 - protein, 9 aa, Homo Sapiens
NRFHLALPE

SEQ ID NO: 104163 - protein, 9 aa, Homo Sapiens
CADFFIHGE

SEQ ID NO: 104164 - protein, 9 aa, Homo Sapiens
EPGTYLIMP

SEQ ID NO: 104165 - protein, 9 aa, Homo Sapiens
VDVHTQAMY

SEQ ID NO: 104166 - protein, 9 aa, Homo Sapiens
LANVLEPVL

SEQ ID NO: 104167 - protein, 9 aa, Homo Sapiens
SYNYAPNMY

SEQ ID NO: 104168 - protein, 9 aa, Homo Sapiens
GFAPLTSQG

SEQ ID NO: 104169 - protein, 9 aa, Homo Sapiens
SDRLAMGFS

SEQ ID NO: 104170 - protein, 9 aa, Homo Sapiens
PAPWVRPPS

SEQ ID NO: 104171 - protein, 9 aa, Homo Sapiens
IVSQNDFPS

SEQ ID NO: 104172 - protein, 9 aa, Homo Sapiens
IPQSTHTHL

SEQ ID NO: 104173 - protein, 9 aa, Homo Sapiens
EARTRLQGQ

SEQ ID NO: 104174 - protein, 9 aa, Homo Sapiens
KDTAKLKDF

SEQ ID NO: 104175 - protein, 9 aa, Homo Sapiens
NDDCTIHIF

SEQ ID NO: 104176 - protein, 9 aa, Homo Sapiens
LTSQGSQQY

SEQ ID NO: 104177 - protein, 9 aa, Homo Sapiens
HHKNMIIYP

SEQ ID NO: 104178 - protein, 9 aa, Homo Sapiens
VEGLQRKRA

SEQ ID NO: 104179 - protein, 9 aa, Homo Sapiens
RSDRLAMGF

SEQ ID NO: 104180 - protein, 9 aa, Homo Sapiens
LKDFYQFTF

SEQ ID NO: 104181 - protein, 9 aa, Homo Sapiens
FFIHGERLR

SEQ ID NO: 104182 - protein, 9 aa, Homo Sapiens
DRLAMGFST

SEQ ID NO: 104183 - protein, 9 aa, Homo Sapiens
IVNQVYGYF

SEQ ID NO: 104184 - protein, 9 aa, Homo Sapiens
APNMYKHWI

SEQ ID NO: 104185 - protein, 9 aa, Homo Sapiens
PSDHSRYRL

SEQ ID NO: 104186 - protein, 9 aa, Homo Sapiens
QRKRAQRGQ

SEQ ID NO: 104187 - protein, 9 aa, Homo Sapiens
KTRLCWSPG

SEQ ID NO: 104188 - protein, 9 aa, Homo Sapiens
YNYAPNMYK

SEQ ID NO: 104189 - protein, 9 aa, Homo Sapiens
GQSGSNWGR

SEQ ID NO: 104190 - protein, 9 aa, Homo Sapiens
DARHGGWTT

SEQ ID NO: 104191 - protein, 9 aa, Homo Sapiens
PWVRPPSPD

SEQ ID NO: 104192 - protein, 9 aa, Homo Sapiens
SRGGQSGSN

SEQ ID NO: 104193 - protein, 9 aa, Homo Sapiens
AGDIVSQND

SEQ ID NO: 104194 - protein, 9 aa, Homo Sapiens
VWPSHVDVH

SEQ ID NO: 104195 - protein, 9 aa, Homo Sapiens
SHVDVHTQA

SEQ ID NO: 104196 - protein, 9 aa, Homo Sapiens
KAARKSPPA

SEQ ID NO: 104197 - protein, 9 aa, Homo Sapiens
YKHWIMQYT

SEQ ID NO: 104198 - protein, 9 aa, Homo Sapiens
ATKAARKSP

SEQ ID NO: 104199 - protein, 9 aa, Homo Sapiens
GESSPPMVR

SEQ ID NO: 104200 - protein, 9 aa, Homo Sapiens
PNMYKHWIM

SEQ ID NO: 104201 - protein, 9 aa, Homo Sapiens
RFHLALPES

SEQ ID NO: 104202 - protein, 9 aa, Homo Sapiens
ESSPPMVRS

SEQ ID NO: 104203 - protein, 9 aa, Homo Sapiens
PKAQIPQST

SEQ ID NO: 104204 - protein, 9 aa, Homo Sapiens
KSPPATGGV

SEQ ID NO: 104205 - protein, 9 aa, Homo Sapiens
TRSDRLAMG

SEQ ID NO: 104206 - protein, 9 aa, Homo Sapiens
VHTQAMYQM

SEQ ID NO: 104207 - protein, 9 aa, Homo Sapiens
SQGSQQYRA

SEQ ID NO: 104208 - protein, 9 aa, Homo Sapiens
ADFFIHGER

SEQ ID NO: 104209 - protein, 9 aa, Homo Sapiens
CSLSLNRFH

SEQ ID NO: 104210 - protein, 9 aa, Homo Sapiens
QGTQPAPWV

SEQ ID NO: 104211 - protein, 9 aa, Homo Sapiens
RKSPPATGG

SEQ ID NO: 104212 - protein, 9 aa, Homo Sapiens
GRDGPLRLR

SEQ ID NO: 104213 - protein, 9 aa, Homo Sapiens
NDARHGGWT

SEQ ID NO: 104214 - protein, 9 aa, Homo Sapiens
ELKDTAKLK

SEQ ID NO: 104215 - protein, 9 aa, Homo Sapiens
LQGTQPAPW

SEQ ID NO: 104216 - protein, 9 aa, Homo Sapiens
DTAKLKDFY

SEQ ID NO: 104217 - protein, 9 aa, Homo Sapiens
ASKTRLCWS

SEQ ID NO: 104218 - protein, 9 aa, Homo Sapiens
WKENSLLAN

SEQ ID NO: 104219 - protein, 9 aa, Homo Sapiens
SEFVEGLQR

SEQ ID NO: 104220 - protein, 9 aa, Homo Sapiens
MVRSTPSQE

SEQ ID NO: 104221 - protein, 9 aa, Homo Sapiens
RLAMGFSTT

SEQ ID NO: 104222 - protein, 9 aa, Homo Sapiens
TPSDHSRYR

SEQ ID NO: 104223 - protein, 9 aa, Homo Sapiens
SGAGRDGPL

SEQ ID NO: 104224 - protein, 9 aa, Homo Sapiens
IHGERLRDK

SEQ ID NO: 104225 - protein, 9 aa, Homo Sapiens
RYRSLAYNK

SEQ ID NO: 104226 - protein, 9 aa, Homo Sapiens
RLCWSPGEV

SEQ ID NO: 104227 - protein, 9 aa, Homo Sapiens
PSRGGQSGS

SEQ ID NO: 104228 - protein, 9 aa, Homo Sapiens
LSLNRFHLA

SEQ ID NO: 104229 - protein, 9 aa, Homo Sapiens
SYPCSGAGR

SEQ ID NO: 104230 - protein, 9 aa, Homo Sapiens
TIPKAQIPQ

SEQ ID NO: 104231 - protein, 9 aa, Homo Sapiens
YPNDNRHSS

SEQ ID NO: 104232 - protein, 9 aa, Homo Sapiens
FPELRYRSL

SEQ ID NO: 104233 - protein, 9 aa, Homo Sapiens
VSRQEARTR

SEQ ID NO: 104234 - protein, 9 aa, Homo Sapiens
NGCADFFIH

SEQ ID NO: 104235 - protein, 9 aa, Homo Sapiens
LLANVLEPV

SEQ ID NO: 104236 - protein, 9 aa, Homo Sapiens
TSQGSQQYR

SEQ ID NO: 104237 - protein, 9 aa, Homo Sapiens
GGQSGSNWG

SEQ ID NO: 104238 - protein, 9 aa, Homo Sapiens
SDHSRYRLD

SEQ ID NO: 104239 - protein, 9 aa, Homo Sapiens
MGFSTTVKD

SEQ ID NO: 104240 - protein, 9 aa, Homo Sapiens
LAMGFSTTV

SEQ ID NO: 104241 - protein, 9 aa, Homo Sapiens
MKQMNDARH

SEQ ID NO: 104242 - protein, 9 aa, Homo Sapiens
QSGSNWGRG

SEQ ID NO: 104243 - protein, 9 aa, Homo Sapiens
ACGNDDCTI

SEQ ID NO: 104244 - protein, 9 aa, Homo Sapiens
PPMVRSTPS

SEQ ID NO: 104245 - protein, 9 aa, Homo Sapiens
CGNDDCTIH

SEQ ID NO: 104246 - protein, 9 aa, Homo Sapiens
EFVEGLQRK

SEQ ID NO: 104247 - protein, 9 aa, Homo Sapiens
QIPQSTHTH

SEQ ID NO: 104248 - protein, 9 aa, Homo Sapiens
RQEARTRLQ

SEQ ID NO: 104249 - protein, 9 aa, Homo Sapiens
TAKLKDFYQ

SEQ ID NO: 104250 - protein, 9 aa, Homo Sapiens
ENSLLANVL

SEQ ID NO: 104251 - protein, 9 aa, Homo Sapiens
MYKHWIMQY

SEQ ID NO: 104252 - protein, 9 aa, Homo Sapiens
LPAGDIVSQ

SEQ ID NO: 104253 - protein, 9 aa, Homo Sapiens
PCSGAGRDG

SEQ ID NO: 104254 - protein, 9 aa, Homo Sapiens
LNRFHLALP

SEQ ID NO: 104255 - protein, 9 aa, Homo Sapiens
DHSRYRLDL

SEQ ID NO: 104256 - protein, 9 aa, Homo Sapiens
RSLAYNKIA

SEQ ID NO: 104257 - protein, 9 aa, Homo Sapiens
PLTSQGSQQ

SEQ ID NO: 104258 - protein, 9 aa, Homo Sapiens
DVHTQAMYQ

SEQ ID NO: 104259 - protein, 9 aa, Homo Sapiens
DIVSQNDFP

SEQ ID NO: 104260 - protein, 9 aa, Homo Sapiens
TKAARKSPP

SEQ ID NO: 104261 - protein, 9 aa, Homo Sapiens
GNDDCTIHI

SEQ ID NO: 104262 - protein, 9 aa, Homo Sapiens
TIHIFAQQN

SEQ ID NO: 104263 - protein, 9 aa, Homo Sapiens
ALDELALLQ

SEQ ID NO: 104264 - protein, 9 aa, Homo Sapiens
TQPAPWVRP

SEQ ID NO: 104265 - protein, 9 aa, Homo Sapiens
MIIYPNDNR

SEQ ID NO: 104266 - protein, 9 aa, Homo Sapiens
GTPSRGGQS

SEQ ID NO: 104267 - protein, 9 aa, Homo Sapiens
MNDARHGGW

SEQ ID NO: 104268 - protein, 9 aa, Homo Sapiens
LKKTTRVTK

SEQ ID NO: 104269 - protein, 9 aa, Homo Sapiens
STINSLVFQ

SEQ ID NO: 104270 - protein, 9 aa, Homo Sapiens
NEVNRKSLK

SEQ ID NO: 104271 - protein, 9 aa, Homo Sapiens
RVDLLAQPR

SEQ ID NO: 104272 - protein, 9 aa, Homo Sapiens
SQIHQSVID

SEQ ID NO: 104273 - protein, 9 aa, Homo Sapiens
ANEEKINGV

SEQ ID NO: 104274 - protein, 9 aa, Homo Sapiens
GTFSPVCTY

SEQ ID NO: 104275 - protein, 9 aa, Homo Sapiens
SDMQSGIIK

SEQ ID NO: 104276 - protein, 9 aa, Homo Sapiens
TQEIFNCRL

SEQ ID NO: 104277 - protein, 9 aa, Homo Sapiens
QEIFNCRLD

SEQ ID NO: 104278 - protein, 9 aa, Homo Sapiens
NSNPIDNDE

SEQ ID NO: 104279 - protein, 9 aa, Homo Sapiens
GSLAANKLG

SEQ ID NO: 104280 - protein, 9 aa, Homo Sapiens
EGSERKPRM

SEQ ID NO: 104281 - protein, 9 aa, Homo Sapiens
HATGLHYGI

SEQ ID NO: 104282 - protein, 9 aa, Homo Sapiens
AGPQYQAIG

SEQ ID NO: 104283 - protein, 9 aa, Homo Sapiens
HQNLSKTKK

SEQ ID NO: 104284 - protein, 9 aa, Homo Sapiens
DSVASGSSL

SEQ ID NO: 104285 - protein, 9 aa, Homo Sapiens
SKEAEVLIK

SEQ ID NO: 104286 - protein, 9 aa, Homo Sapiens
LLYEEGKKL

SEQ ID NO: 104287 - protein, 9 aa, Homo Sapiens
TGRRNISRV

SEQ ID NO: 104288 - protein, 9 aa, Homo Sapiens
HFIQIKLLN

SEQ ID NO: 104289 - protein, 9 aa, Homo Sapiens
GEGSERKPR

SEQ ID NO: 104290 - protein, 9 aa, Homo Sapiens
TEKHFIQIK

SEQ ID NO: 104291 - protein, 9 aa, Homo Sapiens
AFQPPRSSG

SEQ ID NO: 104292 - protein, 9 aa, Homo Sapiens
YRDSAFQPG

SEQ ID NO: 104293 - protein, 9 aa, Homo Sapiens
SERKPRMPV

SEQ ID NO: 104294 - protein, 9 aa, Homo Sapiens
PCDQCLVPT

SEQ ID NO: 104295 - protein, 9 aa, Homo Sapiens
YFLTVMSAN

SEQ ID NO: 104296 - protein, 9 aa, Homo Sapiens
KHAQMKVEK

SEQ ID NO: 104297 - protein, 9 aa, Homo Sapiens
KGSGAPSPL

SEQ ID NO: 104298 - protein, 9 aa, Homo Sapiens
KAFQPPRSS

SEQ ID NO: 104299 - protein, 9 aa, Homo Sapiens
RFFAKWWRC

SEQ ID NO: 104300 - protein, 9 aa, Homo Sapiens
PDCGRLTAA

SEQ ID NO: 104301 - protein, 9 aa, Homo Sapiens
VCGSGTFSP

SEQ ID NO: 104302 - protein, 9 aa, Homo Sapiens
VSGKVTSGC

SEQ ID NO: 104303 - protein, 9 aa, Homo Sapiens
IGGHGLDKP

SEQ ID NO: 104304 - protein, 9 aa, Homo Sapiens
GYRDSAFQP

SEQ ID NO: 104305 - protein, 9 aa, Homo Sapiens
FTYTFEITA

SEQ ID NO: 104306 - protein, 9 aa, Homo Sapiens
LEDSTETLV

SEQ ID NO: 104307 - protein, 9 aa, Homo Sapiens
PPSRQKPPL

SEQ ID NO: 104308 - protein, 9 aa, Homo Sapiens
KLFLFTWSL

SEQ ID NO: 104309 - protein, 9 aa, Homo Sapiens
SLEDSTETL

SEQ ID NO: 104310 - protein, 9 aa, Homo Sapiens
LPPILPKDK

SEQ ID NO: 104311 - protein, 9 aa, Homo Sapiens
RDLEAEGVK

SEQ ID NO: 104312 - protein, 9 aa, Homo Sapiens
TMSHPLAGS

SEQ ID NO: 104313 - protein, 9 aa, Homo Sapiens
SSGYGQQGS

SEQ ID NO: 104314 - protein, 9 aa, Homo Sapiens
DITDGNSEY

SEQ ID NO: 104315 - protein, 9 aa, Homo Sapiens
KEKDNTNVN

SEQ ID NO: 104316 - protein, 9 aa, Homo Sapiens
LLQHGANEN

SEQ ID NO: 104317 - protein, 9 aa, Homo Sapiens
DCKNLLDVS

SEQ ID NO: 104318 - protein, 9 aa, Homo Sapiens
SFVGKQVTI

SEQ ID NO: 104319 - protein, 9 aa, Homo Sapiens
LKLCKIHKM

SEQ ID NO: 104320 - protein, 9 aa, Homo Sapiens
QKPPLPACE

SEQ ID NO: 104321 - protein, 9 aa, Homo Sapiens
ALSSYFLAC

SEQ ID NO: 104322 - protein, 9 aa, Homo Sapiens
TINSLVFQQ

SEQ ID NO: 104323 - protein, 9 aa, Homo Sapiens
EMHLAAQIS

SEQ ID NO: 104324 - protein, 9 aa, Homo Sapiens
EKDYSGLTY

SEQ ID NO: 104325 - protein, 9 aa, Homo Sapiens
CWQPFSGNK

SEQ ID NO: 104326 - protein, 9 aa, Homo Sapiens
VKIENSPLF

SEQ ID NO: 104327 - protein, 9 aa, Homo Sapiens
QIKLLNYLM

SEQ ID NO: 104328 - protein, 9 aa, Homo Sapiens
QKEKDNTNV

SEQ ID NO: 104329 - protein, 9 aa, Homo Sapiens
IVLKTSQGC

SEQ ID NO: 104330 - protein, 9 aa, Homo Sapiens
LPSFTLTAR

SEQ ID NO: 104331 - protein, 9 aa, Homo Sapiens
FSERFFAKW

SEQ ID NO: 104332 - protein, 9 aa, Homo Sapiens
IMELSEDCP

SEQ ID NO: 104333 - protein, 9 aa, Homo Sapiens
MAAEDFFQR

SEQ ID NO: 104334 - protein, 9 aa, Homo Sapiens
NVWRCWQPF

SEQ ID NO: 104335 - protein, 9 aa, Homo Sapiens
NGVVETGRR

SEQ ID NO: 104336 - protein, 9 aa, Homo Sapiens
FKIQEVEEK

SEQ ID NO: 104337 - protein, 9 aa, Homo Sapiens
SYAGCMSKL

SEQ ID NO: 104338 - protein, 9 aa, Homo Sapiens
LSCYFPAQN

SEQ ID NO: 104339 - protein, 9 aa, Homo Sapiens
KEDLSSIVM

SEQ ID NO: 104340 - protein, 9 aa, Homo Sapiens
PHRPPGAAL

SEQ ID NO: 104341 - protein, 9 aa, Homo Sapiens
GGGRDRRAL

SEQ ID NO: 104342 - protein, 9 aa, Homo Sapiens
ASLIAPFFP

SEQ ID NO: 104343 - protein, 9 aa, Homo Sapiens
AFQGSLSCY

SEQ ID NO: 104344 - protein, 9 aa, Homo Sapiens
GVVETGRRL

SEQ ID NO: 104345 - protein, 9 aa, Homo Sapiens
LLHDVFHTT

SEQ ID NO: 104346 - protein, 9 aa, Homo Sapiens
SGNSRYSIV

SEQ ID NO: 104347 - protein, 9 aa, Homo Sapiens
VATAHEDLV

SEQ ID NO: 104348 - protein, 9 aa, Homo Sapiens
GTVILKLCK

SEQ ID NO: 104349 - protein, 9 aa, Homo Sapiens
EFKQVKIEN

SEQ ID NO: 104350 - protein, 9 aa, Homo Sapiens
GPFGQERVT

SEQ ID NO: 104351 - protein, 9 aa, Homo Sapiens
ENLLKSFTD

SEQ ID NO: 104352 - protein, 9 aa, Homo Sapiens
GSMPKPHLT

SEQ ID NO: 104353 - protein, 9 aa, Homo Sapiens
LHLDLTGTS

SEQ ID NO: 104354 - protein, 9 aa, Homo Sapiens
VKKIVIGGH

SEQ ID NO: 104355 - protein, 9 aa, Homo Sapiens
KMLSLTHLF

SEQ ID NO: 104356 - protein, 9 aa, Homo Sapiens
GALRDCKNL

SEQ ID NO: 104357 - protein, 9 aa, Homo Sapiens
RQSKMLTQL

SEQ ID NO: 104358 - protein, 9 aa, Homo Sapiens
SGTFSPVCT

SEQ ID NO: 104359 - protein, 9 aa, Homo Sapiens
FLSLEDSTE

SEQ ID NO: 104360 - protein, 9 aa, Homo Sapiens
SKMLTQLSL

SEQ ID NO: 104361 - protein, 9 aa, Homo Sapiens
EITALNGVS

SEQ ID NO: 104362 - protein, 9 aa, Homo Sapiens
LLCKLFRWP

SEQ ID NO: 104363 - protein, 9 aa, Homo Sapiens
SLAANKLGS

SEQ ID NO: 104364 - protein, 9 aa, Homo Sapiens
GRRSKHAQM

SEQ ID NO: 104365 - protein, 9 aa, Homo Sapiens
SQDQATKSK

SEQ ID NO: 104366 - protein, 9 aa, Homo Sapiens
RQGTSSKIF

SEQ ID NO: 104367 - protein, 9 aa, Homo Sapiens
SLTHLFLVF

SEQ ID NO: 104368 - protein, 9 aa, Homo Sapiens
LRKPNYSSV

SEQ ID NO: 104369 - protein, 9 aa, Homo Sapiens
SGVVTKVQH

SEQ ID NO: 104370 - protein, 9 aa, Homo Sapiens
FVSTINSLV

SEQ ID NO: 104371 - protein, 9 aa, Homo Sapiens
LPTTAPSNY

SEQ ID NO: 104372 - protein, 9 aa, Homo Sapiens
TMHKTSIKP

SEQ ID NO: 104373 - protein, 9 aa, Homo Sapiens
EEISFGDSV

SEQ ID NO: 104374 - protein, 9 aa, Homo Sapiens
APNLCQPKK

SEQ ID NO: 104375 - protein, 9 aa, Homo Sapiens
FVKKIVIGG

SEQ ID NO: 104376 - protein, 9 aa, Homo Sapiens
SAASGECTG

SEQ ID NO: 104377 - protein, 9 aa, Homo Sapiens
PTTAPSNYS

SEQ ID NO: 104378 - protein, 9 aa, Homo Sapiens
KVIKPRKTR

SEQ ID NO: 104379 - protein, 9 aa, Homo Sapiens
NISRVDLLA

SEQ ID NO: 104380 - protein, 9 aa, Homo Sapiens
LDEDVTDEQ

SEQ ID NO: 104381 - protein, 9 aa, Homo Sapiens
TFEITALNG

SEQ ID NO: 104382 - protein, 9 aa, Homo Sapiens
LMEESAEKA

SEQ ID NO: 104383 - protein, 9 aa, Homo Sapiens
ADAAGKAGY

SEQ ID NO: 104384 - protein, 9 aa, Homo Sapiens
NKGHKGKNC

SEQ ID NO: 104385 - protein, 9 aa, Homo Sapiens
DKGGTKCIK

SEQ ID NO: 104386 - protein, 9 aa, Homo Sapiens
DNQLTMIPN

SEQ ID NO: 104387 - protein, 9 aa, Homo Sapiens
DLLKYFRAQ

SEQ ID NO: 104388 - protein, 9 aa, Homo Sapiens
VLERQLVII

SEQ ID NO: 104389 - protein, 9 aa, Homo Sapiens
PRSSGTKYE

SEQ ID NO: 104390 - protein, 9 aa, Homo Sapiens
IQEMKEYLV

SEQ ID NO: 104391 - protein, 9 aa, Homo Sapiens
HYIPGYAGF

SEQ ID NO: 104392 - protein, 9 aa, Homo Sapiens
LLDVSCRKT

SEQ ID NO: 104393 - protein, 9 aa, Homo Sapiens
SICTESVGE

SEQ ID NO: 104394 - protein, 9 aa, Homo Sapiens
KPGKGPGAP

SEQ ID NO: 104395 - protein, 9 aa, Homo Sapiens
EGKKPGNNK

SEQ ID NO: 104396 - protein, 9 aa, Homo Sapiens
YIFNQKEIF

SEQ ID NO: 104397 - protein, 9 aa, Homo Sapiens
VVVSRVTLS

SEQ ID NO: 104398 - protein, 9 aa, Homo Sapiens
MGITPFFCG

SEQ ID NO: 104399 - protein, 9 aa, Homo Sapiens
QRAGKNKPS

SEQ ID NO: 104400 - protein, 9 aa, Homo Sapiens
SGYGQQGSG

SEQ ID NO: 104401 - protein, 9 aa, Homo Sapiens
AGEGSERKP

SEQ ID NO: 104402 - protein, 9 aa, Homo Sapiens
CRLDEDVTD

SEQ ID NO: 104403 - protein, 9 aa, Homo Sapiens
HSFIKVIKP

SEQ ID NO: 104404 - protein, 9 aa, Homo Sapiens
VAQRPEPQL

SEQ ID NO: 104405 - protein, 9 aa, Homo Sapiens
DSVQLTKCT

SEQ ID NO: 104406 - protein, 9 aa, Homo Sapiens
MPDKGGTKC

SEQ ID NO: 104407 - protein, 9 aa, Homo Sapiens
FFNDRLLVY

SEQ ID NO: 104408 - protein, 9 aa, Homo Sapiens
DDHQQGYPR

SEQ ID NO: 104409 - protein, 9 aa, Homo Sapiens
LTQVALPLV

SEQ ID NO: 104410 - protein, 9 aa, Homo Sapiens
FIFFQVGFF

SEQ ID NO: 104411 - protein, 9 aa, Homo Sapiens
GSSLPSSPV

SEQ ID NO: 104412 - protein, 9 aa, Homo Sapiens
RTCLICGDH

SEQ ID NO: 104413 - protein, 9 aa, Homo Sapiens
LPSGVGAHQ

SEQ ID NO: 104414 - protein, 9 aa, Homo Sapiens
KIFFSVRQG

SEQ ID NO: 104415 - protein, 9 aa, Homo Sapiens
LYTIRWRTS

SEQ ID NO: 104416 - protein, 9 aa, Homo Sapiens
TFVSTINSL

SEQ ID NO: 104417 - protein, 9 aa, Homo Sapiens
KEYLVSSWE

SEQ ID NO: 104418 - protein, 9 aa, Homo Sapiens
GSERKPRMP

SEQ ID NO: 104419 - protein, 9 aa, Homo Sapiens
FLNSPRLGP

SEQ ID NO: 104420 - protein, 9 aa, Homo Sapiens
SRSAGVRVG

SEQ ID NO: 104421 - protein, 9 aa, Homo Sapiens
ISELGAGNS

SEQ ID NO: 104422 - protein, 9 aa, Homo Sapiens
AVSTRVRWC

SEQ ID NO: 104423 - protein, 9 aa, Homo Sapiens
HQSVIDTNV

SEQ ID NO: 104424 - protein, 9 aa, Homo Sapiens
HKTSIKPQI

SEQ ID NO: 104425 - protein, 9 aa, Homo Sapiens
TWMMQKSLM

SEQ ID NO: 104426 - protein, 9 aa, Homo Sapiens
LSEEFKQVK

SEQ ID NO: 104427 - protein, 9 aa, Homo Sapiens
WYRQPAGRG

SEQ ID NO: 104428 - protein, 9 aa, Homo Sapiens
QCRENLLKS

SEQ ID NO: 104429 - protein, 9 aa, Homo Sapiens
EEINQSLLA

SEQ ID NO: 104430 - protein, 9 aa, Homo Sapiens
CRAPFAGRR

SEQ ID NO: 104431 - protein, 9 aa, Homo Sapiens
QKEIFEGPK

SEQ ID NO: 104432 - protein, 9 aa, Homo Sapiens
SSGTKYETP

SEQ ID NO: 104433 - protein, 9 aa, Homo Sapiens
SFPDCGRLT

SEQ ID NO: 104434 - protein, 9 aa, Homo Sapiens
SNKACHDGD

SEQ ID NO: 104435 - protein, 9 aa, Homo Sapiens
NSGTVILKL

SEQ ID NO: 104436 - protein, 9 aa, Homo Sapiens
NSRYSIVLK

SEQ ID NO: 104437 - protein, 9 aa, Homo Sapiens
RLSSSCRKA

SEQ ID NO: 104438 - protein, 9 aa, Homo Sapiens
DQMAAELQH

SEQ ID NO: 104439 - protein, 9 aa, Homo Sapiens
LHNPRPGRL

SEQ ID NO: 104440 - protein, 9 aa, Homo Sapiens
GLVCMSSWG

SEQ ID NO: 104441 - protein, 9 aa, Homo Sapiens
QVALPLVED

SEQ ID NO: 104442 - protein, 9 aa, Homo Sapiens
VYSSDIENI

SEQ ID NO: 104443 - protein, 9 aa, Homo Sapiens
LEEISFGDS

SEQ ID NO: 104444 - protein, 9 aa, Homo Sapiens
FEMHLAAQI

SEQ ID NO: 104445 - protein, 9 aa, Homo Sapiens
WMMQKSLMA

SEQ ID NO: 104446 - protein, 9 aa, Homo Sapiens
LTETSLHLV

SEQ ID NO: 104447 - protein, 9 aa, Homo Sapiens
AVAQRPEPQ

SEQ ID NO: 104448 - protein, 9 aa, Homo Sapiens
RKPRMPVLL

SEQ ID NO: 104449 - protein, 9 aa, Homo Sapiens
DNRFFTLTE

SEQ ID NO: 104450 - protein, 9 aa, Homo Sapiens
EGFSERFFA

SEQ ID NO: 104451 - protein, 9 aa, Homo Sapiens
HLLVLHKSN

SEQ ID NO: 104452 - protein, 9 aa, Homo Sapiens
SLTSTSDMQ

SEQ ID NO: 104453 - protein, 9 aa, Homo Sapiens
LSKTKKKQL

SEQ ID NO: 104454 - protein, 9 aa, Homo Sapiens
SSNDKDYTH

SEQ ID NO: 104455 - protein, 9 aa, Homo Sapiens
FFSVRQGTS

SEQ ID NO: 104456 - protein, 9 aa, Homo Sapiens
FTPEPHYIP

SEQ ID NO: 104457 - protein, 9 aa, Homo Sapiens
AKVNYIFNQ

SEQ ID NO: 104458 - protein, 9 aa, Homo Sapiens
ELTQVALPL

SEQ ID NO: 104459 - protein, 9 aa, Homo Sapiens
ALPSGVGAH

SEQ ID NO: 104460 - protein, 9 aa, Homo Sapiens
YQAIGVTTF

SEQ ID NO: 104461 - protein, 9 aa, Homo Sapiens
LQHDVAQRL

SEQ ID NO: 104462 - protein, 9 aa, Homo Sapiens
PARCSVLSG

SEQ ID NO: 104463 - protein, 9 aa, Homo Sapiens
VGPPGATST

SEQ ID NO: 104464 - protein, 9 aa, Homo Sapiens
QAVAPGDRI

SEQ ID NO: 104465 - protein, 9 aa, Homo Sapiens
IKPRKTRKD

SEQ ID NO: 104466 - protein, 9 aa, Homo Sapiens
QVSRSAGVR

SEQ ID NO: 104467 - protein, 9 aa, Homo Sapiens
QDQATKSKS

SEQ ID NO: 104468 - protein, 9 aa, Homo Sapiens
TSTSDMQSG

SEQ ID NO: 104469 - protein, 9 aa, Homo Sapiens
PEPHYIPGY

SEQ ID NO: 104470 - protein, 9 aa, Homo Sapiens
SDYLSRVYI

SEQ ID NO: 104471 - protein, 9 aa, Homo Sapiens
IKPQIFPAL

SEQ ID NO: 104472 - protein, 9 aa, Homo Sapiens
QPTEMAAED

SEQ ID NO: 104473 - protein, 9 aa, Homo Sapiens
HAQMKVEKM

SEQ ID NO: 104474 - protein, 9 aa, Homo Sapiens
HKKRKRLSS

SEQ ID NO: 104475 - protein, 9 aa, Homo Sapiens
QIQEMKEYL

SEQ ID NO: 104476 - protein, 9 aa, Homo Sapiens
LWVQAVAPG

SEQ ID NO: 104477 - protein, 9 aa, Homo Sapiens
EVRLYTIRW

SEQ ID NO: 104478 - protein, 9 aa, Homo Sapiens
MIPNTIGNL

SEQ ID NO: 104479 - protein, 9 aa, Homo Sapiens
PGYSEAPTE

SEQ ID NO: 104480 - protein, 9 aa, Homo Sapiens
VMSANRYLV

SEQ ID NO: 104481 - protein, 9 aa, Homo Sapiens
ASHTPSLLH

SEQ ID NO: 104482 - protein, 9 aa, Homo Sapiens
LTMIPNTIG

SEQ ID NO: 104483 - protein, 9 aa, Homo Sapiens
PGKGPGAPD

SEQ ID NO: 104484 - protein, 9 aa, Homo Sapiens
ILDQVELPA

SEQ ID NO: 104485 - protein, 9 aa, Homo Sapiens
AAEDFFQRW

SEQ ID NO: 104486 - protein, 9 aa, Homo Sapiens
VGDLALLLE

SEQ ID NO: 104487 - protein, 9 aa, Homo Sapiens
KFLGRRSKH

SEQ ID NO: 104488 - protein, 9 aa, Homo Sapiens
NKACHDGDF

SEQ ID NO: 104489 - protein, 9 aa, Homo Sapiens
RSAGVRVGL

SEQ ID NO: 104490 - protein, 9 aa, Homo Sapiens
LLDAGPQYQ

SEQ ID NO: 104491 - protein, 9 aa, Homo Sapiens
RVPPSRQKP

SEQ ID NO: 104492 - protein, 9 aa, Homo Sapiens
KSKKNKGHK

SEQ ID NO: 104493 - protein, 9 aa, Homo Sapiens
FLHNLKPLS

SEQ ID NO: 104494 - protein, 9 aa, Homo Sapiens
VVLERQLVI

SEQ ID NO: 104495 - protein, 9 aa, Homo Sapiens
CHWNGKKML

SEQ ID NO: 104496 - protein, 9 aa, Homo Sapiens
EEDKTPLQK

SEQ ID NO: 104497 - protein, 9 aa, Homo Sapiens
PAQNSLMTC

SEQ ID NO: 104498 - protein, 9 aa, Homo Sapiens
VVSRVTLSL

SEQ ID NO: 104499 - protein, 9 aa, Homo Sapiens
SRVDLLAQP

SEQ ID NO: 104500 - protein, 9 aa, Homo Sapiens
QSNKACHDG

SEQ ID NO: 104501 - protein, 9 aa, Homo Sapiens
VRQSNKACH

SEQ ID NO: 104502 - protein, 9 aa, Homo Sapiens
QTKMEGEEI

SEQ ID NO: 104503 - protein, 9 aa, Homo Sapiens
SAFRHSPFF

SEQ ID NO: 104504 - protein, 9 aa, Homo Sapiens
HIVSFVGKQ

SEQ ID NO: 104505 - protein, 9 aa, Homo Sapiens
TAHEDLVYS

SEQ ID NO: 104506 - protein, 9 aa, Homo Sapiens
EVLNEVNRK

SEQ ID NO: 104507 - protein, 9 aa, Homo Sapiens
ERQLVIIDE

SEQ ID NO: 104508 - protein, 9 aa, Homo Sapiens
QTDMEAVEG

SEQ ID NO: 104509 - protein, 9 aa, Homo Sapiens
KRLPCDQCL

SEQ ID NO: 104510 - protein, 9 aa, Homo Sapiens
PDFTYTFEI

SEQ ID NO: 104511 - protein, 9 aa, Homo Sapiens
RDSAFQPGG

SEQ ID NO: 104512 - protein, 9 aa, Homo Sapiens
DLAKARSTL

SEQ ID NO: 104513 - protein, 9 aa, Homo Sapiens
EAHLPPILP

SEQ ID NO: 104514 - protein, 9 aa, Homo Sapiens
DTIFEMHLA

SEQ ID NO: 104515 - protein, 9 aa, Homo Sapiens
RQTKMEGEE

SEQ ID NO: 104516 - protein, 9 aa, Homo Sapiens
RCWQPFSGN

SEQ ID NO: 104517 - protein, 9 aa, Homo Sapiens
EETSTFGIE

SEQ ID NO: 104518 - protein, 9 aa, Homo Sapiens
RQKPPLPAC

SEQ ID NO: 104519 - protein, 9 aa, Homo Sapiens
RAATSMPGS

SEQ ID NO: 104520 - protein, 9 aa, Homo Sapiens
VDDNQLTMI

SEQ ID NO: 104521 - protein, 9 aa, Homo Sapiens
EDKTPLQKP

SEQ ID NO: 104522 - protein, 9 aa, Homo Sapiens
EGKKLRKPN

SEQ ID NO: 104523 - protein, 9 aa, Homo Sapiens
FPAQNSLMT

SEQ ID NO: 104524 - protein, 9 aa, Homo Sapiens
SFGDSVQLT

SEQ ID NO: 104525 - protein, 9 aa, Homo Sapiens
TCLICGDHA

SEQ ID NO: 104526 - protein, 9 aa, Homo Sapiens
VIDTNVILS

SEQ ID NO: 104527 - protein, 9 aa, Homo Sapiens
DQATKSKSP

SEQ ID NO: 104528 - protein, 9 aa, Homo Sapiens
PQKQCRENL

SEQ ID NO: 104529 - protein, 9 aa, Homo Sapiens
GYGRPPEES

SEQ ID NO: 104530 - protein, 9 aa, Homo Sapiens
VGPFGQERV

SEQ ID NO: 104531 - protein, 9 aa, Homo Sapiens
QSSGYGQQG

SEQ ID NO: 104532 - protein, 9 aa, Homo Sapiens
SADRVGDLA

SEQ ID NO: 104533 - protein, 9 aa, Homo Sapiens
MKEYLVSSW

SEQ ID NO: 104534 - protein, 9 aa, Homo Sapiens
AEAMQALRE

SEQ ID NO: 104535 - protein, 9 aa, Homo Sapiens
QNVEALEGG

SEQ ID NO: 104536 - protein, 9 aa, Homo Sapiens
KTTITLPMA

SEQ ID NO: 104537 - protein, 9 aa, Homo Sapiens
NSPRLGPGL

SEQ ID NO: 104538 - protein, 9 aa, Homo Sapiens
YSSLTLSGI

SEQ ID NO: 104539 - protein, 9 aa, Homo Sapiens
LYWYRQPAG

SEQ ID NO: 104540 - protein, 9 aa, Homo Sapiens
NLYWYRQPA

SEQ ID NO: 104541 - protein, 9 aa, Homo Sapiens
PGAALPSLM

SEQ ID NO: 104542 - protein, 9 aa, Homo Sapiens
PPGATSTVP

SEQ ID NO: 104543 - protein, 9 aa, Homo Sapiens
FPDGEEDKT

SEQ ID NO: 104544 - protein, 9 aa, Homo Sapiens
AVITLTCSG

SEQ ID NO: 104545 - protein, 9 aa, Homo Sapiens
KEDLLKYFR

SEQ ID NO: 104546 - protein, 9 aa, Homo Sapiens
QRTTKSKKN

SEQ ID NO: 104547 - protein, 9 aa, Homo Sapiens
HALGAVAFS

SEQ ID NO: 104548 - protein, 9 aa, Homo Sapiens
VVRGLQNVE

SEQ ID NO: 104549 - protein, 9 aa, Homo Sapiens
VITLTCSGK

SEQ ID NO: 104550 - protein, 9 aa, Homo Sapiens
SFPHRPPGA

SEQ ID NO: 104551 - protein, 9 aa, Homo Sapiens
TARPPCRCM

SEQ ID NO: 104552 - protein, 9 aa, Homo Sapiens
EISFGDSVQ

SEQ ID NO: 104553 - protein, 9 aa, Homo Sapiens
PSGVGAHQH

SEQ ID NO: 104554 - protein, 9 aa, Homo Sapiens
APQKQCREN

SEQ ID NO: 104555 - protein, 9 aa, Homo Sapiens
QNLSKTKKK

SEQ ID NO: 104556 - protein, 9 aa, Homo Sapiens
LRQSKMLTQ

SEQ ID NO: 104557 - protein, 9 aa, Homo Sapiens
VLSGGLGPF

SEQ ID NO: 104558 - protein, 9 aa, Homo Sapiens
ASGECTGPP

SEQ ID NO: 104559 - protein, 9 aa, Homo Sapiens
PLLLCKLFR

SEQ ID NO: 104560 - protein, 9 aa, Homo Sapiens
MEESAEKAQ

SEQ ID NO: 104561 - protein, 9 aa, Homo Sapiens
SSYFLACKI

SEQ ID NO: 104562 - protein, 9 aa, Homo Sapiens
LTSTSDMQS

SEQ ID NO: 104563 - protein, 9 aa, Homo Sapiens
EEFKQVKIE

SEQ ID NO: 104564 - protein, 9 aa, Homo Sapiens
GPPGATSTV

SEQ ID NO: 104565 - protein, 9 aa, Homo Sapiens
TIIEEGSAF

SEQ ID NO: 104566 - protein, 9 aa, Homo Sapiens
KKTEKHFIQ

SEQ ID NO: 104567 - protein, 9 aa, Homo Sapiens
KELIVFLHN

SEQ ID NO: 104568 - protein, 9 aa, Homo Sapiens
SHTPSLLHD

SEQ ID NO: 104569 - protein, 9 aa, Homo Sapiens
GENVWRCWQ

SEQ ID NO: 104570 - protein, 9 aa, Homo Sapiens
RSKHAQMKV

SEQ ID NO: 104571 - protein, 9 aa, Homo Sapiens
FPDCGRLTA

SEQ ID NO: 104572 - protein, 9 aa, Homo Sapiens
LNRDPGYSE

SEQ ID NO: 104573 - protein, 9 aa, Homo Sapiens
QPAGRGLQL

SEQ ID NO: 104574 - protein, 9 aa, Homo Sapiens
FNQKEIFEG

SEQ ID NO: 104575 - protein, 9 aa, Homo Sapiens
IFNCRLDED

SEQ ID NO: 104576 - protein, 9 aa, Homo Sapiens
QKSLMAFQG

SEQ ID NO: 104577 - protein, 9 aa, Homo Sapiens
KNNHSNFLV

SEQ ID NO: 104578 - protein, 9 aa, Homo Sapiens
KKLRKPNYS

SEQ ID NO: 104579 - protein, 9 aa, Homo Sapiens
EKINGVVET

SEQ ID NO: 104580 - protein, 9 aa, Homo Sapiens
EYLVSSWEH

SEQ ID NO: 104581 - protein, 9 aa, Homo Sapiens
EDHKGLIME

SEQ ID NO: 104582 - protein, 9 aa, Homo Sapiens
EAALRDLEA

SEQ ID NO: 104583 - protein, 9 aa, Homo Sapiens
LEALSSYFL

SEQ ID NO: 104584 - protein, 9 aa, Homo Sapiens
RRNISRVDL

SEQ ID NO: 104585 - protein, 9 aa, Homo Sapiens
AKARSTLVP

SEQ ID NO: 104586 - protein, 9 aa, Homo Sapiens
GITPFFCGK

SEQ ID NO: 104587 - protein, 9 aa, Homo Sapiens
LTQLAVAQR

SEQ ID NO: 104588 - protein, 9 aa, Homo Sapiens
LSLTSTSDM

SEQ ID NO: 104589 - protein, 9 aa, Homo Sapiens
LSLAMLSDS

SEQ ID NO: 104590 - protein, 9 aa, Homo Sapiens
CSVLSGGLG

SEQ ID NO: 104591 - protein, 9 aa, Homo Sapiens
RLYTIRWRT

SEQ ID NO: 104592 - protein, 9 aa, Homo Sapiens
VRGLQNVEA

SEQ ID NO: 104593 - protein, 9 aa, Homo Sapiens
TLTARPPCR

SEQ ID NO: 104594 - protein, 9 aa, Homo Sapiens
KQLSHGAVI

SEQ ID NO: 104595 - protein, 9 aa, Homo Sapiens
QILDQVELP

SEQ ID NO: 104596 - protein, 9 aa, Homo Sapiens
DYSGLTYRD

SEQ ID NO: 104597 - protein, 9 aa, Homo Sapiens
LSADRVGDL

SEQ ID NO: 104598 - protein, 9 aa, Homo Sapiens
SVIDTNVIL

SEQ ID NO: 104599 - protein, 9 aa, Homo Sapiens
SEHKKNNHS

SEQ ID NO: 104600 - protein, 9 aa, Homo Sapiens
SGVGAHQHL

SEQ ID NO: 104601 - protein, 9 aa, Homo Sapiens
GKQVTIRRA

SEQ ID NO: 104602 - protein, 9 aa, Homo Sapiens
DHATGLHYG

SEQ ID NO: 104603 - protein, 9 aa, Homo Sapiens
PPPFLNSPR

SEQ ID NO: 104604 - protein, 9 aa, Homo Sapiens
CLICGDHAT

SEQ ID NO: 104605 - protein, 9 aa, Homo Sapiens
CGDDLTHKF

SEQ ID NO: 104606 - protein, 9 aa, Homo Sapiens
GGSLGYGRP

SEQ ID NO: 104607 - protein, 9 aa, Homo Sapiens
GGAEKTDFN

SEQ ID NO: 104608 - protein, 9 aa, Homo Sapiens
HGANENAVD

SEQ ID NO: 104609 - protein, 9 aa, Homo Sapiens
YSSDIENIE

SEQ ID NO: 104610 - protein, 9 aa, Homo Sapiens
PSFTLTARP

SEQ ID NO: 104611 - protein, 9 aa, Homo Sapiens
MLSLTHLFL

SEQ ID NO: 104612 - protein, 9 aa, Homo Sapiens
EVEEKKKFE

SEQ ID NO: 104613 - protein, 9 aa, Homo Sapiens
SAFQPGGYH

SEQ ID NO: 104614 - protein, 9 aa, Homo Sapiens
MVTKYAEHS

SEQ ID NO: 104615 - protein, 9 aa, Homo Sapiens
KRKPGKGPG

SEQ ID NO: 104616 - protein, 9 aa, Homo Sapiens
ITALNGVSS

SEQ ID NO: 104617 - protein, 9 aa, Homo Sapiens
EREDHKGLI

SEQ ID NO: 104618 - protein, 9 aa, Homo Sapiens
YLLVGVCGD

SEQ ID NO: 104619 - protein, 9 aa, Homo Sapiens
EHQNLSKTK

SEQ ID NO: 104620 - protein, 9 aa, Homo Sapiens
YVCGSGTFS

SEQ ID NO: 104621 - protein, 9 aa, Homo Sapiens
KVNYIFNQK

SEQ ID NO: 104622 - protein, 9 aa, Homo Sapiens
VLAPSEKTT

SEQ ID NO: 104623 - protein, 9 aa, Homo Sapiens
GANENAVDA

SEQ ID NO: 104624 - protein, 9 aa, Homo Sapiens
RAQSVRVLS

SEQ ID NO: 104625 - protein, 9 aa, Homo Sapiens
SGAVSTRVR

SEQ ID NO: 104626 - protein, 9 aa, Homo Sapiens
PDKGGTKCI

SEQ ID NO: 104627 - protein, 9 aa, Homo Sapiens
TPTPQALYR

SEQ ID NO: 104628 - protein, 9 aa, Homo Sapiens
LFFNDRLLV

SEQ ID NO: 104629 - protein, 9 aa, Homo Sapiens
SLIAPFFPP

SEQ ID NO: 104630 - protein, 9 aa, Homo Sapiens
RSERQAKEI

SEQ ID NO: 104631 - protein, 9 aa, Homo Sapiens
LTQLSLAEN

SEQ ID NO: 104632 - protein, 9 aa, Homo Sapiens
IFNQKEIFE

SEQ ID NO: 104633 - protein, 9 aa, Homo Sapiens
GGHGLDKPK

SEQ ID NO: 104634 - protein, 9 aa, Homo Sapiens
PHIVSFVGK

SEQ ID NO: 104635 - protein, 9 aa, Homo Sapiens
TAPSNYSSL

SEQ ID NO: 104636 - protein, 9 aa, Homo Sapiens
SNDKDYTHS

SEQ ID NO: 104637 - protein, 9 aa, Homo Sapiens
NRYLVVLAT

SEQ ID NO: 104638 - protein, 9 aa, Homo Sapiens
QERVTSVTE

SEQ ID NO: 104639 - protein, 9 aa, Homo Sapiens
CQPKKICKD

SEQ ID NO: 104640 - protein, 9 aa, Homo Sapiens
PHYIPGYAG

SEQ ID NO: 104641 - protein, 9 aa, Homo Sapiens
EERENSNPI

SEQ ID NO: 104642 - protein, 9 aa, Homo Sapiens
SCYFPAQNS

SEQ ID NO: 104643 - protein, 9 aa, Homo Sapiens
PPTTPEEED

SEQ ID NO: 104644 - protein, 9 aa, Homo Sapiens
RLGPGLQPL

SEQ ID NO: 104645 - protein, 9 aa, Homo Sapiens
LPLLLCKLF

SEQ ID NO: 104646 - protein, 9 aa, Homo Sapiens
GCMSKLFLF

SEQ ID NO: 104647 - protein, 9 aa, Homo Sapiens
YDLAKARST

SEQ ID NO: 104648 - protein, 9 aa, Homo Sapiens
RENLLKSFT

SEQ ID NO: 104649 - protein, 9 aa, Homo Sapiens
TEMAAEDFF

SEQ ID NO: 104650 - protein, 9 aa, Homo Sapiens
HMVVTGTMA

SEQ ID NO: 104651 - protein, 9 aa, Homo Sapiens
SYLLVGVCG

SEQ ID NO: 104652 - protein, 9 aa, Homo Sapiens
KPRKTRKDQ

SEQ ID NO: 104653 - protein, 9 aa, Homo Sapiens
TYTFEITAL

SEQ ID NO: 104654 - protein, 9 aa, Homo Sapiens
GKFYGSSPA

SEQ ID NO: 104655 - protein, 9 aa, Homo Sapiens
DANEEKING

SEQ ID NO: 104656 - protein, 9 aa, Homo Sapiens
GNSRYSIVL

SEQ ID NO: 104657 - protein, 9 aa, Homo Sapiens
VRLYTIRWR

SEQ ID NO: 104658 - protein, 9 aa, Homo Sapiens
LKHLLVLHK

SEQ ID NO: 104659 - protein, 9 aa, Homo Sapiens
GAASLSFPD

SEQ ID NO: 104660 - protein, 9 aa, Homo Sapiens
DGGAEKTDF

SEQ ID NO: 104661 - protein, 9 aa, Homo Sapiens
LLVGVCGDD

SEQ ID NO: 104662 - protein, 9 aa, Homo Sapiens
KIENSPLFE

SEQ ID NO: 104663 - protein, 9 aa, Homo Sapiens
GLWVQAVAP

SEQ ID NO: 104664 - protein, 9 aa, Homo Sapiens
YFRAQSVRV

SEQ ID NO: 104665 - protein, 9 aa, Homo Sapiens
NLLEKDYSG

SEQ ID NO: 104666 - protein, 9 aa, Homo Sapiens
RQLVIIDEL

SEQ ID NO: 104667 - protein, 9 aa, Homo Sapiens
CSGKHISEL

SEQ ID NO: 104668 - protein, 9 aa, Homo Sapiens
PVGPFGQER

SEQ ID NO: 104669 - protein, 9 aa, Homo Sapiens
SMGNPRCDD

SEQ ID NO: 104670 - protein, 9 aa, Homo Sapiens
HTPSLLHDV

SEQ ID NO: 104671 - protein, 9 aa, Homo Sapiens
SGGLGPFRP

SEQ ID NO: 104672 - protein, 9 aa, Homo Sapiens
NDKDYTHSK

SEQ ID NO: 104673 - protein, 9 aa, Homo Sapiens
KAVATWDAN

SEQ ID NO: 104674 - protein, 9 aa, Homo Sapiens
HNPRPGRLL

SEQ ID NO: 104675 - protein, 9 aa, Homo Sapiens
LTARPPCRC

SEQ ID NO: 104676 - protein, 9 aa, Homo Sapiens
PQALYRDLS

SEQ ID NO: 104677 - protein, 9 aa, Homo Sapiens
KTTRVTKNK

SEQ ID NO: 104678 - protein, 9 aa, Homo Sapiens
INSLVFQQI

SEQ ID NO: 104679 - protein, 9 aa, Homo Sapiens
AVATWDANT

SEQ ID NO: 104680 - protein, 9 aa, Homo Sapiens
DHKGLIMEL

SEQ ID NO: 104681 - protein, 9 aa, Homo Sapiens
AVEGLVCMS

SEQ ID NO: 104682 - protein, 9 aa, Homo Sapiens
NYSSLTLSG

SEQ ID NO: 104683 - protein, 9 aa, Homo Sapiens
VSRVTLSLA

SEQ ID NO: 104684 - protein, 9 aa, Homo Sapiens
RSTLVPQGG

SEQ ID NO: 104685 - protein, 9 aa, Homo Sapiens
GSLGYGRPP

SEQ ID NO: 104686 - protein, 9 aa, Homo Sapiens
IPNTIGNLS

SEQ ID NO: 104687 - protein, 9 aa, Homo Sapiens
SEVRLYTIR

SEQ ID NO: 104688 - protein, 9 aa, Homo Sapiens
AELQHDVAQ

SEQ ID NO: 104689 - protein, 9 aa, Homo Sapiens
ILSVVAKQL

SEQ ID NO: 104690 - protein, 9 aa, Homo Sapiens
VQAVAPGDR

SEQ ID NO: 104691 - protein, 9 aa, Homo Sapiens
LVGVCGDDL

SEQ ID NO: 104692 - protein, 9 aa, Homo Sapiens
PGNNKGSGA

SEQ ID NO: 104693 - protein, 9 aa, Homo Sapiens
PQIFPALGL

SEQ ID NO: 104694 - protein, 9 aa, Homo Sapiens
TKKKQLMKK

SEQ ID NO: 104695 - protein, 9 aa, Homo Sapiens
DFCRAPFAG

SEQ ID NO: 104696 - protein, 9 aa, Homo Sapiens
TPEPHYIPG

SEQ ID NO: 104697 - protein, 9 aa, Homo Sapiens
GVGAHQHLK

SEQ ID NO: 104698 - protein, 9 aa, Homo Sapiens
QLTMIPNTI

SEQ ID NO: 104699 - protein, 9 aa, Homo Sapiens
IIEEGSAFR

SEQ ID NO: 104700 - protein, 9 aa, Homo Sapiens
IVFLHNLKP

SEQ ID NO: 104701 - protein, 9 aa, Homo Sapiens
FRAQSVRVL

SEQ ID NO: 104702 - protein, 9 aa, Homo Sapiens
SEEEEEEMA

SEQ ID NO: 104703 - protein, 9 aa, Homo Sapiens
LVWGAEAMQ

SEQ ID NO: 104704 - protein, 9 aa, Homo Sapiens
PRLGPGLQP

SEQ ID NO: 104705 - protein, 9 aa, Homo Sapiens
AFQPGGYHG

SEQ ID NO: 104706 - protein, 9 aa, Homo Sapiens
VAMIWQGLD

SEQ ID NO: 104707 - protein, 9 aa, Homo Sapiens
ENGKMVTVK

SEQ ID NO: 104708 - protein, 9 aa, Homo Sapiens
MAAELQHDV

SEQ ID NO: 104709 - protein, 9 aa, Homo Sapiens
DRQTKMEGE

SEQ ID NO: 104710 - protein, 9 aa, Homo Sapiens
KFDASLIAP

SEQ ID NO: 104711 - protein, 9 aa, Homo Sapiens
RTTKSKKNK

SEQ ID NO: 104712 - protein, 9 aa, Homo Sapiens
GVADAAGKA

SEQ ID NO: 104713 - protein, 9 aa, Homo Sapiens
GEEINQSLL

SEQ ID NO: 104714 - protein, 9 aa, Homo Sapiens
IFNSEAHLP

SEQ ID NO: 104715 - protein, 9 aa, Homo Sapiens
RDPGYSEAP

SEQ ID NO: 104716 - protein, 9 aa, Homo Sapiens
DANTEREQK

SEQ ID NO: 104717 - protein, 9 aa, Homo Sapiens
QSKMLTQLS

SEQ ID NO: 104718 - protein, 9 aa, Homo Sapiens
KKIVIGGHG

SEQ ID NO: 104719 - protein, 9 aa, Homo Sapiens
FEITALNGV

SEQ ID NO: 104720 - protein, 9 aa, Homo Sapiens
ASGSSLPSS

SEQ ID NO: 104721 - protein, 9 aa, Homo Sapiens
LGAVAFSGQ

SEQ ID NO: 104722 - protein, 9 aa, Homo Sapiens
AANKLGSSF

SEQ ID NO: 104723 - protein, 9 aa, Homo Sapiens
NNKGSGAPS

SEQ ID NO: 104724 - protein, 9 aa, Homo Sapiens
GNSGVVTKV

SEQ ID NO: 104725 - protein, 9 aa, Homo Sapiens
MAFQGSLSC

SEQ ID NO: 104726 - protein, 9 aa, Homo Sapiens
IFFSVRQGT

SEQ ID NO: 104727 - protein, 9 aa, Homo Sapiens
CDFCRAPFA

SEQ ID NO: 104728 - protein, 9 aa, Homo Sapiens
VLKTSQGCV

SEQ ID NO: 104729 - protein, 9 aa, Homo Sapiens
RVRWCRPDC

SEQ ID NO: 104730 - protein, 9 aa, Homo Sapiens
PRPGRLLGA

SEQ ID NO: 104731 - protein, 9 aa, Homo Sapiens
GYGQQGSGS

SEQ ID NO: 104732 - protein, 9 aa, Homo Sapiens
KIVIGGHGL

SEQ ID NO: 104733 - protein, 9 aa, Homo Sapiens
NGKKMLSLT

SEQ ID NO: 104734 - protein, 9 aa, Homo Sapiens
QSVVLERQL

SEQ ID NO: 104735 - protein, 9 aa, Homo Sapiens
EDFFQRWKQ

SEQ ID NO: 104736 - protein, 9 aa, Homo Sapiens
MHKTSIKPQ

SEQ ID NO: 104737 - protein, 9 aa, Homo Sapiens
GYSEAPTEE

SEQ ID NO: 104738 - protein, 9 aa, Homo Sapiens
LYRDLSCPE

SEQ ID NO: 104739 - protein, 9 aa, Homo Sapiens
GAVSTRVRW

SEQ ID NO: 104740 - protein, 9 aa, Homo Sapiens
DLVYSSYVH

SEQ ID NO: 104741 - protein, 9 aa, Homo Sapiens
KINGVVETG

SEQ ID NO: 104742 - protein, 9 aa, Homo Sapiens
LSVVAKQLS

SEQ ID NO: 104743 - protein, 9 aa, Homo Sapiens
ENAVDAENR

SEQ ID NO: 104744 - protein, 9 aa, Homo Sapiens
EKLEYMVTK

SEQ ID NO: 104745 - protein, 9 aa, Homo Sapiens
PSRQKPPLP

SEQ ID NO: 104746 - protein, 9 aa, Homo Sapiens
TVVRGLQNV

SEQ ID NO: 104747 - protein, 9 aa, Homo Sapiens
KIVSGKVTS

SEQ ID NO: 104748 - protein, 9 aa, Homo Sapiens
SLLHDVFHT

SEQ ID NO: 104749 - protein, 9 aa, Homo Sapiens
GYDLAKARS

SEQ ID NO: 104750 - protein, 9 aa, Homo Sapiens
VQIHMVVTG

SEQ ID NO: 104751 - protein, 9 aa, Homo Sapiens
MLTQLSLAE

SEQ ID NO: 104752 - protein, 9 aa, Homo Sapiens
PYQNIQCNG

SEQ ID NO: 104753 - protein, 9 aa, Homo Sapiens
TTAPSNYSS

SEQ ID NO: 104754 - protein, 9 aa, Homo Sapiens
NQKEIFEGP

SEQ ID NO: 104755 - protein, 9 aa, Homo Sapiens
AHLPPILPK

SEQ ID NO: 104756 - protein, 9 aa, Homo Sapiens
FTLTETSLH

SEQ ID NO: 104757 - protein, 9 aa, Homo Sapiens
TSGCGDTAL

SEQ ID NO: 104758 - protein, 9 aa, Homo Sapiens
SFTLTARPP

SEQ ID NO: 104759 - protein, 9 aa, Homo Sapiens
DAGPQYQAI

SEQ ID NO: 104760 - protein, 9 aa, Homo Sapiens
PGGGSLGYG

SEQ ID NO: 104761 - protein, 9 aa, Homo Sapiens
LDQVELPAG

SEQ ID NO: 104762 - protein, 9 aa, Homo Sapiens
QCLVPTDSS

SEQ ID NO: 104763 - protein, 9 aa, Homo Sapiens
GKKMLSLTH

SEQ ID NO: 104764 - protein, 9 aa, Homo Sapiens
PIDNDEEEV

SEQ ID NO: 104765 - protein, 9 aa, Homo Sapiens
TSMPGSCPL

SEQ ID NO: 104766 - protein, 9 aa, Homo Sapiens
KARSTLVPQ

SEQ ID NO: 104767 - protein, 9 aa, Homo Sapiens
KDYSGLTYR

SEQ ID NO: 104768 - protein, 9 aa, Homo Sapiens
WGAEAMQAL

SEQ ID NO: 104769 - protein, 9 aa, Homo Sapiens
DIENIEEST

SEQ ID NO: 104770 - protein, 9 aa, Homo Sapiens
GLQNVEALE

SEQ ID NO: 104771 - protein, 9 aa, Homo Sapiens
VIGGHGLDK

SEQ ID NO: 104772 - protein, 9 aa, Homo Sapiens
VKKCGTLHL

SEQ ID NO: 104773 - protein, 9 aa, Homo Sapiens
SKTKKKQLM

SEQ ID NO: 104774 - protein, 9 aa, Homo Sapiens
MSKLFLFTW

SEQ ID NO: 104775 - protein, 9 aa, Homo Sapiens
HPLAGSEDG

SEQ ID NO: 104776 - protein, 9 aa, Homo Sapiens
EGKTFVSTI

SEQ ID NO: 104777 - protein, 9 aa, Homo Sapiens
PAGYPPAIP

SEQ ID NO: 104778 - protein, 9 aa, Homo Sapiens
CMSKEAEVL

SEQ ID NO: 104779 - protein, 9 aa, Homo Sapiens
IHMVVTGTM

SEQ ID NO: 104780 - protein, 9 aa, Homo Sapiens
KQCRENLLK

SEQ ID NO: 104781 - protein, 9 aa, Homo Sapiens
SKSQDQATK

SEQ ID NO: 104782 - protein, 9 aa, Homo Sapiens
GSAFRHSPF

SEQ ID NO: 104783 - protein, 9 aa, Homo Sapiens
PGRLLGAPA

SEQ ID NO: 104784 - protein, 9 aa, Homo Sapiens
YLVSSWEHI

SEQ ID NO: 104785 - protein, 9 aa, Homo Sapiens
PPRSSGTKY

SEQ ID NO: 104786 - protein, 9 aa, Homo Sapiens
PKPHLTWQC

SEQ ID NO: 104787 - protein, 9 aa, Homo Sapiens
VPPSRQKPP

SEQ ID NO: 104788 - protein, 9 aa, Homo Sapiens
SFVKKIVIG

SEQ ID NO: 104789 - protein, 9 aa, Homo Sapiens
PSLESDEAS

SEQ ID NO: 104790 - protein, 9 aa, Homo Sapiens
NKLGSSFPS

SEQ ID NO: 104791 - protein, 9 aa, Homo Sapiens
DRVGDLALL

SEQ ID NO: 104792 - protein, 9 aa, Homo Sapiens
LNSPRLGPG

SEQ ID NO: 104793 - protein, 9 aa, Homo Sapiens
LHDVFHTTV

SEQ ID NO: 104794 - protein, 9 aa, Homo Sapiens
REDHKGLIM

SEQ ID NO: 104795 - protein, 9 aa, Homo Sapiens
NKKEDLSSI

SEQ ID NO: 104796 - protein, 9 aa, Homo Sapiens
SPAPPTTPE

SEQ ID NO: 104797 - protein, 9 aa, Homo Sapiens
STVPAHKYV

SEQ ID NO: 104798 - protein, 9 aa, Homo Sapiens
LCKLFRWPD

SEQ ID NO: 104799 - protein, 9 aa, Homo Sapiens
YVFKIQEVE

SEQ ID NO: 104800 - protein, 9 aa, Homo Sapiens
FTLTARPPC

SEQ ID NO: 104801 - protein, 9 aa, Homo Sapiens
FQPTEMAAE

SEQ ID NO: 104802 - protein, 9 aa, Homo Sapiens
ALWLSADRV

SEQ ID NO: 104803 - protein, 9 aa, Homo Sapiens
PRRLTQLAV

SEQ ID NO: 104804 - protein, 9 aa, Homo Sapiens
GTLHLDLTG

SEQ ID NO: 104805 - protein, 9 aa, Homo Sapiens
EDLSSIVMS

SEQ ID NO: 104806 - protein, 9 aa, Homo Sapiens
PASTKVPQC

SEQ ID NO: 104807 - protein, 9 aa, Homo Sapiens
EMKEYLVSS

SEQ ID NO: 104808 - protein, 9 aa, Homo Sapiens
VTSGCGDTA

SEQ ID NO: 104809 - protein, 9 aa, Homo Sapiens
LIMELSEDC

SEQ ID NO: 104810 - protein, 9 aa, Homo Sapiens
GLIMELSED

SEQ ID NO: 104811 - protein, 9 aa, Homo Sapiens
HRPPGAALP

SEQ ID NO: 104812 - protein, 9 aa, Homo Sapiens
NAVDAENRS

SEQ ID NO: 104813 - protein, 9 aa, Homo Sapiens
VLQKEKDNT

SEQ ID NO: 104814 - protein, 9 aa, Homo Sapiens
NGKMVTVKE

SEQ ID NO: 104815 - protein, 9 aa, Homo Sapiens
QPPRSSGTK

SEQ ID NO: 104816 - protein, 9 aa, Homo Sapiens
VAPGDRIRF

SEQ ID NO: 104817 - protein, 9 aa, Homo Sapiens
VSRSAGVRV

SEQ ID NO: 104818 - protein, 9 aa, Homo Sapiens
TDFNAKRKK

SEQ ID NO: 104819 - protein, 9 aa, Homo Sapiens
WDGGAEKTD

SEQ ID NO: 104820 - protein, 9 aa, Homo Sapiens
SHPLAGSED

SEQ ID NO: 104821 - protein, 9 aa, Homo Sapiens
ERENSNPID

SEQ ID NO: 104822 - protein, 9 aa, Homo Sapiens
MLKATMSHP

SEQ ID NO: 104823 - protein, 9 aa, Homo Sapiens
FGDSVQLTK

SEQ ID NO: 104824 - protein, 9 aa, Homo Sapiens
NENAVDAEN

SEQ ID NO: 104825 - protein, 9 aa, Homo Sapiens
YAGCMSKLF

SEQ ID NO: 104826 - protein, 9 aa, Homo Sapiens
KPQIFPALG

SEQ ID NO: 104827 - protein, 9 aa, Homo Sapiens
KCGTLHLDL

SEQ ID NO: 104828 - protein, 9 aa, Homo Sapiens
ELPAGYPPA

SEQ ID NO: 104829 - protein, 9 aa, Homo Sapiens
VRWCRPDCR

SEQ ID NO: 104830 - protein, 9 aa, Homo Sapiens
GSGTFSPVC

SEQ ID NO: 104831 - protein, 9 aa, Homo Sapiens
RKSLKKLAS

SEQ ID NO: 104832 - protein, 9 aa, Homo Sapiens
NIEESTSFE

SEQ ID NO: 104833 - protein, 9 aa, Homo Sapiens
VDLLAQPRR

SEQ ID NO: 104834 - protein, 9 aa, Homo Sapiens
IPVLQKEKD

SEQ ID NO: 104835 - protein, 9 aa, Homo Sapiens
DVYSSDIEN

SEQ ID NO: 104836 - protein, 9 aa, Homo Sapiens
CMSKLFLFT

SEQ ID NO: 104837 - protein, 9 aa, Homo Sapiens
VSTRVRWCR

SEQ ID NO: 104838 - protein, 9 aa, Homo Sapiens
RRLTQLAVA

SEQ ID NO: 104839 - protein, 9 aa, Homo Sapiens
GAVAFSGQS

SEQ ID NO: 104840 - protein, 9 aa, Homo Sapiens
CKNLLDVSC

SEQ ID NO: 104841 - protein, 9 aa, Homo Sapiens
EYMVTKYAE

SEQ ID NO: 104842 - protein, 9 aa, Homo Sapiens
VAKQLSHGA

SEQ ID NO: 104843 - protein, 9 aa, Homo Sapiens
LQKEKDNTN

SEQ ID NO: 104844 - protein, 9 aa, Homo Sapiens
LIVFLHNLK

SEQ ID NO: 104845 - protein, 9 aa, Homo Sapiens
ILNRDPGYS

SEQ ID NO: 104846 - protein, 9 aa, Homo Sapiens
GVKKCGTLH

SEQ ID NO: 104847 - protein, 9 aa, Homo Sapiens
EALSSYFLA

SEQ ID NO: 104848 - protein, 9 aa, Homo Sapiens
EILSVVAKQ

SEQ ID NO: 104849 - protein, 9 aa, Homo Sapiens
NLLKSFTDQ

SEQ ID NO: 104850 - protein, 9 aa, Homo Sapiens
IVIGGHGLD

SEQ ID NO: 104851 - protein, 9 aa, Homo Sapiens
PLVEDVINY

SEQ ID NO: 104852 - protein, 9 aa, Homo Sapiens
KPSLESDEA

SEQ ID NO: 104853 - protein, 9 aa, Homo Sapiens
TKFDASLIA

SEQ ID NO: 104854 - protein, 9 aa, Homo Sapiens
YKRKPGKGP

SEQ ID NO: 104855 - protein, 9 aa, Homo Sapiens
ERFFAKWWR

SEQ ID NO: 104856 - protein, 9 aa, Homo Sapiens
FQPPRSSGT

SEQ ID NO: 104857 - protein, 9 aa, Homo Sapiens
INGVVETGR

SEQ ID NO: 104858 - protein, 9 aa, Homo Sapiens
GNNKGSGAP

SEQ ID NO: 104859 - protein, 9 aa, Homo Sapiens
KGPGAPDCK

SEQ ID NO: 104860 - protein, 9 aa, Homo Sapiens
NLSKTKKKQ

SEQ ID NO: 104861 - protein, 9 aa, Homo Sapiens
HDVAQRLQD

SEQ ID NO: 104862 - protein, 9 aa, Homo Sapiens
NPRPGRLLG

SEQ ID NO: 104863 - protein, 9 aa, Homo Sapiens
VWRCWQPFS

SEQ ID NO: 104864 - protein, 9 aa, Homo Sapiens
VGKQVTIRR

SEQ ID NO: 104865 - protein, 9 aa, Homo Sapiens
LSFPDCGRL

SEQ ID NO: 104866 - protein, 9 aa, Homo Sapiens
ARCSVLSGG

SEQ ID NO: 104867 - protein, 9 aa, Homo Sapiens
KTFVSTINS

SEQ ID NO: 104868 - protein, 9 aa, Homo Sapiens
ALPLVEDVI

SEQ ID NO: 104869 - protein, 9 aa, Homo Sapiens
TETSLHLVF

SEQ ID NO: 104870 - protein, 9 aa, Homo Sapiens
NCRLDEDVT

SEQ ID NO: 104871 - protein, 9 aa, Homo Sapiens
VRPHKKRKR

SEQ ID NO: 104872 - protein, 9 aa, Homo Sapiens
LPLVEDVIN

SEQ ID NO: 104873 - protein, 9 aa, Homo Sapiens
ITLTCSGKH

SEQ ID NO: 104874 - protein, 9 aa, Homo Sapiens
CDQCLVPTD

SEQ ID NO: 104875 - protein, 9 aa, Homo Sapiens
CYFPAQNSL

SEQ ID NO: 104876 - protein, 9 aa, Homo Sapiens
PDGEEDKTP

SEQ ID NO: 104877 - protein, 9 aa, Homo Sapiens
KTKKKQLMK

SEQ ID NO: 104878 - protein, 9 aa, Homo Sapiens
KACHDGDFH

SEQ ID NO: 104879 - protein, 9 aa, Homo Sapiens
GGYRDSAFQ

SEQ ID NO: 104880 - protein, 9 aa, Homo Sapiens
VESGKFYGS

SEQ ID NO: 104881 - protein, 9 aa, Homo Sapiens
QKKTEKHFI

SEQ ID NO: 104882 - protein, 9 aa, Homo Sapiens
RVTSVTELM

SEQ ID NO: 104883 - protein, 9 aa, Homo Sapiens
MQALRERLG

SEQ ID NO: 104884 - protein, 9 aa, Homo Sapiens
LPSSPVSES

SEQ ID NO: 104885 - protein, 9 aa, Homo Sapiens
LYEEGKKLR

SEQ ID NO: 104886 - protein, 9 aa, Homo Sapiens
LMAFQGSLS

SEQ ID NO: 104887 - protein, 9 aa, Homo Sapiens
KLFRWPDLR

SEQ ID NO: 104888 - protein, 9 aa, Homo Sapiens
DGNSEYLKR

SEQ ID NO: 104889 - protein, 9 aa, Homo Sapiens
EAEVLIKGK

SEQ ID NO: 104890 - protein, 9 aa, Homo Sapiens
KPRMPVLLL

SEQ ID NO: 104891 - protein, 9 aa, Homo Sapiens
FIQIKLLNY

SEQ ID NO: 104892 - protein, 9 aa, Homo Sapiens
SLPLLLCKL

SEQ ID NO: 104893 - protein, 9 aa, Homo Sapiens
KFYGSSPAP

SEQ ID NO: 104894 - protein, 9 aa, Homo Sapiens
PTIIEEGSA

SEQ ID NO: 104895 - protein, 9 aa, Homo Sapiens
ATKSKSPTL

SEQ ID NO: 104896 - protein, 9 aa, Homo Sapiens
MSHPLAGSE

SEQ ID NO: 104897 - protein, 9 aa, Homo Sapiens
MLMEESAEK

SEQ ID NO: 104898 - protein, 9 aa, Homo Sapiens
SERRLKHLL

SEQ ID NO: 104899 - protein, 9 aa, Homo Sapiens
EEKINGVVE

SEQ ID NO: 104900 - protein, 9 aa, Homo Sapiens
VNRKSLKKL

SEQ ID NO: 104901 - protein, 9 aa, Homo Sapiens
QALYRDLSC

SEQ ID NO: 104902 - protein, 9 aa, Homo Sapiens
EKIVSGKVT

SEQ ID NO: 104903 - protein, 9 aa, Homo Sapiens
ATAHEDLVY

SEQ ID NO: 104904 - protein, 9 aa, Homo Sapiens
PPGAALPSL

SEQ ID NO: 104905 - protein, 9 aa, Homo Sapiens
LPEKLEYMV

SEQ ID NO: 104906 - protein, 9 aa, Homo Sapiens
LGYGRPPEE

SEQ ID NO: 104907 - protein, 9 aa, Homo Sapiens
KEAEVLIKG

SEQ ID NO: 104908 - protein, 9 aa, Homo Sapiens
ITPFFCGKC

SEQ ID NO: 104909 - protein, 9 aa, Homo Sapiens
KQVTIRRAD

SEQ ID NO: 104910 - protein, 9 aa, Homo Sapiens
SEKTTITLP

SEQ ID NO: 104911 - protein, 9 aa, Homo Sapiens
VPSLFFNDR

SEQ ID NO: 104912 - protein, 9 aa, Homo Sapiens
CGDHATGLH

SEQ ID NO: 104913 - protein, 9 aa, Homo Sapiens
DAAGKAGYP

SEQ ID NO: 104914 - protein, 9 aa, Homo Sapiens
RLKHLLVLH

SEQ ID NO: 104915 - protein, 9 aa, Homo Sapiens
LGRRSKHAQ

SEQ ID NO: 104916 - protein, 9 aa, Homo Sapiens
AIMSEHKKN

SEQ ID NO: 104917 - protein, 9 aa, Homo Sapiens
YTIRWRTSF

SEQ ID NO: 104918 - protein, 9 aa, Homo Sapiens
AALRDLEAE

SEQ ID NO: 104919 - protein, 9 aa, Homo Sapiens
KQVKIENSP

SEQ ID NO: 104920 - protein, 9 aa, Homo Sapiens
APSEKTTIT

SEQ ID NO: 104921 - protein, 9 aa, Homo Sapiens
QHGANENAV

SEQ ID NO: 104922 - protein, 9 aa, Homo Sapiens
RGGGRDRRA

SEQ ID NO: 104923 - protein, 9 aa, Homo Sapiens
CLVPTDSSV

SEQ ID NO: 104924 - protein, 9 aa, Homo Sapiens
LDAGPQYQA

SEQ ID NO: 104925 - protein, 9 aa, Homo Sapiens
GVCGDDLTH

SEQ ID NO: 104926 - protein, 9 aa, Homo Sapiens
KTEKHFIQI

SEQ ID NO: 104927 - protein, 9 aa, Homo Sapiens
QLKELIVFL

SEQ ID NO: 104928 - protein, 9 aa, Homo Sapiens
SLLEALSSY

SEQ ID NO: 104929 - protein, 9 aa, Homo Sapiens
IWQGLDVVR

SEQ ID NO: 104930 - protein, 9 aa, Homo Sapiens
DHQQGYPRK

SEQ ID NO: 104931 - protein, 9 aa, Homo Sapiens
SLMAFQGSL

SEQ ID NO: 104932 - protein, 9 aa, Homo Sapiens
NRKSLKKLA

SEQ ID NO: 104933 - protein, 9 aa, Homo Sapiens
FCRAPFAGR

SEQ ID NO: 104934 - protein, 9 aa, Homo Sapiens
HLDLTGTSG

SEQ ID NO: 104935 - protein, 9 aa, Homo Sapiens
SLVWGAEAM

SEQ ID NO: 104936 - protein, 9 aa, Homo Sapiens
MQKSLMAFQ

SEQ ID NO: 104937 - protein, 9 aa, Homo Sapiens
VLNEVNRKS

SEQ ID NO: 104938 - protein, 9 aa, Homo Sapiens
EKVRQSNKA

SEQ ID NO: 104939 - protein, 9 aa, Homo Sapiens
HCMSKEAEV

SEQ ID NO: 104940 - protein, 9 aa, Homo Sapiens
KKCGTLHLD

SEQ ID NO: 104941 - protein, 9 aa, Homo Sapiens
SVLSGGLGP

SEQ ID NO: 104942 - protein, 9 aa, Homo Sapiens
TWDANTERE

SEQ ID NO: 104943 - protein, 9 aa, Homo Sapiens
SCPRAATSM

SEQ ID NO: 104944 - protein, 9 aa, Homo Sapiens
IFFQVGFFS

SEQ ID NO: 104945 - protein, 9 aa, Homo Sapiens
YYKRKPGKG

SEQ ID NO: 104946 - protein, 9 aa, Homo Sapiens
RDCKNLLDV

SEQ ID NO: 104947 - protein, 9 aa, Homo Sapiens
LVIIDELIK

SEQ ID NO: 104948 - protein, 9 aa, Homo Sapiens
VGVCGDDLT

SEQ ID NO: 104949 - protein, 9 aa, Homo Sapiens
LNLLEKDYS

SEQ ID NO: 104950 - protein, 9 aa, Homo Sapiens
MSKEAEVLI

SEQ ID NO: 104951 - protein, 9 aa, Homo Sapiens
VATWDANTE

SEQ ID NO: 104952 - protein, 9 aa, Homo Sapiens
LSSYFLACK

SEQ ID NO: 104953 - protein, 9 aa, Homo Sapiens
SLFFNDRLL

SEQ ID NO: 104954 - protein, 9 aa, Homo Sapiens
TSEVRLYTI

SEQ ID NO: 104955 - protein, 9 aa, Homo Sapiens
STRVRWCRP

SEQ ID NO: 104956 - protein, 9 aa, Homo Sapiens
SEAHLPPIL

SEQ ID NO: 104957 - protein, 9 aa, Homo Sapiens
LQNVEALEG

SEQ ID NO: 104958 - protein, 9 aa, Homo Sapiens
SNPIDNDEE

SEQ ID NO: 104959 - protein, 9 aa, Homo Sapiens
ANTNNLKKT

SEQ ID NO: 104960 - protein, 9 aa, Homo Sapiens
EEVESGKFY

SEQ ID NO: 104961 - protein, 9 aa, Homo Sapiens
NTVVRGLQN

SEQ ID NO: 104962 - protein, 9 aa, Homo Sapiens
SSGAVSTRV

SEQ ID NO: 104963 - protein, 9 aa, Homo Sapiens
HWDGGAEKT

SEQ ID NO: 104964 - protein, 9 aa, Homo Sapiens
VFKIQEVEE

SEQ ID NO: 104965 - protein, 9 aa, Homo Sapiens
MIWQGLDVV

SEQ ID NO: 104966 - protein, 9 aa, Homo Sapiens
KMLTQLSLA

SEQ ID NO: 104967 - protein, 9 aa, Homo Sapiens
VASGSSLPS

SEQ ID NO: 104968 - protein, 9 aa, Homo Sapiens
PHLTWQCHN

SEQ ID NO: 104969 - protein, 9 aa, Homo Sapiens
AVQIHMVVT

SEQ ID NO: 104970 - protein, 9 aa, Homo Sapiens
EGEEINQSL

SEQ ID NO: 104971 - protein, 9 aa, Homo Sapiens
AKQLSHGAV

SEQ ID NO: 104972 - protein, 9 aa, Homo Sapiens
IQEVEEKKK

SEQ ID NO: 104973 - protein, 9 aa, Homo Sapiens
TGRVPPSRQ

SEQ ID NO: 104974 - protein, 9 aa, Homo Sapiens
EQKKTEKHF

SEQ ID NO: 104975 - protein, 9 aa, Homo Sapiens
TTPEEEDLR

SEQ ID NO: 104976 - protein, 9 aa, Homo Sapiens
STPYQNIQC

SEQ ID NO: 104977 - protein, 9 aa, Homo Sapiens
RPPCRCMTS

SEQ ID NO: 104978 - protein, 9 aa, Homo Sapiens
ITDGNSEYL

SEQ ID NO: 104979 - protein, 9 aa, Homo Sapiens
CGTLHLDLT

SEQ ID NO: 104980 - protein, 9 aa, Homo Sapiens
EHKKNNHSN

SEQ ID NO: 104981 - protein, 9 aa, Homo Sapiens
SSLPSSPVS

SEQ ID NO: 104982 - protein, 9 aa, Homo Sapiens
EKHFIQIKL

SEQ ID NO: 104983 - protein, 9 aa, Homo Sapiens
SGKFYGSSP

SEQ ID NO: 104984 - protein, 9 aa, Homo Sapiens
AATSMPGSC

SEQ ID NO: 104985 - protein, 9 aa, Homo Sapiens
AMQALRERL

SEQ ID NO: 104986 - protein, 9 aa, Homo Sapiens
CHRRLHTGK

SEQ ID NO: 104987 - protein, 9 aa, Homo Sapiens
DKTPLQKPT

SEQ ID NO: 104988 - protein, 9 aa, Homo Sapiens
FNDRLLVYG

SEQ ID NO: 104989 - protein, 9 aa, Homo Sapiens
NHSNFLVST

SEQ ID NO: 104990 - protein, 9 aa, Homo Sapiens
RVYIWRMDI

SEQ ID NO: 104991 - protein, 9 aa, Homo Sapiens
EESAEKAQR

SEQ ID NO: 104992 - protein, 9 aa, Homo Sapiens
GPQYQAIGV

SEQ ID NO: 104993 - protein, 9 aa, Homo Sapiens
EEGSAFRHS

SEQ ID NO: 104994 - protein, 9 aa, Homo Sapiens
ILFRSICTE

SEQ ID NO: 104995 - protein, 9 aa, Homo Sapiens
TCHWNGKKM

SEQ ID NO: 104996 - protein, 9 aa, Homo Sapiens
SYFLACKIC

SEQ ID NO: 104997 - protein, 9 aa, Homo Sapiens
IQNKKEDLS

SEQ ID NO: 104998 - protein, 9 aa, Homo Sapiens
KDYTHSKTL

SEQ ID NO: 104999 - protein, 9 aa, Homo Sapiens
SQSSGYGQQ

SEQ ID NO: 105000 - protein, 9 aa, Homo Sapiens
ATSTVPAHK

SEQ ID NO: 105001 - protein, 9 aa, Homo Sapiens
RRSKHAQMK

SEQ ID NO: 105002 - protein, 9 aa, Homo Sapiens
LNEVNRKSL

SEQ ID NO: 105003 - protein, 9 aa, Homo Sapiens
IHQSVIDTN

SEQ ID NO: 105004 - protein, 9 aa, Homo Sapiens
VFLHNLKPL

SEQ ID NO: 105005 - protein, 9 aa, Homo Sapiens
PSEKTTITL

SEQ ID NO: 105006 - protein, 9 aa, Homo Sapiens
FKQVKIENS

SEQ ID NO: 105007 - protein, 9 aa, Homo Sapiens
SLPEKLEYM

SEQ ID NO: 105008 - protein, 9 aa, Homo Sapiens
LAQVSRSAG

SEQ ID NO: 105009 - protein, 9 aa, Homo Sapiens
IEEGSAFRH

SEQ ID NO: 105010 - protein, 9 aa, Homo Sapiens
YEEGKKLRK

SEQ ID NO: 105011 - protein, 9 aa, Homo Sapiens
GSLSCYFPA

SEQ ID NO: 105012 - protein, 9 aa, Homo Sapiens
GDDLTHKFK

SEQ ID NO: 105013 - protein, 9 aa, Homo Sapiens
LSLTHLFLV

SEQ ID NO: 105014 - protein, 9 aa, Homo Sapiens
LAKARSTLV

SEQ ID NO: 105015 - protein, 9 aa, Homo Sapiens
EMAAEDFFQ

SEQ ID NO: 105016 - protein, 9 aa, Homo Sapiens
LYVCGSGTF

SEQ ID NO: 105017 - protein, 9 aa, Homo Sapiens
RCDDHQQGY

SEQ ID NO: 105018 - protein, 9 aa, Homo Sapiens
SKLFLFTWS

SEQ ID NO: 105019 - protein, 9 aa, Homo Sapiens
LKYFRAQSV

SEQ ID NO: 105020 - protein, 9 aa, Homo Sapiens
KKEDLSSIV

SEQ ID NO: 105021 - protein, 9 aa, Homo Sapiens
RLDEDVTDE

SEQ ID NO: 105022 - protein, 9 aa, Homo Sapiens
SANRYLVVL

SEQ ID NO: 105023 - protein, 9 aa, Homo Sapiens
STSDMQSGI

SEQ ID NO: 105024 - protein, 9 aa, Homo Sapiens
NNLKKTTRV

SEQ ID NO: 105025 - protein, 9 aa, Homo Sapiens
ADRVGDLAL

SEQ ID NO: 105026 - protein, 9 aa, Homo Sapiens
ICGDHATGL

SEQ ID NO: 105027 - protein, 9 aa, Homo Sapiens
PNLCQPKKI

SEQ ID NO: 105028 - protein, 9 aa, Homo Sapiens
KKMLSLTHL

SEQ ID NO: 105029 - protein, 9 aa, Homo Sapiens
GFPDGEEDK

SEQ ID NO: 105030 - protein, 9 aa, Homo Sapiens
YWYRQPAGR

SEQ ID NO: 105031 - protein, 9 aa, Homo Sapiens
QNSLMTCLN

SEQ ID NO: 105032 - protein, 9 aa, Homo Sapiens
RQSNKACHD

SEQ ID NO: 105033 - protein, 9 aa, Homo Sapiens
IRWRTSFSA

SEQ ID NO: 105034 - protein, 9 aa, Homo Sapiens
GFSERFFAK

SEQ ID NO: 105035 - protein, 9 aa, Homo Sapiens
QVKIENSPL

SEQ ID NO: 105036 - protein, 9 aa, Homo Sapiens
ALGAVAFSG

SEQ ID NO: 105037 - protein, 9 aa, Homo Sapiens
RVTLSLAML

SEQ ID NO: 105038 - protein, 9 aa, Homo Sapiens
GGRGGGRDR

SEQ ID NO: 105039 - protein, 9 aa, Homo Sapiens
TTRVTKNKL

SEQ ID NO: 105040 - protein, 9 aa, Homo Sapiens
HEDLVYSSY

SEQ ID NO: 105041 - protein, 9 aa, Homo Sapiens
KLEYMVTKY

SEQ ID NO: 105042 - protein, 9 aa, Homo Sapiens
EPHYIPGYA

SEQ ID NO: 105043 - protein, 9 aa, Homo Sapiens
YFLACKICL

SEQ ID NO: 105044 - protein, 9 aa, Homo Sapiens
HLYVCGSGT

SEQ ID NO: 105045 - protein, 9 aa, Homo Sapiens
ANKLGSSFP

SEQ ID NO: 105046 - protein, 9 aa, Homo Sapiens
CTESVGEWP

SEQ ID NO: 105047 - protein, 9 aa, Homo Sapiens
ISQIHQSVI

SEQ ID NO: 105048 - protein, 9 aa, Homo Sapiens
MMQKSLMAF

SEQ ID NO: 105049 - protein, 9 aa, Homo Sapiens
GRRNISRVD

SEQ ID NO: 105050 - protein, 9 aa, Homo Sapiens
QHDVAQRLQ

SEQ ID NO: 105051 - protein, 9 aa, Homo Sapiens
TSDMQSGII

SEQ ID NO: 105052 - protein, 9 aa, Homo Sapiens
SIKPQIFPA

SEQ ID NO: 105053 - protein, 9 aa, Homo Sapiens
LRDCKNLLD

SEQ ID NO: 105054 - protein, 9 aa, Homo Sapiens
NAVQIHMVV

SEQ ID NO: 105055 - protein, 9 aa, Homo Sapiens
DQVELPAGY

SEQ ID NO: 105056 - protein, 9 aa, Homo Sapiens
KMEGEEINQ

SEQ ID NO: 105057 - protein, 9 aa, Homo Sapiens
EDLVYSSYV

SEQ ID NO: 105058 - protein, 9 aa, Homo Sapiens
GGVADAAGK

SEQ ID NO: 105059 - protein, 9 aa, Homo Sapiens
ESAEKAQRS

SEQ ID NO: 105060 - protein, 9 aa, Homo Sapiens
ADRSERQAK

SEQ ID NO: 105061 - protein, 9 aa, Homo Sapiens
RLLCDFCRA

SEQ ID NO: 105062 - protein, 9 aa, Homo Sapiens
HLTWQCHNK

SEQ ID NO: 105063 - protein, 9 aa, Homo Sapiens
VEGLVCMSS

SEQ ID NO: 105064 - protein, 9 aa, Homo Sapiens
MVTVKEDQV

SEQ ID NO: 105065 - protein, 9 aa, Homo Sapiens
YQNIQCNGS

SEQ ID NO: 105066 - protein, 9 aa, Homo Sapiens
ATWDANTER

SEQ ID NO: 105067 - protein, 9 aa, Homo Sapiens
LWLSADRVG

SEQ ID NO: 105068 - protein, 9 aa, Homo Sapiens
NRDPGYSEA

SEQ ID NO: 105069 - protein, 9 aa, Homo Sapiens
KKICKDQKD

SEQ ID NO: 105070 - protein, 9 aa, Homo Sapiens
GATSTVPAH

SEQ ID NO: 105071 - protein, 9 aa, Homo Sapiens
EVVVSRVTL

SEQ ID NO: 105072 - protein, 9 aa, Homo Sapiens
IQIKLLNYL

SEQ ID NO: 105073 - protein, 9 aa, Homo Sapiens
RSKSQDQAT

SEQ ID NO: 105074 - protein, 9 aa, Homo Sapiens
PSLLHDVFH

SEQ ID NO: 105075 - protein, 9 aa, Homo Sapiens
NSEAHLPPI

SEQ ID NO: 105076 - protein, 9 aa, Homo Sapiens
NQLTMIPNT

SEQ ID NO: 105077 - protein, 9 aa, Homo Sapiens
GECTGPPGF

SEQ ID NO: 105078 - protein, 9 aa, Homo Sapiens
CRENLLKSF

SEQ ID NO: 105079 - protein, 9 aa, Homo Sapiens
QEVEEKKKF

SEQ ID NO: 105080 - protein, 9 aa, Homo Sapiens
TIFEMHLAA

SEQ ID NO: 105081 - protein, 9 aa, Homo Sapiens
DSTETLVHV

SEQ ID NO: 105082 - protein, 9 aa, Homo Sapiens
LPCDQCLVP

SEQ ID NO: 105083 - protein, 9 aa, Homo Sapiens
CTGPPGFRG

SEQ ID NO: 105084 - protein, 9 aa, Homo Sapiens
TLHLDLTGT

SEQ ID NO: 105085 - protein, 9 aa, Homo Sapiens
LSKAVATWD

SEQ ID NO: 105086 - protein, 9 aa, Homo Sapiens
EDTIFEMHL

SEQ ID NO: 105087 - protein, 9 aa, Homo Sapiens
IQCNGSSRT

SEQ ID NO: 105088 - protein, 9 aa, Homo Sapiens
ALHNPRPGR

SEQ ID NO: 105089 - protein, 9 aa, Homo Sapiens
KLRKPNYSS

SEQ ID NO: 105090 - protein, 9 aa, Homo Sapiens
VRQGTSSKI

SEQ ID NO: 105091 - protein, 9 aa, Homo Sapiens
ALRDLEAEG

SEQ ID NO: 105092 - protein, 9 aa, Homo Sapiens
YLKREHSLI

SEQ ID NO: 105093 - protein, 9 aa, Homo Sapiens
SRQKPPLPA

SEQ ID NO: 105094 - protein, 9 aa, Homo Sapiens
ASTKVPQCS

SEQ ID NO: 105095 - protein, 9 aa, Homo Sapiens
TFSPVCTYL

SEQ ID NO: 105096 - protein, 9 aa, Homo Sapiens
GKKLRKPNY

SEQ ID NO: 105097 - protein, 9 aa, Homo Sapiens
LFTPEPHYI

SEQ ID NO: 105098 - protein, 9 aa, Homo Sapiens
QSVIDTNVI

SEQ ID NO: 105099 - protein, 9 aa, Homo Sapiens
TEGFSERFF

SEQ ID NO: 105100 - protein, 9 aa, Homo Sapiens
GKSTSLSAF

SEQ ID NO: 105101 - protein, 9 aa, Homo Sapiens
ALRDCKNLL

SEQ ID NO: 105102 - protein, 9 aa, Homo Sapiens
FNCRLDEDV

SEQ ID NO: 105103 - protein, 9 aa, Homo Sapiens
VVAKQLSHG

SEQ ID NO: 105104 - protein, 9 aa, Homo Sapiens
HSLTADRSE

SEQ ID NO: 105105 - protein, 9 aa, Homo Sapiens
PHKKRKRLS

SEQ ID NO: 105106 - protein, 9 aa, Homo Sapiens
ISFGDSVQL

SEQ ID NO: 105107 - protein, 9 aa, Homo Sapiens
RLPCDQCLV

SEQ ID NO: 105108 - protein, 9 aa, Homo Sapiens
RPHKKRKRL

SEQ ID NO: 105109 - protein, 9 aa, Homo Sapiens
DSEEEEEEM

SEQ ID NO: 105110 - protein, 9 aa, Homo Sapiens
LTCSGKHIS

SEQ ID NO: 105111 - protein, 9 aa, Homo Sapiens
ENVWRCWQP

SEQ ID NO: 105112 - protein, 9 aa, Homo Sapiens
TVMSANRYL

SEQ ID NO: 105113 - protein, 9 aa, Homo Sapiens
QFLSLEDST

SEQ ID NO: 105114 - protein, 9 aa, Homo Sapiens
GKHISELIL

SEQ ID NO: 105115 - protein, 9 aa, Homo Sapiens
LEYMVTKYA

SEQ ID NO: 105116 - protein, 9 aa, Homo Sapiens
MGNPRCDDH

SEQ ID NO: 105117 - protein, 9 aa, Homo Sapiens
VCGDDLTHK

SEQ ID NO: 105118 - protein, 9 aa, Homo Sapiens
PRCDDHQQG

SEQ ID NO: 105119 - protein, 9 aa, Homo Sapiens
LSSIVMSTL

SEQ ID NO: 105120 - protein, 9 aa, Homo Sapiens
TRVRWCRPD

SEQ ID NO: 105121 - protein, 9 aa, Homo Sapiens
GGGSLGYGR

SEQ ID NO: 105122 - protein, 9 aa, Homo Sapiens
QYQAIGVTT

SEQ ID NO: 105123 - protein, 9 aa, Homo Sapiens
FRSICTESV

SEQ ID NO: 105124 - protein, 9 aa, Homo Sapiens
AQVPSLFFN

SEQ ID NO: 105125 - protein, 9 aa, Homo Sapiens
RRLKHLLVL

SEQ ID NO: 105126 - protein, 9 aa, Homo Sapiens
TLTETSLHL

SEQ ID NO: 105127 - protein, 9 aa, Homo Sapiens
LSRVYIWRM

SEQ ID NO: 105128 - protein, 9 aa, Homo Sapiens
YFPAQNSLM

SEQ ID NO: 105129 - protein, 9 aa, Homo Sapiens
SELGAGNSG

SEQ ID NO: 105130 - protein, 9 aa, Homo Sapiens
DMEAVEGLV

SEQ ID NO: 105131 - protein, 9 aa, Homo Sapiens
GPGAPDCKY

SEQ ID NO: 105132 - protein, 9 aa, Homo Sapiens
PKKICKDQK

SEQ ID NO: 105133 - protein, 9 aa, Homo Sapiens
SGPVVAMIW

SEQ ID NO: 105134 - protein, 9 aa, Homo Sapiens
VEKVRQSNK

SEQ ID NO: 105135 - protein, 9 aa, Homo Sapiens
TESVGEWPE

SEQ ID NO: 105136 - protein, 9 aa, Homo Sapiens
GNPRCDDHQ

SEQ ID NO: 105137 - protein, 9 aa, Homo Sapiens
CKLFRWPDL

SEQ ID NO: 105138 - protein, 9 aa, Homo Sapiens
KTDFNAKRK

SEQ ID NO: 105139 - protein, 9 aa, Homo Sapiens
ISRVDLLAQ

SEQ ID NO: 105140 - protein, 9 aa, Homo Sapiens
KKTTRVTKN

SEQ ID NO: 105141 - protein, 9 aa, Homo Sapiens
LCQPKKICK

SEQ ID NO: 105142 - protein, 9 aa, Homo Sapiens
GQERVTSVT

SEQ ID NO: 105143 - protein, 9 aa, Homo Sapiens
MSANRYLVV

SEQ ID NO: 105144 - protein, 9 aa, Homo Sapiens
AVAFSGQSQ

SEQ ID NO: 105145 - protein, 9 aa, Homo Sapiens
NIPVLQKEK

SEQ ID NO: 105146 - protein, 9 aa, Homo Sapiens
IFEMHLAAQ

SEQ ID NO: 105147 - protein, 9 aa, Homo Sapiens
LVYSSYVHQ

SEQ ID NO: 105148 - protein, 9 aa, Homo Sapiens
VADAAGKAG

SEQ ID NO: 105149 - protein, 9 aa, Homo Sapiens
SAGVRVGLL

SEQ ID NO: 105150 - protein, 9 aa, Homo Sapiens
DGEEDKTPL

SEQ ID NO: 105151 - protein, 9 aa, Homo Sapiens
LCDFCRAPF

SEQ ID NO: 105152 - protein, 9 aa, Homo Sapiens
HDVFHTTVN

SEQ ID NO: 105153 - protein, 9 aa, Homo Sapiens
HKGLIMELS

SEQ ID NO: 105154 - protein, 9 aa, Homo Sapiens
PVLQKEKDN

SEQ ID NO: 105155 - protein, 9 aa, Homo Sapiens
KTPLQKPTS

SEQ ID NO: 105156 - protein, 9 aa, Homo Sapiens
ENIEESTSF

SEQ ID NO: 105157 - protein, 9 aa, Homo Sapiens
PQIQEMKEY

SEQ ID NO: 105158 - protein, 9 aa, Homo Sapiens
LAVAQRPEP

SEQ ID NO: 105159 - protein, 9 aa, Homo Sapiens
FLGRRSKHA

SEQ ID NO: 105160 - protein, 9 aa, Homo Sapiens
SLTADRSER

SEQ ID NO: 105161 - protein, 9 aa, Homo Sapiens
GKGPGAPDC

SEQ ID NO: 105162 - protein, 9 aa, Homo Sapiens
AVAPGDRIR

SEQ ID NO: 105163 - protein, 9 aa, Homo Sapiens
PLVLAPSEK

SEQ ID NO: 105164 - protein, 9 aa, Homo Sapiens
ELIVFLHNL

SEQ ID NO: 105165 - protein, 9 aa, Homo Sapiens
PRAATSMPG

SEQ ID NO: 105166 - protein, 9 aa, Homo Sapiens
SVVLERQLV

SEQ ID NO: 105167 - protein, 9 aa, Homo Sapiens
QNIQCNGSS

SEQ ID NO: 105168 - protein, 9 aa, Homo Sapiens
SERFFAKWW

SEQ ID NO: 105169 - protein, 9 aa, Homo Sapiens
LAPSEKTTI

SEQ ID NO: 105170 - protein, 9 aa, Homo Sapiens
ARPPCRCMT

SEQ ID NO: 105171 - protein, 9 aa, Homo Sapiens
VILKLCKIH

SEQ ID NO: 105172 - protein, 9 aa, Homo Sapiens
SGLTYRDAE

SEQ ID NO: 105173 - protein, 9 aa, Homo Sapiens
TGPPGFRGA

SEQ ID NO: 105174 - protein, 9 aa, Homo Sapiens
RIKALPSGV

SEQ ID NO: 105175 - protein, 9 aa, Homo Sapiens
PVVAMIWQG

SEQ ID NO: 105176 - protein, 9 aa, Homo Sapiens
HRRLHTGKK

SEQ ID NO: 105177 - protein, 9 aa, Homo Sapiens
ANRYLVVLA

SEQ ID NO: 105178 - protein, 9 aa, Homo Sapiens
SVRQGTSSK

SEQ ID NO: 105179 - protein, 9 aa, Homo Sapiens
LAANKLGSS

SEQ ID NO: 105180 - protein, 9 aa, Homo Sapiens
SVVAKQLSH

SEQ ID NO: 105181 - protein, 9 aa, Homo Sapiens
GRVPPSRQK

SEQ ID NO: 105182 - protein, 9 aa, Homo Sapiens
DCGRLTAAE

SEQ ID NO: 105183 - protein, 9 aa, Homo Sapiens
LIAPFFPPL

SEQ ID NO: 105184 - protein, 9 aa, Homo Sapiens
SEEFKQVKI

SEQ ID NO: 105185 - protein, 9 aa, Homo Sapiens
RDLSCPEGL

SEQ ID NO: 105186 - protein, 9 aa, Homo Sapiens
FNSEAHLPP

SEQ ID NO: 105187 - protein, 9 aa, Homo Sapiens
NGYDLAKAR

SEQ ID NO: 105188 - protein, 9 aa, Homo Sapiens
VIKPRKTRK

SEQ ID NO: 105189 - protein, 9 aa, Homo Sapiens
SLSCYFPAQ

SEQ ID NO: 105190 - protein, 9 aa, Homo Sapiens
WNGKKMLSL

SEQ ID NO: 105191 - protein, 9 aa, Homo Sapiens
ASLSFPDCG

SEQ ID NO: 105192 - protein, 9 aa, Homo Sapiens
TSTVPAHKY

SEQ ID NO: 105193 - protein, 9 aa, Homo Sapiens
CGSGTFSPV

SEQ ID NO: 105194 - protein, 9 aa, Homo Sapiens
YSEAPTEEE

SEQ ID NO: 105195 - protein, 9 aa, Homo Sapiens
SFIKVIKPR

SEQ ID NO: 105196 - protein, 9 aa, Homo Sapiens
GAEKTDFNA

SEQ ID NO: 105197 - protein, 9 aa, Homo Sapiens
LRHCMSKEA

SEQ ID NO: 105198 - protein, 9 aa, Homo Sapiens
QAIGVTTFG

SEQ ID NO: 105199 - protein, 9 aa, Homo Sapiens
DASLIAPFF

SEQ ID NO: 105200 - protein, 9 aa, Homo Sapiens
HLAAQISES

SEQ ID NO: 105201 - protein, 9 aa, Homo Sapiens
TGSMPKPHL

SEQ ID NO: 105202 - protein, 9 aa, Homo Sapiens
SVASGSSLP

SEQ ID NO: 105203 - protein, 9 aa, Homo Sapiens
LERQLVIID

SEQ ID NO: 105204 - protein, 9 aa, Homo Sapiens
ERVTSVTEL

SEQ ID NO: 105205 - protein, 9 aa, Homo Sapiens
LHNLKPLSD

SEQ ID NO: 105206 - protein, 9 aa, Homo Sapiens
VYSSYVHQY

SEQ ID NO: 105207 - protein, 9 aa, Homo Sapiens
PPFLNSPRL

SEQ ID NO: 105208 - protein, 9 aa, Homo Sapiens
RSSGTKYET

SEQ ID NO: 105209 - protein, 9 aa, Homo Sapiens
KRKRLSSSC

SEQ ID NO: 105210 - protein, 9 aa, Homo Sapiens
GDHATGLHY

SEQ ID NO: 105211 - protein, 9 aa, Homo Sapiens
AMIWQGLDV

SEQ ID NO: 105212 - protein, 9 aa, Homo Sapiens
IDTNVILSM

SEQ ID NO: 105213 - protein, 9 aa, Homo Sapiens
RLAQVSRSA

SEQ ID NO: 105214 - protein, 9 aa, Homo Sapiens
RENSNPIDN

SEQ ID NO: 105215 - protein, 9 aa, Homo Sapiens
EKTTITLPM

SEQ ID NO: 105216 - protein, 9 aa, Homo Sapiens
GDSVQLTKC

SEQ ID NO: 105217 - protein, 9 aa, Homo Sapiens
RPGRLLGAP

SEQ ID NO: 105218 - protein, 9 aa, Homo Sapiens
SEYLKREHS

SEQ ID NO: 105219 - protein, 9 aa, Homo Sapiens
YRDLSCPEG

SEQ ID NO: 105220 - protein, 9 aa, Homo Sapiens
YTFEITALN

SEQ ID NO: 105221 - protein, 9 aa, Homo Sapiens
HKKNNHSNF

SEQ ID NO: 105222 - protein, 9 aa, Homo Sapiens
RKRLSSSCR

SEQ ID NO: 105223 - protein, 9 aa, Homo Sapiens
YLSRVYIWR

SEQ ID NO: 105224 - protein, 9 aa, Homo Sapiens
SNYSSLTLS

SEQ ID NO: 105225 - protein, 9 aa, Homo Sapiens
AGKNKPSLE

SEQ ID NO: 105226 - protein, 9 aa, Homo Sapiens
ENSNPIDND

SEQ ID NO: 105227 - protein, 9 aa, Homo Sapiens
SGTVILKLC

SEQ ID NO: 105228 - protein, 9 aa, Homo Sapiens
SLPSSPVSE

SEQ ID NO: 105229 - protein, 9 aa, Homo Sapiens
AETENGKMV

SEQ ID NO: 105230 - protein, 9 aa, Homo Sapiens
DLSSIVMST

SEQ ID NO: 105231 - protein, 9 aa, Homo Sapiens
VEEKKKFEF

SEQ ID NO: 105232 - protein, 9 aa, Homo Sapiens
NRHSLTADR

SEQ ID NO: 105233 - protein, 9 aa, Homo Sapiens
VEQKKTEKH

SEQ ID NO: 105234 - protein, 9 aa, Homo Sapiens
ATSMPGSCP

SEQ ID NO: 105235 - protein, 9 aa, Homo Sapiens
QKQCRENLL

SEQ ID NO: 105236 - protein, 9 aa, Homo Sapiens
LLEKDYSGL

SEQ ID NO: 105237 - protein, 9 aa, Homo Sapiens
IKVIKPRKT

SEQ ID NO: 105238 - protein, 9 aa, Homo Sapiens
LFRWPDLRH

SEQ ID NO: 105239 - protein, 9 aa, Homo Sapiens
GKTFVSTIN

SEQ ID NO: 105240 - protein, 9 aa, Homo Sapiens
FIKVIKPRK

SEQ ID NO: 105241 - protein, 9 aa, Homo Sapiens
GEEDKTPLQ

SEQ ID NO: 105242 - protein, 9 aa, Homo Sapiens
IAETENGKM

SEQ ID NO: 105243 - protein, 9 aa, Homo Sapiens
NLKKTTRVT

SEQ ID NO: 105244 - protein, 9 aa, Homo Sapiens
PAPPTTPEE

SEQ ID NO: 105245 - protein, 9 aa, Homo Sapiens
TENGKMVTV

SEQ ID NO: 105246 - protein, 9 aa, Homo Sapiens
VTGSMPKPH

SEQ ID NO: 105247 - protein, 9 aa, Homo Sapiens
IPGYAGFFP

SEQ ID NO: 105248 - protein, 9 aa, Homo Sapiens
CPRAATSMP

SEQ ID NO: 105249 - protein, 9 aa, Homo Sapiens
PAGRGLQLL

SEQ ID NO: 105250 - protein, 9 aa, Homo Sapiens
NPRCDDHQQ

SEQ ID NO: 105251 - protein, 9 aa, Homo Sapiens
QATKSKSPT

SEQ ID NO: 105252 - protein, 9 aa, Homo Sapiens
FPHRPPGAA

SEQ ID NO: 105253 - protein, 9 aa, Homo Sapiens
QVPSLFFND

SEQ ID NO: 105254 - protein, 9 aa, Homo Sapiens
FSERRLKHL

SEQ ID NO: 105255 - protein, 9 aa, Homo Sapiens
DMQSGIIKN

SEQ ID NO: 105256 - protein, 9 aa, Homo Sapiens
KGLIMELSE

SEQ ID NO: 105257 - protein, 9 aa, Homo Sapiens
TQLAVAQRP

SEQ ID NO: 105258 - protein, 9 aa, Homo Sapiens
AASGECTGP

SEQ ID NO: 105259 - protein, 9 aa, Homo Sapiens
SKHAQMKVE

SEQ ID NO: 105260 - protein, 9 aa, Homo Sapiens
TMIPNTIGN

SEQ ID NO: 105261 - protein, 9 aa, Homo Sapiens
ITKFDASLI

SEQ ID NO: 105262 - protein, 9 aa, Homo Sapiens
ASGPVVAMI

SEQ ID NO: 105263 - protein, 9 aa, Homo Sapiens
WVQAVAPGD

SEQ ID NO: 105264 - protein, 9 aa, Homo Sapiens
KICKDQKDK

SEQ ID NO: 105265 - protein, 9 aa, Homo Sapiens
ICTESVGEW

SEQ ID NO: 105266 - protein, 9 aa, Homo Sapiens
FFTLTETSL

SEQ ID NO: 105267 - protein, 9 aa, Homo Sapiens
ANENAVDAE

SEQ ID NO: 105268 - protein, 9 aa, Homo Sapiens
EEGKKLRKP

SEQ ID NO: 105269 - protein, 9 aa, Homo Sapiens
RSCPRAATS

SEQ ID NO: 105270 - protein, 9 aa, Homo Sapiens
PGGVADAAG

SEQ ID NO: 105271 - protein, 9 aa, Homo Sapiens
PFLNSPRLG

SEQ ID NO: 105272 - protein, 9 aa, Homo Sapiens
KSLKKLASQ

SEQ ID NO: 105273 - protein, 9 aa, Homo Sapiens
LQRAGKNKP

SEQ ID NO: 105274 - protein, 9 aa, Homo Sapiens
PQYQAIGVT

SEQ ID NO: 105275 - protein, 9 aa, Homo Sapiens
ENAVQIHMV

SEQ ID NO: 105276 - protein, 9 aa, Homo Sapiens
KKRKRLSSS

SEQ ID NO: 105277 - protein, 9 aa, Homo Sapiens
EDSTETLVH

SEQ ID NO: 105278 - protein, 9 aa, Homo Sapiens
PTEMAAEDF

SEQ ID NO: 105279 - protein, 9 aa, Homo Sapiens
PGATSTVPA

SEQ ID NO: 105280 - protein, 9 aa, Homo Sapiens
MHLAAQISE

SEQ ID NO: 105281 - protein, 9 aa, Homo Sapiens
CGLWVQAVA

SEQ ID NO: 105282 - protein, 9 aa, Homo Sapiens
GNIPVLQKE

SEQ ID NO: 105283 - protein, 9 aa, Homo Sapiens
IKALPSGVG

SEQ ID NO: 105284 - protein, 9 aa, Homo Sapiens
HLPPILPKD

SEQ ID NO: 105285 - protein, 9 aa, Homo Sapiens
LQHGANENA

SEQ ID NO: 105286 - protein, 9 aa, Homo Sapiens
WLSADRVGD

SEQ ID NO: 105287 - protein, 9 aa, Homo Sapiens
FYGSSPAPP

SEQ ID NO: 105288 - protein, 9 aa, Homo Sapiens
PSLFFNDRL

SEQ ID NO: 105289 - protein, 9 aa, Homo Sapiens
RLTQLAVAQ

SEQ ID NO: 105290 - protein, 9 aa, Homo Sapiens
TSIKPQIFP

SEQ ID NO: 105291 - protein, 9 aa, Homo Sapiens
WQPFSGNKE

SEQ ID NO: 105292 - protein, 9 aa, Homo Sapiens
KNLLDVSCR

SEQ ID NO: 105293 - protein, 9 aa, Homo Sapiens
RGLQNVEAL

SEQ ID NO: 105294 - protein, 9 aa, Homo Sapiens
KSLMAFQGS

SEQ ID NO: 105295 - protein, 9 aa, Homo Sapiens
GKKPGNNKG

SEQ ID NO: 105296 - protein, 9 aa, Homo Sapiens
LEKDYSGLT

SEQ ID NO: 105297 - protein, 9 aa, Homo Sapiens
SIVLKTSQG

SEQ ID NO: 105298 - protein, 9 aa, Homo Sapiens
AEKTDFNAK

SEQ ID NO: 105299 - protein, 9 aa, Homo Sapiens
GKNKPSLES

SEQ ID NO: 105300 - protein, 9 aa, Homo Sapiens
RAGKNKPSL

SEQ ID NO: 105301 - protein, 9 aa, Homo Sapiens
TIRWRTSFS

SEQ ID NO: 105302 - protein, 9 aa, Homo Sapiens
DYLSRVYIW

SEQ ID NO: 105303 - protein, 9 aa, Homo Sapiens
EMLKATMSH

SEQ ID NO: 105304 - protein, 9 aa, Homo Sapiens
IMSEHKKNN

SEQ ID NO: 105305 - protein, 9 aa, Homo Sapiens
DCGLWVQAV

SEQ ID NO: 105306 - protein, 9 aa, Homo Sapiens
IVSFVGKQV

SEQ ID NO: 105307 - protein, 9 aa, Homo Sapiens
TTKSKKNKG

SEQ ID NO: 105308 - protein, 9 aa, Homo Sapiens
QSSNDKDYT

SEQ ID NO: 105309 - protein, 9 aa, Homo Sapiens
KVRQSNKAC

SEQ ID NO: 105310 - protein, 9 aa, Homo Sapiens
SRVYIWRMD

SEQ ID NO: 105311 - protein, 9 aa, Homo Sapiens
RKPGKGPGA

SEQ ID NO: 105312 - protein, 9 aa, Homo Sapiens
QEMKEYLVS

SEQ ID NO: 105313 - protein, 9 aa, Homo Sapiens
QIHMVVTGT

SEQ ID NO: 105314 - protein, 9 aa, Homo Sapiens
LLVLHKSNE

SEQ ID NO: 105315 - protein, 9 aa, Homo Sapiens
TKSKSPTLR

SEQ ID NO: 105316 - protein, 9 aa, Homo Sapiens
RHALGAVAF

SEQ ID NO: 105317 - protein, 9 aa, Homo Sapiens
DPGYSEAPT

SEQ ID NO: 105318 - protein, 9 aa, Homo Sapiens
GNSEYLKRE

SEQ ID NO: 105319 - protein, 9 aa, Homo Sapiens
KIQEVEEKK

SEQ ID NO: 105320 - protein, 9 aa, Homo Sapiens
LVLAPSEKT

SEQ ID NO: 105321 - protein, 9 aa, Homo Sapiens
EKTDFNAKR

SEQ ID NO: 105322 - protein, 9 aa, Homo Sapiens
VEETSTFGI

SEQ ID NO: 105323 - protein, 9 aa, Homo Sapiens
VEHQNLSKT

SEQ ID NO: 105324 - protein, 9 aa, Homo Sapiens
KSTSLSAFL

SEQ ID NO: 105325 - protein, 9 aa, Homo Sapiens
KLCKIHKMH

SEQ ID NO: 105326 - protein, 9 aa, Homo Sapiens
RSICTESVG

SEQ ID NO: 105327 - protein, 9 aa, Homo Sapiens
DFTYTFEIT

SEQ ID NO: 105328 - protein, 9 aa, Homo Sapiens
DQFLSLEDS

SEQ ID NO: 105329 - protein, 9 aa, Homo Sapiens
TKSKKNKGH

SEQ ID NO: 105330 - protein, 9 aa, Homo Sapiens
LLLCKLFRW

SEQ ID NO: 105331 - protein, 9 aa, Homo Sapiens
RCSVLSGGL

SEQ ID NO: 105332 - protein, 9 aa, Homo Sapiens
NSGVVTKVQ

SEQ ID NO: 105333 - protein, 9 aa, Homo Sapiens
KHFIQIKLL

SEQ ID NO: 105334 - protein, 9 aa, Homo Sapiens
AAELQHDVA

SEQ ID NO: 105335 - protein, 9 aa, Homo Sapiens
LIQNKKEDL

SEQ ID NO: 105336 - protein, 9 aa, Homo Sapiens
RTGSGKSTS

SEQ ID NO: 105337 - protein, 9 aa, Homo Sapiens
IENIEESTS

SEQ ID NO: 105338 - protein, 9 aa, Homo Sapiens
KKPGNNKGS

SEQ ID NO: 105339 - protein, 9 aa, Homo Sapiens
PITKFDASL

SEQ ID NO: 105340 - protein, 9 aa, Homo Sapiens
AASLSFPDC

SEQ ID NO: 105341 - protein, 9 aa, Homo Sapiens
ELQHDVAQR

SEQ ID NO: 105342 - protein, 9 aa, Homo Sapiens
TCSGKHISE

SEQ ID NO: 105343 - protein, 9 aa, Homo Sapiens
SLSFPDCGR

SEQ ID NO: 105344 - protein, 9 aa, Homo Sapiens
ILKLCKIHK

SEQ ID NO: 105345 - protein, 9 aa, Homo Sapiens
WRCWQPFSG

SEQ ID NO: 105346 - protein, 9 aa, Homo Sapiens
NTNNLKKTT

SEQ ID NO: 105347 - protein, 9 aa, Homo Sapiens
ETENGKMVT

SEQ ID NO: 105348 - protein, 9 aa, Homo Sapiens
EAVEGLVCM

SEQ ID NO: 105349 - protein, 9 aa, Homo Sapiens
TADRSERQA

SEQ ID NO: 105350 - protein, 9 aa, Homo Sapiens
RGRLLCDFC

SEQ ID NO: 105351 - protein, 9 aa, Homo Sapiens
KNSGTVILK

SEQ ID NO: 105352 - protein, 9 aa, Homo Sapiens
KVTSGCGDT

SEQ ID NO: 105353 - protein, 9 aa, Homo Sapiens
AGCMSKLFL

SEQ ID NO: 105354 - protein, 9 aa, Homo Sapiens
RYSIVLKTS

SEQ ID NO: 105355 - protein, 9 aa, Homo Sapiens
DGGYRDSAF

SEQ ID NO: 105356 - protein, 9 aa, Homo Sapiens
EVNRKSLKK

SEQ ID NO: 105357 - protein, 9 aa, Homo Sapiens
HWNGKKMLS

SEQ ID NO: 105358 - protein, 9 aa, Homo Sapiens
QGSLSCYFP

SEQ ID NO: 105359 - protein, 9 aa, Homo Sapiens
GRDRRALGE

SEQ ID NO: 105360 - protein, 9 aa, Homo Sapiens
PNLYWYRQP

SEQ ID NO: 105361 - protein, 9 aa, Homo Sapiens
APARCSVLS

SEQ ID NO: 105362 - protein, 9 aa, Homo Sapiens
VALPLVEDV

SEQ ID NO: 105363 - protein, 9 aa, Homo Sapiens
STKVPQCSP

SEQ ID NO: 105364 - protein, 9 aa, Homo Sapiens
SGKVTSGCG

SEQ ID NO: 105365 - protein, 9 aa, Homo Sapiens
ETSLHLVFQ

SEQ ID NO: 105366 - protein, 9 aa, Homo Sapiens
EAMQALRER

SEQ ID NO: 105367 - protein, 9 aa, Homo Sapiens
FQGSLSCYF

SEQ ID NO: 105368 - protein, 9 aa, Homo Sapiens
EATEGFSER

SEQ ID NO: 105369 - protein, 9 aa, Homo Sapiens
ECTGPPGFR

SEQ ID NO: 105370 - protein, 9 aa, Homo Sapiens
CDDHQQGYP

SEQ ID NO: 105371 - protein, 9 aa, Homo Sapiens
QLRHCMSKE

SEQ ID NO: 105372 - protein, 9 aa, Homo Sapiens
LICGDHATG

SEQ ID NO: 105373 - protein, 9 aa, Homo Sapiens
AEDFFQRWK

SEQ ID NO: 105374 - protein, 9 aa, Homo Sapiens
GYGPGGVAD

SEQ ID NO: 105375 - protein, 9 aa, Homo Sapiens
APSNYSSLT

SEQ ID NO: 105376 - protein, 9 aa, Homo Sapiens
RRLAQVSRS

SEQ ID NO: 105377 - protein, 9 aa, Homo Sapiens
NEEKINGVV

SEQ ID NO: 105378 - protein, 9 aa, Homo Sapiens
MSEHKKNNH

SEQ ID NO: 105379 - protein, 9 aa, Homo Sapiens
TLSLAMLSD

SEQ ID NO: 105380 - protein, 9 aa, Homo Sapiens
PTTPEEEDL

SEQ ID NO: 105381 - protein, 9 aa, Homo Sapiens
QNKKEDLSS

SEQ ID NO: 105382 - protein, 9 aa, Homo Sapiens
TSLSAFLRL

SEQ ID NO: 105383 - protein, 9 aa, Homo Sapiens
TPEEEDLRR

SEQ ID NO: 105384 - protein, 9 aa, Homo Sapiens
KNTVVRGLQ

SEQ ID NO: 105385 - protein, 9 aa, Homo Sapiens
GPVVAMIWQ

SEQ ID NO: 105386 - protein, 9 aa, Homo Sapiens
KKNKGHKGK

SEQ ID NO: 105387 - protein, 9 aa, Homo Sapiens
LVPTDSSVL

SEQ ID NO: 105388 - protein, 9 aa, Homo Sapiens
NSEYLKREH

SEQ ID NO: 105389 - protein, 9 aa, Homo Sapiens
SGTKYETPI

SEQ ID NO: 105390 - protein, 9 aa, Homo Sapiens
RHCMSKEAE

SEQ ID NO: 105391 - protein, 9 aa, Homo Sapiens
QMAAELQHD

SEQ ID NO: 105392 - protein, 9 aa, Homo Sapiens
AGNSGVVTK

SEQ ID NO: 105393 - protein, 9 aa, Homo Sapiens
LPTIIEEGS

SEQ ID NO: 105394 - protein, 9 aa, Homo Sapiens
ERRLKHLLV

SEQ ID NO: 105395 - protein, 9 aa, Homo Sapiens
SSDIENIEE

SEQ ID NO: 105396 - protein, 9 aa, Homo Sapiens
TLTCSGKHI

SEQ ID NO: 105397 - protein, 9 aa, Homo Sapiens
QVELPAGYP

SEQ ID NO: 105398 - protein, 9 aa, Homo Sapiens
AKIFFSVRQ

SEQ ID NO: 105399 - protein, 9 aa, Homo Sapiens
NLLDVSCRK

SEQ ID NO: 105400 - protein, 9 aa, Homo Sapiens
KNKGHKGKN

SEQ ID NO: 105401 - protein, 9 aa, Homo Sapiens
LLCDFCRAP

SEQ ID NO: 105402 - protein, 9 aa, Homo Sapiens
EVESGKFYG

SEQ ID NO: 105403 - protein, 9 aa, Homo Sapiens
TGSGKSTSL

SEQ ID NO: 105404 - protein, 9 aa, Homo Sapiens
KKNNHSNFL

SEQ ID NO: 105405 - protein, 9 aa, Homo Sapiens
DKDYTHSKT

SEQ ID NO: 105406 - protein, 9 aa, Homo Sapiens
VSFVGKQVT

SEQ ID NO: 105407 - protein, 9 aa, Homo Sapiens
TPQALYRDL

SEQ ID NO: 105408 - protein, 9 aa, Homo Sapiens
GAEAMQALR

SEQ ID NO: 105409 - protein, 9 aa, Homo Sapiens
LTADRSERQ

SEQ ID NO: 105410 - protein, 9 aa, Homo Sapiens
TQVALPLVE

SEQ ID NO: 105411 - protein, 9 aa, Homo Sapiens
YGPGGVADA

SEQ ID NO: 105412 - protein, 9 aa, Homo Sapiens
LKATMSHPL

SEQ ID NO: 105413 - protein, 9 aa, Homo Sapiens
GAGEGSERK

SEQ ID NO: 105414 - protein, 9 aa, Homo Sapiens
RQPAGRGLQ

SEQ ID NO: 105415 - protein, 9 aa, Homo Sapiens
NKGSGAPSP

SEQ ID NO: 105416 - protein, 9 aa, Homo Sapiens
VAFSGQSQH

SEQ ID NO: 105417 - protein, 9 aa, Homo Sapiens
EGSAFRHSP

SEQ ID NO: 105418 - protein, 9 aa, Homo Sapiens
WDANTEREQ

SEQ ID NO: 105419 - protein, 9 aa, Homo Sapiens
MPKPHLTWQ

SEQ ID NO: 105420 - protein, 9 aa, Homo Sapiens
FSVRQGTSS

SEQ ID NO: 105421 - protein, 9 aa, Homo Sapiens
SSTPYQNIQ

SEQ ID NO: 105422 - protein, 9 aa, Homo Sapiens
TPSLLHDVF

SEQ ID NO: 105423 - protein, 9 aa, Homo Sapiens
LSGGLGPFR

SEQ ID NO: 105424 - protein, 9 aa, Homo Sapiens
TNNLKKTTR

SEQ ID NO: 105425 - protein, 9 aa, Homo Sapiens
FLEEISFGD

SEQ ID NO: 105426 - protein, 9 aa, Homo Sapiens
EIEAALRDL

SEQ ID NO: 105427 - protein, 9 aa, Homo Sapiens
DELTQVALP

SEQ ID NO: 105428 - protein, 9 aa, Homo Sapiens
KPGNNKGSG

SEQ ID NO: 105429 - protein, 9 aa, Homo Sapiens
ATEGFSERF

SEQ ID NO: 105430 - protein, 9 aa, Homo Sapiens
VWGAEAMQA

SEQ ID NO: 105431 - protein, 9 aa, Homo Sapiens
ELGAGNSGV

SEQ ID NO: 105432 - protein, 9 aa, Homo Sapiens
TQLSLAENA

SEQ ID NO: 105433 - protein, 9 aa, Homo Sapiens
RPPGAALPS

SEQ ID NO: 105434 - protein, 9 aa, Homo Sapiens
EGLVCMSSW

SEQ ID NO: 105435 - protein, 9 aa, Homo Sapiens
VNYIFNQKE

SEQ ID NO: 105436 - protein, 9 aa, Homo Sapiens
NIQCNGSSR

SEQ ID NO: 105437 - protein, 9 aa, Homo Sapiens
KYFRAQSVR

SEQ ID NO: 105438 - protein, 9 aa, Homo Sapiens
RLLGAPAPP

SEQ ID NO: 105439 - protein, 9 aa, Homo Sapiens
GRGGGRDRR

SEQ ID NO: 105440 - protein, 9 aa, Homo Sapiens
EPGGGSLGY

SEQ ID NO: 105441 - protein, 9 aa, Homo Sapiens
NNHSNFLVS

SEQ ID NO: 105442 - protein, 9 aa, Homo Sapiens
RNISRVDLL

SEQ ID NO: 105443 - protein, 9 aa, Homo Sapiens
IDNDEEEVV

SEQ ID NO: 105444 - protein, 9 aa, Homo Sapiens
ATMSHPLAG

SEQ ID NO: 105445 - protein, 9 aa, Homo Sapiens
SRVTLSLAM

SEQ ID NO: 105446 - protein, 9 aa, Homo Sapiens
RRLHTGKKP

SEQ ID NO: 105447 - protein, 9 aa, Homo Sapiens
SMGITPFFC

SEQ ID NO: 105448 - protein, 9 aa, Homo Sapiens
AENAVQIHM

SEQ ID NO: 105449 - protein, 9 aa, Homo Sapiens
SMPKPHLTW

SEQ ID NO: 105450 - protein, 9 aa, Homo Sapiens
GQSSNDKDY

SEQ ID NO: 105451 - protein, 9 aa, Homo Sapiens
QLSLAENAL

SEQ ID NO: 105452 - protein, 9 aa, Homo Sapiens
RVGDLALLL

SEQ ID NO: 105453 - protein, 9 aa, Homo Sapiens
KHLLVLHKS

SEQ ID NO: 105454 - protein, 9 aa, Homo Sapiens
YIPGYAGFF

SEQ ID NO: 105455 - protein, 9 aa, Homo Sapiens
ESVGEWPEF

SEQ ID NO: 105456 - protein, 9 aa, Homo Sapiens
MVVTGTMAL

SEQ ID NO: 105457 - protein, 9 aa, Homo Sapiens
IGSLAANKL

SEQ ID NO: 105458 - protein, 9 aa, Homo Sapiens
DRRALGEAN

SEQ ID NO: 105459 - protein, 9 aa, Homo Sapiens
GAGNSGVVT

SEQ ID NO: 105460 - protein, 9 aa, Homo Sapiens
PPILPKDKK

SEQ ID NO: 105461 - protein, 9 aa, Homo Sapiens
SDIENIEES

SEQ ID NO: 105462 - protein, 9 aa, Homo Sapiens
SLSAFLRLL

SEQ ID NO: 105463 - protein, 9 aa, Homo Sapiens
LPAGYPPAI

SEQ ID NO: 105464 - protein, 9 aa, Homo Sapiens
KNKPSLESD

SEQ ID NO: 105465 - protein, 9 aa, Homo Sapiens
AQVSRSAGV

SEQ ID NO: 105466 - protein, 9 aa, Homo Sapiens
SGKHISELI

SEQ ID NO: 105467 - protein, 9 aa, Homo Sapiens
YRQPAGRGL

SEQ ID NO: 105468 - protein, 9 aa, Homo Sapiens
LKELIVFLH

SEQ ID NO: 105469 - protein, 9 aa, Homo Sapiens
QCNGSSRTA

SEQ ID NO: 105470 - protein, 9 aa, Homo Sapiens
TDMEAVEGL

SEQ ID NO: 105471 - protein, 9 aa, Homo Sapiens
APPTTPEEE

SEQ ID NO: 105472 - protein, 9 aa, Homo Sapiens
NEIEAALRD

SEQ ID NO: 105473 - protein, 9 aa, Homo Sapiens
QLSHGAVIE

SEQ ID NO: 105474 - protein, 9 aa, Homo Sapiens
DLEAEGVKL

SEQ ID NO: 105475 - protein, 9 aa, Homo Sapiens
YSGLTYRDA

SEQ ID NO: 105476 - protein, 9 aa, Homo Sapiens
KPHLTWQCH

SEQ ID NO: 105477 - protein, 9 aa, Homo Sapiens
IVSGKVTSG

SEQ ID NO: 105478 - protein, 9 aa, Homo Sapiens
KMVTVKEDQ

SEQ ID NO: 105479 - protein, 9 aa, Homo Sapiens
YSIVLKTSQ

SEQ ID NO: 105480 - protein, 9 aa, Homo Sapiens
TPYQNIQCN

SEQ ID NO: 105481 - protein, 9 aa, Homo Sapiens
VELPAGYPP

SEQ ID NO: 105482 - protein, 9 aa, Homo Sapiens
SGQSSNDKD

SEQ ID NO: 105483 - protein, 9 aa, Homo Sapiens
DYTHSKTLP

SEQ ID NO: 105484 - protein, 9 aa, Homo Sapiens
TPFFCGKCQ

SEQ ID NO: 105485 - protein, 9 aa, Homo Sapiens
LGAGNSGVV

SEQ ID NO: 105486 - protein, 9 aa, Homo Sapiens
LLEALSSYF

SEQ ID NO: 105487 - protein, 9 aa, Homo Sapiens
ERKPRMPVL

SEQ ID NO: 105488 - protein, 9 aa, Homo Sapiens
EIFNCRLDE

SEQ ID NO: 105489 - protein, 9 aa, Homo Sapiens
VVAMIWQGL

SEQ ID NO: 105490 - protein, 9 aa, Homo Sapiens
NKPSLESDE

SEQ ID NO: 105491 - protein, 9 aa, Homo Sapiens
FLTVMSANR

SEQ ID NO: 105492 - protein, 9 aa, Homo Sapiens
GPPGFRGAR

SEQ ID NO: 105493 - protein, 9 aa, Homo Sapiens
IEAALRDLE

SEQ ID NO: 105494 - protein, 9 aa, Homo Sapiens
QDGGYRDSA

SEQ ID NO: 105495 - protein, 9 aa, Homo Sapiens
PGENVWRCW

SEQ ID NO: 105496 - protein, 9 aa, Homo Sapiens
PSPAPPTTP

SEQ ID NO: 105497 - protein, 9 aa, Homo Sapiens
ALYRDLSCP

SEQ ID NO: 105498 - protein, 9 aa, Homo Sapiens
KILNRDPGY

SEQ ID NO: 105499 - protein, 9 aa, Homo Sapiens
RHSLTADRS

SEQ ID NO: 105500 - protein, 9 aa, Homo Sapiens
SGECTGPPG

SEQ ID NO: 105501 - protein, 9 aa, Homo Sapiens
YMVTKYAEH

SEQ ID NO: 105502 - protein, 9 aa, Homo Sapiens
PTPQALYRD

SEQ ID NO: 105503 - protein, 9 aa, Homo Sapiens
KALPSGVGA

SEQ ID NO: 105504 - protein, 9 aa, Homo Sapiens
YGSSPAPPS

SEQ ID NO: 105505 - protein, 9 aa, Homo Sapiens
STSLSAFLR

SEQ ID NO: 105506 - protein, 9 aa, Homo Sapiens
SKKNKGHKG

SEQ ID NO: 105507 - protein, 9 aa, Homo Sapiens
FGQERVTSV

SEQ ID NO: 105508 - protein, 9 aa, Homo Sapiens
RDRRALGEA

SEQ ID NO: 105509 - protein, 9 aa, Homo Sapiens
ARSCPRAAT

SEQ ID NO: 105510 - protein, 9 aa, Homo Sapiens
KSQDQATKS

SEQ ID NO: 105511 - protein, 9 aa, Homo Sapiens
QLAVAQRPE

SEQ ID NO: 105512 - protein, 9 aa, Homo Sapiens
QPKKICKDQ

SEQ ID NO: 105513 - protein, 9 aa, Homo Sapiens
YGRPPEESA

SEQ ID NO: 105514 - protein, 9 aa, Homo Sapiens
GRLLCDFCR

SEQ ID NO: 105515 - protein, 9 aa, Homo Sapiens
KRLSSSCRK

SEQ ID NO: 105516 - protein, 9 aa, Homo Sapiens
DSAFQPGGY

SEQ ID NO: 105517 - protein, 9 aa, Homo Sapiens
PEKLEYMVT

SEQ ID NO: 105518 - protein, 9 aa, Homo Sapiens
TVILKLCKI

SEQ ID NO: 105519 - protein, 9 aa, Homo Sapiens
LLKYFRAQS

SEQ ID NO: 105520 - protein, 9 aa, Homo Sapiens
TDGNSEYLK

SEQ ID NO: 105521 - protein, 9 aa, Homo Sapiens
ESGKFYGSS

SEQ ID NO: 105522 - protein, 9 aa, Homo Sapiens
MEGEEINQS

SEQ ID NO: 105523 - protein, 9 aa, Homo Sapiens
SPRLGPGLQ

SEQ ID NO: 105524 - protein, 9 aa, Homo Sapiens
PFGQERVTS

SEQ ID NO: 105525 - protein, 9 aa, Homo Sapiens
GSGKSTSLS

SEQ ID NO: 105526 - protein, 9 aa, Homo Sapiens
FVGKQVTIR

SEQ ID NO: 105527 - protein, 9 aa, Homo Sapiens
VVGPPGATS

SEQ ID NO: 105528 - protein, 9 aa, Homo Sapiens
GKVTSGCGD

SEQ ID NO: 105529 - protein, 9 aa, Homo Sapiens
KTSIKPQIF

SEQ ID NO: 105530 - protein, 9 aa, Homo Sapiens
NPIDNDEEE

SEQ ID NO: 105531 - protein, 9 aa, Homo Sapiens
GPSPAPPTT

SEQ ID NO: 105532 - protein, 9 aa, Homo Sapiens
GKMVTVKED

SEQ ID NO: 105533 - protein, 9 aa, Homo Sapiens
DDNQLTMIP

SEQ ID NO: 105534 - protein, 9 aa, Homo Sapiens
PSNYSSLTL

SEQ ID NO: 105535 - protein, 9 aa, Homo Sapiens
NRFFTLTET

SEQ ID NO: 105536 - protein, 9 aa, Homo Sapiens
MEAVEGLVC

SEQ ID NO: 105537 - protein, 9 aa, Homo Sapiens
AQNSLMTCL

SEQ ID NO: 105538 - protein, 9 aa, Homo Sapiens
GRLLGAPAP

SEQ ID NO: 105539 - protein, 9 aa, Homo Sapiens
QLVIIDELI

SEQ ID NO: 105540 - protein, 9 aa, Homo Sapiens
LSLEDSTET

SEQ ID NO: 105541 - protein, 9 aa, Homo Sapiens
SRYSIVLKT

SEQ ID NO: 105542 - protein, 9 aa, Homo Sapiens
RFFTLTETS

SEQ ID NO: 105543 - protein, 9 aa, Homo Sapiens
NYIFNQKEI

SEQ ID NO: 105544 - protein, 9 aa, Homo Sapiens
DQCLVPTDS

SEQ ID NO: 105545 - protein, 9 aa, Homo Sapiens
NLCQPKKIC

SEQ ID NO: 105546 - protein, 9 aa, Homo Sapiens
GPGGVADAA

SEQ ID NO: 105547 - protein, 9 aa, Homo Sapiens
VGAHQHLKT

SEQ ID NO: 105548 - protein, 9 aa, Homo Sapiens
KATMSHPLA

SEQ ID NO: 105549 - protein, 9 aa, Homo Sapiens
PAQVPSLFF

SEQ ID NO: 105550 - protein, 9 aa, Homo Sapiens
DRSERQAKE

SEQ ID NO: 105551 - protein, 9 aa, Homo Sapiens
LTVMSANRY

SEQ ID NO: 105552 - protein, 9 aa, Homo Sapiens
EDQFLSLED

SEQ ID NO: 105553 - protein, 9 aa, Homo Sapiens
ISYAGCMSK

SEQ ID NO: 105554 - protein, 9 aa, Homo Sapiens
MQSGIIKNT

SEQ ID NO: 105555 - protein, 9 aa, Homo Sapiens
AHEDLVYSS

SEQ ID NO: 105556 - protein, 9 aa, Homo Sapiens
VTLSLAMLS

SEQ ID NO: 105557 - protein, 9 aa, Homo Sapiens
SKAVATWDA

SEQ ID NO: 105558 - protein, 9 aa, Homo Sapiens
QIHQSVIDT

SEQ ID NO: 105559 - protein, 9 aa, Homo Sapiens
GGRDRRALG

SEQ ID NO: 105560 - protein, 9 aa, Homo Sapiens
GAALPSLMP

SEQ ID NO: 105561 - protein, 9 aa, Homo Sapiens
ARSTLVPQG

SEQ ID NO: 105562 - protein, 9 aa, Homo Sapiens
LFRSICTES

SEQ ID NO: 105563 - protein, 9 aa, Homo Sapiens
CEDTIFEMH

SEQ ID NO: 105564 - protein, 9 aa, Homo Sapiens
FDASLIAPF

SEQ ID NO: 105565 - protein, 9 aa, Homo Sapiens
TKMEGEEIN

SEQ ID NO: 105566 - protein, 9 aa, Homo Sapiens
SLGYGRPPE

SEQ ID NO: 105567 - protein, 9 aa, Homo Sapiens
EDLLKYFRA

SEQ ID NO: 105568 - protein, 9 aa, Homo Sapiens
SGKSTSLSA

SEQ ID NO: 105569 - protein, 9 aa, Homo Sapiens
EEKKKFEFV

SEQ ID NO: 105570 - protein, 9 aa, Homo Sapiens
VSTINSLVF

SEQ ID NO: 105571 - protein, 9 aa, Homo Sapiens
EKDNTNVNA

SEQ ID NO: 105572 - protein, 9 aa, Homo Sapiens
LRDLEAEGV

SEQ ID NO: 105573 - protein, 9 aa, Homo Sapiens
CFMLNFTVK

SEQ ID NO: 105574 - protein, 9 aa, Homo Sapiens
LEGISSSGD

SEQ ID NO: 105575 - protein, 9 aa, Homo Sapiens
MPPVLGEVG

SEQ ID NO: 105576 - protein, 9 aa, Homo Sapiens
KVSSSLINF

SEQ ID NO: 105577 - protein, 9 aa, Homo Sapiens
VDLPVRHHS

SEQ ID NO: 105578 - protein, 9 aa, Homo Sapiens
SLVVFSACC

SEQ ID NO: 105579 - protein, 9 aa, Homo Sapiens
LTSHTGEKP

SEQ ID NO: 105580 - protein, 9 aa, Homo Sapiens
SCDFEDVPN

SEQ ID NO: 105581 - protein, 9 aa, Homo Sapiens
SRSSSYSYG

SEQ ID NO: 105582 - protein, 9 aa, Homo Sapiens
RRKHEKFIA

SEQ ID NO: 105583 - protein, 9 aa, Homo Sapiens
VRAKEMFVT

SEQ ID NO: 105584 - protein, 9 aa, Homo Sapiens
PIYSCDFED

SEQ ID NO: 105585 - protein, 9 aa, Homo Sapiens
SWTKAMASL

SEQ ID NO: 105586 - protein, 9 aa, Homo Sapiens
TPKPQVVDE

SEQ ID NO: 105587 - protein, 9 aa, Homo Sapiens
RQESLCRFK

SEQ ID NO: 105588 - protein, 9 aa, Homo Sapiens
SCGLNPKLQ

SEQ ID NO: 105589 - protein, 9 aa, Homo Sapiens
AWKAQLENH

SEQ ID NO: 105590 - protein, 9 aa, Homo Sapiens
GPESGILSS

SEQ ID NO: 105591 - protein, 9 aa, Homo Sapiens
GQSLEGISS

SEQ ID NO: 105592 - protein, 9 aa, Homo Sapiens
LPVRHHSYG

SEQ ID NO: 105593 - protein, 9 aa, Homo Sapiens
KMDVILILE

SEQ ID NO: 105594 - protein, 9 aa, Homo Sapiens
SAETIKELR

SEQ ID NO: 105595 - protein, 9 aa, Homo Sapiens
TYNSILTTH

SEQ ID NO: 105596 - protein, 9 aa, Homo Sapiens
KCLRKRRGQ

SEQ ID NO: 105597 - protein, 9 aa, Homo Sapiens
KECGEAFSS

SEQ ID NO: 105598 - protein, 9 aa, Homo Sapiens
KSKEELTEH

SEQ ID NO: 105599 - protein, 9 aa, Homo Sapiens
GIRPSMEIN

SEQ ID NO: 105600 - protein, 9 aa, Homo Sapiens
ARECVVCAK

SEQ ID NO: 105601 - protein, 9 aa, Homo Sapiens
MEINRMIPG

SEQ ID NO: 105602 - protein, 9 aa, Homo Sapiens
LQKELERLH

SEQ ID NO: 105603 - protein, 9 aa, Homo Sapiens
GFSKSMSAE

SEQ ID NO: 105604 - protein, 9 aa, Homo Sapiens
IYIENSNET

SEQ ID NO: 105605 - protein, 9 aa, Homo Sapiens
AIAFINSLH

SEQ ID NO: 105606 - protein, 9 aa, Homo Sapiens
AEEEEEMNA

SEQ ID NO: 105607 - protein, 9 aa, Homo Sapiens
ACKNVKFVL

SEQ ID NO: 105608 - protein, 9 aa, Homo Sapiens
YGTKDSLGG

SEQ ID NO: 105609 - protein, 9 aa, Homo Sapiens
TGFKTSTKM

SEQ ID NO: 105610 - protein, 9 aa, Homo Sapiens
CDFEDVPNK

SEQ ID NO: 105611 - protein, 9 aa, Homo Sapiens
VSSSLINFG

SEQ ID NO: 105612 - protein, 9 aa, Homo Sapiens
ESERSEEEE

SEQ ID NO: 105613 - protein, 9 aa, Homo Sapiens
TYLVAFACK

SEQ ID NO: 105614 - protein, 9 aa, Homo Sapiens
GAALALASV

SEQ ID NO: 105615 - protein, 9 aa, Homo Sapiens
PKLQKCGLG

SEQ ID NO: 105616 - protein, 9 aa, Homo Sapiens
DKSDSEQLT

SEQ ID NO: 105617 - protein, 9 aa, Homo Sapiens
LFTSQIFKL

SEQ ID NO: 105618 - protein, 9 aa, Homo Sapiens
ERSEEEEED

SEQ ID NO: 105619 - protein, 9 aa, Homo Sapiens
SLLASHYDS

SEQ ID NO: 105620 - protein, 9 aa, Homo Sapiens
EVQVKKLQK

SEQ ID NO: 105621 - protein, 9 aa, Homo Sapiens
SCINTECLD

SEQ ID NO: 105622 - protein, 9 aa, Homo Sapiens
DMLVAELKA

SEQ ID NO: 105623 - protein, 9 aa, Homo Sapiens
SSLLASHYD

SEQ ID NO: 105624 - protein, 9 aa, Homo Sapiens
LLASHYDSP

SEQ ID NO: 105625 - protein, 9 aa, Homo Sapiens
RSEEEEEDG

SEQ ID NO: 105626 - protein, 9 aa, Homo Sapiens
NWRRKHEKF

SEQ ID NO: 105627 - protein, 9 aa, Homo Sapiens
SMEINRMIP

SEQ ID NO: 105628 - protein, 9 aa, Homo Sapiens
ETYNSILTT

SEQ ID NO: 105629 - protein, 9 aa, Homo Sapiens
LNINKVSSS

SEQ ID NO: 105630 - protein, 9 aa, Homo Sapiens
AQEAWKAQL

SEQ ID NO: 105631 - protein, 9 aa, Homo Sapiens
DLGLCVSEL

SEQ ID NO: 105632 - protein, 9 aa, Homo Sapiens
ELAKQMEDA

SEQ ID NO: 105633 - protein, 9 aa, Homo Sapiens
SISSELFEL

SEQ ID NO: 105634 - protein, 9 aa, Homo Sapiens
DLPVRHHSY

SEQ ID NO: 105635 - protein, 9 aa, Homo Sapiens
QLTLRIHRK

SEQ ID NO: 105636 - protein, 9 aa, Homo Sapiens
SEQLTLRIH

SEQ ID NO: 105637 - protein, 9 aa, Homo Sapiens
QESHEQSAE

SEQ ID NO: 105638 - protein, 9 aa, Homo Sapiens
CLDIEDKSC

SEQ ID NO: 105639 - protein, 9 aa, Homo Sapiens
ISMRHAFVT

SEQ ID NO: 105640 - protein, 9 aa, Homo Sapiens
ECGEAFSSG

SEQ ID NO: 105641 - protein, 9 aa, Homo Sapiens
YLVAFACKN

SEQ ID NO: 105642 - protein, 9 aa, Homo Sapiens
ESNQIGPES

SEQ ID NO: 105643 - protein, 9 aa, Homo Sapiens
EGIRPSMEI

SEQ ID NO: 105644 - protein, 9 aa, Homo Sapiens
SSLINFGRK

SEQ ID NO: 105645 - protein, 9 aa, Homo Sapiens
LAKQMEDAY

SEQ ID NO: 105646 - protein, 9 aa, Homo Sapiens
FSACCGGFR

SEQ ID NO: 105647 - protein, 9 aa, Homo Sapiens
VVETYNSIL

SEQ ID NO: 105648 - protein, 9 aa, Homo Sapiens
DFDMLVAEL

SEQ ID NO: 105649 - protein, 9 aa, Homo Sapiens
VQVKKLQKE

SEQ ID NO: 105650 - protein, 9 aa, Homo Sapiens
ASLFSINKE

SEQ ID NO: 105651 - protein, 9 aa, Homo Sapiens
RKARSRSSS

SEQ ID NO: 105652 - protein, 9 aa, Homo Sapiens
IHAKYQRLR

SEQ ID NO: 105653 - protein, 9 aa, Homo Sapiens
TARQESLCR

SEQ ID NO: 105654 - protein, 9 aa, Homo Sapiens
LRAVDLPVR

SEQ ID NO: 105655 - protein, 9 aa, Homo Sapiens
DPFMYYYVS

SEQ ID NO: 105656 - protein, 9 aa, Homo Sapiens
LNEEAGAAL

SEQ ID NO: 105657 - protein, 9 aa, Homo Sapiens
NQIGPESGI

SEQ ID NO: 105658 - protein, 9 aa, Homo Sapiens
IGPESGILS

SEQ ID NO: 105659 - protein, 9 aa, Homo Sapiens
TKMKGSDTE

SEQ ID NO: 105660 - protein, 9 aa, Homo Sapiens
SLFSINKEV

SEQ ID NO: 105661 - protein, 9 aa, Homo Sapiens
RSSSYSYGP

SEQ ID NO: 105662 - protein, 9 aa, Homo Sapiens
FSKISTLTF

SEQ ID NO: 105663 - protein, 9 aa, Homo Sapiens
PQVLSELNE

SEQ ID NO: 105664 - protein, 9 aa, Homo Sapiens
FVMPPVLGE

SEQ ID NO: 105665 - protein, 9 aa, Homo Sapiens
HAFVTFPGG

SEQ ID NO: 105666 - protein, 9 aa, Homo Sapiens
SLYIHAKYQ

SEQ ID NO: 105667 - protein, 9 aa, Homo Sapiens
MSAETIKEL

SEQ ID NO: 105668 - protein, 9 aa, Homo Sapiens
SSSEESERS

SEQ ID NO: 105669 - protein, 9 aa, Homo Sapiens
LTLHLTSHT

SEQ ID NO: 105670 - protein, 9 aa, Homo Sapiens
PPVLGEVGG

SEQ ID NO: 105671 - protein, 9 aa, Homo Sapiens
AALALASVL

SEQ ID NO: 105672 - protein, 9 aa, Homo Sapiens
IREYVPQLL

SEQ ID NO: 105673 - protein, 9 aa, Homo Sapiens
WKIRELAKQ

SEQ ID NO: 105674 - protein, 9 aa, Homo Sapiens
YEWYNPQPC

SEQ ID NO: 105675 - protein, 9 aa, Homo Sapiens
TLTFHQRIH

SEQ ID NO: 105676 - protein, 9 aa, Homo Sapiens
LGLCVSELE

SEQ ID NO: 105677 - protein, 9 aa, Homo Sapiens
FHYGTKDSL

SEQ ID NO: 105678 - protein, 9 aa, Homo Sapiens
DGQSLEGIS

SEQ ID NO: 105679 - protein, 9 aa, Homo Sapiens
PPYTGVWLE

SEQ ID NO: 105680 - protein, 9 aa, Homo Sapiens
EAWKAQLEN

SEQ ID NO: 105681 - protein, 9 aa, Homo Sapiens
SERSEEEEE

SEQ ID NO: 105682 - protein, 9 aa, Homo Sapiens
KSSVLKSKQ

SEQ ID NO: 105683 - protein, 9 aa, Homo Sapiens
LQNCVAQAS

SEQ ID NO: 105684 - protein, 9 aa, Homo Sapiens
CINTECLDI

SEQ ID NO: 105685 - protein, 9 aa, Homo Sapiens
CGRGWLRAM

SEQ ID NO: 105686 - protein, 9 aa, Homo Sapiens
ARQESLCRF

SEQ ID NO: 105687 - protein, 9 aa, Homo Sapiens
KARSRSSSY

SEQ ID NO: 105688 - protein, 9 aa, Homo Sapiens
DSEQLTLRI

SEQ ID NO: 105689 - protein, 9 aa, Homo Sapiens
SVLKSKQES

SEQ ID NO: 105690 - protein, 9 aa, Homo Sapiens
EGTLRAVDL

SEQ ID NO: 105691 - protein, 9 aa, Homo Sapiens
TLHLTSHTG

SEQ ID NO: 105692 - protein, 9 aa, Homo Sapiens
LASHYDSPI

SEQ ID NO: 105693 - protein, 9 aa, Homo Sapiens
SLEFLDKME

SEQ ID NO: 105694 - protein, 9 aa, Homo Sapiens
EYLPIYIEN

SEQ ID NO: 105695 - protein, 9 aa, Homo Sapiens
HLTSHTGEK

SEQ ID NO: 105696 - protein, 9 aa, Homo Sapiens
ESLEFLDKM

SEQ ID NO: 105697 - protein, 9 aa, Homo Sapiens
RKHEKFIAT

SEQ ID NO: 105698 - protein, 9 aa, Homo Sapiens
SLEGISSSG

SEQ ID NO: 105699 - protein, 9 aa, Homo Sapiens
LDIEDKSCD

SEQ ID NO: 105700 - protein, 9 aa, Homo Sapiens
NPQPCNPDS

SEQ ID NO: 105701 - protein, 9 aa, Homo Sapiens
MKGSDTESE

SEQ ID NO: 105702 - protein, 9 aa, Homo Sapiens
AAPRGVCYG

SEQ ID NO: 105703 - protein, 9 aa, Homo Sapiens
ESGILSSTT

SEQ ID NO: 105704 - protein, 9 aa, Homo Sapiens
LQKCGLGQE

SEQ ID NO: 105705 - protein, 9 aa, Homo Sapiens
ATVRAKEMF

SEQ ID NO: 105706 - protein, 9 aa, Homo Sapiens
GFKTSTKMK

SEQ ID NO: 105707 - protein, 9 aa, Homo Sapiens
GWSFGLPFT

SEQ ID NO: 105708 - protein, 9 aa, Homo Sapiens
FKRKARSRS

SEQ ID NO: 105709 - protein, 9 aa, Homo Sapiens
KKPTPKPQV

SEQ ID NO: 105710 - protein, 9 aa, Homo Sapiens
KLQKELERL

SEQ ID NO: 105711 - protein, 9 aa, Homo Sapiens
TSHTGEKPY

SEQ ID NO: 105712 - protein, 9 aa, Homo Sapiens
PFMYYYVSA

SEQ ID NO: 105713 - protein, 9 aa, Homo Sapiens
GTKDSLGGF

SEQ ID NO: 105714 - protein, 9 aa, Homo Sapiens
NTECLDIED

SEQ ID NO: 105715 - protein, 9 aa, Homo Sapiens
YTGVWLEDR

SEQ ID NO: 105716 - protein, 9 aa, Homo Sapiens
KGDLGLCVS

SEQ ID NO: 105717 - protein, 9 aa, Homo Sapiens
PIYIENSNE

SEQ ID NO: 105718 - protein, 9 aa, Homo Sapiens
IASLTLHLT

SEQ ID NO: 105719 - protein, 9 aa, Homo Sapiens
FACKNVKFV

SEQ ID NO: 105720 - protein, 9 aa, Homo Sapiens
HYGTKDSLG

SEQ ID NO: 105721 - protein, 9 aa, Homo Sapiens
SCVDPFMYY

SEQ ID NO: 105722 - protein, 9 aa, Homo Sapiens
QIQEAIAFI

SEQ ID NO: 105723 - protein, 9 aa, Homo Sapiens
EELPIYSCD

SEQ ID NO: 105724 - protein, 9 aa, Homo Sapiens
SELELLSSW

SEQ ID NO: 105725 - protein, 9 aa, Homo Sapiens
EEEVEEEGG

SEQ ID NO: 105726 - protein, 9 aa, Homo Sapiens
EQLTLRIHR

SEQ ID NO: 105727 - protein, 9 aa, Homo Sapiens
DKMELLEQL

SEQ ID NO: 105728 - protein, 9 aa, Homo Sapiens
SMRHAFVTF

SEQ ID NO: 105729 - protein, 9 aa, Homo Sapiens
HYDSPINSA

SEQ ID NO: 105730 - protein, 9 aa, Homo Sapiens
ELEAQEAWK

SEQ ID NO: 105731 - protein, 9 aa, Homo Sapiens
CVVCAKGEV

SEQ ID NO: 105732 - protein, 9 aa, Homo Sapiens
TKDSLGGFA

SEQ ID NO: 105733 - protein, 9 aa, Homo Sapiens
GLCVSELEL

SEQ ID NO: 105734 - protein, 9 aa, Homo Sapiens
LYIHAKYQR

SEQ ID NO: 105735 - protein, 9 aa, Homo Sapiens
SDSEQLTLR

SEQ ID NO: 105736 - protein, 9 aa, Homo Sapiens
RSSLLASHY

SEQ ID NO: 105737 - protein, 9 aa, Homo Sapiens
LALASVLCL

SEQ ID NO: 105738 - protein, 9 aa, Homo Sapiens
EEGGEEDVF

SEQ ID NO: 105739 - protein, 9 aa, Homo Sapiens
AHPDCFMLN

SEQ ID NO: 105740 - protein, 9 aa, Homo Sapiens
VWLEDRKIC

SEQ ID NO: 105741 - protein, 9 aa, Homo Sapiens
ENKMDVILI

SEQ ID NO: 105742 - protein, 9 aa, Homo Sapiens
WTKAMASLF

SEQ ID NO: 105743 - protein, 9 aa, Homo Sapiens
LVVFSACCG

SEQ ID NO: 105744 - protein, 9 aa, Homo Sapiens
PLNINKVSS

SEQ ID NO: 105745 - protein, 9 aa, Homo Sapiens
GGCIYTARQ

SEQ ID NO: 105746 - protein, 9 aa, Homo Sapiens
CGEAFSSGS

SEQ ID NO: 105747 - protein, 9 aa, Homo Sapiens
CGGFRGVLK

SEQ ID NO: 105748 - protein, 9 aa, Homo Sapiens
KAMASLFSI

SEQ ID NO: 105749 - protein, 9 aa, Homo Sapiens
AFVTFPGGS

SEQ ID NO: 105750 - protein, 9 aa, Homo Sapiens
VSELELLSS

SEQ ID NO: 105751 - protein, 9 aa, Homo Sapiens
FMLNFTVKL

SEQ ID NO: 105752 - protein, 9 aa, Homo Sapiens
KQESHEQSA

SEQ ID NO: 105753 - protein, 9 aa, Homo Sapiens
IYSCDFEDV

SEQ ID NO: 105754 - protein, 9 aa, Homo Sapiens
FLDKMELLE

SEQ ID NO: 105755 - protein, 9 aa, Homo Sapiens
EINRMIPGS

SEQ ID NO: 105756 - protein, 9 aa, Homo Sapiens
NINKVSSSL

SEQ ID NO: 105757 - protein, 9 aa, Homo Sapiens
VQKSLYIHA

SEQ ID NO: 105758 - protein, 9 aa, Homo Sapiens
RGVCYGADH

SEQ ID NO: 105759 - protein, 9 aa, Homo Sapiens
YTARQESLC

SEQ ID NO: 105760 - protein, 9 aa, Homo Sapiens
KSMSAETIK

SEQ ID NO: 105761 - protein, 9 aa, Homo Sapiens
TPYEWYNPQ

SEQ ID NO: 105762 - protein, 9 aa, Homo Sapiens
LPIYSCDFE

SEQ ID NO: 105763 - protein, 9 aa, Homo Sapiens
DLFTSQIFK

SEQ ID NO: 105764 - protein, 9 aa, Homo Sapiens
LHLTSHTGE

SEQ ID NO: 105765 - protein, 9 aa, Homo Sapiens
GVWLEDRKI

SEQ ID NO: 105766 - protein, 9 aa, Homo Sapiens
ELFELFSGF

SEQ ID NO: 105767 - protein, 9 aa, Homo Sapiens
VVCAKGEVM

SEQ ID NO: 105768 - protein, 9 aa, Homo Sapiens
PDCFMLNFT

SEQ ID NO: 105769 - protein, 9 aa, Homo Sapiens
QEELPIYSC

SEQ ID NO: 105770 - protein, 9 aa, Homo Sapiens
GRGWLRAMR

SEQ ID NO: 105771 - protein, 9 aa, Homo Sapiens
KPTPKPQVV

SEQ ID NO: 105772 - protein, 9 aa, Homo Sapiens
GTLQNCVAQ

SEQ ID NO: 105773 - protein, 9 aa, Homo Sapiens
GWLRAMRGC

SEQ ID NO: 105774 - protein, 9 aa, Homo Sapiens
SELFELFSG

SEQ ID NO: 105775 - protein, 9 aa, Homo Sapiens
VLSELNEEA

SEQ ID NO: 105776 - protein, 9 aa, Homo Sapiens
QVVDEAGSG

SEQ ID NO: 105777 - protein, 9 aa, Homo Sapiens
CKNVKFVLK

SEQ ID NO: 105778 - protein, 9 aa, Homo Sapiens
EKFIATIRA

SEQ ID NO: 105779 - protein, 9 aa, Homo Sapiens
KRQGRTVYG

SEQ ID NO: 105780 - protein, 9 aa, Homo Sapiens
GQIQEAIAF

SEQ ID NO: 105781 - protein, 9 aa, Homo Sapiens
GGTLQNCVA

SEQ ID NO: 105782 - protein, 9 aa, Homo Sapiens
KPQVVDEAG

SEQ ID NO: 105783 - protein, 9 aa, Homo Sapiens
TSTKMKGSD

SEQ ID NO: 105784 - protein, 9 aa, Homo Sapiens
WSYCGRGWL

SEQ ID NO: 105785 - protein, 9 aa, Homo Sapiens
MDVILILEL

SEQ ID NO: 105786 - protein, 9 aa, Homo Sapiens
IQLSEVDKS

SEQ ID NO: 105787 - protein, 9 aa, Homo Sapiens
CVDPFMYYY

SEQ ID NO: 105788 - protein, 9 aa, Homo Sapiens
HEKFIATIR

SEQ ID NO: 105789 - protein, 9 aa, Homo Sapiens
LRAMRGCQL

SEQ ID NO: 105790 - protein, 9 aa, Homo Sapiens
IRDDLFTSQ

SEQ ID NO: 105791 - protein, 9 aa, Homo Sapiens
AGGSRIREY

SEQ ID NO: 105792 - protein, 9 aa, Homo Sapiens
VMPPVLGEV

SEQ ID NO: 105793 - protein, 9 aa, Homo Sapiens
REYVPQLLL

SEQ ID NO: 105794 - protein, 9 aa, Homo Sapiens
QKELERLHA

SEQ ID NO: 105795 - protein, 9 aa, Homo Sapiens
RDDLFTSQI

SEQ ID NO: 105796 - protein, 9 aa, Homo Sapiens
LKSKQESHE

SEQ ID NO: 105797 - protein, 9 aa, Homo Sapiens
CGAALALAS

SEQ ID NO: 105798 - protein, 9 aa, Homo Sapiens
GGEEDVFTE

SEQ ID NO: 105799 - protein, 9 aa, Homo Sapiens
GGSSSSSSD

SEQ ID NO: 105800 - protein, 9 aa, Homo Sapiens
AMASLFSIN

SEQ ID NO: 105801 - protein, 9 aa, Homo Sapiens
MFVTGGSLR

SEQ ID NO: 105802 - protein, 9 aa, Homo Sapiens
YCGRGWLRA

SEQ ID NO: 105803 - protein, 9 aa, Homo Sapiens
EAQEAWKAQ

SEQ ID NO: 105804 - protein, 9 aa, Homo Sapiens
QNCVAQASD

SEQ ID NO: 105805 - protein, 9 aa, Homo Sapiens
STYLVAFAC

SEQ ID NO: 105806 - protein, 9 aa, Homo Sapiens
ISTLTFHQR

SEQ ID NO: 105807 - protein, 9 aa, Homo Sapiens
WSFGLPFTK

SEQ ID NO: 105808 - protein, 9 aa, Homo Sapiens
ALALASVLC

SEQ ID NO: 105809 - protein, 9 aa, Homo Sapiens
AKDFDMLVA

SEQ ID NO: 105810 - protein, 9 aa, Homo Sapiens
SKEELTEHI

SEQ ID NO: 105811 - protein, 9 aa, Homo Sapiens
STAVVETYN

SEQ ID NO: 105812 - protein, 9 aa, Homo Sapiens
PESGILSST

SEQ ID NO: 105813 - protein, 9 aa, Homo Sapiens
RELAKQMED

SEQ ID NO: 105814 - protein, 9 aa, Homo Sapiens
GDLGLCVSE

SEQ ID NO: 105815 - protein, 9 aa, Homo Sapiens
AFINSLHPE

SEQ ID NO: 105816 - protein, 9 aa, Homo Sapiens
LGFSKSMSA

SEQ ID NO: 105817 - protein, 9 aa, Homo Sapiens
EGISSSGDS

SEQ ID NO: 105818 - protein, 9 aa, Homo Sapiens
LSELNEEAG

SEQ ID NO: 105819 - protein, 9 aa, Homo Sapiens
TAVVETYNS

SEQ ID NO: 105820 - protein, 9 aa, Homo Sapiens
VPPQVLSEL

SEQ ID NO: 105821 - protein, 9 aa, Homo Sapiens
CIYTARQES

SEQ ID NO: 105822 - protein, 9 aa, Homo Sapiens
SSEESERSE

SEQ ID NO: 105823 - protein, 9 aa, Homo Sapiens
PKPQVVDEA

SEQ ID NO: 105824 - protein, 9 aa, Homo Sapiens
NSCVDPFMY

SEQ ID NO: 105825 - protein, 9 aa, Homo Sapiens
EEEEMNAEL

SEQ ID NO: 105826 - protein, 9 aa, Homo Sapiens
WKAQLENHE

SEQ ID NO: 105827 - protein, 9 aa, Homo Sapiens
RPSMEINRM

SEQ ID NO: 105828 - protein, 9 aa, Homo Sapiens
YVPQLLLLL

SEQ ID NO: 105829 - protein, 9 aa, Homo Sapiens
MWKIRELAK

SEQ ID NO: 105830 - protein, 9 aa, Homo Sapiens
EWYNPQPCN

SEQ ID NO: 105831 - protein, 9 aa, Homo Sapiens
INKVSSSLI

SEQ ID NO: 105832 - protein, 9 aa, Homo Sapiens
FTSQIFKLE

SEQ ID NO: 105833 - protein, 9 aa, Homo Sapiens
LFSINKEVL

SEQ ID NO: 105834 - protein, 9 aa, Homo Sapiens
YNPQPCNPD

SEQ ID NO: 105835 - protein, 9 aa, Homo Sapiens
INTECLDIE

SEQ ID NO: 105836 - protein, 9 aa, Homo Sapiens
VAFACKNVK

SEQ ID NO: 105837 - protein, 9 aa, Homo Sapiens
LNSCVDPFM

SEQ ID NO: 105838 - protein, 9 aa, Homo Sapiens
LISSISSEL

SEQ ID NO: 105839 - protein, 9 aa, Homo Sapiens
GVCYGADHD

SEQ ID NO: 105840 - protein, 9 aa, Homo Sapiens
STLTFHQRI

SEQ ID NO: 105841 - protein, 9 aa, Homo Sapiens
VLKSKQESH

SEQ ID NO: 105842 - protein, 9 aa, Homo Sapiens
VSTAVVETY

SEQ ID NO: 105843 - protein, 9 aa, Homo Sapiens
IESLEFLDK

SEQ ID NO: 105844 - protein, 9 aa, Homo Sapiens
CLRKRRGQA

SEQ ID NO: 105845 - protein, 9 aa, Homo Sapiens
TLQNCVAQA

SEQ ID NO: 105846 - protein, 9 aa, Homo Sapiens
PQPCNPDSD

SEQ ID NO: 105847 - protein, 9 aa, Homo Sapiens
QEAWKAQLE

SEQ ID NO: 105848 - protein, 9 aa, Homo Sapiens
IRPSMEINR

SEQ ID NO: 105849 - protein, 9 aa, Homo Sapiens
KMKGSDTES

SEQ ID NO: 105850 - protein, 9 aa, Homo Sapiens
PVLGEVGGH

SEQ ID NO: 105851 - protein, 9 aa, Homo Sapiens
KKLQKELER

SEQ ID NO: 105852 - protein, 9 aa, Homo Sapiens
AEAHPDCFM

SEQ ID NO: 105853 - protein, 9 aa, Homo Sapiens
KAAFVMPPV

SEQ ID NO: 105854 - protein, 9 aa, Homo Sapiens
LRKRRGQAA

SEQ ID NO: 105855 - protein, 9 aa, Homo Sapiens
DCFMLNFTV

SEQ ID NO: 105856 - protein, 9 aa, Homo Sapiens
VLGEVGGHL

SEQ ID NO: 105857 - protein, 9 aa, Homo Sapiens
QPCNPDSDV

SEQ ID NO: 105858 - protein, 9 aa, Homo Sapiens
SEESERSEE

SEQ ID NO: 105859 - protein, 9 aa, Homo Sapiens
GLGFSKSMS

SEQ ID NO: 105860 - protein, 9 aa, Homo Sapiens
TATVRAKEM

SEQ ID NO: 105861 - protein, 9 aa, Homo Sapiens
LVAFACKNV

SEQ ID NO: 105862 - protein, 9 aa, Homo Sapiens
QIFKLELQN

SEQ ID NO: 105863 - protein, 9 aa, Homo Sapiens
SGILSSTTV

SEQ ID NO: 105864 - protein, 9 aa, Homo Sapiens
KMELLEQLM

SEQ ID NO: 105865 - protein, 9 aa, Homo Sapiens
AAFVMPPVL

SEQ ID NO: 105866 - protein, 9 aa, Homo Sapiens
NGGTLQNCV

SEQ ID NO: 105867 - protein, 9 aa, Homo Sapiens
AKQMEDAYR

SEQ ID NO: 105868 - protein, 9 aa, Homo Sapiens
EESERSEEE

SEQ ID NO: 105869 - protein, 9 aa, Homo Sapiens
PPQVLSELN

SEQ ID NO: 105870 - protein, 9 aa, Homo Sapiens
FSKSMSAET

SEQ ID NO: 105871 - protein, 9 aa, Homo Sapiens
MASLFSINK

SEQ ID NO: 105872 - protein, 9 aa, Homo Sapiens
STKMKGSDT

SEQ ID NO: 105873 - protein, 9 aa, Homo Sapiens
GSRIREYVP

SEQ ID NO: 105874 - protein, 9 aa, Homo Sapiens
RAKDFDMLV

SEQ ID NO: 105875 - protein, 9 aa, Homo Sapiens
IAFINSLHP

SEQ ID NO: 105876 - protein, 9 aa, Homo Sapiens
EFLDKMELL

SEQ ID NO: 105877 - protein, 9 aa, Homo Sapiens
EDRKICAIG

SEQ ID NO: 105878 - protein, 9 aa, Homo Sapiens
INRMIPGSQ

SEQ ID NO: 105879 - protein, 9 aa, Homo Sapiens
WLEDRKICA

SEQ ID NO: 105880 - protein, 9 aa, Homo Sapiens
PTPKPQVVD

SEQ ID NO: 105881 - protein, 9 aa, Homo Sapiens
QVLSELNEE

SEQ ID NO: 105882 - protein, 9 aa, Homo Sapiens
RAEEEEEMN

SEQ ID NO: 105883 - protein, 9 aa, Homo Sapiens
VEEEGGEED

SEQ ID NO: 105884 - protein, 9 aa, Homo Sapiens
SYCGRGWLR

SEQ ID NO: 105885 - protein, 9 aa, Homo Sapiens
PYTGVWLED

SEQ ID NO: 105886 - protein, 9 aa, Homo Sapiens
LEFLDKMEL

SEQ ID NO: 105887 - protein, 9 aa, Homo Sapiens
PFTKDLRFD

SEQ ID NO: 105888 - protein, 9 aa, Homo Sapiens
DMWKIRELA

SEQ ID NO: 105889 - protein, 9 aa, Homo Sapiens
GGWSFGLPF

SEQ ID NO: 105890 - protein, 9 aa, Homo Sapiens
LDKMELLEQ

SEQ ID NO: 105891 - protein, 9 aa, Homo Sapiens
KDSLGGFAY

SEQ ID NO: 105892 - protein, 9 aa, Homo Sapiens
QLSEVDKSK

SEQ ID NO: 105893 - protein, 9 aa, Homo Sapiens
HEVYENKMD

SEQ ID NO: 105894 - protein, 9 aa, Homo Sapiens
EEEEEMNAE

SEQ ID NO: 105895 - protein, 9 aa, Homo Sapiens
DQPNGGTLQ

SEQ ID NO: 105896 - protein, 9 aa, Homo Sapiens
AKGEVMAAL

SEQ ID NO: 105897 - protein, 9 aa, Homo Sapiens
SFGLPFTKD

SEQ ID NO: 105898 - protein, 9 aa, Homo Sapiens
TGVWLEDRK

SEQ ID NO: 105899 - protein, 9 aa, Homo Sapiens
KELEAQEAW

SEQ ID NO: 105900 - protein, 9 aa, Homo Sapiens
SKISTLTFH

SEQ ID NO: 105901 - protein, 9 aa, Homo Sapiens
LPFTKDLRF

SEQ ID NO: 105902 - protein, 9 aa, Homo Sapiens
SNQIGPESG

SEQ ID NO: 105903 - protein, 9 aa, Homo Sapiens
KRKARSRSS

SEQ ID NO: 105904 - protein, 9 aa, Homo Sapiens
FINSLHPEL

SEQ ID NO: 105905 - protein, 9 aa, Homo Sapiens
LAAPRGVCY

SEQ ID NO: 105906 - protein, 9 aa, Homo Sapiens
SKSMSAETI

SEQ ID NO: 105907 - protein, 9 aa, Homo Sapiens
EAFSSGSNF

SEQ ID NO: 105908 - protein, 9 aa, Homo Sapiens
RAVDLPVRH

SEQ ID NO: 105909 - protein, 9 aa, Homo Sapiens
MGCGAALAL

SEQ ID NO: 105910 - protein, 9 aa, Homo Sapiens
LRFHYGTKD

SEQ ID NO: 105911 - protein, 9 aa, Homo Sapiens
KSLYIHAKY

SEQ ID NO: 105912 - protein, 9 aa, Homo Sapiens
EEVEEEGGE

SEQ ID NO: 105913 - protein, 9 aa, Homo Sapiens
IQEAIAFIN

SEQ ID NO: 105914 - protein, 9 aa, Homo Sapiens
QPNGGTLQN

SEQ ID NO: 105915 - protein, 9 aa, Homo Sapiens
GCIYTARQE

SEQ ID NO: 105916 - protein, 9 aa, Homo Sapiens
RECVVCAKG

SEQ ID NO: 105917 - protein, 9 aa, Homo Sapiens
KLQKCGLGQ

SEQ ID NO: 105918 - protein, 9 aa, Homo Sapiens
DDLFTSQIF

SEQ ID NO: 105919 - protein, 9 aa, Homo Sapiens
AFACKNVKF

SEQ ID NO: 105920 - protein, 9 aa, Homo Sapiens
SRIREYVPQ

SEQ ID NO: 105921 - protein, 9 aa, Homo Sapiens
KSKQESHEQ

SEQ ID NO: 105922 - protein, 9 aa, Homo Sapiens
IYTARQESL

SEQ ID NO: 105923 - protein, 9 aa, Homo Sapiens
TVRAKEMFV

SEQ ID NO: 105924 - protein, 9 aa, Homo Sapiens
KTSTKMKGS

SEQ ID NO: 105925 - protein, 9 aa, Homo Sapiens
LVQKSLYIH

SEQ ID NO: 105926 - protein, 9 aa, Homo Sapiens
VYENKMDVI

SEQ ID NO: 105927 - protein, 9 aa, Homo Sapiens
KDFDMLVAE

SEQ ID NO: 105928 - protein, 9 aa, Homo Sapiens
WLRAMRGCQ

SEQ ID NO: 105929 - protein, 9 aa, Homo Sapiens
KKKPTPKPQ

SEQ ID NO: 105930 - protein, 9 aa, Homo Sapiens
GLNPKLQKC

SEQ ID NO: 105931 - protein, 9 aa, Homo Sapiens
PYEWYNPQP

SEQ ID NO: 105932 - protein, 9 aa, Homo Sapiens
ECLDIEDKS

SEQ ID NO: 105933 - protein, 9 aa, Homo Sapiens
KFIATIRAA

SEQ ID NO: 105934 - protein, 9 aa, Homo Sapiens
ASHYDSPIN

SEQ ID NO: 105935 - protein, 9 aa, Homo Sapiens
TECLDIEDK

SEQ ID NO: 105936 - protein, 9 aa, Homo Sapiens
QVSTAVVET

SEQ ID NO: 105937 - protein, 9 aa, Homo Sapiens
CCGGFRGVL

SEQ ID NO: 105938 - protein, 9 aa, Homo Sapiens
SSVLKSKQE

SEQ ID NO: 105939 - protein, 9 aa, Homo Sapiens
EVDKSKEEL

SEQ ID NO: 105940 - protein, 9 aa, Homo Sapiens
CVSELELLS

SEQ ID NO: 105941 - protein, 9 aa, Homo Sapiens
KISTLTFHQ

SEQ ID NO: 105942 - protein, 9 aa, Homo Sapiens
SNWRRKHEK

SEQ ID NO: 105943 - protein, 9 aa, Homo Sapiens
YIHAKYQRL

SEQ ID NO: 105944 - protein, 9 aa, Homo Sapiens
MYYYVSAEF

SEQ ID NO: 105945 - protein, 9 aa, Homo Sapiens
GTLRAVDLP

SEQ ID NO: 105946 - protein, 9 aa, Homo Sapiens
LPIYIENSN

SEQ ID NO: 105947 - protein, 9 aa, Homo Sapiens
LTLRIHRKN

SEQ ID NO: 105948 - protein, 9 aa, Homo Sapiens
LEDRKICAI

SEQ ID NO: 105949 - protein, 9 aa, Homo Sapiens
PRGVCYGAD

SEQ ID NO: 105950 - protein, 9 aa, Homo Sapiens
ERSSLLASH

SEQ ID NO: 105951 - protein, 9 aa, Homo Sapiens
FVTFPGGSI

SEQ ID NO: 105952 - protein, 9 aa, Homo Sapiens
ALKRQGRTV

SEQ ID NO: 105953 - protein, 9 aa, Homo Sapiens
MLVAELKAN

SEQ ID NO: 105954 - protein, 9 aa, Homo Sapiens
ELNEEAGAA

SEQ ID NO: 105955 - protein, 9 aa, Homo Sapiens
LEYLPIYIE

SEQ ID NO: 105956 - protein, 9 aa, Homo Sapiens
RIREYVPQL

SEQ ID NO: 105957 - protein, 9 aa, Homo Sapiens
VTFPGGSIL

SEQ ID NO: 105958 - protein, 9 aa, Homo Sapiens
GGSRIREYV

SEQ ID NO: 105959 - protein, 9 aa, Homo Sapiens
EYVPQLLLL

SEQ ID NO: 105960 - protein, 9 aa, Homo Sapiens
EEEGGEEDV

SEQ ID NO: 105961 - protein, 9 aa, Homo Sapiens
KEMFVTGGS

SEQ ID NO: 105962 - protein, 9 aa, Homo Sapiens
AELEYLPIY

SEQ ID NO: 105963 - protein, 9 aa, Homo Sapiens
ERAEEEEEM

SEQ ID NO: 105964 - protein, 9 aa, Homo Sapiens
ISSSGDSAG

SEQ ID NO: 105965 - protein, 9 aa, Homo Sapiens
LAELEYLPI

SEQ ID NO: 105966 - protein, 9 aa, Homo Sapiens
CAKGEVMAA

SEQ ID NO: 105967 - protein, 9 aa, Homo Sapiens
CGLNPKLQK

SEQ ID NO: 105968 - protein, 9 aa, Homo Sapiens
FTKDLRFDI

SEQ ID NO: 105969 - protein, 9 aa, Homo Sapiens
VKKLQKELE

SEQ ID NO: 105970 - protein, 9 aa, Homo Sapiens
GDGQSLEGI

SEQ ID NO: 105971 - protein, 9 aa, Homo Sapiens
VCAKGEVMA

SEQ ID NO: 105972 - protein, 9 aa, Homo Sapiens
LCVSELELL

SEQ ID NO: 105973 - protein, 9 aa, Homo Sapiens
QKCGLGQEN

SEQ ID NO: 105974 - protein, 9 aa, Homo Sapiens
TFPGGSILA

SEQ ID NO: 105975 - protein, 9 aa, Homo Sapiens
NKVSSSLIN

SEQ ID NO: 105976 - protein, 9 aa, Homo Sapiens
ASLTLHLTS

SEQ ID NO: 105977 - protein, 9 aa, Homo Sapiens
ISSISSELF

SEQ ID NO: 105978 - protein, 9 aa, Homo Sapiens
WYNPQPCNP

SEQ ID NO: 105979 - protein, 9 aa, Homo Sapiens
GISSSGDSA

SEQ ID NO: 105980 - protein, 9 aa, Homo Sapiens
FYLAAPRGV

SEQ ID NO: 105981 - protein, 9 aa, Homo Sapiens
QGRTVYGFG

SEQ ID NO: 105982 - protein, 9 aa, Homo Sapiens
RSRSSSYSY

SEQ ID NO: 105983 - protein, 9 aa, Homo Sapiens
ELPIYSCDF

SEQ ID NO: 105984 - protein, 9 aa, Homo Sapiens
MRHAFVTFP

SEQ ID NO: 105985 - protein, 9 aa, Homo Sapiens
TDKSDSEQL

SEQ ID NO: 105986 - protein, 9 aa, Homo Sapiens
SMSAETIKE

SEQ ID NO: 105987 - protein, 9 aa, Homo Sapiens
FGLPFTKDL

SEQ ID NO: 105988 - protein, 9 aa, Homo Sapiens
EAIAFINSL

SEQ ID NO: 105989 - protein, 9 aa, Homo Sapiens
VDPFMYYYV

SEQ ID NO: 105990 - protein, 9 aa, Homo Sapiens
QGRAKDFDM

SEQ ID NO: 105991 - protein, 9 aa, Homo Sapiens
SHYDSPINS

SEQ ID NO: 105992 - protein, 9 aa, Homo Sapiens
VCYGADHDL

SEQ ID NO: 105993 - protein, 9 aa, Homo Sapiens
APRGVCYGA

SEQ ID NO: 105994 - protein, 9 aa, Homo Sapiens
GRAKDFDML

SEQ ID NO: 105995 - protein, 9 aa, Homo Sapiens
TKAMASLFS

SEQ ID NO: 105996 - protein, 9 aa, Homo Sapiens
EVEEEGGEE

SEQ ID NO: 105997 - protein, 9 aa, Homo Sapiens
SEVDKSKEE

SEQ ID NO: 105998 - protein, 9 aa, Homo Sapiens
YENKMDVIL

SEQ ID NO: 105999 - protein, 9 aa, Homo Sapiens
TSQIFKLEL

SEQ ID NO: 106000 - protein, 9 aa, Homo Sapiens
EVYENKMDV

SEQ ID NO: 106001 - protein, 9 aa, Homo Sapiens
PQVVDEAGS

SEQ ID NO: 106002 - protein, 9 aa, Homo Sapiens
KGEVMAALV

SEQ ID NO: 106003 - protein, 9 aa, Homo Sapiens
RHAFVTFPG

SEQ ID NO: 106004 - protein, 9 aa, Homo Sapiens
SSSLINFGR

SEQ ID NO: 106005 - protein, 9 aa, Homo Sapiens
SELNEEAGA

SEQ ID NO: 106006 - protein, 9 aa, Homo Sapiens
RAKEMFVTG

SEQ ID NO: 106007 - protein, 9 aa, Homo Sapiens
SACCGGFRG

SEQ ID NO: 106008 - protein, 9 aa, Homo Sapiens
TLRAVDLPV

SEQ ID NO: 106009 - protein, 9 aa, Homo Sapiens
QEAIAFINS

SEQ ID NO: 106010 - protein, 9 aa, Homo Sapiens
RKRRGQAAA

SEQ ID NO: 106011 - protein, 9 aa, Homo Sapiens
FDMLVAELK

SEQ ID NO: 106012 - protein, 9 aa, Homo Sapiens
SKQESHEQS

SEQ ID NO: 106013 - protein, 9 aa, Homo Sapiens
ECVVCAKGE

SEQ ID NO: 106014 - protein, 9 aa, Homo Sapiens
DKSKEELTE

SEQ ID NO: 106015 - protein, 9 aa, Homo Sapiens
AKEMFVTGG

SEQ ID NO: 106016 - protein, 9 aa, Homo Sapiens
VVFSACCGG

SEQ ID NO: 106017 - protein, 9 aa, Homo Sapiens
FKTSTKMKG

SEQ ID NO: 106018 - protein, 9 aa, Homo Sapiens
QESLCRFKD

SEQ ID NO: 106019 - protein, 9 aa, Homo Sapiens
GLPFTKDLR

SEQ ID NO: 106020 - protein, 9 aa, Homo Sapiens
VETYNSILT

SEQ ID NO: 106021 - protein, 9 aa, Homo Sapiens
QIGPESGIL

SEQ ID NO: 106022 - protein, 9 aa, Homo Sapiens
LSEVDKSKE

SEQ ID NO: 106023 - protein, 9 aa, Homo Sapiens
SLTLHLTSH

SEQ ID NO: 106024 - protein, 9 aa, Homo Sapiens
LAEAHPDCF

SEQ ID NO: 106025 - protein, 9 aa, Homo Sapiens
AVDLPVRHH

SEQ ID NO: 106026 - protein, 9 aa, Homo Sapiens
NPKLQKCGL

SEQ ID NO: 106027 - protein, 9 aa, Homo Sapiens
PNGGTLQNC

SEQ ID NO: 106028 - protein, 9 aa, Homo Sapiens
RGWLRAMRG

SEQ ID NO: 106029 - protein, 9 aa, Homo Sapiens
YLPIYIENS

SEQ ID NO: 106030 - protein, 9 aa, Homo Sapiens
GCGAALALA

SEQ ID NO: 106031 - protein, 9 aa, Homo Sapiens
DFKRKARSR

SEQ ID NO: 106032 - protein, 9 aa, Homo Sapiens
GRTVYGFGG

SEQ ID NO: 106033 - protein, 9 aa, Homo Sapiens
LLISSISSE

SEQ ID NO: 106034 - protein, 9 aa, Homo Sapiens
ACCGGFRGV

SEQ ID NO: 106035 - protein, 9 aa, Homo Sapiens
QKSLYIHAK

SEQ ID NO: 106036 - protein, 9 aa, Homo Sapiens
HAKYQRLRF

SEQ ID NO: 106037 - protein, 9 aa, Homo Sapiens
SSISSELFE

SEQ ID NO: 106038 - protein, 9 aa, Homo Sapiens
VFSACCGGF

SEQ ID NO: 106039 - protein, 9 aa, Homo Sapiens
LEAQEAWKA

SEQ ID NO: 106040 - protein, 9 aa, Homo Sapiens
RFHYGTKDS

SEQ ID NO: 106041 - protein, 9 aa, Homo Sapiens
EAHPDCFML

SEQ ID NO: 106042 - protein, 9 aa, Homo Sapiens
IRELAKQME

SEQ ID NO: 106043 - protein, 9 aa, Homo Sapiens
LHEVYENKM

SEQ ID NO: 106044 - protein, 9 aa, Homo Sapiens
AFVMPPVLG

SEQ ID NO: 106045 - protein, 9 aa, Homo Sapiens
MKCLRKRRG

SEQ ID NO: 106046 - protein, 9 aa, Homo Sapiens
RQGRTVYGF

SEQ ID NO: 106047 - protein, 9 aa, Homo Sapiens
EGGEEDVFT

SEQ ID NO: 106048 - protein, 9 aa, Homo Sapiens
KELERLHAG

SEQ ID NO: 106049 - protein, 9 aa, Homo Sapiens
ELEYLPIYI

SEQ ID NO: 106050 - protein, 9 aa, Homo Sapiens
ISSELFELF

SEQ ID NO: 106051 - protein, 9 aa, Homo Sapiens
LKRQGRTVY

SEQ ID NO: 106052 - protein, 9 aa, Homo Sapiens
KSDSEQLTL

SEQ ID NO: 106053 - protein, 9 aa, Homo Sapiens
WRRKHEKFI

SEQ ID NO: 106054 - protein, 9 aa, Homo Sapiens
PSMEINRMI

SEQ ID NO: 106055 - protein, 9 aa, Homo Sapiens
YLAAPRGVC

SEQ ID NO: 106056 - protein, 9 aa, Homo Sapiens
VDKSKEELT

SEQ ID NO: 106057 - protein, 9 aa, Homo Sapiens
FMYYYVSAE

SEQ ID NO: 106058 - protein, 9 aa, Homo Sapiens
ISCINTECL

SEQ ID NO: 106059 - protein, 9 aa, Homo Sapiens
EMFVTGGSL

SEQ ID NO: 106060 - protein, 9 aa, Homo Sapiens
QSLEGISSS

SEQ ID NO: 106061 - protein, 9 aa, Homo Sapiens
YSCDFEDVP

SEQ ID NO: 106062 - protein, 9 aa, Homo Sapiens
SSELFELFS

SEQ ID NO: 106063 - protein, 9 aa, Homo Sapiens
SQIFKLELQ

SEQ ID NO: 106064 - protein, 9 aa, Homo Sapiens
AVVETYNSI

SEQ ID NO: 106065 - protein, 9 aa, Homo Sapiens
HPDCFMLNF

SEQ ID NO: 106066 - protein, 9 aa, Homo Sapiens
YLRFHYGTK

SEQ ID NO: 106067 - protein, 9 aa, Homo Sapiens
NKMDVILIL

SEQ ID NO: 106068 - protein, 9 aa, Homo Sapiens
SSSSEESER

SEQ ID NO: 106069 - protein, 9 aa, Homo Sapiens
LNPKLQKCG

SEQ ID NO: 106070 - protein, 9 aa, Homo Sapiens
KHEKFIATI

SEQ ID NO: 106071 - protein, 9 aa, Homo Sapiens
GEAFSSGSN

SEQ ID NO: 106072 - protein, 9 aa, Homo Sapiens
KIRELAKQM

SEQ ID NO: 106073 - protein, 9 aa, Homo Sapiens
QVKKLQKEL

SEQ ID NO: 106074 - protein, 9 aa, Homo Sapiens
ARSRSSSYS

SEQ ID NO: 106075 - protein, 9 aa, Homo Sapiens
PVSVLMKRM

SEQ ID NO: 106076 - protein, 9 aa, Homo Sapiens
QIFVMMDAK

SEQ ID NO: 106077 - protein, 9 aa, Homo Sapiens
ELEFGTCFQ

SEQ ID NO: 106078 - protein, 9 aa, Homo Sapiens
VFYTTLTLM

SEQ ID NO: 106079 - protein, 9 aa, Homo Sapiens
NAKNSYRNV

SEQ ID NO: 106080 - protein, 9 aa, Homo Sapiens
IVHVPPPKT

SEQ ID NO: 106081 - protein, 9 aa, Homo Sapiens
ILARVGACD

SEQ ID NO: 106082 - protein, 9 aa, Homo Sapiens
YRILKAHKQ

SEQ ID NO: 106083 - protein, 9 aa, Homo Sapiens
RLKDRHGLI

SEQ ID NO: 106084 - protein, 9 aa, Homo Sapiens
GFQSALALK

SEQ ID NO: 106085 - protein, 9 aa, Homo Sapiens
GERRENLLP

SEQ ID NO: 106086 - protein, 9 aa, Homo Sapiens
DNRNVCLLD

SEQ ID NO: 106087 - protein, 9 aa, Homo Sapiens
EDIDSQGGG

SEQ ID NO: 106088 - protein, 9 aa, Homo Sapiens
TFEKAHDCA

SEQ ID NO: 106089 - protein, 9 aa, Homo Sapiens
QNIEEYFAS

SEQ ID NO: 106090 - protein, 9 aa, Homo Sapiens
CVLTDAVDD

SEQ ID NO: 106091 - protein, 9 aa, Homo Sapiens
ISSKKYSMA

SEQ ID NO: 106092 - protein, 9 aa, Homo Sapiens
EEMLKLRPC

SEQ ID NO: 106093 - protein, 9 aa, Homo Sapiens
GEKPYECTY

SEQ ID NO: 106094 - protein, 9 aa, Homo Sapiens
KTSVAYVTT

SEQ ID NO: 106095 - protein, 9 aa, Homo Sapiens
AKLREDLFN

SEQ ID NO: 106096 - protein, 9 aa, Homo Sapiens
ETVRCVCKD

SEQ ID NO: 106097 - protein, 9 aa, Homo Sapiens
HTGTLMRSC

SEQ ID NO: 106098 - protein, 9 aa, Homo Sapiens
VSVLMKRMR

SEQ ID NO: 106099 - protein, 9 aa, Homo Sapiens
LQNCLILAA

SEQ ID NO: 106100 - protein, 9 aa, Homo Sapiens
ESSKKTIEE

SEQ ID NO: 106101 - protein, 9 aa, Homo Sapiens
PLPNLRMVR

SEQ ID NO: 106102 - protein, 9 aa, Homo Sapiens
TDVEEWTSL

SEQ ID NO: 106103 - protein, 9 aa, Homo Sapiens
SDHPSEVQE

SEQ ID NO: 106104 - protein, 9 aa, Homo Sapiens
SGSKSASRT

SEQ ID NO: 106105 - protein, 9 aa, Homo Sapiens
VLPCEIDPA

SEQ ID NO: 106106 - protein, 9 aa, Homo Sapiens
FDIYWDLYF

SEQ ID NO: 106107 - protein, 9 aa, Homo Sapiens
LPPGFPAYV

SEQ ID NO: 106108 - protein, 9 aa, Homo Sapiens
QQHQHQHQQ

SEQ ID NO: 106109 - protein, 9 aa, Homo Sapiens
EKAGSGGVP

SEQ ID NO: 106110 - protein, 9 aa, Homo Sapiens
PLTPCDGNH

SEQ ID NO: 106111 - protein, 9 aa, Homo Sapiens
IYLFVGGIG

SEQ ID NO: 106112 - protein, 9 aa, Homo Sapiens
EENEKIVWV

SEQ ID NO: 106113 - protein, 9 aa, Homo Sapiens
KLMKAVKSV

SEQ ID NO: 106114 - protein, 9 aa, Homo Sapiens
FVMMDAKAR

SEQ ID NO: 106115 - protein, 9 aa, Homo Sapiens
SVCHAELEF

SEQ ID NO: 106116 - protein, 9 aa, Homo Sapiens
MKAVKSVAA

SEQ ID NO: 106117 - protein, 9 aa, Homo Sapiens
TLPLPNLRM

SEQ ID NO: 106118 - protein, 9 aa, Homo Sapiens
KPYECTYCG

SEQ ID NO: 106119 - protein, 9 aa, Homo Sapiens
QQQHQHQHQ

SEQ ID NO: 106120 - protein, 9 aa, Homo Sapiens
FTLTSHCVI

SEQ ID NO: 106121 - protein, 9 aa, Homo Sapiens
IFVMMDAKA

SEQ ID NO: 106122 - protein, 9 aa, Homo Sapiens
GKVLKHRSY

SEQ ID NO: 106123 - protein, 9 aa, Homo Sapiens
QEWKLQELS

SEQ ID NO: 106124 - protein, 9 aa, Homo Sapiens
GRVNVVSQS

SEQ ID NO: 106125 - protein, 9 aa, Homo Sapiens
ASENNAKNS

SEQ ID NO: 106126 - protein, 9 aa, Homo Sapiens
PYKCDICGK

SEQ ID NO: 106127 - protein, 9 aa, Homo Sapiens
DQDDIHIKL

SEQ ID NO: 106128 - protein, 9 aa, Homo Sapiens
RPASPGMID

SEQ ID NO: 106129 - protein, 9 aa, Homo Sapiens
TKKKKKKKW

SEQ ID NO: 106130 - protein, 9 aa, Homo Sapiens
KESSKKTIE

SEQ ID NO: 106131 - protein, 9 aa, Homo Sapiens
KEAGGIYLF

SEQ ID NO: 106132 - protein, 9 aa, Homo Sapiens
FSWMNNLLM

SEQ ID NO: 106133 - protein, 9 aa, Homo Sapiens
KKCYSIEQP

SEQ ID NO: 106134 - protein, 9 aa, Homo Sapiens
DYSFLKNHL

SEQ ID NO: 106135 - protein, 9 aa, Homo Sapiens
DCSDRVSNS

SEQ ID NO: 106136 - protein, 9 aa, Homo Sapiens
VDQNLYEGK

SEQ ID NO: 106137 - protein, 9 aa, Homo Sapiens
ETPRQQEAE

SEQ ID NO: 106138 - protein, 9 aa, Homo Sapiens
SDDLGDEWW

SEQ ID NO: 106139 - protein, 9 aa, Homo Sapiens
LHGDMSTGP

SEQ ID NO: 106140 - protein, 9 aa, Homo Sapiens
APDQRAPVL

SEQ ID NO: 106141 - protein, 9 aa, Homo Sapiens
LTVYVDSLA

SEQ ID NO: 106142 - protein, 9 aa, Homo Sapiens
APRFHSRVG

SEQ ID NO: 106143 - protein, 9 aa, Homo Sapiens
RQQEAELQE

SEQ ID NO: 106144 - protein, 9 aa, Homo Sapiens
SKACTNYDQ

SEQ ID NO: 106145 - protein, 9 aa, Homo Sapiens
KKLMKAVKS

SEQ ID NO: 106146 - protein, 9 aa, Homo Sapiens
EMLKLRPCG

SEQ ID NO: 106147 - protein, 9 aa, Homo Sapiens
LGTTKKCIG

SEQ ID NO: 106148 - protein, 9 aa, Homo Sapiens
LVELHIHDN

SEQ ID NO: 106149 - protein, 9 aa, Homo Sapiens
LCDCSDRVS

SEQ ID NO: 106150 - protein, 9 aa, Homo Sapiens
VCHAELEFG

SEQ ID NO: 106151 - protein, 9 aa, Homo Sapiens
KIKAYAQLK

SEQ ID NO: 106152 - protein, 9 aa, Homo Sapiens
YTCGAENRL

SEQ ID NO: 106153 - protein, 9 aa, Homo Sapiens
EQWEKQVCV

SEQ ID NO: 106154 - protein, 9 aa, Homo Sapiens
GTQIIHSTL

SEQ ID NO: 106155 - protein, 9 aa, Homo Sapiens
YLSSLELEM

SEQ ID NO: 106156 - protein, 9 aa, Homo Sapiens
QNLYEGKIP

SEQ ID NO: 106157 - protein, 9 aa, Homo Sapiens
ECTYCGKAF

SEQ ID NO: 106158 - protein, 9 aa, Homo Sapiens
YFFKQPINQ

SEQ ID NO: 106159 - protein, 9 aa, Homo Sapiens
SLELEMDEE

SEQ ID NO: 106160 - protein, 9 aa, Homo Sapiens
ENNAKNSYR

SEQ ID NO: 106161 - protein, 9 aa, Homo Sapiens
VMSKACTNY

SEQ ID NO: 106162 - protein, 9 aa, Homo Sapiens
EHLRGTIGL

SEQ ID NO: 106163 - protein, 9 aa, Homo Sapiens
AASWKVSPT

SEQ ID NO: 106164 - protein, 9 aa, Homo Sapiens
SLDEDAPTS

SEQ ID NO: 106165 - protein, 9 aa, Homo Sapiens
QEKLIQDRF

SEQ ID NO: 106166 - protein, 9 aa, Homo Sapiens
HIKLEDIIQ

SEQ ID NO: 106167 - protein, 9 aa, Homo Sapiens
GSGVEEESQ

SEQ ID NO: 106168 - protein, 9 aa, Homo Sapiens
NHKIKAYAQ

SEQ ID NO: 106169 - protein, 9 aa, Homo Sapiens
QTIKFLKHR

SEQ ID NO: 106170 - protein, 8 aa, Homo Sapiens
VSSCCGSV

SEQ ID NO: 106171 - protein, 9 aa, Homo Sapiens
ELSSAAVLP

SEQ ID NO: 106172 - protein, 9 aa, Homo Sapiens
IKEAGGIYL

SEQ ID NO: 106173 - protein, 9 aa, Homo Sapiens
YSMAKAEAE

SEQ ID NO: 106174 - protein, 9 aa, Homo Sapiens
VAKDDNLYS

SEQ ID NO: 106175 - protein, 9 aa, Homo Sapiens
NLIKHHRIH

SEQ ID NO: 106176 - protein, 9 aa, Homo Sapiens
ALRESKVAE

SEQ ID NO: 106177 - protein, 9 aa, Homo Sapiens
KAKLREDLF

SEQ ID NO: 106178 - protein, 9 aa, Homo Sapiens
QDDIHIKLE

SEQ ID NO: 106179 - protein, 9 aa, Homo Sapiens
NSYRNVLPY

SEQ ID NO: 106180 - protein, 9 aa, Homo Sapiens
NETIGLEWE

SEQ ID NO: 106181 - protein, 9 aa, Homo Sapiens
QNDIASPVP

SEQ ID NO: 106182 - protein, 9 aa, Homo Sapiens
LTPCDGNHA

SEQ ID NO: 106183 - protein, 9 aa, Homo Sapiens
GNQEWKLQE

SEQ ID NO: 106184 - protein, 9 aa, Homo Sapiens
EMWDFDIYW

SEQ ID NO: 106185 - protein, 9 aa, Homo Sapiens
SFVEDTTGE

SEQ ID NO: 106186 - protein, 9 aa, Homo Sapiens
KGERRENLL

SEQ ID NO: 106187 - protein, 9 aa, Homo Sapiens
PEQKAQTEG

SEQ ID NO: 106188 - protein, 9 aa, Homo Sapiens
LLKRVDQNL

SEQ ID NO: 106189 - protein, 9 aa, Homo Sapiens
YDLRTNLWF

SEQ ID NO: 106190 - protein, 9 aa, Homo Sapiens
NLPPGFPAY

SEQ ID NO: 106191 - protein, 9 aa, Homo Sapiens
CFRGQTIKF

SEQ ID NO: 106192 - protein, 9 aa, Homo Sapiens
LWPFLLRRL

SEQ ID NO: 106193 - protein, 9 aa, Homo Sapiens
PRPTTGQTV

SEQ ID NO: 106194 - protein, 9 aa, Homo Sapiens
FAFSWMNNL

SEQ ID NO: 106195 - protein, 9 aa, Homo Sapiens
RGTIGLKLG

SEQ ID NO: 106196 - protein, 9 aa, Homo Sapiens
SKSASRTTR

SEQ ID NO: 106197 - protein, 9 aa, Homo Sapiens
IERHKHWPF

SEQ ID NO: 106198 - protein, 9 aa, Homo Sapiens
CFWDSSTDW

SEQ ID NO: 106199 - protein, 9 aa, Homo Sapiens
LMKDYFFKQ

SEQ ID NO: 106200 - protein, 9 aa, Homo Sapiens
RVSDNPSIT

SEQ ID NO: 106201 - protein, 9 aa, Homo Sapiens
SLVELHIHD

SEQ ID NO: 106202 - protein, 9 aa, Homo Sapiens
KTDIVKIMS

SEQ ID NO: 106203 - protein, 9 aa, Homo Sapiens
PIFILEDEN

SEQ ID NO: 106204 - protein, 9 aa, Homo Sapiens
NIETVRCVC

SEQ ID NO: 106205 - protein, 9 aa, Homo Sapiens
PPLHGDMST

SEQ ID NO: 106206 - protein, 9 aa, Homo Sapiens
ETIGLEWEL

SEQ ID NO: 106207 - protein, 9 aa, Homo Sapiens
SSLVELHIH

SEQ ID NO: 106208 - protein, 9 aa, Homo Sapiens
QILGEIYFN

SEQ ID NO: 106209 - protein, 9 aa, Homo Sapiens
SNMEISEEK

SEQ ID NO: 106210 - protein, 9 aa, Homo Sapiens
AQPYMIVSI

SEQ ID NO: 106211 - protein, 9 aa, Homo Sapiens
KSFRVSSNL

SEQ ID NO: 106212 - protein, 9 aa, Homo Sapiens
EAFLLMTKT

SEQ ID NO: 106213 - protein, 9 aa, Homo Sapiens
TSLDEDAPT

SEQ ID NO: 106214 - protein, 9 aa, Homo Sapiens
REDLFNQVP

SEQ ID NO: 106215 - protein, 9 aa, Homo Sapiens
ILRKRDYKQ

SEQ ID NO: 106216 - protein, 9 aa, Homo Sapiens
LKHRSYLMW

SEQ ID NO: 106217 - protein, 9 aa, Homo Sapiens
VQIFVMMDA

SEQ ID NO: 106218 - protein, 9 aa, Homo Sapiens
SRGQSGSKS

SEQ ID NO: 106219 - protein, 9 aa, Homo Sapiens
YCGKAFGLK

SEQ ID NO: 106220 - protein, 9 aa, Homo Sapiens
HLRGTIGLK

SEQ ID NO: 106221 - protein, 9 aa, Homo Sapiens
KLALEHILR

SEQ ID NO: 106222 - protein, 9 aa, Homo Sapiens
GGIYLFVGG

SEQ ID NO: 106223 - protein, 9 aa, Homo Sapiens
YVAGPVPSV

SEQ ID NO: 106224 - protein, 9 aa, Homo Sapiens
MAVMAANAI

SEQ ID NO: 106225 - protein, 9 aa, Homo Sapiens
KLREDLFNQ

SEQ ID NO: 106226 - protein, 9 aa, Homo Sapiens
AVQRVLAGE

SEQ ID NO: 106227 - protein, 9 aa, Homo Sapiens
YECTYCGKA

SEQ ID NO: 106228 - protein, 9 aa, Homo Sapiens
KFLKHRFSP

SEQ ID NO: 106229 - protein, 9 aa, Homo Sapiens
YVDSLAELD

SEQ ID NO: 106230 - protein, 9 aa, Homo Sapiens
AKESSKKTI

SEQ ID NO: 106231 - protein, 9 aa, Homo Sapiens
YKGRRMGPP

SEQ ID NO: 106232 - protein, 9 aa, Homo Sapiens
SSVSTSKRI

SEQ ID NO: 106233 - protein, 9 aa, Homo Sapiens
EKPYECTYC

SEQ ID NO: 106234 - protein, 9 aa, Homo Sapiens
LGEHSVNFS

SEQ ID NO: 106235 - protein, 9 aa, Homo Sapiens
AVDKNGNNA

SEQ ID NO: 106236 - protein, 9 aa, Homo Sapiens
NYDSSQNIE

SEQ ID NO: 106237 - protein, 9 aa, Homo Sapiens
PKSNYDSSQ

SEQ ID NO: 106238 - protein, 9 aa, Homo Sapiens
EWTSLDEDA

SEQ ID NO: 106239 - protein, 9 aa, Homo Sapiens
KVGDEIVYR

SEQ ID NO: 106240 - protein, 9 aa, Homo Sapiens
LLDEATSVL

SEQ ID NO: 106241 - protein, 9 aa, Homo Sapiens
VSTSKRISC

SEQ ID NO: 106242 - protein, 9 aa, Homo Sapiens
SFPIFILED

SEQ ID NO: 106243 - protein, 9 aa, Homo Sapiens
NHAAQQLTP

SEQ ID NO: 106244 - protein, 9 aa, Homo Sapiens
NPSITAKLI

SEQ ID NO: 106245 - protein, 9 aa, Homo Sapiens
LLVVMFWTM

SEQ ID NO: 106246 - protein, 9 aa, Homo Sapiens
CLLDTLISP

SEQ ID NO: 106247 - protein, 9 aa, Homo Sapiens
VQHHPPEQK

SEQ ID NO: 106248 - protein, 9 aa, Homo Sapiens
AELEFGTCF

SEQ ID NO: 106249 - protein, 9 aa, Homo Sapiens
DASSVSTSK

SEQ ID NO: 106250 - protein, 9 aa, Homo Sapiens
VRCVCKDNV

SEQ ID NO: 106251 - protein, 9 aa, Homo Sapiens
VTTGDSETA

SEQ ID NO: 106252 - protein, 9 aa, Homo Sapiens
HAELEFGTC

SEQ ID NO: 106253 - protein, 9 aa, Homo Sapiens
KEKAGSGGV

SEQ ID NO: 106254 - protein, 9 aa, Homo Sapiens
DDNLYSGNS

SEQ ID NO: 106255 - protein, 9 aa, Homo Sapiens
GKSFRVSSN

SEQ ID NO: 106256 - protein, 9 aa, Homo Sapiens
KIRVRGHDY

SEQ ID NO: 106257 - protein, 9 aa, Homo Sapiens
PPHYKGRRM

SEQ ID NO: 106258 - protein, 9 aa, Homo Sapiens
LRGTIGLKL

SEQ ID NO: 106259 - protein, 9 aa, Homo Sapiens
LTLMLNPII

SEQ ID NO: 106260 - protein, 9 aa, Homo Sapiens
EKIPVSVLM

SEQ ID NO: 106261 - protein, 9 aa, Homo Sapiens
QWEKQVCVL

SEQ ID NO: 106262 - protein, 9 aa, Homo Sapiens
TGQTVPTPQ

SEQ ID NO: 106263 - protein, 9 aa, Homo Sapiens
KTARDATLF

SEQ ID NO: 106264 - protein, 9 aa, Homo Sapiens
IYWDLYFEK

SEQ ID NO: 106265 - protein, 9 aa, Homo Sapiens
DRWNETIGL

SEQ ID NO: 106266 - protein, 9 aa, Homo Sapiens
NLRMVRGTQ

SEQ ID NO: 106267 - protein, 9 aa, Homo Sapiens
VEDTTGEQF

SEQ ID NO: 106268 - protein, 9 aa, Homo Sapiens
LGEIYFNKS

SEQ ID NO: 106269 - protein, 9 aa, Homo Sapiens
VNAQSQNCF

SEQ ID NO: 106270 - protein, 9 aa, Homo Sapiens
VRILRLKDR

SEQ ID NO: 106271 - protein, 9 aa, Homo Sapiens
PDQRAPVLL

SEQ ID NO: 106272 - protein, 9 aa, Homo Sapiens
TCGAENRLG

SEQ ID NO: 106273 - protein, 9 aa, Homo Sapiens
FILEDENET

SEQ ID NO: 106274 - protein, 9 aa, Homo Sapiens
TYCGKAFGL

SEQ ID NO: 106275 - protein, 9 aa, Homo Sapiens
LTCLASAPV

SEQ ID NO: 106276 - protein, 9 aa, Homo Sapiens
YKCDICGKS

SEQ ID NO: 106277 - protein, 9 aa, Homo Sapiens
PPPKTARDA

SEQ ID NO: 106278 - protein, 9 aa, Homo Sapiens
NKHFAAASW

SEQ ID NO: 106279 - protein, 9 aa, Homo Sapiens
RVGACDSQL

SEQ ID NO: 106280 - protein, 9 aa, Homo Sapiens
CILARVGAC

SEQ ID NO: 106281 - protein, 9 aa, Homo Sapiens
EKEKAGSGG

SEQ ID NO: 106282 - protein, 9 aa, Homo Sapiens
MKEWKSNME

SEQ ID NO: 106283 - protein, 9 aa, Homo Sapiens
IDSQGGGSS

SEQ ID NO: 106284 - protein, 9 aa, Homo Sapiens
AKNSYRNVL

SEQ ID NO: 106285 - protein, 9 aa, Homo Sapiens
SKPRRELRP

SEQ ID NO: 106286 - protein, 9 aa, Homo Sapiens
DSSTDWSCT

SEQ ID NO: 106287 - protein, 9 aa, Homo Sapiens
WDLYFEKAV

SEQ ID NO: 106288 - protein, 9 aa, Homo Sapiens
LRCAKCGKS

SEQ ID NO: 106289 - protein, 9 aa, Homo Sapiens
PAPVRLGFQ

SEQ ID NO: 106290 - protein, 9 aa, Homo Sapiens
YDSSQNIEE

SEQ ID NO: 106291 - protein, 9 aa, Homo Sapiens
GSFVEDTTG

SEQ ID NO: 106292 - protein, 9 aa, Homo Sapiens
CLECGKVLK

SEQ ID NO: 106293 - protein, 9 aa, Homo Sapiens
CDCSDRVSN

SEQ ID NO: 106294 - protein, 9 aa, Homo Sapiens
ESKKLMKAV

SEQ ID NO: 106295 - protein, 9 aa, Homo Sapiens
PVLMAVMAA

SEQ ID NO: 106296 - protein, 9 aa, Homo Sapiens
TIEENTKNR

SEQ ID NO: 106297 - protein, 9 aa, Homo Sapiens
YSFLKNHLV

SEQ ID NO: 106298 - protein, 9 aa, Homo Sapiens
EKTPLGEHS

SEQ ID NO: 106299 - protein, 9 aa, Homo Sapiens
VVSQSLEVA

SEQ ID NO: 106300 - protein, 9 aa, Homo Sapiens
TNYDQMKTP

SEQ ID NO: 106301 - protein, 9 aa, Homo Sapiens
SSAQRQNPV

SEQ ID NO: 106302 - protein, 9 aa, Homo Sapiens
VEDIDSQGG

SEQ ID NO: 106303 - protein, 9 aa, Homo Sapiens
PPKTARDAT

SEQ ID NO: 106304 - protein, 9 aa, Homo Sapiens
KIPVSVLMK

SEQ ID NO: 106305 - protein, 9 aa, Homo Sapiens
AVLLLNPPL

SEQ ID NO: 106306 - protein, 9 aa, Homo Sapiens
DAVQRVLAG

SEQ ID NO: 106307 - protein, 9 aa, Homo Sapiens
QEKEKAGSG

SEQ ID NO: 106308 - protein, 9 aa, Homo Sapiens
SSKKTIEEN

SEQ ID NO: 106309 - protein, 9 aa, Homo Sapiens
NCFTPLYMA

SEQ ID NO: 106310 - protein, 9 aa, Homo Sapiens
FHSRVGFTG

SEQ ID NO: 106311 - protein, 9 aa, Homo Sapiens
GVEEESQTK

SEQ ID NO: 106312 - protein, 9 aa, Homo Sapiens
LLLNPPLST

SEQ ID NO: 106313 - protein, 9 aa, Homo Sapiens
AKKAKLRED

SEQ ID NO: 106314 - protein, 9 aa, Homo Sapiens
PLTEENEKI

SEQ ID NO: 106315 - protein, 9 aa, Homo Sapiens
ADFTLLSMD

SEQ ID NO: 106316 - protein, 9 aa, Homo Sapiens
VYELSSAAV

SEQ ID NO: 106317 - protein, 9 aa, Homo Sapiens
CLRCAKCGK

SEQ ID NO: 106318 - protein, 9 aa, Homo Sapiens
VYRILKAHK

SEQ ID NO: 106319 - protein, 9 aa, Homo Sapiens
NEKIVWVRF

SEQ ID NO: 106320 - protein, 9 aa, Homo Sapiens
AYVTTGDSE

SEQ ID NO: 106321 - protein, 9 aa, Homo Sapiens
QPINQFSLN

SEQ ID NO: 106322 - protein, 9 aa, Homo Sapiens
VLKHRSYLM

SEQ ID NO: 106323 - protein, 9 aa, Homo Sapiens
DDIHIKLED

SEQ ID NO: 106324 - protein, 9 aa, Homo Sapiens
RVSSNLIKH

SEQ ID NO: 106325 - protein, 9 aa, Homo Sapiens
FPTALRESK

SEQ ID NO: 106326 - protein, 9 aa, Homo Sapiens
SLAHTGTLM

SEQ ID NO: 106327 - protein, 9 aa, Homo Sapiens
TIGLEWELE

SEQ ID NO: 106328 - protein, 9 aa, Homo Sapiens
ARREVDSIS

SEQ ID NO: 106329 - protein, 9 aa, Homo Sapiens
QGGGSSQPD

SEQ ID NO: 106330 - protein, 9 aa, Homo Sapiens
LMKRMRQER

SEQ ID NO: 106331 - protein, 9 aa, Homo Sapiens
TCLASAPVP

SEQ ID NO: 106332 - protein, 9 aa, Homo Sapiens
VSSNLIKHH

SEQ ID NO: 106333 - protein, 9 aa, Homo Sapiens
GTIGLKLGP

SEQ ID NO: 106334 - protein, 9 aa, Homo Sapiens
YLLFVCTLP

SEQ ID NO: 106335 - protein, 9 aa, Homo Sapiens
GSGGVPEEL

SEQ ID NO: 106336 - protein, 9 aa, Homo Sapiens
CGAENRLGS

SEQ ID NO: 106337 - protein, 9 aa, Homo Sapiens
RGQTIKFLK

SEQ ID NO: 106338 - protein, 9 aa, Homo Sapiens
EPSSAQRQN

SEQ ID NO: 106339 - protein, 9 aa, Homo Sapiens
SGVEEESQT

SEQ ID NO: 106340 - protein, 9 aa, Homo Sapiens
SMDMPSTAP

SEQ ID NO: 106341 - protein, 9 aa, Homo Sapiens
HKHWPFLLF

SEQ ID NO: 106342 - protein, 9 aa, Homo Sapiens
NPPLSTAFK

SEQ ID NO: 106343 - protein, 9 aa, Homo Sapiens
PRRELRPAS

SEQ ID NO: 106344 - protein, 9 aa, Homo Sapiens
IDECNIETV

SEQ ID NO: 106345 - protein, 9 aa, Homo Sapiens
FRVSSNLIK

SEQ ID NO: 106346 - protein, 9 aa, Homo Sapiens
TDWSCTVRW

SEQ ID NO: 106347 - protein, 9 aa, Homo Sapiens
HKIKAYAQL

SEQ ID NO: 106348 - protein, 9 aa, Homo Sapiens
KVRILRLKD

SEQ ID NO: 106349 - protein, 9 aa, Homo Sapiens
VLDTSNERA

SEQ ID NO: 106350 - protein, 9 aa, Homo Sapiens
KWPFHKMAL

SEQ ID NO: 106351 - protein, 9 aa, Homo Sapiens
SKKLMKAVK

SEQ ID NO: 106352 - protein, 9 aa, Homo Sapiens
LVSLTVYVD

SEQ ID NO: 106353 - protein, 9 aa, Homo Sapiens
GIYLFVGGI

SEQ ID NO: 106354 - protein, 9 aa, Homo Sapiens
VRGHDYSFL

SEQ ID NO: 106355 - protein, 9 aa, Homo Sapiens
CNIETVRCV

SEQ ID NO: 106356 - protein, 9 aa, Homo Sapiens
TPLGEHSVN

SEQ ID NO: 106357 - protein, 8 aa, Homo Sapiens
NDDGKVNA

SEQ ID NO: 106358 - protein, 9 aa, Homo Sapiens
RVRGHDYSF

SEQ ID NO: 106359 - protein, 9 aa, Homo Sapiens
IGLKLGPAL

SEQ ID NO: 106360 - protein, 9 aa, Homo Sapiens
TSKRISCRP

SEQ ID NO: 106361 - protein, 9 aa, Homo Sapiens
KKCIGPVYS

SEQ ID NO: 106362 - protein, 9 aa, Homo Sapiens
QHHPPEQKA

SEQ ID NO: 106363 - protein, 9 aa, Homo Sapiens
LKDRHGLIR

SEQ ID NO: 106364 - protein, 9 aa, Homo Sapiens
ALFNLMQVG

SEQ ID NO: 106365 - protein, 9 aa, Homo Sapiens
TSVLDTSNE

SEQ ID NO: 106366 - protein, 9 aa, Homo Sapiens
LMLNPIIYS

SEQ ID NO: 106367 - protein, 9 aa, Homo Sapiens
ALYVAVVNW

SEQ ID NO: 106368 - protein, 9 aa, Homo Sapiens
PVLLVVMFW

SEQ ID NO: 106369 - protein, 9 aa, Homo Sapiens
KVQIFVMMD

SEQ ID NO: 106370 - protein, 9 aa, Homo Sapiens
LKLRPCGSD

SEQ ID NO: 106371 - protein, 9 aa, Homo Sapiens
NLAVSYLLF

SEQ ID NO: 106372 - protein, 9 aa, Homo Sapiens
DRVSDNPSI

SEQ ID NO: 106373 - protein, 9 aa, Homo Sapiens
DLRTNLWFQ

SEQ ID NO: 106374 - protein, 9 aa, Homo Sapiens
RNWLPGNLF

SEQ ID NO: 106375 - protein, 9 aa, Homo Sapiens
TTGDSETAP

SEQ ID NO: 106376 - protein, 9 aa, Homo Sapiens
HSVNFSLTP

SEQ ID NO: 106377 - protein, 9 aa, Homo Sapiens
LMKAVKSVA

SEQ ID NO: 106378 - protein, 9 aa, Homo Sapiens
WEKQVCVLT

SEQ ID NO: 106379 - protein, 9 aa, Homo Sapiens
SVKLALEHI

SEQ ID NO: 106380 - protein, 9 aa, Homo Sapiens
ALSPQGSFV

SEQ ID NO: 106381 - protein, 9 aa, Homo Sapiens
GPPPPHYKG

SEQ ID NO: 106382 - protein, 9 aa, Homo Sapiens
SKRKLTLTC

SEQ ID NO: 106383 - protein, 9 aa, Homo Sapiens
LAGTDTSRQ

SEQ ID NO: 106384 - protein, 9 aa, Homo Sapiens
SNLIKHHRI

SEQ ID NO: 106385 - protein, 9 aa, Homo Sapiens
SAQRQNPVQ

SEQ ID NO: 106386 - protein, 9 aa, Homo Sapiens
PSSAQRQNP

SEQ ID NO: 106387 - protein, 9 aa, Homo Sapiens
TKKCIGPVY

SEQ ID NO: 106388 - protein, 9 aa, Homo Sapiens
QSALALKEL

SEQ ID NO: 106389 - protein, 9 aa, Homo Sapiens
KAGSGGVPE

SEQ ID NO: 106390 - protein, 9 aa, Homo Sapiens
FQSALALKE

SEQ ID NO: 106391 - protein, 9 aa, Homo Sapiens
GDEIVYRIL

SEQ ID NO: 106392 - protein, 9 aa, Homo Sapiens
EAGGIYLFV

SEQ ID NO: 106393 - protein, 9 aa, Homo Sapiens
HRPGSGVEE

SEQ ID NO: 106394 - protein, 9 aa, Homo Sapiens
VLMAVMAAN

SEQ ID NO: 106395 - protein, 9 aa, Homo Sapiens
YVTTGDSET

SEQ ID NO: 106396 - protein, 9 aa, Homo Sapiens
PGPRPTTGQ

SEQ ID NO: 106397 - protein, 9 aa, Homo Sapiens
SGGVPEELV

SEQ ID NO: 106398 - protein, 9 aa, Homo Sapiens
ENLLPKKLC

SEQ ID NO: 106399 - protein, 9 aa, Homo Sapiens
KCIGPVYSS

SEQ ID NO: 106400 - protein, 9 aa, Homo Sapiens
GEHSVNFSL

SEQ ID NO: 106401 - protein, 9 aa, Homo Sapiens
NKVGDEIVY

SEQ ID NO: 106402 - protein, 9 aa, Homo Sapiens
ITYKNFCDQ

SEQ ID NO: 106403 - protein, 9 aa, Homo Sapiens
PTTGQTVPT

SEQ ID NO: 106404 - protein, 9 aa, Homo Sapiens
AGSGGVPEE

SEQ ID NO: 106405 - protein, 9 aa, Homo Sapiens
WKVSPTASR

SEQ ID NO: 106406 - protein, 9 aa, Homo Sapiens
CHAELEFGT

SEQ ID NO: 106407 - protein, 9 aa, Homo Sapiens
NLGTTKKCI

SEQ ID NO: 106408 - protein, 9 aa, Homo Sapiens
TEEHLRGTI

SEQ ID NO: 106409 - protein, 9 aa, Homo Sapiens
VLWPFLLRR

SEQ ID NO: 106410 - protein, 9 aa, Homo Sapiens
ALPVLMAVM

SEQ ID NO: 106411 - protein, 9 aa, Homo Sapiens
YKKCYSIEQ

SEQ ID NO: 106412 - protein, 9 aa, Homo Sapiens
ITMGNQEWK

SEQ ID NO: 106413 - protein, 9 aa, Homo Sapiens
VPFPQGTHF

SEQ ID NO: 106414 - protein, 9 aa, Homo Sapiens
FDGAPRFHS

SEQ ID NO: 106415 - protein, 9 aa, Homo Sapiens
WHLESTQIL

SEQ ID NO: 106416 - protein, 9 aa, Homo Sapiens
QLQDETPRQ

SEQ ID NO: 106417 - protein, 9 aa, Homo Sapiens
GEAFLLMTK

SEQ ID NO: 106418 - protein, 9 aa, Homo Sapiens
DLVSLTVYV

SEQ ID NO: 106419 - protein, 9 aa, Homo Sapiens
APINEVALF

SEQ ID NO: 106420 - protein, 9 aa, Homo Sapiens
TTKKCIGPV

SEQ ID NO: 106421 - protein, 9 aa, Homo Sapiens
NVVSQSLEV

SEQ ID NO: 106422 - protein, 9 aa, Homo Sapiens
VQEKLIQDR

SEQ ID NO: 106423 - protein, 9 aa, Homo Sapiens
VLLVVMFWT

SEQ ID NO: 106424 - protein, 9 aa, Homo Sapiens
IGLEWELER

SEQ ID NO: 106425 - protein, 9 aa, Homo Sapiens
VALFNLMQV

SEQ ID NO: 106426 - protein, 9 aa, Homo Sapiens
ELRPASPGM

SEQ ID NO: 106427 - protein, 9 aa, Homo Sapiens
YIERHKHWP

SEQ ID NO: 106428 - protein, 9 aa, Homo Sapiens
PINEVALFN

SEQ ID NO: 106429 - protein, 9 aa, Homo Sapiens
RHKHWPFLL

SEQ ID NO: 106430 - protein, 9 aa, Homo Sapiens
AVSYLLFVC

SEQ ID NO: 106431 - protein, 9 aa, Homo Sapiens
REPTPPLHG

SEQ ID NO: 106432 - protein, 9 aa, Homo Sapiens
AVMAANAIA

SEQ ID NO: 106433 - protein, 9 aa, Homo Sapiens
PPGPRPTTG

SEQ ID NO: 106434 - protein, 9 aa, Homo Sapiens
NEVALFNLM

SEQ ID NO: 106435 - protein, 9 aa, Homo Sapiens
MSKACTNYD

SEQ ID NO: 106436 - protein, 9 aa, Homo Sapiens
SWKVSPTAS

SEQ ID NO: 106437 - protein, 9 aa, Homo Sapiens
YFTLTSHCV

SEQ ID NO: 106438 - protein, 9 aa, Homo Sapiens
RKLTLTCLA

SEQ ID NO: 106439 - protein, 9 aa, Homo Sapiens
LRESKVAEE

SEQ ID NO: 106440 - protein, 9 aa, Homo Sapiens
NVCLLDTLI

SEQ ID NO: 106441 - protein, 9 aa, Homo Sapiens
SPQGSFVED

SEQ ID NO: 106442 - protein, 9 aa, Homo Sapiens
TVYVDSLAE

SEQ ID NO: 106443 - protein, 9 aa, Homo Sapiens
LAQPYMIVS

SEQ ID NO: 106444 - protein, 9 aa, Homo Sapiens
PFDYYPNEK

SEQ ID NO: 106445 - protein, 9 aa, Homo Sapiens
LYVAVVNWH

SEQ ID NO: 106446 - protein, 9 aa, Homo Sapiens
LHQYKKCYS

SEQ ID NO: 106447 - protein, 9 aa, Homo Sapiens
PRQQEAELQ

SEQ ID NO: 106448 - protein, 9 aa, Homo Sapiens
ELQILGEIY

SEQ ID NO: 106449 - protein, 9 aa, Homo Sapiens
YGPPPPHYK

SEQ ID NO: 106450 - protein, 9 aa, Homo Sapiens
ILGEIYFNK

SEQ ID NO: 106451 - protein, 9 aa, Homo Sapiens
ACTNYDQMK

SEQ ID NO: 106452 - protein, 9 aa, Homo Sapiens
KYSMAKAEA

SEQ ID NO: 106453 - protein, 9 aa, Homo Sapiens
ITNLAVSYL

SEQ ID NO: 106454 - protein, 9 aa, Homo Sapiens
RILRLKDRH

SEQ ID NO: 106455 - protein, 9 aa, Homo Sapiens
FHRPGSGVE

SEQ ID NO: 106456 - protein, 9 aa, Homo Sapiens
DIDSQGGGS

SEQ ID NO: 106457 - protein, 9 aa, Homo Sapiens
REVDSISLE

SEQ ID NO: 106458 - protein, 9 aa, Homo Sapiens
VRLGFQSAL

SEQ ID NO: 106459 - protein, 9 aa, Homo Sapiens
YDQMKTPLK

SEQ ID NO: 106460 - protein, 9 aa, Homo Sapiens
SISLEEASG

SEQ ID NO: 106461 - protein, 9 aa, Homo Sapiens
PGFPAYVAG

SEQ ID NO: 106462 - protein, 9 aa, Homo Sapiens
FAAVDKNGN

SEQ ID NO: 106463 - protein, 9 aa, Homo Sapiens
ALKKVQIFV

SEQ ID NO: 106464 - protein, 9 aa, Homo Sapiens
DQRAPVLLV

SEQ ID NO: 106465 - protein, 9 aa, Homo Sapiens
FTLLSMDMP

SEQ ID NO: 106466 - protein, 9 aa, Homo Sapiens
TTFEKAHDC

SEQ ID NO: 106467 - protein, 9 aa, Homo Sapiens
GEKIPVSVL

SEQ ID NO: 106468 - protein, 9 aa, Homo Sapiens
YWDLYFEKA

SEQ ID NO: 106469 - protein, 9 aa, Homo Sapiens
DFSFPIFIL

SEQ ID NO: 106470 - protein, 9 aa, Homo Sapiens
RFHSRVGFT

SEQ ID NO: 106471 - protein, 9 aa, Homo Sapiens
SPVPFPQGT

SEQ ID NO: 106472 - protein, 9 aa, Homo Sapiens
KDRHGLIRA

SEQ ID NO: 106473 - protein, 9 aa, Homo Sapiens
QNPVQLDKG

SEQ ID NO: 106474 - protein, 9 aa, Homo Sapiens
VQRVLAGEK

SEQ ID NO: 106475 - protein, 9 aa, Homo Sapiens
VDSISLEEA

SEQ ID NO: 106476 - protein, 9 aa, Homo Sapiens
LAKKAKLRE

SEQ ID NO: 106477 - protein, 9 aa, Homo Sapiens
STDWSCTVR

SEQ ID NO: 106478 - protein, 9 aa, Homo Sapiens
LRMVRGTQV

SEQ ID NO: 106479 - protein, 9 aa, Homo Sapiens
IRRLHKVLW

SEQ ID NO: 106480 - protein, 9 aa, Homo Sapiens
LSPQGSFVE

SEQ ID NO: 106481 - protein, 9 aa, Homo Sapiens
QRNWLPGNL

SEQ ID NO: 106482 - protein, 9 aa, Homo Sapiens
FVEDTTGEQ

SEQ ID NO: 106483 - protein, 9 aa, Homo Sapiens
LDRVSDNPS

SEQ ID NO: 106484 - protein, 9 aa, Homo Sapiens
YKNFCDQPD

SEQ ID NO: 106485 - protein, 9 aa, Homo Sapiens
FCDQPDIRC

SEQ ID NO: 106486 - protein, 9 aa, Homo Sapiens
NYDQMKTPL

SEQ ID NO: 106487 - protein, 9 aa, Homo Sapiens
TVRCVCKDN

SEQ ID NO: 106488 - protein, 9 aa, Homo Sapiens
VLMKRMRQE

SEQ ID NO: 106489 - protein, 9 aa, Homo Sapiens
TPCDGNHAA

SEQ ID NO: 106490 - protein, 9 aa, Homo Sapiens
LREDLFNQV

SEQ ID NO: 106491 - protein, 9 aa, Homo Sapiens
MLKLRPCGS

SEQ ID NO: 106492 - protein, 9 aa, Homo Sapiens
RGTQIIHST

SEQ ID NO: 106493 - protein, 9 aa, Homo Sapiens
DQNLYEGKI

SEQ ID NO: 106494 - protein, 9 aa, Homo Sapiens
DETPRQQEA

SEQ ID NO: 106495 - protein, 9 aa, Homo Sapiens
QQEAELQEP

SEQ ID NO: 106496 - protein, 9 aa, Homo Sapiens
ATSVLDTSN

SEQ ID NO: 106497 - protein, 9 aa, Homo Sapiens
SSPYFTLTS

SEQ ID NO: 106498 - protein, 9 aa, Homo Sapiens
RPGSGVEEE

SEQ ID NO: 106499 - protein, 9 aa, Homo Sapiens
TTGQTVPTP

SEQ ID NO: 106500 - protein, 9 aa, Homo Sapiens
QYKKCYSIE

SEQ ID NO: 106501 - protein, 9 aa, Homo Sapiens
MTKTDIVKI

SEQ ID NO: 106502 - protein, 9 aa, Homo Sapiens
SGRYTCGAE

SEQ ID NO: 106503 - protein, 9 aa, Homo Sapiens
SSQNIEEYF

SEQ ID NO: 106504 - protein, 9 aa, Homo Sapiens
SQNCFTPLY

SEQ ID NO: 106505 - protein, 9 aa, Homo Sapiens
PLSTAFKGE

SEQ ID NO: 106506 - protein, 9 aa, Homo Sapiens
LDEDAPTSV

SEQ ID NO: 106507 - protein, 9 aa, Homo Sapiens
GQSGSKSAS

SEQ ID NO: 106508 - protein, 9 aa, Homo Sapiens
KKTIEENTK

SEQ ID NO: 106509 - protein, 9 aa, Homo Sapiens
EVQEKLIQD

SEQ ID NO: 106510 - protein, 9 aa, Homo Sapiens
DYFFKQPIN

SEQ ID NO: 106511 - protein, 9 aa, Homo Sapiens
NWHLESTQI

SEQ ID NO: 106512 - protein, 9 aa, Homo Sapiens
EKGERRENL

SEQ ID NO: 106513 - protein, 9 aa, Homo Sapiens
KVLKHRSYL

SEQ ID NO: 106514 - protein, 9 aa, Homo Sapiens
KACTNYDQM

SEQ ID NO: 106515 - protein, 9 aa, Homo Sapiens
CFTPLYMAA

SEQ ID NO: 106516 - protein, 9 aa, Homo Sapiens
AAVLPCEID

SEQ ID NO: 106517 - protein, 9 aa, Homo Sapiens
QPFDYYPNE

SEQ ID NO: 106518 - protein, 9 aa, Homo Sapiens
TPPLHGDMS

SEQ ID NO: 106519 - protein, 9 aa, Homo Sapiens
AFSWMNNLL

SEQ ID NO: 106520 - protein, 9 aa, Homo Sapiens
VSLTVYVDS

SEQ ID NO: 106521 - protein, 9 aa, Homo Sapiens
TMGNQEWKL

SEQ ID NO: 106522 - protein, 9 aa, Homo Sapiens
RWNETIGLE

SEQ ID NO: 106523 - protein, 9 aa, Homo Sapiens
RGQSGSKSA

SEQ ID NO: 106524 - protein, 9 aa, Homo Sapiens
LRGTQIIHS

SEQ ID NO: 106525 - protein, 9 aa, Homo Sapiens
SVLMKRMRQ

SEQ ID NO: 106526 - protein, 9 aa, Homo Sapiens
DHPSEVQEK

SEQ ID NO: 106527 - protein, 9 aa, Homo Sapiens
EEHLRGTIG

SEQ ID NO: 106528 - protein, 9 aa, Homo Sapiens
VGDEIVYRI

SEQ ID NO: 106529 - protein, 9 aa, Homo Sapiens
WDFDIYWDL

SEQ ID NO: 106530 - protein, 9 aa, Homo Sapiens
FAAASWKVS

SEQ ID NO: 106531 - protein, 9 aa, Homo Sapiens
GAENRLGSQ

SEQ ID NO: 106532 - protein, 9 aa, Homo Sapiens
VMAANAIAQ

SEQ ID NO: 106533 - protein, 9 aa, Homo Sapiens
IYFNKSLYE

SEQ ID NO: 106534 - protein, 9 aa, Homo Sapiens
NLWFQAGMM

SEQ ID NO: 106535 - protein, 9 aa, Homo Sapiens
PPGFPAYVA

SEQ ID NO: 106536 - protein, 9 aa, Homo Sapiens
GWAGWLLVE

SEQ ID NO: 106537 - protein, 9 aa, Homo Sapiens
IHSTLETTF

SEQ ID NO: 106538 - protein, 9 aa, Homo Sapiens
DAPINEVAL

SEQ ID NO: 106539 - protein, 9 aa, Homo Sapiens
AAADFTLLS

SEQ ID NO: 106540 - protein, 9 aa, Homo Sapiens
SSKKYSMAK

SEQ ID NO: 106541 - protein, 9 aa, Homo Sapiens
QSQNCFTPL

SEQ ID NO: 106542 - protein, 9 aa, Homo Sapiens
KPRRELRPA

SEQ ID NO: 106543 - protein, 9 aa, Homo Sapiens
AMDRWNETI

SEQ ID NO: 106544 - protein, 9 aa, Homo Sapiens
TLTCLASAP

SEQ ID NO: 106545 - protein, 9 aa, Homo Sapiens
LYEGKIPGT

SEQ ID NO: 106546 - protein, 9 aa, Homo Sapiens
KNLGTTKKC

SEQ ID NO: 106547 - protein, 9 aa, Homo Sapiens
LDEATSVLD

SEQ ID NO: 106548 - protein, 9 aa, Homo Sapiens
QRQNPVQLD

SEQ ID NO: 106549 - protein, 9 aa, Homo Sapiens
KAHDCAEVC

SEQ ID NO: 106550 - protein, 9 aa, Homo Sapiens
RVDQNLYEG

SEQ ID NO: 106551 - protein, 9 aa, Homo Sapiens
KQVCVLTDA

SEQ ID NO: 106552 - protein, 9 aa, Homo Sapiens
WSCTVRWEN

SEQ ID NO: 106553 - protein, 9 aa, Homo Sapiens
LPSSLVELH

SEQ ID NO: 106554 - protein, 9 aa, Homo Sapiens
RNVCLLDTL

SEQ ID NO: 106555 - protein, 9 aa, Homo Sapiens
VCLLDTLIS

SEQ ID NO: 106556 - protein, 9 aa, Homo Sapiens
SNYDSSQNI

SEQ ID NO: 106557 - protein, 9 aa, Homo Sapiens
SPLTPCDGN

SEQ ID NO: 106558 - protein, 9 aa, Homo Sapiens
FPAYVAGPV

SEQ ID NO: 106559 - protein, 9 aa, Homo Sapiens
LKRVDQNLY

SEQ ID NO: 106560 - protein, 9 aa, Homo Sapiens
GITMGNQEW

SEQ ID NO: 106561 - protein, 9 aa, Homo Sapiens
LTLTCLASA

SEQ ID NO: 106562 - protein, 9 aa, Homo Sapiens
QVCVLTDAV

SEQ ID NO: 106563 - protein, 9 aa, Homo Sapiens
SVLDTSNER

SEQ ID NO: 106564 - protein, 9 aa, Homo Sapiens
SKRISCRPQ

SEQ ID NO: 106565 - protein, 9 aa, Homo Sapiens
VLLLNPPLS

SEQ ID NO: 106566 - protein, 9 aa, Homo Sapiens
ASSVSTSKR

SEQ ID NO: 106567 - protein, 9 aa, Homo Sapiens
ECNIETVRC

SEQ ID NO: 106568 - protein, 9 aa, Homo Sapiens
VMMDAKARQ

SEQ ID NO: 106569 - protein, 9 aa, Homo Sapiens
TPRQQEAEL

SEQ ID NO: 106570 - protein, 9 aa, Homo Sapiens
CDQPDIRCP

SEQ ID NO: 106571 - protein, 9 aa, Homo Sapiens
GFPAYVAGP

SEQ ID NO: 106572 - protein, 9 aa, Homo Sapiens
LGFQSALAL

SEQ ID NO: 106573 - protein, 9 aa, Homo Sapiens
RMVRGTQVY

SEQ ID NO: 106574 - protein, 9 aa, Homo Sapiens
LECGKVLKH

SEQ ID NO: 106575 - protein, 9 aa, Homo Sapiens
SSDDAVQRV

SEQ ID NO: 106576 - protein, 9 aa, Homo Sapiens
YAQLKLSGL

SEQ ID NO: 106577 - protein, 9 aa, Homo Sapiens
CSDRVSNSD

SEQ ID NO: 106578 - protein, 9 aa, Homo Sapiens
AYVAGPVPS

SEQ ID NO: 106579 - protein, 9 aa, Homo Sapiens
LEKTPLGEH

SEQ ID NO: 106580 - protein, 9 aa, Homo Sapiens
LARVGACDS

SEQ ID NO: 106581 - protein, 9 aa, Homo Sapiens
CLASAPVPF

SEQ ID NO: 106582 - protein, 9 aa, Homo Sapiens
SLEEASGMH

SEQ ID NO: 106583 - protein, 9 aa, Homo Sapiens
PLHGDMSTG

SEQ ID NO: 106584 - protein, 9 aa, Homo Sapiens
ASWKVSPTA

SEQ ID NO: 106585 - protein, 9 aa, Homo Sapiens
LDTLISPGN

SEQ ID NO: 106586 - protein, 9 aa, Homo Sapiens
DNPSITAKL

SEQ ID NO: 106587 - protein, 9 aa, Homo Sapiens
QYLSSLELE

SEQ ID NO: 106588 - protein, 9 aa, Homo Sapiens
CGSDMLPAQ

SEQ ID NO: 106589 - protein, 9 aa, Homo Sapiens
PCDGNHAAQ

SEQ ID NO: 106590 - protein, 9 aa, Homo Sapiens
RREVDSISL

SEQ ID NO: 106591 - protein, 9 aa, Homo Sapiens
MEEKGERRE

SEQ ID NO: 106592 - protein, 9 aa, Homo Sapiens
CDGNHAAQQ

SEQ ID NO: 106593 - protein, 9 aa, Homo Sapiens
PRQRNWLPG

SEQ ID NO: 106594 - protein, 9 aa, Homo Sapiens
HASSPYFTL

SEQ ID NO: 106595 - protein, 9 aa, Homo Sapiens
VPPPKTARD

SEQ ID NO: 106596 - protein, 9 aa, Homo Sapiens
GNHAAQQLT

SEQ ID NO: 106597 - protein, 9 aa, Homo Sapiens
DEATSVLDT

SEQ ID NO: 106598 - protein, 9 aa, Homo Sapiens
ALAGTDTSR

SEQ ID NO: 106599 - protein, 9 aa, Homo Sapiens
MAANAIAQS

SEQ ID NO: 106600 - protein, 9 aa, Homo Sapiens
KKAKLREDL

SEQ ID NO: 106601 - protein, 9 aa, Homo Sapiens
KQYLSSLEL

SEQ ID NO: 106602 - protein, 9 aa, Homo Sapiens
TDTSRQGPT

SEQ ID NO: 106603 - protein, 9 aa, Homo Sapiens
GHDYSFLKN

SEQ ID NO: 106604 - protein, 9 aa, Homo Sapiens
STSKRISCR

SEQ ID NO: 106605 - protein, 9 aa, Homo Sapiens
KKVQIFVMM

SEQ ID NO: 106606 - protein, 9 aa, Homo Sapiens
NYITYKNFC

SEQ ID NO: 106607 - protein, 9 aa, Homo Sapiens
QPYMIVSIR

SEQ ID NO: 106608 - protein, 9 aa, Homo Sapiens
VEEWTSLDE

SEQ ID NO: 106609 - protein, 9 aa, Homo Sapiens
FDYYPNEKS

SEQ ID NO: 106610 - protein, 9 aa, Homo Sapiens
SREPTPPLH

SEQ ID NO: 106611 - protein, 9 aa, Homo Sapiens
LYSGNSNKD

SEQ ID NO: 106612 - protein, 9 aa, Homo Sapiens
HQYKKCYSI

SEQ ID NO: 106613 - protein, 9 aa, Homo Sapiens
VAYVTTGDS

SEQ ID NO: 106614 - protein, 9 aa, Homo Sapiens
SEVQEKLIQ

SEQ ID NO: 106615 - protein, 9 aa, Homo Sapiens
DSGRYTCGA

SEQ ID NO: 106616 - protein, 9 aa, Homo Sapiens
QGSFVEDTT

SEQ ID NO: 106617 - protein, 9 aa, Homo Sapiens
AQSQNCFTP

SEQ ID NO: 106618 - protein, 9 aa, Homo Sapiens
SSAAVLPCE

SEQ ID NO: 106619 - protein, 9 aa, Homo Sapiens
ANLHQYKKC

SEQ ID NO: 106620 - protein, 9 aa, Homo Sapiens
PLGEHSVNF

SEQ ID NO: 106621 - protein, 9 aa, Homo Sapiens
YYPNEKSKH

SEQ ID NO: 106622 - protein, 9 aa, Homo Sapiens
DFTLLSMDM

SEQ ID NO: 106623 - protein, 9 aa, Homo Sapiens
FRGQTIKFL

SEQ ID NO: 106624 - protein, 9 aa, Homo Sapiens
LPNLRMVRG

SEQ ID NO: 106625 - protein, 9 aa, Homo Sapiens
GKPWHKNCL

SEQ ID NO: 106626 - protein, 9 aa, Homo Sapiens
DVEEWTSLD

SEQ ID NO: 106627 - protein, 9 aa, Homo Sapiens
SQSLEVAPG

SEQ ID NO: 106628 - protein, 9 aa, Homo Sapiens
DEIVYRILK

SEQ ID NO: 106629 - protein, 9 aa, Homo Sapiens
HQHQHQQQQ

SEQ ID NO: 106630 - protein, 9 aa, Homo Sapiens
IPVSVLMKR

SEQ ID NO: 106631 - protein, 9 aa, Homo Sapiens
LSSLELEMD

SEQ ID NO: 106632 - protein, 9 aa, Homo Sapiens
ENEKIVWVR

SEQ ID NO: 106633 - protein, 9 aa, Homo Sapiens
AADFTLLSM

SEQ ID NO: 106634 - protein, 9 aa, Homo Sapiens
RLGFQSALA

SEQ ID NO: 106635 - protein, 9 aa, Homo Sapiens
EHILRKRDY

SEQ ID NO: 106636 - protein, 9 aa, Homo Sapiens
IASPVPFPQ

SEQ ID NO: 106637 - protein, 9 aa, Homo Sapiens
NLAKKAKLR

SEQ ID NO: 106638 - protein, 9 aa, Homo Sapiens
HGDMSTGPI

SEQ ID NO: 106639 - protein, 9 aa, Homo Sapiens
AGWLLVECS

SEQ ID NO: 106640 - protein, 9 aa, Homo Sapiens
IEENTKNRI

SEQ ID NO: 106641 - protein, 9 aa, Homo Sapiens
TNLAVSYLL

SEQ ID NO: 106642 - protein, 9 aa, Homo Sapiens
TTLTLMLNP

SEQ ID NO: 106643 - protein, 9 aa, Homo Sapiens
IFILEDENE

SEQ ID NO: 106644 - protein, 9 aa, Homo Sapiens
NLESKKLMK

SEQ ID NO: 106645 - protein, 9 aa, Homo Sapiens
LSTAFKGEK

SEQ ID NO: 106646 - protein, 9 aa, Homo Sapiens
VELHIHDNR

SEQ ID NO: 106647 - protein, 9 aa, Homo Sapiens
RVNVVSQSL

SEQ ID NO: 106648 - protein, 9 aa, Homo Sapiens
IIHSTLETT

SEQ ID NO: 106649 - protein, 9 aa, Homo Sapiens
DECNIETVR

SEQ ID NO: 106650 - protein, 9 aa, Homo Sapiens
YITYKNFCD

SEQ ID NO: 106651 - protein, 9 aa, Homo Sapiens
VMLQPFDYY

SEQ ID NO: 106652 - protein, 9 aa, Homo Sapiens
TLTSHCVIP

SEQ ID NO: 106653 - protein, 9 aa, Homo Sapiens
SYIERHKHW

SEQ ID NO: 106654 - protein, 9 aa, Homo Sapiens
APVRLGFQS

SEQ ID NO: 106655 - protein, 9 aa, Homo Sapiens
HSRVGFTGT

SEQ ID NO: 106656 - protein, 9 aa, Homo Sapiens
KKKKKKWPF

SEQ ID NO: 106657 - protein, 9 aa, Homo Sapiens
VYVDSLAEL

SEQ ID NO: 106658 - protein, 9 aa, Homo Sapiens
GQTIKFLKH

SEQ ID NO: 106659 - protein, 9 aa, Homo Sapiens
KLSSDDAVQ

SEQ ID NO: 106660 - protein, 9 aa, Homo Sapiens
LLSMDMPST

SEQ ID NO: 106661 - protein, 9 aa, Homo Sapiens
LTEENEKIV

SEQ ID NO: 106662 - protein, 9 aa, Homo Sapiens
VVNWHLEST

SEQ ID NO: 106663 - protein, 9 aa, Homo Sapiens
VKQYLSSLE

SEQ ID NO: 106664 - protein, 9 aa, Homo Sapiens
ILLDEATSV

SEQ ID NO: 106665 - protein, 9 aa, Homo Sapiens
DIYWDLYFE

SEQ ID NO: 106666 - protein, 9 aa, Homo Sapiens
LLMTKTDIV

SEQ ID NO: 106667 - protein, 9 aa, Homo Sapiens
VNVVSQSLE

SEQ ID NO: 106668 - protein, 9 aa, Homo Sapiens
SKKTIEENT

SEQ ID NO: 106669 - protein, 9 aa, Homo Sapiens
RPTTGQTVP

SEQ ID NO: 106670 - protein, 9 aa, Homo Sapiens
LWFQAGMMN

SEQ ID NO: 106671 - protein, 9 aa, Homo Sapiens
GAPRFHSRV

SEQ ID NO: 106672 - protein, 9 aa, Homo Sapiens
LRPCGSDML

SEQ ID NO: 106673 - protein, 9 aa, Homo Sapiens
LRLKDRHGL

SEQ ID NO: 106674 - protein, 9 aa, Homo Sapiens
DYYPNEKSK

SEQ ID NO: 106675 - protein, 9 aa, Homo Sapiens
HDCAEVCSA

SEQ ID NO: 106676 - protein, 9 aa, Homo Sapiens
EFGTCFQAV

SEQ ID NO: 106677 - protein, 9 aa, Homo Sapiens
FPIFILEDE

SEQ ID NO: 106678 - protein, 9 aa, Homo Sapiens
EHSVNFSLT

SEQ ID NO: 106679 - protein, 9 aa, Homo Sapiens
CIGPVYSSK

SEQ ID NO: 106680 - protein, 9 aa, Homo Sapiens
IKFLKHRFS

SEQ ID NO: 106681 - protein, 9 aa, Homo Sapiens
TSVAYVTTG

SEQ ID NO: 106682 - protein, 9 aa, Homo Sapiens
DVLDRVSDN

SEQ ID NO: 106683 - protein, 9 aa, Homo Sapiens
SMAKAEAEA

SEQ ID NO: 106684 - protein, 9 aa, Homo Sapiens
KKYSMAKAE

SEQ ID NO: 106685 - protein, 9 aa, Homo Sapiens
NDIASPVPF

SEQ ID NO: 106686 - protein, 9 aa, Homo Sapiens
PWHKNCLRC

SEQ ID NO: 106687 - protein, 9 aa, Homo Sapiens
DSISLEEAS

SEQ ID NO: 106688 - protein, 9 aa, Homo Sapiens
PSEVQEKLI

SEQ ID NO: 106689 - protein, 9 aa, Homo Sapiens
KKKKKWPFH

SEQ ID NO: 106690 - protein, 9 aa, Homo Sapiens
MDRWNETIG

SEQ ID NO: 106691 - protein, 9 aa, Homo Sapiens
SSLELEMDE

SEQ ID NO: 106692 - protein, 9 aa, Homo Sapiens
SDNPSITAK

SEQ ID NO: 106693 - protein, 9 aa, Homo Sapiens
IHIKLEDII

SEQ ID NO: 106694 - protein, 9 aa, Homo Sapiens
LLNPPLSTA

SEQ ID NO: 106695 - protein, 9 aa, Homo Sapiens
WDSSTDWSC

SEQ ID NO: 106696 - protein, 9 aa, Homo Sapiens
FLLMTKTDI

SEQ ID NO: 106697 - protein, 9 aa, Homo Sapiens
DGNHAAQQL

SEQ ID NO: 106698 - protein, 9 aa, Homo Sapiens
QIIHSTLET

SEQ ID NO: 106699 - protein, 9 aa, Homo Sapiens
NCLRCAKCG

SEQ ID NO: 106700 - protein, 9 aa, Homo Sapiens
AKDDNLYSG

SEQ ID NO: 106701 - protein, 9 aa, Homo Sapiens
RELRPASPG

SEQ ID NO: 106702 - protein, 9 aa, Homo Sapiens
LMTKTDIVK

SEQ ID NO: 106703 - protein, 9 aa, Homo Sapiens
RQRNWLPGN

SEQ ID NO: 106704 - protein, 9 aa, Homo Sapiens
NDNRNVCLL

SEQ ID NO: 106705 - protein, 9 aa, Homo Sapiens
EVALFNLMQ

SEQ ID NO: 106706 - protein, 9 aa, Homo Sapiens
RLHKVLWPF

SEQ ID NO: 106707 - protein, 9 aa, Homo Sapiens
FSANLHQYK

SEQ ID NO: 106708 - protein, 9 aa, Homo Sapiens
KRKLTLTCL

SEQ ID NO: 106709 - protein, 9 aa, Homo Sapiens
GTDTSRQGP

SEQ ID NO: 106710 - protein, 9 aa, Homo Sapiens
ASSPYFTLT

SEQ ID NO: 106711 - protein, 9 aa, Homo Sapiens
KHFAAASWK

SEQ ID NO: 106712 - protein, 9 aa, Homo Sapiens
KKWPFHKMA

SEQ ID NO: 106713 - protein, 9 aa, Homo Sapiens
PTALRESKV

SEQ ID NO: 106714 - protein, 9 aa, Homo Sapiens
VSQSLEVAP

SEQ ID NO: 106715 - protein, 9 aa, Homo Sapiens
NVNAQSQNC

SEQ ID NO: 106716 - protein, 9 aa, Homo Sapiens
AHTGTLMRS

SEQ ID NO: 106717 - protein, 9 aa, Homo Sapiens
PHYKGRRMG

SEQ ID NO: 106718 - protein, 9 aa, Homo Sapiens
VHVPPPKTA

SEQ ID NO: 106719 - protein, 9 aa, Homo Sapiens
LTSHCVIPK

SEQ ID NO: 106720 - protein, 9 aa, Homo Sapiens
HKNCLRCAK

SEQ ID NO: 106721 - protein, 9 aa, Homo Sapiens
WPFLLFLSL

SEQ ID NO: 106722 - protein, 9 aa, Homo Sapiens
MSDDLGDEW

SEQ ID NO: 106723 - protein, 9 aa, Homo Sapiens
LPVLMAVMA

SEQ ID NO: 106724 - protein, 9 aa, Homo Sapiens
YPNEKSKHK

SEQ ID NO: 106725 - protein, 9 aa, Homo Sapiens
LQPFDYYPN

SEQ ID NO: 106726 - protein, 9 aa, Homo Sapiens
HKVLWPFLL

SEQ ID NO: 106727 - protein, 9 aa, Homo Sapiens
GSKSASRTT

SEQ ID NO: 106728 - protein, 9 aa, Homo Sapiens
ERHKHWPFL

SEQ ID NO: 106729 - protein, 9 aa, Homo Sapiens
PPPPHYKGR

SEQ ID NO: 106730 - protein, 9 aa, Homo Sapiens
NRNVCLLDT

SEQ ID NO: 106731 - protein, 9 aa, Homo Sapiens
FSFPIFILE

SEQ ID NO: 106732 - protein, 9 aa, Homo Sapiens
ILRLKDRHG

SEQ ID NO: 106733 - protein, 9 aa, Homo Sapiens
SQGGGSSQP

SEQ ID NO: 106734 - protein, 9 aa, Homo Sapiens
NFCDQPDIR

SEQ ID NO: 106735 - protein, 9 aa, Homo Sapiens
GFHRPGSGV

SEQ ID NO: 106736 - protein, 9 aa, Homo Sapiens
VRSPRQRNW

SEQ ID NO: 106737 - protein, 9 aa, Homo Sapiens
RPCGSDMLP

SEQ ID NO: 106738 - protein, 9 aa, Homo Sapiens
DTSRQGPTV

SEQ ID NO: 106739 - protein, 9 aa, Homo Sapiens
VNWHLESTQ

SEQ ID NO: 106740 - protein, 9 aa, Homo Sapiens
DRHGLIRAR

SEQ ID NO: 106741 - protein, 9 aa, Homo Sapiens
IVSIRLLLW

SEQ ID NO: 106742 - protein, 9 aa, Homo Sapiens
PGRVNVVSQ

SEQ ID NO: 106743 - protein, 9 aa, Homo Sapiens
SENNAKNSY

SEQ ID NO: 106744 - protein, 9 aa, Homo Sapiens
LMAVMAANA

SEQ ID NO: 106745 - protein, 9 aa, Homo Sapiens
IKLEDIIQM

SEQ ID NO: 106746 - protein, 9 aa, Homo Sapiens
KRISCRPQI

SEQ ID NO: 106747 - protein, 9 aa, Homo Sapiens
SQNIEEYFA

SEQ ID NO: 106748 - protein, 9 aa, Homo Sapiens
AVVNWHLES

SEQ ID NO: 106749 - protein, 9 aa, Homo Sapiens
GSDHPSEVQ

SEQ ID NO: 106750 - protein, 9 aa, Homo Sapiens
TIVHVPPPK

SEQ ID NO: 106751 - protein, 9 aa, Homo Sapiens
VDFAAVDKN

SEQ ID NO: 106752 - protein, 9 aa, Homo Sapiens
CDSQLKGVS

SEQ ID NO: 106753 - protein, 9 aa, Homo Sapiens
EWKLQELSV

SEQ ID NO: 106754 - protein, 9 aa, Homo Sapiens
KNCLRCAKC

SEQ ID NO: 106755 - protein, 9 aa, Homo Sapiens
EVDSISLEE

SEQ ID NO: 106756 - protein, 9 aa, Homo Sapiens
VAVVNWHLE

SEQ ID NO: 106757 - protein, 9 aa, Homo Sapiens
KDDNLYSGN

SEQ ID NO: 106758 - protein, 9 aa, Homo Sapiens
AFLLMTKTD

SEQ ID NO: 106759 - protein, 9 aa, Homo Sapiens
IFLCDCSDR

SEQ ID NO: 106760 - protein, 9 aa, Homo Sapiens
PYMIVSIRL

SEQ ID NO: 106761 - protein, 9 aa, Homo Sapiens
KQPINQFSL

SEQ ID NO: 106762 - protein, 9 aa, Homo Sapiens
ECGKVLKHR

SEQ ID NO: 106763 - protein, 9 aa, Homo Sapiens
VSYLLFVCT

SEQ ID NO: 106764 - protein, 9 aa, Homo Sapiens
PRFHSRVGF

SEQ ID NO: 106765 - protein, 9 aa, Homo Sapiens
ERRENLLPK

SEQ ID NO: 106766 - protein, 9 aa, Homo Sapiens
GGWAGWLLV

SEQ ID NO: 106767 - protein, 9 aa, Homo Sapiens
RYTCGAENR

SEQ ID NO: 106768 - protein, 9 aa, Homo Sapiens
EKQVCVLTD

SEQ ID NO: 106769 - protein, 9 aa, Homo Sapiens
GGSSQPDTI

SEQ ID NO: 106770 - protein, 9 aa, Homo Sapiens
LEFGTCFQA

SEQ ID NO: 106771 - protein, 9 aa, Homo Sapiens
SKVAEEEEW

SEQ ID NO: 106772 - protein, 9 aa, Homo Sapiens
DFAAVDKNG

SEQ ID NO: 106773 - protein, 9 aa, Homo Sapiens
TLTLMLNPI

SEQ ID NO: 106774 - protein, 9 aa, Homo Sapiens
LRTNLWFQA

SEQ ID NO: 106775 - protein, 9 aa, Homo Sapiens
LWLQNCLIL

SEQ ID NO: 106776 - protein, 9 aa, Homo Sapiens
TALRESKVA

SEQ ID NO: 106777 - protein, 9 aa, Homo Sapiens
HILRKRDYK

SEQ ID NO: 106778 - protein, 9 aa, Homo Sapiens
SKKYSMAKA

SEQ ID NO: 106779 - protein, 9 aa, Homo Sapiens
RESKVAEEE

SEQ ID NO: 106780 - protein, 9 aa, Homo Sapiens
EEKGERREN

SEQ ID NO: 106781 - protein, 9 aa, Homo Sapiens
SRVGFTGTM

SEQ ID NO: 106782 - protein, 9 aa, Homo Sapiens
GVDFAAVDK

SEQ ID NO: 106783 - protein, 9 aa, Homo Sapiens
TEPSSAQRQ

SEQ ID NO: 106784 - protein, 9 aa, Homo Sapiens
CAEVCSAIF

SEQ ID NO: 106785 - protein, 9 aa, Homo Sapiens
WLPGNLFQR

SEQ ID NO: 106786 - protein, 9 aa, Homo Sapiens
AHDCAEVCS

SEQ ID NO: 106787 - protein, 9 aa, Homo Sapiens
TQIIHSTLE

SEQ ID NO: 106788 - protein, 9 aa, Homo Sapiens
ECLECGKVL

SEQ ID NO: 106789 - protein, 9 aa, Homo Sapiens
AGTDTSRQG

SEQ ID NO: 106790 - protein, 9 aa, Homo Sapiens
VKLALEHIL

SEQ ID NO: 106791 - protein, 9 aa, Homo Sapiens
LQNDIASPV

SEQ ID NO: 106792 - protein, 9 aa, Homo Sapiens
LQDETPRQQ

SEQ ID NO: 106793 - protein, 9 aa, Homo Sapiens
TLMLNPIIY

SEQ ID NO: 106794 - protein, 9 aa, Homo Sapiens
SDLVSLTVY

SEQ ID NO: 106795 - protein, 9 aa, Homo Sapiens
AISSKKYSM

SEQ ID NO: 106796 - protein, 9 aa, Homo Sapiens
TYKNFCDQP

SEQ ID NO: 106797 - protein, 9 aa, Homo Sapiens
ILAADDREE

SEQ ID NO: 106798 - protein, 9 aa, Homo Sapiens
RRLHKVLWP

SEQ ID NO: 106799 - protein, 9 aa, Homo Sapiens
EIYFNKSLY

SEQ ID NO: 106800 - protein, 9 aa, Homo Sapiens
MKDYFFKQP

SEQ ID NO: 106801 - protein, 9 aa, Homo Sapiens
KNLESKKLM

SEQ ID NO: 106802 - protein, 9 aa, Homo Sapiens
YFNKSLYEG

SEQ ID NO: 106803 - protein, 9 aa, Homo Sapiens
KKKKKKKWP

SEQ ID NO: 106804 - protein, 9 aa, Homo Sapiens
SYLLFVCTL

SEQ ID NO: 106805 - protein, 9 aa, Homo Sapiens
VDKNGNNAL

SEQ ID NO: 106806 - protein, 9 aa, Homo Sapiens
MLQPFDYYP

SEQ ID NO: 106807 - protein, 9 aa, Homo Sapiens
KLRPCGSDM

SEQ ID NO: 106808 - protein, 9 aa, Homo Sapiens
ARVGACDSQ

SEQ ID NO: 106809 - protein, 9 aa, Homo Sapiens
TPLTEENEK

SEQ ID NO: 106810 - protein, 9 aa, Homo Sapiens
INEVALFNL

SEQ ID NO: 106811 - protein, 9 aa, Homo Sapiens
TIKFLKHRF

SEQ ID NO: 106812 - protein, 9 aa, Homo Sapiens
KKKWPFHKM

SEQ ID NO: 106813 - protein, 9 aa, Homo Sapiens
EIVYRILKA

SEQ ID NO: 106814 - protein, 9 aa, Homo Sapiens
KPWHKNCLR

SEQ ID NO: 106815 - protein, 9 aa, Homo Sapiens
VEYLQFAFS

SEQ ID NO: 106816 - protein, 9 aa, Homo Sapiens
KNGNNALHL

SEQ ID NO: 106817 - protein, 9 aa, Homo Sapiens
PPLSTAFKG

SEQ ID NO: 106818 - protein, 9 aa, Homo Sapiens
PPPHYKGRR

SEQ ID NO: 106819 - protein, 9 aa, Homo Sapiens
QKAQTEGNE

SEQ ID NO: 106820 - protein, 9 aa, Homo Sapiens
QDDQDDIHI

SEQ ID NO: 106821 - protein, 9 aa, Homo Sapiens
NAQSQNCFT

SEQ ID NO: 106822 - protein, 9 aa, Homo Sapiens
AAASWKVSP

SEQ ID NO: 106823 - protein, 9 aa, Homo Sapiens
NLYEGKIPG

SEQ ID NO: 106824 - protein, 9 aa, Homo Sapiens
KKKKWPFHK

SEQ ID NO: 106825 - protein, 9 aa, Homo Sapiens
ASRGQSGSK

SEQ ID NO: 106826 - protein, 9 aa, Homo Sapiens
QNCFTPLYM

SEQ ID NO: 106827 - protein, 9 aa, Homo Sapiens
QRAPVLLVV

SEQ ID NO: 106828 - protein, 9 aa, Homo Sapiens
PASPGMIDV

SEQ ID NO: 106829 - protein, 9 aa, Homo Sapiens
LILAADDRE

SEQ ID NO: 106830 - protein, 9 aa, Homo Sapiens
KIKEAGGIY

SEQ ID NO: 106831 - protein, 9 aa, Homo Sapiens
LFNLMQVGR

SEQ ID NO: 106832 - protein, 9 aa, Homo Sapiens
ENHKIKAYA

SEQ ID NO: 106833 - protein, 9 aa, Homo Sapiens
HWPFLLFLS

SEQ ID NO: 106834 - protein, 9 aa, Homo Sapiens
PCGSDMLPA

SEQ ID NO: 106835 - protein, 9 aa, Homo Sapiens
KLTLTCLAS

SEQ ID NO: 106836 - protein, 9 aa, Homo Sapiens
SPYFTLTSH

SEQ ID NO: 106837 - protein, 9 aa, Homo Sapiens
EATSVLDTS

SEQ ID NO: 106838 - protein, 9 aa, Homo Sapiens
TGTLMRSCM

SEQ ID NO: 106839 - protein, 9 aa, Homo Sapiens
DKNGNNALH

SEQ ID NO: 106840 - protein, 9 aa, Homo Sapiens
RRENLLPKK

SEQ ID NO: 106841 - protein, 9 aa, Homo Sapiens
SDDAVQRVL

SEQ ID NO: 106842 - protein, 9 aa, Homo Sapiens
YLQFAFSWM

SEQ ID NO: 106843 - protein, 9 aa, Homo Sapiens
KPYKCDICG

SEQ ID NO: 106844 - protein, 9 aa, Homo Sapiens
HVPPPKTAR

SEQ ID NO: 106845 - protein, 9 aa, Homo Sapiens
KGRRMGPPV

SEQ ID NO: 106846 - protein, 9 aa, Homo Sapiens
PYFTLTSHC

SEQ ID NO: 106847 - protein, 9 aa, Homo Sapiens
KTPLGEHSV

SEQ ID NO: 106848 - protein, 9 aa, Homo Sapiens
WLQNCLILA

SEQ ID NO: 106849 - protein, 9 aa, Homo Sapiens
EDFSFPIFI

SEQ ID NO: 106850 - protein, 9 aa, Homo Sapiens
NLYSGNSNK

SEQ ID NO: 106851 - protein, 9 aa, Homo Sapiens
PAYVAGPVP

SEQ ID NO: 106852 - protein, 9 aa, Homo Sapiens
FITNLAVSY

SEQ ID NO: 106853 - protein, 9 aa, Homo Sapiens
QFAFSWMNN

SEQ ID NO: 106854 - protein, 9 aa, Homo Sapiens
CGKVLKHRS

SEQ ID NO: 106855 - protein, 9 aa, Homo Sapiens
WAGWLLVEC

SEQ ID NO: 106856 - protein, 9 aa, Homo Sapiens
FFKQPINQF

SEQ ID NO: 106857 - protein, 9 aa, Homo Sapiens
YVAVVNWHL

SEQ ID NO: 106858 - protein, 9 aa, Homo Sapiens
QHQHQHQQQ

SEQ ID NO: 106859 - protein, 9 aa, Homo Sapiens
TIGLKLGPA

SEQ ID NO: 106860 - protein, 9 aa, Homo Sapiens
EYLQFAFSW

SEQ ID NO: 106861 - protein, 9 aa, Homo Sapiens
TSRQGPTVL

SEQ ID NO: 106862 - protein, 9 aa, Homo Sapiens
SLTVYVDSL

SEQ ID NO: 106863 - protein, 9 aa, Homo Sapiens
LALEHILRK

SEQ ID NO: 106864 - protein, 9 aa, Homo Sapiens
HYKGRRMGP

SEQ ID NO: 106865 - protein, 9 aa, Homo Sapiens
HHPPEQKAQ

SEQ ID NO: 106866 - protein, 9 aa, Homo Sapiens
NNAKNSYRN

SEQ ID NO: 106867 - protein, 9 aa, Homo Sapiens
PQGSFVEDT

SEQ ID NO: 106868 - protein, 9 aa, Homo Sapiens
DDAVQRVLA

SEQ ID NO: 106869 - protein, 9 aa, Homo Sapiens
IRVRGHDYS

SEQ ID NO: 106870 - protein, 9 aa, Homo Sapiens
MWDFDIYWD

SEQ ID NO: 106871 - protein, 9 aa, Homo Sapiens
KSASRTTRN

SEQ ID NO: 106872 - protein, 9 aa, Homo Sapiens
DDQDDIHIK

SEQ ID NO: 106873 - protein, 9 aa, Homo Sapiens
GTTKKCIGP

SEQ ID NO: 106874 - protein, 9 aa, Homo Sapiens
FEKAHDCAE

SEQ ID NO: 106875 - protein, 9 aa, Homo Sapiens
SVAYVTTGD

SEQ ID NO: 106876 - protein, 9 aa, Homo Sapiens
AAVDKNGNN

SEQ ID NO: 106877 - protein, 9 aa, Homo Sapiens
LESKKLMKA

SEQ ID NO: 106878 - protein, 9 aa, Homo Sapiens
AQRQNPVQL

SEQ ID NO: 106879 - protein, 9 aa, Homo Sapiens
DGAPRFHSR

SEQ ID NO: 106880 - protein, 9 aa, Homo Sapiens
FQAGMMNGR

SEQ ID NO: 106881 - protein, 9 aa, Homo Sapiens
LAVSYLLFV

SEQ ID NO: 106882 - protein, 9 aa, Homo Sapiens
NCLILAADD

SEQ ID NO: 106883 - protein, 9 aa, Homo Sapiens
NMEISEEKK

SEQ ID NO: 106884 - protein, 9 aa, Homo Sapiens
VLDRVSDNP

SEQ ID NO: 106885 - protein, 9 aa, Homo Sapiens
IVYRILKAH

SEQ ID NO: 106886 - protein, 9 aa, Homo Sapiens
LSSAAVLPC

SEQ ID NO: 106887 - protein, 9 aa, Homo Sapiens
FWDSSTDWS

SEQ ID NO: 106888 - protein, 9 aa, Homo Sapiens
TNLWFQAGM

SEQ ID NO: 106889 - protein, 9 aa, Homo Sapiens
SANLHQYKK

SEQ ID NO: 106890 - protein, 9 aa, Homo Sapiens
SGTPLTEEN

SEQ ID NO: 106891 - protein, 9 aa, Homo Sapiens
WHKNCLRCA

SEQ ID NO: 106892 - protein, 9 aa, Homo Sapiens
GDSGRYTCG

SEQ ID NO: 106893 - protein, 9 aa, Homo Sapiens
GPRPTTGQT

SEQ ID NO: 106894 - protein, 9 aa, Homo Sapiens
YLFVGGIGP

SEQ ID NO: 106895 - protein, 9 aa, Homo Sapiens
IKAYAQLKL

SEQ ID NO: 106896 - protein, 9 aa, Homo Sapiens
HDYSFLKNH

SEQ ID NO: 106897 - protein, 9 aa, Homo Sapiens
KNSYRNVLP

SEQ ID NO: 106898 - protein, 9 aa, Homo Sapiens
KVLWPFLLR

SEQ ID NO: 106899 - protein, 9 aa, Homo Sapiens
SSTDWSCTV

SEQ ID NO: 106900 - protein, 9 aa, Homo Sapiens
QSLEVAPGA

SEQ ID NO: 106901 - protein, 9 aa, Homo Sapiens
KAYAQLKLS

SEQ ID NO: 106902 - protein, 9 aa, Homo Sapiens
EKAHDCAEV

SEQ ID NO: 106903 - protein, 9 aa, Homo Sapiens
FYTTLTLML

SEQ ID NO: 106904 - protein, 9 aa, Homo Sapiens
LVAKDDNLY

SEQ ID NO: 106905 - protein, 9 aa, Homo Sapiens
RGHDYSFLK

SEQ ID NO: 106906 - protein, 9 aa, Homo Sapiens
CLILAADDR

SEQ ID NO: 106907 - protein, 9 aa, Homo Sapiens
GACDSQLKG

SEQ ID NO: 106908 - protein, 9 aa, Homo Sapiens
NQEWKLQEL

SEQ ID NO: 106909 - protein, 9 aa, Homo Sapiens
LAHTGTLMR

SEQ ID NO: 106910 - protein, 9 aa, Homo Sapiens
NLHQYKKCY

SEQ ID NO: 106911 - protein, 9 aa, Homo Sapiens
MIVSIRLLL

SEQ ID NO: 106912 - protein, 9 aa, Homo Sapiens
HIHDNRIRK

SEQ ID NO: 106913 - protein, 9 aa, Homo Sapiens
DNLYSGNSN

SEQ ID NO: 106914 - protein, 9 aa, Homo Sapiens
TPPGPRPTT

SEQ ID NO: 106915 - protein, 9 aa, Homo Sapiens
RSPRQRNWL

SEQ ID NO: 106916 - protein, 9 aa, Homo Sapiens
LKKVQIFVM

SEQ ID NO: 106917 - protein, 9 aa, Homo Sapiens
PPEQKAQTE

SEQ ID NO: 106918 - protein, 9 aa, Homo Sapiens
ELHIHDNRI

SEQ ID NO: 106919 - protein, 9 aa, Homo Sapiens
GTPLTEENE

SEQ ID NO: 106920 - protein, 9 aa, Homo Sapiens
KTIEENTKN

SEQ ID NO: 106921 - protein, 9 aa, Homo Sapiens
WFQAGMMNG

SEQ ID NO: 106922 - protein, 9 aa, Homo Sapiens
SPRQRNWLP

SEQ ID NO: 106923 - protein, 9 aa, Homo Sapiens
SFRVSSNLI

SEQ ID NO: 106924 - protein, 9 aa, Homo Sapiens
TKTDIVKIM

SEQ ID NO: 106925 - protein, 9 aa, Homo Sapiens
SAAVLPCEI

SEQ ID NO: 106926 - protein, 9 aa, Homo Sapiens
RQNPVQLDK

SEQ ID NO: 106927 - protein, 9 aa, Homo Sapiens
NWLPGNLFQ

SEQ ID NO: 106928 - protein, 9 aa, Homo Sapiens
EPTPPLHGD

SEQ ID NO: 106929 - protein, 9 aa, Homo Sapiens
IETVRCVCK

SEQ ID NO: 106930 - protein, 9 aa, Homo Sapiens
EEWTSLDED

SEQ ID NO: 106931 - protein, 9 aa, Homo Sapiens
GGGSSQPDT

SEQ ID NO: 106932 - protein, 9 aa, Homo Sapiens
LLDTLISPG

SEQ ID NO: 106933 - protein, 9 aa, Homo Sapiens
SVSTSKRIS

SEQ ID NO: 106934 - protein, 9 aa, Homo Sapiens
DIHIKLEDI

SEQ ID NO: 106935 - protein, 9 aa, Homo Sapiens
MGNQEWKLQ

SEQ ID NO: 106936 - protein, 9 aa, Homo Sapiens
VIFLCDCSD

SEQ ID NO: 106937 - protein, 9 aa, Homo Sapiens
GVQHHPPEQ

SEQ ID NO: 106938 - protein, 9 aa, Homo Sapiens
QRVLAGEKG

SEQ ID NO: 106939 - protein, 9 aa, Homo Sapiens
KVAEEEEWL

SEQ ID NO: 106940 - protein, 9 aa, Homo Sapiens
AYAQLKLSG

SEQ ID NO: 106941 - protein, 9 aa, Homo Sapiens
KTKKKKKKK

SEQ ID NO: 106942 - protein, 9 aa, Homo Sapiens
YMIVSIRLL

SEQ ID NO: 106943 - protein, 9 aa, Homo Sapiens
LEHILRKRD

SEQ ID NO: 106944 - protein, 9 aa, Homo Sapiens
SYRNVLPYD

SEQ ID NO: 106945 - protein, 9 aa, Homo Sapiens
ALEHILRKR

SEQ ID NO: 106946 - protein, 9 aa, Homo Sapiens
VCVLTDAVD

SEQ ID NO: 106947 - protein, 9 aa, Homo Sapiens
SWMNNLLMR

SEQ ID NO: 106948 - protein, 9 aa, Homo Sapiens
ASPVPFPQG

SEQ ID NO: 106949 - protein, 9 aa, Homo Sapiens
YSGNSNKDK

SEQ ID NO: 106950 - protein, 9 aa, Homo Sapiens
QDETPRQQE

SEQ ID NO: 106951 - protein, 9 aa, Homo Sapiens
RAPVLLVVM

SEQ ID NO: 106952 - protein, 9 aa, Homo Sapiens
CTYCGKAFG

SEQ ID NO: 106953 - protein, 9 aa, Homo Sapiens
QSGSKSASR

SEQ ID NO: 106954 - protein, 9 aa, Homo Sapiens
GRYTCGAEN

SEQ ID NO: 106955 - protein, 9 aa, Homo Sapiens
QQQQHQHQH

SEQ ID NO: 106956 - protein, 9 aa, Homo Sapiens
FLCDCSDRV

SEQ ID NO: 106957 - protein, 9 aa, Homo Sapiens
PSSLVELHI

SEQ ID NO: 106958 - protein, 9 aa, Homo Sapiens
KSNYDSSQN

SEQ ID NO: 106959 - protein, 9 aa, Homo Sapiens
KNFCDQPDI

SEQ ID NO: 106960 - protein, 9 aa, Homo Sapiens
MVRGTQVYD

SEQ ID NO: 106961 - protein, 9 aa, Homo Sapiens
KDYFFKQPI

SEQ ID NO: 106962 - protein, 9 aa, Homo Sapiens
HFAAASWKV

SEQ ID NO: 106963 - protein, 9 aa, Homo Sapiens
KEQWEKQVC

SEQ ID NO: 106964 - protein, 9 aa, Homo Sapiens
FKQPINQFS

SEQ ID NO: 106965 - protein, 9 aa, Homo Sapiens
WKLQELSVS

SEQ ID NO: 106966 - protein, 9 aa, Homo Sapiens
MAKAEAEAE

SEQ ID NO: 106967 - protein, 9 aa, Homo Sapiens
RENLLPKKL

SEQ ID NO: 106968 - protein, 9 aa, Homo Sapiens
DFDIYWDLY

SEQ ID NO: 106969 - protein, 9 aa, Homo Sapiens
AGGIYLFVG

SEQ ID NO: 106970 - protein, 9 aa, Homo Sapiens
GEIYFNKSL

SEQ ID NO: 106971 - protein, 9 aa, Homo Sapiens
LRPASPGMI

SEQ ID NO: 106972 - protein, 9 aa, Homo Sapiens
PNLRMVRGT

SEQ ID NO: 106973 - protein, 9 aa, Homo Sapiens
RTNLWFQAG

SEQ ID NO: 106974 - protein, 9 aa, Homo Sapiens
DWSCTVRWE

SEQ ID NO: 106975 - protein, 9 aa, Homo Sapiens
EWKSNMEIS

SEQ ID NO: 106976 - protein, 9 aa, Homo Sapiens
PALAGTDTS

SEQ ID NO: 106977 - protein, 9 aa, Homo Sapiens
LAADDREED

SEQ ID NO: 106978 - protein, 9 aa, Homo Sapiens
VGACDSQLK

SEQ ID NO: 106979 - protein, 9 aa, Homo Sapiens
KSNMEISEE

SEQ ID NO: 106980 - protein, 9 aa, Homo Sapiens
PTPPLHGDM

SEQ ID NO: 106981 - protein, 9 aa, Homo Sapiens
DCAEVCSAI

SEQ ID NO: 106982 - protein, 9 aa, Homo Sapiens
QNCLILAAD

SEQ ID NO: 106983 - protein, 9 aa, Homo Sapiens
ACDSQLKGV

SEQ ID NO: 106984 - protein, 9 aa, Homo Sapiens
QLAQPYMIV

SEQ ID NO: 106985 - protein, 9 aa, Homo Sapiens
DIASPVPFP

SEQ ID NO: 106986 - protein, 9 aa, Homo Sapiens
RQEKEKAGS

SEQ ID NO: 106987 - protein, 9 aa, Homo Sapiens
ADVIFLCDC

SEQ ID NO: 106988 - protein, 9 aa, Homo Sapiens
VSIRLLLWD

SEQ ID NO: 106989 - protein, 9 aa, Homo Sapiens
AVFYTTLTL

SEQ ID NO: 106990 - protein, 9 aa, Homo Sapiens
HPSEVQEKL

SEQ ID NO: 106991 - protein, 9 aa, Homo Sapiens
KEWKSNMEI

SEQ ID NO: 106992 - protein, 9 aa, Homo Sapiens
HPPEQKAQT

SEQ ID NO: 106993 - protein, 9 aa, Homo Sapiens
LHIHDNRIR

SEQ ID NO: 106994 - protein, 9 aa, Homo Sapiens
PKTARDATL

SEQ ID NO: 106995 - protein, 9 aa, Homo Sapiens
LSMDMPSTA

SEQ ID NO: 106996 - protein, 9 aa, Homo Sapiens
WPFLLRRLK

SEQ ID NO: 106997 - protein, 9 aa, Homo Sapiens
VSDNPSITA

SEQ ID NO: 106998 - protein, 9 aa, Homo Sapiens
WTSLDEDAP

SEQ ID NO: 106999 - protein, 9 aa, Homo Sapiens
FLKHRFSPN

SEQ ID NO: 107000 - protein, 9 aa, Homo Sapiens
KHWPFLLFL

SEQ ID NO: 107001 - protein, 9 aa, Homo Sapiens
SLRGTQIIH

SEQ ID NO: 107002 - protein, 9 aa, Homo Sapiens
DSQGGGSSQ

SEQ ID NO: 107003 - protein, 9 aa, Homo Sapiens
RRELRPASP

SEQ ID NO: 107004 - protein, 9 aa, Homo Sapiens
DVIFLCDCS

SEQ ID NO: 107005 - protein, 9 aa, Homo Sapiens
YELSSAAVL

SEQ ID NO: 107006 - protein, 9 aa, Homo Sapiens
PYECTYCGK

SEQ ID NO: 107007 - protein, 9 aa, Homo Sapiens
LNPPLSTAF

SEQ ID NO: 107008 - protein, 9 aa, Homo Sapiens
PVPFPQGTH

SEQ ID NO: 107009 - protein, 9 aa, Homo Sapiens
LPLPNLRMV

SEQ ID NO: 107010 - protein, 9 aa, Homo Sapiens
YTTLTLMLN

SEQ ID NO: 107011 - protein, 9 aa, Homo Sapiens
CTNYDQMKT

SEQ ID NO: 107012 - protein, 9 aa, Homo Sapiens
WKSNMEISE

SEQ ID NO: 107013 - protein, 9 aa, Homo Sapiens
DICGKSFSW

SEQ ID NO: 107014 - protein, 9 aa, Homo Sapiens
SSLRGTQII

SEQ ID NO: 107015 - protein, 9 aa, Homo Sapiens
TLLSMDMPS

SEQ ID NO: 107016 - protein, 9 aa, Homo Sapiens
FGTCFQAVN

SEQ ID NO: 107017 - protein, 9 aa, Homo Sapiens
ILEDENETK

SEQ ID NO: 107018 - protein, 9 aa, Homo Sapiens
AQLKLSGLL

SEQ ID NO: 107019 - protein, 9 aa, Homo Sapiens
PGSGVEEES

SEQ ID NO: 107020 - protein, 9 aa, Homo Sapiens
VEEESQTKS

SEQ ID NO: 107021 - protein, 9 aa, Homo Sapiens
APVLLVVMF

SEQ ID NO: 107022 - protein, 9 aa, Homo Sapiens
TEENEKIVW

SEQ ID NO: 107023 - protein, 9 aa, Homo Sapiens
TPALAGTDT

SEQ ID NO: 107024 - protein, 9 aa, Homo Sapiens
KRVDQNLYE

SEQ ID NO: 107025 - protein, 9 aa, Homo Sapiens
LHKVLWPFL

SEQ ID NO: 107026 - protein, 9 aa, Homo Sapiens
ESKVAEEEE

SEQ ID NO: 107027 - protein, 9 aa, Homo Sapiens
LQFAFSWMN

SEQ ID NO: 107028 - protein, 9 aa, Homo Sapiens
WNETIGLEW

SEQ ID NO: 107029 - protein, 9 aa, Homo Sapiens
AVLPCEIDP

SEQ ID NO: 107030 - protein, 9 aa, Homo Sapiens
LSSDDAVQR

SEQ ID NO: 107031 - protein, 9 aa, Homo Sapiens
LQILGEIYF

SEQ ID NO: 107032 - protein, 9 aa, Homo Sapiens
ISLEEASGM

SEQ ID NO: 107033 - protein, 9 aa, Homo Sapiens
EQKAQTEGN

SEQ ID NO: 107034 - protein, 9 aa, Homo Sapiens
DSSQNIEEY

SEQ ID NO: 107035 - protein, 9 aa, Homo Sapiens
PVRLGFQSA

SEQ ID NO: 107036 - protein, 9 aa, Homo Sapiens
LVMDKGVVA

SEQ ID NO: 107037 - protein, 9 aa, Homo Sapiens
KMEERFNTE

SEQ ID NO: 107038 - protein, 9 aa, Homo Sapiens
SDMTEAFTK

SEQ ID NO: 107039 - protein, 9 aa, Homo Sapiens
LIINTQSFP

SEQ ID NO: 107040 - protein, 9 aa, Homo Sapiens
DYTRVLVMD

SEQ ID NO: 107041 - protein, 9 aa, Homo Sapiens
TQDSYPGSP

SEQ ID NO: 107042 - protein, 9 aa, Homo Sapiens
SRFRSVHCH

SEQ ID NO: 107043 - protein, 9 aa, Homo Sapiens
VVGAVGVGK

SEQ ID NO: 107044 - protein, 9 aa, Homo Sapiens
LSGQCRVAW

SEQ ID NO: 107045 - protein, 9 aa, Homo Sapiens
PQAVGWPIC

SEQ ID NO: 107046 - protein, 9 aa, Homo Sapiens
DDSLFIYDF

SEQ ID NO: 107047 - protein, 9 aa, Homo Sapiens
PTEESVGQG

SEQ ID NO: 107048 - protein, 9 aa, Homo Sapiens
RRKVREETQ

SEQ ID NO: 107049 - protein, 9 aa, Homo Sapiens
DKSFEENSR

SEQ ID NO: 107050 - protein, 9 aa, Homo Sapiens
LGKKDKPDV

SEQ ID NO: 107051 - protein, 9 aa, Homo Sapiens
VIGPALCNN

SEQ ID NO: 107052 - protein, 9 aa, Homo Sapiens
HDLQQQMTA

SEQ ID NO: 107053 - protein, 9 aa, Homo Sapiens
DNMIWQSAI

SEQ ID NO: 107054 - protein, 9 aa, Homo Sapiens
LAGIPGRQS

SEQ ID NO: 107055 - protein, 9 aa, Homo Sapiens
VTARLCGVH

SEQ ID NO: 107056 - protein, 9 aa, Homo Sapiens
ESEEEEEER

SEQ ID NO: 107057 - protein, 9 aa, Homo Sapiens
LRLRALPDA

SEQ ID NO: 107058 - protein, 9 aa, Homo Sapiens
AWGPVGGKA

SEQ ID NO: 107059 - protein, 9 aa, Homo Sapiens
PVVIGPALC

SEQ ID NO: 107060 - protein, 9 aa, Homo Sapiens
ASRDKWVMK

SEQ ID NO: 107061 - protein, 9 aa, Homo Sapiens
VHDLQQQMT

SEQ ID NO: 107062 - protein, 9 aa, Homo Sapiens
EKRRKVREE

SEQ ID NO: 107063 - protein, 9 aa, Homo Sapiens
EMNRLGMMI

SEQ ID NO: 107064 - protein, 9 aa, Homo Sapiens
KELRPQLMI

SEQ ID NO: 107065 - protein, 9 aa, Homo Sapiens
IINTQSFPN

SEQ ID NO: 107066 - protein, 9 aa, Homo Sapiens
PQLMISQFI

SEQ ID NO: 107067 - protein, 9 aa, Homo Sapiens
STMEQVERE

SEQ ID NO: 107068 - protein, 9 aa, Homo Sapiens
EAVHIPMCR

SEQ ID NO: 107069 - protein, 9 aa, Homo Sapiens
EKIEKVQKK

SEQ ID NO: 107070 - protein, 9 aa, Homo Sapiens
MEQVERERR

SEQ ID NO: 107071 - protein, 9 aa, Homo Sapiens
KDNTVHDLQ

SEQ ID NO: 107072 - protein, 9 aa, Homo Sapiens
GGSSQVLFM

SEQ ID NO: 107073 - protein, 9 aa, Homo Sapiens
TARLCGVHD

SEQ ID NO: 107074 - protein, 9 aa, Homo Sapiens
RLRLRALPD

SEQ ID NO: 107075 - protein, 9 aa, Homo Sapiens
FSNIIVAGG

SEQ ID NO: 107076 - protein, 9 aa, Homo Sapiens
GASRDKWVM

SEQ ID NO: 107077 - protein, 9 aa, Homo Sapiens
EDLLNVPKP

SEQ ID NO: 107078 - protein, 9 aa, Homo Sapiens
SVPSSVRSS

SEQ ID NO: 107079 - protein, 9 aa, Homo Sapiens
FPGPLKEED

SEQ ID NO: 107080 - protein, 9 aa, Homo Sapiens
DMTEAFTKK

SEQ ID NO: 107081 - protein, 9 aa, Homo Sapiens
NVQLRSTME

SEQ ID NO: 107082 - protein, 9 aa, Homo Sapiens
QCRVAWARI

SEQ ID NO: 107083 - protein, 9 aa, Homo Sapiens
SGGSSQVLF

SEQ ID NO: 107084 - protein, 9 aa, Homo Sapiens
EEDLLNVPK

SEQ ID NO: 107085 - protein, 9 aa, Homo Sapiens
YDRYLAICW

SEQ ID NO: 107086 - protein, 9 aa, Homo Sapiens
ANAGPHRPS

SEQ ID NO: 107087 - protein, 9 aa, Homo Sapiens
IYDFSAAEK

SEQ ID NO: 107088 - protein, 9 aa, Homo Sapiens
RGGGGGSSA

SEQ ID NO: 107089 - protein, 9 aa, Homo Sapiens
GPLKEEDLL

SEQ ID NO: 107090 - protein, 9 aa, Homo Sapiens
RLIINTQSF

SEQ ID NO: 107091 - protein, 9 aa, Homo Sapiens
FRSVHCHLY

SEQ ID NO: 107092 - protein, 9 aa, Homo Sapiens
GRGGGGGSS

SEQ ID NO: 107093 - protein, 9 aa, Homo Sapiens
GCCHSSGGY

SEQ ID NO: 107094 - protein, 9 aa, Homo Sapiens
LNLWIHKME

SEQ ID NO: 107095 - protein, 9 aa, Homo Sapiens
GTPHLLSQN

SEQ ID NO: 107096 - protein, 9 aa, Homo Sapiens
GAPCEAVHI

SEQ ID NO: 107097 - protein, 9 aa, Homo Sapiens
VGQGKMVAV

SEQ ID NO: 107098 - protein, 9 aa, Homo Sapiens
NNTGLSTLL

SEQ ID NO: 107099 - protein, 9 aa, Homo Sapiens
SKPLAWLTE

SEQ ID NO: 107100 - protein, 9 aa, Homo Sapiens
SSLPSLGHL

SEQ ID NO: 107101 - protein, 9 aa, Homo Sapiens
VHIPMCRHM

SEQ ID NO: 107102 - protein, 9 aa, Homo Sapiens
RQHLDKSFE

SEQ ID NO: 107103 - protein, 9 aa, Homo Sapiens
DNTVHDLQQ

SEQ ID NO: 107104 - protein, 9 aa, Homo Sapiens
GMMIDLSHV

SEQ ID NO: 107105 - protein, 9 aa, Homo Sapiens
LFLELLQHH

SEQ ID NO: 107106 - protein, 9 aa, Homo Sapiens
RAREKRRKV

SEQ ID NO: 107107 - protein, 9 aa, Homo Sapiens
RIVQRLRLR

SEQ ID NO: 107108 - protein, 9 aa, Homo Sapiens
KTQDSYPGS

SEQ ID NO: 107109 - protein, 9 aa, Homo Sapiens
QWDRLIINT

SEQ ID NO: 107110 - protein, 9 aa, Homo Sapiens
APAPAPQAV

SEQ ID NO: 107111 - protein, 9 aa, Homo Sapiens
RSGGSSQVL

SEQ ID NO: 107112 - protein, 9 aa, Homo Sapiens
IVQRLRLRA

SEQ ID NO: 107113 - protein, 9 aa, Homo Sapiens
ESCEHKEEI

SEQ ID NO: 107114 - protein, 9 aa, Homo Sapiens
ALSQTGFSY

SEQ ID NO: 107115 - protein, 9 aa, Homo Sapiens
QGISTSVPS

SEQ ID NO: 107116 - protein, 9 aa, Homo Sapiens
LDIYWTAHR

SEQ ID NO: 107117 - protein, 9 aa, Homo Sapiens
RVLVMDKGV

SEQ ID NO: 107118 - protein, 9 aa, Homo Sapiens
AAAEAALSQ

SEQ ID NO: 107119 - protein, 9 aa, Homo Sapiens
RQSSGKLMS

SEQ ID NO: 107120 - protein, 9 aa, Homo Sapiens
SHIAFLMVF

SEQ ID NO: 107121 - protein, 9 aa, Homo Sapiens
IPGRQSSGK

SEQ ID NO: 107122 - protein, 9 aa, Homo Sapiens
YLAICWPLH

SEQ ID NO: 107123 - protein, 9 aa, Homo Sapiens
WTLTSNLNE

SEQ ID NO: 107124 - protein, 9 aa, Homo Sapiens
WPLHYPIIM

SEQ ID NO: 107125 - protein, 9 aa, Homo Sapiens
KYWTSKPQP

SEQ ID NO: 107126 - protein, 9 aa, Homo Sapiens
RDGAWGPVG

SEQ ID NO: 107127 - protein, 9 aa, Homo Sapiens
TSLPRSLRQ

SEQ ID NO: 107128 - protein, 9 aa, Homo Sapiens
FLELLQHHG

SEQ ID NO: 107129 - protein, 9 aa, Homo Sapiens
LRALPDARA

SEQ ID NO: 107130 - protein, 9 aa, Homo Sapiens
KEEINEIKD

SEQ ID NO: 107131 - protein, 9 aa, Homo Sapiens
QSSGKLMST

SEQ ID NO: 107132 - protein, 9 aa, Homo Sapiens
YPCPKCGRR

SEQ ID NO: 107133 - protein, 9 aa, Homo Sapiens
GPHRPSSSG

SEQ ID NO: 107134 - protein, 9 aa, Homo Sapiens
KKDKPDVGG

SEQ ID NO: 107135 - protein, 9 aa, Homo Sapiens
SYIYVCMIS

SEQ ID NO: 107136 - protein, 9 aa, Homo Sapiens
QRLRLRALP

SEQ ID NO: 107137 - protein, 9 aa, Homo Sapiens
PSSVRSSHM

SEQ ID NO: 107138 - protein, 9 aa, Homo Sapiens
MSPEESCEH

SEQ ID NO: 107139 - protein, 9 aa, Homo Sapiens
RLRALPDAR

SEQ ID NO: 107140 - protein, 9 aa, Homo Sapiens
NYLGKKDKP

SEQ ID NO: 107141 - protein, 9 aa, Homo Sapiens
TWTASSLPS

SEQ ID NO: 107142 - protein, 9 aa, Homo Sapiens
VGAVGVGKS

SEQ ID NO: 107143 - protein, 9 aa, Homo Sapiens
AREKRRKVR

SEQ ID NO: 107144 - protein, 9 aa, Homo Sapiens
LNRTCGAMQ

SEQ ID NO: 107145 - protein, 9 aa, Homo Sapiens
WDRLIINTQ

SEQ ID NO: 107146 - protein, 9 aa, Homo Sapiens
AGIPGRQSS

SEQ ID NO: 107147 - protein, 9 aa, Homo Sapiens
LRSTMEQVE

SEQ ID NO: 107148 - protein, 9 aa, Homo Sapiens
GERPYPCPK

SEQ ID NO: 107149 - protein, 9 aa, Homo Sapiens
KRRVRAMQL

SEQ ID NO: 107150 - protein, 9 aa, Homo Sapiens
SALNNTGLS

SEQ ID NO: 107151 - protein, 9 aa, Homo Sapiens
GQCRVAWAR

SEQ ID NO: 107152 - protein, 9 aa, Homo Sapiens
DGAWGPVGG

SEQ ID NO: 107153 - protein, 9 aa, Homo Sapiens
DSPSHLEAQ

SEQ ID NO: 107154 - protein, 9 aa, Homo Sapiens
APAPQAVGW

SEQ ID NO: 107155 - protein, 9 aa, Homo Sapiens
GAWGPVGGK

SEQ ID NO: 107156 - protein, 9 aa, Homo Sapiens
VEKFMPGQV

SEQ ID NO: 107157 - protein, 9 aa, Homo Sapiens
PEESCEHKE

SEQ ID NO: 107158 - protein, 9 aa, Homo Sapiens
FIYDFSAAE

SEQ ID NO: 107159 - protein, 9 aa, Homo Sapiens
AWLTEMSII

SEQ ID NO: 107160 - protein, 9 aa, Homo Sapiens
FLSHIAFLM

SEQ ID NO: 107161 - protein, 9 aa, Homo Sapiens
DLQQQMTAL

SEQ ID NO: 107162 - protein, 9 aa, Homo Sapiens
GSALNNTGL

SEQ ID NO: 107163 - protein, 9 aa, Homo Sapiens
MPGQVPYGS

SEQ ID NO: 107164 - protein, 9 aa, Homo Sapiens
CGTPHLLSQ

SEQ ID NO: 107165 - protein, 9 aa, Homo Sapiens
ARSPATGWT

SEQ ID NO: 107166 - protein, 9 aa, Homo Sapiens
TKVTARLCG

SEQ ID NO: 107167 - protein, 9 aa, Homo Sapiens
RPTEESVGQ

SEQ ID NO: 107168 - protein, 9 aa, Homo Sapiens
AVHIPMCRH

SEQ ID NO: 107169 - protein, 9 aa, Homo Sapiens
DLSLDNMIW

SEQ ID NO: 107170 - protein, 9 aa, Homo Sapiens
VLFMTLNRN

SEQ ID NO: 107171 - protein, 9 aa, Homo Sapiens
ISTSVPSSV

SEQ ID NO: 107172 - protein, 9 aa, Homo Sapiens
KGSSSSSSG

SEQ ID NO: 107173 - protein, 9 aa, Homo Sapiens
PAPAPAPQA

SEQ ID NO: 107174 - protein, 9 aa, Homo Sapiens
SVCQSPRRF

SEQ ID NO: 107175 - protein, 9 aa, Homo Sapiens
VGVGKSALT

SEQ ID NO: 107176 - protein, 9 aa, Homo Sapiens
HQGRKRRVR

SEQ ID NO: 107177 - protein, 9 aa, Homo Sapiens
KTVEDCPRM

SEQ ID NO: 107178 - protein, 9 aa, Homo Sapiens
SSQVLFMTL

SEQ ID NO: 107179 - protein, 9 aa, Homo Sapiens
QLMISQFIS

SEQ ID NO: 107180 - protein, 9 aa, Homo Sapiens
RSLRQCHQL

SEQ ID NO: 107181 - protein, 9 aa, Homo Sapiens
GQWDRLIIN

SEQ ID NO: 107182 - protein, 9 aa, Homo Sapiens
YLGKKDKPD

SEQ ID NO: 107183 - protein, 9 aa, Homo Sapiens
PPLDAKIFL

SEQ ID NO: 107184 - protein, 9 aa, Homo Sapiens
LSSRSPKTQ

SEQ ID NO: 107185 - protein, 9 aa, Homo Sapiens
LGQVYSELK

SEQ ID NO: 107186 - protein, 9 aa, Homo Sapiens
NAKRNKKTV

SEQ ID NO: 107187 - protein, 9 aa, Homo Sapiens
SVGQGKMVA

SEQ ID NO: 107188 - protein, 9 aa, Homo Sapiens
LGMMIDLSH

SEQ ID NO: 107189 - protein, 9 aa, Homo Sapiens
GTWTASSLP

SEQ ID NO: 107190 - protein, 9 aa, Homo Sapiens
ARIVQRLRL

SEQ ID NO: 107191 - protein, 9 aa, Homo Sapiens
STTVVALLS

SEQ ID NO: 107192 - protein, 9 aa, Homo Sapiens
ELNRTCGAM

SEQ ID NO: 107193 - protein, 9 aa, Homo Sapiens
KGQWDRLII

SEQ ID NO: 107194 - protein, 9 aa, Homo Sapiens
WTAHRARSL

SEQ ID NO: 107195 - protein, 9 aa, Homo Sapiens
NEIKDTDVI

SEQ ID NO: 107196 - protein, 9 aa, Homo Sapiens
HKMEERFNT

SEQ ID NO: 107197 - protein, 9 aa, Homo Sapiens
QQQMTALQS

SEQ ID NO: 107198 - protein, 9 aa, Homo Sapiens
WTASSLPSL

SEQ ID NO: 107199 - protein, 9 aa, Homo Sapiens
VVIGPALCN

SEQ ID NO: 107200 - protein, 9 aa, Homo Sapiens
LDNMIWQSA

SEQ ID NO: 107201 - protein, 9 aa, Homo Sapiens
DFSAAEKKS

SEQ ID NO: 107202 - protein, 9 aa, Homo Sapiens
IGPALCNNT

SEQ ID NO: 107203 - protein, 9 aa, Homo Sapiens
CGTWTASSL

SEQ ID NO: 107204 - protein, 9 aa, Homo Sapiens
YTRVLVMDK

SEQ ID NO: 107205 - protein, 9 aa, Homo Sapiens
VNRKSYIYV

SEQ ID NO: 107206 - protein, 9 aa, Homo Sapiens
EKVQKKRKT

SEQ ID NO: 107207 - protein, 9 aa, Homo Sapiens
NRTCGAMQQ

SEQ ID NO: 107208 - protein, 9 aa, Homo Sapiens
SGQCRVAWA

SEQ ID NO: 107209 - protein, 9 aa, Homo Sapiens
KLNLWIHKM

SEQ ID NO: 107210 - protein, 9 aa, Homo Sapiens
SFEENSRLK

SEQ ID NO: 107211 - protein, 9 aa, Homo Sapiens
PAPQAVGWP

SEQ ID NO: 107212 - protein, 9 aa, Homo Sapiens
CGAMQQRVL

SEQ ID NO: 107213 - protein, 9 aa, Homo Sapiens
RKYWTSKPQ

SEQ ID NO: 107214 - protein, 9 aa, Homo Sapiens
SRDKWVMKM

SEQ ID NO: 107215 - protein, 9 aa, Homo Sapiens
GCGPPSDMT

SEQ ID NO: 107216 - protein, 9 aa, Homo Sapiens
LFIYDFSAA

SEQ ID NO: 107217 - protein, 9 aa, Homo Sapiens
HNVQLRSTM

SEQ ID NO: 107218 - protein, 9 aa, Homo Sapiens
NTGLSTLLG

SEQ ID NO: 107219 - protein, 9 aa, Homo Sapiens
EAQRITSAR

SEQ ID NO: 107220 - protein, 9 aa, Homo Sapiens
DPSRFRSVH

SEQ ID NO: 107221 - protein, 9 aa, Homo Sapiens
DRYLAICWP

SEQ ID NO: 107222 - protein, 9 aa, Homo Sapiens
FVEKFMPGQ

SEQ ID NO: 107223 - protein, 9 aa, Homo Sapiens
GTKVTARLC

SEQ ID NO: 107224 - protein, 9 aa, Homo Sapiens
KDKPDVGGF

SEQ ID NO: 107225 - protein, 9 aa, Homo Sapiens
MISQFISVF

SEQ ID NO: 107226 - protein, 9 aa, Homo Sapiens
TEESVGQGK

SEQ ID NO: 107227 - protein, 9 aa, Homo Sapiens
GSSQVLFMT

SEQ ID NO: 107228 - protein, 9 aa, Homo Sapiens
STSVPSSVR

SEQ ID NO: 107229 - protein, 9 aa, Homo Sapiens
LRQCHQLQP

SEQ ID NO: 107230 - protein, 9 aa, Homo Sapiens
IAIKPDCVQ

SEQ ID NO: 107231 - protein, 9 aa, Homo Sapiens
KCGRRFSQK

SEQ ID NO: 107232 - protein, 9 aa, Homo Sapiens
MDYTRVLVM

SEQ ID NO: 107233 - protein, 9 aa, Homo Sapiens
WTFLSHIAF

SEQ ID NO: 107234 - protein, 9 aa, Homo Sapiens
SLFIYDFSA

SEQ ID NO: 107235 - protein, 9 aa, Homo Sapiens
PQPSTREQF

SEQ ID NO: 107236 - protein, 9 aa, Homo Sapiens
LEAQRITSA

SEQ ID NO: 107237 - protein, 9 aa, Homo Sapiens
TVHDLQQQM

SEQ ID NO: 107238 - protein, 9 aa, Homo Sapiens
TGWTHSSPP

SEQ ID NO: 107239 - protein, 9 aa, Homo Sapiens
SVHCHLYPD

SEQ ID NO: 107240 - protein, 9 aa, Homo Sapiens
PSRFRSVHC

SEQ ID NO: 107241 - protein, 9 aa, Homo Sapiens
VHCHLYPDT

SEQ ID NO: 107242 - protein, 9 aa, Homo Sapiens
ICWPLHYPI

SEQ ID NO: 107243 - protein, 9 aa, Homo Sapiens
TCGAMQQRV

SEQ ID NO: 107244 - protein, 9 aa, Homo Sapiens
VQLRSTMEQ

SEQ ID NO: 107245 - protein, 9 aa, Homo Sapiens
VPAFSLFLE

SEQ ID NO: 107246 - protein, 9 aa, Homo Sapiens
SQVLFMTLN

SEQ ID NO: 107247 - protein, 9 aa, Homo Sapiens
WTSKPQPST

SEQ ID NO: 107248 - protein, 9 aa, Homo Sapiens
KEEDLLNVP

SEQ ID NO: 107249 - protein, 9 aa, Homo Sapiens
LQQQMTALQ

SEQ ID NO: 107250 - protein, 9 aa, Homo Sapiens
REKRRKVRE

SEQ ID NO: 107251 - protein, 9 aa, Homo Sapiens
EKGSLGPPG

SEQ ID NO: 107252 - protein, 9 aa, Homo Sapiens
ISYTAHHLW

SEQ ID NO: 107253 - protein, 9 aa, Homo Sapiens
SLFLELLQH

SEQ ID NO: 107254 - protein, 9 aa, Homo Sapiens
IKPDCVQRG

SEQ ID NO: 107255 - protein, 9 aa, Homo Sapiens
MMIDLSHVS

SEQ ID NO: 107256 - protein, 9 aa, Homo Sapiens
LNNTGLSTL

SEQ ID NO: 107257 - protein, 9 aa, Homo Sapiens
DRAFFRTKD

SEQ ID NO: 107258 - protein, 9 aa, Homo Sapiens
VQRLRLRAL

SEQ ID NO: 107259 - protein, 9 aa, Homo Sapiens
MNRLGMMID

SEQ ID NO: 107260 - protein, 9 aa, Homo Sapiens
GGRGGGGGS

SEQ ID NO: 107261 - protein, 9 aa, Homo Sapiens
GLAGIPGRQ

SEQ ID NO: 107262 - protein, 9 aa, Homo Sapiens
PAFSLFLEL

SEQ ID NO: 107263 - protein, 9 aa, Homo Sapiens
YNYLGKKDK

SEQ ID NO: 107264 - protein, 9 aa, Homo Sapiens
ACLDIYWTA

SEQ ID NO: 107265 - protein, 9 aa, Homo Sapiens
TVEDCPRMR

SEQ ID NO: 107266 - protein, 9 aa, Homo Sapiens
ATGWTHSSP

SEQ ID NO: 107267 - protein, 9 aa, Homo Sapiens
EESVGQGKM

SEQ ID NO: 107268 - protein, 9 aa, Homo Sapiens
QSPRRFRDQ

SEQ ID NO: 107269 - protein, 9 aa, Homo Sapiens
EINEIKDTD

SEQ ID NO: 107270 - protein, 9 aa, Homo Sapiens
DLLNVPKPL

SEQ ID NO: 107271 - protein, 9 aa, Homo Sapiens
QRITSARKR

SEQ ID NO: 107272 - protein, 9 aa, Homo Sapiens
RRPTEESVG

SEQ ID NO: 107273 - protein, 9 aa, Homo Sapiens
FRTKDSKAF

SEQ ID NO: 107274 - protein, 9 aa, Homo Sapiens
QPSTREQFL

SEQ ID NO: 107275 - protein, 9 aa, Homo Sapiens
NRKSYIYVC

SEQ ID NO: 107276 - protein, 9 aa, Homo Sapiens
GAVGVGKSA

SEQ ID NO: 107277 - protein, 9 aa, Homo Sapiens
QNQVNRKSY

SEQ ID NO: 107278 - protein, 9 aa, Homo Sapiens
AAEAALSQT

SEQ ID NO: 107279 - protein, 9 aa, Homo Sapiens
TRVLVMDKG

SEQ ID NO: 107280 - protein, 9 aa, Homo Sapiens
GPPSDMTEA

SEQ ID NO: 107281 - protein, 9 aa, Homo Sapiens
FEENSRLKS

SEQ ID NO: 107282 - protein, 9 aa, Homo Sapiens
GWTHSSPPR

SEQ ID NO: 107283 - protein, 9 aa, Homo Sapiens
RKRRVRAMQ

SEQ ID NO: 107284 - protein, 9 aa, Homo Sapiens
AEAALSQTG

SEQ ID NO: 107285 - protein, 9 aa, Homo Sapiens
GECGTPHLL

SEQ ID NO: 107286 - protein, 9 aa, Homo Sapiens
IFLGQVYSE

SEQ ID NO: 107287 - protein, 9 aa, Homo Sapiens
LCNNTAEIT

SEQ ID NO: 107288 - protein, 9 aa, Homo Sapiens
LVVVGAVGV

SEQ ID NO: 107289 - protein, 9 aa, Homo Sapiens
LPRSLRQCH

SEQ ID NO: 107290 - protein, 9 aa, Homo Sapiens
LMISQFISV

SEQ ID NO: 107291 - protein, 9 aa, Homo Sapiens
PGLLHQGRK

SEQ ID NO: 107292 - protein, 9 aa, Homo Sapiens
SRSPKTQDS

SEQ ID NO: 107293 - protein, 9 aa, Homo Sapiens
QLRSTMEQV

SEQ ID NO: 107294 - protein, 9 aa, Homo Sapiens
KPDCVQRGL

SEQ ID NO: 107295 - protein, 9 aa, Homo Sapiens
KGSLGPPGP

SEQ ID NO: 107296 - protein, 9 aa, Homo Sapiens
DSLFIYDFS

SEQ ID NO: 107297 - protein, 9 aa, Homo Sapiens
ISQFISVFS

SEQ ID NO: 107298 - protein, 9 aa, Homo Sapiens
ARLCGVHDG

SEQ ID NO: 107299 - protein, 9 aa, Homo Sapiens
PHRPSSSGY

SEQ ID NO: 107300 - protein, 9 aa, Homo Sapiens
QKKRKTEDK

SEQ ID NO: 107301 - protein, 9 aa, Homo Sapiens
HIAFLMVFT

SEQ ID NO: 107302 - protein, 9 aa, Homo Sapiens
DCVQRGLVG

SEQ ID NO: 107303 - protein, 9 aa, Homo Sapiens
RKVREETQG

SEQ ID NO: 107304 - protein, 9 aa, Homo Sapiens
NTVHDLQQQ

SEQ ID NO: 107305 - protein, 9 aa, Homo Sapiens
ADPSRFRSV

SEQ ID NO: 107306 - protein, 9 aa, Homo Sapiens
KIEKVQKKR

SEQ ID NO: 107307 - protein, 9 aa, Homo Sapiens
QGRKRRVRA

SEQ ID NO: 107308 - protein, 9 aa, Homo Sapiens
SKPQPSTRE

SEQ ID NO: 107309 - protein, 9 aa, Homo Sapiens
CVQRGLVGE

SEQ ID NO: 107310 - protein, 9 aa, Homo Sapiens
AKRNKKTVE

SEQ ID NO: 107311 - protein, 9 aa, Homo Sapiens
TEMSPEESC

SEQ ID NO: 107312 - protein, 9 aa, Homo Sapiens
LHQGRKRRV

SEQ ID NO: 107313 - protein, 9 aa, Homo Sapiens
LNEFVEGAS

SEQ ID NO: 107314 - protein, 9 aa, Homo Sapiens
RTCGAMQQR

SEQ ID NO: 107315 - protein, 9 aa, Homo Sapiens
RQCHQLQPL

SEQ ID NO: 107316 - protein, 9 aa, Homo Sapiens
LDKSFEENS

SEQ ID NO: 107317 - protein, 9 aa, Homo Sapiens
KVTARLCGV

SEQ ID NO: 107318 - protein, 9 aa, Homo Sapiens
NMIWQSAIA

SEQ ID NO: 107319 - protein, 9 aa, Homo Sapiens
ALNNTGLST

SEQ ID NO: 107320 - protein, 9 aa, Homo Sapiens
GISTSVPSS

SEQ ID NO: 107321 - protein, 9 aa, Homo Sapiens
YWTSKPQPS

SEQ ID NO: 107322 - protein, 9 aa, Homo Sapiens
AKIFLGQVY

SEQ ID NO: 107323 - protein, 9 aa, Homo Sapiens
GKKDKPDVG

SEQ ID NO: 107324 - protein, 9 aa, Homo Sapiens
RSPATGWTH

SEQ ID NO: 107325 - protein, 9 aa, Homo Sapiens
KSKPLAWLT

SEQ ID NO: 107326 - protein, 9 aa, Homo Sapiens
GRKRRVRAM

SEQ ID NO: 107327 - protein, 9 aa, Homo Sapiens
CEAVHIPMC

SEQ ID NO: 107328 - protein, 9 aa, Homo Sapiens
TTVVALLSS

SEQ ID NO: 107329 - protein, 9 aa, Homo Sapiens
VRTANAGPH

SEQ ID NO: 107330 - protein, 9 aa, Homo Sapiens
PGRQSSGKL

SEQ ID NO: 107331 - protein, 9 aa, Homo Sapiens
RNKKTVEDC

SEQ ID NO: 107332 - protein, 9 aa, Homo Sapiens
TEAFTKKAP

SEQ ID NO: 107333 - protein, 9 aa, Homo Sapiens
IKGQWDRLI

SEQ ID NO: 107334 - protein, 9 aa, Homo Sapiens
TANAGPHRP

SEQ ID NO: 107335 - protein, 9 aa, Homo Sapiens
HRPSSSGYK

SEQ ID NO: 107336 - protein, 9 aa, Homo Sapiens
LELLQHHGL

SEQ ID NO: 107337 - protein, 9 aa, Homo Sapiens
RWVPDRAFF

SEQ ID NO: 107338 - protein, 9 aa, Homo Sapiens
PARSPATGW

SEQ ID NO: 107339 - protein, 9 aa, Homo Sapiens
SLPRSLRQC

SEQ ID NO: 107340 - protein, 9 aa, Homo Sapiens
IYWTAHRAR

SEQ ID NO: 107341 - protein, 9 aa, Homo Sapiens
KKTVEDCPR

SEQ ID NO: 107342 - protein, 9 aa, Homo Sapiens
DEKIEKVQK

SEQ ID NO: 107343 - protein, 9 aa, Homo Sapiens
LAICWPLHY

SEQ ID NO: 107344 - protein, 9 aa, Homo Sapiens
CVPEKGSLG

SEQ ID NO: 107345 - protein, 9 aa, Homo Sapiens
LQELNRTCG

SEQ ID NO: 107346 - protein, 9 aa, Homo Sapiens
PKCGRRFSQ

SEQ ID NO: 107347 - protein, 9 aa, Homo Sapiens
FQGISTSVP

SEQ ID NO: 107348 - protein, 9 aa, Homo Sapiens
ELGRDGAWG

SEQ ID NO: 107349 - protein, 9 aa, Homo Sapiens
PEKGSLGPP

SEQ ID NO: 107350 - protein, 9 aa, Homo Sapiens
ITSVCQSPR

SEQ ID NO: 107351 - protein, 9 aa, Homo Sapiens
TFIAIKPDC

SEQ ID NO: 107352 - protein, 9 aa, Homo Sapiens
LAWLTEMSI

SEQ ID NO: 107353 - protein, 9 aa, Homo Sapiens
TPHLLSQNR

SEQ ID NO: 107354 - protein, 9 aa, Homo Sapiens
ELRPQLMIS

SEQ ID NO: 107355 - protein, 9 aa, Homo Sapiens
GRQSSGKLM

SEQ ID NO: 107356 - protein, 9 aa, Homo Sapiens
RTANAGPHR

SEQ ID NO: 107357 - protein, 9 aa, Homo Sapiens
AVGVGKSAL

SEQ ID NO: 107358 - protein, 9 aa, Homo Sapiens
IVAGGSTSF

SEQ ID NO: 107359 - protein, 9 aa, Homo Sapiens
SPEESCEHK

SEQ ID NO: 107360 - protein, 9 aa, Homo Sapiens
YTAHHLWTL

SEQ ID NO: 107361 - protein, 9 aa, Homo Sapiens
SCGTWTASS

SEQ ID NO: 107362 - protein, 9 aa, Homo Sapiens
FIAIKPDCV

SEQ ID NO: 107363 - protein, 9 aa, Homo Sapiens
WGVGSALNN

SEQ ID NO: 107364 - protein, 9 aa, Homo Sapiens
VPDRAFFRT

SEQ ID NO: 107365 - protein, 9 aa, Homo Sapiens
SPRRFRDQI

SEQ ID NO: 107366 - protein, 9 aa, Homo Sapiens
SPATGWTHS

SEQ ID NO: 107367 - protein, 9 aa, Homo Sapiens
PYPCPKCGR

SEQ ID NO: 107368 - protein, 9 aa, Homo Sapiens
LKEEDLLNV

SEQ ID NO: 107369 - protein, 9 aa, Homo Sapiens
WVPDRAFFR

SEQ ID NO: 107370 - protein, 9 aa, Homo Sapiens
CGPPSDMTE

SEQ ID NO: 107371 - protein, 9 aa, Homo Sapiens
AHRARSLGN

SEQ ID NO: 107372 - protein, 9 aa, Homo Sapiens
LWIHKMEER

SEQ ID NO: 107373 - protein, 9 aa, Homo Sapiens
KPQPSTREQ

SEQ ID NO: 107374 - protein, 9 aa, Homo Sapiens
CLDIYWTAH

SEQ ID NO: 107375 - protein, 9 aa, Homo Sapiens
SCEHKEEIS

SEQ ID NO: 107376 - protein, 9 aa, Homo Sapiens
KFMPGQVPY

SEQ ID NO: 107377 - protein, 9 aa, Homo Sapiens
TAHRARSLG

SEQ ID NO: 107378 - protein, 9 aa, Homo Sapiens
KSYIYVCMI

SEQ ID NO: 107379 - protein, 9 aa, Homo Sapiens
APCEAVHIP

SEQ ID NO: 107380 - protein, 9 aa, Homo Sapiens
TAHHLWTLT

SEQ ID NO: 107381 - protein, 9 aa, Homo Sapiens
EMSPEESCE

SEQ ID NO: 107382 - protein, 9 aa, Homo Sapiens
QVNRKSYIY

SEQ ID NO: 107383 - protein, 9 aa, Homo Sapiens
VLVMDKGVV

SEQ ID NO: 107384 - protein, 9 aa, Homo Sapiens
NKKTVEDCP

SEQ ID NO: 107385 - protein, 9 aa, Homo Sapiens
PRSLRQCHQ

SEQ ID NO: 107386 - protein, 9 aa, Homo Sapiens
FSAAEKKSQ

SEQ ID NO: 107387 - protein, 9 aa, Homo Sapiens
DAKIFLGQV

SEQ ID NO: 107388 - protein, 9 aa, Homo Sapiens
MTEAFTKKA

SEQ ID NO: 107389 - protein, 9 aa, Homo Sapiens
CEHKEEISE

SEQ ID NO: 107390 - protein, 9 aa, Homo Sapiens
GITSVCQSP

SEQ ID NO: 107391 - protein, 9 aa, Homo Sapiens
IHKMEERFN

SEQ ID NO: 107392 - protein, 9 aa, Homo Sapiens
KRRKVREET

SEQ ID NO: 107393 - protein, 9 aa, Homo Sapiens
TTSTTVVAL

SEQ ID NO: 107394 - protein, 9 aa, Homo Sapiens
DRLIINTQS

SEQ ID NO: 107395 - protein, 9 aa, Homo Sapiens
AHHLWTLTS

SEQ ID NO: 107396 - protein, 9 aa, Homo Sapiens
TSVCQSPRR

SEQ ID NO: 107397 - protein, 9 aa, Homo Sapiens
SPSHLEAQR

SEQ ID NO: 107398 - protein, 9 aa, Homo Sapiens
IKEEINEIK

SEQ ID NO: 107399 - protein, 9 aa, Homo Sapiens
FWTFLSHIA

SEQ ID NO: 107400 - protein, 9 aa, Homo Sapiens
NLWIHKMEE

SEQ ID NO: 107401 - protein, 9 aa, Homo Sapiens
AIKPDCVQR

SEQ ID NO: 107402 - protein, 9 aa, Homo Sapiens
SLSSRSPKT

SEQ ID NO: 107403 - protein, 9 aa, Homo Sapiens
WGPVGGKAR

SEQ ID NO: 107404 - protein, 9 aa, Homo Sapiens
KIIKEEINE

SEQ ID NO: 107405 - protein, 9 aa, Homo Sapiens
IEKVQKKRK

SEQ ID NO: 107406 - protein, 9 aa, Homo Sapiens
RAAAEAALS

SEQ ID NO: 107407 - protein, 9 aa, Homo Sapiens
PGPLKEEDL

SEQ ID NO: 107408 - protein, 9 aa, Homo Sapiens
RKLNLWIHK

SEQ ID NO: 107409 - protein, 9 aa, Homo Sapiens
PCEAVHIPM

SEQ ID NO: 107410 - protein, 9 aa, Homo Sapiens
IDLSHVSDA

SEQ ID NO: 107411 - protein, 9 aa, Homo Sapiens
EFVEKFMPG

SEQ ID NO: 107412 - protein, 9 aa, Homo Sapiens
PRRFRDQIR

SEQ ID NO: 107413 - protein, 9 aa, Homo Sapiens
PATGWTHSS

SEQ ID NO: 107414 - protein, 9 aa, Homo Sapiens
WTHSSPPRA

SEQ ID NO: 107415 - protein, 9 aa, Homo Sapiens
NSFFSNIIV

SEQ ID NO: 107416 - protein, 9 aa, Homo Sapiens
LGRDGAWGP

SEQ ID NO: 107417 - protein, 9 aa, Homo Sapiens
LWTLTSNLN

SEQ ID NO: 107418 - protein, 9 aa, Homo Sapiens
GAMQQRVLE

SEQ ID NO: 107419 - protein, 9 aa, Homo Sapiens
INEIKDTDV

SEQ ID NO: 107420 - protein, 9 aa, Homo Sapiens
QHLDKSFEE

SEQ ID NO: 107421 - protein, 9 aa, Homo Sapiens
GLLHQGRKR

SEQ ID NO: 107422 - protein, 9 aa, Homo Sapiens
LDEKIEKVQ

SEQ ID NO: 107423 - protein, 9 aa, Homo Sapiens
VELGRDGAW

SEQ ID NO: 107424 - protein, 9 aa, Homo Sapiens
FLGQVYSEL

SEQ ID NO: 107425 - protein, 9 aa, Homo Sapiens
GRDGAWGPV

SEQ ID NO: 107426 - protein, 9 aa, Homo Sapiens
VGSALNNTG

SEQ ID NO: 107427 - protein, 9 aa, Homo Sapiens
EESCEHKEE

SEQ ID NO: 107428 - protein, 9 aa, Homo Sapiens
GIPGRQSSG

SEQ ID NO: 107429 - protein, 9 aa, Homo Sapiens
LRPQLMISQ

SEQ ID NO: 107430 - protein, 9 aa, Homo Sapiens
SPKTQDSYP

SEQ ID NO: 107431 - protein, 9 aa, Homo Sapiens
ECGTPHLLS

SEQ ID NO: 107432 - protein, 9 aa, Homo Sapiens
FFRTKDSKA

SEQ ID NO: 107433 - protein, 9 aa, Homo Sapiens
PLAWLTEMS

SEQ ID NO: 107434 - protein, 9 aa, Homo Sapiens
KPLAWLTEM

SEQ ID NO: 107435 - protein, 9 aa, Homo Sapiens
LFMTLNRNS

SEQ ID NO: 107436 - protein, 9 aa, Homo Sapiens
LDAKIFLGQ

SEQ ID NO: 107437 - protein, 9 aa, Homo Sapiens
PGQVPYGSW

SEQ ID NO: 107438 - protein, 9 aa, Homo Sapiens
TMEQVERER

SEQ ID NO: 107439 - protein, 9 aa, Homo Sapiens
VAGGSTSFP

SEQ ID NO: 107440 - protein, 9 aa, Homo Sapiens
HIPMCRHMP

SEQ ID NO: 107441 - protein, 9 aa, Homo Sapiens
YDFSAAEKK

SEQ ID NO: 107442 - protein, 9 aa, Homo Sapiens
DIYWTAHRA

SEQ ID NO: 107443 - protein, 9 aa, Homo Sapiens
NEFVEGASR

SEQ ID NO: 107444 - protein, 9 aa, Homo Sapiens
RSPKTQDSY

SEQ ID NO: 107445 - protein, 9 aa, Homo Sapiens
AGPHRPSSS

SEQ ID NO: 107446 - protein, 9 aa, Homo Sapiens
HLEAQRITS

SEQ ID NO: 107447 - protein, 9 aa, Homo Sapiens
LRAAAEAAL

SEQ ID NO: 107448 - protein, 9 aa, Homo Sapiens
TSKPQPSTR

SEQ ID NO: 107449 - protein, 9 aa, Homo Sapiens
PKTQDSYPG

SEQ ID NO: 107450 - protein, 9 aa, Homo Sapiens
LTEMSIICR

SEQ ID NO: 107451 - protein, 9 aa, Homo Sapiens
LNAKRNKKT

SEQ ID NO: 107452 - protein, 9 aa, Homo Sapiens
SEEEEEERV

SEQ ID NO: 107453 - protein, 9 aa, Homo Sapiens
PSHLEAQRI

SEQ ID NO: 107454 - protein, 9 aa, Homo Sapiens
PHLLSQNRG

SEQ ID NO: 107455 - protein, 9 aa, Homo Sapiens
KSFEENSRL

SEQ ID NO: 107456 - protein, 9 aa, Homo Sapiens
KLVVVGAVG

SEQ ID NO: 107457 - protein, 9 aa, Homo Sapiens
PAPAPQAVG

SEQ ID NO: 107458 - protein, 9 aa, Homo Sapiens
MIWQSAIAG

SEQ ID NO: 107459 - protein, 9 aa, Homo Sapiens
MLSGQCRVA

SEQ ID NO: 107460 - protein, 9 aa, Homo Sapiens
APQAVGWPI

SEQ ID NO: 107461 - protein, 9 aa, Homo Sapiens
LCGVHDGLF

SEQ ID NO: 107462 - protein, 9 aa, Homo Sapiens
AFFRTKDSK

SEQ ID NO: 107463 - protein, 9 aa, Homo Sapiens
TYNYLGKKD

SEQ ID NO: 107464 - protein, 9 aa, Homo Sapiens
PALCNNTAE

SEQ ID NO: 107465 - protein, 9 aa, Homo Sapiens
SHLEAQRIT

SEQ ID NO: 107466 - protein, 9 aa, Homo Sapiens
RGAPCEAVH

SEQ ID NO: 107467 - protein, 9 aa, Homo Sapiens
HLLSQNRGA

SEQ ID NO: 107468 - protein, 9 aa, Homo Sapiens
CPKCGRRFS

SEQ ID NO: 107469 - protein, 9 aa, Homo Sapiens
PLDAKIFLG

SEQ ID NO: 107470 - protein, 9 aa, Homo Sapiens
VPEKGSLGP

SEQ ID NO: 107471 - protein, 9 aa, Homo Sapiens
SLDNMIWQS

SEQ ID NO: 107472 - protein, 9 aa, Homo Sapiens
CQSPRRFRD

SEQ ID NO: 107473 - protein, 9 aa, Homo Sapiens
KVQKKRKTE

SEQ ID NO: 107474 - protein, 9 aa, Homo Sapiens
FFSNIIVAG

SEQ ID NO: 107475 - protein, 9 aa, Homo Sapiens
VCQSPRRFR

SEQ ID NO: 107476 - protein, 9 aa, Homo Sapiens
GKSKPLAWL

SEQ ID NO: 107477 - protein, 9 aa, Homo Sapiens
FSLFLELLQ

SEQ ID NO: 107478 - protein, 9 aa, Homo Sapiens
ESVGQGKMV

SEQ ID NO: 107479 - protein, 9 aa, Homo Sapiens
HLDKSFEEN

SEQ ID NO: 107480 - protein, 9 aa, Homo Sapiens
EAALSQTGF

SEQ ID NO: 107481 - protein, 9 aa, Homo Sapiens
MIDLSHVSD

SEQ ID NO: 107482 - protein, 9 aa, Homo Sapiens
TSTTVVALL

SEQ ID NO: 107483 - protein, 9 aa, Homo Sapiens
SNIIVAGGS

SEQ ID NO: 107484 - protein, 9 aa, Homo Sapiens
NAGPHRPSS

SEQ ID NO: 107485 - protein, 9 aa, Homo Sapiens
SLRQCHQLQ

SEQ ID NO: 107486 - protein, 9 aa, Homo Sapiens
LLSQNRGAS

SEQ ID NO: 107487 - protein, 9 aa, Homo Sapiens
SYTAHHLWT

SEQ ID NO: 107488 - protein, 9 aa, Homo Sapiens
EFVEGASRD

SEQ ID NO: 107489 - protein, 9 aa, Homo Sapiens
VREETQGLK

SEQ ID NO: 107490 - protein, 9 aa, Homo Sapiens
CNNTAEITI

SEQ ID NO: 107491 - protein, 9 aa, Homo Sapiens
LSQTGFSYD

SEQ ID NO: 107492 - protein, 9 aa, Homo Sapiens
LEFWTFLSH

SEQ ID NO: 107493 - protein, 9 aa, Homo Sapiens
KRNKKTVED

SEQ ID NO: 107494 - protein, 9 aa, Homo Sapiens
RSVHCHLYP

SEQ ID NO: 107495 - protein, 9 aa, Homo Sapiens
RSTMEQVER

SEQ ID NO: 107496 - protein, 9 aa, Homo Sapiens
EEINEIKDT

SEQ ID NO: 107497 - protein, 9 aa, Homo Sapiens
EGASRDKWV

SEQ ID NO: 107498 - protein, 9 aa, Homo Sapiens
PDCVQRGLV

SEQ ID NO: 107499 - protein, 9 aa, Homo Sapiens
RPQLMISQF

SEQ ID NO: 107500 - protein, 9 aa, Homo Sapiens
EKFMPGQVP

SEQ ID NO: 107501 - protein, 9 aa, Homo Sapiens
RLCGVHDGL

SEQ ID NO: 107502 - protein, 9 aa, Homo Sapiens
VPSSVRSSH

SEQ ID NO: 107503 - protein, 9 aa, Homo Sapiens
PDRAFFRTK

SEQ ID NO: 107504 - protein, 9 aa, Homo Sapiens
ASSLPSLGH

SEQ ID NO: 107505 - protein, 9 aa, Homo Sapiens
LSLDNMIWQ

SEQ ID NO: 107506 - protein, 9 aa, Homo Sapiens
FMPGQVPYG

SEQ ID NO: 107507 - protein, 9 aa, Homo Sapiens
WIHKMEERF

SEQ ID NO: 107508 - protein, 9 aa, Homo Sapiens
TASSLPSLG

SEQ ID NO: 107509 - protein, 9 aa, Homo Sapiens
PCPKCGRRF

SEQ ID NO: 107510 - protein, 9 aa, Homo Sapiens
NQVNRKSYI

SEQ ID NO: 107511 - protein, 9 aa, Homo Sapiens
LRQHLDKSF

SEQ ID NO: 107512 - protein, 9 aa, Homo Sapiens
TSVPSSVRS

SEQ ID NO: 107513 - protein, 9 aa, Homo Sapiens
VVVGAVGVG

SEQ ID NO: 107514 - protein, 9 aa, Homo Sapiens
IIKEEINEI

SEQ ID NO: 107515 - protein, 9 aa, Homo Sapiens
PSDMTEAFT

SEQ ID NO: 107516 - protein, 9 aa, Homo Sapiens
ALCNNTAEI

SEQ ID NO: 107517 - protein, 9 aa, Homo Sapiens
AALSQTGFS

SEQ ID NO: 107518 - protein, 9 aa, Homo Sapiens
CRVAWARIP

SEQ ID NO: 107519 - protein, 9 aa, Homo Sapiens
KVREETQGL

SEQ ID NO: 107520 - protein, 9 aa, Homo Sapiens
YIYVCMISY

SEQ ID NO: 107521 - protein, 9 aa, Homo Sapiens
SLPSLGHLP

SEQ ID NO: 107522 - protein, 9 aa, Homo Sapiens
HLWTLTSNL

SEQ ID NO: 107523 - protein, 9 aa, Homo Sapiens
AQRITSARK

SEQ ID NO: 107524 - protein, 9 aa, Homo Sapiens
LVPAFSLFL

SEQ ID NO: 107525 - protein, 9 aa, Homo Sapiens
VEGASRDKW

SEQ ID NO: 107526 - protein, 9 aa, Homo Sapiens
QELNRTCGA

SEQ ID NO: 107527 - protein, 9 aa, Homo Sapiens
QVLFMTLNR

SEQ ID NO: 107528 - protein, 9 aa, Homo Sapiens
RAFFRTKDS

SEQ ID NO: 107529 - protein, 9 aa, Homo Sapiens
RFRSVHCHL

SEQ ID NO: 107530 - protein, 9 aa, Homo Sapiens
EIKDTDVIM

SEQ ID NO: 107531 - protein, 9 aa, Homo Sapiens
PLKEEDLLN

SEQ ID NO: 107532 - protein, 9 aa, Homo Sapiens
GVGSALNNT

SEQ ID NO: 107533 - protein, 9 aa, Homo Sapiens
IWQSAIAGE

SEQ ID NO: 107534 - protein, 9 aa, Homo Sapiens
PTSLPRSLR

SEQ ID NO: 107535 - protein, 9 aa, Homo Sapiens
WLTEMSIIC

SEQ ID NO: 107536 - protein, 9 aa, Homo Sapiens
EFWTFLSHI

SEQ ID NO: 107537 - protein, 9 aa, Homo Sapiens
GQGKMVAVF

SEQ ID NO: 107538 - protein, 9 aa, Homo Sapiens
IIVAGGSTS

SEQ ID NO: 107539 - protein, 9 aa, Homo Sapiens
CGVHDGLFT

SEQ ID NO: 107540 - protein, 9 aa, Homo Sapiens
YKLVVVGAV

SEQ ID NO: 107541 - protein, 9 aa, Homo Sapiens
SFFSNIIVA

SEQ ID NO: 107542 - protein, 9 aa, Homo Sapiens
NIIVAGGST

SEQ ID NO: 107543 - protein, 9 aa, Homo Sapiens
PEFVEKFMP

SEQ ID NO: 107544 - protein, 9 aa, Homo Sapiens
RKSYIYVCM

SEQ ID NO: 107545 - protein, 9 aa, Homo Sapiens
PGECGTPHL

SEQ ID NO: 107546 - protein, 9 aa, Homo Sapiens
LSHIAFLMV

SEQ ID NO: 107547 - protein, 9 aa, Homo Sapiens
KIFLGQVYS

SEQ ID NO: 107548 - protein, 9 aa, Homo Sapiens
RYLAICWPL

SEQ ID NO: 107549 - protein, 9 aa, Homo Sapiens
YWTAHRARS

SEQ ID NO: 107550 - protein, 9 aa, Homo Sapiens
GPALCNNTA

SEQ ID NO: 107551 - protein, 9 aa, Homo Sapiens
SSRSPKTQD

SEQ ID NO: 107552 - protein, 9 aa, Homo Sapiens
YEEKRKKKM

SEQ ID NO: 107553 - protein, 9 aa, Homo Sapiens
AICWPLHYP

SEQ ID NO: 107554 - protein, 9 aa, Homo Sapiens
FVEGASRDK

SEQ ID NO: 107555 - protein, 9 aa, Homo Sapiens
CWPLHYPII

SEQ ID NO: 107556 - protein, 9 aa, Homo Sapiens
VMDKGVVAE

SEQ ID NO: 107557 - protein, 9 aa, Homo Sapiens
SSVRSSHMS

SEQ ID NO: 107558 - protein, 9 aa, Homo Sapiens
CCHSSGGYC

SEQ ID NO: 107559 - protein, 9 aa, Homo Sapiens
MDKGVVAEF

SEQ ID NO: 107560 - protein, 9 aa, Homo Sapiens
PPSDMTEAF

SEQ ID NO: 107561 - protein, 9 aa, Homo Sapiens
HHLWTLTSN

SEQ ID NO: 107562 - protein, 9 aa, Homo Sapiens
HCVPEKGSL

SEQ ID NO: 107563 - protein, 9 aa, Homo Sapiens
TFLSHIAFL

SEQ ID NO: 107564 - protein, 9 aa, Homo Sapiens
LLHQGRKRR

SEQ ID NO: 107565 - protein, 9 aa, Homo Sapiens
WQSAIAGEE

SEQ ID NO: 107566 - protein, 9 aa, Homo Sapiens
VQKKRKTED

SEQ ID NO: 107567 - protein, 9 aa, Homo Sapiens
AFSLFLELL

SEQ ID NO: 107568 - protein, 9 aa, Homo Sapiens
MNIFGNDNI

SEQ ID NO: 107569 - protein, 9 aa, Homo Sapiens
ENAEGTIPV

SEQ ID NO: 107570 - protein, 9 aa, Homo Sapiens
LRTKVENAE

SEQ ID NO: 107571 - protein, 9 aa, Homo Sapiens
TEELMNFSK

SEQ ID NO: 107572 - protein, 9 aa, Homo Sapiens
VENAEGTIP

SEQ ID NO: 107573 - protein, 9 aa, Homo Sapiens
PMFPTIHKS

SEQ ID NO: 107574 - protein, 9 aa, Homo Sapiens
KGTVLIKTT

SEQ ID NO: 107575 - protein, 9 aa, Homo Sapiens
HASKRDCFM

SEQ ID NO: 107576 - protein, 9 aa, Homo Sapiens
TQSNLSPLQ

SEQ ID NO: 107577 - protein, 9 aa, Homo Sapiens
HLQTKTPDL

SEQ ID NO: 107578 - protein, 9 aa, Homo Sapiens
RSPSHNPRS

SEQ ID NO: 107579 - protein, 9 aa, Homo Sapiens
QQQQQRRRH

SEQ ID NO: 107580 - protein, 9 aa, Homo Sapiens
QRRRHHRSP

SEQ ID NO: 107581 - protein, 9 aa, Homo Sapiens
LHGTQSNLS

SEQ ID NO: 107582 - protein, 9 aa, Homo Sapiens
PDRKWGAPL

SEQ ID NO: 107583 - protein, 9 aa, Homo Sapiens
SHNPRSPSP

SEQ ID NO: 107584 - protein, 9 aa, Homo Sapiens
TGFQATFMN

SEQ ID NO: 107585 - protein, 9 aa, Homo Sapiens
KWGAPLWTV

SEQ ID NO: 107586 - protein, 9 aa, Homo Sapiens
LGNMEENQK

SEQ ID NO: 107587 - protein, 9 aa, Homo Sapiens
QRPMFPTIH

SEQ ID NO: 107588 - protein, 9 aa, Homo Sapiens
ATILCLHGT

SEQ ID NO: 107589 - protein, 9 aa, Homo Sapiens
IGGLPSPEM

SEQ ID NO: 107590 - protein, 9 aa, Homo Sapiens
VIGGLPSPE

SEQ ID NO: 107591 - protein, 9 aa, Homo Sapiens
AAVREASQR

SEQ ID NO: 107592 - protein, 9 aa, Homo Sapiens
RHHRSPSHN

SEQ ID NO: 107593 - protein, 9 aa, Homo Sapiens
KVENAEGTI

SEQ ID NO: 107594 - protein, 9 aa, Homo Sapiens
LTYLVSGEC

SEQ ID NO: 107595 - protein, 9 aa, Homo Sapiens
DDVEKVLSP

SEQ ID NO: 107596 - protein, 9 aa, Homo Sapiens
LIKTTEELM

SEQ ID NO: 107597 - protein, 9 aa, Homo Sapiens
GHELCSVQL

SEQ ID NO: 107598 - protein, 9 aa, Homo Sapiens
HNPRSPSPD

SEQ ID NO: 107599 - protein, 9 aa, Homo Sapiens
MTVTRTTIT

SEQ ID NO: 107600 - protein, 9 aa, Homo Sapiens
MVRGARGHE

SEQ ID NO: 107601 - protein, 9 aa, Homo Sapiens
MFPTIHKSE

SEQ ID NO: 107602 - protein, 9 aa, Homo Sapiens
PQDEKAECL

SEQ ID NO: 107603 - protein, 9 aa, Homo Sapiens
ETIVNLSEN

SEQ ID NO: 107604 - protein, 9 aa, Homo Sapiens
FPYEQQIKF

SEQ ID NO: 107605 - protein, 9 aa, Homo Sapiens
GIHLQTKTP

SEQ ID NO: 107606 - protein, 9 aa, Homo Sapiens
QPQDEKAEC

SEQ ID NO: 107607 - protein, 9 aa, Homo Sapiens
RPMFPTIHK

SEQ ID NO: 107608 - protein, 9 aa, Homo Sapiens
AVREASQRI

SEQ ID NO: 107609 - protein, 9 aa, Homo Sapiens
DEKAECLIN

SEQ ID NO: 107610 - protein, 9 aa, Homo Sapiens
GFQATFMNI

SEQ ID NO: 107611 - protein, 9 aa, Homo Sapiens
QQQQRRRHH

SEQ ID NO: 107612 - protein, 9 aa, Homo Sapiens
QQQRRRHHR

SEQ ID NO: 107613 - protein, 9 aa, Homo Sapiens
KAECLINVS

SEQ ID NO: 107614 - protein, 9 aa, Homo Sapiens
GTVLIKTTE

SEQ ID NO: 107615 - protein, 9 aa, Homo Sapiens
QATFMNIFG

SEQ ID NO: 107616 - protein, 9 aa, Homo Sapiens
SETIVNLSE

SEQ ID NO: 107617 - protein, 9 aa, Homo Sapiens
NMEENQKLE

SEQ ID NO: 107618 - protein, 9 aa, Homo Sapiens
SYCINNFGH

SEQ ID NO: 107619 - protein, 9 aa, Homo Sapiens
PMTVTRTTI

SEQ ID NO: 107620 - protein, 9 aa, Homo Sapiens
IHLQTKTPD

SEQ ID NO: 107621 - protein, 9 aa, Homo Sapiens
GGLPSPEMY

SEQ ID NO: 107622 - protein, 9 aa, Homo Sapiens
QTKTPDLYP

SEQ ID NO: 107623 - protein, 9 aa, Homo Sapiens
TKTPDLYPV

SEQ ID NO: 107624 - protein, 9 aa, Homo Sapiens
QIKFFAKVV

SEQ ID NO: 107625 - protein, 9 aa, Homo Sapiens
TVLIKTTEE

SEQ ID NO: 107626 - protein, 9 aa, Homo Sapiens
VEKVLSPFL

SEQ ID NO: 107627 - protein, 9 aa, Homo Sapiens
DLGNMEENQ

SEQ ID NO: 107628 - protein, 9 aa, Homo Sapiens
CLQTWLEAA

SEQ ID NO: 107629 - protein, 9 aa, Homo Sapiens
GVIGGLPSP

SEQ ID NO: 107630 - protein, 9 aa, Homo Sapiens
INNFGHRLA

SEQ ID NO: 107631 - protein, 9 aa, Homo Sapiens
LVSGECQVQ

SEQ ID NO: 107632 - protein, 9 aa, Homo Sapiens
VRGARGHEL

SEQ ID NO: 107633 - protein, 9 aa, Homo Sapiens
GECQVQVIL

SEQ ID NO: 107634 - protein, 9 aa, Homo Sapiens
GHASKRDCF

SEQ ID NO: 107635 - protein, 9 aa, Homo Sapiens
HGTQSNLSP

SEQ ID NO: 107636 - protein, 9 aa, Homo Sapiens
KRDCFMYGN

SEQ ID NO: 107637 - protein, 9 aa, Homo Sapiens
YCINNFGHR

SEQ ID NO: 107638 - protein, 9 aa, Homo Sapiens
MPMTVTRTT

SEQ ID NO: 107639 - protein, 9 aa, Homo Sapiens
RESYCINNF

SEQ ID NO: 107640 - protein, 9 aa, Homo Sapiens
VLIKTTEEL

SEQ ID NO: 107641 - protein, 9 aa, Homo Sapiens
SKRDCFMYG

SEQ ID NO: 107642 - protein, 9 aa, Homo Sapiens
SQRPMFPTI

SEQ ID NO: 107643 - protein, 9 aa, Homo Sapiens
RKWGAPLWT

SEQ ID NO: 107644 - protein, 9 aa, Homo Sapiens
YLVSGECQV

SEQ ID NO: 107645 - protein, 9 aa, Homo Sapiens
SPDRKWGAP

SEQ ID NO: 107646 - protein, 9 aa, Homo Sapiens
EKAECLINV

SEQ ID NO: 107647 - protein, 9 aa, Homo Sapiens
AEGTIPVES

SEQ ID NO: 107648 - protein, 9 aa, Homo Sapiens
ASETIVNLS

SEQ ID NO: 107649 - protein, 9 aa, Homo Sapiens
FQDTNLCAI

SEQ ID NO: 107650 - protein, 9 aa, Homo Sapiens
IVNLSENQL

SEQ ID NO: 107651 - protein, 9 aa, Homo Sapiens
PSPDRKWGA

SEQ ID NO: 107652 - protein, 9 aa, Homo Sapiens
RTKVENAEG

SEQ ID NO: 107653 - protein, 9 aa, Homo Sapiens
GLFQDTNLC

SEQ ID NO: 107654 - protein, 9 aa, Homo Sapiens
NPRSPSPDR

SEQ ID NO: 107655 - protein, 9 aa, Homo Sapiens
LFQDTNLCA

SEQ ID NO: 107656 - protein, 9 aa, Homo Sapiens
SQRIQAVLA

SEQ ID NO: 107657 - protein, 9 aa, Homo Sapiens
HHRSPSHNP

SEQ ID NO: 107658 - protein, 9 aa, Homo Sapiens
ECLINVSNY

SEQ ID NO: 107659 - protein, 9 aa, Homo Sapiens
LHGHASKRD

SEQ ID NO: 107660 - protein, 9 aa, Homo Sapiens
PSHNPRSPS

SEQ ID NO: 107661 - protein, 9 aa, Homo Sapiens
YLVGLFQDT

SEQ ID NO: 107662 - protein, 9 aa, Homo Sapiens
IKTTEELMN

SEQ ID NO: 107663 - protein, 9 aa, Homo Sapiens
DVEKVLSPF

SEQ ID NO: 107664 - protein, 9 aa, Homo Sapiens
TFMNIFGND

SEQ ID NO: 107665 - protein, 9 aa, Homo Sapiens
VSGECQVQV

SEQ ID NO: 107666 - protein, 9 aa, Homo Sapiens
SGECQVQVI

SEQ ID NO: 107667 - protein, 9 aa, Homo Sapiens
DASETIVNL

SEQ ID NO: 107668 - protein, 9 aa, Homo Sapiens
CLHGTQSNL

SEQ ID NO: 107669 - protein, 9 aa, Homo Sapiens
CLINVSNYS

SEQ ID NO: 107670 - protein, 9 aa, Homo Sapiens
LAAVREASQ

SEQ ID NO: 107671 - protein, 9 aa, Homo Sapiens
EASQRIQAV

SEQ ID NO: 107672 - protein, 9 aa, Homo Sapiens
GKVDASETI

SEQ ID NO: 107673 - protein, 9 aa, Homo Sapiens
HGHASKRDC

SEQ ID NO: 107674 - protein, 9 aa, Homo Sapiens
REASQRIQA

SEQ ID NO: 107675 - protein, 9 aa, Homo Sapiens
RDCFMYGNS

SEQ ID NO: 107676 - protein, 9 aa, Homo Sapiens
LCLHGTQSN

SEQ ID NO: 107677 - protein, 9 aa, Homo Sapiens
EAYLVGLFQ

SEQ ID NO: 107678 - protein, 9 aa, Homo Sapiens
DCFMYGNSF

SEQ ID NO: 107679 - protein, 9 aa, Homo Sapiens
HRSPSHNPR

SEQ ID NO: 107680 - protein, 9 aa, Homo Sapiens
DMVRGARGH

SEQ ID NO: 107681 - protein, 9 aa, Homo Sapiens
AECLINVSN

SEQ ID NO: 107682 - protein, 9 aa, Homo Sapiens
SRESYCINN

SEQ ID NO: 107683 - protein, 9 aa, Homo Sapiens
LQTKTPDLY

SEQ ID NO: 107684 - protein, 9 aa, Homo Sapiens
FQATFMNIF

SEQ ID NO: 107685 - protein, 9 aa, Homo Sapiens
QQRRRHHRS

SEQ ID NO: 107686 - protein, 9 aa, Homo Sapiens
LLCLQTWLE

SEQ ID NO: 107687 - protein, 9 aa, Homo Sapiens
TIHKSEKSR

SEQ ID NO: 107688 - protein, 9 aa, Homo Sapiens
GLPSPEMYV

SEQ ID NO: 107689 - protein, 9 aa, Homo Sapiens
WLEAAGKDS

SEQ ID NO: 107690 - protein, 9 aa, Homo Sapiens
LEAAGKDSE

SEQ ID NO: 107691 - protein, 9 aa, Homo Sapiens
TYLVSGECQ

SEQ ID NO: 107692 - protein, 9 aa, Homo Sapiens
AYLVGLFQD

SEQ ID NO: 107693 - protein, 9 aa, Homo Sapiens
LQTWLEAAG

SEQ ID NO: 107694 - protein, 9 aa, Homo Sapiens
EKVLSPFLL

SEQ ID NO: 107695 - protein, 9 aa, Homo Sapiens
VGLFQDTNL

SEQ ID NO: 107696 - protein, 9 aa, Homo Sapiens
TIVNLSENQ

SEQ ID NO: 107697 - protein, 9 aa, Homo Sapiens
RGARGHELC

SEQ ID NO: 107698 - protein, 9 aa, Homo Sapiens
RRRHHRSPS

SEQ ID NO: 107699 - protein, 9 aa, Homo Sapiens
KTPDLYPVP

SEQ ID NO: 107700 - protein, 9 aa, Homo Sapiens
ARGHELCSV

SEQ ID NO: 107701 - protein, 9 aa, Homo Sapiens
NIFGNDNIV

SEQ ID NO: 107702 - protein, 9 aa, Homo Sapiens
VDDVEKVLS

SEQ ID NO: 107703 - protein, 9 aa, Homo Sapiens
ESYCINNFG

SEQ ID NO: 107704 - protein, 9 aa, Homo Sapiens
ILCLHGTQS

SEQ ID NO: 107705 - protein, 9 aa, Homo Sapiens
LCLQTWLEA

SEQ ID NO: 107706 - protein, 9 aa, Homo Sapiens
GNMEENQKL

SEQ ID NO: 107707 - protein, 9 aa, Homo Sapiens
ALAAVREAS

SEQ ID NO: 107708 - protein, 9 aa, Homo Sapiens
KGVIGGLPS

SEQ ID NO: 107709 - protein, 9 aa, Homo Sapiens
ATFMNIFGN

SEQ ID NO: 107710 - protein, 9 aa, Homo Sapiens
TTEELMNFS

SEQ ID NO: 107711 - protein, 9 aa, Homo Sapiens
GARGHELCS

SEQ ID NO: 107712 - protein, 9 aa, Homo Sapiens
ASKRDCFMY

SEQ ID NO: 107713 - protein, 9 aa, Homo Sapiens
DRKWGAPLW

SEQ ID NO: 107714 - protein, 9 aa, Homo Sapiens
KTTEELMNF

SEQ ID NO: 107715 - protein, 9 aa, Homo Sapiens
HELCSVQLA

SEQ ID NO: 107716 - protein, 9 aa, Homo Sapiens
RSPSPDRKW

SEQ ID NO: 107717 - protein, 9 aa, Homo Sapiens
QKLEENNHK

SEQ ID NO: 107718 - protein, 9 aa, Homo Sapiens
SPSHNPRSP

SEQ ID NO: 107719 - protein, 9 aa, Homo Sapiens
LPSPEMYVI

SEQ ID NO: 107720 - protein, 9 aa, Homo Sapiens
TILCLHGTQ

SEQ ID NO: 107721 - protein, 9 aa, Homo Sapiens
VDASETIVN

SEQ ID NO: 107722 - protein, 9 aa, Homo Sapiens
YEQQIKFFA

SEQ ID NO: 107723 - protein, 9 aa, Homo Sapiens
ASQRIQAVL

SEQ ID NO: 107724 - protein, 9 aa, Homo Sapiens
ENQKLEENN

SEQ ID NO: 107725 - protein, 9 aa, Homo Sapiens
KVDASETIV

SEQ ID NO: 107726 - protein, 9 aa, Homo Sapiens
CQVQVILRV

SEQ ID NO: 107727 - protein, 9 aa, Homo Sapiens
KSQRPMFPT

SEQ ID NO: 107728 - protein, 9 aa, Homo Sapiens
FMNIFGNDN

SEQ ID NO: 107729 - protein, 9 aa, Homo Sapiens
KLRTKVENA

SEQ ID NO: 107730 - protein, 9 aa, Homo Sapiens
EVDDVEKVL

SEQ ID NO: 107731 - protein, 9 aa, Homo Sapiens
FPTIHKSEK

SEQ ID NO: 107732 - protein, 9 aa, Homo Sapiens
SPEMYVIDL

SEQ ID NO: 107733 - protein, 9 aa, Homo Sapiens
VREASQRIQ

SEQ ID NO: 107734 - protein, 9 aa, Homo Sapiens
TKVENAEGT

SEQ ID NO: 107735 - protein, 9 aa, Homo Sapiens
LLLCLQTWL

SEQ ID NO: 107736 - protein, 9 aa, Homo Sapiens
ECQVQVILR

SEQ ID NO: 107737 - protein, 9 aa, Homo Sapiens
GEHFPYEQQ

SEQ ID NO: 107738 - protein, 9 aa, Homo Sapiens
NAEGTIPVE

SEQ ID NO: 107739 - protein, 9 aa, Homo Sapiens
LVGLFQDTN

SEQ ID NO: 107740 - protein, 9 aa, Homo Sapiens
EQQIKFFAK

SEQ ID NO: 107741 - protein, 9 aa, Homo Sapiens
CINNFGHRL

SEQ ID NO: 107742 - protein, 9 aa, Homo Sapiens
QTWLEAAGK

SEQ ID NO: 107743 - protein, 9 aa, Homo Sapiens
PTIHKSEKS

SEQ ID NO: 107744 - protein, 9 aa, Homo Sapiens
SPSPDRKWG

SEQ ID NO: 107745 - protein, 9 aa, Homo Sapiens
EHFPYEQQI

SEQ ID NO: 107746 - protein, 9 aa, Homo Sapiens
QDEKAECLI

SEQ ID NO: 107747 - protein, 9 aa, Homo Sapiens
TWLEAAGKD

SEQ ID NO: 107748 - protein, 9 aa, Homo Sapiens
QDTNLCAIH

SEQ ID NO: 107749 - protein, 9 aa, Homo Sapiens
MEENQKLEE

SEQ ID NO: 107750 - protein, 9 aa, Homo Sapiens
ERSRESYCI

SEQ ID NO: 107751 - protein, 9 aa, Homo Sapiens
QQIKFFAKV

SEQ ID NO: 107752 - protein, 9 aa, Homo Sapiens
PSPEMYVID

SEQ ID NO: 107753 - protein, 9 aa, Homo Sapiens
RSRESYCIN

SEQ ID NO: 107754 - protein, 9 aa, Homo Sapiens
GTQSNLSPL

SEQ ID NO: 107755 - protein, 9 aa, Homo Sapiens
QQQQQQRRR

SEQ ID NO: 107756 - protein, 9 aa, Homo Sapiens
HFPYEQQIK

SEQ ID NO: 107757 - protein, 9 aa, Homo Sapiens
RGHELCSVQ

SEQ ID NO: 107758 - protein, 9 aa, Homo Sapiens
EENQKLEEN

SEQ ID NO: 107759 - protein, 9 aa, Homo Sapiens
NQKLEENNH

SEQ ID NO: 107760 - protein, 9 aa, Homo Sapiens
VGIHLQTKT

SEQ ID NO: 107761 - protein, 9 aa, Homo Sapiens
PRSPSPDRK

SEQ ID NO: 107762 - protein, 9 aa, Homo Sapiens
RRHHRSPSH

SEQ ID NO: 107763 - protein, 9 aa, Homo Sapiens
PYEQQIKFF

SEQ ID NO: 107764 - protein, 9 aa, Homo Sapiens
TVGIHLQTK

SEQ ID NO: 107765 - protein, 9 aa, Homo Sapiens
VAQKLGSTT

SEQ ID NO: 107766 - protein, 9 aa, Homo Sapiens
PCTLLAHIW

SEQ ID NO: 107767 - protein, 9 aa, Homo Sapiens
QHMQQQQLQ

SEQ ID NO: 107768 - protein, 9 aa, Homo Sapiens
KRVVSGSPD

SEQ ID NO: 107769 - protein, 9 aa, Homo Sapiens
VDDRQSSKA

SEQ ID NO: 107770 - protein, 9 aa, Homo Sapiens
KSRDDSQLY

SEQ ID NO: 107771 - protein, 9 aa, Homo Sapiens
RNCEGLGYS

SEQ ID NO: 107772 - protein, 9 aa, Homo Sapiens
SPLRATDGR

SEQ ID NO: 107773 - protein, 9 aa, Homo Sapiens
LVATLNDSV

SEQ ID NO: 107774 - protein, 9 aa, Homo Sapiens
YLVSGNKTD

SEQ ID NO: 107775 - protein, 9 aa, Homo Sapiens
TKAEMKMSL

SEQ ID NO: 107776 - protein, 9 aa, Homo Sapiens
GGGANGTCF

SEQ ID NO: 107777 - protein, 9 aa, Homo Sapiens
VVRFFYDFV

SEQ ID NO: 107778 - protein, 9 aa, Homo Sapiens
FHVCIQWRR

SEQ ID NO: 107779 - protein, 9 aa, Homo Sapiens
ADTGIITSP

SEQ ID NO: 107780 - protein, 9 aa, Homo Sapiens
RKLQEKNGE

SEQ ID NO: 107781 - protein, 9 aa, Homo Sapiens
LEGNFSEKI

SEQ ID NO: 107782 - protein, 9 aa, Homo Sapiens
DKKQLKKEN

SEQ ID NO: 107783 - protein, 9 aa, Homo Sapiens
MINKKHLVA

SEQ ID NO: 107784 - protein, 9 aa, Homo Sapiens
ARGLLGKSG

SEQ ID NO: 107785 - protein, 9 aa, Homo Sapiens
QPPAGAPKQ

SEQ ID NO: 107786 - protein, 9 aa, Homo Sapiens
AQRQPVSTC

SEQ ID NO: 107787 - protein, 9 aa, Homo Sapiens
FRNWHGINP

SEQ ID NO: 107788 - protein, 9 aa, Homo Sapiens
LSHPNVIRL

SEQ ID NO: 107789 - protein, 9 aa, Homo Sapiens
IMTMLNKGL

SEQ ID NO: 107790 - protein, 9 aa, Homo Sapiens
ELYTTHGLM

SEQ ID NO: 107791 - protein, 9 aa, Homo Sapiens
GEGGRRCRA

SEQ ID NO: 107792 - protein, 9 aa, Homo Sapiens
HYREAMIQG

SEQ ID NO: 107793 - protein, 9 aa, Homo Sapiens
REQLCTGPS

SEQ ID NO: 107794 - protein, 9 aa, Homo Sapiens
QNELEMINK

SEQ ID NO: 107795 - protein, 9 aa, Homo Sapiens
DSNDDDSHS

SEQ ID NO: 107796 - protein, 9 aa, Homo Sapiens
KTKKQRSKR

SEQ ID NO: 107797 - protein, 9 aa, Homo Sapiens
GYLHADTGI

SEQ ID NO: 107798 - protein, 9 aa, Homo Sapiens
EDKDEDDGF

SEQ ID NO: 107799 - protein, 9 aa, Homo Sapiens
PPYTSLRRA

SEQ ID NO: 107800 - protein, 9 aa, Homo Sapiens
ASEARAQLL

SEQ ID NO: 107801 - protein, 9 aa, Homo Sapiens
SGGGANGTC

SEQ ID NO: 107802 - protein, 9 aa, Homo Sapiens
PFLSSSVSS

SEQ ID NO: 107803 - protein, 9 aa, Homo Sapiens
KPYRYIQCD

SEQ ID NO: 107804 - protein, 9 aa, Homo Sapiens
QQQQMQHMQ

SEQ ID NO: 107805 - protein, 9 aa, Homo Sapiens
LQQHYREAM

SEQ ID NO: 107806 - protein, 9 aa, Homo Sapiens
FQIKHEVLC

SEQ ID NO: 107807 - protein, 9 aa, Homo Sapiens
TEAGTMVKQ

SEQ ID NO: 107808 - protein, 9 aa, Homo Sapiens
SVDDRQSSK

SEQ ID NO: 107809 - protein, 9 aa, Homo Sapiens
KQLKKENKR

SEQ ID NO: 107810 - protein, 9 aa, Homo Sapiens
QMHLSRSVP

SEQ ID NO: 107811 - protein, 9 aa, Homo Sapiens
LGVAGEGGR

SEQ ID NO: 107812 - protein, 9 aa, Homo Sapiens
KHEATRTPA

SEQ ID NO: 107813 - protein, 9 aa, Homo Sapiens
GGYLHADTG

SEQ ID NO: 107814 - protein, 9 aa, Homo Sapiens
HKFHVCIQW

SEQ ID NO: 107815 - protein, 9 aa, Homo Sapiens
GANGTCFSY

SEQ ID NO: 107816 - protein, 9 aa, Homo Sapiens
GKVTLKNAQ

SEQ ID NO: 107817 - protein, 9 aa, Homo Sapiens
VFNKTPINP

SEQ ID NO: 107818 - protein, 9 aa, Homo Sapiens
PLAQRRFQA

SEQ ID NO: 107819 - protein, 9 aa, Homo Sapiens
EANESEQVR

SEQ ID NO: 107820 - protein, 9 aa, Homo Sapiens
MKMSLAEEL

SEQ ID NO: 107821 - protein, 9 aa, Homo Sapiens
LEKDKKQLK

SEQ ID NO: 107822 - protein, 9 aa, Homo Sapiens
MKDLSHPNV

SEQ ID NO: 107823 - protein, 9 aa, Homo Sapiens
RSLCSTPLS

SEQ ID NO: 107824 - protein, 9 aa, Homo Sapiens
VLAAFLLGF

SEQ ID NO: 107825 - protein, 9 aa, Homo Sapiens
EKDKKQLKK

SEQ ID NO: 107826 - protein, 9 aa, Homo Sapiens
LYTTHGLMK

SEQ ID NO: 107827 - protein, 9 aa, Homo Sapiens
SHSGSDFPT

SEQ ID NO: 107828 - protein, 9 aa, Homo Sapiens
GFMSCKDLG

SEQ ID NO: 107829 - protein, 9 aa, Homo Sapiens
RQPVSEASA

SEQ ID NO: 107830 - protein, 9 aa, Homo Sapiens
KDRDGFMSC

SEQ ID NO: 107831 - protein, 9 aa, Homo Sapiens
QLTDFSPLR

SEQ ID NO: 107832 - protein, 9 aa, Homo Sapiens
VEFLGPLDR

SEQ ID NO: 107833 - protein, 9 aa, Homo Sapiens
KSNIGTLKH

SEQ ID NO: 107834 - protein, 9 aa, Homo Sapiens
SQLYGDSSA

SEQ ID NO: 107835 - protein, 9 aa, Homo Sapiens
EEKKKILLN

SEQ ID NO: 107836 - protein, 9 aa, Homo Sapiens
DYVYFKNSS

SEQ ID NO: 107837 - protein, 9 aa, Homo Sapiens
APNSLGVST

SEQ ID NO: 107838 - protein, 9 aa, Homo Sapiens
RASSRIFWR

SEQ ID NO: 107839 - protein, 9 aa, Homo Sapiens
ARVLEQASR

SEQ ID NO: 107840 - protein, 9 aa, Homo Sapiens
TSIYSCKTS

SEQ ID NO: 107841 - protein, 9 aa, Homo Sapiens
KYLPKVFAP

SEQ ID NO: 107842 - protein, 9 aa, Homo Sapiens
HEQGGLESW

SEQ ID NO: 107843 - protein, 9 aa, Homo Sapiens
APCSPHIYQ

SEQ ID NO: 107844 - protein, 9 aa, Homo Sapiens
KILLNLSCQ

SEQ ID NO: 107845 - protein, 9 aa, Homo Sapiens
HMQQQQLQQ

SEQ ID NO: 107846 - protein, 9 aa, Homo Sapiens
PEKHLQDVL

SEQ ID NO: 107847 - protein, 9 aa, Homo Sapiens
VKMKSEGGA

SEQ ID NO: 107848 - protein, 9 aa, Homo Sapiens
QENLGIDKR

SEQ ID NO: 107849 - protein, 9 aa, Homo Sapiens
LTILIAYKW

SEQ ID NO: 107850 - protein, 9 aa, Homo Sapiens
IRLEREQLC

SEQ ID NO: 107851 - protein, 9 aa, Homo Sapiens
EAGGKAGHI

SEQ ID NO: 107852 - protein, 9 aa, Homo Sapiens
LSLPGPRAG

SEQ ID NO: 107853 - protein, 9 aa, Homo Sapiens
SCKHNTTGQ

SEQ ID NO: 107854 - protein, 9 aa, Homo Sapiens
RDIHFVEDD

SEQ ID NO: 107855 - protein, 9 aa, Homo Sapiens
NAQYWSQFY

SEQ ID NO: 107856 - protein, 9 aa, Homo Sapiens
KSIRCFGSR

SEQ ID NO: 107857 - protein, 9 aa, Homo Sapiens
VSCKHNTTG

SEQ ID NO: 107858 - protein, 9 aa, Homo Sapiens
HEATRTPAT

SEQ ID NO: 107859 - protein, 9 aa, Homo Sapiens
GAPKQSPAH

SEQ ID NO: 107860 - protein, 9 aa, Homo Sapiens
EGNFSEKIL

SEQ ID NO: 107861 - protein, 9 aa, Homo Sapiens
VATLNDSVT

SEQ ID NO: 107862 - protein, 9 aa, Homo Sapiens
LCSTPLSQA

SEQ ID NO: 107863 - protein, 9 aa, Homo Sapiens
QPVSTCTAS

SEQ ID NO: 107864 - protein, 9 aa, Homo Sapiens
PIHDHDCGV

SEQ ID NO: 107865 - protein, 9 aa, Homo Sapiens
FRASSRIFW

SEQ ID NO: 107866 - protein, 9 aa, Homo Sapiens
DDLENDEDD

SEQ ID NO: 107867 - protein, 9 aa, Homo Sapiens
TGLPCTLLA

SEQ ID NO: 107868 - protein, 9 aa, Homo Sapiens
GARGLLGKS

SEQ ID NO: 107869 - protein, 9 aa, Homo Sapiens
TMLNKGLIH

SEQ ID NO: 107870 - protein, 9 aa, Homo Sapiens
FRHGASINY

SEQ ID NO: 107871 - protein, 9 aa, Homo Sapiens
KKKKNKTKP

SEQ ID NO: 107872 - protein, 9 aa, Homo Sapiens
QAMKLLDCN

SEQ ID NO: 107873 - protein, 9 aa, Homo Sapiens
NTKAEMKMS

SEQ ID NO: 107874 - protein, 9 aa, Homo Sapiens
QEGHKVPEF

SEQ ID NO: 107875 - protein, 9 aa, Homo Sapiens
HIHITKATL

SEQ ID NO: 107876 - protein, 9 aa, Homo Sapiens
EFPDIPEKH

SEQ ID NO: 107877 - protein, 9 aa, Homo Sapiens
FANILHLST

SEQ ID NO: 107878 - protein, 9 aa, Homo Sapiens
IQEKDNVIQ

SEQ ID NO: 107879 - protein, 9 aa, Homo Sapiens
SVNKLLLLD

SEQ ID NO: 107880 - protein, 9 aa, Homo Sapiens
TTAVKCFSK

SEQ ID NO: 107881 - protein, 9 aa, Homo Sapiens
PVSEASARI

SEQ ID NO: 107882 - protein, 9 aa, Homo Sapiens
HKVPEFHGK

SEQ ID NO: 107883 - protein, 9 aa, Homo Sapiens
FSEKILKVA

SEQ ID NO: 107884 - protein, 9 aa, Homo Sapiens
GLIHSQSSS

SEQ ID NO: 107885 - protein, 9 aa, Homo Sapiens
NDQILVQNY

SEQ ID NO: 107886 - protein, 9 aa, Homo Sapiens
LVLAAFLLG

SEQ ID NO: 107887 - protein, 9 aa, Homo Sapiens
YDAAEFLAT

SEQ ID NO: 107888 - protein, 9 aa, Homo Sapiens
SLGVSTLCA

SEQ ID NO: 107889 - protein, 9 aa, Homo Sapiens
DRKHIGSIN

SEQ ID NO: 107890 - protein, 9 aa, Homo Sapiens
DYGDQLPKV

SEQ ID NO: 107891 - protein, 9 aa, Homo Sapiens
ANGTCFSYT

SEQ ID NO: 107892 - protein, 9 aa, Homo Sapiens
LIDREMISH

SEQ ID NO: 107893 - protein, 9 aa, Homo Sapiens
ANILHLSTN

SEQ ID NO: 107894 - protein, 9 aa, Homo Sapiens
AAEFLATSA

SEQ ID NO: 107895 - protein, 9 aa, Homo Sapiens
TLCAICGDR

SEQ ID NO: 107896 - protein, 9 aa, Homo Sapiens
DDMGEDKDE

SEQ ID NO: 107897 - protein, 9 aa, Homo Sapiens
GWQRNCEGL

SEQ ID NO: 107898 - protein, 9 aa, Homo Sapiens
EDPTALGFR

SEQ ID NO: 107899 - protein, 9 aa, Homo Sapiens
GMDTVPVCF

SEQ ID NO: 107900 - protein, 9 aa, Homo Sapiens
SVTLQQHYR

SEQ ID NO: 107901 - protein, 9 aa, Homo Sapiens
YLHADTGII

SEQ ID NO: 107902 - protein, 9 aa, Homo Sapiens
SALQRSLCS

SEQ ID NO: 107903 - protein, 9 aa, Homo Sapiens
SFSSSEKGF

SEQ ID NO: 107904 - protein, 9 aa, Homo Sapiens
VRRLETSIY

SEQ ID NO: 107905 - protein, 9 aa, Homo Sapiens
EFHGKWPFS

SEQ ID NO: 107906 - protein, 9 aa, Homo Sapiens
DFPTLDNSR

SEQ ID NO: 107907 - protein, 9 aa, Homo Sapiens
RLETSIYSC

SEQ ID NO: 107908 - protein, 9 aa, Homo Sapiens
NWHGINPRE

SEQ ID NO: 107909 - protein, 9 aa, Homo Sapiens
IFLKTGLPC

SEQ ID NO: 107910 - protein, 9 aa, Homo Sapiens
ARVFNKTPI

SEQ ID NO: 107911 - protein, 9 aa, Homo Sapiens
LEMINKKHL

SEQ ID NO: 107912 - protein, 9 aa, Homo Sapiens
LRATDGRVY

SEQ ID NO: 107913 - protein, 9 aa, Homo Sapiens
SRSVPLTQA

SEQ ID NO: 107914 - protein, 9 aa, Homo Sapiens
VSQIKEGKR

SEQ ID NO: 107915 - protein, 9 aa, Homo Sapiens
LRRRLSLPG

SEQ ID NO: 107916 - protein, 9 aa, Homo Sapiens
ARSPVHDTV

SEQ ID NO: 107917 - protein, 9 aa, Homo Sapiens
GDQLPKVKV

SEQ ID NO: 107918 - protein, 9 aa, Homo Sapiens
NTGRGGFHT

SEQ ID NO: 107919 - protein, 9 aa, Homo Sapiens
KKKNKTKPE

SEQ ID NO: 107920 - protein, 9 aa, Homo Sapiens
FLLGFLSAL

SEQ ID NO: 107921 - protein, 9 aa, Homo Sapiens
RALRRRVAV

SEQ ID NO: 107922 - protein, 9 aa, Homo Sapiens
TAPCSPHIY

SEQ ID NO: 107923 - protein, 9 aa, Homo Sapiens
EREQLCTGP

SEQ ID NO: 107924 - protein, 9 aa, Homo Sapiens
GTLKHAHEF

SEQ ID NO: 107925 - protein, 9 aa, Homo Sapiens
FEAAGSPFL

SEQ ID NO: 107926 - protein, 9 aa, Homo Sapiens
EMKMSLAEE

SEQ ID NO: 107927 - protein, 9 aa, Homo Sapiens
TLQQHYREA

SEQ ID NO: 107928 - protein, 9 aa, Homo Sapiens
PLRATDGRV

SEQ ID NO: 107929 - protein, 9 aa, Homo Sapiens
PCSPHIYQV

SEQ ID NO: 107930 - protein, 9 aa, Homo Sapiens
NGTCFSYTF

SEQ ID NO: 107931 - protein, 9 aa, Homo Sapiens
EKGARGLLG

SEQ ID NO: 107932 - protein, 9 aa, Homo Sapiens
VTLQQHYRE

SEQ ID NO: 107933 - protein, 9 aa, Homo Sapiens
VSTLCAICG

SEQ ID NO: 107934 - protein, 9 aa, Homo Sapiens
GRGAGMLYP

SEQ ID NO: 107935 - protein, 9 aa, Homo Sapiens
IKHEATRTP

SEQ ID NO: 107936 - protein, 9 aa, Homo Sapiens
RLIDREMIS

SEQ ID NO: 107937 - protein, 9 aa, Homo Sapiens
KMSLAEELN

SEQ ID NO: 107938 - protein, 9 aa, Homo Sapiens
PFWNEEIVS

SEQ ID NO: 107939 - protein, 9 aa, Homo Sapiens
ESEQVRQFR

SEQ ID NO: 107940 - protein, 9 aa, Homo Sapiens
HDHDCGVED

SEQ ID NO: 107941 - protein, 9 aa, Homo Sapiens
PKTDGGSKT

SEQ ID NO: 107942 - protein, 9 aa, Homo Sapiens
AYDAAEFLA

SEQ ID NO: 107943 - protein, 9 aa, Homo Sapiens
QGLKGDIIS

SEQ ID NO: 107944 - protein, 9 aa, Homo Sapiens
PYTSLRRAH

SEQ ID NO: 107945 - protein, 9 aa, Homo Sapiens
RLGVAGEGG

SEQ ID NO: 107946 - protein, 9 aa, Homo Sapiens
KTGLPCTLL

SEQ ID NO: 107947 - protein, 9 aa, Homo Sapiens
LTPEDPTAL

SEQ ID NO: 107948 - protein, 9 aa, Homo Sapiens
MRAALLETL

SEQ ID NO: 107949 - protein, 9 aa, Homo Sapiens
VTLKNAQLG

SEQ ID NO: 107950 - protein, 9 aa, Homo Sapiens
NFQIKHEVL

SEQ ID NO: 107951 - protein, 9 aa, Homo Sapiens
RCLQENLGI

SEQ ID NO: 107952 - protein, 9 aa, Homo Sapiens
EERMRAALL

SEQ ID NO: 107953 - protein, 9 aa, Homo Sapiens
AGMLYPTPA

SEQ ID NO: 107954 - protein, 9 aa, Homo Sapiens
PKQSPAHPE

SEQ ID NO: 107955 - protein, 9 aa, Homo Sapiens
VDPEEKKKI

SEQ ID NO: 107956 - protein, 9 aa, Homo Sapiens
GARKLQEKN

SEQ ID NO: 107957 - protein, 9 aa, Homo Sapiens
EAQGLKGDI

SEQ ID NO: 107958 - protein, 9 aa, Homo Sapiens
RCFGSRSRK

SEQ ID NO: 107959 - protein, 9 aa, Homo Sapiens
VQFLNDQIL

SEQ ID NO: 107960 - protein, 9 aa, Homo Sapiens
YWSQFYSVR

SEQ ID NO: 107961 - protein, 9 aa, Homo Sapiens
TMKVHEDPD

SEQ ID NO: 107962 - protein, 9 aa, Homo Sapiens
KDETHVKMK

SEQ ID NO: 107963 - protein, 9 aa, Homo Sapiens
SDPFLSSSV

SEQ ID NO: 107964 - protein, 9 aa, Homo Sapiens
DTGIITSPK

SEQ ID NO: 107965 - protein, 9 aa, Homo Sapiens
AGGKAGHIH

SEQ ID NO: 107966 - protein, 9 aa, Homo Sapiens
EQASRLEEE

SEQ ID NO: 107967 - protein, 9 aa, Homo Sapiens
GVSTLCAIC

SEQ ID NO: 107968 - protein, 9 aa, Homo Sapiens
YKLIVGRDE

SEQ ID NO: 107969 - protein, 9 aa, Homo Sapiens
GQKPANKWI

SEQ ID NO: 107970 - protein, 9 aa, Homo Sapiens
GEKTYKCNQ

SEQ ID NO: 107971 - protein, 9 aa, Homo Sapiens
LIKHEATRT

SEQ ID NO: 107972 - protein, 9 aa, Homo Sapiens
LETSIYSCK

SEQ ID NO: 107973 - protein, 9 aa, Homo Sapiens
EQVRQFRRL

SEQ ID NO: 107974 - protein, 9 aa, Homo Sapiens
RFFYDFVWR

SEQ ID NO: 107975 - protein, 9 aa, Homo Sapiens
HLSRSVPLT

SEQ ID NO: 107976 - protein, 9 aa, Homo Sapiens
GSKTKKQRS

SEQ ID NO: 107977 - protein, 9 aa, Homo Sapiens
YDDLENDED

SEQ ID NO: 107978 - protein, 9 aa, Homo Sapiens
PYRYIQCDK

SEQ ID NO: 107979 - protein, 9 aa, Homo Sapiens
HGLMKGPLS

SEQ ID NO: 107980 - protein, 9 aa, Homo Sapiens
LVKPRRQPV

SEQ ID NO: 107981 - protein, 9 aa, Homo Sapiens
CGVEDEDFS

SEQ ID NO: 107982 - protein, 9 aa, Homo Sapiens
PDIPEKHLQ

SEQ ID NO: 107983 - protein, 9 aa, Homo Sapiens
FPTLDNSRR

SEQ ID NO: 107984 - protein, 9 aa, Homo Sapiens
QPYIIQLKN

SEQ ID NO: 107985 - protein, 9 aa, Homo Sapiens
RVGDYVYFK

SEQ ID NO: 107986 - protein, 9 aa, Homo Sapiens
GRGRGAGML

SEQ ID NO: 107987 - protein, 9 aa, Homo Sapiens
KHLQDVLKC

SEQ ID NO: 107988 - protein, 9 aa, Homo Sapiens
VQPYIIQLK

SEQ ID NO: 107989 - protein, 9 aa, Homo Sapiens
GRDETNCNL

SEQ ID NO: 107990 - protein, 9 aa, Homo Sapiens
MISHDTRRF

SEQ ID NO: 107991 - protein, 9 aa, Homo Sapiens
RMRAALLET

SEQ ID NO: 107992 - protein, 9 aa, Homo Sapiens
FPDIPEKHL

SEQ ID NO: 107993 - protein, 9 aa, Homo Sapiens
RPGSQSLLL

SEQ ID NO: 107994 - protein, 9 aa, Homo Sapiens
SNIGTLKHA

SEQ ID NO: 107995 - protein, 9 aa, Homo Sapiens
DSQLYGDSS

SEQ ID NO: 107996 - protein, 9 aa, Homo Sapiens
LLWSAGTEA

SEQ ID NO: 107997 - protein, 9 aa, Homo Sapiens
QQQMQHMQQ

SEQ ID NO: 107998 - protein, 9 aa, Homo Sapiens
MAKLVTTHK

SEQ ID NO: 107999 - protein, 9 aa, Homo Sapiens
PAQRQPVST

SEQ ID NO: 108000 - protein, 9 aa, Homo Sapiens
FVWRDWDDE

SEQ ID NO: 108001 - protein, 9 aa, Homo Sapiens
KVFAPNAPD

SEQ ID NO: 108002 - protein, 9 aa, Homo Sapiens
PNYGTVDIT

SEQ ID NO: 108003 - protein, 9 aa, Homo Sapiens
EKILKVAAC

SEQ ID NO: 108004 - protein, 9 aa, Homo Sapiens
ACGWQRNCE

SEQ ID NO: 108005 - protein, 9 aa, Homo Sapiens
PEFHGKWPF

SEQ ID NO: 108006 - protein, 9 aa, Homo Sapiens
CGGYLHADT

SEQ ID NO: 108007 - protein, 9 aa, Homo Sapiens
DKYDDLEND

SEQ ID NO: 108008 - protein, 9 aa, Homo Sapiens
DSVNKLLLL

SEQ ID NO: 108009 - protein, 9 aa, Homo Sapiens
KQIYCVDQT

SEQ ID NO: 108010 - protein, 9 aa, Homo Sapiens
DREMISHDT

SEQ ID NO: 108011 - protein, 9 aa, Homo Sapiens
SWPCLDQNG

SEQ ID NO: 108012 - protein, 9 aa, Homo Sapiens
EKKKILLNL

SEQ ID NO: 108013 - protein, 9 aa, Homo Sapiens
SRSGSDSND

SEQ ID NO: 108014 - protein, 9 aa, Homo Sapiens
LGSTDSVNK

SEQ ID NO: 108015 - protein, 9 aa, Homo Sapiens
EKRVVSGSP

SEQ ID NO: 108016 - protein, 9 aa, Homo Sapiens
YGDSSALLN

SEQ ID NO: 108017 - protein, 9 aa, Homo Sapiens
TDSVNKLLL

SEQ ID NO: 108018 - protein, 9 aa, Homo Sapiens
LQEGHKVPE

SEQ ID NO: 108019 - protein, 9 aa, Homo Sapiens
QRNCEGLGY

SEQ ID NO: 108020 - protein, 9 aa, Homo Sapiens
QQHYREAMI

SEQ ID NO: 108021 - protein, 9 aa, Homo Sapiens
YKCNQCRKT

SEQ ID NO: 108022 - protein, 9 aa, Homo Sapiens
NLLWSAGTE

SEQ ID NO: 108023 - protein, 9 aa, Homo Sapiens
LHADTGIIT

SEQ ID NO: 108024 - protein, 9 aa, Homo Sapiens
CPLPLVGNL

SEQ ID NO: 108025 - protein, 9 aa, Homo Sapiens
HVKMKSEGG

SEQ ID NO: 108026 - protein, 9 aa, Homo Sapiens
EAAGSPFLG

SEQ ID NO: 108027 - protein, 9 aa, Homo Sapiens
DETNCNLSV

SEQ ID NO: 108028 - protein, 9 aa, Homo Sapiens
LGKSGPRGE

SEQ ID NO: 108029 - protein, 9 aa, Homo Sapiens
GLESWPCLD

SEQ ID NO: 108030 - protein, 9 aa, Homo Sapiens
PNTKAEMKM

SEQ ID NO: 108031 - protein, 9 aa, Homo Sapiens
NTTGQHCEL

SEQ ID NO: 108032 - protein, 9 aa, Homo Sapiens
KVPEFHGKW

SEQ ID NO: 108033 - protein, 9 aa, Homo Sapiens
QRQPVSTCT

SEQ ID NO: 108034 - protein, 9 aa, Homo Sapiens
YLPKVFAPN

SEQ ID NO: 108035 - protein, 9 aa, Homo Sapiens
VGRDETNCN

SEQ ID NO: 108036 - protein, 9 aa, Homo Sapiens
PYIIQLKNE

SEQ ID NO: 108037 - protein, 9 aa, Homo Sapiens
AGTEAGTMV

SEQ ID NO: 108038 - protein, 9 aa, Homo Sapiens
KNKTKPECP

SEQ ID NO: 108039 - protein, 9 aa, Homo Sapiens
LTVGEQCEE

SEQ ID NO: 108040 - protein, 9 aa, Homo Sapiens
SEKGFYETS

SEQ ID NO: 108041 - protein, 9 aa, Homo Sapiens
RLGMDTVPV

SEQ ID NO: 108042 - protein, 9 aa, Homo Sapiens
LNLVQNFQI

SEQ ID NO: 108043 - protein, 9 aa, Homo Sapiens
QIFNIHTDR

SEQ ID NO: 108044 - protein, 9 aa, Homo Sapiens
FVQPYIIQL

SEQ ID NO: 108045 - protein, 9 aa, Homo Sapiens
DDDMGEDKD

SEQ ID NO: 108046 - protein, 9 aa, Homo Sapiens
CHKFHVCIQ

SEQ ID NO: 108047 - protein, 9 aa, Homo Sapiens
ESVTLQQHY

SEQ ID NO: 108048 - protein, 9 aa, Homo Sapiens
WDLRDIHFV

SEQ ID NO: 108049 - protein, 9 aa, Homo Sapiens
DSATRPGSQ

SEQ ID NO: 108050 - protein, 9 aa, Homo Sapiens
GASINYDDY

SEQ ID NO: 108051 - protein, 9 aa, Homo Sapiens
EKTYKCNQC

SEQ ID NO: 108052 - protein, 9 aa, Homo Sapiens
SARDCHEFA

SEQ ID NO: 108053 - protein, 9 aa, Homo Sapiens
MARSPVHDT

SEQ ID NO: 108054 - protein, 9 aa, Homo Sapiens
TGIITSPKY

SEQ ID NO: 108055 - protein, 9 aa, Homo Sapiens
ARWPPGPCP

SEQ ID NO: 108056 - protein, 9 aa, Homo Sapiens
QVFVQPYII

SEQ ID NO: 108057 - protein, 9 aa, Homo Sapiens
QGGLESWPC

SEQ ID NO: 108058 - protein, 9 aa, Homo Sapiens
KQMHLSRSV

SEQ ID NO: 108059 - protein, 9 aa, Homo Sapiens
KQSPAHPEA

SEQ ID NO: 108060 - protein, 9 aa, Homo Sapiens
SIYSCKTSL

SEQ ID NO: 108061 - protein, 9 aa, Homo Sapiens
LCTGPSNTE

SEQ ID NO: 108062 - protein, 9 aa, Homo Sapiens
KKILLNLSC

SEQ ID NO: 108063 - protein, 9 aa, Homo Sapiens
SGSPDATLR

SEQ ID NO: 108064 - protein, 9 aa, Homo Sapiens
VKPRRQPVS

SEQ ID NO: 108065 - protein, 9 aa, Homo Sapiens
ALSPPPLLL

SEQ ID NO: 108066 - protein, 9 aa, Homo Sapiens
KDEDDGFFV

SEQ ID NO: 108067 - protein, 9 aa, Homo Sapiens
THGLMKGPL

SEQ ID NO: 108068 - protein, 9 aa, Homo Sapiens
KPANKWIRH

SEQ ID NO: 108069 - protein, 9 aa, Homo Sapiens
SPDATLRVW

SEQ ID NO: 108070 - protein, 9 aa, Homo Sapiens
SQIKEGKRV

SEQ ID NO: 108071 - protein, 9 aa, Homo Sapiens
GSDFPTLDN

SEQ ID NO: 108072 - protein, 9 aa, Homo Sapiens
EKDNVIQNL

SEQ ID NO: 108073 - protein, 9 aa, Homo Sapiens
LKTGLPCTL

SEQ ID NO: 108074 - protein, 9 aa, Homo Sapiens
ETPSAAPQL

SEQ ID NO: 108075 - protein, 9 aa, Homo Sapiens
LPCTLLAHI

SEQ ID NO: 108076 - protein, 9 aa, Homo Sapiens
VCIQWRRSD

SEQ ID NO: 108077 - protein, 9 aa, Homo Sapiens
RVVSGSPDA

SEQ ID NO: 108078 - protein, 9 aa, Homo Sapiens
GSEAQGLKG

SEQ ID NO: 108079 - protein, 9 aa, Homo Sapiens
AGEGGRRCR

SEQ ID NO: 108080 - protein, 9 aa, Homo Sapiens
ILIAYKWKR

SEQ ID NO: 108081 - protein, 9 aa, Homo Sapiens
LNQPRLGMD

SEQ ID NO: 108082 - protein, 9 aa, Homo Sapiens
ARDCHEFAN

SEQ ID NO: 108083 - protein, 9 aa, Homo Sapiens
SWLRKQIYC

SEQ ID NO: 108084 - protein, 9 aa, Homo Sapiens
NITAPCSPH

SEQ ID NO: 108085 - protein, 9 aa, Homo Sapiens
CHEFANILH

SEQ ID NO: 108086 - protein, 9 aa, Homo Sapiens
ANLLWSAGT

SEQ ID NO: 108087 - protein, 9 aa, Homo Sapiens
HTDRACAVE

SEQ ID NO: 108088 - protein, 9 aa, Homo Sapiens
TGQHCELCR

SEQ ID NO: 108089 - protein, 9 aa, Homo Sapiens
IAYKWKRQK

SEQ ID NO: 108090 - protein, 9 aa, Homo Sapiens
ALEARVLEQ

SEQ ID NO: 108091 - protein, 9 aa, Homo Sapiens
SGKVTLKNA

SEQ ID NO: 108092 - protein, 9 aa, Homo Sapiens
DMGEDKDED

SEQ ID NO: 108093 - protein, 9 aa, Homo Sapiens
QTDNNKSIR

SEQ ID NO: 108094 - protein, 9 aa, Homo Sapiens
FNIHTDRAC

SEQ ID NO: 108095 - protein, 9 aa, Homo Sapiens
DEQKGSEAQ

SEQ ID NO: 108096 - protein, 9 aa, Homo Sapiens
KESCVSIPE

SEQ ID NO: 108097 - protein, 9 aa, Homo Sapiens
PKKKKKKKN

SEQ ID NO: 108098 - protein, 9 aa, Homo Sapiens
NIHTDRACA

SEQ ID NO: 108099 - protein, 9 aa, Homo Sapiens
ELRRRLSLP

SEQ ID NO: 108100 - protein, 9 aa, Homo Sapiens
PEDPTALGF

SEQ ID NO: 108101 - protein, 9 aa, Homo Sapiens
SKEESHIVV

SEQ ID NO: 108102 - protein, 9 aa, Homo Sapiens
GEDKDEDDG

SEQ ID NO: 108103 - protein, 9 aa, Homo Sapiens
DETPSAAPQ

SEQ ID NO: 108104 - protein, 9 aa, Homo Sapiens
PRLGMDTVP

SEQ ID NO: 108105 - protein, 9 aa, Homo Sapiens
EGGRRCRAC

SEQ ID NO: 108106 - protein, 9 aa, Homo Sapiens
GFYETSKHE

SEQ ID NO: 108107 - protein, 9 aa, Homo Sapiens
IKHEVLCRW

SEQ ID NO: 108108 - protein, 9 aa, Homo Sapiens
HPNYGTVDI

SEQ ID NO: 108109 - protein, 9 aa, Homo Sapiens
IGTLKHAHE

SEQ ID NO: 108110 - protein, 9 aa, Homo Sapiens
LESWPCLDQ

SEQ ID NO: 108111 - protein, 9 aa, Homo Sapiens
NKWIRHSFR

SEQ ID NO: 108112 - protein, 9 aa, Homo Sapiens
PGSQSLLLT

SEQ ID NO: 108113 - protein, 9 aa, Homo Sapiens
KSEGGAEDS

SEQ ID NO: 108114 - protein, 9 aa, Homo Sapiens
TLNDSVTIM

SEQ ID NO: 108115 - protein, 9 aa, Homo Sapiens
TSGVEFLGP

SEQ ID NO: 108116 - protein, 9 aa, Homo Sapiens
DGFMSCKDL

SEQ ID NO: 108117 - protein, 9 aa, Homo Sapiens
EKHLQDVLK

SEQ ID NO: 108118 - protein, 9 aa, Homo Sapiens
HADTGIITS

SEQ ID NO: 108119 - protein, 9 aa, Homo Sapiens
TVDITTGIE

SEQ ID NO: 108120 - protein, 9 aa, Homo Sapiens
LLNQPRLGM

SEQ ID NO: 108121 - protein, 9 aa, Homo Sapiens
VHEDPDLGL

SEQ ID NO: 108122 - protein, 9 aa, Homo Sapiens
DQILVQNYK

SEQ ID NO: 108123 - protein, 9 aa, Homo Sapiens
EESHIVVKE

SEQ ID NO: 108124 - protein, 9 aa, Homo Sapiens
YCVDQTRRN

SEQ ID NO: 108125 - protein, 9 aa, Homo Sapiens
EGHKVPEFH

SEQ ID NO: 108126 - protein, 9 aa, Homo Sapiens
HLQDVLKCC

SEQ ID NO: 108127 - protein, 9 aa, Homo Sapiens
KMKSEGGAE

SEQ ID NO: 108128 - protein, 9 aa, Homo Sapiens
SIRCFGSRS

SEQ ID NO: 108129 - protein, 9 aa, Homo Sapiens
PPLAQRRFQ

SEQ ID NO: 108130 - protein, 9 aa, Homo Sapiens
FLNDQILVQ

SEQ ID NO: 108131 - protein, 9 aa, Homo Sapiens
ITAPCSPHI

SEQ ID NO: 108132 - protein, 9 aa, Homo Sapiens
GINPREPAV

SEQ ID NO: 108133 - protein, 9 aa, Homo Sapiens
LRKQIYCVD

SEQ ID NO: 108134 - protein, 9 aa, Homo Sapiens
CLEGNFSEK

SEQ ID NO: 108135 - protein, 9 aa, Homo Sapiens
IQVMAKSID

SEQ ID NO: 108136 - protein, 9 aa, Homo Sapiens
IHTDRACAV

SEQ ID NO: 108137 - protein, 9 aa, Homo Sapiens
QRRFQAPEP

SEQ ID NO: 108138 - protein, 9 aa, Homo Sapiens
ITTGIEADE

SEQ ID NO: 108139 - protein, 9 aa, Homo Sapiens
KPRRQPVSE

SEQ ID NO: 108140 - protein, 9 aa, Homo Sapiens
NDEDDDEEG

SEQ ID NO: 108141 - protein, 9 aa, Homo Sapiens
EFANILHLS

SEQ ID NO: 108142 - protein, 9 aa, Homo Sapiens
GLLGKSGPR

SEQ ID NO: 108143 - protein, 9 aa, Homo Sapiens
KFAKLEERM

SEQ ID NO: 108144 - protein, 9 aa, Homo Sapiens
ESSDPFLSS

SEQ ID NO: 108145 - protein, 9 aa, Homo Sapiens
LIVGRDETN

SEQ ID NO: 108146 - protein, 9 aa, Homo Sapiens
VNQNTGRGG

SEQ ID NO: 108147 - protein, 9 aa, Homo Sapiens
SLALKYLPK

SEQ ID NO: 108148 - protein, 9 aa, Homo Sapiens
LENDEDDDE

SEQ ID NO: 108149 - protein, 9 aa, Homo Sapiens
KCNQCRKTF

SEQ ID NO: 108150 - protein, 9 aa, Homo Sapiens
NKGLIHSQS

SEQ ID NO: 108151 - protein, 9 aa, Homo Sapiens
APPLAQRRF

SEQ ID NO: 108152 - protein, 9 aa, Homo Sapiens
AYKWKRQKQ

SEQ ID NO: 108153 - protein, 9 aa, Homo Sapiens
TARLWDKAD

SEQ ID NO: 108154 - protein, 9 aa, Homo Sapiens
LIQEKDNVI

SEQ ID NO: 108155 - protein, 9 aa, Homo Sapiens
KLLDCNYPD

SEQ ID NO: 108156 - protein, 9 aa, Homo Sapiens
RHGASINYD

SEQ ID NO: 108157 - protein, 9 aa, Homo Sapiens
PLALSPPPL

SEQ ID NO: 108158 - protein, 9 aa, Homo Sapiens
LRLIDREMI

SEQ ID NO: 108159 - protein, 9 aa, Homo Sapiens
QILVQNYKQ

SEQ ID NO: 108160 - protein, 9 aa, Homo Sapiens
TTHGLMKGP

SEQ ID NO: 108161 - protein, 9 aa, Homo Sapiens
CFSYTFHGD

SEQ ID NO: 108162 - protein, 9 aa, Homo Sapiens
PNSLGVSTL

SEQ ID NO: 108163 - protein, 9 aa, Homo Sapiens
VGEQCEELV

SEQ ID NO: 108164 - protein, 9 aa, Homo Sapiens
KAGHIHITK

SEQ ID NO: 108165 - protein, 9 aa, Homo Sapiens
QPRLGMDTV

SEQ ID NO: 108166 - protein, 9 aa, Homo Sapiens
KKKKKNKTK

SEQ ID NO: 108167 - protein, 9 aa, Homo Sapiens
GEQCEELVT

SEQ ID NO: 108168 - protein, 9 aa, Homo Sapiens
PKVFAPNAP

SEQ ID NO: 108169 - protein, 9 aa, Homo Sapiens
ILVQNYKQV

SEQ ID NO: 108170 - protein, 9 aa, Homo Sapiens
PKVKVTSLA

SEQ ID NO: 108171 - protein, 9 aa, Homo Sapiens
TEGLYLVSG

SEQ ID NO: 108172 - protein, 9 aa, Homo Sapiens
ESITSGVEF

SEQ ID NO: 108173 - protein, 9 aa, Homo Sapiens
KGARGLLGK

SEQ ID NO: 108174 - protein, 9 aa, Homo Sapiens
QCRKTFSRR

SEQ ID NO: 108175 - protein, 9 aa, Homo Sapiens
MEAGGKAGH

SEQ ID NO: 108176 - protein, 9 aa, Homo Sapiens
RLWDKADQL

SEQ ID NO: 108177 - protein, 9 aa, Homo Sapiens
QDEAYDAAE

SEQ ID NO: 108178 - protein, 9 aa, Homo Sapiens
GPRASEARA

SEQ ID NO: 108179 - protein, 9 aa, Homo Sapiens
LEQASRLEE

SEQ ID NO: 108180 - protein, 9 aa, Homo Sapiens
SSTPSNPVT

SEQ ID NO: 108181 - protein, 9 aa, Homo Sapiens
WPCLDQNGH

SEQ ID NO: 108182 - protein, 9 aa, Homo Sapiens
DETHVKMKS

SEQ ID NO: 108183 - protein, 9 aa, Homo Sapiens
KLQEKNGEV

SEQ ID NO: 108184 - protein, 9 aa, Homo Sapiens
DLENDEDDD

SEQ ID NO: 108185 - protein, 9 aa, Homo Sapiens
RQSSKATTS

SEQ ID NO: 108186 - protein, 9 aa, Homo Sapiens
LEERMRAAL

SEQ ID NO: 108187 - protein, 9 aa, Homo Sapiens
RRRVAVVNL

SEQ ID NO: 108188 - protein, 9 aa, Homo Sapiens
YIIQLKNET

SEQ ID NO: 108189 - protein, 9 aa, Homo Sapiens
FSSSEKGFY

SEQ ID NO: 108190 - protein, 9 aa, Homo Sapiens
LLNLSCQSC

SEQ ID NO: 108191 - protein, 9 aa, Homo Sapiens
LVSGNKTDQ

SEQ ID NO: 108192 - protein, 9 aa, Homo Sapiens
SPVHDTVFY

SEQ ID NO: 108193 - protein, 9 aa, Homo Sapiens
RGLLGKSGP

SEQ ID NO: 108194 - protein, 9 aa, Homo Sapiens
NLSCQSCTF

SEQ ID NO: 108195 - protein, 9 aa, Homo Sapiens
YTRKTARLW

SEQ ID NO: 108196 - protein, 9 aa, Homo Sapiens
LNDSVTIMI

SEQ ID NO: 108197 - protein, 9 aa, Homo Sapiens
AQKLGSTTV

SEQ ID NO: 108198 - protein, 9 aa, Homo Sapiens
YFRNWHGIN

SEQ ID NO: 108199 - protein, 9 aa, Homo Sapiens
EQAMKLLDC

SEQ ID NO: 108200 - protein, 9 aa, Homo Sapiens
SPFLGGPVS

SEQ ID NO: 108201 - protein, 9 aa, Homo Sapiens
KPEQAMKLL

SEQ ID NO: 108202 - protein, 9 aa, Homo Sapiens
FRCLQENLG

SEQ ID NO: 108203 - protein, 9 aa, Homo Sapiens
AEWDLRDIH

SEQ ID NO: 108204 - protein, 9 aa, Homo Sapiens
LRALRRRVA

SEQ ID NO: 108205 - protein, 9 aa, Homo Sapiens
CTLLAHIWS

SEQ ID NO: 108206 - protein, 9 aa, Homo Sapiens
TDYGDQLPK

SEQ ID NO: 108207 - protein, 9 aa, Homo Sapiens
LPKVFAPNA

SEQ ID NO: 108208 - protein, 9 aa, Homo Sapiens
TRKTARLWD

SEQ ID NO: 108209 - protein, 9 aa, Homo Sapiens
QRSLCSTPL

SEQ ID NO: 108210 - protein, 9 aa, Homo Sapiens
GGKAGHIHI

SEQ ID NO: 108211 - protein, 9 aa, Homo Sapiens
RYIQCDKAL

SEQ ID NO: 108212 - protein, 9 aa, Homo Sapiens
RDETNCNLS

SEQ ID NO: 108213 - protein, 9 aa, Homo Sapiens
CMKDLSHPN

SEQ ID NO: 108214 - protein, 9 aa, Homo Sapiens
CFSKESCVS

SEQ ID NO: 108215 - protein, 9 aa, Homo Sapiens
LEREQLCTG

SEQ ID NO: 108216 - protein, 9 aa, Homo Sapiens
FESSDPFLS

SEQ ID NO: 108217 - protein, 9 aa, Homo Sapiens
VSGSPDATL

SEQ ID NO: 108218 - protein, 9 aa, Homo Sapiens
HGINPREPA

SEQ ID NO: 108219 - protein, 9 aa, Homo Sapiens
LALSPPPLL

SEQ ID NO: 108220 - protein, 9 aa, Homo Sapiens
EEIVSQIKE

SEQ ID NO: 108221 - protein, 9 aa, Homo Sapiens
YTTHGLMKG

SEQ ID NO: 108222 - protein, 9 aa, Homo Sapiens
HAHEFKEDR

SEQ ID NO: 108223 - protein, 9 aa, Homo Sapiens
GFRHGASIN

SEQ ID NO: 108224 - protein, 9 aa, Homo Sapiens
SLIQEKDNV

SEQ ID NO: 108225 - protein, 9 aa, Homo Sapiens
DITTGIEAD

SEQ ID NO: 108226 - protein, 9 aa, Homo Sapiens
SEQVRQFRR

SEQ ID NO: 108227 - protein, 9 aa, Homo Sapiens
KLKEEIQVM

SEQ ID NO: 108228 - protein, 9 aa, Homo Sapiens
AKLVTTHKC

SEQ ID NO: 108229 - protein, 9 aa, Homo Sapiens
STMKVHEDP

SEQ ID NO: 108230 - protein, 9 aa, Homo Sapiens
MPIHDHDCG

SEQ ID NO: 108231 - protein, 9 aa, Homo Sapiens
FIGVDLIKH

SEQ ID NO: 108232 - protein, 9 aa, Homo Sapiens
PAGAPKQSP

SEQ ID NO: 108233 - protein, 9 aa, Homo Sapiens
LKEEIQVMA

SEQ ID NO: 108234 - protein, 9 aa, Homo Sapiens
ILLNLSCQS

SEQ ID NO: 108235 - protein, 9 aa, Homo Sapiens
DKDEDDGFF

SEQ ID NO: 108236 - protein, 9 aa, Homo Sapiens
GNFSEKILK

SEQ ID NO: 108237 - protein, 9 aa, Homo Sapiens
GMLYPTPAM

SEQ ID NO: 108238 - protein, 9 aa, Homo Sapiens
NYGTVDITT

SEQ ID NO: 108239 - protein, 9 aa, Homo Sapiens
PGPRASEAR

SEQ ID NO: 108240 - protein, 9 aa, Homo Sapiens
IYSCKTSLQ

SEQ ID NO: 108241 - protein, 9 aa, Homo Sapiens
LGVSTLCAI

SEQ ID NO: 108242 - protein, 9 aa, Homo Sapiens
LPKVKVTSL

SEQ ID NO: 108243 - protein, 9 aa, Homo Sapiens
DLIKHEATR

SEQ ID NO: 108244 - protein, 9 aa, Homo Sapiens
KLSALQRSL

SEQ ID NO: 108245 - protein, 9 aa, Homo Sapiens
ESDETPSAA

SEQ ID NO: 108246 - protein, 9 aa, Homo Sapiens
LRRRVAVVN

SEQ ID NO: 108247 - protein, 9 aa, Homo Sapiens
RVFNKTPIN

SEQ ID NO: 108248 - protein, 9 aa, Homo Sapiens
QIKHEVLCR

SEQ ID NO: 108249 - protein, 9 aa, Homo Sapiens
TVGEQCEEL

SEQ ID NO: 108250 - protein, 9 aa, Homo Sapiens
PSDRKHIGS

SEQ ID NO: 108251 - protein, 9 aa, Homo Sapiens
LQEARVFNK

SEQ ID NO: 108252 - protein, 9 aa, Homo Sapiens
NFSEKILKV

SEQ ID NO: 108253 - protein, 9 aa, Homo Sapiens
LCTEGLYLV

SEQ ID NO: 108254 - protein, 9 aa, Homo Sapiens
QLPKVKVTS

SEQ ID NO: 108255 - protein, 9 aa, Homo Sapiens
GPYHFRASS

SEQ ID NO: 108256 - protein, 9 aa, Homo Sapiens
SPGPRASEA

SEQ ID NO: 108257 - protein, 9 aa, Homo Sapiens
LQLTDFSPL

SEQ ID NO: 108258 - protein, 9 aa, Homo Sapiens
YAAPPLAQR

SEQ ID NO: 108259 - protein, 9 aa, Homo Sapiens
VRFFYDFVW

SEQ ID NO: 108260 - protein, 9 aa, Homo Sapiens
NIGTLKHAH

SEQ ID NO: 108261 - protein, 9 aa, Homo Sapiens
SGVEFLGPL

SEQ ID NO: 108262 - protein, 9 aa, Homo Sapiens
EIVSQIKEG

SEQ ID NO: 108263 - protein, 9 aa, Homo Sapiens
GHIHITKAT

SEQ ID NO: 108264 - protein, 9 aa, Homo Sapiens
LVQNFQIKH

SEQ ID NO: 108265 - protein, 9 aa, Homo Sapiens
LWSAGTEAG

SEQ ID NO: 108266 - protein, 9 aa, Homo Sapiens
KTYKCNQCR

SEQ ID NO: 108267 - protein, 9 aa, Homo Sapiens
FWNEEIVSQ

SEQ ID NO: 108268 - protein, 9 aa, Homo Sapiens
GSQSLLLTV

SEQ ID NO: 108269 - protein, 9 aa, Homo Sapiens
EGQKPANKW

SEQ ID NO: 108270 - protein, 9 aa, Homo Sapiens
GLGSTDSVN

SEQ ID NO: 108271 - protein, 9 aa, Homo Sapiens
EESTMKVHE

SEQ ID NO: 108272 - protein, 9 aa, Homo Sapiens
YIQCDKALN

SEQ ID NO: 108273 - protein, 9 aa, Homo Sapiens
DRQSSKATT

SEQ ID NO: 108274 - protein, 9 aa, Homo Sapiens
MKLLDCNYP

SEQ ID NO: 108275 - protein, 9 aa, Homo Sapiens
PHGLGSTDS

SEQ ID NO: 108276 - protein, 9 aa, Homo Sapiens
SDIEGARKL

SEQ ID NO: 108277 - protein, 9 aa, Homo Sapiens
ESHIVVKEK

SEQ ID NO: 108278 - protein, 9 aa, Homo Sapiens
VYFKNSSSN

SEQ ID NO: 108279 - protein, 9 aa, Homo Sapiens
SPPAQRQPV

SEQ ID NO: 108280 - protein, 9 aa, Homo Sapiens
HFRASSRIF

SEQ ID NO: 108281 - protein, 9 aa, Homo Sapiens
DVAQKLGST

SEQ ID NO: 108282 - protein, 9 aa, Homo Sapiens
FLSSSVSSK

SEQ ID NO: 108283 - protein, 9 aa, Homo Sapiens
KDKKQLKKE

SEQ ID NO: 108284 - protein, 9 aa, Homo Sapiens
KVHEDPDLG

SEQ ID NO: 108285 - protein, 9 aa, Homo Sapiens
LQMAKLVTT

SEQ ID NO: 108286 - protein, 9 aa, Homo Sapiens
ESGKVTLKN

SEQ ID NO: 108287 - protein, 9 aa, Homo Sapiens
PLLTPEDPT

SEQ ID NO: 108288 - protein, 9 aa, Homo Sapiens
DRLGVAGEG

SEQ ID NO: 108289 - protein, 9 aa, Homo Sapiens
ATRPGSQSL

SEQ ID NO: 108290 - protein, 9 aa, Homo Sapiens
DFVWRDWDD

SEQ ID NO: 108291 - protein, 9 aa, Homo Sapiens
RGAGMLYPT

SEQ ID NO: 108292 - protein, 9 aa, Homo Sapiens
RDCHEFANI

SEQ ID NO: 108293 - protein, 9 aa, Homo Sapiens
LMKGPLSKV

SEQ ID NO: 108294 - protein, 9 aa, Homo Sapiens
GKGSPSDRK

SEQ ID NO: 108295 - protein, 9 aa, Homo Sapiens
EAYDAAEFL

SEQ ID NO: 108296 - protein, 9 aa, Homo Sapiens
CSHQGCGLE

SEQ ID NO: 108297 - protein, 9 aa, Homo Sapiens
SSRIFWRTV

SEQ ID NO: 108298 - protein, 9 aa, Homo Sapiens
TLKNAQLGE

SEQ ID NO: 108299 - protein, 9 aa, Homo Sapiens
KLEERMRAA

SEQ ID NO: 108300 - protein, 9 aa, Homo Sapiens
MQHMQQQQL

SEQ ID NO: 108301 - protein, 9 aa, Homo Sapiens
PRASEARAQ

SEQ ID NO: 108302 - protein, 9 aa, Homo Sapiens
DRDGFMSCK

SEQ ID NO: 108303 - protein, 9 aa, Homo Sapiens
NPVTKDPPA

SEQ ID NO: 108304 - protein, 9 aa, Homo Sapiens
DKDRDGFMS

SEQ ID NO: 108305 - protein, 9 aa, Homo Sapiens
LNDQILVQN

SEQ ID NO: 108306 - protein, 9 aa, Homo Sapiens
SLKQMHLSR

SEQ ID NO: 108307 - protein, 9 aa, Homo Sapiens
ASNITAPCS

SEQ ID NO: 108308 - protein, 9 aa, Homo Sapiens
KDNVIQNLE

SEQ ID NO: 108309 - protein, 9 aa, Homo Sapiens
WDKDVAQKL

SEQ ID NO: 108310 - protein, 9 aa, Homo Sapiens
LIHSQSSSF

SEQ ID NO: 108311 - protein, 9 aa, Homo Sapiens
SLLVLAAFL

SEQ ID NO: 108312 - protein, 9 aa, Homo Sapiens
FAKLEERMR

SEQ ID NO: 108313 - protein, 9 aa, Homo Sapiens
SDRKHIGSI

SEQ ID NO: 108314 - protein, 9 aa, Homo Sapiens
KVKVTSLAP

SEQ ID NO: 108315 - protein, 9 aa, Homo Sapiens
PIKPEQAMK

SEQ ID NO: 108316 - protein, 9 aa, Homo Sapiens
KNSSSNPYL

SEQ ID NO: 108317 - protein, 9 aa, Homo Sapiens
SSSHSGSDF

SEQ ID NO: 108318 - protein, 9 aa, Homo Sapiens
ESESDETPS

SEQ ID NO: 108319 - protein, 9 aa, Homo Sapiens
RSLKQMHLS

SEQ ID NO: 108320 - protein, 9 aa, Homo Sapiens
GSPFLGGPV

SEQ ID NO: 108321 - protein, 9 aa, Homo Sapiens
LSSSVSSKG

SEQ ID NO: 108322 - protein, 9 aa, Homo Sapiens
CLQENLGID

SEQ ID NO: 108323 - protein, 9 aa, Homo Sapiens
QLYGDSSAL

SEQ ID NO: 108324 - protein, 9 aa, Homo Sapiens
QQMQHMQQQ

SEQ ID NO: 108325 - protein, 9 aa, Homo Sapiens
KGKGSPSDR

SEQ ID NO: 108326 - protein, 9 aa, Homo Sapiens
SDSNDDDSH

SEQ ID NO: 108327 - protein, 9 aa, Homo Sapiens
GSDSNDDDS

SEQ ID NO: 108328 - protein, 9 aa, Homo Sapiens
LYLVSGNKT

SEQ ID NO: 108329 - protein, 9 aa, Homo Sapiens
NNKSIRCFG

SEQ ID NO: 108330 - protein, 9 aa, Homo Sapiens
QKGSEAQGL

SEQ ID NO: 108331 - protein, 9 aa, Homo Sapiens
NKKHLVAFY

SEQ ID NO: 108332 - protein, 9 aa, Homo Sapiens
SESDETPSA

SEQ ID NO: 108333 - protein, 9 aa, Homo Sapiens
LETSVNQNT

SEQ ID NO: 108334 - protein, 9 aa, Homo Sapiens
YVYFKNSSS

SEQ ID NO: 108335 - protein, 9 aa, Homo Sapiens
YGTVDITTG

SEQ ID NO: 108336 - protein, 9 aa, Homo Sapiens
LKYLPKVFA

SEQ ID NO: 108337 - protein, 9 aa, Homo Sapiens
DDDDMGEDK

SEQ ID NO: 108338 - protein, 9 aa, Homo Sapiens
RASEARAQL

SEQ ID NO: 108339 - protein, 9 aa, Homo Sapiens
AQGLKGDII

SEQ ID NO: 108340 - protein, 9 aa, Homo Sapiens
WPPGPCPLP

SEQ ID NO: 108341 - protein, 9 aa, Homo Sapiens
RKTARLWDK

SEQ ID NO: 108342 - protein, 9 aa, Homo Sapiens
DHDCGVEDE

SEQ ID NO: 108343 - protein, 9 aa, Homo Sapiens
LKKENKRLR

SEQ ID NO: 108344 - protein, 9 aa, Homo Sapiens
GLPCTLLAH

SEQ ID NO: 108345 - protein, 9 aa, Homo Sapiens
GGSKTKKQR

SEQ ID NO: 108346 - protein, 9 aa, Homo Sapiens
GKGKGSPSD

SEQ ID NO: 108347 - protein, 9 aa, Homo Sapiens
EMISHDTRR

SEQ ID NO: 108348 - protein, 9 aa, Homo Sapiens
LKQMHLSRS

SEQ ID NO: 108349 - protein, 9 aa, Homo Sapiens
YGFRHGASI

SEQ ID NO: 108350 - protein, 9 aa, Homo Sapiens
ATLNDSVTI

SEQ ID NO: 108351 - protein, 9 aa, Homo Sapiens
DQLPKVKVT

SEQ ID NO: 108352 - protein, 9 aa, Homo Sapiens
FYSVRPQGP

SEQ ID NO: 108353 - protein, 9 aa, Homo Sapiens
ESLIQEKDN

SEQ ID NO: 108354 - protein, 9 aa, Homo Sapiens
PPAQRQPVS

SEQ ID NO: 108355 - protein, 9 aa, Homo Sapiens
LYPTPAMQG

SEQ ID NO: 108356 - protein, 9 aa, Homo Sapiens
PVSTCTASA

SEQ ID NO: 108357 - protein, 9 aa, Homo Sapiens
VQLQMAKLV

SEQ ID NO: 108358 - protein, 9 aa, Homo Sapiens
MKVHEDPDL

SEQ ID NO: 108359 - protein, 9 aa, Homo Sapiens
RQPVSTCTA

SEQ ID NO: 108360 - protein, 9 aa, Homo Sapiens
LSRSVPLTQ

SEQ ID NO: 108361 - protein, 9 aa, Homo Sapiens
QQQQQQMQH

SEQ ID NO: 108362 - protein, 9 aa, Homo Sapiens
KVTLKNAQL

SEQ ID NO: 108363 - protein, 9 aa, Homo Sapiens
RDGFMSCKD

SEQ ID NO: 108364 - protein, 9 aa, Homo Sapiens
PYAAPPLAQ

SEQ ID NO: 108365 - protein, 9 aa, Homo Sapiens
RRLETSIYS

SEQ ID NO: 108366 - protein, 9 aa, Homo Sapiens
QNTGRGGFH

SEQ ID NO: 108367 - protein, 9 aa, Homo Sapiens
KGFYETSKH

SEQ ID NO: 108368 - protein, 9 aa, Homo Sapiens
KKQLKKENK

SEQ ID NO: 108369 - protein, 9 aa, Homo Sapiens
FSSSTPSNP

SEQ ID NO: 108370 - protein, 9 aa, Homo Sapiens
PDATLRVWD

SEQ ID NO: 108371 - protein, 9 aa, Homo Sapiens
CSPHIYQVY

SEQ ID NO: 108372 - protein, 9 aa, Homo Sapiens
QEARVFNKT

SEQ ID NO: 108373 - protein, 9 aa, Homo Sapiens
EWDLRDIHF

SEQ ID NO: 108374 - protein, 9 aa, Homo Sapiens
DLRDIHFVE

SEQ ID NO: 108375 - protein, 9 aa, Homo Sapiens
IDREMISHD

SEQ ID NO: 108376 - protein, 9 aa, Homo Sapiens
PGPRAGRER

SEQ ID NO: 108377 - protein, 9 aa, Homo Sapiens
LKNAQLGEA

SEQ ID NO: 108378 - protein, 9 aa, Homo Sapiens
FMSCKDLGN

SEQ ID NO: 108379 - protein, 9 aa, Homo Sapiens
QESGKVTLK

SEQ ID NO: 108380 - protein, 9 aa, Homo Sapiens
AARWPPGPC

SEQ ID NO: 108381 - protein, 9 aa, Homo Sapiens
ERMRAALLE

SEQ ID NO: 108382 - protein, 9 aa, Homo Sapiens
ELEMINKKH

SEQ ID NO: 108383 - protein, 9 aa, Homo Sapiens
QCDKALNHG

SEQ ID NO: 108384 - protein, 9 aa, Homo Sapiens
QMAKLVTTH

SEQ ID NO: 108385 - protein, 9 aa, Homo Sapiens
AGAPKQSPA

SEQ ID NO: 108386 - protein, 9 aa, Homo Sapiens
GAGMLYPTP

SEQ ID NO: 108387 - protein, 9 aa, Homo Sapiens
LEEGQKPAN

SEQ ID NO: 108388 - protein, 9 aa, Homo Sapiens
STDSVNKLL

SEQ ID NO: 108389 - protein, 9 aa, Homo Sapiens
YRYIQCDKA

SEQ ID NO: 108390 - protein, 9 aa, Homo Sapiens
CGWQRNCEG

SEQ ID NO: 108391 - protein, 9 aa, Homo Sapiens
QCEELVTRE

SEQ ID NO: 108392 - protein, 9 aa, Homo Sapiens
HQGCGLENC

SEQ ID NO: 108393 - protein, 9 aa, Homo Sapiens
VDITTGIEA

SEQ ID NO: 108394 - protein, 9 aa, Homo Sapiens
EQCEELVTR

SEQ ID NO: 108395 - protein, 9 aa, Homo Sapiens
SEFLRALRR

SEQ ID NO: 108396 - protein, 9 aa, Homo Sapiens
SRDDSQLYG

SEQ ID NO: 108397 - protein, 9 aa, Homo Sapiens
KFHVCIQWR

SEQ ID NO: 108398 - protein, 9 aa, Homo Sapiens
KHAHEFKED

SEQ ID NO: 108399 - protein, 9 aa, Homo Sapiens
SITSGVEFL

SEQ ID NO: 108400 - protein, 9 aa, Homo Sapiens
SEAACMKDL

SEQ ID NO: 108401 - protein, 9 aa, Homo Sapiens
AVKCFSKES

SEQ ID NO: 108402 - protein, 9 aa, Homo Sapiens
RVQLQMAKL

SEQ ID NO: 108403 - protein, 9 aa, Homo Sapiens
QSPAHPEAD

SEQ ID NO: 108404 - protein, 9 aa, Homo Sapiens
EFLRALRRR

SEQ ID NO: 108405 - protein, 9 aa, Homo Sapiens
GLCTEGLYL

SEQ ID NO: 108406 - protein, 9 aa, Homo Sapiens
QEKDNVIQN

SEQ ID NO: 108407 - protein, 9 aa, Homo Sapiens
TFSSSTPSN

SEQ ID NO: 108408 - protein, 9 aa, Homo Sapiens
PANKWIRHS

SEQ ID NO: 108409 - protein, 9 aa, Homo Sapiens
SQSLLLTVP

SEQ ID NO: 108410 - protein, 9 aa, Homo Sapiens
IQCDKALNH

SEQ ID NO: 108411 - protein, 9 aa, Homo Sapiens
IKPEQAMKL

SEQ ID NO: 108412 - protein, 9 aa, Homo Sapiens
YSVRPQGPQ

SEQ ID NO: 108413 - protein, 9 aa, Homo Sapiens
GDYVYFKNS

SEQ ID NO: 108414 - protein, 9 aa, Homo Sapiens
GSTDSVNKL

SEQ ID NO: 108415 - protein, 9 aa, Homo Sapiens
SKTKKQRSK

SEQ ID NO: 108416 - protein, 9 aa, Homo Sapiens
VAGEGGRRC

SEQ ID NO: 108417 - protein, 9 aa, Homo Sapiens
QASRLEEEA

SEQ ID NO: 108418 - protein, 9 aa, Homo Sapiens
PSNPVTKDP

SEQ ID NO: 108419 - protein, 9 aa, Homo Sapiens
DNVIQNLEL

SEQ ID NO: 108420 - protein, 9 aa, Homo Sapiens
KCFSKESCV

SEQ ID NO: 108421 - protein, 9 aa, Homo Sapiens
GTEAGTMVK

SEQ ID NO: 108422 - protein, 9 aa, Homo Sapiens
EGARKLQEK

SEQ ID NO: 108423 - protein, 9 aa, Homo Sapiens
NDDDSHSKK

SEQ ID NO: 108424 - protein, 9 aa, Homo Sapiens
HGASINYDD

SEQ ID NO: 108425 - protein, 9 aa, Homo Sapiens
SLPGPRAGR

SEQ ID NO: 108426 - protein, 9 aa, Homo Sapiens
HVCIQWRRS

SEQ ID NO: 108427 - protein, 9 aa, Homo Sapiens
VDRLGVAGE

SEQ ID NO: 108428 - protein, 9 aa, Homo Sapiens
SGSDSNDDD

SEQ ID NO: 108429 - protein, 9 aa, Homo Sapiens
EARAQLLHA

SEQ ID NO: 108430 - protein, 9 aa, Homo Sapiens
DIEGARKLQ

SEQ ID NO: 108431 - protein, 9 aa, Homo Sapiens
KGSPSDRKH

SEQ ID NO: 108432 - protein, 9 aa, Homo Sapiens
DNNKSIRCF

SEQ ID NO: 108433 - protein, 9 aa, Homo Sapiens
HEDPDLGLG

SEQ ID NO: 108434 - protein, 9 aa, Homo Sapiens
PPGPCPLPL

SEQ ID NO: 108435 - protein, 9 aa, Homo Sapiens
NQCRKTFSR

SEQ ID NO: 108436 - protein, 9 aa, Homo Sapiens
VPEFHGKWP

SEQ ID NO: 108437 - protein, 9 aa, Homo Sapiens
AKLEERMRA

SEQ ID NO: 108438 - protein, 9 aa, Homo Sapiens
HSGSDFPTL

SEQ ID NO: 108439 - protein, 9 aa, Homo Sapiens
DGGSKTKKQ

SEQ ID NO: 108440 - protein, 9 aa, Homo Sapiens
GLMKGPLSK

SEQ ID NO: 108441 - protein, 9 aa, Homo Sapiens
NEEIVSQIK

SEQ ID NO: 108442 - protein, 9 aa, Homo Sapiens
KKKKKKNKT

SEQ ID NO: 108443 - protein, 9 aa, Homo Sapiens
SSKATTSQD

SEQ ID NO: 108444 - protein, 9 aa, Homo Sapiens
GTVDITTGI

SEQ ID NO: 108445 - protein, 9 aa, Homo Sapiens
DDSQLYGDS

SEQ ID NO: 108446 - protein, 9 aa, Homo Sapiens
TDFSPLRAT

SEQ ID NO: 108447 - protein, 9 aa, Homo Sapiens
KKNKTKPEC

SEQ ID NO: 108448 - protein, 9 aa, Homo Sapiens
TPEDPTALG

SEQ ID NO: 108449 - protein, 9 aa, Homo Sapiens
LSALQRSLC

SEQ ID NO: 108450 - protein, 9 aa, Homo Sapiens
SHIVVKEKR

SEQ ID NO: 108451 - protein, 9 aa, Homo Sapiens
QHYREAMIQ

SEQ ID NO: 108452 - protein, 9 aa, Homo Sapiens
TPSNPVTKD

SEQ ID NO: 108453 - protein, 9 aa, Homo Sapiens
CNQCRKTFS

SEQ ID NO: 108454 - protein, 9 aa, Homo Sapiens
GKAGHIHIT

SEQ ID NO: 108455 - protein, 9 aa, Homo Sapiens
RSRSGSDSN

SEQ ID NO: 108456 - protein, 9 aa, Homo Sapiens
GGLESWPCL

SEQ ID NO: 108457 - protein, 9 aa, Homo Sapiens
FNKTPINPR

SEQ ID NO: 108458 - protein, 9 aa, Homo Sapiens
QKLGSTTVG

SEQ ID NO: 108459 - protein, 9 aa, Homo Sapiens
SNPVTKDPP

SEQ ID NO: 108460 - protein, 9 aa, Homo Sapiens
KLVTTHKCL

SEQ ID NO: 108461 - protein, 9 aa, Homo Sapiens
QYWSQFYSV

SEQ ID NO: 108462 - protein, 9 aa, Homo Sapiens
THVKMKSEG

SEQ ID NO: 108463 - protein, 9 aa, Homo Sapiens
QIYCVDQTR

SEQ ID NO: 108464 - protein, 9 aa, Homo Sapiens
NESEQVRQF

SEQ ID NO: 108465 - protein, 9 aa, Homo Sapiens
QLCTGPSNT

SEQ ID NO: 108466 - protein, 9 aa, Homo Sapiens
TYKCNQCRK

SEQ ID NO: 108467 - protein, 9 aa, Homo Sapiens
FKNSSSNPY

SEQ ID NO: 108468 - protein, 9 aa, Homo Sapiens
QPLLTPEDP

SEQ ID NO: 108469 - protein, 9 aa, Homo Sapiens
DFSPLRATD

SEQ ID NO: 108470 - protein, 9 aa, Homo Sapiens
KMPIHDHDC

SEQ ID NO: 108471 - protein, 9 aa, Homo Sapiens
REMISHDTR

SEQ ID NO: 108472 - protein, 9 aa, Homo Sapiens
SEARAQLLH

SEQ ID NO: 108473 - protein, 9 aa, Homo Sapiens
STLCAICGD

SEQ ID NO: 108474 - protein, 9 aa, Homo Sapiens
FLQVFVQPY

SEQ ID NO: 108475 - protein, 9 aa, Homo Sapiens
MKSEGGAED

SEQ ID NO: 108476 - protein, 9 aa, Homo Sapiens
ENDEDDDEE

SEQ ID NO: 108477 - protein, 9 aa, Homo Sapiens
MTMLNKGLI

SEQ ID NO: 108478 - protein, 9 aa, Homo Sapiens
ERVQLQMAK

SEQ ID NO: 108479 - protein, 9 aa, Homo Sapiens
ARLWDKADQ

SEQ ID NO: 108480 - protein, 9 aa, Homo Sapiens
TCFSYTFHG

SEQ ID NO: 108481 - protein, 9 aa, Homo Sapiens
PFESSDPFL

SEQ ID NO: 108482 - protein, 9 aa, Homo Sapiens
KATTSQDEA

SEQ ID NO: 108483 - protein, 9 aa, Homo Sapiens
NCEGLGYSS

SEQ ID NO: 108484 - protein, 9 aa, Homo Sapiens
RNWHGINPR

SEQ ID NO: 108485 - protein, 9 aa, Homo Sapiens
QLKKENKRL

SEQ ID NO: 108486 - protein, 9 aa, Homo Sapiens
FLGPLDRGD

SEQ ID NO: 108487 - protein, 9 aa, Homo Sapiens
LLTPEDPTA

SEQ ID NO: 108488 - protein, 9 aa, Homo Sapiens
KAEMKMSLA

SEQ ID NO: 108489 - protein, 9 aa, Homo Sapiens
VDLIKHEAT

SEQ ID NO: 108490 - protein, 9 aa, Homo Sapiens
FLRALRRRV

SEQ ID NO: 108491 - protein, 9 aa, Homo Sapiens
PYKLIVGRD

SEQ ID NO: 108492 - protein, 9 aa, Homo Sapiens
EEGQKPANK

SEQ ID NO: 108493 - protein, 9 aa, Homo Sapiens
YKWKRQKQT

SEQ ID NO: 108494 - protein, 9 aa, Homo Sapiens
CEGLGYSSQ

SEQ ID NO: 108495 - protein, 9 aa, Homo Sapiens
EGKLKEEIQ

SEQ ID NO: 108496 - protein, 9 aa, Homo Sapiens
RVLEQASRL

SEQ ID NO: 108497 - protein, 9 aa, Homo Sapiens
TLETSVNQN

SEQ ID NO: 108498 - protein, 9 aa, Homo Sapiens
CKHNTTGQH

SEQ ID NO: 108499 - protein, 9 aa, Homo Sapiens
CTEGLYLVS

SEQ ID NO: 108500 - protein, 9 aa, Homo Sapiens
MGEDKDEDD

SEQ ID NO: 108501 - protein, 9 aa, Homo Sapiens
VTFRCLQEN

SEQ ID NO: 108502 - protein, 9 aa, Homo Sapiens
PEQAMKLLD

SEQ ID NO: 108503 - protein, 9 aa, Homo Sapiens
ESTMKVHED

SEQ ID NO: 108504 - protein, 9 aa, Homo Sapiens
LPLALSPPP

SEQ ID NO: 108505 - protein, 9 aa, Homo Sapiens
KEEIQVMAK

SEQ ID NO: 108506 - protein, 9 aa, Homo Sapiens
VLEQASRLE

SEQ ID NO: 108507 - protein, 9 aa, Homo Sapiens
LNLSCQSCT

SEQ ID NO: 108508 - protein, 9 aa, Homo Sapiens
IGVDLIKHE

SEQ ID NO: 108509 - protein, 9 aa, Homo Sapiens
DAAEFLATS

SEQ ID NO: 108510 - protein, 9 aa, Homo Sapiens
RDDSQLYGD

SEQ ID NO: 108511 - protein, 9 aa, Homo Sapiens
WHGINPREP

SEQ ID NO: 108512 - protein, 9 aa, Homo Sapiens
GYLTVGEQC

SEQ ID NO: 108513 - protein, 9 aa, Homo Sapiens
AMKLLDCNY

SEQ ID NO: 108514 - protein, 9 aa, Homo Sapiens
AQYWSQFYS

SEQ ID NO: 108515 - protein, 9 aa, Homo Sapiens
ALQRSLCST

SEQ ID NO: 108516 - protein, 9 aa, Homo Sapiens
SDFPTLDNS

SEQ ID NO: 108517 - protein, 9 aa, Homo Sapiens
GLQIFNIHT

SEQ ID NO: 108518 - protein, 9 aa, Homo Sapiens
EMINKKHLV

SEQ ID NO: 108519 - protein, 9 aa, Homo Sapiens
IVSQIKEGK

SEQ ID NO: 108520 - protein, 9 aa, Homo Sapiens
KGLIHSQSS

SEQ ID NO: 108521 - protein, 9 aa, Homo Sapiens
QLQMAKLVT

SEQ ID NO: 108522 - protein, 9 aa, Homo Sapiens
SVNQNTGRG

SEQ ID NO: 108523 - protein, 9 aa, Homo Sapiens
YSCKTSLQR

SEQ ID NO: 108524 - protein, 9 aa, Homo Sapiens
YLTVGEQCE

SEQ ID NO: 108525 - protein, 9 aa, Homo Sapiens
HNTTGQHCE

SEQ ID NO: 108526 - protein, 9 aa, Homo Sapiens
LLVLAAFLL

SEQ ID NO: 108527 - protein, 9 aa, Homo Sapiens
PRRQPVSEA

SEQ ID NO: 108528 - protein, 9 aa, Homo Sapiens
SDETPSAAP

SEQ ID NO: 108529 - protein, 9 aa, Homo Sapiens
GHKVPEFHG

SEQ ID NO: 108530 - protein, 9 aa, Homo Sapiens
QNFQIKHEV

SEQ ID NO: 108531 - protein, 9 aa, Homo Sapiens
IRCFGSRSR

SEQ ID NO: 108532 - protein, 9 aa, Homo Sapiens
GSKEESHIV

SEQ ID NO: 108533 - protein, 9 aa, Homo Sapiens
PVHDTVFYC

SEQ ID NO: 108534 - protein, 9 aa, Homo Sapiens
ANKWIRHSF

SEQ ID NO: 108535 - protein, 9 aa, Homo Sapiens
LAQRRFQAP

SEQ ID NO: 108536 - protein, 9 aa, Homo Sapiens
WSQFYSVRP

SEQ ID NO: 108537 - protein, 9 aa, Homo Sapiens
TPSAAPQLI

SEQ ID NO: 108538 - protein, 9 aa, Homo Sapiens
HDCGVEDED

SEQ ID NO: 108539 - protein, 9 aa, Homo Sapiens
IEGARKLQE

SEQ ID NO: 108540 - protein, 9 aa, Homo Sapiens
SGSDFPTLD

SEQ ID NO: 108541 - protein, 9 aa, Homo Sapiens
TAVKCFSKE

SEQ ID NO: 108542 - protein, 9 aa, Homo Sapiens
FYDFVWRDW

SEQ ID NO: 108543 - protein, 9 aa, Homo Sapiens
RLSLPGPRA

SEQ ID NO: 108544 - protein, 9 aa, Homo Sapiens
NIEANESEQ

SEQ ID NO: 108545 - protein, 9 aa, Homo Sapiens
YDFVWRDWD

SEQ ID NO: 108546 - protein, 9 aa, Homo Sapiens
AQRRFQAPE

SEQ ID NO: 108547 - protein, 9 aa, Homo Sapiens
QKPANKWIR

SEQ ID NO: 108548 - protein, 9 aa, Homo Sapiens
IQWRRSDYC

SEQ ID NO: 108549 - protein, 9 aa, Homo Sapiens
KYDDLENDE

SEQ ID NO: 108550 - protein, 9 aa, Homo Sapiens
LQVFVQPYI

SEQ ID NO: 108551 - protein, 9 aa, Homo Sapiens
SSSTPSNPV

SEQ ID NO: 108552 - protein, 9 aa, Homo Sapiens
LNKGLIHSQ

SEQ ID NO: 108553 - protein, 9 aa, Homo Sapiens
SNITAPCSP

SEQ ID NO: 108554 - protein, 9 aa, Homo Sapiens
CVDQTRRNS

SEQ ID NO: 108555 - protein, 9 aa, Homo Sapiens
RSGSDSNDD

SEQ ID NO: 108556 - protein, 9 aa, Homo Sapiens
VSTCTASAS

SEQ ID NO: 108557 - protein, 9 aa, Homo Sapiens
SAGTEAGTM

SEQ ID NO: 108558 - protein, 9 aa, Homo Sapiens
ALKYLPKVF

SEQ ID NO: 108559 - protein, 9 aa, Homo Sapiens
STPSNPVTK

SEQ ID NO: 108560 - protein, 9 aa, Homo Sapiens
LIAYKWKRQ

SEQ ID NO: 108561 - protein, 9 aa, Homo Sapiens
CEELVTRET

SEQ ID NO: 108562 - protein, 9 aa, Homo Sapiens
QFLNDQILV

SEQ ID NO: 108563 - protein, 9 aa, Homo Sapiens
KDLSHPNVI

SEQ ID NO: 108564 - protein, 9 aa, Homo Sapiens
EGSKEESHI

SEQ ID NO: 108565 - protein, 9 aa, Homo Sapiens
TDGGSKTKK

SEQ ID NO: 108566 - protein, 9 aa, Homo Sapiens
YGDQLPKVK

SEQ ID NO: 108567 - protein, 9 aa, Homo Sapiens
ETHVKMKSE

SEQ ID NO: 108568 - protein, 9 aa, Homo Sapiens
SAAPQLIKK

SEQ ID NO: 108569 - protein, 9 aa, Homo Sapiens
PPNTKAEMK

SEQ ID NO: 108570 - protein, 9 aa, Homo Sapiens
AAGSPFLGG

SEQ ID NO: 108571 - protein, 9 aa, Homo Sapiens
SLCSTPLSQ

SEQ ID NO: 108572 - protein, 9 aa, Homo Sapiens
EAACMKDLS

SEQ ID NO: 108573 - protein, 9 aa, Homo Sapiens
WLRKQIYCV

SEQ ID NO: 108574 - protein, 9 aa, Homo Sapiens
SQNELEMIN

SEQ ID NO: 108575 - protein, 9 aa, Homo Sapiens
KEESHIVVK

SEQ ID NO: 108576 - protein, 9 aa, Homo Sapiens
DSVTIMIIL

SEQ ID NO: 108577 - protein, 9 aa, Homo Sapiens
SKATTSQDE

SEQ ID NO: 108578 - protein, 9 aa, Homo Sapiens
PEEKKKILL

SEQ ID NO: 108579 - protein, 9 aa, Homo Sapiens
PPAGAPKQS

SEQ ID NO: 108580 - protein, 9 aa, Homo Sapiens
EIQVMAKSI

SEQ ID NO: 108581 - protein, 9 aa, Homo Sapiens
AEFLATSAG

SEQ ID NO: 108582 - protein, 9 aa, Homo Sapiens
IHFVEDDSD

SEQ ID NO: 108583 - protein, 9 aa, Homo Sapiens
LPVTFRCLQ

SEQ ID NO: 108584 - protein, 9 aa, Homo Sapiens
LYGDSSALL

SEQ ID NO: 108585 - protein, 9 aa, Homo Sapiens
EQKGSEAQG

SEQ ID NO: 108586 - protein, 9 aa, Homo Sapiens
ETSVNQNTG

SEQ ID NO: 108587 - protein, 9 aa, Homo Sapiens
FSKESCVSI

SEQ ID NO: 108588 - protein, 9 aa, Homo Sapiens
EARVFNKTP

SEQ ID NO: 108589 - protein, 9 aa, Homo Sapiens
FSPLRATDG

SEQ ID NO: 108590 - protein, 9 aa, Homo Sapiens
PQPLLTPED

SEQ ID NO: 108591 - protein, 9 aa, Homo Sapiens
LQENLGIDK

SEQ ID NO: 108592 - protein, 9 aa, Homo Sapiens
KLIVGRDET

SEQ ID NO: 108593 - protein, 9 aa, Homo Sapiens
NLVQNFQIK

SEQ ID NO: 108594 - protein, 9 aa, Homo Sapiens
WNEEIVSQI

SEQ ID NO: 108595 - protein, 9 aa, Homo Sapiens
NVIQNLELQ

SEQ ID NO: 108596 - protein, 9 aa, Homo Sapiens
ITSGVEFLG

SEQ ID NO: 108597 - protein, 9 aa, Homo Sapiens
DCGVEDEDF

SEQ ID NO: 108598 - protein, 9 aa, Homo Sapiens
DKDVAQKLG

SEQ ID NO: 108599 - protein, 9 aa, Homo Sapiens
VCSHQGCGL

SEQ ID NO: 108600 - protein, 9 aa, Homo Sapiens
NQNTGRGGF

SEQ ID NO: 108601 - protein, 9 aa, Homo Sapiens
GVDLIKHEA

SEQ ID NO: 108602 - protein, 9 aa, Homo Sapiens
QPVSEASAR

SEQ ID NO: 108603 - protein, 9 aa, Homo Sapiens
PFLGGPVSF

SEQ ID NO: 108604 - protein, 9 aa, Homo Sapiens
NKTKPECPC

SEQ ID NO: 108605 - protein, 9 aa, Homo Sapiens
PVTFRCLQE

SEQ ID NO: 108606 - protein, 9 aa, Homo Sapiens
LPKTDGGSK

SEQ ID NO: 108607 - protein, 9 aa, Homo Sapiens
IVVKEKRKG

SEQ ID NO: 108608 - protein, 9 aa, Homo Sapiens
PLRLIDREM

SEQ ID NO: 108609 - protein, 9 aa, Homo Sapiens
DLSHPNVIR

SEQ ID NO: 108610 - protein, 9 aa, Homo Sapiens
EARVLEQAS

SEQ ID NO: 108611 - protein, 9 aa, Homo Sapiens
TTGQHCELC

SEQ ID NO: 108612 - protein, 9 aa, Homo Sapiens
KTPINPRKC

SEQ ID NO: 108613 - protein, 9 aa, Homo Sapiens
AEMKMSLAE

SEQ ID NO: 108614 - protein, 9 aa, Homo Sapiens
LQESGKVTL

SEQ ID NO: 108615 - protein, 9 aa, Homo Sapiens
NKTPINPRK

SEQ ID NO: 108616 - protein, 9 aa, Homo Sapiens
EQGGLESWP

SEQ ID NO: 108617 - protein, 9 aa, Homo Sapiens
PGPCPLPLV

SEQ ID NO: 108618 - protein, 9 aa, Homo Sapiens
KDVAQKLGS

SEQ ID NO: 108619 - protein, 9 aa, Homo Sapiens
LRDIHFVED

SEQ ID NO: 108620 - protein, 9 aa, Homo Sapiens
YFKNSSSNP

SEQ ID NO: 108621 - protein, 9 aa, Homo Sapiens
KGSEAQGLK

SEQ ID NO: 108622 - protein, 9 aa, Homo Sapiens
MSEFLRALR

SEQ ID NO: 108623 - protein, 9 aa, Homo Sapiens
DPEEKKKIL

SEQ ID NO: 108624 - protein, 9 aa, Homo Sapiens
AFLLGFLSA

SEQ ID NO: 108625 - protein, 9 aa, Homo Sapiens
NDSVTIMII

SEQ ID NO: 108626 - protein, 9 aa, Homo Sapiens
VKCFSKESC

SEQ ID NO: 108627 - protein, 9 aa, Homo Sapiens
YHFRASSRI

SEQ ID NO: 108628 - protein, 9 aa, Homo Sapiens
KHNTTGQHC

SEQ ID NO: 108629 - protein, 9 aa, Homo Sapiens
WSAGTEAGT

SEQ ID NO: 108630 - protein, 9 aa, Homo Sapiens
LSPGPRASE

SEQ ID NO: 108631 - protein, 9 aa, Homo Sapiens
GLYLVSGNK

SEQ ID NO: 108632 - protein, 9 aa, Homo Sapiens
GSPSDRKHI

SEQ ID NO: 108633 - protein, 9 aa, Homo Sapiens
WDKADQLVK

SEQ ID NO: 108634 - protein, 9 aa, Homo Sapiens
FFYDFVWRD

SEQ ID NO: 108635 - protein, 9 aa, Homo Sapiens
FLKTGLPCT

SEQ ID NO: 108636 - protein, 9 aa, Homo Sapiens
RRRLSLPGP

SEQ ID NO: 108637 - protein, 9 aa, Homo Sapiens
GKLKEEIQV

SEQ ID NO: 108638 - protein, 9 aa, Homo Sapiens
KTDGGSKTK

SEQ ID NO: 108639 - protein, 9 aa, Homo Sapiens
WQRNCEGLG

SEQ ID NO: 108640 - protein, 9 aa, Homo Sapiens
LKHAHEFKE

SEQ ID NO: 108641 - protein, 9 aa, Homo Sapiens
LCLEGNFSE

SEQ ID NO: 108642 - protein, 9 aa, Homo Sapiens
EFLATSAGN

SEQ ID NO: 108643 - protein, 9 aa, Homo Sapiens
QVRQFRRLF

SEQ ID NO: 108644 - protein, 9 aa, Homo Sapiens
TDNNKSIRC

SEQ ID NO: 108645 - protein, 9 aa, Homo Sapiens
KKKKKKKNK

SEQ ID NO: 108646 - protein, 9 aa, Homo Sapiens
LGMDTVPVC

SEQ ID NO: 108647 - protein, 9 aa, Homo Sapiens
SHQGCGLEN

SEQ ID NO: 108648 - protein, 9 aa, Homo Sapiens
LLGFLSALT

SEQ ID NO: 108649 - protein, 9 aa, Homo Sapiens
TSVNQNTGR

SEQ ID NO: 108650 - protein, 9 aa, Homo Sapiens
SPPPLLLLL

SEQ ID NO: 108651 - protein, 9 aa, Homo Sapiens
LQIFNIHTD

SEQ ID NO: 108652 - protein, 9 aa, Homo Sapiens
CTGPSNTEV

SEQ ID NO: 108653 - protein, 9 aa, Homo Sapiens
DEAYDAAEF

SEQ ID NO: 108654 - protein, 9 aa, Homo Sapiens
LAAFLLGFL

SEQ ID NO: 108655 - protein, 9 aa, Homo Sapiens
ANESEQVRQ

SEQ ID NO: 108656 - protein, 9 aa, Homo Sapiens
HGLGSTDSV

SEQ ID NO: 108657 - protein, 9 aa, Homo Sapiens
MSCKDLGNL

SEQ ID NO: 108658 - protein, 9 aa, Homo Sapiens
EEIQVMAKS

SEQ ID NO: 108659 - protein, 9 aa, Homo Sapiens
SEKILKVAA

SEQ ID NO: 108660 - protein, 9 aa, Homo Sapiens
SPSDRKHIG

SEQ ID NO: 108661 - protein, 9 aa, Homo Sapiens
KDKYDDLEN

SEQ ID NO: 108662 - protein, 9 aa, Homo Sapiens
LALKYLPKV

SEQ ID NO: 108663 - protein, 9 aa, Homo Sapiens
DPFLSSSVS

SEQ ID NO: 108664 - protein, 9 aa, Homo Sapiens
GVAGEGGRR

SEQ ID NO: 108665 - protein, 9 aa, Homo Sapiens
SPQPLLTPE

SEQ ID NO: 108666 - protein, 9 aa, Homo Sapiens
RLEREQLCT

SEQ ID NO: 108667 - protein, 9 aa, Homo Sapiens
PSAAPQLIK

SEQ ID NO: 108668 - protein, 9 aa, Homo Sapiens
LGGPVSFPP

SEQ ID NO: 108669 - protein, 9 aa, Homo Sapiens
FYETSKHEK

SEQ ID NO: 108670 - protein, 9 aa, Homo Sapiens
RSPVHDTVF

SEQ ID NO: 108671 - protein, 9 aa, Homo Sapiens
DIHFVEDDS

SEQ ID NO: 108672 - protein, 9 aa, Homo Sapiens
RWPPGPCPL

SEQ ID NO: 108673 - protein, 9 aa, Homo Sapiens
RKQIYCVDQ

SEQ ID NO: 108674 - protein, 9 aa, Homo Sapiens
SSEKGFYET

SEQ ID NO: 108675 - protein, 9 aa, Homo Sapiens
QFYSVRPQG

SEQ ID NO: 108676 - protein, 9 aa, Homo Sapiens
IPEKHLQDV

SEQ ID NO: 108677 - protein, 9 aa, Homo Sapiens
ETSIYSCKT

SEQ ID NO: 108678 - protein, 9 aa, Homo Sapiens
YASNITAPC

SEQ ID NO: 108679 - protein, 9 aa, Homo Sapiens
GVEFLGPLD

SEQ ID NO: 108680 - protein, 9 aa, Homo Sapiens
VVSGSPDAT

SEQ ID NO: 108681 - protein, 9 aa, Homo Sapiens
MKGPLSKVH

SEQ ID NO: 108682 - protein, 9 aa, Homo Sapiens
AACMKDLSH

SEQ ID NO: 108683 - protein, 9 aa, Homo Sapiens
EKGFYETSK

SEQ ID NO: 108684 - protein, 9 aa, Homo Sapiens
RGPYHFRAS

SEQ ID NO: 108685 - protein, 9 aa, Homo Sapiens
LWDKADQLV

SEQ ID NO: 108686 - protein, 9 aa, Homo Sapiens
NKSIRCFGS

SEQ ID NO: 108687 - protein, 9 aa, Homo Sapiens
QSSKATTSQ

SEQ ID NO: 108688 - protein, 9 aa, Homo Sapiens
INPREPAVY

SEQ ID NO: 108689 - protein, 9 aa, Homo Sapiens
HLVKPRRQP

SEQ ID NO: 108690 - protein, 9 aa, Homo Sapiens
GPCPLPLVG

SEQ ID NO: 108691 - protein, 9 aa, Homo Sapiens
SNDDDSHSK

SEQ ID NO: 108692 - protein, 9 aa, Homo Sapiens
VGDYVYFKN

SEQ ID NO: 108693 - protein, 9 aa, Homo Sapiens
AAPPLAQRR

SEQ ID NO: 108694 - protein, 9 aa, Homo Sapiens
TRPGSQSLL

SEQ ID NO: 108695 - protein, 9 aa, Homo Sapiens
SATRPGSQS

SEQ ID NO: 108696 - protein, 9 aa, Homo Sapiens
LFLVATLND

SEQ ID NO: 108697 - protein, 9 aa, Homo Sapiens
QEESTMKVH

SEQ ID NO: 108698 - protein, 9 aa, Homo Sapiens
AGSPFLGGP

SEQ ID NO: 108699 - protein, 9 aa, Homo Sapiens
EGLGYSSQT

SEQ ID NO: 108700 - protein, 9 aa, Homo Sapiens
FYFRNWHGI

SEQ ID NO: 108701 - protein, 9 aa, Homo Sapiens
PLLLLLLLS

SEQ ID NO: 108702 - protein, 9 aa, Homo Sapiens
VFVQPYIIQ

SEQ ID NO: 108703 - protein, 9 aa, Homo Sapiens
GGANGTCFS

SEQ ID NO: 108704 - protein, 9 aa, Homo Sapiens
SESVTLQQH

SEQ ID NO: 108705 - protein, 9 aa, Homo Sapiens
IFNIHTDRA

SEQ ID NO: 108706 - protein, 9 aa, Homo Sapiens
LSDIEGARK

SEQ ID NO: 108707 - protein, 9 aa, Homo Sapiens
EQLCTGPSN

SEQ ID NO: 108708 - protein, 9 aa, Homo Sapiens
QVMAKSIDF

SEQ ID NO: 108709 - protein, 9 aa, Homo Sapiens
FDKDRDGFM

SEQ ID NO: 108710 - protein, 9 aa, Homo Sapiens
SSDPFLSSS

SEQ ID NO: 108711 - protein, 9 aa, Homo Sapiens
ALRRRVAVV

SEQ ID NO: 108712 - protein, 9 aa, Homo Sapiens
MDTVPVCFS

SEQ ID NO: 108713 - protein, 9 aa, Homo Sapiens
EEWDKDVAQ

SEQ ID NO: 108714 - protein, 9 aa, Homo Sapiens
LVQNYKQVC

SEQ ID NO: 108715 - protein, 9 aa, Homo Sapiens
NSLGVSTLC

SEQ ID NO: 108716 - protein, 9 aa, Homo Sapiens
TILIAYKWK

SEQ ID NO: 108717 - protein, 9 aa, Homo Sapiens
LQRSLCSTP

SEQ ID NO: 108718 - protein, 9 aa, Homo Sapiens
KKENKRLRQ

SEQ ID NO: 108719 - protein, 9 aa, Homo Sapiens
QQQQQMQHM

SEQ ID NO: 108720 - protein, 9 aa, Homo Sapiens
SSSEKGFYE

SEQ ID NO: 108721 - protein, 9 aa, Homo Sapiens
SSHSGSDFP

SEQ ID NO: 108722 - protein, 9 aa, Homo Sapiens
GEKGARGLL

SEQ ID NO: 108723 - protein, 9 aa, Homo Sapiens
PYHFRASSR

SEQ ID NO: 108724 - protein, 9 aa, Homo Sapiens
MLNKGLIHS

SEQ ID NO: 108725 - protein, 9 aa, Homo Sapiens
INKKHLVAF

SEQ ID NO: 108726 - protein, 9 aa, Homo Sapiens
SQFYSVRPQ

SEQ ID NO: 108727 - protein, 9 aa, Homo Sapiens
SEAQGLKGD

SEQ ID NO: 108728 - protein, 9 aa, Homo Sapiens
FLVATLNDS

SEQ ID NO: 108729 - protein, 9 aa, Homo Sapiens
GTCFSYTFH

SEQ ID NO: 108730 - protein, 9 aa, Homo Sapiens
RRQPVSEAS

SEQ ID NO: 108731 - protein, 9 aa, Homo Sapiens
FLGGPVSFP

SEQ ID NO: 108732 - protein, 9 aa, Homo Sapiens
EGLYLVSGN

SEQ ID NO: 108733 - protein, 9 aa, Homo Sapiens
GSPDATLRV

SEQ ID NO: 108734 - protein, 9 aa, Homo Sapiens
DDRQSSKAT

SEQ ID NO: 108735 - protein, 9 aa, Homo Sapiens
MHLSRSVPL

SEQ ID NO: 108736 - protein, 9 aa, Homo Sapiens
EFLGPLDRG

SEQ ID NO: 108737 - protein, 9 aa, Homo Sapiens
RGRGAGMLY

SEQ ID NO: 108738 - protein, 9 aa, Homo Sapiens
LSPPPLLLL

SEQ ID NO: 108739 - protein, 9 aa, Homo Sapiens
AAFLLGFLS

SEQ ID NO: 108740 - protein, 9 aa, Homo Sapiens
LPGPRAGRE

SEQ ID NO: 108741 - protein, 9 aa, Homo Sapiens
IVGRDETNC

SEQ ID NO: 108742 - protein, 9 aa, Homo Sapiens
KKKILLNLS

SEQ ID NO: 108743 - protein, 9 aa, Homo Sapiens
QWRRSDYCP

SEQ ID NO: 108744 - protein, 9 aa, Homo Sapiens
DIPEKHLQD

SEQ ID NO: 108745 - protein, 9 aa, Homo Sapiens
NQPRLGMDT

SEQ ID NO: 108746 - protein, 9 aa, Homo Sapiens
TLKHAHEFK

SEQ ID NO: 108747 - protein, 9 aa, Homo Sapiens
REKPYRYIQ

SEQ ID NO: 108748 - protein, 9 aa, Homo Sapiens
ASSRIFWRT

SEQ ID NO: 108749 - protein, 9 aa, Homo Sapiens
ARKLQEKNG

SEQ ID NO: 108750 - protein, 9 aa, Homo Sapiens
QSLLLTVPA

SEQ ID NO: 108751 - protein, 9 aa, Homo Sapiens
DCHEFANIL

SEQ ID NO: 108752 - protein, 9 aa, Homo Sapiens
HFVEDDSDI

SEQ ID NO: 108753 - protein, 9 aa, Homo Sapiens
EKPYRYIQC

SEQ ID NO: 108754 - protein, 9 aa, Homo Sapiens
LLGKSGPRG

SEQ ID NO: 108755 - protein, 9 aa, Homo Sapiens
IYCVDQTRR

SEQ ID NO: 108756 - protein, 9 aa, Homo Sapiens
APKQSPAHP

SEQ ID NO: 108757 - protein, 9 aa, Homo Sapiens
IHDHDCGVE

SEQ ID NO: 108758 - protein, 9 aa, Homo Sapiens
HIVVKEKRK

SEQ ID NO: 108759 - protein, 9 aa, Homo Sapiens
ACMKDLSHP

SEQ ID NO: 108760 - protein, 9 aa, Homo Sapiens
LTDFSPLRA

SEQ ID NO: 108761 - protein, 9 aa, Homo Sapiens
IEANESEQV

SEQ ID NO: 108762 - protein, 8 aa, Homo Sapiens
TLNTEQEA

SEQ ID NO: 108763 - protein, 9 aa, Homo Sapiens
CVSCKHNTT

SEQ ID NO: 108764 - protein, 9 aa, Homo Sapiens
VQNFQIKHE

SEQ ID NO: 108765 - protein, 9 aa, Homo Sapiens
KTARLWDKA

SEQ ID NO: 108766 - protein, 9 aa, Homo Sapiens
CIQWRRSDY

SEQ ID NO: 108767 - protein, 9 aa, Homo Sapiens
LEARVLEQA

SEQ ID NO: 108768 - protein, 9 aa, Homo Sapiens
QMQHMQQQQ

SEQ ID NO: 108769 - protein, 9 aa, Homo Sapiens
MLYPTPAMQ

SEQ ID NO: 108770 - protein, 9 aa, Homo Sapiens
HEFANILHL

SEQ ID NO: 108771 - protein, 9 aa, Homo Sapiens
EWDKDVAQK

SEQ ID NO: 108772 - protein, 9 aa, Homo Sapiens
ESWPCLDQN

SEQ ID NO: 108773 - protein, 9 aa, Homo Sapiens
SKESCVSIP

SEQ ID NO: 108774 - protein, 9 aa, Homo Sapiens
VWRDWDDEE

SEQ ID NO: 108775 - protein, 9 aa, Homo Sapiens
IGLQIFNIH

SEQ ID NO: 108776 - protein, 9 aa, Homo Sapiens
AGHIHITKA

SEQ ID NO: 108777 - protein, 9 aa, Homo Sapiens
TFRCLQENL

SEQ ID NO: 108778 - protein, 9 aa, Homo Sapiens
PCPLPLVGN

SEQ ID NO: 108779 - protein, 9 aa, Homo Sapiens
NELEMINKK

SEQ ID NO: 108780 - protein, 9 aa, Homo Sapiens
AFLTYNEVK

SEQ ID NO: 108781 - protein, 9 aa, Homo Sapiens
FTLSLICFV

SEQ ID NO: 108782 - protein, 9 aa, Homo Sapiens
ICLAESNAG

SEQ ID NO: 108783 - protein, 9 aa, Homo Sapiens
PGAAVVAVE

SEQ ID NO: 108784 - protein, 9 aa, Homo Sapiens
TLSLICFVL

SEQ ID NO: 108785 - protein, 9 aa, Homo Sapiens
GYVGLPSVS

SEQ ID NO: 108786 - protein, 9 aa, Homo Sapiens
EKSKIGSIP

SEQ ID NO: 108787 - protein, 9 aa, Homo Sapiens
LYQVSLRRQ

SEQ ID NO: 108788 - protein, 9 aa, Homo Sapiens
SADCYISYT

SEQ ID NO: 108789 - protein, 9 aa, Homo Sapiens
IAPSHTVIP

SEQ ID NO: 108790 - protein, 9 aa, Homo Sapiens
GSVRASVPQ

SEQ ID NO: 108791 - protein, 9 aa, Homo Sapiens
SLGHPEPLP

SEQ ID NO: 108792 - protein, 9 aa, Homo Sapiens
ALIDSSSQN

SEQ ID NO: 108793 - protein, 9 aa, Homo Sapiens
TSFAYYSLA

SEQ ID NO: 108794 - protein, 9 aa, Homo Sapiens
FEEVLSLEQ

SEQ ID NO: 108795 - protein, 9 aa, Homo Sapiens
DDNKDSNGA

SEQ ID NO: 108796 - protein, 9 aa, Homo Sapiens
FRPFGVFEE

SEQ ID NO: 108797 - protein, 9 aa, Homo Sapiens
LITLVGSSV

SEQ ID NO: 108798 - protein, 9 aa, Homo Sapiens
ATQSNALSS

SEQ ID NO: 108799 - protein, 9 aa, Homo Sapiens
IQTAGNLTC

SEQ ID NO: 108800 - protein, 9 aa, Homo Sapiens
GIRLAVDWF

SEQ ID NO: 108801 - protein, 9 aa, Homo Sapiens
PAGKEGLHG

SEQ ID NO: 108802 - protein, 9 aa, Homo Sapiens
QLVETGGYV

SEQ ID NO: 108803 - protein, 9 aa, Homo Sapiens
PFGPLLAMP

SEQ ID NO: 108804 - protein, 9 aa, Homo Sapiens
LSSSSSSFN

SEQ ID NO: 108805 - protein, 9 aa, Homo Sapiens
VIPPATYSV

SEQ ID NO: 108806 - protein, 9 aa, Homo Sapiens
KKKDDNKDS

SEQ ID NO: 108807 - protein, 9 aa, Homo Sapiens
TCLPWNDEL

SEQ ID NO: 108808 - protein, 9 aa, Homo Sapiens
TPQTTCPGP

SEQ ID NO: 108809 - protein, 9 aa, Homo Sapiens
KDDNKDSNG

SEQ ID NO: 108810 - protein, 9 aa, Homo Sapiens
GPAGKEGLH

SEQ ID NO: 108811 - protein, 9 aa, Homo Sapiens
LPWNDELLA

SEQ ID NO: 108812 - protein, 9 aa, Homo Sapiens
ELYQVSLRR

SEQ ID NO: 108813 - protein, 9 aa, Homo Sapiens
HLQTMTLEH

SEQ ID NO: 108814 - protein, 9 aa, Homo Sapiens
RVKCEGISL

SEQ ID NO: 108815 - protein, 9 aa, Homo Sapiens
SWCVKFLLR

SEQ ID NO: 108816 - protein, 9 aa, Homo Sapiens
LLITLVGSS

SEQ ID NO: 108817 - protein, 9 aa, Homo Sapiens
CLTLASVTL

SEQ ID NO: 108818 - protein, 9 aa, Homo Sapiens
ATLSVRQLI

SEQ ID NO: 108819 - protein, 9 aa, Homo Sapiens
QRALRTRLH

SEQ ID NO: 108820 - protein, 9 aa, Homo Sapiens
GGRSFCPPG

SEQ ID NO: 108821 - protein, 9 aa, Homo Sapiens
NWLCFVHEA

SEQ ID NO: 108822 - protein, 9 aa, Homo Sapiens
THQCFDQMR

SEQ ID NO: 108823 - protein, 9 aa, Homo Sapiens
PYVIYARLW

SEQ ID NO: 108824 - protein, 9 aa, Homo Sapiens
CFDQMRDMF

SEQ ID NO: 108825 - protein, 9 aa, Homo Sapiens
RDKRVKCEG

SEQ ID NO: 108826 - protein, 9 aa, Homo Sapiens
LEKIICVLR

SEQ ID NO: 108827 - protein, 9 aa, Homo Sapiens
EPLPNGRPQ

SEQ ID NO: 108828 - protein, 9 aa, Homo Sapiens
RTRLHLQTM

SEQ ID NO: 108829 - protein, 9 aa, Homo Sapiens
HGPRGDQGP

SEQ ID NO: 108830 - protein, 9 aa, Homo Sapiens
YRRDNDYRG

SEQ ID NO: 108831 - protein, 9 aa, Homo Sapiens
CGPGAAVVA

SEQ ID NO: 108832 - protein, 9 aa, Homo Sapiens
KSFTCSLNL

SEQ ID NO: 108833 - protein, 9 aa, Homo Sapiens
LESYNDFAN

SEQ ID NO: 108834 - protein, 9 aa, Homo Sapiens
LAWFATSFA

SEQ ID NO: 108835 - protein, 9 aa, Homo Sapiens
GRLSNNSSR

SEQ ID NO: 108836 - protein, 9 aa, Homo Sapiens
HTVIPPATY

SEQ ID NO: 108837 - protein, 9 aa, Homo Sapiens
LHLQTMTLE

SEQ ID NO: 108838 - protein, 9 aa, Homo Sapiens
TGGYVGLPS

SEQ ID NO: 108839 - protein, 9 aa, Homo Sapiens
KKDDNKDSN

SEQ ID NO: 108840 - protein, 9 aa, Homo Sapiens
MDFMVDKSG

SEQ ID NO: 108841 - protein, 9 aa, Homo Sapiens
VAGRKGFPY

SEQ ID NO: 108842 - protein, 9 aa, Homo Sapiens
SRPQASITG

SEQ ID NO: 108843 - protein, 9 aa, Homo Sapiens
SPCLTLASV

SEQ ID NO: 108844 - protein, 9 aa, Homo Sapiens
FHATSADCY

SEQ ID NO: 108845 - protein, 9 aa, Homo Sapiens
MAFLTYNEV

SEQ ID NO: 108846 - protein, 9 aa, Homo Sapiens
TNPCGIDNA

SEQ ID NO: 108847 - protein, 9 aa, Homo Sapiens
VYYKRGNFI

SEQ ID NO: 108848 - protein, 9 aa, Homo Sapiens
APRRGSVRA

SEQ ID NO: 108849 - protein, 9 aa, Homo Sapiens
FMVDKSGLW

SEQ ID NO: 108850 - protein, 9 aa, Homo Sapiens
GYMAFLTYN

SEQ ID NO: 108851 - protein, 9 aa, Homo Sapiens
TTPQTTCPG

SEQ ID NO: 108852 - protein, 9 aa, Homo Sapiens
TVLRDKRVK

SEQ ID NO: 108853 - protein, 9 aa, Homo Sapiens
YQVSLRRQR

SEQ ID NO: 108854 - protein, 9 aa, Homo Sapiens
QSNALSSVS

SEQ ID NO: 108855 - protein, 9 aa, Homo Sapiens
GNANSTVKI

SEQ ID NO: 108856 - protein, 9 aa, Homo Sapiens
SDMDFMVDK

SEQ ID NO: 108857 - protein, 9 aa, Homo Sapiens
ELLAAETSL

SEQ ID NO: 108858 - protein, 9 aa, Homo Sapiens
PWNDELLAA

SEQ ID NO: 108859 - protein, 9 aa, Homo Sapiens
NVTVLRDKR

SEQ ID NO: 108860 - protein, 9 aa, Homo Sapiens
LTYNEVKAR

SEQ ID NO: 108861 - protein, 9 aa, Homo Sapiens
TQRLIETFR

SEQ ID NO: 108862 - protein, 9 aa, Homo Sapiens
DELLAAETS

SEQ ID NO: 108863 - protein, 9 aa, Homo Sapiens
EVLSLEQAP

SEQ ID NO: 108864 - protein, 9 aa, Homo Sapiens
TFRPFGVFE

SEQ ID NO: 108865 - protein, 9 aa, Homo Sapiens
PYNATLSVR

SEQ ID NO: 108866 - protein, 9 aa, Homo Sapiens
WNDELLAAE

SEQ ID NO: 108867 - protein, 9 aa, Homo Sapiens
PNGRPQGNS

SEQ ID NO: 108868 - protein, 9 aa, Homo Sapiens
AWFATSFAY

SEQ ID NO: 108869 - protein, 9 aa, Homo Sapiens
GRKGFPYVI

SEQ ID NO: 108870 - protein, 9 aa, Homo Sapiens
AGRKGFPYV

SEQ ID NO: 108871 - protein, 9 aa, Homo Sapiens
ALRTRLHLQ

SEQ ID NO: 108872 - protein, 9 aa, Homo Sapiens
TCSLNLIKH

SEQ ID NO: 108873 - protein, 9 aa, Homo Sapiens
RGSVRASVP

SEQ ID NO: 108874 - protein, 9 aa, Homo Sapiens
RRGSVRASV

SEQ ID NO: 108875 - protein, 9 aa, Homo Sapiens
DNKDSNGAK

SEQ ID NO: 108876 - protein, 9 aa, Homo Sapiens
EGKLLITLV

SEQ ID NO: 108877 - protein, 9 aa, Homo Sapiens
LTLASVTLR

SEQ ID NO: 108878 - protein, 9 aa, Homo Sapiens
SYNDFANME

SEQ ID NO: 108879 - protein, 9 aa, Homo Sapiens
SNALSSVSC

SEQ ID NO: 108880 - protein, 9 aa, Homo Sapiens
KGFPYVIYA

SEQ ID NO: 108881 - protein, 9 aa, Homo Sapiens
TERAAASPV

SEQ ID NO: 108882 - protein, 9 aa, Homo Sapiens
TGVPITHQC

SEQ ID NO: 108883 - protein, 9 aa, Homo Sapiens
LAMPGRPRG

SEQ ID NO: 108884 - protein, 9 aa, Homo Sapiens
LICFVLLIC

SEQ ID NO: 108885 - protein, 9 aa, Homo Sapiens
RTTPQTTCP

SEQ ID NO: 108886 - protein, 9 aa, Homo Sapiens
VPITHQCFD

SEQ ID NO: 108887 - protein, 9 aa, Homo Sapiens
AGKEGLHGP

SEQ ID NO: 108888 - protein, 9 aa, Homo Sapiens
NDYRGGGDR

SEQ ID NO: 108889 - protein, 9 aa, Homo Sapiens
VAVERGAAG

SEQ ID NO: 108890 - protein, 9 aa, Homo Sapiens
AAASPVYYK

SEQ ID NO: 108891 - protein, 9 aa, Homo Sapiens
TTCPGPGTE

SEQ ID NO: 108892 - protein, 9 aa, Homo Sapiens
PAPRRGSVR

SEQ ID NO: 108893 - protein, 9 aa, Homo Sapiens
MKKKDDNKD

SEQ ID NO: 108894 - protein, 9 aa, Homo Sapiens
FTCSLNLIK

SEQ ID NO: 108895 - protein, 9 aa, Homo Sapiens
GQEVICLAE

SEQ ID NO: 108896 - protein, 9 aa, Homo Sapiens
QEKQRELYQ

SEQ ID NO: 108897 - protein, 9 aa, Homo Sapiens
SPVYYKRGN

SEQ ID NO: 108898 - protein, 9 aa, Homo Sapiens
DKRVKCEGI

SEQ ID NO: 108899 - protein, 9 aa, Homo Sapiens
NLTCLDEEV

SEQ ID NO: 108900 - protein, 9 aa, Homo Sapiens
RLIETFRPF

SEQ ID NO: 108901 - protein, 9 aa, Homo Sapiens
KPSPFEEVL

SEQ ID NO: 108902 - protein, 9 aa, Homo Sapiens
RAAASPVYY

SEQ ID NO: 108903 - protein, 9 aa, Homo Sapiens
LPFGPLLAM

SEQ ID NO: 108904 - protein, 9 aa, Homo Sapiens
CPGPGTERE

SEQ ID NO: 108905 - protein, 9 aa, Homo Sapiens
CLPVLDRLL

SEQ ID NO: 108906 - protein, 9 aa, Homo Sapiens
TFPNSLESY

SEQ ID NO: 108907 - protein, 9 aa, Homo Sapiens
DVKHLEKII

SEQ ID NO: 108908 - protein, 9 aa, Homo Sapiens
RQLIENADE

SEQ ID NO: 108909 - protein, 9 aa, Homo Sapiens
SNWLCFVHE

SEQ ID NO: 108910 - protein, 9 aa, Homo Sapiens
CLPWNDELL

SEQ ID NO: 108911 - protein, 9 aa, Homo Sapiens
PSHTVIPPA

SEQ ID NO: 108912 - protein, 9 aa, Homo Sapiens
FPYVIYARL

SEQ ID NO: 108913 - protein, 9 aa, Homo Sapiens
IGQEVICLA

SEQ ID NO: 108914 - protein, 9 aa, Homo Sapiens
PCGIDNAGC

SEQ ID NO: 108915 - protein, 9 aa, Homo Sapiens
NANSTVKIW

SEQ ID NO: 108916 - protein, 9 aa, Homo Sapiens
SCGPGAAVV

SEQ ID NO: 108917 - protein, 9 aa, Homo Sapiens
LRDKRVKCE

SEQ ID NO: 108918 - protein, 9 aa, Homo Sapiens
VETGGYVGL

SEQ ID NO: 108919 - protein, 9 aa, Homo Sapiens
FATSFAYYS

SEQ ID NO: 108920 - protein, 9 aa, Homo Sapiens
TEKSKIGSI

SEQ ID NO: 108921 - protein, 9 aa, Homo Sapiens
ETFRPFGVF

SEQ ID NO: 108922 - protein, 9 aa, Homo Sapiens
EEFSCRGIR

SEQ ID NO: 108923 - protein, 9 aa, Homo Sapiens
ALSSVSCMP

SEQ ID NO: 108924 - protein, 9 aa, Homo Sapiens
SVRASVPQK

SEQ ID NO: 108925 - protein, 9 aa, Homo Sapiens
SFRVKWLRR

SEQ ID NO: 108926 - protein, 9 aa, Homo Sapiens
KIICVLRSG

SEQ ID NO: 108927 - protein, 9 aa, Homo Sapiens
ILVSGNANS

SEQ ID NO: 108928 - protein, 9 aa, Homo Sapiens
TVIPPATYS

SEQ ID NO: 108929 - protein, 9 aa, Homo Sapiens
FGPLLAMPG

SEQ ID NO: 108930 - protein, 9 aa, Homo Sapiens
EFSCRGIRL

SEQ ID NO: 108931 - protein, 9 aa, Homo Sapiens
RRTTPQTTC

SEQ ID NO: 108932 - protein, 9 aa, Homo Sapiens
RLHLQTMTL

SEQ ID NO: 108933 - protein, 9 aa, Homo Sapiens
LSLAWFATS

SEQ ID NO: 108934 - protein, 9 aa, Homo Sapiens
QLNDEGKLL

SEQ ID NO: 108935 - protein, 9 aa, Homo Sapiens
KHLEKIICV

SEQ ID NO: 108936 - protein, 9 aa, Homo Sapiens
TFALIDSSS

SEQ ID NO: 108937 - protein, 9 aa, Homo Sapiens
PQASITGYR

SEQ ID NO: 108938 - protein, 9 aa, Homo Sapiens
LHGPRGDQG

SEQ ID NO: 108939 - protein, 9 aa, Homo Sapiens
NDELLAAET

SEQ ID NO: 108940 - protein, 9 aa, Homo Sapiens
KIGQEVICL

SEQ ID NO: 108941 - protein, 9 aa, Homo Sapiens
RRRGRLSNN

SEQ ID NO: 108942 - protein, 9 aa, Homo Sapiens
SNNSSRPST

SEQ ID NO: 108943 - protein, 9 aa, Homo Sapiens
AMPGRPRGG

SEQ ID NO: 108944 - protein, 9 aa, Homo Sapiens
VICLAESNA

SEQ ID NO: 108945 - protein, 9 aa, Homo Sapiens
PLLAMPGRP

SEQ ID NO: 108946 - protein, 9 aa, Homo Sapiens
PCLTLASVT

SEQ ID NO: 108947 - protein, 9 aa, Homo Sapiens
PFEEVLSLE

SEQ ID NO: 108948 - protein, 9 aa, Homo Sapiens
IRLAVDWFL

SEQ ID NO: 108949 - protein, 9 aa, Homo Sapiens
FLTYNEVKA

SEQ ID NO: 108950 - protein, 9 aa, Homo Sapiens
KQRELYQVS

SEQ ID NO: 108951 - protein, 9 aa, Homo Sapiens
SKIAPSHTV

SEQ ID NO: 108952 - protein, 9 aa, Homo Sapiens
QEVICLAES

SEQ ID NO: 108953 - protein, 9 aa, Homo Sapiens
MVDKSGLWA

SEQ ID NO: 108954 - protein, 9 aa, Homo Sapiens
GGYVGLPSV

SEQ ID NO: 108955 - protein, 9 aa, Homo Sapiens
RLSNNSSRP

SEQ ID NO: 108956 - protein, 9 aa, Homo Sapiens
WSRPQASIT

SEQ ID NO: 108957 - protein, 9 aa, Homo Sapiens
HLEKIICVL

SEQ ID NO: 108958 - protein, 9 aa, Homo Sapiens
RGIRLAVDW

SEQ ID NO: 108959 - protein, 9 aa, Homo Sapiens
KFLLRYVHN

SEQ ID NO: 108960 - protein, 9 aa, Homo Sapiens
DNDYRGGGD

SEQ ID NO: 108961 - protein, 9 aa, Homo Sapiens
DFMVDKSGL

SEQ ID NO: 108962 - protein, 9 aa, Homo Sapiens
YNDFANMEL

SEQ ID NO: 108963 - protein, 9 aa, Homo Sapiens
ASITGYRIV

SEQ ID NO: 108964 - protein, 9 aa, Homo Sapiens
QCFDQMRDM

SEQ ID NO: 108965 - protein, 9 aa, Homo Sapiens
PEPLPNGRP

SEQ ID NO: 108966 - protein, 9 aa, Homo Sapiens
PNSLESYND

SEQ ID NO: 108967 - protein, 9 aa, Homo Sapiens
PVYYKRGNF

SEQ ID NO: 108968 - protein, 9 aa, Homo Sapiens
YMAFLTYNE

SEQ ID NO: 108969 - protein, 9 aa, Homo Sapiens
SLSSSSSSF

SEQ ID NO: 108970 - protein, 9 aa, Homo Sapiens
LDRLLHWAV

SEQ ID NO: 108971 - protein, 9 aa, Homo Sapiens
SLAWFATSF

SEQ ID NO: 108972 - protein, 9 aa, Homo Sapiens
ITHQCFDQM

SEQ ID NO: 108973 - protein, 9 aa, Homo Sapiens
SCRGIRLAV

SEQ ID NO: 108974 - protein, 9 aa, Homo Sapiens
HPEPLPNGR

SEQ ID NO: 108975 - protein, 9 aa, Homo Sapiens
GYRRDNDYR

SEQ ID NO: 108976 - protein, 9 aa, Homo Sapiens
NAGCSHLCL

SEQ ID NO: 108977 - protein, 9 aa, Homo Sapiens
EEHDSTFAL

SEQ ID NO: 108978 - protein, 9 aa, Homo Sapiens
ESYNDFANM

SEQ ID NO: 108979 - protein, 9 aa, Homo Sapiens
EKIICVLRS

SEQ ID NO: 108980 - protein, 9 aa, Homo Sapiens
TLSVRQLIE

SEQ ID NO: 108981 - protein, 9 aa, Homo Sapiens
RALRTRLHL

SEQ ID NO: 108982 - protein, 9 aa, Homo Sapiens
NSLESYNDF

SEQ ID NO: 108983 - protein, 9 aa, Homo Sapiens
GAAVVAVER

SEQ ID NO: 108984 - protein, 9 aa, Homo Sapiens
SICLPVLDR

SEQ ID NO: 108985 - protein, 9 aa, Homo Sapiens
IICVLRSGE

SEQ ID NO: 108986 - protein, 9 aa, Homo Sapiens
VDKSGLWAV

SEQ ID NO: 108987 - protein, 9 aa, Homo Sapiens
KSIMKKKDD

SEQ ID NO: 108988 - protein, 9 aa, Homo Sapiens
GLHGPRGDQ

SEQ ID NO: 108989 - protein, 9 aa, Homo Sapiens
EGLHGPRGD

SEQ ID NO: 108990 - protein, 9 aa, Homo Sapiens
LTQRLIETF

SEQ ID NO: 108991 - protein, 9 aa, Homo Sapiens
GHPEPLPNG

SEQ ID NO: 108992 - protein, 9 aa, Homo Sapiens
GPGAAVVAV

SEQ ID NO: 108993 - protein, 9 aa, Homo Sapiens
NILVSGNAN

SEQ ID NO: 108994 - protein, 9 aa, Homo Sapiens
QASITGYRI

SEQ ID NO: 108995 - protein, 9 aa, Homo Sapiens
PQTTCPGPG

SEQ ID NO: 108996 - protein, 9 aa, Homo Sapiens
GWKIGQEVI

SEQ ID NO: 108997 - protein, 9 aa, Homo Sapiens
SVRQLIENA

SEQ ID NO: 108998 - protein, 9 aa, Homo Sapiens
YISYTPRSI

SEQ ID NO: 108999 - protein, 9 aa, Homo Sapiens
CVKFLLRYV

SEQ ID NO: 109000 - protein, 9 aa, Homo Sapiens
LPNGRPQGN

SEQ ID NO: 109001 - protein, 9 aa, Homo Sapiens
AASPVYYKR

SEQ ID NO: 109002 - protein, 9 aa, Homo Sapiens
EKQRELYQV

SEQ ID NO: 109003 - protein, 9 aa, Homo Sapiens
VLRDKRVKC

SEQ ID NO: 109004 - protein, 9 aa, Homo Sapiens
GGRRRGRLS

SEQ ID NO: 109005 - protein, 9 aa, Homo Sapiens
GSGYRRDND

SEQ ID NO: 109006 - protein, 9 aa, Homo Sapiens
GFPYVIYAR

SEQ ID NO: 109007 - protein, 9 aa, Homo Sapiens
CYISYTPRS

SEQ ID NO: 109008 - protein, 9 aa, Homo Sapiens
LVETGGYVG

SEQ ID NO: 109009 - protein, 9 aa, Homo Sapiens
LRTRLHLQT

SEQ ID NO: 109010 - protein, 9 aa, Homo Sapiens
WKIGQEVIC

SEQ ID NO: 109011 - protein, 9 aa, Homo Sapiens
CSLNLIKHK

SEQ ID NO: 109012 - protein, 9 aa, Homo Sapiens
GPLLAMPGR

SEQ ID NO: 109013 - protein, 9 aa, Homo Sapiens
KEGLHGPRG

SEQ ID NO: 109014 - protein, 9 aa, Homo Sapiens
WLCFVHEAP

SEQ ID NO: 109015 - protein, 9 aa, Homo Sapiens
SPFEEVLSL

SEQ ID NO: 109016 - protein, 9 aa, Homo Sapiens
RPQASITGY

SEQ ID NO: 109017 - protein, 9 aa, Homo Sapiens
GGGRSFCPP

SEQ ID NO: 109018 - protein, 9 aa, Homo Sapiens
LIETFRPFG

SEQ ID NO: 109019 - protein, 9 aa, Homo Sapiens
SIMKKKDDN

SEQ ID NO: 109020 - protein, 9 aa, Homo Sapiens
SGYRRDNDY

SEQ ID NO: 109021 - protein, 9 aa, Homo Sapiens
VVAVERGAA

SEQ ID NO: 109022 - protein, 9 aa, Homo Sapiens
GKEGLHGPR

SEQ ID NO: 109023 - protein, 9 aa, Homo Sapiens
TCLDEEVDI

SEQ ID NO: 109024 - protein, 9 aa, Homo Sapiens
LTCLDEEVD

SEQ ID NO: 109025 - protein, 9 aa, Homo Sapiens
GVPITHQCF

SEQ ID NO: 109026 - protein, 9 aa, Homo Sapiens
EVICLAESN

SEQ ID NO: 109027 - protein, 9 aa, Homo Sapiens
SVTLREFSV

SEQ ID NO: 109028 - protein, 9 aa, Homo Sapiens
KSGLWAVYT

SEQ ID NO: 109029 - protein, 9 aa, Homo Sapiens
SGNANSTVK

SEQ ID NO: 109030 - protein, 9 aa, Homo Sapiens
LCFVHEAPS

SEQ ID NO: 109031 - protein, 9 aa, Homo Sapiens
VLDRLLHWA

SEQ ID NO: 109032 - protein, 9 aa, Homo Sapiens
DRLLHWAVC

SEQ ID NO: 109033 - protein, 9 aa, Homo Sapiens
RLAVDWFLD

SEQ ID NO: 109034 - protein, 9 aa, Homo Sapiens
RWSRPQASI

SEQ ID NO: 109035 - protein, 9 aa, Homo Sapiens
SFTCSLNLI

SEQ ID NO: 109036 - protein, 9 aa, Homo Sapiens
HATSADCYI

SEQ ID NO: 109037 - protein, 9 aa, Homo Sapiens
SCGGGRSFC

SEQ ID NO: 109038 - protein, 9 aa, Homo Sapiens
CRGIRLAVD

SEQ ID NO: 109039 - protein, 9 aa, Homo Sapiens
GRSFCPPGH

SEQ ID NO: 109040 - protein, 9 aa, Homo Sapiens
MSCGGGRSF

SEQ ID NO: 109041 - protein, 9 aa, Homo Sapiens
DNAGCSHLC

SEQ ID NO: 109042 - protein, 9 aa, Homo Sapiens
NALSSVSCM

SEQ ID NO: 109043 - protein, 9 aa, Homo Sapiens
PSATQSNAL

SEQ ID NO: 109044 - protein, 9 aa, Homo Sapiens
NDEGKLLIT

SEQ ID NO: 109045 - protein, 9 aa, Homo Sapiens
KIAPSHTVI

SEQ ID NO: 109046 - protein, 9 aa, Homo Sapiens
PKTEKSKIG

SEQ ID NO: 109047 - protein, 9 aa, Homo Sapiens
TYNEVKARL

SEQ ID NO: 109048 - protein, 9 aa, Homo Sapiens
AAVVAVERG

SEQ ID NO: 109049 - protein, 9 aa, Homo Sapiens
AGNLTCLDE

SEQ ID NO: 109050 - protein, 9 aa, Homo Sapiens
VRQLIENAD

SEQ ID NO: 109051 - protein, 9 aa, Homo Sapiens
SITGYRIVY

SEQ ID NO: 109052 - protein, 9 aa, Homo Sapiens
HDSTFALID

SEQ ID NO: 109053 - protein, 9 aa, Homo Sapiens
QRELYQVSL

SEQ ID NO: 109054 - protein, 9 aa, Homo Sapiens
VTVLRDKRV

SEQ ID NO: 109055 - protein, 9 aa, Homo Sapiens
PLPNGRPQG

SEQ ID NO: 109056 - protein, 9 aa, Homo Sapiens
LSLEQAPAS

SEQ ID NO: 109057 - protein, 9 aa, Homo Sapiens
RRGRLSNNS

SEQ ID NO: 109058 - protein, 9 aa, Homo Sapiens
DCYISYTPR

SEQ ID NO: 109059 - protein, 9 aa, Homo Sapiens
TCPGPGTER

SEQ ID NO: 109060 - protein, 9 aa, Homo Sapiens
DSTFALIDS

SEQ ID NO: 109061 - protein, 9 aa, Homo Sapiens
GRRRGRLSN

SEQ ID NO: 109062 - protein, 9 aa, Homo Sapiens
HQCFDQMRD

SEQ ID NO: 109063 - protein, 9 aa, Homo Sapiens
FPKTEKSKI

SEQ ID NO: 109064 - protein, 9 aa, Homo Sapiens
LSNNSSRPS

SEQ ID NO: 109065 - protein, 9 aa, Homo Sapiens
QTTCPGPGT

SEQ ID NO: 109066 - protein, 9 aa, Homo Sapiens
ESPAPRRGS

SEQ ID NO: 109067 - protein, 9 aa, Homo Sapiens
TQSNALSSV

SEQ ID NO: 109068 - protein, 9 aa, Homo Sapiens
LRYVHNKLL

SEQ ID NO: 109069 - protein, 9 aa, Homo Sapiens
CLDEEVDIN

SEQ ID NO: 109070 - protein, 9 aa, Homo Sapiens
FGSGYRRDN

SEQ ID NO: 109071 - protein, 9 aa, Homo Sapiens
DKSGLWAVY

SEQ ID NO: 109072 - protein, 9 aa, Homo Sapiens
DEGKLLITL

SEQ ID NO: 109073 - protein, 9 aa, Homo Sapiens
EHDSTFALI

SEQ ID NO: 109074 - protein, 9 aa, Homo Sapiens
LPVLDRLLH

SEQ ID NO: 109075 - protein, 9 aa, Homo Sapiens
QTAGNLTCL

SEQ ID NO: 109076 - protein, 9 aa, Homo Sapiens
STFALIDSS

SEQ ID NO: 109077 - protein, 9 aa, Homo Sapiens
FALIDSSSQ

SEQ ID NO: 109078 - protein, 9 aa, Homo Sapiens
ADCYISYTP

SEQ ID NO: 109079 - protein, 9 aa, Homo Sapiens
ATSFAYYSL

SEQ ID NO: 109080 - protein, 9 aa, Homo Sapiens
TLASVTLRE

SEQ ID NO: 109081 - protein, 9 aa, Homo Sapiens
KRVKCEGIS

SEQ ID NO: 109082 - protein, 9 aa, Homo Sapiens
YNATLSVRQ

SEQ ID NO: 109083 - protein, 9 aa, Homo Sapiens
ICLPVLDRL

SEQ ID NO: 109084 - protein, 9 aa, Homo Sapiens
APSHTVIPP

SEQ ID NO: 109085 - protein, 9 aa, Homo Sapiens
ATSADCYIS

SEQ ID NO: 109086 - protein, 9 aa, Homo Sapiens
LLRYVHNKL

SEQ ID NO: 109087 - protein, 9 aa, Homo Sapiens
SEEHDSTFA

SEQ ID NO: 109088 - protein, 9 aa, Homo Sapiens
SFPKTEKSK

SEQ ID NO: 109089 - protein, 9 aa, Homo Sapiens
SLESYNDFA

SEQ ID NO: 109090 - protein, 9 aa, Homo Sapiens
GNLTCLDEE

SEQ ID NO: 109091 - protein, 9 aa, Homo Sapiens
GKLLITLVG

SEQ ID NO: 109092 - protein, 9 aa, Homo Sapiens
EEVLSLEQA

SEQ ID NO: 109093 - protein, 9 aa, Homo Sapiens
LNLIKHKRI

SEQ ID NO: 109094 - protein, 9 aa, Homo Sapiens
SLICFVLLI

SEQ ID NO: 109095 - protein, 9 aa, Homo Sapiens
VKHLEKIIC

SEQ ID NO: 109096 - protein, 9 aa, Homo Sapiens
VRWSRPQAS

SEQ ID NO: 109097 - protein, 9 aa, Homo Sapiens
WCVKFLLRY

SEQ ID NO: 109098 - protein, 9 aa, Homo Sapiens
PSPFEEVLS

SEQ ID NO: 109099 - protein, 9 aa, Homo Sapiens
RMSCGGGRS

SEQ ID NO: 109100 - protein, 9 aa, Homo Sapiens
MPGRPRGGA

SEQ ID NO: 109101 - protein, 9 aa, Homo Sapiens
NATLSVRQL

SEQ ID NO: 109102 - protein, 9 aa, Homo Sapiens
TSFPKTEKS

SEQ ID NO: 109103 - protein, 9 aa, Homo Sapiens
SPAPRRGSV

SEQ ID NO: 109104 - protein, 9 aa, Homo Sapiens
FSFRVKWLR

SEQ ID NO: 109105 - protein, 9 aa, Homo Sapiens
LASVTLREF

SEQ ID NO: 109106 - protein, 9 aa, Homo Sapiens
PITHQCFDQ

SEQ ID NO: 109107 - protein, 9 aa, Homo Sapiens
GIDNAGCSH

SEQ ID NO: 109108 - protein, 9 aa, Homo Sapiens
SATQSNALS

SEQ ID NO: 109109 - protein, 9 aa, Homo Sapiens
VLLICSLCK

SEQ ID NO: 109110 - protein, 9 aa, Homo Sapiens
KLLITLVGS

SEQ ID NO: 109111 - protein, 9 aa, Homo Sapiens
IMKKKDDNK

SEQ ID NO: 109112 - protein, 9 aa, Homo Sapiens
LSVRQLIEN

SEQ ID NO: 109113 - protein, 9 aa, Homo Sapiens
LSLICFVLL

SEQ ID NO: 109114 - protein, 9 aa, Homo Sapiens
ANSTVKIWD

SEQ ID NO: 109115 - protein, 9 aa, Homo Sapiens
VSGNANSTV

SEQ ID NO: 109116 - protein, 9 aa, Homo Sapiens
YNEVKARLQ

SEQ ID NO: 109117 - protein, 9 aa, Homo Sapiens
RELYQVSLR

SEQ ID NO: 109118 - protein, 9 aa, Homo Sapiens
QVSLRRQRF

SEQ ID NO: 109119 - protein, 9 aa, Homo Sapiens
LPSATQSNA

SEQ ID NO: 109120 - protein, 9 aa, Homo Sapiens
CFVHEAPSQ

SEQ ID NO: 109121 - protein, 9 aa, Homo Sapiens
ERAAASPVY

SEQ ID NO: 109122 - protein, 9 aa, Homo Sapiens
AVVAVERGA

SEQ ID NO: 109123 - protein, 9 aa, Homo Sapiens
RYVHNKLLL

SEQ ID NO: 109124 - protein, 9 aa, Homo Sapiens
IDNAGCSHL

SEQ ID NO: 109125 - protein, 9 aa, Homo Sapiens
ETGGYVGLP

SEQ ID NO: 109126 - protein, 9 aa, Homo Sapiens
NPRHSNWLC

SEQ ID NO: 109127 - protein, 9 aa, Homo Sapiens
CFVLLICSL

SEQ ID NO: 109128 - protein, 9 aa, Homo Sapiens
YVIYARLWR

SEQ ID NO: 109129 - protein, 9 aa, Homo Sapiens
FVLLICSLC

SEQ ID NO: 109130 - protein, 9 aa, Homo Sapiens
FSCRGIRLA

SEQ ID NO: 109131 - protein, 9 aa, Homo Sapiens
LNDEGKLLI

SEQ ID NO: 109132 - protein, 9 aa, Homo Sapiens
NQLVETGGY

SEQ ID NO: 109133 - protein, 9 aa, Homo Sapiens
SFCPPGHPL

SEQ ID NO: 109134 - protein, 9 aa, Homo Sapiens
IETFRPFGV

SEQ ID NO: 109135 - protein, 9 aa, Homo Sapiens
ICVLRSGEE

SEQ ID NO: 109136 - protein, 9 aa, Homo Sapiens
YVGLPSVSY

SEQ ID NO: 109137 - protein, 9 aa, Homo Sapiens
RHSNWLCFV

SEQ ID NO: 109138 - protein, 9 aa, Homo Sapiens
VTLREFSVG

SEQ ID NO: 109139 - protein, 9 aa, Homo Sapiens
LKTSFPKTE

SEQ ID NO: 109140 - protein, 9 aa, Homo Sapiens
SHTVIPPAT

SEQ ID NO: 109141 - protein, 9 aa, Homo Sapiens
TAGNLTCLD

SEQ ID NO: 109142 - protein, 9 aa, Homo Sapiens
ASVTLREFS

SEQ ID NO: 109143 - protein, 9 aa, Homo Sapiens
VLSLEQAPA

SEQ ID NO: 109144 - protein, 9 aa, Homo Sapiens
RKGFPYVIY

SEQ ID NO: 109145 - protein, 9 aa, Homo Sapiens
LVSGNANST

SEQ ID NO: 109146 - protein, 9 aa, Homo Sapiens
CGIDNAGCS

SEQ ID NO: 109147 - protein, 9 aa, Homo Sapiens
FRVKWLRRS

SEQ ID NO: 109148 - protein, 9 aa, Homo Sapiens
HSNWLCFVH

SEQ ID NO: 109149 - protein, 9 aa, Homo Sapiens
TRLHLQTMT

SEQ ID NO: 109150 - protein, 9 aa, Homo Sapiens
FLLRYVHNK

SEQ ID NO: 109151 - protein, 9 aa, Homo Sapiens
FPNSLESYN

SEQ ID NO: 109152 - protein, 9 aa, Homo Sapiens
PVLDRLLHW

SEQ ID NO: 109153 - protein, 9 aa, Homo Sapiens
LGHPEPLPN

SEQ ID NO: 109154 - protein, 9 aa, Homo Sapiens
VKFLLRYVH

SEQ ID NO: 109155 - protein, 9 aa, Homo Sapiens
KTEKSKIGS

SEQ ID NO: 109156 - protein, 9 aa, Homo Sapiens
NEVKARLQK

SEQ ID NO: 109157 - protein, 9 aa, Homo Sapiens
AGCSHLCLM

SEQ ID NO: 109158 - protein, 9 aa, Homo Sapiens
SFAYYSLAM

SEQ ID NO: 109159 - protein, 9 aa, Homo Sapiens
TSADCYISY

SEQ ID NO: 109160 - protein, 9 aa, Homo Sapiens
DMDFMVDKS

SEQ ID NO: 109161 - protein, 9 aa, Homo Sapiens
NSTVKIWDI

SEQ ID NO: 109162 - protein, 9 aa, Homo Sapiens
ASPVYYKRG

SEQ ID NO: 109163 - protein, 9 aa, Homo Sapiens
ICFVLLICS

SEQ ID NO: 109164 - protein, 9 aa, Homo Sapiens
SLNLIKHKR

SEQ ID NO: 109165 - protein, 9 aa, Homo Sapiens
RLLHWAVCP

SEQ ID NO: 109166 - protein, 9 aa, Homo Sapiens
NPCGIDNAG

SEQ ID NO: 109167 - protein, 9 aa, Homo Sapiens
RRDNDYRGG

SEQ ID NO: 109168 - protein, 9 aa, Homo Sapiens
RGRLSNNSS

SEQ ID NO: 109169 - protein, 9 aa, Homo Sapiens
CGKSFTCSL

SEQ ID NO: 109170 - protein, 9 aa, Homo Sapiens
GKSFTCSLN

SEQ ID NO: 109171 - protein, 9 aa, Homo Sapiens
LLAMPGRPR

SEQ ID NO: 109172 - protein, 9 aa, Homo Sapiens
RSFCPPGHP

SEQ ID NO: 109173 - protein, 9 aa, Homo Sapiens
KTSFPKTEK

SEQ ID NO: 109174 - protein, 9 aa, Homo Sapiens
QRLIETFRP

SEQ ID NO: 109175 - protein, 9 aa, Homo Sapiens
PRHSNWLCF

SEQ ID NO: 109176 - protein, 9 aa, Homo Sapiens
RVKWLRRSR

SEQ ID NO: 109177 - protein, 9 aa, Homo Sapiens
LLAAETSLL

SEQ ID NO: 109178 - protein, 9 aa, Homo Sapiens
PRRGSVRAS

SEQ ID NO: 109179 - protein, 9 aa, Homo Sapiens
CGGGRSFCP

SEQ ID NO: 109180 - protein, 9 aa, Homo Sapiens
RDNDYRGGG

SEQ ID NO: 109181 - protein, 9 aa, Homo Sapiens
FQPAPYQQG

SEQ ID NO: 109182 - protein, 9 aa, Homo Sapiens
WYRTQTKPS

SEQ ID NO: 109183 - protein, 9 aa, Homo Sapiens
NLDDATFLS

SEQ ID NO: 109184 - protein, 9 aa, Homo Sapiens
LNFLDTYQG

SEQ ID NO: 109185 - protein, 9 aa, Homo Sapiens
IFVQVDTLC

SEQ ID NO: 109186 - protein, 9 aa, Homo Sapiens
LTQGQTQDE

SEQ ID NO: 109187 - protein, 9 aa, Homo Sapiens
MEDDGTVTE

SEQ ID NO: 109188 - protein, 9 aa, Homo Sapiens
VPVSKPCAL

SEQ ID NO: 109189 - protein, 9 aa, Homo Sapiens
CHKNIVGYL

SEQ ID NO: 109190 - protein, 9 aa, Homo Sapiens
GESQPSQAV

SEQ ID NO: 109191 - protein, 9 aa, Homo Sapiens
PGAGVSHKK

SEQ ID NO: 109192 - protein, 9 aa, Homo Sapiens
IEDKKVHRE

SEQ ID NO: 109193 - protein, 9 aa, Homo Sapiens
NGSCFLINT

SEQ ID NO: 109194 - protein, 9 aa, Homo Sapiens
VCQITWAKF

SEQ ID NO: 109195 - protein, 9 aa, Homo Sapiens
KLLMKLKKV

SEQ ID NO: 109196 - protein, 9 aa, Homo Sapiens
GPCHSGYDL

SEQ ID NO: 109197 - protein, 9 aa, Homo Sapiens
MVIHSENLP

SEQ ID NO: 109198 - protein, 9 aa, Homo Sapiens
PLLLLLFLC

SEQ ID NO: 109199 - protein, 9 aa, Homo Sapiens
VPCIFRVTA

SEQ ID NO: 109200 - protein, 9 aa, Homo Sapiens
ESHMQSISN

SEQ ID NO: 109201 - protein, 9 aa, Homo Sapiens
NKYKGQDEK

SEQ ID NO: 109202 - protein, 9 aa, Homo Sapiens
YEQEETRQV

SEQ ID NO: 109203 - protein, 9 aa, Homo Sapiens
KSFHCFGPV

SEQ ID NO: 109204 - protein, 9 aa, Homo Sapiens
KPTTPTKAS

SEQ ID NO: 109205 - protein, 9 aa, Homo Sapiens
TFCKTKYWS

SEQ ID NO: 109206 - protein, 9 aa, Homo Sapiens
RPSSWNASY

SEQ ID NO: 109207 - protein, 9 aa, Homo Sapiens
WKTGYLASH

SEQ ID NO: 109208 - protein, 9 aa, Homo Sapiens
SSCGLPAPS

SEQ ID NO: 109209 - protein, 9 aa, Homo Sapiens
LYPPQVSMS

SEQ ID NO: 109210 - protein, 9 aa, Homo Sapiens
MNSFFETPA

SEQ ID NO: 109211 - protein, 9 aa, Homo Sapiens
FGFAICSQT

SEQ ID NO: 109212 - protein, 9 aa, Homo Sapiens
LSISLQFLI

SEQ ID NO: 109213 - protein, 9 aa, Homo Sapiens
RAPLGLGAP

SEQ ID NO: 109214 - protein, 9 aa, Homo Sapiens
AICSQTTKK

SEQ ID NO: 109215 - protein, 9 aa, Homo Sapiens
GQKIKLTFG

SEQ ID NO: 109216 - protein, 9 aa, Homo Sapiens
GMQEALLCT

SEQ ID NO: 109217 - protein, 9 aa, Homo Sapiens
NSHCFPALL

SEQ ID NO: 109218 - protein, 9 aa, Homo Sapiens
VYSPSQQLW

SEQ ID NO: 109219 - protein, 9 aa, Homo Sapiens
VSPLTHRSI

SEQ ID NO: 109220 - protein, 9 aa, Homo Sapiens
CKHYSSQPC

SEQ ID NO: 109221 - protein, 9 aa, Homo Sapiens
LNLLLEYKK

SEQ ID NO: 109222 - protein, 9 aa, Homo Sapiens
TADTENTTA

SEQ ID NO: 109223 - protein, 9 aa, Homo Sapiens
HATSLSVTS

SEQ ID NO: 109224 - protein, 9 aa, Homo Sapiens
KTRIRNGVN

SEQ ID NO: 109225 - protein, 9 aa, Homo Sapiens
GSSYKLMVE

SEQ ID NO: 109226 - protein, 9 aa, Homo Sapiens
DGLFLVLES

SEQ ID NO: 109227 - protein, 9 aa, Homo Sapiens
LQNVLEEFI

SEQ ID NO: 109228 - protein, 9 aa, Homo Sapiens
QAYYRQKNP

SEQ ID NO: 109229 - protein, 9 aa, Homo Sapiens
IKKLRKLQE

SEQ ID NO: 109230 - protein, 9 aa, Homo Sapiens
TTTVSTADT

SEQ ID NO: 109231 - protein, 9 aa, Homo Sapiens
LSVTSLSSA

SEQ ID NO: 109232 - protein, 9 aa, Homo Sapiens
DGPCAFRRL

SEQ ID NO: 109233 - protein, 9 aa, Homo Sapiens
CCLLIYIFV

SEQ ID NO: 109234 - protein, 9 aa, Homo Sapiens
RRDISFIDI

SEQ ID NO: 109235 - protein, 9 aa, Homo Sapiens
HAHMVIHSE

SEQ ID NO: 109236 - protein, 9 aa, Homo Sapiens
LFNATNRRV

SEQ ID NO: 109237 - protein, 9 aa, Homo Sapiens
GDREPVYSD

SEQ ID NO: 109238 - protein, 9 aa, Homo Sapiens
PYFDDIDDE

SEQ ID NO: 109239 - protein, 9 aa, Homo Sapiens
KQLESNNRD

SEQ ID NO: 109240 - protein, 9 aa, Homo Sapiens
FPKSSLHAQ

SEQ ID NO: 109241 - protein, 9 aa, Homo Sapiens
IRKCHLVHH

SEQ ID NO: 109242 - protein, 9 aa, Homo Sapiens
PPFQPAPYQ

SEQ ID NO: 109243 - protein, 9 aa, Homo Sapiens
QVRQNYHQY

SEQ ID NO: 109244 - protein, 9 aa, Homo Sapiens
TTHGVRIVL

SEQ ID NO: 109245 - protein, 9 aa, Homo Sapiens
SENSSSTQE

SEQ ID NO: 109246 - protein, 9 aa, Homo Sapiens
MKSSKSECS

SEQ ID NO: 109247 - protein, 9 aa, Homo Sapiens
YRISLKLQN

SEQ ID NO: 109248 - protein, 9 aa, Homo Sapiens
CFSDMAITF

SEQ ID NO: 109249 - protein, 9 aa, Homo Sapiens
AESSKQIKQ

SEQ ID NO: 109250 - protein, 9 aa, Homo Sapiens
IVTAKESQY

SEQ ID NO: 109251 - protein, 9 aa, Homo Sapiens
PFQPAPYQQ

SEQ ID NO: 109252 - protein, 9 aa, Homo Sapiens
KCHLVHHQK

SEQ ID NO: 109253 - protein, 9 aa, Homo Sapiens
EDETSSIKM

SEQ ID NO: 109254 - protein, 9 aa, Homo Sapiens
FAICSQTTK

SEQ ID NO: 109255 - protein, 9 aa, Homo Sapiens
TRRDVPCIF

SEQ ID NO: 109256 - protein, 9 aa, Homo Sapiens
KDLCKLQAA

SEQ ID NO: 109257 - protein, 9 aa, Homo Sapiens
REPVYSDCV

SEQ ID NO: 109258 - protein, 9 aa, Homo Sapiens
NAVIVAKSH

SEQ ID NO: 109259 - protein, 9 aa, Homo Sapiens
RPFRPSTSP

SEQ ID NO: 109260 - protein, 9 aa, Homo Sapiens
AFLGQKDIF

SEQ ID NO: 109261 - protein, 9 aa, Homo Sapiens
QSNKETAGM

SEQ ID NO: 109262 - protein, 9 aa, Homo Sapiens
WLKETQEIT

SEQ ID NO: 109263 - protein, 9 aa, Homo Sapiens
GCQGKPTRG

SEQ ID NO: 109264 - protein, 9 aa, Homo Sapiens
ELEDCDRQK

SEQ ID NO: 109265 - protein, 9 aa, Homo Sapiens
YHPPPTKGG

SEQ ID NO: 109266 - protein, 9 aa, Homo Sapiens
FKIVQPELK

SEQ ID NO: 109267 - protein, 9 aa, Homo Sapiens
ALQAYLIKP

SEQ ID NO: 109268 - protein, 9 aa, Homo Sapiens
LLLSKQIKR

SEQ ID NO: 109269 - protein, 9 aa, Homo Sapiens
QTWLDIREF

SEQ ID NO: 109270 - protein, 9 aa, Homo Sapiens
KAFIRKCHL

SEQ ID NO: 109271 - protein, 9 aa, Homo Sapiens
LADGCKESG

SEQ ID NO: 109272 - protein, 9 aa, Homo Sapiens
FLTIEELQK

SEQ ID NO: 109273 - protein, 9 aa, Homo Sapiens
TTIMIQYRS

SEQ ID NO: 109274 - protein, 9 aa, Homo Sapiens
LGKSSVWTS

SEQ ID NO: 109275 - protein, 9 aa, Homo Sapiens
QKAIEHKSR

SEQ ID NO: 109276 - protein, 9 aa, Homo Sapiens
GLPSSFSYN

SEQ ID NO: 109277 - protein, 9 aa, Homo Sapiens
NTRIPEQMF

SEQ ID NO: 109278 - protein, 9 aa, Homo Sapiens
LESQRNPQG

SEQ ID NO: 109279 - protein, 9 aa, Homo Sapiens
IAFAYKRRT

SEQ ID NO: 109280 - protein, 9 aa, Homo Sapiens
ILSSLIAER

SEQ ID NO: 109281 - protein, 9 aa, Homo Sapiens
VSHKKAHSC

SEQ ID NO: 109282 - protein, 9 aa, Homo Sapiens
CFSSEESES

SEQ ID NO: 109283 - protein, 9 aa, Homo Sapiens
YIPKSPEEA

SEQ ID NO: 109284 - protein, 9 aa, Homo Sapiens
NHWLHYDIK

SEQ ID NO: 109285 - protein, 9 aa, Homo Sapiens
VYPALNFIL

SEQ ID NO: 109286 - protein, 9 aa, Homo Sapiens
THGVRIVLG

SEQ ID NO: 109287 - protein, 9 aa, Homo Sapiens
RYAEIREEH

SEQ ID NO: 109288 - protein, 9 aa, Homo Sapiens
ASCKREKRP

SEQ ID NO: 109289 - protein, 9 aa, Homo Sapiens
NKETAGMVR

SEQ ID NO: 109290 - protein, 9 aa, Homo Sapiens
RVGLGKSSV

SEQ ID NO: 109291 - protein, 9 aa, Homo Sapiens
MSNQRLQLI

SEQ ID NO: 109292 - protein, 9 aa, Homo Sapiens
NTQSNKETA

SEQ ID NO: 109293 - protein, 9 aa, Homo Sapiens
PETRDALWA

SEQ ID NO: 109294 - protein, 9 aa, Homo Sapiens
TAAYLCQSV

SEQ ID NO: 109295 - protein, 9 aa, Homo Sapiens
ACLAMLLNF

SEQ ID NO: 109296 - protein, 9 aa, Homo Sapiens
LMVEQAKLK

SEQ ID NO: 109297 - protein, 9 aa, Homo Sapiens
IQYRSVIIP

SEQ ID NO: 109298 - protein, 9 aa, Homo Sapiens
QQLALQDEL

SEQ ID NO: 109299 - protein, 9 aa, Homo Sapiens
YQLRNVLER

SEQ ID NO: 109300 - protein, 9 aa, Homo Sapiens
EHTAENKPL

SEQ ID NO: 109301 - protein, 9 aa, Homo Sapiens
IEFARNGSC

SEQ ID NO: 109302 - protein, 9 aa, Homo Sapiens
KSHDAAKRA

SEQ ID NO: 109303 - protein, 9 aa, Homo Sapiens
QPAPYQQGM

SEQ ID NO: 109304 - protein, 9 aa, Homo Sapiens
DIKTIPRTK

SEQ ID NO: 109305 - protein, 9 aa, Homo Sapiens
PSLALFMFH

SEQ ID NO: 109306 - protein, 9 aa, Homo Sapiens
DIAFAYKRR

SEQ ID NO: 109307 - protein, 9 aa, Homo Sapiens
IVTCEHDVL

SEQ ID NO: 109308 - protein, 9 aa, Homo Sapiens
MLLGQGDFI

SEQ ID NO: 109309 - protein, 9 aa, Homo Sapiens
SLALFMFHP

SEQ ID NO: 109310 - protein, 9 aa, Homo Sapiens
WAASCKREK

SEQ ID NO: 109311 - protein, 9 aa, Homo Sapiens
LLCWYRTQT

SEQ ID NO: 109312 - protein, 9 aa, Homo Sapiens
LLFCQENGF

SEQ ID NO: 109313 - protein, 9 aa, Homo Sapiens
SSQGDITVE

SEQ ID NO: 109314 - protein, 9 aa, Homo Sapiens
SSWNASYRC

SEQ ID NO: 109315 - protein, 9 aa, Homo Sapiens
NQLKNKYKG

SEQ ID NO: 109316 - protein, 9 aa, Homo Sapiens
LLPWGPGLH

SEQ ID NO: 109317 - protein, 9 aa, Homo Sapiens
YIVTCEHDV

SEQ ID NO: 109318 - protein, 9 aa, Homo Sapiens
RIRNGVNCF

SEQ ID NO: 109319 - protein, 9 aa, Homo Sapiens
EFRLKQSNI

SEQ ID NO: 109320 - protein, 9 aa, Homo Sapiens
QGIGYSFSS

SEQ ID NO: 109321 - protein, 9 aa, Homo Sapiens
SFHCFGPVK

SEQ ID NO: 109322 - protein, 9 aa, Homo Sapiens
VLESQRNPQ

SEQ ID NO: 109323 - protein, 9 aa, Homo Sapiens
KTKYWSSNV

SEQ ID NO: 109324 - protein, 9 aa, Homo Sapiens
VQRIAESHM

SEQ ID NO: 109325 - protein, 9 aa, Homo Sapiens
VIVAKSHDA

SEQ ID NO: 109326 - protein, 9 aa, Homo Sapiens
CQKAFIRKC

SEQ ID NO: 109327 - protein, 9 aa, Homo Sapiens
PSPGPIFGP

SEQ ID NO: 109328 - protein, 9 aa, Homo Sapiens
QLGDERCTH

SEQ ID NO: 109329 - protein, 9 aa, Homo Sapiens
KAIEHKSRS

SEQ ID NO: 109330 - protein, 9 aa, Homo Sapiens
SSKSECSSS

SEQ ID NO: 109331 - protein, 9 aa, Homo Sapiens
LLSWLGGEG

SEQ ID NO: 109332 - protein, 9 aa, Homo Sapiens
DLKLCVSQQ

SEQ ID NO: 109333 - protein, 9 aa, Homo Sapiens
QDELDSYTD

SEQ ID NO: 109334 - protein, 9 aa, Homo Sapiens
ISEKTAAYL

SEQ ID NO: 109335 - protein, 9 aa, Homo Sapiens
YLQLGDERC

SEQ ID NO: 109336 - protein, 9 aa, Homo Sapiens
SSSQGDITV

SEQ ID NO: 109337 - protein, 9 aa, Homo Sapiens
LHHTARTEM

SEQ ID NO: 109338 - protein, 9 aa, Homo Sapiens
ITIMKELSC

SEQ ID NO: 109339 - protein, 9 aa, Homo Sapiens
NLLLEYKKH

SEQ ID NO: 109340 - protein, 9 aa, Homo Sapiens
YSVCQITWA

SEQ ID NO: 109341 - protein, 9 aa, Homo Sapiens
FCKTKYWSS

SEQ ID NO: 109342 - protein, 9 aa, Homo Sapiens
VVPVSKPCA

SEQ ID NO: 109343 - protein, 9 aa, Homo Sapiens
MQSQMEHAM

SEQ ID NO: 109344 - protein, 9 aa, Homo Sapiens
TGHATSLSV

SEQ ID NO: 109345 - protein, 9 aa, Homo Sapiens
VILQSEPHC

SEQ ID NO: 109346 - protein, 9 aa, Homo Sapiens
CALRRSLSR

SEQ ID NO: 109347 - protein, 9 aa, Homo Sapiens
IVQPNDVQC

SEQ ID NO: 109348 - protein, 9 aa, Homo Sapiens
TTPTKASNL

SEQ ID NO: 109349 - protein, 9 aa, Homo Sapiens
LLSKQIKRM

SEQ ID NO: 109350 - protein, 9 aa, Homo Sapiens
IYIFVQVDT

SEQ ID NO: 109351 - protein, 9 aa, Homo Sapiens
TKYWSSNVH

SEQ ID NO: 109352 - protein, 9 aa, Homo Sapiens
GLGLLLLSK

SEQ ID NO: 109353 - protein, 9 aa, Homo Sapiens
WYLSSTKLA

SEQ ID NO: 109354 - protein, 9 aa, Homo Sapiens
AILSSLIAE

SEQ ID NO: 109355 - protein, 9 aa, Homo Sapiens
LKQSNIMGS

SEQ ID NO: 109356 - protein, 9 aa, Homo Sapiens
NVLERLAKN

SEQ ID NO: 109357 - protein, 9 aa, Homo Sapiens
GAGDPYFDD

SEQ ID NO: 109358 - protein, 9 aa, Homo Sapiens
QKIKLTFGI

SEQ ID NO: 109359 - protein, 9 aa, Homo Sapiens
GYFQVGWTI

SEQ ID NO: 109360 - protein, 9 aa, Homo Sapiens
MIQLHHTAR

SEQ ID NO: 109361 - protein, 9 aa, Homo Sapiens
ESSKQIKQL

SEQ ID NO: 109362 - protein, 9 aa, Homo Sapiens
CGLPAPSDF

SEQ ID NO: 109363 - protein, 9 aa, Homo Sapiens
RRASNGETI

SEQ ID NO: 109364 - protein, 9 aa, Homo Sapiens
SFIDIILIS

SEQ ID NO: 109365 - protein, 9 aa, Homo Sapiens
IKKSYDQTK

SEQ ID NO: 109366 - protein, 9 aa, Homo Sapiens
FCDTCPILA

SEQ ID NO: 109367 - protein, 9 aa, Homo Sapiens
PKSSLHAQS

SEQ ID NO: 109368 - protein, 9 aa, Homo Sapiens
HAGVPGGKQ

SEQ ID NO: 109369 - protein, 9 aa, Homo Sapiens
HVMLIFKIV

SEQ ID NO: 109370 - protein, 9 aa, Homo Sapiens
MNQLKNKYK

SEQ ID NO: 109371 - protein, 9 aa, Homo Sapiens
YTELMCEQY

SEQ ID NO: 109372 - protein, 9 aa, Homo Sapiens
TRIPEQMFS

SEQ ID NO: 109373 - protein, 9 aa, Homo Sapiens
LLMKLKKVN

SEQ ID NO: 109374 - protein, 9 aa, Homo Sapiens
KIAPYCVEI

SEQ ID NO: 109375 - protein, 9 aa, Homo Sapiens
YDIKTIPRT

SEQ ID NO: 109376 - protein, 9 aa, Homo Sapiens
ENSSSTQEE

SEQ ID NO: 109377 - protein, 9 aa, Homo Sapiens
HIEESEHML

SEQ ID NO: 109378 - protein, 9 aa, Homo Sapiens
FYDVYSRKA

SEQ ID NO: 109379 - protein, 9 aa, Homo Sapiens
VDNEEEMLY

SEQ ID NO: 109380 - protein, 9 aa, Homo Sapiens
QRIAESHMQ

SEQ ID NO: 109381 - protein, 9 aa, Homo Sapiens
KYEYEQEET

SEQ ID NO: 109382 - protein, 9 aa, Homo Sapiens
KGLKKLLNR

SEQ ID NO: 109383 - protein, 9 aa, Homo Sapiens
IHSENLPDP

SEQ ID NO: 109384 - protein, 9 aa, Homo Sapiens
TPLIEAAQE

SEQ ID NO: 109385 - protein, 9 aa, Homo Sapiens
AGIAMYQDA

SEQ ID NO: 109386 - protein, 9 aa, Homo Sapiens
TQSNKETAG

SEQ ID NO: 109387 - protein, 9 aa, Homo Sapiens
SKAELKETP

SEQ ID NO: 109388 - protein, 9 aa, Homo Sapiens
HFQKAIEHK

SEQ ID NO: 109389 - protein, 9 aa, Homo Sapiens
QLWLHCDAC

SEQ ID NO: 109390 - protein, 9 aa, Homo Sapiens
MELIEYKTG

SEQ ID NO: 109391 - protein, 9 aa, Homo Sapiens
KLQALKYLD

SEQ ID NO: 109392 - protein, 9 aa, Homo Sapiens
GKPTRGEGV

SEQ ID NO: 109393 - protein, 9 aa, Homo Sapiens
LKNKYKGQD

SEQ ID NO: 109394 - protein, 9 aa, Homo Sapiens
KVSMAPDVN

SEQ ID NO: 109395 - protein, 9 aa, Homo Sapiens
RPKRSRFHE

SEQ ID NO: 109396 - protein, 9 aa, Homo Sapiens
CMTTCCRPS

SEQ ID NO: 109397 - protein, 9 aa, Homo Sapiens
ANQVATGIL

SEQ ID NO: 109398 - protein, 9 aa, Homo Sapiens
FLKEFSNIV

SEQ ID NO: 109399 - protein, 9 aa, Homo Sapiens
LTIEELQKK

SEQ ID NO: 109400 - protein, 9 aa, Homo Sapiens
VCMFILCWL

SEQ ID NO: 109401 - protein, 9 aa, Homo Sapiens
SEHMLKKAH

SEQ ID NO: 109402 - protein, 9 aa, Homo Sapiens
HEQSVPAES

SEQ ID NO: 109403 - protein, 9 aa, Homo Sapiens
LLLLLFLCS

SEQ ID NO: 109404 - protein, 9 aa, Homo Sapiens
KLCNSHINS

SEQ ID NO: 109405 - protein, 9 aa, Homo Sapiens
NEMIQLHHT

SEQ ID NO: 109406 - protein, 9 aa, Homo Sapiens
KELSCHKNI

SEQ ID NO: 109407 - protein, 9 aa, Homo Sapiens
LNEFEEDFD

SEQ ID NO: 109408 - protein, 9 aa, Homo Sapiens
RKCHLVHHQ

SEQ ID NO: 109409 - protein, 9 aa, Homo Sapiens
SCCMTTCCR

SEQ ID NO: 109410 - protein, 9 aa, Homo Sapiens
NLSGGQKIK

SEQ ID NO: 109411 - protein, 9 aa, Homo Sapiens
LERPKTISP

SEQ ID NO: 109412 - protein, 9 aa, Homo Sapiens
NQVATGILY

SEQ ID NO: 109413 - protein, 9 aa, Homo Sapiens
ALCCLLIYI

SEQ ID NO: 109414 - protein, 9 aa, Homo Sapiens
PGPAHTVLS

SEQ ID NO: 109415 - protein, 9 aa, Homo Sapiens
GMHAGVPGG

SEQ ID NO: 109416 - protein, 9 aa, Homo Sapiens
TIFQGFAKI

SEQ ID NO: 109417 - protein, 9 aa, Homo Sapiens
SEPHCAGVQ

SEQ ID NO: 109418 - protein, 9 aa, Homo Sapiens
LCSSSSVPF

SEQ ID NO: 109419 - protein, 9 aa, Homo Sapiens
VPCLRGAAP

SEQ ID NO: 109420 - protein, 9 aa, Homo Sapiens
TQTKPSSLN

SEQ ID NO: 109421 - protein, 9 aa, Homo Sapiens
RSRFHESYN

SEQ ID NO: 109422 - protein, 9 aa, Homo Sapiens
LCCLLIYIF

SEQ ID NO: 109423 - protein, 9 aa, Homo Sapiens
AMRRYMLLG

SEQ ID NO: 109424 - protein, 9 aa, Homo Sapiens
SLPSLALFM

SEQ ID NO: 109425 - protein, 9 aa, Homo Sapiens
EVRKLSISL

SEQ ID NO: 109426 - protein, 9 aa, Homo Sapiens
GLFLVLESQ

SEQ ID NO: 109427 - protein, 9 aa, Homo Sapiens
STHEQSVPA

SEQ ID NO: 109428 - protein, 9 aa, Homo Sapiens
ETLTAILSS

SEQ ID NO: 109429 - protein, 9 aa, Homo Sapiens
YPPQVSMSP

SEQ ID NO: 109430 - protein, 9 aa, Homo Sapiens
YSAFRELEH

SEQ ID NO: 109431 - protein, 9 aa, Homo Sapiens
NEFEEDFDL

SEQ ID NO: 109432 - protein, 9 aa, Homo Sapiens
CVEIKNTCT

SEQ ID NO: 109433 - protein, 9 aa, Homo Sapiens
TLVGESQPS

SEQ ID NO: 109434 - protein, 9 aa, Homo Sapiens
ALADGCKES

SEQ ID NO: 109435 - protein, 9 aa, Homo Sapiens
SNSSSQGDI

SEQ ID NO: 109436 - protein, 9 aa, Homo Sapiens
DAMQHAAEL

SEQ ID NO: 109437 - protein, 9 aa, Homo Sapiens
RNLLTQGQT

SEQ ID NO: 109438 - protein, 9 aa, Homo Sapiens
PGPIFGPSP

SEQ ID NO: 109439 - protein, 9 aa, Homo Sapiens
ESGHLAKSL

SEQ ID NO: 109440 - protein, 9 aa, Homo Sapiens
FLCSSSSVP

SEQ ID NO: 109441 - protein, 9 aa, Homo Sapiens
GILYNERKG

SEQ ID NO: 109442 - protein, 9 aa, Homo Sapiens
CRLHVLLQE

SEQ ID NO: 109443 - protein, 9 aa, Homo Sapiens
YRTQTKPSS

SEQ ID NO: 109444 - protein, 9 aa, Homo Sapiens
MLIFKIVQP

SEQ ID NO: 109445 - protein, 9 aa, Homo Sapiens
NATNRRVFF

SEQ ID NO: 109446 - protein, 9 aa, Homo Sapiens
KGMHAGVPG

SEQ ID NO: 109447 - protein, 9 aa, Homo Sapiens
FCSGTCYVF

SEQ ID NO: 109448 - protein, 9 aa, Homo Sapiens
RDALWAEIR

SEQ ID NO: 109449 - protein, 9 aa, Homo Sapiens
TSHVMLIFK

SEQ ID NO: 109450 - protein, 9 aa, Homo Sapiens
DISFIDIIL

SEQ ID NO: 109451 - protein, 9 aa, Homo Sapiens
GYIPKSPEE

SEQ ID NO: 109452 - protein, 9 aa, Homo Sapiens
KSSLHAQSE

SEQ ID NO: 109453 - protein, 9 aa, Homo Sapiens
ILKKSQIEA

SEQ ID NO: 109454 - protein, 9 aa, Homo Sapiens
HCFPALLAI

SEQ ID NO: 109455 - protein, 9 aa, Homo Sapiens
HKLSEEQRV

SEQ ID NO: 109456 - protein, 9 aa, Homo Sapiens
LLPKTYIVT

SEQ ID NO: 109457 - protein, 9 aa, Homo Sapiens
QNVLEEFIT

SEQ ID NO: 109458 - protein, 9 aa, Homo Sapiens
QPSQAVGKG

SEQ ID NO: 109459 - protein, 9 aa, Homo Sapiens
LHYQLRNVL

SEQ ID NO: 109460 - protein, 9 aa, Homo Sapiens
LLEYKKHME

SEQ ID NO: 109461 - protein, 9 aa, Homo Sapiens
QPKKGYIPK

SEQ ID NO: 109462 - protein, 9 aa, Homo Sapiens
TSLSVTSLS

SEQ ID NO: 109463 - protein, 9 aa, Homo Sapiens
QQDELDSYT

SEQ ID NO: 109464 - protein, 9 aa, Homo Sapiens
TETPWYPDT

SEQ ID NO: 109465 - protein, 9 aa, Homo Sapiens
EKRPRDSPG

SEQ ID NO: 109466 - protein, 9 aa, Homo Sapiens
GLYPPQVSM

SEQ ID NO: 109467 - protein, 9 aa, Homo Sapiens
QQKGLKKLL

SEQ ID NO: 109468 - protein, 9 aa, Homo Sapiens
LIVYHPPPT

SEQ ID NO: 109469 - protein, 9 aa, Homo Sapiens
DEPETRDAL

SEQ ID NO: 109470 - protein, 9 aa, Homo Sapiens
KKVHRESKL

SEQ ID NO: 109471 - protein, 9 aa, Homo Sapiens
LACAELHQN

SEQ ID NO: 109472 - protein, 9 aa, Homo Sapiens
FRLKQSNIM

SEQ ID NO: 109473 - protein, 9 aa, Homo Sapiens
LCFSSEESE

SEQ ID NO: 109474 - protein, 9 aa, Homo Sapiens
KEFSNIVTA

SEQ ID NO: 109475 - protein, 9 aa, Homo Sapiens
SEKKAANQI

SEQ ID NO: 109476 - protein, 9 aa, Homo Sapiens
KTISPGKNG

SEQ ID NO: 109477 - protein, 9 aa, Homo Sapiens
ISFIDIILI

SEQ ID NO: 109478 - protein, 9 aa, Homo Sapiens
WTIFDSMIV

SEQ ID NO: 109479 - protein, 9 aa, Homo Sapiens
QETFYDVYS

SEQ ID NO: 109480 - protein, 9 aa, Homo Sapiens
AKQKCEQML

SEQ ID NO: 109481 - protein, 9 aa, Homo Sapiens
LLAIPPTQF

SEQ ID NO: 109482 - protein, 9 aa, Homo Sapiens
KLMVEQAKL

SEQ ID NO: 109483 - protein, 9 aa, Homo Sapiens
ICLWWLFNQ

SEQ ID NO: 109484 - protein, 9 aa, Homo Sapiens
KAGKGMHAG

SEQ ID NO: 109485 - protein, 9 aa, Homo Sapiens
PSVPCLRGA

SEQ ID NO: 109486 - protein, 9 aa, Homo Sapiens
SSYKLMVEQ

SEQ ID NO: 109487 - protein, 9 aa, Homo Sapiens
ECEEGSEDY

SEQ ID NO: 109488 - protein, 9 aa, Homo Sapiens
KRSSCGLPA

SEQ ID NO: 109489 - protein, 9 aa, Homo Sapiens
KLQEQSKRV

SEQ ID NO: 109490 - protein, 9 aa, Homo Sapiens
SPGPIFGPS

SEQ ID NO: 109491 - protein, 9 aa, Homo Sapiens
KNLHVINLD

SEQ ID NO: 109492 - protein, 9 aa, Homo Sapiens
QHGDDASEK

SEQ ID NO: 109493 - protein, 9 aa, Homo Sapiens
AQPLNLTGL

SEQ ID NO: 109494 - protein, 9 aa, Homo Sapiens
RNVALQAYL

SEQ ID NO: 109495 - protein, 9 aa, Homo Sapiens
PGLYPPQVS

SEQ ID NO: 109496 - protein, 9 aa, Homo Sapiens
KREKRPRDS

SEQ ID NO: 109497 - protein, 9 aa, Homo Sapiens
WNASYRCSM

SEQ ID NO: 109498 - protein, 9 aa, Homo Sapiens
HRAIQSTQS

SEQ ID NO: 109499 - protein, 9 aa, Homo Sapiens
RLPSNSSSQ

SEQ ID NO: 109500 - protein, 9 aa, Homo Sapiens
SYDQTKRQR

SEQ ID NO: 109501 - protein, 9 aa, Homo Sapiens
KETQEITGD

SEQ ID NO: 109502 - protein, 9 aa, Homo Sapiens
EPHCAGVQW

SEQ ID NO: 109503 - protein, 9 aa, Homo Sapiens
IVLVHCKGS

SEQ ID NO: 109504 - protein, 9 aa, Homo Sapiens
MQAMRRYML

SEQ ID NO: 109505 - protein, 9 aa, Homo Sapiens
RPKTISPGK

SEQ ID NO: 109506 - protein, 9 aa, Homo Sapiens
EAELQELMI

SEQ ID NO: 109507 - protein, 9 aa, Homo Sapiens
HETAFLGQK

SEQ ID NO: 109508 - protein, 9 aa, Homo Sapiens
KITFCKTKY

SEQ ID NO: 109509 - protein, 9 aa, Homo Sapiens
YKTIFQGFA

SEQ ID NO: 109510 - protein, 9 aa, Homo Sapiens
GIVQPNDVQ

SEQ ID NO: 109511 - protein, 9 aa, Homo Sapiens
TLEECIVTL

SEQ ID NO: 109512 - protein, 9 aa, Homo Sapiens
CHLVHHQKI

SEQ ID NO: 109513 - protein, 9 aa, Homo Sapiens
NLSICLWWL

SEQ ID NO: 109514 - protein, 9 aa, Homo Sapiens
LEECIVTLE

SEQ ID NO: 109515 - protein, 9 aa, Homo Sapiens
DFGLSSFLE

SEQ ID NO: 109516 - protein, 9 aa, Homo Sapiens
AFAYKRRTK

SEQ ID NO: 109517 - protein, 9 aa, Homo Sapiens
EDPSSQEGR

SEQ ID NO: 109518 - protein, 9 aa, Homo Sapiens
SSENSSSTQ

SEQ ID NO: 109519 - protein, 9 aa, Homo Sapiens
LFLVLESQR

SEQ ID NO: 109520 - protein, 9 aa, Homo Sapiens
SFLKEFSNI

SEQ ID NO: 109521 - protein, 9 aa, Homo Sapiens
PNPGLYPPQ

SEQ ID NO: 109522 - protein, 9 aa, Homo Sapiens
KNKSEDVFG

SEQ ID NO: 109523 - protein, 9 aa, Homo Sapiens
FLGQKDIFP

SEQ ID NO: 109524 - protein, 9 aa, Homo Sapiens
DPSSQEGRQ

SEQ ID NO: 109525 - protein, 9 aa, Homo Sapiens
KRSRFHESY

SEQ ID NO: 109526 - protein, 9 aa, Homo Sapiens
PSYTETPWY

SEQ ID NO: 109527 - protein, 9 aa, Homo Sapiens
AELQELMIQ

SEQ ID NO: 109528 - protein, 9 aa, Homo Sapiens
HWLHYDIKT

SEQ ID NO: 109529 - protein, 9 aa, Homo Sapiens
RRDVPCIFR

SEQ ID NO: 109530 - protein, 9 aa, Homo Sapiens
HFFCDTCPI

SEQ ID NO: 109531 - protein, 9 aa, Homo Sapiens
HRESKLTSG

SEQ ID NO: 109532 - protein, 9 aa, Homo Sapiens
IAESHMQSI

SEQ ID NO: 109533 - protein, 9 aa, Homo Sapiens
IFKLLRKCI

SEQ ID NO: 109534 - protein, 9 aa, Homo Sapiens
QIAAKQKCE

SEQ ID NO: 109535 - protein, 9 aa, Homo Sapiens
TLKVSPLTH

SEQ ID NO: 109536 - protein, 9 aa, Homo Sapiens
YKRSSCGLP

SEQ ID NO: 109537 - protein, 9 aa, Homo Sapiens
WLHYDIKTI

SEQ ID NO: 109538 - protein, 9 aa, Homo Sapiens
KKNLHVINL

SEQ ID NO: 109539 - protein, 9 aa, Homo Sapiens
SKQIKQLES

SEQ ID NO: 109540 - protein, 9 aa, Homo Sapiens
NYSVCQITW

SEQ ID NO: 109541 - protein, 9 aa, Homo Sapiens
QQILYQAYY

SEQ ID NO: 109542 - protein, 9 aa, Homo Sapiens
EFRPDGKLI

SEQ ID NO: 109543 - protein, 9 aa, Homo Sapiens
YDLKETGIA

SEQ ID NO: 109544 - protein, 9 aa, Homo Sapiens
IFQGFAKID

SEQ ID NO: 109545 - protein, 9 aa, Homo Sapiens
KPCALRRSL

SEQ ID NO: 109546 - protein, 9 aa, Homo Sapiens
LNFILLSIC

SEQ ID NO: 109547 - protein, 9 aa, Homo Sapiens
VNMSHIVPC

SEQ ID NO: 109548 - protein, 9 aa, Homo Sapiens
ALNFILLSI

SEQ ID NO: 109549 - protein, 9 aa, Homo Sapiens
SSLSSGALM

SEQ ID NO: 109550 - protein, 9 aa, Homo Sapiens
PRGAAPPFQ

SEQ ID NO: 109551 - protein, 9 aa, Homo Sapiens
VSTADTENT

SEQ ID NO: 109552 - protein, 9 aa, Homo Sapiens
LPSSFSYNE

SEQ ID NO: 109553 - protein, 9 aa, Homo Sapiens
VEGCFSDMA

SEQ ID NO: 109554 - protein, 9 aa, Homo Sapiens
EKHLLFCQE

SEQ ID NO: 109555 - protein, 9 aa, Homo Sapiens
SVFDEITRI

SEQ ID NO: 109556 - protein, 9 aa, Homo Sapiens
HKKAHSCEM

SEQ ID NO: 109557 - protein, 9 aa, Homo Sapiens
HGIVLVHCK

SEQ ID NO: 109558 - protein, 9 aa, Homo Sapiens
QPNDVQCHV

SEQ ID NO: 109559 - protein, 9 aa, Homo Sapiens
ETRDALWAE

SEQ ID NO: 109560 - protein, 9 aa, Homo Sapiens
YSEAAINRQ

SEQ ID NO: 109561 - protein, 9 aa, Homo Sapiens
LSHRPKRSR

SEQ ID NO: 109562 - protein, 9 aa, Homo Sapiens
SHKKAHSCE

SEQ ID NO: 109563 - protein, 9 aa, Homo Sapiens
PGPSPGPIF

SEQ ID NO: 109564 - protein, 9 aa, Homo Sapiens
LVQKLIVYH

SEQ ID NO: 109565 - protein, 9 aa, Homo Sapiens
STQSAMFNQ

SEQ ID NO: 109566 - protein, 9 aa, Homo Sapiens
LKKSQIEAI

SEQ ID NO: 109567 - protein, 9 aa, Homo Sapiens
GLPRGFPRA

SEQ ID NO: 109568 - protein, 9 aa, Homo Sapiens
NDLHRAIQS

SEQ ID NO: 109569 - protein, 9 aa, Homo Sapiens
SSFSYNEAS

SEQ ID NO: 109570 - protein, 9 aa, Homo Sapiens
PKRSRFHES

SEQ ID NO: 109571 - protein, 9 aa, Homo Sapiens
RLQMELIEY

SEQ ID NO: 109572 - protein, 9 aa, Homo Sapiens
FLYSSSRPF

SEQ ID NO: 109573 - protein, 9 aa, Homo Sapiens
QSYFLTIEE

SEQ ID NO: 109574 - protein, 9 aa, Homo Sapiens
EIREEHGEK

SEQ ID NO: 109575 - protein, 9 aa, Homo Sapiens
DTENTTAST

SEQ ID NO: 109576 - protein, 9 aa, Homo Sapiens
PHCAGVQWK

SEQ ID NO: 109577 - protein, 9 aa, Homo Sapiens
TVLSFLRPS

SEQ ID NO: 109578 - protein, 9 aa, Homo Sapiens
GKLIYANNS

SEQ ID NO: 109579 - protein, 9 aa, Homo Sapiens
CMFILCWLP

SEQ ID NO: 109580 - protein, 9 aa, Homo Sapiens
FQGFAKIDG

SEQ ID NO: 109581 - protein, 9 aa, Homo Sapiens
IAMYQDAIG

SEQ ID NO: 109582 - protein, 9 aa, Homo Sapiens
QIKQLESNN

SEQ ID NO: 109583 - protein, 9 aa, Homo Sapiens
PGGVTHQEE

SEQ ID NO: 109584 - protein, 9 aa, Homo Sapiens
KYKRSSCGL

SEQ ID NO: 109585 - protein, 9 aa, Homo Sapiens
AFRRLAGCQ

SEQ ID NO: 109586 - protein, 9 aa, Homo Sapiens
SCKREKRPR

SEQ ID NO: 109587 - protein, 9 aa, Homo Sapiens
FEKVGCQGK

SEQ ID NO: 109588 - protein, 9 aa, Homo Sapiens
LFLCSSSSV

SEQ ID NO: 109589 - protein, 9 aa, Homo Sapiens
YDVYSRKAS

SEQ ID NO: 109590 - protein, 9 aa, Homo Sapiens
LPSLALFMF

SEQ ID NO: 109591 - protein, 9 aa, Homo Sapiens
YKKHMETFD

SEQ ID NO: 109592 - protein, 9 aa, Homo Sapiens
FSVFDEITR

SEQ ID NO: 109593 - protein, 9 aa, Homo Sapiens
FHCFGPVKF

SEQ ID NO: 109594 - protein, 9 aa, Homo Sapiens
GFALADGCK

SEQ ID NO: 109595 - protein, 9 aa, Homo Sapiens
LLLLFLCSS

SEQ ID NO: 109596 - protein, 9 aa, Homo Sapiens
ASEKKAANQ

SEQ ID NO: 109597 - protein, 9 aa, Homo Sapiens
GETIEKITN

SEQ ID NO: 109598 - protein, 9 aa, Homo Sapiens
AAKQKCEQM

SEQ ID NO: 109599 - protein, 9 aa, Homo Sapiens
HVPEVPSYT

SEQ ID NO: 109600 - protein, 9 aa, Homo Sapiens
YQSYFLTIE

SEQ ID NO: 109601 - protein, 9 aa, Homo Sapiens
STADTENTT

SEQ ID NO: 109602 - protein, 9 aa, Homo Sapiens
TCLTPGQHS

SEQ ID NO: 109603 - protein, 9 aa, Homo Sapiens
TVSTADTEN

SEQ ID NO: 109604 - protein, 9 aa, Homo Sapiens
LKRRDISFI

SEQ ID NO: 109605 - protein, 9 aa, Homo Sapiens
RDAALLALE

SEQ ID NO: 109606 - protein, 9 aa, Homo Sapiens
SICLWWLFN

SEQ ID NO: 109607 - protein, 9 aa, Homo Sapiens
CAFRRLAGC

SEQ ID NO: 109608 - protein, 9 aa, Homo Sapiens
AAELRDAEL

SEQ ID NO: 109609 - protein, 9 aa, Homo Sapiens
YRFWKTGYL

SEQ ID NO: 109610 - protein, 9 aa, Homo Sapiens
NDVQCHVGS

SEQ ID NO: 109611 - protein, 9 aa, Homo Sapiens
YLFKLQALK

SEQ ID NO: 109612 - protein, 9 aa, Homo Sapiens
IKTIPRTKK

SEQ ID NO: 109613 - protein, 9 aa, Homo Sapiens
AYLCQSVTE

SEQ ID NO: 109614 - protein, 9 aa, Homo Sapiens
EHKSRSLNE

SEQ ID NO: 109615 - protein, 9 aa, Homo Sapiens
EAYNWVKAL

SEQ ID NO: 109616 - protein, 9 aa, Homo Sapiens
YRTNCDSST

SEQ ID NO: 109617 - protein, 9 aa, Homo Sapiens
YSSSRPFRP

SEQ ID NO: 109618 - protein, 9 aa, Homo Sapiens
VPEVPSYTE

SEQ ID NO: 109619 - protein, 9 aa, Homo Sapiens
PALNFILLS

SEQ ID NO: 109620 - protein, 9 aa, Homo Sapiens
IPKDKAFCK

SEQ ID NO: 109621 - protein, 9 aa, Homo Sapiens
SLSVTSLSS

SEQ ID NO: 109622 - protein, 9 aa, Homo Sapiens
PEQMFSEHI

SEQ ID NO: 109623 - protein, 9 aa, Homo Sapiens
VIHSENLPD

SEQ ID NO: 109624 - protein, 9 aa, Homo Sapiens
GLLLLSKQI

SEQ ID NO: 109625 - protein, 9 aa, Homo Sapiens
GGQKIKLTF

SEQ ID NO: 109626 - protein, 9 aa, Homo Sapiens
GKYLQLGDE

SEQ ID NO: 109627 - protein, 9 aa, Homo Sapiens
KGSSYKLMV

SEQ ID NO: 109628 - protein, 9 aa, Homo Sapiens
RRLAGCQYY

SEQ ID NO: 109629 - protein, 9 aa, Homo Sapiens
LKLCVSQQT

SEQ ID NO: 109630 - protein, 9 aa, Homo Sapiens
GFAICSQTT

SEQ ID NO: 109631 - protein, 9 aa, Homo Sapiens
SGAGDPYFD

SEQ ID NO: 109632 - protein, 9 aa, Homo Sapiens
PVYSDCVLQ

SEQ ID NO: 109633 - protein, 9 aa, Homo Sapiens
VSMEDDGTV

SEQ ID NO: 109634 - protein, 9 aa, Homo Sapiens
QLHHTARTE

SEQ ID NO: 109635 - protein, 9 aa, Homo Sapiens
NCFEIEWEK

SEQ ID NO: 109636 - protein, 9 aa, Homo Sapiens
AELRDAELA

SEQ ID NO: 109637 - protein, 9 aa, Homo Sapiens
SSQEGRQEL

SEQ ID NO: 109638 - protein, 9 aa, Homo Sapiens
ELDSYTDSV

SEQ ID NO: 109639 - protein, 9 aa, Homo Sapiens
KLIVYHPPP

SEQ ID NO: 109640 - protein, 9 aa, Homo Sapiens
PSSWNASYR

SEQ ID NO: 109641 - protein, 9 aa, Homo Sapiens
FRPSTSPCC

SEQ ID NO: 109642 - protein, 9 aa, Homo Sapiens
TQGQTQDEI

SEQ ID NO: 109643 - protein, 9 aa, Homo Sapiens
CLRGAAPRS

SEQ ID NO: 109644 - protein, 9 aa, Homo Sapiens
AVTIHKLSE

SEQ ID NO: 109645 - protein, 9 aa, Homo Sapiens
VLLQEEFPG

SEQ ID NO: 109646 - protein, 9 aa, Homo Sapiens
HTVLSFLRP

SEQ ID NO: 109647 - protein, 9 aa, Homo Sapiens
GPGVNYSVC

SEQ ID NO: 109648 - protein, 9 aa, Homo Sapiens
NCDSSTTSL

SEQ ID NO: 109649 - protein, 9 aa, Homo Sapiens
GVTHQEERL

SEQ ID NO: 109650 - protein, 9 aa, Homo Sapiens
GPGGVTHQE

SEQ ID NO: 109651 - protein, 9 aa, Homo Sapiens
KTGYLASHL

SEQ ID NO: 109652 - protein, 9 aa, Homo Sapiens
LNPFLLACA

SEQ ID NO: 109653 - protein, 9 aa, Homo Sapiens
ESPSGPKLC

SEQ ID NO: 109654 - protein, 9 aa, Homo Sapiens
EPVYSDCVL

SEQ ID NO: 109655 - protein, 9 aa, Homo Sapiens
LMWTKKFSL

SEQ ID NO: 109656 - protein, 9 aa, Homo Sapiens
VPPKKPTTP

SEQ ID NO: 109657 - protein, 9 aa, Homo Sapiens
MQPGPAHTV

SEQ ID NO: 109658 - protein, 9 aa, Homo Sapiens
VHCKGSLSS

SEQ ID NO: 109659 - protein, 9 aa, Homo Sapiens
WIINTDLKG

SEQ ID NO: 109660 - protein, 9 aa, Homo Sapiens
LALFMFHPL

SEQ ID NO: 109661 - protein, 9 aa, Homo Sapiens
SHRPKRSRF

SEQ ID NO: 109662 - protein, 9 aa, Homo Sapiens
ISLQFLIVL

SEQ ID NO: 109663 - protein, 9 aa, Homo Sapiens
LIFKIVQPE

SEQ ID NO: 109664 - protein, 9 aa, Homo Sapiens
MLKKAHKYS

SEQ ID NO: 109665 - protein, 9 aa, Homo Sapiens
VAKSHDAAK

SEQ ID NO: 109666 - protein, 9 aa, Homo Sapiens
YSPSQQLWL

SEQ ID NO: 109667 - protein, 9 aa, Homo Sapiens
RYMLLGQGD

SEQ ID NO: 109668 - protein, 9 aa, Homo Sapiens
DKAFCKHYS

SEQ ID NO: 109669 - protein, 9 aa, Homo Sapiens
GGVTHQEER

SEQ ID NO: 109670 - protein, 9 aa, Homo Sapiens
FGPVKFTIV

SEQ ID NO: 109671 - protein, 9 aa, Homo Sapiens
QTKPSSLNN

SEQ ID NO: 109672 - protein, 9 aa, Homo Sapiens
FAYKRRTKK

SEQ ID NO: 109673 - protein, 9 aa, Homo Sapiens
KALRPVIRP

SEQ ID NO: 109674 - protein, 9 aa, Homo Sapiens
IKSIEFARN

SEQ ID NO: 109675 - protein, 9 aa, Homo Sapiens
SYTELMCEQ

SEQ ID NO: 109676 - protein, 9 aa, Homo Sapiens
KQIKQLESN

SEQ ID NO: 109677 - protein, 9 aa, Homo Sapiens
LVHCKGSLS

SEQ ID NO: 109678 - protein, 9 aa, Homo Sapiens
TYIVTCEHD

SEQ ID NO: 109679 - protein, 9 aa, Homo Sapiens
MWTKKFSLD

SEQ ID NO: 109680 - protein, 9 aa, Homo Sapiens
TQEECEEMS

SEQ ID NO: 109681 - protein, 9 aa, Homo Sapiens
EDPYLFKLQ

SEQ ID NO: 109682 - protein, 9 aa, Homo Sapiens
APLGLGAPA

SEQ ID NO: 109683 - protein, 9 aa, Homo Sapiens
TLERPKTIS

SEQ ID NO: 109684 - protein, 9 aa, Homo Sapiens
QMFSEHIKD

SEQ ID NO: 109685 - protein, 9 aa, Homo Sapiens
IRNGVNCFE

SEQ ID NO: 109686 - protein, 9 aa, Homo Sapiens
SQALLVPPG

SEQ ID NO: 109687 - protein, 9 aa, Homo Sapiens
SSTQEECEE

SEQ ID NO: 109688 - protein, 9 aa, Homo Sapiens
SPSQQLWLH

SEQ ID NO: 109689 - protein, 9 aa, Homo Sapiens
GIVVCMFIL

SEQ ID NO: 109690 - protein, 9 aa, Homo Sapiens
LFKLQALKY

SEQ ID NO: 109691 - protein, 9 aa, Homo Sapiens
INTDLKGRL

SEQ ID NO: 109692 - protein, 9 aa, Homo Sapiens
GIVLVHCKG

SEQ ID NO: 109693 - protein, 9 aa, Homo Sapiens
GQKDIFPYS

SEQ ID NO: 109694 - protein, 9 aa, Homo Sapiens
LSVKSFHCF

SEQ ID NO: 109695 - protein, 9 aa, Homo Sapiens
YLCQSVTEL

SEQ ID NO: 109696 - protein, 9 aa, Homo Sapiens
KWLNESELR

SEQ ID NO: 109697 - protein, 9 aa, Homo Sapiens
LALQDELEF

SEQ ID NO: 109698 - protein, 9 aa, Homo Sapiens
IEYKTGKRI

SEQ ID NO: 109699 - protein, 9 aa, Homo Sapiens
TFRWLKETQ

SEQ ID NO: 109700 - protein, 9 aa, Homo Sapiens
PSSQEGRQE

SEQ ID NO: 109701 - protein, 9 aa, Homo Sapiens
SKSECSSSS

SEQ ID NO: 109702 - protein, 9 aa, Homo Sapiens
DIREFETRI

SEQ ID NO: 109703 - protein, 9 aa, Homo Sapiens
EDVFGTKDV

SEQ ID NO: 109704 - protein, 9 aa, Homo Sapiens
QEETRQVYM

SEQ ID NO: 109705 - protein, 9 aa, Homo Sapiens
DELDSYTDS

SEQ ID NO: 109706 - protein, 9 aa, Homo Sapiens
GLGKSSVWT

SEQ ID NO: 109707 - protein, 9 aa, Homo Sapiens
PVSKPCALR

SEQ ID NO: 109708 - protein, 9 aa, Homo Sapiens
TNRRVFFRN

SEQ ID NO: 109709 - protein, 9 aa, Homo Sapiens
TEDETSSIK

SEQ ID NO: 109710 - protein, 9 aa, Homo Sapiens
PCLRGAAPR

SEQ ID NO: 109711 - protein, 9 aa, Homo Sapiens
PKYGSSARL

SEQ ID NO: 109712 - protein, 9 aa, Homo Sapiens
LCQSVTELK

SEQ ID NO: 109713 - protein, 9 aa, Homo Sapiens
GVNCFEIEW

SEQ ID NO: 109714 - protein, 9 aa, Homo Sapiens
DADDPKYGS

SEQ ID NO: 109715 - protein, 9 aa, Homo Sapiens
IHATRRDVP

SEQ ID NO: 109716 - protein, 9 aa, Homo Sapiens
HMQAMRRYM

SEQ ID NO: 109717 - protein, 9 aa, Homo Sapiens
SQGDITVEG

SEQ ID NO: 109718 - protein, 9 aa, Homo Sapiens
STPLIEAAQ

SEQ ID NO: 109719 - protein, 9 aa, Homo Sapiens
IQSTQSAMF

SEQ ID NO: 109720 - protein, 9 aa, Homo Sapiens
LQEEFPGHP

SEQ ID NO: 109721 - protein, 9 aa, Homo Sapiens
FLLACAELH

SEQ ID NO: 109722 - protein, 9 aa, Homo Sapiens
KLIYANNSN

SEQ ID NO: 109723 - protein, 9 aa, Homo Sapiens
KTLEECIVT

SEQ ID NO: 109724 - protein, 9 aa, Homo Sapiens
VTHQEERLG

SEQ ID NO: 109725 - protein, 9 aa, Homo Sapiens
FYLFNATNR

SEQ ID NO: 109726 - protein, 9 aa, Homo Sapiens
KPSCCMTTC

SEQ ID NO: 109727 - protein, 9 aa, Homo Sapiens
QNLSGGQKI

SEQ ID NO: 109728 - protein, 9 aa, Homo Sapiens
ICSQTTKKA

SEQ ID NO: 109729 - protein, 9 aa, Homo Sapiens
LTAILSSLI

SEQ ID NO: 109730 - protein, 9 aa, Homo Sapiens
YYRQKNPSK

SEQ ID NO: 109731 - protein, 9 aa, Homo Sapiens
SVCQITWAK

SEQ ID NO: 109732 - protein, 9 aa, Homo Sapiens
KTKDLCKLQ

SEQ ID NO: 109733 - protein, 9 aa, Homo Sapiens
ANLSICLWW

SEQ ID NO: 109734 - protein, 9 aa, Homo Sapiens
NVALQAYLI

SEQ ID NO: 109735 - protein, 9 aa, Homo Sapiens
CFGPVKFTI

SEQ ID NO: 109736 - protein, 9 aa, Homo Sapiens
VQCHVGSDN

SEQ ID NO: 109737 - protein, 9 aa, Homo Sapiens
KEPGTGGAA

SEQ ID NO: 109738 - protein, 9 aa, Homo Sapiens
CLAMLLNFL

SEQ ID NO: 109739 - protein, 9 aa, Homo Sapiens
PVHFYYRTN

SEQ ID NO: 109740 - protein, 9 aa, Homo Sapiens
LYSSSRPFR

SEQ ID NO: 109741 - protein, 9 aa, Homo Sapiens
KNLNEFEED

SEQ ID NO: 109742 - protein, 9 aa, Homo Sapiens
ATRVGLGKS

SEQ ID NO: 109743 - protein, 9 aa, Homo Sapiens
TIFDSMIVF

SEQ ID NO: 109744 - protein, 9 aa, Homo Sapiens
ELIEYKTGK

SEQ ID NO: 109745 - protein, 9 aa, Homo Sapiens
KTLGIVVCM

SEQ ID NO: 109746 - protein, 9 aa, Homo Sapiens
EGLLCCPHE

SEQ ID NO: 109747 - protein, 9 aa, Homo Sapiens
ESQPSQAVG

SEQ ID NO: 109748 - protein, 9 aa, Homo Sapiens
EFARNGSCF

SEQ ID NO: 109749 - protein, 9 aa, Homo Sapiens
FYIFKLLRK

SEQ ID NO: 109750 - protein, 9 aa, Homo Sapiens
TKLAEKLLC

SEQ ID NO: 109751 - protein, 9 aa, Homo Sapiens
KKAANQIRK

SEQ ID NO: 109752 - protein, 9 aa, Homo Sapiens
QDAIGLEGF

SEQ ID NO: 109753 - protein, 9 aa, Homo Sapiens
WLGGEGILS

SEQ ID NO: 109754 - protein, 9 aa, Homo Sapiens
DNEEEMLYG

SEQ ID NO: 109755 - protein, 9 aa, Homo Sapiens
SRPFRPSTS

SEQ ID NO: 109756 - protein, 9 aa, Homo Sapiens
GWTIFDSMI

SEQ ID NO: 109757 - protein, 9 aa, Homo Sapiens
YLASHLLRR

SEQ ID NO: 109758 - protein, 9 aa, Homo Sapiens
LDSKEPGTG

SEQ ID NO: 109759 - protein, 9 aa, Homo Sapiens
QGFAKIDGR

SEQ ID NO: 109760 - protein, 9 aa, Homo Sapiens
FIRKCHLVH

SEQ ID NO: 109761 - protein, 9 aa, Homo Sapiens
GLSSFLEDD

SEQ ID NO: 109762 - protein, 9 aa, Homo Sapiens
QGDREPVYS

SEQ ID NO: 109763 - protein, 9 aa, Homo Sapiens
GTSHVMLIF

SEQ ID NO: 109764 - protein, 9 aa, Homo Sapiens
FSYTELMCE

SEQ ID NO: 109765 - protein, 9 aa, Homo Sapiens
CTTIMNNIV

SEQ ID NO: 109766 - protein, 9 aa, Homo Sapiens
FFCDTCPIL

SEQ ID NO: 109767 - protein, 9 aa, Homo Sapiens
KHLLFCQEN

SEQ ID NO: 109768 - protein, 9 aa, Homo Sapiens
IEHKSRSLN

SEQ ID NO: 109769 - protein, 9 aa, Homo Sapiens
VVSMEDDGT

SEQ ID NO: 109770 - protein, 9 aa, Homo Sapiens
CPQTSNKNK

SEQ ID NO: 109771 - protein, 9 aa, Homo Sapiens
YNEASGYVC

SEQ ID NO: 109772 - protein, 9 aa, Homo Sapiens
PKDKAFCKH

SEQ ID NO: 109773 - protein, 9 aa, Homo Sapiens
KIKLTFGIA

SEQ ID NO: 109774 - protein, 9 aa, Homo Sapiens
PAHTVLSFL

SEQ ID NO: 109775 - protein, 9 aa, Homo Sapiens
APPFQPAPY

SEQ ID NO: 109776 - protein, 9 aa, Homo Sapiens
CDLGKLLMK

SEQ ID NO: 109777 - protein, 9 aa, Homo Sapiens
LQELMIQID

SEQ ID NO: 109778 - protein, 9 aa, Homo Sapiens
INTQSNKET

SEQ ID NO: 109779 - protein, 9 aa, Homo Sapiens
ARTLQGIGY

SEQ ID NO: 109780 - protein, 9 aa, Homo Sapiens
FSDMAITFN

SEQ ID NO: 109781 - protein, 9 aa, Homo Sapiens
TNAELKSTH

SEQ ID NO: 109782 - protein, 9 aa, Homo Sapiens
SYKLMVEQA

SEQ ID NO: 109783 - protein, 9 aa, Homo Sapiens
PYCVEIKNT

SEQ ID NO: 109784 - protein, 9 aa, Homo Sapiens
WLKRRDISF

SEQ ID NO: 109785 - protein, 9 aa, Homo Sapiens
LQMELIEYK

SEQ ID NO: 109786 - protein, 9 aa, Homo Sapiens
ATLERPKTI

SEQ ID NO: 109787 - protein, 9 aa, Homo Sapiens
KSECSSSSK

SEQ ID NO: 109788 - protein, 9 aa, Homo Sapiens
GYDLKETGI

SEQ ID NO: 109789 - protein, 9 aa, Homo Sapiens
LQALKYLDM

SEQ ID NO: 109790 - protein, 9 aa, Homo Sapiens
LIEEDPSSQ

SEQ ID NO: 109791 - protein, 9 aa, Homo Sapiens
LCWYRTQTK

SEQ ID NO: 109792 - protein, 9 aa, Homo Sapiens
VAFTEDETS

SEQ ID NO: 109793 - protein, 9 aa, Homo Sapiens
DSVILKTCL

SEQ ID NO: 109794 - protein, 9 aa, Homo Sapiens
SELRNQEGQ

SEQ ID NO: 109795 - protein, 9 aa, Homo Sapiens
SLCFSSEES

SEQ ID NO: 109796 - protein, 9 aa, Homo Sapiens
SNGETIEKI

SEQ ID NO: 109797 - protein, 9 aa, Homo Sapiens
NKDLYEYSL

SEQ ID NO: 109798 - protein, 9 aa, Homo Sapiens
KSIEFARNG

SEQ ID NO: 109799 - protein, 9 aa, Homo Sapiens
SSEEVNMSH

SEQ ID NO: 109800 - protein, 9 aa, Homo Sapiens
ESEHMLKKA

SEQ ID NO: 109801 - protein, 9 aa, Homo Sapiens
TLVYPALNF

SEQ ID NO: 109802 - protein, 9 aa, Homo Sapiens
PVKVVSMED

SEQ ID NO: 109803 - protein, 9 aa, Homo Sapiens
SVKSFHCFG

SEQ ID NO: 109804 - protein, 9 aa, Homo Sapiens
RVCTFVWII

SEQ ID NO: 109805 - protein, 9 aa, Homo Sapiens
ETPAASWCL

SEQ ID NO: 109806 - protein, 9 aa, Homo Sapiens
LCNSHINSN

SEQ ID NO: 109807 - protein, 9 aa, Homo Sapiens
SGPKLCNSH

SEQ ID NO: 109808 - protein, 9 aa, Homo Sapiens
HLAKSLDFI

SEQ ID NO: 109809 - protein, 9 aa, Homo Sapiens
TNELEDCDR

SEQ ID NO: 109810 - protein, 9 aa, Homo Sapiens
LWAEIRQEI

SEQ ID NO: 109811 - protein, 9 aa, Homo Sapiens
LSCHKNIVG

SEQ ID NO: 109812 - protein, 9 aa, Homo Sapiens
ELMIQIDIM

SEQ ID NO: 109813 - protein, 9 aa, Homo Sapiens
LCKLQAASW

SEQ ID NO: 109814 - protein, 9 aa, Homo Sapiens
TISPGKNGV

SEQ ID NO: 109815 - protein, 9 aa, Homo Sapiens
QKAFIRKCH

SEQ ID NO: 109816 - protein, 9 aa, Homo Sapiens
ELGCSTPLI

SEQ ID NO: 109817 - protein, 9 aa, Homo Sapiens
DEITRIVVK

SEQ ID NO: 109818 - protein, 9 aa, Homo Sapiens
FYYRTNCDS

SEQ ID NO: 109819 - protein, 9 aa, Homo Sapiens
NYSYSSLCF

SEQ ID NO: 109820 - protein, 9 aa, Homo Sapiens
LVLESQRNP

SEQ ID NO: 109821 - protein, 9 aa, Homo Sapiens
YHQYSEAAI

SEQ ID NO: 109822 - protein, 9 aa, Homo Sapiens
CVSQQTIFS

SEQ ID NO: 109823 - protein, 9 aa, Homo Sapiens
DLGKLLMKL

SEQ ID NO: 109824 - protein, 9 aa, Homo Sapiens
EVYSPSQQL

SEQ ID NO: 109825 - protein, 9 aa, Homo Sapiens
IVVCMFILC

SEQ ID NO: 109826 - protein, 9 aa, Homo Sapiens
PKKGYIPKS

SEQ ID NO: 109827 - protein, 9 aa, Homo Sapiens
ITFCKTKYW

SEQ ID NO: 109828 - protein, 9 aa, Homo Sapiens
YPALNFILL

SEQ ID NO: 109829 - protein, 9 aa, Homo Sapiens
NKVSMAPDV

SEQ ID NO: 109830 - protein, 9 aa, Homo Sapiens
PFQPEHRDS

SEQ ID NO: 109831 - protein, 9 aa, Homo Sapiens
NLNRTTHGV

SEQ ID NO: 109832 - protein, 9 aa, Homo Sapiens
TDSVKKENK

SEQ ID NO: 109833 - protein, 9 aa, Homo Sapiens
VTCEHDVLR

SEQ ID NO: 109834 - protein, 9 aa, Homo Sapiens
GKSSVWTSH

SEQ ID NO: 109835 - protein, 9 aa, Homo Sapiens
TLTAILSSL

SEQ ID NO: 109836 - protein, 9 aa, Homo Sapiens
MPTLVGESQ

SEQ ID NO: 109837 - protein, 9 aa, Homo Sapiens
QEALLCTTI

SEQ ID NO: 109838 - protein, 9 aa, Homo Sapiens
VPVKVVSME

SEQ ID NO: 109839 - protein, 9 aa, Homo Sapiens
TCYVFSGDL

SEQ ID NO: 109840 - protein, 9 aa, Homo Sapiens
ADGCKESGL

SEQ ID NO: 109841 - protein, 9 aa, Homo Sapiens
IVTLEGLKM

SEQ ID NO: 109842 - protein, 9 aa, Homo Sapiens
LLLFLCSSS

SEQ ID NO: 109843 - protein, 9 aa, Homo Sapiens
SDLDSKEPG

SEQ ID NO: 109844 - protein, 9 aa, Homo Sapiens
CAGVQWKFA

SEQ ID NO: 109845 - protein, 9 aa, Homo Sapiens
CHIEESEHM

SEQ ID NO: 109846 - protein, 9 aa, Homo Sapiens
PEVPSYTET

SEQ ID NO: 109847 - protein, 9 aa, Homo Sapiens
NSGRRSAQP

SEQ ID NO: 109848 - protein, 9 aa, Homo Sapiens
HGPCHSGYD

SEQ ID NO: 109849 - protein, 9 aa, Homo Sapiens
KDKAFCKHY

SEQ ID NO: 109850 - protein, 9 aa, Homo Sapiens
GYKNLNEFE

SEQ ID NO: 109851 - protein, 9 aa, Homo Sapiens
STQEECEEM

SEQ ID NO: 109852 - protein, 9 aa, Homo Sapiens
EGSKAELKE

SEQ ID NO: 109853 - protein, 9 aa, Homo Sapiens
RNEMIQLHH

SEQ ID NO: 109854 - protein, 9 aa, Homo Sapiens
LFMFHPLVL

SEQ ID NO: 109855 - protein, 9 aa, Homo Sapiens
DPYFDDIDD

SEQ ID NO: 109856 - protein, 9 aa, Homo Sapiens
RWYLSSTKL

SEQ ID NO: 109857 - protein, 9 aa, Homo Sapiens
RISLKLQNV

SEQ ID NO: 109858 - protein, 9 aa, Homo Sapiens
IRRPSSWNA

SEQ ID NO: 109859 - protein, 9 aa, Homo Sapiens
SVTSLSSAS

SEQ ID NO: 109860 - protein, 9 aa, Homo Sapiens
VFCSGTCYV

SEQ ID NO: 109861 - protein, 9 aa, Homo Sapiens
LSGGQKIKL

SEQ ID NO: 109862 - protein, 9 aa, Homo Sapiens
LQTLNPFLL

SEQ ID NO: 109863 - protein, 9 aa, Homo Sapiens
LCCPHERHI

SEQ ID NO: 109864 - protein, 9 aa, Homo Sapiens
AMQHAAELR

SEQ ID NO: 109865 - protein, 9 aa, Homo Sapiens
QDYQTWLDI

SEQ ID NO: 109866 - protein, 9 aa, Homo Sapiens
LSSLIAERE

SEQ ID NO: 109867 - protein, 9 aa, Homo Sapiens
DTSSEEVNM

SEQ ID NO: 109868 - protein, 9 aa, Homo Sapiens
WLDIREFET

SEQ ID NO: 109869 - protein, 9 aa, Homo Sapiens
VFGTKDVTT

SEQ ID NO: 109870 - protein, 9 aa, Homo Sapiens
VLEKWLNES

SEQ ID NO: 109871 - protein, 9 aa, Homo Sapiens
SDFGLSSFL

SEQ ID NO: 109872 - protein, 9 aa, Homo Sapiens
CWYRTQTKP

SEQ ID NO: 109873 - protein, 9 aa, Homo Sapiens
KKHMETFDQ

SEQ ID NO: 109874 - protein, 9 aa, Homo Sapiens
QAESSKQIK

SEQ ID NO: 109875 - protein, 9 aa, Homo Sapiens
SYTETPWYP

SEQ ID NO: 109876 - protein, 9 aa, Homo Sapiens
ETIQPKKGY

SEQ ID NO: 109877 - protein, 9 aa, Homo Sapiens
CKTKYWSSN

SEQ ID NO: 109878 - protein, 9 aa, Homo Sapiens
FGPSPGPGP

SEQ ID NO: 109879 - protein, 9 aa, Homo Sapiens
PYLFKLQAL

SEQ ID NO: 109880 - protein, 9 aa, Homo Sapiens
RLHVLLQEE

SEQ ID NO: 109881 - protein, 9 aa, Homo Sapiens
DREPVYSDC

SEQ ID NO: 109882 - protein, 9 aa, Homo Sapiens
EGSEDYESL

SEQ ID NO: 109883 - protein, 9 aa, Homo Sapiens
FLVLESQRN

SEQ ID NO: 109884 - protein, 9 aa, Homo Sapiens
ETAFLGQKD

SEQ ID NO: 109885 - protein, 9 aa, Homo Sapiens
IFGPSPGPG

SEQ ID NO: 109886 - protein, 9 aa, Homo Sapiens
IMKELSCHK

SEQ ID NO: 109887 - protein, 9 aa, Homo Sapiens
CKREKRPRD

SEQ ID NO: 109888 - protein, 9 aa, Homo Sapiens
GPIFGPSPG

SEQ ID NO: 109889 - protein, 9 aa, Homo Sapiens
MIQIDIMVA

SEQ ID NO: 109890 - protein, 9 aa, Homo Sapiens
EDKKVHRES

SEQ ID NO: 109891 - protein, 9 aa, Homo Sapiens
SEKTAAYLC

SEQ ID NO: 109892 - protein, 9 aa, Homo Sapiens
SRNFPKSSL

SEQ ID NO: 109893 - protein, 9 aa, Homo Sapiens
WDINTQSNK

SEQ ID NO: 109894 - protein, 9 aa, Homo Sapiens
LLIYIFVQV

SEQ ID NO: 109895 - protein, 9 aa, Homo Sapiens
TLQGIGYSF

SEQ ID NO: 109896 - protein, 9 aa, Homo Sapiens
DYQSYFLTI

SEQ ID NO: 109897 - protein, 9 aa, Homo Sapiens
DYESLREMV

SEQ ID NO: 109898 - protein, 9 aa, Homo Sapiens
ILYNERKGR

SEQ ID NO: 109899 - protein, 9 aa, Homo Sapiens
HSGYDLKET

SEQ ID NO: 109900 - protein, 9 aa, Homo Sapiens
SLIAEREAM

SEQ ID NO: 109901 - protein, 9 aa, Homo Sapiens
HYQLRNVLE

SEQ ID NO: 109902 - protein, 9 aa, Homo Sapiens
EEGSEDYES

SEQ ID NO: 109903 - protein, 9 aa, Homo Sapiens
LTHRSIHTG

SEQ ID NO: 109904 - protein, 9 aa, Homo Sapiens
LEHTAENKP

SEQ ID NO: 109905 - protein, 9 aa, Homo Sapiens
TTPSVPCLR

SEQ ID NO: 109906 - protein, 9 aa, Homo Sapiens
QNYHQYSEA

SEQ ID NO: 109907 - protein, 9 aa, Homo Sapiens
VNYSVCQIT

SEQ ID NO: 109908 - protein, 9 aa, Homo Sapiens
IHKLSEEQR

SEQ ID NO: 109909 - protein, 9 aa, Homo Sapiens
PEHRDSEDL

SEQ ID NO: 109910 - protein, 9 aa, Homo Sapiens
QVGWTIFDS

SEQ ID NO: 109911 - protein, 9 aa, Homo Sapiens
SFSYNEASG

SEQ ID NO: 109912 - protein, 9 aa, Homo Sapiens
QPLNLTGLP

SEQ ID NO: 109913 - protein, 9 aa, Homo Sapiens
SHVMLIFKI

SEQ ID NO: 109914 - protein, 9 aa, Homo Sapiens
HYDIKTIPR

SEQ ID NO: 109915 - protein, 9 aa, Homo Sapiens
NTTPSVPCL

SEQ ID NO: 109916 - protein, 9 aa, Homo Sapiens
VNCFEIEWE

SEQ ID NO: 109917 - protein, 9 aa, Homo Sapiens
SLQFLIVLV

SEQ ID NO: 109918 - protein, 9 aa, Homo Sapiens
AESHMQSIS

SEQ ID NO: 109919 - protein, 9 aa, Homo Sapiens
CKESGLSKW

SEQ ID NO: 109920 - protein, 9 aa, Homo Sapiens
MFSEHIKDE

SEQ ID NO: 109921 - protein, 9 aa, Homo Sapiens
VNGGLYRAL

SEQ ID NO: 109922 - protein, 9 aa, Homo Sapiens
FGLSSFLED

SEQ ID NO: 109923 - protein, 9 aa, Homo Sapiens
SPTVDNEEE

SEQ ID NO: 109924 - protein, 9 aa, Homo Sapiens
IYANNSNYK

SEQ ID NO: 109925 - protein, 9 aa, Homo Sapiens
SSRPFRPST

SEQ ID NO: 109926 - protein, 9 aa, Homo Sapiens
SSGALMWTK

SEQ ID NO: 109927 - protein, 9 aa, Homo Sapiens
NAELKSTHE

SEQ ID NO: 109928 - protein, 9 aa, Homo Sapiens
ADDPKYGSS

SEQ ID NO: 109929 - protein, 9 aa, Homo Sapiens
GDDASEKKA

SEQ ID NO: 109930 - protein, 9 aa, Homo Sapiens
QSEPHCAGV

SEQ ID NO: 109931 - protein, 9 aa, Homo Sapiens
CEQMLQNPQ

SEQ ID NO: 109932 - protein, 9 aa, Homo Sapiens
KVSDFGLSS

SEQ ID NO: 109933 - protein, 9 aa, Homo Sapiens
GYKMSSPRV

SEQ ID NO: 109934 - protein, 9 aa, Homo Sapiens
VLVHCKGSL

SEQ ID NO: 109935 - protein, 9 aa, Homo Sapiens
LRDAELAQK

SEQ ID NO: 109936 - protein, 9 aa, Homo Sapiens
ECSSSSKLS

SEQ ID NO: 109937 - protein, 9 aa, Homo Sapiens
FFETPAASW

SEQ ID NO: 109938 - protein, 9 aa, Homo Sapiens
YIFVQVDTL

SEQ ID NO: 109939 - protein, 9 aa, Homo Sapiens
QPEHRDSED

SEQ ID NO: 109940 - protein, 9 aa, Homo Sapiens
HRSIHTGQK

SEQ ID NO: 109941 - protein, 9 aa, Homo Sapiens
DVYSRKASE

SEQ ID NO: 109942 - protein, 9 aa, Homo Sapiens
IPEQMFSEH

SEQ ID NO: 109943 - protein, 9 aa, Homo Sapiens
DPEGSKAEL

SEQ ID NO: 109944 - protein, 9 aa, Homo Sapiens
RIPEQMFSE

SEQ ID NO: 109945 - protein, 9 aa, Homo Sapiens
LPRGFPRAP

SEQ ID NO: 109946 - protein, 9 aa, Homo Sapiens
CLLIYIFVQ

SEQ ID NO: 109947 - protein, 9 aa, Homo Sapiens
MQSISNLNE

SEQ ID NO: 109948 - protein, 9 aa, Homo Sapiens
QTSNKNKQY

SEQ ID NO: 109949 - protein, 9 aa, Homo Sapiens
ESELRNQEG

SEQ ID NO: 109950 - protein, 9 aa, Homo Sapiens
TSNKNKQYE

SEQ ID NO: 109951 - protein, 9 aa, Homo Sapiens
PVFCSGTCY

SEQ ID NO: 109952 - protein, 9 aa, Homo Sapiens
HCAGVQWKF

SEQ ID NO: 109953 - protein, 9 aa, Homo Sapiens
SLVQGPLHS

SEQ ID NO: 109954 - protein, 9 aa, Homo Sapiens
TSPTVDNEE

SEQ ID NO: 109955 - protein, 9 aa, Homo Sapiens
EHFQKAIEH

SEQ ID NO: 109956 - protein, 9 aa, Homo Sapiens
LLCCPHERH

SEQ ID NO: 109957 - protein, 9 aa, Homo Sapiens
YKNLNEFEE

SEQ ID NO: 109958 - protein, 9 aa, Homo Sapiens
AKIEDKKVH

SEQ ID NO: 109959 - protein, 9 aa, Homo Sapiens
WVKALRPVI

SEQ ID NO: 109960 - protein, 9 aa, Homo Sapiens
VKVVSMEDD

SEQ ID NO: 109961 - protein, 9 aa, Homo Sapiens
EIVAVCRDA

SEQ ID NO: 109962 - protein, 9 aa, Homo Sapiens
MSHIVPCEP

SEQ ID NO: 109963 - protein, 9 aa, Homo Sapiens
SRKASERQY

SEQ ID NO: 109964 - protein, 9 aa, Homo Sapiens
EVSELEEIF

SEQ ID NO: 109965 - protein, 9 aa, Homo Sapiens
YIFKLLRKC

SEQ ID NO: 109966 - protein, 9 aa, Homo Sapiens
MIIKDLKLC

SEQ ID NO: 109967 - protein, 9 aa, Homo Sapiens
QQVVEGCFS

SEQ ID NO: 109968 - protein, 9 aa, Homo Sapiens
KLSEEQRVQ

SEQ ID NO: 109969 - protein, 9 aa, Homo Sapiens
LGCSTPLIE

SEQ ID NO: 109970 - protein, 9 aa, Homo Sapiens
RQDIAFAYK

SEQ ID NO: 109971 - protein, 9 aa, Homo Sapiens
LYQAYYRQK

SEQ ID NO: 109972 - protein, 9 aa, Homo Sapiens
VNARNVALQ

SEQ ID NO: 109973 - protein, 9 aa, Homo Sapiens
RLAGCQYYA

SEQ ID NO: 109974 - protein, 9 aa, Homo Sapiens
KLQNVLEEF

SEQ ID NO: 109975 - protein, 9 aa, Homo Sapiens
LVGESQPSQ

SEQ ID NO: 109976 - protein, 9 aa, Homo Sapiens
DVNGGLYRA

SEQ ID NO: 109977 - protein, 9 aa, Homo Sapiens
HGVRIVLGG

SEQ ID NO: 109978 - protein, 9 aa, Homo Sapiens
FTTIMIQYR

SEQ ID NO: 109979 - protein, 9 aa, Homo Sapiens
LSICLWWLF

SEQ ID NO: 109980 - protein, 9 aa, Homo Sapiens
QKCEQMLQN

SEQ ID NO: 109981 - protein, 9 aa, Homo Sapiens
RTLQGIGYS

SEQ ID NO: 109982 - protein, 9 aa, Homo Sapiens
HLLFCQENG

SEQ ID NO: 109983 - protein, 9 aa, Homo Sapiens
SISLQFLIV

SEQ ID NO: 109984 - protein, 9 aa, Homo Sapiens
AEIREEHGE

SEQ ID NO: 109985 - protein, 9 aa, Homo Sapiens
NGKKRHSSS

SEQ ID NO: 109986 - protein, 9 aa, Homo Sapiens
GRRSAQPLN

SEQ ID NO: 109987 - protein, 9 aa, Homo Sapiens
CSQTTKKAS

SEQ ID NO: 109988 - protein, 9 aa, Homo Sapiens
PSGPKLCNS

SEQ ID NO: 109989 - protein, 9 aa, Homo Sapiens
CPILALSCM

SEQ ID NO: 109990 - protein, 9 aa, Homo Sapiens
SDKEVSELE

SEQ ID NO: 109991 - protein, 9 aa, Homo Sapiens
LWLHCDACE

SEQ ID NO: 109992 - protein, 9 aa, Homo Sapiens
EEHGEKVSE

SEQ ID NO: 109993 - protein, 9 aa, Homo Sapiens
NGETIEKIT

SEQ ID NO: 109994 - protein, 9 aa, Homo Sapiens
SQEGRQELS

SEQ ID NO: 109995 - protein, 9 aa, Homo Sapiens
VNSHCFPAL

SEQ ID NO: 109996 - protein, 9 aa, Homo Sapiens
GHATSLSVT

SEQ ID NO: 109997 - protein, 9 aa, Homo Sapiens
KTCLTPGQH

SEQ ID NO: 109998 - protein, 9 aa, Homo Sapiens
FVWIINTDL

SEQ ID NO: 109999 - protein, 9 aa, Homo Sapiens
SPLTHRSIH

SEQ ID NO: 110000 - protein, 9 aa, Homo Sapiens
HPPPTKGGL

SEQ ID NO: 110001 - protein, 9 aa, Homo Sapiens
SQPSQAVGK

SEQ ID NO: 110002 - protein, 9 aa, Homo Sapiens
LLNRVKWTR

SEQ ID NO: 110003 - protein, 9 aa, Homo Sapiens
PKKPTTPTK

SEQ ID NO: 110004 - protein, 9 aa, Homo Sapiens
LGPGVNYSV

SEQ ID NO: 110005 - protein, 9 aa, Homo Sapiens
VSELEEIFR

SEQ ID NO: 110006 - protein, 9 aa, Homo Sapiens
TCPILALSC

SEQ ID NO: 110007 - protein, 9 aa, Homo Sapiens
KEVSELEEI

SEQ ID NO: 110008 - protein, 9 aa, Homo Sapiens
KLRKLQEQS

SEQ ID NO: 110009 - protein, 9 aa, Homo Sapiens
NIMGSQNNL

SEQ ID NO: 110010 - protein, 9 aa, Homo Sapiens
QKGLKKLLN

SEQ ID NO: 110011 - protein, 9 aa, Homo Sapiens
SNIMGSQNN

SEQ ID NO: 110012 - protein, 9 aa, Homo Sapiens
KGYIPKSPE

SEQ ID NO: 110013 - protein, 9 aa, Homo Sapiens
EHMLKKAHK

SEQ ID NO: 110014 - protein, 9 aa, Homo Sapiens
YQAYYRQKN

SEQ ID NO: 110015 - protein, 9 aa, Homo Sapiens
YSRKASERQ

SEQ ID NO: 110016 - protein, 9 aa, Homo Sapiens
NSSSQGDIT

SEQ ID NO: 110017 - protein, 9 aa, Homo Sapiens
IINTDLKGR

SEQ ID NO: 110018 - protein, 9 aa, Homo Sapiens
MQHAAELRD

SEQ ID NO: 110019 - protein, 9 aa, Homo Sapiens
SEDVFGTKD

SEQ ID NO: 110020 - protein, 9 aa, Homo Sapiens
HGYSDLDSK

SEQ ID NO: 110021 - protein, 9 aa, Homo Sapiens
AFTEDETSS

SEQ ID NO: 110022 - protein, 9 aa, Homo Sapiens
MYQDAIGLE

SEQ ID NO: 110023 - protein, 9 aa, Homo Sapiens
IREFETRIG

SEQ ID NO: 110024 - protein, 9 aa, Homo Sapiens
EMQGGKYLQ

SEQ ID NO: 110025 - protein, 9 aa, Homo Sapiens
GILLPWGPG

SEQ ID NO: 110026 - protein, 9 aa, Homo Sapiens
YHAHMVIHS

SEQ ID NO: 110027 - protein, 9 aa, Homo Sapiens
VPSYTETPW

SEQ ID NO: 110028 - protein, 9 aa, Homo Sapiens
ETKILKKSQ

SEQ ID NO: 110029 - protein, 9 aa, Homo Sapiens
QEQSKRVSQ

SEQ ID NO: 110030 - protein, 9 aa, Homo Sapiens
LCTTIMNNI

SEQ ID NO: 110031 - protein, 9 aa, Homo Sapiens
FSNIVTAKE

SEQ ID NO: 110032 - protein, 9 aa, Homo Sapiens
AKAGKGMHA

SEQ ID NO: 110033 - protein, 9 aa, Homo Sapiens
TKDLCKLQA

SEQ ID NO: 110034 - protein, 9 aa, Homo Sapiens
PFLLACAEL

SEQ ID NO: 110035 - protein, 9 aa, Homo Sapiens
KKYEYEQEE

SEQ ID NO: 110036 - protein, 9 aa, Homo Sapiens
HQEERLGVA

SEQ ID NO: 110037 - protein, 9 aa, Homo Sapiens
AMYQDAIGL

SEQ ID NO: 110038 - protein, 9 aa, Homo Sapiens
ILLPWGPGL

SEQ ID NO: 110039 - protein, 9 aa, Homo Sapiens
KLAEKLLCM

SEQ ID NO: 110040 - protein, 9 aa, Homo Sapiens
FTEDETSSI

SEQ ID NO: 110041 - protein, 9 aa, Homo Sapiens
RNGVNCFEI

SEQ ID NO: 110042 - protein, 9 aa, Homo Sapiens
FETPAASWC

SEQ ID NO: 110043 - protein, 9 aa, Homo Sapiens
QTLNPFLLA

SEQ ID NO: 110044 - protein, 9 aa, Homo Sapiens
YTETPWYPD

SEQ ID NO: 110045 - protein, 9 aa, Homo Sapiens
CRDAALLAL

SEQ ID NO: 110046 - protein, 9 aa, Homo Sapiens
FARNGSCFL

SEQ ID NO: 110047 - protein, 9 aa, Homo Sapiens
MALPFQPEH

SEQ ID NO: 110048 - protein, 9 aa, Homo Sapiens
SGYDLKETG

SEQ ID NO: 110049 - protein, 9 aa, Homo Sapiens
KKGYIPKSP

SEQ ID NO: 110050 - protein, 9 aa, Homo Sapiens
DDPKYGSSA

SEQ ID NO: 110051 - protein, 9 aa, Homo Sapiens
SGILLPWGP

SEQ ID NO: 110052 - protein, 9 aa, Homo Sapiens
QGGKYLQLG

SEQ ID NO: 110053 - protein, 9 aa, Homo Sapiens
KQSNIMGSQ

SEQ ID NO: 110054 - protein, 9 aa, Homo Sapiens
HQYSEAAIN

SEQ ID NO: 110055 - protein, 9 aa, Homo Sapiens
VGLGKSSVW

SEQ ID NO: 110056 - protein, 9 aa, Homo Sapiens
NKSEDVFGT

SEQ ID NO: 110057 - protein, 9 aa, Homo Sapiens
LKVSPLTHR

SEQ ID NO: 110058 - protein, 9 aa, Homo Sapiens
EKWLNESEL

SEQ ID NO: 110059 - protein, 9 aa, Homo Sapiens
LMKLKKVNK

SEQ ID NO: 110060 - protein, 9 aa, Homo Sapiens
ATNRRVFFR

SEQ ID NO: 110061 - protein, 9 aa, Homo Sapiens
KILKKSQIE

SEQ ID NO: 110062 - protein, 9 aa, Homo Sapiens
RDISFIDII

SEQ ID NO: 110063 - protein, 9 aa, Homo Sapiens
QHAAELRDA

SEQ ID NO: 110064 - protein, 9 aa, Homo Sapiens
LMIQIDIMV

SEQ ID NO: 110065 - protein, 9 aa, Homo Sapiens
SSLHAQSES

SEQ ID NO: 110066 - protein, 9 aa, Homo Sapiens
ARNVALQAY

SEQ ID NO: 110067 - protein, 9 aa, Homo Sapiens
GTCYVFSGD

SEQ ID NO: 110068 - protein, 9 aa, Homo Sapiens
LPSNSSSQG

SEQ ID NO: 110069 - protein, 9 aa, Homo Sapiens
QGMQEALLC

SEQ ID NO: 110070 - protein, 9 aa, Homo Sapiens
FRPDGKLIY

SEQ ID NO: 110071 - protein, 9 aa, Homo Sapiens
GAAPPFQPA

SEQ ID NO: 110072 - protein, 9 aa, Homo Sapiens
TSSEEVNMS

SEQ ID NO: 110073 - protein, 9 aa, Homo Sapiens
ISKTKDLCK

SEQ ID NO: 110074 - protein, 9 aa, Homo Sapiens
QLLPKTYIV

SEQ ID NO: 110075 - protein, 9 aa, Homo Sapiens
LSSFLEDDP

SEQ ID NO: 110076 - protein, 9 aa, Homo Sapiens
IAPYCVEIK

SEQ ID NO: 110077 - protein, 9 aa, Homo Sapiens
VRHFFCDTC

SEQ ID NO: 110078 - protein, 9 aa, Homo Sapiens
YEYSLVQGP

SEQ ID NO: 110079 - protein, 9 aa, Homo Sapiens
LASGILLPW

SEQ ID NO: 110080 - protein, 9 aa, Homo Sapiens
ASGILLPWG

SEQ ID NO: 110081 - protein, 9 aa, Homo Sapiens
VAVCRDAAL

SEQ ID NO: 110082 - protein, 9 aa, Homo Sapiens
KESGLSKWI

SEQ ID NO: 110083 - protein, 9 aa, Homo Sapiens
EAQGYKNLN

SEQ ID NO: 110084 - protein, 9 aa, Homo Sapiens
LPFQPEHRD

SEQ ID NO: 110085 - protein, 9 aa, Homo Sapiens
SNSGRRSAQ

SEQ ID NO: 110086 - protein, 9 aa, Homo Sapiens
CFPALLAIP

SEQ ID NO: 110087 - protein, 9 aa, Homo Sapiens
KIEDKKVHR

SEQ ID NO: 110088 - protein, 9 aa, Homo Sapiens
NLLTQGQTQ

SEQ ID NO: 110089 - protein, 9 aa, Homo Sapiens
ALRPVIRPN

SEQ ID NO: 110090 - protein, 9 aa, Homo Sapiens
KDLYEYSLV

SEQ ID NO: 110091 - protein, 9 aa, Homo Sapiens
LSLLSWLGG

SEQ ID NO: 110092 - protein, 9 aa, Homo Sapiens
RNVLERLAK

SEQ ID NO: 110093 - protein, 9 aa, Homo Sapiens
EECIVTLEG

SEQ ID NO: 110094 - protein, 9 aa, Homo Sapiens
KAELKETPC

SEQ ID NO: 110095 - protein, 9 aa, Homo Sapiens
NLNEFEEDF

SEQ ID NO: 110096 - protein, 9 aa, Homo Sapiens
VWIINTDLK

SEQ ID NO: 110097 - protein, 9 aa, Homo Sapiens
SYNEASGYV

SEQ ID NO: 110098 - protein, 9 aa, Homo Sapiens
SSLCFSSEE

SEQ ID NO: 110099 - protein, 9 aa, Homo Sapiens
SYSSLCFSS

SEQ ID NO: 110100 - protein, 9 aa, Homo Sapiens
EGCFSDMAI

SEQ ID NO: 110101 - protein, 9 aa, Homo Sapiens
DLHRAIQST

SEQ ID NO: 110102 - protein, 9 aa, Homo Sapiens
WLNLLLEYK

SEQ ID NO: 110103 - protein, 9 aa, Homo Sapiens
SNKETAGMV

SEQ ID NO: 110104 - protein, 9 aa, Homo Sapiens
DSYTDSVKK

SEQ ID NO: 110105 - protein, 9 aa, Homo Sapiens
HDAAKRAQS

SEQ ID NO: 110106 - protein, 9 aa, Homo Sapiens
DVPCIFRVT

SEQ ID NO: 110107 - protein, 9 aa, Homo Sapiens
LERLAKNLV

SEQ ID NO: 110108 - protein, 9 aa, Homo Sapiens
YDAGIAMYQ

SEQ ID NO: 110109 - protein, 9 aa, Homo Sapiens
DVFGTKDVT

SEQ ID NO: 110110 - protein, 9 aa, Homo Sapiens
KTKKYEYEQ

SEQ ID NO: 110111 - protein, 9 aa, Homo Sapiens
LVYPALNFI

SEQ ID NO: 110112 - protein, 9 aa, Homo Sapiens
QSQMEHAME

SEQ ID NO: 110113 - protein, 9 aa, Homo Sapiens
MFSVFDEIT

SEQ ID NO: 110114 - protein, 9 aa, Homo Sapiens
QEECEEMSE

SEQ ID NO: 110115 - protein, 9 aa, Homo Sapiens
KSSVWTSHR

SEQ ID NO: 110116 - protein, 9 aa, Homo Sapiens
EESEHMLKK

SEQ ID NO: 110117 - protein, 9 aa, Homo Sapiens
QVYFYIFKL

SEQ ID NO: 110118 - protein, 9 aa, Homo Sapiens
VVCMFILCW

SEQ ID NO: 110119 - protein, 9 aa, Homo Sapiens
TPGAGVSHK

SEQ ID NO: 110120 - protein, 9 aa, Homo Sapiens
GLLCCPHER

SEQ ID NO: 110121 - protein, 9 aa, Homo Sapiens
FGLGLLLLS

SEQ ID NO: 110122 - protein, 9 aa, Homo Sapiens
GIAMYQDAI

SEQ ID NO: 110123 - protein, 9 aa, Homo Sapiens
QMELIEYKT

SEQ ID NO: 110124 - protein, 9 aa, Homo Sapiens
SSKQIKQLE

SEQ ID NO: 110125 - protein, 9 aa, Homo Sapiens
SAFRELEHT

SEQ ID NO: 110126 - protein, 9 aa, Homo Sapiens
LRPVIRPNV

SEQ ID NO: 110127 - protein, 9 aa, Homo Sapiens
LTCRNLLTQ

SEQ ID NO: 110128 - protein, 9 aa, Homo Sapiens
LQEQSKRVS

SEQ ID NO: 110129 - protein, 9 aa, Homo Sapiens
SVFTTIMIQ

SEQ ID NO: 110130 - protein, 9 aa, Homo Sapiens
IEESEHMLK

SEQ ID NO: 110131 - protein, 9 aa, Homo Sapiens
SCCKPSCCM

SEQ ID NO: 110132 - protein, 9 aa, Homo Sapiens
HGDDASEKK

SEQ ID NO: 110133 - protein, 9 aa, Homo Sapiens
ELKETPCIL

SEQ ID NO: 110134 - protein, 9 aa, Homo Sapiens
QYSEAAINR

SEQ ID NO: 110135 - protein, 9 aa, Homo Sapiens
CQGKPTRGE

SEQ ID NO: 110136 - protein, 9 aa, Homo Sapiens
CSSSSKLSS

SEQ ID NO: 110137 - protein, 9 aa, Homo Sapiens
YKMSSPRVV

SEQ ID NO: 110138 - protein, 9 aa, Homo Sapiens
PALLAIPPT

SEQ ID NO: 110139 - protein, 9 aa, Homo Sapiens
ETQEITGDD

SEQ ID NO: 110140 - protein, 9 aa, Homo Sapiens
SGHLAKSLD

SEQ ID NO: 110141 - protein, 9 aa, Homo Sapiens
PSCCMTTCC

SEQ ID NO: 110142 - protein, 9 aa, Homo Sapiens
AIQSTQSAM

SEQ ID NO: 110143 - protein, 9 aa, Homo Sapiens
PPKKPTTPT

SEQ ID NO: 110144 - protein, 9 aa, Homo Sapiens
SKYKRSSCG

SEQ ID NO: 110145 - protein, 9 aa, Homo Sapiens
TCRNLLTQG

SEQ ID NO: 110146 - protein, 9 aa, Homo Sapiens
VQKLIVYHP

SEQ ID NO: 110147 - protein, 9 aa, Homo Sapiens
ASDADDPKY

SEQ ID NO: 110148 - protein, 9 aa, Homo Sapiens
HFYYRTNCD

SEQ ID NO: 110149 - protein, 9 aa, Homo Sapiens
MLLNFLDTY

SEQ ID NO: 110150 - protein, 9 aa, Homo Sapiens
ERPKTISPG

SEQ ID NO: 110151 - protein, 9 aa, Homo Sapiens
KVHRESKLT

SEQ ID NO: 110152 - protein, 9 aa, Homo Sapiens
NMSHIVPCE

SEQ ID NO: 110153 - protein, 9 aa, Homo Sapiens
CKITFCKTK

SEQ ID NO: 110154 - protein, 9 aa, Homo Sapiens
WGPGLHDPC

SEQ ID NO: 110155 - protein, 9 aa, Homo Sapiens
QKLIVYHPP

SEQ ID NO: 110156 - protein, 9 aa, Homo Sapiens
NKGSSYKLM

SEQ ID NO: 110157 - protein, 9 aa, Homo Sapiens
EMIQLHHTA

SEQ ID NO: 110158 - protein, 9 aa, Homo Sapiens
CSTPLIEAA

SEQ ID NO: 110159 - protein, 9 aa, Homo Sapiens
LEKWLNESE

SEQ ID NO: 110160 - protein, 9 aa, Homo Sapiens
VLERLAKNL

SEQ ID NO: 110161 - protein, 9 aa, Homo Sapiens
PDYQSYFLT

SEQ ID NO: 110162 - protein, 9 aa, Homo Sapiens
REEHGEKVS

SEQ ID NO: 110163 - protein, 9 aa, Homo Sapiens
RNGSCFLIN

SEQ ID NO: 110164 - protein, 9 aa, Homo Sapiens
KRPRDSPGP

SEQ ID NO: 110165 - protein, 9 aa, Homo Sapiens
STKLAEKLL

SEQ ID NO: 110166 - protein, 9 aa, Homo Sapiens
RTTHGVRIV

SEQ ID NO: 110167 - protein, 9 aa, Homo Sapiens
ELALMYNTQ

SEQ ID NO: 110168 - protein, 9 aa, Homo Sapiens
ALLCTTIMN

SEQ ID NO: 110169 - protein, 9 aa, Homo Sapiens
DETSSIKMD

SEQ ID NO: 110170 - protein, 9 aa, Homo Sapiens
GCKESGLSK

SEQ ID NO: 110171 - protein, 9 aa, Homo Sapiens
ILYQAYYRQ

SEQ ID NO: 110172 - protein, 9 aa, Homo Sapiens
YSSLCFSSE

SEQ ID NO: 110173 - protein, 9 aa, Homo Sapiens
LLCTTIMNN

SEQ ID NO: 110174 - protein, 9 aa, Homo Sapiens
SKTKDLCKL

SEQ ID NO: 110175 - protein, 9 aa, Homo Sapiens
ETSSIKMDR

SEQ ID NO: 110176 - protein, 9 aa, Homo Sapiens
LDFICVNIL

SEQ ID NO: 110177 - protein, 9 aa, Homo Sapiens
CYVFSGDLA

SEQ ID NO: 110178 - protein, 9 aa, Homo Sapiens
LEYKKHMET

SEQ ID NO: 110179 - protein, 9 aa, Homo Sapiens
AFCKHYSSQ

SEQ ID NO: 110180 - protein, 9 aa, Homo Sapiens
GKLLMKLKK

SEQ ID NO: 110181 - protein, 9 aa, Homo Sapiens
SQQLWLHCD

SEQ ID NO: 110182 - protein, 9 aa, Homo Sapiens
DASEKKAAN

SEQ ID NO: 110183 - protein, 9 aa, Homo Sapiens
CKPSCCMTT

SEQ ID NO: 110184 - protein, 9 aa, Homo Sapiens
VINLDDATF

SEQ ID NO: 110185 - protein, 9 aa, Homo Sapiens
REKRPRDSP

SEQ ID NO: 110186 - protein, 9 aa, Homo Sapiens
LQGIGYSFS

SEQ ID NO: 110187 - protein, 9 aa, Homo Sapiens
CDTCPILAL

SEQ ID NO: 110188 - protein, 9 aa, Homo Sapiens
SNTRIPEQM

SEQ ID NO: 110189 - protein, 9 aa, Homo Sapiens
CAALYEGLL

SEQ ID NO: 110190 - protein, 9 aa, Homo Sapiens
GYSFSSVAG

SEQ ID NO: 110191 - protein, 9 aa, Homo Sapiens
VYFYIFKLL

SEQ ID NO: 110192 - protein, 9 aa, Homo Sapiens
AKKNLHVIN

SEQ ID NO: 110193 - protein, 9 aa, Homo Sapiens
TFYDVYSRK

SEQ ID NO: 110194 - protein, 9 aa, Homo Sapiens
YRQKNPSKE

SEQ ID NO: 110195 - protein, 9 aa, Homo Sapiens
TKQVYFYIF

SEQ ID NO: 110196 - protein, 9 aa, Homo Sapiens
ALMWTKKFS

SEQ ID NO: 110197 - protein, 9 aa, Homo Sapiens
VFDEITRIV

SEQ ID NO: 110198 - protein, 9 aa, Homo Sapiens
LAMLLNFLD

SEQ ID NO: 110199 - protein, 9 aa, Homo Sapiens
TLGIVVCMF

SEQ ID NO: 110200 - protein, 9 aa, Homo Sapiens
IIKDLKLCV

SEQ ID NO: 110201 - protein, 9 aa, Homo Sapiens
GDPYFDDID

SEQ ID NO: 110202 - protein, 9 aa, Homo Sapiens
SRFHESYNF

SEQ ID NO: 110203 - protein, 9 aa, Homo Sapiens
NYHQYSEAA

SEQ ID NO: 110204 - protein, 9 aa, Homo Sapiens
TPTKASNLL

SEQ ID NO: 110205 - protein, 9 aa, Homo Sapiens
SAQPLNLTG

SEQ ID NO: 110206 - protein, 9 aa, Homo Sapiens
IVAVCRDAA

SEQ ID NO: 110207 - protein, 9 aa, Homo Sapiens
THETAFLGQ

SEQ ID NO: 110208 - protein, 9 aa, Homo Sapiens
VQPNDVQCH

SEQ ID NO: 110209 - protein, 9 aa, Homo Sapiens
TLNPFLLAC

SEQ ID NO: 110210 - protein, 9 aa, Homo Sapiens
STETKILKK

SEQ ID NO: 110211 - protein, 9 aa, Homo Sapiens
VTIHKLSEE

SEQ ID NO: 110212 - protein, 9 aa, Homo Sapiens
LFANLSICL

SEQ ID NO: 110213 - protein, 9 aa, Homo Sapiens
NRRVFFRNI

SEQ ID NO: 110214 - protein, 9 aa, Homo Sapiens
PTVDNEEEM

SEQ ID NO: 110215 - protein, 9 aa, Homo Sapiens
LLTQGQTQD

SEQ ID NO: 110216 - protein, 9 aa, Homo Sapiens
SHCFPALLA

SEQ ID NO: 110217 - protein, 9 aa, Homo Sapiens
LRKLQEQSK

SEQ ID NO: 110218 - protein, 9 aa, Homo Sapiens
GAGVSHKKA

SEQ ID NO: 110219 - protein, 9 aa, Homo Sapiens
SVTAVTIHK

SEQ ID NO: 110220 - protein, 9 aa, Homo Sapiens
VHFYYRTNC

SEQ ID NO: 110221 - protein, 9 aa, Homo Sapiens
TVDNEEEML

SEQ ID NO: 110222 - protein, 9 aa, Homo Sapiens
KVVSMEDDG

SEQ ID NO: 110223 - protein, 9 aa, Homo Sapiens
HATRRDVPC

SEQ ID NO: 110224 - protein, 9 aa, Homo Sapiens
HGEKVSERP

SEQ ID NO: 110225 - protein, 9 aa, Homo Sapiens
PGVNYSVCQ

SEQ ID NO: 110226 - protein, 9 aa, Homo Sapiens
SPRVVSPNY

SEQ ID NO: 110227 - protein, 9 aa, Homo Sapiens
SFEKVGCQG

SEQ ID NO: 110228 - protein, 9 aa, Homo Sapiens
CNSHINSNS

SEQ ID NO: 110229 - protein, 9 aa, Homo Sapiens
AGVSHKKAH

SEQ ID NO: 110230 - protein, 9 aa, Homo Sapiens
VTAVTIHKL

SEQ ID NO: 110231 - protein, 9 aa, Homo Sapiens
YFQVGWTIF

SEQ ID NO: 110232 - protein, 9 aa, Homo Sapiens
GPCAFRRLA

SEQ ID NO: 110233 - protein, 9 aa, Homo Sapiens
LNESELRNQ

SEQ ID NO: 110234 - protein, 9 aa, Homo Sapiens
TETKILKKS

SEQ ID NO: 110235 - protein, 9 aa, Homo Sapiens
PLTHRSIHT

SEQ ID NO: 110236 - protein, 9 aa, Homo Sapiens
QQIAAKQKC

SEQ ID NO: 110237 - protein, 9 aa, Homo Sapiens
AYNWVKALR

SEQ ID NO: 110238 - protein, 9 aa, Homo Sapiens
AYKRRTKKE

SEQ ID NO: 110239 - protein, 9 aa, Homo Sapiens
ALPFQPEHR

SEQ ID NO: 110240 - protein, 9 aa, Homo Sapiens
EKTAAYLCQ

SEQ ID NO: 110241 - protein, 9 aa, Homo Sapiens
SCHKNIVGY

SEQ ID NO: 110242 - protein, 9 aa, Homo Sapiens
VLIKKSYDQ

SEQ ID NO: 110243 - protein, 9 aa, Homo Sapiens
ALWAEIRQE

SEQ ID NO: 110244 - protein, 9 aa, Homo Sapiens
NSFFETPAA

SEQ ID NO: 110245 - protein, 9 aa, Homo Sapiens
GLFANLSIC

SEQ ID NO: 110246 - protein, 9 aa, Homo Sapiens
VKALRPVIR

SEQ ID NO: 110247 - protein, 9 aa, Homo Sapiens
SDCVLQCEE

SEQ ID NO: 110248 - protein, 9 aa, Homo Sapiens
TCRLHVLLQ

SEQ ID NO: 110249 - protein, 9 aa, Homo Sapiens
LIYIFVQVD

SEQ ID NO: 110250 - protein, 9 aa, Homo Sapiens
RTQTKPSSL

SEQ ID NO: 110251 - protein, 9 aa, Homo Sapiens
GCFSDMAIT

SEQ ID NO: 110252 - protein, 9 aa, Homo Sapiens
HMLKKAHKY

SEQ ID NO: 110253 - protein, 9 aa, Homo Sapiens
PTLVGESQP

SEQ ID NO: 110254 - protein, 9 aa, Homo Sapiens
LSWLGGEGI

SEQ ID NO: 110255 - protein, 9 aa, Homo Sapiens
DAALLALEE

SEQ ID NO: 110256 - protein, 9 aa, Homo Sapiens
SIFSYTELM

SEQ ID NO: 110257 - protein, 9 aa, Homo Sapiens
QGQTQDEIS

SEQ ID NO: 110258 - protein, 9 aa, Homo Sapiens
MFRNGKKRH

SEQ ID NO: 110259 - protein, 9 aa, Homo Sapiens
PLIEAAQEG

SEQ ID NO: 110260 - protein, 9 aa, Homo Sapiens
VSKPCALRR

SEQ ID NO: 110261 - protein, 9 aa, Homo Sapiens
KQKCEQMLQ

SEQ ID NO: 110262 - protein, 9 aa, Homo Sapiens
ELSCHKNIV

SEQ ID NO: 110263 - protein, 9 aa, Homo Sapiens
DKKVHRESK

SEQ ID NO: 110264 - protein, 9 aa, Homo Sapiens
GGKYLQLGD

SEQ ID NO: 110265 - protein, 9 aa, Homo Sapiens
AVCRDAALL

SEQ ID NO: 110266 - protein, 9 aa, Homo Sapiens
RQNYHQYSE

SEQ ID NO: 110267 - protein, 9 aa, Homo Sapiens
QAMRRYMLL

SEQ ID NO: 110268 - protein, 9 aa, Homo Sapiens
LNRTTHGVR

SEQ ID NO: 110269 - protein, 9 aa, Homo Sapiens
CCMTTCCRP

SEQ ID NO: 110270 - protein, 9 aa, Homo Sapiens
VYHPPPTKG

SEQ ID NO: 110271 - protein, 9 aa, Homo Sapiens
LLQEEFPGH

SEQ ID NO: 110272 - protein, 9 aa, Homo Sapiens
VILKTCLTP

SEQ ID NO: 110273 - protein, 9 aa, Homo Sapiens
KSYDQTKRQ

SEQ ID NO: 110274 - protein, 9 aa, Homo Sapiens
LPWGPGLHD

SEQ ID NO: 110275 - protein, 9 aa, Homo Sapiens
TKKYEYEQE

SEQ ID NO: 110276 - protein, 9 aa, Homo Sapiens
CTFVWIINT

SEQ ID NO: 110277 - protein, 9 aa, Homo Sapiens
SGRRSAQPL

SEQ ID NO: 110278 - protein, 9 aa, Homo Sapiens
NFGLGLLLL

SEQ ID NO: 110279 - protein, 9 aa, Homo Sapiens
CCDLGKLLM

SEQ ID NO: 110280 - protein, 9 aa, Homo Sapiens
LRNVLERLA

SEQ ID NO: 110281 - protein, 9 aa, Homo Sapiens
KKLLNRVKW

SEQ ID NO: 110282 - protein, 9 aa, Homo Sapiens
ECIVTLEGL

SEQ ID NO: 110283 - protein, 9 aa, Homo Sapiens
APDVNGGLY

SEQ ID NO: 110284 - protein, 9 aa, Homo Sapiens
KDLKLCVSQ

SEQ ID NO: 110285 - protein, 9 aa, Homo Sapiens
QAYLIKPHS

SEQ ID NO: 110286 - protein, 9 aa, Homo Sapiens
DGCKESGLS

SEQ ID NO: 110287 - protein, 9 aa, Homo Sapiens
SIRRPSSWN

SEQ ID NO: 110288 - protein, 9 aa, Homo Sapiens
TGILYNERK

SEQ ID NO: 110289 - protein, 9 aa, Homo Sapiens
FSYNEASGY

SEQ ID NO: 110290 - protein, 9 aa, Homo Sapiens
LMYNTQRAA

SEQ ID NO: 110291 - protein, 9 aa, Homo Sapiens
KTAAYLCQS

SEQ ID NO: 110292 - protein, 9 aa, Homo Sapiens
SKFGFAICS

SEQ ID NO: 110293 - protein, 9 aa, Homo Sapiens
NGVNCFEIE

SEQ ID NO: 110294 - protein, 9 aa, Homo Sapiens
KPEKHLLFC

SEQ ID NO: 110295 - protein, 9 aa, Homo Sapiens
YQTWLDIRE

SEQ ID NO: 110296 - protein, 9 aa, Homo Sapiens
YEYEQEETR

SEQ ID NO: 110297 - protein, 9 aa, Homo Sapiens
SNQRLQLIF

SEQ ID NO: 110298 - protein, 9 aa, Homo Sapiens
NARNVALQA

SEQ ID NO: 110299 - protein, 9 aa, Homo Sapiens
KLCVSQQTI

SEQ ID NO: 110300 - protein, 9 aa, Homo Sapiens
TAILSSLIA

SEQ ID NO: 110301 - protein, 9 aa, Homo Sapiens
SHDAAKRAQ

SEQ ID NO: 110302 - protein, 9 aa, Homo Sapiens
RRYMLLGQG

SEQ ID NO: 110303 - protein, 9 aa, Homo Sapiens
VFTTIMIQY

SEQ ID NO: 110304 - protein, 9 aa, Homo Sapiens
SKEPGTGGA

SEQ ID NO: 110305 - protein, 9 aa, Homo Sapiens
ITRLQMELI

SEQ ID NO: 110306 - protein, 9 aa, Homo Sapiens
AASCKREKR

SEQ ID NO: 110307 - protein, 9 aa, Homo Sapiens
VYSDCVLQC

SEQ ID NO: 110308 - protein, 9 aa, Homo Sapiens
PCHSGYDLK

SEQ ID NO: 110309 - protein, 9 aa, Homo Sapiens
LYEYSLVQG

SEQ ID NO: 110310 - protein, 9 aa, Homo Sapiens
NWVKALRPV

SEQ ID NO: 110311 - protein, 9 aa, Homo Sapiens
ATGILYNER

SEQ ID NO: 110312 - protein, 9 aa, Homo Sapiens
QILYQAYYR

SEQ ID NO: 110313 - protein, 9 aa, Homo Sapiens
YTDSVKKEN

SEQ ID NO: 110314 - protein, 9 aa, Homo Sapiens
KEFRLKQSN

SEQ ID NO: 110315 - protein, 9 aa, Homo Sapiens
PEGSKAELK

SEQ ID NO: 110316 - protein, 9 aa, Homo Sapiens
KRRTKKELA

SEQ ID NO: 110317 - protein, 9 aa, Homo Sapiens
EQEETRQVY

SEQ ID NO: 110318 - protein, 9 aa, Homo Sapiens
CHSGYDLKE

SEQ ID NO: 110319 - protein, 9 aa, Homo Sapiens
QVATGILYN

SEQ ID NO: 110320 - protein, 9 aa, Homo Sapiens
GKGMHAGVP

SEQ ID NO: 110321 - protein, 9 aa, Homo Sapiens
YISIFSYTE

SEQ ID NO: 110322 - protein, 9 aa, Homo Sapiens
DALWAEIRQ

SEQ ID NO: 110323 - protein, 9 aa, Homo Sapiens
HSENLPDPN

SEQ ID NO: 110324 - protein, 9 aa, Homo Sapiens
ATRRDVPCI

SEQ ID NO: 110325 - protein, 9 aa, Homo Sapiens
GNFSDKEVS

SEQ ID NO: 110326 - protein, 9 aa, Homo Sapiens
TIKPEKHLL

SEQ ID NO: 110327 - protein, 9 aa, Homo Sapiens
KCEQMLQNP

SEQ ID NO: 110328 - protein, 9 aa, Homo Sapiens
NFSDKEVSE

SEQ ID NO: 110329 - protein, 9 aa, Homo Sapiens
KYLQLGDER

SEQ ID NO: 110330 - protein, 9 aa, Homo Sapiens
QKIAPYCVE

SEQ ID NO: 110331 - protein, 9 aa, Homo Sapiens
SVPCLRGAA

SEQ ID NO: 110332 - protein, 9 aa, Homo Sapiens
SLHAQSESE

SEQ ID NO: 110333 - protein, 9 aa, Homo Sapiens
LKKLLNRVK

SEQ ID NO: 110334 - protein, 9 aa, Homo Sapiens
LHVLLQEEF

SEQ ID NO: 110335 - protein, 9 aa, Homo Sapiens
FYISIFSYT

SEQ ID NO: 110336 - protein, 9 aa, Homo Sapiens
SDADDPKYG

SEQ ID NO: 110337 - protein, 9 aa, Homo Sapiens
RWLKETQEI

SEQ ID NO: 110338 - protein, 9 aa, Homo Sapiens
LSSTKLAEK

SEQ ID NO: 110339 - protein, 9 aa, Homo Sapiens
SSLIAEREA

SEQ ID NO: 110340 - protein, 9 aa, Homo Sapiens
ETIEKITNS

SEQ ID NO: 110341 - protein, 9 aa, Homo Sapiens
MSQALLVPP

SEQ ID NO: 110342 - protein, 9 aa, Homo Sapiens
LIEAAQEGH

SEQ ID NO: 110343 - protein, 9 aa, Homo Sapiens
GALMWTKKF

SEQ ID NO: 110344 - protein, 9 aa, Homo Sapiens
YNWVKALRP

SEQ ID NO: 110345 - protein, 9 aa, Homo Sapiens
SVILKTCLT

SEQ ID NO: 110346 - protein, 9 aa, Homo Sapiens
DLSHRPKRS

SEQ ID NO: 110347 - protein, 9 aa, Homo Sapiens
ALLAIPPTQ

SEQ ID NO: 110348 - protein, 9 aa, Homo Sapiens
AATRVGLGK

SEQ ID NO: 110349 - protein, 9 aa, Homo Sapiens
VDGLFLVLE

SEQ ID NO: 110350 - protein, 9 aa, Homo Sapiens
AGDPYFDDI

SEQ ID NO: 110351 - protein, 9 aa, Homo Sapiens
PTTPTKASN

SEQ ID NO: 110352 - protein, 9 aa, Homo Sapiens
AGKGMHAGV

SEQ ID NO: 110353 - protein, 9 aa, Homo Sapiens
GGPGGVTHQ

SEQ ID NO: 110354 - protein, 9 aa, Homo Sapiens
YSLVQGPLH

SEQ ID NO: 110355 - protein, 9 aa, Homo Sapiens
SFFETPAAS

SEQ ID NO: 110356 - protein, 9 aa, Homo Sapiens
LQDELEFEK

SEQ ID NO: 110357 - protein, 9 aa, Homo Sapiens
LKETPCILS

SEQ ID NO: 110358 - protein, 9 aa, Homo Sapiens
PQQVVEGCF

SEQ ID NO: 110359 - protein, 9 aa, Homo Sapiens
KYGSSARLV

SEQ ID NO: 110360 - protein, 9 aa, Homo Sapiens
VALQAYLIK

SEQ ID NO: 110361 - protein, 9 aa, Homo Sapiens
CPDYQSYFL

SEQ ID NO: 110362 - protein, 9 aa, Homo Sapiens
SELEEIFRV

SEQ ID NO: 110363 - protein, 9 aa, Homo Sapiens
SEEVNMSHI

SEQ ID NO: 110364 - protein, 9 aa, Homo Sapiens
KMKSSKSEC

SEQ ID NO: 110365 - protein, 9 aa, Homo Sapiens
YMLLGQGDF

SEQ ID NO: 110366 - protein, 9 aa, Homo Sapiens
ELKSTHEQS

SEQ ID NO: 110367 - protein, 9 aa, Homo Sapiens
DAGIAMYQD

SEQ ID NO: 110368 - protein, 9 aa, Homo Sapiens
GPSPGPIFG

SEQ ID NO: 110369 - protein, 9 aa, Homo Sapiens
SSPRVVSPN

SEQ ID NO: 110370 - protein, 9 aa, Homo Sapiens
LQLIFSLLF

SEQ ID NO: 110371 - protein, 9 aa, Homo Sapiens
YDQTKRQRR

SEQ ID NO: 110372 - protein, 9 aa, Homo Sapiens
QQLWLHCDA

SEQ ID NO: 110373 - protein, 9 aa, Homo Sapiens
IQIDIMVAH

SEQ ID NO: 110374 - protein, 9 aa, Homo Sapiens
QDELEFEKE

SEQ ID NO: 110375 - protein, 9 aa, Homo Sapiens
EFSNIVTAK

SEQ ID NO: 110376 - protein, 9 aa, Homo Sapiens
DSTETKILK

SEQ ID NO: 110377 - protein, 9 aa, Homo Sapiens
DLDSKEPGT

SEQ ID NO: 110378 - protein, 9 aa, Homo Sapiens
TIKKLRKLQ

SEQ ID NO: 110379 - protein, 9 aa, Homo Sapiens
TIEKITNSR

SEQ ID NO: 110380 - protein, 9 aa, Homo Sapiens
EVNMSHIVP

SEQ ID NO: 110381 - protein, 9 aa, Homo Sapiens
KKNKSEDVF

SEQ ID NO: 110382 - protein, 9 aa, Homo Sapiens
PIFGPSPGP

SEQ ID NO: 110383 - protein, 9 aa, Homo Sapiens
SFYLFNATN

SEQ ID NO: 110384 - protein, 9 aa, Homo Sapiens
DSKEPGTGG

SEQ ID NO: 110385 - protein, 9 aa, Homo Sapiens
STGHATSLS

SEQ ID NO: 110386 - protein, 9 aa, Homo Sapiens
KMSSPRVVS

SEQ ID NO: 110387 - protein, 9 aa, Homo Sapiens
CRNLLTQGQ

SEQ ID NO: 110388 - protein, 9 aa, Homo Sapiens
FSSEESESS

SEQ ID NO: 110389 - protein, 9 aa, Homo Sapiens
GCLSLLSWL

SEQ ID NO: 110390 - protein, 9 aa, Homo Sapiens
QEGRQELSH

SEQ ID NO: 110391 - protein, 9 aa, Homo Sapiens
RRPSSWNAS

SEQ ID NO: 110392 - protein, 9 aa, Homo Sapiens
LIKKSYDQT

SEQ ID NO: 110393 - protein, 9 aa, Homo Sapiens
IKLTFGIAI

SEQ ID NO: 110394 - protein, 9 aa, Homo Sapiens
LGLLLLSKQ

SEQ ID NO: 110395 - protein, 9 aa, Homo Sapiens
PFRPSTSPC

SEQ ID NO: 110396 - protein, 9 aa, Homo Sapiens
LQAYLIKPH

SEQ ID NO: 110397 - protein, 9 aa, Homo Sapiens
EALLCTTIM

SEQ ID NO: 110398 - protein, 9 aa, Homo Sapiens
YYRTNCDSS

SEQ ID NO: 110399 - protein, 9 aa, Homo Sapiens
TAVTIHKLS

SEQ ID NO: 110400 - protein, 9 aa, Homo Sapiens
DQTKRQRRR

SEQ ID NO: 110401 - protein, 9 aa, Homo Sapiens
ALMYNTQRA

SEQ ID NO: 110402 - protein, 9 aa, Homo Sapiens
VGWTIFDSM

SEQ ID NO: 110403 - protein, 9 aa, Homo Sapiens
AKSHDAAKR

SEQ ID NO: 110404 - protein, 9 aa, Homo Sapiens
YFYIFKLLR

SEQ ID NO: 110405 - protein, 9 aa, Homo Sapiens
MFHPLVLSF

SEQ ID NO: 110406 - protein, 9 aa, Homo Sapiens
TELMCEQYV

SEQ ID NO: 110407 - protein, 9 aa, Homo Sapiens
IQPKKGYIP

SEQ ID NO: 110408 - protein, 9 aa, Homo Sapiens
AGIVQPNDV

SEQ ID NO: 110409 - protein, 9 aa, Homo Sapiens
VMLIFKIVQ

SEQ ID NO: 110410 - protein, 9 aa, Homo Sapiens
DYQTWLDIR

SEQ ID NO: 110411 - protein, 9 aa, Homo Sapiens
HVLLQEEFP

SEQ ID NO: 110412 - protein, 9 aa, Homo Sapiens
NQRLQLIFS

SEQ ID NO: 110413 - protein, 9 aa, Homo Sapiens
GSEDYESLR

SEQ ID NO: 110414 - protein, 9 aa, Homo Sapiens
LLACAELHQ

SEQ ID NO: 110415 - protein, 9 aa, Homo Sapiens
EYSLVQGPL

SEQ ID NO: 110416 - protein, 9 aa, Homo Sapiens
MASDADDPK

SEQ ID NO: 110417 - protein, 9 aa, Homo Sapiens
VVTNELEDC

SEQ ID NO: 110418 - protein, 9 aa, Homo Sapiens
SFLEDDPSD

SEQ ID NO: 110419 - protein, 9 aa, Homo Sapiens
KLSISLQFL

SEQ ID NO: 110420 - protein, 9 aa, Homo Sapiens
AIEHKSRSL

SEQ ID NO: 110421 - protein, 9 aa, Homo Sapiens
FQKAIEHKS

SEQ ID NO: 110422 - protein, 9 aa, Homo Sapiens
DNHWLHYDI

SEQ ID NO: 110423 - protein, 9 aa, Homo Sapiens
RKLQEQSKR

SEQ ID NO: 110424 - protein, 9 aa, Homo Sapiens
LHRAIQSTQ

SEQ ID NO: 110425 - protein, 9 aa, Homo Sapiens
DCDRQKAMK

SEQ ID NO: 110426 - protein, 9 aa, Homo Sapiens
QIHGIVLVH

SEQ ID NO: 110427 - protein, 9 aa, Homo Sapiens
GPKLCNSHI

SEQ ID NO: 110428 - protein, 9 aa, Homo Sapiens
RDVPCIFRV

SEQ ID NO: 110429 - protein, 9 aa, Homo Sapiens
LAGCQYYAP

SEQ ID NO: 110430 - protein, 9 aa, Homo Sapiens
GQKIAPYCV

SEQ ID NO: 110431 - protein, 9 aa, Homo Sapiens
QSNIMGSQN

SEQ ID NO: 110432 - protein, 9 aa, Homo Sapiens
EKKAANQIR

SEQ ID NO: 110433 - protein, 9 aa, Homo Sapiens
PRAPLGLGA

SEQ ID NO: 110434 - protein, 9 aa, Homo Sapiens
FDDIDDEMD

SEQ ID NO: 110435 - protein, 9 aa, Homo Sapiens
EEVNMSHIV

SEQ ID NO: 110436 - protein, 9 aa, Homo Sapiens
CDRQKAMKR

SEQ ID NO: 110437 - protein, 9 aa, Homo Sapiens
YSYSSLCFS

SEQ ID NO: 110438 - protein, 9 aa, Homo Sapiens
MQEALLCTT

SEQ ID NO: 110439 - protein, 9 aa, Homo Sapiens
SLKLQNVLE

SEQ ID NO: 110440 - protein, 9 aa, Homo Sapiens
VATGILYNE

SEQ ID NO: 110441 - protein, 9 aa, Homo Sapiens
VYNLNRTTH

SEQ ID NO: 110442 - protein, 9 aa, Homo Sapiens
PRGFPRAPL

SEQ ID NO: 110443 - protein, 9 aa, Homo Sapiens
TSSIKMDRT

SEQ ID NO: 110444 - protein, 9 aa, Homo Sapiens
CEEGSEDYE

SEQ ID NO: 110445 - protein, 9 aa, Homo Sapiens
FRELEHTAE

SEQ ID NO: 110446 - protein, 9 aa, Homo Sapiens
KKSQIEAIA

SEQ ID NO: 110447 - protein, 9 aa, Homo Sapiens
KKPTTPTKA

SEQ ID NO: 110448 - protein, 9 aa, Homo Sapiens
HAAELRDAE

SEQ ID NO: 110449 - protein, 9 aa, Homo Sapiens
SSSTQEECE

SEQ ID NO: 110450 - protein, 9 aa, Homo Sapiens
ELVQQLALQ

SEQ ID NO: 110451 - protein, 9 aa, Homo Sapiens
KKLRKLQEQ

SEQ ID NO: 110452 - protein, 9 aa, Homo Sapiens
LEDCDRQKA

SEQ ID NO: 110453 - protein, 9 aa, Homo Sapiens
MAKTLEECI

SEQ ID NO: 110454 - protein, 9 aa, Homo Sapiens
KSEDVFGTK

SEQ ID NO: 110455 - protein, 9 aa, Homo Sapiens
VTNELEDCD

SEQ ID NO: 110456 - protein, 9 aa, Homo Sapiens
KSSKSECSS

SEQ ID NO: 110457 - protein, 9 aa, Homo Sapiens
ILYKTIFQG

SEQ ID NO: 110458 - protein, 9 aa, Homo Sapiens
EHGEKVSER

SEQ ID NO: 110459 - protein, 9 aa, Homo Sapiens
SECSSSSKL

SEQ ID NO: 110460 - protein, 9 aa, Homo Sapiens
TKILKKSQI

SEQ ID NO: 110461 - protein, 9 aa, Homo Sapiens
RHFFCDTCP

SEQ ID NO: 110462 - protein, 9 aa, Homo Sapiens
SMAPDVNGG

SEQ ID NO: 110463 - protein, 9 aa, Homo Sapiens
LCVSQQTIF

SEQ ID NO: 110464 - protein, 9 aa, Homo Sapiens
LKTCLTPGQ

SEQ ID NO: 110465 - protein, 9 aa, Homo Sapiens
ELEHTAENK

SEQ ID NO: 110466 - protein, 9 aa, Homo Sapiens
SNIVTAKES

SEQ ID NO: 110467 - protein, 9 aa, Homo Sapiens
GFPRAPLGL

SEQ ID NO: 110468 - protein, 9 aa, Homo Sapiens
FALADGCKE

SEQ ID NO: 110469 - protein, 9 aa, Homo Sapiens
AELKETPCI

SEQ ID NO: 110470 - protein, 9 aa, Homo Sapiens
LYEGLLCCP

SEQ ID NO: 110471 - protein, 9 aa, Homo Sapiens
NEEEMLYGD

SEQ ID NO: 110472 - protein, 9 aa, Homo Sapiens
LLLLSKQIK

SEQ ID NO: 110473 - protein, 9 aa, Homo Sapiens
ELQELMIQI

SEQ ID NO: 110474 - protein, 9 aa, Homo Sapiens
PLLCWYRTQ

SEQ ID NO: 110475 - protein, 9 aa, Homo Sapiens
HCKITFCKT

SEQ ID NO: 110476 - protein, 9 aa, Homo Sapiens
STPGAGVSH

SEQ ID NO: 110477 - protein, 9 aa, Homo Sapiens
AHTVLSFLR

SEQ ID NO: 110478 - protein, 9 aa, Homo Sapiens
LQFLIVLVL

SEQ ID NO: 110479 - protein, 9 aa, Homo Sapiens
AVPVKVVSM

SEQ ID NO: 110480 - protein, 9 aa, Homo Sapiens
STLVYPALN

SEQ ID NO: 110481 - protein, 9 aa, Homo Sapiens
RVVSPNYSD

SEQ ID NO: 110482 - protein, 9 aa, Homo Sapiens
ELRDAELAQ

SEQ ID NO: 110483 - protein, 9 aa, Homo Sapiens
QDIAFAYKR

SEQ ID NO: 110484 - protein, 9 aa, Homo Sapiens
QRAATIVAT

SEQ ID NO: 110485 - protein, 9 aa, Homo Sapiens
NRTTHGVRI

SEQ ID NO: 110486 - protein, 9 aa, Homo Sapiens
DYRISLKLQ

SEQ ID NO: 110487 - protein, 9 aa, Homo Sapiens
LKEFSNIVT

SEQ ID NO: 110488 - protein, 9 aa, Homo Sapiens
RNFPKSSLH

SEQ ID NO: 110489 - protein, 9 aa, Homo Sapiens
YKLMVEQAK

SEQ ID NO: 110490 - protein, 9 aa, Homo Sapiens
FPRAPLGLG

SEQ ID NO: 110491 - protein, 9 aa, Homo Sapiens
DTKQVYFYI

SEQ ID NO: 110492 - protein, 9 aa, Homo Sapiens
PEKHLLFCQ

SEQ ID NO: 110493 - protein, 9 aa, Homo Sapiens
KETAGMVRH

SEQ ID NO: 110494 - protein, 9 aa, Homo Sapiens
VIHATRRDV

SEQ ID NO: 110495 - protein, 9 aa, Homo Sapiens
SLDFICVNI

SEQ ID NO: 110496 - protein, 9 aa, Homo Sapiens
RLQLIFSLL

SEQ ID NO: 110497 - protein, 9 aa, Homo Sapiens
SDSVILKTC

SEQ ID NO: 110498 - protein, 9 aa, Homo Sapiens
NESELRNQE

SEQ ID NO: 110499 - protein, 9 aa, Homo Sapiens
IHGIVLVHC

SEQ ID NO: 110500 - protein, 9 aa, Homo Sapiens
QEEFPGHPS

SEQ ID NO: 110501 - protein, 9 aa, Homo Sapiens
ILKTCLTPG

SEQ ID NO: 110502 - protein, 9 aa, Homo Sapiens
SGTCYVFSG

SEQ ID NO: 110503 - protein, 9 aa, Homo Sapiens
VRQNYHQYS

SEQ ID NO: 110504 - protein, 9 aa, Homo Sapiens
RLKQSNIMG

SEQ ID NO: 110505 - protein, 9 aa, Homo Sapiens
QEERLGVAG

SEQ ID NO: 110506 - protein, 9 aa, Homo Sapiens
QGKPTRGEG

SEQ ID NO: 110507 - protein, 9 aa, Homo Sapiens
PSQQLWLHC

SEQ ID NO: 110508 - protein, 9 aa, Homo Sapiens
PQTSNKNKQ

SEQ ID NO: 110509 - protein, 9 aa, Homo Sapiens
SSSRPFRPS

SEQ ID NO: 110510 - protein, 9 aa, Homo Sapiens
SKPCALRRS

SEQ ID NO: 110511 - protein, 9 aa, Homo Sapiens
AFIRKCHLV

SEQ ID NO: 110512 - protein, 9 aa, Homo Sapiens
PDGKLIYAN

SEQ ID NO: 110513 - protein, 9 aa, Homo Sapiens
INLDDATFL

SEQ ID NO: 110514 - protein, 9 aa, Homo Sapiens
THQEERLGV

SEQ ID NO: 110515 - protein, 9 aa, Homo Sapiens
PQVSMSPGQ

SEQ ID NO: 110516 - protein, 9 aa, Homo Sapiens
NELEDCDRQ

SEQ ID NO: 110517 - protein, 9 aa, Homo Sapiens
GCSTPLIEA

SEQ ID NO: 110518 - protein, 9 aa, Homo Sapiens
TPSVPCLRG

SEQ ID NO: 110519 - protein, 9 aa, Homo Sapiens
LKLQNVLEE

SEQ ID NO: 110520 - protein, 9 aa, Homo Sapiens
YLFNATNRR

SEQ ID NO: 110521 - protein, 9 aa, Homo Sapiens
PWGPGLHDP

SEQ ID NO: 110522 - protein, 9 aa, Homo Sapiens
MRRYMLLGQ

SEQ ID NO: 110523 - protein, 9 aa, Homo Sapiens
RFWKTGYLA

SEQ ID NO: 110524 - protein, 9 aa, Homo Sapiens
LDIREFETR

SEQ ID NO: 110525 - protein, 9 aa, Homo Sapiens
RIAESHMQS

SEQ ID NO: 110526 - protein, 9 aa, Homo Sapiens
HRPKRSRFH

SEQ ID NO: 110527 - protein, 9 aa, Homo Sapiens
AKSLDFICV

SEQ ID NO: 110528 - protein, 9 aa, Homo Sapiens
AMLLNFLDT

SEQ ID NO: 110529 - protein, 9 aa, Homo Sapiens
FDEITRIVV

SEQ ID NO: 110530 - protein, 9 aa, Homo Sapiens
SGALMWTKK

SEQ ID NO: 110531 - protein, 9 aa, Homo Sapiens
KQVYFYIFK

SEQ ID NO: 110532 - protein, 9 aa, Homo Sapiens
AFRELEHTA

SEQ ID NO: 110533 - protein, 9 aa, Homo Sapiens
VVEGCFSDM

SEQ ID NO: 110534 - protein, 9 aa, Homo Sapiens
MYNTQRAAT

SEQ ID NO: 110535 - protein, 9 aa, Homo Sapiens
KRRDISFID

SEQ ID NO: 110536 - protein, 9 aa, Homo Sapiens
HCKGSLSSS

SEQ ID NO: 110537 - protein, 9 aa, Homo Sapiens
DINTQSNKE

SEQ ID NO: 110538 - protein, 9 aa, Homo Sapiens
SIEFARNGS

SEQ ID NO: 110539 - protein, 9 aa, Homo Sapiens
RAIQSTQSA

SEQ ID NO: 110540 - protein, 9 aa, Homo Sapiens
DKEVSELEE

SEQ ID NO: 110541 - protein, 9 aa, Homo Sapiens
GIGYSFSSV

SEQ ID NO: 110542 - protein, 9 aa, Homo Sapiens
LALMYNTQR

SEQ ID NO: 110543 - protein, 9 aa, Homo Sapiens
VSDFGLSSF

SEQ ID NO: 110544 - protein, 9 aa, Homo Sapiens
QRLQLIFSL

SEQ ID NO: 110545 - protein, 9 aa, Homo Sapiens
VGESQPSQA

SEQ ID NO: 110546 - protein, 9 aa, Homo Sapiens
NTQRAATIV

SEQ ID NO: 110547 - protein, 9 aa, Homo Sapiens
QVPPKKPTT

SEQ ID NO: 110548 - protein, 9 aa, Homo Sapiens
MHAGVPGGK

SEQ ID NO: 110549 - protein, 9 aa, Homo Sapiens
NPFLLACAE

SEQ ID NO: 110550 - protein, 9 aa, Homo Sapiens
QPGPAHTVL

SEQ ID NO: 110551 - protein, 9 aa, Homo Sapiens
TRDALWAEI

SEQ ID NO: 110552 - protein, 9 aa, Homo Sapiens
KKSYDQTKR

SEQ ID NO: 110553 - protein, 9 aa, Homo Sapiens
YNTQRAATI

SEQ ID NO: 110554 - protein, 9 aa, Homo Sapiens
QGDITVEGL

SEQ ID NO: 110555 - protein, 9 aa, Homo Sapiens
IMIQYRSVI

SEQ ID NO: 110556 - protein, 9 aa, Homo Sapiens
GSKAELKET

SEQ ID NO: 110557 - protein, 9 aa, Homo Sapiens
ALQDELEFE

SEQ ID NO: 110558 - protein, 9 aa, Homo Sapiens
CSGTCYVFS

SEQ ID NO: 110559 - protein, 9 aa, Homo Sapiens
PVVPVSKPC

SEQ ID NO: 110560 - protein, 9 aa, Homo Sapiens
PNDVQCHVG

SEQ ID NO: 110561 - protein, 9 aa, Homo Sapiens
KYKGQDEKL

SEQ ID NO: 110562 - protein, 9 aa, Homo Sapiens
SLSSGALMW

SEQ ID NO: 110563 - protein, 9 aa, Homo Sapiens
HKSRSLNES

SEQ ID NO: 110564 - protein, 9 aa, Homo Sapiens
SPSGPKLCN

SEQ ID NO: 110565 - protein, 9 aa, Homo Sapiens
YFDDIDDEM

SEQ ID NO: 110566 - protein, 9 aa, Homo Sapiens
LGCLSLLSW

SEQ ID NO: 110567 - protein, 9 aa, Homo Sapiens
LLNFLDTYQ

SEQ ID NO: 110568 - protein, 9 aa, Homo Sapiens
PSSFSYNEA

SEQ ID NO: 110569 - protein, 9 aa, Homo Sapiens
DTCPILALS

SEQ ID NO: 110570 - protein, 9 aa, Homo Sapiens
ALYEGLLCC

SEQ ID NO: 110571 - protein, 9 aa, Homo Sapiens
TRIRNGVNC

SEQ ID NO: 110572 - protein, 9 aa, Homo Sapiens
LGKLLMKLK

SEQ ID NO: 110573 - protein, 9 aa, Homo Sapiens
QLKNKYKGQ

SEQ ID NO: 110574 - protein, 9 aa, Homo Sapiens
IGYSFSSVA

SEQ ID NO: 110575 - protein, 9 aa, Homo Sapiens
LGQKDIFPY

SEQ ID NO: 110576 - protein, 9 aa, Homo Sapiens
AGVPGGKQF

SEQ ID NO: 110577 - protein, 9 aa, Homo Sapiens
EYKKHMETF

SEQ ID NO: 110578 - protein, 9 aa, Homo Sapiens
FNATNRRVF

SEQ ID NO: 110579 - protein, 9 aa, Homo Sapiens
LDSYTDSVK

SEQ ID NO: 110580 - protein, 9 aa, Homo Sapiens
TIMKELSCH

SEQ ID NO: 110581 - protein, 9 aa, Homo Sapiens
QVSMSPGQP

SEQ ID NO: 110582 - protein, 9 aa, Homo Sapiens
MIQYRSVII

SEQ ID NO: 110583 - protein, 9 aa, Homo Sapiens
RRSAQPLNL

SEQ ID NO: 110584 - protein, 9 aa, Homo Sapiens
AHMVIHSEN

SEQ ID NO: 110585 - protein, 9 aa, Homo Sapiens
IFSYTELMC

SEQ ID NO: 110586 - protein, 9 aa, Homo Sapiens
NPGLYPPQV

SEQ ID NO: 110587 - protein, 9 aa, Homo Sapiens
KNKYKGQDE

SEQ ID NO: 110588 - protein, 9 aa, Homo Sapiens
SSIKMDRTR

SEQ ID NO: 110589 - protein, 9 aa, Homo Sapiens
FRRLAGCQY

SEQ ID NO: 110590 - protein, 9 aa, Homo Sapiens
NEASGYVCI

SEQ ID NO: 110591 - protein, 9 aa, Homo Sapiens
DDASEKKAA

SEQ ID NO: 110592 - protein, 9 aa, Homo Sapiens
FIDIILISL

SEQ ID NO: 110593 - protein, 9 aa, Homo Sapiens
ALFMFHPLV

SEQ ID NO: 110594 - protein, 9 aa, Homo Sapiens
QALKYLDMG

SEQ ID NO: 110595 - protein, 9 aa, Homo Sapiens
IFKIVQPEL

SEQ ID NO: 110596 - protein, 9 aa, Homo Sapiens
PDVNGGLYR

SEQ ID NO: 110597 - protein, 9 aa, Homo Sapiens
DPKYGSSAR

SEQ ID NO: 110598 - protein, 9 aa, Homo Sapiens
AELKSTHEQ

SEQ ID NO: 110599 - protein, 9 aa, Homo Sapiens
RKLSISLQF

SEQ ID NO: 110600 - protein, 9 aa, Homo Sapiens
FPALLAIPP

SEQ ID NO: 110601 - protein, 9 aa, Homo Sapiens
VSMAPDVNG

SEQ ID NO: 110602 - protein, 9 aa, Homo Sapiens
VCTFVWIIN

SEQ ID NO: 110603 - protein, 9 aa, Homo Sapiens
LHAQSESET

SEQ ID NO: 110604 - protein, 9 aa, Homo Sapiens
LAKSLDFIC

SEQ ID NO: 110605 - protein, 9 aa, Homo Sapiens
MQGGKYLQL

SEQ ID NO: 110606 - protein, 9 aa, Homo Sapiens
MGQKIAPYC

SEQ ID NO: 110607 - protein, 9 aa, Homo Sapiens
SWLGGEGIL

SEQ ID NO: 110608 - protein, 9 aa, Homo Sapiens
GHLAKSLDF

SEQ ID NO: 110609 - protein, 9 aa, Homo Sapiens
TRLQMELIE

SEQ ID NO: 110610 - protein, 8 aa, Homo Sapiens
VESVRLEN

SEQ ID NO: 110611 - protein, 9 aa, Homo Sapiens
FANLSICLW

SEQ ID NO: 110612 - protein, 9 aa, Homo Sapiens
AALYEGLLC

SEQ ID NO: 110613 - protein, 9 aa, Homo Sapiens
AAPPFQPAP

SEQ ID NO: 110614 - protein, 9 aa, Homo Sapiens
RELEHTAEN

SEQ ID NO: 110615 - protein, 9 aa, Homo Sapiens
LQSEPHCAG

SEQ ID NO: 110616 - protein, 9 aa, Homo Sapiens
LVQGPLHSN

SEQ ID NO: 110617 - protein, 9 aa, Homo Sapiens
IKQLESNNR

SEQ ID NO: 110618 - protein, 9 aa, Homo Sapiens
RNGKKRHSS

SEQ ID NO: 110619 - protein, 9 aa, Homo Sapiens
ISLKLQNVL

SEQ ID NO: 110620 - protein, 9 aa, Homo Sapiens
NIVTAKESQ

SEQ ID NO: 110621 - protein, 9 aa, Homo Sapiens
CSSSSVPFT

SEQ ID NO: 110622 - protein, 9 aa, Homo Sapiens
RRNEMIQLH

SEQ ID NO: 110623 - protein, 9 aa, Homo Sapiens
YSFSSVAGL

SEQ ID NO: 110624 - protein, 9 aa, Homo Sapiens
LISKTKDLC

SEQ ID NO: 110625 - protein, 9 aa, Homo Sapiens
PKTISPGKN

SEQ ID NO: 110626 - protein, 9 aa, Homo Sapiens
YEGLLCCPH

SEQ ID NO: 110627 - protein, 9 aa, Homo Sapiens
FCKHYSSQP

SEQ ID NO: 110628 - protein, 9 aa, Homo Sapiens
IREEHGEKV

SEQ ID NO: 110629 - protein, 9 aa, Homo Sapiens
APYCVEIKN

SEQ ID NO: 110630 - protein, 9 aa, Homo Sapiens
LKKNKSEDV

SEQ ID NO: 110631 - protein, 9 aa, Homo Sapiens
TIMIQYRSV

SEQ ID NO: 110632 - protein, 9 aa, Homo Sapiens
YLSSTKLAE

SEQ ID NO: 110633 - protein, 9 aa, Homo Sapiens
TFVWIINTD

SEQ ID NO: 110634 - protein, 9 aa, Homo Sapiens
IAAKQKCEQ

SEQ ID NO: 110635 - protein, 9 aa, Homo Sapiens
YKRRTKKEL

SEQ ID NO: 110636 - protein, 9 aa, Homo Sapiens
AAYLCQSVT

SEQ ID NO: 110637 - protein, 9 aa, Homo Sapiens
QLALQDELE

SEQ ID NO: 110638 - protein, 9 aa, Homo Sapiens
PKLCNSHIN

SEQ ID NO: 110639 - protein, 9 aa, Homo Sapiens
ETSPTVDNE

SEQ ID NO: 110640 - protein, 9 aa, Homo Sapiens
SYTDSVKKE

SEQ ID NO: 110641 - protein, 9 aa, Homo Sapiens
ASIRRPSSW

SEQ ID NO: 110642 - protein, 9 aa, Homo Sapiens
QYRSVIIPI

SEQ ID NO: 110643 - protein, 9 aa, Homo Sapiens
CKLQAASWR

SEQ ID NO: 110644 - protein, 9 aa, Homo Sapiens
PKTYIVTCE

SEQ ID NO: 110645 - protein, 9 aa, Homo Sapiens
FQPEHRDSE

SEQ ID NO: 110646 - protein, 9 aa, Homo Sapiens
TQRAATIVA

SEQ ID NO: 110647 - protein, 9 aa, Homo Sapiens
CLTPGQHSP

SEQ ID NO: 110648 - protein, 9 aa, Homo Sapiens
GVSHKKAHS

SEQ ID NO: 110649 - protein, 9 aa, Homo Sapiens
SGGQKIKLT

SEQ ID NO: 110650 - protein, 9 aa, Homo Sapiens
GYLASHLLR

SEQ ID NO: 110651 - protein, 9 aa, Homo Sapiens
EDCDRQKAM

SEQ ID NO: 110652 - protein, 9 aa, Homo Sapiens
EDYESLREM

SEQ ID NO: 110653 - protein, 9 aa, Homo Sapiens
LSGAGDPYF

SEQ ID NO: 110654 - protein, 9 aa, Homo Sapiens
TAFLGQKDI

SEQ ID NO: 110655 - protein, 9 aa, Homo Sapiens
TENTTASTA

SEQ ID NO: 110656 - protein, 9 aa, Homo Sapiens
EPETRDALW

SEQ ID NO: 110657 - protein, 9 aa, Homo Sapiens
SLLSWLGGE

SEQ ID NO: 110658 - protein, 9 aa, Homo Sapiens
CIVTLEGLK

SEQ ID NO: 110659 - protein, 9 aa, Homo Sapiens
LQLGDERCT

SEQ ID NO: 110660 - protein, 9 aa, Homo Sapiens
TRVGLGKSS

SEQ ID NO: 110661 - protein, 9 aa, Homo Sapiens
LASHLLRRK

SEQ ID NO: 110662 - protein, 9 aa, Homo Sapiens
VKSFHCFGP

SEQ ID NO: 110663 - protein, 9 aa, Homo Sapiens
NILYKTIFQ

SEQ ID NO: 110664 - protein, 9 aa, Homo Sapiens
IVAKSHDAA

SEQ ID NO: 110665 - protein, 9 aa, Homo Sapiens
QGYKNLNEF

SEQ ID NO: 110666 - protein, 9 aa, Homo Sapiens
ILQSEPHCA

SEQ ID NO: 110667 - protein, 9 aa, Homo Sapiens
AVIVAKSHD

SEQ ID NO: 110668 - protein, 9 aa, Homo Sapiens
KSLDFICVN

SEQ ID NO: 110669 - protein, 9 aa, Homo Sapiens
NLHVINLDD

SEQ ID NO: 110670 - protein, 9 aa, Homo Sapiens
AYYRQKNPS

SEQ ID NO: 110671 - protein, 9 aa, Homo Sapiens
SCGLPAPSD

SEQ ID NO: 110672 - protein, 9 aa, Homo Sapiens
KTIFQGFAK

SEQ ID NO: 110673 - protein, 9 aa, Homo Sapiens
ADTENTTAS

SEQ ID NO: 110674 - protein, 9 aa, Homo Sapiens
IQLHHTART

SEQ ID NO: 110675 - protein, 9 aa, Homo Sapiens
MVEQAKLKQ

SEQ ID NO: 110676 - protein, 9 aa, Homo Sapiens
ARRNEMIQL

SEQ ID NO: 110677 - protein, 9 aa, Homo Sapiens
FWKTGYLAS

SEQ ID NO: 110678 - protein, 9 aa, Homo Sapiens
QVVEGCFSD

SEQ ID NO: 110679 - protein, 9 aa, Homo Sapiens
VCRDAALLA

SEQ ID NO: 110680 - protein, 9 aa, Homo Sapiens
KTFRWLKET

SEQ ID NO: 110681 - protein, 9 aa, Homo Sapiens
GVNYSVCQI

SEQ ID NO: 110682 - protein, 9 aa, Homo Sapiens
SYFLTIEEL

SEQ ID NO: 110683 - protein, 9 aa, Homo Sapiens
YNLNRTTHG

SEQ ID NO: 110684 - protein, 9 aa, Homo Sapiens
WLNESELRN

SEQ ID NO: 110685 - protein, 9 aa, Homo Sapiens
NFILLSICI

SEQ ID NO: 110686 - protein, 9 aa, Homo Sapiens
PKTFRWLKE

SEQ ID NO: 110687 - protein, 9 aa, Homo Sapiens
KTYIVTCEH

SEQ ID NO: 110688 - protein, 9 aa, Homo Sapiens
IEKITNSRP

SEQ ID NO: 110689 - protein, 9 aa, Homo Sapiens
EKVGCQGKP

SEQ ID NO: 110690 - protein, 9 aa, Homo Sapiens
ASNGETIEK

SEQ ID NO: 110691 - protein, 9 aa, Homo Sapiens
QTKRQRRRN

SEQ ID NO: 110692 - protein, 9 aa, Homo Sapiens
AKTLEECIV

SEQ ID NO: 110693 - protein, 9 aa, Homo Sapiens
DVQCHVGSD

SEQ ID NO: 110694 - protein, 9 aa, Homo Sapiens
LSSGALMWT

SEQ ID NO: 110695 - protein, 9 aa, Homo Sapiens
YPVFCSGTC

SEQ ID NO: 110696 - protein, 9 aa, Homo Sapiens
RMQPGPAHT

SEQ ID NO: 110697 - protein, 9 aa, Homo Sapiens
LKETQEITG

SEQ ID NO: 110698 - protein, 9 aa, Homo Sapiens
THRSIHTGQ

SEQ ID NO: 110699 - protein, 9 aa, Homo Sapiens
MKELSCHKN

SEQ ID NO: 110700 - protein, 9 aa, Homo Sapiens
YAEIREEHG

SEQ ID NO: 110701 - protein, 9 aa, Homo Sapiens
RGAAPPFQP

SEQ ID NO: 110702 - protein, 9 aa, Homo Sapiens
MAPDVNGGL

SEQ ID NO: 110703 - protein, 9 aa, Homo Sapiens
FSDKEVSEL

SEQ ID NO: 110704 - protein, 9 aa, Homo Sapiens
IVYHPPPTK

SEQ ID NO: 110705 - protein, 9 aa, Homo Sapiens
LHYDIKTIP

SEQ ID NO: 110706 - protein, 9 aa, Homo Sapiens
HRDSEDLLK

SEQ ID NO: 110707 - protein, 9 aa, Homo Sapiens
PPQVSMSPG

SEQ ID NO: 110708 - protein, 9 aa, Homo Sapiens
TIQPKKGYI

SEQ ID NO: 110709 - protein, 9 aa, Homo Sapiens
SEDYESLRE

SEQ ID NO: 110710 - protein, 9 aa, Homo Sapiens
LSKQIKRMV

SEQ ID NO: 110711 - protein, 9 aa, Homo Sapiens
ISPGKNGVV

SEQ ID NO: 110712 - protein, 9 aa, Homo Sapiens
RTNCDSSTT

SEQ ID NO: 110713 - protein, 9 aa, Homo Sapiens
YESLREMVE

SEQ ID NO: 110714 - protein, 9 aa, Homo Sapiens
HTAENKPLG

SEQ ID NO: 110715 - protein, 9 aa, Homo Sapiens
MTTCCRPSC

SEQ ID NO: 110716 - protein, 9 aa, Homo Sapiens
SNKNKQYED

SEQ ID NO: 110717 - protein, 9 aa, Homo Sapiens
PRVVSPNYS

SEQ ID NO: 110718 - protein, 9 aa, Homo Sapiens
RSAQPLNLT

SEQ ID NO: 110719 - protein, 9 aa, Homo Sapiens
QKDIFPYSE

SEQ ID NO: 110720 - protein, 9 aa, Homo Sapiens
TIHKLSEEQ

SEQ ID NO: 110721 - protein, 9 aa, Homo Sapiens
IKDLKLCVS

SEQ ID NO: 110722 - protein, 9 aa, Homo Sapiens
ESKYKRSSC

SEQ ID NO: 110723 - protein, 9 aa, Homo Sapiens
YGYFQVGWT

SEQ ID NO: 110724 - protein, 9 aa, Homo Sapiens
QELMIQIDI

SEQ ID NO: 110725 - protein, 9 aa, Homo Sapiens
KSTHEQSVP

SEQ ID NO: 110726 - protein, 9 aa, Homo Sapiens
AKTLGIVVC

SEQ ID NO: 110727 - protein, 9 aa, Homo Sapiens
SETSPTVDN

SEQ ID NO: 110728 - protein, 9 aa, Homo Sapiens
HMQSISNLN

SEQ ID NO: 110729 - protein, 9 aa, Homo Sapiens
TTVSTADTE

SEQ ID NO: 110730 - protein, 9 aa, Homo Sapiens
YSDLDSKEP

SEQ ID NO: 110731 - protein, 9 aa, Homo Sapiens
SENLPDPNV

SEQ ID NO: 110732 - protein, 9 aa, Homo Sapiens
RNTTPSVPC

SEQ ID NO: 110733 - protein, 9 aa, Homo Sapiens
EYEQEETRQ

SEQ ID NO: 110734 - protein, 9 aa, Homo Sapiens
KVGCQGKPT

SEQ ID NO: 110735 - protein, 9 aa, Homo Sapiens
GYSDLDSKE

SEQ ID NO: 110736 - protein, 9 aa, Homo Sapiens
ISIFSYTEL

SEQ ID NO: 110737 - protein, 9 aa, Homo Sapiens
LVDGLFLVL

SEQ ID NO: 110738 - protein, 9 aa, Homo Sapiens
RASNGETIE

SEQ ID NO: 110739 - protein, 9 aa, Homo Sapiens
RGFPRAPLG

SEQ ID NO: 110740 - protein, 9 aa, Homo Sapiens
LIEYKTGKR

SEQ ID NO: 110741 - protein, 9 aa, Homo Sapiens
GPAHTVLSF

SEQ ID NO: 110742 - protein, 9 aa, Homo Sapiens
MKLKKVNKA

SEQ ID NO: 110743 - protein, 9 aa, Homo Sapiens
LKSTHEQSV

SEQ ID NO: 110744 - protein, 9 aa, Homo Sapiens
LYKTIFQGF

SEQ ID NO: 110745 - protein, 9 aa, Homo Sapiens
CLSLLSWLG

SEQ ID NO: 110746 - protein, 9 aa, Homo Sapiens
VQQLALQDE

SEQ ID NO: 110747 - protein, 9 aa, Homo Sapiens
LIYANNSNY

SEQ ID NO: 110748 - protein, 9 aa, Homo Sapiens
IEEDPSSQE

SEQ ID NO: 110749 - protein, 9 aa, Homo Sapiens
ARNGSCFLI

SEQ ID NO: 110750 - protein, 9 aa, Homo Sapiens
LFCQENGFS

SEQ ID NO: 110751 - protein, 9 aa, Homo Sapiens
IGLFANLSI

SEQ ID NO: 110752 - protein, 9 aa, Homo Sapiens
QLRNVLERL

SEQ ID NO: 110753 - protein, 9 aa, Homo Sapiens
YKGQDEKLW

SEQ ID NO: 110754 - protein, 9 aa, Homo Sapiens
FRWLKETQE

SEQ ID NO: 110755 - protein, 9 aa, Homo Sapiens
PCALRRSLS

SEQ ID NO: 110756 - protein, 9 aa, Homo Sapiens
TNCDSSTTS

SEQ ID NO: 110757 - protein, 9 aa, Homo Sapiens
CCKPSCCMT

SEQ ID NO: 110758 - protein, 9 aa, Homo Sapiens
THEQSVPAE

SEQ ID NO: 110759 - protein, 9 aa, Homo Sapiens
DPYLFKLQA

SEQ ID NO: 110760 - protein, 9 aa, Homo Sapiens
IEAAQEGHL

SEQ ID NO: 110761 - protein, 9 aa, Homo Sapiens
TGYLASHLL

SEQ ID NO: 110762 - protein, 9 aa, Homo Sapiens
FKLQALKYL

SEQ ID NO: 110763 - protein, 9 aa, Homo Sapiens
VHRESKLTS

SEQ ID NO: 110764 - protein, 9 aa, Homo Sapiens
KVSPLTHRS

SEQ ID NO: 110765 - protein, 9 aa, Homo Sapiens
QSTQSAMFN

SEQ ID NO: 110766 - protein, 9 aa, Homo Sapiens
SSTKLAEKL

SEQ ID NO: 110767 - protein, 9 aa, Homo Sapiens
YSDCVLQCE

SEQ ID NO: 110768 - protein, 9 aa, Homo Sapiens
ISKFGFAIC

SEQ ID NO: 110769 - protein, 9 aa, Homo Sapiens
VRKLSISLQ

SEQ ID NO: 110770 - protein, 9 aa, Homo Sapiens
SHGPCHSGY

SEQ ID NO: 110771 - protein, 9 aa, Homo Sapiens
LYNERKGRS

SEQ ID NO: 110772 - protein, 9 aa, Homo Sapiens
VYSRKASER

SEQ ID NO: 110773 - protein, 9 aa, Homo Sapiens
HCFGPVKFT

SEQ ID NO: 110774 - protein, 9 aa, Homo Sapiens
SHMQSISNL

SEQ ID NO: 110775 - protein, 9 aa, Homo Sapiens
DLYEYSLVQ

SEQ ID NO: 110776 - protein, 9 aa, Homo Sapiens
GLKKLLNRV

SEQ ID NO: 110777 - protein, 9 aa, Homo Sapiens
VGCQGKPTR

SEQ ID NO: 110778 - protein, 9 aa, Homo Sapiens
EQMFSEHIK

SEQ ID NO: 110779 - protein, 9 aa, Homo Sapiens
DLCKLQAAS

SEQ ID NO: 110780 - protein, 9 aa, Homo Sapiens
YQDAIGLEG

SEQ ID NO: 110781 - protein, 9 aa, Homo Sapiens
NSSSTQEEC

SEQ ID NO: 110782 - protein, 9 aa, Homo Sapiens
FRNGKKRHS

SEQ ID NO: 110783 - protein, 9 aa, Homo Sapiens
LPKTYIVTC

SEQ ID NO: 110784 - protein, 9 aa, Homo Sapiens
EVPSYTETP

SEQ ID NO: 110785 - protein, 9 aa, Homo Sapiens
AQGYKNLNE

SEQ ID NO: 110786 - protein, 9 aa, Homo Sapiens
LVQQLALQD

SEQ ID NO: 110787 - protein, 9 aa, Homo Sapiens
PCAFRRLAG

SEQ ID NO: 110788 - protein, 9 aa, Homo Sapiens
DGKLIYANN

SEQ ID NO: 110789 - protein, 9 aa, Homo Sapiens
PSNSSSQGD

SEQ ID NO: 110790 - protein, 9 aa, Homo Sapiens
NFPKSSLHA

SEQ ID NO: 110791 - protein, 9 aa, Homo Sapiens
KAFCKHYSS

SEQ ID NO: 110792 - protein, 9 aa, Homo Sapiens
FQVGWTIFD

SEQ ID NO: 110793 - protein, 9 aa, Homo Sapiens
EEDPSSQEG

SEQ ID NO: 110794 - protein, 9 aa, Homo Sapiens
AEIVAVCRD

SEQ ID NO: 110795 - protein, 9 aa, Homo Sapiens
KLLNRVKWT

SEQ ID NO: 110796 - protein, 9 aa, Homo Sapiens
MSSPRVVSP

SEQ ID NO: 110797 - protein, 9 aa, Homo Sapiens
RSSCGLPAP

SEQ ID NO: 110798 - protein, 9 aa, Homo Sapiens
SMEDDGTVT

SEQ ID NO: 110799 - protein, 9 aa, Homo Sapiens
PGYKMSSPR

SEQ ID NO: 110800 - protein, 9 aa, Homo Sapiens
DIPKDKAFC

SEQ ID NO: 110801 - protein, 9 aa, Homo Sapiens
ATSLSVTSL

SEQ ID NO: 110802 - protein, 9 aa, Homo Sapiens
YCVEIKNTC

SEQ ID NO: 110803 - protein, 9 aa, Homo Sapiens
QACLAMLLN

SEQ ID NO: 110804 - protein, 9 aa, Homo Sapiens
IKPEKHLLF

SEQ ID NO: 110805 - protein, 9 aa, Homo Sapiens
LLFLCSSSS

SEQ ID NO: 110806 - protein, 9 aa, Homo Sapiens
LHVINLDDA

SEQ ID NO: 110807 - protein, 9 aa, Homo Sapiens
NFLDTYQGL

SEQ ID NO: 110808 - protein, 9 aa, Homo Sapiens
EHRDSEDLL

SEQ ID NO: 110809 - protein, 9 aa, Homo Sapiens
SWNASYRCS

SEQ ID NO: 110810 - protein, 9 aa, Homo Sapiens
LNRVKWTRD

SEQ ID NO: 110811 - protein, 9 aa, Homo Sapiens
TWLDIREFE

SEQ ID NO: 110812 - protein, 9 aa, Homo Sapiens
KGQDEKLWK

SEQ ID NO: 110813 - protein, 9 aa, Homo Sapiens
KFGFAICSQ

SEQ ID NO: 110814 - protein, 9 aa, Homo Sapiens
YFLTIEELQ

SEQ ID NO: 110815 - protein, 9 aa, Homo Sapiens
LGIVVCMFI

SEQ ID NO: 110816 - protein, 9 aa, Homo Sapiens
HVINLDDAT

SEQ ID NO: 110817 - protein, 9 aa, Homo Sapiens
HMVIHSENL

SEQ ID NO: 110818 - protein, 9 aa, Homo Sapiens
HRWYLSSTK

SEQ ID NO: 110819 - protein, 9 aa, Homo Sapiens
SSFLEDDPS

SEQ ID NO: 110820 - protein, 9 aa, Homo Sapiens
ETFYDVYSR

SEQ ID NO: 110821 - protein, 9 aa, Homo Sapiens
RPDGKLIYA

SEQ ID NO: 110822 - protein, 9 aa, Homo Sapiens
LLLEYKKHM

SEQ ID NO: 110823 - protein, 9 aa, Homo Sapiens
QLIFSLLFI

SEQ ID NO: 110824 - protein, 9 aa, Homo Sapiens
FMFHPLVLS

SEQ ID NO: 110825 - protein, 9 aa, Homo Sapiens
MQRLIPPFR

SEQ ID NO: 110826 - protein, 9 aa, Homo Sapiens
LDNRRQGGR

SEQ ID NO: 110827 - protein, 9 aa, Homo Sapiens
TPYLGHIRN

SEQ ID NO: 110828 - protein, 9 aa, Homo Sapiens
QCGKAFSVF

SEQ ID NO: 110829 - protein, 9 aa, Homo Sapiens
KDEIQGVIY

SEQ ID NO: 110830 - protein, 9 aa, Homo Sapiens
RPSLVQYHE

SEQ ID NO: 110831 - protein, 9 aa, Homo Sapiens
KRRQSDLSG

SEQ ID NO: 110832 - protein, 9 aa, Homo Sapiens
INHSFLSAK

SEQ ID NO: 110833 - protein, 9 aa, Homo Sapiens
SSSKTRPEP

SEQ ID NO: 110834 - protein, 9 aa, Homo Sapiens
LPLDYVVSH

SEQ ID NO: 110835 - protein, 9 aa, Homo Sapiens
DFRNEVYST

SEQ ID NO: 110836 - protein, 9 aa, Homo Sapiens
SLDTTMQRL

SEQ ID NO: 110837 - protein, 9 aa, Homo Sapiens
CVVEANPNQ

SEQ ID NO: 110838 - protein, 9 aa, Homo Sapiens
QLDKILFYN

SEQ ID NO: 110839 - protein, 8 aa, Homo Sapiens
NKILSSTV

SEQ ID NO: 110840 - protein, 9 aa, Homo Sapiens
PLLSYYPYP

SEQ ID NO: 110841 - protein, 9 aa, Homo Sapiens
ELGSFENQH

SEQ ID NO: 110842 - protein, 9 aa, Homo Sapiens
VCTIRNTEM

SEQ ID NO: 110843 - protein, 9 aa, Homo Sapiens
TSILQSVGS

SEQ ID NO: 110844 - protein, 9 aa, Homo Sapiens
DILELKCNL

SEQ ID NO: 110845 - protein, 9 aa, Homo Sapiens
GKAFSVFGS

SEQ ID NO: 110846 - protein, 9 aa, Homo Sapiens
FYMLLHLFI

SEQ ID NO: 110847 - protein, 9 aa, Homo Sapiens
DDDHEIITL

SEQ ID NO: 110848 - protein, 9 aa, Homo Sapiens
VGSKIACSN

SEQ ID NO: 110849 - protein, 9 aa, Homo Sapiens
RAVAFNKQI

SEQ ID NO: 110850 - protein, 9 aa, Homo Sapiens
IPSTAMHTS

SEQ ID NO: 110851 - protein, 9 aa, Homo Sapiens
PPAFYRPNL

SEQ ID NO: 110852 - protein, 9 aa, Homo Sapiens
EDKDPSCPR

SEQ ID NO: 110853 - protein, 9 aa, Homo Sapiens
VCENAQLGQ

SEQ ID NO: 110854 - protein, 9 aa, Homo Sapiens
GSKIACSNK

SEQ ID NO: 110855 - protein, 9 aa, Homo Sapiens
LESEGFAGM

SEQ ID NO: 110856 - protein, 9 aa, Homo Sapiens
KAVVHMNVK

SEQ ID NO: 110857 - protein, 9 aa, Homo Sapiens
MRDQYIRAG

SEQ ID NO: 110858 - protein, 9 aa, Homo Sapiens
KSSATCCCC

SEQ ID NO: 110859 - protein, 9 aa, Homo Sapiens
ASQIWNLNP

SEQ ID NO: 110860 - protein, 9 aa, Homo Sapiens
NVLNDHVNV

SEQ ID NO: 110861 - protein, 9 aa, Homo Sapiens
GVIYEIRMH

SEQ ID NO: 110862 - protein, 9 aa, Homo Sapiens
HELCAARVL

SEQ ID NO: 110863 - protein, 9 aa, Homo Sapiens
LDNLVMADK

SEQ ID NO: 110864 - protein, 9 aa, Homo Sapiens
QKLYFPASV

SEQ ID NO: 110865 - protein, 9 aa, Homo Sapiens
KRLGRYHQC

SEQ ID NO: 110866 - protein, 9 aa, Homo Sapiens
RGKSSATCC

SEQ ID NO: 110867 - protein, 9 aa, Homo Sapiens
LGHIRNLQK

SEQ ID NO: 110868 - protein, 9 aa, Homo Sapiens
IDDFRNEVY

SEQ ID NO: 110869 - protein, 9 aa, Homo Sapiens
LEVGLEEGS

SEQ ID NO: 110870 - protein, 9 aa, Homo Sapiens
VVRGYAICY

SEQ ID NO: 110871 - protein, 9 aa, Homo Sapiens
NKIKAFLPS

SEQ ID NO: 110872 - protein, 9 aa, Homo Sapiens
KYQEVEEDK

SEQ ID NO: 110873 - protein, 9 aa, Homo Sapiens
GFDRPSLVQ

SEQ ID NO: 110874 - protein, 9 aa, Homo Sapiens
DTSQPWKKL

SEQ ID NO: 110875 - protein, 9 aa, Homo Sapiens
DFKKLKVAL

SEQ ID NO: 110876 - protein, 9 aa, Homo Sapiens
VASNFYISR

SEQ ID NO: 110877 - protein, 9 aa, Homo Sapiens
LVDFKDAKA

SEQ ID NO: 110878 - protein, 9 aa, Homo Sapiens
FRGRDFVMW

SEQ ID NO: 110879 - protein, 9 aa, Homo Sapiens
INGTDVTPQ

SEQ ID NO: 110880 - protein, 9 aa, Homo Sapiens
DSGSNAWLF

SEQ ID NO: 110881 - protein, 9 aa, Homo Sapiens
VGTPGPGSV

SEQ ID NO: 110882 - protein, 9 aa, Homo Sapiens
CENAQLGQV

SEQ ID NO: 110883 - protein, 9 aa, Homo Sapiens
KVTRASSQR

SEQ ID NO: 110884 - protein, 9 aa, Homo Sapiens
LCLLGCALL

SEQ ID NO: 110885 - protein, 9 aa, Homo Sapiens
RRVCEPLLS

SEQ ID NO: 110886 - protein, 9 aa, Homo Sapiens
PQRPASSGS

SEQ ID NO: 110887 - protein, 9 aa, Homo Sapiens
FVANSESTL

SEQ ID NO: 110888 - protein, 9 aa, Homo Sapiens
HPLTHSAVM

SEQ ID NO: 110889 - protein, 9 aa, Homo Sapiens
PSFFFFSRP

SEQ ID NO: 110890 - protein, 9 aa, Homo Sapiens
QSLDTTMQR

SEQ ID NO: 110891 - protein, 9 aa, Homo Sapiens
SQRVVGPSY

SEQ ID NO: 110892 - protein, 9 aa, Homo Sapiens
TSGVPPMAE

SEQ ID NO: 110893 - protein, 9 aa, Homo Sapiens
DFGDIISSK

SEQ ID NO: 110894 - protein, 9 aa, Homo Sapiens
TKRDCSCEP

SEQ ID NO: 110895 - protein, 9 aa, Homo Sapiens
NGCLQLSGT

SEQ ID NO: 110896 - protein, 9 aa, Homo Sapiens
VPTHFVPYA

SEQ ID NO: 110897 - protein, 9 aa, Homo Sapiens
PNKIKAFLP

SEQ ID NO: 110898 - protein, 9 aa, Homo Sapiens
SGKGKKPSK

SEQ ID NO: 110899 - protein, 9 aa, Homo Sapiens
GSNAWLFYH

SEQ ID NO: 110900 - protein, 9 aa, Homo Sapiens
WKYRYSCIR

SEQ ID NO: 110901 - protein, 9 aa, Homo Sapiens
FINHSFLSA

SEQ ID NO: 110902 - protein, 9 aa, Homo Sapiens
VFCTSPMAK

SEQ ID NO: 110903 - protein, 9 aa, Homo Sapiens
TYGLSKIRL

SEQ ID NO: 110904 - protein, 9 aa, Homo Sapiens
PEEGLEVGL

SEQ ID NO: 110905 - protein, 9 aa, Homo Sapiens
AMHTSSTAA

SEQ ID NO: 110906 - protein, 9 aa, Homo Sapiens
FENQHRKLN

SEQ ID NO: 110907 - protein, 9 aa, Homo Sapiens
HNTAHSYNG

SEQ ID NO: 110908 - protein, 9 aa, Homo Sapiens
SIEKTSFFS

SEQ ID NO: 110909 - protein, 9 aa, Homo Sapiens
GLGQNALGF

SEQ ID NO: 110910 - protein, 9 aa, Homo Sapiens
CLLSAICFF

SEQ ID NO: 110911 - protein, 9 aa, Homo Sapiens
NSLWKYRYS

SEQ ID NO: 110912 - protein, 9 aa, Homo Sapiens
YKMHPKLVI

SEQ ID NO: 110913 - protein, 9 aa, Homo Sapiens
VGLEEGSGG

SEQ ID NO: 110914 - protein, 9 aa, Homo Sapiens
GEPKEENNS

SEQ ID NO: 110915 - protein, 9 aa, Homo Sapiens
IKTRLHVAA

SEQ ID NO: 110916 - protein, 9 aa, Homo Sapiens
DADVFVFVA

SEQ ID NO: 110917 - protein, 9 aa, Homo Sapiens
PVQKSGKGK

SEQ ID NO: 110918 - protein, 9 aa, Homo Sapiens
AGMKKGIRA

SEQ ID NO: 110919 - protein, 9 aa, Homo Sapiens
KDCPHMKDK

SEQ ID NO: 110920 - protein, 9 aa, Homo Sapiens
YFPASVCRY

SEQ ID NO: 110921 - protein, 9 aa, Homo Sapiens
EELQVSFEP

SEQ ID NO: 110922 - protein, 9 aa, Homo Sapiens
LVQYHERIH

SEQ ID NO: 110923 - protein, 9 aa, Homo Sapiens
QGVIYEIRM

SEQ ID NO: 110924 - protein, 9 aa, Homo Sapiens
YRISLRYVA

SEQ ID NO: 110925 - protein, 9 aa, Homo Sapiens
PKIQQKDSL

SEQ ID NO: 110926 - protein, 9 aa, Homo Sapiens
EEGLEVGLE

SEQ ID NO: 110927 - protein, 9 aa, Homo Sapiens
MNGVTGRFP

SEQ ID NO: 110928 - protein, 9 aa, Homo Sapiens
ELFFLNAEA

SEQ ID NO: 110929 - protein, 9 aa, Homo Sapiens
YISRALEIL

SEQ ID NO: 110930 - protein, 9 aa, Homo Sapiens
SKEGDEFNN

SEQ ID NO: 110931 - protein, 9 aa, Homo Sapiens
QKSGKGKKP

SEQ ID NO: 110932 - protein, 9 aa, Homo Sapiens
KEEELQVSF

SEQ ID NO: 110933 - protein, 9 aa, Homo Sapiens
RGYAICYGI

SEQ ID NO: 110934 - protein, 9 aa, Homo Sapiens
VFVFVANSE

SEQ ID NO: 110935 - protein, 9 aa, Homo Sapiens
RYVPTHFVP

SEQ ID NO: 110936 - protein, 9 aa, Homo Sapiens
KRDCSCEPY

SEQ ID NO: 110937 - protein, 9 aa, Homo Sapiens
NHSFLSAKV

SEQ ID NO: 110938 - protein, 9 aa, Homo Sapiens
AEACVHKGQ

SEQ ID NO: 110939 - protein, 9 aa, Homo Sapiens
ADQRGLVQH

SEQ ID NO: 110940 - protein, 9 aa, Homo Sapiens
KEGDEFNNS

SEQ ID NO: 110941 - protein, 9 aa, Homo Sapiens
KQTFDIVVD

SEQ ID NO: 110942 - protein, 9 aa, Homo Sapiens
GTDVTPQPL

SEQ ID NO: 110943 - protein, 9 aa, Homo Sapiens
LKVALFSRL

SEQ ID NO: 110944 - protein, 9 aa, Homo Sapiens
QKDSLTLLP

SEQ ID NO: 110945 - protein, 9 aa, Homo Sapiens
RGLVTQSGC

SEQ ID NO: 110946 - protein, 9 aa, Homo Sapiens
PMAEGKKPS

SEQ ID NO: 110947 - protein, 9 aa, Homo Sapiens
DTTMQRLIP

SEQ ID NO: 110948 - protein, 9 aa, Homo Sapiens
KQILCLFRP

SEQ ID NO: 110949 - protein, 9 aa, Homo Sapiens
KVLLHTTPP

SEQ ID NO: 110950 - protein, 9 aa, Homo Sapiens
WREKEEELQ

SEQ ID NO: 110951 - protein, 9 aa, Homo Sapiens
IRKHIVNCF

SEQ ID NO: 110952 - protein, 9 aa, Homo Sapiens
MRTYLKQHE

SEQ ID NO: 110953 - protein, 9 aa, Homo Sapiens
GLCSQEGNY

SEQ ID NO: 110954 - protein, 9 aa, Homo Sapiens
EGFAGMKKG

SEQ ID NO: 110955 - protein, 9 aa, Homo Sapiens
VDDSEEIIV

SEQ ID NO: 110956 - protein, 9 aa, Homo Sapiens
LGSFENQHR

SEQ ID NO: 110957 - protein, 9 aa, Homo Sapiens
ASEDGPNLN

SEQ ID NO: 110958 - protein, 9 aa, Homo Sapiens
KCPNVLNDH

SEQ ID NO: 110959 - protein, 9 aa, Homo Sapiens
VFINHSFLS

SEQ ID NO: 110960 - protein, 9 aa, Homo Sapiens
PGEPKEENN

SEQ ID NO: 110961 - protein, 9 aa, Homo Sapiens
VHLFYMLLH

SEQ ID NO: 110962 - protein, 9 aa, Homo Sapiens
EEGTAAWQL

SEQ ID NO: 110963 - protein, 9 aa, Homo Sapiens
AEGKKPSKR

SEQ ID NO: 110964 - protein, 9 aa, Homo Sapiens
LGSLPGCVV

SEQ ID NO: 110965 - protein, 9 aa, Homo Sapiens
FSPPPYGEI

SEQ ID NO: 110966 - protein, 9 aa, Homo Sapiens
LGREKGNDI

SEQ ID NO: 110967 - protein, 9 aa, Homo Sapiens
CAARVLEVL

SEQ ID NO: 110968 - protein, 9 aa, Homo Sapiens
GGGLRSHGG

SEQ ID NO: 110969 - protein, 9 aa, Homo Sapiens
KNHLDYETL

SEQ ID NO: 110970 - protein, 9 aa, Homo Sapiens
ESPGPPESS

SEQ ID NO: 110971 - protein, 9 aa, Homo Sapiens
EPLLSYYPY

SEQ ID NO: 110972 - protein, 9 aa, Homo Sapiens
TAMHTSSTA

SEQ ID NO: 110973 - protein, 9 aa, Homo Sapiens
KHPVTHSHF

SEQ ID NO: 110974 - protein, 9 aa, Homo Sapiens
KTQDHLRQQ

SEQ ID NO: 110975 - protein, 9 aa, Homo Sapiens
PPYGEIYSL

SEQ ID NO: 110976 - protein, 9 aa, Homo Sapiens
SRSDAHRAQ

SEQ ID NO: 110977 - protein, 9 aa, Homo Sapiens
AAWQLLSPE

SEQ ID NO: 110978 - protein, 9 aa, Homo Sapiens
TKQTFDIVV

SEQ ID NO: 110979 - protein, 9 aa, Homo Sapiens
YQEVEEDKD

SEQ ID NO: 110980 - protein, 9 aa, Homo Sapiens
REYHRGLVT

SEQ ID NO: 110981 - protein, 9 aa, Homo Sapiens
KNAEQQALA

SEQ ID NO: 110982 - protein, 9 aa, Homo Sapiens
LNTFQFEGQ

SEQ ID NO: 110983 - protein, 9 aa, Homo Sapiens
CPHMKDKGA

SEQ ID NO: 110984 - protein, 9 aa, Homo Sapiens
KIKAFLPSS

SEQ ID NO: 110985 - protein, 9 aa, Homo Sapiens
SAICFFFAF

SEQ ID NO: 110986 - protein, 9 aa, Homo Sapiens
ETVFYHSPY

SEQ ID NO: 110987 - protein, 9 aa, Homo Sapiens
THSAVMGHR

SEQ ID NO: 110988 - protein, 9 aa, Homo Sapiens
LQVSFEPPK

SEQ ID NO: 110989 - protein, 9 aa, Homo Sapiens
SKQEINRLS

SEQ ID NO: 110990 - protein, 9 aa, Homo Sapiens
LCTEERHHI

SEQ ID NO: 110991 - protein, 9 aa, Homo Sapiens
DRPSLVQYH

SEQ ID NO: 110992 - protein, 9 aa, Homo Sapiens
VIYEIRMHL

SEQ ID NO: 110993 - protein, 9 aa, Homo Sapiens
SNENESESK

SEQ ID NO: 110994 - protein, 9 aa, Homo Sapiens
TKEAEFWER

SEQ ID NO: 110995 - protein, 9 aa, Homo Sapiens
VKRSRSDAH

SEQ ID NO: 110996 - protein, 9 aa, Homo Sapiens
VIKTRLHVA

SEQ ID NO: 110997 - protein, 9 aa, Homo Sapiens
VKEVSGRLL

SEQ ID NO: 110998 - protein, 9 aa, Homo Sapiens
VTPKLLDNL

SEQ ID NO: 110999 - protein, 9 aa, Homo Sapiens
AASLCLLGC

SEQ ID NO: 111000 - protein, 9 aa, Homo Sapiens
HHTYGLSKI

SEQ ID NO: 111001 - protein, 9 aa, Homo Sapiens
IVTPKLLDN

SEQ ID NO: 111002 - protein, 9 aa, Homo Sapiens
GLVQHGADQ

SEQ ID NO: 111003 - protein, 9 aa, Homo Sapiens
AMRDQYIRA

SEQ ID NO: 111004 - protein, 9 aa, Homo Sapiens
RGLVQHGAD

SEQ ID NO: 111005 - protein, 9 aa, Homo Sapiens
MEGRAALIT

SEQ ID NO: 111006 - protein, 9 aa, Homo Sapiens
WLFYHISRA

SEQ ID NO: 111007 - protein, 9 aa, Homo Sapiens
SNKRRQSDL

SEQ ID NO: 111008 - protein, 9 aa, Homo Sapiens
PATKEAEFW

SEQ ID NO: 111009 - protein, 9 aa, Homo Sapiens
LKQHEKLNL

SEQ ID NO: 111010 - protein, 9 aa, Homo Sapiens
FAGMKKGIR

SEQ ID NO: 111011 - protein, 9 aa, Homo Sapiens
AAASMYNYA

SEQ ID NO: 111012 - protein, 9 aa, Homo Sapiens
ERDNMIKNC

SEQ ID NO: 111013 - protein, 9 aa, Homo Sapiens
KPKIQQKDS

SEQ ID NO: 111014 - protein, 9 aa, Homo Sapiens
QKPSFFFFS

SEQ ID NO: 111015 - protein, 9 aa, Homo Sapiens
NQHRKLNLW

SEQ ID NO: 111016 - protein, 9 aa, Homo Sapiens
LYFPASVCR

SEQ ID NO: 111017 - protein, 9 aa, Homo Sapiens
FYHSPYPIR

SEQ ID NO: 111018 - protein, 9 aa, Homo Sapiens
QEETKQTFD

SEQ ID NO: 111019 - protein, 9 aa, Homo Sapiens
SLCLLGCAL

SEQ ID NO: 111020 - protein, 9 aa, Homo Sapiens
PNLIMEGRA

SEQ ID NO: 111021 - protein, 9 aa, Homo Sapiens
WQELEKLDC

SEQ ID NO: 111022 - protein, 9 aa, Homo Sapiens
GMKKGIRAR

SEQ ID NO: 111023 - protein, 9 aa, Homo Sapiens
FFSSLMPSP

SEQ ID NO: 111024 - protein, 9 aa, Homo Sapiens
MCFPLEACR

SEQ ID NO: 111025 - protein, 9 aa, Homo Sapiens
ELEKLDCLT

SEQ ID NO: 111026 - protein, 9 aa, Homo Sapiens
PTHFVPYAV

SEQ ID NO: 111027 - protein, 9 aa, Homo Sapiens
SVCRYIRIV

SEQ ID NO: 111028 - protein, 9 aa, Homo Sapiens
NIRKHIVNC

SEQ ID NO: 111029 - protein, 9 aa, Homo Sapiens
KNCNREYDL

SEQ ID NO: 111030 - protein, 9 aa, Homo Sapiens
CTEERHHIG

SEQ ID NO: 111031 - protein, 9 aa, Homo Sapiens
AASMYNYAE

SEQ ID NO: 111032 - protein, 9 aa, Homo Sapiens
SLGSLPGCV

SEQ ID NO: 111033 - protein, 9 aa, Homo Sapiens
KKLRVAGRL

SEQ ID NO: 111034 - protein, 9 aa, Homo Sapiens
SNAWLFYHI

SEQ ID NO: 111035 - protein, 9 aa, Homo Sapiens
PCASPYAYV

SEQ ID NO: 111036 - protein, 9 aa, Homo Sapiens
GVMNGVTGR

SEQ ID NO: 111037 - protein, 9 aa, Homo Sapiens
IYEIRMHLQ

SEQ ID NO: 111038 - protein, 9 aa, Homo Sapiens
YPAPVPLPC

SEQ ID NO: 111039 - protein, 9 aa, Homo Sapiens
MHTSSTAAP

SEQ ID NO: 111040 - protein, 9 aa, Homo Sapiens
VAFNKQILC

SEQ ID NO: 111041 - protein, 9 aa, Homo Sapiens
FSEDGYKMH

SEQ ID NO: 111042 - protein, 9 aa, Homo Sapiens
QRGLVQHGA

SEQ ID NO: 111043 - protein, 9 aa, Homo Sapiens
PAASCAVQP

SEQ ID NO: 111044 - protein, 9 aa, Homo Sapiens
IISSKQEIN

SEQ ID NO: 111045 - protein, 9 aa, Homo Sapiens
CLDADVFVF

SEQ ID NO: 111046 - protein, 9 aa, Homo Sapiens
SRLSASQIW

SEQ ID NO: 111047 - protein, 9 aa, Homo Sapiens
KEDGYTLFV

SEQ ID NO: 111048 - protein, 9 aa, Homo Sapiens
YGEIYSLPR

SEQ ID NO: 111049 - protein, 9 aa, Homo Sapiens
HIVNCFHKN

SEQ ID NO: 111050 - protein, 9 aa, Homo Sapiens
LVQLYETEK

SEQ ID NO: 111051 - protein, 9 aa, Homo Sapiens
IVMEYVSGG

SEQ ID NO: 111052 - protein, 9 aa, Homo Sapiens
VSHQIKEEL

SEQ ID NO: 111053 - protein, 9 aa, Homo Sapiens
SLVQYHERI

SEQ ID NO: 111054 - protein, 9 aa, Homo Sapiens
KQLDKILFY

SEQ ID NO: 111055 - protein, 9 aa, Homo Sapiens
EDGPNLNNN

SEQ ID NO: 111056 - protein, 9 aa, Homo Sapiens
NGTDVTPQP

SEQ ID NO: 111057 - protein, 9 aa, Homo Sapiens
ALGREKGND

SEQ ID NO: 111058 - protein, 9 aa, Homo Sapiens
YSYSEKEFI

SEQ ID NO: 111059 - protein, 9 aa, Homo Sapiens
SCTHELCTE

SEQ ID NO: 111060 - protein, 9 aa, Homo Sapiens
YSGKVLLHT

SEQ ID NO: 111061 - protein, 9 aa, Homo Sapiens
CPNVLNDHV

SEQ ID NO: 111062 - protein, 9 aa, Homo Sapiens
MLLHLFICF

SEQ ID NO: 111063 - protein, 9 aa, Homo Sapiens
ADAIKLMPV

SEQ ID NO: 111064 - protein, 9 aa, Homo Sapiens
EVEEDKDPS

SEQ ID NO: 111065 - protein, 9 aa, Homo Sapiens
PPPYGEIYS

SEQ ID NO: 111066 - protein, 9 aa, Homo Sapiens
SGTVKSSFL

SEQ ID NO: 111067 - protein, 9 aa, Homo Sapiens
SEKEFICHN

SEQ ID NO: 111068 - protein, 9 aa, Homo Sapiens
CTHELCTEE

SEQ ID NO: 111069 - protein, 9 aa, Homo Sapiens
HEIITLERR

SEQ ID NO: 111070 - protein, 9 aa, Homo Sapiens
YIRAGEGFI

SEQ ID NO: 111071 - protein, 9 aa, Homo Sapiens
GDIISSKQE

SEQ ID NO: 111072 - protein, 9 aa, Homo Sapiens
LFFLNAEAC

SEQ ID NO: 111073 - protein, 9 aa, Homo Sapiens
IKDVNPGEP

SEQ ID NO: 111074 - protein, 9 aa, Homo Sapiens
PHMKDKGAL

SEQ ID NO: 111075 - protein, 9 aa, Homo Sapiens
KLRVAGRLR

SEQ ID NO: 111076 - protein, 9 aa, Homo Sapiens
LFSRYVPTH

SEQ ID NO: 111077 - protein, 9 aa, Homo Sapiens
HCREYHRGL

SEQ ID NO: 111078 - protein, 9 aa, Homo Sapiens
GRAVAFNKQ

SEQ ID NO: 111079 - protein, 9 aa, Homo Sapiens
NAEACVHKG

SEQ ID NO: 111080 - protein, 9 aa, Homo Sapiens
IKNCNREYD

SEQ ID NO: 111081 - protein, 9 aa, Homo Sapiens
EITKQEKDF

SEQ ID NO: 111082 - protein, 9 aa, Homo Sapiens
TIVFINHSF

SEQ ID NO: 111083 - protein, 9 aa, Homo Sapiens
EREPPAASC

SEQ ID NO: 111084 - protein, 9 aa, Homo Sapiens
ILQSVGSKI

SEQ ID NO: 111085 - protein, 9 aa, Homo Sapiens
NALGFTLGT

SEQ ID NO: 111086 - protein, 9 aa, Homo Sapiens
ELQVSFEPP

SEQ ID NO: 111087 - protein, 9 aa, Homo Sapiens
QPYSSRLYV

SEQ ID NO: 111088 - protein, 9 aa, Homo Sapiens
GIYDDDHEI

SEQ ID NO: 111089 - protein, 9 aa, Homo Sapiens
IRAGEGFII

SEQ ID NO: 111090 - protein, 9 aa, Homo Sapiens
SSTAAPIPI

SEQ ID NO: 111091 - protein, 9 aa, Homo Sapiens
KLKPKIQQK

SEQ ID NO: 111092 - protein, 9 aa, Homo Sapiens
KQEKDFLWS

SEQ ID NO: 111093 - protein, 9 aa, Homo Sapiens
LDCLTLIPA

SEQ ID NO: 111094 - protein, 9 aa, Homo Sapiens
HVAARAGQT

SEQ ID NO: 111095 - protein, 9 aa, Homo Sapiens
FTLGTTAAT

SEQ ID NO: 111096 - protein, 9 aa, Homo Sapiens
KDTSQPWKK

SEQ ID NO: 111097 - protein, 9 aa, Homo Sapiens
PAKRLGRYH

SEQ ID NO: 111098 - protein, 9 aa, Homo Sapiens
FLPSSEVAK

SEQ ID NO: 111099 - protein, 9 aa, Homo Sapiens
PTDFFIVME

SEQ ID NO: 111100 - protein, 9 aa, Homo Sapiens
LSGNSLWKY

SEQ ID NO: 111101 - protein, 9 aa, Homo Sapiens
TVFYHSPYP

SEQ ID NO: 111102 - protein, 9 aa, Homo Sapiens
RVKRSRSDA

SEQ ID NO: 111103 - protein, 9 aa, Homo Sapiens
FYRPNLDNR

SEQ ID NO: 111104 - protein, 9 aa, Homo Sapiens
RVCTIRNTE

SEQ ID NO: 111105 - protein, 9 aa, Homo Sapiens
HIRNLQKLI

SEQ ID NO: 111106 - protein, 9 aa, Homo Sapiens
GLVTQSGCR

SEQ ID NO: 111107 - protein, 9 aa, Homo Sapiens
VELFFLNAE

SEQ ID NO: 111108 - protein, 9 aa, Homo Sapiens
MIKNCNREY

SEQ ID NO: 111109 - protein, 9 aa, Homo Sapiens
KLLDNLVMA

SEQ ID NO: 111110 - protein, 9 aa, Homo Sapiens
GPPESSGPP

SEQ ID NO: 111111 - protein, 9 aa, Homo Sapiens
QWQLAQLEA

SEQ ID NO: 111112 - protein, 9 aa, Homo Sapiens
QIWNLNPVF

SEQ ID NO: 111113 - protein, 9 aa, Homo Sapiens
LYFPEQPYS

SEQ ID NO: 111114 - protein, 9 aa, Homo Sapiens
LWREKNAEQ

SEQ ID NO: 111115 - protein, 9 aa, Homo Sapiens
TKQEKDFLW

SEQ ID NO: 111116 - protein, 9 aa, Homo Sapiens
FKDAKACAE

SEQ ID NO: 111117 - protein, 9 aa, Homo Sapiens
SQEGNYYFY

SEQ ID NO: 111118 - protein, 9 aa, Homo Sapiens
IGIPAKRLG

SEQ ID NO: 111119 - protein, 9 aa, Homo Sapiens
ASVVFCTSP

SEQ ID NO: 111120 - protein, 9 aa, Homo Sapiens
AIKLVDFKD

SEQ ID NO: 111121 - protein, 9 aa, Homo Sapiens
LRVCTIRNT

SEQ ID NO: 111122 - protein, 9 aa, Homo Sapiens
EKEEELQVS

SEQ ID NO: 111123 - protein, 9 aa, Homo Sapiens
PKTIVFINH

SEQ ID NO: 111124 - protein, 9 aa, Homo Sapiens
DQRGLVQHG

SEQ ID NO: 111125 - protein, 9 aa, Homo Sapiens
DSGNYSNEN

SEQ ID NO: 111126 - protein, 9 aa, Homo Sapiens
ELCTEERHH

SEQ ID NO: 111127 - protein, 9 aa, Homo Sapiens
DNLVMADKS

SEQ ID NO: 111128 - protein, 9 aa, Homo Sapiens
NFYISRALE

SEQ ID NO: 111129 - protein, 9 aa, Homo Sapiens
FFIVMEYVS

SEQ ID NO: 111130 - protein, 9 aa, Homo Sapiens
GTSILQSVG

SEQ ID NO: 111131 - protein, 9 aa, Homo Sapiens
HTSSTAAPI

SEQ ID NO: 111132 - protein, 9 aa, Homo Sapiens
VYSYSEKEF

SEQ ID NO: 111133 - protein, 9 aa, Homo Sapiens
YLGHIRNLQ

SEQ ID NO: 111134 - protein, 9 aa, Homo Sapiens
ENQHRKLNL

SEQ ID NO: 111135 - protein, 9 aa, Homo Sapiens
IWNLNPVFG

SEQ ID NO: 111136 - protein, 9 aa, Homo Sapiens
RISLRYVAP

SEQ ID NO: 111137 - protein, 9 aa, Homo Sapiens
QRVKRSRSD

SEQ ID NO: 111138 - protein, 9 aa, Homo Sapiens
IFEMNEERL

SEQ ID NO: 111139 - protein, 9 aa, Homo Sapiens
PSSSKTRPE

SEQ ID NO: 111140 - protein, 9 aa, Homo Sapiens
SFSEDGYKM

SEQ ID NO: 111141 - protein, 9 aa, Homo Sapiens
VYSGKVLLH

SEQ ID NO: 111142 - protein, 9 aa, Homo Sapiens
TTMQRLIPP

SEQ ID NO: 111143 - protein, 9 aa, Homo Sapiens
ASMYNYAEQ

SEQ ID NO: 111144 - protein, 9 aa, Homo Sapiens
NDHVNVRIN

SEQ ID NO: 111145 - protein, 9 aa, Homo Sapiens
SIVTPKLLD

SEQ ID NO: 111146 - protein, 9 aa, Homo Sapiens
EFFYVHFFR

SEQ ID NO: 111147 - protein, 9 aa, Homo Sapiens
FFFSRPSPK

SEQ ID NO: 111148 - protein, 9 aa, Homo Sapiens
PPAASCAVQ

SEQ ID NO: 111149 - protein, 9 aa, Homo Sapiens
QDHLRQQRA

SEQ ID NO: 111150 - protein, 9 aa, Homo Sapiens
ESLLLRVCT

SEQ ID NO: 111151 - protein, 9 aa, Homo Sapiens
QNALGFTLG

SEQ ID NO: 111152 - protein, 9 aa, Homo Sapiens
TVCENAQLG

SEQ ID NO: 111153 - protein, 9 aa, Homo Sapiens
DHEIITLER

SEQ ID NO: 111154 - protein, 9 aa, Homo Sapiens
VMQLAEMCF

SEQ ID NO: 111155 - protein, 9 aa, Homo Sapiens
PASVCRYIR

SEQ ID NO: 111156 - protein, 9 aa, Homo Sapiens
AFNKQILCL

SEQ ID NO: 111157 - protein, 9 aa, Homo Sapiens
LSFAEDEKW

SEQ ID NO: 111158 - protein, 9 aa, Homo Sapiens
ACSNKRRQS

SEQ ID NO: 111159 - protein, 9 aa, Homo Sapiens
STHHTYGLS

SEQ ID NO: 111160 - protein, 9 aa, Homo Sapiens
SCAVQPHYQ

SEQ ID NO: 111161 - protein, 9 aa, Homo Sapiens
VHFFRFWMK

SEQ ID NO: 111162 - protein, 9 aa, Homo Sapiens
TGRFPGNYV

SEQ ID NO: 111163 - protein, 9 aa, Homo Sapiens
CCCVTYCEG

SEQ ID NO: 111164 - protein, 9 aa, Homo Sapiens
PNVLNDHVN

SEQ ID NO: 111165 - protein, 9 aa, Homo Sapiens
KDPSCPRLS

SEQ ID NO: 111166 - protein, 9 aa, Homo Sapiens
HQIKEELFA

SEQ ID NO: 111167 - protein, 9 aa, Homo Sapiens
CSQEGNYYF

SEQ ID NO: 111168 - protein, 9 aa, Homo Sapiens
FICHNQFSL

SEQ ID NO: 111169 - protein, 9 aa, Homo Sapiens
KLKVALFSR

SEQ ID NO: 111170 - protein, 9 aa, Homo Sapiens
APVPLPCAS

SEQ ID NO: 111171 - protein, 9 aa, Homo Sapiens
YETEKAFSH

SEQ ID NO: 111172 - protein, 9 aa, Homo Sapiens
LGFTLGTTA

SEQ ID NO: 111173 - protein, 9 aa, Homo Sapiens
MYNYAEQTL

SEQ ID NO: 111174 - protein, 9 aa, Homo Sapiens
LLTQYRISL

SEQ ID NO: 111175 - protein, 9 aa, Homo Sapiens
IKLMPVPQQ

SEQ ID NO: 111176 - protein, 9 aa, Homo Sapiens
RPEPGQFLN

SEQ ID NO: 111177 - protein, 9 aa, Homo Sapiens
GYVPCIAFY

SEQ ID NO: 111178 - protein, 9 aa, Homo Sapiens
NENESESKT

SEQ ID NO: 111179 - protein, 9 aa, Homo Sapiens
QYHERIHTG

SEQ ID NO: 111180 - protein, 9 aa, Homo Sapiens
LTHSAVMGH

SEQ ID NO: 111181 - protein, 9 aa, Homo Sapiens
MNTIMPCQD

SEQ ID NO: 111182 - protein, 9 aa, Homo Sapiens
PVEETVFYH

SEQ ID NO: 111183 - protein, 9 aa, Homo Sapiens
LCSQEGNYY

SEQ ID NO: 111184 - protein, 9 aa, Homo Sapiens
KGNDILELK

SEQ ID NO: 111185 - protein, 9 aa, Homo Sapiens
LHVAARAGQ

SEQ ID NO: 111186 - protein, 9 aa, Homo Sapiens
FKKLKVALF

SEQ ID NO: 111187 - protein, 9 aa, Homo Sapiens
SHHNTAHSY

SEQ ID NO: 111188 - protein, 9 aa, Homo Sapiens
GSAHTLVNH

SEQ ID NO: 111189 - protein, 9 aa, Homo Sapiens
RNALIHQLN

SEQ ID NO: 111190 - protein, 9 aa, Homo Sapiens
LFYNFLPRG

SEQ ID NO: 111191 - protein, 9 aa, Homo Sapiens
LIHQLNTFQ

SEQ ID NO: 111192 - protein, 9 aa, Homo Sapiens
YHRGLVTQS

SEQ ID NO: 111193 - protein, 9 aa, Homo Sapiens
SQPWKKLRV

SEQ ID NO: 111194 - protein, 9 aa, Homo Sapiens
DQEETKQTF

SEQ ID NO: 111195 - protein, 9 aa, Homo Sapiens
GLEVGLEEG

SEQ ID NO: 111196 - protein, 9 aa, Homo Sapiens
ASELGSFEN

SEQ ID NO: 111197 - protein, 9 aa, Homo Sapiens
GYVRQPMVD

SEQ ID NO: 111198 - protein, 9 aa, Homo Sapiens
TGFSHPLTH

SEQ ID NO: 111199 - protein, 9 aa, Homo Sapiens
YLKQHEKLN

SEQ ID NO: 111200 - protein, 9 aa, Homo Sapiens
SLWKYRYSC

SEQ ID NO: 111201 - protein, 9 aa, Homo Sapiens
VLNDHVNVR

SEQ ID NO: 111202 - protein, 9 aa, Homo Sapiens
IPAKRLGRY

SEQ ID NO: 111203 - protein, 9 aa, Homo Sapiens
EMCFPLEAC

SEQ ID NO: 111204 - protein, 9 aa, Homo Sapiens
TQDHLRQQR

SEQ ID NO: 111205 - protein, 9 aa, Homo Sapiens
ASLCLLGCA

SEQ ID NO: 111206 - protein, 9 aa, Homo Sapiens
NLIMEGRAA

SEQ ID NO: 111207 - protein, 9 aa, Homo Sapiens
DYKVDDSEE

SEQ ID NO: 111208 - protein, 9 aa, Homo Sapiens
ISSKQEINR

SEQ ID NO: 111209 - protein, 9 aa, Homo Sapiens
AVVHMNVKE

SEQ ID NO: 111210 - protein, 9 aa, Homo Sapiens
SELGSFENQ

SEQ ID NO: 111211 - protein, 9 aa, Homo Sapiens
YSNENESES

SEQ ID NO: 111212 - protein, 9 aa, Homo Sapiens
VQLYETEKA

SEQ ID NO: 111213 - protein, 9 aa, Homo Sapiens
VVSHQIKEE

SEQ ID NO: 111214 - protein, 9 aa, Homo Sapiens
NVKEVSGRL

SEQ ID NO: 111215 - protein, 9 aa, Homo Sapiens
REKNAEQQA

SEQ ID NO: 111216 - protein, 9 aa, Homo Sapiens
GVPPMAEGK

SEQ ID NO: 111217 - protein, 9 aa, Homo Sapiens
SVVFCTSPM

SEQ ID NO: 111218 - protein, 9 aa, Homo Sapiens
TPSSSKTRP

SEQ ID NO: 111219 - protein, 9 aa, Homo Sapiens
GPPGPASED

SEQ ID NO: 111220 - protein, 9 aa, Homo Sapiens
SKIACSNKR

SEQ ID NO: 111221 - protein, 9 aa, Homo Sapiens
RFYGQSKEG

SEQ ID NO: 111222 - protein, 9 aa, Homo Sapiens
ASSGSAHTL

SEQ ID NO: 111223 - protein, 9 aa, Homo Sapiens
PATKRDCSC

SEQ ID NO: 111224 - protein, 9 aa, Homo Sapiens
QEVEEDKDP

SEQ ID NO: 111225 - protein, 9 aa, Homo Sapiens
EKGNDILEL

SEQ ID NO: 111226 - protein, 9 aa, Homo Sapiens
KIFEMNEER

SEQ ID NO: 111227 - protein, 9 aa, Homo Sapiens
FDRPSLVQY

SEQ ID NO: 111228 - protein, 9 aa, Homo Sapiens
AEVLFRGRD

SEQ ID NO: 111229 - protein, 9 aa, Homo Sapiens
LMPVPQQPS

SEQ ID NO: 111230 - protein, 9 aa, Homo Sapiens
MPCQDQYFV

SEQ ID NO: 111231 - protein, 9 aa, Homo Sapiens
LTQYRISLR

SEQ ID NO: 111232 - protein, 9 aa, Homo Sapiens
QSVGSKIAC

SEQ ID NO: 111233 - protein, 9 aa, Homo Sapiens
ICYGIGSPH

SEQ ID NO: 111234 - protein, 9 aa, Homo Sapiens
AWLFYHISR

SEQ ID NO: 111235 - protein, 9 aa, Homo Sapiens
GKDCPHMKD

SEQ ID NO: 111236 - protein, 9 aa, Homo Sapiens
NEVYSTLYS

SEQ ID NO: 111237 - protein, 9 aa, Homo Sapiens
FMGQDFKKL

SEQ ID NO: 111238 - protein, 9 aa, Homo Sapiens
DDSEEIIVC

SEQ ID NO: 111239 - protein, 9 aa, Homo Sapiens
EGDEFNNSI

SEQ ID NO: 111240 - protein, 9 aa, Homo Sapiens
SILQSVGSK

SEQ ID NO: 111241 - protein, 9 aa, Homo Sapiens
QYIRAGEGF

SEQ ID NO: 111242 - protein, 9 aa, Homo Sapiens
LAEMCFPLE

SEQ ID NO: 111243 - protein, 9 aa, Homo Sapiens
SASQIWNLN

SEQ ID NO: 111244 - protein, 9 aa, Homo Sapiens
MNVKEVSGR

SEQ ID NO: 111245 - protein, 9 aa, Homo Sapiens
YFPEQPYSS

SEQ ID NO: 111246 - protein, 9 aa, Homo Sapiens
QKNHLDYET

SEQ ID NO: 111247 - protein, 9 aa, Homo Sapiens
YKVDDSEEI

SEQ ID NO: 111248 - protein, 9 aa, Homo Sapiens
YMLLHLFIC

SEQ ID NO: 111249 - protein, 9 aa, Homo Sapiens
HELCTEERH

SEQ ID NO: 111250 - protein, 9 aa, Homo Sapiens
CSNKRRQSD

SEQ ID NO: 111251 - protein, 9 aa, Homo Sapiens
CFPLEACRK

SEQ ID NO: 111252 - protein, 9 aa, Homo Sapiens
CFSPPPYGE

SEQ ID NO: 111253 - protein, 9 aa, Homo Sapiens
SHQIKEELF

SEQ ID NO: 111254 - protein, 9 aa, Homo Sapiens
YVHFFRFWM

SEQ ID NO: 111255 - protein, 9 aa, Homo Sapiens
RNEVYSTLY

SEQ ID NO: 111256 - protein, 9 aa, Homo Sapiens
KKLKVALFS

SEQ ID NO: 111257 - protein, 9 aa, Homo Sapiens
VFGSLQRHE

SEQ ID NO: 111258 - protein, 9 aa, Homo Sapiens
LFEVQWQLA

SEQ ID NO: 111259 - protein, 9 aa, Homo Sapiens
PVPLPCASP

SEQ ID NO: 111260 - protein, 9 aa, Homo Sapiens
QRVVGPSYF

SEQ ID NO: 111261 - protein, 9 aa, Homo Sapiens
QFIKDVNPG

SEQ ID NO: 111262 - protein, 9 aa, Homo Sapiens
THHTYGLSK

SEQ ID NO: 111263 - protein, 9 aa, Homo Sapiens
YEIRMHLQE

SEQ ID NO: 111264 - protein, 9 aa, Homo Sapiens
PCIAFYAGL

SEQ ID NO: 111265 - protein, 9 aa, Homo Sapiens
DYETLAKLI

SEQ ID NO: 111266 - protein, 9 aa, Homo Sapiens
LYETEKAFS

SEQ ID NO: 111267 - protein, 9 aa, Homo Sapiens
VAAAAASMY

SEQ ID NO: 111268 - protein, 9 aa, Homo Sapiens
TEERHHIGD

SEQ ID NO: 111269 - protein, 9 aa, Homo Sapiens
ISCVPNLIM

SEQ ID NO: 111270 - protein, 9 aa, Homo Sapiens
WQKLYFPAS

SEQ ID NO: 111271 - protein, 9 aa, Homo Sapiens
FSSLMPSPA

SEQ ID NO: 111272 - protein, 9 aa, Homo Sapiens
AASCAVQPH

SEQ ID NO: 111273 - protein, 9 aa, Homo Sapiens
ISLWEFFYV

SEQ ID NO: 111274 - protein, 9 aa, Homo Sapiens
SGVPPMAEG

SEQ ID NO: 111275 - protein, 9 aa, Homo Sapiens
PGCVVEANP

SEQ ID NO: 111276 - protein, 9 aa, Homo Sapiens
MVAKHPVTH

SEQ ID NO: 111277 - protein, 9 aa, Homo Sapiens
VPLPCASPY

SEQ ID NO: 111278 - protein, 9 aa, Homo Sapiens
VHMNVKEVS

SEQ ID NO: 111279 - protein, 9 aa, Homo Sapiens
RRQSDLSGN

SEQ ID NO: 111280 - protein, 9 aa, Homo Sapiens
LSSTHHTYG

SEQ ID NO: 111281 - protein, 9 aa, Homo Sapiens
GYTCLLSAI

SEQ ID NO: 111282 - protein, 9 aa, Homo Sapiens
PAEVLFRGR

SEQ ID NO: 111283 - protein, 9 aa, Homo Sapiens
QVSFEPPKW

SEQ ID NO: 111284 - protein, 9 aa, Homo Sapiens
THPNKIKAF

SEQ ID NO: 111285 - protein, 9 aa, Homo Sapiens
GNSLWKYRY

SEQ ID NO: 111286 - protein, 9 aa, Homo Sapiens
PKLLDNLVM

SEQ ID NO: 111287 - protein, 9 aa, Homo Sapiens
EGKKPSKRP

SEQ ID NO: 111288 - protein, 9 aa, Homo Sapiens
GFSHPLTHS

SEQ ID NO: 111289 - protein, 9 aa, Homo Sapiens
TAAWQLLSP

SEQ ID NO: 111290 - protein, 9 aa, Homo Sapiens
ELCAARVLE

SEQ ID NO: 111291 - protein, 9 aa, Homo Sapiens
DVTPQPLYH

SEQ ID NO: 111292 - protein, 9 aa, Homo Sapiens
EADAIKLMP

SEQ ID NO: 111293 - protein, 9 aa, Homo Sapiens
TDVTPQPLY

SEQ ID NO: 111294 - protein, 9 aa, Homo Sapiens
LLVQLYETE

SEQ ID NO: 111295 - protein, 9 aa, Homo Sapiens
GQNALGFTL

SEQ ID NO: 111296 - protein, 9 aa, Homo Sapiens
PNGCLQLSG

SEQ ID NO: 111297 - protein, 9 aa, Homo Sapiens
RLLVQLYET

SEQ ID NO: 111298 - protein, 9 aa, Homo Sapiens
RVLEVLQNR

SEQ ID NO: 111299 - protein, 9 aa, Homo Sapiens
PAPVPLPCA

SEQ ID NO: 111300 - protein, 9 aa, Homo Sapiens
AQLGQVIQK

SEQ ID NO: 111301 - protein, 9 aa, Homo Sapiens
FRNEVYSTL

SEQ ID NO: 111302 - protein, 9 aa, Homo Sapiens
TRLHVAARA

SEQ ID NO: 111303 - protein, 9 aa, Homo Sapiens
PSLVQYHER

SEQ ID NO: 111304 - protein, 9 aa, Homo Sapiens
RNYLWREKN

SEQ ID NO: 111305 - protein, 9 aa, Homo Sapiens
QYRISLRYV

SEQ ID NO: 111306 - protein, 9 aa, Homo Sapiens
PLTHSAVMG

SEQ ID NO: 111307 - protein, 9 aa, Homo Sapiens
VVHMNVKEV

SEQ ID NO: 111308 - protein, 9 aa, Homo Sapiens
SEDGYKMHP

SEQ ID NO: 111309 - protein, 9 aa, Homo Sapiens
FSRYVPTHF

SEQ ID NO: 111310 - protein, 9 aa, Homo Sapiens
TDFFIVMEY

SEQ ID NO: 111311 - protein, 9 aa, Homo Sapiens
EVGLEEGSG

SEQ ID NO: 111312 - protein, 9 aa, Homo Sapiens
TPGPGSVWL

SEQ ID NO: 111313 - protein, 9 aa, Homo Sapiens
SYYPYPYCY

SEQ ID NO: 111314 - protein, 9 aa, Homo Sapiens
ITKQEKDFL

SEQ ID NO: 111315 - protein, 9 aa, Homo Sapiens
VNPGEPKEE

SEQ ID NO: 111316 - protein, 9 aa, Homo Sapiens
DDHEIITLE

SEQ ID NO: 111317 - protein, 9 aa, Homo Sapiens
TSQPWKKLR

SEQ ID NO: 111318 - protein, 9 aa, Homo Sapiens
NMIKNCNRE

SEQ ID NO: 111319 - protein, 9 aa, Homo Sapiens
KVDDSEEII

SEQ ID NO: 111320 - protein, 9 aa, Homo Sapiens
EGTAAWQLL

SEQ ID NO: 111321 - protein, 9 aa, Homo Sapiens
GCALLCCSC

SEQ ID NO: 111322 - protein, 9 aa, Homo Sapiens
ATKRDCSCE

SEQ ID NO: 111323 - protein, 9 aa, Homo Sapiens
YSSRLYVPM

SEQ ID NO: 111324 - protein, 9 aa, Homo Sapiens
WEFFYVHFF

SEQ ID NO: 111325 - protein, 9 aa, Homo Sapiens
GLRSHGGGR

SEQ ID NO: 111326 - protein, 9 aa, Homo Sapiens
KDAKACAEM

SEQ ID NO: 111327 - protein, 9 aa, Homo Sapiens
AGYVRQPMV

SEQ ID NO: 111328 - protein, 9 aa, Homo Sapiens
GGLRSHGGG

SEQ ID NO: 111329 - protein, 9 aa, Homo Sapiens
FLNAEACVH

SEQ ID NO: 111330 - protein, 9 aa, Homo Sapiens
DNMIKNCNR

SEQ ID NO: 111331 - protein, 9 aa, Homo Sapiens
LLSYYPYPY

SEQ ID NO: 111332 - protein, 9 aa, Homo Sapiens
IVVRGYAIC

SEQ ID NO: 111333 - protein, 9 aa, Homo Sapiens
EKWKRIRTL

SEQ ID NO: 111334 - protein, 9 aa, Homo Sapiens
EDEKWKRIR

SEQ ID NO: 111335 - protein, 9 aa, Homo Sapiens
LRQQRASAR

SEQ ID NO: 111336 - protein, 9 aa, Homo Sapiens
LFRGRDFVM

SEQ ID NO: 111337 - protein, 9 aa, Homo Sapiens
QEGNYYFYE

SEQ ID NO: 111338 - protein, 9 aa, Homo Sapiens
VFYHSPYPI

SEQ ID NO: 111339 - protein, 9 aa, Homo Sapiens
SSGSAHTLV

SEQ ID NO: 111340 - protein, 9 aa, Homo Sapiens
HMKDKGALK

SEQ ID NO: 111341 - protein, 9 aa, Homo Sapiens
RVVGPSYFV

SEQ ID NO: 111342 - protein, 9 aa, Homo Sapiens
QPLYHPDPL

SEQ ID NO: 111343 - protein, 9 aa, Homo Sapiens
EETVFYHSP

SEQ ID NO: 111344 - protein, 9 aa, Homo Sapiens
FPASVCRYI

SEQ ID NO: 111345 - protein, 9 aa, Homo Sapiens
LCAARVLEV

SEQ ID NO: 111346 - protein, 9 aa, Homo Sapiens
KAFLPSSEV

SEQ ID NO: 111347 - protein, 9 aa, Homo Sapiens
GSLPGCVVE

SEQ ID NO: 111348 - protein, 9 aa, Homo Sapiens
MKKGIRARI

SEQ ID NO: 111349 - protein, 9 aa, Homo Sapiens
KLDCLTLIP

SEQ ID NO: 111350 - protein, 9 aa, Homo Sapiens
NKRRQSDLS

SEQ ID NO: 111351 - protein, 9 aa, Homo Sapiens
FYHISRASD

SEQ ID NO: 111352 - protein, 9 aa, Homo Sapiens
QILCLFRPQ

SEQ ID NO: 111353 - protein, 9 aa, Homo Sapiens
YYFYEIITE

SEQ ID NO: 111354 - protein, 9 aa, Homo Sapiens
RSHGGGRDC

SEQ ID NO: 111355 - protein, 9 aa, Homo Sapiens
HGPPGPASE

SEQ ID NO: 111356 - protein, 9 aa, Homo Sapiens
WNLNPVFGG

SEQ ID NO: 111357 - protein, 9 aa, Homo Sapiens
SPKTQDHLR

SEQ ID NO: 111358 - protein, 9 aa, Homo Sapiens
EDGYKMHPK

SEQ ID NO: 111359 - protein, 9 aa, Homo Sapiens
EKEFICHNQ

SEQ ID NO: 111360 - protein, 9 aa, Homo Sapiens
SSATCCCCV

SEQ ID NO: 111361 - protein, 9 aa, Homo Sapiens
TQYRISLRY

SEQ ID NO: 111362 - protein, 9 aa, Homo Sapiens
LHTTPPHVI

SEQ ID NO: 111363 - protein, 9 aa, Homo Sapiens
PYLGHIRNL

SEQ ID NO: 111364 - protein, 9 aa, Homo Sapiens
VMNGVTGRF

SEQ ID NO: 111365 - protein, 9 aa, Homo Sapiens
KEFICHNQF

SEQ ID NO: 111366 - protein, 9 aa, Homo Sapiens
GSLFEVQWQ

SEQ ID NO: 111367 - protein, 9 aa, Homo Sapiens
SKTRPEPGQ

SEQ ID NO: 111368 - protein, 9 aa, Homo Sapiens
KMTFKIFEM

SEQ ID NO: 111369 - protein, 9 aa, Homo Sapiens
CLQLSGTVK

SEQ ID NO: 111370 - protein, 9 aa, Homo Sapiens
FVFVANSES

SEQ ID NO: 111371 - protein, 9 aa, Homo Sapiens
MQLAEMCFP

SEQ ID NO: 111372 - protein, 9 aa, Homo Sapiens
DYVVSHQIK

SEQ ID NO: 111373 - protein, 9 aa, Homo Sapiens
KILFYNFLP

SEQ ID NO: 111374 - protein, 9 aa, Homo Sapiens
DVIKTRLHV

SEQ ID NO: 111375 - protein, 9 aa, Homo Sapiens
EEEGTAAWQ

SEQ ID NO: 111376 - protein, 9 aa, Homo Sapiens
AFLPSSEVA

SEQ ID NO: 111377 - protein, 9 aa, Homo Sapiens
LSGTVKSSF

SEQ ID NO: 111378 - protein, 9 aa, Homo Sapiens
LSFSEDGYK

SEQ ID NO: 111379 - protein, 9 aa, Homo Sapiens
FPEQPYSSR

SEQ ID NO: 111380 - protein, 9 aa, Homo Sapiens
FIVMEYVSG

SEQ ID NO: 111381 - protein, 9 aa, Homo Sapiens
FTPYLGHIR

SEQ ID NO: 111382 - protein, 9 aa, Homo Sapiens
FSVFGSLQR

SEQ ID NO: 111383 - protein, 9 aa, Homo Sapiens
GTAAWQLLS

SEQ ID NO: 111384 - protein, 9 aa, Homo Sapiens
VHRKSVKKR

SEQ ID NO: 111385 - protein, 9 aa, Homo Sapiens
AKRLGRYHQ

SEQ ID NO: 111386 - protein, 9 aa, Homo Sapiens
TPQPLYHPD

SEQ ID NO: 111387 - protein, 9 aa, Homo Sapiens
CMRIGIPAK

SEQ ID NO: 111388 - protein, 9 aa, Homo Sapiens
NALIHQLNT

SEQ ID NO: 111389 - protein, 9 aa, Homo Sapiens
GSFENQHRK

SEQ ID NO: 111390 - protein, 9 aa, Homo Sapiens
GPVASVVFC

SEQ ID NO: 111391 - protein, 9 aa, Homo Sapiens
DCPHMKDKG

SEQ ID NO: 111392 - protein, 9 aa, Homo Sapiens
REKGNDILE

SEQ ID NO: 111393 - protein, 9 aa, Homo Sapiens
QIAGYVRQP

SEQ ID NO: 111394 - protein, 9 aa, Homo Sapiens
YVRQPMVDV

SEQ ID NO: 111395 - protein, 9 aa, Homo Sapiens
ATKEAEFWE

SEQ ID NO: 111396 - protein, 9 aa, Homo Sapiens
NAWLFYHIS

SEQ ID NO: 111397 - protein, 9 aa, Homo Sapiens
SFDYKVDDS

SEQ ID NO: 111398 - protein, 9 aa, Homo Sapiens
PSIEKTSFF

SEQ ID NO: 111399 - protein, 9 aa, Homo Sapiens
GHIRNLQKL

SEQ ID NO: 111400 - protein, 9 aa, Homo Sapiens
EQPYSSRLY

SEQ ID NO: 111401 - protein, 9 aa, Homo Sapiens
FWERLTQFL

SEQ ID NO: 111402 - protein, 9 aa, Homo Sapiens
EETKQTFDI

SEQ ID NO: 111403 - protein, 9 aa, Homo Sapiens
NAQLGQVIQ

SEQ ID NO: 111404 - protein, 9 aa, Homo Sapiens
LGGGGLRSH

SEQ ID NO: 111405 - protein, 9 aa, Homo Sapiens
TCCCCVTYC

SEQ ID NO: 111406 - protein, 9 aa, Homo Sapiens
KVGTPGPGS

SEQ ID NO: 111407 - protein, 9 aa, Homo Sapiens
HEKLNLILQ

SEQ ID NO: 111408 - protein, 9 aa, Homo Sapiens
FAEDEKWKR

SEQ ID NO: 111409 - protein, 9 aa, Homo Sapiens
IMPCQDQYF

SEQ ID NO: 111410 - protein, 9 aa, Homo Sapiens
YIIVGSHHN

SEQ ID NO: 111411 - protein, 9 aa, Homo Sapiens
VPPMAEGKK

SEQ ID NO: 111412 - protein, 9 aa, Homo Sapiens
AEFWERLTQ

SEQ ID NO: 111413 - protein, 9 aa, Homo Sapiens
GNYSNENES

SEQ ID NO: 111414 - protein, 9 aa, Homo Sapiens
FFSRPSPKT

SEQ ID NO: 111415 - protein, 9 aa, Homo Sapiens
QFTPYLGHI

SEQ ID NO: 111416 - protein, 9 aa, Homo Sapiens
ASVCRYIRI

SEQ ID NO: 111417 - protein, 9 aa, Homo Sapiens
LLGCALLCC

SEQ ID NO: 111418 - protein, 9 aa, Homo Sapiens
FGDIISSKQ

SEQ ID NO: 111419 - protein, 9 aa, Homo Sapiens
LSASQIWNL

SEQ ID NO: 111420 - protein, 9 aa, Homo Sapiens
HTYGLSKIR

SEQ ID NO: 111421 - protein, 9 aa, Homo Sapiens
ESEGFAGMK

SEQ ID NO: 111422 - protein, 9 aa, Homo Sapiens
AKHPVTHSH

SEQ ID NO: 111423 - protein, 9 aa, Homo Sapiens
DPLSEITKQ

SEQ ID NO: 111424 - protein, 9 aa, Homo Sapiens
NAVSAKEDG

SEQ ID NO: 111425 - protein, 9 aa, Homo Sapiens
IKLVDFKDA

SEQ ID NO: 111426 - protein, 9 aa, Homo Sapiens
CCCCVTYCE

SEQ ID NO: 111427 - protein, 9 aa, Homo Sapiens
FNKQILCLF

SEQ ID NO: 111428 - protein, 9 aa, Homo Sapiens
SGPPEREAA

SEQ ID NO: 111429 - protein, 9 aa, Homo Sapiens
ALIHQLNTF

SEQ ID NO: 111430 - protein, 9 aa, Homo Sapiens
RIGIPAKRL

SEQ ID NO: 111431 - protein, 9 aa, Homo Sapiens
FYNFLPRGF

SEQ ID NO: 111432 - protein, 9 aa, Homo Sapiens
GVASNFYIS

SEQ ID NO: 111433 - protein, 9 aa, Homo Sapiens
QHGADQHGL

SEQ ID NO: 111434 - protein, 9 aa, Homo Sapiens
EVLFRGRDF

SEQ ID NO: 111435 - protein, 9 aa, Homo Sapiens
YGQSKEGDE

SEQ ID NO: 111436 - protein, 9 aa, Homo Sapiens
TMQRLIPPF

SEQ ID NO: 111437 - protein, 9 aa, Homo Sapiens
DEIQGVIYE

SEQ ID NO: 111438 - protein, 9 aa, Homo Sapiens
DTIDDFRNE

SEQ ID NO: 111439 - protein, 9 aa, Homo Sapiens
IYDDDHEII

SEQ ID NO: 111440 - protein, 9 aa, Homo Sapiens
CGKAFSVFG

SEQ ID NO: 111441 - protein, 9 aa, Homo Sapiens
MTFKIFEMN

SEQ ID NO: 111442 - protein, 9 aa, Homo Sapiens
KRSRSDAHR

SEQ ID NO: 111443 - protein, 9 aa, Homo Sapiens
TAMRDQYIR

SEQ ID NO: 111444 - protein, 9 aa, Homo Sapiens
SSKQEINRL

SEQ ID NO: 111445 - protein, 9 aa, Homo Sapiens
HPVTHSHFT

SEQ ID NO: 111446 - protein, 9 aa, Homo Sapiens
PLPCASPYA

SEQ ID NO: 111447 - protein, 9 aa, Homo Sapiens
VTGRFPGNY

SEQ ID NO: 111448 - protein, 9 aa, Homo Sapiens
GKVLLHTTP

SEQ ID NO: 111449 - protein, 9 aa, Homo Sapiens
SFAEDEKWK

SEQ ID NO: 111450 - protein, 9 aa, Homo Sapiens
EEDKDPSCP

SEQ ID NO: 111451 - protein, 9 aa, Homo Sapiens
PESSGPPER

SEQ ID NO: 111452 - protein, 9 aa, Homo Sapiens
HSPYPIRSL

SEQ ID NO: 111453 - protein, 9 aa, Homo Sapiens
PAAGYVPCI

SEQ ID NO: 111454 - protein, 9 aa, Homo Sapiens
AAAAASMYN

SEQ ID NO: 111455 - protein, 9 aa, Homo Sapiens
AIKLMPVPQ

SEQ ID NO: 111456 - protein, 9 aa, Homo Sapiens
QLYETEKAF

SEQ ID NO: 111457 - protein, 9 aa, Homo Sapiens
EIQGVIYEI

SEQ ID NO: 111458 - protein, 9 aa, Homo Sapiens
TRASSQRVV

SEQ ID NO: 111459 - protein, 9 aa, Homo Sapiens
RLSASQIWN

SEQ ID NO: 111460 - protein, 9 aa, Homo Sapiens
QSKEGDEFN

SEQ ID NO: 111461 - protein, 9 aa, Homo Sapiens
KIACSNKRR

SEQ ID NO: 111462 - protein, 9 aa, Homo Sapiens
GVPAEVLFR

SEQ ID NO: 111463 - protein, 9 aa, Homo Sapiens
ENESESKTS

SEQ ID NO: 111464 - protein, 9 aa, Homo Sapiens
LLLRVCTIR

SEQ ID NO: 111465 - protein, 9 aa, Homo Sapiens
DKDPSCPRL

SEQ ID NO: 111466 - protein, 9 aa, Homo Sapiens
LWEFFYVHF

SEQ ID NO: 111467 - protein, 9 aa, Homo Sapiens
HGADQHGLV

SEQ ID NO: 111468 - protein, 9 aa, Homo Sapiens
TRPEPGQFL

SEQ ID NO: 111469 - protein, 9 aa, Homo Sapiens
PVASVVFCT

SEQ ID NO: 111470 - protein, 9 aa, Homo Sapiens
AVAAAAASM

SEQ ID NO: 111471 - protein, 9 aa, Homo Sapiens
VLEVLQNRV

SEQ ID NO: 111472 - protein, 9 aa, Homo Sapiens
YVVSHQIKE

SEQ ID NO: 111473 - protein, 9 aa, Homo Sapiens
VPNLIMEGR

SEQ ID NO: 111474 - protein, 9 aa, Homo Sapiens
HMNVKEVSG

SEQ ID NO: 111475 - protein, 9 aa, Homo Sapiens
VQWQLAQLE

SEQ ID NO: 111476 - protein, 9 aa, Homo Sapiens
GRFPGNYVE

SEQ ID NO: 111477 - protein, 9 aa, Homo Sapiens
SPPPYGEIY

SEQ ID NO: 111478 - protein, 9 aa, Homo Sapiens
EFICHNQFS

SEQ ID NO: 111479 - protein, 9 aa, Homo Sapiens
LPCASPYAY

SEQ ID NO: 111480 - protein, 9 aa, Homo Sapiens
AARVLEVLQ

SEQ ID NO: 111481 - protein, 9 aa, Homo Sapiens
EERDNMIKN

SEQ ID NO: 111482 - protein, 9 aa, Homo Sapiens
SGKVLLHTT

SEQ ID NO: 111483 - protein, 9 aa, Homo Sapiens
RVCEPLLSY

SEQ ID NO: 111484 - protein, 9 aa, Homo Sapiens
VLFRGRDFV

SEQ ID NO: 111485 - protein, 9 aa, Homo Sapiens
VNCFHKNKA

SEQ ID NO: 111486 - protein, 9 aa, Homo Sapiens
PSPKTQDHL

SEQ ID NO: 111487 - protein, 9 aa, Homo Sapiens
WERLTQFLE

SEQ ID NO: 111488 - protein, 9 aa, Homo Sapiens
QRLIPPFRE

SEQ ID NO: 111489 - protein, 9 aa, Homo Sapiens
IHQLNTFQF

SEQ ID NO: 111490 - protein, 9 aa, Homo Sapiens
IRNLQKLIL

SEQ ID NO: 111491 - protein, 9 aa, Homo Sapiens
LIGYTCLLS

SEQ ID NO: 111492 - protein, 9 aa, Homo Sapiens
ERNYLWREK

SEQ ID NO: 111493 - protein, 9 aa, Homo Sapiens
KEAEFWERL

SEQ ID NO: 111494 - protein, 9 aa, Homo Sapiens
AGYVPCIAF

SEQ ID NO: 111495 - protein, 9 aa, Homo Sapiens
LRSHGGGRD

SEQ ID NO: 111496 - protein, 9 aa, Homo Sapiens
IVNCFHKNK

SEQ ID NO: 111497 - protein, 9 aa, Homo Sapiens
EWQELEKLD

SEQ ID NO: 111498 - protein, 9 aa, Homo Sapiens
QHEKLNLIL

SEQ ID NO: 111499 - protein, 9 aa, Homo Sapiens
EMNEERLKI

SEQ ID NO: 111500 - protein, 9 aa, Homo Sapiens
AEDEKWKRI

SEQ ID NO: 111501 - protein, 9 aa, Homo Sapiens
FFLNAEACV

SEQ ID NO: 111502 - protein, 9 aa, Homo Sapiens
RPASSGSAH

SEQ ID NO: 111503 - protein, 9 aa, Homo Sapiens
SEITKQEKD

SEQ ID NO: 111504 - protein, 9 aa, Homo Sapiens
SLWEFFYVH

SEQ ID NO: 111505 - protein, 9 aa, Homo Sapiens
WREKNAEQQ

SEQ ID NO: 111506 - protein, 9 aa, Homo Sapiens
SGVPAEVLF

SEQ ID NO: 111507 - protein, 9 aa, Homo Sapiens
EFWERLTQF

SEQ ID NO: 111508 - protein, 9 aa, Homo Sapiens
EKTSFFSSL

SEQ ID NO: 111509 - protein, 9 aa, Homo Sapiens
ALSFAEDEK

SEQ ID NO: 111510 - protein, 9 aa, Homo Sapiens
PNAVSAKED

SEQ ID NO: 111511 - protein, 9 aa, Homo Sapiens
DDFRNEVYS

SEQ ID NO: 111512 - protein, 9 aa, Homo Sapiens
FFYVHFFRF

SEQ ID NO: 111513 - protein, 9 aa, Homo Sapiens
TFKIFEMNE

SEQ ID NO: 111514 - protein, 9 aa, Homo Sapiens
HGGGRDCMV

SEQ ID NO: 111515 - protein, 9 aa, Homo Sapiens
IAGYVRQPM

SEQ ID NO: 111516 - protein, 9 aa, Homo Sapiens
CPKTIVFIN

SEQ ID NO: 111517 - protein, 9 aa, Homo Sapiens
YDDDHEIIT

SEQ ID NO: 111518 - protein, 9 aa, Homo Sapiens
VFVANSEST

SEQ ID NO: 111519 - protein, 9 aa, Homo Sapiens
LLYFPEQPY

SEQ ID NO: 111520 - protein, 9 aa, Homo Sapiens
RAPEEGLEV

SEQ ID NO: 111521 - protein, 9 aa, Homo Sapiens
ASNFYISRA

SEQ ID NO: 111522 - protein, 9 aa, Homo Sapiens
EGNYYFYEI

SEQ ID NO: 111523 - protein, 9 aa, Homo Sapiens
FYGQSKEGD

SEQ ID NO: 111524 - protein, 9 aa, Homo Sapiens
DFKDAKACA

SEQ ID NO: 111525 - protein, 9 aa, Homo Sapiens
KEADAIKLM

SEQ ID NO: 111526 - protein, 9 aa, Homo Sapiens
VGSHHNTAH

SEQ ID NO: 111527 - protein, 9 aa, Homo Sapiens
QELEKLDCL

SEQ ID NO: 111528 - protein, 9 aa, Homo Sapiens
DVNPGEPKE

SEQ ID NO: 111529 - protein, 9 aa, Homo Sapiens
ILFYNFLPR

SEQ ID NO: 111530 - protein, 9 aa, Homo Sapiens
LSYYPYPYC

SEQ ID NO: 111531 - protein, 9 aa, Homo Sapiens
RASSQRVVG

SEQ ID NO: 111532 - protein, 9 aa, Homo Sapiens
CIAFYAGLR

SEQ ID NO: 111533 - protein, 9 aa, Homo Sapiens
HVNVRINCI

SEQ ID NO: 111534 - protein, 9 aa, Homo Sapiens
SHGGGRDCM

SEQ ID NO: 111535 - protein, 9 aa, Homo Sapiens
ISRALEILT

SEQ ID NO: 111536 - protein, 9 aa, Homo Sapiens
DFFIVMEYV

SEQ ID NO: 111537 - protein, 9 aa, Homo Sapiens
PLDYVVSHQ

SEQ ID NO: 111538 - protein, 9 aa, Homo Sapiens
VVFCTSPMA

SEQ ID NO: 111539 - protein, 9 aa, Homo Sapiens
AFSVFGSLQ

SEQ ID NO: 111540 - protein, 9 aa, Homo Sapiens
LDYETLAKL

SEQ ID NO: 111541 - protein, 9 aa, Homo Sapiens
PPGPASEDG

SEQ ID NO: 111542 - protein, 9 aa, Homo Sapiens
CALLCCSCP

SEQ ID NO: 111543 - protein, 9 aa, Homo Sapiens
MRIGIPAKR

SEQ ID NO: 111544 - protein, 9 aa, Homo Sapiens
QSDLSGNSL

SEQ ID NO: 111545 - protein, 9 aa, Homo Sapiens
ENAQLGQVI

SEQ ID NO: 111546 - protein, 9 aa, Homo Sapiens
PKTQDHLRQ

SEQ ID NO: 111547 - protein, 9 aa, Homo Sapiens
GVTGRFPGN

SEQ ID NO: 111548 - protein, 9 aa, Homo Sapiens
SGNSLWKYR

SEQ ID NO: 111549 - protein, 9 aa, Homo Sapiens
KDKGALKQN

SEQ ID NO: 111550 - protein, 9 aa, Homo Sapiens
CTESKVGTP

SEQ ID NO: 111551 - protein, 9 aa, Homo Sapiens
CEPYCSCSD

SEQ ID NO: 111552 - protein, 9 aa, Homo Sapiens
SCEPYCSCS

SEQ ID NO: 111553 - protein, 9 aa, Homo Sapiens
FTAMRDQYI

SEQ ID NO: 111554 - protein, 9 aa, Homo Sapiens
VEETVFYHS

SEQ ID NO: 111555 - protein, 9 aa, Homo Sapiens
EPPAASCAV

SEQ ID NO: 111556 - protein, 9 aa, Homo Sapiens
QVHLFYMLL

SEQ ID NO: 111557 - protein, 9 aa, Homo Sapiens
TIDDFRNEV

SEQ ID NO: 111558 - protein, 9 aa, Homo Sapiens
DVFVFVANS

SEQ ID NO: 111559 - protein, 9 aa, Homo Sapiens
KGKKPSKRP

SEQ ID NO: 111560 - protein, 9 aa, Homo Sapiens
ETPSSSKTR

SEQ ID NO: 111561 - protein, 9 aa, Homo Sapiens
WKKLRVAGR

SEQ ID NO: 111562 - protein, 9 aa, Homo Sapiens
IACSNKRRQ

SEQ ID NO: 111563 - protein, 9 aa, Homo Sapiens
SKVGTPGPG

SEQ ID NO: 111564 - protein, 9 aa, Homo Sapiens
REPPAASCA

SEQ ID NO: 111565 - protein, 9 aa, Homo Sapiens
GFAGMKKGI

SEQ ID NO: 111566 - protein, 9 aa, Homo Sapiens
VEEDKDPSC

SEQ ID NO: 111567 - protein, 9 aa, Homo Sapiens
YAICYGIGS

SEQ ID NO: 111568 - protein, 9 aa, Homo Sapiens
ARVLEVLQN

SEQ ID NO: 111569 - protein, 9 aa, Homo Sapiens
EKLDCLTLI

SEQ ID NO: 111570 - protein, 9 aa, Homo Sapiens
VLLHTTPPH

SEQ ID NO: 111571 - protein, 9 aa, Homo Sapiens
ASCAVQPHY

SEQ ID NO: 111572 - protein, 9 aa, Homo Sapiens
MGQDFKKLK

SEQ ID NO: 111573 - protein, 9 aa, Homo Sapiens
CSCEPYCSC

SEQ ID NO: 111574 - protein, 9 aa, Homo Sapiens
LNDHVNVRI

SEQ ID NO: 111575 - protein, 9 aa, Homo Sapiens
THFVPYAVQ

SEQ ID NO: 111576 - protein, 9 aa, Homo Sapiens
KWKRIRTLL

SEQ ID NO: 111577 - protein, 9 aa, Homo Sapiens
PGPPESSGP

SEQ ID NO: 111578 - protein, 9 aa, Homo Sapiens
WQLAQLEAR

SEQ ID NO: 111579 - protein, 9 aa, Homo Sapiens
LQSVGSKIA

SEQ ID NO: 111580 - protein, 9 aa, Homo Sapiens
RSLGSLPGC

SEQ ID NO: 111581 - protein, 9 aa, Homo Sapiens
PQPLYHPDP

SEQ ID NO: 111582 - protein, 9 aa, Homo Sapiens
KLMPVPQQP

SEQ ID NO: 111583 - protein, 9 aa, Homo Sapiens
PYSSRLYVP

SEQ ID NO: 111584 - protein, 9 aa, Homo Sapiens
AAAASMYNY

SEQ ID NO: 111585 - protein, 9 aa, Homo Sapiens
ADVFVFVAN

SEQ ID NO: 111586 - protein, 9 aa, Homo Sapiens
LLRVCTIRN

SEQ ID NO: 111587 - protein, 9 aa, Homo Sapiens
MKDKGALKQ

SEQ ID NO: 111588 - protein, 9 aa, Homo Sapiens
LVTQSGCRP

SEQ ID NO: 111589 - protein, 9 aa, Homo Sapiens
RQSDLSGNS

SEQ ID NO: 111590 - protein, 9 aa, Homo Sapiens
GHQVHLFYM

SEQ ID NO: 111591 - protein, 9 aa, Homo Sapiens
NYLWREKNA

SEQ ID NO: 111592 - protein, 9 aa, Homo Sapiens
NHLDYETLA

SEQ ID NO: 111593 - protein, 9 aa, Homo Sapiens
QPWKKLRVA

SEQ ID NO: 111594 - protein, 9 aa, Homo Sapiens
FYVHFFRFW

SEQ ID NO: 111595 - protein, 9 aa, Homo Sapiens
ASSQRVVGP

SEQ ID NO: 111596 - protein, 9 aa, Homo Sapiens
NYYFYEIIT

SEQ ID NO: 111597 - protein, 9 aa, Homo Sapiens
HQVHLFYML

SEQ ID NO: 111598 - protein, 9 aa, Homo Sapiens
VCEPLLSYY

SEQ ID NO: 111599 - protein, 9 aa, Homo Sapiens
TESKVGTPG

SEQ ID NO: 111600 - protein, 9 aa, Homo Sapiens
ERLLVQLYE

SEQ ID NO: 111601 - protein, 9 aa, Homo Sapiens
QLSGTVKSS

SEQ ID NO: 111602 - protein, 9 aa, Homo Sapiens
ESKVGTPGP

SEQ ID NO: 111603 - protein, 9 aa, Homo Sapiens
NTFQFEGQE

SEQ ID NO: 111604 - protein, 9 aa, Homo Sapiens
GCVVEANPN

SEQ ID NO: 111605 - protein, 9 aa, Homo Sapiens
QQKDSLTLL

SEQ ID NO: 111606 - protein, 9 aa, Homo Sapiens
AFYRPNLDN

SEQ ID NO: 111607 - protein, 9 aa, Homo Sapiens
SLPGCVVEA

SEQ ID NO: 111608 - protein, 9 aa, Homo Sapiens
SRALEILTN

SEQ ID NO: 111609 - protein, 9 aa, Homo Sapiens
VPAEVLFRG

SEQ ID NO: 111610 - protein, 9 aa, Homo Sapiens
SFENQHRKL

SEQ ID NO: 111611 - protein, 9 aa, Homo Sapiens
LLDNLVMAD

SEQ ID NO: 111612 - protein, 9 aa, Homo Sapiens
VTPQPLYHP

SEQ ID NO: 111613 - protein, 9 aa, Homo Sapiens
KLYFPASVC

SEQ ID NO: 111614 - protein, 9 aa, Homo Sapiens
LGQNALGFT

SEQ ID NO: 111615 - protein, 9 aa, Homo Sapiens
MPVPQQPSP

SEQ ID NO: 111616 - protein, 9 aa, Homo Sapiens
SAIKLVDFK

SEQ ID NO: 111617 - protein, 9 aa, Homo Sapiens
SATCCCCVT

SEQ ID NO: 111618 - protein, 9 aa, Homo Sapiens
AVAFNKQIL

SEQ ID NO: 111619 - protein, 9 aa, Homo Sapiens
RDPLSEITK

SEQ ID NO: 111620 - protein, 9 aa, Homo Sapiens
KAFSVFGSL

SEQ ID NO: 111621 - protein, 9 aa, Homo Sapiens
AAGYVPCIA

SEQ ID NO: 111622 - protein, 9 aa, Homo Sapiens
RDNMIKNCN

SEQ ID NO: 111623 - protein, 9 aa, Homo Sapiens
GTPGPGSVW

SEQ ID NO: 111624 - protein, 9 aa, Homo Sapiens
KTIVFINHS

SEQ ID NO: 111625 - protein, 9 aa, Homo Sapiens
FGIYDDDHE

SEQ ID NO: 111626 - protein, 9 aa, Homo Sapiens
CLLTQYRIS

SEQ ID NO: 111627 - protein, 9 aa, Homo Sapiens
YETLAKLIA

SEQ ID NO: 111628 - protein, 9 aa, Homo Sapiens
LEERDNMIK

SEQ ID NO: 111629 - protein, 9 aa, Homo Sapiens
PNLDNRRQG

SEQ ID NO: 111630 - protein, 9 aa, Homo Sapiens
YSEKEFICH

SEQ ID NO: 111631 - protein, 9 aa, Homo Sapiens
KTRPEPGQF

SEQ ID NO: 111632 - protein, 9 aa, Homo Sapiens
RPNLDNRRQ

SEQ ID NO: 111633 - protein, 9 aa, Homo Sapiens
GSHHNTAHS

SEQ ID NO: 111634 - protein, 9 aa, Homo Sapiens
VQHGADQHG

SEQ ID NO: 111635 - protein, 9 aa, Homo Sapiens
EGLEVGLEE

SEQ ID NO: 111636 - protein, 9 aa, Homo Sapiens
GYKMHPKLV

SEQ ID NO: 111637 - protein, 9 aa, Homo Sapiens
DSEEIIVCR

SEQ ID NO: 111638 - protein, 9 aa, Homo Sapiens
KTRLHVAAR

SEQ ID NO: 111639 - protein, 9 aa, Homo Sapiens
KSGKGKKPS

SEQ ID NO: 111640 - protein, 9 aa, Homo Sapiens
LGPVASVVF

SEQ ID NO: 111641 - protein, 9 aa, Homo Sapiens
CASPYAYVA

SEQ ID NO: 111642 - protein, 9 aa, Homo Sapiens
DEKWKRIRT

SEQ ID NO: 111643 - protein, 9 aa, Homo Sapiens
NTAHSYNGQ

SEQ ID NO: 111644 - protein, 9 aa, Homo Sapiens
GCESLLLRV

SEQ ID NO: 111645 - protein, 9 aa, Homo Sapiens
KQIAGYVRQ

SEQ ID NO: 111646 - protein, 9 aa, Homo Sapiens
IEKTSFFSS

SEQ ID NO: 111647 - protein, 9 aa, Homo Sapiens
SVMQLAEMC

SEQ ID NO: 111648 - protein, 9 aa, Homo Sapiens
GFTLGTTAA

SEQ ID NO: 111649 - protein, 9 aa, Homo Sapiens
VSAKEDGYT

SEQ ID NO: 111650 - protein, 9 aa, Homo Sapiens
VDFKDAKAC

SEQ ID NO: 111651 - protein, 9 aa, Homo Sapiens
KPSFFFFSR

SEQ ID NO: 111652 - protein, 9 aa, Homo Sapiens
YTCLLSAIC

SEQ ID NO: 111653 - protein, 9 aa, Homo Sapiens
GREKGNDIL

SEQ ID NO: 111654 - protein, 9 aa, Homo Sapiens
NYSNENESE

SEQ ID NO: 111655 - protein, 9 aa, Homo Sapiens
QLAEMCFPL

SEQ ID NO: 111656 - protein, 9 aa, Homo Sapiens
RDCSCEPYC

SEQ ID NO: 111657 - protein, 9 aa, Homo Sapiens
TYLKQHEKL

SEQ ID NO: 111658 - protein, 9 aa, Homo Sapiens
APAAGYVPC

SEQ ID NO: 111659 - protein, 9 aa, Homo Sapiens
YHSPYPIRS

SEQ ID NO: 111660 - protein, 9 aa, Homo Sapiens
NPGEPKEEN

SEQ ID NO: 111661 - protein, 9 aa, Homo Sapiens
VQKSGKGKK

SEQ ID NO: 111662 - protein, 9 aa, Homo Sapiens
FGSLQRHET

SEQ ID NO: 111663 - protein, 9 aa, Homo Sapiens
KQHEKLNLI

SEQ ID NO: 111664 - protein, 9 aa, Homo Sapiens
MERLLVQLY

SEQ ID NO: 111665 - protein, 9 aa, Homo Sapiens
YLWREKNAE

SEQ ID NO: 111666 - protein, 9 aa, Homo Sapiens
NTIMPCQDQ

SEQ ID NO: 111667 - protein, 9 aa, Homo Sapiens
STAMHTSST

SEQ ID NO: 111668 - protein, 9 aa, Homo Sapiens
APEEGLEVG

SEQ ID NO: 111669 - protein, 9 aa, Homo Sapiens
FSHPLTHSA

SEQ ID NO: 111670 - protein, 9 aa, Homo Sapiens
KLVDFKDAK

SEQ ID NO: 111671 - protein, 9 aa, Homo Sapiens
LEVLQNRVH

SEQ ID NO: 111672 - protein, 9 aa, Homo Sapiens
KTSFFSSLM

SEQ ID NO: 111673 - protein, 9 aa, Homo Sapiens
KHIVNCFHK

SEQ ID NO: 111674 - protein, 9 aa, Homo Sapiens
LFYHISRAS

SEQ ID NO: 111675 - protein, 9 aa, Homo Sapiens
ESSGPPERE

SEQ ID NO: 111676 - protein, 9 aa, Homo Sapiens
GGGGLRSHG

SEQ ID NO: 111677 - protein, 9 aa, Homo Sapiens
SDAHRAQPS

SEQ ID NO: 111678 - protein, 9 aa, Homo Sapiens
TPKLLDNLV

SEQ ID NO: 111679 - protein, 9 aa, Homo Sapiens
DQYIRAGEG

SEQ ID NO: 111680 - protein, 9 aa, Homo Sapiens
HFVPYAVQK

SEQ ID NO: 111681 - protein, 9 aa, Homo Sapiens
QLNTFQFEG

SEQ ID NO: 111682 - protein, 9 aa, Homo Sapiens
STPTDFFIV

SEQ ID NO: 111683 - protein, 9 aa, Homo Sapiens
VQYHERIHT

SEQ ID NO: 111684 - protein, 9 aa, Homo Sapiens
LFYMLLHLF

SEQ ID NO: 111685 - protein, 9 aa, Homo Sapiens
VPCIAFYAG

SEQ ID NO: 111686 - protein, 9 aa, Homo Sapiens
NDILELKCN

SEQ ID NO: 111687 - protein, 9 aa, Homo Sapiens
RKHIVNCFH

SEQ ID NO: 111688 - protein, 9 aa, Homo Sapiens
RPSPKTQDH

SEQ ID NO: 111689 - protein, 9 aa, Homo Sapiens
TCLLSAICF

SEQ ID NO: 111690 - protein, 9 aa, Homo Sapiens
ACLLTQYRI

SEQ ID NO: 111691 - protein, 9 aa, Homo Sapiens
EDQEETKQT

SEQ ID NO: 111692 - protein, 9 aa, Homo Sapiens
YGLSKIRLN

SEQ ID NO: 111693 - protein, 9 aa, Homo Sapiens
HLRQQRASA

SEQ ID NO: 111694 - protein, 9 aa, Homo Sapiens
SLLLRVCTI

SEQ ID NO: 111695 - protein, 9 aa, Homo Sapiens
GNDILELKC

SEQ ID NO: 111696 - protein, 9 aa, Homo Sapiens
EEELQVSFE

SEQ ID NO: 111697 - protein, 9 aa, Homo Sapiens
QLGQVIQKI

SEQ ID NO: 111698 - protein, 9 aa, Homo Sapiens
AKMTFKIFE

SEQ ID NO: 111699 - protein, 9 aa, Homo Sapiens
IVGSHHNTA

SEQ ID NO: 111700 - protein, 9 aa, Homo Sapiens
CLLGCALLC

SEQ ID NO: 111701 - protein, 9 aa, Homo Sapiens
PWKKLRVAG

SEQ ID NO: 111702 - protein, 9 aa, Homo Sapiens
TTVCENAQL

SEQ ID NO: 111703 - protein, 9 aa, Homo Sapiens
HRGLVTQSG

SEQ ID NO: 111704 - protein, 9 aa, Homo Sapiens
SPNAVSAKE

SEQ ID NO: 111705 - protein, 9 aa, Homo Sapiens
LDADVFVFV

SEQ ID NO: 111706 - protein, 9 aa, Homo Sapiens
RSDAHRAQP

SEQ ID NO: 111707 - protein, 9 aa, Homo Sapiens
HLDYETLAK

SEQ ID NO: 111708 - protein, 9 aa, Homo Sapiens
EAEFWERLT

SEQ ID NO: 111709 - protein, 9 aa, Homo Sapiens
PEQPYSSRL

SEQ ID NO: 111710 - protein, 9 aa, Homo Sapiens
SYSEKEFIC

SEQ ID NO: 111711 - protein, 9 aa, Homo Sapiens
EGSLFEVQW

SEQ ID NO: 111712 - protein, 9 aa, Homo Sapiens
LDYVVSHQI

SEQ ID NO: 111713 - protein, 9 aa, Homo Sapiens
NKQILCLFR

SEQ ID NO: 111714 - protein, 9 aa, Homo Sapiens
CAVQPHYQL

SEQ ID NO: 111715 - protein, 9 aa, Homo Sapiens
SLSSTHHTY

SEQ ID NO: 111716 - protein, 9 aa, Homo Sapiens
CREYHRGLV

SEQ ID NO: 111717 - protein, 9 aa, Homo Sapiens
SVFGSLQRH

SEQ ID NO: 111718 - protein, 9 aa, Homo Sapiens
GNYYFYEII

SEQ ID NO: 111719 - protein, 9 aa, Homo Sapiens
SAKEDGYTL

SEQ ID NO: 111720 - protein, 9 aa, Homo Sapiens
ALGFTLGTT

SEQ ID NO: 111721 - protein, 9 aa, Homo Sapiens
RFPGNYVES

SEQ ID NO: 111722 - protein, 9 aa, Homo Sapiens
TSFFSSLMP

SEQ ID NO: 111723 - protein, 9 aa, Homo Sapiens
LSAICFFFA

SEQ ID NO: 111724 - protein, 9 aa, Homo Sapiens
ATCCCCVTY

SEQ ID NO: 111725 - protein, 9 aa, Homo Sapiens
MSCTHELCT

SEQ ID NO: 111726 - protein, 9 aa, Homo Sapiens
FFFFSRPSP

SEQ ID NO: 111727 - protein, 9 aa, Homo Sapiens
YVPTHFVPY

SEQ ID NO: 111728 - protein, 9 aa, Homo Sapiens
NGVTGRFPG

SEQ ID NO: 111729 - protein, 9 aa, Homo Sapiens
LSEITKQEK

SEQ ID NO: 111730 - protein, 9 aa, Homo Sapiens
HPNKIKAFL

SEQ ID NO: 111731 - protein, 9 aa, Homo Sapiens
HSAVMGHRS

SEQ ID NO: 111732 - protein, 9 aa, Homo Sapiens
KQEINRLSN

SEQ ID NO: 111733 - protein, 9 aa, Homo Sapiens
HLFYMLLHL

SEQ ID NO: 111734 - protein, 9 aa, Homo Sapiens
LPGCVVEAN

SEQ ID NO: 111735 - protein, 9 aa, Homo Sapiens
MAEGKKPSK

SEQ ID NO: 111736 - protein, 9 aa, Homo Sapiens
SNFYISRAL

SEQ ID NO: 111737 - protein, 9 aa, Homo Sapiens
TSSTAAPIP

SEQ ID NO: 111738 - protein, 9 aa, Homo Sapiens
DAHRAQPSP

SEQ ID NO: 111739 - protein, 9 aa, Homo Sapiens
AEWQELEKL

SEQ ID NO: 111740 - protein, 9 aa, Homo Sapiens
SPGPPESSG

SEQ ID NO: 111741 - protein, 9 aa, Homo Sapiens
QRPASSGSA

SEQ ID NO: 111742 - protein, 9 aa, Homo Sapiens
LNAEACVHK

SEQ ID NO: 111743 - protein, 9 aa, Homo Sapiens
GYAICYGIG

SEQ ID NO: 111744 - protein, 9 aa, Homo Sapiens
FEMNEERLK

SEQ ID NO: 111745 - protein, 9 aa, Homo Sapiens
PASEDGPNL

SEQ ID NO: 111746 - protein, 9 aa, Homo Sapiens
VPVQKSGKG

SEQ ID NO: 111747 - protein, 9 aa, Homo Sapiens
ADVIKTRLH

SEQ ID NO: 111748 - protein, 9 aa, Homo Sapiens
WQLLSPETV

SEQ ID NO: 111749 - protein, 9 aa, Homo Sapiens
ISLRYVAPP

SEQ ID NO: 111750 - protein, 9 aa, Homo Sapiens
ACFSPPPYG

SEQ ID NO: 111751 - protein, 9 aa, Homo Sapiens
IKAFLPSSE

SEQ ID NO: 111752 - protein, 9 aa, Homo Sapiens
PPESSGPPE

SEQ ID NO: 111753 - protein, 9 aa, Homo Sapiens
LDTTMQRLI

SEQ ID NO: 111754 - protein, 9 aa, Homo Sapiens
CEPLLSYYP

SEQ ID NO: 111755 - protein, 9 aa, Homo Sapiens
SSKTRPEPG

SEQ ID NO: 111756 - protein, 9 aa, Homo Sapiens
LDKILFYNF

SEQ ID NO: 111757 - protein, 9 aa, Homo Sapiens
SGSAHTLVN

SEQ ID NO: 111758 - protein, 9 aa, Homo Sapiens
GCLQLSGTV

SEQ ID NO: 111759 - protein, 9 aa, Homo Sapiens
QDFKKLKVA

SEQ ID NO: 111760 - protein, 9 aa, Homo Sapiens
NLDNRRQGG

SEQ ID NO: 111761 - protein, 9 aa, Homo Sapiens
DHLRQQRAS

SEQ ID NO: 111762 - protein, 9 aa, Homo Sapiens
AICYGIGSP

SEQ ID NO: 111763 - protein, 9 aa, Homo Sapiens
AVPVQKSGK

SEQ ID NO: 111764 - protein, 9 aa, Homo Sapiens
EACVHKGQI

SEQ ID NO: 111765 - protein, 9 aa, Homo Sapiens
RQPMVDVSI

SEQ ID NO: 111766 - protein, 9 aa, Homo Sapiens
SLFEVQWQL

SEQ ID NO: 111767 - protein, 9 aa, Homo Sapiens
SCVPNLIME

SEQ ID NO: 111768 - protein, 9 aa, Homo Sapiens
LIMEGRAAL

SEQ ID NO: 111769 - protein, 9 aa, Homo Sapiens
GKGKKPSKR

SEQ ID NO: 111770 - protein, 9 aa, Homo Sapiens
PVTHSHFTQ

SEQ ID NO: 111771 - protein, 9 aa, Homo Sapiens
LLHTTPPHV

SEQ ID NO: 111772 - protein, 9 aa, Homo Sapiens
IVFINHSFL

SEQ ID NO: 111773 - protein, 9 aa, Homo Sapiens
SGNYSNENE

SEQ ID NO: 111774 - protein, 9 aa, Homo Sapiens
LQLSGTVKS

SEQ ID NO: 111775 - protein, 9 aa, Homo Sapiens
RKLKPKIQQ

SEQ ID NO: 111776 - protein, 9 aa, Homo Sapiens
VIQKNHLDY

SEQ ID NO: 111777 - protein, 9 aa, Homo Sapiens
GIPAKRLGR

SEQ ID NO: 111778 - protein, 9 aa, Homo Sapiens
LGQVIQKIS

SEQ ID NO: 111779 - protein, 9 aa, Homo Sapiens
LLSAICFFF

SEQ ID NO: 111780 - protein, 9 aa, Homo Sapiens
THELCTEER

SEQ ID NO: 111781 - protein, 9 aa, Homo Sapiens
CESLLLRVC

SEQ ID NO: 111782 - protein, 9 aa, Homo Sapiens
PGPASEDGP

SEQ ID NO: 111783 - protein, 9 aa, Homo Sapiens
PAFYRPNLD

SEQ ID NO: 111784 - protein, 9 aa, Homo Sapiens
RLHVAARAG

SEQ ID NO: 111785 - protein, 9 aa, Homo Sapiens
KIQQKDSLT

SEQ ID NO: 111786 - protein, 9 aa, Homo Sapiens
RSRSDAHRA

SEQ ID NO: 111787 - protein, 9 aa, Homo Sapiens
IMEGRAALI

SEQ ID NO: 111788 - protein, 9 aa, Homo Sapiens
SAHTLVNHG

SEQ ID NO: 111789 - protein, 9 aa, Homo Sapiens
DFGIYDDDH

SEQ ID NO: 111790 - protein, 9 aa, Homo Sapiens
DLSGNSLWK

SEQ ID NO: 111791 - protein, 9 aa, Homo Sapiens
EYHRGLVTQ

SEQ ID NO: 111792 - protein, 9 aa, Homo Sapiens
LKPKIQQKD

SEQ ID NO: 111793 - protein, 9 aa, Homo Sapiens
VTRASSQRV

SEQ ID NO: 111794 - protein, 9 aa, Homo Sapiens
YRPNLDNRR

SEQ ID NO: 111795 - protein, 9 aa, Homo Sapiens
HHNTAHSYN

SEQ ID NO: 111796 - protein, 9 aa, Homo Sapiens
DKGALKQNK

SEQ ID NO: 111797 - protein, 9 aa, Homo Sapiens
SSGPPEREA

SEQ ID NO: 111798 - protein, 9 aa, Homo Sapiens
HTTPPHVIG

SEQ ID NO: 111799 - protein, 9 aa, Homo Sapiens
GQDFKKLKV

SEQ ID NO: 111800 - protein, 9 aa, Homo Sapiens
VMRTYLKQH

SEQ ID NO: 111801 - protein, 9 aa, Homo Sapiens
GCTESKVGT

SEQ ID NO: 111802 - protein, 9 aa, Homo Sapiens
VAKHPVTHS

SEQ ID NO: 111803 - protein, 9 aa, Homo Sapiens
DIISSKQEI

SEQ ID NO: 111804 - protein, 9 aa, Homo Sapiens
PLSEITKQE

SEQ ID NO: 111805 - protein, 9 aa, Homo Sapiens
GQSKEGDEF

SEQ ID NO: 111806 - protein, 9 aa, Homo Sapiens
RDQYIRAGE

SEQ ID NO: 111807 - protein, 9 aa, Homo Sapiens
SSQRVVGPS

SEQ ID NO: 111808 - protein, 9 aa, Homo Sapiens
LVQHGADQH

SEQ ID NO: 111809 - protein, 9 aa, Homo Sapiens
AKEDGYTLF

SEQ ID NO: 111810 - protein, 9 aa, Homo Sapiens
FDYKVDDSE

SEQ ID NO: 111811 - protein, 9 aa, Homo Sapiens
VRGYAICYG

SEQ ID NO: 111812 - protein, 9 aa, Homo Sapiens
IKQIAGYVR

SEQ ID NO: 111813 - protein, 9 aa, Homo Sapiens
LRFYGQSKE

SEQ ID NO: 111814 - protein, 9 aa, Homo Sapiens
GKSSATCCC

SEQ ID NO: 111815 - protein, 9 aa, Homo Sapiens
DCSCEPYCS

SEQ ID NO: 111816 - protein, 9 aa, Homo Sapiens
KMHPKLVII

SEQ ID NO: 111817 - protein, 9 aa, Homo Sapiens
DKILFYNFL

SEQ ID NO: 111818 - protein, 9 aa, Homo Sapiens
GPASEDGPN

SEQ ID NO: 111819 - protein, 9 aa, Homo Sapiens
SDLSGNSLW

SEQ ID NO: 111820 - protein, 9 aa, Homo Sapiens
EVYSTLYSM

SEQ ID NO: 111821 - protein, 9 aa, Homo Sapiens
EVQWQLAQL

SEQ ID NO: 111822 - protein, 9 aa, Homo Sapiens
ISPNAVSAK

SEQ ID NO: 111823 - protein, 9 aa, Homo Sapiens
CVPNLIMEG

SEQ ID NO: 111824 - protein, 9 aa, Homo Sapiens
TIMPCQDQY

SEQ ID NO: 111825 - protein, 9 aa, Homo Sapiens
GSFDYKVDD

SEQ ID NO: 111826 - protein, 9 aa, Homo Sapiens
LWKYRYSCI

SEQ ID NO: 111827 - protein, 9 aa, Homo Sapiens
FKIFEMNEE

SEQ ID NO: 111828 - protein, 9 aa, Homo Sapiens
PSTAMHTSS

SEQ ID NO: 111829 - protein, 9 aa, Homo Sapiens
PPMAEGKKP

SEQ ID NO: 111830 - protein, 9 aa, Homo Sapiens
AVSAKEDGY

SEQ ID NO: 111831 - protein, 9 aa, Homo Sapiens
FIKDVNPGE

SEQ ID NO: 111832 - protein, 9 aa, Homo Sapiens
AWQLLSPET

SEQ ID NO: 111833 - protein, 9 aa, Homo Sapiens
REKEEELQV

SEQ ID NO: 111834 - protein, 9 aa, Homo Sapiens
DHVNVRINC

SEQ ID NO: 111835 - protein, 9 aa, Homo Sapiens
RTYLKQHEK

SEQ ID NO: 111836 - protein, 9 aa, Homo Sapiens
ALGPVASVV

SEQ ID NO: 111837 - protein, 9 aa, Homo Sapiens
IQKNHLDYE

SEQ ID NO: 111838 - protein, 9 aa, Homo Sapiens
NESESKTSE

SEQ ID NO: 111839 - protein, 9 aa, Homo Sapiens
KDVNPGEPK

SEQ ID NO: 111840 - protein, 9 aa, Homo Sapiens
VRQPMVDVS

SEQ ID NO: 111841 - protein, 9 aa, Homo Sapiens
PYGEIYSLP

SEQ ID NO: 111842 - protein, 9 aa, Homo Sapiens
IQQKDSLTL

SEQ ID NO: 111843 - protein, 9 aa, Homo Sapiens
SFFFFSRPS

SEQ ID NO: 111844 - protein, 9 aa, Homo Sapiens
YVPCIAFYA

SEQ ID NO: 111845 - protein, 9 aa, Homo Sapiens
SRYVPTHFV

SEQ ID NO: 111846 - protein, 9 aa, Homo Sapiens
FYISRALEI

SEQ ID NO: 111847 - protein, 9 aa, Homo Sapiens
LEKLDCLTL

SEQ ID NO: 111848 - protein, 9 aa, Homo Sapiens
HRKSVKKRF

SEQ ID NO: 111849 - protein, 9 aa, Homo Sapiens
CYGIGSPHA

SEQ ID NO: 111850 - protein, 9 aa, Homo Sapiens
EEEEGTAAW

SEQ ID NO: 111851 - protein, 9 aa, Homo Sapiens
EKNAEQQAL

SEQ ID NO: 111852 - protein, 9 aa, Homo Sapiens
FEVQWQLAQ

SEQ ID NO: 111853 - protein, 9 aa, Homo Sapiens
SGSNAWLFY

SEQ ID NO: 111854 - protein, 9 aa, Homo Sapiens
SEGFAGMKK

SEQ ID NO: 111855 - protein, 9 aa, Homo Sapiens
KEDQEETKQ

SEQ ID NO: 111856 - protein, 9 aa, Homo Sapiens
SVGSKIACS

SEQ ID NO: 111857 - protein, 9 aa, Homo Sapiens
DAIKLMPVP

SEQ ID NO: 111858 - protein, 9 aa, Homo Sapiens
FSRPSPKTQ

SEQ ID NO: 111859 - protein, 9 aa, Homo Sapiens
ETKQTFDIV

SEQ ID NO: 111860 - protein, 9 aa, Homo Sapiens
ISTPTDFFI

SEQ ID NO: 111861 - protein, 9 aa, Homo Sapiens
PASSGSAHT

SEQ ID NO: 111862 - protein, 9 aa, Homo Sapiens
SRPSPKTQD

SEQ ID NO: 111863 - protein, 9 aa, Homo Sapiens
FQSLDTTMQ

SEQ ID NO: 111864 - protein, 9 aa, Homo Sapiens
IQGVIYEIR

SEQ ID NO: 111865 - protein, 9 aa, Homo Sapiens
SEDGPNLNN

SEQ ID NO: 111866 - protein, 9 aa, Homo Sapiens
AEMCFPLEA

SEQ ID NO: 111867 - protein, 9 aa, Homo Sapiens
IIVGSHHNT

SEQ ID NO: 111868 - protein, 9 aa, Homo Sapiens
SHPLTHSAV

SEQ ID NO: 111869 - protein, 9 aa, Homo Sapiens
QTFDIVVDT

SEQ ID NO: 111870 - protein, 9 aa, Homo Sapiens
SMYNYAEQT

SEQ ID NO: 111871 - protein, 9 aa, Homo Sapiens
LGCALLCCS

SEQ ID NO: 111872 - protein, 9 aa, Homo Sapiens
TPTDFFIVM

SEQ ID NO: 111873 - protein, 9 aa, Homo Sapiens
IGYTCLLSA

SEQ ID NO: 111874 - protein, 9 aa, Homo Sapiens
SPNGCLQLS

SEQ ID NO: 111875 - protein, 9 aa, Homo Sapiens
QKAVVHMNV

SEQ ID NO: 111876 - protein, 9 aa, Homo Sapiens
SSTHHTYGL

SEQ ID NO: 111877 - protein, 9 aa, Homo Sapiens
SFFSSLMPS

SEQ ID NO: 111878 - protein, 9 aa, Homo Sapiens
VASVVFCTS

SEQ ID NO: 111879 - protein, 9 aa, Homo Sapiens
DGYKMHPKL

SEQ ID NO: 111880 - protein, 9 aa, Homo Sapiens
HQLNTFQFE

SEQ ID NO: 111881 - protein, 9 aa, Homo Sapiens
SQIWNLNPV

SEQ ID NO: 111882 - protein, 9 aa, Homo Sapiens
YNFLPRGFN

SEQ ID NO: 111883 - protein, 9 aa, Homo Sapiens
CQNLGLDRN

SEQ ID NO: 111884 - protein, 9 aa, Homo Sapiens
QSSMPHVPY

SEQ ID NO: 111885 - protein, 9 aa, Homo Sapiens
FSSNNDEDK

SEQ ID NO: 111886 - protein, 9 aa, Homo Sapiens
ISPLVVAKG

SEQ ID NO: 111887 - protein, 9 aa, Homo Sapiens
SAMVFVSNK

SEQ ID NO: 111888 - protein, 9 aa, Homo Sapiens
ALLSGRRFL

SEQ ID NO: 111889 - protein, 9 aa, Homo Sapiens
IECINEHAP

SEQ ID NO: 111890 - protein, 9 aa, Homo Sapiens
RVASVLGLI

SEQ ID NO: 111891 - protein, 9 aa, Homo Sapiens
PLPANCYIG

SEQ ID NO: 111892 - protein, 9 aa, Homo Sapiens
DINENPYFA

SEQ ID NO: 111893 - protein, 9 aa, Homo Sapiens
ERKKVTPLM

SEQ ID NO: 111894 - protein, 9 aa, Homo Sapiens
TVSVTVIDI

SEQ ID NO: 111895 - protein, 9 aa, Homo Sapiens
KPQKGIQYL

SEQ ID NO: 111896 - protein, 9 aa, Homo Sapiens
AVQPEVPPV

SEQ ID NO: 111897 - protein, 9 aa, Homo Sapiens
LSLSEWLWC

SEQ ID NO: 111898 - protein, 9 aa, Homo Sapiens
CYIGDDGTS

SEQ ID NO: 111899 - protein, 9 aa, Homo Sapiens
AGPNCSRDE

SEQ ID NO: 111900 - protein, 9 aa, Homo Sapiens
HKNYVACSR

SEQ ID NO: 111901 - protein, 9 aa, Homo Sapiens
EEERKKVTP

SEQ ID NO: 111902 - protein, 9 aa, Homo Sapiens
LGLIMLSVA

SEQ ID NO: 111903 - protein, 9 aa, Homo Sapiens
ASYGRKDTI

SEQ ID NO: 111904 - protein, 9 aa, Homo Sapiens
SMTEMTRTF

SEQ ID NO: 111905 - protein, 9 aa, Homo Sapiens
RKDTINSIM

SEQ ID NO: 111906 - protein, 9 aa, Homo Sapiens
HQRDHKNYV

SEQ ID NO: 111907 - protein, 9 aa, Homo Sapiens
PEVTSRVQA

SEQ ID NO: 111908 - protein, 9 aa, Homo Sapiens
EDQDVDNRD

SEQ ID NO: 111909 - protein, 9 aa, Homo Sapiens
CKNVKIPLF

SEQ ID NO: 111910 - protein, 9 aa, Homo Sapiens
LESKGTSHS

SEQ ID NO: 111911 - protein, 9 aa, Homo Sapiens
AGGPVAVQP

SEQ ID NO: 111912 - protein, 9 aa, Homo Sapiens
LITIIDTLF

SEQ ID NO: 111913 - protein, 9 aa, Homo Sapiens
NNDEDKDDD

SEQ ID NO: 111914 - protein, 9 aa, Homo Sapiens
QPEVPPVPL

SEQ ID NO: 111915 - protein, 9 aa, Homo Sapiens
QECLEFIHQ

SEQ ID NO: 111916 - protein, 9 aa, Homo Sapiens
IIDTLFDKR

SEQ ID NO: 111917 - protein, 9 aa, Homo Sapiens
LYVHIECIN

SEQ ID NO: 111918 - protein, 9 aa, Homo Sapiens
ETDEKQTKS

SEQ ID NO: 111919 - protein, 9 aa, Homo Sapiens
IAAAGMVHA

SEQ ID NO: 111920 - protein, 9 aa, Homo Sapiens
YAIAAAGMV

SEQ ID NO: 111921 - protein, 9 aa, Homo Sapiens
SILSSTKEN

SEQ ID NO: 111922 - protein, 9 aa, Homo Sapiens
PPIVHIPRK

SEQ ID NO: 111923 - protein, 9 aa, Homo Sapiens
VKIPLFFCE

SEQ ID NO: 111924 - protein, 9 aa, Homo Sapiens
CDAKRKEKQ

SEQ ID NO: 111925 - protein, 9 aa, Homo Sapiens
ALELDFWMR

SEQ ID NO: 111926 - protein, 9 aa, Homo Sapiens
LEDQDVDNR

SEQ ID NO: 111927 - protein, 9 aa, Homo Sapiens
LTILITIID

SEQ ID NO: 111928 - protein, 9 aa, Homo Sapiens
LGQHALLSG

SEQ ID NO: 111929 - protein, 9 aa, Homo Sapiens
AAFQALRKQ

SEQ ID NO: 111930 - protein, 9 aa, Homo Sapiens
PRVMSTQCV

SEQ ID NO: 111931 - protein, 9 aa, Homo Sapiens
SSNNDEDKD

SEQ ID NO: 111932 - protein, 9 aa, Homo Sapiens
KKQLEKLIR

SEQ ID NO: 111933 - protein, 9 aa, Homo Sapiens
FEADEGTCV

SEQ ID NO: 111934 - protein, 9 aa, Homo Sapiens
NLGLDRNMV

SEQ ID NO: 111935 - protein, 9 aa, Homo Sapiens
SVQNIMRRK

SEQ ID NO: 111936 - protein, 9 aa, Homo Sapiens
EEEEEIDGS

SEQ ID NO: 111937 - protein, 9 aa, Homo Sapiens
TETDEKQTK

SEQ ID NO: 111938 - protein, 9 aa, Homo Sapiens
VDCLGQHAL

SEQ ID NO: 111939 - protein, 9 aa, Homo Sapiens
SSSDPGSAG

SEQ ID NO: 111940 - protein, 9 aa, Homo Sapiens
TQSSMPHVP

SEQ ID NO: 111941 - protein, 9 aa, Homo Sapiens
QCVANTSTQ

SEQ ID NO: 111942 - protein, 9 aa, Homo Sapiens
RLAKQMPAQ

SEQ ID NO: 111943 - protein, 9 aa, Homo Sapiens
ARLAKQMPA

SEQ ID NO: 111944 - protein, 9 aa, Homo Sapiens
IMRRKEQEH

SEQ ID NO: 111945 - protein, 9 aa, Homo Sapiens
EEEEIDGSG

SEQ ID NO: 111946 - protein, 9 aa, Homo Sapiens
STKENGRSN

SEQ ID NO: 111947 - protein, 9 aa, Homo Sapiens
LFVNSRINR

SEQ ID NO: 111948 - protein, 9 aa, Homo Sapiens
EDAGPNCSR

SEQ ID NO: 111949 - protein, 9 aa, Homo Sapiens
KSRTITPPA

SEQ ID NO: 111950 - protein, 9 aa, Homo Sapiens
KQLEKLIRR

SEQ ID NO: 111951 - protein, 9 aa, Homo Sapiens
LFHQKKQLE

SEQ ID NO: 111952 - protein, 9 aa, Homo Sapiens
PWSWLDAQQ

SEQ ID NO: 111953 - protein, 9 aa, Homo Sapiens
LESTVSPPT

SEQ ID NO: 111954 - protein, 9 aa, Homo Sapiens
NCYIGDDGT

SEQ ID NO: 111955 - protein, 9 aa, Homo Sapiens
ACDAKRKEK

SEQ ID NO: 111956 - protein, 9 aa, Homo Sapiens
EGKEEEEEI

SEQ ID NO: 111957 - protein, 9 aa, Homo Sapiens
ADACDAKRK

SEQ ID NO: 111958 - protein, 9 aa, Homo Sapiens
CEQEERLHE

SEQ ID NO: 111959 - protein, 9 aa, Homo Sapiens
INREELCGR

SEQ ID NO: 111960 - protein, 9 aa, Homo Sapiens
QKELAEKEE

SEQ ID NO: 111961 - protein, 9 aa, Homo Sapiens
VHTISAAFQ

SEQ ID NO: 111962 - protein, 9 aa, Homo Sapiens
HLFHQKKQL

SEQ ID NO: 111963 - protein, 9 aa, Homo Sapiens
APYWLVSMT

SEQ ID NO: 111964 - protein, 9 aa, Homo Sapiens
CARLAKQMP

SEQ ID NO: 111965 - protein, 9 aa, Homo Sapiens
VCQVLFCLN

SEQ ID NO: 111966 - protein, 9 aa, Homo Sapiens
DEKQTKSRT

SEQ ID NO: 111967 - protein, 9 aa, Homo Sapiens
QARGPGGEN

SEQ ID NO: 111968 - protein, 9 aa, Homo Sapiens
PPTSPNTPS

SEQ ID NO: 111969 - protein, 9 aa, Homo Sapiens
NELKSPWQA

SEQ ID NO: 111970 - protein, 9 aa, Homo Sapiens
SLLEQLHAK

SEQ ID NO: 111971 - protein, 9 aa, Homo Sapiens
EYGACGLSQ

SEQ ID NO: 111972 - protein, 9 aa, Homo Sapiens
CPGCGYLCT

SEQ ID NO: 111973 - protein, 9 aa, Homo Sapiens
VICRCFEGK

SEQ ID NO: 111974 - protein, 9 aa, Homo Sapiens
GYLCTAGNF

SEQ ID NO: 111975 - protein, 9 aa, Homo Sapiens
QNIMRRKEQ

SEQ ID NO: 111976 - protein, 9 aa, Homo Sapiens
EGQKELAEK

SEQ ID NO: 111977 - protein, 9 aa, Homo Sapiens
RVCQVLFCL

SEQ ID NO: 111978 - protein, 9 aa, Homo Sapiens
VHIECINEH

SEQ ID NO: 111979 - protein, 9 aa, Homo Sapiens
EKVAYEMVK

SEQ ID NO: 111980 - protein, 9 aa, Homo Sapiens
GACGLSQEK

SEQ ID NO: 111981 - protein, 9 aa, Homo Sapiens
AMVFVSNKV

SEQ ID NO: 111982 - protein, 9 aa, Homo Sapiens
HNELKSPWQ

SEQ ID NO: 111983 - protein, 9 aa, Homo Sapiens
TISPLVVAK

SEQ ID NO: 111984 - protein, 9 aa, Homo Sapiens
ILFVNSRIN

SEQ ID NO: 111985 - protein, 9 aa, Homo Sapiens
KNVKIPLFF

SEQ ID NO: 111986 - protein, 9 aa, Homo Sapiens
EPLPANCYI

SEQ ID NO: 111987 - protein, 9 aa, Homo Sapiens
TSHSKIEKF

SEQ ID NO: 111988 - protein, 9 aa, Homo Sapiens
RVMSTQCVA

SEQ ID NO: 111989 - protein, 9 aa, Homo Sapiens
VPRVMSTQC

SEQ ID NO: 111990 - protein, 9 aa, Homo Sapiens
GSAGQDPNI

SEQ ID NO: 111991 - protein, 9 aa, Homo Sapiens
KVDMIVNFT

SEQ ID NO: 111992 - protein, 9 aa, Homo Sapiens
VFVSNKVGE

SEQ ID NO: 111993 - protein, 9 aa, Homo Sapiens
GQHALLSGR

SEQ ID NO: 111994 - protein, 9 aa, Homo Sapiens
VTSRVQARG

SEQ ID NO: 111995 - protein, 9 aa, Homo Sapiens
GPNCSRDEG

SEQ ID NO: 111996 - protein, 9 aa, Homo Sapiens
EVTSRVQAR

SEQ ID NO: 111997 - protein, 9 aa, Homo Sapiens
SSILSSTKE

SEQ ID NO: 111998 - protein, 9 aa, Homo Sapiens
LDRNMVTHT

SEQ ID NO: 111999 - protein, 9 aa, Homo Sapiens
GEGQKELAE

SEQ ID NO: 112000 - protein, 9 aa, Homo Sapiens
KGGTAWLEW

SEQ ID NO: 112001 - protein, 9 aa, Homo Sapiens
KKPQKGIQY

SEQ ID NO: 112002 - protein, 9 aa, Homo Sapiens
ETQSSMPHV

SEQ ID NO: 112003 - protein, 9 aa, Homo Sapiens
IFHLFHQKK

SEQ ID NO: 112004 - protein, 9 aa, Homo Sapiens
ASVLGLIML

SEQ ID NO: 112005 - protein, 9 aa, Homo Sapiens
IDGSGKESK

SEQ ID NO: 112006 - protein, 9 aa, Homo Sapiens
YRVCQVLFC

SEQ ID NO: 112007 - protein, 9 aa, Homo Sapiens
ATEKAEHNE

SEQ ID NO: 112008 - protein, 9 aa, Homo Sapiens
MIVNFTHQH

SEQ ID NO: 112009 - protein, 9 aa, Homo Sapiens
HALLSGRRF

SEQ ID NO: 112010 - protein, 9 aa, Homo Sapiens
QHALLSGRR

SEQ ID NO: 112011 - protein, 9 aa, Homo Sapiens
DNRDFFDNG

SEQ ID NO: 112012 - protein, 9 aa, Homo Sapiens
HWVPFQTKG

SEQ ID NO: 112013 - protein, 9 aa, Homo Sapiens
DEGTCVRFG

SEQ ID NO: 112014 - protein, 9 aa, Homo Sapiens
KEMKSKVDM

SEQ ID NO: 112015 - protein, 9 aa, Homo Sapiens
DAGPNCSRD

SEQ ID NO: 112016 - protein, 9 aa, Homo Sapiens
DRNMVTHTA

SEQ ID NO: 112017 - protein, 9 aa, Homo Sapiens
RYEVICRCF

SEQ ID NO: 112018 - protein, 9 aa, Homo Sapiens
VNSRINREE

SEQ ID NO: 112019 - protein, 9 aa, Homo Sapiens
EHNELKSPW

SEQ ID NO: 112020 - protein, 9 aa, Homo Sapiens
SPPTSPNTP

SEQ ID NO: 112021 - protein, 9 aa, Homo Sapiens
HISVQNIMR

SEQ ID NO: 112022 - protein, 9 aa, Homo Sapiens
LLEQLHAKF

SEQ ID NO: 112023 - protein, 9 aa, Homo Sapiens
QLSFCKNVK

SEQ ID NO: 112024 - protein, 9 aa, Homo Sapiens
GCGYLCTAG

SEQ ID NO: 112025 - protein, 9 aa, Homo Sapiens
VGFSSNNDE

SEQ ID NO: 112026 - protein, 9 aa, Homo Sapiens
PNCSRDEGG

SEQ ID NO: 112027 - protein, 9 aa, Homo Sapiens
GHLQLDFSG

SEQ ID NO: 112028 - protein, 9 aa, Homo Sapiens
PEKVAYEMV

SEQ ID NO: 112029 - protein, 9 aa, Homo Sapiens
EVGFSSNND

SEQ ID NO: 112030 - protein, 9 aa, Homo Sapiens
ESSILSSTK

SEQ ID NO: 112031 - protein, 9 aa, Homo Sapiens
KEEEEEIDG

SEQ ID NO: 112032 - protein, 9 aa, Homo Sapiens
AEVGFSSNN

SEQ ID NO: 112033 - protein, 9 aa, Homo Sapiens
ECINEHAPT

SEQ ID NO: 112034 - protein, 9 aa, Homo Sapiens
MSSLLEQLH

SEQ ID NO: 112035 - protein, 9 aa, Homo Sapiens
EKAEHNELK

SEQ ID NO: 112036 - protein, 9 aa, Homo Sapiens
CQVLFCLNF

SEQ ID NO: 112037 - protein, 9 aa, Homo Sapiens
SLSLSEWLW

SEQ ID NO: 112038 - protein, 9 aa, Homo Sapiens
YAHWVPFQT

SEQ ID NO: 112039 - protein, 9 aa, Homo Sapiens
CPSSSDPGS

SEQ ID NO: 112040 - protein, 9 aa, Homo Sapiens
LGLDRNMVT

SEQ ID NO: 112041 - protein, 9 aa, Homo Sapiens
ASKCEFLRR

SEQ ID NO: 112042 - protein, 9 aa, Homo Sapiens
PRKPGERPS

SEQ ID NO: 112043 - protein, 9 aa, Homo Sapiens
NGDREVDFQ

SEQ ID NO: 112044 - protein, 9 aa, Homo Sapiens
NTEPLPANC

SEQ ID NO: 112045 - protein, 9 aa, Homo Sapiens
NKVGEHSIT

SEQ ID NO: 112046 - protein, 9 aa, Homo Sapiens
QDLQLLLHI

SEQ ID NO: 112047 - protein, 9 aa, Homo Sapiens
ICRCFEGKA

SEQ ID NO: 112048 - protein, 9 aa, Homo Sapiens
AASLTSSPK

SEQ ID NO: 112049 - protein, 9 aa, Homo Sapiens
YEVICRCFE

SEQ ID NO: 112050 - protein, 9 aa, Homo Sapiens
KAEHNELKS

SEQ ID NO: 112051 - protein, 9 aa, Homo Sapiens
YILKFCIIC

SEQ ID NO: 112052 - protein, 9 aa, Homo Sapiens
ELDFWMRLA

SEQ ID NO: 112053 - protein, 9 aa, Homo Sapiens
LPANCYIGD

SEQ ID NO: 112054 - protein, 9 aa, Homo Sapiens
MVFVSNKVG

SEQ ID NO: 112055 - protein, 9 aa, Homo Sapiens
VAVQPEVPP

SEQ ID NO: 112056 - protein, 9 aa, Homo Sapiens
HITASKCEF

SEQ ID NO: 112057 - protein, 9 aa, Homo Sapiens
YWLVSMTEM

SEQ ID NO: 112058 - protein, 9 aa, Homo Sapiens
LIMLSVALL

SEQ ID NO: 112059 - protein, 9 aa, Homo Sapiens
YVHIECINE

SEQ ID NO: 112060 - protein, 9 aa, Homo Sapiens
CLNFLVVVL

SEQ ID NO: 112061 - protein, 9 aa, Homo Sapiens
SEWLWCLFI

SEQ ID NO: 112062 - protein, 9 aa, Homo Sapiens
AKGGTAWLE

SEQ ID NO: 112063 - protein, 9 aa, Homo Sapiens
RPGEGQKEL

SEQ ID NO: 112064 - protein, 9 aa, Homo Sapiens
LSFCKNVKI

SEQ ID NO: 112065 - protein, 9 aa, Homo Sapiens
LTSSPKAED

SEQ ID NO: 112066 - protein, 9 aa, Homo Sapiens
GLIMLSVAL

SEQ ID NO: 112067 - protein, 9 aa, Homo Sapiens
PYWLVSMTE

SEQ ID NO: 112068 - protein, 9 aa, Homo Sapiens
MSTQCVANT

SEQ ID NO: 112069 - protein, 9 aa, Homo Sapiens
EEDAGPNCS

SEQ ID NO: 112070 - protein, 9 aa, Homo Sapiens
GFVYRTFQE

SEQ ID NO: 112071 - protein, 9 aa, Homo Sapiens
YHISVQNIM

SEQ ID NO: 112072 - protein, 9 aa, Homo Sapiens
SPYAHWVPF

SEQ ID NO: 112073 - protein, 9 aa, Homo Sapiens
SEASVLVSD

SEQ ID NO: 112074 - protein, 9 aa, Homo Sapiens
EWLWCLFIG

SEQ ID NO: 112075 - protein, 9 aa, Homo Sapiens
LDFWMRLAE

SEQ ID NO: 112076 - protein, 9 aa, Homo Sapiens
DREVDFQEY

SEQ ID NO: 112077 - protein, 9 aa, Homo Sapiens
TASKCEFLR

SEQ ID NO: 112078 - protein, 9 aa, Homo Sapiens
TIIDTLFDK

SEQ ID NO: 112079 - protein, 9 aa, Homo Sapiens
LEQLHAKFN

SEQ ID NO: 112080 - protein, 9 aa, Homo Sapiens
YLCTAGNFM

SEQ ID NO: 112081 - protein, 9 aa, Homo Sapiens
EGDADACDA

SEQ ID NO: 112082 - protein, 9 aa, Homo Sapiens
ASVLVSDKP

SEQ ID NO: 112083 - protein, 9 aa, Homo Sapiens
ASLTSSPKA

SEQ ID NO: 112084 - protein, 9 aa, Homo Sapiens
LLSGRRFLY

SEQ ID NO: 112085 - protein, 9 aa, Homo Sapiens
VSVTVIDIN

SEQ ID NO: 112086 - protein, 9 aa, Homo Sapiens
SYGRKDTIN

SEQ ID NO: 112087 - protein, 9 aa, Homo Sapiens
LETDTPEKV

SEQ ID NO: 112088 - protein, 9 aa, Homo Sapiens
QTKSRTITP

SEQ ID NO: 112089 - protein, 9 aa, Homo Sapiens
QKKQLEKLI

SEQ ID NO: 112090 - protein, 9 aa, Homo Sapiens
TKSRTITPP

SEQ ID NO: 112091 - protein, 9 aa, Homo Sapiens
DACDAKRKE

SEQ ID NO: 112092 - protein, 9 aa, Homo Sapiens
VLFCLNFLV

SEQ ID NO: 112093 - protein, 9 aa, Homo Sapiens
GQDLQLLLH

SEQ ID NO: 112094 - protein, 9 aa, Homo Sapiens
ILKFCIICW

SEQ ID NO: 112095 - protein, 9 aa, Homo Sapiens
FHQKKQLEK

SEQ ID NO: 112096 - protein, 9 aa, Homo Sapiens
FCPSSSDPG

SEQ ID NO: 112097 - protein, 9 aa, Homo Sapiens
KEPLESKGT

SEQ ID NO: 112098 - protein, 9 aa, Homo Sapiens
MPHVPYEPD

SEQ ID NO: 112099 - protein, 9 aa, Homo Sapiens
HGPPWSWLD

SEQ ID NO: 112100 - protein, 9 aa, Homo Sapiens
DHITASKCE

SEQ ID NO: 112101 - protein, 9 aa, Homo Sapiens
HIQRVPDST

SEQ ID NO: 112102 - protein, 9 aa, Homo Sapiens
EVICRCFEG

SEQ ID NO: 112103 - protein, 9 aa, Homo Sapiens
IDINENPYF

SEQ ID NO: 112104 - protein, 9 aa, Homo Sapiens
EIDGSGKES

SEQ ID NO: 112105 - protein, 9 aa, Homo Sapiens
ESTVSPPTS

SEQ ID NO: 112106 - protein, 9 aa, Homo Sapiens
EGTCVRFGA

SEQ ID NO: 112107 - protein, 9 aa, Homo Sapiens
SEEERKKVT

SEQ ID NO: 112108 - protein, 9 aa, Homo Sapiens
NREELCGRS

SEQ ID NO: 112109 - protein, 9 aa, Homo Sapiens
STQCVANTS

SEQ ID NO: 112110 - protein, 9 aa, Homo Sapiens
KDTINSIMS

SEQ ID NO: 112111 - protein, 9 aa, Homo Sapiens
PGSAGQDPN

SEQ ID NO: 112112 - protein, 9 aa, Homo Sapiens
SKVDMIVNF

SEQ ID NO: 112113 - protein, 9 aa, Homo Sapiens
ETDTPEKVA

SEQ ID NO: 112114 - protein, 9 aa, Homo Sapiens
DTINSIMSV

SEQ ID NO: 112115 - protein, 9 aa, Homo Sapiens
GFSSNNDED

SEQ ID NO: 112116 - protein, 9 aa, Homo Sapiens
GTCVRFGAP

SEQ ID NO: 112117 - protein, 9 aa, Homo Sapiens
FCIICWGLP

SEQ ID NO: 112118 - protein, 9 aa, Homo Sapiens
KVAYEMVKS

SEQ ID NO: 112119 - protein, 9 aa, Homo Sapiens
LQLDFSGNA

SEQ ID NO: 112120 - protein, 9 aa, Homo Sapiens
RKKVTPLMV

SEQ ID NO: 112121 - protein, 9 aa, Homo Sapiens
CGLSQEKAV

SEQ ID NO: 112122 - protein, 9 aa, Homo Sapiens
EASVLVSDK

SEQ ID NO: 112123 - protein, 9 aa, Homo Sapiens
AGSSSSSRA

SEQ ID NO: 112124 - protein, 9 aa, Homo Sapiens
LDENGDREV

SEQ ID NO: 112125 - protein, 9 aa, Homo Sapiens
FCLNFLVVV

SEQ ID NO: 112126 - protein, 9 aa, Homo Sapiens
RKPGERPSP

SEQ ID NO: 112127 - protein, 9 aa, Homo Sapiens
VLVSDKPQG

SEQ ID NO: 112128 - protein, 9 aa, Homo Sapiens
DQDVDNRDF

SEQ ID NO: 112129 - protein, 9 aa, Homo Sapiens
MERPGEGQK

SEQ ID NO: 112130 - protein, 9 aa, Homo Sapiens
LLHIQRVPD

SEQ ID NO: 112131 - protein, 9 aa, Homo Sapiens
YGRKDTINS

SEQ ID NO: 112132 - protein, 9 aa, Homo Sapiens
PGCGYLCTA

SEQ ID NO: 112133 - protein, 9 aa, Homo Sapiens
SSLLEQLHA

SEQ ID NO: 112134 - protein, 9 aa, Homo Sapiens
IVHIPRKPG

SEQ ID NO: 112135 - protein, 9 aa, Homo Sapiens
RFEADEGTC

SEQ ID NO: 112136 - protein, 9 aa, Homo Sapiens
EYEEDAGPN

SEQ ID NO: 112137 - protein, 9 aa, Homo Sapiens
KCEFLRRTE

SEQ ID NO: 112138 - protein, 9 aa, Homo Sapiens
HIECINEHA

SEQ ID NO: 112139 - protein, 9 aa, Homo Sapiens
QLDFSGNAL

SEQ ID NO: 112140 - protein, 9 aa, Homo Sapiens
ASAASLTSS

SEQ ID NO: 112141 - protein, 9 aa, Homo Sapiens
KSKVDMIVN

SEQ ID NO: 112142 - protein, 9 aa, Homo Sapiens
CLGQHALLS

SEQ ID NO: 112143 - protein, 9 aa, Homo Sapiens
AAAGMVHAV

SEQ ID NO: 112144 - protein, 9 aa, Homo Sapiens
DAPYWLVSM

SEQ ID NO: 112145 - protein, 9 aa, Homo Sapiens
HIPRKPGER

SEQ ID NO: 112146 - protein, 9 aa, Homo Sapiens
QVLFCLNFL

SEQ ID NO: 112147 - protein, 9 aa, Homo Sapiens
NMVTHTAAS

SEQ ID NO: 112148 - protein, 9 aa, Homo Sapiens
NDEDKDDDV

SEQ ID NO: 112149 - protein, 9 aa, Homo Sapiens
VSDKPQGLS

SEQ ID NO: 112150 - protein, 9 aa, Homo Sapiens
LFCLNFLVV

SEQ ID NO: 112151 - protein, 9 aa, Homo Sapiens
RNMVTHTAA

SEQ ID NO: 112152 - protein, 9 aa, Homo Sapiens
ILITIIDTL

SEQ ID NO: 112153 - protein, 9 aa, Homo Sapiens
TVSPPTSPN

SEQ ID NO: 112154 - protein, 9 aa, Homo Sapiens
RHGPPWSWL

SEQ ID NO: 112155 - protein, 9 aa, Homo Sapiens
SHQRDHKNY

SEQ ID NO: 112156 - protein, 9 aa, Homo Sapiens
VDMIVNFTH

SEQ ID NO: 112157 - protein, 9 aa, Homo Sapiens
SAAFQALRK

SEQ ID NO: 112158 - protein, 9 aa, Homo Sapiens
AFQALRKQV

SEQ ID NO: 112159 - protein, 9 aa, Homo Sapiens
SRINREELC

SEQ ID NO: 112160 - protein, 9 aa, Homo Sapiens
FNKKPQKGI

SEQ ID NO: 112161 - protein, 9 aa, Homo Sapiens
ICWGLPALV

SEQ ID NO: 112162 - protein, 9 aa, Homo Sapiens
SDKPQGLSH

SEQ ID NO: 112163 - protein, 9 aa, Homo Sapiens
SDPGSAGQD

SEQ ID NO: 112164 - protein, 9 aa, Homo Sapiens
DHKNYVACS

SEQ ID NO: 112165 - protein, 9 aa, Homo Sapiens
EQLHAKFNQ

SEQ ID NO: 112166 - protein, 9 aa, Homo Sapiens
SVTVIDINE

SEQ ID NO: 112167 - protein, 9 aa, Homo Sapiens
TEKAEHNEL

SEQ ID NO: 112168 - protein, 9 aa, Homo Sapiens
GDADACDAK

SEQ ID NO: 112169 - protein, 9 aa, Homo Sapiens
FVSNKVGEH

SEQ ID NO: 112170 - protein, 9 aa, Homo Sapiens
LGHLQLDFS

SEQ ID NO: 112171 - protein, 9 aa, Homo Sapiens
MDALELDFW

SEQ ID NO: 112172 - protein, 9 aa, Homo Sapiens
DENGDREVD

SEQ ID NO: 112173 - protein, 9 aa, Homo Sapiens
FQECLEFIH

SEQ ID NO: 112174 - protein, 9 aa, Homo Sapiens
PETQSSMPH

SEQ ID NO: 112175 - protein, 9 aa, Homo Sapiens
KIIRYEVIC

SEQ ID NO: 112176 - protein, 9 aa, Homo Sapiens
SAASLTSSP

SEQ ID NO: 112177 - protein, 9 aa, Homo Sapiens
GSCHLGHLQ

SEQ ID NO: 112178 - protein, 9 aa, Homo Sapiens
VHIPRKPGE

SEQ ID NO: 112179 - protein, 9 aa, Homo Sapiens
TISAAFQAL

SEQ ID NO: 112180 - protein, 9 aa, Homo Sapiens
QMPAQYLAQ

SEQ ID NO: 112181 - protein, 9 aa, Homo Sapiens
PANCYIGDD

SEQ ID NO: 112182 - protein, 9 aa, Homo Sapiens
CGYLCTAGN

SEQ ID NO: 112183 - protein, 9 aa, Homo Sapiens
LSQEKAVEK

SEQ ID NO: 112184 - protein, 9 aa, Homo Sapiens
GRKDTINSI

SEQ ID NO: 112185 - protein, 9 aa, Homo Sapiens
FVNSRINRE

SEQ ID NO: 112186 - protein, 9 aa, Homo Sapiens
GMVHAVSNA

SEQ ID NO: 112187 - protein, 9 aa, Homo Sapiens
SQEKAVEKF

SEQ ID NO: 112188 - protein, 9 aa, Homo Sapiens
DVDNRDFFD

SEQ ID NO: 112189 - protein, 9 aa, Homo Sapiens
ADAPYWLVS

SEQ ID NO: 112190 - protein, 9 aa, Homo Sapiens
EAASAASLT

SEQ ID NO: 112191 - protein, 9 aa, Homo Sapiens
GDREVDFQE

SEQ ID NO: 112192 - protein, 9 aa, Homo Sapiens
DFWMRLAEV

SEQ ID NO: 112193 - protein, 9 aa, Homo Sapiens
NSRINREEL

SEQ ID NO: 112194 - protein, 9 aa, Homo Sapiens
ILEDQDVDN

SEQ ID NO: 112195 - protein, 9 aa, Homo Sapiens
HQKKQLEKL

SEQ ID NO: 112196 - protein, 9 aa, Homo Sapiens
KNYVACSRS

SEQ ID NO: 112197 - protein, 9 aa, Homo Sapiens
ALGPSPYAH

SEQ ID NO: 112198 - protein, 9 aa, Homo Sapiens
MESHQRDHK

SEQ ID NO: 112199 - protein, 9 aa, Homo Sapiens
ELDENGDRE

SEQ ID NO: 112200 - protein, 9 aa, Homo Sapiens
GGPVAVQPE

SEQ ID NO: 112201 - protein, 9 aa, Homo Sapiens
VQPEVPPVP

SEQ ID NO: 112202 - protein, 9 aa, Homo Sapiens
EPLESKGTS

SEQ ID NO: 112203 - protein, 9 aa, Homo Sapiens
VQARGPGGE

SEQ ID NO: 112204 - protein, 9 aa, Homo Sapiens
NLFNKKPQK

SEQ ID NO: 112205 - protein, 9 aa, Homo Sapiens
SKMSSLLEQ

SEQ ID NO: 112206 - protein, 9 aa, Homo Sapiens
AYAIAAAGM

SEQ ID NO: 112207 - protein, 9 aa, Homo Sapiens
QSMSEEERK

SEQ ID NO: 112208 - protein, 9 aa, Homo Sapiens
EDHITASKC

SEQ ID NO: 112209 - protein, 9 aa, Homo Sapiens
SCHLGHLQL

SEQ ID NO: 112210 - protein, 9 aa, Homo Sapiens
GSSSSSRAS

SEQ ID NO: 112211 - protein, 9 aa, Homo Sapiens
IDTLFDKRC

SEQ ID NO: 112212 - protein, 9 aa, Homo Sapiens
LSSTKENGR

SEQ ID NO: 112213 - protein, 9 aa, Homo Sapiens
KQTKSRTIT

SEQ ID NO: 112214 - protein, 9 aa, Homo Sapiens
TSLSLSEWL

SEQ ID NO: 112215 - protein, 9 aa, Homo Sapiens
RVQARGPGG

SEQ ID NO: 112216 - protein, 9 aa, Homo Sapiens
STVSPPTSP

SEQ ID NO: 112217 - protein, 9 aa, Homo Sapiens
ILSSTKENG

SEQ ID NO: 112218 - protein, 9 aa, Homo Sapiens
QALRKQVPC

SEQ ID NO: 112219 - protein, 9 aa, Homo Sapiens
INENPYFAP

SEQ ID NO: 112220 - protein, 9 aa, Homo Sapiens
GPSPYAHWV

SEQ ID NO: 112221 - protein, 9 aa, Homo Sapiens
VLGLIMLSV

SEQ ID NO: 112222 - protein, 9 aa, Homo Sapiens
LCTAGNFME

SEQ ID NO: 112223 - protein, 9 aa, Homo Sapiens
LFNKKPQKG

SEQ ID NO: 112224 - protein, 9 aa, Homo Sapiens
FHLFHQKKQ

SEQ ID NO: 112225 - protein, 9 aa, Homo Sapiens
SVLGLIMLS

SEQ ID NO: 112226 - protein, 9 aa, Homo Sapiens
SKCEFLRRT

SEQ ID NO: 112227 - protein, 9 aa, Homo Sapiens
VSNKVGEHS

SEQ ID NO: 112228 - protein, 9 aa, Homo Sapiens
TILITIIDT

SEQ ID NO: 112229 - protein, 9 aa, Homo Sapiens
KKVTPLMVK

SEQ ID NO: 112230 - protein, 9 aa, Homo Sapiens
LSEWLWCLF

SEQ ID NO: 112231 - protein, 9 aa, Homo Sapiens
YEEDAGPNC

SEQ ID NO: 112232 - protein, 9 aa, Homo Sapiens
VDNRDFFDN

SEQ ID NO: 112233 - protein, 9 aa, Homo Sapiens
PSPYAHWVP

SEQ ID NO: 112234 - protein, 9 aa, Homo Sapiens
IMLSVALLI

SEQ ID NO: 112235 - protein, 9 aa, Homo Sapiens
DYHISVQNI

SEQ ID NO: 112236 - protein, 9 aa, Homo Sapiens
TPEKVAYEM

SEQ ID NO: 112237 - protein, 9 aa, Homo Sapiens
LGPSPYAHW

SEQ ID NO: 112238 - protein, 9 aa, Homo Sapiens
EEGDADACD

SEQ ID NO: 112239 - protein, 9 aa, Homo Sapiens
ERPGEGQKE

SEQ ID NO: 112240 - protein, 9 aa, Homo Sapiens
TDTPEKVAY

SEQ ID NO: 112241 - protein, 9 aa, Homo Sapiens
EEEIDGSGK

SEQ ID NO: 112242 - protein, 9 aa, Homo Sapiens
PYAHWVPFQ

SEQ ID NO: 112243 - protein, 9 aa, Homo Sapiens
WLVSMTEMT

SEQ ID NO: 112244 - protein, 9 aa, Homo Sapiens
ISAAFQALR

SEQ ID NO: 112245 - protein, 9 aa, Homo Sapiens
IPRKPGERP

SEQ ID NO: 112246 - protein, 9 aa, Homo Sapiens
QDVDNRDFF

SEQ ID NO: 112247 - protein, 9 aa, Homo Sapiens
ESHQRDHKN

SEQ ID NO: 112248 - protein, 9 aa, Homo Sapiens
GTSHSKIEK

SEQ ID NO: 112249 - protein, 9 aa, Homo Sapiens
SMPHVPYEP

SEQ ID NO: 112250 - protein, 9 aa, Homo Sapiens
DMIVNFTHQ

SEQ ID NO: 112251 - protein, 9 aa, Homo Sapiens
ADEGTCVRF

SEQ ID NO: 112252 - protein, 9 aa, Homo Sapiens
VAKGGTAWL

SEQ ID NO: 112253 - protein, 9 aa, Homo Sapiens
PQKGIQYLI

SEQ ID NO: 112254 - protein, 9 aa, Homo Sapiens
AEHNELKSP

SEQ ID NO: 112255 - protein, 9 aa, Homo Sapiens
ITASKCEFL

SEQ ID NO: 112256 - protein, 9 aa, Homo Sapiens
ACGLSQEKA

SEQ ID NO: 112257 - protein, 9 aa, Homo Sapiens
CINEHAPTI

SEQ ID NO: 112258 - protein, 9 aa, Homo Sapiens
KLYVHIECI

SEQ ID NO: 112259 - protein, 9 aa, Homo Sapiens
KGTSHSKIE

SEQ ID NO: 112260 - protein, 9 aa, Homo Sapiens
WLDAQQERD

SEQ ID NO: 112261 - protein, 9 aa, Homo Sapiens
YGACGLSQE

SEQ ID NO: 112262 - protein, 9 aa, Homo Sapiens
MSEEERKKV

SEQ ID NO: 112263 - protein, 9 aa, Homo Sapiens
EERKKVTPL

SEQ ID NO: 112264 - protein, 9 aa, Homo Sapiens
LELDFWMRL

SEQ ID NO: 112265 - protein, 9 aa, Homo Sapiens
PGEGQKELA

SEQ ID NO: 112266 - protein, 9 aa, Homo Sapiens
ITIIDTLFD

SEQ ID NO: 112267 - protein, 9 aa, Homo Sapiens
CCPGCGYLC

SEQ ID NO: 112268 - protein, 9 aa, Homo Sapiens
QRDHKNYVA

SEQ ID NO: 112269 - protein, 9 aa, Homo Sapiens
ESKGTSHSK

SEQ ID NO: 112270 - protein, 9 aa, Homo Sapiens
AGMVHAVSN

SEQ ID NO: 112271 - protein, 9 aa, Homo Sapiens
SKGTSHSKI

SEQ ID NO: 112272 - protein, 9 aa, Homo Sapiens
NVKIPLFFC

SEQ ID NO: 112273 - protein, 9 aa, Homo Sapiens
WMRLAEVQR

SEQ ID NO: 112274 - protein, 9 aa, Homo Sapiens
GQKELAEKE

SEQ ID NO: 112275 - protein, 9 aa, Homo Sapiens
LASYGRKDT

SEQ ID NO: 112276 - protein, 9 aa, Homo Sapiens
FVYRTFQEC

SEQ ID NO: 112277 - protein, 9 aa, Homo Sapiens
AKQMPAQYL

SEQ ID NO: 112278 - protein, 9 aa, Homo Sapiens
TCVRFGAPR

SEQ ID NO: 112279 - protein, 9 aa, Homo Sapiens
EMKSKVDMI

SEQ ID NO: 112280 - protein, 9 aa, Homo Sapiens
AEEGDADAC

SEQ ID NO: 112281 - protein, 9 aa, Homo Sapiens
PSSSDPGSA

SEQ ID NO: 112282 - protein, 9 aa, Homo Sapiens
TKENGRSNS

SEQ ID NO: 112283 - protein, 9 aa, Homo Sapiens
DKPQGLSHQ

SEQ ID NO: 112284 - protein, 9 aa, Homo Sapiens
RTFQECLEF

SEQ ID NO: 112285 - protein, 9 aa, Homo Sapiens
EKQTKSRTI

SEQ ID NO: 112286 - protein, 9 aa, Homo Sapiens
KQMPAQYLA

SEQ ID NO: 112287 - protein, 9 aa, Homo Sapiens
MKSKVDMIV

SEQ ID NO: 112288 - protein, 9 aa, Homo Sapiens
NLETDTPEK

SEQ ID NO: 112289 - protein, 9 aa, Homo Sapiens
IRYEVICRC

SEQ ID NO: 112290 - protein, 9 aa, Homo Sapiens
VAGGPVAVQ

SEQ ID NO: 112291 - protein, 9 aa, Homo Sapiens
LNLFNKKPQ

SEQ ID NO: 112292 - protein, 9 aa, Homo Sapiens
ELESTVSPP

SEQ ID NO: 112293 - protein, 9 aa, Homo Sapiens
MVHAVSNAC

SEQ ID NO: 112294 - protein, 9 aa, Homo Sapiens
AASAASLTS

SEQ ID NO: 112295 - protein, 9 aa, Homo Sapiens
HCARLAKQM

SEQ ID NO: 112296 - protein, 9 aa, Homo Sapiens
PLESKGTSH

SEQ ID NO: 112297 - protein, 9 aa, Homo Sapiens
KIPLFFCEV

SEQ ID NO: 112298 - protein, 9 aa, Homo Sapiens
NCSRDEGGS

SEQ ID NO: 112299 - protein, 9 aa, Homo Sapiens
SLSEWLWCL

SEQ ID NO: 112300 - protein, 9 aa, Homo Sapiens
FCKNVKIPL

SEQ ID NO: 112301 - protein, 9 aa, Homo Sapiens
SPLVVAKGG

SEQ ID NO: 112302 - protein, 9 aa, Homo Sapiens
WSWLDAQQE

SEQ ID NO: 112303 - protein, 9 aa, Homo Sapiens
GPPWSWLDA

SEQ ID NO: 112304 - protein, 9 aa, Homo Sapiens
HLQLDFSGN

SEQ ID NO: 112305 - protein, 9 aa, Homo Sapiens
KVGEHSITT

SEQ ID NO: 112306 - protein, 9 aa, Homo Sapiens
CWGLPALVV

SEQ ID NO: 112307 - protein, 9 aa, Homo Sapiens
PHVPYEPDL

SEQ ID NO: 112308 - protein, 9 aa, Homo Sapiens
TVIDINENP

SEQ ID NO: 112309 - protein, 9 aa, Homo Sapiens
SMSEEERKK

SEQ ID NO: 112310 - protein, 9 aa, Homo Sapiens
SSTKENGRS

SEQ ID NO: 112311 - protein, 9 aa, Homo Sapiens
TINSIMSVV

SEQ ID NO: 112312 - protein, 9 aa, Homo Sapiens
AHWVPFQTK

SEQ ID NO: 112313 - protein, 9 aa, Homo Sapiens
GEAASAASL

SEQ ID NO: 112314 - protein, 9 aa, Homo Sapiens
SSDPGSAGQ

SEQ ID NO: 112315 - protein, 9 aa, Homo Sapiens
LHIQRVPDS

SEQ ID NO: 112316 - protein, 9 aa, Homo Sapiens
PVAVQPEVP

SEQ ID NO: 112317 - protein, 9 aa, Homo Sapiens
SLTSSPKAE

SEQ ID NO: 112318 - protein, 9 aa, Homo Sapiens
LAKQMPAQY

SEQ ID NO: 112319 - protein, 9 aa, Homo Sapiens
PATEKAEHN

SEQ ID NO: 112320 - protein, 9 aa, Homo Sapiens
LVSMTEMTR

SEQ ID NO: 112321 - protein, 9 aa, Homo Sapiens
TELESTVSP

SEQ ID NO: 112322 - protein, 9 aa, Homo Sapiens
EADEGTCVR

SEQ ID NO: 112323 - protein, 9 aa, Homo Sapiens
YRTFQECLE

SEQ ID NO: 112324 - protein, 9 aa, Homo Sapiens
PPWSWLDAQ

SEQ ID NO: 112325 - protein, 9 aa, Homo Sapiens
VYRTFQECL

SEQ ID NO: 112326 - protein, 9 aa, Homo Sapiens
EEIDGSGKE

SEQ ID NO: 112327 - protein, 9 aa, Homo Sapiens
FWMRLAEVQ

SEQ ID NO: 112328 - protein, 9 aa, Homo Sapiens
LQLLLHIQR

SEQ ID NO: 112329 - protein, 9 aa, Homo Sapiens
SCTSLSLSE

SEQ ID NO: 112330 - protein, 9 aa, Homo Sapiens
KMSSLLEQL

SEQ ID NO: 112331 - protein, 9 aa, Homo Sapiens
CHLGHLQLD

SEQ ID NO: 112332 - protein, 9 aa, Homo Sapiens
SSMPHVPYE

SEQ ID NO: 112333 - protein, 9 aa, Homo Sapiens
DADACDAKR

SEQ ID NO: 112334 - protein, 9 aa, Homo Sapiens
AIAAAGMVH

SEQ ID NO: 112335 - protein, 9 aa, Homo Sapiens
RPEVTSRVQ

SEQ ID NO: 112336 - protein, 9 aa, Homo Sapiens
DCLGQHALL

SEQ ID NO: 112337 - protein, 9 aa, Homo Sapiens
VASVLGLIM

SEQ ID NO: 112338 - protein, 9 aa, Homo Sapiens
SWLDAQQER

SEQ ID NO: 112339 - protein, 9 aa, Homo Sapiens
CVRFGAPRF

SEQ ID NO: 112340 - protein, 9 aa, Homo Sapiens
TSRVQARGP

SEQ ID NO: 112341 - protein, 9 aa, Homo Sapiens
DTPEKVAYE

SEQ ID NO: 112342 - protein, 9 aa, Homo Sapiens
DLQLLLHIQ

SEQ ID NO: 112343 - protein, 9 aa, Homo Sapiens
RINREELCG

SEQ ID NO: 112344 - protein, 9 aa, Homo Sapiens
HTISAAFQA

SEQ ID NO: 112345 - protein, 9 aa, Homo Sapiens
PLVVAKGGT

SEQ ID NO: 112346 - protein, 9 aa, Homo Sapiens
VIDINENPY

SEQ ID NO: 112347 - protein, 9 aa, Homo Sapiens
ARHGPPWSW

SEQ ID NO: 112348 - protein, 9 aa, Homo Sapiens
PESSILSST

SEQ ID NO: 112349 - protein, 9 aa, Homo Sapiens
DALELDFWM

SEQ ID NO: 112350 - protein, 9 aa, Homo Sapiens
TFQECLEFI

SEQ ID NO: 112351 - protein, 9 aa, Homo Sapiens
ANCYIGDDG

SEQ ID NO: 112352 - protein, 9 aa, Homo Sapiens
DTLFDKRCW

SEQ ID NO: 112353 - protein, 9 aa, Homo Sapiens
CRCFEGKAW

SEQ ID NO: 112354 - protein, 9 aa, Homo Sapiens
QEKAVEKFG

SEQ ID NO: 112355 - protein, 9 aa, Homo Sapiens
SFCKNVKIP

SEQ ID NO: 112356 - protein, 9 aa, Homo Sapiens
REVDFQEYV

SEQ ID NO: 112357 - protein, 9 aa, Homo Sapiens
SNNDEDKDD

SEQ ID NO: 112358 - protein, 9 aa, Homo Sapiens
TQCVANTST

SEQ ID NO: 112359 - protein, 9 aa, Homo Sapiens
SRVQARGPG

SEQ ID NO: 112360 - protein, 9 aa, Homo Sapiens
QCCPGCGYL

SEQ ID NO: 112361 - protein, 9 aa, Homo Sapiens
FQALRKQVP

SEQ ID NO: 112362 - protein, 9 aa, Homo Sapiens
KFCIICWGL

SEQ ID NO: 112363 - protein, 9 aa, Homo Sapiens
AAGMVHAVS

SEQ ID NO: 112364 - protein, 9 aa, Homo Sapiens
VTVIDINEN

SEQ ID NO: 112365 - protein, 9 aa, Homo Sapiens
EMERPGEGQ

SEQ ID NO: 112366 - protein, 9 aa, Homo Sapiens
SVLVSDKPQ

SEQ ID NO: 112367 - protein, 9 aa, Homo Sapiens
HVPYEPDLD

SEQ ID NO: 112368 - protein, 9 aa, Homo Sapiens
DPGSAGQDP

SEQ ID NO: 112369 - protein, 9 aa, Homo Sapiens
VSMTEMTRT

SEQ ID NO: 112370 - protein, 9 aa, Homo Sapiens
ISVQNIMRR

SEQ ID NO: 112371 - protein, 9 aa, Homo Sapiens
VQNIMRRKE

SEQ ID NO: 112372 - protein, 9 aa, Homo Sapiens
QLLLHIQRV

SEQ ID NO: 112373 - protein, 9 aa, Homo Sapiens
NIMRRKEQE

SEQ ID NO: 112374 - protein, 9 aa, Homo Sapiens
LVVAKGGTA

SEQ ID NO: 112375 - protein, 9 aa, Homo Sapiens
CIICWGLPA

SEQ ID NO: 112376 - protein, 9 aa, Homo Sapiens
NRDFFDNGE

SEQ ID NO: 112377 - protein, 9 aa, Homo Sapiens
GLSQEKAVE

SEQ ID NO: 112378 - protein, 9 aa, Homo Sapiens
VSPPTSPNT

SEQ ID NO: 112379 - protein, 9 aa, Homo Sapiens
VVAKGGTAW

SEQ ID NO: 112380 - protein, 9 aa, Homo Sapiens
PIVHIPRKP

SEQ ID NO: 112381 - protein, 9 aa, Homo Sapiens
HLGHLQLDF

SEQ ID NO: 112382 - protein, 9 aa, Homo Sapiens
VMSTQCVAN

SEQ ID NO: 112383 - protein, 9 aa, Homo Sapiens
AKLYVHIEC

SEQ ID NO: 112384 - protein, 9 aa, Homo Sapiens
GPVAVQPEV

SEQ ID NO: 112385 - protein, 9 aa, Homo Sapiens
RDHKNYVAC

SEQ ID NO: 112386 - protein, 9 aa, Homo Sapiens
DAGSSSSSR

SEQ ID NO: 112387 - protein, 9 aa, Homo Sapiens
CTSLSLSEW

SEQ ID NO: 112388 - protein, 9 aa, Homo Sapiens
SGFVYRTFQ

SEQ ID NO: 112389 - protein, 9 aa, Homo Sapiens
LKFCIICWG

SEQ ID NO: 112390 - protein, 9 aa, Homo Sapiens
QNLGLDRNM

SEQ ID NO: 112391 - protein, 9 aa, Homo Sapiens
LVSDKPQGL

SEQ ID NO: 112392 - protein, 9 aa, Homo Sapiens
CEFLRRTEV

SEQ ID NO: 112393 - protein, 9 aa, Homo Sapiens
TEPLPANCY

SEQ ID NO: 112394 - protein, 9 aa, Homo Sapiens
CVANTSTQT

SEQ ID NO: 112395 - protein, 9 aa, Homo Sapiens
LCEQEERLH

SEQ ID NO: 112396 - protein, 9 aa, Homo Sapiens
IIRYEVICR

SEQ ID NO: 112397 - protein, 9 aa, Homo Sapiens
QLHAKFNQN

SEQ ID NO: 112398 - protein, 9 aa, Homo Sapiens
KPGERPSPI

SEQ ID NO: 112399 - protein, 9 aa, Homo Sapiens
LLLHIQRVP

SEQ ID NO: 112400 - protein, 9 aa, Homo Sapiens
ENGDREVDF

SEQ ID NO: 112401 - protein, 9 aa, Homo Sapiens
GKEEEEEID

SEQ ID NO: 112402 - protein, 9 aa, Homo Sapiens
TDEKQTKSR

SEQ ID NO: 112403 - protein, 9 aa, Homo Sapiens
IICWGLPAL

SEQ ID NO: 112404 - protein, 9 aa, Homo Sapiens
SNKVGEHSI

SEQ ID NO: 112405 - protein, 9 aa, Homo Sapiens
MPAQYLAQH

SEQ ID NO: 112406 - protein, 9 aa, Homo Sapiens
GLDRNMVTH

SEQ ID NO: 112407 - protein, 9 aa, Homo Sapiens
NKKPQKGIQ

SEQ ID NO: 112408 - protein, 9 aa, Homo Sapiens
QKGIQYLIE

SEQ ID NO: 112409 - protein, 9 aa, Homo Sapiens
KELDENGDR

SEQ ID NO: 112410 - protein, 9 aa, Homo Sapiens
SPISPNYSP

SEQ ID NO: 112411 - protein, 9 aa, Homo Sapiens
SIRVFILKK

SEQ ID NO: 112412 - protein, 9 aa, Homo Sapiens
TPAGPARAP

SEQ ID NO: 112413 - protein, 9 aa, Homo Sapiens
ATVGRAWGY

SEQ ID NO: 112414 - protein, 9 aa, Homo Sapiens
SRVAGTAGA

SEQ ID NO: 112415 - protein, 9 aa, Homo Sapiens
SHLPTLASR

SEQ ID NO: 112416 - protein, 9 aa, Homo Sapiens
KCMAPPSTS

SEQ ID NO: 112417 - protein, 9 aa, Homo Sapiens
PSKGTTSTS

SEQ ID NO: 112418 - protein, 9 aa, Homo Sapiens
FILVPRLEC

SEQ ID NO: 112419 - protein, 9 aa, Homo Sapiens
LLLLVFIIF

SEQ ID NO: 112420 - protein, 9 aa, Homo Sapiens
TILAYCSLS

SEQ ID NO: 112421 - protein, 9 aa, Homo Sapiens
FDKFANIMP

SEQ ID NO: 112422 - protein, 9 aa, Homo Sapiens
KNPLNVRNA

SEQ ID NO: 112423 - protein, 9 aa, Homo Sapiens
FGCASRLQI

SEQ ID NO: 112424 - protein, 9 aa, Homo Sapiens
ASNTLNALC

SEQ ID NO: 112425 - protein, 9 aa, Homo Sapiens
SLVASHFLF

SEQ ID NO: 112426 - protein, 9 aa, Homo Sapiens
RGATPSRAT

SEQ ID NO: 112427 - protein, 9 aa, Homo Sapiens
MPFDSWDQL

SEQ ID NO: 112428 - protein, 9 aa, Homo Sapiens
STTIFRLLG

SEQ ID NO: 112429 - protein, 9 aa, Homo Sapiens
ATFINHDCK

SEQ ID NO: 112430 - protein, 9 aa, Homo Sapiens
NKAAGVQEE

SEQ ID NO: 112431 - protein, 9 aa, Homo Sapiens
SPSTTSPRV

SEQ ID NO: 112432 - protein, 9 aa, Homo Sapiens
LSAGLSMGA

SEQ ID NO: 112433 - protein, 9 aa, Homo Sapiens
LAVCFHGSS

SEQ ID NO: 112434 - protein, 9 aa, Homo Sapiens
HEEHRHAMN

SEQ ID NO: 112435 - protein, 9 aa, Homo Sapiens
TDREPAFEQ

SEQ ID NO: 112436 - protein, 9 aa, Homo Sapiens
SGRGATPSR

SEQ ID NO: 112437 - protein, 9 aa, Homo Sapiens
TSPSYSPIS

SEQ ID NO: 112438 - protein, 9 aa, Homo Sapiens
IAVKRRSAE

SEQ ID NO: 112439 - protein, 9 aa, Homo Sapiens
LILSAGLSM

SEQ ID NO: 112440 - protein, 9 aa, Homo Sapiens
SKWWRERPE

SEQ ID NO: 112441 - protein, 9 aa, Homo Sapiens
LRTSGRGAT

SEQ ID NO: 112442 - protein, 9 aa, Homo Sapiens
NKCLKQSLV

SEQ ID NO: 112443 - protein, 9 aa, Homo Sapiens
LFSIRVFIL

SEQ ID NO: 112444 - protein, 9 aa, Homo Sapiens
ISDSTTIFR

SEQ ID NO: 112445 - protein, 9 aa, Homo Sapiens
AAGVQEEFM

SEQ ID NO: 112446 - protein, 9 aa, Homo Sapiens
RVFILKKNP

SEQ ID NO: 112447 - protein, 9 aa, Homo Sapiens
LVCISLALC

SEQ ID NO: 112448 - protein, 9 aa, Homo Sapiens
SYSPISPNY

SEQ ID NO: 112449 - protein, 9 aa, Homo Sapiens
FPGSSHLPT

SEQ ID NO: 112450 - protein, 9 aa, Homo Sapiens
RSRPTSKKL

SEQ ID NO: 112451 - protein, 9 aa, Homo Sapiens
CASRLQIHG

SEQ ID NO: 112452 - protein, 9 aa, Homo Sapiens
NLCAIHGKR

SEQ ID NO: 112453 - protein, 9 aa, Homo Sapiens
CLKQSLVAS

SEQ ID NO: 112454 - protein, 9 aa, Homo Sapiens
DREPAFEQQ

SEQ ID NO: 112455 - protein, 9 aa, Homo Sapiens
LLLVFIIFV

SEQ ID NO: 112456 - protein, 9 aa, Homo Sapiens
TTIFRLLGS

SEQ ID NO: 112457 - protein, 9 aa, Homo Sapiens
FLFSIRVFI

SEQ ID NO: 112458 - protein, 9 aa, Homo Sapiens
KFANIMPFD

SEQ ID NO: 112459 - protein, 9 aa, Homo Sapiens
PALVLPPAS

SEQ ID NO: 112460 - protein, 9 aa, Homo Sapiens
SRATVAPRS

SEQ ID NO: 112461 - protein, 9 aa, Homo Sapiens
WRERPESCD

SEQ ID NO: 112462 - protein, 9 aa, Homo Sapiens
WTTGDQVRW

SEQ ID NO: 112463 - protein, 9 aa, Homo Sapiens
PASRWTSGR

SEQ ID NO: 112464 - protein, 9 aa, Homo Sapiens
RWECDPFHV

SEQ ID NO: 112465 - protein, 9 aa, Homo Sapiens
HCTRSRRTT

SEQ ID NO: 112466 - protein, 9 aa, Homo Sapiens
SPSYSPISP

SEQ ID NO: 112467 - protein, 9 aa, Homo Sapiens
VFILKKNPL

SEQ ID NO: 112468 - protein, 9 aa, Homo Sapiens
KEKDTEGKK

SEQ ID NO: 112469 - protein, 9 aa, Homo Sapiens
RFAQDQDNG

SEQ ID NO: 112470 - protein, 9 aa, Homo Sapiens
FVTHNVFKR

SEQ ID NO: 112471 - protein, 9 aa, Homo Sapiens
PNLKGFSGA

SEQ ID NO: 112472 - protein, 9 aa, Homo Sapiens
PRHCTRSRR

SEQ ID NO: 112473 - protein, 9 aa, Homo Sapiens
GNPSTSLNH

SEQ ID NO: 112474 - protein, 9 aa, Homo Sapiens
RAANRKGPR

SEQ ID NO: 112475 - protein, 9 aa, Homo Sapiens
TPSPASRWT

SEQ ID NO: 112476 - protein, 9 aa, Homo Sapiens
PSPASRWTS

SEQ ID NO: 112477 - protein, 9 aa, Homo Sapiens
LAYCSLSFP

SEQ ID NO: 112478 - protein, 9 aa, Homo Sapiens
RKGPRGPGG

SEQ ID NO: 112479 - protein, 9 aa, Homo Sapiens
KKKLEKKNK

SEQ ID NO: 112480 - protein, 9 aa, Homo Sapiens
PTAWTPSPA

SEQ ID NO: 112481 - protein, 9 aa, Homo Sapiens
SHFLFSIRV

SEQ ID NO: 112482 - protein, 9 aa, Homo Sapiens
LKQSLVASH

SEQ ID NO: 112483 - protein, 9 aa, Homo Sapiens
RLQIHGRTH

SEQ ID NO: 112484 - protein, 9 aa, Homo Sapiens
GARHHTREI

SEQ ID NO: 112485 - protein, 9 aa, Homo Sapiens
KGPRGPGGQ

SEQ ID NO: 112486 - protein, 9 aa, Homo Sapiens
SQEEWACLD

SEQ ID NO: 112487 - protein, 9 aa, Homo Sapiens
SDSTTIFRL

SEQ ID NO: 112488 - protein, 9 aa, Homo Sapiens
MPPAAPGTR

SEQ ID NO: 112489 - protein, 9 aa, Homo Sapiens
AYCSLSFPG

SEQ ID NO: 112490 - protein, 9 aa, Homo Sapiens
TPKEKDTEG

SEQ ID NO: 112491 - protein, 9 aa, Homo Sapiens
AFECDEHKD

SEQ ID NO: 112492 - protein, 9 aa, Homo Sapiens
TGDQVRWEC

SEQ ID NO: 112493 - protein, 9 aa, Homo Sapiens
GSSHLPTLA

SEQ ID NO: 112494 - protein, 9 aa, Homo Sapiens
FSIRVFILK

SEQ ID NO: 112495 - protein, 9 aa, Homo Sapiens
LVGLVCISL

SEQ ID NO: 112496 - protein, 9 aa, Homo Sapiens
SVISLLLLV

SEQ ID NO: 112497 - protein, 9 aa, Homo Sapiens
GPARAPRLS

SEQ ID NO: 112498 - protein, 9 aa, Homo Sapiens
SRPRLPTAW

SEQ ID NO: 112499 - protein, 9 aa, Homo Sapiens
VAFECDEHK

SEQ ID NO: 112500 - protein, 9 aa, Homo Sapiens
NGMYVCIAS

SEQ ID NO: 112501 - protein, 9 aa, Homo Sapiens
EGKKSGDSG

SEQ ID NO: 112502 - protein, 9 aa, Homo Sapiens
FILKKNPLN

SEQ ID NO: 112503 - protein, 9 aa, Homo Sapiens
HFLFSIRVF

SEQ ID NO: 112504 - protein, 9 aa, Homo Sapiens
DTNLCAIHG

SEQ ID NO: 112505 - protein, 9 aa, Homo Sapiens
KSPTWAWPR

SEQ ID NO: 112506 - protein, 9 aa, Homo Sapiens
PARAPRLSS

SEQ ID NO: 112507 - protein, 9 aa, Homo Sapiens
RATVAPRSL

SEQ ID NO: 112508 - protein, 9 aa, Homo Sapiens
LMPPAAPGT

SEQ ID NO: 112509 - protein, 9 aa, Homo Sapiens
SAGLSMGAL

SEQ ID NO: 112510 - protein, 9 aa, Homo Sapiens
ITDREPAFE

SEQ ID NO: 112511 - protein, 9 aa, Homo Sapiens
RHHTREIFV

SEQ ID NO: 112512 - protein, 9 aa, Homo Sapiens
ASRWTSGRL

SEQ ID NO: 112513 - protein, 9 aa, Homo Sapiens
PGSSHLPTL

SEQ ID NO: 112514 - protein, 9 aa, Homo Sapiens
AGVQEEFMD

SEQ ID NO: 112515 - protein, 9 aa, Homo Sapiens
FFPFFFILV

SEQ ID NO: 112516 - protein, 9 aa, Homo Sapiens
LSFPGSSHL

SEQ ID NO: 112517 - protein, 9 aa, Homo Sapiens
SPRVCTPSK

SEQ ID NO: 112518 - protein, 9 aa, Homo Sapiens
VYDADEQCH

SEQ ID NO: 112519 - protein, 9 aa, Homo Sapiens
WWRERPESC

SEQ ID NO: 112520 - protein, 9 aa, Homo Sapiens
RVCTPSKGT

SEQ ID NO: 112521 - protein, 9 aa, Homo Sapiens
PFFFILVPR

SEQ ID NO: 112522 - protein, 9 aa, Homo Sapiens
KLSFHEEHR

SEQ ID NO: 112523 - protein, 9 aa, Homo Sapiens
TTGDQVRWE

SEQ ID NO: 112524 - protein, 9 aa, Homo Sapiens
SMGALVAIL

SEQ ID NO: 112525 - protein, 9 aa, Homo Sapiens
TAWTPSPAS

SEQ ID NO: 112526 - protein, 9 aa, Homo Sapiens
GLSMGALVA

SEQ ID NO: 112527 - protein, 9 aa, Homo Sapiens
KQSLVASHF

SEQ ID NO: 112528 - protein, 9 aa, Homo Sapiens
TNLCAIHGK

SEQ ID NO: 112529 - protein, 9 aa, Homo Sapiens
PAFEQQAPC

SEQ ID NO: 112530 - protein, 9 aa, Homo Sapiens
GDSGRAERA

SEQ ID NO: 112531 - protein, 9 aa, Homo Sapiens
VTHNVFKRT

SEQ ID NO: 112532 - protein, 9 aa, Homo Sapiens
NVRNAGNPS

SEQ ID NO: 112533 - protein, 9 aa, Homo Sapiens
ASRVAGTAG

SEQ ID NO: 112534 - protein, 9 aa, Homo Sapiens
LPPASNTLN

SEQ ID NO: 112535 - protein, 9 aa, Homo Sapiens
VKRRSAEHE

SEQ ID NO: 112536 - protein, 9 aa, Homo Sapiens
SLALCLDLG

SEQ ID NO: 112537 - protein, 9 aa, Homo Sapiens
LPTAWTPSP

SEQ ID NO: 112538 - protein, 9 aa, Homo Sapiens
NLKGFSGAG

SEQ ID NO: 112539 - protein, 9 aa, Homo Sapiens
KTPKEKDTE

SEQ ID NO: 112540 - protein, 9 aa, Homo Sapiens
LVASHFLFS

SEQ ID NO: 112541 - protein, 9 aa, Homo Sapiens
TSPRVCTPS

SEQ ID NO: 112542 - protein, 9 aa, Homo Sapiens
CTRSRRTTP

SEQ ID NO: 112543 - protein, 9 aa, Homo Sapiens
TSTSCLRTS

SEQ ID NO: 112544 - protein, 9 aa, Homo Sapiens
IHGKRVTIM

SEQ ID NO: 112545 - protein, 9 aa, Homo Sapiens
WPRHCTRSR

SEQ ID NO: 112546 - protein, 9 aa, Homo Sapiens
STSCLGDAQ

SEQ ID NO: 112547 - protein, 9 aa, Homo Sapiens
LKGFSGAGE

SEQ ID NO: 112548 - protein, 9 aa, Homo Sapiens
IKPGNLLLS

SEQ ID NO: 112549 - protein, 9 aa, Homo Sapiens
SPASRWTSG

SEQ ID NO: 112550 - protein, 9 aa, Homo Sapiens
CMAPPSTSC

SEQ ID NO: 112551 - protein, 9 aa, Homo Sapiens
KNKTPKEKD

SEQ ID NO: 112552 - protein, 9 aa, Homo Sapiens
ATPSRATVA

SEQ ID NO: 112553 - protein, 9 aa, Homo Sapiens
GTSKWWRER

SEQ ID NO: 112554 - protein, 9 aa, Homo Sapiens
SSHLPTLAS

SEQ ID NO: 112555 - protein, 9 aa, Homo Sapiens
TQEISDSTT

SEQ ID NO: 112556 - protein, 9 aa, Homo Sapiens
ECNKCLKQS

SEQ ID NO: 112557 - protein, 9 aa, Homo Sapiens
SFPGSSHLP

SEQ ID NO: 112558 - protein, 9 aa, Homo Sapiens
SGTILAYCS

SEQ ID NO: 112559 - protein, 9 aa, Homo Sapiens
RNAGNPSTS

SEQ ID NO: 112560 - protein, 9 aa, Homo Sapiens
KKLEKKNKT

SEQ ID NO: 112561 - protein, 9 aa, Homo Sapiens
RAWGYPCEM

SEQ ID NO: 112562 - protein, 9 aa, Homo Sapiens
PGNLLLSKS

SEQ ID NO: 112563 - protein, 9 aa, Homo Sapiens
LLLMPPAAP

SEQ ID NO: 112564 - protein, 9 aa, Homo Sapiens
RAPRLSSRP

SEQ ID NO: 112565 - protein, 9 aa, Homo Sapiens
TPSRATVAP

SEQ ID NO: 112566 - protein, 9 aa, Homo Sapiens
AINVALTQA

SEQ ID NO: 112567 - protein, 9 aa, Homo Sapiens
ARHHTREIF

SEQ ID NO: 112568 - protein, 9 aa, Homo Sapiens
LSKSPTWAW

SEQ ID NO: 112569 - protein, 9 aa, Homo Sapiens
YDADEQCHF

SEQ ID NO: 112570 - protein, 9 aa, Homo Sapiens
ERAANRKGP

SEQ ID NO: 112571 - protein, 9 aa, Homo Sapiens
ISPNYSPTS

SEQ ID NO: 112572 - protein, 9 aa, Homo Sapiens
GSPSTTSPR

SEQ ID NO: 112573 - protein, 9 aa, Homo Sapiens
RPRLPTAWT

SEQ ID NO: 112574 - protein, 9 aa, Homo Sapiens
SGRLGSPST

SEQ ID NO: 112575 - protein, 9 aa, Homo Sapiens
LNVRNAGNP

SEQ ID NO: 112576 - protein, 9 aa, Homo Sapiens
MGALVAILL

SEQ ID NO: 112577 - protein, 9 aa, Homo Sapiens
PPSTSCLGD

SEQ ID NO: 112578 - protein, 9 aa, Homo Sapiens
MKLSFHEEH

SEQ ID NO: 112579 - protein, 9 aa, Homo Sapiens
GNNKAAGVQ

SEQ ID NO: 112580 - protein, 9 aa, Homo Sapiens
WGYPCEMCP

SEQ ID NO: 112581 - protein, 9 aa, Homo Sapiens
WTPSPASRW

SEQ ID NO: 112582 - protein, 9 aa, Homo Sapiens
HKDEREAPP

SEQ ID NO: 112583 - protein, 9 aa, Homo Sapiens
LLSKSPTWA

SEQ ID NO: 112584 - protein, 9 aa, Homo Sapiens
YPCEMCPAQ

SEQ ID NO: 112585 - protein, 9 aa, Homo Sapiens
KKNKTPKEK

SEQ ID NO: 112586 - protein, 9 aa, Homo Sapiens
KLEKKNKTP

SEQ ID NO: 112587 - protein, 9 aa, Homo Sapiens
WTSGRLGSP

SEQ ID NO: 112588 - protein, 9 aa, Homo Sapiens
DPNLKGFSG

SEQ ID NO: 112589 - protein, 9 aa, Homo Sapiens
ASRLQIHGR

SEQ ID NO: 112590 - protein, 9 aa, Homo Sapiens
GERAANRKG

SEQ ID NO: 112591 - protein, 9 aa, Homo Sapiens
GRAWGYPCE

SEQ ID NO: 112592 - protein, 9 aa, Homo Sapiens
VLPPASNTL

SEQ ID NO: 112593 - protein, 9 aa, Homo Sapiens
NNKAAGVQE

SEQ ID NO: 112594 - protein, 9 aa, Homo Sapiens
VTSVISLLL

SEQ ID NO: 112595 - protein, 9 aa, Homo Sapiens
WECDPFHVQ

SEQ ID NO: 112596 - protein, 9 aa, Homo Sapiens
NRQAINVAL

SEQ ID NO: 112597 - protein, 9 aa, Homo Sapiens
HHTREIFVL

SEQ ID NO: 112598 - protein, 9 aa, Homo Sapiens
KLAVCFHGS

SEQ ID NO: 112599 - protein, 9 aa, Homo Sapiens
SRLQIHGRT

SEQ ID NO: 112600 - protein, 9 aa, Homo Sapiens
TSGRLGSPS

SEQ ID NO: 112601 - protein, 9 aa, Homo Sapiens
CTPSKGTTS

SEQ ID NO: 112602 - protein, 9 aa, Homo Sapiens
TWAWPRHCT

SEQ ID NO: 112603 - protein, 9 aa, Homo Sapiens
RRSAEHEMA

SEQ ID NO: 112604 - protein, 9 aa, Homo Sapiens
PATFINHDC

SEQ ID NO: 112605 - protein, 9 aa, Homo Sapiens
CSGTILAYC

SEQ ID NO: 112606 - protein, 9 aa, Homo Sapiens
KPGNLLLSK

SEQ ID NO: 112607 - protein, 9 aa, Homo Sapiens
TTPAGPARA

SEQ ID NO: 112608 - protein, 9 aa, Homo Sapiens
GLVCISLAL

SEQ ID NO: 112609 - protein, 9 aa, Homo Sapiens
LKKNPLNVR

SEQ ID NO: 112610 - protein, 9 aa, Homo Sapiens
QEEWACLDS

SEQ ID NO: 112611 - protein, 9 aa, Homo Sapiens
ILVPRLECS

SEQ ID NO: 112612 - protein, 9 aa, Homo Sapiens
NPLNVRNAG

SEQ ID NO: 112613 - protein, 9 aa, Homo Sapiens
KWWRERPES

SEQ ID NO: 112614 - protein, 9 aa, Homo Sapiens
RLSSRPRLP

SEQ ID NO: 112615 - protein, 9 aa, Homo Sapiens
QLWLGPATF

SEQ ID NO: 112616 - protein, 9 aa, Homo Sapiens
ADEQCHFQY

SEQ ID NO: 112617 - protein, 9 aa, Homo Sapiens
KRRSAEHEM

SEQ ID NO: 112618 - protein, 9 aa, Homo Sapiens
ISLLLLVFI

SEQ ID NO: 112619 - protein, 9 aa, Homo Sapiens
PRVCTPSKG

SEQ ID NO: 112620 - protein, 9 aa, Homo Sapiens
TEGKKSGDS

SEQ ID NO: 112621 - protein, 9 aa, Homo Sapiens
YSPISPNYS

SEQ ID NO: 112622 - protein, 9 aa, Homo Sapiens
DEHKDEREA

SEQ ID NO: 112623 - protein, 9 aa, Homo Sapiens
LGPATFINH

SEQ ID NO: 112624 - protein, 9 aa, Homo Sapiens
KGTTSTSCL

SEQ ID NO: 112625 - protein, 9 aa, Homo Sapiens
QDNGMYVCI

SEQ ID NO: 112626 - protein, 9 aa, Homo Sapiens
PGTSKWWRE

SEQ ID NO: 112627 - protein, 9 aa, Homo Sapiens
RRTTPAGPA

SEQ ID NO: 112628 - protein, 9 aa, Homo Sapiens
SPTWAWPRH

SEQ ID NO: 112629 - protein, 9 aa, Homo Sapiens
PPASNTLNA

SEQ ID NO: 112630 - protein, 9 aa, Homo Sapiens
HLPTLASRV

SEQ ID NO: 112631 - protein, 9 aa, Homo Sapiens
EPGTSKWWR

SEQ ID NO: 112632 - protein, 9 aa, Homo Sapiens
DQDNGMYVC

SEQ ID NO: 112633 - protein, 9 aa, Homo Sapiens
PTWAWPRHC

SEQ ID NO: 112634 - protein, 9 aa, Homo Sapiens
CAIHGKRVT

SEQ ID NO: 112635 - protein, 9 aa, Homo Sapiens
LPLLLMPPA

SEQ ID NO: 112636 - protein, 9 aa, Homo Sapiens
QAINVALTQ

SEQ ID NO: 112637 - protein, 9 aa, Homo Sapiens
QSLVASHFL

SEQ ID NO: 112638 - protein, 9 aa, Homo Sapiens
TVAPRSLTC

SEQ ID NO: 112639 - protein, 9 aa, Homo Sapiens
GNAMRFVTH

SEQ ID NO: 112640 - protein, 9 aa, Homo Sapiens
KLVGLVCIS

SEQ ID NO: 112641 - protein, 9 aa, Homo Sapiens
AVKRRSAEH

SEQ ID NO: 112642 - protein, 9 aa, Homo Sapiens
NVALTQATR

SEQ ID NO: 112643 - protein, 9 aa, Homo Sapiens
AFEQQAPCS

SEQ ID NO: 112644 - protein, 9 aa, Homo Sapiens
TLASRVAGT

SEQ ID NO: 112645 - protein, 9 aa, Homo Sapiens
IRVFILKKN

SEQ ID NO: 112646 - protein, 9 aa, Homo Sapiens
FPFFFILVP

SEQ ID NO: 112647 - protein, 9 aa, Homo Sapiens
VPRLECSGT

SEQ ID NO: 112648 - protein, 9 aa, Homo Sapiens
GRGATPSRA

SEQ ID NO: 112649 - protein, 9 aa, Homo Sapiens
FFDKFANIM

SEQ ID NO: 112650 - protein, 9 aa, Homo Sapiens
LLMPPAAPG

SEQ ID NO: 112651 - protein, 9 aa, Homo Sapiens
AGTAGARHH

SEQ ID NO: 112652 - protein, 9 aa, Homo Sapiens
YCSLSFPGS

SEQ ID NO: 112653 - protein, 9 aa, Homo Sapiens
ANRQAINVA

SEQ ID NO: 112654 - protein, 9 aa, Homo Sapiens
NRKGPRGPG

SEQ ID NO: 112655 - protein, 9 aa, Homo Sapiens
TAGARHHTR

SEQ ID NO: 112656 - protein, 9 aa, Homo Sapiens
ANIMPFDSW

SEQ ID NO: 112657 - protein, 9 aa, Homo Sapiens
RQAINVALT

SEQ ID NO: 112658 - protein, 9 aa, Homo Sapiens
SNTLNALCG

SEQ ID NO: 112659 - protein, 9 aa, Homo Sapiens
ECSGTILAY

SEQ ID NO: 112660 - protein, 9 aa, Homo Sapiens
STSCLRTSG

SEQ ID NO: 112661 - protein, 9 aa, Homo Sapiens
AWTPSPASR

SEQ ID NO: 112662 - protein, 9 aa, Homo Sapiens
ASHFLFSIR

SEQ ID NO: 112663 - protein, 9 aa, Homo Sapiens
AANRKGPRG

SEQ ID NO: 112664 - protein, 9 aa, Homo Sapiens
INVALTQAT

SEQ ID NO: 112665 - protein, 9 aa, Homo Sapiens
PSRATVAPR

SEQ ID NO: 112666 - protein, 9 aa, Homo Sapiens
DTEGKKSGD

SEQ ID NO: 112667 - protein, 9 aa, Homo Sapiens
VISLLLLVF

SEQ ID NO: 112668 - protein, 9 aa, Homo Sapiens
LSMGALVAI

SEQ ID NO: 112669 - protein, 9 aa, Homo Sapiens
FGKKDPNLK

SEQ ID NO: 112670 - protein, 9 aa, Homo Sapiens
RVAGTAGAR

SEQ ID NO: 112671 - protein, 9 aa, Homo Sapiens
DEQCHFQYG

SEQ ID NO: 112672 - protein, 9 aa, Homo Sapiens
VRNAGNPST

SEQ ID NO: 112673 - protein, 9 aa, Homo Sapiens
RTSGRGATP

SEQ ID NO: 112674 - protein, 9 aa, Homo Sapiens
KDTEGKKSG

SEQ ID NO: 112675 - protein, 9 aa, Homo Sapiens
SLSFPGSSH

SEQ ID NO: 112676 - protein, 9 aa, Homo Sapiens
KKSGDSGRA

SEQ ID NO: 112677 - protein, 9 aa, Homo Sapiens
AMRFVTHNV

SEQ ID NO: 112678 - protein, 9 aa, Homo Sapiens
TVGRAWGYP

SEQ ID NO: 112679 - protein, 9 aa, Homo Sapiens
FFFILVPRL

SEQ ID NO: 112680 - protein, 9 aa, Homo Sapiens
CLRTSGRGA

SEQ ID NO: 112681 - protein, 9 aa, Homo Sapiens
EQQAPCSVA

SEQ ID NO: 112682 - protein, 9 aa, Homo Sapiens
LVLPPASNT

SEQ ID NO: 112683 - protein, 9 aa, Homo Sapiens
RSRRTTPAG

SEQ ID NO: 112684 - protein, 9 aa, Homo Sapiens
LSFHEEHRH

SEQ ID NO: 112685 - protein, 9 aa, Homo Sapiens
QFGKKDPNL

SEQ ID NO: 112686 - protein, 9 aa, Homo Sapiens
CSLSFPGSS

SEQ ID NO: 112687 - protein, 9 aa, Homo Sapiens
ALVLPPASN

SEQ ID NO: 112688 - protein, 9 aa, Homo Sapiens
PSTSCLGDA

SEQ ID NO: 112689 - protein, 9 aa, Homo Sapiens
GANRQAINV

SEQ ID NO: 112690 - protein, 9 aa, Homo Sapiens
AKKKLEKKN

SEQ ID NO: 112691 - protein, 9 aa, Homo Sapiens
NLLLSKSPT

SEQ ID NO: 112692 - protein, 9 aa, Homo Sapiens
DQVRWECDP

SEQ ID NO: 112693 - protein, 9 aa, Homo Sapiens
IRFAQDQDN

SEQ ID NO: 112694 - protein, 9 aa, Homo Sapiens
RTTPAGPAR

SEQ ID NO: 112695 - protein, 9 aa, Homo Sapiens
HFQYGATSR

SEQ ID NO: 112696 - protein, 9 aa, Homo Sapiens
WLGPATFIN

SEQ ID NO: 112697 - protein, 9 aa, Homo Sapiens
RLPTAWTPS

SEQ ID NO: 112698 - protein, 9 aa, Homo Sapiens
LMKLSFHEE

SEQ ID NO: 112699 - protein, 9 aa, Homo Sapiens
PRLSSRPRL

SEQ ID NO: 112700 - protein, 9 aa, Homo Sapiens
APRLSSRPR

SEQ ID NO: 112701 - protein, 9 aa, Homo Sapiens
GTAGARHHT

SEQ ID NO: 112702 - protein, 9 aa, Homo Sapiens
LLLPLLLMP

SEQ ID NO: 112703 - protein, 9 aa, Homo Sapiens
NKTPKEKDT

SEQ ID NO: 112704 - protein, 9 aa, Homo Sapiens
TFINHDCKP

SEQ ID NO: 112705 - protein, 9 aa, Homo Sapiens
LEKKNKTPK

SEQ ID NO: 112706 - protein, 9 aa, Homo Sapiens
ENGNNKAAG

SEQ ID NO: 112707 - protein, 9 aa, Homo Sapiens
RHCTRSRRT

SEQ ID NO: 112708 - protein, 9 aa, Homo Sapiens
PLLLMPPAA

SEQ ID NO: 112709 - protein, 9 aa, Homo Sapiens
PASNTLNAL

SEQ ID NO: 112710 - protein, 9 aa, Homo Sapiens
LPTLASRVA

SEQ ID NO: 112711 - protein, 9 aa, Homo Sapiens
GRLGSPSTT

SEQ ID NO: 112712 - protein, 9 aa, Homo Sapiens
TTSTSCLRT

SEQ ID NO: 112713 - protein, 9 aa, Homo Sapiens
KDPNLKGFS

SEQ ID NO: 112714 - protein, 9 aa, Homo Sapiens
TSGRGATPS

SEQ ID NO: 112715 - protein, 9 aa, Homo Sapiens
KSGDSGRAE

SEQ ID NO: 112716 - protein, 9 aa, Homo Sapiens
EQCHFQYGA

SEQ ID NO: 112717 - protein, 9 aa, Homo Sapiens
FANIMPFDS

SEQ ID NO: 112718 - protein, 9 aa, Homo Sapiens
PPLLLLLLQ

SEQ ID NO: 112719 - protein, 9 aa, Homo Sapiens
LCAIHGKRV

SEQ ID NO: 112720 - protein, 9 aa, Homo Sapiens
KCLKQSLVA

SEQ ID NO: 112721 - protein, 9 aa, Homo Sapiens
TSCLRTSGR

SEQ ID NO: 112722 - protein, 9 aa, Homo Sapiens
KKDPNLKGF

SEQ ID NO: 112723 - protein, 9 aa, Homo Sapiens
MEPGTSKWW

SEQ ID NO: 112724 - protein, 9 aa, Homo Sapiens
EHKDEREAP

SEQ ID NO: 112725 - protein, 9 aa, Homo Sapiens
ARAPRLSSR

SEQ ID NO: 112726 - protein, 9 aa, Homo Sapiens
QVAFECDEH

SEQ ID NO: 112727 - protein, 9 aa, Homo Sapiens
VGRAWGYPC

SEQ ID NO: 112728 - protein, 9 aa, Homo Sapiens
RSAEHEMAK

SEQ ID NO: 112729 - protein, 9 aa, Homo Sapiens
GNLLLSKSP

SEQ ID NO: 112730 - protein, 9 aa, Homo Sapiens
SGDSGRAER

SEQ ID NO: 112731 - protein, 9 aa, Homo Sapiens
AEHEMAKSE

SEQ ID NO: 112732 - protein, 9 aa, Homo Sapiens
DGERAANRK

SEQ ID NO: 112733 - protein, 9 aa, Homo Sapiens
MRFVTHNVF

SEQ ID NO: 112734 - protein, 9 aa, Homo Sapiens
DSTTIFRLL

SEQ ID NO: 112735 - protein, 9 aa, Homo Sapiens
KKLAVCFHG

SEQ ID NO: 112736 - protein, 9 aa, Homo Sapiens
EKDTEGKKS

SEQ ID NO: 112737 - protein, 9 aa, Homo Sapiens
ECDEHKDER

SEQ ID NO: 112738 - protein, 9 aa, Homo Sapiens
GTILAYCSL

SEQ ID NO: 112739 - protein, 9 aa, Homo Sapiens
LLPLLLMPP

SEQ ID NO: 112740 - protein, 9 aa, Homo Sapiens
ILAYCSLSF

SEQ ID NO: 112741 - protein, 9 aa, Homo Sapiens
PTSPSYSPI

SEQ ID NO: 112742 - protein, 9 aa, Homo Sapiens
MAPPSTSCL

SEQ ID NO: 112743 - protein, 9 aa, Homo Sapiens
PLLLLLLQP

SEQ ID NO: 112744 - protein, 9 aa, Homo Sapiens
TREIFVLFL

SEQ ID NO: 112745 - protein, 9 aa, Homo Sapiens
TTSPRVCTP

SEQ ID NO: 112746 - protein, 9 aa, Homo Sapiens
CISLALCLD

SEQ ID NO: 112747 - protein, 9 aa, Homo Sapiens
ISLALCLDL

SEQ ID NO: 112748 - protein, 9 aa, Homo Sapiens
LSSRPRLPT

SEQ ID NO: 112749 - protein, 9 aa, Homo Sapiens
TIFRLLGSD

SEQ ID NO: 112750 - protein, 9 aa, Homo Sapiens
SAEHEMAKS

SEQ ID NO: 112751 - protein, 9 aa, Homo Sapiens
PAGPARAPR

SEQ ID NO: 112752 - protein, 9 aa, Homo Sapiens
SCLRTSGRG

SEQ ID NO: 112753 - protein, 9 aa, Homo Sapiens
QDQDNGMYV

SEQ ID NO: 112754 - protein, 9 aa, Homo Sapiens
LLLSKSPTW

SEQ ID NO: 112755 - protein, 9 aa, Homo Sapiens
QVRWECDPF

SEQ ID NO: 112756 - protein, 9 aa, Homo Sapiens
TSKWWRERP

SEQ ID NO: 112757 - protein, 9 aa, Homo Sapiens
DNGMYVCIA

SEQ ID NO: 112758 - protein, 9 aa, Homo Sapiens
ILSAGLSMG

SEQ ID NO: 112759 - protein, 9 aa, Homo Sapiens
DADEQCHFQ

SEQ ID NO: 112760 - protein, 9 aa, Homo Sapiens
GTTSTSCLR

SEQ ID NO: 112761 - protein, 9 aa, Homo Sapiens
YECNKCLKQ

SEQ ID NO: 112762 - protein, 9 aa, Homo Sapiens
SFHEEHRHA

SEQ ID NO: 112763 - protein, 9 aa, Homo Sapiens
STTSPRVCT

SEQ ID NO: 112764 - protein, 9 aa, Homo Sapiens
VALTQATRT

SEQ ID NO: 112765 - protein, 9 aa, Homo Sapiens
ILKKNPLNV

SEQ ID NO: 112766 - protein, 9 aa, Homo Sapiens
YFFPFFFIL

SEQ ID NO: 112767 - protein, 9 aa, Homo Sapiens
GPATFINHD

SEQ ID NO: 112768 - protein, 9 aa, Homo Sapiens
IYFFPFFFI

SEQ ID NO: 112769 - protein, 9 aa, Homo Sapiens
PLNVRNAGN

SEQ ID NO: 112770 - protein, 9 aa, Homo Sapiens
HGKRVTIMP

SEQ ID NO: 112771 - protein, 9 aa, Homo Sapiens
PISPNYSPT

SEQ ID NO: 112772 - protein, 9 aa, Homo Sapiens
AGPARAPRL

SEQ ID NO: 112773 - protein, 9 aa, Homo Sapiens
CDEHKDERE

SEQ ID NO: 112774 - protein, 9 aa, Homo Sapiens
SSRPRLPTA

SEQ ID NO: 112775 - protein, 9 aa, Homo Sapiens
EKCMAPPST

SEQ ID NO: 112776 - protein, 9 aa, Homo Sapiens
FHEEHRHAM

SEQ ID NO: 112777 - protein, 9 aa, Homo Sapiens
KAAGVQEEF

SEQ ID NO: 112778 - protein, 9 aa, Homo Sapiens
FEQQAPCSV

SEQ ID NO: 112779 - protein, 9 aa, Homo Sapiens
AGARHHTRE

SEQ ID NO: 112780 - protein, 9 aa, Homo Sapiens
PKEKDTEGK

SEQ ID NO: 112781 - protein, 9 aa, Homo Sapiens
NAGNPSTSL

SEQ ID NO: 112782 - protein, 9 aa, Homo Sapiens
DKFANIMPF

SEQ ID NO: 112783 - protein, 9 aa, Homo Sapiens
GATPSRATV

SEQ ID NO: 112784 - protein, 9 aa, Homo Sapiens
GKKDPNLKG

SEQ ID NO: 112785 - protein, 9 aa, Homo Sapiens
MVTSVISLL

SEQ ID NO: 112786 - protein, 9 aa, Homo Sapiens
RFVTHNVFK

SEQ ID NO: 112787 - protein, 9 aa, Homo Sapiens
TSVISLLLL

SEQ ID NO: 112788 - protein, 9 aa, Homo Sapiens
CNKCLKQSL

SEQ ID NO: 112789 - protein, 9 aa, Homo Sapiens
SKGTTSTSC

SEQ ID NO: 112790 - protein, 9 aa, Homo Sapiens
AQLWLGPAT

SEQ ID NO: 112791 - protein, 9 aa, Homo Sapiens
ANRKGPRGP

SEQ ID NO: 112792 - protein, 9 aa, Homo Sapiens
AIHGKRVTI

SEQ ID NO: 112793 - protein, 9 aa, Homo Sapiens
LGSPSTTSP

SEQ ID NO: 112794 - protein, 9 aa, Homo Sapiens
ATVAPRSLT

SEQ ID NO: 112795 - protein, 9 aa, Homo Sapiens
AGNPSTSLN

SEQ ID NO: 112796 - protein, 9 aa, Homo Sapiens
AQDQDNGMY

SEQ ID NO: 112797 - protein, 9 aa, Homo Sapiens
TSKKLAVCF

SEQ ID NO: 112798 - protein, 9 aa, Homo Sapiens
CVLMKLSFH

SEQ ID NO: 112799 - protein, 9 aa, Homo Sapiens
GKRVTIMPK

SEQ ID NO: 112800 - protein, 9 aa, Homo Sapiens
PRLPTAWTP

SEQ ID NO: 112801 - protein, 9 aa, Homo Sapiens
RLGSPSTTS

SEQ ID NO: 112802 - protein, 9 aa, Homo Sapiens
TPSKGTTST

SEQ ID NO: 112803 - protein, 9 aa, Homo Sapiens
CHFQYGATS

SEQ ID NO: 112804 - protein, 9 aa, Homo Sapiens
QCHFQYGAT

SEQ ID NO: 112805 - protein, 9 aa, Homo Sapiens
VASHFLFSI

SEQ ID NO: 112806 - protein, 9 aa, Homo Sapiens
FAQDQDNGM

SEQ ID NO: 112807 - protein, 9 aa, Homo Sapiens
FECDEHKDE

SEQ ID NO: 112808 - protein, 9 aa, Homo Sapiens
PSTTSPRVC

SEQ ID NO: 112809 - protein, 9 aa, Homo Sapiens
GVQEEFMDA

SEQ ID NO: 112810 - protein, 9 aa, Homo Sapiens
IMPFDSWDQ

SEQ ID NO: 112811 - protein, 9 aa, Homo Sapiens
GCASRLQIH

SEQ ID NO: 112812 - protein, 9 aa, Homo Sapiens
SRPTSKKLA

SEQ ID NO: 112813 - protein, 9 aa, Homo Sapiens
GKKSGDSGR

SEQ ID NO: 112814 - protein, 9 aa, Homo Sapiens
QEISDSTTI

SEQ ID NO: 112815 - protein, 9 aa, Homo Sapiens
APPSTSCLG

SEQ ID NO: 112816 - protein, 9 aa, Homo Sapiens
WIAVKRRSA

SEQ ID NO: 112817 - protein, 9 aa, Homo Sapiens
KKNPLNVRN

SEQ ID NO: 112818 - protein, 9 aa, Homo Sapiens
VRWECDPFH

SEQ ID NO: 112819 - protein, 9 aa, Homo Sapiens
EPAFEQQAP

SEQ ID NO: 112820 - protein, 9 aa, Homo Sapiens
VGLVCISLA

SEQ ID NO: 112821 - protein, 9 aa, Homo Sapiens
LWLGPATFI

SEQ ID NO: 112822 - protein, 9 aa, Homo Sapiens
VCTPSKGTT

SEQ ID NO: 112823 - protein, 9 aa, Homo Sapiens
GDQVRWECD

SEQ ID NO: 112824 - protein, 9 aa, Homo Sapiens
VCISLALCL

SEQ ID NO: 112825 - protein, 9 aa, Homo Sapiens
TRSRRTTPA

SEQ ID NO: 112826 - protein, 9 aa, Homo Sapiens
GYPCEMCPA

SEQ ID NO: 112827 - protein, 9 aa, Homo Sapiens
SRWTSGRLG

SEQ ID NO: 112828 - protein, 9 aa, Homo Sapiens
EKKNKTPKE

SEQ ID NO: 112829 - protein, 9 aa, Homo Sapiens
AGLSMGALV

SEQ ID NO: 112830 - protein, 9 aa, Homo Sapiens
FFILVPRLE

SEQ ID NO: 112831 - protein, 9 aa, Homo Sapiens
PSYSPISPN

SEQ ID NO: 112832 - protein, 9 aa, Homo Sapiens
AWPRHCTRS

SEQ ID NO: 112833 - protein, 9 aa, Homo Sapiens
NGNNKAAGV

SEQ ID NO: 112834 - protein, 9 aa, Homo Sapiens
EISDSTTIF

SEQ ID NO: 112835 - protein, 9 aa, Homo Sapiens
SRRTTPAGP

SEQ ID NO: 112836 - protein, 9 aa, Homo Sapiens
NIMPFDSWD

SEQ ID NO: 112837 - protein, 9 aa, Homo Sapiens
TSCLGDAQL

SEQ ID NO: 112838 - protein, 9 aa, Homo Sapiens
THNVFKRTY

SEQ ID NO: 112839 - protein, 9 aa, Homo Sapiens
WAWPRHCTR

SEQ ID NO: 112840 - protein, 9 aa, Homo Sapiens
SKSPTWAWP

SEQ ID NO: 112841 - protein, 9 aa, Homo Sapiens
LASRVAGTA

SEQ ID NO: 112842 - protein, 9 aa, Homo Sapiens
NAMRFVTHN

SEQ ID NO: 112843 - protein, 9 aa, Homo Sapiens
RWTSGRLGS

SEQ ID NO: 112844 - protein, 9 aa, Homo Sapiens
RPTSKKLAV

SEQ ID NO: 112845 - protein, 9 aa, Homo Sapiens
REPAFEQQA

SEQ ID NO: 112846 - protein, 9 aa, Homo Sapiens
SLLLLVFII

SEQ ID NO: 112847 - protein, 9 aa, Homo Sapiens
LVPRLECSG

SEQ ID NO: 112848 - protein, 9 aa, Homo Sapiens
HNVFKRTYA

SEQ ID NO: 112849 - protein, 9 aa, Homo Sapiens
PTSKKLAVC

SEQ ID NO: 112850 - protein, 9 aa, Homo Sapiens
VLMKLSFHE

SEQ ID NO: 112851 - protein, 9 aa, Homo Sapiens
HTREIFVLF

SEQ ID NO: 112852 - protein, 9 aa, Homo Sapiens
VAGTAGARH

SEQ ID NO: 112853 - protein, 9 aa, Homo Sapiens
AWGYPCEMC

SEQ ID NO: 112854 - protein, 9 aa, Homo Sapiens
SKKLAVCFH

SEQ ID NO: 112855 - protein, 9 aa, Homo Sapiens
IVGGHAPGE

SEQ ID NO: 112856 - protein, 9 aa, Homo Sapiens
LTYVNDNPP

SEQ ID NO: 112857 - protein, 9 aa, Homo Sapiens
HRHTGIHTD

SEQ ID NO: 112858 - protein, 9 aa, Homo Sapiens
GGTQSWLWF

SEQ ID NO: 112859 - protein, 9 aa, Homo Sapiens
VGNLCIRSI

SEQ ID NO: 112860 - protein, 9 aa, Homo Sapiens
LIDLDPEGA

SEQ ID NO: 112861 - protein, 9 aa, Homo Sapiens
EPALFIGSK

SEQ ID NO: 112862 - protein, 9 aa, Homo Sapiens
DTHRNTQAH

SEQ ID NO: 112863 - protein, 9 aa, Homo Sapiens
DNGYLLEKK

SEQ ID NO: 112864 - protein, 9 aa, Homo Sapiens
LFYIFCFLF

SEQ ID NO: 112865 - protein, 9 aa, Homo Sapiens
TGIHTDTHR

SEQ ID NO: 112866 - protein, 9 aa, Homo Sapiens
RHTHTQAYT

SEQ ID NO: 112867 - protein, 9 aa, Homo Sapiens
AIKIEVEAE

SEQ ID NO: 112868 - protein, 9 aa, Homo Sapiens
SPVGNLCIR

SEQ ID NO: 112869 - protein, 9 aa, Homo Sapiens
HRHTHTQAY

SEQ ID NO: 112870 - protein, 9 aa, Homo Sapiens
VDIIRLQLK

SEQ ID NO: 112871 - protein, 9 aa, Homo Sapiens
DIEESSRGQ

SEQ ID NO: 112872 - protein, 9 aa, Homo Sapiens
CARGFLGIF

SEQ ID NO: 112873 - protein, 9 aa, Homo Sapiens
QDIETRAFH

SEQ ID NO: 112874 - protein, 9 aa, Homo Sapiens
EWWHVQPTL

SEQ ID NO: 112875 - protein, 9 aa, Homo Sapiens
NLCIRSILG

SEQ ID NO: 112876 - protein, 9 aa, Homo Sapiens
TLPFLNCYC

SEQ ID NO: 112877 - protein, 9 aa, Homo Sapiens
LSDKDLRDF

SEQ ID NO: 112878 - protein, 9 aa, Homo Sapiens
ACSYGYYEV

SEQ ID NO: 112879 - protein, 9 aa, Homo Sapiens
TYTGTHRHT

SEQ ID NO: 112880 - protein, 9 aa, Homo Sapiens
HFDFSLESS

SEQ ID NO: 112881 - protein, 9 aa, Homo Sapiens
CTVLSNFTL

SEQ ID NO: 112882 - protein, 9 aa, Homo Sapiens
LPDNEMYYN

SEQ ID NO: 112883 - protein, 9 aa, Homo Sapiens
DTLPFLNCY

SEQ ID NO: 112884 - protein, 9 aa, Homo Sapiens
FFSFLPVFN

SEQ ID NO: 112885 - protein, 9 aa, Homo Sapiens
QVLDYDCFS

SEQ ID NO: 112886 - protein, 9 aa, Homo Sapiens
EPGTLGCAA

SEQ ID NO: 112887 - protein, 9 aa, Homo Sapiens
CLNSSPLYH

SEQ ID NO: 112888 - protein, 9 aa, Homo Sapiens
ETKETVTCE

SEQ ID NO: 112889 - protein, 9 aa, Homo Sapiens
SYVQMLDQI

SEQ ID NO: 112890 - protein, 9 aa, Homo Sapiens
GTLPLEPNL

SEQ ID NO: 112891 - protein, 9 aa, Homo Sapiens
TDEHKDLRK

SEQ ID NO: 112892 - protein, 9 aa, Homo Sapiens
QDHHVLFPL

SEQ ID NO: 112893 - protein, 9 aa, Homo Sapiens
RSGGMLFYI

SEQ ID NO: 112894 - protein, 9 aa, Homo Sapiens
KERTDEHKD

SEQ ID NO: 112895 - protein, 9 aa, Homo Sapiens
RQLLDFGGV

SEQ ID NO: 112896 - protein, 9 aa, Homo Sapiens
EWAIWKLGL

SEQ ID NO: 112897 - protein, 9 aa, Homo Sapiens
LCRKVTAIP

SEQ ID NO: 112898 - protein, 9 aa, Homo Sapiens
TNGAADAFV

SEQ ID NO: 112899 - protein, 9 aa, Homo Sapiens
KPHTVSILE

SEQ ID NO: 112900 - protein, 9 aa, Homo Sapiens
MSDPNFCTV

SEQ ID NO: 112901 - protein, 9 aa, Homo Sapiens
HQTLQRNRP

SEQ ID NO: 112902 - protein, 9 aa, Homo Sapiens
KKAKKEAKL

SEQ ID NO: 112903 - protein, 9 aa, Homo Sapiens
YLGADCVDV

SEQ ID NO: 112904 - protein, 9 aa, Homo Sapiens
FSGCKGLFD

SEQ ID NO: 112905 - protein, 9 aa, Homo Sapiens
PTRRNTEIL

SEQ ID NO: 112906 - protein, 9 aa, Homo Sapiens
LNKEEDVVI

SEQ ID NO: 112907 - protein, 9 aa, Homo Sapiens
HEDELIQQV

SEQ ID NO: 112908 - protein, 9 aa, Homo Sapiens
AYTLTYTGT

SEQ ID NO: 112909 - protein, 9 aa, Homo Sapiens
QTHIQAQTG

SEQ ID NO: 112910 - protein, 9 aa, Homo Sapiens
DKLIRQVST

SEQ ID NO: 112911 - protein, 9 aa, Homo Sapiens
LRDFRDRDR

SEQ ID NO: 112912 - protein, 9 aa, Homo Sapiens
AYSDYMLRP

SEQ ID NO: 112913 - protein, 9 aa, Homo Sapiens
EGNEVANFD

SEQ ID NO: 112914 - protein, 9 aa, Homo Sapiens
NKEEDVVIT

SEQ ID NO: 112915 - protein, 9 aa, Homo Sapiens
AIPGGLICS

SEQ ID NO: 112916 - protein, 9 aa, Homo Sapiens
RECLGTHTV

SEQ ID NO: 112917 - protein, 9 aa, Homo Sapiens
CLVKMKFLP

SEQ ID NO: 112918 - protein, 9 aa, Homo Sapiens
ASKVTTTKK

SEQ ID NO: 112919 - protein, 9 aa, Homo Sapiens
RHTGIHTDT

SEQ ID NO: 112920 - protein, 9 aa, Homo Sapiens
REHRRPVKD

SEQ ID NO: 112921 - protein, 9 aa, Homo Sapiens
GRFAFSHQQ

SEQ ID NO: 112922 - protein, 9 aa, Homo Sapiens
AAYLRLERD

SEQ ID NO: 112923 - protein, 9 aa, Homo Sapiens
LGLLYELEK

SEQ ID NO: 112924 - protein, 9 aa, Homo Sapiens
TTVNITLTY

SEQ ID NO: 112925 - protein, 9 aa, Homo Sapiens
VQCEDGDRF

SEQ ID NO: 112926 - protein, 9 aa, Homo Sapiens
TVIFVSYLI

SEQ ID NO: 112927 - protein, 9 aa, Homo Sapiens
QAYTLTYTG

SEQ ID NO: 112928 - protein, 9 aa, Homo Sapiens
YSAGYSLTA

SEQ ID NO: 112929 - protein, 9 aa, Homo Sapiens
HTGIHTDTD

SEQ ID NO: 112930 - protein, 9 aa, Homo Sapiens
PRLMKHLGL

SEQ ID NO: 112931 - protein, 9 aa, Homo Sapiens
HRYTHRHTQ

SEQ ID NO: 112932 - protein, 9 aa, Homo Sapiens
CIRSILGTP

SEQ ID NO: 112933 - protein, 9 aa, Homo Sapiens
LKSFSEEIC

SEQ ID NO: 112934 - protein, 9 aa, Homo Sapiens
VMPRLMKHL

SEQ ID NO: 112935 - protein, 9 aa, Homo Sapiens
DHHVLFPLH

SEQ ID NO: 112936 - protein, 9 aa, Homo Sapiens
HTVSILELL

SEQ ID NO: 112937 - protein, 9 aa, Homo Sapiens
TRGGGGGPW

SEQ ID NO: 112938 - protein, 9 aa, Homo Sapiens
HAHVAFRPD

SEQ ID NO: 112939 - protein, 9 aa, Homo Sapiens
ELLSKSRNA

SEQ ID NO: 112940 - protein, 9 aa, Homo Sapiens
THRHTHTHR

SEQ ID NO: 112941 - protein, 9 aa, Homo Sapiens
LTAQAIIIM

SEQ ID NO: 112942 - protein, 9 aa, Homo Sapiens
PHFDFSLES

SEQ ID NO: 112943 - protein, 9 aa, Homo Sapiens
VGVWKVLFK

SEQ ID NO: 112944 - protein, 9 aa, Homo Sapiens
PLCRKVTAI

SEQ ID NO: 112945 - protein, 9 aa, Homo Sapiens
FIGSKQFGL

SEQ ID NO: 112946 - protein, 9 aa, Homo Sapiens
QWAQKCELA

SEQ ID NO: 112947 - protein, 9 aa, Homo Sapiens
AQAIIIMLI

SEQ ID NO: 112948 - protein, 9 aa, Homo Sapiens
VEVTHQTLQ

SEQ ID NO: 112949 - protein, 9 aa, Homo Sapiens
EICSESCAL

SEQ ID NO: 112950 - protein, 9 aa, Homo Sapiens
DPNFCTVLS

SEQ ID NO: 112951 - protein, 9 aa, Homo Sapiens
LIASAVYIM

SEQ ID NO: 112952 - protein, 9 aa, Homo Sapiens
LASMSSEEV

SEQ ID NO: 112953 - protein, 9 aa, Homo Sapiens
SRGQSSTSR

SEQ ID NO: 112954 - protein, 9 aa, Homo Sapiens
CAASSYSPL

SEQ ID NO: 112955 - protein, 9 aa, Homo Sapiens
NAQVVDITE

SEQ ID NO: 112956 - protein, 9 aa, Homo Sapiens
EFIAYSDYM

SEQ ID NO: 112957 - protein, 9 aa, Homo Sapiens
WRSPSRGGP

SEQ ID NO: 112958 - protein, 9 aa, Homo Sapiens
LLIASAVYI

SEQ ID NO: 112959 - protein, 9 aa, Homo Sapiens
GTHRHTHTH

SEQ ID NO: 112960 - protein, 9 aa, Homo Sapiens
AFLTQPHSI

SEQ ID NO: 112961 - protein, 9 aa, Homo Sapiens
RYTHRHTQA

SEQ ID NO: 112962 - protein, 9 aa, Homo Sapiens
EQERYDCKG

SEQ ID NO: 112963 - protein, 9 aa, Homo Sapiens
IHGPHFDFS

SEQ ID NO: 112964 - protein, 9 aa, Homo Sapiens
TVEFIAYSD

SEQ ID NO: 112965 - protein, 9 aa, Homo Sapiens
NEMYYNTVY

SEQ ID NO: 112966 - protein, 9 aa, Homo Sapiens
QAQTGTHRH

SEQ ID NO: 112967 - protein, 9 aa, Homo Sapiens
DNEMYYNTV

SEQ ID NO: 112968 - protein, 9 aa, Homo Sapiens
GAEDKRGED

SEQ ID NO: 112969 - protein, 9 aa, Homo Sapiens
CHCSVGCGG

SEQ ID NO: 112970 - protein, 9 aa, Homo Sapiens
EQDSKLTSE

SEQ ID NO: 112971 - protein, 9 aa, Homo Sapiens
TWGTLPLEP

SEQ ID NO: 112972 - protein, 9 aa, Homo Sapiens
FMLHNSPGS

SEQ ID NO: 112973 - protein, 9 aa, Homo Sapiens
GGGLFSGCK

SEQ ID NO: 112974 - protein, 9 aa, Homo Sapiens
AFHFAGDAC

SEQ ID NO: 112975 - protein, 9 aa, Homo Sapiens
EEGFDYNEQ

SEQ ID NO: 112976 - protein, 9 aa, Homo Sapiens
SLLDAIKIE

SEQ ID NO: 112977 - protein, 9 aa, Homo Sapiens
KTTTLASKV

SEQ ID NO: 112978 - protein, 9 aa, Homo Sapiens
PGPPAAAAY

SEQ ID NO: 112979 - protein, 9 aa, Homo Sapiens
DKRGEDGDG

SEQ ID NO: 112980 - protein, 9 aa, Homo Sapiens
HTDTDTHSH

SEQ ID NO: 112981 - protein, 9 aa, Homo Sapiens
TQAYTQTHI

SEQ ID NO: 112982 - protein, 9 aa, Homo Sapiens
MLFYIFCFL

SEQ ID NO: 112983 - protein, 9 aa, Homo Sapiens
SKKAKKEAK

SEQ ID NO: 112984 - protein, 9 aa, Homo Sapiens
LTVALIFLP

SEQ ID NO: 112985 - protein, 9 aa, Homo Sapiens
RWNAQVVDI

SEQ ID NO: 112986 - protein, 9 aa, Homo Sapiens
IDGIPNIIP

SEQ ID NO: 112987 - protein, 9 aa, Homo Sapiens
CEVVNLSNK

SEQ ID NO: 112988 - protein, 9 aa, Homo Sapiens
LGCAASSYS

SEQ ID NO: 112989 - protein, 9 aa, Homo Sapiens
SFSEEICSE

SEQ ID NO: 112990 - protein, 9 aa, Homo Sapiens
ICLVKMKFL

SEQ ID NO: 112991 - protein, 9 aa, Homo Sapiens
LEPNLVPGG

SEQ ID NO: 112992 - protein, 9 aa, Homo Sapiens
ELIRQLLDF

SEQ ID NO: 112993 - protein, 9 aa, Homo Sapiens
DEPIHGPHF

SEQ ID NO: 112994 - protein, 9 aa, Homo Sapiens
FLGIFPACH

SEQ ID NO: 112995 - protein, 9 aa, Homo Sapiens
EEICSESCA

SEQ ID NO: 112996 - protein, 9 aa, Homo Sapiens
QCARGFLGI

SEQ ID NO: 112997 - protein, 9 aa, Homo Sapiens
YSYEQHGSR

SEQ ID NO: 112998 - protein, 9 aa, Homo Sapiens
PDMELLQDV

SEQ ID NO: 112999 - protein, 9 aa, Homo Sapiens
GVIYPDTLT

SEQ ID NO: 113000 - protein, 9 aa, Homo Sapiens
LSQDHHVLF

SEQ ID NO: 113001 - protein, 9 aa, Homo Sapiens
KAASFQWGP

SEQ ID NO: 113002 - protein, 9 aa, Homo Sapiens
QSMEEEEED

SEQ ID NO: 113003 - protein, 9 aa, Homo Sapiens
ISLRDTAAY

SEQ ID NO: 113004 - protein, 9 aa, Homo Sapiens
CFSRNDPIG

SEQ ID NO: 113005 - protein, 9 aa, Homo Sapiens
EPAFHFAGD

SEQ ID NO: 113006 - protein, 9 aa, Homo Sapiens
GQSSTSRTL

SEQ ID NO: 113007 - protein, 9 aa, Homo Sapiens
TASAERLLS

SEQ ID NO: 113008 - protein, 9 aa, Homo Sapiens
SLLIASAVY

SEQ ID NO: 113009 - protein, 9 aa, Homo Sapiens
HTDTHRNTQ

SEQ ID NO: 113010 - protein, 9 aa, Homo Sapiens
HTHTHRYTH

SEQ ID NO: 113011 - protein, 9 aa, Homo Sapiens
SIVGGHAPG

SEQ ID NO: 113012 - protein, 9 aa, Homo Sapiens
HRYLGADCV

SEQ ID NO: 113013 - protein, 9 aa, Homo Sapiens
TKGSMLQCA

SEQ ID NO: 113014 - protein, 9 aa, Homo Sapiens
TLLEYSART

SEQ ID NO: 113015 - protein, 9 aa, Homo Sapiens
GKVGVWKVL

SEQ ID NO: 113016 - protein, 9 aa, Homo Sapiens
VEFVFYYGP

SEQ ID NO: 113017 - protein, 9 aa, Homo Sapiens
LNSSPLYHH

SEQ ID NO: 113018 - protein, 9 aa, Homo Sapiens
TVTCEVVNL

SEQ ID NO: 113019 - protein, 9 aa, Homo Sapiens
YTGTHRHTH

SEQ ID NO: 113020 - protein, 9 aa, Homo Sapiens
HTVVVMGGK

SEQ ID NO: 113021 - protein, 9 aa, Homo Sapiens
LCTMEEVDI

SEQ ID NO: 113022 - protein, 9 aa, Homo Sapiens
EGSPGDQWV

SEQ ID NO: 113023 - protein, 9 aa, Homo Sapiens
RTHAYTREC

SEQ ID NO: 113024 - protein, 9 aa, Homo Sapiens
HRNTQAHTG

SEQ ID NO: 113025 - protein, 9 aa, Homo Sapiens
EFKTNRSGE

SEQ ID NO: 113026 - protein, 9 aa, Homo Sapiens
GGPEHFMLH

SEQ ID NO: 113027 - protein, 9 aa, Homo Sapiens
SQEPAFHFA

SEQ ID NO: 113028 - protein, 9 aa, Homo Sapiens
VSYLIAHGF

SEQ ID NO: 113029 - protein, 9 aa, Homo Sapiens
VEFKTNRSG

SEQ ID NO: 113030 - protein, 9 aa, Homo Sapiens
SKSRNAHYL

SEQ ID NO: 113031 - protein, 9 aa, Homo Sapiens
QTGTHRHIH

SEQ ID NO: 113032 - protein, 9 aa, Homo Sapiens
GSMLQCAAS

SEQ ID NO: 113033 - protein, 9 aa, Homo Sapiens
NQRTRNVLL

SEQ ID NO: 113034 - protein, 9 aa, Homo Sapiens
VTCEVVNLS

SEQ ID NO: 113035 - protein, 9 aa, Homo Sapiens
GTAWLEWWH

SEQ ID NO: 113036 - protein, 9 aa, Homo Sapiens
RHYFLEHLL

SEQ ID NO: 113037 - protein, 9 aa, Homo Sapiens
EEDVVITNT

SEQ ID NO: 113038 - protein, 9 aa, Homo Sapiens
AERLLSGTP

SEQ ID NO: 113039 - protein, 9 aa, Homo Sapiens
YQRRRMFWE

SEQ ID NO: 113040 - protein, 9 aa, Homo Sapiens
QLFPEGSPG

SEQ ID NO: 113041 - protein, 9 aa, Homo Sapiens
KDNFLHMSV

SEQ ID NO: 113042 - protein, 9 aa, Homo Sapiens
GAADAFVGG

SEQ ID NO: 113043 - protein, 9 aa, Homo Sapiens
CRKVTAIPG

SEQ ID NO: 113044 - protein, 9 aa, Homo Sapiens
ASAVYIMDT

SEQ ID NO: 113045 - protein, 9 aa, Homo Sapiens
KEDNGYLLE

SEQ ID NO: 113046 - protein, 9 aa, Homo Sapiens
VNALSNSMT

SEQ ID NO: 113047 - protein, 9 aa, Homo Sapiens
EEVDIIRLQ

SEQ ID NO: 113048 - protein, 9 aa, Homo Sapiens
LWGVSTGRR

SEQ ID NO: 113049 - protein, 9 aa, Homo Sapiens
AIWKLGLVK

SEQ ID NO: 113050 - protein, 9 aa, Homo Sapiens
SRNAHYLRH

SEQ ID NO: 113051 - protein, 9 aa, Homo Sapiens
SPLYHHSQL

SEQ ID NO: 113052 - protein, 9 aa, Homo Sapiens
RGQSSTSRT

SEQ ID NO: 113053 - protein, 9 aa, Homo Sapiens
LIEKNMKLA

SEQ ID NO: 113054 - protein, 9 aa, Homo Sapiens
MPRLMKHLG

SEQ ID NO: 113055 - protein, 9 aa, Homo Sapiens
DNFLHMSVQ

SEQ ID NO: 113056 - protein, 9 aa, Homo Sapiens
LLSGTPISF

SEQ ID NO: 113057 - protein, 9 aa, Homo Sapiens
EDKRGEDGD

SEQ ID NO: 113058 - protein, 9 aa, Homo Sapiens
TFPVSVQCE

SEQ ID NO: 113059 - protein, 9 aa, Homo Sapiens
EKNMKLAQK

SEQ ID NO: 113060 - protein, 9 aa, Homo Sapiens
FYIFCFLFC

SEQ ID NO: 113061 - protein, 9 aa, Homo Sapiens
AYDPTKDDK

SEQ ID NO: 113062 - protein, 9 aa, Homo Sapiens
ANRLFGKKS

SEQ ID NO: 113063 - protein, 9 aa, Homo Sapiens
PEASSKKAK

SEQ ID NO: 113064 - protein, 9 aa, Homo Sapiens
GFDYNEQER

SEQ ID NO: 113065 - protein, 9 aa, Homo Sapiens
QPEVEVTHQ

SEQ ID NO: 113066 - protein, 9 aa, Homo Sapiens
PIIDGIPNI

SEQ ID NO: 113067 - protein, 9 aa, Homo Sapiens
YTRECLGTH

SEQ ID NO: 113068 - protein, 9 aa, Homo Sapiens
MNQRTRNVL

SEQ ID NO: 113069 - protein, 9 aa, Homo Sapiens
KVTAIPGGL

SEQ ID NO: 113070 - protein, 9 aa, Homo Sapiens
GIHTDTDTH

SEQ ID NO: 113071 - protein, 9 aa, Homo Sapiens
HCSVGCGGT

SEQ ID NO: 113072 - protein, 9 aa, Homo Sapiens
SDKDLRDFR

SEQ ID NO: 113073 - protein, 9 aa, Homo Sapiens
PFLNCYCSG

SEQ ID NO: 113074 - protein, 9 aa, Homo Sapiens
YFKELTMYR

SEQ ID NO: 113075 - protein, 9 aa, Homo Sapiens
TVNITLTYV

SEQ ID NO: 113076 - protein, 9 aa, Homo Sapiens
IERHYFLEH

SEQ ID NO: 113077 - protein, 9 aa, Homo Sapiens
GGTAWLEWW

SEQ ID NO: 113078 - protein, 9 aa, Homo Sapiens
GGLFSGCKG

SEQ ID NO: 113079 - protein, 9 aa, Homo Sapiens
IPNIIPQAA

SEQ ID NO: 113080 - protein, 9 aa, Homo Sapiens
PMPVDPTQG

SEQ ID NO: 113081 - protein, 9 aa, Homo Sapiens
SGHSYSYEQ

SEQ ID NO: 113082 - protein, 9 aa, Homo Sapiens
SSGLTAQAI

SEQ ID NO: 113083 - protein, 9 aa, Homo Sapiens
QLEYLGLLE

SEQ ID NO: 113084 - protein, 9 aa, Homo Sapiens
STSITNIGF

SEQ ID NO: 113085 - protein, 9 aa, Homo Sapiens
SKVTTTKKT

SEQ ID NO: 113086 - protein, 9 aa, Homo Sapiens
GHSYSYEQH

SEQ ID NO: 113087 - protein, 9 aa, Homo Sapiens
HTHTQAYTL

SEQ ID NO: 113088 - protein, 9 aa, Homo Sapiens
KVGVWKVLF

SEQ ID NO: 113089 - protein, 9 aa, Homo Sapiens
FLTQPHSIM

SEQ ID NO: 113090 - protein, 9 aa, Homo Sapiens
QSLLDAIKI

SEQ ID NO: 113091 - protein, 9 aa, Homo Sapiens
SQQLFPEGS

SEQ ID NO: 113092 - protein, 9 aa, Homo Sapiens
FFTQPKKDF

SEQ ID NO: 113093 - protein, 9 aa, Homo Sapiens
WGSSLAKHQ

SEQ ID NO: 113094 - protein, 9 aa, Homo Sapiens
PNFCTVLSN

SEQ ID NO: 113095 - protein, 9 aa, Homo Sapiens
CGGTNCETP

SEQ ID NO: 113096 - protein, 9 aa, Homo Sapiens
AGLICLVKM

SEQ ID NO: 113097 - protein, 9 aa, Homo Sapiens
TAAYLRLER

SEQ ID NO: 113098 - protein, 9 aa, Homo Sapiens
GMLFYIFCF

SEQ ID NO: 113099 - protein, 9 aa, Homo Sapiens
HGYVDEVMP

SEQ ID NO: 113100 - protein, 9 aa, Homo Sapiens
HCLVYKVPL

SEQ ID NO: 113101 - protein, 9 aa, Homo Sapiens
LFPLHLDTQ

SEQ ID NO: 113102 - protein, 9 aa, Homo Sapiens
PEHFMLHNS

SEQ ID NO: 113103 - protein, 9 aa, Homo Sapiens
LLYELEKNT

SEQ ID NO: 113104 - protein, 9 aa, Homo Sapiens
LIRQLLDFG

SEQ ID NO: 113105 - protein, 9 aa, Homo Sapiens
VSWGSLWGV

SEQ ID NO: 113106 - protein, 9 aa, Homo Sapiens
LTQPHSIMV

SEQ ID NO: 113107 - protein, 9 aa, Homo Sapiens
YGRFAFSHQ

SEQ ID NO: 113108 - protein, 9 aa, Homo Sapiens
ICSESCALL

SEQ ID NO: 113109 - protein, 9 aa, Homo Sapiens
SITNIGFRD

SEQ ID NO: 113110 - protein, 9 aa, Homo Sapiens
LPTRRNTEI

SEQ ID NO: 113111 - protein, 9 aa, Homo Sapiens
QVSTLDGVL

SEQ ID NO: 113112 - protein, 9 aa, Homo Sapiens
THTVVVMGG

SEQ ID NO: 113113 - protein, 9 aa, Homo Sapiens
IQAQTGTHR

SEQ ID NO: 113114 - protein, 9 aa, Homo Sapiens
AEDKRGEDG

SEQ ID NO: 113115 - protein, 9 aa, Homo Sapiens
NACSYGYYE

SEQ ID NO: 113116 - protein, 9 aa, Homo Sapiens
EGFDYNEQE

SEQ ID NO: 113117 - protein, 9 aa, Homo Sapiens
HSRTHAYTR

SEQ ID NO: 113118 - protein, 9 aa, Homo Sapiens
IHTDTHRNT

SEQ ID NO: 113119 - protein, 9 aa, Homo Sapiens
NEQERYDCK

SEQ ID NO: 113120 - protein, 9 aa, Homo Sapiens
GKKSCDFLS

SEQ ID NO: 113121 - protein, 9 aa, Homo Sapiens
EPIHGPHFD

SEQ ID NO: 113122 - protein, 9 aa, Homo Sapiens
KSQEPAFHF

SEQ ID NO: 113123 - protein, 9 aa, Homo Sapiens
HTQAYTLTY

SEQ ID NO: 113124 - protein, 9 aa, Homo Sapiens
LSGYISYQR

SEQ ID NO: 113125 - protein, 9 aa, Homo Sapiens
LASKVTTTK

SEQ ID NO: 113126 - protein, 9 aa, Homo Sapiens
YSARTILHN

SEQ ID NO: 113127 - protein, 9 aa, Homo Sapiens
QYTKERTDE

SEQ ID NO: 113128 - protein, 9 aa, Homo Sapiens
SEPGTLGCA

SEQ ID NO: 113129 - protein, 9 aa, Homo Sapiens
VNKFGEVFP

SEQ ID NO: 113130 - protein, 9 aa, Homo Sapiens
TRECLGTHT

SEQ ID NO: 113131 - protein, 9 aa, Homo Sapiens
HTGMHRHTH

SEQ ID NO: 113132 - protein, 9 aa, Homo Sapiens
PHTVSILEL

SEQ ID NO: 113133 - protein, 9 aa, Homo Sapiens
SYSYEQHGS

SEQ ID NO: 113134 - protein, 9 aa, Homo Sapiens
KREQLIEKN

SEQ ID NO: 113135 - protein, 9 aa, Homo Sapiens
KSFSEEICS

SEQ ID NO: 113136 - protein, 9 aa, Homo Sapiens
IFVSYLIAH

SEQ ID NO: 113137 - protein, 9 aa, Homo Sapiens
GPWRSPSRG

SEQ ID NO: 113138 - protein, 9 aa, Homo Sapiens
AEDCNELPT

SEQ ID NO: 113139 - protein, 9 aa, Homo Sapiens
SWGSLWGVS

SEQ ID NO: 113140 - protein, 9 aa, Homo Sapiens
FIAYSDYML

SEQ ID NO: 113141 - protein, 9 aa, Homo Sapiens
TFLELLSKS

SEQ ID NO: 113142 - protein, 9 aa, Homo Sapiens
TYHMPDMEL

SEQ ID NO: 113143 - protein, 9 aa, Homo Sapiens
THRYTHRHT

SEQ ID NO: 113144 - protein, 9 aa, Homo Sapiens
NIGFRDNWV

SEQ ID NO: 113145 - protein, 9 aa, Homo Sapiens
GQLDKLIRQ

SEQ ID NO: 113146 - protein, 9 aa, Homo Sapiens
EVDIIRLQL

SEQ ID NO: 113147 - protein, 9 aa, Homo Sapiens
GIPNIIPQA

SEQ ID NO: 113148 - protein, 9 aa, Homo Sapiens
TKETVTCEV

SEQ ID NO: 113149 - protein, 9 aa, Homo Sapiens
GMHRHTHTQ

SEQ ID NO: 113150 - protein, 9 aa, Homo Sapiens
VTHQTLQRN

SEQ ID NO: 113151 - protein, 9 aa, Homo Sapiens
FTQPKKDFC

SEQ ID NO: 113152 - protein, 9 aa, Homo Sapiens
QLDKLIRQV

SEQ ID NO: 113153 - protein, 9 aa, Homo Sapiens
AAAAYDPTK

SEQ ID NO: 113154 - protein, 9 aa, Homo Sapiens
PYGGPEHFM

SEQ ID NO: 113155 - protein, 9 aa, Homo Sapiens
NITLTYVND

SEQ ID NO: 113156 - protein, 9 aa, Homo Sapiens
TGTHRHTHT

SEQ ID NO: 113157 - protein, 9 aa, Homo Sapiens
CHCSTCYYD

SEQ ID NO: 113158 - protein, 9 aa, Homo Sapiens
SEEICSESC

SEQ ID NO: 113159 - protein, 9 aa, Homo Sapiens
HQLEYLGLL

SEQ ID NO: 113160 - protein, 9 aa, Homo Sapiens
GECHCSVGC

SEQ ID NO: 113161 - protein, 9 aa, Homo Sapiens
NRSGEPFII

SEQ ID NO: 113162 - protein, 9 aa, Homo Sapiens
NCYCSGHCP

SEQ ID NO: 113163 - protein, 9 aa, Homo Sapiens
GCGGTNCET

SEQ ID NO: 113164 - protein, 9 aa, Homo Sapiens
LGSTSITNI

SEQ ID NO: 113165 - protein, 9 aa, Homo Sapiens
EGVIYPDTL

SEQ ID NO: 113166 - protein, 9 aa, Homo Sapiens
RFAFSHQQL

SEQ ID NO: 113167 - protein, 9 aa, Homo Sapiens
AWLEWWHVQ

SEQ ID NO: 113168 - protein, 9 aa, Homo Sapiens
SVEKAGLIC

SEQ ID NO: 113169 - protein, 9 aa, Homo Sapiens
DTENIYEIL

SEQ ID NO: 113170 - protein, 9 aa, Homo Sapiens
SLRRLLIDL

SEQ ID NO: 113171 - protein, 9 aa, Homo Sapiens
LLDFGGVYD

SEQ ID NO: 113172 - protein, 9 aa, Homo Sapiens
TQPHSIMVP

SEQ ID NO: 113173 - protein, 9 aa, Homo Sapiens
FLPVFNWAS

SEQ ID NO: 113174 - protein, 9 aa, Homo Sapiens
TDTHRNTQA

SEQ ID NO: 113175 - protein, 9 aa, Homo Sapiens
YTHRHTQAY

SEQ ID NO: 113176 - protein, 9 aa, Homo Sapiens
VVDITEELA

SEQ ID NO: 113177 - protein, 9 aa, Homo Sapiens
EVTHQTLQR

SEQ ID NO: 113178 - protein, 9 aa, Homo Sapiens
NKFGEVFPQ

SEQ ID NO: 113179 - protein, 9 aa, Homo Sapiens
GCKGLFDDE

SEQ ID NO: 113180 - protein, 9 aa, Homo Sapiens
DSKLTSEEE

SEQ ID NO: 113181 - protein, 9 aa, Homo Sapiens
TDTHSHRHT

SEQ ID NO: 113182 - protein, 9 aa, Homo Sapiens
HRHTGMHRH

SEQ ID NO: 113183 - protein, 9 aa, Homo Sapiens
GTQSWLWFA

SEQ ID NO: 113184 - protein, 9 aa, Homo Sapiens
THRHTGIHT

SEQ ID NO: 113185 - protein, 9 aa, Homo Sapiens
FLQMTLLLT

SEQ ID NO: 113186 - protein, 9 aa, Homo Sapiens
SKAASFQWG

SEQ ID NO: 113187 - protein, 9 aa, Homo Sapiens
SVQQGYLGN

SEQ ID NO: 113188 - protein, 9 aa, Homo Sapiens
LDFGGVYDT

SEQ ID NO: 113189 - protein, 9 aa, Homo Sapiens
YKVPLASMS

SEQ ID NO: 113190 - protein, 9 aa, Homo Sapiens
FGKKSCDFL

SEQ ID NO: 113191 - protein, 9 aa, Homo Sapiens
VSVQCEDGD

SEQ ID NO: 113192 - protein, 9 aa, Homo Sapiens
IIDGIPNII

SEQ ID NO: 113193 - protein, 9 aa, Homo Sapiens
AYTQTHIQA

SEQ ID NO: 113194 - protein, 9 aa, Homo Sapiens
IPREMPGKV

SEQ ID NO: 113195 - protein, 9 aa, Homo Sapiens
SSPLYHHSQ

SEQ ID NO: 113196 - protein, 9 aa, Homo Sapiens
WATWGTLPL

SEQ ID NO: 113197 - protein, 9 aa, Homo Sapiens
NGYLLEKKI

SEQ ID NO: 113198 - protein, 9 aa, Homo Sapiens
VLDYDCFSR

SEQ ID NO: 113199 - protein, 9 aa, Homo Sapiens
SILELLKLK

SEQ ID NO: 113200 - protein, 9 aa, Homo Sapiens
GYLGNFSDL

SEQ ID NO: 113201 - protein, 9 aa, Homo Sapiens
EVMPRLMKH

SEQ ID NO: 113202 - protein, 9 aa, Homo Sapiens
IIIMLIVIA

SEQ ID NO: 113203 - protein, 9 aa, Homo Sapiens
DIETRAFHG

SEQ ID NO: 113204 - protein, 9 aa, Homo Sapiens
PPAAAAYDP

SEQ ID NO: 113205 - protein, 9 aa, Homo Sapiens
GGAEDKRGE

SEQ ID NO: 113206 - protein, 9 aa, Homo Sapiens
ESEPALFIG

SEQ ID NO: 113207 - protein, 9 aa, Homo Sapiens
ECKPHTVSI

SEQ ID NO: 113208 - protein, 9 aa, Homo Sapiens
DTHSHRHTH

SEQ ID NO: 113209 - protein, 9 aa, Homo Sapiens
GSTSITNIG

SEQ ID NO: 113210 - protein, 9 aa, Homo Sapiens
NGAADAFVG

SEQ ID NO: 113211 - protein, 9 aa, Homo Sapiens
PGLEAPPHA

SEQ ID NO: 113212 - protein, 9 aa, Homo Sapiens
CTMEEVDII

SEQ ID NO: 113213 - protein, 9 aa, Homo Sapiens
TQAHTGIHT

SEQ ID NO: 113214 - protein, 9 aa, Homo Sapiens
SGGMLFYIF

SEQ ID NO: 113215 - protein, 9 aa, Homo Sapiens
GGPWRSPSR

SEQ ID NO: 113216 - protein, 9 aa, Homo Sapiens
GSGHSYSYE

SEQ ID NO: 113217 - protein, 9 aa, Homo Sapiens
QMTLLLTVA

SEQ ID NO: 113218 - protein, 9 aa, Homo Sapiens
EIIDTNGAA

SEQ ID NO: 113219 - protein, 9 aa, Homo Sapiens
KDLRDFRDR

SEQ ID NO: 113220 - protein, 9 aa, Homo Sapiens
SDPNFCTVL

SEQ ID NO: 113221 - protein, 9 aa, Homo Sapiens
IRQVSTLDG

SEQ ID NO: 113222 - protein, 9 aa, Homo Sapiens
GSSLAKHQI

SEQ ID NO: 113223 - protein, 9 aa, Homo Sapiens
IYEILNNAD

SEQ ID NO: 113224 - protein, 9 aa, Homo Sapiens
PLLTVIFVS

SEQ ID NO: 113225 - protein, 9 aa, Homo Sapiens
TTTLASKVT

SEQ ID NO: 113226 - protein, 9 aa, Homo Sapiens
GGGGPWRSP

SEQ ID NO: 113227 - protein, 9 aa, Homo Sapiens
LDYDCFSRN

SEQ ID NO: 113228 - protein, 9 aa, Homo Sapiens
TVVVMGGKE

SEQ ID NO: 113229 - protein, 9 aa, Homo Sapiens
FAGDACLQR

SEQ ID NO: 113230 - protein, 9 aa, Homo Sapiens
VTSKAASFQ

SEQ ID NO: 113231 - protein, 9 aa, Homo Sapiens
TENIYEILN

SEQ ID NO: 113232 - protein, 9 aa, Homo Sapiens
MEEVDIIRL

SEQ ID NO: 113233 - protein, 9 aa, Homo Sapiens
SIMVPPTSP

SEQ ID NO: 113234 - protein, 9 aa, Homo Sapiens
AYLRLERDT

SEQ ID NO: 113235 - protein, 9 aa, Homo Sapiens
GLFSGCKGL

SEQ ID NO: 113236 - protein, 9 aa, Homo Sapiens
HYFLEHLLK

SEQ ID NO: 113237 - protein, 9 aa, Homo Sapiens
ASFQWGPEQ

SEQ ID NO: 113238 - protein, 9 aa, Homo Sapiens
DMLPMPVDP

SEQ ID NO: 113239 - protein, 9 aa, Homo Sapiens
AFSHQQLRV

SEQ ID NO: 113240 - protein, 9 aa, Homo Sapiens
GGMLFYIFC

SEQ ID NO: 113241 - protein, 9 aa, Homo Sapiens
IEKNMKLAQ

SEQ ID NO: 113242 - protein, 9 aa, Homo Sapiens
GGGGGPWRS

SEQ ID NO: 113243 - protein, 9 aa, Homo Sapiens
RHIHSRTHA

SEQ ID NO: 113244 - protein, 9 aa, Homo Sapiens
FSHQQLRVS

SEQ ID NO: 113245 - protein, 9 aa, Homo Sapiens
SMEEEEEDT

SEQ ID NO: 113246 - protein, 9 aa, Homo Sapiens
EESSRGQSS

SEQ ID NO: 113247 - protein, 9 aa, Homo Sapiens
DTLTYGSVR

SEQ ID NO: 113248 - protein, 9 aa, Homo Sapiens
REQLIEKNM

SEQ ID NO: 113249 - protein, 9 aa, Homo Sapiens
YDYSAGYSL

SEQ ID NO: 113250 - protein, 9 aa, Homo Sapiens
DMELLQDVG

SEQ ID NO: 113251 - protein, 9 aa, Homo Sapiens
LAKHQIIHT

SEQ ID NO: 113252 - protein, 9 aa, Homo Sapiens
HRRPVKDNF

SEQ ID NO: 113253 - protein, 9 aa, Homo Sapiens
ENIYEILNN

SEQ ID NO: 113254 - protein, 9 aa, Homo Sapiens
DLLEWVNVL

SEQ ID NO: 113255 - protein, 9 aa, Homo Sapiens
PVDPTQGTG

SEQ ID NO: 113256 - protein, 9 aa, Homo Sapiens
CRHQLEYLG

SEQ ID NO: 113257 - protein, 9 aa, Homo Sapiens
LPLEPNLVP

SEQ ID NO: 113258 - protein, 9 aa, Homo Sapiens
GKVGEWAIW

SEQ ID NO: 113259 - protein, 9 aa, Homo Sapiens
RHTHTHRYT

SEQ ID NO: 113260 - protein, 9 aa, Homo Sapiens
THRNTQAHT

SEQ ID NO: 113261 - protein, 9 aa, Homo Sapiens
IAYSDYMLR

SEQ ID NO: 113262 - protein, 9 aa, Homo Sapiens
TLTYVNDNP

SEQ ID NO: 113263 - protein, 9 aa, Homo Sapiens
SNSMTAGQA

SEQ ID NO: 113264 - protein, 9 aa, Homo Sapiens
TQAYTLTYT

SEQ ID NO: 113265 - protein, 9 aa, Homo Sapiens
HSHRHTHTH

SEQ ID NO: 113266 - protein, 9 aa, Homo Sapiens
RVNKFGEVF

SEQ ID NO: 113267 - protein, 9 aa, Homo Sapiens
VKDNFLHMS

SEQ ID NO: 113268 - protein, 9 aa, Homo Sapiens
WHVQPTLDL

SEQ ID NO: 113269 - protein, 9 aa, Homo Sapiens
GETFPVSVQ

SEQ ID NO: 113270 - protein, 9 aa, Homo Sapiens
RCRHQLEYL

SEQ ID NO: 113271 - protein, 9 aa, Homo Sapiens
RMIERHYFL

SEQ ID NO: 113272 - protein, 9 aa, Homo Sapiens
ETYHMPDME

SEQ ID NO: 113273 - protein, 9 aa, Homo Sapiens
LQVLDYDCF

SEQ ID NO: 113274 - protein, 9 aa, Homo Sapiens
VANFDLAVA

SEQ ID NO: 113275 - protein, 9 aa, Homo Sapiens
THTQAYTLT

SEQ ID NO: 113276 - protein, 9 aa, Homo Sapiens
NTQAHTGIH

SEQ ID NO: 113277 - protein, 9 aa, Homo Sapiens
APLTLLEYS

SEQ ID NO: 113278 - protein, 9 aa, Homo Sapiens
WAIWKLGLV

SEQ ID NO: 113279 - protein, 9 aa, Homo Sapiens
FCTVLSNFT

SEQ ID NO: 113280 - protein, 9 aa, Homo Sapiens
EEEGNEVAN

SEQ ID NO: 113281 - protein, 9 aa, Homo Sapiens
WGTLPLEPN

SEQ ID NO: 113282 - protein, 9 aa, Homo Sapiens
LGIFPACHP

SEQ ID NO: 113283 - protein, 9 aa, Homo Sapiens
SFQWGPEQE

SEQ ID NO: 113284 - protein, 9 aa, Homo Sapiens
ERLLSGTPI

SEQ ID NO: 113285 - protein, 9 aa, Homo Sapiens
LDKLIRQVS

SEQ ID NO: 113286 - protein, 9 aa, Homo Sapiens
TNRSGEPFI

SEQ ID NO: 113287 - protein, 9 aa, Homo Sapiens
MLPMPVDPT

SEQ ID NO: 113288 - protein, 9 aa, Homo Sapiens
SGGGLFSGC

SEQ ID NO: 113289 - protein, 9 aa, Homo Sapiens
CLGTHTVVV

SEQ ID NO: 113290 - protein, 9 aa, Homo Sapiens
MANRLFGKK

SEQ ID NO: 113291 - protein, 9 aa, Homo Sapiens
EDCNELPTR

SEQ ID NO: 113292 - protein, 9 aa, Homo Sapiens
QFAAAYFKE

SEQ ID NO: 113293 - protein, 9 aa, Homo Sapiens
FLEHLLKNF

SEQ ID NO: 113294 - protein, 9 aa, Homo Sapiens
YGYYEVTEL

SEQ ID NO: 113295 - protein, 9 aa, Homo Sapiens
RRPVKDNFL

SEQ ID NO: 113296 - protein, 9 aa, Homo Sapiens
NDQQDLLEW

SEQ ID NO: 113297 - protein, 9 aa, Homo Sapiens
VTAIPGGLI

SEQ ID NO: 113298 - protein, 9 aa, Homo Sapiens
QPKKDFCND

SEQ ID NO: 113299 - protein, 9 aa, Homo Sapiens
PEDTLPFLN

SEQ ID NO: 113300 - protein, 9 aa, Homo Sapiens
TSLDTENIY

SEQ ID NO: 113301 - protein, 9 aa, Homo Sapiens
TQPKKDFCN

SEQ ID NO: 113302 - protein, 9 aa, Homo Sapiens
QAPLTLLEY

SEQ ID NO: 113303 - protein, 9 aa, Homo Sapiens
GGGPWRSPS

SEQ ID NO: 113304 - protein, 9 aa, Homo Sapiens
RNTQAHTGI

SEQ ID NO: 113305 - protein, 9 aa, Homo Sapiens
TPLPDNEMY

SEQ ID NO: 113306 - protein, 9 aa, Homo Sapiens
LEYLGLLEN

SEQ ID NO: 113307 - protein, 9 aa, Homo Sapiens
YYGPEKIQG

SEQ ID NO: 113308 - protein, 9 aa, Homo Sapiens
VDPTQGTGN

SEQ ID NO: 113309 - protein, 9 aa, Homo Sapiens
ATWGTLPLE

SEQ ID NO: 113310 - protein, 9 aa, Homo Sapiens
QQLFPEGSP

SEQ ID NO: 113311 - protein, 9 aa, Homo Sapiens
QTLQRNRPD

SEQ ID NO: 113312 - protein, 9 aa, Homo Sapiens
STVEFIAYS

SEQ ID NO: 113313 - protein, 9 aa, Homo Sapiens
FHFAGDACL

SEQ ID NO: 113314 - protein, 9 aa, Homo Sapiens
YELEKNTDK

SEQ ID NO: 113315 - protein, 9 aa, Homo Sapiens
TCEVVNLSN

SEQ ID NO: 113316 - protein, 9 aa, Homo Sapiens
NIIPQAARM

SEQ ID NO: 113317 - protein, 9 aa, Homo Sapiens
TGDNGQWAQ

SEQ ID NO: 113318 - protein, 9 aa, Homo Sapiens
AQTGTHRHI

SEQ ID NO: 113319 - protein, 9 aa, Homo Sapiens
RTDEHKDLR

SEQ ID NO: 113320 - protein, 9 aa, Homo Sapiens
LTLLEYSAR

SEQ ID NO: 113321 - protein, 9 aa, Homo Sapiens
PSHTKGSML

SEQ ID NO: 113322 - protein, 9 aa, Homo Sapiens
HGSGSGHSY

SEQ ID NO: 113323 - protein, 9 aa, Homo Sapiens
LQYTKERTD

SEQ ID NO: 113324 - protein, 9 aa, Homo Sapiens
MDMSDPNFC

SEQ ID NO: 113325 - protein, 9 aa, Homo Sapiens
RGSIVGGHA

SEQ ID NO: 113326 - protein, 9 aa, Homo Sapiens
VLFPLHLDT

SEQ ID NO: 113327 - protein, 9 aa, Homo Sapiens
LRRLLIDLD

SEQ ID NO: 113328 - protein, 9 aa, Homo Sapiens
RHTQAYTQT

SEQ ID NO: 113329 - protein, 9 aa, Homo Sapiens
FAFSHQQLR

SEQ ID NO: 113330 - protein, 9 aa, Homo Sapiens
DTASAERLL

SEQ ID NO: 113331 - protein, 9 aa, Homo Sapiens
LLEYSARTI

SEQ ID NO: 113332 - protein, 9 aa, Homo Sapiens
SAERLLSGT

SEQ ID NO: 113333 - protein, 9 aa, Homo Sapiens
SLWGVSTGR

SEQ ID NO: 113334 - protein, 9 aa, Homo Sapiens
KFFTQPKKD

SEQ ID NO: 113335 - protein, 9 aa, Homo Sapiens
YEILNNADV

SEQ ID NO: 113336 - protein, 9 aa, Homo Sapiens
LLTVIFVSY

SEQ ID NO: 113337 - protein, 9 aa, Homo Sapiens
PAFHFAGDA

SEQ ID NO: 113338 - protein, 9 aa, Homo Sapiens
LRDTAAYLR

SEQ ID NO: 113339 - protein, 9 aa, Homo Sapiens
LCIRSILGT

SEQ ID NO: 113340 - protein, 9 aa, Homo Sapiens
LHLLHEDEL

SEQ ID NO: 113341 - protein, 9 aa, Homo Sapiens
LTVIFVSYL

SEQ ID NO: 113342 - protein, 9 aa, Homo Sapiens
VIPERVNKF

SEQ ID NO: 113343 - protein, 9 aa, Homo Sapiens
RDTAAYLRL

SEQ ID NO: 113344 - protein, 9 aa, Homo Sapiens
SRRRAGGTQ

SEQ ID NO: 113345 - protein, 9 aa, Homo Sapiens
GNLCIRSIL

SEQ ID NO: 113346 - protein, 9 aa, Homo Sapiens
AKKEAKLAA

SEQ ID NO: 113347 - protein, 9 aa, Homo Sapiens
FPEGSPGDQ

SEQ ID NO: 113348 - protein, 9 aa, Homo Sapiens
EKAGLICLV

SEQ ID NO: 113349 - protein, 9 aa, Homo Sapiens
SEPALFIGS

SEQ ID NO: 113350 - protein, 9 aa, Homo Sapiens
PEQDSKLTS

SEQ ID NO: 113351 - protein, 9 aa, Homo Sapiens
IWKLGLVKY

SEQ ID NO: 113352 - protein, 9 aa, Homo Sapiens
SKLTSEEES

SEQ ID NO: 113353 - protein, 9 aa, Homo Sapiens
VSRRRAGGT

SEQ ID NO: 113354 - protein, 9 aa, Homo Sapiens
DIIRLQLKL

SEQ ID NO: 113355 - protein, 9 aa, Homo Sapiens
VGGHAPGEP

SEQ ID NO: 113356 - protein, 9 aa, Homo Sapiens
ISVQQGYLG

SEQ ID NO: 113357 - protein, 9 aa, Homo Sapiens
QCLNSSPLY

SEQ ID NO: 113358 - protein, 9 aa, Homo Sapiens
VEFIAYSDY

SEQ ID NO: 113359 - protein, 9 aa, Homo Sapiens
NSTVEFIAY

SEQ ID NO: 113360 - protein, 9 aa, Homo Sapiens
VIFVSYLIA

SEQ ID NO: 113361 - protein, 9 aa, Homo Sapiens
QRTRNVLLS

SEQ ID NO: 113362 - protein, 9 aa, Homo Sapiens
HSYSYEQHG

SEQ ID NO: 113363 - protein, 9 aa, Homo Sapiens
CKGLFDDED

SEQ ID NO: 113364 - protein, 9 aa, Homo Sapiens
GHAPGEPRG

SEQ ID NO: 113365 - protein, 9 aa, Homo Sapiens
DLISVQQGY

SEQ ID NO: 113366 - protein, 9 aa, Homo Sapiens
GSLWGVSTG

SEQ ID NO: 113367 - protein, 9 aa, Homo Sapiens
GPEHFMLHN

SEQ ID NO: 113368 - protein, 9 aa, Homo Sapiens
KSRNAHYLR

SEQ ID NO: 113369 - protein, 9 aa, Homo Sapiens
KVPLASMSS

SEQ ID NO: 113370 - protein, 9 aa, Homo Sapiens
EEEEGNEVA

SEQ ID NO: 113371 - protein, 9 aa, Homo Sapiens
SRLHLLHED

SEQ ID NO: 113372 - protein, 9 aa, Homo Sapiens
FGGVYDTEK

SEQ ID NO: 113373 - protein, 9 aa, Homo Sapiens
PVFNWASMH

SEQ ID NO: 113374 - protein, 9 aa, Homo Sapiens
WGVSTGRRA

SEQ ID NO: 113375 - protein, 9 aa, Homo Sapiens
LFSLLIASA

SEQ ID NO: 113376 - protein, 9 aa, Homo Sapiens
GKVEFVFYY

SEQ ID NO: 113377 - protein, 9 aa, Homo Sapiens
FPLHLDTQV

SEQ ID NO: 113378 - protein, 9 aa, Homo Sapiens
RLLIDLDPE

SEQ ID NO: 113379 - protein, 9 aa, Homo Sapiens
ADCVDVDIP

SEQ ID NO: 113380 - protein, 9 aa, Homo Sapiens
LIRQVSTLD

SEQ ID NO: 113381 - protein, 9 aa, Homo Sapiens
TSKAASFQW

SEQ ID NO: 113382 - protein, 9 aa, Homo Sapiens
DERCRHQLE

SEQ ID NO: 113383 - protein, 9 aa, Homo Sapiens
ERHYFLEHL

SEQ ID NO: 113384 - protein, 9 aa, Homo Sapiens
SAVYIMDTV

SEQ ID NO: 113385 - protein, 9 aa, Homo Sapiens
MLQCAASDV

SEQ ID NO: 113386 - protein, 9 aa, Homo Sapiens
ADAFVGGFL

SEQ ID NO: 113387 - protein, 9 aa, Homo Sapiens
THRHIHSRT

SEQ ID NO: 113388 - protein, 9 aa, Homo Sapiens
DVVITNTCL

SEQ ID NO: 113389 - protein, 9 aa, Homo Sapiens
QECKPHTVS

SEQ ID NO: 113390 - protein, 9 aa, Homo Sapiens
AAYDPTKDD

SEQ ID NO: 113391 - protein, 9 aa, Homo Sapiens
MEEEEEDTD

SEQ ID NO: 113392 - protein, 9 aa, Homo Sapiens
VQQGYLGNF

SEQ ID NO: 113393 - protein, 9 aa, Homo Sapiens
HFMLHNSPG

SEQ ID NO: 113394 - protein, 9 aa, Homo Sapiens
ALSNSMTAG

SEQ ID NO: 113395 - protein, 9 aa, Homo Sapiens
QAHTGIHTD

SEQ ID NO: 113396 - protein, 9 aa, Homo Sapiens
NEVANFDLA

SEQ ID NO: 113397 - protein, 9 aa, Homo Sapiens
VGEWAIWKL

SEQ ID NO: 113398 - protein, 9 aa, Homo Sapiens
PLTLLEYSA

SEQ ID NO: 113399 - protein, 9 aa, Homo Sapiens
LGTHTVVVM

SEQ ID NO: 113400 - protein, 9 aa, Homo Sapiens
FDYNEQERY

SEQ ID NO: 113401 - protein, 9 aa, Homo Sapiens
THRHTQAYT

SEQ ID NO: 113402 - protein, 9 aa, Homo Sapiens
AIIIMLIVI

SEQ ID NO: 113403 - protein, 9 aa, Homo Sapiens
FQDMLPMPV

SEQ ID NO: 113404 - protein, 9 aa, Homo Sapiens
RLFGKKSCD

SEQ ID NO: 113405 - protein, 9 aa, Homo Sapiens
LSNSMTAGQ

SEQ ID NO: 113406 - protein, 9 aa, Homo Sapiens
WETYHMPDM

SEQ ID NO: 113407 - protein, 9 aa, Homo Sapiens
FRDRDRERD

SEQ ID NO: 113408 - protein, 9 aa, Homo Sapiens
LFPEGSPGD

SEQ ID NO: 113409 - protein, 9 aa, Homo Sapiens
LLLTVALIF

SEQ ID NO: 113410 - protein, 9 aa, Homo Sapiens
TKERTDEHK

SEQ ID NO: 113411 - protein, 9 aa, Homo Sapiens
SVQCEDGDR

SEQ ID NO: 113412 - protein, 9 aa, Homo Sapiens
LDTENIYEI

SEQ ID NO: 113413 - protein, 9 aa, Homo Sapiens
LPFLNCYCS

SEQ ID NO: 113414 - protein, 9 aa, Homo Sapiens
HRHTQAYTQ

SEQ ID NO: 113415 - protein, 9 aa, Homo Sapiens
NIYEILNNA

SEQ ID NO: 113416 - protein, 9 aa, Homo Sapiens
EFVFYYGPE

SEQ ID NO: 113417 - protein, 9 aa, Homo Sapiens
SYGYYEVTE

SEQ ID NO: 113418 - protein, 9 aa, Homo Sapiens
IDLDPEGAV

SEQ ID NO: 113419 - protein, 9 aa, Homo Sapiens
QANDQQDLL

SEQ ID NO: 113420 - protein, 9 aa, Homo Sapiens
ALFIGSKQF

SEQ ID NO: 113421 - protein, 9 aa, Homo Sapiens
YGKVEFVFY

SEQ ID NO: 113422 - protein, 9 aa, Homo Sapiens
NPYGGPEHF

SEQ ID NO: 113423 - protein, 9 aa, Homo Sapiens
LEWVNVLNK

SEQ ID NO: 113424 - protein, 9 aa, Homo Sapiens
PERVNKFGE

SEQ ID NO: 113425 - protein, 9 aa, Homo Sapiens
FYYGPEKIQ

SEQ ID NO: 113426 - protein, 9 aa, Homo Sapiens
EAPPHAHVA

SEQ ID NO: 113427 - protein, 9 aa, Homo Sapiens
NFFSFLPVF

SEQ ID NO: 113428 - protein, 9 aa, Homo Sapiens
TVSILELLK

SEQ ID NO: 113429 - protein, 9 aa, Homo Sapiens
MGGKEDNGY

SEQ ID NO: 113430 - protein, 9 aa, Homo Sapiens
DELIQQVVE

SEQ ID NO: 113431 - protein, 9 aa, Homo Sapiens
PWRSPSRGG

SEQ ID NO: 113432 - protein, 9 aa, Homo Sapiens
EASSKKAKK

SEQ ID NO: 113433 - protein, 9 aa, Homo Sapiens
GYYEVTELL

SEQ ID NO: 113434 - protein, 9 aa, Homo Sapiens
GADCVDVDI

SEQ ID NO: 113435 - protein, 9 aa, Homo Sapiens
HAYTRECLG

SEQ ID NO: 113436 - protein, 9 aa, Homo Sapiens
GTLGCAASS

SEQ ID NO: 113437 - protein, 9 aa, Homo Sapiens
IKIEVEAEE

SEQ ID NO: 113438 - protein, 9 aa, Homo Sapiens
YTQTHIQAQ

SEQ ID NO: 113439 - protein, 9 aa, Homo Sapiens
MYYNTVYGH

SEQ ID NO: 113440 - protein, 9 aa, Homo Sapiens
LLTVALIFL

SEQ ID NO: 113441 - protein, 9 aa, Homo Sapiens
DGIPNIIPQ

SEQ ID NO: 113442 - protein, 9 aa, Homo Sapiens
KVGEWAIWK

SEQ ID NO: 113443 - protein, 9 aa, Homo Sapiens
DKDLRDFRD

SEQ ID NO: 113444 - protein, 9 aa, Homo Sapiens
AADAFVGGF

SEQ ID NO: 113445 - protein, 9 aa, Homo Sapiens
LDAIKIEVE

SEQ ID NO: 113446 - protein, 9 aa, Homo Sapiens
HAPGEPRGI

SEQ ID NO: 113447 - protein, 9 aa, Homo Sapiens
DCFSRNDPI

SEQ ID NO: 113448 - protein, 9 aa, Homo Sapiens
LTAYSSLWR

SEQ ID NO: 113449 - protein, 9 aa, Homo Sapiens
GTHRHIHSR

SEQ ID NO: 113450 - protein, 9 aa, Homo Sapiens
GCAASSYSP

SEQ ID NO: 113451 - protein, 9 aa, Homo Sapiens
EDELIQQVV

SEQ ID NO: 113452 - protein, 9 aa, Homo Sapiens
LWFTGDNGQ

SEQ ID NO: 113453 - protein, 9 aa, Homo Sapiens
RRLLIDLDP

SEQ ID NO: 113454 - protein, 9 aa, Homo Sapiens
GGHAPGEPR

SEQ ID NO: 113455 - protein, 9 aa, Homo Sapiens
LELLSKSRN

SEQ ID NO: 113456 - protein, 9 aa, Homo Sapiens
LFSGCKGLF

SEQ ID NO: 113457 - protein, 9 aa, Homo Sapiens
ANDQQDLLE

SEQ ID NO: 113458 - protein, 9 aa, Homo Sapiens
YLGNFSDLH

SEQ ID NO: 113459 - protein, 9 aa, Homo Sapiens
PVGNLCIRS

SEQ ID NO: 113460 - protein, 9 aa, Homo Sapiens
LTYTGTHRH

SEQ ID NO: 113461 - protein, 9 aa, Homo Sapiens
GPHFDFSLE

SEQ ID NO: 113462 - protein, 9 aa, Homo Sapiens
QRRRMFWET

SEQ ID NO: 113463 - protein, 9 aa, Homo Sapiens
LHEDELIQQ

SEQ ID NO: 113464 - protein, 9 aa, Homo Sapiens
ELPTRRNTE

SEQ ID NO: 113465 - protein, 9 aa, Homo Sapiens
HCSTCYYDK

SEQ ID NO: 113466 - protein, 9 aa, Homo Sapiens
FSPVGNLCI

SEQ ID NO: 113467 - protein, 9 aa, Homo Sapiens
AASFQWGPE

SEQ ID NO: 113468 - protein, 9 aa, Homo Sapiens
GIHTDTHRN

SEQ ID NO: 113469 - protein, 9 aa, Homo Sapiens
GLLYELEKN

SEQ ID NO: 113470 - protein, 9 aa, Homo Sapiens
TRNVLLSSF

SEQ ID NO: 113471 - protein, 9 aa, Homo Sapiens
RMANRLFGK

SEQ ID NO: 113472 - protein, 9 aa, Homo Sapiens
IHSRTHAYT

SEQ ID NO: 113473 - protein, 9 aa, Homo Sapiens
HTHTHRHTG

SEQ ID NO: 113474 - protein, 9 aa, Homo Sapiens
NSSPLYHHS

SEQ ID NO: 113475 - protein, 9 aa, Homo Sapiens
CDQCARGFL

SEQ ID NO: 113476 - protein, 9 aa, Homo Sapiens
THTHRYTHR

SEQ ID NO: 113477 - protein, 9 aa, Homo Sapiens
PLPDNEMYY

SEQ ID NO: 113478 - protein, 9 aa, Homo Sapiens
TAWLEWWHV

SEQ ID NO: 113479 - protein, 9 aa, Homo Sapiens
HTHRHTGIH

SEQ ID NO: 113480 - protein, 9 aa, Homo Sapiens
DQQDLLEWV

SEQ ID NO: 113481 - protein, 9 aa, Homo Sapiens
THTHRHTGI

SEQ ID NO: 113482 - protein, 9 aa, Homo Sapiens
ASSKKAKKE

SEQ ID NO: 113483 - protein, 9 aa, Homo Sapiens
RHTHTHRHT

SEQ ID NO: 113484 - protein, 9 aa, Homo Sapiens
HSIMVPPTS

SEQ ID NO: 113485 - protein, 9 aa, Homo Sapiens
DTAAYLRLE

SEQ ID NO: 113486 - protein, 9 aa, Homo Sapiens
AAAYDPTKD

SEQ ID NO: 113487 - protein, 9 aa, Homo Sapiens
LDPEGAVAH

SEQ ID NO: 113488 - protein, 9 aa, Homo Sapiens
EHRRPVKDN

SEQ ID NO: 113489 - protein, 9 aa, Homo Sapiens
DCVDVDIPT

SEQ ID NO: 113490 - protein, 9 aa, Homo Sapiens
KGSMLQCAA

SEQ ID NO: 113491 - protein, 9 aa, Homo Sapiens
DMSDPNFCT

SEQ ID NO: 113492 - protein, 9 aa, Homo Sapiens
ILKVEFKTN

SEQ ID NO: 113493 - protein, 9 aa, Homo Sapiens
VVITNTCLD

SEQ ID NO: 113494 - protein, 9 aa, Homo Sapiens
NVLLSSFLS

SEQ ID NO: 113495 - protein, 9 aa, Homo Sapiens
RFLQMTLLL

SEQ ID NO: 113496 - protein, 9 aa, Homo Sapiens
NELPTRRNT

SEQ ID NO: 113497 - protein, 9 aa, Homo Sapiens
YYNTVYGHS

SEQ ID NO: 113498 - protein, 9 aa, Homo Sapiens
SLTAYSSLW

SEQ ID NO: 113499 - protein, 9 aa, Homo Sapiens
AVNALSNSM

SEQ ID NO: 113500 - protein, 9 aa, Homo Sapiens
MTAGQAVTV

SEQ ID NO: 113501 - protein, 9 aa, Homo Sapiens
IASAVYIMD

SEQ ID NO: 113502 - protein, 9 aa, Homo Sapiens
YTKERTDEH

SEQ ID NO: 113503 - protein, 9 aa, Homo Sapiens
ITLTYVNDN

SEQ ID NO: 113504 - protein, 9 aa, Homo Sapiens
NSMTAGQAV

SEQ ID NO: 113505 - protein, 9 aa, Homo Sapiens
PMKFFTQPK

SEQ ID NO: 113506 - protein, 9 aa, Homo Sapiens
DCNELPTRR

SEQ ID NO: 113507 - protein, 9 aa, Homo Sapiens
PGTLGCAAS

SEQ ID NO: 113508 - protein, 9 aa, Homo Sapiens
VEKAGLICL

SEQ ID NO: 113509 - protein, 9 aa, Homo Sapiens
YSDYMLRPP

SEQ ID NO: 113510 - protein, 9 aa, Homo Sapiens
RYLGADCVD

SEQ ID NO: 113511 - protein, 9 aa, Homo Sapiens
YSLTAYSSL

SEQ ID NO: 113512 - protein, 9 aa, Homo Sapiens
AEGVIYPDT

SEQ ID NO: 113513 - protein, 9 aa, Homo Sapiens
PVKDNFLHM

SEQ ID NO: 113514 - protein, 9 aa, Homo Sapiens
APPHAHVAF

SEQ ID NO: 113515 - protein, 9 aa, Homo Sapiens
LRHEDIHEQ

SEQ ID NO: 113516 - protein, 9 aa, Homo Sapiens
DTDTHSHRH

SEQ ID NO: 113517 - protein, 9 aa, Homo Sapiens
NQFAAAYFK

SEQ ID NO: 113518 - protein, 9 aa, Homo Sapiens
QPHSIMVPP

SEQ ID NO: 113519 - protein, 9 aa, Homo Sapiens
GNEVANFDL

SEQ ID NO: 113520 - protein, 9 aa, Homo Sapiens
TMEEVDIIR

SEQ ID NO: 113521 - protein, 9 aa, Homo Sapiens
NVIQDIETR

SEQ ID NO: 113522 - protein, 9 aa, Homo Sapiens
YGQPCGTQE

SEQ ID NO: 113523 - protein, 9 aa, Homo Sapiens
SRTHAYTRE

SEQ ID NO: 113524 - protein, 9 aa, Homo Sapiens
PEVEVTHQT

SEQ ID NO: 113525 - protein, 9 aa, Homo Sapiens
WFTGDNGQW

SEQ ID NO: 113526 - protein, 9 aa, Homo Sapiens
MPGKVGVWK

SEQ ID NO: 113527 - protein, 9 aa, Homo Sapiens
IIDTNGAAD

SEQ ID NO: 113528 - protein, 9 aa, Homo Sapiens
EDVVITNTC

SEQ ID NO: 113529 - protein, 9 aa, Homo Sapiens
LKTTTLASK

SEQ ID NO: 113530 - protein, 9 aa, Homo Sapiens
GLTAQAIII

SEQ ID NO: 113531 - protein, 9 aa, Homo Sapiens
KAGLICLVK

SEQ ID NO: 113532 - protein, 9 aa, Homo Sapiens
KIEVEAEER

SEQ ID NO: 113533 - protein, 9 aa, Homo Sapiens
RGGGGGPWR

SEQ ID NO: 113534 - protein, 9 aa, Homo Sapiens
PDTLTYGSV

SEQ ID NO: 113535 - protein, 9 aa, Homo Sapiens
EMPGKVGVW

SEQ ID NO: 113536 - protein, 9 aa, Homo Sapiens
QAIIIMLIV

SEQ ID NO: 113537 - protein, 9 aa, Homo Sapiens
IETRAFHGL

SEQ ID NO: 113538 - protein, 9 aa, Homo Sapiens
QLNKEEDVV

SEQ ID NO: 113539 - protein, 9 aa, Homo Sapiens
AAYFKELTM

SEQ ID NO: 113540 - protein, 9 aa, Homo Sapiens
VGCGGTNCE

SEQ ID NO: 113541 - protein, 9 aa, Homo Sapiens
HTQAYTQTH

SEQ ID NO: 113542 - protein, 9 aa, Homo Sapiens
PVSVQCEDG

SEQ ID NO: 113543 - protein, 9 aa, Homo Sapiens
AGYSLTAYS

SEQ ID NO: 113544 - protein, 9 aa, Homo Sapiens
TAIPGGLIC

SEQ ID NO: 113545 - protein, 9 aa, Homo Sapiens
HRHIHSRTH

SEQ ID NO: 113546 - protein, 9 aa, Homo Sapiens
MIERHYFLE

SEQ ID NO: 113547 - protein, 9 aa, Homo Sapiens
HTGIHTDTH

SEQ ID NO: 113548 - protein, 9 aa, Homo Sapiens
MELLQDVGN

SEQ ID NO: 113549 - protein, 9 aa, Homo Sapiens
DNGQWAQKC

SEQ ID NO: 113550 - protein, 9 aa, Homo Sapiens
DEVMPRLMK

SEQ ID NO: 113551 - protein, 9 aa, Homo Sapiens
TGIHTDTDT

SEQ ID NO: 113552 - protein, 9 aa, Homo Sapiens
VPLLTVIFV

SEQ ID NO: 113553 - protein, 9 aa, Homo Sapiens
GGKEDNGYL

SEQ ID NO: 113554 - protein, 9 aa, Homo Sapiens
DLDPEGAVA

SEQ ID NO: 113555 - protein, 9 aa, Homo Sapiens
IDTNGAADA

SEQ ID NO: 113556 - protein, 9 aa, Homo Sapiens
RLHLLHEDE

SEQ ID NO: 113557 - protein, 9 aa, Homo Sapiens
ISYQRRRMF

SEQ ID NO: 113558 - protein, 9 aa, Homo Sapiens
ARGFLGIFP

SEQ ID NO: 113559 - protein, 9 aa, Homo Sapiens
YTLTYTGTH

SEQ ID NO: 113560 - protein, 9 aa, Homo Sapiens
LYHHSQLMF

SEQ ID NO: 113561 - protein, 9 aa, Homo Sapiens
VRESYVQML

SEQ ID NO: 113562 - protein, 9 aa, Homo Sapiens
DTNGAADAF

SEQ ID NO: 113563 - protein, 9 aa, Homo Sapiens
VFYYGPEKI

SEQ ID NO: 113564 - protein, 9 aa, Homo Sapiens
SSKKAKKEA

SEQ ID NO: 113565 - protein, 9 aa, Homo Sapiens
GDNGQWAQK

SEQ ID NO: 113566 - protein, 9 aa, Homo Sapiens
TDTDTHSHR

SEQ ID NO: 113567 - protein, 9 aa, Homo Sapiens
QQLRVSEAQ

SEQ ID NO: 113568 - protein, 9 aa, Homo Sapiens
NPEQDSKLT

SEQ ID NO: 113569 - protein, 9 aa, Homo Sapiens
DYSAGYSLT

SEQ ID NO: 113570 - protein, 9 aa, Homo Sapiens
GLICLVKMK

SEQ ID NO: 113571 - protein, 9 aa, Homo Sapiens
VIYPDTLTY

SEQ ID NO: 113572 - protein, 9 aa, Homo Sapiens
GEWAIWKLG

SEQ ID NO: 113573 - protein, 9 aa, Homo Sapiens
AQVVDITEE

SEQ ID NO: 113574 - protein, 9 aa, Homo Sapiens
QEPAFHFAG

SEQ ID NO: 113575 - protein, 9 aa, Homo Sapiens
IHTDTDTHS

SEQ ID NO: 113576 - protein, 9 aa, Homo Sapiens
RHQLEYLGL

SEQ ID NO: 113577 - protein, 9 aa, Homo Sapiens
REMPGKVGV

SEQ ID NO: 113578 - protein, 9 aa, Homo Sapiens
NRLFGKKSC

SEQ ID NO: 113579 - protein, 9 aa, Homo Sapiens
KVRESYVQM

SEQ ID NO: 113580 - protein, 9 aa, Homo Sapiens
GPPAAAAYD

SEQ ID NO: 113581 - protein, 9 aa, Homo Sapiens
YDTASAERL

SEQ ID NO: 113582 - protein, 9 aa, Homo Sapiens
DFGGVYDTE

SEQ ID NO: 113583 - protein, 9 aa, Homo Sapiens
AAAYFKELT

SEQ ID NO: 113584 - protein, 9 aa, Homo Sapiens
SGCKGLFDD

SEQ ID NO: 113585 - protein, 9 aa, Homo Sapiens
PEGSPGDQW

SEQ ID NO: 113586 - protein, 9 aa, Homo Sapiens
EVEVTHQTL

SEQ ID NO: 113587 - protein, 9 aa, Homo Sapiens
QGYLGNFSD

SEQ ID NO: 113588 - protein, 9 aa, Homo Sapiens
KPGLEAPPH

SEQ ID NO: 113589 - protein, 9 aa, Homo Sapiens
SNPEQDSKL

SEQ ID NO: 113590 - protein, 9 aa, Homo Sapiens
PGKVGVWKV

SEQ ID NO: 113591 - protein, 9 aa, Homo Sapiens
HEDIHEQQD

SEQ ID NO: 113592 - protein, 9 aa, Homo Sapiens
MPVDPTQGT

SEQ ID NO: 113593 - protein, 9 aa, Homo Sapiens
IRQLLDFGG

SEQ ID NO: 113594 - protein, 9 aa, Homo Sapiens
HLLHEDELI

SEQ ID NO: 113595 - protein, 9 aa, Homo Sapiens
SLDTENIYE

SEQ ID NO: 113596 - protein, 9 aa, Homo Sapiens
VIQDIETRA

SEQ ID NO: 113597 - protein, 9 aa, Homo Sapiens
YYEVTELLL

SEQ ID NO: 113598 - protein, 9 aa, Homo Sapiens
YGGPEHFML

SEQ ID NO: 113599 - protein, 9 aa, Homo Sapiens
KVEFKTNRS

SEQ ID NO: 113600 - protein, 9 aa, Homo Sapiens
GYISYQRRR

SEQ ID NO: 113601 - protein, 9 aa, Homo Sapiens
SHTKGSMLQ

SEQ ID NO: 113602 - protein, 9 aa, Homo Sapiens
GYLLEKKIY

SEQ ID NO: 113603 - protein, 9 aa, Homo Sapiens
YLRLERDTR

SEQ ID NO: 113604 - protein, 9 aa, Homo Sapiens
RHEDIHEQQ

SEQ ID NO: 113605 - protein, 9 aa, Homo Sapiens
PLYHHSQLM

SEQ ID NO: 113606 - protein, 9 aa, Homo Sapiens
FQWGPEQEK

SEQ ID NO: 113607 - protein, 9 aa, Homo Sapiens
LLHEDELIQ

SEQ ID NO: 113608 - protein, 9 aa, Homo Sapiens
ENSNPEQDS

SEQ ID NO: 113609 - protein, 9 aa, Homo Sapiens
LNCYCSGHC

SEQ ID NO: 113610 - protein, 9 aa, Homo Sapiens
AAESEPALF

SEQ ID NO: 113611 - protein, 9 aa, Homo Sapiens
AYFKELTMY

SEQ ID NO: 113612 - protein, 9 aa, Homo Sapiens
CKPHTVSIL

SEQ ID NO: 113613 - protein, 9 aa, Homo Sapiens
ASAERLLSG

SEQ ID NO: 113614 - protein, 9 aa, Homo Sapiens
PLASMSSEE

SEQ ID NO: 113615 - protein, 9 aa, Homo Sapiens
EEGNEVANF

SEQ ID NO: 113616 - protein, 9 aa, Homo Sapiens
RQVSTLDGV

SEQ ID NO: 113617 - protein, 9 aa, Homo Sapiens
VVMGGKEDN

SEQ ID NO: 113618 - protein, 9 aa, Homo Sapiens
IQDIETRAF

SEQ ID NO: 113619 - protein, 9 aa, Homo Sapiens
YHHSQLMFP

SEQ ID NO: 113620 - protein, 9 aa, Homo Sapiens
AHTGIHTDT

SEQ ID NO: 113621 - protein, 9 aa, Homo Sapiens
PDEPIHGPH

SEQ ID NO: 113622 - protein, 9 aa, Homo Sapiens
IIRLQLKLQ

SEQ ID NO: 113623 - protein, 9 aa, Homo Sapiens
DFMNQRTRN

SEQ ID NO: 113624 - protein, 9 aa, Homo Sapiens
LKVEFKTNR

SEQ ID NO: 113625 - protein, 9 aa, Homo Sapiens
NSNPEQDSK

SEQ ID NO: 113626 - protein, 9 aa, Homo Sapiens
QQGYLGNFS

SEQ ID NO: 113627 - protein, 9 aa, Homo Sapiens
KFGEVFPQS

SEQ ID NO: 113628 - protein, 9 aa, Homo Sapiens
LVYKVPLAS

SEQ ID NO: 113629 - protein, 9 aa, Homo Sapiens
CSVGCGGTN

SEQ ID NO: 113630 - protein, 9 aa, Homo Sapiens
AYTRECLGT

SEQ ID NO: 113631 - protein, 9 aa, Homo Sapiens
VFNWASMHR

SEQ ID NO: 113632 - protein, 9 aa, Homo Sapiens
ITNIGFRDN

SEQ ID NO: 113633 - protein, 9 aa, Homo Sapiens
LLEWVNVLN

SEQ ID NO: 113634 - protein, 9 aa, Homo Sapiens
SHRHTHTHR

SEQ ID NO: 113635 - protein, 9 aa, Homo Sapiens
LEWWHVQPT

SEQ ID NO: 113636 - protein, 9 aa, Homo Sapiens
KLIRQVSTL

SEQ ID NO: 113637 - protein, 9 aa, Homo Sapiens
LPVFNWASM

SEQ ID NO: 113638 - protein, 9 aa, Homo Sapiens
EDNGYLLEK

SEQ ID NO: 113639 - protein, 9 aa, Homo Sapiens
GYSLTAYSS

SEQ ID NO: 113640 - protein, 9 aa, Homo Sapiens
THSHRHTHT

SEQ ID NO: 113641 - protein, 9 aa, Homo Sapiens
VNITLTYVN

SEQ ID NO: 113642 - protein, 9 aa, Homo Sapiens
PHSIMVPPT

SEQ ID NO: 113643 - protein, 9 aa, Homo Sapiens
VPLASMSSE

SEQ ID NO: 113644 - protein, 9 aa, Homo Sapiens
YLQVLDYDC

SEQ ID NO: 113645 - protein, 9 aa, Homo Sapiens
LSKSRNAHY

SEQ ID NO: 113646 - protein, 9 aa, Homo Sapiens
THQTLQRNR

SEQ ID NO: 113647 - protein, 9 aa, Homo Sapiens
KVEFVFYYG

SEQ ID NO: 113648 - protein, 9 aa, Homo Sapiens
TLLLTVALI

SEQ ID NO: 113649 - protein, 9 aa, Homo Sapiens
ECLGTHTVV

SEQ ID NO: 113650 - protein, 9 aa, Homo Sapiens
RSEPGTLGC

SEQ ID NO: 113651 - protein, 9 aa, Homo Sapiens
EEEEEGNEV

SEQ ID NO: 113652 - protein, 9 aa, Homo Sapiens
ETVTCEVVN

SEQ ID NO: 113653 - protein, 9 aa, Homo Sapiens
SKVRESYVQ

SEQ ID NO: 113654 - protein, 9 aa, Homo Sapiens
QERYDCKGG

SEQ ID NO: 113655 - protein, 9 aa, Homo Sapiens
QLLDFGGVY

SEQ ID NO: 113656 - protein, 9 aa, Homo Sapiens
KEEDVVITN

SEQ ID NO: 113657 - protein, 9 aa, Homo Sapiens
HNACSYGYY

SEQ ID NO: 113658 - protein, 9 aa, Homo Sapiens
FKTNRSGEP

SEQ ID NO: 113659 - protein, 9 aa, Homo Sapiens
TNIGFRDNW

SEQ ID NO: 113660 - protein, 9 aa, Homo Sapiens
PHAHVAFRP

SEQ ID NO: 113661 - protein, 9 aa, Homo Sapiens
GSGSGHSYS

SEQ ID NO: 113662 - protein, 9 aa, Homo Sapiens
VSILELLKL

SEQ ID NO: 113663 - protein, 9 aa, Homo Sapiens
LQMTLLLTV

SEQ ID NO: 113664 - protein, 9 aa, Homo Sapiens
RDFRDRDRE

SEQ ID NO: 113665 - protein, 9 aa, Homo Sapiens
AESEPALFI

SEQ ID NO: 113666 - protein, 9 aa, Homo Sapiens
EYSARTILH

SEQ ID NO: 113667 - protein, 9 aa, Homo Sapiens
ELEKNTDKA

SEQ ID NO: 113668 - protein, 9 aa, Homo Sapiens
EKNTDKAVE

SEQ ID NO: 113669 - protein, 9 aa, Homo Sapiens
MKFFTQPKK

SEQ ID NO: 113670 - protein, 9 aa, Homo Sapiens
EQLIEKNMK

SEQ ID NO: 113671 - protein, 9 aa, Homo Sapiens
KRGEDGDGE

SEQ ID NO: 113672 - protein, 9 aa, Homo Sapiens
LLDAIKIEV

SEQ ID NO: 113673 - protein, 9 aa, Homo Sapiens
MHRHTHTQA

SEQ ID NO: 113674 - protein, 9 aa, Homo Sapiens
HHVLFPLHL

SEQ ID NO: 113675 - protein, 9 aa, Homo Sapiens
NFCTVLSNF

SEQ ID NO: 113676 - protein, 9 aa, Homo Sapiens
QDSKLTSEE

SEQ ID NO: 113677 - protein, 9 aa, Homo Sapiens
KETVTCEVV

SEQ ID NO: 113678 - protein, 9 aa, Homo Sapiens
FLNCYCSGH

SEQ ID NO: 113679 - protein, 9 aa, Homo Sapiens
DDERCRHQL

SEQ ID NO: 113680 - protein, 9 aa, Homo Sapiens
YFLEHLLKN

SEQ ID NO: 113681 - protein, 9 aa, Homo Sapiens
LLSKSRNAH

SEQ ID NO: 113682 - protein, 9 aa, Homo Sapiens
YPDTLTYGS

SEQ ID NO: 113683 - protein, 9 aa, Homo Sapiens
RESYVQMLD

SEQ ID NO: 113684 - protein, 9 aa, Homo Sapiens
HHRYLGADC

SEQ ID NO: 113685 - protein, 9 aa, Homo Sapiens
SLFSLLIAS

SEQ ID NO: 113686 - protein, 9 aa, Homo Sapiens
RLLSGTPIS

SEQ ID NO: 113687 - protein, 9 aa, Homo Sapiens
PRSGGMLFY

SEQ ID NO: 113688 - protein, 9 aa, Homo Sapiens
TSITNIGFR

SEQ ID NO: 113689 - protein, 9 aa, Homo Sapiens
VYKVPLASM

SEQ ID NO: 113690 - protein, 9 aa, Homo Sapiens
HVLFPLHLD

SEQ ID NO: 113691 - protein, 9 aa, Homo Sapiens
TRAFHGLRG

SEQ ID NO: 113692 - protein, 9 aa, Homo Sapiens
VMGGKEDNG

SEQ ID NO: 113693 - protein, 9 aa, Homo Sapiens
TLPLEPNLV

SEQ ID NO: 113694 - protein, 9 aa, Homo Sapiens
IEESSRGQS

SEQ ID NO: 113695 - protein, 9 aa, Homo Sapiens
YVNDNPPRF

SEQ ID NO: 113696 - protein, 9 aa, Homo Sapiens
WNAQVVDIT

SEQ ID NO: 113697 - protein, 9 aa, Homo Sapiens
PPSHTKGSM

SEQ ID NO: 113698 - protein, 9 aa, Homo Sapiens
GSIVGGHAP

SEQ ID NO: 113699 - protein, 9 aa, Homo Sapiens
HSQQLFPEG

SEQ ID NO: 113700 - protein, 9 aa, Homo Sapiens
GSRGGAEDK

SEQ ID NO: 113701 - protein, 9 aa, Homo Sapiens
LEHLLKNFD

SEQ ID NO: 113702 - protein, 9 aa, Homo Sapiens
KNTDKAVEC

SEQ ID NO: 113703 - protein, 9 aa, Homo Sapiens
CNELPTRRN

SEQ ID NO: 113704 - protein, 9 aa, Homo Sapiens
IMVPPTSPN

SEQ ID NO: 113705 - protein, 9 aa, Homo Sapiens
TGMHRHTHT

SEQ ID NO: 113706 - protein, 9 aa, Homo Sapiens
AKHQIIHTG

SEQ ID NO: 113707 - protein, 9 aa, Homo Sapiens
DAIKIEVEA

SEQ ID NO: 113708 - protein, 9 aa, Homo Sapiens
SMTAGQAVT

SEQ ID NO: 113709 - protein, 9 aa, Homo Sapiens
CSTCYYDKS

SEQ ID NO: 113710 - protein, 9 aa, Homo Sapiens
YISYQRRRM

SEQ ID NO: 113711 - protein, 9 aa, Homo Sapiens
YHMPDMELL

SEQ ID NO: 113712 - protein, 9 aa, Homo Sapiens
ETRAFHGLR

SEQ ID NO: 113713 - protein, 9 aa, Homo Sapiens
FVFYYGPEK

SEQ ID NO: 113714 - protein, 9 aa, Homo Sapiens
KTNRSGEPF

SEQ ID NO: 113715 - protein, 9 aa, Homo Sapiens
HIQAQTGTH

SEQ ID NO: 113716 - protein, 9 aa, Homo Sapiens
PALFIGSKQ

SEQ ID NO: 113717 - protein, 9 aa, Homo Sapiens
WGSLWGVST

SEQ ID NO: 113718 - protein, 9 aa, Homo Sapiens
VDEVMPRLM

SEQ ID NO: 113719 - protein, 9 aa, Homo Sapiens
RHSQQLFPE

SEQ ID NO: 113720 - protein, 9 aa, Homo Sapiens
YDPTKDDKG

SEQ ID NO: 113721 - protein, 9 aa, Homo Sapiens
LEAPPHAHV

SEQ ID NO: 113722 - protein, 9 aa, Homo Sapiens
SLRDTAAYL

SEQ ID NO: 113723 - protein, 9 aa, Homo Sapiens
SFLPVFNWA

SEQ ID NO: 113724 - protein, 9 aa, Homo Sapiens
PKKDFCNDK

SEQ ID NO: 113725 - protein, 9 aa, Homo Sapiens
PLEPNLVPG

SEQ ID NO: 113726 - protein, 9 aa, Homo Sapiens
CSYGYYEVT

SEQ ID NO: 113727 - protein, 9 aa, Homo Sapiens
LFIGSKQFG

SEQ ID NO: 113728 - protein, 9 aa, Homo Sapiens
VVIPERVNK

SEQ ID NO: 113729 - protein, 9 aa, Homo Sapiens
TLTYGSVRL

SEQ ID NO: 113730 - protein, 9 aa, Homo Sapiens
YNEQERYDC

SEQ ID NO: 113731 - protein, 9 aa, Homo Sapiens
TRRNTEILT

SEQ ID NO: 113732 - protein, 9 aa, Homo Sapiens
NGQWAQKCE

SEQ ID NO: 113733 - protein, 9 aa, Homo Sapiens
KKSCDFLSS

SEQ ID NO: 113734 - protein, 9 aa, Homo Sapiens
RAGGTQSWL

SEQ ID NO: 113735 - protein, 9 aa, Homo Sapiens
TQTHIQAQT

SEQ ID NO: 113736 - protein, 9 aa, Homo Sapiens
PREMPGKVG

SEQ ID NO: 113737 - protein, 9 aa, Homo Sapiens
IIPQAARMT

SEQ ID NO: 113738 - protein, 9 aa, Homo Sapiens
RRAGGTQSW

SEQ ID NO: 113739 - protein, 9 aa, Homo Sapiens
ILRHEDIHE

SEQ ID NO: 113740 - protein, 9 aa, Homo Sapiens
KRWNAQVVD

SEQ ID NO: 113741 - protein, 9 aa, Homo Sapiens
FKELTMYRG

SEQ ID NO: 113742 - protein, 9 aa, Homo Sapiens
QVVDITEEL

SEQ ID NO: 113743 - protein, 9 aa, Homo Sapiens
LFGKKSCDF

SEQ ID NO: 113744 - protein, 9 aa, Homo Sapiens
SGYISYQRR

SEQ ID NO: 113745 - protein, 9 aa, Homo Sapiens
EHFMLHNSP

SEQ ID NO: 113746 - protein, 9 aa, Homo Sapiens
SRGGAEDKR

SEQ ID NO: 113747 - protein, 9 aa, Homo Sapiens
QSSTSRTLW

SEQ ID NO: 113748 - protein, 9 aa, Homo Sapiens
QLIEKNMKL

SEQ ID NO: 113749 - protein, 9 aa, Homo Sapiens
LWVSWGSLW

SEQ ID NO: 113750 - protein, 9 aa, Homo Sapiens
HMPDMELLQ

SEQ ID NO: 113751 - protein, 9 aa, Homo Sapiens
TTLASKVTT

SEQ ID NO: 113752 - protein, 9 aa, Homo Sapiens
TLKTTTLAS

SEQ ID NO: 113753 - protein, 9 aa, Homo Sapiens
ELLSKVRES

SEQ ID NO: 113754 - protein, 9 aa, Homo Sapiens
ECHCSVGCG

SEQ ID NO: 113755 - protein, 9 aa, Homo Sapiens
TQSWLWFAT

SEQ ID NO: 113756 - protein, 9 aa, Homo Sapiens
SGSGHSYSY

SEQ ID NO: 113757 - protein, 9 aa, Homo Sapiens
SGLTAQAII

SEQ ID NO: 113758 - protein, 9 aa, Homo Sapiens
WWHVQPTLD

SEQ ID NO: 113759 - protein, 9 aa, Homo Sapiens
MPDMELLQD

SEQ ID NO: 113760 - protein, 9 aa, Homo Sapiens
HQQLRVSEA

SEQ ID NO: 113761 - protein, 9 aa, Homo Sapiens
VDITEELAT

SEQ ID NO: 113762 - protein, 9 aa, Homo Sapiens
GTHTVVVMG

SEQ ID NO: 113763 - protein, 9 aa, Homo Sapiens
EMYYNTVYG

SEQ ID NO: 113764 - protein, 9 aa, Homo Sapiens
LLIDLDPEG

SEQ ID NO: 113765 - protein, 9 aa, Homo Sapiens
QAYTQTHIQ

SEQ ID NO: 113766 - protein, 9 aa, Homo Sapiens
LYELEKNTD

SEQ ID NO: 113767 - protein, 9 aa, Homo Sapiens
LQLNKEEDV

SEQ ID NO: 113768 - protein, 9 aa, Homo Sapiens
IPGGLICSL

SEQ ID NO: 113769 - protein, 9 aa, Homo Sapiens
RNVLLSSFL

SEQ ID NO: 113770 - protein, 9 aa, Homo Sapiens
IRSILGTPL

SEQ ID NO: 113771 - protein, 9 aa, Homo Sapiens
GFLGIFPAC

SEQ ID NO: 113772 - protein, 9 aa, Homo Sapiens
DEHKDLRKA

SEQ ID NO: 113773 - protein, 9 aa, Homo Sapiens
TLGCAASSY

SEQ ID NO: 113774 - protein, 9 aa, Homo Sapiens
WVSWGSLWG

SEQ ID NO: 113775 - protein, 9 aa, Homo Sapiens
RPVKDNFLH

SEQ ID NO: 113776 - protein, 9 aa, Homo Sapiens
ERCRHQLEY

SEQ ID NO: 113777 - protein, 9 aa, Homo Sapiens
SQDHHVLFP

SEQ ID NO: 113778 - protein, 9 aa, Homo Sapiens
KAKKEAKLA

SEQ ID NO: 113779 - protein, 9 aa, Homo Sapiens
FMNQRTRNV

SEQ ID NO: 113780 - protein, 9 aa, Homo Sapiens
SSLAKHQII

SEQ ID NO: 113781 - protein, 9 aa, Homo Sapiens
MTLLLTVAL

SEQ ID NO: 113782 - protein, 9 aa, Homo Sapiens
LISVQQGYL

SEQ ID NO: 113783 - protein, 9 aa, Homo Sapiens
DYNEQERYD

SEQ ID NO: 113784 - protein, 9 aa, Homo Sapiens
CLVYKVPLA

SEQ ID NO: 113785 - protein, 9 aa, Homo Sapiens
IEVEAEERG

SEQ ID NO: 113786 - protein, 9 aa, Homo Sapiens
LGADCVDVD

SEQ ID NO: 113787 - protein, 9 aa, Homo Sapiens
QQDLLEWVN

SEQ ID NO: 113788 - protein, 9 aa, Homo Sapiens
IGFRDNWVF

SEQ ID NO: 113789 - protein, 9 aa, Homo Sapiens
QWGPEQEKA

SEQ ID NO: 113790 - protein, 9 aa, Homo Sapiens
LLSKVRESY

SEQ ID NO: 113791 - protein, 9 aa, Homo Sapiens
SLAKHQIIH

SEQ ID NO: 113792 - protein, 9 aa, Homo Sapiens
THAYTRECL

SEQ ID NO: 113793 - protein, 9 aa, Homo Sapiens
FVSYLIAHG

SEQ ID NO: 113794 - protein, 9 aa, Homo Sapiens
SYQRRRMFW

SEQ ID NO: 113795 - protein, 9 aa, Homo Sapiens
RKVTAIPGG

SEQ ID NO: 113796 - protein, 9 aa, Homo Sapiens
LEKNTDKAV

SEQ ID NO: 113797 - protein, 9 aa, Homo Sapiens
SVGCGGTNC

SEQ ID NO: 113798 - protein, 9 aa, Homo Sapiens
GLEAPPHAH

SEQ ID NO: 113799 - protein, 9 aa, Homo Sapiens
FLELLSKSR

SEQ ID NO: 113800 - protein, 9 aa, Homo Sapiens
DQCARGFLG

SEQ ID NO: 113801 - protein, 9 aa, Homo Sapiens
NMKLAQKRE

SEQ ID NO: 113802 - protein, 9 aa, Homo Sapiens
DYDCFSRND

SEQ ID NO: 113803 - protein, 9 aa, Homo Sapiens
LHNACSYGY

SEQ ID NO: 113804 - protein, 9 aa, Homo Sapiens
ILSGYISYQ

SEQ ID NO: 113805 - protein, 9 aa, Homo Sapiens
RAFHGLRGL

SEQ ID NO: 113806 - protein, 9 aa, Homo Sapiens
WLEWWHVQP

SEQ ID NO: 113807 - protein, 9 aa, Homo Sapiens
LICLVKMKF

SEQ ID NO: 113808 - protein, 9 aa, Homo Sapiens
RRRAGGTQS

SEQ ID NO: 113809 - protein, 9 aa, Homo Sapiens
PNIIPQAAR

SEQ ID NO: 113810 - protein, 9 aa, Homo Sapiens
NALSNSMTA

SEQ ID NO: 113811 - protein, 9 aa, Homo Sapiens
ESSRGQSST

SEQ ID NO: 113812 - protein, 9 aa, Homo Sapiens
GYVDEVMPR

SEQ ID NO: 113813 - protein, 9 aa, Homo Sapiens
METKETVTC

SEQ ID NO: 113814 - protein, 9 aa, Homo Sapiens
FSEEICSES

SEQ ID NO: 113815 - protein, 9 aa, Homo Sapiens
PDNEMYYNT

SEQ ID NO: 113816 - protein, 9 aa, Homo Sapiens
LSKVRESYV

SEQ ID NO: 113817 - protein, 9 aa, Homo Sapiens
KKEAKLAAP

SEQ ID NO: 113818 - protein, 9 aa, Homo Sapiens
ESYVQMLDQ

SEQ ID NO: 113819 - protein, 9 aa, Homo Sapiens
SHQQLRVSE

SEQ ID NO: 113820 - protein, 9 aa, Homo Sapiens
TLTYTGTHR

SEQ ID NO: 113821 - protein, 9 aa, Homo Sapiens
YDCFSRNDP

SEQ ID NO: 113822 - protein, 9 aa, Homo Sapiens
GQWAQKCEL

SEQ ID NO: 113823 - protein, 9 aa, Homo Sapiens
ETFPVSVQC

SEQ ID NO: 113824 - protein, 9 aa, Homo Sapiens
KNMKLAQKR

SEQ ID NO: 113825 - protein, 9 aa, Homo Sapiens
PAAAAYDPT

SEQ ID NO: 113826 - protein, 9 aa, Homo Sapiens
HRHTHTHRY

SEQ ID NO: 113827 - protein, 9 aa, Homo Sapiens
APGEPRGIK

SEQ ID NO: 113828 - protein, 9 aa, Homo Sapiens
RHTGMHRHT

SEQ ID NO: 113829 - protein, 9 aa, Homo Sapiens
IPERVNKFG

SEQ ID NO: 113830 - protein, 9 aa, Homo Sapiens
CVDVDIPTD

SEQ ID NO: 113831 - protein, 9 aa, Homo Sapiens
FSFLPVFNW

SEQ ID NO: 113832 - protein, 9 aa, Homo Sapiens
EVANFDLAV

SEQ ID NO: 113833 - protein, 9 aa, Homo Sapiens
WKLGLVKYG

SEQ ID NO: 113834 - protein, 9 aa, Homo Sapiens
HRHTHTHRH

SEQ ID NO: 113835 - protein, 9 aa, Homo Sapiens
FTGDNGQWA

SEQ ID NO: 113836 - protein, 9 aa, Homo Sapiens
EDTLPFLNC

SEQ ID NO: 113837 - protein, 9 aa, Homo Sapiens
KKDFCNDKS

SEQ ID NO: 113838 - protein, 9 aa, Homo Sapiens
RTRNVLLSS

SEQ ID NO: 113839 - protein, 9 aa, Homo Sapiens
THIQAQTGT

SEQ ID NO: 113840 - protein, 9 aa, Homo Sapiens
LEYSARTIL

SEQ ID NO: 113841 - protein, 9 aa, Homo Sapiens
FSLLIASAV

SEQ ID NO: 113842 - protein, 9 aa, Homo Sapiens
FNWASMHRT

SEQ ID NO: 113843 - protein, 9 aa, Homo Sapiens
KELTMYRGN

SEQ ID NO: 113844 - protein, 9 aa, Homo Sapiens
HIHSRTHAY

SEQ ID NO: 113845 - protein, 9 aa, Homo Sapiens
TAQAIIIML

SEQ ID NO: 113846 - protein, 9 aa, Homo Sapiens
TLASKVTTT

SEQ ID NO: 113847 - protein, 9 aa, Homo Sapiens
RGGAEDKRG

SEQ ID NO: 113848 - protein, 9 aa, Homo Sapiens
QDMLPMPVD

SEQ ID NO: 113849 - protein, 9 aa, Homo Sapiens
FAAAYFKEL

SEQ ID NO: 113850 - protein, 9 aa, Homo Sapiens
TGTHRHIHS

SEQ ID NO: 113851 - protein, 9 aa, Homo Sapiens
ERVNKFGEV

SEQ ID NO: 113852 - protein, 9 aa, Homo Sapiens
PPHAHVAFR

SEQ ID NO: 113853 - protein, 9 aa, Homo Sapiens
DLRDFRDRD

SEQ ID NO: 113854 - protein, 9 aa, Homo Sapiens
SMLQCAASD

SEQ ID NO: 113855 - protein, 9 aa, Homo Sapiens
IYPDTLTYG

SEQ ID NO: 113856 - protein, 9 aa, Homo Sapiens
YIFCFLFCT

SEQ ID NO: 113857 - protein, 9 aa, Homo Sapiens
QDLLEWVNV

SEQ ID NO: 113858 - protein, 9 aa, Homo Sapiens
SAGYSLTAY

SEQ ID NO: 113859 - protein, 9 aa, Homo Sapiens
DITEELATL

SEQ ID NO: 113860 - protein, 9 aa, Homo Sapiens
HTKGSMLQC

SEQ ID NO: 113861 - protein, 9 aa, Homo Sapiens
ERTDEHKDL

SEQ ID NO: 113862 - protein, 9 aa, Homo Sapiens
DFRDRDRER

SEQ ID NO: 113863 - protein, 9 aa, Homo Sapiens
YVDEVMPRL

SEQ ID NO: 113864 - protein, 9 aa, Homo Sapiens
PIHGPHFDF

SEQ ID NO: 113865 - protein, 9 aa, Homo Sapiens
QCEDGDRFP

SEQ ID NO: 113866 - protein, 9 aa, Homo Sapiens
SSRGQSSTS

SEQ ID NO: 113867 - protein, 9 aa, Homo Sapiens
TYVNDNPPR

SEQ ID NO: 113868 - protein, 9 aa, Homo Sapiens
FPVSVQCED

SEQ ID NO: 113869 - protein, 9 aa, Homo Sapiens
RGFLGIFPA

SEQ ID NO: 113870 - protein, 9 aa, Homo Sapiens
GKEDNGYLL

SEQ ID NO: 113871 - protein, 9 aa, Homo Sapiens
CSESCALLP

SEQ ID NO: 113872 - protein, 9 aa, Homo Sapiens
HFAGDACLQ

SEQ ID NO: 113873 - protein, 9 aa, Homo Sapiens
AGGTQSWLW

SEQ ID NO: 113874 - protein, 9 aa, Homo Sapiens
LPMPVDPTQ

SEQ ID NO: 113875 - protein, 9 aa, Homo Sapiens
HTHRYTHRH

SEQ ID NO: 113876 - protein, 9 aa, Homo Sapiens
HGPHFDFSL

SEQ ID NO: 113877 - protein, 9 aa, Homo Sapiens
VVVMGGKED

SEQ ID NO: 113878 - protein, 9 aa, Homo Sapiens
LCLSQSEGH

SEQ ID NO: 113879 - protein, 9 aa, Homo Sapiens
TSFQLPSLR

SEQ ID NO: 113880 - protein, 9 aa, Homo Sapiens
LDVPQQRPS

SEQ ID NO: 113881 - protein, 9 aa, Homo Sapiens
IISIENCPL

SEQ ID NO: 113882 - protein, 9 aa, Homo Sapiens
LKDKVAHCQ

SEQ ID NO: 113883 - protein, 9 aa, Homo Sapiens
TKLSNPAYT

SEQ ID NO: 113884 - protein, 9 aa, Homo Sapiens
LSCIPQAGM

SEQ ID NO: 113885 - protein, 9 aa, Homo Sapiens
SRNVTMNES

SEQ ID NO: 113886 - protein, 9 aa, Homo Sapiens
QDKEEQTPL

SEQ ID NO: 113887 - protein, 9 aa, Homo Sapiens
ILPTLRSVL

SEQ ID NO: 113888 - protein, 9 aa, Homo Sapiens
ILEVRSCLK

SEQ ID NO: 113889 - protein, 9 aa, Homo Sapiens
AAWLHGARG

SEQ ID NO: 113890 - protein, 9 aa, Homo Sapiens
PWPEAQCLT

SEQ ID NO: 113891 - protein, 9 aa, Homo Sapiens
TASYLRGRP

SEQ ID NO: 113892 - protein, 9 aa, Homo Sapiens
SDAGRKRGL

SEQ ID NO: 113893 - protein, 9 aa, Homo Sapiens
IIGMMLDRK

SEQ ID NO: 113894 - protein, 9 aa, Homo Sapiens
LGCLAISNT

SEQ ID NO: 113895 - protein, 9 aa, Homo Sapiens
NYATDVDIV

SEQ ID NO: 113896 - protein, 9 aa, Homo Sapiens
INKIQPCLS

SEQ ID NO: 113897 - protein, 9 aa, Homo Sapiens
LQEVFQAER

SEQ ID NO: 113898 - protein, 9 aa, Homo Sapiens
ELCMVGVRK

SEQ ID NO: 113899 - protein, 9 aa, Homo Sapiens
KDKVAHCQS

SEQ ID NO: 113900 - protein, 9 aa, Homo Sapiens
IFCYQEDSN

SEQ ID NO: 113901 - protein, 9 aa, Homo Sapiens
RPCPSLRTA

SEQ ID NO: 113902 - protein, 9 aa, Homo Sapiens
VDRQVAKGM

SEQ ID NO: 113903 - protein, 9 aa, Homo Sapiens
ASSRSASKP

SEQ ID NO: 113904 - protein, 9 aa, Homo Sapiens
LCPPTKFQC

SEQ ID NO: 113905 - protein, 9 aa, Homo Sapiens
DEQQTQLNH

SEQ ID NO: 113906 - protein, 9 aa, Homo Sapiens
KRGLGTPAP

SEQ ID NO: 113907 - protein, 9 aa, Homo Sapiens
VMQSFLKII

SEQ ID NO: 113908 - protein, 9 aa, Homo Sapiens
QCMRKQPKQ

SEQ ID NO: 113909 - protein, 9 aa, Homo Sapiens
LDGDPQRKE

SEQ ID NO: 113910 - protein, 9 aa, Homo Sapiens
VSNHLCCQV

SEQ ID NO: 113911 - protein, 9 aa, Homo Sapiens
GHVLLCRKP

SEQ ID NO: 113912 - protein, 9 aa, Homo Sapiens
TNYATDVDI

SEQ ID NO: 113913 - protein, 9 aa, Homo Sapiens
TTNNSSEQH

SEQ ID NO: 113914 - protein, 9 aa, Homo Sapiens
FRKMEEKCE

SEQ ID NO: 113915 - protein, 9 aa, Homo Sapiens
LASSLNLDV

SEQ ID NO: 113916 - protein, 9 aa, Homo Sapiens
NETPKKKKE

SEQ ID NO: 113917 - protein, 9 aa, Homo Sapiens
MGQVPKKDN

SEQ ID NO: 113918 - protein, 9 aa, Homo Sapiens
QNQLNFSSY

SEQ ID NO: 113919 - protein, 9 aa, Homo Sapiens
LSPSSLPRS

SEQ ID NO: 113920 - protein, 9 aa, Homo Sapiens
DRQVAKGMF

SEQ ID NO: 113921 - protein, 9 aa, Homo Sapiens
CNFPHRPDS

SEQ ID NO: 113922 - protein, 9 aa, Homo Sapiens
SPSSLPRSM

SEQ ID NO: 113923 - protein, 9 aa, Homo Sapiens
VLNNVIFCY

SEQ ID NO: 113924 - protein, 9 aa, Homo Sapiens
LSIISIENC

SEQ ID NO: 113925 - protein, 9 aa, Homo Sapiens
CPSLRTASS

SEQ ID NO: 113926 - protein, 9 aa, Homo Sapiens
LYELDGDPQ

SEQ ID NO: 113927 - protein, 9 aa, Homo Sapiens
AHSQNQLNF

SEQ ID NO: 113928 - protein, 9 aa, Homo Sapiens
FHAPFQADH

SEQ ID NO: 113929 - protein, 9 aa, Homo Sapiens
DTLSCIPQA

SEQ ID NO: 113930 - protein, 9 aa, Homo Sapiens
PPPGPGLSL

SEQ ID NO: 113931 - protein, 9 aa, Homo Sapiens
LNNVIFCYQ

SEQ ID NO: 113932 - protein, 9 aa, Homo Sapiens
AGPWPEAQC

SEQ ID NO: 113933 - protein, 9 aa, Homo Sapiens
PRRADLGRR

SEQ ID NO: 113934 - protein, 9 aa, Homo Sapiens
TDVDIVFED

SEQ ID NO: 113935 - protein, 9 aa, Homo Sapiens
LLQEEQEGG

SEQ ID NO: 113936 - protein, 9 aa, Homo Sapiens
AITYSSHLK

SEQ ID NO: 113937 - protein, 9 aa, Homo Sapiens
PKEYAGADD

SEQ ID NO: 113938 - protein, 9 aa, Homo Sapiens
LPRMQARMH

SEQ ID NO: 113939 - protein, 9 aa, Homo Sapiens
NLELGDISL

SEQ ID NO: 113940 - protein, 9 aa, Homo Sapiens
CPQRKCYPL

SEQ ID NO: 113941 - protein, 9 aa, Homo Sapiens
HCRAGFGGW

SEQ ID NO: 113942 - protein, 9 aa, Homo Sapiens
DHQSTLSFK

SEQ ID NO: 113943 - protein, 9 aa, Homo Sapiens
LNRGLKKKK

SEQ ID NO: 113944 - protein, 9 aa, Homo Sapiens
CYQEDSNWP

SEQ ID NO: 113945 - protein, 9 aa, Homo Sapiens
TNNSSEQHV

SEQ ID NO: 113946 - protein, 9 aa, Homo Sapiens
LSDKEDQKP

SEQ ID NO: 113947 - protein, 9 aa, Homo Sapiens
ESSAEKFRK

SEQ ID NO: 113948 - protein, 9 aa, Homo Sapiens
INDNAPKFV

SEQ ID NO: 113949 - protein, 9 aa, Homo Sapiens
FKYSQEFFD

SEQ ID NO: 113950 - protein, 9 aa, Homo Sapiens
QKQILEVRS

SEQ ID NO: 113951 - protein, 9 aa, Homo Sapiens
DKKIQFDRA

SEQ ID NO: 113952 - protein, 9 aa, Homo Sapiens
GVDRQVAKG

SEQ ID NO: 113953 - protein, 9 aa, Homo Sapiens
WTCSECQEL

SEQ ID NO: 113954 - protein, 9 aa, Homo Sapiens
QRNNKNREN

SEQ ID NO: 113955 - protein, 9 aa, Homo Sapiens
VDIVFEDFA

SEQ ID NO: 113956 - protein, 9 aa, Homo Sapiens
FPHRPDSGD

SEQ ID NO: 113957 - protein, 9 aa, Homo Sapiens
ALQLQGDNA

SEQ ID NO: 113958 - protein, 9 aa, Homo Sapiens
ARRICGERA

SEQ ID NO: 113959 - protein, 9 aa, Homo Sapiens
ADWCLYEIY

SEQ ID NO: 113960 - protein, 9 aa, Homo Sapiens
LPHFWQLRF

SEQ ID NO: 113961 - protein, 9 aa, Homo Sapiens
AGPSSGLCP

SEQ ID NO: 113962 - protein, 9 aa, Homo Sapiens
DGLSDKEDQ

SEQ ID NO: 113963 - protein, 9 aa, Homo Sapiens
ISQAFSQRV

SEQ ID NO: 113964 - protein, 9 aa, Homo Sapiens
GSSGRPCPS

SEQ ID NO: 113965 - protein, 9 aa, Homo Sapiens
SIISIENCP

SEQ ID NO: 113966 - protein, 9 aa, Homo Sapiens
SQNQLNFSS

SEQ ID NO: 113967 - protein, 9 aa, Homo Sapiens
TKDCPQRKC

SEQ ID NO: 113968 - protein, 9 aa, Homo Sapiens
SQSEGHVLL

SEQ ID NO: 113969 - protein, 9 aa, Homo Sapiens
EYVSLFKYQ

SEQ ID NO: 113970 - protein, 9 aa, Homo Sapiens
TLSKLLEKS

SEQ ID NO: 113971 - protein, 9 aa, Homo Sapiens
SMWFHAPFQ

SEQ ID NO: 113972 - protein, 9 aa, Homo Sapiens
LREERNQNE

SEQ ID NO: 113973 - protein, 9 aa, Homo Sapiens
SQAFSQRVG

SEQ ID NO: 113974 - protein, 9 aa, Homo Sapiens
TSERQKMGQ

SEQ ID NO: 113975 - protein, 9 aa, Homo Sapiens
SDKEDQKPV

SEQ ID NO: 113976 - protein, 9 aa, Homo Sapiens
FQLPSLRST

SEQ ID NO: 113977 - protein, 9 aa, Homo Sapiens
RPCRHSTEG

SEQ ID NO: 113978 - protein, 9 aa, Homo Sapiens
QSEGHVLLC

SEQ ID NO: 113979 - protein, 9 aa, Homo Sapiens
YQMLCDMAR

SEQ ID NO: 113980 - protein, 9 aa, Homo Sapiens
DIQLARRIC

SEQ ID NO: 113981 - protein, 9 aa, Homo Sapiens
QILEVRSCL

SEQ ID NO: 113982 - protein, 9 aa, Homo Sapiens
KCSGYVMSG

SEQ ID NO: 113983 - protein, 9 aa, Homo Sapiens
VSCKNQQDL

SEQ ID NO: 113984 - protein, 9 aa, Homo Sapiens
ALFLQEVFQ

SEQ ID NO: 113985 - protein, 9 aa, Homo Sapiens
RDKIRAKDR

SEQ ID NO: 113986 - protein, 9 aa, Homo Sapiens
GGSTSCGSS

SEQ ID NO: 113987 - protein, 9 aa, Homo Sapiens
EKFRKMEEK

SEQ ID NO: 113988 - protein, 9 aa, Homo Sapiens
RLYITTKLS

SEQ ID NO: 113989 - protein, 9 aa, Homo Sapiens
KEAAQKRKG

SEQ ID NO: 113990 - protein, 9 aa, Homo Sapiens
IQIEELTER

SEQ ID NO: 113991 - protein, 9 aa, Homo Sapiens
VRKLREERN

SEQ ID NO: 113992 - protein, 9 aa, Homo Sapiens
DAGRKRGLG

SEQ ID NO: 113993 - protein, 9 aa, Homo Sapiens
FTKETASYL

SEQ ID NO: 113994 - protein, 9 aa, Homo Sapiens
EQQTQLNHD

SEQ ID NO: 113995 - protein, 9 aa, Homo Sapiens
HVWSAPLPR

SEQ ID NO: 113996 - protein, 9 aa, Homo Sapiens
EVRSCLKNK

SEQ ID NO: 113997 - protein, 9 aa, Homo Sapiens
AWRRVQPQE

SEQ ID NO: 113998 - protein, 9 aa, Homo Sapiens
RNNKNRENA

SEQ ID NO: 113999 - protein, 9 aa, Homo Sapiens
SLPRSMASG

SEQ ID NO: 114000 - protein, 9 aa, Homo Sapiens
SLVGFVSSS

SEQ ID NO: 114001 - protein, 9 aa, Homo Sapiens
NNKNRENAS

SEQ ID NO: 114002 - protein, 9 aa, Homo Sapiens
KIIGMMLDR

SEQ ID NO: 114003 - protein, 9 aa, Homo Sapiens
TYSSHLKQC

SEQ ID NO: 114004 - protein, 9 aa, Homo Sapiens
TLSFKYDLL

SEQ ID NO: 114005 - protein, 9 aa, Homo Sapiens
LYITTKLSN

SEQ ID NO: 114006 - protein, 9 aa, Homo Sapiens
WFHAPFQAD

SEQ ID NO: 114007 - protein, 9 aa, Homo Sapiens
CKAFYKDGC

SEQ ID NO: 114008 - protein, 9 aa, Homo Sapiens
SSEQHVSLD

SEQ ID NO: 114009 - protein, 9 aa, Homo Sapiens
RKCYPLRPK

SEQ ID NO: 114010 - protein, 9 aa, Homo Sapiens
HCQIGSQVY

SEQ ID NO: 114011 - protein, 9 aa, Homo Sapiens
SSGLCPPTK

SEQ ID NO: 114012 - protein, 9 aa, Homo Sapiens
SALSQLIPC

SEQ ID NO: 114013 - protein, 9 aa, Homo Sapiens
TTCKAFYKD

SEQ ID NO: 114014 - protein, 9 aa, Homo Sapiens
LSDGWAGPS

SEQ ID NO: 114015 - protein, 9 aa, Homo Sapiens
FLKIIGMML

SEQ ID NO: 114016 - protein, 9 aa, Homo Sapiens
RRADLGRRE

SEQ ID NO: 114017 - protein, 9 aa, Homo Sapiens
NIQDKEEQT

SEQ ID NO: 114018 - protein, 9 aa, Homo Sapiens
QALQLQGDN

SEQ ID NO: 114019 - protein, 9 aa, Homo Sapiens
TLRSVLFSR

SEQ ID NO: 114020 - protein, 9 aa, Homo Sapiens
SEGEGEPLV

SEQ ID NO: 114021 - protein, 9 aa, Homo Sapiens
DIASEAFAT

SEQ ID NO: 114022 - protein, 9 aa, Homo Sapiens
KLDRNTSFQ

SEQ ID NO: 114023 - protein, 9 aa, Homo Sapiens
SAPLSPSSL

SEQ ID NO: 114024 - protein, 9 aa, Homo Sapiens
AGFGGSTSC

SEQ ID NO: 114025 - protein, 9 aa, Homo Sapiens
VEMKRINKI

SEQ ID NO: 114026 - protein, 9 aa, Homo Sapiens
PPGPGLSLL

SEQ ID NO: 114027 - protein, 9 aa, Homo Sapiens
LCMVGVRKN

SEQ ID NO: 114028 - protein, 9 aa, Homo Sapiens
PFYVIAESF

SEQ ID NO: 114029 - protein, 9 aa, Homo Sapiens
EERNQNEQE

SEQ ID NO: 114030 - protein, 9 aa, Homo Sapiens
QDIAQEISQ

SEQ ID NO: 114031 - protein, 9 aa, Homo Sapiens
SERQKMGQV

SEQ ID NO: 114032 - protein, 9 aa, Homo Sapiens
QRRPCRHST

SEQ ID NO: 114033 - protein, 9 aa, Homo Sapiens
NTSERQKMG

SEQ ID NO: 114034 - protein, 9 aa, Homo Sapiens
IQLARRICG

SEQ ID NO: 114035 - protein, 9 aa, Homo Sapiens
TQLNHDLNM

SEQ ID NO: 114036 - protein, 9 aa, Homo Sapiens
PTLRSVLFS

SEQ ID NO: 114037 - protein, 9 aa, Homo Sapiens
DKEDQKPVR

SEQ ID NO: 114038 - protein, 9 aa, Homo Sapiens
QLRFHLMAE

SEQ ID NO: 114039 - protein, 9 aa, Homo Sapiens
AGRKRGLGT

SEQ ID NO: 114040 - protein, 9 aa, Homo Sapiens
ALRSNRLLI

SEQ ID NO: 114041 - protein, 9 aa, Homo Sapiens
LNLDVPQQR

SEQ ID NO: 114042 - protein, 9 aa, Homo Sapiens
LHAVEIQIE

SEQ ID NO: 114043 - protein, 9 aa, Homo Sapiens
LSTFDIASE

SEQ ID NO: 114044 - protein, 9 aa, Homo Sapiens
THCDCNADW

SEQ ID NO: 114045 - protein, 9 aa, Homo Sapiens
GPWPEAQCL

SEQ ID NO: 114046 - protein, 9 aa, Homo Sapiens
EAAWLHGAR

SEQ ID NO: 114047 - protein, 9 aa, Homo Sapiens
ECRRAITYS

SEQ ID NO: 114048 - protein, 9 aa, Homo Sapiens
GRKRGLGTP

SEQ ID NO: 114049 - protein, 9 aa, Homo Sapiens
ISNTEYLSK

SEQ ID NO: 114050 - protein, 9 aa, Homo Sapiens
GSVVSNHLC

SEQ ID NO: 114051 - protein, 9 aa, Homo Sapiens
ERLLLQEEQ

SEQ ID NO: 114052 - protein, 9 aa, Homo Sapiens
FFDHQSTLS

SEQ ID NO: 114053 - protein, 9 aa, Homo Sapiens
MNESEREFV

SEQ ID NO: 114054 - protein, 9 aa, Homo Sapiens
RKNAQQNSP

SEQ ID NO: 114055 - protein, 9 aa, Homo Sapiens
ALGCLAISN

SEQ ID NO: 114056 - protein, 9 aa, Homo Sapiens
ARARPRRAD

SEQ ID NO: 114057 - protein, 9 aa, Homo Sapiens
DPKSELGTV

SEQ ID NO: 114058 - protein, 9 aa, Homo Sapiens
HVLLCRKPA

SEQ ID NO: 114059 - protein, 9 aa, Homo Sapiens
KQRDKIRAK

SEQ ID NO: 114060 - protein, 9 aa, Homo Sapiens
LQGDNANSL

SEQ ID NO: 114061 - protein, 9 aa, Homo Sapiens
QEYVSLFKY

SEQ ID NO: 114062 - protein, 9 aa, Homo Sapiens
RQVAKGMFE

SEQ ID NO: 114063 - protein, 9 aa, Homo Sapiens
PITDFKYSQ

SEQ ID NO: 114064 - protein, 9 aa, Homo Sapiens
DGWAGPSEA

SEQ ID NO: 114065 - protein, 9 aa, Homo Sapiens
DIAQEISQA

SEQ ID NO: 114066 - protein, 9 aa, Homo Sapiens
APLSPSSLP

SEQ ID NO: 114067 - protein, 9 aa, Homo Sapiens
LSNPAYTPE

SEQ ID NO: 114068 - protein, 9 aa, Homo Sapiens
RFFDHQSTL

SEQ ID NO: 114069 - protein, 9 aa, Homo Sapiens
APFQADHWM

SEQ ID NO: 114070 - protein, 9 aa, Homo Sapiens
GWAGPSEAR

SEQ ID NO: 114071 - protein, 9 aa, Homo Sapiens
PSRNVTMNE

SEQ ID NO: 114072 - protein, 9 aa, Homo Sapiens
LGELSDGWA

SEQ ID NO: 114073 - protein, 9 aa, Homo Sapiens
VLGDCFTVN

SEQ ID NO: 114074 - protein, 9 aa, Homo Sapiens
KYQMLCDMA

SEQ ID NO: 114075 - protein, 9 aa, Homo Sapiens
NKNRENASS

SEQ ID NO: 114076 - protein, 9 aa, Homo Sapiens
PCPSLRTAS

SEQ ID NO: 114077 - protein, 9 aa, Homo Sapiens
HSQNQLNFS

SEQ ID NO: 114078 - protein, 9 aa, Homo Sapiens
LSALSQLIP

SEQ ID NO: 114079 - protein, 9 aa, Homo Sapiens
HAPFQADHW

SEQ ID NO: 114080 - protein, 9 aa, Homo Sapiens
GSNKPKANY

SEQ ID NO: 114081 - protein, 9 aa, Homo Sapiens
SCIPQAGMR

SEQ ID NO: 114082 - protein, 9 aa, Homo Sapiens
KYSQEFFDH

SEQ ID NO: 114083 - protein, 9 aa, Homo Sapiens
RQKMGQVPK

SEQ ID NO: 114084 - protein, 9 aa, Homo Sapiens
CLAISNTEY

SEQ ID NO: 114085 - protein, 9 aa, Homo Sapiens
RMQARMHGF

SEQ ID NO: 114086 - protein, 9 aa, Homo Sapiens
YKDGCRNGG

SEQ ID NO: 114087 - protein, 9 aa, Homo Sapiens
DLVISLVGF

SEQ ID NO: 114088 - protein, 9 aa, Homo Sapiens
DCNADWCLY

SEQ ID NO: 114089 - protein, 9 aa, Homo Sapiens
KKEALFLQE

SEQ ID NO: 114090 - protein, 9 aa, Homo Sapiens
RSVLFSRYS

SEQ ID NO: 114091 - protein, 9 aa, Homo Sapiens
FYKDGCRNG

SEQ ID NO: 114092 - protein, 9 aa, Homo Sapiens
GDISLSDNA

SEQ ID NO: 114093 - protein, 9 aa, Homo Sapiens
KKKEALFLQ

SEQ ID NO: 114094 - protein, 9 aa, Homo Sapiens
PKQRPAPEE

SEQ ID NO: 114095 - protein, 9 aa, Homo Sapiens
IPQAGMRIG

SEQ ID NO: 114096 - protein, 9 aa, Homo Sapiens
PDGLSDKED

SEQ ID NO: 114097 - protein, 9 aa, Homo Sapiens
VTMNESERE

SEQ ID NO: 114098 - protein, 9 aa, Homo Sapiens
WRRVQPQEL

SEQ ID NO: 114099 - protein, 9 aa, Homo Sapiens
LNFSSYSSK

SEQ ID NO: 114100 - protein, 9 aa, Homo Sapiens
SSLPRSMAS

SEQ ID NO: 114101 - protein, 9 aa, Homo Sapiens
KLREERNQN

SEQ ID NO: 114102 - protein, 9 aa, Homo Sapiens
GAWRRVQPQ

SEQ ID NO: 114103 - protein, 9 aa, Homo Sapiens
RRQRNNKNR

SEQ ID NO: 114104 - protein, 9 aa, Homo Sapiens
KIRAKDREL

SEQ ID NO: 114105 - protein, 9 aa, Homo Sapiens
APITDFKYS

SEQ ID NO: 114106 - protein, 9 aa, Homo Sapiens
MLCDKKIQF

SEQ ID NO: 114107 - protein, 9 aa, Homo Sapiens
PQPPPKEYA

SEQ ID NO: 114108 - protein, 9 aa, Homo Sapiens
LCSKLSIIS

SEQ ID NO: 114109 - protein, 9 aa, Homo Sapiens
VQPQELRVY

SEQ ID NO: 114110 - protein, 9 aa, Homo Sapiens
YATDVDIVF

SEQ ID NO: 114111 - protein, 9 aa, Homo Sapiens
KSELGTVKP

SEQ ID NO: 114112 - protein, 9 aa, Homo Sapiens
PNIQDKEEQ

SEQ ID NO: 114113 - protein, 9 aa, Homo Sapiens
QLARRICGE

SEQ ID NO: 114114 - protein, 9 aa, Homo Sapiens
TASSRSASK

SEQ ID NO: 114115 - protein, 9 aa, Homo Sapiens
SLFKYQMLC

SEQ ID NO: 114116 - protein, 9 aa, Homo Sapiens
VRKNAQQNS

SEQ ID NO: 114117 - protein, 9 aa, Homo Sapiens
MLSCNFPHR

SEQ ID NO: 114118 - protein, 9 aa, Homo Sapiens
TMNESEREF

SEQ ID NO: 114119 - protein, 9 aa, Homo Sapiens
GELSDGWAG

SEQ ID NO: 114120 - protein, 9 aa, Homo Sapiens
SNTLSKLLE

SEQ ID NO: 114121 - protein, 9 aa, Homo Sapiens
RALRSNRLL

SEQ ID NO: 114122 - protein, 9 aa, Homo Sapiens
RKRGLGTPA

SEQ ID NO: 114123 - protein, 9 aa, Homo Sapiens
ITYSSHLKQ

SEQ ID NO: 114124 - protein, 9 aa, Homo Sapiens
ARMHGFQAR

SEQ ID NO: 114125 - protein, 9 aa, Homo Sapiens
GPSSGLCPP

SEQ ID NO: 114126 - protein, 9 aa, Homo Sapiens
SEGHVLLCR

SEQ ID NO: 114127 - protein, 9 aa, Homo Sapiens
KPAHSQNQL

SEQ ID NO: 114128 - protein, 9 aa, Homo Sapiens
HVSLDIDLW

SEQ ID NO: 114129 - protein, 9 aa, Homo Sapiens
IPCVGCRRS

SEQ ID NO: 114130 - protein, 9 aa, Homo Sapiens
LEVRSCLKN

SEQ ID NO: 114131 - protein, 9 aa, Homo Sapiens
SRRQRNNKN

SEQ ID NO: 114132 - protein, 9 aa, Homo Sapiens
CGSSGRPCP

SEQ ID NO: 114133 - protein, 9 aa, Homo Sapiens
VVDKQRDKI

SEQ ID NO: 114134 - protein, 9 aa, Homo Sapiens
TKETASYLR

SEQ ID NO: 114135 - protein, 9 aa, Homo Sapiens
LKIIGMMLD

SEQ ID NO: 114136 - protein, 9 aa, Homo Sapiens
TSNTLSKLL

SEQ ID NO: 114137 - protein, 9 aa, Homo Sapiens
MIDLIKVEK

SEQ ID NO: 114138 - protein, 9 aa, Homo Sapiens
KLKDKVAHC

SEQ ID NO: 114139 - protein, 9 aa, Homo Sapiens
CRHSTEGEE

SEQ ID NO: 114140 - protein, 9 aa, Homo Sapiens
NFPHRPDSG

SEQ ID NO: 114141 - protein, 9 aa, Homo Sapiens
ANTSERQKM

SEQ ID NO: 114142 - protein, 9 aa, Homo Sapiens
EAFATFKDL

SEQ ID NO: 114143 - protein, 9 aa, Homo Sapiens
RKEAAQKRK

SEQ ID NO: 114144 - protein, 9 aa, Homo Sapiens
TTKLSNPAY

SEQ ID NO: 114145 - protein, 9 aa, Homo Sapiens
QHVSLDIDL

SEQ ID NO: 114146 - protein, 9 aa, Homo Sapiens
FMLSCNFPH

SEQ ID NO: 114147 - protein, 9 aa, Homo Sapiens
SDGWAGPSE

SEQ ID NO: 114148 - protein, 9 aa, Homo Sapiens
VRSCLKNKT

SEQ ID NO: 114149 - protein, 9 aa, Homo Sapiens
CDKKIQFDR

SEQ ID NO: 114150 - protein, 9 aa, Homo Sapiens
RVQPQELRV

SEQ ID NO: 114151 - protein, 9 aa, Homo Sapiens
NQLNFSSYS

SEQ ID NO: 114152 - protein, 9 aa, Homo Sapiens
EISQAFSQR

SEQ ID NO: 114153 - protein, 9 aa, Homo Sapiens
YNLELGDIS

SEQ ID NO: 114154 - protein, 9 aa, Homo Sapiens
DNANSLHLL

SEQ ID NO: 114155 - protein, 9 aa, Homo Sapiens
QRKEFLDDL

SEQ ID NO: 114156 - protein, 9 aa, Homo Sapiens
QIEELTERQ

SEQ ID NO: 114157 - protein, 9 aa, Homo Sapiens
EPLVLGDCF

SEQ ID NO: 114158 - protein, 9 aa, Homo Sapiens
PQRKCYPLR

SEQ ID NO: 114159 - protein, 9 aa, Homo Sapiens
ISLVGFVSS

SEQ ID NO: 114160 - protein, 9 aa, Homo Sapiens
QPPPKEYAG

SEQ ID NO: 114161 - protein, 9 aa, Homo Sapiens
SYLRGRPQD

SEQ ID NO: 114162 - protein, 9 aa, Homo Sapiens
DCPQRKCYP

SEQ ID NO: 114163 - protein, 9 aa, Homo Sapiens
DVALGCLAI

SEQ ID NO: 114164 - protein, 9 aa, Homo Sapiens
LIPCVGCRR

SEQ ID NO: 114165 - protein, 9 aa, Homo Sapiens
QLPSLRSTD

SEQ ID NO: 114166 - protein, 9 aa, Homo Sapiens
CRAGFGGWT

SEQ ID NO: 114167 - protein, 9 aa, Homo Sapiens
QLWMLCDKK

SEQ ID NO: 114168 - protein, 9 aa, Homo Sapiens
YQASTSNTL

SEQ ID NO: 114169 - protein, 9 aa, Homo Sapiens
RMHGFQARK

SEQ ID NO: 114170 - protein, 9 aa, Homo Sapiens
WQLRFHLMA

SEQ ID NO: 114171 - protein, 9 aa, Homo Sapiens
PGLSLLPLP

SEQ ID NO: 114172 - protein, 9 aa, Homo Sapiens
CMVGVRKNA

SEQ ID NO: 114173 - protein, 9 aa, Homo Sapiens
IRQVEAAWL

SEQ ID NO: 114174 - protein, 9 aa, Homo Sapiens
ETASYLRGR

SEQ ID NO: 114175 - protein, 9 aa, Homo Sapiens
PRMQARMHG

SEQ ID NO: 114176 - protein, 9 aa, Homo Sapiens
DISLSDNAS

SEQ ID NO: 114177 - protein, 9 aa, Homo Sapiens
TCKAFYKDG

SEQ ID NO: 114178 - protein, 9 aa, Homo Sapiens
HCDCNADWC

SEQ ID NO: 114179 - protein, 9 aa, Homo Sapiens
RKLREERNQ

SEQ ID NO: 114180 - protein, 9 aa, Homo Sapiens
KKKKEALFL

SEQ ID NO: 114181 - protein, 9 aa, Homo Sapiens
RSCLKNKTK

SEQ ID NO: 114182 - protein, 9 aa, Homo Sapiens
NQNEQEQAE

SEQ ID NO: 114183 - protein, 9 aa, Homo Sapiens
LELGDISLS

SEQ ID NO: 114184 - protein, 9 aa, Homo Sapiens
VVSNHLCCQ

SEQ ID NO: 114185 - protein, 9 aa, Homo Sapiens
KLSNPAYTP

SEQ ID NO: 114186 - protein, 9 aa, Homo Sapiens
NANSLHLLA

SEQ ID NO: 114187 - protein, 9 aa, Homo Sapiens
KQRPAPEEL

SEQ ID NO: 114188 - protein, 9 aa, Homo Sapiens
GLGTPAPTG

SEQ ID NO: 114189 - protein, 9 aa, Homo Sapiens
KNQQDLQEW

SEQ ID NO: 114190 - protein, 9 aa, Homo Sapiens
QTPLHCAAW

SEQ ID NO: 114191 - protein, 9 aa, Homo Sapiens
IGSFKCSGY

SEQ ID NO: 114192 - protein, 9 aa, Homo Sapiens
EGEGEPLVL

SEQ ID NO: 114193 - protein, 9 aa, Homo Sapiens
PHFWQLRFH

SEQ ID NO: 114194 - protein, 9 aa, Homo Sapiens
TVKPDGRLR

SEQ ID NO: 114195 - protein, 9 aa, Homo Sapiens
FLQEVFQAE

SEQ ID NO: 114196 - protein, 9 aa, Homo Sapiens
ALGELSDGW

SEQ ID NO: 114197 - protein, 9 aa, Homo Sapiens
AQNKPFYVI

SEQ ID NO: 114198 - protein, 9 aa, Homo Sapiens
GFGGWTCSE

SEQ ID NO: 114199 - protein, 9 aa, Homo Sapiens
FQAERLLLQ

SEQ ID NO: 114200 - protein, 9 aa, Homo Sapiens
AERLLLQEE

SEQ ID NO: 114201 - protein, 9 aa, Homo Sapiens
APVEMKRIN

SEQ ID NO: 114202 - protein, 9 aa, Homo Sapiens
LARRICGER

SEQ ID NO: 114203 - protein, 9 aa, Homo Sapiens
DFKYSQEFF

SEQ ID NO: 114204 - protein, 9 aa, Homo Sapiens
ASYLRGRPQ

SEQ ID NO: 114205 - protein, 9 aa, Homo Sapiens
TDTLSCIPQ

SEQ ID NO: 114206 - protein, 9 aa, Homo Sapiens
SELGTVKPD

SEQ ID NO: 114207 - protein, 9 aa, Homo Sapiens
FKCSGYVMS

SEQ ID NO: 114208 - protein, 9 aa, Homo Sapiens
RNVTMNESE

SEQ ID NO: 114209 - protein, 9 aa, Homo Sapiens
IAESFKFVR

SEQ ID NO: 114210 - protein, 9 aa, Homo Sapiens
FCYQEDSNW

SEQ ID NO: 114211 - protein, 9 aa, Homo Sapiens
SQLIPCVGC

SEQ ID NO: 114212 - protein, 9 aa, Homo Sapiens
ASEAFATFK

SEQ ID NO: 114213 - protein, 9 aa, Homo Sapiens
IRGIVGVQN

SEQ ID NO: 114214 - protein, 9 aa, Homo Sapiens
ISIENCPLS

SEQ ID NO: 114215 - protein, 9 aa, Homo Sapiens
RSRRQRNNK

SEQ ID NO: 114216 - protein, 9 aa, Homo Sapiens
KEYAGADDV

SEQ ID NO: 114217 - protein, 9 aa, Homo Sapiens
RGLKKKKQY

SEQ ID NO: 114218 - protein, 9 aa, Homo Sapiens
RRAITYSSH

SEQ ID NO: 114219 - protein, 9 aa, Homo Sapiens
LLLQEEQEG

SEQ ID NO: 114220 - protein, 9 aa, Homo Sapiens
YQEDSNWPL

SEQ ID NO: 114221 - protein, 9 aa, Homo Sapiens
SCGSSGRPC

SEQ ID NO: 114222 - protein, 9 aa, Homo Sapiens
VAKGMFERA

SEQ ID NO: 114223 - protein, 9 aa, Homo Sapiens
SGLCPPTKF

SEQ ID NO: 114224 - protein, 9 aa, Homo Sapiens
AKGMFERAQ

SEQ ID NO: 114225 - protein, 9 aa, Homo Sapiens
FVSSSALAL

SEQ ID NO: 114226 - protein, 9 aa, Homo Sapiens
VLSALSQLI

SEQ ID NO: 114227 - protein, 9 aa, Homo Sapiens
ERNQNEQEQ

SEQ ID NO: 114228 - protein, 9 aa, Homo Sapiens
QAGMRIGLS

SEQ ID NO: 114229 - protein, 9 aa, Homo Sapiens
SVLFSRYSP

SEQ ID NO: 114230 - protein, 9 aa, Homo Sapiens
FQADHWMLY

SEQ ID NO: 114231 - protein, 9 aa, Homo Sapiens
KPGSNKPKA

SEQ ID NO: 114232 - protein, 9 aa, Homo Sapiens
RGIVGVQNV

SEQ ID NO: 114233 - protein, 9 aa, Homo Sapiens
RTASSRSAS

SEQ ID NO: 114234 - protein, 9 aa, Homo Sapiens
STSCGSSGR

SEQ ID NO: 114235 - protein, 9 aa, Homo Sapiens
TSEEIGSFK

SEQ ID NO: 114236 - protein, 9 aa, Homo Sapiens
LPTLRSVLF

SEQ ID NO: 114237 - protein, 9 aa, Homo Sapiens
IQDKEEQTP

SEQ ID NO: 114238 - protein, 9 aa, Homo Sapiens
FYVIAESFK

SEQ ID NO: 114239 - protein, 9 aa, Homo Sapiens
DKVAHCQSK

SEQ ID NO: 114240 - protein, 9 aa, Homo Sapiens
LARARPRRA

SEQ ID NO: 114241 - protein, 9 aa, Homo Sapiens
GSLMIDLIK

SEQ ID NO: 114242 - protein, 9 aa, Homo Sapiens
ARPRRADLG

SEQ ID NO: 114243 - protein, 9 aa, Homo Sapiens
SIAPITDFK

SEQ ID NO: 114244 - protein, 9 aa, Homo Sapiens
QLNHDLNMQ

SEQ ID NO: 114245 - protein, 9 aa, Homo Sapiens
QAAGPSSGL

SEQ ID NO: 114246 - protein, 9 aa, Homo Sapiens
CYPLRPKKI

SEQ ID NO: 114247 - protein, 9 aa, Homo Sapiens
SEEIGSFKC

SEQ ID NO: 114248 - protein, 9 aa, Homo Sapiens
KDEQQTQLN

SEQ ID NO: 114249 - protein, 9 aa, Homo Sapiens
RESSAEKFR

SEQ ID NO: 114250 - protein, 9 aa, Homo Sapiens
SFKCSGYVM

SEQ ID NO: 114251 - protein, 9 aa, Homo Sapiens
FDHQSTLSF

SEQ ID NO: 114252 - protein, 9 aa, Homo Sapiens
ERQKMGQVP

SEQ ID NO: 114253 - protein, 9 aa, Homo Sapiens
AEKFRKMEE

SEQ ID NO: 114254 - protein, 9 aa, Homo Sapiens
QEISQAFSQ

SEQ ID NO: 114255 - protein, 9 aa, Homo Sapiens
QPQPPPKEY

SEQ ID NO: 114256 - protein, 9 aa, Homo Sapiens
ELGTVKPDG

SEQ ID NO: 114257 - protein, 9 aa, Homo Sapiens
CLGGGRHVW

SEQ ID NO: 114258 - protein, 9 aa, Homo Sapiens
LTCLGGGRH

SEQ ID NO: 114259 - protein, 9 aa, Homo Sapiens
NNVIFCYQE

SEQ ID NO: 114260 - protein, 9 aa, Homo Sapiens
LFTKETASY

SEQ ID NO: 114261 - protein, 9 aa, Homo Sapiens
QNKPFYVIA

SEQ ID NO: 114262 - protein, 9 aa, Homo Sapiens
QARMHGFQA

SEQ ID NO: 114263 - protein, 9 aa, Homo Sapiens
CIPQAGMRI

SEQ ID NO: 114264 - protein, 9 aa, Homo Sapiens
LRTASSRSA

SEQ ID NO: 114265 - protein, 9 aa, Homo Sapiens
CCQVGIMLG

SEQ ID NO: 114266 - protein, 9 aa, Homo Sapiens
AISNTEYLS

SEQ ID NO: 114267 - protein, 9 aa, Homo Sapiens
QRESSAEKF

SEQ ID NO: 114268 - protein, 9 aa, Homo Sapiens
LCCQVGIML

SEQ ID NO: 114269 - protein, 9 aa, Homo Sapiens
PSSGLCPPT

SEQ ID NO: 114270 - protein, 9 aa, Homo Sapiens
GDNANSLHL

SEQ ID NO: 114271 - protein, 9 aa, Homo Sapiens
LVSCKNQQD

SEQ ID NO: 114272 - protein, 9 aa, Homo Sapiens
VLAGFGGST

SEQ ID NO: 114273 - protein, 9 aa, Homo Sapiens
VLFTKETAS

SEQ ID NO: 114274 - protein, 9 aa, Homo Sapiens
QPKQRPAPE

SEQ ID NO: 114275 - protein, 9 aa, Homo Sapiens
RQRNNKNRE

SEQ ID NO: 114276 - protein, 9 aa, Homo Sapiens
MHGFQARKR

SEQ ID NO: 114277 - protein, 9 aa, Homo Sapiens
PLVLGDCFT

SEQ ID NO: 114278 - protein, 9 aa, Homo Sapiens
DKIRAKDRE

SEQ ID NO: 114279 - protein, 9 aa, Homo Sapiens
VEAAWLHGA

SEQ ID NO: 114280 - protein, 9 aa, Homo Sapiens
QEVFQAERL

SEQ ID NO: 114281 - protein, 9 aa, Homo Sapiens
RADLGRRET

SEQ ID NO: 114282 - protein, 9 aa, Homo Sapiens
MKRINKIQP

SEQ ID NO: 114283 - protein, 9 aa, Homo Sapiens
LSLHCQIGS

SEQ ID NO: 114284 - protein, 9 aa, Homo Sapiens
QSTLSFKYD

SEQ ID NO: 114285 - protein, 9 aa, Homo Sapiens
EEQEGGWRR

SEQ ID NO: 114286 - protein, 9 aa, Homo Sapiens
YVSLFKYQM

SEQ ID NO: 114287 - protein, 9 aa, Homo Sapiens
EEIGSFKCS

SEQ ID NO: 114288 - protein, 9 aa, Homo Sapiens
DPQRKEFLD

SEQ ID NO: 114289 - protein, 9 aa, Homo Sapiens
DKQRDKIRA

SEQ ID NO: 114290 - protein, 9 aa, Homo Sapiens
CNADWCLYE

SEQ ID NO: 114291 - protein, 9 aa, Homo Sapiens
TILPTLRSV

SEQ ID NO: 114292 - protein, 9 aa, Homo Sapiens
QLIPCVGCR

SEQ ID NO: 114293 - protein, 9 aa, Homo Sapiens
KEEQTPLHC

SEQ ID NO: 114294 - protein, 9 aa, Homo Sapiens
CKNQQDLQE

SEQ ID NO: 114295 - protein, 9 aa, Homo Sapiens
NLSLHCQIG

SEQ ID NO: 114296 - protein, 9 aa, Homo Sapiens
LQEEQEGGW

SEQ ID NO: 114297 - protein, 9 aa, Homo Sapiens
EGEPLVLGD

SEQ ID NO: 114298 - protein, 9 aa, Homo Sapiens
PQRKEFLDD

SEQ ID NO: 114299 - protein, 9 aa, Homo Sapiens
QNWQRRPCR

SEQ ID NO: 114300 - protein, 9 aa, Homo Sapiens
SEQHVSLDI

SEQ ID NO: 114301 - protein, 9 aa, Homo Sapiens
IQNWQRRPC

SEQ ID NO: 114302 - protein, 9 aa, Homo Sapiens
AAGPSSGLC

SEQ ID NO: 114303 - protein, 9 aa, Homo Sapiens
RILVSCKNQ

SEQ ID NO: 114304 - protein, 9 aa, Homo Sapiens
SSLNLDVPQ

SEQ ID NO: 114305 - protein, 9 aa, Homo Sapiens
VALGCLAIS

SEQ ID NO: 114306 - protein, 9 aa, Homo Sapiens
NKPKANYEQ

SEQ ID NO: 114307 - protein, 9 aa, Homo Sapiens
LGTVKPDGR

SEQ ID NO: 114308 - protein, 9 aa, Homo Sapiens
LRKEAAQKR

SEQ ID NO: 114309 - protein, 9 aa, Homo Sapiens
LVISLVGFV

SEQ ID NO: 114310 - protein, 9 aa, Homo Sapiens
QRDKIRAKD

SEQ ID NO: 114311 - protein, 9 aa, Homo Sapiens
KETASYLRG

SEQ ID NO: 114312 - protein, 9 aa, Homo Sapiens
CDPDGLSDK

SEQ ID NO: 114313 - protein, 9 aa, Homo Sapiens
IKVEKERLL

SEQ ID NO: 114314 - protein, 9 aa, Homo Sapiens
PGSNKPKAN

SEQ ID NO: 114315 - protein, 9 aa, Homo Sapiens
ITTKLSNPA

SEQ ID NO: 114316 - protein, 9 aa, Homo Sapiens
GFVSSSALA

SEQ ID NO: 114317 - protein, 9 aa, Homo Sapiens
EQHVSLDID

SEQ ID NO: 114318 - protein, 9 aa, Homo Sapiens
PLSPSSLPR

SEQ ID NO: 114319 - protein, 9 aa, Homo Sapiens
VIAESFKFV

SEQ ID NO: 114320 - protein, 9 aa, Homo Sapiens
PPKEYAGAD

SEQ ID NO: 114321 - protein, 9 aa, Homo Sapiens
GTVKPDGRL

SEQ ID NO: 114322 - protein, 9 aa, Homo Sapiens
QSFLKIIGM

SEQ ID NO: 114323 - protein, 9 aa, Homo Sapiens
PKKKKEALF

SEQ ID NO: 114324 - protein, 9 aa, Homo Sapiens
RINKIQPCL

SEQ ID NO: 114325 - protein, 9 aa, Homo Sapiens
LDRNTSFQL

SEQ ID NO: 114326 - protein, 9 aa, Homo Sapiens
MQARMHGFQ

SEQ ID NO: 114327 - protein, 9 aa, Homo Sapiens
GIVGVQNVA

SEQ ID NO: 114328 - protein, 9 aa, Homo Sapiens
GCLAISNTE

SEQ ID NO: 114329 - protein, 9 aa, Homo Sapiens
PQAGMRIGL

SEQ ID NO: 114330 - protein, 9 aa, Homo Sapiens
STFDIASEA

SEQ ID NO: 114331 - protein, 9 aa, Homo Sapiens
KFRKMEEKC

SEQ ID NO: 114332 - protein, 9 aa, Homo Sapiens
KAFYKDGCR

SEQ ID NO: 114333 - protein, 9 aa, Homo Sapiens
EMKRINKIQ

SEQ ID NO: 114334 - protein, 9 aa, Homo Sapiens
DTNYATDVD

SEQ ID NO: 114335 - protein, 9 aa, Homo Sapiens
PFQADHWML

SEQ ID NO: 114336 - protein, 9 aa, Homo Sapiens
RFHLMAEGS

SEQ ID NO: 114337 - protein, 9 aa, Homo Sapiens
IAQEISQAF

SEQ ID NO: 114338 - protein, 9 aa, Homo Sapiens
PSLRTASSR

SEQ ID NO: 114339 - protein, 9 aa, Homo Sapiens
NADWCLYEI

SEQ ID NO: 114340 - protein, 9 aa, Homo Sapiens
ELSDGWAGP

SEQ ID NO: 114341 - protein, 9 aa, Homo Sapiens
QRKCYPLRP

SEQ ID NO: 114342 - protein, 9 aa, Homo Sapiens
SLNLDVPQQ

SEQ ID NO: 114343 - protein, 9 aa, Homo Sapiens
RAITYSSHL

SEQ ID NO: 114344 - protein, 9 aa, Homo Sapiens
WPEAQCLTS

SEQ ID NO: 114345 - protein, 9 aa, Homo Sapiens
SPTKPGSNK

SEQ ID NO: 114346 - protein, 9 aa, Homo Sapiens
FYNLELGDI

SEQ ID NO: 114347 - protein, 9 aa, Homo Sapiens
QVEAAWLHG

SEQ ID NO: 114348 - protein, 9 aa, Homo Sapiens
NVTMNESER

SEQ ID NO: 114349 - protein, 9 aa, Homo Sapiens
QAFSQRVGF

SEQ ID NO: 114350 - protein, 9 aa, Homo Sapiens
KLSIISIEN

SEQ ID NO: 114351 - protein, 9 aa, Homo Sapiens
EQEGGWRRR

SEQ ID NO: 114352 - protein, 9 aa, Homo Sapiens
NWQRRPCRH

SEQ ID NO: 114353 - protein, 9 aa, Homo Sapiens
VLFSRYSPH

SEQ ID NO: 114354 - protein, 9 aa, Homo Sapiens
SIRGIVGVQ

SEQ ID NO: 114355 - protein, 9 aa, Homo Sapiens
LRSNRLLIG

SEQ ID NO: 114356 - protein, 9 aa, Homo Sapiens
QLQGDNANS

SEQ ID NO: 114357 - protein, 9 aa, Homo Sapiens
KEALFLQEV

SEQ ID NO: 114358 - protein, 9 aa, Homo Sapiens
LVLGDCFTV

SEQ ID NO: 114359 - protein, 9 aa, Homo Sapiens
RRVQPQELR

SEQ ID NO: 114360 - protein, 9 aa, Homo Sapiens
GGRHVWSAP

SEQ ID NO: 114361 - protein, 9 aa, Homo Sapiens
CLSQSEGHV

SEQ ID NO: 114362 - protein, 9 aa, Homo Sapiens
LNHDLNMQK

SEQ ID NO: 114363 - protein, 9 aa, Homo Sapiens
TKPGSNKPK

SEQ ID NO: 114364 - protein, 9 aa, Homo Sapiens
SNPAYTPEI

SEQ ID NO: 114365 - protein, 9 aa, Homo Sapiens
DPDGLSDKE

SEQ ID NO: 114366 - protein, 9 aa, Homo Sapiens
ELDGDPQRK

SEQ ID NO: 114367 - protein, 9 aa, Homo Sapiens
DLIKVEKER

SEQ ID NO: 114368 - protein, 9 aa, Homo Sapiens
RLLLQEEQE

SEQ ID NO: 114369 - protein, 9 aa, Homo Sapiens
AAGPWPEAQ

SEQ ID NO: 114370 - protein, 9 aa, Homo Sapiens
RSNRLLIGI

SEQ ID NO: 114371 - protein, 9 aa, Homo Sapiens
SLMIDLIKV

SEQ ID NO: 114372 - protein, 9 aa, Homo Sapiens
YELDGDPQR

SEQ ID NO: 114373 - protein, 9 aa, Homo Sapiens
LGTPAPTGL

SEQ ID NO: 114374 - protein, 9 aa, Homo Sapiens
PKSELGTVK

SEQ ID NO: 114375 - protein, 9 aa, Homo Sapiens
LQLQGDNAN

SEQ ID NO: 114376 - protein, 9 aa, Homo Sapiens
SNHLCCQVG

SEQ ID NO: 114377 - protein, 9 aa, Homo Sapiens
GLSDKEDQK

SEQ ID NO: 114378 - protein, 9 aa, Homo Sapiens
VFQAERLLL

SEQ ID NO: 114379 - protein, 9 aa, Homo Sapiens
KMGQVPKKD

SEQ ID NO: 114380 - protein, 9 aa, Homo Sapiens
LQKQILEVR

SEQ ID NO: 114381 - protein, 9 aa, Homo Sapiens
DGDPQRKEF

SEQ ID NO: 114382 - protein, 9 aa, Homo Sapiens
SLLPLPLLL

SEQ ID NO: 114383 - protein, 9 aa, Homo Sapiens
VIFCYQEDS

SEQ ID NO: 114384 - protein, 9 aa, Homo Sapiens
IEELTERQQ

SEQ ID NO: 114385 - protein, 9 aa, Homo Sapiens
MVGVRKNAQ

SEQ ID NO: 114386 - protein, 9 aa, Homo Sapiens
RRALRSNRL

SEQ ID NO: 114387 - protein, 9 aa, Homo Sapiens
PQELRVYPV

SEQ ID NO: 114388 - protein, 9 aa, Homo Sapiens
QGAAGPWPE

SEQ ID NO: 114389 - protein, 9 aa, Homo Sapiens
LRSVLFSRY

SEQ ID NO: 114390 - protein, 9 aa, Homo Sapiens
HLCCQVGIM

SEQ ID NO: 114391 - protein, 9 aa, Homo Sapiens
GVRKNAQQN

SEQ ID NO: 114392 - protein, 9 aa, Homo Sapiens
RQVEAAWLH

SEQ ID NO: 114393 - protein, 9 aa, Homo Sapiens
QEEQEGGWR

SEQ ID NO: 114394 - protein, 9 aa, Homo Sapiens
SGRPCPSLR

SEQ ID NO: 114395 - protein, 9 aa, Homo Sapiens
VAPVEMKRI

SEQ ID NO: 114396 - protein, 9 aa, Homo Sapiens
GLCPPTKFQ

SEQ ID NO: 114397 - protein, 9 aa, Homo Sapiens
HRPDSGDVT

SEQ ID NO: 114398 - protein, 9 aa, Homo Sapiens
LIKVEKERL

SEQ ID NO: 114399 - protein, 9 aa, Homo Sapiens
SCNFPHRPD

SEQ ID NO: 114400 - protein, 9 aa, Homo Sapiens
ELPSRNVTM

SEQ ID NO: 114401 - protein, 9 aa, Homo Sapiens
LMIDLIKVE

SEQ ID NO: 114402 - protein, 9 aa, Homo Sapiens
SLHCQIGSQ

SEQ ID NO: 114403 - protein, 9 aa, Homo Sapiens
QELRVYPVS

SEQ ID NO: 114404 - protein, 9 aa, Homo Sapiens
TPKKKKEAL

SEQ ID NO: 114405 - protein, 9 aa, Homo Sapiens
RNQNEQEQA

SEQ ID NO: 114406 - protein, 9 aa, Homo Sapiens
CSKLSIISI

SEQ ID NO: 114407 - protein, 9 aa, Homo Sapiens
SFQLPSLRS

SEQ ID NO: 114408 - protein, 9 aa, Homo Sapiens
NSSEQHVSL

SEQ ID NO: 114409 - protein, 9 aa, Homo Sapiens
EVMQSFLKI

SEQ ID NO: 114410 - protein, 9 aa, Homo Sapiens
LSKLLEKSR

SEQ ID NO: 114411 - protein, 9 aa, Homo Sapiens
KKIQFDRAM

SEQ ID NO: 114412 - protein, 9 aa, Homo Sapiens
QAERLLLQE

SEQ ID NO: 114413 - protein, 9 aa, Homo Sapiens
PPPKEYAGA

SEQ ID NO: 114414 - protein, 9 aa, Homo Sapiens
VGVRKNAQQ

SEQ ID NO: 114415 - protein, 9 aa, Homo Sapiens
VDKQRDKIR

SEQ ID NO: 114416 - protein, 9 aa, Homo Sapiens
ASTSNTLSK

SEQ ID NO: 114417 - protein, 9 aa, Homo Sapiens
AGFGGWTCS

SEQ ID NO: 114418 - protein, 9 aa, Homo Sapiens
QADHWMLYE

SEQ ID NO: 114419 - protein, 9 aa, Homo Sapiens
RGVDRQVAK

SEQ ID NO: 114420 - protein, 9 aa, Homo Sapiens
QPQELRVYP

SEQ ID NO: 114421 - protein, 9 aa, Homo Sapiens
KPKANYEQS

SEQ ID NO: 114422 - protein, 9 aa, Homo Sapiens
HQSTLSFKY

SEQ ID NO: 114423 - protein, 9 aa, Homo Sapiens
DVDIVFEDF

SEQ ID NO: 114424 - protein, 9 aa, Homo Sapiens
VVLAGFGGS

SEQ ID NO: 114425 - protein, 9 aa, Homo Sapiens
KQILEVRSC

SEQ ID NO: 114426 - protein, 9 aa, Homo Sapiens
FGGWTCSEC

SEQ ID NO: 114427 - protein, 9 aa, Homo Sapiens
RNTSFQLPS

SEQ ID NO: 114428 - protein, 9 aa, Homo Sapiens
RARPRRADL

SEQ ID NO: 114429 - protein, 9 aa, Homo Sapiens
CMRKQPKQR

SEQ ID NO: 114430 - protein, 9 aa, Homo Sapiens
WQRRPCRHS

SEQ ID NO: 114431 - protein, 9 aa, Homo Sapiens
QRRALRSNR

SEQ ID NO: 114432 - protein, 9 aa, Homo Sapiens
AQEISQAFS

SEQ ID NO: 114433 - protein, 9 aa, Homo Sapiens
KCYPLRPKK

SEQ ID NO: 114434 - protein, 9 aa, Homo Sapiens
SEAFATFKD

SEQ ID NO: 114435 - protein, 9 aa, Homo Sapiens
KNAQQNSPK

SEQ ID NO: 114436 - protein, 9 aa, Homo Sapiens
SRSASKPVD

SEQ ID NO: 114437 - protein, 9 aa, Homo Sapiens
LRFHLMAEG

SEQ ID NO: 114438 - protein, 9 aa, Homo Sapiens
GSTSCGSSG

SEQ ID NO: 114439 - protein, 9 aa, Homo Sapiens
KQPKQRPAP

SEQ ID NO: 114440 - protein, 9 aa, Homo Sapiens
AQLWMLCDK

SEQ ID NO: 114441 - protein, 9 aa, Homo Sapiens
RIRQVEAAW

SEQ ID NO: 114442 - protein, 9 aa, Homo Sapiens
TCLGGGRHV

SEQ ID NO: 114443 - protein, 9 aa, Homo Sapiens
QRPAPEELM

SEQ ID NO: 114444 - protein, 9 aa, Homo Sapiens
LSQSEGHVL

SEQ ID NO: 114445 - protein, 9 aa, Homo Sapiens
IAPITDFKY

SEQ ID NO: 114446 - protein, 9 aa, Homo Sapiens
ERILVSCKN

SEQ ID NO: 114447 - protein, 9 aa, Homo Sapiens
CDCNADWCL

SEQ ID NO: 114448 - protein, 9 aa, Homo Sapiens
SKLSIISIE

SEQ ID NO: 114449 - protein, 9 aa, Homo Sapiens
LPSRNVTMN

SEQ ID NO: 114450 - protein, 9 aa, Homo Sapiens
QQTQLNHDL

SEQ ID NO: 114451 - protein, 9 aa, Homo Sapiens
NVIFCYQED

SEQ ID NO: 114452 - protein, 9 aa, Homo Sapiens
LWMLCDKKI

SEQ ID NO: 114453 - protein, 9 aa, Homo Sapiens
HGFQARKRY

SEQ ID NO: 114454 - protein, 9 aa, Homo Sapiens
ISLSDNASM

SEQ ID NO: 114455 - protein, 9 aa, Homo Sapiens
SNRLLIGII

SEQ ID NO: 114456 - protein, 9 aa, Homo Sapiens
SSRSASKPV

SEQ ID NO: 114457 - protein, 9 aa, Homo Sapiens
NHDLNMQKA

SEQ ID NO: 114458 - protein, 9 aa, Homo Sapiens
ALCSKLSII

SEQ ID NO: 114459 - protein, 9 aa, Homo Sapiens
GPLASSLNL

SEQ ID NO: 114460 - protein, 9 aa, Homo Sapiens
EQTPLHCAA

SEQ ID NO: 114461 - protein, 9 aa, Homo Sapiens
REERNQNEQ

SEQ ID NO: 114462 - protein, 9 aa, Homo Sapiens
ITDFKYSQE

SEQ ID NO: 114463 - protein, 9 aa, Homo Sapiens
NTLSKLLEK

SEQ ID NO: 114464 - protein, 9 aa, Homo Sapiens
GRPCPSLRT

SEQ ID NO: 114465 - protein, 9 aa, Homo Sapiens
LPRSMASGS

SEQ ID NO: 114466 - protein, 9 aa, Homo Sapiens
LCDKKIQFD

SEQ ID NO: 114467 - protein, 9 aa, Homo Sapiens
SAEKFRKME

SEQ ID NO: 114468 - protein, 9 aa, Homo Sapiens
FHLMAEGSR

SEQ ID NO: 114469 - protein, 9 aa, Homo Sapiens
CRRAITYSS

SEQ ID NO: 114470 - protein, 9 aa, Homo Sapiens
MRKQPKQRP

SEQ ID NO: 114471 - protein, 9 aa, Homo Sapiens
IVGVQNVAE

SEQ ID NO: 114472 - protein, 9 aa, Homo Sapiens
LGDISLSDN

SEQ ID NO: 114473 - protein, 9 aa, Homo Sapiens
GLSLLPLPL

SEQ ID NO: 114474 - protein, 9 aa, Homo Sapiens
GHNLSLHCQ

SEQ ID NO: 114475 - protein, 9 aa, Homo Sapiens
EEQTPLHCA

SEQ ID NO: 114476 - protein, 9 aa, Homo Sapiens
TLSCIPQAG

SEQ ID NO: 114477 - protein, 9 aa, Homo Sapiens
STLSFKYDL

SEQ ID NO: 114478 - protein, 9 aa, Homo Sapiens
RRPCRHSTE

SEQ ID NO: 114479 - protein, 9 aa, Homo Sapiens
YSSHLKQCV

SEQ ID NO: 114480 - protein, 9 aa, Homo Sapiens
KGMFERAQE

SEQ ID NO: 114481 - protein, 9 aa, Homo Sapiens
SVVSNHLCC

SEQ ID NO: 114482 - protein, 9 aa, Homo Sapiens
ETPKKKKEA

SEQ ID NO: 114483 - protein, 9 aa, Homo Sapiens
PCRHSTEGE

SEQ ID NO: 114484 - protein, 9 aa, Homo Sapiens
LAISNTEYL

SEQ ID NO: 114485 - protein, 9 aa, Homo Sapiens
NRLLIGIIR

SEQ ID NO: 114486 - protein, 9 aa, Homo Sapiens
IASEAFATF

SEQ ID NO: 114487 - protein, 9 aa, Homo Sapiens
GRHVWSAPL

SEQ ID NO: 114488 - protein, 9 aa, Homo Sapiens
IDLIKVEKE

SEQ ID NO: 114489 - protein, 9 aa, Homo Sapiens
LFKYQMLCD

SEQ ID NO: 114490 - protein, 9 aa, Homo Sapiens
GWTCSECQE

SEQ ID NO: 114491 - protein, 9 aa, Homo Sapiens
PVEMKRINK

SEQ ID NO: 114492 - protein, 9 aa, Homo Sapiens
GEGEPLVLG

SEQ ID NO: 114493 - protein, 9 aa, Homo Sapiens
HNLSLHCQI

SEQ ID NO: 114494 - protein, 9 aa, Homo Sapiens
FDTNYATDV

SEQ ID NO: 114495 - protein, 9 aa, Homo Sapiens
GLARARPRR

SEQ ID NO: 114496 - protein, 9 aa, Homo Sapiens
QNVAELKKS

SEQ ID NO: 114497 - protein, 9 aa, Homo Sapiens
NLDVPQQRP

SEQ ID NO: 114498 - protein, 9 aa, Homo Sapiens
GPGLSLLPL

SEQ ID NO: 114499 - protein, 9 aa, Homo Sapiens
ATDVDIVFE

SEQ ID NO: 114500 - protein, 9 aa, Homo Sapiens
NGTTCKAFY

SEQ ID NO: 114501 - protein, 9 aa, Homo Sapiens
GSFKCSGYV

SEQ ID NO: 114502 - protein, 9 aa, Homo Sapiens
PDPKSELGT

SEQ ID NO: 114503 - protein, 9 aa, Homo Sapiens
STSNTLSKL

SEQ ID NO: 114504 - protein, 9 aa, Homo Sapiens
WLHGARGLR

SEQ ID NO: 114505 - protein, 9 aa, Homo Sapiens
GGWTCSECQ

SEQ ID NO: 114506 - protein, 9 aa, Homo Sapiens
LAGFGGSTS

SEQ ID NO: 114507 - protein, 9 aa, Homo Sapiens
KRINKIQPC

SEQ ID NO: 114508 - protein, 9 aa, Homo Sapiens
MQSFLKIIG

SEQ ID NO: 114509 - protein, 9 aa, Homo Sapiens
QQGHNLSLH

SEQ ID NO: 114510 - protein, 9 aa, Homo Sapiens
SFLKIIGMM

SEQ ID NO: 114511 - protein, 9 aa, Homo Sapiens
VQNVAELKK

SEQ ID NO: 114512 - protein, 9 aa, Homo Sapiens
LSLLPLPLL

SEQ ID NO: 114513 - protein, 9 aa, Homo Sapiens
MWFHAPFQA

SEQ ID NO: 114514 - protein, 9 aa, Homo Sapiens
RPRRADLGR

SEQ ID NO: 114515 - protein, 9 aa, Homo Sapiens
SLRTASSRS

SEQ ID NO: 114516 - protein, 9 aa, Homo Sapiens
EVVDKQRDK

SEQ ID NO: 114517 - protein, 9 aa, Homo Sapiens
KQRRALRSN

SEQ ID NO: 114518 - protein, 9 aa, Homo Sapiens
HAVEIQIEE

SEQ ID NO: 114519 - protein, 9 aa, Homo Sapiens
WAGPSEARM

SEQ ID NO: 114520 - protein, 9 aa, Homo Sapiens
EVFQAERLL

SEQ ID NO: 114521 - protein, 9 aa, Homo Sapiens
ELGDISLSD

SEQ ID NO: 114522 - protein, 9 aa, Homo Sapiens
EIGSFKCSG

SEQ ID NO: 114523 - protein, 9 aa, Homo Sapiens
GEPLVLGDC

SEQ ID NO: 114524 - protein, 9 aa, Homo Sapiens
RHVWSAPLP

SEQ ID NO: 114525 - protein, 9 aa, Homo Sapiens
QECRRAITY

SEQ ID NO: 114526 - protein, 9 aa, Homo Sapiens
MLRKEAAQK

SEQ ID NO: 114527 - protein, 9 aa, Homo Sapiens
TSCGSSGRP

SEQ ID NO: 114528 - protein, 9 aa, Homo Sapiens
YRFFDHQST

SEQ ID NO: 114529 - protein, 9 aa, Homo Sapiens
WMLCDKKIQ

SEQ ID NO: 114530 - protein, 9 aa, Homo Sapiens
QGHNLSLHC

SEQ ID NO: 114531 - protein, 9 aa, Homo Sapiens
NTSFQLPSL

SEQ ID NO: 114532 - protein, 9 aa, Homo Sapiens
PSSLPRSMA

SEQ ID NO: 114533 - protein, 9 aa, Homo Sapiens
GGGRHVWSA

SEQ ID NO: 114534 - protein, 9 aa, Homo Sapiens
QGDNANSLH

SEQ ID NO: 114535 - protein, 9 aa, Homo Sapiens
RAGFGGWTC

SEQ ID NO: 114536 - protein, 9 aa, Homo Sapiens
SNKPKANYE

SEQ ID NO: 114537 - protein, 9 aa, Homo Sapiens
LDINDNAPK

SEQ ID NO: 114538 - protein, 9 aa, Homo Sapiens
DRNTSFQLP

SEQ ID NO: 114539 - protein, 9 aa, Homo Sapiens
NRGLKKKKQ

SEQ ID NO: 114540 - protein, 9 aa, Homo Sapiens
AFYKDGCRN

SEQ ID NO: 114541 - protein, 9 aa, Homo Sapiens
LVGFVSSSA

SEQ ID NO: 114542 - protein, 9 aa, Homo Sapiens
SCKNQQDLQ

SEQ ID NO: 114543 - protein, 9 aa, Homo Sapiens
EALFLQEVF

SEQ ID NO: 114544 - protein, 9 aa, Homo Sapiens
KVEKERLLD

SEQ ID NO: 114545 - protein, 9 aa, Homo Sapiens
NHLCCQVGI

SEQ ID NO: 114546 - protein, 9 aa, Homo Sapiens
EIQIEELTE

SEQ ID NO: 114547 - protein, 9 aa, Homo Sapiens
EKTHCDCNA

SEQ ID NO: 114548 - protein, 9 aa, Homo Sapiens
YVIAESFKF

SEQ ID NO: 114549 - protein, 9 aa, Homo Sapiens
VGFVSSSAL

SEQ ID NO: 114550 - protein, 9 aa, Homo Sapiens
LFLQEVFQA

SEQ ID NO: 114551 - protein, 9 aa, Homo Sapiens
ALSQLIPCV

SEQ ID NO: 114552 - protein, 9 aa, Homo Sapiens
SSAEKFRKM

SEQ ID NO: 114553 - protein, 9 aa, Homo Sapiens
AWLHGARGL

SEQ ID NO: 114554 - protein, 9 aa, Homo Sapiens
DKEEQTPLH

SEQ ID NO: 114555 - protein, 9 aa, Homo Sapiens
KDCPQRKCY

SEQ ID NO: 114556 - protein, 9 aa, Homo Sapiens
LSQLIPCVG

SEQ ID NO: 114557 - protein, 9 aa, Homo Sapiens
LHCQIGSQV

SEQ ID NO: 114558 - protein, 9 aa, Homo Sapiens
LGGGRHVWS

SEQ ID NO: 114559 - protein, 9 aa, Homo Sapiens
EGHVLLCRK

SEQ ID NO: 114560 - protein, 9 aa, Homo Sapiens
PAHSQNQLN

SEQ ID NO: 114561 - protein, 9 aa, Homo Sapiens
QLNFSSYSS

SEQ ID NO: 114562 - protein, 9 aa, Homo Sapiens
WSQPQPPPK

SEQ ID NO: 114563 - protein, 9 aa, Homo Sapiens
QTQLNHDLN

SEQ ID NO: 114564 - protein, 9 aa, Homo Sapiens
RGLGTPAPT

SEQ ID NO: 114565 - protein, 9 aa, Homo Sapiens
EELTERQQE

SEQ ID NO: 114566 - protein, 9 aa, Homo Sapiens
QASTSNTLS

SEQ ID NO: 114567 - protein, 9 aa, Homo Sapiens
FDIASEAFA

SEQ ID NO: 114568 - protein, 9 aa, Homo Sapiens
PGPGLSLLP

SEQ ID NO: 114569 - protein, 9 aa, Homo Sapiens
ILVSCKNQQ

SEQ ID NO: 114570 - protein, 9 aa, Homo Sapiens
GAAGPWPEA

SEQ ID NO: 114571 - protein, 9 aa, Homo Sapiens
QKMGQVPKK

SEQ ID NO: 114572 - protein, 9 aa, Homo Sapiens
PTKPGSNKP

SEQ ID NO: 114573 - protein, 9 aa, Homo Sapiens
GDPQRKEFL

SEQ ID NO: 114574 - protein, 9 aa, Homo Sapiens
NKPFYVIAE

SEQ ID NO: 114575 - protein, 9 aa, Homo Sapiens
AVEIQIEEL

SEQ ID NO: 114576 - protein, 9 aa, Homo Sapiens
PLASSLNLD

SEQ ID NO: 114577 - protein, 9 aa, Homo Sapiens
FKYQMLCDM

SEQ ID NO: 114578 - protein, 9 aa, Homo Sapiens
KNRENASSN

SEQ ID NO: 114579 - protein, 9 aa, Homo Sapiens
GQQGAAGPW

SEQ ID NO: 114580 - protein, 9 aa, Homo Sapiens
QVAKGMFER

SEQ ID NO: 114581 - protein, 9 aa, Homo Sapiens
SSGRPCPSL

SEQ ID NO: 114582 - protein, 9 aa, Homo Sapiens
VGVQNVAEL

SEQ ID NO: 114583 - protein, 9 aa, Homo Sapiens
NNSSEQHVS

SEQ ID NO: 114584 - protein, 9 aa, Homo Sapiens
TDFKYSQEF

SEQ ID NO: 114585 - protein, 9 aa, Homo Sapiens
LSCNFPHRP

SEQ ID NO: 114586 - protein, 9 aa, Homo Sapiens
GFGGSTSCG

SEQ ID NO: 114587 - protein, 9 aa, Homo Sapiens
QQGAAGPWP

SEQ ID NO: 114588 - protein, 9 aa, Homo Sapiens
PHRPDSGDV

SEQ ID NO: 114589 - protein, 9 aa, Homo Sapiens
IERILVSCK

SEQ ID NO: 114590 - protein, 9 aa, Homo Sapiens
VISLVGFVS

SEQ ID NO: 114591 - protein, 9 aa, Homo Sapiens
VSLFKYQML

SEQ ID NO: 114592 - protein, 9 aa, Homo Sapiens
HFWQLRFHL

SEQ ID NO: 114593 - protein, 9 aa, Homo Sapiens
RKQPKQRPA

SEQ ID NO: 114594 - protein, 9 aa, Homo Sapiens
FGGSTSCGS

SEQ ID NO: 114595 - protein, 9 aa, Homo Sapiens
SQPQPPPKE

SEQ ID NO: 114596 - protein, 9 aa, Homo Sapiens
FWQLRFHLM

SEQ ID NO: 114597 - protein, 9 aa, Homo Sapiens
GTTCKAFYK

SEQ ID NO: 114598 - protein, 9 aa, Homo Sapiens
TFDIASEAF

SEQ ID NO: 114599 - protein, 9 aa, Homo Sapiens
KEDQKPVRL

SEQ ID NO: 114600 - protein, 9 aa, Homo Sapiens
KPFYVIAES

SEQ ID NO: 114601 - protein, 9 aa, Homo Sapiens
VEIQIEELT

SEQ ID NO: 114602 - protein, 9 aa, Homo Sapiens
GVQNVAELK

SEQ ID NO: 114603 - protein, 9 aa, Homo Sapiens
ASSLNLDVP

SEQ ID NO: 114604 - protein, 9 aa, Homo Sapiens
KTHCDCNAD

SEQ ID NO: 114605 - protein, 9 aa, Homo Sapiens
SASPSIRSA

SEQ ID NO: 114606 - protein, 9 aa, Homo Sapiens
KKKRNRPEE

SEQ ID NO: 114607 - protein, 9 aa, Homo Sapiens
GEGGGGGEG

SEQ ID NO: 114608 - protein, 9 aa, Homo Sapiens
VSDRWLGEP

SEQ ID NO: 114609 - protein, 9 aa, Homo Sapiens
CMTSFVLGF

SEQ ID NO: 114610 - protein, 9 aa, Homo Sapiens
ELAEPGAHG

SEQ ID NO: 114611 - protein, 9 aa, Homo Sapiens
NPYQEPRSM

SEQ ID NO: 114612 - protein, 9 aa, Homo Sapiens
EKKEKDKKE

SEQ ID NO: 114613 - protein, 9 aa, Homo Sapiens
PRSMAAGGW

SEQ ID NO: 114614 - protein, 9 aa, Homo Sapiens
PSAPIPPQE

SEQ ID NO: 114615 - protein, 9 aa, Homo Sapiens
KLKGGDGGG

SEQ ID NO: 114616 - protein, 9 aa, Homo Sapiens
RKKKRNRPE

SEQ ID NO: 114617 - protein, 9 aa, Homo Sapiens
LVQEDFVLT

SEQ ID NO: 114618 - protein, 9 aa, Homo Sapiens
LPAAQAHRL

SEQ ID NO: 114619 - protein, 9 aa, Homo Sapiens
HFFEQHLHS

SEQ ID NO: 114620 - protein, 9 aa, Homo Sapiens
GRSILKPSA

SEQ ID NO: 114621 - protein, 9 aa, Homo Sapiens
YDFGKLKGG

SEQ ID NO: 114622 - protein, 9 aa, Homo Sapiens
VLPYPELAE

SEQ ID NO: 114623 - protein, 9 aa, Homo Sapiens
QRGSPVSSL

SEQ ID NO: 114624 - protein, 9 aa, Homo Sapiens
EGGGEEGGE

SEQ ID NO: 114625 - protein, 9 aa, Homo Sapiens
STEATNVET

SEQ ID NO: 114626 - protein, 9 aa, Homo Sapiens
TFMEQRGSP

SEQ ID NO: 114627 - protein, 9 aa, Homo Sapiens
FVWAALQGA

SEQ ID NO: 114628 - protein, 9 aa, Homo Sapiens
IPVLPYPEL

SEQ ID NO: 114629 - protein, 9 aa, Homo Sapiens
RSRSRRSRS

SEQ ID NO: 114630 - protein, 9 aa, Homo Sapiens
RSMAAGGWR

SEQ ID NO: 114631 - protein, 9 aa, Homo Sapiens
HPSTSTEAT

SEQ ID NO: 114632 - protein, 9 aa, Homo Sapiens
RNALGGHQQ

SEQ ID NO: 114633 - protein, 9 aa, Homo Sapiens
LLASMGESL

SEQ ID NO: 114634 - protein, 9 aa, Homo Sapiens
IRLSPNCPP

SEQ ID NO: 114635 - protein, 9 aa, Homo Sapiens
LYVKWKHCE

SEQ ID NO: 114636 - protein, 9 aa, Homo Sapiens
VVVNLSTST

SEQ ID NO: 114637 - protein, 9 aa, Homo Sapiens
IRSASSRAS

SEQ ID NO: 114638 - protein, 9 aa, Homo Sapiens
PGAPIGGQG

SEQ ID NO: 114639 - protein, 9 aa, Homo Sapiens
LTIDYVNHR

SEQ ID NO: 114640 - protein, 9 aa, Homo Sapiens
LGFVWAALQ

SEQ ID NO: 114641 - protein, 9 aa, Homo Sapiens
ADQWTLISG

SEQ ID NO: 114642 - protein, 9 aa, Homo Sapiens
KKLSTCETV

SEQ ID NO: 114643 - protein, 9 aa, Homo Sapiens
LGGHQQAPE

SEQ ID NO: 114644 - protein, 9 aa, Homo Sapiens
SIRLSPNCP

SEQ ID NO: 114645 - protein, 9 aa, Homo Sapiens
HRLYWADEN

SEQ ID NO: 114646 - protein, 9 aa, Homo Sapiens
GGFLVQEDF

SEQ ID NO: 114647 - protein, 9 aa, Homo Sapiens
ILKPSAPIP

SEQ ID NO: 114648 - protein, 9 aa, Homo Sapiens
EEERKKKRN

SEQ ID NO: 114649 - protein, 9 aa, Homo Sapiens
RLGFVWAAL

SEQ ID NO: 114650 - protein, 9 aa, Homo Sapiens
NVSHKRSSS

SEQ ID NO: 114651 - protein, 9 aa, Homo Sapiens
GGGEEGGEG

SEQ ID NO: 114652 - protein, 9 aa, Homo Sapiens
ASMGESLPA

SEQ ID NO: 114653 - protein, 9 aa, Homo Sapiens
EGGVVVHFF

SEQ ID NO: 114654 - protein, 9 aa, Homo Sapiens
SASSRASTS

SEQ ID NO: 114655 - protein, 9 aa, Homo Sapiens
KDKKEKKEK

SEQ ID NO: 114656 - protein, 9 aa, Homo Sapiens
SILKPSAPI

SEQ ID NO: 114657 - protein, 9 aa, Homo Sapiens
NLSTSTRRY

SEQ ID NO: 114658 - protein, 9 aa, Homo Sapiens
EPELYVKWK

SEQ ID NO: 114659 - protein, 9 aa, Homo Sapiens
DRYLTFMEQ

SEQ ID NO: 114660 - protein, 9 aa, Homo Sapiens
LVSASASPS

SEQ ID NO: 114661 - protein, 9 aa, Homo Sapiens
QEQQRLGFV

SEQ ID NO: 114662 - protein, 9 aa, Homo Sapiens
VVVHFFEQH

SEQ ID NO: 114663 - protein, 9 aa, Homo Sapiens
SPNCPPLGG

SEQ ID NO: 114664 - protein, 9 aa, Homo Sapiens
STSTRRYAA

SEQ ID NO: 114665 - protein, 9 aa, Homo Sapiens
ALGGHQQAP

SEQ ID NO: 114666 - protein, 9 aa, Homo Sapiens
DTLRLSDCS

SEQ ID NO: 114667 - protein, 9 aa, Homo Sapiens
NEGGVVVHF

SEQ ID NO: 114668 - protein, 9 aa, Homo Sapiens
WQERPGAPI

SEQ ID NO: 114669 - protein, 9 aa, Homo Sapiens
TPPADQWTL

SEQ ID NO: 114670 - protein, 9 aa, Homo Sapiens
PYQEPRSMA

SEQ ID NO: 114671 - protein, 9 aa, Homo Sapiens
NRPEEGSCC

SEQ ID NO: 114672 - protein, 9 aa, Homo Sapiens
LKPSAPIPP

SEQ ID NO: 114673 - protein, 9 aa, Homo Sapiens
SIRSASSRA

SEQ ID NO: 114674 - protein, 9 aa, Homo Sapiens
CSCARRIRS

SEQ ID NO: 114675 - protein, 9 aa, Homo Sapiens
QEPRSMAAG

SEQ ID NO: 114676 - protein, 9 aa, Homo Sapiens
QRLGFVWAA

SEQ ID NO: 114677 - protein, 9 aa, Homo Sapiens
YPELAEPGA

SEQ ID NO: 114678 - protein, 9 aa, Homo Sapiens
PSTSTEATN

SEQ ID NO: 114679 - protein, 9 aa, Homo Sapiens
DREVVKNLI

SEQ ID NO: 114680 - protein, 9 aa, Homo Sapiens
SNHVSDRWL

SEQ ID NO: 114681 - protein, 9 aa, Homo Sapiens
GHQQAPERE

SEQ ID NO: 114682 - protein, 9 aa, Homo Sapiens
VQEDFVLTA

SEQ ID NO: 114683 - protein, 9 aa, Homo Sapiens
ERPGAPIGG

SEQ ID NO: 114684 - protein, 9 aa, Homo Sapiens
EGGEGGGGG

SEQ ID NO: 114685 - protein, 9 aa, Homo Sapiens
SNVSHKRSS

SEQ ID NO: 114686 - protein, 9 aa, Homo Sapiens
RRRGETKSE

SEQ ID NO: 114687 - protein, 9 aa, Homo Sapiens
SASASPSIR

SEQ ID NO: 114688 - protein, 9 aa, Homo Sapiens
MAAGGWRHR

SEQ ID NO: 114689 - protein, 9 aa, Homo Sapiens
TSTEATNVE

SEQ ID NO: 114690 - protein, 9 aa, Homo Sapiens
ESLPAAQAH

SEQ ID NO: 114691 - protein, 9 aa, Homo Sapiens
LRRRRGETK

SEQ ID NO: 114692 - protein, 9 aa, Homo Sapiens
DLPSNHVSD

SEQ ID NO: 114693 - protein, 9 aa, Homo Sapiens
SAPIPPQEG

SEQ ID NO: 114694 - protein, 9 aa, Homo Sapiens
NALGGHQQA

SEQ ID NO: 114695 - protein, 9 aa, Homo Sapiens
GESLPAAQA

SEQ ID NO: 114696 - protein, 9 aa, Homo Sapiens
ILFVAEGFV

SEQ ID NO: 114697 - protein, 9 aa, Homo Sapiens
VNCMTSFVL

SEQ ID NO: 114698 - protein, 9 aa, Homo Sapiens
TSTRRYAAL

SEQ ID NO: 114699 - protein, 9 aa, Homo Sapiens
EILFVAEGF

SEQ ID NO: 114700 - protein, 9 aa, Homo Sapiens
EQRGSPVSS

SEQ ID NO: 114701 - protein, 9 aa, Homo Sapiens
EEREPELYV

SEQ ID NO: 114702 - protein, 9 aa, Homo Sapiens
LPDETKPRD

SEQ ID NO: 114703 - protein, 9 aa, Homo Sapiens
LTFMEQRGS

SEQ ID NO: 114704 - protein, 9 aa, Homo Sapiens
NHVSDRWLG

SEQ ID NO: 114705 - protein, 9 aa, Homo Sapiens
LPEKKLSTC

SEQ ID NO: 114706 - protein, 9 aa, Homo Sapiens
RSILKPSAP

SEQ ID NO: 114707 - protein, 9 aa, Homo Sapiens
NCMTSFVLG

SEQ ID NO: 114708 - protein, 9 aa, Homo Sapiens
KEKDKKEAP

SEQ ID NO: 114709 - protein, 9 aa, Homo Sapiens
LRRSNVSHK

SEQ ID NO: 114710 - protein, 9 aa, Homo Sapiens
CEILFVAEG

SEQ ID NO: 114711 - protein, 9 aa, Homo Sapiens
HVSDRWLGE

SEQ ID NO: 114712 - protein, 9 aa, Homo Sapiens
TIDYVNHRL

SEQ ID NO: 114713 - protein, 9 aa, Homo Sapiens
YLTFMEQRG

SEQ ID NO: 114714 - protein, 9 aa, Homo Sapiens
LGFVIFTVL

SEQ ID NO: 114715 - protein, 9 aa, Homo Sapiens
RYLTFMEQR

SEQ ID NO: 114716 - protein, 9 aa, Homo Sapiens
RDTHVEFSK

SEQ ID NO: 114717 - protein, 9 aa, Homo Sapiens
LRLSDCSVT

SEQ ID NO: 114718 - protein, 9 aa, Homo Sapiens
KRNRPEEGS

SEQ ID NO: 114719 - protein, 9 aa, Homo Sapiens
RRSNVSHKR

SEQ ID NO: 114720 - protein, 9 aa, Homo Sapiens
EATNVETTS

SEQ ID NO: 114721 - protein, 9 aa, Homo Sapiens
VNHRLYWAD

SEQ ID NO: 114722 - protein, 9 aa, Homo Sapiens
TKPRDTHVE

SEQ ID NO: 114723 - protein, 9 aa, Homo Sapiens
CPPLGGSCR

SEQ ID NO: 114724 - protein, 9 aa, Homo Sapiens
DETKPRDTH

SEQ ID NO: 114725 - protein, 9 aa, Homo Sapiens
GVVVHFFEQ

SEQ ID NO: 114726 - protein, 9 aa, Homo Sapiens
EEGSCCSCA

SEQ ID NO: 114727 - protein, 9 aa, Homo Sapiens
EKKLSTCET

SEQ ID NO: 114728 - protein, 9 aa, Homo Sapiens
AMHPSTSTE

SEQ ID NO: 114729 - protein, 9 aa, Homo Sapiens
GEEGGEGGG

SEQ ID NO: 114730 - protein, 9 aa, Homo Sapiens
CGGFLVQED

SEQ ID NO: 114731 - protein, 9 aa, Homo Sapiens
VSASASPSI

SEQ ID NO: 114732 - protein, 9 aa, Homo Sapiens
EKDKKEAPA

SEQ ID NO: 114733 - protein, 9 aa, Homo Sapiens
VIPTPPADQ

SEQ ID NO: 114734 - protein, 9 aa, Homo Sapiens
SLPEKKLST

SEQ ID NO: 114735 - protein, 9 aa, Homo Sapiens
RSASSRAST

SEQ ID NO: 114736 - protein, 9 aa, Homo Sapiens
PELYVKWKH

SEQ ID NO: 114737 - protein, 9 aa, Homo Sapiens
KPRDTHVEF

SEQ ID NO: 114738 - protein, 9 aa, Homo Sapiens
IAPELSEKT

SEQ ID NO: 114739 - protein, 9 aa, Homo Sapiens
GSCCSCARR

SEQ ID NO: 114740 - protein, 9 aa, Homo Sapiens
SRCGGFLVQ

SEQ ID NO: 114741 - protein, 9 aa, Homo Sapiens
VNLSTSTRR

SEQ ID NO: 114742 - protein, 9 aa, Homo Sapiens
LSTSTRRYA

SEQ ID NO: 114743 - protein, 9 aa, Homo Sapiens
GGEGGGGGE

SEQ ID NO: 114744 - protein, 9 aa, Homo Sapiens
DKDKKEKKE

SEQ ID NO: 114745 - protein, 9 aa, Homo Sapiens
ELYVKWKHC

SEQ ID NO: 114746 - protein, 9 aa, Homo Sapiens
TSFVLGFVI

SEQ ID NO: 114747 - protein, 9 aa, Homo Sapiens
FMEQRGSPV

SEQ ID NO: 114748 - protein, 9 aa, Homo Sapiens
SMAAGGWRH

SEQ ID NO: 114749 - protein, 9 aa, Homo Sapiens
DFGKLKGGD

SEQ ID NO: 114750 - protein, 9 aa, Homo Sapiens
LYDFGKLKG

SEQ ID NO: 114751 - protein, 9 aa, Homo Sapiens
LFVAEGFVD

SEQ ID NO: 114752 - protein, 9 aa, Homo Sapiens
IRPSQEDRE

SEQ ID NO: 114753 - protein, 9 aa, Homo Sapiens
LICEILFVA

SEQ ID NO: 114754 - protein, 9 aa, Homo Sapiens
FGKLKGGDG

SEQ ID NO: 114755 - protein, 9 aa, Homo Sapiens
KKEKKEKDK

SEQ ID NO: 114756 - protein, 9 aa, Homo Sapiens
EERKKKRNR

SEQ ID NO: 114757 - protein, 9 aa, Homo Sapiens
VVNLSTSTR

SEQ ID NO: 114758 - protein, 9 aa, Homo Sapiens
DYVNHRLYW

SEQ ID NO: 114759 - protein, 9 aa, Homo Sapiens
TSCKCDSHR

SEQ ID NO: 114760 - protein, 9 aa, Homo Sapiens
ELSEKTSCK

SEQ ID NO: 114761 - protein, 9 aa, Homo Sapiens
EEGGEGGGG

SEQ ID NO: 114762 - protein, 9 aa, Homo Sapiens
GKLKGGDGG

SEQ ID NO: 114763 - protein, 9 aa, Homo Sapiens
FLVQEDFVL

SEQ ID NO: 114764 - protein, 9 aa, Homo Sapiens
HKRSSSLGG

SEQ ID NO: 114765 - protein, 9 aa, Homo Sapiens
QWTLISGLP

SEQ ID NO: 114766 - protein, 9 aa, Homo Sapiens
ADLPSNHVS

SEQ ID NO: 114767 - protein, 9 aa, Homo Sapiens
KEKKEKDKK

SEQ ID NO: 114768 - protein, 9 aa, Homo Sapiens
YQEPRSMAA

SEQ ID NO: 114769 - protein, 9 aa, Homo Sapiens
LSTCETVDF

SEQ ID NO: 114770 - protein, 9 aa, Homo Sapiens
STRRYAALS

SEQ ID NO: 114771 - protein, 9 aa, Homo Sapiens
RASTSWCSA

SEQ ID NO: 114772 - protein, 9 aa, Homo Sapiens
QEDREVVKN

SEQ ID NO: 114773 - protein, 9 aa, Homo Sapiens
PRDTHVEFS

SEQ ID NO: 114774 - protein, 9 aa, Homo Sapiens
QQRLGFVWA

SEQ ID NO: 114775 - protein, 9 aa, Homo Sapiens
VLGFVIFTV

SEQ ID NO: 114776 - protein, 9 aa, Homo Sapiens
LSPNCPPLG

SEQ ID NO: 114777 - protein, 9 aa, Homo Sapiens
VKWKHCETP

SEQ ID NO: 114778 - protein, 9 aa, Homo Sapiens
SEKTSCKCD

SEQ ID NO: 114779 - protein, 9 aa, Homo Sapiens
SRSRRSRSQ

SEQ ID NO: 114780 - protein, 9 aa, Homo Sapiens
CCSCARRIR

SEQ ID NO: 114781 - protein, 9 aa, Homo Sapiens
FVLGFVIFT

SEQ ID NO: 114782 - protein, 9 aa, Homo Sapiens
ISLPEKKLS

SEQ ID NO: 114783 - protein, 9 aa, Homo Sapiens
RPSQEDREV

SEQ ID NO: 114784 - protein, 9 aa, Homo Sapiens
PYPELAEPG

SEQ ID NO: 114785 - protein, 9 aa, Homo Sapiens
ASASPSIRS

SEQ ID NO: 114786 - protein, 9 aa, Homo Sapiens
RCGGFLVQE

SEQ ID NO: 114787 - protein, 9 aa, Homo Sapiens
KSEEFEKLK

SEQ ID NO: 114788 - protein, 9 aa, Homo Sapiens
RLSDCSVTA

SEQ ID NO: 114789 - protein, 9 aa, Homo Sapiens
STCETVDFW

SEQ ID NO: 114790 - protein, 9 aa, Homo Sapiens
APIPPQEGE

SEQ ID NO: 114791 - protein, 9 aa, Homo Sapiens
PELAEPGAH

SEQ ID NO: 114792 - protein, 9 aa, Homo Sapiens
LRSLYDFGK

SEQ ID NO: 114793 - protein, 9 aa, Homo Sapiens
RPEEGSCCS

SEQ ID NO: 114794 - protein, 9 aa, Homo Sapiens
PEKKLSTCE

SEQ ID NO: 114795 - protein, 9 aa, Homo Sapiens
ASTSWCSAA

SEQ ID NO: 114796 - protein, 9 aa, Homo Sapiens
TKSEEFEKL

SEQ ID NO: 114797 - protein, 9 aa, Homo Sapiens
RNEGGVVVH

SEQ ID NO: 114798 - protein, 9 aa, Homo Sapiens
RNRPEEGSC

SEQ ID NO: 114799 - protein, 9 aa, Homo Sapiens
EKTSCKCDS

SEQ ID NO: 114800 - protein, 9 aa, Homo Sapiens
IDYVNHRLY

SEQ ID NO: 114801 - protein, 9 aa, Homo Sapiens
VSHKRSSSL

SEQ ID NO: 114802 - protein, 9 aa, Homo Sapiens
YVKWKHCET

SEQ ID NO: 114803 - protein, 9 aa, Homo Sapiens
PSIRSASSR

SEQ ID NO: 114804 - protein, 9 aa, Homo Sapiens
SQEDREVVK

SEQ ID NO: 114805 - protein, 9 aa, Homo Sapiens
RRRRGETKS

SEQ ID NO: 114806 - protein, 9 aa, Homo Sapiens
ALTIDYVNH

SEQ ID NO: 114807 - protein, 9 aa, Homo Sapiens
LASMGESLP

SEQ ID NO: 114808 - protein, 9 aa, Homo Sapiens
PELSEKTSC

SEQ ID NO: 114809 - protein, 9 aa, Homo Sapiens
KPSAPIPPQ

SEQ ID NO: 114810 - protein, 9 aa, Homo Sapiens
ASIRLSPNC

SEQ ID NO: 114811 - protein, 9 aa, Homo Sapiens
QAPERERRS

SEQ ID NO: 114812 - protein, 9 aa, Homo Sapiens
EDREVVKNL

SEQ ID NO: 114813 - protein, 9 aa, Homo Sapiens
RGETKSEEF

SEQ ID NO: 114814 - protein, 9 aa, Homo Sapiens
PSNHVSDRW

SEQ ID NO: 114815 - protein, 9 aa, Homo Sapiens
DIRPSQEDR

SEQ ID NO: 114816 - protein, 9 aa, Homo Sapiens
PADQWTLIS

SEQ ID NO: 114817 - protein, 9 aa, Homo Sapiens
LPYPELAEP

SEQ ID NO: 114818 - protein, 9 aa, Homo Sapiens
PTPPADQWT

SEQ ID NO: 114819 - protein, 9 aa, Homo Sapiens
RPGAPIGGQ

SEQ ID NO: 114820 - protein, 9 aa, Homo Sapiens
TLRRSNVSH

SEQ ID NO: 114821 - protein, 9 aa, Homo Sapiens
MTSFVLGFV

SEQ ID NO: 114822 - protein, 9 aa, Homo Sapiens
SHKRSSSLG

SEQ ID NO: 114823 - protein, 9 aa, Homo Sapiens
PIGGQGDPA

SEQ ID NO: 114824 - protein, 9 aa, Homo Sapiens
VVHFFEQHL

SEQ ID NO: 114825 - protein, 9 aa, Homo Sapiens
GAPIGGQGD

SEQ ID NO: 114826 - protein, 9 aa, Homo Sapiens
KKRNRPEEG

SEQ ID NO: 114827 - protein, 9 aa, Homo Sapiens
EPRSMAAGG

SEQ ID NO: 114828 - protein, 9 aa, Homo Sapiens
IGGQGDPAV

SEQ ID NO: 114829 - protein, 9 aa, Homo Sapiens
SLPAAQAHR

SEQ ID NO: 114830 - protein, 9 aa, Homo Sapiens
PNCPPLGGS

SEQ ID NO: 114831 - protein, 9 aa, Homo Sapiens
ASSRASTSW

SEQ ID NO: 114832 - protein, 9 aa, Homo Sapiens
GGVVVHFFE

SEQ ID NO: 114833 - protein, 9 aa, Homo Sapiens
SDRWLGEPI

SEQ ID NO: 114834 - protein, 9 aa, Homo Sapiens
REPELYVKW

SEQ ID NO: 114835 - protein, 9 aa, Homo Sapiens
SPSIRSASS

SEQ ID NO: 114836 - protein, 9 aa, Homo Sapiens
KTSCKCDSH

SEQ ID NO: 114837 - protein, 9 aa, Homo Sapiens
SRASTSWCS

SEQ ID NO: 114838 - protein, 9 aa, Homo Sapiens
PVLPYPELA

SEQ ID NO: 114839 - protein, 9 aa, Homo Sapiens
SFVLGFVIF

SEQ ID NO: 114840 - protein, 9 aa, Homo Sapiens
REVVKNLIL

SEQ ID NO: 114841 - protein, 9 aa, Homo Sapiens
PEEGSCCSC

SEQ ID NO: 114842 - protein, 9 aa, Homo Sapiens
RSNVSHKRS

SEQ ID NO: 114843 - protein, 9 aa, Homo Sapiens
QQAPERERR

SEQ ID NO: 114844 - protein, 9 aa, Homo Sapiens
QERPGAPIG

SEQ ID NO: 114845 - protein, 9 aa, Homo Sapiens
ERKKKRNRP

SEQ ID NO: 114846 - protein, 9 aa, Homo Sapiens
KEEERKKKR

SEQ ID NO: 114847 - protein, 9 aa, Homo Sapiens
NHRLYWADE

SEQ ID NO: 114848 - protein, 9 aa, Homo Sapiens
TRRYAALSL

SEQ ID NO: 114849 - protein, 9 aa, Homo Sapiens
ICEILFVAE

SEQ ID NO: 114850 - protein, 9 aa, Homo Sapiens
GFVWAALQG

SEQ ID NO: 114851 - protein, 9 aa, Homo Sapiens
LAEPGAHGG

SEQ ID NO: 114852 - protein, 9 aa, Homo Sapiens
EGSCCSCAR

SEQ ID NO: 114853 - protein, 9 aa, Homo Sapiens
SLYDFGKLK

SEQ ID NO: 114854 - protein, 9 aa, Homo Sapiens
LPSNHVSDR

SEQ ID NO: 114855 - protein, 9 aa, Homo Sapiens
QEDFVLTAA

SEQ ID NO: 114856 - protein, 9 aa, Homo Sapiens
VHFFEQHLH

SEQ ID NO: 114857 - protein, 9 aa, Homo Sapiens
ASPSIRSAS

SEQ ID NO: 114858 - protein, 9 aa, Homo Sapiens
SCCSCARRI

SEQ ID NO: 114859 - protein, 9 aa, Homo Sapiens
EEGGGEEGG

SEQ ID NO: 114860 - protein, 9 aa, Homo Sapiens
RLSPNCPPL

SEQ ID NO: 114861 - protein, 9 aa, Homo Sapiens
PPADQWTLI

SEQ ID NO: 114862 - protein, 9 aa, Homo Sapiens
FVAEGFVDA

SEQ ID NO: 114863 - protein, 9 aa, Homo Sapiens
PSQEDREVV

SEQ ID NO: 114864 - protein, 9 aa, Homo Sapiens
EQQRLGFVW

SEQ ID NO: 114865 - protein, 9 aa, Homo Sapiens
IELICEILF

SEQ ID NO: 114866 - protein, 9 aa, Homo Sapiens
TLRLSDCSV

SEQ ID NO: 114867 - protein, 9 aa, Homo Sapiens
GGEEGGEGG

SEQ ID NO: 114868 - protein, 9 aa, Homo Sapiens
EREPELYVK

SEQ ID NO: 114869 - protein, 9 aa, Homo Sapiens
RSLYDFGKL

SEQ ID NO: 114870 - protein, 9 aa, Homo Sapiens
MHPSTSTEA

SEQ ID NO: 114871 - protein, 9 aa, Homo Sapiens
PDETKPRDT

SEQ ID NO: 114872 - protein, 9 aa, Homo Sapiens
HQQAPERER

SEQ ID NO: 114873 - protein, 9 aa, Homo Sapiens
STSTEATNV

SEQ ID NO: 114874 - protein, 9 aa, Homo Sapiens
ETKSEEFEK

SEQ ID NO: 114875 - protein, 9 aa, Homo Sapiens
ETKPRDTHV

SEQ ID NO: 114876 - protein, 9 aa, Homo Sapiens
APIGGQGDP

SEQ ID NO: 114877 - protein, 9 aa, Homo Sapiens
SMGESLPAA

SEQ ID NO: 114878 - protein, 9 aa, Homo Sapiens
LSEKTSCKC

SEQ ID NO: 114879 - protein, 9 aa, Homo Sapiens
KKEKDKKEA

SEQ ID NO: 114880 - protein, 9 aa, Homo Sapiens
SSRASTSWC

SEQ ID NO: 114881 - protein, 9 aa, Homo Sapiens
LSDCSVTAQ

SEQ ID NO: 114882 - protein, 9 aa, Homo Sapiens
KLSTCETVD

SEQ ID NO: 114883 - protein, 9 aa, Homo Sapiens
DQWTLISGL

SEQ ID NO: 114884 - protein, 9 aa, Homo Sapiens
APELSEKTS

SEQ ID NO: 114885 - protein, 9 aa, Homo Sapiens
MEQRGSPVS

SEQ ID NO: 114886 - protein, 9 aa, Homo Sapiens
RRGETKSEE

SEQ ID NO: 114887 - protein, 9 aa, Homo Sapiens
TEATNVETT

SEQ ID NO: 114888 - protein, 9 aa, Homo Sapiens
LQEQQRLGF

SEQ ID NO: 114889 - protein, 9 aa, Homo Sapiens
NCPPLGGSC

SEQ ID NO: 114890 - protein, 9 aa, Homo Sapiens
DTHVEFSKE

SEQ ID NO: 114891 - protein, 9 aa, Homo Sapiens
GFLVQEDFV

SEQ ID NO: 114892 - protein, 9 aa, Homo Sapiens
DKKEKKEKD

SEQ ID NO: 114893 - protein, 9 aa, Homo Sapiens
MGESLPAAQ

SEQ ID NO: 114894 - protein, 9 aa, Homo Sapiens
IPTPPADQW

SEQ ID NO: 114895 - protein, 9 aa, Homo Sapiens
GGHQQAPER

SEQ ID NO: 114896 - protein, 9 aa, Homo Sapiens
ELICEILFV

SEQ ID NO: 114897 - protein, 9 aa, Homo Sapiens
GETKSEEFE

SEQ ID NO: 114898 - protein, 9 aa, Homo Sapiens
YVNHRLYWA

SEQ ID NO: 114899 - protein, 9 aa, Homo Sapiens
SASPSIRSA

SEQ ID NO: 114900 - protein, 9 aa, Homo Sapiens
KLFSFLKRK

SEQ ID NO: 114901 - protein, 9 aa, Homo Sapiens
YAVEVQYDV

SEQ ID NO: 114902 - protein, 9 aa, Homo Sapiens
AKHKSVISW

SEQ ID NO: 114903 - protein, 9 aa, Homo Sapiens
LDETGNSFK

SEQ ID NO: 114904 - protein, 9 aa, Homo Sapiens
FGVKHYAVE

SEQ ID NO: 114905 - protein, 9 aa, Homo Sapiens
TDTFNRSPL

SEQ ID NO: 114906 - protein, 9 aa, Homo Sapiens
LMGSSPVLN

SEQ ID NO: 114907 - protein, 9 aa, Homo Sapiens
LPPLLGSGS

SEQ ID NO: 114908 - protein, 9 aa, Homo Sapiens
YYSGSLESK

SEQ ID NO: 114909 - protein, 9 aa, Homo Sapiens
APSLRKCHI

SEQ ID NO: 114910 - protein, 9 aa, Homo Sapiens
NHFSTAFCK

SEQ ID NO: 114911 - protein, 9 aa, Homo Sapiens
RLKQQELLL

SEQ ID NO: 114912 - protein, 9 aa, Homo Sapiens
VMEKVTKED

SEQ ID NO: 114913 - protein, 9 aa, Homo Sapiens
ADAGPGPKP

SEQ ID NO: 114914 - protein, 9 aa, Homo Sapiens
LLPDGCHAV

SEQ ID NO: 114915 - protein, 9 aa, Homo Sapiens
RSASSRAST

SEQ ID NO: 114916 - protein, 9 aa, Homo Sapiens
VVGQHQGVF

SEQ ID NO: 114917 - protein, 9 aa, Homo Sapiens
IVDPIRSHL

SEQ ID NO: 114918 - protein, 9 aa, Homo Sapiens
ADPAVDRHH

SEQ ID NO: 114919 - protein, 9 aa, Homo Sapiens
EFTPTQAFP

SEQ ID NO: 114920 - protein, 9 aa, Homo Sapiens
HLLSDQTDT

SEQ ID NO: 114921 - protein, 9 aa, Homo Sapiens
HHERKSKQL

SEQ ID NO: 114922 - protein, 9 aa, Homo Sapiens
LSKLKRARS

SEQ ID NO: 114923 - protein, 9 aa, Homo Sapiens
TIVKKILSK

SEQ ID NO: 114924 - protein, 9 aa, Homo Sapiens
NKYVASSYL

SEQ ID NO: 114925 - protein, 9 aa, Homo Sapiens
YTPEPGEKW

SEQ ID NO: 114926 - protein, 9 aa, Homo Sapiens
PFLYVWTLI

SEQ ID NO: 114927 - protein, 9 aa, Homo Sapiens
LLLQAMRNI

SEQ ID NO: 114928 - protein, 9 aa, Homo Sapiens
FSQIIFKKH

SEQ ID NO: 114929 - protein, 9 aa, Homo Sapiens
DLLPDGCHA

SEQ ID NO: 114930 - protein, 9 aa, Homo Sapiens
MDEITHGAN

SEQ ID NO: 114931 - protein, 9 aa, Homo Sapiens
ETYLGSEFV

SEQ ID NO: 114932 - protein, 9 aa, Homo Sapiens
KLAQDLVYK

SEQ ID NO: 114933 - protein, 9 aa, Homo Sapiens
TCHDTIDDL

SEQ ID NO: 114934 - protein, 9 aa, Homo Sapiens
FDVLTAFNA

SEQ ID NO: 114935 - protein, 9 aa, Homo Sapiens
PNRWCFYSY

SEQ ID NO: 114936 - protein, 9 aa, Homo Sapiens
ENSGLQHNS

SEQ ID NO: 114937 - protein, 9 aa, Homo Sapiens
PKPCATLVQ

SEQ ID NO: 114938 - protein, 9 aa, Homo Sapiens
KSKQLCQEK

SEQ ID NO: 114939 - protein, 9 aa, Homo Sapiens
IDDSKGAME

SEQ ID NO: 114940 - protein, 9 aa, Homo Sapiens
CCDTLDLSA

SEQ ID NO: 114941 - protein, 9 aa, Homo Sapiens
FLETNHFST

SEQ ID NO: 114942 - protein, 9 aa, Homo Sapiens
GAMERANGM

SEQ ID NO: 114943 - protein, 9 aa, Homo Sapiens
SIRSASSRA

SEQ ID NO: 114944 - protein, 9 aa, Homo Sapiens
DPGYPKSIS

SEQ ID NO: 114945 - protein, 9 aa, Homo Sapiens
WDEHLSEQN

SEQ ID NO: 114946 - protein, 9 aa, Homo Sapiens
LSEQNVPFI

SEQ ID NO: 114947 - protein, 9 aa, Homo Sapiens
LKRKNETRS

SEQ ID NO: 114948 - protein, 9 aa, Homo Sapiens
KYVASSYLS

SEQ ID NO: 114949 - protein, 9 aa, Homo Sapiens
VRLLMLDYQ

SEQ ID NO: 114950 - protein, 9 aa, Homo Sapiens
QALLYETLD

SEQ ID NO: 114951 - protein, 9 aa, Homo Sapiens
TIEWYKGGD

SEQ ID NO: 114952 - protein, 9 aa, Homo Sapiens
QALRVLIAL

SEQ ID NO: 114953 - protein, 9 aa, Homo Sapiens
PDMNSEDVD

SEQ ID NO: 114954 - protein, 9 aa, Homo Sapiens
AYEPADTAM

SEQ ID NO: 114955 - protein, 9 aa, Homo Sapiens
AGPGPKPCA

SEQ ID NO: 114956 - protein, 9 aa, Homo Sapiens
RGKKSYECS

SEQ ID NO: 114957 - protein, 9 aa, Homo Sapiens
IEWYKGGDR

SEQ ID NO: 114958 - protein, 9 aa, Homo Sapiens
VDPIRSHLH

SEQ ID NO: 114959 - protein, 9 aa, Homo Sapiens
LQAPPGIPG

SEQ ID NO: 114960 - protein, 9 aa, Homo Sapiens
CHAVVEVED

SEQ ID NO: 114961 - protein, 9 aa, Homo Sapiens
NKLFSFLKR

SEQ ID NO: 114962 - protein, 9 aa, Homo Sapiens
TPLTVSCGG

SEQ ID NO: 114963 - protein, 9 aa, Homo Sapiens
QNSHGGSLM

SEQ ID NO: 114964 - protein, 9 aa, Homo Sapiens
LQKEIRRKF

SEQ ID NO: 114965 - protein, 9 aa, Homo Sapiens
GELPLCSRI

SEQ ID NO: 114966 - protein, 9 aa, Homo Sapiens
CPVLFVHCL

SEQ ID NO: 114967 - protein, 9 aa, Homo Sapiens
PKADPAVDR

SEQ ID NO: 114968 - protein, 9 aa, Homo Sapiens
ELLLQAMRN

SEQ ID NO: 114969 - protein, 9 aa, Homo Sapiens
GGGSLSLHP

SEQ ID NO: 114970 - protein, 9 aa, Homo Sapiens
KAEKQALLY

SEQ ID NO: 114971 - protein, 9 aa, Homo Sapiens
TPDMNSEDV

SEQ ID NO: 114972 - protein, 9 aa, Homo Sapiens
PTQAFPALQ

SEQ ID NO: 114973 - protein, 9 aa, Homo Sapiens
CPICSGIIK

SEQ ID NO: 114974 - protein, 9 aa, Homo Sapiens
TNHFSTAFC

SEQ ID NO: 114975 - protein, 9 aa, Homo Sapiens
RGVHFILNK

SEQ ID NO: 114976 - protein, 9 aa, Homo Sapiens
IRRKFGSFI

SEQ ID NO: 114977 - protein, 9 aa, Homo Sapiens
PYHVRERAW

SEQ ID NO: 114978 - protein, 9 aa, Homo Sapiens
MTAYWTNFA

SEQ ID NO: 114979 - protein, 9 aa, Homo Sapiens
CFYSYCEQL

SEQ ID NO: 114980 - protein, 9 aa, Homo Sapiens
LPDGCHAVV

SEQ ID NO: 114981 - protein, 9 aa, Homo Sapiens
FRHMIKLKT

SEQ ID NO: 114982 - protein, 9 aa, Homo Sapiens
VCIFICVEA

SEQ ID NO: 114983 - protein, 9 aa, Homo Sapiens
WTLISKNFA

SEQ ID NO: 114984 - protein, 9 aa, Homo Sapiens
KHYAVEVQY

SEQ ID NO: 114985 - protein, 9 aa, Homo Sapiens
ALQTYRAHL

SEQ ID NO: 114986 - protein, 9 aa, Homo Sapiens
DETGNSFKV

SEQ ID NO: 114987 - protein, 9 aa, Homo Sapiens
IRSHLHVLY

SEQ ID NO: 114988 - protein, 9 aa, Homo Sapiens
SELDLLGML

SEQ ID NO: 114989 - protein, 9 aa, Homo Sapiens
DDGEHAKHK

SEQ ID NO: 114990 - protein, 9 aa, Homo Sapiens
LPLCSRIVS

SEQ ID NO: 114991 - protein, 9 aa, Homo Sapiens
SALQTYRAH

SEQ ID NO: 114992 - protein, 9 aa, Homo Sapiens
YHVRERAWL

SEQ ID NO: 114993 - protein, 9 aa, Homo Sapiens
EEEEEEAKH

SEQ ID NO: 114994 - protein, 9 aa, Homo Sapiens
GVKHYAVEV

SEQ ID NO: 114995 - protein, 9 aa, Homo Sapiens
VEAVQGNCV

SEQ ID NO: 114996 - protein, 9 aa, Homo Sapiens
TKQVLKLAQ

SEQ ID NO: 114997 - protein, 9 aa, Homo Sapiens
FERIDDSKG

SEQ ID NO: 114998 - protein, 9 aa, Homo Sapiens
ESPLQALRV

SEQ ID NO: 114999 - protein, 9 aa, Homo Sapiens
ALRVLIALL

SEQ ID NO: 115000 - protein, 9 aa, Homo Sapiens
SFLKRKNET

SEQ ID NO: 115001 - protein, 9 aa, Homo Sapiens
DGKLSLEQF

SEQ ID NO: 115002 - protein, 9 aa, Homo Sapiens
ALLYETLDL

SEQ ID NO: 115003 - protein, 9 aa, Homo Sapiens
LVLISLSGD

SEQ ID NO: 115004 - protein, 9 aa, Homo Sapiens
RSHLHVLYH

SEQ ID NO: 115005 - protein, 9 aa, Homo Sapiens
PSLRKCHIC

SEQ ID NO: 115006 - protein, 9 aa, Homo Sapiens
QELPALADN

SEQ ID NO: 115007 - protein, 9 aa, Homo Sapiens
VLFVHCLYQ

SEQ ID NO: 115008 - protein, 9 aa, Homo Sapiens
EQLEEEEEE

SEQ ID NO: 115009 - protein, 9 aa, Homo Sapiens
TYEFLMAEN

SEQ ID NO: 115010 - protein, 9 aa, Homo Sapiens
QQLIYLLEN

SEQ ID NO: 115011 - protein, 9 aa, Homo Sapiens
YLGSEFVTG

SEQ ID NO: 115012 - protein, 9 aa, Homo Sapiens
DGEHAKHKS

SEQ ID NO: 115013 - protein, 9 aa, Homo Sapiens
KLGFTIDNV

SEQ ID NO: 115014 - protein, 9 aa, Homo Sapiens
DAVKNAAAP

SEQ ID NO: 115015 - protein, 9 aa, Homo Sapiens
ETGNSFKVI

SEQ ID NO: 115016 - protein, 9 aa, Homo Sapiens
GGDRVETDK

SEQ ID NO: 115017 - protein, 9 aa, Homo Sapiens
KTIVKKILS

SEQ ID NO: 115018 - protein, 9 aa, Homo Sapiens
DLRNQVYST

SEQ ID NO: 115019 - protein, 9 aa, Homo Sapiens
KTSELYKKT

SEQ ID NO: 115020 - protein, 9 aa, Homo Sapiens
EQELPALAD

SEQ ID NO: 115021 - protein, 9 aa, Homo Sapiens
RWCFYSYCE

SEQ ID NO: 115022 - protein, 9 aa, Homo Sapiens
ADTAMLLDN

SEQ ID NO: 115023 - protein, 9 aa, Homo Sapiens
KEIRRKFGS

SEQ ID NO: 115024 - protein, 9 aa, Homo Sapiens
LFSFLKRKN

SEQ ID NO: 115025 - protein, 9 aa, Homo Sapiens
GANQLTSPP

SEQ ID NO: 115026 - protein, 9 aa, Homo Sapiens
LSSDQQLIY

SEQ ID NO: 115027 - protein, 9 aa, Homo Sapiens
HLQNSHGGS

SEQ ID NO: 115028 - protein, 9 aa, Homo Sapiens
MNTLRSKMG

SEQ ID NO: 115029 - protein, 9 aa, Homo Sapiens
IVSGQDESS

SEQ ID NO: 115030 - protein, 9 aa, Homo Sapiens
SKLKRARSK

SEQ ID NO: 115031 - protein, 9 aa, Homo Sapiens
LKIPYHVRE

SEQ ID NO: 115032 - protein, 9 aa, Homo Sapiens
ICSGIIKGT

SEQ ID NO: 115033 - protein, 9 aa, Homo Sapiens
SLAQHKKTH

SEQ ID NO: 115034 - protein, 9 aa, Homo Sapiens
ASTSWCSAA

SEQ ID NO: 115035 - protein, 9 aa, Homo Sapiens
NNYTPDMNS

SEQ ID NO: 115036 - protein, 9 aa, Homo Sapiens
GPRGVHFIL

SEQ ID NO: 115037 - protein, 9 aa, Homo Sapiens
GGSLSLHPP

SEQ ID NO: 115038 - protein, 9 aa, Homo Sapiens
SPLQALRVL

SEQ ID NO: 115039 - protein, 9 aa, Homo Sapiens
HLQQVELAL

SEQ ID NO: 115040 - protein, 9 aa, Homo Sapiens
LLQAMRNIN

SEQ ID NO: 115041 - protein, 9 aa, Homo Sapiens
KISELCLPK

SEQ ID NO: 115042 - protein, 9 aa, Homo Sapiens
YFIVDPIRS

SEQ ID NO: 115043 - protein, 9 aa, Homo Sapiens
PRGVHFILN

SEQ ID NO: 115044 - protein, 9 aa, Homo Sapiens
GPGPKPCAT

SEQ ID NO: 115045 - protein, 9 aa, Homo Sapiens
ALADNLHQE

SEQ ID NO: 115046 - protein, 9 aa, Homo Sapiens
YRAHLQQVE

SEQ ID NO: 115047 - protein, 9 aa, Homo Sapiens
MVRGSHCCC

SEQ ID NO: 115048 - protein, 9 aa, Homo Sapiens
QGLQAPPGI

SEQ ID NO: 115049 - protein, 9 aa, Homo Sapiens
DNLHQEQKQ

SEQ ID NO: 115050 - protein, 9 aa, Homo Sapiens
TGNSFKVIH

SEQ ID NO: 115051 - protein, 9 aa, Homo Sapiens
FLKRKNETR

SEQ ID NO: 115052 - protein, 9 aa, Homo Sapiens
IDLLPDGCH

SEQ ID NO: 115053 - protein, 9 aa, Homo Sapiens
ASPSIRSAS

SEQ ID NO: 115054 - protein, 9 aa, Homo Sapiens
EWYKGGDRV

SEQ ID NO: 115055 - protein, 9 aa, Homo Sapiens
GGGCGSSSG

SEQ ID NO: 115056 - protein, 9 aa, Homo Sapiens
HDTIDDLRN

SEQ ID NO: 115057 - protein, 9 aa, Homo Sapiens
GKKSYECSE

SEQ ID NO: 115058 - protein, 9 aa, Homo Sapiens
NSLGAGPFR

SEQ ID NO: 115059 - protein, 9 aa, Homo Sapiens
SQIIFKKHK

SEQ ID NO: 115060 - protein, 9 aa, Homo Sapiens
YEPADTAML

SEQ ID NO: 115061 - protein, 9 aa, Homo Sapiens
PPLLGSGSI

SEQ ID NO: 115062 - protein, 9 aa, Homo Sapiens
SDQQLIYLL

SEQ ID NO: 115063 - protein, 9 aa, Homo Sapiens
YKKTYWASY

SEQ ID NO: 115064 - protein, 9 aa, Homo Sapiens
PALADNLHQ

SEQ ID NO: 115065 - protein, 9 aa, Homo Sapiens
LHLQNSHGG

SEQ ID NO: 115066 - protein, 9 aa, Homo Sapiens
MEKVTKEDK

SEQ ID NO: 115067 - protein, 9 aa, Homo Sapiens
DFKDQRPYC

SEQ ID NO: 115068 - protein, 9 aa, Homo Sapiens
FKVIHEQVN

SEQ ID NO: 115069 - protein, 9 aa, Homo Sapiens
ESKSTHHET

SEQ ID NO: 115070 - protein, 9 aa, Homo Sapiens
ANIENSGLQ

SEQ ID NO: 115071 - protein, 9 aa, Homo Sapiens
GPKPCATLV

SEQ ID NO: 115072 - protein, 9 aa, Homo Sapiens
SNNKYVASS

SEQ ID NO: 115073 - protein, 9 aa, Homo Sapiens
LKQQELLLQ

SEQ ID NO: 115074 - protein, 9 aa, Homo Sapiens
KLPPLLGSG

SEQ ID NO: 115075 - protein, 9 aa, Homo Sapiens
FTIDNVKLH

SEQ ID NO: 115076 - protein, 9 aa, Homo Sapiens
RNRRHKLKE

SEQ ID NO: 115077 - protein, 9 aa, Homo Sapiens
RTVSKAMTA

SEQ ID NO: 115078 - protein, 9 aa, Homo Sapiens
GKLSLEQFI

SEQ ID NO: 115079 - protein, 9 aa, Homo Sapiens
VLKLAQDLV

SEQ ID NO: 115080 - protein, 9 aa, Homo Sapiens
ESVSFDVLT

SEQ ID NO: 115081 - protein, 9 aa, Homo Sapiens
LSTLVIKNA

SEQ ID NO: 115082 - protein, 9 aa, Homo Sapiens
CAIYVMEKV

SEQ ID NO: 115083 - protein, 9 aa, Homo Sapiens
SSGGGCGSS

SEQ ID NO: 115084 - protein, 9 aa, Homo Sapiens
APPGIPGIG

SEQ ID NO: 115085 - protein, 9 aa, Homo Sapiens
DQQLIYLLE

SEQ ID NO: 115086 - protein, 9 aa, Homo Sapiens
SKSTHHETL

SEQ ID NO: 115087 - protein, 9 aa, Homo Sapiens
ELCLPKEVK

SEQ ID NO: 115088 - protein, 9 aa, Homo Sapiens
CHICRSTIK

SEQ ID NO: 115089 - protein, 9 aa, Homo Sapiens
AIYVMEKVT

SEQ ID NO: 115090 - protein, 9 aa, Homo Sapiens
EQFIRGAKS

SEQ ID NO: 115091 - protein, 9 aa, Homo Sapiens
IQIEDEWQH

SEQ ID NO: 115092 - protein, 9 aa, Homo Sapiens
ILSKLKRAR

SEQ ID NO: 115093 - protein, 9 aa, Homo Sapiens
LKLAQDLVY

SEQ ID NO: 115094 - protein, 9 aa, Homo Sapiens
PDGCHAVVE

SEQ ID NO: 115095 - protein, 9 aa, Homo Sapiens
SEDVDYAIR

SEQ ID NO: 115096 - protein, 9 aa, Homo Sapiens
LCFNKIPVL

SEQ ID NO: 115097 - protein, 9 aa, Homo Sapiens
QHNSSANST

SEQ ID NO: 115098 - protein, 9 aa, Homo Sapiens
SLVLISLSG

SEQ ID NO: 115099 - protein, 9 aa, Homo Sapiens
FNKIPVLRE

SEQ ID NO: 115100 - protein, 9 aa, Homo Sapiens
MLDLLENLG

SEQ ID NO: 115101 - protein, 9 aa, Homo Sapiens
DTAMLLDNM

SEQ ID NO: 115102 - protein, 9 aa, Homo Sapiens
HFSTAFCKD

SEQ ID NO: 115103 - protein, 9 aa, Homo Sapiens
GGGGGSLSL

SEQ ID NO: 115104 - protein, 9 aa, Homo Sapiens
HAKHKSVIS

SEQ ID NO: 115105 - protein, 9 aa, Homo Sapiens
DGCHAVVEV

SEQ ID NO: 115106 - protein, 9 aa, Homo Sapiens
FIVDPIRSH

SEQ ID NO: 115107 - protein, 9 aa, Homo Sapiens
PAELSTLVI

SEQ ID NO: 115108 - protein, 9 aa, Homo Sapiens
FTPTQAFPA

SEQ ID NO: 115109 - protein, 9 aa, Homo Sapiens
GMLDLLENL

SEQ ID NO: 115110 - protein, 9 aa, Homo Sapiens
TQAFPALQY

SEQ ID NO: 115111 - protein, 9 aa, Homo Sapiens
KLDETGNSF

SEQ ID NO: 115112 - protein, 9 aa, Homo Sapiens
LVSASASPS

SEQ ID NO: 115113 - protein, 9 aa, Homo Sapiens
VKHYAVEVQ

SEQ ID NO: 115114 - protein, 9 aa, Homo Sapiens
NRWCFYSYC

SEQ ID NO: 115115 - protein, 9 aa, Homo Sapiens
EEDPVMALE

SEQ ID NO: 115116 - protein, 9 aa, Homo Sapiens
QLEEEEEEA

SEQ ID NO: 115117 - protein, 9 aa, Homo Sapiens
IVIPFLYVW

SEQ ID NO: 115118 - protein, 9 aa, Homo Sapiens
SSLAQHKKT

SEQ ID NO: 115119 - protein, 9 aa, Homo Sapiens
NNKYVASSY

SEQ ID NO: 115120 - protein, 9 aa, Homo Sapiens
KKISELCLP

SEQ ID NO: 115121 - protein, 9 aa, Homo Sapiens
TAFNALGQL

SEQ ID NO: 115122 - protein, 9 aa, Homo Sapiens
WQHVNDQKD

SEQ ID NO: 115123 - protein, 9 aa, Homo Sapiens
IRSASSRAS

SEQ ID NO: 115124 - protein, 9 aa, Homo Sapiens
KIDLLPDGC

SEQ ID NO: 115125 - protein, 9 aa, Homo Sapiens
VMALEWDPL

SEQ ID NO: 115126 - protein, 9 aa, Homo Sapiens
LSDQTDTFN

SEQ ID NO: 115127 - protein, 9 aa, Homo Sapiens
VGQHQGVFG

SEQ ID NO: 115128 - protein, 9 aa, Homo Sapiens
QSLVLISLS

SEQ ID NO: 115129 - protein, 9 aa, Homo Sapiens
SFDVLTAFN

SEQ ID NO: 115130 - protein, 9 aa, Homo Sapiens
TVSCGGNPL

SEQ ID NO: 115131 - protein, 9 aa, Homo Sapiens
PLQALRVLI

SEQ ID NO: 115132 - protein, 9 aa, Homo Sapiens
SELCLPKEV

SEQ ID NO: 115133 - protein, 9 aa, Homo Sapiens
DNVKLHNVS

SEQ ID NO: 115134 - protein, 9 aa, Homo Sapiens
SELYKKTYW

SEQ ID NO: 115135 - protein, 9 aa, Homo Sapiens
SERNNPAPQ

SEQ ID NO: 115136 - protein, 9 aa, Homo Sapiens
SRIVSGQDE

SEQ ID NO: 115137 - protein, 9 aa, Homo Sapiens
SKAMTAYWT

SEQ ID NO: 115138 - protein, 9 aa, Homo Sapiens
SGGGGGSLS

SEQ ID NO: 115139 - protein, 9 aa, Homo Sapiens
MLDYQRLLL

SEQ ID NO: 115140 - protein, 9 aa, Homo Sapiens
QVLKLAQDL

SEQ ID NO: 115141 - protein, 9 aa, Homo Sapiens
KKTYWASYN

SEQ ID NO: 115142 - protein, 9 aa, Homo Sapiens
ANQLTSPPS

SEQ ID NO: 115143 - protein, 9 aa, Homo Sapiens
HCSSLAQHK

SEQ ID NO: 115144 - protein, 9 aa, Homo Sapiens
IFICVEAVQ

SEQ ID NO: 115145 - protein, 9 aa, Homo Sapiens
HLSEQNVPF

SEQ ID NO: 115146 - protein, 9 aa, Homo Sapiens
KAMTAYWTN

SEQ ID NO: 115147 - protein, 9 aa, Homo Sapiens
RNTKLPPLL

SEQ ID NO: 115148 - protein, 9 aa, Homo Sapiens
IDDLRNQVY

SEQ ID NO: 115149 - protein, 9 aa, Homo Sapiens
VDRHHLMEW

SEQ ID NO: 115150 - protein, 9 aa, Homo Sapiens
LRKCPICSG

SEQ ID NO: 115151 - protein, 9 aa, Homo Sapiens
SKQSNNKYV

SEQ ID NO: 115152 - protein, 9 aa, Homo Sapiens
PVLNQRCKK

SEQ ID NO: 115153 - protein, 9 aa, Homo Sapiens
PLTVSCGGN

SEQ ID NO: 115154 - protein, 9 aa, Homo Sapiens
KQVLKLAQD

SEQ ID NO: 115155 - protein, 9 aa, Homo Sapiens
RKSKQLCQE

SEQ ID NO: 115156 - protein, 9 aa, Homo Sapiens
VSASASPSI

SEQ ID NO: 115157 - protein, 9 aa, Homo Sapiens
MYYSGSLES

SEQ ID NO: 115158 - protein, 9 aa, Homo Sapiens
SLRKCPICS

SEQ ID NO: 115159 - protein, 9 aa, Homo Sapiens
KFGSFIWEQ

SEQ ID NO: 115160 - protein, 9 aa, Homo Sapiens
MLLDNMKKA

SEQ ID NO: 115161 - protein, 9 aa, Homo Sapiens
IENSGLQHN

SEQ ID NO: 115162 - protein, 9 aa, Homo Sapiens
SIQIEDEWQ

SEQ ID NO: 115163 - protein, 9 aa, Homo Sapiens
GGGGSLSLH

SEQ ID NO: 115164 - protein, 9 aa, Homo Sapiens
FDDGEHAKH

SEQ ID NO: 115165 - protein, 9 aa, Homo Sapiens
DEWQHVNDQ

SEQ ID NO: 115166 - protein, 9 aa, Homo Sapiens
PGPKPCATL

SEQ ID NO: 115167 - protein, 9 aa, Homo Sapiens
QFIRGAKSD

SEQ ID NO: 115168 - protein, 9 aa, Homo Sapiens
SVSFDVLTA

SEQ ID NO: 115169 - protein, 9 aa, Homo Sapiens
RRKFGSFIW

SEQ ID NO: 115170 - protein, 9 aa, Homo Sapiens
MFQSERNNP

SEQ ID NO: 115171 - protein, 9 aa, Homo Sapiens
GFTIDNVKL

SEQ ID NO: 115172 - protein, 9 aa, Homo Sapiens
LLMLDYQRL

SEQ ID NO: 115173 - protein, 9 aa, Homo Sapiens
RKCPICSGI

SEQ ID NO: 115174 - protein, 9 aa, Homo Sapiens
KKSYECSEC

SEQ ID NO: 115175 - protein, 9 aa, Homo Sapiens
RLLMLDYQR

SEQ ID NO: 115176 - protein, 9 aa, Homo Sapiens
DKTSELYKK

SEQ ID NO: 115177 - protein, 9 aa, Homo Sapiens
LTAFNALGQ

SEQ ID NO: 115178 - protein, 9 aa, Homo Sapiens
QMEVFKILA

SEQ ID NO: 115179 - protein, 9 aa, Homo Sapiens
GRLLSLWWE

SEQ ID NO: 115180 - protein, 9 aa, Homo Sapiens
SEQNVPFIK

SEQ ID NO: 115181 - protein, 9 aa, Homo Sapiens
VHCLYQCSF

SEQ ID NO: 115182 - protein, 9 aa, Homo Sapiens
SLESKSTHH

SEQ ID NO: 115183 - protein, 9 aa, Homo Sapiens
SFKVIHEQV

SEQ ID NO: 115184 - protein, 9 aa, Homo Sapiens
LVYTPEPGE

SEQ ID NO: 115185 - protein, 9 aa, Homo Sapiens
RAHLQQVEL

SEQ ID NO: 115186 - protein, 9 aa, Homo Sapiens
LYETLDLSE

SEQ ID NO: 115187 - protein, 9 aa, Homo Sapiens
TDAVKNAAA

SEQ ID NO: 115188 - protein, 9 aa, Homo Sapiens
PNIQSLVLI

SEQ ID NO: 115189 - protein, 9 aa, Homo Sapiens
DVLTAFNAL

SEQ ID NO: 115190 - protein, 9 aa, Homo Sapiens
LETNHFSTA

SEQ ID NO: 115191 - protein, 9 aa, Homo Sapiens
GQTDAVKNA

SEQ ID NO: 115192 - protein, 9 aa, Homo Sapiens
WCFYSYCEQ

SEQ ID NO: 115193 - protein, 9 aa, Homo Sapiens
NVRLLMLDY

SEQ ID NO: 115194 - protein, 9 aa, Homo Sapiens
YCEQLDQLI

SEQ ID NO: 115195 - protein, 9 aa, Homo Sapiens
GCGSSSGGC

SEQ ID NO: 115196 - protein, 9 aa, Homo Sapiens
LEQFIRGAK

SEQ ID NO: 115197 - protein, 9 aa, Homo Sapiens
GAGPFRHMI

SEQ ID NO: 115198 - protein, 9 aa, Homo Sapiens
HFILNKENF

SEQ ID NO: 115199 - protein, 9 aa, Homo Sapiens
IPYHVRERA

SEQ ID NO: 115200 - protein, 9 aa, Homo Sapiens
KPCATLVQG

SEQ ID NO: 115201 - protein, 9 aa, Homo Sapiens
TIDNVKLHN

SEQ ID NO: 115202 - protein, 9 aa, Homo Sapiens
PPTPLTVSC

SEQ ID NO: 115203 - protein, 9 aa, Homo Sapiens
FVHCLYQCS

SEQ ID NO: 115204 - protein, 9 aa, Homo Sapiens
TVSGQTDAV

SEQ ID NO: 115205 - protein, 9 aa, Homo Sapiens
HALHLQNSH

SEQ ID NO: 115206 - protein, 9 aa, Homo Sapiens
HGGSLMTRT

SEQ ID NO: 115207 - protein, 9 aa, Homo Sapiens
ELDLLGMLD

SEQ ID NO: 115208 - protein, 9 aa, Homo Sapiens
LTVSCGGNP

SEQ ID NO: 115209 - protein, 9 aa, Homo Sapiens
AVDRHHLME

SEQ ID NO: 115210 - protein, 9 aa, Homo Sapiens
PIEEFTPTQ

SEQ ID NO: 115211 - protein, 9 aa, Homo Sapiens
DTFNRSPLT

SEQ ID NO: 115212 - protein, 9 aa, Homo Sapiens
DSAMNTLRS

SEQ ID NO: 115213 - protein, 9 aa, Homo Sapiens
LGMLDLLEN

SEQ ID NO: 115214 - protein, 9 aa, Homo Sapiens
LRVLIALLA

SEQ ID NO: 115215 - protein, 9 aa, Homo Sapiens
PICSGIIKG

SEQ ID NO: 115216 - protein, 9 aa, Homo Sapiens
KQALLYETL

SEQ ID NO: 115217 - protein, 9 aa, Homo Sapiens
ASASPSIRS

SEQ ID NO: 115218 - protein, 9 aa, Homo Sapiens
LDLLGMLDL

SEQ ID NO: 115219 - protein, 9 aa, Homo Sapiens
QELLLQAMR

SEQ ID NO: 115220 - protein, 9 aa, Homo Sapiens
YDGPNIQSL

SEQ ID NO: 115221 - protein, 9 aa, Homo Sapiens
DPIRSHLHV

SEQ ID NO: 115222 - protein, 9 aa, Homo Sapiens
STYEFLMAE

SEQ ID NO: 115223 - protein, 9 aa, Homo Sapiens
NFGVKHYAV

SEQ ID NO: 115224 - protein, 9 aa, Homo Sapiens
LMLDYQRLL

SEQ ID NO: 115225 - protein, 9 aa, Homo Sapiens
QDLVYKVQT

SEQ ID NO: 115226 - protein, 9 aa, Homo Sapiens
IEDEWQHVN

SEQ ID NO: 115227 - protein, 9 aa, Homo Sapiens
LLSLWWEVV

SEQ ID NO: 115228 - protein, 9 aa, Homo Sapiens
CSGIIKGTV

SEQ ID NO: 115229 - protein, 9 aa, Homo Sapiens
NTLRSKMGK

SEQ ID NO: 115230 - protein, 9 aa, Homo Sapiens
EITHGANQL

SEQ ID NO: 115231 - protein, 9 aa, Homo Sapiens
YKGGDRVET

SEQ ID NO: 115232 - protein, 9 aa, Homo Sapiens
WYKGGDRVE

SEQ ID NO: 115233 - protein, 9 aa, Homo Sapiens
ILHHERKSK

SEQ ID NO: 115234 - protein, 9 aa, Homo Sapiens
TAETYLGSE

SEQ ID NO: 115235 - protein, 9 aa, Homo Sapiens
DSKGAMERA

SEQ ID NO: 115236 - protein, 9 aa, Homo Sapiens
DPAVDRHHL

SEQ ID NO: 115237 - protein, 9 aa, Homo Sapiens
GEHAKHKSV

SEQ ID NO: 115238 - protein, 9 aa, Homo Sapiens
DDLRNQVYS

SEQ ID NO: 115239 - protein, 9 aa, Homo Sapiens
CLYQCSFLM

SEQ ID NO: 115240 - protein, 9 aa, Homo Sapiens
GDHDDSAMN

SEQ ID NO: 115241 - protein, 9 aa, Homo Sapiens
LSIQIEDEW

SEQ ID NO: 115242 - protein, 9 aa, Homo Sapiens
GTDEEDPVM

SEQ ID NO: 115243 - protein, 9 aa, Homo Sapiens
LRNQVYSTL

SEQ ID NO: 115244 - protein, 9 aa, Homo Sapiens
VWTLISKNF

SEQ ID NO: 115245 - protein, 9 aa, Homo Sapiens
DRTVSKAMT

SEQ ID NO: 115246 - protein, 9 aa, Homo Sapiens
NTKLPPLLG

SEQ ID NO: 115247 - protein, 9 aa, Homo Sapiens
MNSEDVDYA

SEQ ID NO: 115248 - protein, 9 aa, Homo Sapiens
EWQHVNDQK

SEQ ID NO: 115249 - protein, 9 aa, Homo Sapiens
GADAGPGPK

SEQ ID NO: 115250 - protein, 9 aa, Homo Sapiens
SGSLESKST

SEQ ID NO: 115251 - protein, 9 aa, Homo Sapiens
KHSFTAETY

SEQ ID NO: 115252 - protein, 9 aa, Homo Sapiens
VYTPEPGEK

SEQ ID NO: 115253 - protein, 9 aa, Homo Sapiens
QTDTFNRSP

SEQ ID NO: 115254 - protein, 9 aa, Homo Sapiens
EDEWQHVND

SEQ ID NO: 115255 - protein, 9 aa, Homo Sapiens
WEVVTFRRH

SEQ ID NO: 115256 - protein, 9 aa, Homo Sapiens
SGGPLVYTP

SEQ ID NO: 115257 - protein, 9 aa, Homo Sapiens
NNPAPQCPP

SEQ ID NO: 115258 - protein, 9 aa, Homo Sapiens
DMNSEDVDY

SEQ ID NO: 115259 - protein, 9 aa, Homo Sapiens
SLRKCHICR

SEQ ID NO: 115260 - protein, 9 aa, Homo Sapiens
LQTYRAHLQ

SEQ ID NO: 115261 - protein, 9 aa, Homo Sapiens
KCHICRSTI

SEQ ID NO: 115262 - protein, 9 aa, Homo Sapiens
PVLFVHCLY

SEQ ID NO: 115263 - protein, 9 aa, Homo Sapiens
EHAKHKSVI

SEQ ID NO: 115264 - protein, 9 aa, Homo Sapiens
NVCIFICVE

SEQ ID NO: 115265 - protein, 9 aa, Homo Sapiens
VSFDVLTAF

SEQ ID NO: 115266 - protein, 9 aa, Homo Sapiens
KILSKLKRA

SEQ ID NO: 115267 - protein, 9 aa, Homo Sapiens
TAMLLDNMK

SEQ ID NO: 115268 - protein, 9 aa, Homo Sapiens
LAQDLVYKV

SEQ ID NO: 115269 - protein, 9 aa, Homo Sapiens
HLCFNKIPV

SEQ ID NO: 115270 - protein, 9 aa, Homo Sapiens
VGCFSQIIF

SEQ ID NO: 115271 - protein, 9 aa, Homo Sapiens
ELYKKTYWA

SEQ ID NO: 115272 - protein, 9 aa, Homo Sapiens
YVASSYLSL

SEQ ID NO: 115273 - protein, 9 aa, Homo Sapiens
YDNQRQFMD

SEQ ID NO: 115274 - protein, 9 aa, Homo Sapiens
IEIMKTPRC

SEQ ID NO: 115275 - protein, 9 aa, Homo Sapiens
IDIQHLCFN

SEQ ID NO: 115276 - protein, 9 aa, Homo Sapiens
LNVCIFICV

SEQ ID NO: 115277 - protein, 9 aa, Homo Sapiens
YQRLLLPHW

SEQ ID NO: 115278 - protein, 9 aa, Homo Sapiens
KKILSKLKR

SEQ ID NO: 115279 - protein, 9 aa, Homo Sapiens
KHKSVISWL

SEQ ID NO: 115280 - protein, 9 aa, Homo Sapiens
DNQRQFMDP

SEQ ID NO: 115281 - protein, 9 aa, Homo Sapiens
ALHLQNSHG

SEQ ID NO: 115282 - protein, 9 aa, Homo Sapiens
VRGSHCCCD

SEQ ID NO: 115283 - protein, 9 aa, Homo Sapiens
LCQKLKIPY

SEQ ID NO: 115284 - protein, 9 aa, Homo Sapiens
RIVSGQDES

SEQ ID NO: 115285 - protein, 9 aa, Homo Sapiens
DQGLQAPPG

SEQ ID NO: 115286 - protein, 9 aa, Homo Sapiens
CIFICVEAV

SEQ ID NO: 115287 - protein, 9 aa, Homo Sapiens
QKLKIPYHV

SEQ ID NO: 115288 - protein, 9 aa, Homo Sapiens
NRRHKLKES

SEQ ID NO: 115289 - protein, 9 aa, Homo Sapiens
RAAASEASQ

SEQ ID NO: 115290 - protein, 9 aa, Homo Sapiens
SGGGCGSSS

SEQ ID NO: 115291 - protein, 9 aa, Homo Sapiens
KCPICSGII

SEQ ID NO: 115292 - protein, 9 aa, Homo Sapiens
LHHERKSKQ

SEQ ID NO: 115293 - protein, 9 aa, Homo Sapiens
VLTAFNALG

SEQ ID NO: 115294 - protein, 9 aa, Homo Sapiens
DEITHGANQ

SEQ ID NO: 115295 - protein, 9 aa, Homo Sapiens
AHLQQVELA

SEQ ID NO: 115296 - protein, 9 aa, Homo Sapiens
CVEAVQGNC

SEQ ID NO: 115297 - protein, 9 aa, Homo Sapiens
AVEVQYDVR

SEQ ID NO: 115298 - protein, 9 aa, Homo Sapiens
VSCGGNPLH

SEQ ID NO: 115299 - protein, 9 aa, Homo Sapiens
YTPDMNSED

SEQ ID NO: 115300 - protein, 9 aa, Homo Sapiens
MEVFKILAA

SEQ ID NO: 115301 - protein, 9 aa, Homo Sapiens
KADPAVDRH

SEQ ID NO: 115302 - protein, 9 aa, Homo Sapiens
AQHKKTHTE

SEQ ID NO: 115303 - protein, 9 aa, Homo Sapiens
FSFLKRKNE

SEQ ID NO: 115304 - protein, 9 aa, Homo Sapiens
LGSGSILEN

SEQ ID NO: 115305 - protein, 9 aa, Homo Sapiens
VASSYLSLT

SEQ ID NO: 115306 - protein, 9 aa, Homo Sapiens
NYTPDMNSE

SEQ ID NO: 115307 - protein, 9 aa, Homo Sapiens
LLGSGSILE

SEQ ID NO: 115308 - protein, 9 aa, Homo Sapiens
TDEEDPVMA

SEQ ID NO: 115309 - protein, 9 aa, Homo Sapiens
KLKIPYHVR

SEQ ID NO: 115310 - protein, 9 aa, Homo Sapiens
HKSVISWLL

SEQ ID NO: 115311 - protein, 9 aa, Homo Sapiens
KPKADPAVD

SEQ ID NO: 115312 - protein, 9 aa, Homo Sapiens
VIPFLYVWT

SEQ ID NO: 115313 - protein, 9 aa, Homo Sapiens
ADKTSELYK

SEQ ID NO: 115314 - protein, 9 aa, Homo Sapiens
LCPVLFVHC

SEQ ID NO: 115315 - protein, 9 aa, Homo Sapiens
FLYVWTLIS

SEQ ID NO: 115316 - protein, 9 aa, Homo Sapiens
DAGPGPKPC

SEQ ID NO: 115317 - protein, 9 aa, Homo Sapiens
RNNPAPQCP

SEQ ID NO: 115318 - protein, 9 aa, Homo Sapiens
TGKLDSNTI

SEQ ID NO: 115319 - protein, 9 aa, Homo Sapiens
TPTQAFPAL

SEQ ID NO: 115320 - protein, 9 aa, Homo Sapiens
SSDQQLIYL

SEQ ID NO: 115321 - protein, 9 aa, Homo Sapiens
NIENSGLQH

SEQ ID NO: 115322 - protein, 9 aa, Homo Sapiens
YVWTLISKN

SEQ ID NO: 115323 - protein, 9 aa, Homo Sapiens
DDSKGAMER

SEQ ID NO: 115324 - protein, 9 aa, Homo Sapiens
NSGLQHNSS

SEQ ID NO: 115325 - protein, 9 aa, Homo Sapiens
YSYCEQLDQ

SEQ ID NO: 115326 - protein, 9 aa, Homo Sapiens
KIPYHVRER

SEQ ID NO: 115327 - protein, 9 aa, Homo Sapiens
CAPSLRKCH

SEQ ID NO: 115328 - protein, 9 aa, Homo Sapiens
MINLISVVG

SEQ ID NO: 115329 - protein, 9 aa, Homo Sapiens
SLGAGPFRH

SEQ ID NO: 115330 - protein, 9 aa, Homo Sapiens
LYVWTLISK

SEQ ID NO: 115331 - protein, 9 aa, Homo Sapiens
ISVVGQHQG

SEQ ID NO: 115332 - protein, 9 aa, Homo Sapiens
IVKKILSKL

SEQ ID NO: 115333 - protein, 9 aa, Homo Sapiens
QIDIQHLCF

SEQ ID NO: 115334 - protein, 9 aa, Homo Sapiens
SDQTDTFNR

SEQ ID NO: 115335 - protein, 9 aa, Homo Sapiens
LGLQDFDFK

SEQ ID NO: 115336 - protein, 9 aa, Homo Sapiens
SLMGSSPVL

SEQ ID NO: 115337 - protein, 9 aa, Homo Sapiens
THGANQLTS

SEQ ID NO: 115338 - protein, 9 aa, Homo Sapiens
PVMALEWDP

SEQ ID NO: 115339 - protein, 9 aa, Homo Sapiens
SGIIKGTVR

SEQ ID NO: 115340 - protein, 9 aa, Homo Sapiens
VIKNAFVCI

SEQ ID NO: 115341 - protein, 9 aa, Homo Sapiens
INLISVVGQ

SEQ ID NO: 115342 - protein, 9 aa, Homo Sapiens
KLPKKRMYK

SEQ ID NO: 115343 - protein, 9 aa, Homo Sapiens
FTAETYLGS

SEQ ID NO: 115344 - protein, 9 aa, Homo Sapiens
FKDQRPYCF

SEQ ID NO: 115345 - protein, 9 aa, Homo Sapiens
AMNTLRSKM

SEQ ID NO: 115346 - protein, 9 aa, Homo Sapiens
SASASPSIR

SEQ ID NO: 115347 - protein, 9 aa, Homo Sapiens
CAYKFQRNR

SEQ ID NO: 115348 - protein, 9 aa, Homo Sapiens
YVMEKVTKE

SEQ ID NO: 115349 - protein, 9 aa, Homo Sapiens
QFMDPGYPK

SEQ ID NO: 115350 - protein, 9 aa, Homo Sapiens
GCFSQIIFK

SEQ ID NO: 115351 - protein, 9 aa, Homo Sapiens
GSHCCCDTL

SEQ ID NO: 115352 - protein, 9 aa, Homo Sapiens
KLSLEQFIR

SEQ ID NO: 115353 - protein, 9 aa, Homo Sapiens
IYVMEKVTK

SEQ ID NO: 115354 - protein, 9 aa, Homo Sapiens
QTYRAHLQQ

SEQ ID NO: 115355 - protein, 9 aa, Homo Sapiens
PKKISELCL

SEQ ID NO: 115356 - protein, 9 aa, Homo Sapiens
QLIYLLENK

SEQ ID NO: 115357 - protein, 9 aa, Homo Sapiens
PSIRSASSR

SEQ ID NO: 115358 - protein, 9 aa, Homo Sapiens
DDSAMNTLR

SEQ ID NO: 115359 - protein, 9 aa, Homo Sapiens
SFTAETYLG

SEQ ID NO: 115360 - protein, 9 aa, Homo Sapiens
SAMNTLRSK

SEQ ID NO: 115361 - protein, 9 aa, Homo Sapiens
YKFQRNRRH

SEQ ID NO: 115362 - protein, 9 aa, Homo Sapiens
GLQAPPGIP

SEQ ID NO: 115363 - protein, 9 aa, Homo Sapiens
IKNAFVCIY

SEQ ID NO: 115364 - protein, 9 aa, Homo Sapiens
SHCCCDTLD

SEQ ID NO: 115365 - protein, 9 aa, Homo Sapiens
GSLESKSTH

SEQ ID NO: 115366 - protein, 9 aa, Homo Sapiens
KLDSNTIEI

SEQ ID NO: 115367 - protein, 9 aa, Homo Sapiens
YPKKISELC

SEQ ID NO: 115368 - protein, 9 aa, Homo Sapiens
EKVTKEDKS

SEQ ID NO: 115369 - protein, 9 aa, Homo Sapiens
PGDQGLQAP

SEQ ID NO: 115370 - protein, 9 aa, Homo Sapiens
KGGDRVETD

SEQ ID NO: 115371 - protein, 9 aa, Homo Sapiens
LESKSTHHE

SEQ ID NO: 115372 - protein, 9 aa, Homo Sapiens
DYQRLLLPH

SEQ ID NO: 115373 - protein, 9 aa, Homo Sapiens
VKLHNVSLG

SEQ ID NO: 115374 - protein, 9 aa, Homo Sapiens
NQLTSPPSQ

SEQ ID NO: 115375 - protein, 9 aa, Homo Sapiens
QHLCFNKIP

SEQ ID NO: 115376 - protein, 9 aa, Homo Sapiens
GGCGSSSGG

SEQ ID NO: 115377 - protein, 9 aa, Homo Sapiens
HGANQLTSP

SEQ ID NO: 115378 - protein, 9 aa, Homo Sapiens
MCAIYVMEK

SEQ ID NO: 115379 - protein, 9 aa, Homo Sapiens
FSTAFCKDH

SEQ ID NO: 115380 - protein, 9 aa, Homo Sapiens
GDRVETDKD

SEQ ID NO: 115381 - protein, 9 aa, Homo Sapiens
EPADTAMLL

SEQ ID NO: 115382 - protein, 9 aa, Homo Sapiens
LGAGPFRHM

SEQ ID NO: 115383 - protein, 9 aa, Homo Sapiens
FQRNRRHKL

SEQ ID NO: 115384 - protein, 9 aa, Homo Sapiens
SSRASTSWC

SEQ ID NO: 115385 - protein, 9 aa, Homo Sapiens
AELSTLVIK

SEQ ID NO: 115386 - protein, 9 aa, Homo Sapiens
DSTYEFLMA

SEQ ID NO: 115387 - protein, 9 aa, Homo Sapiens
NIQSLVLIS

SEQ ID NO: 115388 - protein, 9 aa, Homo Sapiens
VSDSTYEFL

SEQ ID NO: 115389 - protein, 9 aa, Homo Sapiens
IQSLVLISL

SEQ ID NO: 115390 - protein, 9 aa, Homo Sapiens
GFKEDFQME

SEQ ID NO: 115391 - protein, 9 aa, Homo Sapiens
ASSRASTSW

SEQ ID NO: 115392 - protein, 9 aa, Homo Sapiens
NVKLHNVSL

SEQ ID NO: 115393 - protein, 9 aa, Homo Sapiens
PMVRGSHCC

SEQ ID NO: 115394 - protein, 9 aa, Homo Sapiens
PFRHMIKLK

SEQ ID NO: 115395 - protein, 9 aa, Homo Sapiens
SPSIRSASS

SEQ ID NO: 115396 - protein, 9 aa, Homo Sapiens
SRASTSWCS

SEQ ID NO: 115397 - protein, 9 aa, Homo Sapiens
AYKFQRNRR

SEQ ID NO: 115398 - protein, 9 aa, Homo Sapiens
IQHLCFNKI

SEQ ID NO: 115399 - protein, 9 aa, Homo Sapiens
FYSYCEQLD

SEQ ID NO: 115400 - protein, 9 aa, Homo Sapiens
MNKLFSFLK

SEQ ID NO: 115401 - protein, 9 aa, Homo Sapiens
KDQRPYCFS

SEQ ID NO: 115402 - protein, 9 aa, Homo Sapiens
VLNQRCKKR

SEQ ID NO: 115403 - protein, 9 aa, Homo Sapiens
TSELYKKTY

SEQ ID NO: 115404 - protein, 9 aa, Homo Sapiens
DRVETDKDD

SEQ ID NO: 115405 - protein, 9 aa, Homo Sapiens
YETLDLSEL

SEQ ID NO: 115406 - protein, 9 aa, Homo Sapiens
DSNTIEIMK

SEQ ID NO: 115407 - protein, 9 aa, Homo Sapiens
ELPALADNL

SEQ ID NO: 115408 - protein, 9 aa, Homo Sapiens
STLVIKNAF

SEQ ID NO: 115409 - protein, 9 aa, Homo Sapiens
VSKAMTAYW

SEQ ID NO: 115410 - protein, 9 aa, Homo Sapiens
ETNHFSTAF

SEQ ID NO: 115411 - protein, 9 aa, Homo Sapiens
EKQALLYET

SEQ ID NO: 115412 - protein, 9 aa, Homo Sapiens
ADNLHQEQK

SEQ ID NO: 115413 - protein, 9 aa, Homo Sapiens
LKLPKKRMY

SEQ ID NO: 115414 - protein, 9 aa, Homo Sapiens
SYCEQLDQL

SEQ ID NO: 115415 - protein, 9 aa, Homo Sapiens
GPNIQSLVL

SEQ ID NO: 115416 - protein, 9 aa, Homo Sapiens
PTPLTVSCG

SEQ ID NO: 115417 - protein, 9 aa, Homo Sapiens
ISELCLPKE

SEQ ID NO: 115418 - protein, 9 aa, Homo Sapiens
IEEVSDSTY

SEQ ID NO: 115419 - protein, 9 aa, Homo Sapiens
LQAMRNINP

SEQ ID NO: 115420 - protein, 9 aa, Homo Sapiens
DFQMEVFKI

SEQ ID NO: 115421 - protein, 9 aa, Homo Sapiens
ELSTLVIKN

SEQ ID NO: 115422 - protein, 9 aa, Homo Sapiens
LEEEEEEAK

SEQ ID NO: 115423 - protein, 9 aa, Homo Sapiens
HDDSAMNTL

SEQ ID NO: 115424 - protein, 9 aa, Homo Sapiens
SPVLNQRCK

SEQ ID NO: 115425 - protein, 9 aa, Homo Sapiens
LQNSHGGSL

SEQ ID NO: 115426 - protein, 9 aa, Homo Sapiens
LQHNSSANS

SEQ ID NO: 115427 - protein, 9 aa, Homo Sapiens
MALEWDPLS

SEQ ID NO: 115428 - protein, 9 aa, Homo Sapiens
AETYLGSEF

SEQ ID NO: 115429 - protein, 9 aa, Homo Sapiens
ITHGANQLT

SEQ ID NO: 115430 - protein, 9 aa, Homo Sapiens
LQDFDFKDQ

SEQ ID NO: 115431 - protein, 9 aa, Homo Sapiens
FICVEAVQG

SEQ ID NO: 115432 - protein, 9 aa, Homo Sapiens
LAQHKKTHT

SEQ ID NO: 115433 - protein, 9 aa, Homo Sapiens
SNTIEIMKT

SEQ ID NO: 115434 - protein, 9 aa, Homo Sapiens
DHDDSAMNT

SEQ ID NO: 115435 - protein, 9 aa, Homo Sapiens
AVKNAAAPA

SEQ ID NO: 115436 - protein, 9 aa, Homo Sapiens
GCHAVVEVE

SEQ ID NO: 115437 - protein, 9 aa, Homo Sapiens
TLVIKNAFV

SEQ ID NO: 115438 - protein, 9 aa, Homo Sapiens
DGPNIQSLV

SEQ ID NO: 115439 - protein, 9 aa, Homo Sapiens
LWWEVVTFR

SEQ ID NO: 115440 - protein, 9 aa, Homo Sapiens
IYLLENKSL

SEQ ID NO: 115441 - protein, 9 aa, Homo Sapiens
MDPGYPKSI

SEQ ID NO: 115442 - protein, 9 aa, Homo Sapiens
TRAAASEAS

SEQ ID NO: 115443 - protein, 9 aa, Homo Sapiens
FFLETNHFS

SEQ ID NO: 115444 - protein, 9 aa, Homo Sapiens
QAFPALQYL

SEQ ID NO: 115445 - protein, 9 aa, Homo Sapiens
QHKKTHTEE

SEQ ID NO: 115446 - protein, 9 aa, Homo Sapiens
RHMIKLKTK

SEQ ID NO: 115447 - protein, 9 aa, Homo Sapiens
TKLPPLLGS

SEQ ID NO: 115448 - protein, 9 aa, Homo Sapiens
KQSNNKYVA

SEQ ID NO: 115449 - protein, 9 aa, Homo Sapiens
LGFTIDNVK

SEQ ID NO: 115450 - protein, 9 aa, Homo Sapiens
AMLLDNMKK

SEQ ID NO: 115451 - protein, 9 aa, Homo Sapiens
DRHHLMEWS

SEQ ID NO: 115452 - protein, 9 aa, Homo Sapiens
SHGGSLMTR

SEQ ID NO: 115453 - protein, 9 aa, Homo Sapiens
VSGQTDAVK

SEQ ID NO: 115454 - protein, 9 aa, Homo Sapiens
DSGGPLVYT

SEQ ID NO: 115455 - protein, 9 aa, Homo Sapiens
FMDPGYPKS

SEQ ID NO: 115456 - protein, 9 aa, Homo Sapiens
VKNAAAPAA

SEQ ID NO: 115457 - protein, 9 aa, Homo Sapiens
EILHHERKS

SEQ ID NO: 115458 - protein, 9 aa, Homo Sapiens
GSLSLHPPQ

SEQ ID NO: 115459 - protein, 9 aa, Homo Sapiens
SASSRASTS

SEQ ID NO: 115460 - protein, 9 aa, Homo Sapiens
SLEQFIRGA

SEQ ID NO: 115461 - protein, 9 aa, Homo Sapiens
HERKSKQLC

SEQ ID NO: 115462 - protein, 9 aa, Homo Sapiens
HYAVEVQYD

SEQ ID NO: 115463 - protein, 9 aa, Homo Sapiens
QNVPFIKQL

SEQ ID NO: 115464 - protein, 9 aa, Homo Sapiens
EVSDSTYEF

SEQ ID NO: 115465 - protein, 9 aa, Homo Sapiens
SECGKFFCH

SEQ ID NO: 115466 - protein, 9 aa, Homo Sapiens
DLLGMLDLL

SEQ ID NO: 115467 - protein, 9 aa, Homo Sapiens
LDLLENLGY

SEQ ID NO: 115468 - protein, 9 aa, Homo Sapiens
RQFMDPGYP

SEQ ID NO: 115469 - protein, 9 aa, Homo Sapiens
GVHFILNKE

SEQ ID NO: 115470 - protein, 9 aa, Homo Sapiens
MGSSPVLNQ

SEQ ID NO: 115471 - protein, 9 aa, Homo Sapiens
EEVSDSTYE

SEQ ID NO: 115472 - protein, 9 aa, Homo Sapiens
VEVQYDVRG

SEQ ID NO: 115473 - protein, 9 aa, Homo Sapiens
CCCDTLDLS

SEQ ID NO: 115474 - protein, 9 aa, Homo Sapiens
QKEIRRKFG

SEQ ID NO: 115475 - protein, 9 aa, Homo Sapiens
AAMFQSERN

SEQ ID NO: 115476 - protein, 9 aa, Homo Sapiens
GKLDSNTIE

SEQ ID NO: 115477 - protein, 9 aa, Homo Sapiens
GPLVYTPEP

SEQ ID NO: 115478 - protein, 9 aa, Homo Sapiens
AMTAYWTNF

SEQ ID NO: 115479 - protein, 9 aa, Homo Sapiens
EVFKILAAI

SEQ ID NO: 115480 - protein, 9 aa, Homo Sapiens
GGPLVYTPE

SEQ ID NO: 115481 - protein, 9 aa, Homo Sapiens
GLQDFDFKD

SEQ ID NO: 115482 - protein, 9 aa, Homo Sapiens
IIFKKHKSL

SEQ ID NO: 115483 - protein, 9 aa, Homo Sapiens
DTIDDLRNQ

SEQ ID NO: 115484 - protein, 9 aa, Homo Sapiens
RIDDSKGAM

SEQ ID NO: 115485 - protein, 9 aa, Homo Sapiens
GDQGLQAPP

SEQ ID NO: 115486 - protein, 9 aa, Homo Sapiens
HICRSTIKG

SEQ ID NO: 115487 - protein, 9 aa, Homo Sapiens
LPALADNLH

SEQ ID NO: 115488 - protein, 9 aa, Homo Sapiens
CSSLAQHKK

SEQ ID NO: 115489 - protein, 9 aa, Homo Sapiens
ERNNPAPQC

SEQ ID NO: 115490 - protein, 9 aa, Homo Sapiens
HCLYQCSFL

SEQ ID NO: 115491 - protein, 9 aa, Homo Sapiens
QSNNKYVAS

SEQ ID NO: 115492 - protein, 9 aa, Homo Sapiens
LCLPKEVKK

SEQ ID NO: 115493 - protein, 9 aa, Homo Sapiens
NSHGGSLMT

SEQ ID NO: 115494 - protein, 9 aa, Homo Sapiens
SPESPLQAL

SEQ ID NO: 115495 - protein, 9 aa, Homo Sapiens
CHDTIDDLR

SEQ ID NO: 115496 - protein, 9 aa, Homo Sapiens
AMFQSERNN

SEQ ID NO: 115497 - protein, 9 aa, Homo Sapiens
TFNRSPLTM

SEQ ID NO: 115498 - protein, 9 aa, Homo Sapiens
QQELLLQAM

SEQ ID NO: 115499 - protein, 9 aa, Homo Sapiens
KQQELLLQA

SEQ ID NO: 115500 - protein, 9 aa, Homo Sapiens
SGLQHNSSA

SEQ ID NO: 115501 - protein, 9 aa, Homo Sapiens
RKFGSFIWE

SEQ ID NO: 115502 - protein, 9 aa, Homo Sapiens
HGRLLSLWW

SEQ ID NO: 115503 - protein, 9 aa, Homo Sapiens
NLISVVGQH

SEQ ID NO: 115504 - protein, 9 aa, Homo Sapiens
RGSHCCCDT

SEQ ID NO: 115505 - protein, 9 aa, Homo Sapiens
TIEIMKTPR

SEQ ID NO: 115506 - protein, 9 aa, Homo Sapiens
ERKSKQLCQ

SEQ ID NO: 115507 - protein, 9 aa, Homo Sapiens
IEEFTPTQA

SEQ ID NO: 115508 - protein, 9 aa, Homo Sapiens
FQSERNNPA

SEQ ID NO: 115509 - protein, 9 aa, Homo Sapiens
SVVGQHQGV

SEQ ID NO: 115510 - protein, 9 aa, Homo Sapiens
RKCHICRST

SEQ ID NO: 115511 - protein, 9 aa, Homo Sapiens
HCCCDTLDL

SEQ ID NO: 115512 - protein, 9 aa, Homo Sapiens
EQNVPFIKQ

SEQ ID NO: 115513 - protein, 9 aa, Homo Sapiens
PKVGCFSQI

SEQ ID NO: 115514 - protein, 9 aa, Homo Sapiens
EHLSEQNVP

SEQ ID NO: 115515 - protein, 9 aa, Homo Sapiens
DPVMALEWD

SEQ ID NO: 115516 - protein, 9 aa, Homo Sapiens
CFSQIIFKK

SEQ ID NO: 115517 - protein, 9 aa, Homo Sapiens
IPFLYVWTL

SEQ ID NO: 115518 - protein, 9 aa, Homo Sapiens
LDYQRLLLP

SEQ ID NO: 115519 - protein, 9 aa, Homo Sapiens
QIIFKKHKS

SEQ ID NO: 115520 - protein, 9 aa, Homo Sapiens
QDFDFKDQR

SEQ ID NO: 115521 - protein, 9 aa, Homo Sapiens
TAYWTNFAK

SEQ ID NO: 115522 - protein, 9 aa, Homo Sapiens
PLCSRIVSG

SEQ ID NO: 115523 - protein, 9 aa, Homo Sapiens
SDSTYEFLM

SEQ ID NO: 115524 - protein, 9 aa, Homo Sapiens
CLPKEVKKI

SEQ ID NO: 115525 - protein, 9 aa, Homo Sapiens
SLWWEVVTF

SEQ ID NO: 115526 - protein, 9 aa, Homo Sapiens
KEDFQMEVF

SEQ ID NO: 115527 - protein, 9 aa, Homo Sapiens
LQALRVLIA

SEQ ID NO: 115528 - protein, 9 aa, Homo Sapiens
WWDEHLSEQ

SEQ ID NO: 115529 - protein, 9 aa, Homo Sapiens
FQMEVFKIL

SEQ ID NO: 115530 - protein, 9 aa, Homo Sapiens
LIYLLENKS

SEQ ID NO: 115531 - protein, 9 aa, Homo Sapiens
QIEDEWQHV

SEQ ID NO: 115532 - protein, 9 aa, Homo Sapiens
NDGKLSLEQ

SEQ ID NO: 115533 - protein, 9 aa, Homo Sapiens
KCAYKFQRN

SEQ ID NO: 115534 - protein, 9 aa, Homo Sapiens
KFQRNRRHK

SEQ ID NO: 115535 - protein, 9 aa, Homo Sapiens
LLGMLDLLE

SEQ ID NO: 115536 - protein, 9 aa, Homo Sapiens
PESPLQALR

SEQ ID NO: 115537 - protein, 9 aa, Homo Sapiens
SKGAMERAN

SEQ ID NO: 115538 - protein, 9 aa, Homo Sapiens
NQRQFMDPG

SEQ ID NO: 115539 - protein, 9 aa, Homo Sapiens
GNSFKVIHE

SEQ ID NO: 115540 - protein, 9 aa, Homo Sapiens
LSLEQFIRG

SEQ ID NO: 115541 - protein, 9 aa, Homo Sapiens
ESGGGGGSL

SEQ ID NO: 115542 - protein, 9 aa, Homo Sapiens
QSERNNPAP

SEQ ID NO: 115543 - protein, 9 aa, Homo Sapiens
VHFILNKEN

SEQ ID NO: 115544 - protein, 9 aa, Homo Sapiens
RASTSWCSA

SEQ ID NO: 115545 - protein, 9 aa, Homo Sapiens
PAVDRHHLM

SEQ ID NO: 115546 - protein, 9 aa, Homo Sapiens
LRKCHICRS

SEQ ID NO: 115547 - protein, 9 aa, Homo Sapiens
NSFKVIHEQ

SEQ ID NO: 115548 - protein, 9 aa, Homo Sapiens
VKKILSKLK

SEQ ID NO: 115549 - protein, 9 aa, Homo Sapiens
LLYETLDLS

SEQ ID NO: 115550 - protein, 9 aa, Homo Sapiens
GLQHNSSAN

SEQ ID NO: 115551 - protein, 9 aa, Homo Sapiens
ICVEAVQGN

SEQ ID NO: 115552 - protein, 9 aa, Homo Sapiens
FKEDFQMEV

SEQ ID NO: 115553 - protein, 9 aa, Homo Sapiens
LADNLHQEQ

SEQ ID NO: 115554 - protein, 9 aa, Homo Sapiens
CGGNPLHCN

SEQ ID NO: 115555 - protein, 9 aa, Homo Sapiens
LSLWWEVVT

SEQ ID NO: 115556 - protein, 9 aa, Homo Sapiens
EEFTPTQAF

SEQ ID NO: 115557 - protein, 9 aa, Homo Sapiens
STAFCKDHD

SEQ ID NO: 115558 - protein, 9 aa, Homo Sapiens
KVGCFSQII

SEQ ID NO: 115559 - protein, 9 aa, Homo Sapiens
GPFRHMIKL

SEQ ID NO: 115560 - protein, 9 aa, Homo Sapiens
LDSNTIEIM

SEQ ID NO: 115561 - protein, 9 aa, Homo Sapiens
KGAMERANG

SEQ ID NO: 115562 - protein, 9 aa, Homo Sapiens
PMINLISVV

SEQ ID NO: 115563 - protein, 9 aa, Homo Sapiens
ELPLCSRIV

SEQ ID NO: 115564 - protein, 9 aa, Homo Sapiens
AQDLVYKVQ

SEQ ID NO: 115565 - protein, 9 aa, Homo Sapiens
AGPFRHMIK

SEQ ID NO: 115566 - protein, 9 aa, Homo Sapiens
LYKKTYWAS

SEQ ID NO: 115567 - protein, 9 aa, Homo Sapiens
ERIDDSKGA

SEQ ID NO: 115568 - protein, 9 aa, Homo Sapiens
AEKQALLYE

SEQ ID NO: 115569 - protein, 9 aa, Homo Sapiens
SCGGNPLHC

SEQ ID NO: 115570 - protein, 9 aa, Homo Sapiens
IDNVKLHNV

SEQ ID NO: 115571 - protein, 9 aa, Homo Sapiens
LMCAIYVME

SEQ ID NO: 115572 - protein, 9 aa, Homo Sapiens
EDFQMEVFK

SEQ ID NO: 115573 - protein, 9 aa, Homo Sapiens
SHLHVLYHC

SEQ ID NO: 115574 - protein, 9 aa, Homo Sapiens
TYLGSEFVT

SEQ ID NO: 115575 - protein, 9 aa, Homo Sapiens
QRQFMDPGY

SEQ ID NO: 115576 - protein, 9 aa, Homo Sapiens
QAPPGIPGI

SEQ ID NO: 115577 - protein, 9 aa, Homo Sapiens
PLLGSGSIL

SEQ ID NO: 115578 - protein, 9 aa, Homo Sapiens
QTDAVKNAA

SEQ ID NO: 115579 - protein, 9 aa, Homo Sapiens
CQKLKIPYH

SEQ ID NO: 115580 - protein, 9 aa, Homo Sapiens
NSEDVDYAI

SEQ ID NO: 115581 - protein, 9 aa, Homo Sapiens
HSFTAETYL

SEQ ID NO: 115582 - protein, 9 aa, Homo Sapiens
CSRIVSGQD

SEQ ID NO: 115583 - protein, 9 aa, Homo Sapiens
PIRSHLHVL

SEQ ID NO: 115584 - protein, 9 aa, Homo Sapiens
LLSDQTDTF

SEQ ID NO: 115585 - protein, 9 aa, Homo Sapiens
EGESGGGGG

SEQ ID NO: 115586 - protein, 9 aa, Homo Sapiens
DQTDTFNRS

SEQ ID NO: 115587 - protein, 9 aa, Homo Sapiens
YEFLMAENL

SEQ ID NO: 115588 - protein, 9 aa, Homo Sapiens
WWEVVTFRR

SEQ ID NO: 115589 - protein, 9 aa, Homo Sapiens
SSPVLNQRC

SEQ ID NO: 115590 - protein, 9 aa, Homo Sapiens
DIQHLCFNK

SEQ ID NO: 115591 - protein, 9 aa, Homo Sapiens
SKQLCQEKS

SEQ ID NO: 115592 - protein, 9 aa, Homo Sapiens
LCSRIVSGQ

SEQ ID NO: 115593 - protein, 9 aa, Homo Sapiens
IPGDQGLQA

SEQ ID NO: 115594 - protein, 9 aa, Homo Sapiens
EDPVMALEW

SEQ ID NO: 115595 - protein, 9 aa, Homo Sapiens
YLLENKSLE

SEQ ID NO: 115596 - protein, 9 aa, Homo Sapiens
DFDFKDQRP

SEQ ID NO: 115597 - protein, 9 aa, Homo Sapiens
TYRAHLQQV

SEQ ID NO: 115598 - protein, 9 aa, Homo Sapiens
FGSFIWEQD

SEQ ID NO: 115599 - protein, 9 aa, Homo Sapiens
CSECGKFFC

SEQ ID NO: 115600 - protein, 9 aa, Homo Sapiens
EIRRKFGSF

SEQ ID NO: 115601 - protein, 9 aa, Homo Sapiens
NTIEIMKTP

SEQ ID NO: 115602 - protein, 9 aa, Homo Sapiens
TIDDLRNQV

SEQ ID NO: 115603 - protein, 9 aa, Homo Sapiens
SGQTDAVKN

SEQ ID NO: 115604 - protein, 9 aa, Homo Sapiens
LVIKNAFVC

SEQ ID NO: 115605 - protein, 9 aa, Homo Sapiens
TVSKAMTAY

SEQ ID NO: 115606 - protein, 9 aa, Homo Sapiens
DEHLSEQNV

SEQ ID NO: 115607 - protein, 9 aa, Homo Sapiens
PLVYTPEPG

SEQ ID NO: 115608 - protein, 9 aa, Homo Sapiens
PADTAMLLD

SEQ ID NO: 115609 - protein, 9 aa, Homo Sapiens
LNQRCKKRM

SEQ ID NO: 115610 - protein, 9 aa, Homo Sapiens
LFVHCLYQC

SEQ ID NO: 115611 - protein, 9 aa, Homo Sapiens
YSGSLESKS

SEQ ID NO: 115612 - protein, 9 aa, Homo Sapiens
FDFKDQRPY

SEQ ID NO: 115613 - protein, 9 aa, Homo Sapiens
CFNKIPVLR

SEQ ID NO: 115614 - protein, 9 aa, Homo Sapiens
RLLSLWWEV

SEQ ID NO: 115615 - protein, 9 aa, Homo Sapiens
QRNRRHKLK

SEQ ID NO: 115616 - protein, 9 aa, Homo Sapiens
GSSPVLNQR

SEQ ID NO: 115617 - protein, 9 aa, Homo Sapiens
LISVVGQHQ

SEQ ID NO: 115618 - protein, 9 aa, Homo Sapiens
DEEDPVMAL

SEQ ID NO: 115619 - protein, 9 aa, Homo Sapiens
HWALSFLGI

SEQ ID NO: 115620 - protein, 9 aa, Homo Sapiens
HEIIDTGVK

SEQ ID NO: 115621 - protein, 9 aa, Homo Sapiens
RQVYLSNPC

SEQ ID NO: 115622 - protein, 9 aa, Homo Sapiens
ASEQETLVK

SEQ ID NO: 115623 - protein, 9 aa, Homo Sapiens
RTPSCEAMP

SEQ ID NO: 115624 - protein, 9 aa, Homo Sapiens
DIGPAGHVR

SEQ ID NO: 115625 - protein, 9 aa, Homo Sapiens
FSATDKCRS

SEQ ID NO: 115626 - protein, 9 aa, Homo Sapiens
CKEAINVLS

SEQ ID NO: 115627 - protein, 9 aa, Homo Sapiens
HLSAHYNIW

SEQ ID NO: 115628 - protein, 9 aa, Homo Sapiens
QPIDANYLN

SEQ ID NO: 115629 - protein, 9 aa, Homo Sapiens
NGLLSRALR

SEQ ID NO: 115630 - protein, 9 aa, Homo Sapiens
YKGMIDNYK

SEQ ID NO: 115631 - protein, 9 aa, Homo Sapiens
EWDQEEGAN

SEQ ID NO: 115632 - protein, 9 aa, Homo Sapiens
VRDMKCLVE

SEQ ID NO: 115633 - protein, 9 aa, Homo Sapiens
SGNEDGVPS

SEQ ID NO: 115634 - protein, 9 aa, Homo Sapiens
GGSWIELRW

SEQ ID NO: 115635 - protein, 9 aa, Homo Sapiens
HVLKHLQVQ

SEQ ID NO: 115636 - protein, 9 aa, Homo Sapiens
FSPNHKPMV

SEQ ID NO: 115637 - protein, 9 aa, Homo Sapiens
HLRQHEIID

SEQ ID NO: 115638 - protein, 9 aa, Homo Sapiens
GNLRDLYND

SEQ ID NO: 115639 - protein, 9 aa, Homo Sapiens
HKVHTGKKL

SEQ ID NO: 115640 - protein, 9 aa, Homo Sapiens
QFLRILFHM

SEQ ID NO: 115641 - protein, 9 aa, Homo Sapiens
GKHHYTSAG

SEQ ID NO: 115642 - protein, 9 aa, Homo Sapiens
HEIICAFAP

SEQ ID NO: 115643 - protein, 9 aa, Homo Sapiens
WGRWIGVAR

SEQ ID NO: 115644 - protein, 9 aa, Homo Sapiens
RGFAHPLGP

SEQ ID NO: 115645 - protein, 9 aa, Homo Sapiens
SKEEILQSS

SEQ ID NO: 115646 - protein, 9 aa, Homo Sapiens
ETEEIRSAI

SEQ ID NO: 115647 - protein, 9 aa, Homo Sapiens
DQILAINGK

SEQ ID NO: 115648 - protein, 9 aa, Homo Sapiens
LRQHEIIDT

SEQ ID NO: 115649 - protein, 9 aa, Homo Sapiens
WSTPQRFEW

SEQ ID NO: 115650 - protein, 9 aa, Homo Sapiens
MLNTFCGST

SEQ ID NO: 115651 - protein, 9 aa, Homo Sapiens
EIIDTGVKP

SEQ ID NO: 115652 - protein, 9 aa, Homo Sapiens
SLHLLPLAL

SEQ ID NO: 115653 - protein, 9 aa, Homo Sapiens
TEPLPWAAE

SEQ ID NO: 115654 - protein, 9 aa, Homo Sapiens
RSFPGSPLG

SEQ ID NO: 115655 - protein, 9 aa, Homo Sapiens
FLGISLCLA

SEQ ID NO: 115656 - protein, 9 aa, Homo Sapiens
DKLKERTQR

SEQ ID NO: 115657 - protein, 9 aa, Homo Sapiens
EHPLSELNG

SEQ ID NO: 115658 - protein, 9 aa, Homo Sapiens
WLLFSDFSN

SEQ ID NO: 115659 - protein, 9 aa, Homo Sapiens
HGSKAVTVP

SEQ ID NO: 115660 - protein, 9 aa, Homo Sapiens
APCTEPLPW

SEQ ID NO: 115661 - protein, 9 aa, Homo Sapiens
SNIAVEEKF

SEQ ID NO: 115662 - protein, 9 aa, Homo Sapiens
LVVQDVVAS

SEQ ID NO: 115663 - protein, 9 aa, Homo Sapiens
KSCKTHPYG

SEQ ID NO: 115664 - protein, 9 aa, Homo Sapiens
RILKIQNRE

SEQ ID NO: 115665 - protein, 9 aa, Homo Sapiens
TQRFGLNVS

SEQ ID NO: 115666 - protein, 9 aa, Homo Sapiens
AARCPLCQK

SEQ ID NO: 115667 - protein, 9 aa, Homo Sapiens
DLPDAIKPH

SEQ ID NO: 115668 - protein, 9 aa, Homo Sapiens
QVQTLTQED

SEQ ID NO: 115669 - protein, 9 aa, Homo Sapiens
QRFEWDQEE

SEQ ID NO: 115670 - protein, 9 aa, Homo Sapiens
NTKGEAIFN

SEQ ID NO: 115671 - protein, 9 aa, Homo Sapiens
SCEAMPHRD

SEQ ID NO: 115672 - protein, 9 aa, Homo Sapiens
VPLAELAQH

SEQ ID NO: 115673 - protein, 9 aa, Homo Sapiens
LTAKILELA

SEQ ID NO: 115674 - protein, 9 aa, Homo Sapiens
DYEAFCGFS

SEQ ID NO: 115675 - protein, 9 aa, Homo Sapiens
AQAKESLDL

SEQ ID NO: 115676 - protein, 9 aa, Homo Sapiens
CPLCQKPFP

SEQ ID NO: 115677 - protein, 9 aa, Homo Sapiens
LEIPVVNLK

SEQ ID NO: 115678 - protein, 9 aa, Homo Sapiens
LCQKPFPDG

SEQ ID NO: 115679 - protein, 9 aa, Homo Sapiens
RWFSLMNPW

SEQ ID NO: 115680 - protein, 9 aa, Homo Sapiens
VAKHEIICA

SEQ ID NO: 115681 - protein, 9 aa, Homo Sapiens
CSLDVVCTK

SEQ ID NO: 115682 - protein, 9 aa, Homo Sapiens
DHPWVQHAK

SEQ ID NO: 115683 - protein, 9 aa, Homo Sapiens
LKGLVVLGG

SEQ ID NO: 115684 - protein, 9 aa, Homo Sapiens
DNYGDQIAI

SEQ ID NO: 115685 - protein, 9 aa, Homo Sapiens
MNIYVVVYL

SEQ ID NO: 115686 - protein, 9 aa, Homo Sapiens
SSHLSAHYN

SEQ ID NO: 115687 - protein, 9 aa, Homo Sapiens
TKNLGNVIF

SEQ ID NO: 115688 - protein, 9 aa, Homo Sapiens
VQTLTQEDI

SEQ ID NO: 115689 - protein, 9 aa, Homo Sapiens
VSGAAWLDA

SEQ ID NO: 115690 - protein, 9 aa, Homo Sapiens
SEEQSVEDS

SEQ ID NO: 115691 - protein, 9 aa, Homo Sapiens
SQLVGSRAF

SEQ ID NO: 115692 - protein, 9 aa, Homo Sapiens
VCTKYGLLD

SEQ ID NO: 115693 - protein, 9 aa, Homo Sapiens
HKPSIKKMY

SEQ ID NO: 115694 - protein, 9 aa, Homo Sapiens
LQFLRILFH

SEQ ID NO: 115695 - protein, 9 aa, Homo Sapiens
LYKTNRILK

SEQ ID NO: 115696 - protein, 9 aa, Homo Sapiens
YNIWYMNIY

SEQ ID NO: 115697 - protein, 9 aa, Homo Sapiens
HYNIWYMNI

SEQ ID NO: 115698 - protein, 9 aa, Homo Sapiens
GEDTKNLGN

SEQ ID NO: 115699 - protein, 9 aa, Homo Sapiens
IDTGVKPYI

SEQ ID NO: 115700 - protein, 9 aa, Homo Sapiens
VTNSSQRFI

SEQ ID NO: 115701 - protein, 9 aa, Homo Sapiens
CQSFPGPRQ

SEQ ID NO: 115702 - protein, 9 aa, Homo Sapiens
QDVVASCFA

SEQ ID NO: 115703 - protein, 9 aa, Homo Sapiens
KKQHSVTQA

SEQ ID NO: 115704 - protein, 9 aa, Homo Sapiens
NIYVVVYLR

SEQ ID NO: 115705 - protein, 9 aa, Homo Sapiens
GSTPYAAPE

SEQ ID NO: 115706 - protein, 9 aa, Homo Sapiens
NLRDLYNDK

SEQ ID NO: 115707 - protein, 9 aa, Homo Sapiens
EKQFHCKKY

SEQ ID NO: 115708 - protein, 9 aa, Homo Sapiens
HCSGMGKHH

SEQ ID NO: 115709 - protein, 9 aa, Homo Sapiens
QLLELEKQF

SEQ ID NO: 115710 - protein, 9 aa, Homo Sapiens
YNCKEAINV

SEQ ID NO: 115711 - protein, 9 aa, Homo Sapiens
SDFSNELYK

SEQ ID NO: 115712 - protein, 9 aa, Homo Sapiens
LRLSSEVEA

SEQ ID NO: 115713 - protein, 9 aa, Homo Sapiens
RTQRFGLNV

SEQ ID NO: 115714 - protein, 9 aa, Homo Sapiens
AIGSTGDFT

SEQ ID NO: 115715 - protein, 9 aa, Homo Sapiens
KAVTVPMIP

SEQ ID NO: 115716 - protein, 9 aa, Homo Sapiens
LKASVKNYK

SEQ ID NO: 115717 - protein, 9 aa, Homo Sapiens
EQTFSPNHK

SEQ ID NO: 115718 - protein, 9 aa, Homo Sapiens
GTVLTADNC

SEQ ID NO: 115719 - protein, 9 aa, Homo Sapiens
DKRRDLTTS

SEQ ID NO: 115720 - protein, 9 aa, Homo Sapiens
TPSQIMFLE

SEQ ID NO: 115721 - protein, 9 aa, Homo Sapiens
INPRSLEPL

SEQ ID NO: 115722 - protein, 9 aa, Homo Sapiens
VLKHLQVQT

SEQ ID NO: 115723 - protein, 9 aa, Homo Sapiens
KHGTLVVQD

SEQ ID NO: 115724 - protein, 9 aa, Homo Sapiens
WVKIYHLEY

SEQ ID NO: 115725 - protein, 9 aa, Homo Sapiens
WRGIDIGPA

SEQ ID NO: 115726 - protein, 9 aa, Homo Sapiens
HHYTSAGIS

SEQ ID NO: 115727 - protein, 9 aa, Homo Sapiens
GLSKSMFDV

SEQ ID NO: 115728 - protein, 9 aa, Homo Sapiens
KFVMTADDD

SEQ ID NO: 115729 - protein, 9 aa, Homo Sapiens
EEGHSDLMS

SEQ ID NO: 115730 - protein, 9 aa, Homo Sapiens
VVVYLRLIS

SEQ ID NO: 115731 - protein, 9 aa, Homo Sapiens
SNELYKTNR

SEQ ID NO: 115732 - protein, 9 aa, Homo Sapiens
RGKCQQLTV

SEQ ID NO: 115733 - protein, 9 aa, Homo Sapiens
ETVETGKNL

SEQ ID NO: 115734 - protein, 9 aa, Homo Sapiens
VYLSNPCPG

SEQ ID NO: 115735 - protein, 9 aa, Homo Sapiens
LYKAPKKKS

SEQ ID NO: 115736 - protein, 9 aa, Homo Sapiens
IAVEEKFNQ

SEQ ID NO: 115737 - protein, 9 aa, Homo Sapiens
PLCQKPFPD

SEQ ID NO: 115738 - protein, 9 aa, Homo Sapiens
LKERTQRFG

SEQ ID NO: 115739 - protein, 9 aa, Homo Sapiens
HHKVHTGKK

SEQ ID NO: 115740 - protein, 9 aa, Homo Sapiens
QSFVELMKT

SEQ ID NO: 115741 - protein, 9 aa, Homo Sapiens
KHVVSEGTK

SEQ ID NO: 115742 - protein, 9 aa, Homo Sapiens
TCTVLVWLL

SEQ ID NO: 115743 - protein, 9 aa, Homo Sapiens
CRESQLVGS

SEQ ID NO: 115744 - protein, 9 aa, Homo Sapiens
RWIGVARRA

SEQ ID NO: 115745 - protein, 9 aa, Homo Sapiens
PLGPCKMTN

SEQ ID NO: 115746 - protein, 9 aa, Homo Sapiens
CTKYGLLDL

SEQ ID NO: 115747 - protein, 9 aa, Homo Sapiens
LAKHVVSEG

SEQ ID NO: 115748 - protein, 9 aa, Homo Sapiens
YPIAIFINP

SEQ ID NO: 115749 - protein, 9 aa, Homo Sapiens
AGHVRVAIG

SEQ ID NO: 115750 - protein, 9 aa, Homo Sapiens
QNSAKYQAL

SEQ ID NO: 115751 - protein, 9 aa, Homo Sapiens
TGDFTSGGL

SEQ ID NO: 115752 - protein, 9 aa, Homo Sapiens
LDYEAFCGF

SEQ ID NO: 115753 - protein, 9 aa, Homo Sapiens
LMNPWTKEV

SEQ ID NO: 115754 - protein, 9 aa, Homo Sapiens
AQGLRPHTV

SEQ ID NO: 115755 - protein, 9 aa, Homo Sapiens
SIKKMYQFN

SEQ ID NO: 115756 - protein, 9 aa, Homo Sapiens
YVVVYLRLI

SEQ ID NO: 115757 - protein, 9 aa, Homo Sapiens
SDRLLVHQK

SEQ ID NO: 115758 - protein, 9 aa, Homo Sapiens
ANYLNKGIG

SEQ ID NO: 115759 - protein, 9 aa, Homo Sapiens
ILFHMLIRL

SEQ ID NO: 115760 - protein, 9 aa, Homo Sapiens
EDGEEEEEV

SEQ ID NO: 115761 - protein, 9 aa, Homo Sapiens
FLEKEIMDK

SEQ ID NO: 115762 - protein, 9 aa, Homo Sapiens
IGSTGDFTS

SEQ ID NO: 115763 - protein, 9 aa, Homo Sapiens
NITCTVLVW

SEQ ID NO: 115764 - protein, 9 aa, Homo Sapiens
RLLVHQKSC

SEQ ID NO: 115765 - protein, 9 aa, Homo Sapiens
GRHGSKAVT

SEQ ID NO: 115766 - protein, 9 aa, Homo Sapiens
AELAQHKLH

SEQ ID NO: 115767 - protein, 9 aa, Homo Sapiens
PPPLLPPLL

SEQ ID NO: 115768 - protein, 9 aa, Homo Sapiens
TPQRFEWDQ

SEQ ID NO: 115769 - protein, 9 aa, Homo Sapiens
HFTFEILAV

SEQ ID NO: 115770 - protein, 9 aa, Homo Sapiens
EKISRYQEM

SEQ ID NO: 115771 - protein, 9 aa, Homo Sapiens
QAWEGEDTK

SEQ ID NO: 115772 - protein, 9 aa, Homo Sapiens
GNEDGVPSL

SEQ ID NO: 115773 - protein, 9 aa, Homo Sapiens
AFPPGLGLG

SEQ ID NO: 115774 - protein, 9 aa, Homo Sapiens
NPRSLEPLM

SEQ ID NO: 115775 - protein, 9 aa, Homo Sapiens
YEGAVVIVD

SEQ ID NO: 115776 - protein, 9 aa, Homo Sapiens
SDLMSFQPT

SEQ ID NO: 115777 - protein, 9 aa, Homo Sapiens
AAWLDASCL

SEQ ID NO: 115778 - protein, 9 aa, Homo Sapiens
GHSDLMSFQ

SEQ ID NO: 115779 - protein, 9 aa, Homo Sapiens
SAKYQALCS

SEQ ID NO: 115780 - protein, 9 aa, Homo Sapiens
LFYSTAILK

SEQ ID NO: 115781 - protein, 9 aa, Homo Sapiens
WESGDHPWV

SEQ ID NO: 115782 - protein, 9 aa, Homo Sapiens
PGELAKHVV

SEQ ID NO: 115783 - protein, 9 aa, Homo Sapiens
VCLMDVAKH

SEQ ID NO: 115784 - protein, 9 aa, Homo Sapiens
ELRLSSEVE

SEQ ID NO: 115785 - protein, 9 aa, Homo Sapiens
TVALWKIQQ

SEQ ID NO: 115786 - protein, 9 aa, Homo Sapiens
RVAIGSTGD

SEQ ID NO: 115787 - protein, 9 aa, Homo Sapiens
ISQLKQKLK

SEQ ID NO: 115788 - protein, 9 aa, Homo Sapiens
EEIRSAIAP

SEQ ID NO: 115789 - protein, 9 aa, Homo Sapiens
VETEEIRSA

SEQ ID NO: 115790 - protein, 9 aa, Homo Sapiens
SSEEQSVED

SEQ ID NO: 115791 - protein, 9 aa, Homo Sapiens
KLKNLQNSQ

SEQ ID NO: 115792 - protein, 9 aa, Homo Sapiens
IIEAGDQIL

SEQ ID NO: 115793 - protein, 9 aa, Homo Sapiens
DFTSGGLRC

SEQ ID NO: 115794 - protein, 9 aa, Homo Sapiens
AHYNIWYMN

SEQ ID NO: 115795 - protein, 9 aa, Homo Sapiens
FPLVEQTFS

SEQ ID NO: 115796 - protein, 9 aa, Homo Sapiens
EYLTAKILE

SEQ ID NO: 115797 - protein, 9 aa, Homo Sapiens
GSWIELRWG

SEQ ID NO: 115798 - protein, 9 aa, Homo Sapiens
DDSSEEQSV

SEQ ID NO: 115799 - protein, 9 aa, Homo Sapiens
HNLKEKLLN

SEQ ID NO: 115800 - protein, 9 aa, Homo Sapiens
SWIELRWGR

SEQ ID NO: 115801 - protein, 9 aa, Homo Sapiens
AGVHSIGDW

SEQ ID NO: 115802 - protein, 9 aa, Homo Sapiens
KGLVVLGGI

SEQ ID NO: 115803 - protein, 9 aa, Homo Sapiens
LRSRWFSLM

SEQ ID NO: 115804 - protein, 9 aa, Homo Sapiens
NSAKYQALC

SEQ ID NO: 115805 - protein, 9 aa, Homo Sapiens
NGAPCRESQ

SEQ ID NO: 115806 - protein, 9 aa, Homo Sapiens
IQNRESSHL

SEQ ID NO: 115807 - protein, 9 aa, Homo Sapiens
LQRGKCQQL

SEQ ID NO: 115808 - protein, 9 aa, Homo Sapiens
VKNYKGMID

SEQ ID NO: 115809 - protein, 9 aa, Homo Sapiens
LTTNTVVYD

SEQ ID NO: 115810 - protein, 9 aa, Homo Sapiens
RVRDMKCLV

SEQ ID NO: 115811 - protein, 9 aa, Homo Sapiens
LPGELAKHV

SEQ ID NO: 115812 - protein, 9 aa, Homo Sapiens
FPGSPLGAS

SEQ ID NO: 115813 - protein, 9 aa, Homo Sapiens
QVYLSNPCP

SEQ ID NO: 115814 - protein, 9 aa, Homo Sapiens
SEGTPDSLY

SEQ ID NO: 115815 - protein, 9 aa, Homo Sapiens
VDAGAQYGK

SEQ ID NO: 115816 - protein, 9 aa, Homo Sapiens
LVHQKSCKT

SEQ ID NO: 115817 - protein, 9 aa, Homo Sapiens
KQFHCKKYL

SEQ ID NO: 115818 - protein, 9 aa, Homo Sapiens
RDLTTSAEP

SEQ ID NO: 115819 - protein, 9 aa, Homo Sapiens
VQWLKNGQP

SEQ ID NO: 115820 - protein, 9 aa, Homo Sapiens
RGGNPLATV

SEQ ID NO: 115821 - protein, 9 aa, Homo Sapiens
FPPGLGLGG

SEQ ID NO: 115822 - protein, 9 aa, Homo Sapiens
TSSVTVALW

SEQ ID NO: 115823 - protein, 9 aa, Homo Sapiens
LSKINITCT

SEQ ID NO: 115824 - protein, 9 aa, Homo Sapiens
GGNPLATVQ

SEQ ID NO: 115825 - protein, 9 aa, Homo Sapiens
FYSTAILKY

SEQ ID NO: 115826 - protein, 9 aa, Homo Sapiens
KSLQSFVEL

SEQ ID NO: 115827 - protein, 9 aa, Homo Sapiens
KPSIKKMYQ

SEQ ID NO: 115828 - protein, 9 aa, Homo Sapiens
QGLRPHTVS

SEQ ID NO: 115829 - protein, 9 aa, Homo Sapiens
YNDKDGLRK

SEQ ID NO: 115830 - protein, 9 aa, Homo Sapiens
LELEKQFHC

SEQ ID NO: 115831 - protein, 9 aa, Homo Sapiens
LDFPDSNHV

SEQ ID NO: 115832 - protein, 9 aa, Homo Sapiens
LRVPNGLLS

SEQ ID NO: 115833 - protein, 9 aa, Homo Sapiens
PLAELAQHK

SEQ ID NO: 115834 - protein, 9 aa, Homo Sapiens
AGIIEAGDQ

SEQ ID NO: 115835 - protein, 9 aa, Homo Sapiens
VMTADDDIF

SEQ ID NO: 115836 - protein, 9 aa, Homo Sapiens
SAQGLRPHT

SEQ ID NO: 115837 - protein, 9 aa, Homo Sapiens
LAQHKLHFS

SEQ ID NO: 115838 - protein, 9 aa, Homo Sapiens
NIVVYHVIV

SEQ ID NO: 115839 - protein, 9 aa, Homo Sapiens
LQSSKDKED

SEQ ID NO: 115840 - protein, 9 aa, Homo Sapiens
ACQSFPGPR

SEQ ID NO: 115841 - protein, 9 aa, Homo Sapiens
TKYGLLDLS

SEQ ID NO: 115842 - protein, 9 aa, Homo Sapiens
VLCTSSVTV

SEQ ID NO: 115843 - protein, 9 aa, Homo Sapiens
GLRCHLEHP

SEQ ID NO: 115844 - protein, 9 aa, Homo Sapiens
KKMYQFNAV

SEQ ID NO: 115845 - protein, 9 aa, Homo Sapiens
STRACQSFP

SEQ ID NO: 115846 - protein, 9 aa, Homo Sapiens
NYKGMIDNY

SEQ ID NO: 115847 - protein, 9 aa, Homo Sapiens
SELNGAPCR

SEQ ID NO: 115848 - protein, 9 aa, Homo Sapiens
GDQIAIELR

SEQ ID NO: 115849 - protein, 9 aa, Homo Sapiens
GISLCLALM

SEQ ID NO: 115850 - protein, 9 aa, Homo Sapiens
SARQVYLSN

SEQ ID NO: 115851 - protein, 9 aa, Homo Sapiens
RCHLEHPLS

SEQ ID NO: 115852 - protein, 9 aa, Homo Sapiens
SAHYNIWYM

SEQ ID NO: 115853 - protein, 9 aa, Homo Sapiens
TDCILIVGL

SEQ ID NO: 115854 - protein, 9 aa, Homo Sapiens
MMQALLGAQ

SEQ ID NO: 115855 - protein, 9 aa, Homo Sapiens
VRQVETEEI

SEQ ID NO: 115856 - protein, 9 aa, Homo Sapiens
AKFVMTADD

SEQ ID NO: 115857 - protein, 9 aa, Homo Sapiens
FINPRSLEP

SEQ ID NO: 115858 - protein, 9 aa, Homo Sapiens
ETKLKSLQS

SEQ ID NO: 115859 - protein, 9 aa, Homo Sapiens
LKCGNIVVY

SEQ ID NO: 115860 - protein, 9 aa, Homo Sapiens
CRSFPGSPL

SEQ ID NO: 115861 - protein, 9 aa, Homo Sapiens
VIVDAGAQY

SEQ ID NO: 115862 - protein, 9 aa, Homo Sapiens
GLVVLGGIY

SEQ ID NO: 115863 - protein, 9 aa, Homo Sapiens
KVPDNYGDQ

SEQ ID NO: 115864 - protein, 9 aa, Homo Sapiens
DAIKPHEIQ

SEQ ID NO: 115865 - protein, 9 aa, Homo Sapiens
RWGRWIGVA

SEQ ID NO: 115866 - protein, 9 aa, Homo Sapiens
HDKRRDLTT

SEQ ID NO: 115867 - protein, 9 aa, Homo Sapiens
SKHDKRRDL

SEQ ID NO: 115868 - protein, 9 aa, Homo Sapiens
NTFCGSTPY

SEQ ID NO: 115869 - protein, 9 aa, Homo Sapiens
AHPLGPCKM

SEQ ID NO: 115870 - protein, 9 aa, Homo Sapiens
GVPSLCSKS

SEQ ID NO: 115871 - protein, 9 aa, Homo Sapiens
QSTRQEVER

SEQ ID NO: 115872 - protein, 9 aa, Homo Sapiens
CTSSVTVAL

SEQ ID NO: 115873 - protein, 9 aa, Homo Sapiens
QKPFPDGLQ

SEQ ID NO: 115874 - protein, 9 aa, Homo Sapiens
HNTKGEAIF

SEQ ID NO: 115875 - protein, 9 aa, Homo Sapiens
TKLKSLQSF

SEQ ID NO: 115876 - protein, 9 aa, Homo Sapiens
LSFLGISLC

SEQ ID NO: 115877 - protein, 9 aa, Homo Sapiens
RLLRVPNGL

SEQ ID NO: 115878 - protein, 9 aa, Homo Sapiens
WDQEEGANT

SEQ ID NO: 115879 - protein, 9 aa, Homo Sapiens
GDHPWVQHA

SEQ ID NO: 115880 - protein, 9 aa, Homo Sapiens
AWEGEDTKN

SEQ ID NO: 115881 - protein, 9 aa, Homo Sapiens
RSRLTYHHK

SEQ ID NO: 115882 - protein, 9 aa, Homo Sapiens
GFAHPLGPC

SEQ ID NO: 115883 - protein, 9 aa, Homo Sapiens
CHLEHPLSE

SEQ ID NO: 115884 - protein, 9 aa, Homo Sapiens
LKKQHSVTQ

SEQ ID NO: 115885 - protein, 9 aa, Homo Sapiens
GGLRCHLEH

SEQ ID NO: 115886 - protein, 9 aa, Homo Sapiens
VHETGLAMI

SEQ ID NO: 115887 - protein, 9 aa, Homo Sapiens
PPLLLLLGA

SEQ ID NO: 115888 - protein, 9 aa, Homo Sapiens
LAGCGSRVD

SEQ ID NO: 115889 - protein, 9 aa, Homo Sapiens
LLFSDFSNE

SEQ ID NO: 115890 - protein, 9 aa, Homo Sapiens
DTKNLGNVI

SEQ ID NO: 115891 - protein, 9 aa, Homo Sapiens
ARQVYLSNP

SEQ ID NO: 115892 - protein, 9 aa, Homo Sapiens
DGEEEEEVL

SEQ ID NO: 115893 - protein, 9 aa, Homo Sapiens
QHEIIDTGV

SEQ ID NO: 115894 - protein, 9 aa, Homo Sapiens
SRWFSLMNP

SEQ ID NO: 115895 - protein, 9 aa, Homo Sapiens
FSDFSNELY

SEQ ID NO: 115896 - protein, 9 aa, Homo Sapiens
HQKSCKTHP

SEQ ID NO: 115897 - protein, 9 aa, Homo Sapiens
EGPQATGGL

SEQ ID NO: 115898 - protein, 9 aa, Homo Sapiens
LFHMLIRLL

SEQ ID NO: 115899 - protein, 9 aa, Homo Sapiens
RVPNGLLSR

SEQ ID NO: 115900 - protein, 9 aa, Homo Sapiens
TGKNLGPLE

SEQ ID NO: 115901 - protein, 9 aa, Homo Sapiens
EILQSSKDK

SEQ ID NO: 115902 - protein, 9 aa, Homo Sapiens
TSGGLRCHL

SEQ ID NO: 115903 - protein, 9 aa, Homo Sapiens
ESNIAVEEK

SEQ ID NO: 115904 - protein, 9 aa, Homo Sapiens
LVWLLFSDF

SEQ ID NO: 115905 - protein, 9 aa, Homo Sapiens
RRDLTTSAE

SEQ ID NO: 115906 - protein, 9 aa, Homo Sapiens
DGVPSLCSK

SEQ ID NO: 115907 - protein, 9 aa, Homo Sapiens
GGQPIDANY

SEQ ID NO: 115908 - protein, 9 aa, Homo Sapiens
AINVLSHLP

SEQ ID NO: 115909 - protein, 9 aa, Homo Sapiens
CWESGDHPW

SEQ ID NO: 115910 - protein, 9 aa, Homo Sapiens
CQKPFPDGL

SEQ ID NO: 115911 - protein, 9 aa, Homo Sapiens
HHGGSWIEL

SEQ ID NO: 115912 - protein, 9 aa, Homo Sapiens
EDTKNLGNV

SEQ ID NO: 115913 - protein, 9 aa, Homo Sapiens
KYGLLDLSL

SEQ ID NO: 115914 - protein, 9 aa, Homo Sapiens
RAFPATSRF

SEQ ID NO: 115915 - protein, 9 aa, Homo Sapiens
LPWAAEPGY

SEQ ID NO: 115916 - protein, 9 aa, Homo Sapiens
SVTVALWKI

SEQ ID NO: 115917 - protein, 9 aa, Homo Sapiens
ETLVKPKPL

SEQ ID NO: 115918 - protein, 9 aa, Homo Sapiens
KLKERTQRF

SEQ ID NO: 115919 - protein, 9 aa, Homo Sapiens
KCQQLTVSA

SEQ ID NO: 115920 - protein, 9 aa, Homo Sapiens
PCPAQNSAK

SEQ ID NO: 115921 - protein, 9 aa, Homo Sapiens
LAELAQHKL

SEQ ID NO: 115922 - protein, 9 aa, Homo Sapiens
WIGVARRAG

SEQ ID NO: 115923 - protein, 9 aa, Homo Sapiens
CPAQNSAKY

SEQ ID NO: 115924 - protein, 9 aa, Homo Sapiens
FRLHCSLDV

SEQ ID NO: 115925 - protein, 9 aa, Homo Sapiens
PQATGGLEP

SEQ ID NO: 115926 - protein, 9 aa, Homo Sapiens
VQDVVASCF

SEQ ID NO: 115927 - protein, 9 aa, Homo Sapiens
GPVHHGGSW

SEQ ID NO: 115928 - protein, 9 aa, Homo Sapiens
LETDSSEKI

SEQ ID NO: 115929 - protein, 9 aa, Homo Sapiens
SEVQSLSVQ

SEQ ID NO: 115930 - protein, 9 aa, Homo Sapiens
PAQNSAKYQ

SEQ ID NO: 115931 - protein, 9 aa, Homo Sapiens
RESSHLSAH

SEQ ID NO: 115932 - protein, 9 aa, Homo Sapiens
LGFLHLLQP

SEQ ID NO: 115933 - protein, 9 aa, Homo Sapiens
ELYKTNRIL

SEQ ID NO: 115934 - protein, 9 aa, Homo Sapiens
KNLQNSQLP

SEQ ID NO: 115935 - protein, 9 aa, Homo Sapiens
SNPCPGLYL

SEQ ID NO: 115936 - protein, 9 aa, Homo Sapiens
GHVRVAIGS

SEQ ID NO: 115937 - protein, 9 aa, Homo Sapiens
QLKQKLKNL

SEQ ID NO: 115938 - protein, 9 aa, Homo Sapiens
KINITCTVL

SEQ ID NO: 115939 - protein, 9 aa, Homo Sapiens
NELYKTNRI

SEQ ID NO: 115940 - protein, 9 aa, Homo Sapiens
NDKDGLRKE

SEQ ID NO: 115941 - protein, 9 aa, Homo Sapiens
NPLATVQWL

SEQ ID NO: 115942 - protein, 9 aa, Homo Sapiens
TNRILKIQN

SEQ ID NO: 115943 - protein, 9 aa, Homo Sapiens
KILELAGNA

SEQ ID NO: 115944 - protein, 9 aa, Homo Sapiens
DRLLVHQKS

SEQ ID NO: 115945 - protein, 9 aa, Homo Sapiens
GNPLATVQW

SEQ ID NO: 115946 - protein, 9 aa, Homo Sapiens
DLWGTVLTA

SEQ ID NO: 115947 - protein, 9 aa, Homo Sapiens
KERTQRFGL

SEQ ID NO: 115948 - protein, 9 aa, Homo Sapiens
DLYNDKDGL

SEQ ID NO: 115949 - protein, 9 aa, Homo Sapiens
PCTEPLPWA

SEQ ID NO: 115950 - protein, 9 aa, Homo Sapiens
RDLYNDKDG

SEQ ID NO: 115951 - protein, 9 aa, Homo Sapiens
SKSMFDVTN

SEQ ID NO: 115952 - protein, 9 aa, Homo Sapiens
RESQLVGSR

SEQ ID NO: 115953 - protein, 9 aa, Homo Sapiens
GLRPHTVSS

SEQ ID NO: 115954 - protein, 9 aa, Homo Sapiens
FESEVQSLS

SEQ ID NO: 115955 - protein, 9 aa, Homo Sapiens
IKKMYQFNA

SEQ ID NO: 115956 - protein, 9 aa, Homo Sapiens
FCGFSATDK

SEQ ID NO: 115957 - protein, 9 aa, Homo Sapiens
RQTDCILIV

SEQ ID NO: 115958 - protein, 9 aa, Homo Sapiens
CGNIVVYHV

SEQ ID NO: 115959 - protein, 9 aa, Homo Sapiens
LSNPCPGLY

SEQ ID NO: 115960 - protein, 9 aa, Homo Sapiens
TFCGSTPYA

SEQ ID NO: 115961 - protein, 9 aa, Homo Sapiens
SMFDVTNSS

SEQ ID NO: 115962 - protein, 9 aa, Homo Sapiens
FKHRRVRFV

SEQ ID NO: 115963 - protein, 9 aa, Homo Sapiens
KHNTKGEAI

SEQ ID NO: 115964 - protein, 9 aa, Homo Sapiens
KRRDLTTSA

SEQ ID NO: 115965 - protein, 9 aa, Homo Sapiens
TDSSEKISR

SEQ ID NO: 115966 - protein, 9 aa, Homo Sapiens
STGDFTSGG

SEQ ID NO: 115967 - protein, 9 aa, Homo Sapiens
KHLLDFPDS

SEQ ID NO: 115968 - protein, 9 aa, Homo Sapiens
GSPLGASNA

SEQ ID NO: 115969 - protein, 9 aa, Homo Sapiens
SFLGISLCL

SEQ ID NO: 115970 - protein, 9 aa, Homo Sapiens
FTSGGLRCH

SEQ ID NO: 115971 - protein, 9 aa, Homo Sapiens
HPWVQHAKW

SEQ ID NO: 115972 - protein, 9 aa, Homo Sapiens
HAKFVMTAD

SEQ ID NO: 115973 - protein, 9 aa, Homo Sapiens
EEEGHSDLM

SEQ ID NO: 115974 - protein, 9 aa, Homo Sapiens
GQPIDANYL

SEQ ID NO: 115975 - protein, 9 aa, Homo Sapiens
EAFCGFSAT

SEQ ID NO: 115976 - protein, 9 aa, Homo Sapiens
IKPHEIQEK

SEQ ID NO: 115977 - protein, 9 aa, Homo Sapiens
SHLSAHYNI

SEQ ID NO: 115978 - protein, 9 aa, Homo Sapiens
DPGRHGSKA

SEQ ID NO: 115979 - protein, 9 aa, Homo Sapiens
HLQVQTLTQ

SEQ ID NO: 115980 - protein, 9 aa, Homo Sapiens
HVVSEGTKA

SEQ ID NO: 115981 - protein, 9 aa, Homo Sapiens
TQEELRLSS

SEQ ID NO: 115982 - protein, 9 aa, Homo Sapiens
HLLPLALGF

SEQ ID NO: 115983 - protein, 9 aa, Homo Sapiens
INITCTVLV

SEQ ID NO: 115984 - protein, 9 aa, Homo Sapiens
APCRESQLV

SEQ ID NO: 115985 - protein, 9 aa, Homo Sapiens
INHFTFEIL

SEQ ID NO: 115986 - protein, 9 aa, Homo Sapiens
NNFQSTRQE

SEQ ID NO: 115987 - protein, 9 aa, Homo Sapiens
PSTRACQSF

SEQ ID NO: 115988 - protein, 9 aa, Homo Sapiens
ELEKQFHCK

SEQ ID NO: 115989 - protein, 9 aa, Homo Sapiens
ESGDHPWVQ

SEQ ID NO: 115990 - protein, 9 aa, Homo Sapiens
PDSNHVKSC

SEQ ID NO: 115991 - protein, 9 aa, Homo Sapiens
RRTPSCEAM

SEQ ID NO: 115992 - protein, 9 aa, Homo Sapiens
RLTYHHKVH

SEQ ID NO: 115993 - protein, 9 aa, Homo Sapiens
GAVVIVDAG

SEQ ID NO: 115994 - protein, 9 aa, Homo Sapiens
KVLFKKSEK

SEQ ID NO: 115995 - protein, 9 aa, Homo Sapiens
VPNGLLSRA

SEQ ID NO: 115996 - protein, 9 aa, Homo Sapiens
ATGGLEPDL

SEQ ID NO: 115997 - protein, 9 aa, Homo Sapiens
PNGLLSRAL

SEQ ID NO: 115998 - protein, 9 aa, Homo Sapiens
KEAINVLSH

SEQ ID NO: 115999 - protein, 9 aa, Homo Sapiens
HYTSAGISQ

SEQ ID NO: 116000 - protein, 9 aa, Homo Sapiens
GFSATDKCR

SEQ ID NO: 116001 - protein, 9 aa, Homo Sapiens
SISKEEILQ

SEQ ID NO: 116002 - protein, 9 aa, Homo Sapiens
TPYAAPELF

SEQ ID NO: 116003 - protein, 9 aa, Homo Sapiens
QNTRNNFQS

SEQ ID NO: 116004 - protein, 9 aa, Homo Sapiens
SGMGKHHYT

SEQ ID NO: 116005 - protein, 9 aa, Homo Sapiens
IQAWEGEDT

SEQ ID NO: 116006 - protein, 9 aa, Homo Sapiens
IYVVVYLRL

SEQ ID NO: 116007 - protein, 9 aa, Homo Sapiens
RCPLCQKPF

SEQ ID NO: 116008 - protein, 9 aa, Homo Sapiens
INVLSHLPS

SEQ ID NO: 116009 - protein, 9 aa, Homo Sapiens
KYQALCSSG

SEQ ID NO: 116010 - protein, 9 aa, Homo Sapiens
AWLDASCLG

SEQ ID NO: 116011 - protein, 9 aa, Homo Sapiens
GAQAKESLD

SEQ ID NO: 116012 - protein, 9 aa, Homo Sapiens
EVTVQPGCY

SEQ ID NO: 116013 - protein, 9 aa, Homo Sapiens
GCGSRVDGG

SEQ ID NO: 116014 - protein, 9 aa, Homo Sapiens
KPFPDGLQL

SEQ ID NO: 116015 - protein, 9 aa, Homo Sapiens
PALPSTRAC

SEQ ID NO: 116016 - protein, 9 aa, Homo Sapiens
QIAIELRSS

SEQ ID NO: 116017 - protein, 9 aa, Homo Sapiens
LRWGRWIGV

SEQ ID NO: 116018 - protein, 9 aa, Homo Sapiens
PLGASNASC

SEQ ID NO: 116019 - protein, 9 aa, Homo Sapiens
EELRLSSEV

SEQ ID NO: 116020 - protein, 9 aa, Homo Sapiens
QTFSPNHKP

SEQ ID NO: 116021 - protein, 9 aa, Homo Sapiens
EPLPWAAEP

SEQ ID NO: 116022 - protein, 9 aa, Homo Sapiens
KCGNIVVYH

SEQ ID NO: 116023 - protein, 9 aa, Homo Sapiens
LLRVPNGLL

SEQ ID NO: 116024 - protein, 9 aa, Homo Sapiens
PIDANYLNK

SEQ ID NO: 116025 - protein, 9 aa, Homo Sapiens
DSLYKAPKK

SEQ ID NO: 116026 - protein, 9 aa, Homo Sapiens
RVRFVHETG

SEQ ID NO: 116027 - protein, 9 aa, Homo Sapiens
DKHNTKGEA

SEQ ID NO: 116028 - protein, 9 aa, Homo Sapiens
SSEKISRYQ

SEQ ID NO: 116029 - protein, 9 aa, Homo Sapiens
GPAGHVRVA

SEQ ID NO: 116030 - protein, 9 aa, Homo Sapiens
LKYFRPQSS

SEQ ID NO: 116031 - protein, 9 aa, Homo Sapiens
STAILKYFR

SEQ ID NO: 116032 - protein, 9 aa, Homo Sapiens
LRCWESGDH

SEQ ID NO: 116033 - protein, 9 aa, Homo Sapiens
QDLPDAIKP

SEQ ID NO: 116034 - protein, 9 aa, Homo Sapiens
DTGVKPYIC

SEQ ID NO: 116035 - protein, 9 aa, Homo Sapiens
YDEALSKAI

SEQ ID NO: 116036 - protein, 9 aa, Homo Sapiens
PLLLLLGAS

SEQ ID NO: 116037 - protein, 9 aa, Homo Sapiens
LVGSRAFPA

SEQ ID NO: 116038 - protein, 9 aa, Homo Sapiens
QETVETGKN

SEQ ID NO: 116039 - protein, 9 aa, Homo Sapiens
YNLEIPVVN

SEQ ID NO: 116040 - protein, 9 aa, Homo Sapiens
AGDQILAIN

SEQ ID NO: 116041 - protein, 9 aa, Homo Sapiens
QALLGAQAK

SEQ ID NO: 116042 - protein, 9 aa, Homo Sapiens
QFHCKKYLS

SEQ ID NO: 116043 - protein, 9 aa, Homo Sapiens
YEAFCGFSA

SEQ ID NO: 116044 - protein, 9 aa, Homo Sapiens
ISDLSKINI

SEQ ID NO: 116045 - protein, 9 aa, Homo Sapiens
VLTADNCFQ

SEQ ID NO: 116046 - protein, 9 aa, Homo Sapiens
WLDASCLGR

SEQ ID NO: 116047 - protein, 9 aa, Homo Sapiens
DQIAIELRS

SEQ ID NO: 116048 - protein, 9 aa, Homo Sapiens
LSKSMFDVT

SEQ ID NO: 116049 - protein, 9 aa, Homo Sapiens
PHAKFVMTA

SEQ ID NO: 116050 - protein, 9 aa, Homo Sapiens
TYCPHAKFV

SEQ ID NO: 116051 - protein, 9 aa, Homo Sapiens
NYGDQIAIE

SEQ ID NO: 116052 - protein, 9 aa, Homo Sapiens
VYHVIVPCS

SEQ ID NO: 116053 - protein, 9 aa, Homo Sapiens
IMFLEKEIM

SEQ ID NO: 116054 - protein, 9 aa, Homo Sapiens
EIRSAIAPD

SEQ ID NO: 116055 - protein, 9 aa, Homo Sapiens
ALPSTRACQ

SEQ ID NO: 116056 - protein, 9 aa, Homo Sapiens
HGPVHHGGS

SEQ ID NO: 116057 - protein, 9 aa, Homo Sapiens
DAVLKGLVV

SEQ ID NO: 116058 - protein, 9 aa, Homo Sapiens
KSMFDVTNS

SEQ ID NO: 116059 - protein, 9 aa, Homo Sapiens
NCKEAINVL

SEQ ID NO: 116060 - protein, 9 aa, Homo Sapiens
VTVALWKIQ

SEQ ID NO: 116061 - protein, 9 aa, Homo Sapiens
GLGLGGDTH

SEQ ID NO: 116062 - protein, 9 aa, Homo Sapiens
LNGAPCRES

SEQ ID NO: 116063 - protein, 9 aa, Homo Sapiens
WEGEDTKNL

SEQ ID NO: 116064 - protein, 9 aa, Homo Sapiens
EKFNQPLSV

SEQ ID NO: 116065 - protein, 9 aa, Homo Sapiens
TPDSLYKAP

SEQ ID NO: 116066 - protein, 9 aa, Homo Sapiens
QRCVRQTDC

SEQ ID NO: 116067 - protein, 9 aa, Homo Sapiens
FLRILFHML

SEQ ID NO: 116068 - protein, 9 aa, Homo Sapiens
EEKFNQPLS

SEQ ID NO: 116069 - protein, 9 aa, Homo Sapiens
VVQDVVASC

SEQ ID NO: 116070 - protein, 9 aa, Homo Sapiens
RVDGGFRPS

SEQ ID NO: 116071 - protein, 9 aa, Homo Sapiens
YLSNPCPGL

SEQ ID NO: 116072 - protein, 9 aa, Homo Sapiens
PLVEQTFSP

SEQ ID NO: 116073 - protein, 9 aa, Homo Sapiens
QVETEEIRS

SEQ ID NO: 116074 - protein, 9 aa, Homo Sapiens
NSSKVLFKK

SEQ ID NO: 116075 - protein, 9 aa, Homo Sapiens
AMPHRDSLE

SEQ ID NO: 116076 - protein, 9 aa, Homo Sapiens
SEKISRYQE

SEQ ID NO: 116077 - protein, 9 aa, Homo Sapiens
KIQNRESSH

SEQ ID NO: 116078 - protein, 9 aa, Homo Sapiens
STPQRFEWD

SEQ ID NO: 116079 - protein, 9 aa, Homo Sapiens
QTDCILIVG

SEQ ID NO: 116080 - protein, 9 aa, Homo Sapiens
KASVKNYKG

SEQ ID NO: 116081 - protein, 9 aa, Homo Sapiens
LRPHTVSSP

SEQ ID NO: 116082 - protein, 9 aa, Homo Sapiens
IEAGDQILA

SEQ ID NO: 116083 - protein, 9 aa, Homo Sapiens
FAHPLGPCK

SEQ ID NO: 116084 - protein, 9 aa, Homo Sapiens
VVYDEALSK

SEQ ID NO: 116085 - protein, 9 aa, Homo Sapiens
NVLSHLPSH

SEQ ID NO: 116086 - protein, 9 aa, Homo Sapiens
VDGGFRPSR

SEQ ID NO: 116087 - protein, 9 aa, Homo Sapiens
LETKLKSLQ

SEQ ID NO: 116088 - protein, 9 aa, Homo Sapiens
LSAHYNIWY

SEQ ID NO: 116089 - protein, 9 aa, Homo Sapiens
RFLHKPSIK

SEQ ID NO: 116090 - protein, 9 aa, Homo Sapiens
MDVAKHEII

SEQ ID NO: 116091 - protein, 9 aa, Homo Sapiens
YLTAKILEL

SEQ ID NO: 116092 - protein, 9 aa, Homo Sapiens
PLATVQWLK

SEQ ID NO: 116093 - protein, 9 aa, Homo Sapiens
VLSHLPSHH

SEQ ID NO: 116094 - protein, 9 aa, Homo Sapiens
GHAFPPGLG

SEQ ID NO: 116095 - protein, 9 aa, Homo Sapiens
DFPDSNHVK

SEQ ID NO: 116096 - protein, 9 aa, Homo Sapiens
VINHFTFEI

SEQ ID NO: 116097 - protein, 9 aa, Homo Sapiens
GLDLWGTVL

SEQ ID NO: 116098 - protein, 9 aa, Homo Sapiens
VDPGRHGSK

SEQ ID NO: 116099 - protein, 9 aa, Homo Sapiens
LGASNASCA

SEQ ID NO: 116100 - protein, 9 aa, Homo Sapiens
PGRHGSKAV

SEQ ID NO: 116101 - protein, 9 aa, Homo Sapiens
GRWIGVARR

SEQ ID NO: 116102 - protein, 9 aa, Homo Sapiens
HYEGAVVIV

SEQ ID NO: 116103 - protein, 9 aa, Homo Sapiens
GLGTEGPQA

SEQ ID NO: 116104 - protein, 9 aa, Homo Sapiens
LTTSAEPGS

SEQ ID NO: 116105 - protein, 9 aa, Homo Sapiens
PLALGFLHL

SEQ ID NO: 116106 - protein, 9 aa, Homo Sapiens
EAINVLSHL

SEQ ID NO: 116107 - protein, 9 aa, Homo Sapiens
LNTFCGSTP

SEQ ID NO: 116108 - protein, 9 aa, Homo Sapiens
LCTSSVTVA

SEQ ID NO: 116109 - protein, 9 aa, Homo Sapiens
VVIVDAGAQ

SEQ ID NO: 116110 - protein, 9 aa, Homo Sapiens
PDAIKPHEI

SEQ ID NO: 116111 - protein, 9 aa, Homo Sapiens
ILKIQNRES

SEQ ID NO: 116112 - protein, 9 aa, Homo Sapiens
HRSRLTYHH

SEQ ID NO: 116113 - protein, 9 aa, Homo Sapiens
LMDVAKHEI

SEQ ID NO: 116114 - protein, 9 aa, Homo Sapiens
SHGPVHHGG

SEQ ID NO: 116115 - protein, 9 aa, Homo Sapiens
FPDSNHVKS

SEQ ID NO: 116116 - protein, 9 aa, Homo Sapiens
IVVYHVIVP

SEQ ID NO: 116117 - protein, 9 aa, Homo Sapiens
ELAKHVVSE

SEQ ID NO: 116118 - protein, 9 aa, Homo Sapiens
WTQRCVRQT

SEQ ID NO: 116119 - protein, 9 aa, Homo Sapiens
DLSKINITC

SEQ ID NO: 116120 - protein, 9 aa, Homo Sapiens
CQQLTVSAA

SEQ ID NO: 116121 - protein, 9 aa, Homo Sapiens
MGKHHYTSA

SEQ ID NO: 116122 - protein, 9 aa, Homo Sapiens
GPGYWVKIY

SEQ ID NO: 116123 - protein, 9 aa, Homo Sapiens
CPHAKFVMT

SEQ ID NO: 116124 - protein, 9 aa, Homo Sapiens
KYFRPQSSA

SEQ ID NO: 116125 - protein, 9 aa, Homo Sapiens
WFSLMNPWT

SEQ ID NO: 116126 - protein, 9 aa, Homo Sapiens
NLDKLKERT

SEQ ID NO: 116127 - protein, 9 aa, Homo Sapiens
AVLKGLVVL

SEQ ID NO: 116128 - protein, 9 aa, Homo Sapiens
KHEIICAFA

SEQ ID NO: 116129 - protein, 9 aa, Homo Sapiens
LGTEGPQAT

SEQ ID NO: 116130 - protein, 9 aa, Homo Sapiens
GDQILAING

SEQ ID NO: 116131 - protein, 9 aa, Homo Sapiens
AVVIVDAGA

SEQ ID NO: 116132 - protein, 9 aa, Homo Sapiens
KEEILQSSK

SEQ ID NO: 116133 - protein, 9 aa, Homo Sapiens
LKQKLKNLQ

SEQ ID NO: 116134 - protein, 9 aa, Homo Sapiens
DVTNSSQRF

SEQ ID NO: 116135 - protein, 9 aa, Homo Sapiens
FVMTADDDI

SEQ ID NO: 116136 - protein, 9 aa, Homo Sapiens
STPYAAPEL

SEQ ID NO: 116137 - protein, 9 aa, Homo Sapiens
PSQIMFLEK

SEQ ID NO: 116138 - protein, 9 aa, Homo Sapiens
KIYHLEYTD

SEQ ID NO: 116139 - protein, 9 aa, Homo Sapiens
TPSCEAMPH

SEQ ID NO: 116140 - protein, 9 aa, Homo Sapiens
TYHHKVHTG

SEQ ID NO: 116141 - protein, 9 aa, Homo Sapiens
HRRVRFVHE

SEQ ID NO: 116142 - protein, 9 aa, Homo Sapiens
LPLALGFLH

SEQ ID NO: 116143 - protein, 9 aa, Homo Sapiens
VETGKNLGP

SEQ ID NO: 116144 - protein, 9 aa, Homo Sapiens
SSVTVALWK

SEQ ID NO: 116145 - protein, 9 aa, Homo Sapiens
YMNIYVVVY

SEQ ID NO: 116146 - protein, 9 aa, Homo Sapiens
KQKLKNLQN

SEQ ID NO: 116147 - protein, 9 aa, Homo Sapiens
FTFEILAVL

SEQ ID NO: 116148 - protein, 9 aa, Homo Sapiens
TLVKPKPLL

SEQ ID NO: 116149 - protein, 9 aa, Homo Sapiens
VRVAIGSTG

SEQ ID NO: 116150 - protein, 9 aa, Homo Sapiens
VEEKFNQPL

SEQ ID NO: 116151 - protein, 9 aa, Homo Sapiens
GSTGDFTSG

SEQ ID NO: 116152 - protein, 9 aa, Homo Sapiens
AQNSAKYQA

SEQ ID NO: 116153 - protein, 9 aa, Homo Sapiens
QSSKDKEDG

SEQ ID NO: 116154 - protein, 9 aa, Homo Sapiens
CSLVSGAAW

SEQ ID NO: 116155 - protein, 9 aa, Homo Sapiens
LKHLQVQTL

SEQ ID NO: 116156 - protein, 9 aa, Homo Sapiens
DLKKQHSVT

SEQ ID NO: 116157 - protein, 9 aa, Homo Sapiens
EGAVVIVDA

SEQ ID NO: 116158 - protein, 9 aa, Homo Sapiens
QETLVKPKP

SEQ ID NO: 116159 - protein, 9 aa, Homo Sapiens
RPHTVSSPI

SEQ ID NO: 116160 - protein, 9 aa, Homo Sapiens
HAFPPGLGL

SEQ ID NO: 116161 - protein, 9 aa, Homo Sapiens
RNNFQSTRQ

SEQ ID NO: 116162 - protein, 9 aa, Homo Sapiens
CGFSATDKC

SEQ ID NO: 116163 - protein, 9 aa, Homo Sapiens
RCVRQTDCI

SEQ ID NO: 116164 - protein, 9 aa, Homo Sapiens
NLKEKLLNR

SEQ ID NO: 116165 - protein, 9 aa, Homo Sapiens
QKLKNLQNS

SEQ ID NO: 116166 - protein, 9 aa, Homo Sapiens
AGCGSRVDG

SEQ ID NO: 116167 - protein, 9 aa, Homo Sapiens
LKSLQSFVE

SEQ ID NO: 116168 - protein, 9 aa, Homo Sapiens
PGYWVKIYH

SEQ ID NO: 116169 - protein, 9 aa, Homo Sapiens
KQHSVTQAT

SEQ ID NO: 116170 - protein, 9 aa, Homo Sapiens
VYDEALSKA

SEQ ID NO: 116171 - protein, 9 aa, Homo Sapiens
QAKESLDLR

SEQ ID NO: 116172 - protein, 9 aa, Homo Sapiens
TVQPGCYLP

SEQ ID NO: 116173 - protein, 9 aa, Homo Sapiens
VLKGLVVLG

SEQ ID NO: 116174 - protein, 9 aa, Homo Sapiens
VKPKPLLLK

SEQ ID NO: 116175 - protein, 9 aa, Homo Sapiens
SPNHKPMVT

SEQ ID NO: 116176 - protein, 9 aa, Homo Sapiens
GELAKHVVS

SEQ ID NO: 116177 - protein, 9 aa, Homo Sapiens
TRNNFQSTR

SEQ ID NO: 116178 - protein, 9 aa, Homo Sapiens
LVSGAAWLD

SEQ ID NO: 116179 - protein, 9 aa, Homo Sapiens
NRILKIQNR

SEQ ID NO: 116180 - protein, 9 aa, Homo Sapiens
ALSFLGISL

SEQ ID NO: 116181 - protein, 9 aa, Homo Sapiens
IGDWRGIDI

SEQ ID NO: 116182 - protein, 9 aa, Homo Sapiens
CLMDVAKHE

SEQ ID NO: 116183 - protein, 9 aa, Homo Sapiens
LHCSLDVVC

SEQ ID NO: 116184 - protein, 9 aa, Homo Sapiens
LALGFLHLL

SEQ ID NO: 116185 - protein, 9 aa, Homo Sapiens
MQALLGAQA

SEQ ID NO: 116186 - protein, 9 aa, Homo Sapiens
RACQSFPGP

SEQ ID NO: 116187 - protein, 9 aa, Homo Sapiens
GSRAFPATS

SEQ ID NO: 116188 - protein, 9 aa, Homo Sapiens
DKAQDSGGR

SEQ ID NO: 116189 - protein, 9 aa, Homo Sapiens
TAKILELAG

SEQ ID NO: 116190 - protein, 9 aa, Homo Sapiens
IVLCTSSVT

SEQ ID NO: 116191 - protein, 9 aa, Homo Sapiens
LEHPLSELN

SEQ ID NO: 116192 - protein, 9 aa, Homo Sapiens
GIIEAGDQI

SEQ ID NO: 116193 - protein, 9 aa, Homo Sapiens
LGPCKMTNL

SEQ ID NO: 116194 - protein, 9 aa, Homo Sapiens
GTPDSLYKA

SEQ ID NO: 116195 - protein, 9 aa, Homo Sapiens
DFSNELYKT

SEQ ID NO: 116196 - protein, 9 aa, Homo Sapiens
KEKLLNRSS

SEQ ID NO: 116197 - protein, 9 aa, Homo Sapiens
KHHYTSAGI

SEQ ID NO: 116198 - protein, 9 aa, Homo Sapiens
LRILFHMLI

SEQ ID NO: 116199 - protein, 9 aa, Homo Sapiens
TRACQSFPG

SEQ ID NO: 116200 - protein, 9 aa, Homo Sapiens
VEQTFSPNH

SEQ ID NO: 116201 - protein, 9 aa, Homo Sapiens
SSKVLFKKS

SEQ ID NO: 116202 - protein, 9 aa, Homo Sapiens
AFCGFSATD

SEQ ID NO: 116203 - protein, 9 aa, Homo Sapiens
IRSAIAPDP

SEQ ID NO: 116204 - protein, 9 aa, Homo Sapiens
QFESEVQSL

SEQ ID NO: 116205 - protein, 9 aa, Homo Sapiens
CVRQTDCIL

SEQ ID NO: 116206 - protein, 9 aa, Homo Sapiens
PSCEAMPHR

SEQ ID NO: 116207 - protein, 9 aa, Homo Sapiens
LGAQAKESL

SEQ ID NO: 116208 - protein, 9 aa, Homo Sapiens
AVEEKFNQP

SEQ ID NO: 116209 - protein, 9 aa, Homo Sapiens
CGSRVDGGF

SEQ ID NO: 116210 - protein, 9 aa, Homo Sapiens
EQLLELEKQ

SEQ ID NO: 116211 - protein, 9 aa, Homo Sapiens
TQRCVRQTD

SEQ ID NO: 116212 - protein, 9 aa, Homo Sapiens
GSKAVTVPM

SEQ ID NO: 116213 - protein, 9 aa, Homo Sapiens
QHSVTQATQ

SEQ ID NO: 116214 - protein, 9 aa, Homo Sapiens
LHLLPLALG

SEQ ID NO: 116215 - protein, 9 aa, Homo Sapiens
GEEEEEVLA

SEQ ID NO: 116216 - protein, 9 aa, Homo Sapiens
ISLCLALMF

SEQ ID NO: 116217 - protein, 9 aa, Homo Sapiens
DMSEYNLEI

SEQ ID NO: 116218 - protein, 9 aa, Homo Sapiens
QLVGSRAFP

SEQ ID NO: 116219 - protein, 9 aa, Homo Sapiens
RTQEELRLS

SEQ ID NO: 116220 - protein, 9 aa, Homo Sapiens
SRLTYHHKV

SEQ ID NO: 116221 - protein, 9 aa, Homo Sapiens
YLAVWDKAQ

SEQ ID NO: 116222 - protein, 9 aa, Homo Sapiens
HPLGPCKMT

SEQ ID NO: 116223 - protein, 9 aa, Homo Sapiens
VLFKKSEKY

SEQ ID NO: 116224 - protein, 9 aa, Homo Sapiens
DVVCTKYGL

SEQ ID NO: 116225 - protein, 9 aa, Homo Sapiens
TTNTVVYDE

SEQ ID NO: 116226 - protein, 9 aa, Homo Sapiens
EEQSVEDSY

SEQ ID NO: 116227 - protein, 9 aa, Homo Sapiens
WALSFLGIS

SEQ ID NO: 116228 - protein, 9 aa, Homo Sapiens
SGGLRCHLE

SEQ ID NO: 116229 - protein, 9 aa, Homo Sapiens
QLTPSQIMF

SEQ ID NO: 116230 - protein, 9 aa, Homo Sapiens
LYPIAIFIN

SEQ ID NO: 116231 - protein, 9 aa, Homo Sapiens
ALLGAQAKE

SEQ ID NO: 116232 - protein, 9 aa, Homo Sapiens
VPDNYGDQI

SEQ ID NO: 116233 - protein, 9 aa, Homo Sapiens
VVSEGTKAV

SEQ ID NO: 116234 - protein, 9 aa, Homo Sapiens
PLQRGKCQQ

SEQ ID NO: 116235 - protein, 9 aa, Homo Sapiens
PVHHGGSWI

SEQ ID NO: 116236 - protein, 9 aa, Homo Sapiens
GTLVVQDVV

SEQ ID NO: 116237 - protein, 9 aa, Homo Sapiens
VDQFESEVQ

SEQ ID NO: 116238 - protein, 9 aa, Homo Sapiens
PLSELNGAP

SEQ ID NO: 116239 - protein, 9 aa, Homo Sapiens
TEEIRSAIA

SEQ ID NO: 116240 - protein, 9 aa, Homo Sapiens
SRAFPATSR

SEQ ID NO: 116241 - protein, 9 aa, Homo Sapiens
HSIGDWRGI

SEQ ID NO: 116242 - protein, 9 aa, Homo Sapiens
AKHVVSEGT

SEQ ID NO: 116243 - protein, 9 aa, Homo Sapiens
FCGSTPYAA

SEQ ID NO: 116244 - protein, 9 aa, Homo Sapiens
QHKLHFSVY

SEQ ID NO: 116245 - protein, 9 aa, Homo Sapiens
DSSEEQSVE

SEQ ID NO: 116246 - protein, 9 aa, Homo Sapiens
NLEIPVVNL

SEQ ID NO: 116247 - protein, 9 aa, Homo Sapiens
LPSTRACQS

SEQ ID NO: 116248 - protein, 9 aa, Homo Sapiens
SKVLFKKSE

SEQ ID NO: 116249 - protein, 9 aa, Homo Sapiens
AKYQALCSS

SEQ ID NO: 116250 - protein, 9 aa, Homo Sapiens
RLHCSLDVV

SEQ ID NO: 116251 - protein, 9 aa, Homo Sapiens
ESSHLSAHY

SEQ ID NO: 116252 - protein, 9 aa, Homo Sapiens
FHMLIRLLE

SEQ ID NO: 116253 - protein, 9 aa, Homo Sapiens
PPLQRGKCQ

SEQ ID NO: 116254 - protein, 9 aa, Homo Sapiens
LLDFPDSNH

SEQ ID NO: 116255 - protein, 9 aa, Homo Sapiens
QDSGGRMTT

SEQ ID NO: 116256 - protein, 9 aa, Homo Sapiens
HLLDFPDSN

SEQ ID NO: 116257 - protein, 9 aa, Homo Sapiens
LTADNCFQE

SEQ ID NO: 116258 - protein, 9 aa, Homo Sapiens
FEWDQEEGA

SEQ ID NO: 116259 - protein, 9 aa, Homo Sapiens
YSTAILKYF

SEQ ID NO: 116260 - protein, 9 aa, Homo Sapiens
FEILAVLKL

SEQ ID NO: 116261 - protein, 9 aa, Homo Sapiens
VLEYLTAKI

SEQ ID NO: 116262 - protein, 9 aa, Homo Sapiens
LRDLYNDKD

SEQ ID NO: 116263 - protein, 9 aa, Homo Sapiens
VRQTDCILI

SEQ ID NO: 116264 - protein, 9 aa, Homo Sapiens
KPKPLLLKL

SEQ ID NO: 116265 - protein, 9 aa, Homo Sapiens
EGHSDLMSF

SEQ ID NO: 116266 - protein, 9 aa, Homo Sapiens
SVKNYKGMI

SEQ ID NO: 116267 - protein, 9 aa, Homo Sapiens
LGLGGDTHF

SEQ ID NO: 116268 - protein, 9 aa, Homo Sapiens
GSRVDGGFR

SEQ ID NO: 116269 - protein, 9 aa, Homo Sapiens
IDANYLNKG

SEQ ID NO: 116270 - protein, 9 aa, Homo Sapiens
TVLVWLLFS

SEQ ID NO: 116271 - protein, 9 aa, Homo Sapiens
YLNKGIGMG

SEQ ID NO: 116272 - protein, 9 aa, Homo Sapiens
WIELRWGRW

SEQ ID NO: 116273 - protein, 9 aa, Homo Sapiens
PLPWAAEPG

SEQ ID NO: 116274 - protein, 9 aa, Homo Sapiens
KAQDSGGRM

SEQ ID NO: 116275 - protein, 9 aa, Homo Sapiens
PSLCSKSGQ

SEQ ID NO: 116276 - protein, 9 aa, Homo Sapiens
ELRWGRWIG

SEQ ID NO: 116277 - protein, 9 aa, Homo Sapiens
VWLLFSDFS

SEQ ID NO: 116278 - protein, 9 aa, Homo Sapiens
GDFTSGGLR

SEQ ID NO: 116279 - protein, 9 aa, Homo Sapiens
ARCPLCQKP

SEQ ID NO: 116280 - protein, 9 aa, Homo Sapiens
SLDVVCTKY

SEQ ID NO: 116281 - protein, 9 aa, Homo Sapiens
NKQDLPDAI

SEQ ID NO: 116282 - protein, 9 aa, Homo Sapiens
KNSSKVLFK

SEQ ID NO: 116283 - protein, 9 aa, Homo Sapiens
QILAINGKP

SEQ ID NO: 116284 - protein, 9 aa, Homo Sapiens
YHLEYTDGG

SEQ ID NO: 116285 - protein, 9 aa, Homo Sapiens
VLGGIYLLF

SEQ ID NO: 116286 - protein, 9 aa, Homo Sapiens
SLYKAPKKK

SEQ ID NO: 116287 - protein, 9 aa, Homo Sapiens
VAIGSTGDF

SEQ ID NO: 116288 - protein, 9 aa, Homo Sapiens
GNIVVYHVI

SEQ ID NO: 116289 - protein, 9 aa, Homo Sapiens
NHNLKEKLL

SEQ ID NO: 116290 - protein, 9 aa, Homo Sapiens
YKTNRILKI

SEQ ID NO: 116291 - protein, 9 aa, Homo Sapiens
ESQLVGSRA

SEQ ID NO: 116292 - protein, 9 aa, Homo Sapiens
CLKCGNIVV

SEQ ID NO: 116293 - protein, 9 aa, Homo Sapiens
FQSTRQEVE

SEQ ID NO: 116294 - protein, 9 aa, Homo Sapiens
FSNELYKTN

SEQ ID NO: 116295 - protein, 9 aa, Homo Sapiens
IWYMNIYVV

SEQ ID NO: 116296 - protein, 9 aa, Homo Sapiens
PGSPLGASN

SEQ ID NO: 116297 - protein, 9 aa, Homo Sapiens
LKNLQNSQL

SEQ ID NO: 116298 - protein, 9 aa, Homo Sapiens
QLETDSSEK

SEQ ID NO: 116299 - protein, 9 aa, Homo Sapiens
TFSPNHKPM

SEQ ID NO: 116300 - protein, 9 aa, Homo Sapiens
SEYNLEIPV

SEQ ID NO: 116301 - protein, 9 aa, Homo Sapiens
QTLTQEDIK

SEQ ID NO: 116302 - protein, 9 aa, Homo Sapiens
EGEDTKNLG

SEQ ID NO: 116303 - protein, 9 aa, Homo Sapiens
TLVVQDVVA

SEQ ID NO: 116304 - protein, 9 aa, Homo Sapiens
FPATSRFRL

SEQ ID NO: 116305 - protein, 9 aa, Homo Sapiens
VGSRAFPAT

SEQ ID NO: 116306 - protein, 9 aa, Homo Sapiens
KLKSLQSFV

SEQ ID NO: 116307 - protein, 9 aa, Homo Sapiens
SGAAWLDAS

SEQ ID NO: 116308 - protein, 9 aa, Homo Sapiens
PATSRFRLH

SEQ ID NO: 116309 - protein, 9 aa, Homo Sapiens
VARRAGVHS

SEQ ID NO: 116310 - protein, 9 aa, Homo Sapiens
RDKHNTKGE

SEQ ID NO: 116311 - protein, 9 aa, Homo Sapiens
EGTPDSLYK

SEQ ID NO: 116312 - protein, 9 aa, Homo Sapiens
LQVQTLTQE

SEQ ID NO: 116313 - protein, 9 aa, Homo Sapiens
VKIYHLEYT

SEQ ID NO: 116314 - protein, 9 aa, Homo Sapiens
NVINHFTFE

SEQ ID NO: 116315 - protein, 9 aa, Homo Sapiens
AQDSGGRMT

SEQ ID NO: 116316 - protein, 9 aa, Homo Sapiens
YHHKVHTGK

SEQ ID NO: 116317 - protein, 9 aa, Homo Sapiens
QPRGFAHPL

SEQ ID NO: 116318 - protein, 9 aa, Homo Sapiens
LDVVCTKYG

SEQ ID NO: 116319 - protein, 9 aa, Homo Sapiens
AQHKLHFSV

SEQ ID NO: 116320 - protein, 9 aa, Homo Sapiens
HPLSELNGA

SEQ ID NO: 116321 - protein, 9 aa, Homo Sapiens
RFEWDQEEG

SEQ ID NO: 116322 - protein, 9 aa, Homo Sapiens
ARRAGVHSI

SEQ ID NO: 116323 - protein, 9 aa, Homo Sapiens
LTYHHKVHT

SEQ ID NO: 116324 - protein, 9 aa, Homo Sapiens
WYMNIYVVV

SEQ ID NO: 116325 - protein, 9 aa, Homo Sapiens
SIGDWRGID

SEQ ID NO: 116326 - protein, 9 aa, Homo Sapiens
SQIMFLEKE

SEQ ID NO: 116327 - protein, 9 aa, Homo Sapiens
DSSEKISRY

SEQ ID NO: 116328 - protein, 9 aa, Homo Sapiens
AQETVETGK

SEQ ID NO: 116329 - protein, 9 aa, Homo Sapiens
TAILKYFRP

SEQ ID NO: 116330 - protein, 9 aa, Homo Sapiens
SGDHPWVQH

SEQ ID NO: 116331 - protein, 9 aa, Homo Sapiens
MSAQGLRPH

SEQ ID NO: 116332 - protein, 9 aa, Homo Sapiens
NHFTFEILA

SEQ ID NO: 116333 - protein, 9 aa, Homo Sapiens
TVETGKNLG

SEQ ID NO: 116334 - protein, 9 aa, Homo Sapiens
HCSLDVVCT

SEQ ID NO: 116335 - protein, 9 aa, Homo Sapiens
VLVWLLFSD

SEQ ID NO: 116336 - protein, 9 aa, Homo Sapiens
GKNLGPLEE

SEQ ID NO: 116337 - protein, 9 aa, Homo Sapiens
AVWDKAQDS

SEQ ID NO: 116338 - protein, 9 aa, Homo Sapiens
CSGMGKHHY

SEQ ID NO: 116339 - protein, 9 aa, Homo Sapiens
CGSTPYAAP

SEQ ID NO: 116340 - protein, 9 aa, Homo Sapiens
RAGVHSIGD

SEQ ID NO: 116341 - protein, 9 aa, Homo Sapiens
FKKSEKYMK

SEQ ID NO: 116342 - protein, 9 aa, Homo Sapiens
LLPLALGFL

SEQ ID NO: 116343 - protein, 9 aa, Homo Sapiens
CTEPLPWAA

SEQ ID NO: 116344 - protein, 9 aa, Homo Sapiens
DNVINHFTF

SEQ ID NO: 116345 - protein, 9 aa, Homo Sapiens
RILFHMLIR

SEQ ID NO: 116346 - protein, 9 aa, Homo Sapiens
VRFVHETGL

SEQ ID NO: 116347 - protein, 9 aa, Homo Sapiens
SKAVTVPMI

SEQ ID NO: 116348 - protein, 9 aa, Homo Sapiens
TEGPQATGG

SEQ ID NO: 116349 - protein, 9 aa, Homo Sapiens
KIVNHNLKE

SEQ ID NO: 116350 - protein, 9 aa, Homo Sapiens
ERTQRFGLN

SEQ ID NO: 116351 - protein, 9 aa, Homo Sapiens
HSDLMSFQP

SEQ ID NO: 116352 - protein, 9 aa, Homo Sapiens
RQHEIIDTG

SEQ ID NO: 116353 - protein, 9 aa, Homo Sapiens
FSLMNPWTK

SEQ ID NO: 116354 - protein, 9 aa, Homo Sapiens
YGDQIAIEL

SEQ ID NO: 116355 - protein, 9 aa, Homo Sapiens
LVVLGGIYL

SEQ ID NO: 116356 - protein, 9 aa, Homo Sapiens
MSFQPTDSD

SEQ ID NO: 116357 - protein, 9 aa, Homo Sapiens
WGTVLTADN

SEQ ID NO: 116358 - protein, 9 aa, Homo Sapiens
GVARRAGVH

SEQ ID NO: 116359 - protein, 9 aa, Homo Sapiens
PDSLYKAPK

SEQ ID NO: 116360 - protein, 9 aa, Homo Sapiens
SRFRLHCSL

SEQ ID NO: 116361 - protein, 9 aa, Homo Sapiens
KYDLKKQHS

SEQ ID NO: 116362 - protein, 9 aa, Homo Sapiens
DLMSFQPTD

SEQ ID NO: 116363 - protein, 9 aa, Homo Sapiens
SLQSFVELM

SEQ ID NO: 116364 - protein, 9 aa, Homo Sapiens
RHGSKAVTV

SEQ ID NO: 116365 - protein, 9 aa, Homo Sapiens
ALGFLHLLQ

SEQ ID NO: 116366 - protein, 9 aa, Homo Sapiens
DQFESEVQS

SEQ ID NO: 116367 - protein, 9 aa, Homo Sapiens
QRTQEELRL

SEQ ID NO: 116368 - protein, 9 aa, Homo Sapiens
LSELNGAPC

SEQ ID NO: 116369 - protein, 9 aa, Homo Sapiens
EDGVPSLCS

SEQ ID NO: 116370 - protein, 9 aa, Homo Sapiens
KGMIDNYKS

SEQ ID NO: 116371 - protein, 9 aa, Homo Sapiens
LLELEKQFH

SEQ ID NO: 116372 - protein, 9 aa, Homo Sapiens
MPHRDSLEP

SEQ ID NO: 116373 - protein, 9 aa, Homo Sapiens
LVKPKPLLL

SEQ ID NO: 116374 - protein, 9 aa, Homo Sapiens
RCWESGDHP

SEQ ID NO: 116375 - protein, 9 aa, Homo Sapiens
KISRYQEMI

SEQ ID NO: 116376 - protein, 9 aa, Homo Sapiens
IGVARRAGV

SEQ ID NO: 116377 - protein, 9 aa, Homo Sapiens
LKIQNRESS

SEQ ID NO: 116378 - protein, 9 aa, Homo Sapiens
SGNLRDLYN

SEQ ID NO: 116379 - protein, 9 aa, Homo Sapiens
PGLGLGGDT

SEQ ID NO: 116380 - protein, 9 aa, Homo Sapiens
VVLGGIYLL

SEQ ID NO: 116381 - protein, 9 aa, Homo Sapiens
NEDGVPSLC

SEQ ID NO: 116382 - protein, 9 aa, Homo Sapiens
LLTTNTVVY

SEQ ID NO: 116383 - protein, 9 aa, Homo Sapiens
GYWVKIYHL

SEQ ID NO: 116384 - protein, 9 aa, Homo Sapiens
GPQATGGLE

SEQ ID NO: 116385 - protein, 9 aa, Homo Sapiens
SLVSGAAWL

SEQ ID NO: 116386 - protein, 9 aa, Homo Sapiens
NFQSTRQEV

SEQ ID NO: 116387 - protein, 9 aa, Homo Sapiens
QSLSVQTRK

SEQ ID NO: 116388 - protein, 9 aa, Homo Sapiens
AKILELAGN

SEQ ID NO: 116389 - protein, 9 aa, Homo Sapiens
YRDKHNTKG

SEQ ID NO: 116390 - protein, 9 aa, Homo Sapiens
TFEILAVLK

SEQ ID NO: 116391 - protein, 9 aa, Homo Sapiens
LGHAFPPGL

SEQ ID NO: 116392 - protein, 9 aa, Homo Sapiens
DLTTSAEPG

SEQ ID NO: 116393 - protein, 9 aa, Homo Sapiens
NTVVYDEAL

SEQ ID NO: 116394 - protein, 9 aa, Homo Sapiens
WDKAQDSGG

SEQ ID NO: 116395 - protein, 9 aa, Homo Sapiens
GDWRGIDIG

SEQ ID NO: 116396 - protein, 9 aa, Homo Sapiens
TSRFRLHCS

SEQ ID NO: 116397 - protein, 9 aa, Homo Sapiens
GLDMSEYNL

SEQ ID NO: 116398 - protein, 9 aa, Homo Sapiens
SLMNPWTKE

SEQ ID NO: 116399 - protein, 9 aa, Homo Sapiens
EQSVEDSYE

SEQ ID NO: 116400 - protein, 9 aa, Homo Sapiens
EAMPHRDSL

SEQ ID NO: 116401 - protein, 9 aa, Homo Sapiens
QRGKCQQLT

SEQ ID NO: 116402 - protein, 9 aa, Homo Sapiens
IYHLEYTDG

SEQ ID NO: 116403 - protein, 9 aa, Homo Sapiens
NIWYMNIYV

SEQ ID NO: 116404 - protein, 9 aa, Homo Sapiens
ILKYFRPQS

SEQ ID NO: 116405 - protein, 9 aa, Homo Sapiens
IKIVNHNLK

SEQ ID NO: 116406 - protein, 9 aa, Homo Sapiens
QIMFLEKEI

SEQ ID NO: 116407 - protein, 9 aa, Homo Sapiens
HSVTQATQT

SEQ ID NO: 116408 - protein, 9 aa, Homo Sapiens
GAPCRESQL

SEQ ID NO: 116409 - protein, 9 aa, Homo Sapiens
LAVWDKAQD

SEQ ID NO: 116410 - protein, 9 aa, Homo Sapiens
ASVKNYKGM

SEQ ID NO: 116411 - protein, 9 aa, Homo Sapiens
IIDTGVKPY

SEQ ID NO: 116412 - protein, 9 aa, Homo Sapiens
YDLKKQHSV

SEQ ID NO: 116413 - protein, 9 aa, Homo Sapiens
IAIFINPRS

SEQ ID NO: 116414 - protein, 9 aa, Homo Sapiens
EAGDQILAI

SEQ ID NO: 116415 - protein, 9 aa, Homo Sapiens
RSRWFSLMN

SEQ ID NO: 116416 - protein, 9 aa, Homo Sapiens
KQDLPDAIK

SEQ ID NO: 116417 - protein, 9 aa, Homo Sapiens
CTVLVWLLF

SEQ ID NO: 116418 - protein, 9 aa, Homo Sapiens
LVEQTFSPN

SEQ ID NO: 116419 - protein, 9 aa, Homo Sapiens
AILKYFRPQ

SEQ ID NO: 116420 - protein, 9 aa, Homo Sapiens
VEDSYEASP

SEQ ID NO: 116421 - protein, 9 aa, Homo Sapiens
DSNHVKSCF

SEQ ID NO: 116422 - protein, 9 aa, Homo Sapiens
ETGKNLGPL

SEQ ID NO: 116423 - protein, 9 aa, Homo Sapiens
KHLQVQTLT

SEQ ID NO: 116424 - protein, 9 aa, Homo Sapiens
NTRNNFQST

SEQ ID NO: 116425 - protein, 9 aa, Homo Sapiens
HLEHPLSEL

SEQ ID NO: 116426 - protein, 9 aa, Homo Sapiens
ETDSSEKIS

SEQ ID NO: 116427 - protein, 9 aa, Homo Sapiens
MFLEKEIMD

SEQ ID NO: 116428 - protein, 9 aa, Homo Sapiens
PRGFAHPLG

SEQ ID NO: 116429 - protein, 9 aa, Homo Sapiens
KNLGPLEEI

SEQ ID NO: 116430 - protein, 9 aa, Homo Sapiens
AIFINPRSL

SEQ ID NO: 116431 - protein, 9 aa, Homo Sapiens
MFDVTNSSQ

SEQ ID NO: 116432 - protein, 9 aa, Homo Sapiens
VPSLCSKSG

SEQ ID NO: 116433 - protein, 9 aa, Homo Sapiens
SRVDGGFRP

SEQ ID NO: 116434 - protein, 9 aa, Homo Sapiens
SFPGSPLGA

SEQ ID NO: 116435 - protein, 9 aa, Homo Sapiens
QEELRLSSE

SEQ ID NO: 116436 - protein, 9 aa, Homo Sapiens
AIKPHEIQE

SEQ ID NO: 116437 - protein, 9 aa, Homo Sapiens
TNTVVYDEA

SEQ ID NO: 116438 - protein, 9 aa, Homo Sapiens
LATVQWLKN

SEQ ID NO: 116439 - protein, 9 aa, Homo Sapiens
SEQETLVKP

SEQ ID NO: 116440 - protein, 9 aa, Homo Sapiens
VTVQPGCYL

SEQ ID NO: 116441 - protein, 9 aa, Homo Sapiens
HKLHFSVYD

SEQ ID NO: 116442 - protein, 9 aa, Homo Sapiens
YKAPKKKSI

SEQ ID NO: 116443 - protein, 9 aa, Homo Sapiens
FVHETGLAM

SEQ ID NO: 116444 - protein, 9 aa, Homo Sapiens
PPGLGLGGD

SEQ ID NO: 116445 - protein, 9 aa, Homo Sapiens
NYLNKGIGM

SEQ ID NO: 116446 - protein, 9 aa, Homo Sapiens
ILQSSKDKE

SEQ ID NO: 116447 - protein, 9 aa, Homo Sapiens
LLGAQAKES

SEQ ID NO: 116448 - protein, 9 aa, Homo Sapiens
VHHGGSWIE

SEQ ID NO: 116449 - protein, 9 aa, Homo Sapiens
GTEGPQATG

SEQ ID NO: 116450 - protein, 9 aa, Homo Sapiens
IELRWGRWI

SEQ ID NO: 116451 - protein, 9 aa, Homo Sapiens
LKEKLLNRS

SEQ ID NO: 116452 - protein, 9 aa, Homo Sapiens
PPLLPPLLL

SEQ ID NO: 116453 - protein, 9 aa, Homo Sapiens
SQLKQKLKN

SEQ ID NO: 116454 - protein, 9 aa, Homo Sapiens
DWRGIDIGP

SEQ ID NO: 116455 - protein, 9 aa, Homo Sapiens
SPLGASNAS

SEQ ID NO: 116456 - protein, 9 aa, Homo Sapiens
EVQSLSVQT

SEQ ID NO: 116457 - protein, 9 aa, Homo Sapiens
LYNDKDGLR

SEQ ID NO: 116458 - protein, 9 aa, Homo Sapiens
GMGKHHYTS

SEQ ID NO: 116459 - protein, 9 aa, Homo Sapiens
PHTVSSPIP

SEQ ID NO: 116460 - protein, 9 aa, Homo Sapiens
GVHSIGDWR

SEQ ID NO: 116461 - protein, 9 aa, Homo Sapiens
YGLLDLSLS

SEQ ID NO: 116462 - protein, 9 aa, Homo Sapiens
HVRVAIGST

SEQ ID NO: 116463 - protein, 9 aa, Homo Sapiens
EEILQSSKD

SEQ ID NO: 116464 - protein, 9 aa, Homo Sapiens
ELNGAPCRE

SEQ ID NO: 116465 - protein, 9 aa, Homo Sapiens
KHRRVRFVH

SEQ ID NO: 116466 - protein, 9 aa, Homo Sapiens
AVLEYLTAK

SEQ ID NO: 116467 - protein, 9 aa, Homo Sapiens
LLVHQKSCK

SEQ ID NO: 116468 - protein, 9 aa, Homo Sapiens
RQVETEEIR

SEQ ID NO: 116469 - protein, 9 aa, Homo Sapiens
LGISLCLAL

SEQ ID NO: 116470 - protein, 9 aa, Homo Sapiens
LDMSEYNLE

SEQ ID NO: 116471 - protein, 9 aa, Homo Sapiens
KHDKRRDLT

SEQ ID NO: 116472 - protein, 9 aa, Homo Sapiens
RFVHETGLA

SEQ ID NO: 116473 - protein, 9 aa, Homo Sapiens
LMSFQPTDS

SEQ ID NO: 116474 - protein, 9 aa, Homo Sapiens
GKYDLKKQH

SEQ ID NO: 116475 - protein, 9 aa, Homo Sapiens
AFPATSRFR

SEQ ID NO: 116476 - protein, 9 aa, Homo Sapiens
HTVSSPIPY

SEQ ID NO: 116477 - protein, 9 aa, Homo Sapiens
LEKQFHCKK

SEQ ID NO: 116478 - protein, 9 aa, Homo Sapiens
ITCTVLVWL

SEQ ID NO: 116479 - protein, 9 aa, Homo Sapiens
KFNQPLSVS

SEQ ID NO: 116480 - protein, 9 aa, Homo Sapiens
TKHGTLVVQ

SEQ ID NO: 116481 - protein, 9 aa, Homo Sapiens
LDLWGTVLT

SEQ ID NO: 116482 - protein, 9 aa, Homo Sapiens
IGPAGHVRV

SEQ ID NO: 116483 - protein, 9 aa, Homo Sapiens
HGGSWIELR

SEQ ID NO: 116484 - protein, 9 aa, Homo Sapiens
NIAVEEKFN

SEQ ID NO: 116485 - protein, 9 aa, Homo Sapiens
TKGEAIFNF

SEQ ID NO: 116486 - protein, 9 aa, Homo Sapiens
IDIGPAGHV

SEQ ID NO: 116487 - protein, 9 aa, Homo Sapiens
ISKEEILQS

SEQ ID NO: 116488 - protein, 9 aa, Homo Sapiens
IVDAGAQYG

SEQ ID NO: 116489 - protein, 9 aa, Homo Sapiens
LQSFVELMK

SEQ ID NO: 116490 - protein, 9 aa, Homo Sapiens
QNRESSHLS

SEQ ID NO: 116491 - protein, 9 aa, Homo Sapiens
FHYRDKHNT

SEQ ID NO: 116492 - protein, 9 aa, Homo Sapiens
GCRLLRVPN

SEQ ID NO: 116493 - protein, 9 aa, Homo Sapiens
YCPHAKFVM

SEQ ID NO: 116494 - protein, 9 aa, Homo Sapiens
LHKPSIKKM

SEQ ID NO: 116495 - protein, 9 aa, Homo Sapiens
SDLSKINIT

SEQ ID NO: 116496 - protein, 9 aa, Homo Sapiens
SKINITCTV

SEQ ID NO: 116497 - protein, 9 aa, Homo Sapiens
VHSIGDWRG

SEQ ID NO: 116498 - protein, 9 aa, Homo Sapiens
LPDAIKPHE

SEQ ID NO: 116499 - protein, 9 aa, Homo Sapiens
LTPSQIMFL

SEQ ID NO: 116500 - protein, 9 aa, Homo Sapiens
GIDIGPAGH

SEQ ID NO: 116501 - protein, 9 aa, Homo Sapiens
KTNRILKIQ

SEQ ID NO: 116502 - protein, 9 aa, Homo Sapiens
PAGHVRVAI

SEQ ID NO: 116503 - protein, 9 aa, Homo Sapiens
NRESSHLSA

SEQ ID NO: 116504 - protein, 9 aa, Homo Sapiens
TVQWLKNGQ

SEQ ID NO: 116505 - protein, 9 aa, Homo Sapiens
RRVRFVHET

SEQ ID NO: 116506 - protein, 9 aa, Homo Sapiens
VHQKSCKTH

SEQ ID NO: 116507 - protein, 9 aa, Homo Sapiens
KKSEKYMKL

SEQ ID NO: 116508 - protein, 9 aa, Homo Sapiens
QATGGLEPD

SEQ ID NO: 116509 - protein, 9 aa, Homo Sapiens
PQRFEWDQE

SEQ ID NO: 116510 - protein, 9 aa, Homo Sapiens
LWGTVLTAD

SEQ ID NO: 116511 - protein, 9 aa, Homo Sapiens
PIAIFINPR

SEQ ID NO: 116512 - protein, 9 aa, Homo Sapiens
TLRSRWFSL

SEQ ID NO: 116513 - protein, 9 aa, Homo Sapiens
RRAGVHSIG

SEQ ID NO: 116514 - protein, 9 aa, Homo Sapiens
CEAMPHRDS

SEQ ID NO: 116515 - protein, 9 aa, Homo Sapiens
HGTLVVQDV

SEQ ID NO: 116516 - protein, 9 aa, Homo Sapiens
PSIKKMYQF

SEQ ID NO: 116517 - protein, 9 aa, Homo Sapiens
ELAQHKLHF

SEQ ID NO: 116518 - protein, 9 aa, Homo Sapiens
VVCTKYGLL

SEQ ID NO: 116519 - protein, 9 aa, Homo Sapiens
QSVEDSYEA

SEQ ID NO: 116520 - protein, 9 aa, Homo Sapiens
MKHLLDFPD

SEQ ID NO: 116521 - protein, 9 aa, Homo Sapiens
LFSDFSNEL

SEQ ID NO: 116522 - protein, 9 aa, Homo Sapiens
LQNTRNNFQ

SEQ ID NO: 116523 - protein, 9 aa, Homo Sapiens
PPPLQRGKC

SEQ ID NO: 116524 - protein, 9 aa, Homo Sapiens
LEYLTAKIL

SEQ ID NO: 116525 - protein, 9 aa, Homo Sapiens
LDKLKERTQ

SEQ ID NO: 116526 - protein, 9 aa, Homo Sapiens
IVNHNLKEK

SEQ ID NO: 116527 - protein, 9 aa, Homo Sapiens
IFINPRSLE

SEQ ID NO: 116528 - protein, 9 aa, Homo Sapiens
GKCQQLTVS

SEQ ID NO: 116529 - protein, 9 aa, Homo Sapiens
GAAWLDASC

SEQ ID NO: 116530 - protein, 9 aa, Homo Sapiens
DVAKHEIIC

SEQ ID NO: 116531 - protein, 9 aa, Homo Sapiens
AKHEIICAF

SEQ ID NO: 116532 - protein, 9 aa, Homo Sapiens
SVEDSYEAS

SEQ ID NO: 116533 - protein, 9 aa, Homo Sapiens
HYRDKHNTK

SEQ ID NO: 116534 - protein, 9 aa, Homo Sapiens
DANYLNKGI

SEQ ID NO: 116535 - protein, 9 aa, Homo Sapiens
NPCPGLYLA

SEQ ID NO: 116536 - protein, 9 aa, Homo Sapiens
ELAGCGSRV

SEQ ID NO: 116537 - protein, 9 aa, Homo Sapiens
RGIDIGPAG

SEQ ID NO: 116538 - protein, 9 aa, Homo Sapiens
ATVQWLKNG

SEQ ID NO: 116539 - protein, 9 aa, Homo Sapiens
LRCHLEHPL

SEQ ID NO: 116540 - protein, 9 aa, Homo Sapiens
MSEYNLEIP

SEQ ID NO: 116541 - protein, 9 aa, Homo Sapiens
VNHNLKEKL

SEQ ID NO: 116542 - protein, 9 aa, Homo Sapiens
TVLTADNCF

SEQ ID NO: 116543 - protein, 9 aa, Homo Sapiens
VQSLSVQTR

SEQ ID NO: 116544 - protein, 9 aa, Homo Sapiens
LFKKSEKYM

SEQ ID NO: 116545 - protein, 9 aa, Homo Sapiens
YWVKIYHLE

SEQ ID NO: 116546 - protein, 9 aa, Homo Sapiens
VVYHVIVPC

SEQ ID NO: 116547 - protein, 9 aa, Homo Sapiens
ATSRFRLHC

SEQ ID NO: 116548 - protein, 9 aa, Homo Sapiens
EQETLVKPK

SEQ ID NO: 116549 - protein, 9 aa, Homo Sapiens
FSGNEDGVP

SEQ ID NO: 116550 - protein, 9 aa, Homo Sapiens
PCRESQLVG

SEQ ID NO: 116551 - protein, 9 aa, Homo Sapiens
HMLIRLLEV

SEQ ID NO: 116552 - protein, 9 aa, Homo Sapiens
TVVYDEALS

SEQ ID NO: 116553 - protein, 9 aa, Homo Sapiens
FDVTNSSQR

SEQ ID NO: 116554 - protein, 9 aa, Homo Sapiens
VWDKAQDSG

SEQ ID NO: 116555 - protein, 9 aa, Homo Sapiens
FLHKPSIKK

SEQ ID NO: 116556 - protein, 9 aa, Homo Sapiens
ESEVQSLSV

SEQ ID NO: 116557 - protein, 9 aa, Homo Sapiens
EYNLEIPVV

SEQ ID NO: 116558 - protein, 9 aa, Homo Sapiens
KNYKGMIDN

SEQ ID NO: 116559 - protein, 9 aa, Homo Sapiens
PDNYGDQIA

SEQ ID NO: 116560 - protein, 9 aa, Homo Sapiens
CRLLRVPNG

SEQ ID NO: 116561 - protein, 9 aa, Homo Sapiens
QKSCKTHPY

SEQ ID NO: 116562 - protein, 9 aa, Homo Sapiens
RFRLHCSLD

SEQ ID NO: 116563 - protein, 9 aa, Homo Sapiens
LRSAAPASS

SEQ ID NO: 116564 - protein, 9 aa, Homo Sapiens
RDIKISTEE

SEQ ID NO: 116565 - protein, 9 aa, Homo Sapiens
HQPGGELLP

SEQ ID NO: 116566 - protein, 9 aa, Homo Sapiens
CPAPFMAQE

SEQ ID NO: 116567 - protein, 9 aa, Homo Sapiens
RHEPGGQSF

SEQ ID NO: 116568 - protein, 9 aa, Homo Sapiens
GYSLALGQL

SEQ ID NO: 116569 - protein, 9 aa, Homo Sapiens
SKENRDIKI

SEQ ID NO: 116570 - protein, 9 aa, Homo Sapiens
VYPPPKNGG

SEQ ID NO: 116571 - protein, 9 aa, Homo Sapiens
QADPDMLHN

SEQ ID NO: 116572 - protein, 9 aa, Homo Sapiens
GSITIPQPQ

SEQ ID NO: 116573 - protein, 9 aa, Homo Sapiens
VLNEFHAIQ

SEQ ID NO: 116574 - protein, 9 aa, Homo Sapiens
QMFSSGQPV

SEQ ID NO: 116575 - protein, 9 aa, Homo Sapiens
VFIALLQRF

SEQ ID NO: 116576 - protein, 9 aa, Homo Sapiens
VAMARAPLH

SEQ ID NO: 116577 - protein, 9 aa, Homo Sapiens
WRTTLTFQQ

SEQ ID NO: 116578 - protein, 9 aa, Homo Sapiens
PAPFMAQEA

SEQ ID NO: 116579 - protein, 9 aa, Homo Sapiens
QRFDCNFDL

SEQ ID NO: 116580 - protein, 9 aa, Homo Sapiens
VSYGTGELQ

SEQ ID NO: 116581 - protein, 9 aa, Homo Sapiens
AWRTTLTFQ

SEQ ID NO: 116582 - protein, 9 aa, Homo Sapiens
VGGGGAGSE

SEQ ID NO: 116583 - protein, 9 aa, Homo Sapiens
GRVAHTHAC

SEQ ID NO: 116584 - protein, 9 aa, Homo Sapiens
QAANAWRTT

SEQ ID NO: 116585 - protein, 9 aa, Homo Sapiens
LLQRFDCNF

SEQ ID NO: 116586 - protein, 9 aa, Homo Sapiens
GTEESRRRG

SEQ ID NO: 116587 - protein, 9 aa, Homo Sapiens
GDPRHPSRA

SEQ ID NO: 116588 - protein, 9 aa, Homo Sapiens
LGPRLCRGT

SEQ ID NO: 116589 - protein, 9 aa, Homo Sapiens
AAPASSSLP

SEQ ID NO: 116590 - protein, 9 aa, Homo Sapiens
PDMLHNSYA

SEQ ID NO: 116591 - protein, 9 aa, Homo Sapiens
APASSSLPT

SEQ ID NO: 116592 - protein, 9 aa, Homo Sapiens
ASKENRDIK

SEQ ID NO: 116593 - protein, 9 aa, Homo Sapiens
RVPWYSKAC

SEQ ID NO: 116594 - protein, 9 aa, Homo Sapiens
TLGSITIPQ

SEQ ID NO: 116595 - protein, 9 aa, Homo Sapiens
SSGESVAPP

SEQ ID NO: 116596 - protein, 9 aa, Homo Sapiens
GWKPGLDFA

SEQ ID NO: 116597 - protein, 9 aa, Homo Sapiens
FTFGLCDYH

SEQ ID NO: 116598 - protein, 9 aa, Homo Sapiens
YLQDNHINW

SEQ ID NO: 116599 - protein, 9 aa, Homo Sapiens
QEASSPSTG

SEQ ID NO: 116600 - protein, 9 aa, Homo Sapiens
VTVHLEKTN

SEQ ID NO: 116601 - protein, 9 aa, Homo Sapiens
WEGNVCEQE

SEQ ID NO: 116602 - protein, 9 aa, Homo Sapiens
YLPKGTFQE

SEQ ID NO: 116603 - protein, 9 aa, Homo Sapiens
ICPLEPQPA

SEQ ID NO: 116604 - protein, 9 aa, Homo Sapiens
GTFQEEMLL

SEQ ID NO: 116605 - protein, 9 aa, Homo Sapiens
SGESVAPPS

SEQ ID NO: 116606 - protein, 9 aa, Homo Sapiens
IRDGEKVKA

SEQ ID NO: 116607 - protein, 9 aa, Homo Sapiens
LNQYHLMGK

SEQ ID NO: 116608 - protein, 9 aa, Homo Sapiens
VVTVHLEKT

SEQ ID NO: 116609 - protein, 9 aa, Homo Sapiens
AAALTWSSA

SEQ ID NO: 116610 - protein, 9 aa, Homo Sapiens
GHFHSTKKG

SEQ ID NO: 116611 - protein, 9 aa, Homo Sapiens
LAENKQQFK

SEQ ID NO: 116612 - protein, 9 aa, Homo Sapiens
PPACCPSDR

SEQ ID NO: 116613 - protein, 9 aa, Homo Sapiens
RHAAHWLGN

SEQ ID NO: 116614 - protein, 9 aa, Homo Sapiens
LGGGQGSGV

SEQ ID NO: 116615 - protein, 9 aa, Homo Sapiens
WKPSDGGYE

SEQ ID NO: 116616 - protein, 9 aa, Homo Sapiens
HFIRTSHLV

SEQ ID NO: 116617 - protein, 9 aa, Homo Sapiens
SITIPQPQG

SEQ ID NO: 116618 - protein, 9 aa, Homo Sapiens
CRGTEESRR

SEQ ID NO: 116619 - protein, 9 aa, Homo Sapiens
PSRSNYKRF

SEQ ID NO: 116620 - protein, 9 aa, Homo Sapiens
FMAQEASSP

SEQ ID NO: 116621 - protein, 9 aa, Homo Sapiens
CPQPLAFSF

SEQ ID NO: 116622 - protein, 9 aa, Homo Sapiens
VEREKERNP

SEQ ID NO: 116623 - protein, 9 aa, Homo Sapiens
NNTASWEQM

SEQ ID NO: 116624 - protein, 9 aa, Homo Sapiens
VEMYGSSFD

SEQ ID NO: 116625 - protein, 9 aa, Homo Sapiens
NGFNGMLVV

SEQ ID NO: 116626 - protein, 9 aa, Homo Sapiens
TNKMEWWSR

SEQ ID NO: 116627 - protein, 9 aa, Homo Sapiens
EKAQSCQPR

SEQ ID NO: 116628 - protein, 9 aa, Homo Sapiens
AEEQSVGGE

SEQ ID NO: 116629 - protein, 9 aa, Homo Sapiens
RHDNKRQHP

SEQ ID NO: 116630 - protein, 9 aa, Homo Sapiens
ILHVLSCVI

SEQ ID NO: 116631 - protein, 9 aa, Homo Sapiens
GPSRSNYKR

SEQ ID NO: 116632 - protein, 9 aa, Homo Sapiens
PWYSKACAS

SEQ ID NO: 116633 - protein, 9 aa, Homo Sapiens
PSRAAALTW

SEQ ID NO: 116634 - protein, 9 aa, Homo Sapiens
QSFIVLKTD

SEQ ID NO: 116635 - protein, 9 aa, Homo Sapiens
FLDVNLHEN

SEQ ID NO: 116636 - protein, 9 aa, Homo Sapiens
GAGTAPLGT

SEQ ID NO: 116637 - protein, 9 aa, Homo Sapiens
YQWNIPQRS

SEQ ID NO: 116638 - protein, 9 aa, Homo Sapiens
TSGPPACCP

SEQ ID NO: 116639 - protein, 9 aa, Homo Sapiens
NHINWVPPN

SEQ ID NO: 116640 - protein, 9 aa, Homo Sapiens
SHKGIIPEE

SEQ ID NO: 116641 - protein, 9 aa, Homo Sapiens
GEKVKAYQW

SEQ ID NO: 116642 - protein, 9 aa, Homo Sapiens
AYPNTAPGE

SEQ ID NO: 116643 - protein, 9 aa, Homo Sapiens
KHIPYREDK

SEQ ID NO: 116644 - protein, 9 aa, Homo Sapiens
DRPDHLDTV

SEQ ID NO: 116645 - protein, 9 aa, Homo Sapiens
QFLDVNLHE

SEQ ID NO: 116646 - protein, 9 aa, Homo Sapiens
PQGYSLALG

SEQ ID NO: 116647 - protein, 9 aa, Homo Sapiens
WPSRRVPAA

SEQ ID NO: 116648 - protein, 9 aa, Homo Sapiens
RDGEKVKAY

SEQ ID NO: 116649 - protein, 9 aa, Homo Sapiens
NRTRKHIPY

SEQ ID NO: 116650 - protein, 9 aa, Homo Sapiens
PCPAPFMAQ

SEQ ID NO: 116651 - protein, 9 aa, Homo Sapiens
TIPQPQGRK

SEQ ID NO: 116652 - protein, 9 aa, Homo Sapiens
TTLTFQQIK

SEQ ID NO: 116653 - protein, 9 aa, Homo Sapiens
SKRGSKKRQ

SEQ ID NO: 116654 - protein, 9 aa, Homo Sapiens
NYKRFLPPD

SEQ ID NO: 116655 - protein, 9 aa, Homo Sapiens
CPCDAKGWK

SEQ ID NO: 116656 - protein, 9 aa, Homo Sapiens
NFSIIDMSL

SEQ ID NO: 116657 - protein, 9 aa, Homo Sapiens
ITIPQPQGR

SEQ ID NO: 116658 - protein, 9 aa, Homo Sapiens
GWPSRRVPA

SEQ ID NO: 116659 - protein, 9 aa, Homo Sapiens
AQCCSMILD

SEQ ID NO: 116660 - protein, 9 aa, Homo Sapiens
PKPLSWQFD

SEQ ID NO: 116661 - protein, 9 aa, Homo Sapiens
THACVDELL

SEQ ID NO: 116662 - protein, 9 aa, Homo Sapiens
LPTALGPRL

SEQ ID NO: 116663 - protein, 9 aa, Homo Sapiens
SDEEGRGGV

SEQ ID NO: 116664 - protein, 9 aa, Homo Sapiens
GGRVKTWKH

SEQ ID NO: 116665 - protein, 9 aa, Homo Sapiens
PPGWPSRRV

SEQ ID NO: 116666 - protein, 9 aa, Homo Sapiens
AQEASSPST

SEQ ID NO: 116667 - protein, 9 aa, Homo Sapiens
VCSKCGKHF

SEQ ID NO: 116668 - protein, 9 aa, Homo Sapiens
QSVGGEEEE

SEQ ID NO: 116669 - protein, 9 aa, Homo Sapiens
PGGELLPGD

SEQ ID NO: 116670 - protein, 9 aa, Homo Sapiens
AFSFVETME

SEQ ID NO: 116671 - protein, 9 aa, Homo Sapiens
HRSKRGSKK

SEQ ID NO: 116672 - protein, 9 aa, Homo Sapiens
SALGGGQGS

SEQ ID NO: 116673 - protein, 9 aa, Homo Sapiens
ALLQRFDCN

SEQ ID NO: 116674 - protein, 9 aa, Homo Sapiens
EGRGRVAHT

SEQ ID NO: 116675 - protein, 9 aa, Homo Sapiens
EATNQFLDV

SEQ ID NO: 116676 - protein, 9 aa, Homo Sapiens
EELQMFSSG

SEQ ID NO: 116677 - protein, 9 aa, Homo Sapiens
DQSFIVLKT

SEQ ID NO: 116678 - protein, 9 aa, Homo Sapiens
LHRECCPAV

SEQ ID NO: 116679 - protein, 9 aa, Homo Sapiens
PLCDCHCCS

SEQ ID NO: 116680 - protein, 9 aa, Homo Sapiens
SSSSSNSSS

SEQ ID NO: 116681 - protein, 9 aa, Homo Sapiens
PGDRPDHLD

SEQ ID NO: 116682 - protein, 9 aa, Homo Sapiens
PLRSAAPAS

SEQ ID NO: 116683 - protein, 9 aa, Homo Sapiens
DWEGNVCEQ

SEQ ID NO: 116684 - protein, 9 aa, Homo Sapiens
NRDIKISTE

SEQ ID NO: 116685 - protein, 9 aa, Homo Sapiens
HRWFILTDN

SEQ ID NO: 116686 - protein, 9 aa, Homo Sapiens
GWKPSDGGY

SEQ ID NO: 116687 - protein, 9 aa, Homo Sapiens
AGYTGEDCP

SEQ ID NO: 116688 - protein, 9 aa, Homo Sapiens
SYPPLHREC

SEQ ID NO: 116689 - protein, 9 aa, Homo Sapiens
CSKCGKHFI

SEQ ID NO: 116690 - protein, 9 aa, Homo Sapiens
CSHTASFVV

SEQ ID NO: 116691 - protein, 9 aa, Homo Sapiens
MLASKRTDG

SEQ ID NO: 116692 - protein, 9 aa, Homo Sapiens
PQPQGRKTP

SEQ ID NO: 116693 - protein, 9 aa, Homo Sapiens
DVGSQNDFA

SEQ ID NO: 116694 - protein, 9 aa, Homo Sapiens
HEPGGQSFS

SEQ ID NO: 116695 - protein, 9 aa, Homo Sapiens
RKHIPYRED

SEQ ID NO: 116696 - protein, 9 aa, Homo Sapiens
LVGRHEPGG

SEQ ID NO: 116697 - protein, 9 aa, Homo Sapiens
NVCEQESNE

SEQ ID NO: 116698 - protein, 9 aa, Homo Sapiens
LCDYHQEVS

SEQ ID NO: 116699 - protein, 9 aa, Homo Sapiens
SEDQSFIVL

SEQ ID NO: 116700 - protein, 9 aa, Homo Sapiens
GEIQSLIPT

SEQ ID NO: 116701 - protein, 9 aa, Homo Sapiens
ALGQLSPAA

SEQ ID NO: 116702 - protein, 9 aa, Homo Sapiens
VVGVAMARA

SEQ ID NO: 116703 - protein, 9 aa, Homo Sapiens
KPSDGGYEL

SEQ ID NO: 116704 - protein, 9 aa, Homo Sapiens
GGGQGSGVA

SEQ ID NO: 116705 - protein, 9 aa, Homo Sapiens
LVVFLAGTP

SEQ ID NO: 116706 - protein, 9 aa, Homo Sapiens
RTRKHIPYR

SEQ ID NO: 116707 - protein, 9 aa, Homo Sapiens
VTYQWNIPQ

SEQ ID NO: 116708 - protein, 9 aa, Homo Sapiens
SVGGEEEEE

SEQ ID NO: 116709 - protein, 9 aa, Homo Sapiens
SIVICPLEP

SEQ ID NO: 116710 - protein, 9 aa, Homo Sapiens
AEHHQPGGE

SEQ ID NO: 116711 - protein, 9 aa, Homo Sapiens
LSWQFDTVS

SEQ ID NO: 116712 - protein, 9 aa, Homo Sapiens
NIPQRSGPG

SEQ ID NO: 116713 - protein, 9 aa, Homo Sapiens
SVAPPSTSA

SEQ ID NO: 116714 - protein, 9 aa, Homo Sapiens
KQQFKNLKE

SEQ ID NO: 116715 - protein, 9 aa, Homo Sapiens
QGSGVATGR

SEQ ID NO: 116716 - protein, 9 aa, Homo Sapiens
CDTKMHILH

SEQ ID NO: 116717 - protein, 9 aa, Homo Sapiens
SRAAALTWS

SEQ ID NO: 116718 - protein, 9 aa, Homo Sapiens
KTVGTENIS

SEQ ID NO: 116719 - protein, 9 aa, Homo Sapiens
SLPKRYIIA

SEQ ID NO: 116720 - protein, 9 aa, Homo Sapiens
NGVLRVHPQ

SEQ ID NO: 116721 - protein, 9 aa, Homo Sapiens
PGGAGTAPL

SEQ ID NO: 116722 - protein, 9 aa, Homo Sapiens
LGKEEDAGH

SEQ ID NO: 116723 - protein, 9 aa, Homo Sapiens
NQYHLMGKT

SEQ ID NO: 116724 - protein, 9 aa, Homo Sapiens
HILHVLSCV

SEQ ID NO: 116725 - protein, 9 aa, Homo Sapiens
GKEEDAGHF

SEQ ID NO: 116726 - protein, 9 aa, Homo Sapiens
PFMAQEASS

SEQ ID NO: 116727 - protein, 9 aa, Homo Sapiens
PACCPSDRK

SEQ ID NO: 116728 - protein, 9 aa, Homo Sapiens
FIVLKTDLG

SEQ ID NO: 116729 - protein, 9 aa, Homo Sapiens
HHQPGGELL

SEQ ID NO: 116730 - protein, 9 aa, Homo Sapiens
HKGIIPEEY

SEQ ID NO: 116731 - protein, 9 aa, Homo Sapiens
QSCQPRLDR

SEQ ID NO: 116732 - protein, 9 aa, Homo Sapiens
LMGKTVGTE

SEQ ID NO: 116733 - protein, 9 aa, Homo Sapiens
SLPTALGPR

SEQ ID NO: 116734 - protein, 9 aa, Homo Sapiens
ALGPRLCRG

SEQ ID NO: 116735 - protein, 9 aa, Homo Sapiens
PSRRVPAAE

SEQ ID NO: 116736 - protein, 9 aa, Homo Sapiens
CVYPPPKNG

SEQ ID NO: 116737 - protein, 9 aa, Homo Sapiens
PLHRECCPA

SEQ ID NO: 116738 - protein, 9 aa, Homo Sapiens
QGRVPWYSK

SEQ ID NO: 116739 - protein, 9 aa, Homo Sapiens
PGGQSFSIQ

SEQ ID NO: 116740 - protein, 9 aa, Homo Sapiens
QCSHTASFV

SEQ ID NO: 116741 - protein, 9 aa, Homo Sapiens
RLRNRAAEL

SEQ ID NO: 116742 - protein, 9 aa, Homo Sapiens
TDGAAPAGE

SEQ ID NO: 116743 - protein, 9 aa, Homo Sapiens
DNHINWVPP

SEQ ID NO: 116744 - protein, 9 aa, Homo Sapiens
DTKMHILHV

SEQ ID NO: 116745 - protein, 9 aa, Homo Sapiens
SVRAGYTGE

SEQ ID NO: 116746 - protein, 9 aa, Homo Sapiens
PHRSKRGSK

SEQ ID NO: 116747 - protein, 9 aa, Homo Sapiens
KRGSKKRQM

SEQ ID NO: 116748 - protein, 9 aa, Homo Sapiens
ECDTKMHIL

SEQ ID NO: 116749 - protein, 9 aa, Homo Sapiens
YRDNRTRKH

SEQ ID NO: 116750 - protein, 9 aa, Homo Sapiens
NEFHAIQKA

SEQ ID NO: 116751 - protein, 9 aa, Homo Sapiens
RGTEESRRR

SEQ ID NO: 116752 - protein, 9 aa, Homo Sapiens
ERNPEHRAL

SEQ ID NO: 116753 - protein, 9 aa, Homo Sapiens
HLMGKTVGT

SEQ ID NO: 116754 - protein, 9 aa, Homo Sapiens
RVPAAEHHQ

SEQ ID NO: 116755 - protein, 9 aa, Homo Sapiens
AKDVGSQND

SEQ ID NO: 116756 - protein, 9 aa, Homo Sapiens
AAELRQDFN

SEQ ID NO: 116757 - protein, 9 aa, Homo Sapiens
LSHKGIIPE

SEQ ID NO: 116758 - protein, 9 aa, Homo Sapiens
GRVPWYSKA

SEQ ID NO: 116759 - protein, 9 aa, Homo Sapiens
SSSSSSGPN

SEQ ID NO: 116760 - protein, 9 aa, Homo Sapiens
AHTHACVDE

SEQ ID NO: 116761 - protein, 9 aa, Homo Sapiens
FQADPDMLH

SEQ ID NO: 116762 - protein, 9 aa, Homo Sapiens
EFHAIQKAQ

SEQ ID NO: 116763 - protein, 9 aa, Homo Sapiens
QPGGELLPG

SEQ ID NO: 116764 - protein, 9 aa, Homo Sapiens
RTARAKVQK

SEQ ID NO: 116765 - protein, 9 aa, Homo Sapiens
ISSSLGEIQ

SEQ ID NO: 116766 - protein, 9 aa, Homo Sapiens
NAGVKRSAV

SEQ ID NO: 116767 - protein, 9 aa, Homo Sapiens
IQSLIPTDE

SEQ ID NO: 116768 - protein, 9 aa, Homo Sapiens
PGDPRHPSR

SEQ ID NO: 116769 - protein, 9 aa, Homo Sapiens
NWVPPNAFS

SEQ ID NO: 116770 - protein, 9 aa, Homo Sapiens
EEATNQFLD

SEQ ID NO: 116771 - protein, 9 aa, Homo Sapiens
HAAHWLGNN

SEQ ID NO: 116772 - protein, 9 aa, Homo Sapiens
HAIQKAQKE

SEQ ID NO: 116773 - protein, 9 aa, Homo Sapiens
AQSCQPRLD

SEQ ID NO: 116774 - protein, 9 aa, Homo Sapiens
AAHWLGNNT

SEQ ID NO: 116775 - protein, 9 aa, Homo Sapiens
RTDGAAPAG

SEQ ID NO: 116776 - protein, 9 aa, Homo Sapiens
MYFLLTNFS

SEQ ID NO: 116777 - protein, 9 aa, Homo Sapiens
RPPACLQGL

SEQ ID NO: 116778 - protein, 9 aa, Homo Sapiens
ASNVEFITR

SEQ ID NO: 116779 - protein, 9 aa, Homo Sapiens
GPGGAGTAP

SEQ ID NO: 116780 - protein, 9 aa, Homo Sapiens
WQYGPVRHD

SEQ ID NO: 116781 - protein, 9 aa, Homo Sapiens
NKQQFKNLK

SEQ ID NO: 116782 - protein, 9 aa, Homo Sapiens
HDNKRQHPC

SEQ ID NO: 116783 - protein, 9 aa, Homo Sapiens
TALGPRLCR

SEQ ID NO: 116784 - protein, 9 aa, Homo Sapiens
LSRPPACLQ

SEQ ID NO: 116785 - protein, 9 aa, Homo Sapiens
KFSYPPLHR

SEQ ID NO: 116786 - protein, 9 aa, Homo Sapiens
YHLMGKTVG

SEQ ID NO: 116787 - protein, 9 aa, Homo Sapiens
MLSHKGIIP

SEQ ID NO: 116788 - protein, 9 aa, Homo Sapiens
SSLGEIQSL

SEQ ID NO: 116789 - protein, 9 aa, Homo Sapiens
PGPGGAGTA

SEQ ID NO: 116790 - protein, 9 aa, Homo Sapiens
IEEATNQFL

SEQ ID NO: 116791 - protein, 9 aa, Homo Sapiens
ACCPSDRKV

SEQ ID NO: 116792 - protein, 9 aa, Homo Sapiens
HVEREKERN

SEQ ID NO: 116793 - protein, 9 aa, Homo Sapiens
LEKTNKMEW

SEQ ID NO: 116794 - protein, 9 aa, Homo Sapiens
MHILHVLSC

SEQ ID NO: 116795 - protein, 9 aa, Homo Sapiens
EKERNPEHR

SEQ ID NO: 116796 - protein, 9 aa, Homo Sapiens
YTGEDCPKA

SEQ ID NO: 116797 - protein, 9 aa, Homo Sapiens
HIIEELQMF

SEQ ID NO: 116798 - protein, 9 aa, Homo Sapiens
AMARAPLHS

SEQ ID NO: 116799 - protein, 9 aa, Homo Sapiens
AGTAPLGTL

SEQ ID NO: 116800 - protein, 9 aa, Homo Sapiens
KACASTLTT

SEQ ID NO: 116801 - protein, 9 aa, Homo Sapiens
SQNDFADDE

SEQ ID NO: 116802 - protein, 9 aa, Homo Sapiens
VGGEEEEEE

SEQ ID NO: 116803 - protein, 9 aa, Homo Sapiens
GFNGMLVVF

SEQ ID NO: 116804 - protein, 9 aa, Homo Sapiens
SCQPRLDRE

SEQ ID NO: 116805 - protein, 9 aa, Homo Sapiens
TGELQREAD

SEQ ID NO: 116806 - protein, 9 aa, Homo Sapiens
DPRHPSRAA

SEQ ID NO: 116807 - protein, 9 aa, Homo Sapiens
MFSSGQPVQ

SEQ ID NO: 116808 - protein, 9 aa, Homo Sapiens
RSAVEMYGS

SEQ ID NO: 116809 - protein, 9 aa, Homo Sapiens
LGNNTASWE

SEQ ID NO: 116810 - protein, 9 aa, Homo Sapiens
WNIPQRSGP

SEQ ID NO: 116811 - protein, 9 aa, Homo Sapiens
SLGEIQSLI

SEQ ID NO: 116812 - protein, 9 aa, Homo Sapiens
YLSRPPACL

SEQ ID NO: 116813 - protein, 9 aa, Homo Sapiens
EPGPGGAGT

SEQ ID NO: 116814 - protein, 9 aa, Homo Sapiens
LGEIQSLIP

SEQ ID NO: 116815 - protein, 9 aa, Homo Sapiens
TWSSALGGG

SEQ ID NO: 116816 - protein, 9 aa, Homo Sapiens
KENRDIKIS

SEQ ID NO: 116817 - protein, 9 aa, Homo Sapiens
SLALGQLSP

SEQ ID NO: 116818 - protein, 9 aa, Homo Sapiens
GKHFIRTSH

SEQ ID NO: 116819 - protein, 9 aa, Homo Sapiens
FSFVETMEG

SEQ ID NO: 116820 - protein, 9 aa, Homo Sapiens
SKRTDGAAP

SEQ ID NO: 116821 - protein, 9 aa, Homo Sapiens
TFGLCDYHQ

SEQ ID NO: 116822 - protein, 9 aa, Homo Sapiens
VEFITRTRT

SEQ ID NO: 116823 - protein, 9 aa, Homo Sapiens
INWVPPNAF

SEQ ID NO: 116824 - protein, 9 aa, Homo Sapiens
QPQGRKTPE

SEQ ID NO: 116825 - protein, 9 aa, Homo Sapiens
PPACLQGLY

SEQ ID NO: 116826 - protein, 9 aa, Homo Sapiens
ARAKVQKLR

SEQ ID NO: 116827 - protein, 9 aa, Homo Sapiens
LCRGTEESR

SEQ ID NO: 116828 - protein, 9 aa, Homo Sapiens
VPAAEHHQP

SEQ ID NO: 116829 - protein, 9 aa, Homo Sapiens
VVLMDISRR

SEQ ID NO: 116830 - protein, 9 aa, Homo Sapiens
LGSITIPQP

SEQ ID NO: 116831 - protein, 9 aa, Homo Sapiens
LTGQEPAQC

SEQ ID NO: 116832 - protein, 9 aa, Homo Sapiens
KAQSCQPRL

SEQ ID NO: 116833 - protein, 9 aa, Homo Sapiens
PMYFLLTNF

SEQ ID NO: 116834 - protein, 9 aa, Homo Sapiens
SFVETMEGP

SEQ ID NO: 116835 - protein, 9 aa, Homo Sapiens
DCHCCSLPK

SEQ ID NO: 116836 - protein, 9 aa, Homo Sapiens
ENRDIKIST

SEQ ID NO: 116837 - protein, 9 aa, Homo Sapiens
ERTARAKVQ

SEQ ID NO: 116838 - protein, 9 aa, Homo Sapiens
SSSLGEIQS

SEQ ID NO: 116839 - protein, 9 aa, Homo Sapiens
SGPPACCPS

SEQ ID NO: 116840 - protein, 9 aa, Homo Sapiens
HTHACVDEL

SEQ ID NO: 116841 - protein, 9 aa, Homo Sapiens
KPHRSKRGS

SEQ ID NO: 116842 - protein, 9 aa, Homo Sapiens
GVGGGGAGS

SEQ ID NO: 116843 - protein, 9 aa, Homo Sapiens
QQFKNLKEK

SEQ ID NO: 116844 - protein, 9 aa, Homo Sapiens
EKVKAYQWS

SEQ ID NO: 116845 - protein, 9 aa, Homo Sapiens
LCDCHCCSL

SEQ ID NO: 116846 - protein, 9 aa, Homo Sapiens
KMHILHVLS

SEQ ID NO: 116847 - protein, 9 aa, Homo Sapiens
KRSAVEMYG

SEQ ID NO: 116848 - protein, 9 aa, Homo Sapiens
QFKNLKEKC

SEQ ID NO: 116849 - protein, 9 aa, Homo Sapiens
QVSFTFGLC

SEQ ID NO: 116850 - protein, 9 aa, Homo Sapiens
LAFSFVETM

SEQ ID NO: 116851 - protein, 9 aa, Homo Sapiens
TARAKVQKL

SEQ ID NO: 116852 - protein, 9 aa, Homo Sapiens
LQMFSSGQP

SEQ ID NO: 116853 - protein, 9 aa, Homo Sapiens
QNDFADDEH

SEQ ID NO: 116854 - protein, 9 aa, Homo Sapiens
GRVKTWKHR

SEQ ID NO: 116855 - protein, 9 aa, Homo Sapiens
SGVATGRRM

SEQ ID NO: 116856 - protein, 9 aa, Homo Sapiens
LLTNFSIID

SEQ ID NO: 116857 - protein, 9 aa, Homo Sapiens
TGRRMHLFQ

SEQ ID NO: 116858 - protein, 9 aa, Homo Sapiens
IPQRSGPGP

SEQ ID NO: 116859 - protein, 9 aa, Homo Sapiens
RHPSRAAAL

SEQ ID NO: 116860 - protein, 9 aa, Homo Sapiens
GMLVVFLAG

SEQ ID NO: 116861 - protein, 9 aa, Homo Sapiens
QDNHINWVP

SEQ ID NO: 116862 - protein, 9 aa, Homo Sapiens
LQREADEEE

SEQ ID NO: 116863 - protein, 9 aa, Homo Sapiens
PGETPLRSA

SEQ ID NO: 116864 - protein, 9 aa, Homo Sapiens
QCCSMILDE

SEQ ID NO: 116865 - protein, 9 aa, Homo Sapiens
PPLHRECCP

SEQ ID NO: 116866 - protein, 9 aa, Homo Sapiens
QVPPGWPSR

SEQ ID NO: 116867 - protein, 9 aa, Homo Sapiens
KYLPKGTFQ

SEQ ID NO: 116868 - protein, 9 aa, Homo Sapiens
PLDKSIVIC

SEQ ID NO: 116869 - protein, 9 aa, Homo Sapiens
GRRMHLFQH

SEQ ID NO: 116870 - protein, 9 aa, Homo Sapiens
IIEELQMFS

SEQ ID NO: 116871 - protein, 9 aa, Homo Sapiens
EKTNKMEWW

SEQ ID NO: 116872 - protein, 9 aa, Homo Sapiens
ACLQGLYEL

SEQ ID NO: 116873 - protein, 9 aa, Homo Sapiens
GLCDYHQEV

SEQ ID NO: 116874 - protein, 9 aa, Homo Sapiens
CCPSDRKVE

SEQ ID NO: 116875 - protein, 9 aa, Homo Sapiens
MRLRNRAAE

SEQ ID NO: 116876 - protein, 9 aa, Homo Sapiens
SFSVRAGYT

SEQ ID NO: 116877 - protein, 9 aa, Homo Sapiens
LGPSRSNYK

SEQ ID NO: 116878 - protein, 9 aa, Homo Sapiens
RAAALTWSS

SEQ ID NO: 116879 - protein, 9 aa, Homo Sapiens
WYSKACAST

SEQ ID NO: 116880 - protein, 9 aa, Homo Sapiens
QSLIPTDEK

SEQ ID NO: 116881 - protein, 9 aa, Homo Sapiens
VICPLEPQP

SEQ ID NO: 116882 - protein, 9 aa, Homo Sapiens
EESRRRGPG

SEQ ID NO: 116883 - protein, 9 aa, Homo Sapiens
EEQSVGGEE

SEQ ID NO: 116884 - protein, 9 aa, Homo Sapiens
TLTFQQIKQ

SEQ ID NO: 116885 - protein, 9 aa, Homo Sapiens
RGPGDPRHP

SEQ ID NO: 116886 - protein, 9 aa, Homo Sapiens
PLAFSFVET

SEQ ID NO: 116887 - protein, 9 aa, Homo Sapiens
SFTFGLCDY

SEQ ID NO: 116888 - protein, 9 aa, Homo Sapiens
WKPGLDFAW

SEQ ID NO: 116889 - protein, 9 aa, Homo Sapiens
IKISTEEEK

SEQ ID NO: 116890 - protein, 9 aa, Homo Sapiens
ASKRTDGAA

SEQ ID NO: 116891 - protein, 9 aa, Homo Sapiens
RSVLNEFHA

SEQ ID NO: 116892 - protein, 9 aa, Homo Sapiens
HPSRAAALT

SEQ ID NO: 116893 - protein, 9 aa, Homo Sapiens
QGYSLALGQ

SEQ ID NO: 116894 - protein, 9 aa, Homo Sapiens
HLEKTNKME

SEQ ID NO: 116895 - protein, 9 aa, Homo Sapiens
HCCSLPKRY

SEQ ID NO: 116896 - protein, 9 aa, Homo Sapiens
VQKLRSDLS

SEQ ID NO: 116897 - protein, 9 aa, Homo Sapiens
GGQSFSIQV

SEQ ID NO: 116898 - protein, 9 aa, Homo Sapiens
KTWKHRWFI

SEQ ID NO: 116899 - protein, 9 aa, Homo Sapiens
VATGRRMHL

SEQ ID NO: 116900 - protein, 9 aa, Homo Sapiens
TWKHRWFIL

SEQ ID NO: 116901 - protein, 9 aa, Homo Sapiens
YPPPKNGGA

SEQ ID NO: 116902 - protein, 9 aa, Homo Sapiens
TRKHIPYRE

SEQ ID NO: 116903 - protein, 9 aa, Homo Sapiens
FSIIDMSLA

SEQ ID NO: 116904 - protein, 9 aa, Homo Sapiens
KMLASKRTD

SEQ ID NO: 116905 - protein, 9 aa, Homo Sapiens
GTAPLGTLR

SEQ ID NO: 116906 - protein, 9 aa, Homo Sapiens
APGETPLRS

SEQ ID NO: 116907 - protein, 9 aa, Homo Sapiens
SCVYPPPKN

SEQ ID NO: 116908 - protein, 9 aa, Homo Sapiens
GPVRHDNKR

SEQ ID NO: 116909 - protein, 9 aa, Homo Sapiens
VGVAMARAP

SEQ ID NO: 116910 - protein, 9 aa, Homo Sapiens
MAQEASSPS

SEQ ID NO: 116911 - protein, 9 aa, Homo Sapiens
QFQADPDML

SEQ ID NO: 116912 - protein, 9 aa, Homo Sapiens
QCDPKPLSW

SEQ ID NO: 116913 - protein, 9 aa, Homo Sapiens
CDPKPLSWQ

SEQ ID NO: 116914 - protein, 9 aa, Homo Sapiens
WSSALGGGQ

SEQ ID NO: 116915 - protein, 9 aa, Homo Sapiens
LRSVLNEFH

SEQ ID NO: 116916 - protein, 9 aa, Homo Sapiens
GTGELQREA

SEQ ID NO: 116917 - protein, 9 aa, Homo Sapiens
KGTFQEEML

SEQ ID NO: 116918 - protein, 9 aa, Homo Sapiens
GSKKRQMSV

SEQ ID NO: 116919 - protein, 9 aa, Homo Sapiens
FHAIQKAQK

SEQ ID NO: 116920 - protein, 9 aa, Homo Sapiens
GVAMARAPL

SEQ ID NO: 116921 - protein, 9 aa, Homo Sapiens
QYHLMGKTV

SEQ ID NO: 116922 - protein, 9 aa, Homo Sapiens
ATGRRMHLF

SEQ ID NO: 116923 - protein, 9 aa, Homo Sapiens
TNQFLDVNL

SEQ ID NO: 116924 - protein, 9 aa, Homo Sapiens
EKMLASKRT

SEQ ID NO: 116925 - protein, 9 aa, Homo Sapiens
KSIVICPLE

SEQ ID NO: 116926 - protein, 9 aa, Homo Sapiens
CPLEPQPAP

SEQ ID NO: 116927 - protein, 9 aa, Homo Sapiens
SFVVLMDIS

SEQ ID NO: 116928 - protein, 9 aa, Homo Sapiens
GELQREADE

SEQ ID NO: 116929 - protein, 9 aa, Homo Sapiens
KNLKEKCFV

SEQ ID NO: 116930 - protein, 9 aa, Homo Sapiens
KRTDGAAPA

SEQ ID NO: 116931 - protein, 9 aa, Homo Sapiens
AAEHHQPGG

SEQ ID NO: 116932 - protein, 9 aa, Homo Sapiens
LALGQLSPA

SEQ ID NO: 116933 - protein, 9 aa, Homo Sapiens
NQFLDVNLH

SEQ ID NO: 116934 - protein, 9 aa, Homo Sapiens
CCSMILDEE

SEQ ID NO: 116935 - protein, 9 aa, Homo Sapiens
TYQWNIPQR

SEQ ID NO: 116936 - protein, 9 aa, Homo Sapiens
KYRDNRTRK

SEQ ID NO: 116937 - protein, 9 aa, Homo Sapiens
VNKFSYPPL

SEQ ID NO: 116938 - protein, 9 aa, Homo Sapiens
ELQREADEE

SEQ ID NO: 116939 - protein, 9 aa, Homo Sapiens
GDRPDHLDT

SEQ ID NO: 116940 - protein, 9 aa, Homo Sapiens
CQVSFTFGL

SEQ ID NO: 116941 - protein, 9 aa, Homo Sapiens
DNRTRKHIP

SEQ ID NO: 116942 - protein, 9 aa, Homo Sapiens
GWQYGPVRH

SEQ ID NO: 116943 - protein, 9 aa, Homo Sapiens
WQFDTVSGS

SEQ ID NO: 116944 - protein, 9 aa, Homo Sapiens
RRGPGDPRH

SEQ ID NO: 116945 - protein, 9 aa, Homo Sapiens
PRLDREISN

SEQ ID NO: 116946 - protein, 9 aa, Homo Sapiens
LRVHPQVPP

SEQ ID NO: 116947 - protein, 9 aa, Homo Sapiens
GVLRVHPQV

SEQ ID NO: 116948 - protein, 9 aa, Homo Sapiens
KEEDAGHFH

SEQ ID NO: 116949 - protein, 9 aa, Homo Sapiens
ADPDMLHNS

SEQ ID NO: 116950 - protein, 9 aa, Homo Sapiens
NGMLVVFLA

SEQ ID NO: 116951 - protein, 9 aa, Homo Sapiens
PNGFNGMLV

SEQ ID NO: 116952 - protein, 9 aa, Homo Sapiens
PVRHDNKRQ

SEQ ID NO: 116953 - protein, 9 aa, Homo Sapiens
ALTWSSALG

SEQ ID NO: 116954 - protein, 9 aa, Homo Sapiens
KAYQWSVSE

SEQ ID NO: 116955 - protein, 9 aa, Homo Sapiens
ETPLRSAAP

SEQ ID NO: 116956 - protein, 9 aa, Homo Sapiens
QSRQRSCVY

SEQ ID NO: 116957 - protein, 9 aa, Homo Sapiens
MARAPLHSV

SEQ ID NO: 116958 - protein, 9 aa, Homo Sapiens
LEKAQSCQP

SEQ ID NO: 116959 - protein, 9 aa, Homo Sapiens
YSLALGQLS

SEQ ID NO: 116960 - protein, 9 aa, Homo Sapiens
VAHTHACVD

SEQ ID NO: 116961 - protein, 9 aa, Homo Sapiens
SRQRSCVYP

SEQ ID NO: 116962 - protein, 9 aa, Homo Sapiens
EHNGVLRVH

SEQ ID NO: 116963 - protein, 9 aa, Homo Sapiens
LNEFHAIQK

SEQ ID NO: 116964 - protein, 9 aa, Homo Sapiens
SAVEMYGSS

SEQ ID NO: 116965 - protein, 9 aa, Homo Sapiens
NTAPGETPL

SEQ ID NO: 116966 - protein, 9 aa, Homo Sapiens
PAQCCSMIL

SEQ ID NO: 116967 - protein, 9 aa, Homo Sapiens
GSQNDFADD

SEQ ID NO: 116968 - protein, 9 aa, Homo Sapiens
RSNYKRFLP

SEQ ID NO: 116969 - protein, 9 aa, Homo Sapiens
PAAEHHQPG

SEQ ID NO: 116970 - protein, 9 aa, Homo Sapiens
FVETMEGPP

SEQ ID NO: 116971 - protein, 9 aa, Homo Sapiens
RGRVAHTHA

SEQ ID NO: 116972 - protein, 9 aa, Homo Sapiens
GESVAPPST

SEQ ID NO: 116973 - protein, 9 aa, Homo Sapiens
RRRGPGDPR

SEQ ID NO: 116974 - protein, 9 aa, Homo Sapiens
ELQMFSSGQ

SEQ ID NO: 116975 - protein, 9 aa, Homo Sapiens
RAKVQKLRS

SEQ ID NO: 116976 - protein, 9 aa, Homo Sapiens
YSKACASTL

SEQ ID NO: 116977 - protein, 9 aa, Homo Sapiens
VKAYQWSVS

SEQ ID NO: 116978 - protein, 9 aa, Homo Sapiens
PCDAKGWKP

SEQ ID NO: 116979 - protein, 9 aa, Homo Sapiens
PAEEQSVGG

SEQ ID NO: 116980 - protein, 9 aa, Homo Sapiens
LTNFSIIDM

SEQ ID NO: 116981 - protein, 9 aa, Homo Sapiens
HFHSTKKGN

SEQ ID NO: 116982 - protein, 9 aa, Homo Sapiens
GELLPGDRP

SEQ ID NO: 116983 - protein, 9 aa, Homo Sapiens
GQEPAQCCS

SEQ ID NO: 116984 - protein, 9 aa, Homo Sapiens
PPPSSGESV

SEQ ID NO: 116985 - protein, 9 aa, Homo Sapiens
LTWSSALGG

SEQ ID NO: 116986 - protein, 9 aa, Homo Sapiens
SYGTGELQR

SEQ ID NO: 116987 - protein, 9 aa, Homo Sapiens
LRNRAAELR

SEQ ID NO: 116988 - protein, 9 aa, Homo Sapiens
DMLHNSYAL

SEQ ID NO: 116989 - protein, 9 aa, Homo Sapiens
YFLLTNFSI

SEQ ID NO: 116990 - protein, 9 aa, Homo Sapiens
DAKGWKPGL

SEQ ID NO: 116991 - protein, 9 aa, Homo Sapiens
EPGGQSFSI

SEQ ID NO: 116992 - protein, 9 aa, Homo Sapiens
YGPVRHDNK

SEQ ID NO: 116993 - protein, 9 aa, Homo Sapiens
DIKISTEEE

SEQ ID NO: 116994 - protein, 9 aa, Homo Sapiens
ATNQFLDVN

SEQ ID NO: 116995 - protein, 9 aa, Homo Sapiens
NVEFITRTR

SEQ ID NO: 116996 - protein, 9 aa, Homo Sapiens
VYGASNVEF

SEQ ID NO: 116997 - protein, 9 aa, Homo Sapiens
EHHQPGGEL

SEQ ID NO: 116998 - protein, 9 aa, Homo Sapiens
GSGVATGRR

SEQ ID NO: 116999 - protein, 9 aa, Homo Sapiens
LPGDRPDHL

SEQ ID NO: 117000 - protein, 9 aa, Homo Sapiens
SRRVPAAEH

SEQ ID NO: 117001 - protein, 9 aa, Homo Sapiens
SKKRQMSVS

SEQ ID NO: 117002 - protein, 9 aa, Homo Sapiens
SDWEGNVCE

SEQ ID NO: 117003 - protein, 9 aa, Homo Sapiens
FVCSKCGKH

SEQ ID NO: 117004 - protein, 9 aa, Homo Sapiens
VHSEDQSFI

SEQ ID NO: 117005 - protein, 9 aa, Homo Sapiens
GVATGRRMH

SEQ ID NO: 117006 - protein, 9 aa, Homo Sapiens
RQRSCVYPP

SEQ ID NO: 117007 - protein, 9 aa, Homo Sapiens
KERNPEHRA

SEQ ID NO: 117008 - protein, 9 aa, Homo Sapiens
QEPAQCCSM

SEQ ID NO: 117009 - protein, 9 aa, Homo Sapiens
LQGLYELML

SEQ ID NO: 117010 - protein, 9 aa, Homo Sapiens
EGRGGVGGG

SEQ ID NO: 117011 - protein, 9 aa, Homo Sapiens
AANAWRTTL

SEQ ID NO: 117012 - protein, 9 aa, Homo Sapiens
NPEHRALCD

SEQ ID NO: 117013 - protein, 9 aa, Homo Sapiens
GRHEPGGQS

SEQ ID NO: 117014 - protein, 9 aa, Homo Sapiens
PSDGGYELP

SEQ ID NO: 117015 - protein, 9 aa, Homo Sapiens
HWLGNNTAS

SEQ ID NO: 117016 - protein, 9 aa, Homo Sapiens
GGAGTAPLG

SEQ ID NO: 117017 - protein, 9 aa, Homo Sapiens
DGEKVKAYQ

SEQ ID NO: 117018 - protein, 9 aa, Homo Sapiens
SRSNYKRFL

SEQ ID NO: 117019 - protein, 9 aa, Homo Sapiens
PQRSGPGPN

SEQ ID NO: 117020 - protein, 9 aa, Homo Sapiens
QRSCVYPPP

SEQ ID NO: 117021 - protein, 9 aa, Homo Sapiens
GETPLRSAA

SEQ ID NO: 117022 - protein, 9 aa, Homo Sapiens
RDNRTRKHI

SEQ ID NO: 117023 - protein, 9 aa, Homo Sapiens
YGTGELQRE

SEQ ID NO: 117024 - protein, 9 aa, Homo Sapiens
GPRLCRGTE

SEQ ID NO: 117025 - protein, 9 aa, Homo Sapiens
RTTLTFQQI

SEQ ID NO: 117026 - protein, 9 aa, Homo Sapiens
GRAKDVGSQ

SEQ ID NO: 117027 - protein, 9 aa, Homo Sapiens
VRAGYTGED

SEQ ID NO: 117028 - protein, 9 aa, Homo Sapiens
GSVFIALLQ

SEQ ID NO: 117029 - protein, 9 aa, Homo Sapiens
RNRAAELRQ

SEQ ID NO: 117030 - protein, 9 aa, Homo Sapiens
IEELQMFSS

SEQ ID NO: 117031 - protein, 9 aa, Homo Sapiens
SKACASTLT

SEQ ID NO: 117032 - protein, 9 aa, Homo Sapiens
MLVVFLAGT

SEQ ID NO: 117033 - protein, 9 aa, Homo Sapiens
DAGHFHSTK

SEQ ID NO: 117034 - protein, 9 aa, Homo Sapiens
EREKERNPE

SEQ ID NO: 117035 - protein, 9 aa, Homo Sapiens
TGEDCPKAD

SEQ ID NO: 117036 - protein, 9 aa, Homo Sapiens
GNNTASWEQ

SEQ ID NO: 117037 - protein, 9 aa, Homo Sapiens
KISTEEEKD

SEQ ID NO: 117038 - protein, 9 aa, Homo Sapiens
QKLRSDLSR

SEQ ID NO: 117039 - protein, 9 aa, Homo Sapiens
SNYKRFLPP

SEQ ID NO: 117040 - protein, 9 aa, Homo Sapiens
FGLCDYHQE

SEQ ID NO: 117041 - protein, 9 aa, Homo Sapiens
ESVAPPSTS

SEQ ID NO: 117042 - protein, 9 aa, Homo Sapiens
PLSWQFDTV

SEQ ID NO: 117043 - protein, 9 aa, Homo Sapiens
NAWRTTLTF

SEQ ID NO: 117044 - protein, 9 aa, Homo Sapiens
VKTWKHRWF

SEQ ID NO: 117045 - protein, 9 aa, Homo Sapiens
KVKAYQWSV

SEQ ID NO: 117046 - protein, 9 aa, Homo Sapiens
SVLNEFHAI

SEQ ID NO: 117047 - protein, 9 aa, Homo Sapiens
ANAWRTTLT

SEQ ID NO: 117048 - protein, 9 aa, Homo Sapiens
EPAQCCSMI

SEQ ID NO: 117049 - protein, 9 aa, Homo Sapiens
LGQLSPAAA

SEQ ID NO: 117050 - protein, 9 aa, Homo Sapiens
EEDAGHFHS

SEQ ID NO: 117051 - protein, 9 aa, Homo Sapiens
KGWKPGLDF

SEQ ID NO: 117052 - protein, 9 aa, Homo Sapiens
HPQVPPGWP

SEQ ID NO: 117053 - protein, 9 aa, Homo Sapiens
PQPLAFSFV

SEQ ID NO: 117054 - protein, 9 aa, Homo Sapiens
RAAELRQDF

SEQ ID NO: 117055 - protein, 9 aa, Homo Sapiens
RRVPAAEHH

SEQ ID NO: 117056 - protein, 9 aa, Homo Sapiens
FIALLQRFD

SEQ ID NO: 117057 - protein, 9 aa, Homo Sapiens
PGWPSRRVP

SEQ ID NO: 117058 - protein, 9 aa, Homo Sapiens
SSLPTALGP

SEQ ID NO: 117059 - protein, 9 aa, Homo Sapiens
EFITRTRTE

SEQ ID NO: 117060 - protein, 9 aa, Homo Sapiens
VRHDNKRQH

SEQ ID NO: 117061 - protein, 9 aa, Homo Sapiens
KPLSWQFDT

SEQ ID NO: 117062 - protein, 9 aa, Homo Sapiens
DPKPLSWQF

SEQ ID NO: 117063 - protein, 9 aa, Homo Sapiens
DEEGRGGVG

SEQ ID NO: 117064 - protein, 9 aa, Homo Sapiens
CDAKGWKPG

SEQ ID NO: 117065 - protein, 9 aa, Homo Sapiens
VHLEKTNKM

SEQ ID NO: 117066 - protein, 9 aa, Homo Sapiens
FITRTRTEH

SEQ ID NO: 117067 - protein, 9 aa, Homo Sapiens
EDAGHFHST

SEQ ID NO: 117068 - protein, 9 aa, Homo Sapiens
VCEQESNEC

SEQ ID NO: 117069 - protein, 9 aa, Homo Sapiens
AHWLGNNTA

SEQ ID NO: 117070 - protein, 9 aa, Homo Sapiens
KRFLPPDAF

SEQ ID NO: 117071 - protein, 9 aa, Homo Sapiens
VHPQVPPGW

SEQ ID NO: 117072 - protein, 9 aa, Homo Sapiens
PTALGPRLC

SEQ ID NO: 117073 - protein, 9 aa, Homo Sapiens
AKGWKPGLD

SEQ ID NO: 117074 - protein, 9 aa, Homo Sapiens
IPQPQGRKT

SEQ ID NO: 117075 - protein, 9 aa, Homo Sapiens
QRSGPGPND

SEQ ID NO: 117076 - protein, 9 aa, Homo Sapiens
CGKHFIRTS

SEQ ID NO: 117077 - protein, 9 aa, Homo Sapiens
KPGLDFAWN

SEQ ID NO: 117078 - protein, 9 aa, Homo Sapiens
LQRFDCNFD

SEQ ID NO: 117079 - protein, 9 aa, Homo Sapiens
SRRRGPGDP

SEQ ID NO: 117080 - protein, 9 aa, Homo Sapiens
RVAHTHACV

SEQ ID NO: 117081 - protein, 9 aa, Homo Sapiens
TPLRSAAPA

SEQ ID NO: 117082 - protein, 9 aa, Homo Sapiens
GQGSGVATG

SEQ ID NO: 117083 - protein, 9 aa, Homo Sapiens
CHCCSLPKR

SEQ ID NO: 117084 - protein, 9 aa, Homo Sapiens
QYGPVRHDN

SEQ ID NO: 117085 - protein, 9 aa, Homo Sapiens
VGSQNDFAD

SEQ ID NO: 117086 - protein, 9 aa, Homo Sapiens
KHFIRTSHL

SEQ ID NO: 117087 - protein, 9 aa, Homo Sapiens
AALTWSSAL

SEQ ID NO: 117088 - protein, 9 aa, Homo Sapiens
VSFTFGLCD

SEQ ID NO: 117089 - protein, 9 aa, Homo Sapiens
ASSSLPTAL

SEQ ID NO: 117090 - protein, 9 aa, Homo Sapiens
NSSSSSSGP

SEQ ID NO: 117091 - protein, 9 aa, Homo Sapiens
YPPLHRECC

SEQ ID NO: 117092 - protein, 9 aa, Homo Sapiens
TVHLEKTNK

SEQ ID NO: 117093 - protein, 9 aa, Homo Sapiens
GKTVGTENI

SEQ ID NO: 117094 - protein, 9 aa, Homo Sapiens
KDVGSQNDF

SEQ ID NO: 117095 - protein, 9 aa, Homo Sapiens
DKSIVICPL

SEQ ID NO: 117096 - protein, 9 aa, Homo Sapiens
AVEMYGSSF

SEQ ID NO: 117097 - protein, 9 aa, Homo Sapiens
RVKTWKHRW

SEQ ID NO: 117098 - protein, 9 aa, Homo Sapiens
ALGGGQGSG

SEQ ID NO: 117099 - protein, 8 aa, Homo Sapiens
RKSGTLSV

SEQ ID NO: 117100 - protein, 9 aa, Homo Sapiens
HSEDQSFIV

SEQ ID NO: 117101 - protein, 9 aa, Homo Sapiens
GGYELPDGS

SEQ ID NO: 117102 - protein, 9 aa, Homo Sapiens
GRGRVAHTH

SEQ ID NO: 117103 - protein, 9 aa, Homo Sapiens
DGGYELPDG

SEQ ID NO: 117104 - protein, 9 aa, Homo Sapiens
PQVPPGWPS

SEQ ID NO: 117105 - protein, 9 aa, Homo Sapiens
PASSSLPTA

SEQ ID NO: 117106 - protein, 9 aa, Homo Sapiens
HNGVLRVHP

SEQ ID NO: 117107 - protein, 9 aa, Homo Sapiens
ASFVVLMDI

SEQ ID NO: 117108 - protein, 9 aa, Homo Sapiens
RSKRGSKKR

SEQ ID NO: 117109 - protein, 9 aa, Homo Sapiens
MGKTVGTEN

SEQ ID NO: 117110 - protein, 9 aa, Homo Sapiens
VPWYSKACA

SEQ ID NO: 117111 - protein, 9 aa, Homo Sapiens
HTASFVVLM

SEQ ID NO: 117112 - protein, 9 aa, Homo Sapiens
THAVVGVAM

SEQ ID NO: 117113 - protein, 9 aa, Homo Sapiens
TLVGRHEPG

SEQ ID NO: 117114 - protein, 9 aa, Homo Sapiens
YPNTAPGET

SEQ ID NO: 117115 - protein, 9 aa, Homo Sapiens
FKNLKEKCF

SEQ ID NO: 117116 - protein, 9 aa, Homo Sapiens
KCGKHFIRT

SEQ ID NO: 117117 - protein, 9 aa, Homo Sapiens
VKRSAVEMY

SEQ ID NO: 117118 - protein, 9 aa, Homo Sapiens
DWTSGPPAC

SEQ ID NO: 117119 - protein, 9 aa, Homo Sapiens
RLCRGTEES

SEQ ID NO: 117120 - protein, 9 aa, Homo Sapiens
HINWVPPNA

SEQ ID NO: 117121 - protein, 9 aa, Homo Sapiens
CLSDWEGNV

SEQ ID NO: 117122 - protein, 9 aa, Homo Sapiens
KTNKMEWWS

SEQ ID NO: 117123 - protein, 9 aa, Homo Sapiens
FNGMLVVFL

SEQ ID NO: 117124 - protein, 9 aa, Homo Sapiens
ESRRRGPGD

SEQ ID NO: 117125 - protein, 9 aa, Homo Sapiens
DIEEATNQF

SEQ ID NO: 117126 - protein, 9 aa, Homo Sapiens
TEESRRRGP

SEQ ID NO: 117127 - protein, 9 aa, Homo Sapiens
GPPACCPSD

SEQ ID NO: 117128 - protein, 9 aa, Homo Sapiens
EQSVGGEEE

SEQ ID NO: 117129 - protein, 9 aa, Homo Sapiens
GASNVEFIT

SEQ ID NO: 117130 - protein, 9 aa, Homo Sapiens
FSVRAGYTG

SEQ ID NO: 117131 - protein, 9 aa, Homo Sapiens
PKGTFQEEM

SEQ ID NO: 117132 - protein, 9 aa, Homo Sapiens
SAAPASSSL

SEQ ID NO: 117133 - protein, 9 aa, Homo Sapiens
PACLQGLYE

SEQ ID NO: 117134 - protein, 9 aa, Homo Sapiens
LIRDGEKVK

SEQ ID NO: 117135 - protein, 9 aa, Homo Sapiens
YELPDGSGK

SEQ ID NO: 117136 - protein, 9 aa, Homo Sapiens
RSCVYPPPK

SEQ ID NO: 117137 - protein, 9 aa, Homo Sapiens
TGQEPAQCC

SEQ ID NO: 117138 - protein, 9 aa, Homo Sapiens
PRLCRGTEE

SEQ ID NO: 117139 - protein, 9 aa, Homo Sapiens
KVQKLRSDL

SEQ ID NO: 117140 - protein, 9 aa, Homo Sapiens
QREADEEEE

SEQ ID NO: 117141 - protein, 9 aa, Homo Sapiens
GGQGSGVAT

SEQ ID NO: 117142 - protein, 9 aa, Homo Sapiens
LPKGTFQEE

SEQ ID NO: 117143 - protein, 9 aa, Homo Sapiens
GNVCEQESN

SEQ ID NO: 117144 - protein, 9 aa, Homo Sapiens
EIQSLIPTD

SEQ ID NO: 117145 - protein, 9 aa, Homo Sapiens
GPGDPRHPS

SEQ ID NO: 117146 - protein, 9 aa, Homo Sapiens
SKCGKHFIR

SEQ ID NO: 117147 - protein, 9 aa, Homo Sapiens
RVHPQVPPG

SEQ ID NO: 117148 - protein, 9 aa, Homo Sapiens
WLGNNTASW

SEQ ID NO: 117149 - protein, 9 aa, Homo Sapiens
SRPPACLQG

SEQ ID NO: 117150 - protein, 9 aa, Homo Sapiens
WKHRWFILT

SEQ ID NO: 117151 - protein, 9 aa, Homo Sapiens
SFIVLKTDL

SEQ ID NO: 117152 - protein, 9 aa, Homo Sapiens
YGASNVEFI

SEQ ID NO: 117153 - protein, 9 aa, Homo Sapiens
TNFSIIDMS

SEQ ID NO: 117154 - protein, 9 aa, Homo Sapiens
RGSKKRQMS

SEQ ID NO: 117155 - protein, 9 aa, Homo Sapiens
RAGYTGEDC

SEQ ID NO: 117156 - protein, 9 aa, Homo Sapiens
IALLQRFDC

SEQ ID NO: 117157 - protein, 9 aa, Homo Sapiens
SSALGGGQG

SEQ ID NO: 117158 - protein, 9 aa, Homo Sapiens
CCSLPKRYI

SEQ ID NO: 117159 - protein, 9 aa, Homo Sapiens
EEGRGGVGG

SEQ ID NO: 117160 - protein, 9 aa, Homo Sapiens
TASFVVLMD

SEQ ID NO: 117161 - protein, 9 aa, Homo Sapiens
APFMAQEAS

SEQ ID NO: 117162 - protein, 9 aa, Homo Sapiens
EDQSFIVLK

SEQ ID NO: 117163 - protein, 9 aa, Homo Sapiens
YPQGYSLAL

SEQ ID NO: 117164 - protein, 9 aa, Homo Sapiens
TFQEEMLLW

SEQ ID NO: 117165 - protein, 9 aa, Homo Sapiens
QPRLDREIS

SEQ ID NO: 117166 - protein, 9 aa, Homo Sapiens
YKRFLPPDA

SEQ ID NO: 117167 - protein, 9 aa, Homo Sapiens
GVKRSAVEM

SEQ ID NO: 117168 - protein, 9 aa, Homo Sapiens
PPSSGESVA

SEQ ID NO: 117169 - protein, 9 aa, Homo Sapiens
GRGGVGGGG

SEQ ID NO: 117170 - protein, 9 aa, Homo Sapiens
KHRWFILTD

SEQ ID NO: 117171 - protein, 9 aa, Homo Sapiens
CLQGLYELM

SEQ ID NO: 117172 - protein, 9 aa, Homo Sapiens
VPPGWPSRR

SEQ ID NO: 117173 - protein, 9 aa, Homo Sapiens
IPNGFNGML

SEQ ID NO: 117174 - protein, 9 aa, Homo Sapiens
NKFSYPPLH

SEQ ID NO: 117175 - protein, 9 aa, Homo Sapiens
SHTASFVVL

SEQ ID NO: 117176 - protein, 9 aa, Homo Sapiens
LLPGDRPDH

SEQ ID NO: 117177 - protein, 9 aa, Homo Sapiens
RNPEHRALC

SEQ ID NO: 117178 - protein, 9 aa, Homo Sapiens
LQDNHINWV

SEQ ID NO: 117179 - protein, 9 aa, Homo Sapiens
NRAAELRQD

SEQ ID NO: 117180 - protein, 9 aa, Homo Sapiens
PSSGESVAP

SEQ ID NO: 117181 - protein, 9 aa, Homo Sapiens
RAKDVGSQN

SEQ ID NO: 117182 - protein, 9 aa, Homo Sapiens
CQPRLDREI

SEQ ID NO: 117183 - protein, 9 aa, Homo Sapiens
FVVLMDISR

SEQ ID NO: 117184 - protein, 9 aa, Homo Sapiens
RGGVGGGGA

SEQ ID NO: 117185 - protein, 9 aa, Homo Sapiens
TAPLGTLRA

SEQ ID NO: 117186 - protein, 9 aa, Homo Sapiens
FQEEMLLWR

SEQ ID NO: 117187 - protein, 9 aa, Homo Sapiens
QEEMLLWRR

SEQ ID NO: 117188 - protein, 9 aa, Homo Sapiens
GYTGEDCPK

SEQ ID NO: 117189 - protein, 9 aa, Homo Sapiens
FLLTNFSII

SEQ ID NO: 117190 - protein, 9 aa, Homo Sapiens
VLRVHPQVP

SEQ ID NO: 117191 - protein, 9 aa, Homo Sapiens
TKMHILHVL

SEQ ID NO: 117192 - protein, 9 aa, Homo Sapiens
PRHPSRAAA

SEQ ID NO: 117193 - protein, 9 aa, Homo Sapiens
SDGGYELPD

SEQ ID NO: 117194 - protein, 9 aa, Homo Sapiens
PPPPSSGES

SEQ ID NO: 117195 - protein, 9 aa, Homo Sapiens
AGHFHSTKK

SEQ ID NO: 117196 - protein, 9 aa, Homo Sapiens
LSDWEGNVC

SEQ ID NO: 117197 - protein, 9 aa, Homo Sapiens
AGVKRSAVE

SEQ ID NO: 117198 - protein, 9 aa, Homo Sapiens
IVICPLEPQ

SEQ ID NO: 117199 - protein, 9 aa, Homo Sapiens
DPDMLHNSY

SEQ ID NO: 117200 - protein, 9 aa, Homo Sapiens
HAVVGVAMA

SEQ ID NO: 117201 - protein, 9 aa, Homo Sapiens
GGELLPGDR

SEQ ID NO: 117202 - protein, 9 aa, Homo Sapiens
CSLPKRYII

SEQ ID NO: 117203 - protein, 9 aa, Homo Sapiens
RSAAPASSS

SEQ ID NO: 117204 - protein, 9 aa, Homo Sapiens
WVPPNAFSY

SEQ ID NO: 117205 - protein, 9 aa, Homo Sapiens
SWQFDTVSG

SEQ ID NO: 117206 - protein, 9 aa, Homo Sapiens
SVFIALLQR

SEQ ID NO: 117207 - protein, 9 aa, Homo Sapiens
AELRQDFNL

SEQ ID NO: 117208 - protein, 9 aa, Homo Sapiens
REKERNPEH

SEQ ID NO: 117209 - protein, 9 aa, Homo Sapiens
VHIIEELQM

SEQ ID NO: 117210 - protein, 9 aa, Homo Sapiens
AENKQQFKN

SEQ ID NO: 117211 - protein, 9 aa, Homo Sapiens
LQFQADPDM

SEQ ID NO: 117212 - protein, 9 aa, Homo Sapiens
IVLKTDLGR

SEQ ID NO: 117213 - protein, 9 aa, Homo Sapiens
SNVEFITRT

SEQ ID NO: 117214 - protein, 9 aa, Homo Sapiens
MLHNSYALH

SEQ ID NO: 117215 - protein, 9 aa, Homo Sapiens
QPLAFSFVE

SEQ ID NO: 117216 - protein, 9 aa, Homo Sapiens
GYELPDGSG

SEQ ID NO: 117217 - protein, 9 aa, Homo Sapiens
QWNIPQRSG

SEQ ID NO: 117218 - protein, 9 aa, Homo Sapiens
TEHNGVLRV

SEQ ID NO: 117219 - protein, 9 aa, Homo Sapiens
TAPGETPLR

SEQ ID NO: 117220 - protein, 9 aa, Homo Sapiens
AVVGVAMAR

SEQ ID NO: 117221 - protein, 9 aa, Homo Sapiens
TECDTKMHI

SEQ ID NO: 117222 - protein, 9 aa, Homo Sapiens
LDKSIVICP

SEQ ID NO: 117223 - protein, 9 aa, Homo Sapiens
ENKQQFKNL

SEQ ID NO: 117224 - protein, 9 aa, Homo Sapiens
ELLPGDRPD

SEQ ID NO: 117225 - protein, 9 aa, Homo Sapiens
SSSLPTALG

SEQ ID NO: 117226 - protein, 9 aa, Homo Sapiens
AKVQKLRSD

SEQ ID NO: 117227 - protein, 9 aa, Homo Sapiens
EGNVCEQES

SEQ ID NO: 117228 - protein, 9 aa, Homo Sapiens
PNTAPGETP

SEQ ID NO: 117229 - protein, 9 aa, Homo Sapiens
VGRHEPGGQ

SEQ ID NO: 117230 - protein, 9 aa, Homo Sapiens
CDCHCCSLP

SEQ ID NO: 117231 - protein, 9 aa, Homo Sapiens
WTSGPPACC

SEQ ID NO: 117232 - protein, 9 aa, Homo Sapiens
ELRQDFNLM

SEQ ID NO: 117233 - protein, 9 aa, Homo Sapiens
FSYPPLHRE

SEQ ID NO: 117234 - protein, 9 aa, Homo Sapiens
LASKRTDGA

SEQ ID NO: 117235 - protein, 9 aa, Homo Sapiens
FGRPIAMLA

SEQ ID NO: 117236 - protein, 9 aa, Homo Sapiens
IILSHHQGL

SEQ ID NO: 117237 - protein, 9 aa, Homo Sapiens
AWVWAYRHI

SEQ ID NO: 117238 - protein, 9 aa, Homo Sapiens
KILVIAIMF

SEQ ID NO: 117239 - protein, 9 aa, Homo Sapiens
IVQLTIQTG

SEQ ID NO: 117240 - protein, 9 aa, Homo Sapiens
QAWVWAYRH

SEQ ID NO: 117241 - protein, 9 aa, Homo Sapiens
APRAVLKGH

SEQ ID NO: 117242 - protein, 9 aa, Homo Sapiens
EKPPTPLQF

SEQ ID NO: 117243 - protein, 9 aa, Homo Sapiens
GRLQPILES

SEQ ID NO: 117244 - protein, 9 aa, Homo Sapiens
DLNRNHPLE

SEQ ID NO: 117245 - protein, 9 aa, Homo Sapiens
SYLEDVRLI

SEQ ID NO: 117246 - protein, 9 aa, Homo Sapiens
DAGQAECSF

SEQ ID NO: 117247 - protein, 9 aa, Homo Sapiens
KRTIPRRIA

SEQ ID NO: 117248 - protein, 9 aa, Homo Sapiens
NLTSVTKNC

SEQ ID NO: 117249 - protein, 9 aa, Homo Sapiens
IEARSRDLR

SEQ ID NO: 117250 - protein, 9 aa, Homo Sapiens
CVKTGGEPA

SEQ ID NO: 117251 - protein, 9 aa, Homo Sapiens
NLLVMFVII

SEQ ID NO: 117252 - protein, 9 aa, Homo Sapiens
IRYLMLFNY

SEQ ID NO: 117253 - protein, 9 aa, Homo Sapiens
GEKPPTPLQ

SEQ ID NO: 117254 - protein, 9 aa, Homo Sapiens
AECSFQVTV

SEQ ID NO: 117255 - protein, 9 aa, Homo Sapiens
CPCPYSEIP

SEQ ID NO: 117256 - protein, 9 aa, Homo Sapiens
QTRLQRQIS

SEQ ID NO: 117257 - protein, 9 aa, Homo Sapiens
LGKGAFLVV

SEQ ID NO: 117258 - protein, 9 aa, Homo Sapiens
FRHIRKTID

SEQ ID NO: 117259 - protein, 9 aa, Homo Sapiens
MQHHTQSIK

SEQ ID NO: 117260 - protein, 9 aa, Homo Sapiens
WGFDGLAGL

SEQ ID NO: 117261 - protein, 9 aa, Homo Sapiens
INMPSSSHG

SEQ ID NO: 117262 - protein, 9 aa, Homo Sapiens
MKEQILELL

SEQ ID NO: 117263 - protein, 9 aa, Homo Sapiens
SVIVLEKSG

SEQ ID NO: 117264 - protein, 9 aa, Homo Sapiens
QVLSTTVKS

SEQ ID NO: 117265 - protein, 9 aa, Homo Sapiens
QVTQLFREY

SEQ ID NO: 117266 - protein, 9 aa, Homo Sapiens
HGVLHRDLK

SEQ ID NO: 117267 - protein, 9 aa, Homo Sapiens
DFRHIRKTI

SEQ ID NO: 117268 - protein, 9 aa, Homo Sapiens
VDLDIPQDS

SEQ ID NO: 117269 - protein, 9 aa, Homo Sapiens
LEGDSVASK

SEQ ID NO: 117270 - protein, 9 aa, Homo Sapiens
ETCLGDARF

SEQ ID NO: 117271 - protein, 9 aa, Homo Sapiens
GMLYVTNGY

SEQ ID NO: 117272 - protein, 9 aa, Homo Sapiens
MERAKAMRE

SEQ ID NO: 117273 - protein, 9 aa, Homo Sapiens
DTDVPEEEE

SEQ ID NO: 117274 - protein, 9 aa, Homo Sapiens
GRTMYNTFR

SEQ ID NO: 117275 - protein, 9 aa, Homo Sapiens
SRKITKNFS

SEQ ID NO: 117276 - protein, 9 aa, Homo Sapiens
TVVGLDLET

SEQ ID NO: 117277 - protein, 9 aa, Homo Sapiens
TLGRRSMCK

SEQ ID NO: 117278 - protein, 9 aa, Homo Sapiens
VTKNCADKN

SEQ ID NO: 117279 - protein, 9 aa, Homo Sapiens
FQVTVDDAP

SEQ ID NO: 117280 - protein, 9 aa, Homo Sapiens
KVSKVEHEK

SEQ ID NO: 117281 - protein, 9 aa, Homo Sapiens
GADGVGKSA

SEQ ID NO: 117282 - protein, 9 aa, Homo Sapiens
PSLASLCPV

SEQ ID NO: 117283 - protein, 9 aa, Homo Sapiens
DWGFDGLAG

SEQ ID NO: 117284 - protein, 9 aa, Homo Sapiens
LKWKLPQEL

SEQ ID NO: 117285 - protein, 9 aa, Homo Sapiens
RIIQLVRDP

SEQ ID NO: 117286 - protein, 9 aa, Homo Sapiens
QHIVQLIQD

SEQ ID NO: 117287 - protein, 9 aa, Homo Sapiens
WCGSECPVA

SEQ ID NO: 117288 - protein, 9 aa, Homo Sapiens
MPQMYKRKR

SEQ ID NO: 117289 - protein, 9 aa, Homo Sapiens
SDGSDTSMP

SEQ ID NO: 117290 - protein, 9 aa, Homo Sapiens
FLTVGFMQH

SEQ ID NO: 117291 - protein, 9 aa, Homo Sapiens
THEFHKSPS

SEQ ID NO: 117292 - protein, 9 aa, Homo Sapiens
PTVMVHSPI

SEQ ID NO: 117293 - protein, 9 aa, Homo Sapiens
MCKHAEKER

SEQ ID NO: 117294 - protein, 9 aa, Homo Sapiens
ARSRDLRRR

SEQ ID NO: 117295 - protein, 9 aa, Homo Sapiens
SLASLCPVR

SEQ ID NO: 117296 - protein, 9 aa, Homo Sapiens
QSRAKITNN

SEQ ID NO: 117297 - protein, 9 aa, Homo Sapiens
TYGLCMQTA

SEQ ID NO: 117298 - protein, 9 aa, Homo Sapiens
TSPVRLASR

SEQ ID NO: 117299 - protein, 9 aa, Homo Sapiens
IICGMLYVT

SEQ ID NO: 117300 - protein, 9 aa, Homo Sapiens
SGQAWVWAY

SEQ ID NO: 117301 - protein, 9 aa, Homo Sapiens
TKDTMPQMY

SEQ ID NO: 117302 - protein, 9 aa, Homo Sapiens
HLSFCASNI

SEQ ID NO: 117303 - protein, 9 aa, Homo Sapiens
QRNLAHFPA

SEQ ID NO: 117304 - protein, 9 aa, Homo Sapiens
RSRKITKNF

SEQ ID NO: 117305 - protein, 9 aa, Homo Sapiens
AQSGVVFVQ

SEQ ID NO: 117306 - protein, 9 aa, Homo Sapiens
STSPVRLAS

SEQ ID NO: 117307 - protein, 9 aa, Homo Sapiens
VCMGGKRRR

SEQ ID NO: 117308 - protein, 9 aa, Homo Sapiens
QLVRASLVQ

SEQ ID NO: 117309 - protein, 9 aa, Homo Sapiens
AYRHIGEER

SEQ ID NO: 117310 - protein, 9 aa, Homo Sapiens
WTAPSTSQN

SEQ ID NO: 117311 - protein, 9 aa, Homo Sapiens
WAYRHIGEE

SEQ ID NO: 117312 - protein, 9 aa, Homo Sapiens
AHLSFCASN

SEQ ID NO: 117313 - protein, 9 aa, Homo Sapiens
LHTVLIAHL

SEQ ID NO: 117314 - protein, 9 aa, Homo Sapiens
LFVSELKSY

SEQ ID NO: 117315 - protein, 9 aa, Homo Sapiens
RLDLRIIQL

SEQ ID NO: 117316 - protein, 9 aa, Homo Sapiens
TAGSDVPER

SEQ ID NO: 117317 - protein, 9 aa, Homo Sapiens
FSGQSRAKI

SEQ ID NO: 117318 - protein, 9 aa, Homo Sapiens
DCETQSHYS

SEQ ID NO: 117319 - protein, 9 aa, Homo Sapiens
SLDCETQSH

SEQ ID NO: 117320 - protein, 9 aa, Homo Sapiens
AALSVLGKR

SEQ ID NO: 117321 - protein, 9 aa, Homo Sapiens
KRMKPLHIQ

SEQ ID NO: 117322 - protein, 9 aa, Homo Sapiens
RVCGGTELV

SEQ ID NO: 117323 - protein, 9 aa, Homo Sapiens
RLQRQISDI

SEQ ID NO: 117324 - protein, 9 aa, Homo Sapiens
QLFREYLLE

SEQ ID NO: 117325 - protein, 9 aa, Homo Sapiens
VTQLFREYL

SEQ ID NO: 117326 - protein, 9 aa, Homo Sapiens
HSHGVLHRD

SEQ ID NO: 117327 - protein, 9 aa, Homo Sapiens
ELYSKDPWH

SEQ ID NO: 117328 - protein, 9 aa, Homo Sapiens
CMEELFDFL

SEQ ID NO: 117329 - protein, 9 aa, Homo Sapiens
VKLPMVPHA

SEQ ID NO: 117330 - protein, 9 aa, Homo Sapiens
KVEHEKNQE

SEQ ID NO: 117331 - protein, 9 aa, Homo Sapiens
RSLHHHVNV

SEQ ID NO: 117332 - protein, 9 aa, Homo Sapiens
TPLQFHLLR

SEQ ID NO: 117333 - protein, 9 aa, Homo Sapiens
DPRLDLRII

SEQ ID NO: 117334 - protein, 9 aa, Homo Sapiens
VLQAFHSVG

SEQ ID NO: 117335 - protein, 9 aa, Homo Sapiens
VNKPGVYTG

SEQ ID NO: 117336 - protein, 9 aa, Homo Sapiens
RPVSSEVRS

SEQ ID NO: 117337 - protein, 9 aa, Homo Sapiens
TVSSEAFSL

SEQ ID NO: 117338 - protein, 9 aa, Homo Sapiens
HIKKPLNVF

SEQ ID NO: 117339 - protein, 9 aa, Homo Sapiens
IVEAHVCAQ

SEQ ID NO: 117340 - protein, 9 aa, Homo Sapiens
GVFRVCHCN

SEQ ID NO: 117341 - protein, 9 aa, Homo Sapiens
EEDCMEELF

SEQ ID NO: 117342 - protein, 9 aa, Homo Sapiens
SSEVRSRKI

SEQ ID NO: 117343 - protein, 9 aa, Homo Sapiens
GQAWVWAYR

SEQ ID NO: 117344 - protein, 9 aa, Homo Sapiens
SEAFSLLEE

SEQ ID NO: 117345 - protein, 9 aa, Homo Sapiens
AGQAECSFQ

SEQ ID NO: 117346 - protein, 9 aa, Homo Sapiens
CSPYYFQCK

SEQ ID NO: 117347 - protein, 9 aa, Homo Sapiens
TPSTRVCGG

SEQ ID NO: 117348 - protein, 9 aa, Homo Sapiens
QDVKDPEDF

SEQ ID NO: 117349 - protein, 9 aa, Homo Sapiens
SEAMLVDVN

SEQ ID NO: 117350 - protein, 9 aa, Homo Sapiens
AANMAPKFL

SEQ ID NO: 117351 - protein, 9 aa, Homo Sapiens
TGEVRTAHT

SEQ ID NO: 117352 - protein, 9 aa, Homo Sapiens
STRVCGGTE

SEQ ID NO: 117353 - protein, 9 aa, Homo Sapiens
LQMDFLVHP

SEQ ID NO: 117354 - protein, 9 aa, Homo Sapiens
PRRVCMGGK

SEQ ID NO: 117355 - protein, 9 aa, Homo Sapiens
VKNLVVKVH

SEQ ID NO: 117356 - protein, 9 aa, Homo Sapiens
VRLASRQED

SEQ ID NO: 117357 - protein, 9 aa, Homo Sapiens
GPSKLLLPH

SEQ ID NO: 117358 - protein, 9 aa, Homo Sapiens
TNSSINMPS

SEQ ID NO: 117359 - protein, 9 aa, Homo Sapiens
GTDDKSIYG

SEQ ID NO: 117360 - protein, 9 aa, Homo Sapiens
SLSFPIRHD

SEQ ID NO: 117361 - protein, 9 aa, Homo Sapiens
KRFLPNDHG

SEQ ID NO: 117362 - protein, 9 aa, Homo Sapiens
VIVQLTIQT

SEQ ID NO: 117363 - protein, 9 aa, Homo Sapiens
LDIHKRMKP

SEQ ID NO: 117364 - protein, 9 aa, Homo Sapiens
ESLAAIEQH

SEQ ID NO: 117365 - protein, 9 aa, Homo Sapiens
EHSRALEEE

SEQ ID NO: 117366 - protein, 9 aa, Homo Sapiens
SDMDTDVPE

SEQ ID NO: 117367 - protein, 9 aa, Homo Sapiens
QIQRNLAHF

SEQ ID NO: 117368 - protein, 9 aa, Homo Sapiens
LLTKALSGP

SEQ ID NO: 117369 - protein, 9 aa, Homo Sapiens
NEHLFVSEL

SEQ ID NO: 117370 - protein, 9 aa, Homo Sapiens
QAECSFQVT

SEQ ID NO: 117371 - protein, 9 aa, Homo Sapiens
LPTVMVHSP

SEQ ID NO: 117372 - protein, 9 aa, Homo Sapiens
FSVSTPNAG

SEQ ID NO: 117373 - protein, 9 aa, Homo Sapiens
KDPEDFFTE

SEQ ID NO: 117374 - protein, 9 aa, Homo Sapiens
VEESVPVIV

SEQ ID NO: 117375 - protein, 9 aa, Homo Sapiens
HIRKTIDTL

SEQ ID NO: 117376 - protein, 9 aa, Homo Sapiens
PSTRVCGGT

SEQ ID NO: 117377 - protein, 9 aa, Homo Sapiens
FLNLKSLGL

SEQ ID NO: 117378 - protein, 9 aa, Homo Sapiens
GIEARSRDL

SEQ ID NO: 117379 - protein, 9 aa, Homo Sapiens
RQPGMLCSF

SEQ ID NO: 117380 - protein, 9 aa, Homo Sapiens
KHLQMLPLQ

SEQ ID NO: 117381 - protein, 9 aa, Homo Sapiens
RLTSSHVHA

SEQ ID NO: 117382 - protein, 9 aa, Homo Sapiens
TGMDWTGAR

SEQ ID NO: 117383 - protein, 9 aa, Homo Sapiens
EVRTAHTLG

SEQ ID NO: 117384 - protein, 9 aa, Homo Sapiens
SWLCESLVV

SEQ ID NO: 117385 - protein, 9 aa, Homo Sapiens
EDMLQAPKV

SEQ ID NO: 117386 - protein, 9 aa, Homo Sapiens
RETADTQAC

SEQ ID NO: 117387 - protein, 9 aa, Homo Sapiens
RHDDGSWEV

SEQ ID NO: 117388 - protein, 9 aa, Homo Sapiens
AAGSEAMLV

SEQ ID NO: 117389 - protein, 9 aa, Homo Sapiens
LLHTVLIAH

SEQ ID NO: 117390 - protein, 9 aa, Homo Sapiens
LPNDHGKNA

SEQ ID NO: 117391 - protein, 9 aa, Homo Sapiens
MLVDVNVYL

SEQ ID NO: 117392 - protein, 9 aa, Homo Sapiens
YGLCMQTAP

SEQ ID NO: 117393 - protein, 9 aa, Homo Sapiens
KNLVVKVHM

SEQ ID NO: 117394 - protein, 9 aa, Homo Sapiens
FYLNCCDCC

SEQ ID NO: 117395 - protein, 9 aa, Homo Sapiens
LCESLVVPS

SEQ ID NO: 117396 - protein, 9 aa, Homo Sapiens
KTHIEMVIN

SEQ ID NO: 117397 - protein, 9 aa, Homo Sapiens
LQAPKVHAS

SEQ ID NO: 117398 - protein, 9 aa, Homo Sapiens
RTAGSDVPE

SEQ ID NO: 117399 - protein, 9 aa, Homo Sapiens
RPELHMKEQ

SEQ ID NO: 117400 - protein, 9 aa, Homo Sapiens
SEKTAKGVV

SEQ ID NO: 117401 - protein, 9 aa, Homo Sapiens
QRTAGSDVP

SEQ ID NO: 117402 - protein, 9 aa, Homo Sapiens
KPPTPLQFH

SEQ ID NO: 117403 - protein, 9 aa, Homo Sapiens
RTAHTLGDR

SEQ ID NO: 117404 - protein, 9 aa, Homo Sapiens
SEVRSRKIT

SEQ ID NO: 117405 - protein, 9 aa, Homo Sapiens
AMLVDVNVY

SEQ ID NO: 117406 - protein, 9 aa, Homo Sapiens
LHMTELLNR

SEQ ID NO: 117407 - protein, 9 aa, Homo Sapiens
LTVGFMQHH

SEQ ID NO: 117408 - protein, 9 aa, Homo Sapiens
SPRCPYQFR

SEQ ID NO: 117409 - protein, 9 aa, Homo Sapiens
LSLSFPIRH

SEQ ID NO: 117410 - protein, 9 aa, Homo Sapiens
SLHHHVNVM

SEQ ID NO: 117411 - protein, 9 aa, Homo Sapiens
PYFNPPEKK

SEQ ID NO: 117412 - protein, 9 aa, Homo Sapiens
MTTTAFPTM

SEQ ID NO: 117413 - protein, 9 aa, Homo Sapiens
NVLQQRQLK

SEQ ID NO: 117414 - protein, 9 aa, Homo Sapiens
KENEEHSRA

SEQ ID NO: 117415 - protein, 9 aa, Homo Sapiens
TDMLSADDI

SEQ ID NO: 117416 - protein, 9 aa, Homo Sapiens
GIIRTAWRL

SEQ ID NO: 117417 - protein, 9 aa, Homo Sapiens
TIPRRIADQ

SEQ ID NO: 117418 - protein, 9 aa, Homo Sapiens
HLTLESRER

SEQ ID NO: 117419 - protein, 9 aa, Homo Sapiens
VLPSLGASS

SEQ ID NO: 117420 - protein, 9 aa, Homo Sapiens
GEVRTAHTL

SEQ ID NO: 117421 - protein, 9 aa, Homo Sapiens
ANMAPKFLA

SEQ ID NO: 117422 - protein, 9 aa, Homo Sapiens
LLQSQLYWT

SEQ ID NO: 117423 - protein, 9 aa, Homo Sapiens
NLAHFPAVD

SEQ ID NO: 117424 - protein, 9 aa, Homo Sapiens
SECPVADNE

SEQ ID NO: 117425 - protein, 9 aa, Homo Sapiens
HMTELLNRG

SEQ ID NO: 117426 - protein, 9 aa, Homo Sapiens
NSCSPYYFQ

SEQ ID NO: 117427 - protein, 9 aa, Homo Sapiens
RNRNQHIVQ

SEQ ID NO: 117428 - protein, 9 aa, Homo Sapiens
SINMPSSSH

SEQ ID NO: 117429 - protein, 9 aa, Homo Sapiens
TRVCGGTEL

SEQ ID NO: 117430 - protein, 9 aa, Homo Sapiens
FVLSNGLLY

SEQ ID NO: 117431 - protein, 9 aa, Homo Sapiens
TMYNTFRAA

SEQ ID NO: 117432 - protein, 9 aa, Homo Sapiens
KEAKVKNLV

SEQ ID NO: 117433 - protein, 9 aa, Homo Sapiens
VFMLYMKEM

SEQ ID NO: 117434 - protein, 9 aa, Homo Sapiens
RRAVEKRTI

SEQ ID NO: 117435 - protein, 9 aa, Homo Sapiens
VRLIHRDLA

SEQ ID NO: 117436 - protein, 9 aa, Homo Sapiens
SVAANMAPK

SEQ ID NO: 117437 - protein, 9 aa, Homo Sapiens
IVLEKSGPP

SEQ ID NO: 117438 - protein, 9 aa, Homo Sapiens
GQVLSPRYP

SEQ ID NO: 117439 - protein, 9 aa, Homo Sapiens
LPMVPHAEC

SEQ ID NO: 117440 - protein, 9 aa, Homo Sapiens
PQELYSKDP

SEQ ID NO: 117441 - protein, 9 aa, Homo Sapiens
SKVSKVEHE

SEQ ID NO: 117442 - protein, 9 aa, Homo Sapiens
MAPKFLANM

SEQ ID NO: 117443 - protein, 9 aa, Homo Sapiens
GFDVTMKYT

SEQ ID NO: 117444 - protein, 9 aa, Homo Sapiens
SHVHAALPL

SEQ ID NO: 117445 - protein, 9 aa, Homo Sapiens
GKNAMMRKA

SEQ ID NO: 117446 - protein, 9 aa, Homo Sapiens
GKGAFLVVR

SEQ ID NO: 117447 - protein, 9 aa, Homo Sapiens
AVLKGHDHE

SEQ ID NO: 117448 - protein, 9 aa, Homo Sapiens
PKGDWGFDG

SEQ ID NO: 117449 - protein, 9 aa, Homo Sapiens
SLVQPQTLL

SEQ ID NO: 117450 - protein, 9 aa, Homo Sapiens
FPTMQRPWT

SEQ ID NO: 117451 - protein, 9 aa, Homo Sapiens
GLHWWNHID

SEQ ID NO: 117452 - protein, 9 aa, Homo Sapiens
LQAFHSVGS

SEQ ID NO: 117453 - protein, 9 aa, Homo Sapiens
PYYFQCKTT

SEQ ID NO: 117454 - protein, 9 aa, Homo Sapiens
NVFMLYMKE

SEQ ID NO: 117455 - protein, 9 aa, Homo Sapiens
PLEPPKKGL

SEQ ID NO: 117456 - protein, 9 aa, Homo Sapiens
TQLNTDGAL

SEQ ID NO: 117457 - protein, 9 aa, Homo Sapiens
LRRAVEKRT

SEQ ID NO: 117458 - protein, 9 aa, Homo Sapiens
PSIVHCKCF

SEQ ID NO: 117459 - protein, 9 aa, Homo Sapiens
PNGTDDKSI

SEQ ID NO: 117460 - protein, 9 aa, Homo Sapiens
LSSCVRTGR

SEQ ID NO: 117461 - protein, 9 aa, Homo Sapiens
RTMYNTFRA

SEQ ID NO: 117462 - protein, 9 aa, Homo Sapiens
SHHQGLSII

SEQ ID NO: 117463 - protein, 9 aa, Homo Sapiens
VLQSKNCTY

SEQ ID NO: 117464 - protein, 9 aa, Homo Sapiens
GGAPCTAIR

SEQ ID NO: 117465 - protein, 9 aa, Homo Sapiens
VFVQRAFDH

SEQ ID NO: 117466 - protein, 9 aa, Homo Sapiens
GVVVSLTLG

SEQ ID NO: 117467 - protein, 9 aa, Homo Sapiens
AAPGEKPPT

SEQ ID NO: 117468 - protein, 9 aa, Homo Sapiens
RLEHEGGAP

SEQ ID NO: 117469 - protein, 9 aa, Homo Sapiens
QSQLYWTHQ

SEQ ID NO: 117470 - protein, 9 aa, Homo Sapiens
KSKVSKVEH

SEQ ID NO: 117471 - protein, 9 aa, Homo Sapiens
YLEDVRLIH

SEQ ID NO: 117472 - protein, 9 aa, Homo Sapiens
DCMEELFDF

SEQ ID NO: 117473 - protein, 9 aa, Homo Sapiens
NRVPRATTS

SEQ ID NO: 117474 - protein, 9 aa, Homo Sapiens
DDKSIYGEK

SEQ ID NO: 117475 - protein, 9 aa, Homo Sapiens
CTKGFLEKK

SEQ ID NO: 117476 - protein, 9 aa, Homo Sapiens
LQPILESFP

SEQ ID NO: 117477 - protein, 9 aa, Homo Sapiens
VGLDLETTA

SEQ ID NO: 117478 - protein, 9 aa, Homo Sapiens
DTGIIRTAW

SEQ ID NO: 117479 - protein, 9 aa, Homo Sapiens
IMFQVCIGC

SEQ ID NO: 117480 - protein, 9 aa, Homo Sapiens
MGKNAMMRK

SEQ ID NO: 117481 - protein, 9 aa, Homo Sapiens
EMAENEERE

SEQ ID NO: 117482 - protein, 9 aa, Homo Sapiens
EFLKCLNPY

SEQ ID NO: 117483 - protein, 9 aa, Homo Sapiens
VLCRGVEIL

SEQ ID NO: 117484 - protein, 9 aa, Homo Sapiens
LPQELYSKD

SEQ ID NO: 117485 - protein, 9 aa, Homo Sapiens
RKTIDTLLA

SEQ ID NO: 117486 - protein, 9 aa, Homo Sapiens
NVLPSLGAS

SEQ ID NO: 117487 - protein, 9 aa, Homo Sapiens
VLSNGLLYY

SEQ ID NO: 117488 - protein, 9 aa, Homo Sapiens
KGVVVSLTL

SEQ ID NO: 117489 - protein, 9 aa, Homo Sapiens
EQHQETCLG

SEQ ID NO: 117490 - protein, 9 aa, Homo Sapiens
LVVEKSLDC

SEQ ID NO: 117491 - protein, 9 aa, Homo Sapiens
SQAGAFSVS

SEQ ID NO: 117492 - protein, 9 aa, Homo Sapiens
LEKSGPPVG

SEQ ID NO: 117493 - protein, 9 aa, Homo Sapiens
DVKDPEDFF

SEQ ID NO: 117494 - protein, 9 aa, Homo Sapiens
VLILGAVLL

SEQ ID NO: 117495 - protein, 9 aa, Homo Sapiens
FTLDPADFY

SEQ ID NO: 117496 - protein, 9 aa, Homo Sapiens
DPADFYLNC

SEQ ID NO: 117497 - protein, 9 aa, Homo Sapiens
STSQNCDEP

SEQ ID NO: 117498 - protein, 9 aa, Homo Sapiens
KSLGLRLHY

SEQ ID NO: 117499 - protein, 9 aa, Homo Sapiens
FVFSGQSRA

SEQ ID NO: 117500 - protein, 9 aa, Homo Sapiens
VRSRKITKN

SEQ ID NO: 117501 - protein, 9 aa, Homo Sapiens
GSECPVADN

SEQ ID NO: 117502 - protein, 9 aa, Homo Sapiens
SAAALSVLG

SEQ ID NO: 117503 - protein, 9 aa, Homo Sapiens
VQLTIQTGS

SEQ ID NO: 117504 - protein, 9 aa, Homo Sapiens
PEDFFTEGC

SEQ ID NO: 117505 - protein, 9 aa, Homo Sapiens
GLAFCHSHG

SEQ ID NO: 117506 - protein, 9 aa, Homo Sapiens
FWKLDTLQT

SEQ ID NO: 117507 - protein, 9 aa, Homo Sapiens
DLSPRCPYQ

SEQ ID NO: 117508 - protein, 9 aa, Homo Sapiens
DLETTAAYM

SEQ ID NO: 117509 - protein, 9 aa, Homo Sapiens
LMVGLHWWN

SEQ ID NO: 117510 - protein, 9 aa, Homo Sapiens
DVTMKYTQG

SEQ ID NO: 117511 - protein, 9 aa, Homo Sapiens
GLDLETTAA

SEQ ID NO: 117512 - protein, 9 aa, Homo Sapiens
QLPQVLHMT

SEQ ID NO: 117513 - protein, 9 aa, Homo Sapiens
LQPVPLGGQ

SEQ ID NO: 117514 - protein, 9 aa, Homo Sapiens
EHGGQARRH

SEQ ID NO: 117515 - protein, 9 aa, Homo Sapiens
TYYILPRKV

SEQ ID NO: 117516 - protein, 9 aa, Homo Sapiens
NGTDDKSIY

SEQ ID NO: 117517 - protein, 9 aa, Homo Sapiens
GGQARRHRG

SEQ ID NO: 117518 - protein, 9 aa, Homo Sapiens
PELHMKEQI

SEQ ID NO: 117519 - protein, 9 aa, Homo Sapiens
LASRQEDAP

SEQ ID NO: 117520 - protein, 9 aa, Homo Sapiens
RQLKHLCTI

SEQ ID NO: 117521 - protein, 9 aa, Homo Sapiens
PRCPYQFRV

SEQ ID NO: 117522 - protein, 9 aa, Homo Sapiens
YNGEGRTAR

SEQ ID NO: 117523 - protein, 9 aa, Homo Sapiens
SVLPESAHW

SEQ ID NO: 117524 - protein, 9 aa, Homo Sapiens
SAQSGVVFV

SEQ ID NO: 117525 - protein, 9 aa, Homo Sapiens
NEEREIKCY

SEQ ID NO: 117526 - protein, 9 aa, Homo Sapiens
GSDVPEREL

SEQ ID NO: 117527 - protein, 9 aa, Homo Sapiens
GAFLVVRRC

SEQ ID NO: 117528 - protein, 9 aa, Homo Sapiens
QSKNCTYGL

SEQ ID NO: 117529 - protein, 9 aa, Homo Sapiens
LLYYRSKAE

SEQ ID NO: 117530 - protein, 9 aa, Homo Sapiens
GLSIINYDD

SEQ ID NO: 117531 - protein, 9 aa, Homo Sapiens
IRHDDGSWE

SEQ ID NO: 117532 - protein, 9 aa, Homo Sapiens
VSSEAFSLL

SEQ ID NO: 117533 - protein, 9 aa, Homo Sapiens
LDLRIIQLV

SEQ ID NO: 117534 - protein, 9 aa, Homo Sapiens
GDWGFDGLA

SEQ ID NO: 117535 - protein, 9 aa, Homo Sapiens
GRRSMCKHA

SEQ ID NO: 117536 - protein, 9 aa, Homo Sapiens
TSSHVHAAL

SEQ ID NO: 117537 - protein, 9 aa, Homo Sapiens
LYPPPPPPK

SEQ ID NO: 117538 - protein, 9 aa, Homo Sapiens
PHIKKPLNV

SEQ ID NO: 117539 - protein, 9 aa, Homo Sapiens
LDPADFYLN

SEQ ID NO: 117540 - protein, 9 aa, Homo Sapiens
TQLFREYLL

SEQ ID NO: 117541 - protein, 9 aa, Homo Sapiens
ASAVVRLGP

SEQ ID NO: 117542 - protein, 9 aa, Homo Sapiens
KLPQELYSK

SEQ ID NO: 117543 - protein, 9 aa, Homo Sapiens
KPLNVFMLY

SEQ ID NO: 117544 - protein, 9 aa, Homo Sapiens
LPQVLHMTE

SEQ ID NO: 117545 - protein, 9 aa, Homo Sapiens
CETQSHYSF

SEQ ID NO: 117546 - protein, 9 aa, Homo Sapiens
VWCGSECPV

SEQ ID NO: 117547 - protein, 9 aa, Homo Sapiens
HQRVYHNHQ

SEQ ID NO: 117548 - protein, 9 aa, Homo Sapiens
GAFSVSTPN

SEQ ID NO: 117549 - protein, 9 aa, Homo Sapiens
DTQACLRNH

SEQ ID NO: 117550 - protein, 9 aa, Homo Sapiens
NMAPKFLAN

SEQ ID NO: 117551 - protein, 9 aa, Homo Sapiens
DIPQDSLLF

SEQ ID NO: 117552 - protein, 9 aa, Homo Sapiens
VKDPEDFFT

SEQ ID NO: 117553 - protein, 9 aa, Homo Sapiens
QELYSKDPW

SEQ ID NO: 117554 - protein, 9 aa, Homo Sapiens
PVRLASRQE

SEQ ID NO: 117555 - protein, 9 aa, Homo Sapiens
RLGFRVHVP

SEQ ID NO: 117556 - protein, 9 aa, Homo Sapiens
RVYHNHQRL

SEQ ID NO: 117557 - protein, 9 aa, Homo Sapiens
LAFPLEWFP

SEQ ID NO: 117558 - protein, 9 aa, Homo Sapiens
PVIVQLTIQ

SEQ ID NO: 117559 - protein, 9 aa, Homo Sapiens
RGTPSTRVC

SEQ ID NO: 117560 - protein, 9 aa, Homo Sapiens
SRQEDAPMI

SEQ ID NO: 117561 - protein, 9 aa, Homo Sapiens
YTLAYIRYL

SEQ ID NO: 117562 - protein, 9 aa, Homo Sapiens
PLNVFMLYM

SEQ ID NO: 117563 - protein, 9 aa, Homo Sapiens
KLDTLQTFI

SEQ ID NO: 117564 - protein, 9 aa, Homo Sapiens
KTGGEPAPS

SEQ ID NO: 117565 - protein, 9 aa, Homo Sapiens
AEHGGQARR

SEQ ID NO: 117566 - protein, 9 aa, Homo Sapiens
LRPELHMKE

SEQ ID NO: 117567 - protein, 9 aa, Homo Sapiens
TIDTLLALG

SEQ ID NO: 117568 - protein, 9 aa, Homo Sapiens
SGERPYDCN

SEQ ID NO: 117569 - protein, 9 aa, Homo Sapiens
AFLVVRRCV

SEQ ID NO: 117570 - protein, 9 aa, Homo Sapiens
PGLFGVWAY

SEQ ID NO: 117571 - protein, 9 aa, Homo Sapiens
EGGAPCTAI

SEQ ID NO: 117572 - protein, 9 aa, Homo Sapiens
WLCESLVVP

SEQ ID NO: 117573 - protein, 9 aa, Homo Sapiens
LFWKLDTLQ

SEQ ID NO: 117574 - protein, 9 aa, Homo Sapiens
HKRMKPLHI

SEQ ID NO: 117575 - protein, 9 aa, Homo Sapiens
LYSKDPWHI

SEQ ID NO: 117576 - protein, 9 aa, Homo Sapiens
RMKPLHIQI

SEQ ID NO: 117577 - protein, 9 aa, Homo Sapiens
LILGAVLLL

SEQ ID NO: 117578 - protein, 9 aa, Homo Sapiens
TQLVRASLV

SEQ ID NO: 117579 - protein, 9 aa, Homo Sapiens
EKSLDCETQ

SEQ ID NO: 117580 - protein, 9 aa, Homo Sapiens
AHVCAQLIK

SEQ ID NO: 117581 - protein, 9 aa, Homo Sapiens
CPVRCCFAL

SEQ ID NO: 117582 - protein, 9 aa, Homo Sapiens
NTRVRLGFR

SEQ ID NO: 117583 - protein, 9 aa, Homo Sapiens
REGECPSHI

SEQ ID NO: 117584 - protein, 9 aa, Homo Sapiens
VLGKREQYG

SEQ ID NO: 117585 - protein, 9 aa, Homo Sapiens
QHIFQVLST

SEQ ID NO: 117586 - protein, 9 aa, Homo Sapiens
RSRDLRRRW

SEQ ID NO: 117587 - protein, 9 aa, Homo Sapiens
TGIIRTAWR

SEQ ID NO: 117588 - protein, 9 aa, Homo Sapiens
VGNLLVMFV

SEQ ID NO: 117589 - protein, 9 aa, Homo Sapiens
VQHIFQVLS

SEQ ID NO: 117590 - protein, 9 aa, Homo Sapiens
ENEEREIKC

SEQ ID NO: 117591 - protein, 9 aa, Homo Sapiens
LESFPKDVD

SEQ ID NO: 117592 - protein, 9 aa, Homo Sapiens
LGASSTRRA

SEQ ID NO: 117593 - protein, 9 aa, Homo Sapiens
CKHAEKERL

SEQ ID NO: 117594 - protein, 9 aa, Homo Sapiens
VVFVQRAFD

SEQ ID NO: 117595 - protein, 9 aa, Homo Sapiens
RNHPLEPPK

SEQ ID NO: 117596 - protein, 9 aa, Homo Sapiens
YRHIGEERD

SEQ ID NO: 117597 - protein, 9 aa, Homo Sapiens
TLAYIRYLM

SEQ ID NO: 117598 - protein, 9 aa, Homo Sapiens
AFIICGMLY

SEQ ID NO: 117599 - protein, 9 aa, Homo Sapiens
VGAAGSEAM

SEQ ID NO: 117600 - protein, 9 aa, Homo Sapiens
IGSFPGMRQ

SEQ ID NO: 117601 - protein, 9 aa, Homo Sapiens
LVSDMDTDV

SEQ ID NO: 117602 - protein, 9 aa, Homo Sapiens
PRLDLRIIQ

SEQ ID NO: 117603 - protein, 9 aa, Homo Sapiens
NAMMRKAIR

SEQ ID NO: 117604 - protein, 9 aa, Homo Sapiens
SQNSWLCES

SEQ ID NO: 117605 - protein, 9 aa, Homo Sapiens
MKPLHIQIK

SEQ ID NO: 117606 - protein, 9 aa, Homo Sapiens
HSHLQGAEV

SEQ ID NO: 117607 - protein, 9 aa, Homo Sapiens
FIICGMLYV

SEQ ID NO: 117608 - protein, 9 aa, Homo Sapiens
LSLTCDLLQ

SEQ ID NO: 117609 - protein, 9 aa, Homo Sapiens
GVTSFLDWI

SEQ ID NO: 117610 - protein, 9 aa, Homo Sapiens
NGLLYYRSK

SEQ ID NO: 117611 - protein, 9 aa, Homo Sapiens
LDCCVIAGL

SEQ ID NO: 117612 - protein, 9 aa, Homo Sapiens
RVCHCNWLM

SEQ ID NO: 117613 - protein, 9 aa, Homo Sapiens
RLPTVMVHS

SEQ ID NO: 117614 - protein, 9 aa, Homo Sapiens
ETIAQIQRN

SEQ ID NO: 117615 - protein, 9 aa, Homo Sapiens
SAHWLKSSI

SEQ ID NO: 117616 - protein, 9 aa, Homo Sapiens
LNPYFNPPE

SEQ ID NO: 117617 - protein, 9 aa, Homo Sapiens
SPSLASLCP

SEQ ID NO: 117618 - protein, 9 aa, Homo Sapiens
LEHEGGAPC

SEQ ID NO: 117619 - protein, 9 aa, Homo Sapiens
QNVLQQRQL

SEQ ID NO: 117620 - protein, 9 aa, Homo Sapiens
PPPPKHLQM

SEQ ID NO: 117621 - protein, 9 aa, Homo Sapiens
AKVKNLVVK

SEQ ID NO: 117622 - protein, 9 aa, Homo Sapiens
DLDIPQDSL

SEQ ID NO: 117623 - protein, 9 aa, Homo Sapiens
TGALPPLAL

SEQ ID NO: 117624 - protein, 9 aa, Homo Sapiens
QRQLKHLCT

SEQ ID NO: 117625 - protein, 9 aa, Homo Sapiens
SFPGMRQPG

SEQ ID NO: 117626 - protein, 9 aa, Homo Sapiens
VYHNHQRLD

SEQ ID NO: 117627 - protein, 9 aa, Homo Sapiens
FGVWAYNGE

SEQ ID NO: 117628 - protein, 9 aa, Homo Sapiens
EYLLERALN

SEQ ID NO: 117629 - protein, 9 aa, Homo Sapiens
PGPAGKEGI

SEQ ID NO: 117630 - protein, 9 aa, Homo Sapiens
AQIQRNLAH

SEQ ID NO: 117631 - protein, 9 aa, Homo Sapiens
EKAIALEME

SEQ ID NO: 117632 - protein, 9 aa, Homo Sapiens
HQETCLGDA

SEQ ID NO: 117633 - protein, 9 aa, Homo Sapiens
DPNYVLSSC

SEQ ID NO: 117634 - protein, 9 aa, Homo Sapiens
QMDFLVHPA

SEQ ID NO: 117635 - protein, 9 aa, Homo Sapiens
GNLLVMFVI

SEQ ID NO: 117636 - protein, 9 aa, Homo Sapiens
LNEHLFVSE

SEQ ID NO: 117637 - protein, 9 aa, Homo Sapiens
GVQHIFQVL

SEQ ID NO: 117638 - protein, 9 aa, Homo Sapiens
TAWRLDRER

SEQ ID NO: 117639 - protein, 9 aa, Homo Sapiens
PQRTAGSDV

SEQ ID NO: 117640 - protein, 9 aa, Homo Sapiens
EREIKCYNS

SEQ ID NO: 117641 - protein, 9 aa, Homo Sapiens
SVTKNCADK

SEQ ID NO: 117642 - protein, 9 aa, Homo Sapiens
PQDSLLFSI

SEQ ID NO: 117643 - protein, 9 aa, Homo Sapiens
VGADGVGKS

SEQ ID NO: 117644 - protein, 9 aa, Homo Sapiens
LKIPHVIAL

SEQ ID NO: 117645 - protein, 9 aa, Homo Sapiens
LGGQGGQYD

SEQ ID NO: 117646 - protein, 9 aa, Homo Sapiens
PESAHWLKS

SEQ ID NO: 117647 - protein, 9 aa, Homo Sapiens
DFTHPNGTD

SEQ ID NO: 117648 - protein, 9 aa, Homo Sapiens
KEGIRGPRG

SEQ ID NO: 117649 - protein, 9 aa, Homo Sapiens
FTHPNGTDD

SEQ ID NO: 117650 - protein, 9 aa, Homo Sapiens
EGLLTKALS

SEQ ID NO: 117651 - protein, 9 aa, Homo Sapiens
MKENEEHSR

SEQ ID NO: 117652 - protein, 9 aa, Homo Sapiens
CRGVEILNE

SEQ ID NO: 117653 - protein, 9 aa, Homo Sapiens
GQARRHRGH

SEQ ID NO: 117654 - protein, 9 aa, Homo Sapiens
SCVRTGRSI

SEQ ID NO: 117655 - protein, 9 aa, Homo Sapiens
GNSSQSCPC

SEQ ID NO: 117656 - protein, 9 aa, Homo Sapiens
NRNHPLEPP

SEQ ID NO: 117657 - protein, 9 aa, Homo Sapiens
TGVTSFLDW

SEQ ID NO: 117658 - protein, 9 aa, Homo Sapiens
EAKVKNLVV

SEQ ID NO: 117659 - protein, 9 aa, Homo Sapiens
CGMLYVTNG

SEQ ID NO: 117660 - protein, 9 aa, Homo Sapiens
EHEGGAPCT

SEQ ID NO: 117661 - protein, 9 aa, Homo Sapiens
NCDEPLVSG

SEQ ID NO: 117662 - protein, 9 aa, Homo Sapiens
AYNGEGRTA

SEQ ID NO: 117663 - protein, 9 aa, Homo Sapiens
IKVLCRGVE

SEQ ID NO: 117664 - protein, 9 aa, Homo Sapiens
EDPRLDLRI

SEQ ID NO: 117665 - protein, 9 aa, Homo Sapiens
GGGLHSHLQ

SEQ ID NO: 117666 - protein, 9 aa, Homo Sapiens
IPHVIALEN

SEQ ID NO: 117667 - protein, 9 aa, Homo Sapiens
KCLNPYFNP

SEQ ID NO: 117668 - protein, 9 aa, Homo Sapiens
RSAAALSVL

SEQ ID NO: 117669 - protein, 9 aa, Homo Sapiens
VIEDLSPRC

SEQ ID NO: 117670 - protein, 9 aa, Homo Sapiens
LFGVWAYNG

SEQ ID NO: 117671 - protein, 9 aa, Homo Sapiens
CPENSCSPY

SEQ ID NO: 117672 - protein, 9 aa, Homo Sapiens
YPPPPPPKH

SEQ ID NO: 117673 - protein, 9 aa, Homo Sapiens
ALEGDSVAS

SEQ ID NO: 117674 - protein, 9 aa, Homo Sapiens
DGVGKSALT

SEQ ID NO: 117675 - protein, 9 aa, Homo Sapiens
IRTAWRLDR

SEQ ID NO: 117676 - protein, 9 aa, Homo Sapiens
HEFHKSPSI

SEQ ID NO: 117677 - protein, 9 aa, Homo Sapiens
PSKLLLPHL

SEQ ID NO: 117678 - protein, 9 aa, Homo Sapiens
HPNGTDDKS

SEQ ID NO: 117679 - protein, 9 aa, Homo Sapiens
NKKYVPDYY

SEQ ID NO: 117680 - protein, 9 aa, Homo Sapiens
ILSHHQGLS

SEQ ID NO: 117681 - protein, 9 aa, Homo Sapiens
RNVLPSLGA

SEQ ID NO: 117682 - protein, 9 aa, Homo Sapiens
ESFPKDVDL

SEQ ID NO: 117683 - protein, 9 aa, Homo Sapiens
SQNCDEPLV

SEQ ID NO: 117684 - protein, 9 aa, Homo Sapiens
MVHSPIDSA

SEQ ID NO: 117685 - protein, 9 aa, Homo Sapiens
QISDIHVAF

SEQ ID NO: 117686 - protein, 9 aa, Homo Sapiens
RNQHIVQLI

SEQ ID NO: 117687 - protein, 9 aa, Homo Sapiens
LVVRRCVKV

SEQ ID NO: 117688 - protein, 9 aa, Homo Sapiens
ICGMLYVTN

SEQ ID NO: 117689 - protein, 9 aa, Homo Sapiens
QHIAEEKAK

SEQ ID NO: 117690 - protein, 9 aa, Homo Sapiens
LASCGGRSL

SEQ ID NO: 117691 - protein, 9 aa, Homo Sapiens
KVLCRGVEI

SEQ ID NO: 117692 - protein, 9 aa, Homo Sapiens
GQTGPKGDW

SEQ ID NO: 117693 - protein, 9 aa, Homo Sapiens
VRASLVQPQ

SEQ ID NO: 117694 - protein, 9 aa, Homo Sapiens
YYILPRKVL

SEQ ID NO: 117695 - protein, 9 aa, Homo Sapiens
REYLLERAL

SEQ ID NO: 117696 - protein, 9 aa, Homo Sapiens
MLYVTNGYS

SEQ ID NO: 117697 - protein, 9 aa, Homo Sapiens
PLALEGDSV

SEQ ID NO: 117698 - protein, 9 aa, Homo Sapiens
CGGTELVFE

SEQ ID NO: 117699 - protein, 9 aa, Homo Sapiens
LKSLGLRLH

SEQ ID NO: 117700 - protein, 9 aa, Homo Sapiens
VLQMDFLVH

SEQ ID NO: 117701 - protein, 9 aa, Homo Sapiens
YFNPPEKKC

SEQ ID NO: 117702 - protein, 9 aa, Homo Sapiens
SGPPVGPVR

SEQ ID NO: 117703 - protein, 9 aa, Homo Sapiens
AVDKRFLPN

SEQ ID NO: 117704 - protein, 9 aa, Homo Sapiens
LKPRRVCMG

SEQ ID NO: 117705 - protein, 9 aa, Homo Sapiens
FFTEGCVRR

SEQ ID NO: 117706 - protein, 9 aa, Homo Sapiens
YHANYREGE

SEQ ID NO: 117707 - protein, 9 aa, Homo Sapiens
PVPLGGQGG

SEQ ID NO: 117708 - protein, 9 aa, Homo Sapiens
ADFYLNCCD

SEQ ID NO: 117709 - protein, 9 aa, Homo Sapiens
DTMPQMYKR

SEQ ID NO: 117710 - protein, 9 aa, Homo Sapiens
ISDIHVAFQ

SEQ ID NO: 117711 - protein, 9 aa, Homo Sapiens
NSTHEFHKS

SEQ ID NO: 117712 - protein, 9 aa, Homo Sapiens
FREYLLERA

SEQ ID NO: 117713 - protein, 9 aa, Homo Sapiens
PPLALEGDS

SEQ ID NO: 117714 - protein, 9 aa, Homo Sapiens
DFYLNCCDC

SEQ ID NO: 117715 - protein, 9 aa, Homo Sapiens
IPVLQAFHS

SEQ ID NO: 117716 - protein, 9 aa, Homo Sapiens
VVGLDLETT

SEQ ID NO: 117717 - protein, 9 aa, Homo Sapiens
RSKGFDVTM

SEQ ID NO: 117718 - protein, 9 aa, Homo Sapiens
DMLSADDIA

SEQ ID NO: 117719 - protein, 9 aa, Homo Sapiens
TAKGVVVSL

SEQ ID NO: 117720 - protein, 9 aa, Homo Sapiens
PGVYTGVTS

SEQ ID NO: 117721 - protein, 9 aa, Homo Sapiens
SQSCPCPYS

SEQ ID NO: 117722 - protein, 9 aa, Homo Sapiens
ELEGLLTKA

SEQ ID NO: 117723 - protein, 9 aa, Homo Sapiens
CQCTGMDWT

SEQ ID NO: 117724 - protein, 9 aa, Homo Sapiens
PRATTSRTE

SEQ ID NO: 117725 - protein, 9 aa, Homo Sapiens
KIHKRETAD

SEQ ID NO: 117726 - protein, 9 aa, Homo Sapiens
TAPSTSQNC

SEQ ID NO: 117727 - protein, 9 aa, Homo Sapiens
PIKVLCRGV

SEQ ID NO: 117728 - protein, 9 aa, Homo Sapiens
RQISDIHVA

SEQ ID NO: 117729 - protein, 9 aa, Homo Sapiens
PDADTYYIL

SEQ ID NO: 117730 - protein, 9 aa, Homo Sapiens
PLGATQLNT

SEQ ID NO: 117731 - protein, 9 aa, Homo Sapiens
RLMVGLHWW

SEQ ID NO: 117732 - protein, 9 aa, Homo Sapiens
YQSLRLTSS

SEQ ID NO: 117733 - protein, 9 aa, Homo Sapiens
EHLFVSELK

SEQ ID NO: 117734 - protein, 9 aa, Homo Sapiens
QNSWLCESL

SEQ ID NO: 117735 - protein, 9 aa, Homo Sapiens
EAFIICGML

SEQ ID NO: 117736 - protein, 9 aa, Homo Sapiens
KSLDCETQS

SEQ ID NO: 117737 - protein, 9 aa, Homo Sapiens
RKGVQHIFQ

SEQ ID NO: 117738 - protein, 9 aa, Homo Sapiens
VEKSLDCET

SEQ ID NO: 117739 - protein, 9 aa, Homo Sapiens
SKNCTYGLC

SEQ ID NO: 117740 - protein, 9 aa, Homo Sapiens
HNHQRLDME

SEQ ID NO: 117741 - protein, 9 aa, Homo Sapiens
MYNTFRAAA

SEQ ID NO: 117742 - protein, 9 aa, Homo Sapiens
LSPRYPAPY

SEQ ID NO: 117743 - protein, 9 aa, Homo Sapiens
THSGERPYD

SEQ ID NO: 117744 - protein, 9 aa, Homo Sapiens
IAMLAFPLE

SEQ ID NO: 117745 - protein, 9 aa, Homo Sapiens
PAPRAVLKG

SEQ ID NO: 117746 - protein, 9 aa, Homo Sapiens
EVWCGSECP

SEQ ID NO: 117747 - protein, 9 aa, Homo Sapiens
LQSEVEGDK

SEQ ID NO: 117748 - protein, 9 aa, Homo Sapiens
FLPNDHGKN

SEQ ID NO: 117749 - protein, 9 aa, Homo Sapiens
GAHLDCCVI

SEQ ID NO: 117750 - protein, 9 aa, Homo Sapiens
RMKENEEHS

SEQ ID NO: 117751 - protein, 9 aa, Homo Sapiens
VFSGQSRAK

SEQ ID NO: 117752 - protein, 9 aa, Homo Sapiens
NPYFNPPEK

SEQ ID NO: 117753 - protein, 9 aa, Homo Sapiens
YREGECPSH

SEQ ID NO: 117754 - protein, 9 aa, Homo Sapiens
SCSPYYFQC

SEQ ID NO: 117755 - protein, 9 aa, Homo Sapiens
SELKSYLKT

SEQ ID NO: 117756 - protein, 9 aa, Homo Sapiens
MFVFSGQSR

SEQ ID NO: 117757 - protein, 9 aa, Homo Sapiens
LPPLALEGD

SEQ ID NO: 117758 - protein, 9 aa, Homo Sapiens
RGRTMYNTF

SEQ ID NO: 117759 - protein, 9 aa, Homo Sapiens
VLPESAHWL

SEQ ID NO: 117760 - protein, 9 aa, Homo Sapiens
KGHDHEVVC

SEQ ID NO: 117761 - protein, 9 aa, Homo Sapiens
VLHMTELLN

SEQ ID NO: 117762 - protein, 9 aa, Homo Sapiens
DTYYILPRK

SEQ ID NO: 117763 - protein, 9 aa, Homo Sapiens
GATQLNTDG

SEQ ID NO: 117764 - protein, 9 aa, Homo Sapiens
WKLDTLQTF

SEQ ID NO: 117765 - protein, 9 aa, Homo Sapiens
LVNQVLADV

SEQ ID NO: 117766 - protein, 9 aa, Homo Sapiens
EKSGPPVGP

SEQ ID NO: 117767 - protein, 9 aa, Homo Sapiens
CHSHGVLHR

SEQ ID NO: 117768 - protein, 9 aa, Homo Sapiens
STHEFHKSP

SEQ ID NO: 117769 - protein, 9 aa, Homo Sapiens
TQNVLQQRQ

SEQ ID NO: 117770 - protein, 9 aa, Homo Sapiens
GPSIVHCKC

SEQ ID NO: 117771 - protein, 9 aa, Homo Sapiens
CDLLQSQLY

SEQ ID NO: 117772 - protein, 9 aa, Homo Sapiens
LPESAHWLK

SEQ ID NO: 117773 - protein, 9 aa, Homo Sapiens
TLDPADFYL

SEQ ID NO: 117774 - protein, 9 aa, Homo Sapiens
GTRMGLASC

SEQ ID NO: 117775 - protein, 9 aa, Homo Sapiens
AFHSVGSTW

SEQ ID NO: 117776 - protein, 9 aa, Homo Sapiens
RSMCKHAEK

SEQ ID NO: 117777 - protein, 9 aa, Homo Sapiens
SPRYPAPYE

SEQ ID NO: 117778 - protein, 9 aa, Homo Sapiens
PNDHGKNAL

SEQ ID NO: 117779 - protein, 9 aa, Homo Sapiens
LPDADTYYI

SEQ ID NO: 117780 - protein, 9 aa, Homo Sapiens
SSINMPSSS

SEQ ID NO: 117781 - protein, 9 aa, Homo Sapiens
KGAFLVVRR

SEQ ID NO: 117782 - protein, 9 aa, Homo Sapiens
LSFPIRHDD

SEQ ID NO: 117783 - protein, 9 aa, Homo Sapiens
NCADKNAIH

SEQ ID NO: 117784 - protein, 9 aa, Homo Sapiens
KPLHIQIKS

SEQ ID NO: 117785 - protein, 9 aa, Homo Sapiens
VSSEVRSRK

SEQ ID NO: 117786 - protein, 9 aa, Homo Sapiens
ARLGAHLDC

SEQ ID NO: 117787 - protein, 9 aa, Homo Sapiens
VPEEEEDEA

SEQ ID NO: 117788 - protein, 9 aa, Homo Sapiens
KLKEAKVKN

SEQ ID NO: 117789 - protein, 9 aa, Homo Sapiens
FMQHHTQSI

SEQ ID NO: 117790 - protein, 9 aa, Homo Sapiens
HSGERPYDC

SEQ ID NO: 117791 - protein, 9 aa, Homo Sapiens
VLIAHLSFC

SEQ ID NO: 117792 - protein, 9 aa, Homo Sapiens
RFRRENDNP

SEQ ID NO: 117793 - protein, 9 aa, Homo Sapiens
LGRRSMCKH

SEQ ID NO: 117794 - protein, 9 aa, Homo Sapiens
EAMLVDVNV

SEQ ID NO: 117795 - protein, 9 aa, Homo Sapiens
NSSQSCPCP

SEQ ID NO: 117796 - protein, 9 aa, Homo Sapiens
NTDGALWLG

SEQ ID NO: 117797 - protein, 9 aa, Homo Sapiens
PHRSLHHHV

SEQ ID NO: 117798 - protein, 9 aa, Homo Sapiens
GQAECSFQV

SEQ ID NO: 117799 - protein, 9 aa, Homo Sapiens
VLLLLVLPW

SEQ ID NO: 117800 - protein, 9 aa, Homo Sapiens
QRVYHNHQR

SEQ ID NO: 117801 - protein, 9 aa, Homo Sapiens
EDCMEELFD

SEQ ID NO: 117802 - protein, 9 aa, Homo Sapiens
RFLPNDHGK

SEQ ID NO: 117803 - protein, 9 aa, Homo Sapiens
FRVCHCNWL

SEQ ID NO: 117804 - protein, 9 aa, Homo Sapiens
QVLPDADTY

SEQ ID NO: 117805 - protein, 9 aa, Homo Sapiens
VKTHIEMVI

SEQ ID NO: 117806 - protein, 9 aa, Homo Sapiens
LAFCHSHGV

SEQ ID NO: 117807 - protein, 9 aa, Homo Sapiens
AGNSSQSCP

SEQ ID NO: 117808 - protein, 9 aa, Homo Sapiens
LPHLTLESR

SEQ ID NO: 117809 - protein, 9 aa, Homo Sapiens
SLRLTSSHV

SEQ ID NO: 117810 - protein, 9 aa, Homo Sapiens
LQSQLYWTH

SEQ ID NO: 117811 - protein, 9 aa, Homo Sapiens
AVVRLGPVA

SEQ ID NO: 117812 - protein, 9 aa, Homo Sapiens
IKKPLNVFM

SEQ ID NO: 117813 - protein, 9 aa, Homo Sapiens
LNTDGALWL

SEQ ID NO: 117814 - protein, 9 aa, Homo Sapiens
ARRNVLPSL

SEQ ID NO: 117815 - protein, 9 aa, Homo Sapiens
ILPRKVLQM

SEQ ID NO: 117816 - protein, 9 aa, Homo Sapiens
LSVIVLEKS

SEQ ID NO: 117817 - protein, 9 aa, Homo Sapiens
IPQDSLLFS

SEQ ID NO: 117818 - protein, 9 aa, Homo Sapiens
RTIPRRIAD

SEQ ID NO: 117819 - protein, 9 aa, Homo Sapiens
LMGKNAMMR

SEQ ID NO: 117820 - protein, 9 aa, Homo Sapiens
HHPVNKKYV

SEQ ID NO: 117821 - protein, 9 aa, Homo Sapiens
KAIALEMER

SEQ ID NO: 117822 - protein, 9 aa, Homo Sapiens
LPSLGASST

SEQ ID NO: 117823 - protein, 9 aa, Homo Sapiens
VAVASAVVR

SEQ ID NO: 117824 - protein, 9 aa, Homo Sapiens
KNTRVRLGF

SEQ ID NO: 117825 - protein, 9 aa, Homo Sapiens
RTAWRLDRE

SEQ ID NO: 117826 - protein, 9 aa, Homo Sapiens
GTPSTRVCG

SEQ ID NO: 117827 - protein, 9 aa, Homo Sapiens
EDLSPRCPY

SEQ ID NO: 117828 - protein, 9 aa, Homo Sapiens
RYLMLFNYI

SEQ ID NO: 117829 - protein, 9 aa, Homo Sapiens
HWLKSSIGL

SEQ ID NO: 117830 - protein, 9 aa, Homo Sapiens
GGLHSHLQG

SEQ ID NO: 117831 - protein, 9 aa, Homo Sapiens
PPTPLQFHL

SEQ ID NO: 117832 - protein, 9 aa, Homo Sapiens
KNAMMRKAI

SEQ ID NO: 117833 - protein, 9 aa, Homo Sapiens
EASSQAGAF

SEQ ID NO: 117834 - protein, 9 aa, Homo Sapiens
DLLQSQLYW

SEQ ID NO: 117835 - protein, 9 aa, Homo Sapiens
QETCLGDAR

SEQ ID NO: 117836 - protein, 9 aa, Homo Sapiens
VSDMDTDVP

SEQ ID NO: 117837 - protein, 9 aa, Homo Sapiens
KYVPDYYKM

SEQ ID NO: 117838 - protein, 9 aa, Homo Sapiens
EDFFTEGCV

SEQ ID NO: 117839 - protein, 9 aa, Homo Sapiens
LHMKEQILE

SEQ ID NO: 117840 - protein, 9 aa, Homo Sapiens
SDIHVAFQS

SEQ ID NO: 117841 - protein, 9 aa, Homo Sapiens
VNKKYVPDY

SEQ ID NO: 117842 - protein, 9 aa, Homo Sapiens
VEHEKNQEL

SEQ ID NO: 117843 - protein, 9 aa, Homo Sapiens
QHQETCLGD

SEQ ID NO: 117844 - protein, 9 aa, Homo Sapiens
GEAFIICGM

SEQ ID NO: 117845 - protein, 9 aa, Homo Sapiens
PSGYHANYR

SEQ ID NO: 117846 - protein, 9 aa, Homo Sapiens
LAELEGLLT

SEQ ID NO: 117847 - protein, 9 aa, Homo Sapiens
THPNGTDDK

SEQ ID NO: 117848 - protein, 9 aa, Homo Sapiens
RLASRQEDA

SEQ ID NO: 117849 - protein, 9 aa, Homo Sapiens
SSHVHAALP

SEQ ID NO: 117850 - protein, 9 aa, Homo Sapiens
LLVMFVIIR

SEQ ID NO: 117851 - protein, 9 aa, Homo Sapiens
TEEDCMEEL

SEQ ID NO: 117852 - protein, 9 aa, Homo Sapiens
EHEKNQELR

SEQ ID NO: 117853 - protein, 9 aa, Homo Sapiens
MKYTQGSWT

SEQ ID NO: 117854 - protein, 9 aa, Homo Sapiens
VRTAHTLGD

SEQ ID NO: 117855 - protein, 9 aa, Homo Sapiens
RTVVGLDLE

SEQ ID NO: 117856 - protein, 9 aa, Homo Sapiens
ESGPSIVHC

SEQ ID NO: 117857 - protein, 9 aa, Homo Sapiens
QQRQLKHLC

SEQ ID NO: 117858 - protein, 9 aa, Homo Sapiens
HLDCCVIAG

SEQ ID NO: 117859 - protein, 9 aa, Homo Sapiens
IAIMFQVCI

SEQ ID NO: 117860 - protein, 9 aa, Homo Sapiens
LTSVTKNCA

SEQ ID NO: 117861 - protein, 9 aa, Homo Sapiens
RTLGRRSMC

SEQ ID NO: 117862 - protein, 9 aa, Homo Sapiens
MLSADDIAA

SEQ ID NO: 117863 - protein, 9 aa, Homo Sapiens
FDVTMKYTQ

SEQ ID NO: 117864 - protein, 9 aa, Homo Sapiens
VFRVCHCNW

SEQ ID NO: 117865 - protein, 9 aa, Homo Sapiens
LHSHLQGAE

SEQ ID NO: 117866 - protein, 9 aa, Homo Sapiens
EKRTIPRRI

SEQ ID NO: 117867 - protein, 9 aa, Homo Sapiens
CVRTGRSIK

SEQ ID NO: 117868 - protein, 9 aa, Homo Sapiens
WFYTLAYIR

SEQ ID NO: 117869 - protein, 9 aa, Homo Sapiens
VWAYRHIGE

SEQ ID NO: 117870 - protein, 9 aa, Homo Sapiens
PQVLHMTEL

SEQ ID NO: 117871 - protein, 9 aa, Homo Sapiens
HIFQVLSTT

SEQ ID NO: 117872 - protein, 9 aa, Homo Sapiens
GRLMVGLHW

SEQ ID NO: 117873 - protein, 9 aa, Homo Sapiens
VRLGFRVHV

SEQ ID NO: 117874 - protein, 9 aa, Homo Sapiens
VGAVVLILG

SEQ ID NO: 117875 - protein, 9 aa, Homo Sapiens
TCDLLQSQL

SEQ ID NO: 117876 - protein, 9 aa, Homo Sapiens
PSTSQNCDE

SEQ ID NO: 117877 - protein, 9 aa, Homo Sapiens
FEQHQETCL

SEQ ID NO: 117878 - protein, 9 aa, Homo Sapiens
GVLHRDLKP

SEQ ID NO: 117879 - protein, 9 aa, Homo Sapiens
LPRKVLQMD

SEQ ID NO: 117880 - protein, 9 aa, Homo Sapiens
SHTEEDCME

SEQ ID NO: 117881 - protein, 9 aa, Homo Sapiens
ILGAVLLLF

SEQ ID NO: 117882 - protein, 9 aa, Homo Sapiens
SAVVRLGPV

SEQ ID NO: 117883 - protein, 9 aa, Homo Sapiens
RVCMGGKRR

SEQ ID NO: 117884 - protein, 9 aa, Homo Sapiens
LSVLGKREQ

SEQ ID NO: 117885 - protein, 9 aa, Homo Sapiens
PDLNRNHPL

SEQ ID NO: 117886 - protein, 9 aa, Homo Sapiens
PRYPAPYEH

SEQ ID NO: 117887 - protein, 9 aa, Homo Sapiens
MYKRKRSWS

SEQ ID NO: 117888 - protein, 9 aa, Homo Sapiens
AVEKRTIPR

SEQ ID NO: 117889 - protein, 9 aa, Homo Sapiens
IALEMERAK

SEQ ID NO: 117890 - protein, 9 aa, Homo Sapiens
TADTQACLR

SEQ ID NO: 117891 - protein, 9 aa, Homo Sapiens
LEKAIALEM

SEQ ID NO: 117892 - protein, 9 aa, Homo Sapiens
GAVVLILGA

SEQ ID NO: 117893 - protein, 9 aa, Homo Sapiens
TLQTFIRDL

SEQ ID NO: 117894 - protein, 9 aa, Homo Sapiens
LEDMLQAPK

SEQ ID NO: 117895 - protein, 9 aa, Homo Sapiens
ERLDFLTLQ

SEQ ID NO: 117896 - protein, 9 aa, Homo Sapiens
HVCAQLIKP

SEQ ID NO: 117897 - protein, 9 aa, Homo Sapiens
SVPVIVQLT

SEQ ID NO: 117898 - protein, 9 aa, Homo Sapiens
RRLPTVMVH

SEQ ID NO: 117899 - protein, 9 aa, Homo Sapiens
QNCDEPLVS

SEQ ID NO: 117900 - protein, 9 aa, Homo Sapiens
ALEDMLQAP

SEQ ID NO: 117901 - protein, 9 aa, Homo Sapiens
ADTYYILPR

SEQ ID NO: 117902 - protein, 9 aa, Homo Sapiens
NLKSLGLRL

SEQ ID NO: 117903 - protein, 9 aa, Homo Sapiens
TSMPPTPGE

SEQ ID NO: 117904 - protein, 9 aa, Homo Sapiens
TDVPEEEED

SEQ ID NO: 117905 - protein, 9 aa, Homo Sapiens
LVIEDLSPR

SEQ ID NO: 117906 - protein, 9 aa, Homo Sapiens
TRVRLGFRV

SEQ ID NO: 117907 - protein, 9 aa, Homo Sapiens
AGAFSVSTP

SEQ ID NO: 117908 - protein, 9 aa, Homo Sapiens
DGSDTSMPP

SEQ ID NO: 117909 - protein, 9 aa, Homo Sapiens
RAVLKGHDH

SEQ ID NO: 117910 - protein, 9 aa, Homo Sapiens
RLQPILESF

SEQ ID NO: 117911 - protein, 9 aa, Homo Sapiens
ESLVVPSGG

SEQ ID NO: 117912 - protein, 9 aa, Homo Sapiens
RHRGHGSED

SEQ ID NO: 117913 - protein, 9 aa, Homo Sapiens
LFREYLLER

SEQ ID NO: 117914 - protein, 9 aa, Homo Sapiens
HTLGDREAA

SEQ ID NO: 117915 - protein, 9 aa, Homo Sapiens
GPAGKEGIR

SEQ ID NO: 117916 - protein, 9 aa, Homo Sapiens
RRSMCKHAE

SEQ ID NO: 117917 - protein, 9 aa, Homo Sapiens
KRMKENEEH

SEQ ID NO: 117918 - protein, 9 aa, Homo Sapiens
VPVIVQLTI

SEQ ID NO: 117919 - protein, 9 aa, Homo Sapiens
VVGLVGNLL

SEQ ID NO: 117920 - protein, 9 aa, Homo Sapiens
KGFDVTMKY

SEQ ID NO: 117921 - protein, 9 aa, Homo Sapiens
KNCADKNAI

SEQ ID NO: 117922 - protein, 9 aa, Homo Sapiens
KLHFSPHRS

SEQ ID NO: 117923 - protein, 9 aa, Homo Sapiens
PPPPPKHLQ

SEQ ID NO: 117924 - protein, 9 aa, Homo Sapiens
RKVLQMDFL

SEQ ID NO: 117925 - protein, 9 aa, Homo Sapiens
TWIPVLQAF

SEQ ID NO: 117926 - protein, 9 aa, Homo Sapiens
QIERLDFLT

SEQ ID NO: 117927 - protein, 9 aa, Homo Sapiens
RKNTRVRLG

SEQ ID NO: 117928 - protein, 9 aa, Homo Sapiens
PVLQAFHSV

SEQ ID NO: 117929 - protein, 9 aa, Homo Sapiens
FCHSHGVLH

SEQ ID NO: 117930 - protein, 9 aa, Homo Sapiens
LQYVKLPMV

SEQ ID NO: 117931 - protein, 9 aa, Homo Sapiens
SCPCPYSEI

SEQ ID NO: 117932 - protein, 9 aa, Homo Sapiens
PADFYLNCC

SEQ ID NO: 117933 - protein, 9 aa, Homo Sapiens
VLKPRRVCM

SEQ ID NO: 117934 - protein, 9 aa, Homo Sapiens
QDSLLFSIT

SEQ ID NO: 117935 - protein, 9 aa, Homo Sapiens
EGIRGPRGD

SEQ ID NO: 117936 - protein, 9 aa, Homo Sapiens
HGGQARRHR

SEQ ID NO: 117937 - protein, 9 aa, Homo Sapiens
VVGADGVGK

SEQ ID NO: 117938 - protein, 9 aa, Homo Sapiens
FSLLEEVIT

SEQ ID NO: 117939 - protein, 9 aa, Homo Sapiens
RRVCMGGKR

SEQ ID NO: 117940 - protein, 9 aa, Homo Sapiens
SRDLRRRWC

SEQ ID NO: 117941 - protein, 9 aa, Homo Sapiens
VMVHSPIDS

SEQ ID NO: 117942 - protein, 9 aa, Homo Sapiens
DLRRRWCPA

SEQ ID NO: 117943 - protein, 9 aa, Homo Sapiens
QHHTQSIKY

SEQ ID NO: 117944 - protein, 9 aa, Homo Sapiens
HGFLNLKSL

SEQ ID NO: 117945 - protein, 9 aa, Homo Sapiens
SSEAFSLLE

SEQ ID NO: 117946 - protein, 9 aa, Homo Sapiens
SSQSCPCPY

SEQ ID NO: 117947 - protein, 9 aa, Homo Sapiens
ELHMKEQIL

SEQ ID NO: 117948 - protein, 9 aa, Homo Sapiens
EESVPVIVQ

SEQ ID NO: 117949 - protein, 9 aa, Homo Sapiens
TSVTKNCAD

SEQ ID NO: 117950 - protein, 9 aa, Homo Sapiens
SMPPTPGEG

SEQ ID NO: 117951 - protein, 9 aa, Homo Sapiens
VIAIMFQVC

SEQ ID NO: 117952 - protein, 9 aa, Homo Sapiens
HTVSSEAFS

SEQ ID NO: 117953 - protein, 9 aa, Homo Sapiens
NSWLCESLV

SEQ ID NO: 117954 - protein, 9 aa, Homo Sapiens
LEMERAKAM

SEQ ID NO: 117955 - protein, 9 aa, Homo Sapiens
PGMRQPGML

SEQ ID NO: 117956 - protein, 9 aa, Homo Sapiens
PSLGASSTR

SEQ ID NO: 117957 - protein, 9 aa, Homo Sapiens
GALPPLALE

SEQ ID NO: 117958 - protein, 9 aa, Homo Sapiens
QVLHMTELL

SEQ ID NO: 117959 - protein, 9 aa, Homo Sapiens
SITDMLSAD

SEQ ID NO: 117960 - protein, 9 aa, Homo Sapiens
LDTLQTFIR

SEQ ID NO: 117961 - protein, 9 aa, Homo Sapiens
YHQRVYHNH

SEQ ID NO: 117962 - protein, 9 aa, Homo Sapiens
IHKRMKPLH

SEQ ID NO: 117963 - protein, 9 aa, Homo Sapiens
LVCVKTGGE

SEQ ID NO: 117964 - protein, 9 aa, Homo Sapiens
NQVLADVLP

SEQ ID NO: 117965 - protein, 9 aa, Homo Sapiens
SFQVTVDDA

SEQ ID NO: 117966 - protein, 9 aa, Homo Sapiens
KGVQHIFQV

SEQ ID NO: 117967 - protein, 9 aa, Homo Sapiens
AFCHSHGVL

SEQ ID NO: 117968 - protein, 9 aa, Homo Sapiens
VSKVEHEKN

SEQ ID NO: 117969 - protein, 9 aa, Homo Sapiens
SHLQGAEVA

SEQ ID NO: 117970 - protein, 9 aa, Homo Sapiens
AVVLILGAV

SEQ ID NO: 117971 - protein, 9 aa, Homo Sapiens
TKALSGPFM

SEQ ID NO: 117972 - protein, 9 aa, Homo Sapiens
LSPRCPYQF

SEQ ID NO: 117973 - protein, 9 aa, Homo Sapiens
DADTYYILP

SEQ ID NO: 117974 - protein, 9 aa, Homo Sapiens
GLVGNLLVM

SEQ ID NO: 117975 - protein, 9 aa, Homo Sapiens
EGDKNIMTQ

SEQ ID NO: 117976 - protein, 9 aa, Homo Sapiens
VLEKSGPPV

SEQ ID NO: 117977 - protein, 9 aa, Homo Sapiens
VLSPRYPAP

SEQ ID NO: 117978 - protein, 9 aa, Homo Sapiens
ANYREGECP

SEQ ID NO: 117979 - protein, 9 aa, Homo Sapiens
EMVINALKT

SEQ ID NO: 117980 - protein, 9 aa, Homo Sapiens
TSQNCDEPL

SEQ ID NO: 117981 - protein, 9 aa, Homo Sapiens
ELKSYLKTF

SEQ ID NO: 117982 - protein, 9 aa, Homo Sapiens
IRKTIDTLL

SEQ ID NO: 117983 - protein, 9 aa, Homo Sapiens
GLHSHLQGA

SEQ ID NO: 117984 - protein, 9 aa, Homo Sapiens
KEIRLEHEG

SEQ ID NO: 117985 - protein, 9 aa, Homo Sapiens
RTGEVRTAH

SEQ ID NO: 117986 - protein, 9 aa, Homo Sapiens
CTYGLCMQT

SEQ ID NO: 117987 - protein, 9 aa, Homo Sapiens
TVMVHSPID

SEQ ID NO: 117988 - protein, 9 aa, Homo Sapiens
GAAGSEAML

SEQ ID NO: 117989 - protein, 9 aa, Homo Sapiens
CPVADNERM

SEQ ID NO: 117990 - protein, 9 aa, Homo Sapiens
GKEGIRGPR

SEQ ID NO: 117991 - protein, 9 aa, Homo Sapiens
VSGQVLSPR

SEQ ID NO: 117992 - protein, 9 aa, Homo Sapiens
KKYVPDYYK

SEQ ID NO: 117993 - protein, 9 aa, Homo Sapiens
LETTAAYML

SEQ ID NO: 117994 - protein, 9 aa, Homo Sapiens
LGDARFVCK

SEQ ID NO: 117995 - protein, 9 aa, Homo Sapiens
FPIRHDDGS

SEQ ID NO: 117996 - protein, 9 aa, Homo Sapiens
KPGVYTGVT

SEQ ID NO: 117997 - protein, 9 aa, Homo Sapiens
AFPLEWFPL

SEQ ID NO: 117998 - protein, 9 aa, Homo Sapiens
EAHVCAQLI

SEQ ID NO: 117999 - protein, 9 aa, Homo Sapiens
IRGPRGDQG

SEQ ID NO: 118000 - protein, 9 aa, Homo Sapiens
DFFTEGCVR

SEQ ID NO: 118001 - protein, 9 aa, Homo Sapiens
FRRENDNPS

SEQ ID NO: 118002 - protein, 9 aa, Homo Sapiens
VEAHVCAQL

SEQ ID NO: 118003 - protein, 9 aa, Homo Sapiens
AGSDVPERE

SEQ ID NO: 118004 - protein, 9 aa, Homo Sapiens
NRNQHIVQL

SEQ ID NO: 118005 - protein, 9 aa, Homo Sapiens
RAVEKRTIP

SEQ ID NO: 118006 - protein, 9 aa, Homo Sapiens
SHGVLHRDL

SEQ ID NO: 118007 - protein, 9 aa, Homo Sapiens
RGRGRTMYN

SEQ ID NO: 118008 - protein, 9 aa, Homo Sapiens
PPPKHLQML

SEQ ID NO: 118009 - protein, 9 aa, Homo Sapiens
MRQPGMLCS

SEQ ID NO: 118010 - protein, 9 aa, Homo Sapiens
RENDNPSSS

SEQ ID NO: 118011 - protein, 9 aa, Homo Sapiens
LLQGVFRVC

SEQ ID NO: 118012 - protein, 9 aa, Homo Sapiens
ITDMLSADD

SEQ ID NO: 118013 - protein, 9 aa, Homo Sapiens
SGQVLSPRY

SEQ ID NO: 118014 - protein, 9 aa, Homo Sapiens
LEPPKKGLL

SEQ ID NO: 118015 - protein, 9 aa, Homo Sapiens
GFRVHVPQP

SEQ ID NO: 118016 - protein, 9 aa, Homo Sapiens
LNVFMLYMK

SEQ ID NO: 118017 - protein, 9 aa, Homo Sapiens
TTTAFPTMQ

SEQ ID NO: 118018 - protein, 9 aa, Homo Sapiens
AIALEMERA

SEQ ID NO: 118019 - protein, 9 aa, Homo Sapiens
QAPKVHASK

SEQ ID NO: 118020 - protein, 9 aa, Homo Sapiens
LNRNHPLEP

SEQ ID NO: 118021 - protein, 9 aa, Homo Sapiens
QSCPCPYSE

SEQ ID NO: 118022 - protein, 9 aa, Homo Sapiens
MAENEEREI

SEQ ID NO: 118023 - protein, 9 aa, Homo Sapiens
QYVKLPMVP

SEQ ID NO: 118024 - protein, 9 aa, Homo Sapiens
LGFRVHVPQ

SEQ ID NO: 118025 - protein, 9 aa, Homo Sapiens
VLKGHDHEV

SEQ ID NO: 118026 - protein, 9 aa, Homo Sapiens
QSEVEGDKN

SEQ ID NO: 118027 - protein, 9 aa, Homo Sapiens
PVNKKYVPD

SEQ ID NO: 118028 - protein, 9 aa, Homo Sapiens
LDLETTAAY

SEQ ID NO: 118029 - protein, 9 aa, Homo Sapiens
IIRTAWRLD

SEQ ID NO: 118030 - protein, 9 aa, Homo Sapiens
PKHLQMLPL

SEQ ID NO: 118031 - protein, 9 aa, Homo Sapiens
GLLTKALSG

SEQ ID NO: 118032 - protein, 9 aa, Homo Sapiens
GSFPGMRQP

SEQ ID NO: 118033 - protein, 9 aa, Homo Sapiens
ASDGSDTSM

SEQ ID NO: 118034 - protein, 9 aa, Homo Sapiens
GPKGDWGFD

SEQ ID NO: 118035 - protein, 9 aa, Homo Sapiens
IAHLSFCAS

SEQ ID NO: 118036 - protein, 9 aa, Homo Sapiens
VPQRTAGSD

SEQ ID NO: 118037 - protein, 9 aa, Homo Sapiens
KIPHVIALE

SEQ ID NO: 118038 - protein, 9 aa, Homo Sapiens
LGLRLHYVS

SEQ ID NO: 118039 - protein, 9 aa, Homo Sapiens
CLGDARFVC

SEQ ID NO: 118040 - protein, 9 aa, Homo Sapiens
IRLEHEGGA

SEQ ID NO: 118041 - protein, 9 aa, Homo Sapiens
TKNCADKNA

SEQ ID NO: 118042 - protein, 9 aa, Homo Sapiens
ASAGTRMGL

SEQ ID NO: 118043 - protein, 9 aa, Homo Sapiens
HKRETADTQ

SEQ ID NO: 118044 - protein, 9 aa, Homo Sapiens
AVASAVVRL

SEQ ID NO: 118045 - protein, 9 aa, Homo Sapiens
PIRHDDGSW

SEQ ID NO: 118046 - protein, 9 aa, Homo Sapiens
TCHCQCTGM

SEQ ID NO: 118047 - protein, 9 aa, Homo Sapiens
APGEKPPTP

SEQ ID NO: 118048 - protein, 9 aa, Homo Sapiens
ENEEHSRAL

SEQ ID NO: 118049 - protein, 9 aa, Homo Sapiens
ECPVADNER

SEQ ID NO: 118050 - protein, 9 aa, Homo Sapiens
VVSVAANMA

SEQ ID NO: 118051 - protein, 9 aa, Homo Sapiens
HTEEDCMEE

SEQ ID NO: 118052 - protein, 9 aa, Homo Sapiens
EDLFWKLDT

SEQ ID NO: 118053 - protein, 9 aa, Homo Sapiens
NDHGKNALL

SEQ ID NO: 118054 - protein, 9 aa, Homo Sapiens
KVGAVVLIL

SEQ ID NO: 118055 - protein, 9 aa, Homo Sapiens
AITLVCVKT

SEQ ID NO: 118056 - protein, 9 aa, Homo Sapiens
QGGQYDGSA

SEQ ID NO: 118057 - protein, 9 aa, Homo Sapiens
PQIERLDFL

SEQ ID NO: 118058 - protein, 9 aa, Homo Sapiens
SPVRLASRQ

SEQ ID NO: 118059 - protein, 9 aa, Homo Sapiens
DVRLIHRDL

SEQ ID NO: 118060 - protein, 9 aa, Homo Sapiens
NCTYGLCMQ

SEQ ID NO: 118061 - protein, 9 aa, Homo Sapiens
FLVVRRCVK

SEQ ID NO: 118062 - protein, 9 aa, Homo Sapiens
PRAVLKGHD

SEQ ID NO: 118063 - protein, 9 aa, Homo Sapiens
HPLEPPKKG

SEQ ID NO: 118064 - protein, 9 aa, Homo Sapiens
LDCETQSHY

SEQ ID NO: 118065 - protein, 9 aa, Homo Sapiens
QLNTDGALW

SEQ ID NO: 118066 - protein, 9 aa, Homo Sapiens
LGKREQYGS

SEQ ID NO: 118067 - protein, 9 aa, Homo Sapiens
PLGGQGGQY

SEQ ID NO: 118068 - protein, 9 aa, Homo Sapiens
LSPSNSTHE

SEQ ID NO: 118069 - protein, 9 aa, Homo Sapiens
AMMRKAIRG

SEQ ID NO: 118070 - protein, 9 aa, Homo Sapiens
SLLFSITQK

SEQ ID NO: 118071 - protein, 8 aa, Homo Sapiens
SAGGGRAF

SEQ ID NO: 118072 - protein, 9 aa, Homo Sapiens
SKLLLPHLT

SEQ ID NO: 118073 - protein, 9 aa, Homo Sapiens
SSQAGAFSV

SEQ ID NO: 118074 - protein, 9 aa, Homo Sapiens
VASAVVRLG

SEQ ID NO: 118075 - protein, 9 aa, Homo Sapiens
LVVSVAANM

SEQ ID NO: 118076 - protein, 9 aa, Homo Sapiens
EEFRNRNQH

SEQ ID NO: 118077 - protein, 9 aa, Homo Sapiens
AKGVVVSLT

SEQ ID NO: 118078 - protein, 9 aa, Homo Sapiens
ITQLVRASL

SEQ ID NO: 118079 - protein, 9 aa, Homo Sapiens
GQSRAKITN

SEQ ID NO: 118080 - protein, 9 aa, Homo Sapiens
MRKPAERLA

SEQ ID NO: 118081 - protein, 9 aa, Homo Sapiens
PHLTLESRE

SEQ ID NO: 118082 - protein, 9 aa, Homo Sapiens
MDTDVPEEE

SEQ ID NO: 118083 - protein, 9 aa, Homo Sapiens
CSFQVTVDD

SEQ ID NO: 118084 - protein, 9 aa, Homo Sapiens
GLASCGGRS

SEQ ID NO: 118085 - protein, 9 aa, Homo Sapiens
RLIHRDLAA

SEQ ID NO: 118086 - protein, 9 aa, Homo Sapiens
SPYYFQCKT

SEQ ID NO: 118087 - protein, 9 aa, Homo Sapiens
HIEMVINAL

SEQ ID NO: 118088 - protein, 9 aa, Homo Sapiens
WAYNGEGRT

SEQ ID NO: 118089 - protein, 9 aa, Homo Sapiens
GSEAMLVDV

SEQ ID NO: 118090 - protein, 9 aa, Homo Sapiens
EARSRDLRR

SEQ ID NO: 118091 - protein, 9 aa, Homo Sapiens
NHQRLDMED

SEQ ID NO: 118092 - protein, 9 aa, Homo Sapiens
ATQLNTDGA

SEQ ID NO: 118093 - protein, 9 aa, Homo Sapiens
ILESFPKDV

SEQ ID NO: 118094 - protein, 9 aa, Homo Sapiens
LSHHQGLSI

SEQ ID NO: 118095 - protein, 9 aa, Homo Sapiens
ASRQEDAPM

SEQ ID NO: 118096 - protein, 9 aa, Homo Sapiens
HLRGRGRTM

SEQ ID NO: 118097 - protein, 9 aa, Homo Sapiens
SDVPERELY

SEQ ID NO: 118098 - protein, 9 aa, Homo Sapiens
SGQSRAKIT

SEQ ID NO: 118099 - protein, 9 aa, Homo Sapiens
SLTCDLLQS

SEQ ID NO: 118100 - protein, 9 aa, Homo Sapiens
TAHTLGDRE

SEQ ID NO: 118101 - protein, 9 aa, Homo Sapiens
AMLAFPLEW

SEQ ID NO: 118102 - protein, 9 aa, Homo Sapiens
NKPGVYTGV

SEQ ID NO: 118103 - protein, 9 aa, Homo Sapiens
AHLDCCVIA

SEQ ID NO: 118104 - protein, 9 aa, Homo Sapiens
TDDKSIYGE

SEQ ID NO: 118105 - protein, 9 aa, Homo Sapiens
LNMTNSSIN

SEQ ID NO: 118106 - protein, 9 aa, Homo Sapiens
FVVGLVGNL

SEQ ID NO: 118107 - protein, 9 aa, Homo Sapiens
ESVPVIVQL

SEQ ID NO: 118108 - protein, 9 aa, Homo Sapiens
LQRQISDIH

SEQ ID NO: 118109 - protein, 9 aa, Homo Sapiens
YPAPRAVLK

SEQ ID NO: 118110 - protein, 9 aa, Homo Sapiens
EAITLVCVK

SEQ ID NO: 118111 - protein, 9 aa, Homo Sapiens
LEMAENEER

SEQ ID NO: 118112 - protein, 9 aa, Homo Sapiens
LTKDTMPQM

SEQ ID NO: 118113 - protein, 9 aa, Homo Sapiens
LDIPQDSLL

SEQ ID NO: 118114 - protein, 9 aa, Homo Sapiens
VGLVGNLLV

SEQ ID NO: 118115 - protein, 9 aa, Homo Sapiens
FQVLSTTVK

SEQ ID NO: 118116 - protein, 9 aa, Homo Sapiens
ARRHRGHGS

SEQ ID NO: 118117 - protein, 9 aa, Homo Sapiens
VAANMAPKF

SEQ ID NO: 118118 - protein, 9 aa, Homo Sapiens
GVEILNEHR

SEQ ID NO: 118119 - protein, 9 aa, Homo Sapiens
GRPIAMLAF

SEQ ID NO: 118120 - protein, 9 aa, Homo Sapiens
MVGLHWWNH

SEQ ID NO: 118121 - protein, 9 aa, Homo Sapiens
VYTGVTSFL

SEQ ID NO: 118122 - protein, 9 aa, Homo Sapiens
SVLGKREQY

SEQ ID NO: 118123 - protein, 9 aa, Homo Sapiens
WKLPQELYS

SEQ ID NO: 118124 - protein, 9 aa, Homo Sapiens
DKNIMTQNV

SEQ ID NO: 118125 - protein, 9 aa, Homo Sapiens
AYIRYLMLF

SEQ ID NO: 118126 - protein, 9 aa, Homo Sapiens
SPLGATQLN

SEQ ID NO: 118127 - protein, 9 aa, Homo Sapiens
LLPHLTLES

SEQ ID NO: 118128 - protein, 9 aa, Homo Sapiens
IQRNLAHFP

SEQ ID NO: 118129 - protein, 9 aa, Homo Sapiens
AAIEQHIAE

SEQ ID NO: 118130 - protein, 9 aa, Homo Sapiens
VTMKYTQGS

SEQ ID NO: 118131 - protein, 9 aa, Homo Sapiens
MVINALKTE

SEQ ID NO: 118132 - protein, 9 aa, Homo Sapiens
FSPHRSLHH

SEQ ID NO: 118133 - protein, 9 aa, Homo Sapiens
EKNRVPRAT

SEQ ID NO: 118134 - protein, 9 aa, Homo Sapiens
EEREIKCYN

SEQ ID NO: 118135 - protein, 9 aa, Homo Sapiens
HEKNQELRQ

SEQ ID NO: 118136 - protein, 9 aa, Homo Sapiens
SDTSMPPTP

SEQ ID NO: 118137 - protein, 9 aa, Homo Sapiens
FLKCLNPYF

SEQ ID NO: 118138 - protein, 9 aa, Homo Sapiens
CHCQCTGMD

SEQ ID NO: 118139 - protein, 9 aa, Homo Sapiens
VDKRFLPND

SEQ ID NO: 118140 - protein, 9 aa, Homo Sapiens
TRLQRQISD

SEQ ID NO: 118141 - protein, 9 aa, Homo Sapiens
IEDLSPRCP

SEQ ID NO: 118142 - protein, 9 aa, Homo Sapiens
APSTSQNCD

SEQ ID NO: 118143 - protein, 9 aa, Homo Sapiens
LQQRQLKHL

SEQ ID NO: 118144 - protein, 9 aa, Homo Sapiens
PSNSTHEFH

SEQ ID NO: 118145 - protein, 9 aa, Homo Sapiens
KLPMVPHAE

SEQ ID NO: 118146 - protein, 9 aa, Homo Sapiens
QSLRLTSSH

SEQ ID NO: 118147 - protein, 9 aa, Homo Sapiens
FVSELKSYL

SEQ ID NO: 118148 - protein, 9 aa, Homo Sapiens
LQSKNCTYG

SEQ ID NO: 118149 - protein, 9 aa, Homo Sapiens
VVVGADGVG

SEQ ID NO: 118150 - protein, 9 aa, Homo Sapiens
HFSPHRSLH

SEQ ID NO: 118151 - protein, 9 aa, Homo Sapiens
TGRLMVGLH

SEQ ID NO: 118152 - protein, 9 aa, Homo Sapiens
KSGPPVGPV

SEQ ID NO: 118153 - protein, 9 aa, Homo Sapiens
AENEEREIK

SEQ ID NO: 118154 - protein, 9 aa, Homo Sapiens
SHIVEAHVC

SEQ ID NO: 118155 - protein, 9 aa, Homo Sapiens
DMDTDVPEE

SEQ ID NO: 118156 - protein, 9 aa, Homo Sapiens
PAGKEGIRG

SEQ ID NO: 118157 - protein, 9 aa, Homo Sapiens
PILESFPKD

SEQ ID NO: 118158 - protein, 9 aa, Homo Sapiens
LFLTVGFMQ

SEQ ID NO: 118159 - protein, 9 aa, Homo Sapiens
RGVEILNEH

SEQ ID NO: 118160 - protein, 9 aa, Homo Sapiens
IHTVSSEAF

SEQ ID NO: 118161 - protein, 9 aa, Homo Sapiens
IIQLVRDPR

SEQ ID NO: 118162 - protein, 9 aa, Homo Sapiens
ELGKGAFLV

SEQ ID NO: 118163 - protein, 9 aa, Homo Sapiens
EPQIERLDF

SEQ ID NO: 118164 - protein, 9 aa, Homo Sapiens
GLFGVWAYN

SEQ ID NO: 118165 - protein, 9 aa, Homo Sapiens
SRAKITNNL

SEQ ID NO: 118166 - protein, 9 aa, Homo Sapiens
DTLQTFIRD

SEQ ID NO: 118167 - protein, 9 aa, Homo Sapiens
ALEMAENEE

SEQ ID NO: 118168 - protein, 9 aa, Homo Sapiens
SPSNSTHEF

SEQ ID NO: 118169 - protein, 9 aa, Homo Sapiens
RPIAMLAFP

SEQ ID NO: 118170 - protein, 9 aa, Homo Sapiens
HVIALENPR

SEQ ID NO: 118171 - protein, 9 aa, Homo Sapiens
GYHANYREG

SEQ ID NO: 118172 - protein, 9 aa, Homo Sapiens
KRETADTQA

SEQ ID NO: 118173 - protein, 9 aa, Homo Sapiens
ADTQACLRN

SEQ ID NO: 118174 - protein, 9 aa, Homo Sapiens
QLNMTNSSI

SEQ ID NO: 118175 - protein, 9 aa, Homo Sapiens
TTCHCQCTG

SEQ ID NO: 118176 - protein, 9 aa, Homo Sapiens
ADGVGKSAL

SEQ ID NO: 118177 - protein, 9 aa, Homo Sapiens
YLNCCDCCS

SEQ ID NO: 118178 - protein, 9 aa, Homo Sapiens
NLVDNLVNQ

SEQ ID NO: 118179 - protein, 9 aa, Homo Sapiens
HMKEQILEL

SEQ ID NO: 118180 - protein, 9 aa, Homo Sapiens
GVWAYNGEG

SEQ ID NO: 118181 - protein, 9 aa, Homo Sapiens
QVLSPRYPA

SEQ ID NO: 118182 - protein, 9 aa, Homo Sapiens
QVLADVLPD

SEQ ID NO: 118183 - protein, 9 aa, Homo Sapiens
DSLLFSITQ

SEQ ID NO: 118184 - protein, 9 aa, Homo Sapiens
FVQRAFDHE

SEQ ID NO: 118185 - protein, 9 aa, Homo Sapiens
HWWNHIDED

SEQ ID NO: 118186 - protein, 9 aa, Homo Sapiens
GRGRTMYNT

SEQ ID NO: 118187 - protein, 9 aa, Homo Sapiens
TIAQIQRNL

SEQ ID NO: 118188 - protein, 9 aa, Homo Sapiens
EIRLEHEGG

SEQ ID NO: 118189 - protein, 9 aa, Homo Sapiens
VRLGPVAFK

SEQ ID NO: 118190 - protein, 9 aa, Homo Sapiens
TMQRPWTPS

SEQ ID NO: 118191 - protein, 9 aa, Homo Sapiens
AVPQRTAGS

SEQ ID NO: 118192 - protein, 9 aa, Homo Sapiens
PGEKPPTPL

SEQ ID NO: 118193 - protein, 9 aa, Homo Sapiens
PVSSEVRSR

SEQ ID NO: 118194 - protein, 9 aa, Homo Sapiens
VPLGGQGGQ

SEQ ID NO: 118195 - protein, 9 aa, Homo Sapiens
FPGMRQPGM

SEQ ID NO: 118196 - protein, 9 aa, Homo Sapiens
NSSINMPSS

SEQ ID NO: 118197 - protein, 9 aa, Homo Sapiens
TMKYTQGSW

SEQ ID NO: 118198 - protein, 9 aa, Homo Sapiens
MGGKRRRDD

SEQ ID NO: 118199 - protein, 9 aa, Homo Sapiens
HCQCTGMDW

SEQ ID NO: 118200 - protein, 9 aa, Homo Sapiens
LQGVFRVCH

SEQ ID NO: 118201 - protein, 9 aa, Homo Sapiens
AFPTMQRPW

SEQ ID NO: 118202 - protein, 9 aa, Homo Sapiens
VNQVLADVL

SEQ ID NO: 118203 - protein, 9 aa, Homo Sapiens
QGVFRVCHC

SEQ ID NO: 118204 - protein, 9 aa, Homo Sapiens
LIHRDLAAR

SEQ ID NO: 118205 - protein, 9 aa, Homo Sapiens
CLNPYFNPP

SEQ ID NO: 118206 - protein, 9 aa, Homo Sapiens
LHFSPHRSL

SEQ ID NO: 118207 - protein, 9 aa, Homo Sapiens
VCVKTGGEP

SEQ ID NO: 118208 - protein, 9 aa, Homo Sapiens
RASLVQPQT

SEQ ID NO: 118209 - protein, 9 aa, Homo Sapiens
YGRLQPILE

SEQ ID NO: 118210 - protein, 9 aa, Homo Sapiens
LNLKIPHVI

SEQ ID NO: 118211 - protein, 9 aa, Homo Sapiens
IEQHIAEEK

SEQ ID NO: 118212 - protein, 9 aa, Homo Sapiens
YVLSSCVRT

SEQ ID NO: 118213 - protein, 9 aa, Homo Sapiens
FYTLAYIRY

SEQ ID NO: 118214 - protein, 9 aa, Homo Sapiens
CHCNWLMPS

SEQ ID NO: 118215 - protein, 9 aa, Homo Sapiens
SLGLRLHYV

SEQ ID NO: 118216 - protein, 9 aa, Homo Sapiens
YILPRKVLQ

SEQ ID NO: 118217 - protein, 9 aa, Homo Sapiens
MKVLLLLVL

SEQ ID NO: 118218 - protein, 9 aa, Homo Sapiens
LVQPQTLLT

SEQ ID NO: 118219 - protein, 9 aa, Homo Sapiens
QAFHSVGST

SEQ ID NO: 118220 - protein, 9 aa, Homo Sapiens
YVKLPMVPH

SEQ ID NO: 118221 - protein, 9 aa, Homo Sapiens
LGAHLDCCV

SEQ ID NO: 118222 - protein, 9 aa, Homo Sapiens
HLQGAEVAA

SEQ ID NO: 118223 - protein, 9 aa, Homo Sapiens
HDDGSWEVI

SEQ ID NO: 118224 - protein, 9 aa, Homo Sapiens
IERLDFLTL

SEQ ID NO: 118225 - protein, 9 aa, Homo Sapiens
RNLAHFPAV

SEQ ID NO: 118226 - protein, 9 aa, Homo Sapiens
MLAFPLEWF

SEQ ID NO: 118227 - protein, 9 aa, Homo Sapiens
VEKRTIPRR

SEQ ID NO: 118228 - protein, 9 aa, Homo Sapiens
SGYHANYRE

SEQ ID NO: 118229 - protein, 9 aa, Homo Sapiens
LRGRGRTMY

SEQ ID NO: 118230 - protein, 9 aa, Homo Sapiens
KVLQMDFLV

SEQ ID NO: 118231 - protein, 9 aa, Homo Sapiens
DPEDFFTEG

SEQ ID NO: 118232 - protein, 9 aa, Homo Sapiens
MEMRKPAER

SEQ ID NO: 118233 - protein, 9 aa, Homo Sapiens
PTPLQFHLL

SEQ ID NO: 118234 - protein, 9 aa, Homo Sapiens
TVGFMQHHT

SEQ ID NO: 118235 - protein, 9 aa, Homo Sapiens
EPIKVLCRG

SEQ ID NO: 118236 - protein, 9 aa, Homo Sapiens
CTGMDWTGA

SEQ ID NO: 118237 - protein, 9 aa, Homo Sapiens
HHQGLSIIN

SEQ ID NO: 118238 - protein, 9 aa, Homo Sapiens
DMLQAPKVH

SEQ ID NO: 118239 - protein, 9 aa, Homo Sapiens
QCTGMDWTG

SEQ ID NO: 118240 - protein, 9 aa, Homo Sapiens
ETTCHCQCT

SEQ ID NO: 118241 - protein, 9 aa, Homo Sapiens
VVSLTLGEI

SEQ ID NO: 118242 - protein, 9 aa, Homo Sapiens
NQHIVQLIQ

SEQ ID NO: 118243 - protein, 9 aa, Homo Sapiens
DTSMPPTPG

SEQ ID NO: 118244 - protein, 9 aa, Homo Sapiens
EVEGDKNIM

SEQ ID NO: 118245 - protein, 9 aa, Homo Sapiens
QTGPKGDWG

SEQ ID NO: 118246 - protein, 9 aa, Homo Sapiens
RLGPVAFKL

SEQ ID NO: 118247 - protein, 9 aa, Homo Sapiens
VCGGTELVF

SEQ ID NO: 118248 - protein, 9 aa, Homo Sapiens
AWRLDRERR

SEQ ID NO: 118249 - protein, 9 aa, Homo Sapiens
VLSSCVRTG

SEQ ID NO: 118250 - protein, 9 aa, Homo Sapiens
THIEMVINA

SEQ ID NO: 118251 - protein, 9 aa, Homo Sapiens
IAQIQRNLA

SEQ ID NO: 118252 - protein, 9 aa, Homo Sapiens
HQRLDMEDP

SEQ ID NO: 118253 - protein, 9 aa, Homo Sapiens
NYVLSSCVR

SEQ ID NO: 118254 - protein, 9 aa, Homo Sapiens
RDLRRRWCP

SEQ ID NO: 118255 - protein, 9 aa, Homo Sapiens
AGKEGIRGP

SEQ ID NO: 118256 - protein, 9 aa, Homo Sapiens
IHKRETADT

SEQ ID NO: 118257 - protein, 9 aa, Homo Sapiens
KLVVVGADG

SEQ ID NO: 118258 - protein, 9 aa, Homo Sapiens
LAAIEQHIA

SEQ ID NO: 118259 - protein, 9 aa, Homo Sapiens
GSDTSMPPT

SEQ ID NO: 118260 - protein, 9 aa, Homo Sapiens
VIVLEKSGP

SEQ ID NO: 118261 - protein, 9 aa, Homo Sapiens
IDTLLALGE

SEQ ID NO: 118262 - protein, 9 aa, Homo Sapiens
FHHPVNKKY

SEQ ID NO: 118263 - protein, 9 aa, Homo Sapiens
LSNGLLYYR

SEQ ID NO: 118264 - protein, 9 aa, Homo Sapiens
QPILESFPK

SEQ ID NO: 118265 - protein, 9 aa, Homo Sapiens
KTAKGVVVS

SEQ ID NO: 118266 - protein, 9 aa, Homo Sapiens
TMPQMYKRK

SEQ ID NO: 118267 - protein, 9 aa, Homo Sapiens
LQGAEVAAG

SEQ ID NO: 118268 - protein, 9 aa, Homo Sapiens
VSVAANMAP

SEQ ID NO: 118269 - protein, 9 aa, Homo Sapiens
QMYKRKRSW

SEQ ID NO: 118270 - protein, 9 aa, Homo Sapiens
TTAFPTMQR

SEQ ID NO: 118271 - protein, 9 aa, Homo Sapiens
SNSTHEFHK

SEQ ID NO: 118272 - protein, 9 aa, Homo Sapiens
ASQNSWLCE

SEQ ID NO: 118273 - protein, 9 aa, Homo Sapiens
VWAYNGEGR

SEQ ID NO: 118274 - protein, 9 aa, Homo Sapiens
KGDWGFDGL

SEQ ID NO: 118275 - protein, 9 aa, Homo Sapiens
LEGLLTKAL

SEQ ID NO: 118276 - protein, 9 aa, Homo Sapiens
CADKNAIHN

SEQ ID NO: 118277 - protein, 9 aa, Homo Sapiens
EDVRLIHRD

SEQ ID NO: 118278 - protein, 9 aa, Homo Sapiens
KDTMPQMYK

SEQ ID NO: 118279 - protein, 9 aa, Homo Sapiens
LTWIPVLQA

SEQ ID NO: 118280 - protein, 9 aa, Homo Sapiens
PIAMLAFPL

SEQ ID NO: 118281 - protein, 9 aa, Homo Sapiens
LSIINYDDE

SEQ ID NO: 118282 - protein, 9 aa, Homo Sapiens
HANYREGEC

SEQ ID NO: 118283 - protein, 9 aa, Homo Sapiens
WLRPELHMK

SEQ ID NO: 118284 - protein, 9 aa, Homo Sapiens
SNGLLYYRS

SEQ ID NO: 118285 - protein, 9 aa, Homo Sapiens
VCHCNWLMP

SEQ ID NO: 118286 - protein, 9 aa, Homo Sapiens
VKTGGEPAP

SEQ ID NO: 118287 - protein, 9 aa, Homo Sapiens
LASLCPVRC

SEQ ID NO: 118288 - protein, 9 aa, Homo Sapiens
MEELFDFLH

SEQ ID NO: 118289 - protein, 9 aa, Homo Sapiens
RYPAPYEHN

SEQ ID NO: 118290 - protein, 9 aa, Homo Sapiens
NHPLEPPKK

SEQ ID NO: 118291 - protein, 9 aa, Homo Sapiens
VDNLVNQVL

SEQ ID NO: 118292 - protein, 9 aa, Homo Sapiens
LKGHDHEVV

SEQ ID NO: 118293 - protein, 9 aa, Homo Sapiens
LYYRSKAEM

SEQ ID NO: 118294 - protein, 9 aa, Homo Sapiens
VVRLGPVAF

SEQ ID NO: 118295 - protein, 9 aa, Homo Sapiens
APKVHASKP

SEQ ID NO: 118296 - protein, 9 aa, Homo Sapiens
NMTNSSINM

SEQ ID NO: 118297 - protein, 9 aa, Homo Sapiens
VYAVEKGKN

SEQ ID NO: 118298 - protein, 9 aa, Homo Sapiens
DKRFLPNDH

SEQ ID NO: 118299 - protein, 9 aa, Homo Sapiens
SKGFDVTMK

SEQ ID NO: 118300 - protein, 9 aa, Homo Sapiens
LRIIQLVRD

SEQ ID NO: 118301 - protein, 9 aa, Homo Sapiens
NLVNQVLAD

SEQ ID NO: 118302 - protein, 9 aa, Homo Sapiens
MPPTPGEGA

SEQ ID NO: 118303 - protein, 9 aa, Homo Sapiens
LEDVRLIHR

SEQ ID NO: 118304 - protein, 9 aa, Homo Sapiens
WRLDRERRD

SEQ ID NO: 118305 - protein, 9 aa, Homo Sapiens
AAALSVLGK

SEQ ID NO: 118306 - protein, 9 aa, Homo Sapiens
LNLKSLGLR

SEQ ID NO: 118307 - protein, 9 aa, Homo Sapiens
GMRQPGMLC

SEQ ID NO: 118308 - protein, 9 aa, Homo Sapiens
GDKNIMTQN

SEQ ID NO: 118309 - protein, 9 aa, Homo Sapiens
ALSPSNSTH

SEQ ID NO: 118310 - protein, 9 aa, Homo Sapiens
AGSEAMLVD

SEQ ID NO: 118311 - protein, 9 aa, Homo Sapiens
SLCPVRCCF

SEQ ID NO: 118312 - protein, 9 aa, Homo Sapiens
NLKIPHVIA

SEQ ID NO: 118313 - protein, 9 aa, Homo Sapiens
VVLILGAVL

SEQ ID NO: 118314 - protein, 9 aa, Homo Sapiens
SKVEHEKNQ

SEQ ID NO: 118315 - protein, 9 aa, Homo Sapiens
GVVFVQRAF

SEQ ID NO: 118316 - protein, 9 aa, Homo Sapiens
QAGAFSVST

SEQ ID NO: 118317 - protein, 9 aa, Homo Sapiens
DIHKRMKPL

SEQ ID NO: 118318 - protein, 9 aa, Homo Sapiens
KKPLNVFML

SEQ ID NO: 118319 - protein, 9 aa, Homo Sapiens
YYFQCKTTK

SEQ ID NO: 118320 - protein, 9 aa, Homo Sapiens
QPVPLGGQG

SEQ ID NO: 118321 - protein, 9 aa, Homo Sapiens
YVPDYYKMI

SEQ ID NO: 118322 - protein, 9 aa, Homo Sapiens
PHVIALENP

SEQ ID NO: 118323 - protein, 9 aa, Homo Sapiens
NKILVIAIM

SEQ ID NO: 118324 - protein, 9 aa, Homo Sapiens
DVPEEEEDE

SEQ ID NO: 118325 - protein, 9 aa, Homo Sapiens
EAVKTHIEM

SEQ ID NO: 118326 - protein, 9 aa, Homo Sapiens
SPHRSLHHH

SEQ ID NO: 118327 - protein, 9 aa, Homo Sapiens
EKTAKGVVV

SEQ ID NO: 118328 - protein, 9 aa, Homo Sapiens
LALEGDSVA

SEQ ID NO: 118329 - protein, 9 aa, Homo Sapiens
DLFWKLDTL

SEQ ID NO: 118330 - protein, 9 aa, Homo Sapiens
MQRPWTPSP

SEQ ID NO: 118331 - protein, 9 aa, Homo Sapiens
CAGNSSQSC

SEQ ID NO: 118332 - protein, 9 aa, Homo Sapiens
QGLSIINYD

SEQ ID NO: 118333 - protein, 9 aa, Homo Sapiens
AHTLGDREA

SEQ ID NO: 118334 - protein, 9 aa, Homo Sapiens
VLPDADTYY

SEQ ID NO: 118335 - protein, 9 aa, Homo Sapiens
EEHSRALEE

SEQ ID NO: 118336 - protein, 9 aa, Homo Sapiens
VLQQRQLKH

SEQ ID NO: 118337 - protein, 9 aa, Homo Sapiens
ASLVQPQTL

SEQ ID NO: 118338 - protein, 9 aa, Homo Sapiens
PKVHASKPA

SEQ ID NO: 118339 - protein, 9 aa, Homo Sapiens
LGAVLLLFG

SEQ ID NO: 118340 - protein, 9 aa, Homo Sapiens
DCCVIAGLC

SEQ ID NO: 118341 - protein, 9 aa, Homo Sapiens
HSRALEEER

SEQ ID NO: 118342 - protein, 9 aa, Homo Sapiens
SEVEGDKNI

SEQ ID NO: 118343 - protein, 9 aa, Homo Sapiens
YLLERALNC

SEQ ID NO: 118344 - protein, 9 aa, Homo Sapiens
EMERAKAMR

SEQ ID NO: 118345 - protein, 9 aa, Homo Sapiens
EFRNRNQHI

SEQ ID NO: 118346 - protein, 9 aa, Homo Sapiens
PTMQRPWTP

SEQ ID NO: 118347 - protein, 9 aa, Homo Sapiens
WIPVLQAFH

SEQ ID NO: 118348 - protein, 9 aa, Homo Sapiens
EAFSLLEEV

SEQ ID NO: 118349 - protein, 9 aa, Homo Sapiens
GLLYYRSKA

SEQ ID NO: 118350 - protein, 9 aa, Homo Sapiens
QLKHLCTIC

SEQ ID NO: 118351 - protein, 9 aa, Homo Sapiens
TLVCVKTGG

SEQ ID NO: 118352 - protein, 9 aa, Homo Sapiens
ALEMERAKA

SEQ ID NO: 118353 - protein, 9 aa, Homo Sapiens
RCPYQFRVS

SEQ ID NO: 118354 - protein, 9 aa, Homo Sapiens
RVPRATTSR

SEQ ID NO: 118355 - protein, 9 aa, Homo Sapiens
NLQSEVEGD

SEQ ID NO: 118356 - protein, 9 aa, Homo Sapiens
ETADTQACL

SEQ ID NO: 118357 - protein, 9 aa, Homo Sapiens
GFMQHHTQS

SEQ ID NO: 118358 - protein, 9 aa, Homo Sapiens
MSITDMLSA

SEQ ID NO: 118359 - protein, 9 aa, Homo Sapiens
AELEGLLTK

SEQ ID NO: 118360 - protein, 9 aa, Homo Sapiens
TELLNRGLG

SEQ ID NO: 118361 - protein, 9 aa, Homo Sapiens
EELGKGAFL

SEQ ID NO: 118362 - protein, 9 aa, Homo Sapiens
AEVWCGSEC

SEQ ID NO: 118363 - protein, 9 aa, Homo Sapiens
HEGGAPCTA

SEQ ID NO: 118364 - protein, 9 aa, Homo Sapiens
RSHTEEDCM

SEQ ID NO: 118365 - protein, 9 aa, Homo Sapiens
GIRGPRGDQ

SEQ ID NO: 118366 - protein, 9 aa, Homo Sapiens
RMGLASCGG

SEQ ID NO: 118367 - protein, 9 aa, Homo Sapiens
KNRVPRATT

SEQ ID NO: 118368 - protein, 9 aa, Homo Sapiens
TCLGDARFV

SEQ ID NO: 118369 - protein, 9 aa, Homo Sapiens
SGPSIVHCK

SEQ ID NO: 118370 - protein, 9 aa, Homo Sapiens
NLVVKVHMN

SEQ ID NO: 118371 - protein, 9 aa, Homo Sapiens
TAFPTMQRP

SEQ ID NO: 118372 - protein, 9 aa, Homo Sapiens
LAYIRYLML

SEQ ID NO: 118373 - protein, 9 aa, Homo Sapiens
KEPQIERLD

SEQ ID NO: 118374 - protein, 9 aa, Homo Sapiens
PENSCSPYY

SEQ ID NO: 118375 - protein, 9 aa, Homo Sapiens
KLLLPHLTL

SEQ ID NO: 118376 - protein, 9 aa, Homo Sapiens
VEGDKNIMT

SEQ ID NO: 118377 - protein, 9 aa, Homo Sapiens
AIEQHIAEE

SEQ ID NO: 118378 - protein, 9 aa, Homo Sapiens
HIVEAHVCA

SEQ ID NO: 118379 - protein, 9 aa, Homo Sapiens
ASLCPVRCC

SEQ ID NO: 118380 - protein, 9 aa, Homo Sapiens
AGTRMGLAS

SEQ ID NO: 118381 - protein, 9 aa, Homo Sapiens
LRLTSSHVH

SEQ ID NO: 118382 - protein, 9 aa, Homo Sapiens
FRNRNQHIV

SEQ ID NO: 118383 - protein, 9 aa, Homo Sapiens
HRSLHHHVN

SEQ ID NO: 118384 - protein, 9 aa, Homo Sapiens
AIMFQVCIG

SEQ ID NO: 118385 - protein, 9 aa, Homo Sapiens
RVRLGFRVH

SEQ ID NO: 118386 - protein, 9 aa, Homo Sapiens
KTIDTLLAL

SEQ ID NO: 118387 - protein, 9 aa, Homo Sapiens
RRHRGHGSE

SEQ ID NO: 118388 - protein, 9 aa, Homo Sapiens
EVRSRKITK

SEQ ID NO: 118389 - protein, 9 aa, Homo Sapiens
YIRYLMLFN

SEQ ID NO: 118390 - protein, 9 aa, Homo Sapiens
HSPIDSASP

SEQ ID NO: 118391 - protein, 9 aa, Homo Sapiens
ITLVCVKTG

SEQ ID NO: 118392 - protein, 9 aa, Homo Sapiens
LVDNLVNQV

SEQ ID NO: 118393 - protein, 9 aa, Homo Sapiens
SGVVFVQRA

SEQ ID NO: 118394 - protein, 9 aa, Homo Sapiens
KPRRVCMGG

SEQ ID NO: 118395 - protein, 9 aa, Homo Sapiens
PQMYKRKRS

SEQ ID NO: 118396 - protein, 9 aa, Homo Sapiens
CAQLIKPRV

SEQ ID NO: 118397 - protein, 9 aa, Homo Sapiens
MTNSSINMP

SEQ ID NO: 118398 - protein, 9 aa, Homo Sapiens
CESLVVPSG

SEQ ID NO: 118399 - protein, 9 aa, Homo Sapiens
GLNLKIPHV

SEQ ID NO: 118400 - protein, 9 aa, Homo Sapiens
LTCDLLQSQ

SEQ ID NO: 118401 - protein, 9 aa, Homo Sapiens
HPVNKKYVP

SEQ ID NO: 118402 - protein, 9 aa, Homo Sapiens
KVLLLLVLP

SEQ ID NO: 118403 - protein, 9 aa, Homo Sapiens
IFQVLSTTV

SEQ ID NO: 118404 - protein, 9 aa, Homo Sapiens
VSELKSYLK

SEQ ID NO: 118405 - protein, 9 aa, Homo Sapiens
SLGASSTRR

SEQ ID NO: 118406 - protein, 9 aa, Homo Sapiens
HTVLIAHLS

SEQ ID NO: 118407 - protein, 9 aa, Homo Sapiens
YKLVVVGAD

SEQ ID NO: 118408 - protein, 9 aa, Homo Sapiens
VCAQLIKPR

SEQ ID NO: 118409 - protein, 9 aa, Homo Sapiens
GVYTGVTSF

SEQ ID NO: 118410 - protein, 9 aa, Homo Sapiens
LVGNLLVMF

SEQ ID NO: 118411 - protein, 9 aa, Homo Sapiens
SFPIRHDDG

SEQ ID NO: 118412 - protein, 9 aa, Homo Sapiens
LKEAKVKNL

SEQ ID NO: 118413 - protein, 9 aa, Homo Sapiens
AFSVSTPNA

SEQ ID NO: 118414 - protein, 9 aa, Homo Sapiens
VLQYVKLPM

SEQ ID NO: 118415 - protein, 9 aa, Homo Sapiens
SLAAIEQHI

SEQ ID NO: 118416 - protein, 9 aa, Homo Sapiens
QARRHRGHG

SEQ ID NO: 118417 - protein, 9 aa, Homo Sapiens
GQGGQYDGS

SEQ ID NO: 118418 - protein, 9 aa, Homo Sapiens
LVIAIMFQV

SEQ ID NO: 118419 - protein, 9 aa, Homo Sapiens
TRMGLASCG

SEQ ID NO: 118420 - protein, 9 aa, Homo Sapiens
RRENDNPSS

SEQ ID NO: 118421 - protein, 9 aa, Homo Sapiens
VPRATTSRT

SEQ ID NO: 118422 - protein, 9 aa, Homo Sapiens
KNCTYGLCM

SEQ ID NO: 118423 - protein, 9 aa, Homo Sapiens
ESAHWLKSS

SEQ ID NO: 118424 - protein, 9 aa, Homo Sapiens
VRTVVGLDL

SEQ ID NO: 118425 - protein, 9 aa, Homo Sapiens
NEEHSRALE

SEQ ID NO: 118426 - protein, 9 aa, Homo Sapiens
PRKVLQMDF

SEQ ID NO: 118427 - protein, 9 aa, Homo Sapiens
KWKLPQELY

SEQ ID NO: 118428 - protein, 9 aa, Homo Sapiens
TGPKGDWGF

SEQ ID NO: 118429 - protein, 9 aa, Homo Sapiens
VGFMQHHTQ

SEQ ID NO: 118430 - protein, 9 aa, Homo Sapiens
MGLASCGGR

SEQ ID NO: 118431 - protein, 9 aa, Homo Sapiens
ECSFQVTVD

SEQ ID NO: 118432 - protein, 9 aa, Homo Sapiens
NYREGECPS

SEQ ID NO: 118433 - protein, 9 aa, Homo Sapiens
QRQISDIHV

SEQ ID NO: 118434 - protein, 9 aa, Homo Sapiens
SMCKHAEKE

SEQ ID NO: 118435 - protein, 9 aa, Homo Sapiens
TKGFLEKKQ

SEQ ID NO: 118436 - protein, 9 aa, Homo Sapiens
YHNHQRLDM

SEQ ID NO: 118437 - protein, 9 aa, Homo Sapiens
GGQGGQYDG

SEQ ID NO: 118438 - protein, 9 aa, Homo Sapiens
CMGGKRRRD

SEQ ID NO: 118439 - protein, 9 aa, Homo Sapiens
ISPSLASLC

SEQ ID NO: 118440 - protein, 9 aa, Homo Sapiens
EMRKPAERL

SEQ ID NO: 118441 - protein, 9 aa, Homo Sapiens
KGLNLKIPH

SEQ ID NO: 118442 - protein, 9 aa, Homo Sapiens
ILVIAIMFQ

SEQ ID NO: 118443 - protein, 9 aa, Homo Sapiens
RLGAHLDCC

SEQ ID NO: 118444 - protein, 9 aa, Homo Sapiens
LCPVRCCFA

SEQ ID NO: 118445 - protein, 9 aa, Homo Sapiens
DLRIIQLVR

SEQ ID NO: 118446 - protein, 9 aa, Homo Sapiens
LTSSHVHAA

SEQ ID NO: 118447 - protein, 9 aa, Homo Sapiens
LIAHLSFCA

SEQ ID NO: 118448 - protein, 9 aa, Homo Sapiens
PNYVLSSCV

SEQ ID NO: 118449 - protein, 9 aa, Homo Sapiens
LCRGVEILN

SEQ ID NO: 118450 - protein, 9 aa, Homo Sapiens
LGGGLHSHL

SEQ ID NO: 118451 - protein, 9 aa, Homo Sapiens
LVVVGADGV

SEQ ID NO: 118452 - protein, 9 aa, Homo Sapiens
ALSVLGKRE

SEQ ID NO: 118453 - protein, 9 aa, Homo Sapiens
AVKTHIEMV

SEQ ID NO: 118454 - protein, 9 aa, Homo Sapiens
RHIRKTIDT

SEQ ID NO: 118455 - protein, 9 aa, Homo Sapiens
AGIEARSRD

SEQ ID NO: 118456 - protein, 9 aa, Homo Sapiens
HIVQLIQDT

SEQ ID NO: 118457 - protein, 9 aa, Homo Sapiens
DNLVNQVLA

SEQ ID NO: 118458 - protein, 9 aa, Homo Sapiens
PPKHLQMLP

SEQ ID NO: 118459 - protein, 9 aa, Homo Sapiens
VVVSLTLGE

SEQ ID NO: 118460 - protein, 9 aa, Homo Sapiens
RAKITNNLF

SEQ ID NO: 118461 - protein, 9 aa, Homo Sapiens
VQRAFDHEQ

SEQ ID NO: 118462 - protein, 9 aa, Homo Sapiens
TLDIHKRMK

SEQ ID NO: 118463 - protein, 9 aa, Homo Sapiens
HQGLSIINY

SEQ ID NO: 118464 - protein, 9 aa, Homo Sapiens
LKCLNPYFN

SEQ ID NO: 118465 - protein, 9 aa, Homo Sapiens
MFQVCIGCF

SEQ ID NO: 118466 - protein, 9 aa, Homo Sapiens
WLKSSIGLI

SEQ ID NO: 118467 - protein, 9 aa, Homo Sapiens
ENSCSPYYF

SEQ ID NO: 118468 - protein, 9 aa, Homo Sapiens
ASSQAGAFS

SEQ ID NO: 118469 - protein, 9 aa, Homo Sapiens
YTGVTSFLD

SEQ ID NO: 118470 - protein, 9 aa, Homo Sapiens
EQHIAEEKA

SEQ ID NO: 118471 - protein, 9 aa, Homo Sapiens
CGSECPVAD

SEQ ID NO: 118472 - protein, 9 aa, Homo Sapiens
WVWAYRHIG

SEQ ID NO: 118473 - protein, 9 aa, Homo Sapiens
TVLIAHLSF

SEQ ID NO: 118474 - protein, 9 aa, Homo Sapiens
VVEKSLDCE

SEQ ID NO: 118475 - protein, 9 aa, Homo Sapiens
MTELLNRGL

SEQ ID NO: 118476 - protein, 9 aa, Homo Sapiens
MMEMRKPAE

SEQ ID NO: 118477 - protein, 9 aa, Homo Sapiens
LTKALSGPF

SEQ ID NO: 118478 - protein, 9 aa, Homo Sapiens
PPPPPPKHL

SEQ ID NO: 118479 - protein, 9 aa, Homo Sapiens
MLQAPKVHA

SEQ ID NO: 118480 - protein, 9 aa, Homo Sapiens
MVPHAECKT

SEQ ID NO: 118481 - protein, 9 aa, Homo Sapiens
VLMGKNAMM

SEQ ID NO: 118482 - protein, 9 aa, Homo Sapiens
AFSLLEEVI

SEQ ID NO: 118483 - protein, 9 aa, Homo Sapiens
HIAEEKAKR

SEQ ID NO: 118484 - protein, 9 aa, Homo Sapiens
SAGTRMGLA

SEQ ID NO: 118485 - protein, 9 aa, Homo Sapiens
EWLRPELHM

SEQ ID NO: 118486 - protein, 9 aa, Homo Sapiens
HLFVSELKS

SEQ ID NO: 118487 - protein, 9 aa, Homo Sapiens
PMVPHAECK

SEQ ID NO: 118488 - protein, 9 aa, Homo Sapiens
AHWLKSSIG

SEQ ID NO: 118489 - protein, 9 aa, Homo Sapiens
VGLHWWNHI

SEQ ID NO: 118490 - protein, 9 aa, Homo Sapiens
LVRASLVQP

SEQ ID NO: 118491 - protein, 9 aa, Homo Sapiens
QSGVVFVQR

SEQ ID NO: 118492 - protein, 9 aa, Homo Sapiens
VHSPIDSAS

SEQ ID NO: 118493 - protein, 9 aa, Homo Sapiens
GFLNLKSLG

SEQ ID NO: 118494 - protein, 9 aa, Homo Sapiens
LLLPHLTLE

SEQ ID NO: 118495 - protein, 9 aa, Homo Sapiens
LHWWNHIDE

SEQ ID NO: 118496 - protein, 9 aa, Homo Sapiens
SSCVRTGRS

SEQ ID NO: 118497 - protein, 9 aa, Homo Sapiens
ALPPLALEG

SEQ ID NO: 118498 - protein, 9 aa, Homo Sapiens
KVKNLVVKV

SEQ ID NO: 118499 - protein, 9 aa, Homo Sapiens
CCVIAGLCL

SEQ ID NO: 118500 - protein, 9 aa, Homo Sapiens
RRNVLPSLG

SEQ ID NO: 118501 - protein, 9 aa, Homo Sapiens
LGATQLNTD

SEQ ID NO: 118502 - protein, 9 aa, Homo Sapiens
IEMVINALK

SEQ ID NO: 118503 - protein, 9 aa, Homo Sapiens
STNIWPHGT

SEQ ID NO: 118504 - protein, 9 aa, Homo Sapiens
AVLEFPVCG

SEQ ID NO: 118505 - protein, 9 aa, Homo Sapiens
SQIYMNGSP

SEQ ID NO: 118506 - protein, 9 aa, Homo Sapiens
LVGYEVLDN

SEQ ID NO: 118507 - protein, 9 aa, Homo Sapiens
FVDGVKLNL

SEQ ID NO: 118508 - protein, 9 aa, Homo Sapiens
LLVRERKLA

SEQ ID NO: 118509 - protein, 9 aa, Homo Sapiens
RLKMMTRNF

SEQ ID NO: 118510 - protein, 9 aa, Homo Sapiens
AGNLPSDED

SEQ ID NO: 118511 - protein, 9 aa, Homo Sapiens
KTVISSKRR

SEQ ID NO: 118512 - protein, 9 aa, Homo Sapiens
ALIVLPGEM

SEQ ID NO: 118513 - protein, 9 aa, Homo Sapiens
PPNATLPPP

SEQ ID NO: 118514 - protein, 9 aa, Homo Sapiens
VSLSREHLS

SEQ ID NO: 118515 - protein, 9 aa, Homo Sapiens
RRTTKSKKK

SEQ ID NO: 118516 - protein, 9 aa, Homo Sapiens
PVIMNNFGM

SEQ ID NO: 118517 - protein, 9 aa, Homo Sapiens
KTTTDLLQS

SEQ ID NO: 118518 - protein, 9 aa, Homo Sapiens
SNSQQKKHL

SEQ ID NO: 118519 - protein, 9 aa, Homo Sapiens
PYRRPQRLW

SEQ ID NO: 118520 - protein, 9 aa, Homo Sapiens
IEAPPPTAL

SEQ ID NO: 118521 - protein, 9 aa, Homo Sapiens
CLPDPSFSS

SEQ ID NO: 118522 - protein, 9 aa, Homo Sapiens
WDWVLPVAK

SEQ ID NO: 118523 - protein, 9 aa, Homo Sapiens
VQVDRVKIH

SEQ ID NO: 118524 - protein, 9 aa, Homo Sapiens
NLTVSNVTL

SEQ ID NO: 118525 - protein, 9 aa, Homo Sapiens
HVLAALQEM

SEQ ID NO: 118526 - protein, 9 aa, Homo Sapiens
EAGFVESAE

SEQ ID NO: 118527 - protein, 9 aa, Homo Sapiens
GLHLYPVGS

SEQ ID NO: 118528 - protein, 9 aa, Homo Sapiens
DSYQGRGFV

SEQ ID NO: 118529 - protein, 9 aa, Homo Sapiens
LNLQGGCLL

SEQ ID NO: 118530 - protein, 9 aa, Homo Sapiens
ERSWARCVP

SEQ ID NO: 118531 - protein, 9 aa, Homo Sapiens
RTRLLAKGK

SEQ ID NO: 118532 - protein, 9 aa, Homo Sapiens
ICAVLAAVA

SEQ ID NO: 118533 - protein, 9 aa, Homo Sapiens
ATSFAAPPR

SEQ ID NO: 118534 - protein, 9 aa, Homo Sapiens
HLLPRPGPY

SEQ ID NO: 118535 - protein, 9 aa, Homo Sapiens
TWYQEVPKC

SEQ ID NO: 118536 - protein, 9 aa, Homo Sapiens
RCAQVRKPF

SEQ ID NO: 118537 - protein, 9 aa, Homo Sapiens
GLVSTRNGY

SEQ ID NO: 118538 - protein, 9 aa, Homo Sapiens
APHGIFAAS

SEQ ID NO: 118539 - protein, 9 aa, Homo Sapiens
AAGANATDE

SEQ ID NO: 118540 - protein, 9 aa, Homo Sapiens
WNSTFSPIS

SEQ ID NO: 118541 - protein, 9 aa, Homo Sapiens
EEKGLLPGA

SEQ ID NO: 118542 - protein, 9 aa, Homo Sapiens
QLSCLFLKH

SEQ ID NO: 118543 - protein, 9 aa, Homo Sapiens
SPTSTTSTT

SEQ ID NO: 118544 - protein, 9 aa, Homo Sapiens
EQAIVYTKL

SEQ ID NO: 118545 - protein, 9 aa, Homo Sapiens
PPECCSSWL

SEQ ID NO: 118546 - protein, 9 aa, Homo Sapiens
SGLQGCLHG

SEQ ID NO: 118547 - protein, 9 aa, Homo Sapiens
KRRLCSPVG

SEQ ID NO: 118548 - protein, 9 aa, Homo Sapiens
AAVAPPWVP

SEQ ID NO: 118549 - protein, 9 aa, Homo Sapiens
DTIEEGTLD

SEQ ID NO: 118550 - protein, 9 aa, Homo Sapiens
DETTTLVCD

SEQ ID NO: 118551 - protein, 9 aa, Homo Sapiens
LLRESEHFL

SEQ ID NO: 118552 - protein, 9 aa, Homo Sapiens
KNFVTSLYS

SEQ ID NO: 118553 - protein, 9 aa, Homo Sapiens
KNSTEGRAH

SEQ ID NO: 118554 - protein, 9 aa, Homo Sapiens
AANCADCQP

SEQ ID NO: 118555 - protein, 9 aa, Homo Sapiens
MEIPPCRRP

SEQ ID NO: 118556 - protein, 9 aa, Homo Sapiens
LDSSLPEYN

SEQ ID NO: 118557 - protein, 9 aa, Homo Sapiens
GRGGNQAGG

SEQ ID NO: 118558 - protein, 9 aa, Homo Sapiens
PTREPQHPV

SEQ ID NO: 118559 - protein, 9 aa, Homo Sapiens
NIVGVDVPL

SEQ ID NO: 118560 - protein, 9 aa, Homo Sapiens
SQLLGGCSG

SEQ ID NO: 118561 - protein, 9 aa, Homo Sapiens
ENEMKLYMK

SEQ ID NO: 118562 - protein, 9 aa, Homo Sapiens
KQLHMHLVW

SEQ ID NO: 118563 - protein, 9 aa, Homo Sapiens
IQASHVLMK

SEQ ID NO: 118564 - protein, 9 aa, Homo Sapiens
ISLKLFPES

SEQ ID NO: 118565 - protein, 9 aa, Homo Sapiens
LQHRADTVQ

SEQ ID NO: 118566 - protein, 9 aa, Homo Sapiens
RRSYPEFQS

SEQ ID NO: 118567 - protein, 9 aa, Homo Sapiens
EPRGLGLSP

SEQ ID NO: 118568 - protein, 9 aa, Homo Sapiens
SQDEEAQTI

SEQ ID NO: 118569 - protein, 9 aa, Homo Sapiens
YCLPDPSFS

SEQ ID NO: 118570 - protein, 9 aa, Homo Sapiens
CHTSYEEFT

SEQ ID NO: 118571 - protein, 9 aa, Homo Sapiens
FSGRQPLTH

SEQ ID NO: 118572 - protein, 9 aa, Homo Sapiens
KFLLFDMGL

SEQ ID NO: 118573 - protein, 9 aa, Homo Sapiens
RCFFHSVCL

SEQ ID NO: 118574 - protein, 9 aa, Homo Sapiens
GCLPRAGGA

SEQ ID NO: 118575 - protein, 9 aa, Homo Sapiens
KKTQVTNNH

SEQ ID NO: 118576 - protein, 9 aa, Homo Sapiens
PCSSKVSPS

SEQ ID NO: 118577 - protein, 9 aa, Homo Sapiens
PRDEIATEA

SEQ ID NO: 118578 - protein, 9 aa, Homo Sapiens
PGACNIPTN

SEQ ID NO: 118579 - protein, 9 aa, Homo Sapiens
YRASLLAVK

SEQ ID NO: 118580 - protein, 9 aa, Homo Sapiens
QLLGGCSGL

SEQ ID NO: 118581 - protein, 9 aa, Homo Sapiens
PTLGCSSNS

SEQ ID NO: 118582 - protein, 9 aa, Homo Sapiens
VSVRPLSSI

SEQ ID NO: 118583 - protein, 9 aa, Homo Sapiens
VRGGKRRRD

SEQ ID NO: 118584 - protein, 9 aa, Homo Sapiens
PGSSARWRS

SEQ ID NO: 118585 - protein, 9 aa, Homo Sapiens
QSLTCGKPT

SEQ ID NO: 118586 - protein, 9 aa, Homo Sapiens
IMEIEEYLI

SEQ ID NO: 118587 - protein, 9 aa, Homo Sapiens
VLYLLGAAA

SEQ ID NO: 118588 - protein, 9 aa, Homo Sapiens
EQISGSVSC

SEQ ID NO: 118589 - protein, 9 aa, Homo Sapiens
VAVLGNLIF

SEQ ID NO: 118590 - protein, 9 aa, Homo Sapiens
TQTSTFSGV

SEQ ID NO: 118591 - protein, 9 aa, Homo Sapiens
KIEFQLTKH

SEQ ID NO: 118592 - protein, 9 aa, Homo Sapiens
TTSSPRRSP

SEQ ID NO: 118593 - protein, 9 aa, Homo Sapiens
RSRGARRPA

SEQ ID NO: 118594 - protein, 9 aa, Homo Sapiens
DALVEELAT

SEQ ID NO: 118595 - protein, 9 aa, Homo Sapiens
FHKASGVCQ

SEQ ID NO: 118596 - protein, 9 aa, Homo Sapiens
QYGSPIHGQ

SEQ ID NO: 118597 - protein, 9 aa, Homo Sapiens
VTNNHGTVK

SEQ ID NO: 118598 - protein, 9 aa, Homo Sapiens
KENELQHLK

SEQ ID NO: 118599 - protein, 9 aa, Homo Sapiens
RITFLFDST

SEQ ID NO: 118600 - protein, 9 aa, Homo Sapiens
GRLCAPGAP

SEQ ID NO: 118601 - protein, 9 aa, Homo Sapiens
TAKLWALSQ

SEQ ID NO: 118602 - protein, 9 aa, Homo Sapiens
TVSRWMTSL

SEQ ID NO: 118603 - protein, 9 aa, Homo Sapiens
EFLVCLVIL

SEQ ID NO: 118604 - protein, 9 aa, Homo Sapiens
LIIATALSL

SEQ ID NO: 118605 - protein, 9 aa, Homo Sapiens
GEKGLALEV

SEQ ID NO: 118606 - protein, 9 aa, Homo Sapiens
CIKPKENNL

SEQ ID NO: 118607 - protein, 9 aa, Homo Sapiens
QASSVRTTR

SEQ ID NO: 118608 - protein, 9 aa, Homo Sapiens
LMITRARKG

SEQ ID NO: 118609 - protein, 9 aa, Homo Sapiens
ASKRAELLE

SEQ ID NO: 118610 - protein, 9 aa, Homo Sapiens
CKIRWESAY

SEQ ID NO: 118611 - protein, 9 aa, Homo Sapiens
AVNYRFLTP

SEQ ID NO: 118612 - protein, 9 aa, Homo Sapiens
KSIDYVFEE

SEQ ID NO: 118613 - protein, 9 aa, Homo Sapiens
RQGSHHEQL

SEQ ID NO: 118614 - protein, 9 aa, Homo Sapiens
CVTKAFSVN

SEQ ID NO: 118615 - protein, 9 aa, Homo Sapiens
QDMLSPNSS

SEQ ID NO: 118616 - protein, 9 aa, Homo Sapiens
ATRPFHDSA

SEQ ID NO: 118617 - protein, 9 aa, Homo Sapiens
CDDSWNSKA

SEQ ID NO: 118618 - protein, 9 aa, Homo Sapiens
GSSPPCLTW

SEQ ID NO: 118619 - protein, 9 aa, Homo Sapiens
RWRSSLSSV

SEQ ID NO: 118620 - protein, 9 aa, Homo Sapiens
SPAKINEVV

SEQ ID NO: 118621 - protein, 9 aa, Homo Sapiens
LLLNYFSGD

SEQ ID NO: 118622 - protein, 9 aa, Homo Sapiens
FYNVSPRRP

SEQ ID NO: 118623 - protein, 9 aa, Homo Sapiens
VAKALTNLV

SEQ ID NO: 118624 - protein, 9 aa, Homo Sapiens
FGISMDPDD

SEQ ID NO: 118625 - protein, 9 aa, Homo Sapiens
HNNGEAVSF

SEQ ID NO: 118626 - protein, 9 aa, Homo Sapiens
APSIFFFLF

SEQ ID NO: 118627 - protein, 9 aa, Homo Sapiens
CPFLVFLTS

SEQ ID NO: 118628 - protein, 9 aa, Homo Sapiens
DDGAITPWQ

SEQ ID NO: 118629 - protein, 9 aa, Homo Sapiens
HSVCLAGMI

SEQ ID NO: 118630 - protein, 9 aa, Homo Sapiens
VTEVSKTPE

SEQ ID NO: 118631 - protein, 9 aa, Homo Sapiens
VTAFPSPAF

SEQ ID NO: 118632 - protein, 9 aa, Homo Sapiens
RSSDSEWPC

SEQ ID NO: 118633 - protein, 9 aa, Homo Sapiens
GCTGDMIRM

SEQ ID NO: 118634 - protein, 9 aa, Homo Sapiens
SFEVTPSLA

SEQ ID NO: 118635 - protein, 9 aa, Homo Sapiens
SNHLKEKER

SEQ ID NO: 118636 - protein, 9 aa, Homo Sapiens
INHQKNTHW

SEQ ID NO: 118637 - protein, 9 aa, Homo Sapiens
GGGGPEGPG

SEQ ID NO: 118638 - protein, 9 aa, Homo Sapiens
QQRLEDELG

SEQ ID NO: 118639 - protein, 9 aa, Homo Sapiens
DHDCKFPEA

SEQ ID NO: 118640 - protein, 9 aa, Homo Sapiens
LAYCSLSFP

SEQ ID NO: 118641 - protein, 9 aa, Homo Sapiens
YTSRVLCIF

SEQ ID NO: 118642 - protein, 9 aa, Homo Sapiens
LYTLPSLCR

SEQ ID NO: 118643 - protein, 9 aa, Homo Sapiens
KCLTEEQAR

SEQ ID NO: 118644 - protein, 9 aa, Homo Sapiens
LNKREECDK

SEQ ID NO: 118645 - protein, 9 aa, Homo Sapiens
TMGFLLVRE

SEQ ID NO: 118646 - protein, 9 aa, Homo Sapiens
RKRKMRRTN

SEQ ID NO: 118647 - protein, 9 aa, Homo Sapiens
GHSQAAANV

SEQ ID NO: 118648 - protein, 9 aa, Homo Sapiens
AKTKDPPAM

SEQ ID NO: 118649 - protein, 9 aa, Homo Sapiens
SLVEKHLMR

SEQ ID NO: 118650 - protein, 9 aa, Homo Sapiens
TPEQIKYIV

SEQ ID NO: 118651 - protein, 9 aa, Homo Sapiens
SRLDFPEAT

SEQ ID NO: 118652 - protein, 9 aa, Homo Sapiens
LSCLYATVE

SEQ ID NO: 118653 - protein, 9 aa, Homo Sapiens
QLTLQVACL

SEQ ID NO: 118654 - protein, 9 aa, Homo Sapiens
PPTMVQGPA

SEQ ID NO: 118655 - protein, 9 aa, Homo Sapiens
GRASHVDDL

SEQ ID NO: 118656 - protein, 9 aa, Homo Sapiens
EKDLLYATG

SEQ ID NO: 118657 - protein, 9 aa, Homo Sapiens
LVNESNHLK

SEQ ID NO: 118658 - protein, 9 aa, Homo Sapiens
GAALASPTV

SEQ ID NO: 118659 - protein, 9 aa, Homo Sapiens
DLLYATGCF

SEQ ID NO: 118660 - protein, 9 aa, Homo Sapiens
DNEIDTMFV

SEQ ID NO: 118661 - protein, 9 aa, Homo Sapiens
SGDEFYSDA

SEQ ID NO: 118662 - protein, 9 aa, Homo Sapiens
RSSEEGYYP

SEQ ID NO: 118663 - protein, 9 aa, Homo Sapiens
PRMIVTPRA

SEQ ID NO: 118664 - protein, 9 aa, Homo Sapiens
LLQVSLGEE

SEQ ID NO: 118665 - protein, 9 aa, Homo Sapiens
LPPAPGDLQ

SEQ ID NO: 118666 - protein, 9 aa, Homo Sapiens
RTKSLYRDG

SEQ ID NO: 118667 - protein, 9 aa, Homo Sapiens
SAEAVLKRE

SEQ ID NO: 118668 - protein, 9 aa, Homo Sapiens
SHIAGNLPS

SEQ ID NO: 118669 - protein, 9 aa, Homo Sapiens
TKNLENAIS

SEQ ID NO: 118670 - protein, 9 aa, Homo Sapiens
MATKIVQAT

SEQ ID NO: 118671 - protein, 9 aa, Homo Sapiens
VLITVPECS

SEQ ID NO: 118672 - protein, 9 aa, Homo Sapiens
PRTAGRNPK

SEQ ID NO: 118673 - protein, 9 aa, Homo Sapiens
VNEEQESKK

SEQ ID NO: 118674 - protein, 9 aa, Homo Sapiens
SEEGDETET

SEQ ID NO: 118675 - protein, 9 aa, Homo Sapiens
YPAIILFSR

SEQ ID NO: 118676 - protein, 9 aa, Homo Sapiens
HPPLHRPTL

SEQ ID NO: 118677 - protein, 9 aa, Homo Sapiens
NSDELVGHL

SEQ ID NO: 118678 - protein, 9 aa, Homo Sapiens
LRVRRREPT

SEQ ID NO: 118679 - protein, 9 aa, Homo Sapiens
IQTNVVPMM

SEQ ID NO: 118680 - protein, 9 aa, Homo Sapiens
SICGGDVKK

SEQ ID NO: 118681 - protein, 9 aa, Homo Sapiens
AVREASSLL

SEQ ID NO: 118682 - protein, 9 aa, Homo Sapiens
GEDVTCQCL

SEQ ID NO: 118683 - protein, 9 aa, Homo Sapiens
GQLCGRCRG

SEQ ID NO: 118684 - protein, 9 aa, Homo Sapiens
HNFTMAMNA

SEQ ID NO: 118685 - protein, 9 aa, Homo Sapiens
AGRRRPALR

SEQ ID NO: 118686 - protein, 9 aa, Homo Sapiens
CPSRSDSEF

SEQ ID NO: 118687 - protein, 9 aa, Homo Sapiens
RKRERRRKG

SEQ ID NO: 118688 - protein, 9 aa, Homo Sapiens
KTLNWKRGP

SEQ ID NO: 118689 - protein, 9 aa, Homo Sapiens
PPRLDACCA

SEQ ID NO: 118690 - protein, 9 aa, Homo Sapiens
RRIHGQYIH

SEQ ID NO: 118691 - protein, 9 aa, Homo Sapiens
SRGPSTGSA

SEQ ID NO: 118692 - protein, 9 aa, Homo Sapiens
TQGVYMQLL

SEQ ID NO: 118693 - protein, 9 aa, Homo Sapiens
ISGPDGYKR

SEQ ID NO: 118694 - protein, 9 aa, Homo Sapiens
LVRERKLAG

SEQ ID NO: 118695 - protein, 9 aa, Homo Sapiens
TARTPSSPP

SEQ ID NO: 118696 - protein, 9 aa, Homo Sapiens
GTFRRVLQQ

SEQ ID NO: 118697 - protein, 9 aa, Homo Sapiens
TMELDSSLP

SEQ ID NO: 118698 - protein, 9 aa, Homo Sapiens
MALCSGPRP

SEQ ID NO: 118699 - protein, 9 aa, Homo Sapiens
FIAHERLDF

SEQ ID NO: 118700 - protein, 9 aa, Homo Sapiens
YSTSQPNAS

SEQ ID NO: 118701 - protein, 9 aa, Homo Sapiens
HSPPHRAAP

SEQ ID NO: 118702 - protein, 9 aa, Homo Sapiens
VKSLKSIDY

SEQ ID NO: 118703 - protein, 9 aa, Homo Sapiens
LLQRNLLRL

SEQ ID NO: 118704 - protein, 9 aa, Homo Sapiens
RPSSHLSHS

SEQ ID NO: 118705 - protein, 9 aa, Homo Sapiens
PENYSKKAK

SEQ ID NO: 118706 - protein, 9 aa, Homo Sapiens
GLKQQEKQK

SEQ ID NO: 118707 - protein, 9 aa, Homo Sapiens
TGINMSLLT

SEQ ID NO: 118708 - protein, 9 aa, Homo Sapiens
VHQENGFGS

SEQ ID NO: 118709 - protein, 9 aa, Homo Sapiens
GRICSPVGS

SEQ ID NO: 118710 - protein, 9 aa, Homo Sapiens
YITVKLMVC

SEQ ID NO: 118711 - protein, 9 aa, Homo Sapiens
YSKKAKERQ

SEQ ID NO: 118712 - protein, 9 aa, Homo Sapiens
KGVASDLRE

SEQ ID NO: 118713 - protein, 9 aa, Homo Sapiens
LKNIYRKSG

SEQ ID NO: 118714 - protein, 9 aa, Homo Sapiens
RYGISSVHD

SEQ ID NO: 118715 - protein, 9 aa, Homo Sapiens
TAVTTRPPI

SEQ ID NO: 118716 - protein, 9 aa, Homo Sapiens
LERGEAEWH

SEQ ID NO: 118717 - protein, 9 aa, Homo Sapiens
PTTSTCTRP

SEQ ID NO: 118718 - protein, 9 aa, Homo Sapiens
HFAADGFLS

SEQ ID NO: 118719 - protein, 9 aa, Homo Sapiens
KPLVSGTAV

SEQ ID NO: 118720 - protein, 9 aa, Homo Sapiens
TTEIAKKKE

SEQ ID NO: 118721 - protein, 9 aa, Homo Sapiens
LLDTPDVEN

SEQ ID NO: 118722 - protein, 9 aa, Homo Sapiens
GDREGYLLC

SEQ ID NO: 118723 - protein, 9 aa, Homo Sapiens
SFPSTNLQQ

SEQ ID NO: 118724 - protein, 9 aa, Homo Sapiens
LAEYSPPSP

SEQ ID NO: 118725 - protein, 9 aa, Homo Sapiens
ITVTLCSFG

SEQ ID NO: 118726 - protein, 9 aa, Homo Sapiens
RGIGETCKI

SEQ ID NO: 118727 - protein, 9 aa, Homo Sapiens
GLGNRGSKN

SEQ ID NO: 118728 - protein, 9 aa, Homo Sapiens
GDGKQRSPK

SEQ ID NO: 118729 - protein, 9 aa, Homo Sapiens
LPAGEQDVE

SEQ ID NO: 118730 - protein, 9 aa, Homo Sapiens
LAEVKDNLE

SEQ ID NO: 118731 - protein, 9 aa, Homo Sapiens
GASLRPCKL

SEQ ID NO: 118732 - protein, 9 aa, Homo Sapiens
LRIDTLTWL

SEQ ID NO: 118733 - protein, 9 aa, Homo Sapiens
LHFSDVFRS

SEQ ID NO: 118734 - protein, 9 aa, Homo Sapiens
LHVTTIFPP

SEQ ID NO: 118735 - protein, 9 aa, Homo Sapiens
KYKYKSSGH

SEQ ID NO: 118736 - protein, 9 aa, Homo Sapiens
KNLMNVMNV

SEQ ID NO: 118737 - protein, 9 aa, Homo Sapiens
QILHILAVV

SEQ ID NO: 118738 - protein, 9 aa, Homo Sapiens
FLVLLLGWL

SEQ ID NO: 118739 - protein, 9 aa, Homo Sapiens
SILRSNPED

SEQ ID NO: 118740 - protein, 9 aa, Homo Sapiens
HKLPMIDFV

SEQ ID NO: 118741 - protein, 9 aa, Homo Sapiens
PDDLLQDML

SEQ ID NO: 118742 - protein, 9 aa, Homo Sapiens
NSQQKKHLG

SEQ ID NO: 118743 - protein, 9 aa, Homo Sapiens
RKIEFQLTK

SEQ ID NO: 118744 - protein, 9 aa, Homo Sapiens
RMRCLLKVQ

SEQ ID NO: 118745 - protein, 9 aa, Homo Sapiens
IAGSLDSRV

SEQ ID NO: 118746 - protein, 9 aa, Homo Sapiens
AAHSSTLAE

SEQ ID NO: 118747 - protein, 9 aa, Homo Sapiens
WPGSEVAIM

SEQ ID NO: 118748 - protein, 9 aa, Homo Sapiens
EDVQGENCL

SEQ ID NO: 118749 - protein, 9 aa, Homo Sapiens
NWKRPQMRL

SEQ ID NO: 118750 - protein, 9 aa, Homo Sapiens
FEYFEQNSF

SEQ ID NO: 118751 - protein, 9 aa, Homo Sapiens
DAAFFKAWT

SEQ ID NO: 118752 - protein, 9 aa, Homo Sapiens
QEYLSMSYQ

SEQ ID NO: 118753 - protein, 9 aa, Homo Sapiens
ASSSSSSNT

SEQ ID NO: 118754 - protein, 9 aa, Homo Sapiens
RSSCSRPSA

SEQ ID NO: 118755 - protein, 9 aa, Homo Sapiens
AACGSRGAP

SEQ ID NO: 118756 - protein, 9 aa, Homo Sapiens
EGSEIKDTD

SEQ ID NO: 118757 - protein, 9 aa, Homo Sapiens
ATIQNESPK

SEQ ID NO: 118758 - protein, 9 aa, Homo Sapiens
LGHSRDDEL

SEQ ID NO: 118759 - protein, 9 aa, Homo Sapiens
KKIIKVWRD

SEQ ID NO: 118760 - protein, 9 aa, Homo Sapiens
SYLGCVYDL

SEQ ID NO: 118761 - protein, 9 aa, Homo Sapiens
QQRIRSKKR

SEQ ID NO: 118762 - protein, 9 aa, Homo Sapiens
KREIYDHYG

SEQ ID NO: 118763 - protein, 9 aa, Homo Sapiens
YLGCVYDLT

SEQ ID NO: 118764 - protein, 9 aa, Homo Sapiens
SGTETPSAR

SEQ ID NO: 118765 - protein, 9 aa, Homo Sapiens
LARAAVSPP

SEQ ID NO: 118766 - protein, 9 aa, Homo Sapiens
RDRSVRDKY

SEQ ID NO: 118767 - protein, 9 aa, Homo Sapiens
AAPAAMRAA

SEQ ID NO: 118768 - protein, 9 aa, Homo Sapiens
CETPAPLAV

SEQ ID NO: 118769 - protein, 9 aa, Homo Sapiens
RPGSPRSSA

SEQ ID NO: 118770 - protein, 9 aa, Homo Sapiens
MTHAGNKQG

SEQ ID NO: 118771 - protein, 9 aa, Homo Sapiens
VSSSRLPPT

SEQ ID NO: 118772 - protein, 9 aa, Homo Sapiens
DIPKAVEPG

SEQ ID NO: 118773 - protein, 9 aa, Homo Sapiens
NGAEAVLKH

SEQ ID NO: 118774 - protein, 9 aa, Homo Sapiens
KRKWGALWL

SEQ ID NO: 118775 - protein, 9 aa, Homo Sapiens
KHLGKLRVL

SEQ ID NO: 118776 - protein, 9 aa, Homo Sapiens
TNNHGTVKI

SEQ ID NO: 118777 - protein, 9 aa, Homo Sapiens
LPELCSHQD

SEQ ID NO: 118778 - protein, 9 aa, Homo Sapiens
SEALPLCWH

SEQ ID NO: 118779 - protein, 9 aa, Homo Sapiens
LHRKGPLNL

SEQ ID NO: 118780 - protein, 9 aa, Homo Sapiens
SSRLDFPEA

SEQ ID NO: 118781 - protein, 9 aa, Homo Sapiens
DLESMCKEL

SEQ ID NO: 118782 - protein, 9 aa, Homo Sapiens
KRVYIPLPE

SEQ ID NO: 118783 - protein, 9 aa, Homo Sapiens
RYVAICKHL

SEQ ID NO: 118784 - protein, 9 aa, Homo Sapiens
WWELGGPCA

SEQ ID NO: 118785 - protein, 9 aa, Homo Sapiens
ATSLGHRAA

SEQ ID NO: 118786 - protein, 9 aa, Homo Sapiens
RWHWQKKGD

SEQ ID NO: 118787 - protein, 9 aa, Homo Sapiens
VALLHHQTE

SEQ ID NO: 118788 - protein, 9 aa, Homo Sapiens
SCRQSHHGS

SEQ ID NO: 118789 - protein, 9 aa, Homo Sapiens
VACEKKMLS

SEQ ID NO: 118790 - protein, 9 aa, Homo Sapiens
GYYSWRNPG

SEQ ID NO: 118791 - protein, 9 aa, Homo Sapiens
CWEALPGAE

SEQ ID NO: 118792 - protein, 9 aa, Homo Sapiens
IDGVLRDDY

SEQ ID NO: 118793 - protein, 9 aa, Homo Sapiens
DAGMRELCQ

SEQ ID NO: 118794 - protein, 9 aa, Homo Sapiens
TTLEVSMCD

SEQ ID NO: 118795 - protein, 9 aa, Homo Sapiens
GTTAVLHGA

SEQ ID NO: 118796 - protein, 9 aa, Homo Sapiens
CGPSQRGAA

SEQ ID NO: 118797 - protein, 9 aa, Homo Sapiens
NVIFLGAPH

SEQ ID NO: 118798 - protein, 9 aa, Homo Sapiens
IKSAMGTSF

SEQ ID NO: 118799 - protein, 9 aa, Homo Sapiens
LEKFTHFGA

SEQ ID NO: 118800 - protein, 9 aa, Homo Sapiens
KVLRDGARK

SEQ ID NO: 118801 - protein, 9 aa, Homo Sapiens
TQQPECEAH

SEQ ID NO: 118802 - protein, 9 aa, Homo Sapiens
NQLAHILAE

SEQ ID NO: 118803 - protein, 9 aa, Homo Sapiens
LPASHPLFG

SEQ ID NO: 118804 - protein, 9 aa, Homo Sapiens
AKRACTAPR

SEQ ID NO: 118805 - protein, 9 aa, Homo Sapiens
SSSVDFSLF

SEQ ID NO: 118806 - protein, 9 aa, Homo Sapiens
IILWLFIRE

SEQ ID NO: 118807 - protein, 9 aa, Homo Sapiens
KNDLRYIET

SEQ ID NO: 118808 - protein, 9 aa, Homo Sapiens
PVNVTPQFH

SEQ ID NO: 118809 - protein, 9 aa, Homo Sapiens
NSDGARPVG

SEQ ID NO: 118810 - protein, 9 aa, Homo Sapiens
DNSRFHKTY

SEQ ID NO: 118811 - protein, 9 aa, Homo Sapiens
IALRWTGKQ

SEQ ID NO: 118812 - protein, 9 aa, Homo Sapiens
PHPADRGPP

SEQ ID NO: 118813 - protein, 9 aa, Homo Sapiens
PWRQWEGEA

SEQ ID NO: 118814 - protein, 9 aa, Homo Sapiens
ITGTVQEEA

SEQ ID NO: 118815 - protein, 9 aa, Homo Sapiens
CESNSAMPG

SEQ ID NO: 118816 - protein, 9 aa, Homo Sapiens
NMRRPAHTD

SEQ ID NO: 118817 - protein, 9 aa, Homo Sapiens
ISCPFQSPT

SEQ ID NO: 118818 - protein, 9 aa, Homo Sapiens
KCTQGVYMQ

SEQ ID NO: 118819 - protein, 9 aa, Homo Sapiens
GSRKNVFRL

SEQ ID NO: 118820 - protein, 9 aa, Homo Sapiens
QSQRNYMVQ

SEQ ID NO: 118821 - protein, 9 aa, Homo Sapiens
CRDKPSERL

SEQ ID NO: 118822 - protein, 9 aa, Homo Sapiens
ATQPHRLHL

SEQ ID NO: 118823 - protein, 9 aa, Homo Sapiens
TPLALSTEA

SEQ ID NO: 118824 - protein, 9 aa, Homo Sapiens
RRRRCCRQP

SEQ ID NO: 118825 - protein, 9 aa, Homo Sapiens
EAAESLPGL

SEQ ID NO: 118826 - protein, 9 aa, Homo Sapiens
MPMPMPMPI

SEQ ID NO: 118827 - protein, 9 aa, Homo Sapiens
LKQEDHSRR

SEQ ID NO: 118828 - protein, 9 aa, Homo Sapiens
GEYARYYEG

SEQ ID NO: 118829 - protein, 9 aa, Homo Sapiens
VVIGPALCN

SEQ ID NO: 118830 - protein, 9 aa, Homo Sapiens
SVDGEEWAI

SEQ ID NO: 118831 - protein, 9 aa, Homo Sapiens
YGEPSNPSM

SEQ ID NO: 118832 - protein, 9 aa, Homo Sapiens
YASDSAEKR

SEQ ID NO: 118833 - protein, 9 aa, Homo Sapiens
IQTLQKSEP

SEQ ID NO: 118834 - protein, 9 aa, Homo Sapiens
QLTKPALKS

SEQ ID NO: 118835 - protein, 9 aa, Homo Sapiens
QLYQQAMEK

SEQ ID NO: 118836 - protein, 9 aa, Homo Sapiens
GAARRSQRL

SEQ ID NO: 118837 - protein, 9 aa, Homo Sapiens
FSEAAQLIV

SEQ ID NO: 118838 - protein, 9 aa, Homo Sapiens
LAATGRKTT

SEQ ID NO: 118839 - protein, 9 aa, Homo Sapiens
CFLLATMAC

SEQ ID NO: 118840 - protein, 9 aa, Homo Sapiens
KKVVVVKNG

SEQ ID NO: 118841 - protein, 9 aa, Homo Sapiens
GSHFNIKDQ

SEQ ID NO: 118842 - protein, 9 aa, Homo Sapiens
VEFSDQFFT

SEQ ID NO: 118843 - protein, 9 aa, Homo Sapiens
DVQQVEPEG

SEQ ID NO: 118844 - protein, 9 aa, Homo Sapiens
VAAVGVEDG

SEQ ID NO: 118845 - protein, 9 aa, Homo Sapiens
RPMTAKKKA

SEQ ID NO: 118846 - protein, 9 aa, Homo Sapiens
LVIWVAGFQ

SEQ ID NO: 118847 - protein, 9 aa, Homo Sapiens
GNLPSDEDE

SEQ ID NO: 118848 - protein, 9 aa, Homo Sapiens
FNFELGIRQ

SEQ ID NO: 118849 - protein, 9 aa, Homo Sapiens
HAALASCPT

SEQ ID NO: 118850 - protein, 9 aa, Homo Sapiens
HPPSPTIPC

SEQ ID NO: 118851 - protein, 9 aa, Homo Sapiens
DHRDHILQG

SEQ ID NO: 118852 - protein, 9 aa, Homo Sapiens
MEKRRLRAK

SEQ ID NO: 118853 - protein, 9 aa, Homo Sapiens
FYNNNRTSF

SEQ ID NO: 118854 - protein, 9 aa, Homo Sapiens
VNTPVCKDP

SEQ ID NO: 118855 - protein, 9 aa, Homo Sapiens
EASTHISGD

SEQ ID NO: 118856 - protein, 9 aa, Homo Sapiens
GLFYTSRVL

SEQ ID NO: 118857 - protein, 9 aa, Homo Sapiens
TMEELRSLV

SEQ ID NO: 118858 - protein, 9 aa, Homo Sapiens
SRSLPALGL

SEQ ID NO: 118859 - protein, 9 aa, Homo Sapiens
VVLGEILEQ

SEQ ID NO: 118860 - protein, 9 aa, Homo Sapiens
RLHPWWREH

SEQ ID NO: 118861 - protein, 9 aa, Homo Sapiens
PCPSTAMYN

SEQ ID NO: 118862 - protein, 9 aa, Homo Sapiens
GARKYFLWV

SEQ ID NO: 118863 - protein, 9 aa, Homo Sapiens
QVDNVLTMD

SEQ ID NO: 118864 - protein, 9 aa, Homo Sapiens
LRSAQEEGE

SEQ ID NO: 118865 - protein, 9 aa, Homo Sapiens
GFEFNNEIK

SEQ ID NO: 118866 - protein, 9 aa, Homo Sapiens
AEPFPLVGL

SEQ ID NO: 118867 - protein, 9 aa, Homo Sapiens
GLFFHAPSR

SEQ ID NO: 118868 - protein, 9 aa, Homo Sapiens
VLALSPPWA

SEQ ID NO: 118869 - protein, 9 aa, Homo Sapiens
MPYAGGVGA

SEQ ID NO: 118870 - protein, 9 aa, Homo Sapiens
IGIPGLESS

SEQ ID NO: 118871 - protein, 9 aa, Homo Sapiens
QEEENEGEE

SEQ ID NO: 118872 - protein, 9 aa, Homo Sapiens
LGMTCSIDM

SEQ ID NO: 118873 - protein, 9 aa, Homo Sapiens
KEEEKHEES

SEQ ID NO: 118874 - protein, 9 aa, Homo Sapiens
VAQSTNSVE

SEQ ID NO: 118875 - protein, 9 aa, Homo Sapiens
ADKRKYVFS

SEQ ID NO: 118876 - protein, 9 aa, Homo Sapiens
VKKRKKREK

SEQ ID NO: 118877 - protein, 9 aa, Homo Sapiens
TIGFNQRNR

SEQ ID NO: 118878 - protein, 9 aa, Homo Sapiens
KQTQYSSIQ

SEQ ID NO: 118879 - protein, 9 aa, Homo Sapiens
PAARSGSAW

SEQ ID NO: 118880 - protein, 9 aa, Homo Sapiens
DLYDVVWIQ

SEQ ID NO: 118881 - protein, 9 aa, Homo Sapiens
SEFKTQPVR

SEQ ID NO: 118882 - protein, 9 aa, Homo Sapiens
VCSVLKQGS

SEQ ID NO: 118883 - protein, 9 aa, Homo Sapiens
FRVFCLLGT

SEQ ID NO: 118884 - protein, 9 aa, Homo Sapiens
VGGIGQKGD

SEQ ID NO: 118885 - protein, 9 aa, Homo Sapiens
TTTATTGPT

SEQ ID NO: 118886 - protein, 9 aa, Homo Sapiens
LPTARTPSS

SEQ ID NO: 118887 - protein, 9 aa, Homo Sapiens
IGPREQCEP

SEQ ID NO: 118888 - protein, 9 aa, Homo Sapiens
TCFNIFFYD

SEQ ID NO: 118889 - protein, 9 aa, Homo Sapiens
FLYNREKAV

SEQ ID NO: 118890 - protein, 9 aa, Homo Sapiens
KLTDAMVWK

SEQ ID NO: 118891 - protein, 9 aa, Homo Sapiens
IIPSPNFSV

SEQ ID NO: 118892 - protein, 9 aa, Homo Sapiens
ENQKEQTAL

SEQ ID NO: 118893 - protein, 9 aa, Homo Sapiens
RPPQATRAR

SEQ ID NO: 118894 - protein, 9 aa, Homo Sapiens
TLLKEITAR

SEQ ID NO: 118895 - protein, 9 aa, Homo Sapiens
WLDTSLRKS

SEQ ID NO: 118896 - protein, 9 aa, Homo Sapiens
AAKVGYEKL

SEQ ID NO: 118897 - protein, 9 aa, Homo Sapiens
NHHPLQRSW

SEQ ID NO: 118898 - protein, 9 aa, Homo Sapiens
RMKDPRVLV

SEQ ID NO: 118899 - protein, 9 aa, Homo Sapiens
SAGKCTQGV

SEQ ID NO: 118900 - protein, 9 aa, Homo Sapiens
DSPPLQDGS

SEQ ID NO: 118901 - protein, 9 aa, Homo Sapiens
RQGYSVRQS

SEQ ID NO: 118902 - protein, 9 aa, Homo Sapiens
CLAPQELSQ

SEQ ID NO: 118903 - protein, 9 aa, Homo Sapiens
DNHCQERPS

SEQ ID NO: 118904 - protein, 9 aa, Homo Sapiens
YSQLISFCL

SEQ ID NO: 118905 - protein, 9 aa, Homo Sapiens
INMSLLTVI

SEQ ID NO: 118906 - protein, 9 aa, Homo Sapiens
EAEAGAARR

SEQ ID NO: 118907 - protein, 9 aa, Homo Sapiens
NLLAHPCPL

SEQ ID NO: 118908 - protein, 9 aa, Homo Sapiens
CSLEKLPVH

SEQ ID NO: 118909 - protein, 9 aa, Homo Sapiens
CRTHSQQCA

SEQ ID NO: 118910 - protein, 9 aa, Homo Sapiens
AGVPKGPLL

SEQ ID NO: 118911 - protein, 9 aa, Homo Sapiens
ALHVCYGMT

SEQ ID NO: 118912 - protein, 9 aa, Homo Sapiens
MKHHYKSCK

SEQ ID NO: 118913 - protein, 9 aa, Homo Sapiens
EFPAVGLEL

SEQ ID NO: 118914 - protein, 9 aa, Homo Sapiens
LYHRMTQNP

SEQ ID NO: 118915 - protein, 9 aa, Homo Sapiens
CRSHSHQDH

SEQ ID NO: 118916 - protein, 9 aa, Homo Sapiens
RIMYPVESV

SEQ ID NO: 118917 - protein, 9 aa, Homo Sapiens
TLAFLACIV

SEQ ID NO: 118918 - protein, 9 aa, Homo Sapiens
TQPAHLTSI

SEQ ID NO: 118919 - protein, 9 aa, Homo Sapiens
SFWGHSQPA

SEQ ID NO: 118920 - protein, 9 aa, Homo Sapiens
LCYELNFHR

SEQ ID NO: 118921 - protein, 9 aa, Homo Sapiens
CYPYYLSDI

SEQ ID NO: 118922 - protein, 9 aa, Homo Sapiens
PRGTGIVSV

SEQ ID NO: 118923 - protein, 9 aa, Homo Sapiens
ASHVLMKIC

SEQ ID NO: 118924 - protein, 9 aa, Homo Sapiens
SRAAPPHVD

SEQ ID NO: 118925 - protein, 9 aa, Homo Sapiens
ENWTHLLQR

SEQ ID NO: 118926 - protein, 9 aa, Homo Sapiens
KLRQKLQCN

SEQ ID NO: 118927 - protein, 9 aa, Homo Sapiens
TPLNKLRVK

SEQ ID NO: 118928 - protein, 9 aa, Homo Sapiens
ASAATSRGM

SEQ ID NO: 118929 - protein, 9 aa, Homo Sapiens
FSGALIPWL

SEQ ID NO: 118930 - protein, 9 aa, Homo Sapiens
NLVSGMRVP

SEQ ID NO: 118931 - protein, 9 aa, Homo Sapiens
RQRCALSHP

SEQ ID NO: 118932 - protein, 9 aa, Homo Sapiens
ARAAATPSC

SEQ ID NO: 118933 - protein, 9 aa, Homo Sapiens
AQGILWTIR

SEQ ID NO: 118934 - protein, 9 aa, Homo Sapiens
EWLQLEDVC

SEQ ID NO: 118935 - protein, 9 aa, Homo Sapiens
TVPRADLVR

SEQ ID NO: 118936 - protein, 9 aa, Homo Sapiens
ALEVLLSKG

SEQ ID NO: 118937 - protein, 9 aa, Homo Sapiens
GCRHSVPEA

SEQ ID NO: 118938 - protein, 9 aa, Homo Sapiens
RGAAEPFLT

SEQ ID NO: 118939 - protein, 9 aa, Homo Sapiens
RRLSDFYVI

SEQ ID NO: 118940 - protein, 9 aa, Homo Sapiens
TDKKREQRK

SEQ ID NO: 118941 - protein, 9 aa, Homo Sapiens
PAFRKGDVV

SEQ ID NO: 118942 - protein, 9 aa, Homo Sapiens
LNSHAHEDP

SEQ ID NO: 118943 - protein, 9 aa, Homo Sapiens
VLQHAQDGH

SEQ ID NO: 118944 - protein, 9 aa, Homo Sapiens
IKIENPLVS

SEQ ID NO: 118945 - protein, 9 aa, Homo Sapiens
NRYVQQKRL

SEQ ID NO: 118946 - protein, 9 aa, Homo Sapiens
KRRKVFRKS

SEQ ID NO: 118947 - protein, 9 aa, Homo Sapiens
DNPATAFFS

SEQ ID NO: 118948 - protein, 9 aa, Homo Sapiens
CVLGCQPDF

SEQ ID NO: 118949 - protein, 9 aa, Homo Sapiens
LLSPLVGED

SEQ ID NO: 118950 - protein, 9 aa, Homo Sapiens
FILRFCPKI

SEQ ID NO: 118951 - protein, 9 aa, Homo Sapiens
RAFQSTCAL

SEQ ID NO: 118952 - protein, 9 aa, Homo Sapiens
VGRAGPAPR

SEQ ID NO: 118953 - protein, 9 aa, Homo Sapiens
PCRRPPPPL

SEQ ID NO: 118954 - protein, 9 aa, Homo Sapiens
PMTSRPYYV

SEQ ID NO: 118955 - protein, 9 aa, Homo Sapiens
KLAQLYDRY

SEQ ID NO: 118956 - protein, 9 aa, Homo Sapiens
EVIGGAGKY

SEQ ID NO: 118957 - protein, 9 aa, Homo Sapiens
EETPIQGSA

SEQ ID NO: 118958 - protein, 9 aa, Homo Sapiens
RASGRHTTG

SEQ ID NO: 118959 - protein, 9 aa, Homo Sapiens
NFIHAMGGF

SEQ ID NO: 118960 - protein, 9 aa, Homo Sapiens
ALGAVALVH

SEQ ID NO: 118961 - protein, 9 aa, Homo Sapiens
GLIPQEPGP

SEQ ID NO: 118962 - protein, 9 aa, Homo Sapiens
GALWLLSPS

SEQ ID NO: 118963 - protein, 9 aa, Homo Sapiens
VKILRALRV

SEQ ID NO: 118964 - protein, 9 aa, Homo Sapiens
LQTETMEAT

SEQ ID NO: 118965 - protein, 9 aa, Homo Sapiens
LILSPGCWA

SEQ ID NO: 118966 - protein, 9 aa, Homo Sapiens
TIQNESPKK

SEQ ID NO: 118967 - protein, 9 aa, Homo Sapiens
ATSPQPISN

SEQ ID NO: 118968 - protein, 9 aa, Homo Sapiens
EYTKGFVWI

SEQ ID NO: 118969 - protein, 9 aa, Homo Sapiens
PHLPIMRKR

SEQ ID NO: 118970 - protein, 9 aa, Homo Sapiens
QLQPFLKIR

SEQ ID NO: 118971 - protein, 9 aa, Homo Sapiens
PAITSISSM

SEQ ID NO: 118972 - protein, 9 aa, Homo Sapiens
PVVVGGIPV

SEQ ID NO: 118973 - protein, 9 aa, Homo Sapiens
QHAQDGHGR

SEQ ID NO: 118974 - protein, 9 aa, Homo Sapiens
CVLRSSEEG

SEQ ID NO: 118975 - protein, 9 aa, Homo Sapiens
PSGTPPSPV

SEQ ID NO: 118976 - protein, 9 aa, Homo Sapiens
CDMRYWPQE

SEQ ID NO: 118977 - protein, 9 aa, Homo Sapiens
PVTLGRGRG

SEQ ID NO: 118978 - protein, 9 aa, Homo Sapiens
NTSTPPSAA

SEQ ID NO: 118979 - protein, 9 aa, Homo Sapiens
QGKDLDVLE

SEQ ID NO: 118980 - protein, 9 aa, Homo Sapiens
SLSNTSVSS

SEQ ID NO: 118981 - protein, 9 aa, Homo Sapiens
GNADLRCEL

SEQ ID NO: 118982 - protein, 9 aa, Homo Sapiens
HLPTLASRV

SEQ ID NO: 118983 - protein, 9 aa, Homo Sapiens
NGRGGNQAG

SEQ ID NO: 118984 - protein, 9 aa, Homo Sapiens
LPGFPSSLQ

SEQ ID NO: 118985 - protein, 9 aa, Homo Sapiens
DLATSVRSD

SEQ ID NO: 118986 - protein, 9 aa, Homo Sapiens
LSDSLLDII

SEQ ID NO: 118987 - protein, 9 aa, Homo Sapiens
LDRCNAGWL

SEQ ID NO: 118988 - protein, 9 aa, Homo Sapiens
DAKRRGSSP

SEQ ID NO: 118989 - protein, 9 aa, Homo Sapiens
PLLITVTLC

SEQ ID NO: 118990 - protein, 9 aa, Homo Sapiens
EKEGDKPST

SEQ ID NO: 118991 - protein, 9 aa, Homo Sapiens
GPAGLPLAM

SEQ ID NO: 118992 - protein, 9 aa, Homo Sapiens
AAQHEFHGL

SEQ ID NO: 118993 - protein, 9 aa, Homo Sapiens
YPEFQSSSV

SEQ ID NO: 118994 - protein, 9 aa, Homo Sapiens
LPLCWHGGF

SEQ ID NO: 118995 - protein, 9 aa, Homo Sapiens
AALEAVSMD

SEQ ID NO: 118996 - protein, 9 aa, Homo Sapiens
KKENTLVQM

SEQ ID NO: 118997 - protein, 9 aa, Homo Sapiens
CGNVLRFLP

SEQ ID NO: 118998 - protein, 9 aa, Homo Sapiens
GPGGGGPEG

SEQ ID NO: 118999 - protein, 9 aa, Homo Sapiens
SLQERLPHI

SEQ ID NO: 119000 - protein, 9 aa, Homo Sapiens
IQAPHPGPL

SEQ ID NO: 119001 - protein, 9 aa, Homo Sapiens
PRAIGLSWV

SEQ ID NO: 119002 - protein, 9 aa, Homo Sapiens
CAIQNQLAH

SEQ ID NO: 119003 - protein, 9 aa, Homo Sapiens
GSSPPGRHW

SEQ ID NO: 119004 - protein, 9 aa, Homo Sapiens
DITGEETPL

SEQ ID NO: 119005 - protein, 9 aa, Homo Sapiens
AYSNGKDDG

SEQ ID NO: 119006 - protein, 9 aa, Homo Sapiens
VTLASAEDQ

SEQ ID NO: 119007 - protein, 9 aa, Homo Sapiens
LDILLVRDR

SEQ ID NO: 119008 - protein, 9 aa, Homo Sapiens
STLLKEITA

SEQ ID NO: 119009 - protein, 9 aa, Homo Sapiens
QKCIKPKEN

SEQ ID NO: 119010 - protein, 9 aa, Homo Sapiens
VWATIGEAR

SEQ ID NO: 119011 - protein, 9 aa, Homo Sapiens
EKIVALMSS

SEQ ID NO: 119012 - protein, 9 aa, Homo Sapiens
QPMGPPPEC

SEQ ID NO: 119013 - protein, 9 aa, Homo Sapiens
SRCTTPPRG

SEQ ID NO: 119014 - protein, 9 aa, Homo Sapiens
ADRLCFHPP

SEQ ID NO: 119015 - protein, 9 aa, Homo Sapiens
PGFRQCVNT

SEQ ID NO: 119016 - protein, 9 aa, Homo Sapiens
AIMAPFLPY

SEQ ID NO: 119017 - protein, 9 aa, Homo Sapiens
DLDLVLRDL

SEQ ID NO: 119018 - protein, 9 aa, Homo Sapiens
FPRYDLTNE

SEQ ID NO: 119019 - protein, 9 aa, Homo Sapiens
LACDDNEID

SEQ ID NO: 119020 - protein, 9 aa, Homo Sapiens
DEDETTTLV

SEQ ID NO: 119021 - protein, 9 aa, Homo Sapiens
DSQSHIMEY

SEQ ID NO: 119022 - protein, 9 aa, Homo Sapiens
LKKRSSITK

SEQ ID NO: 119023 - protein, 9 aa, Homo Sapiens
HLQQLEHLR

SEQ ID NO: 119024 - protein, 9 aa, Homo Sapiens
VGRCRAWLW

SEQ ID NO: 119025 - protein, 9 aa, Homo Sapiens
QHRFRGHLE

SEQ ID NO: 119026 - protein, 9 aa, Homo Sapiens
PPPKMPPPR

SEQ ID NO: 119027 - protein, 9 aa, Homo Sapiens
ALPLPMVCT

SEQ ID NO: 119028 - protein, 9 aa, Homo Sapiens
FAQTGINPF

SEQ ID NO: 119029 - protein, 9 aa, Homo Sapiens
NQTSLNIKE

SEQ ID NO: 119030 - protein, 9 aa, Homo Sapiens
LCVLRSSEE

SEQ ID NO: 119031 - protein, 9 aa, Homo Sapiens
NSVREPRGL

SEQ ID NO: 119032 - protein, 9 aa, Homo Sapiens
SNQELIEKK

SEQ ID NO: 119033 - protein, 9 aa, Homo Sapiens
PSAPEPLTY

SEQ ID NO: 119034 - protein, 9 aa, Homo Sapiens
FQHSHLAVT

SEQ ID NO: 119035 - protein, 9 aa, Homo Sapiens
PKPPSDGHA

SEQ ID NO: 119036 - protein, 9 aa, Homo Sapiens
LRIAGCRHS

SEQ ID NO: 119037 - protein, 9 aa, Homo Sapiens
TMVQGPAGL

SEQ ID NO: 119038 - protein, 9 aa, Homo Sapiens
TGATPGTHR

SEQ ID NO: 119039 - protein, 9 aa, Homo Sapiens
STMSCLSRP

SEQ ID NO: 119040 - protein, 9 aa, Homo Sapiens
HSRVTASHP

SEQ ID NO: 119041 - protein, 9 aa, Homo Sapiens
PGSVSHLQP

SEQ ID NO: 119042 - protein, 9 aa, Homo Sapiens
CLSRLVSST

SEQ ID NO: 119043 - protein, 9 aa, Homo Sapiens
ERGEAEWHK

SEQ ID NO: 119044 - protein, 9 aa, Homo Sapiens
HSPVKASVV

SEQ ID NO: 119045 - protein, 9 aa, Homo Sapiens
IEPAILLLG

SEQ ID NO: 119046 - protein, 9 aa, Homo Sapiens
LHPPSPPPV

SEQ ID NO: 119047 - protein, 9 aa, Homo Sapiens
GPWVRESHI

SEQ ID NO: 119048 - protein, 9 aa, Homo Sapiens
RLVSAAAAA

SEQ ID NO: 119049 - protein, 9 aa, Homo Sapiens
AAGTGLYVR

SEQ ID NO: 119050 - protein, 9 aa, Homo Sapiens
SVHNNGEAV

SEQ ID NO: 119051 - protein, 9 aa, Homo Sapiens
TVDRTKTQT

SEQ ID NO: 119052 - protein, 9 aa, Homo Sapiens
LSMSGNYLP

SEQ ID NO: 119053 - protein, 9 aa, Homo Sapiens
LVLTSNNHL

SEQ ID NO: 119054 - protein, 9 aa, Homo Sapiens
RILLQRNLL

SEQ ID NO: 119055 - protein, 9 aa, Homo Sapiens
KKRVKIPRR

SEQ ID NO: 119056 - protein, 9 aa, Homo Sapiens
LTEFVPPPT

SEQ ID NO: 119057 - protein, 9 aa, Homo Sapiens
RPSTRPSRM

SEQ ID NO: 119058 - protein, 9 aa, Homo Sapiens
SHSPLLQKN

SEQ ID NO: 119059 - protein, 9 aa, Homo Sapiens
YLSPPEYFG

SEQ ID NO: 119060 - protein, 9 aa, Homo Sapiens
QRHRRNLTE

SEQ ID NO: 119061 - protein, 9 aa, Homo Sapiens
RSLDYAYVN

SEQ ID NO: 119062 - protein, 9 aa, Homo Sapiens
WYFGVSYCK

SEQ ID NO: 119063 - protein, 9 aa, Homo Sapiens
QGRDLMDVM

SEQ ID NO: 119064 - protein, 9 aa, Homo Sapiens
KKTLNWKRG

SEQ ID NO: 119065 - protein, 9 aa, Homo Sapiens
WEALPGAER

SEQ ID NO: 119066 - protein, 9 aa, Homo Sapiens
GENTDASAS

SEQ ID NO: 119067 - protein, 9 aa, Homo Sapiens
APWPSYVKH

SEQ ID NO: 119068 - protein, 9 aa, Homo Sapiens
CGSRRVTAL

SEQ ID NO: 119069 - protein, 9 aa, Homo Sapiens
VPWWATHTL

SEQ ID NO: 119070 - protein, 9 aa, Homo Sapiens
VAHGLLQVS

SEQ ID NO: 119071 - protein, 9 aa, Homo Sapiens
LPHALHGLS

SEQ ID NO: 119072 - protein, 9 aa, Homo Sapiens
RVAGTAGAR

SEQ ID NO: 119073 - protein, 9 aa, Homo Sapiens
PAEFLPFMA

SEQ ID NO: 119074 - protein, 9 aa, Homo Sapiens
AEAWWCRCP

SEQ ID NO: 119075 - protein, 9 aa, Homo Sapiens
WCGGRQTPA

SEQ ID NO: 119076 - protein, 9 aa, Homo Sapiens
QVTGDVETS

SEQ ID NO: 119077 - protein, 9 aa, Homo Sapiens
CHRVLEAHP

SEQ ID NO: 119078 - protein, 9 aa, Homo Sapiens
TWKIRTCLR

SEQ ID NO: 119079 - protein, 9 aa, Homo Sapiens
QPHLNSKRN

SEQ ID NO: 119080 - protein, 9 aa, Homo Sapiens
NFELGIRQG

SEQ ID NO: 119081 - protein, 9 aa, Homo Sapiens
LGDPGLFRT

SEQ ID NO: 119082 - protein, 9 aa, Homo Sapiens
VFRDPCHDV

SEQ ID NO: 119083 - protein, 9 aa, Homo Sapiens
RSGSFKAAV

SEQ ID NO: 119084 - protein, 9 aa, Homo Sapiens
VHHLHRPVA

SEQ ID NO: 119085 - protein, 9 aa, Homo Sapiens
PVCKDPGLA

SEQ ID NO: 119086 - protein, 9 aa, Homo Sapiens
MNEHLFKQA

SEQ ID NO: 119087 - protein, 9 aa, Homo Sapiens
NFFVTEGNC

SEQ ID NO: 119088 - protein, 9 aa, Homo Sapiens
WVDKEFFSD

SEQ ID NO: 119089 - protein, 9 aa, Homo Sapiens
TCSIDMDTV

SEQ ID NO: 119090 - protein, 9 aa, Homo Sapiens
GLQGCLHGA

SEQ ID NO: 119091 - protein, 9 aa, Homo Sapiens
LIAGPYVIG

SEQ ID NO: 119092 - protein, 9 aa, Homo Sapiens
NPNTGDIYT

SEQ ID NO: 119093 - protein, 9 aa, Homo Sapiens
SHSNSNTLS

SEQ ID NO: 119094 - protein, 9 aa, Homo Sapiens
CLALIAGPY

SEQ ID NO: 119095 - protein, 9 aa, Homo Sapiens
YPSLATMMV

SEQ ID NO: 119096 - protein, 9 aa, Homo Sapiens
LFYIIDILV

SEQ ID NO: 119097 - protein, 9 aa, Homo Sapiens
ESSTRKPPR

SEQ ID NO: 119098 - protein, 9 aa, Homo Sapiens
LVSGTAVTL

SEQ ID NO: 119099 - protein, 9 aa, Homo Sapiens
LKGLCGVII

SEQ ID NO: 119100 - protein, 9 aa, Homo Sapiens
SHAHEDPGP

SEQ ID NO: 119101 - protein, 9 aa, Homo Sapiens
LESWALTIL

SEQ ID NO: 119102 - protein, 9 aa, Homo Sapiens
LVTREKHPD

SEQ ID NO: 119103 - protein, 9 aa, Homo Sapiens
MEKFGILII

SEQ ID NO: 119104 - protein, 9 aa, Homo Sapiens
GLCNCAVFK

SEQ ID NO: 119105 - protein, 9 aa, Homo Sapiens
EQGALLRAC

SEQ ID NO: 119106 - protein, 9 aa, Homo Sapiens
KGGGRESVL

SEQ ID NO: 119107 - protein, 9 aa, Homo Sapiens
VYIPKSLGL

SEQ ID NO: 119108 - protein, 9 aa, Homo Sapiens
SIHLVLGCN

SEQ ID NO: 119109 - protein, 9 aa, Homo Sapiens
KGSMRDKKR

SEQ ID NO: 119110 - protein, 9 aa, Homo Sapiens
GNKQGKDLD

SEQ ID NO: 119111 - protein, 9 aa, Homo Sapiens
SEGEDVTCQ

SEQ ID NO: 119112 - protein, 9 aa, Homo Sapiens
GADASHWCG

SEQ ID NO: 119113 - protein, 9 aa, Homo Sapiens
ALLRGCPQY

SEQ ID NO: 119114 - protein, 9 aa, Homo Sapiens
EGQLCGRCR

SEQ ID NO: 119115 - protein, 9 aa, Homo Sapiens
DLPQPLAEP

SEQ ID NO: 119116 - protein, 9 aa, Homo Sapiens
NWKRGPSVV

SEQ ID NO: 119117 - protein, 9 aa, Homo Sapiens
HLSLFFVMM

SEQ ID NO: 119118 - protein, 9 aa, Homo Sapiens
SCLISLSCF

SEQ ID NO: 119119 - protein, 9 aa, Homo Sapiens
YKACFSMPG

SEQ ID NO: 119120 - protein, 9 aa, Homo Sapiens
PMMSSMACG

SEQ ID NO: 119121 - protein, 9 aa, Homo Sapiens
NYQFVCQNL

SEQ ID NO: 119122 - protein, 9 aa, Homo Sapiens
HAQPSCTGT

SEQ ID NO: 119123 - protein, 9 aa, Homo Sapiens
CSQIPNCDV

SEQ ID NO: 119124 - protein, 9 aa, Homo Sapiens
AFTTQRSCG

SEQ ID NO: 119125 - protein, 9 aa, Homo Sapiens
SQGLYSNFW

SEQ ID NO: 119126 - protein, 9 aa, Homo Sapiens
FFLFNNFIF

SEQ ID NO: 119127 - protein, 9 aa, Homo Sapiens
DLVLHFLKK

SEQ ID NO: 119128 - protein, 9 aa, Homo Sapiens
IRMQSPVDI

SEQ ID NO: 119129 - protein, 9 aa, Homo Sapiens
SVRTGNDKG

SEQ ID NO: 119130 - protein, 9 aa, Homo Sapiens
LINHQKNTH

SEQ ID NO: 119131 - protein, 9 aa, Homo Sapiens
IRQSKIFFR

SEQ ID NO: 119132 - protein, 9 aa, Homo Sapiens
STMANLAII

SEQ ID NO: 119133 - protein, 9 aa, Homo Sapiens
GESELVVRA

SEQ ID NO: 119134 - protein, 9 aa, Homo Sapiens
RRREPTPRL

SEQ ID NO: 119135 - protein, 9 aa, Homo Sapiens
AEGGEEDLT

SEQ ID NO: 119136 - protein, 9 aa, Homo Sapiens
CLRRVRQKC

SEQ ID NO: 119137 - protein, 9 aa, Homo Sapiens
VHIKNSRNH

SEQ ID NO: 119138 - protein, 9 aa, Homo Sapiens
QMHQHKSIT

SEQ ID NO: 119139 - protein, 9 aa, Homo Sapiens
AFFSVFMAL

SEQ ID NO: 119140 - protein, 9 aa, Homo Sapiens
EVLLSKGAE

SEQ ID NO: 119141 - protein, 9 aa, Homo Sapiens
STNFLPLLV

SEQ ID NO: 119142 - protein, 9 aa, Homo Sapiens
DYYAALLGS

SEQ ID NO: 119143 - protein, 9 aa, Homo Sapiens
ELVGHLDAI

SEQ ID NO: 119144 - protein, 9 aa, Homo Sapiens
TPAEPRGRA

SEQ ID NO: 119145 - protein, 9 aa, Homo Sapiens
GEAATAAVA

SEQ ID NO: 119146 - protein, 9 aa, Homo Sapiens
SEFYTGLEI

SEQ ID NO: 119147 - protein, 9 aa, Homo Sapiens
NVVIPQYQA

SEQ ID NO: 119148 - protein, 9 aa, Homo Sapiens
VERSQHRFR

SEQ ID NO: 119149 - protein, 9 aa, Homo Sapiens
GRDREIKVN

SEQ ID NO: 119150 - protein, 9 aa, Homo Sapiens
PEKRQGLYL

SEQ ID NO: 119151 - protein, 9 aa, Homo Sapiens
LALAHSTAT

SEQ ID NO: 119152 - protein, 9 aa, Homo Sapiens
DNDMKKLNM

SEQ ID NO: 119153 - protein, 9 aa, Homo Sapiens
QHFCTQYGS

SEQ ID NO: 119154 - protein, 9 aa, Homo Sapiens
HEFHGLGDC

SEQ ID NO: 119155 - protein, 9 aa, Homo Sapiens
QCECHRGRK

SEQ ID NO: 119156 - protein, 9 aa, Homo Sapiens
NKKRKTANY

SEQ ID NO: 119157 - protein, 9 aa, Homo Sapiens
AKDSHGVMS

SEQ ID NO: 119158 - protein, 9 aa, Homo Sapiens
VTCQLQATA

SEQ ID NO: 119159 - protein, 9 aa, Homo Sapiens
QECRLVGPE

SEQ ID NO: 119160 - protein, 9 aa, Homo Sapiens
LDGNPYAQV

SEQ ID NO: 119161 - protein, 9 aa, Homo Sapiens
SRRSKASIP

SEQ ID NO: 119162 - protein, 9 aa, Homo Sapiens
RSVVLGEIL

SEQ ID NO: 119163 - protein, 9 aa, Homo Sapiens
ACIRGETLG

SEQ ID NO: 119164 - protein, 9 aa, Homo Sapiens
SKKHKRKPY

SEQ ID NO: 119165 - protein, 9 aa, Homo Sapiens
IVSVPVPKK

SEQ ID NO: 119166 - protein, 9 aa, Homo Sapiens
LQQQLQQIQ

SEQ ID NO: 119167 - protein, 9 aa, Homo Sapiens
PPLAVLEFP

SEQ ID NO: 119168 - protein, 9 aa, Homo Sapiens
TSLNIKEYT

SEQ ID NO: 119169 - protein, 9 aa, Homo Sapiens
FDNHCQERP

SEQ ID NO: 119170 - protein, 9 aa, Homo Sapiens
ISEWQQLSE

SEQ ID NO: 119171 - protein, 9 aa, Homo Sapiens
QVHSPSLLR

SEQ ID NO: 119172 - protein, 9 aa, Homo Sapiens
SLLRAGVDI

SEQ ID NO: 119173 - protein, 9 aa, Homo Sapiens
VRTGNDKGE

SEQ ID NO: 119174 - protein, 9 aa, Homo Sapiens
LRSKSVDKC

SEQ ID NO: 119175 - protein, 9 aa, Homo Sapiens
GVHSSGQKI

SEQ ID NO: 119176 - protein, 9 aa, Homo Sapiens
ATTTAPLSG

SEQ ID NO: 119177 - protein, 9 aa, Homo Sapiens
LELRACGLG

SEQ ID NO: 119178 - protein, 9 aa, Homo Sapiens
QTEPGQGRA

SEQ ID NO: 119179 - protein, 9 aa, Homo Sapiens
HFSDLSQPR

SEQ ID NO: 119180 - protein, 9 aa, Homo Sapiens
MTVGERSWA

SEQ ID NO: 119181 - protein, 9 aa, Homo Sapiens
DYISEWQQL

SEQ ID NO: 119182 - protein, 9 aa, Homo Sapiens
HLCLKTWNE

SEQ ID NO: 119183 - protein, 9 aa, Homo Sapiens
TLFLPYDLK

SEQ ID NO: 119184 - protein, 9 aa, Homo Sapiens
VLYPNVVQV

SEQ ID NO: 119185 - protein, 9 aa, Homo Sapiens
QLPHPHPTP

SEQ ID NO: 119186 - protein, 9 aa, Homo Sapiens
EFEVVAPEE

SEQ ID NO: 119187 - protein, 9 aa, Homo Sapiens
AAAILSRDH

SEQ ID NO: 119188 - protein, 9 aa, Homo Sapiens
IDFGVVSSR

SEQ ID NO: 119189 - protein, 9 aa, Homo Sapiens
TTKRLNKMV

SEQ ID NO: 119190 - protein, 9 aa, Homo Sapiens
VRSTRKVST

SEQ ID NO: 119191 - protein, 9 aa, Homo Sapiens
GESGDLATE

SEQ ID NO: 119192 - protein, 9 aa, Homo Sapiens
RSFCLQNKE

SEQ ID NO: 119193 - protein, 9 aa, Homo Sapiens
IYGHVTCMQ

SEQ ID NO: 119194 - protein, 9 aa, Homo Sapiens
QHLPPHGYP

SEQ ID NO: 119195 - protein, 9 aa, Homo Sapiens
SRRPPSAAS

SEQ ID NO: 119196 - protein, 9 aa, Homo Sapiens
SSSSNTDSA

SEQ ID NO: 119197 - protein, 9 aa, Homo Sapiens
NALDKMIRN

SEQ ID NO: 119198 - protein, 9 aa, Homo Sapiens
TWNELPLPN

SEQ ID NO: 119199 - protein, 9 aa, Homo Sapiens
FTCFNIFFY

SEQ ID NO: 119200 - protein, 9 aa, Homo Sapiens
NREICCYSI

SEQ ID NO: 119201 - protein, 9 aa, Homo Sapiens
VYGVPEANS

SEQ ID NO: 119202 - protein, 9 aa, Homo Sapiens
MPEVEFSDQ

SEQ ID NO: 119203 - protein, 9 aa, Homo Sapiens
LNYTHLSVQ

SEQ ID NO: 119204 - protein, 9 aa, Homo Sapiens
RHAAHRPLC

SEQ ID NO: 119205 - protein, 9 aa, Homo Sapiens
FDTLYDEDV

SEQ ID NO: 119206 - protein, 9 aa, Homo Sapiens
PRQAESGMS

SEQ ID NO: 119207 - protein, 9 aa, Homo Sapiens
CKNVGRPLD

SEQ ID NO: 119208 - protein, 9 aa, Homo Sapiens
ETALPTRRP

SEQ ID NO: 119209 - protein, 9 aa, Homo Sapiens
IDICHRVLE

SEQ ID NO: 119210 - protein, 9 aa, Homo Sapiens
PKKISLKLF

SEQ ID NO: 119211 - protein, 9 aa, Homo Sapiens
TPRGTPGSG

SEQ ID NO: 119212 - protein, 9 aa, Homo Sapiens
MPHQMHQHK

SEQ ID NO: 119213 - protein, 9 aa, Homo Sapiens
ELMTVENIN

SEQ ID NO: 119214 - protein, 9 aa, Homo Sapiens
MENDPKENK

SEQ ID NO: 119215 - protein, 9 aa, Homo Sapiens
NVSPRRPLC

SEQ ID NO: 119216 - protein, 9 aa, Homo Sapiens
EYFILRNTH

SEQ ID NO: 119217 - protein, 9 aa, Homo Sapiens
TTSSEGTAS

SEQ ID NO: 119218 - protein, 9 aa, Homo Sapiens
DIQCVFGKP

SEQ ID NO: 119219 - protein, 9 aa, Homo Sapiens
LAGPWANSS

SEQ ID NO: 119220 - protein, 9 aa, Homo Sapiens
SMWKTAVHL

SEQ ID NO: 119221 - protein, 9 aa, Homo Sapiens
YFVCTKAGG

SEQ ID NO: 119222 - protein, 9 aa, Homo Sapiens
STLGAALEA

SEQ ID NO: 119223 - protein, 9 aa, Homo Sapiens
SDGHAQPSC

SEQ ID NO: 119224 - protein, 9 aa, Homo Sapiens
APPWVPHTE

SEQ ID NO: 119225 - protein, 9 aa, Homo Sapiens
AYAATGFPA

SEQ ID NO: 119226 - protein, 9 aa, Homo Sapiens
TPVKEKHSD

SEQ ID NO: 119227 - protein, 9 aa, Homo Sapiens
LAADHIRRL

SEQ ID NO: 119228 - protein, 9 aa, Homo Sapiens
VGEMVPTFF

SEQ ID NO: 119229 - protein, 9 aa, Homo Sapiens
ERQPREPTK

SEQ ID NO: 119230 - protein, 9 aa, Homo Sapiens
VIWVAGFQM

SEQ ID NO: 119231 - protein, 9 aa, Homo Sapiens
YQRFLRRHV

SEQ ID NO: 119232 - protein, 9 aa, Homo Sapiens
KQELCAQHN

SEQ ID NO: 119233 - protein, 9 aa, Homo Sapiens
KPQGFRDAV

SEQ ID NO: 119234 - protein, 9 aa, Homo Sapiens
FAPGMRMQT

SEQ ID NO: 119235 - protein, 9 aa, Homo Sapiens
QKGDLEKVR

SEQ ID NO: 119236 - protein, 9 aa, Homo Sapiens
SNSHRATSN

SEQ ID NO: 119237 - protein, 9 aa, Homo Sapiens
STGSSTASA

SEQ ID NO: 119238 - protein, 9 aa, Homo Sapiens
RLPCAPPPP

SEQ ID NO: 119239 - protein, 9 aa, Homo Sapiens
CAVFKAGQE

SEQ ID NO: 119240 - protein, 9 aa, Homo Sapiens
KILTSEDSN

SEQ ID NO: 119241 - protein, 9 aa, Homo Sapiens
DSACSSTPG

SEQ ID NO: 119242 - protein, 9 aa, Homo Sapiens
LSIHLVLGC

SEQ ID NO: 119243 - protein, 9 aa, Homo Sapiens
NKFQMENSH

SEQ ID NO: 119244 - protein, 9 aa, Homo Sapiens
VDWAPKSDR

SEQ ID NO: 119245 - protein, 9 aa, Homo Sapiens
GKMDRSTAA

SEQ ID NO: 119246 - protein, 9 aa, Homo Sapiens
LTNPNTGDI

SEQ ID NO: 119247 - protein, 9 aa, Homo Sapiens
SHINTRLNM

SEQ ID NO: 119248 - protein, 9 aa, Homo Sapiens
VWMSFAQTG

SEQ ID NO: 119249 - protein, 9 aa, Homo Sapiens
EGESELVVR

SEQ ID NO: 119250 - protein, 9 aa, Homo Sapiens
CVGAQHDQR

SEQ ID NO: 119251 - protein, 9 aa, Homo Sapiens
LHGAPAAPG

SEQ ID NO: 119252 - protein, 9 aa, Homo Sapiens
EFVPGTAYG

SEQ ID NO: 119253 - protein, 9 aa, Homo Sapiens
KDCKIRWES

SEQ ID NO: 119254 - protein, 9 aa, Homo Sapiens
TLPSLCRLN

SEQ ID NO: 119255 - protein, 9 aa, Homo Sapiens
HPLATQEAE

SEQ ID NO: 119256 - protein, 9 aa, Homo Sapiens
LSPSRKRRR

SEQ ID NO: 119257 - protein, 9 aa, Homo Sapiens
LGAPHPSDL

SEQ ID NO: 119258 - protein, 9 aa, Homo Sapiens
RTQGRNHMN

SEQ ID NO: 119259 - protein, 9 aa, Homo Sapiens
FSLSFHLIQ

SEQ ID NO: 119260 - protein, 9 aa, Homo Sapiens
KNSRNHQRP

SEQ ID NO: 119261 - protein, 9 aa, Homo Sapiens
LIVTKEENR

SEQ ID NO: 119262 - protein, 9 aa, Homo Sapiens
QVTTLEVSM

SEQ ID NO: 119263 - protein, 9 aa, Homo Sapiens
ENHPPYPGP

SEQ ID NO: 119264 - protein, 9 aa, Homo Sapiens
NEMKLYMKL

SEQ ID NO: 119265 - protein, 9 aa, Homo Sapiens
TEHLARCET

SEQ ID NO: 119266 - protein, 9 aa, Homo Sapiens
ENIVGVDVP

SEQ ID NO: 119267 - protein, 9 aa, Homo Sapiens
MFLENWKRP

SEQ ID NO: 119268 - protein, 9 aa, Homo Sapiens
IGKNSTEGR

SEQ ID NO: 119269 - protein, 9 aa, Homo Sapiens
TQVTNNHGT

SEQ ID NO: 119270 - protein, 9 aa, Homo Sapiens
ITGDMESVM

SEQ ID NO: 119271 - protein, 9 aa, Homo Sapiens
QAKRAGQNS

SEQ ID NO: 119272 - protein, 9 aa, Homo Sapiens
EPNNCLTPG

SEQ ID NO: 119273 - protein, 9 aa, Homo Sapiens
CQKVALTQE

SEQ ID NO: 119274 - protein, 9 aa, Homo Sapiens
PRAAPPPPQ

SEQ ID NO: 119275 - protein, 9 aa, Homo Sapiens
ASTILSDPE

SEQ ID NO: 119276 - protein, 9 aa, Homo Sapiens
PAPQEEEEE

SEQ ID NO: 119277 - protein, 9 aa, Homo Sapiens
TLPRTPLLP

SEQ ID NO: 119278 - protein, 9 aa, Homo Sapiens
RSSLSSVWP

SEQ ID NO: 119279 - protein, 9 aa, Homo Sapiens
DEFYSDAAK

SEQ ID NO: 119280 - protein, 9 aa, Homo Sapiens
AGERLFTPS

SEQ ID NO: 119281 - protein, 9 aa, Homo Sapiens
QDQSSLVVT

SEQ ID NO: 119282 - protein, 9 aa, Homo Sapiens
SQFIKAKTG

SEQ ID NO: 119283 - protein, 9 aa, Homo Sapiens
AEKKATLSH

SEQ ID NO: 119284 - protein, 9 aa, Homo Sapiens
LDVLEVVGE

SEQ ID NO: 119285 - protein, 9 aa, Homo Sapiens
GAQAGRASQ

SEQ ID NO: 119286 - protein, 9 aa, Homo Sapiens
AAERAGAAR

SEQ ID NO: 119287 - protein, 9 aa, Homo Sapiens
EGCTGDMIR

SEQ ID NO: 119288 - protein, 9 aa, Homo Sapiens
KASGVCQTA

SEQ ID NO: 119289 - protein, 9 aa, Homo Sapiens
QSTPWMTGV

SEQ ID NO: 119290 - protein, 9 aa, Homo Sapiens
FSVDKEAST

SEQ ID NO: 119291 - protein, 9 aa, Homo Sapiens
QPKFRLASV

SEQ ID NO: 119292 - protein, 9 aa, Homo Sapiens
LSPIEWLQL

SEQ ID NO: 119293 - protein, 9 aa, Homo Sapiens
AHLQPPIAE

SEQ ID NO: 119294 - protein, 9 aa, Homo Sapiens
VPGGNQELV

SEQ ID NO: 119295 - protein, 9 aa, Homo Sapiens
QLRDLSRSL

SEQ ID NO: 119296 - protein, 9 aa, Homo Sapiens
QHLDAADLH

SEQ ID NO: 119297 - protein, 9 aa, Homo Sapiens
KVFRKSGAT

SEQ ID NO: 119298 - protein, 9 aa, Homo Sapiens
LRLHRPWAP

SEQ ID NO: 119299 - protein, 9 aa, Homo Sapiens
PPPQQHSDG

SEQ ID NO: 119300 - protein, 9 aa, Homo Sapiens
LGCSSNSSC

SEQ ID NO: 119301 - protein, 9 aa, Homo Sapiens
TEFVPPPTP

SEQ ID NO: 119302 - protein, 9 aa, Homo Sapiens
GLLACSQCG

SEQ ID NO: 119303 - protein, 9 aa, Homo Sapiens
AIYDICRHN

SEQ ID NO: 119304 - protein, 9 aa, Homo Sapiens
NPLPGIIMG

SEQ ID NO: 119305 - protein, 9 aa, Homo Sapiens
AFQGHYFWM

SEQ ID NO: 119306 - protein, 9 aa, Homo Sapiens
SMDPDDILP

SEQ ID NO: 119307 - protein, 9 aa, Homo Sapiens
ECCSSWLRR

SEQ ID NO: 119308 - protein, 9 aa, Homo Sapiens
RAELLEETP

SEQ ID NO: 119309 - protein, 9 aa, Homo Sapiens
GSDLGGPCP

SEQ ID NO: 119310 - protein, 9 aa, Homo Sapiens
SVYAITSND

SEQ ID NO: 119311 - protein, 9 aa, Homo Sapiens
GENCLTNFH

SEQ ID NO: 119312 - protein, 9 aa, Homo Sapiens
GNDKGESND

SEQ ID NO: 119313 - protein, 9 aa, Homo Sapiens
KELEALSCL

SEQ ID NO: 119314 - protein, 9 aa, Homo Sapiens
ITARKINFD

SEQ ID NO: 119315 - protein, 9 aa, Homo Sapiens
GKVPLAKRK

SEQ ID NO: 119316 - protein, 9 aa, Homo Sapiens
TCTQLFTSR

SEQ ID NO: 119317 - protein, 9 aa, Homo Sapiens
HRAAQIRFP

SEQ ID NO: 119318 - protein, 9 aa, Homo Sapiens
KMGIRVYYS

SEQ ID NO: 119319 - protein, 9 aa, Homo Sapiens
DKPSTTIHA

SEQ ID NO: 119320 - protein, 9 aa, Homo Sapiens
KVEPNNCLT

SEQ ID NO: 119321 - protein, 9 aa, Homo Sapiens
IENEWKPAV

SEQ ID NO: 119322 - protein, 9 aa, Homo Sapiens
ITEDEEATN

SEQ ID NO: 119323 - protein, 9 aa, Homo Sapiens
VHRIGREPG

SEQ ID NO: 119324 - protein, 9 aa, Homo Sapiens
QSTLKLHRR

SEQ ID NO: 119325 - protein, 9 aa, Homo Sapiens
HRPWAPADR

SEQ ID NO: 119326 - protein, 9 aa, Homo Sapiens
KINHVMTSF

SEQ ID NO: 119327 - protein, 9 aa, Homo Sapiens
ICSPVGSCP

SEQ ID NO: 119328 - protein, 9 aa, Homo Sapiens
SDIPKAVEP

SEQ ID NO: 119329 - protein, 9 aa, Homo Sapiens
RQPYRVKAI

SEQ ID NO: 119330 - protein, 9 aa, Homo Sapiens
GKVPRKGLI

SEQ ID NO: 119331 - protein, 9 aa, Homo Sapiens
EEGEPAAAG

SEQ ID NO: 119332 - protein, 9 aa, Homo Sapiens
ENEWKPAVI

SEQ ID NO: 119333 - protein, 9 aa, Homo Sapiens
AGGVGAQLM

SEQ ID NO: 119334 - protein, 9 aa, Homo Sapiens
MNVMNVGSH

SEQ ID NO: 119335 - protein, 9 aa, Homo Sapiens
YNINTCARF

SEQ ID NO: 119336 - protein, 9 aa, Homo Sapiens
TADPYARVS

SEQ ID NO: 119337 - protein, 9 aa, Homo Sapiens
DLDAAIGDR

SEQ ID NO: 119338 - protein, 9 aa, Homo Sapiens
VWELLGVAG

SEQ ID NO: 119339 - protein, 9 aa, Homo Sapiens
AGARHHTRE

SEQ ID NO: 119340 - protein, 9 aa, Homo Sapiens
KVVVVKNGR

SEQ ID NO: 119341 - protein, 9 aa, Homo Sapiens
RVTNSQKCV

SEQ ID NO: 119342 - protein, 9 aa, Homo Sapiens
SLDDPPKGA

SEQ ID NO: 119343 - protein, 9 aa, Homo Sapiens
HKVVSCLST

SEQ ID NO: 119344 - protein, 9 aa, Homo Sapiens
APSFPKTTT

SEQ ID NO: 119345 - protein, 9 aa, Homo Sapiens
EFVPPPTPM

SEQ ID NO: 119346 - protein, 9 aa, Homo Sapiens
SSLLNEMTH

SEQ ID NO: 119347 - protein, 9 aa, Homo Sapiens
PGPRDASPS

SEQ ID NO: 119348 - protein, 9 aa, Homo Sapiens
HLGRSGSFK

SEQ ID NO: 119349 - protein, 9 aa, Homo Sapiens
AAPGCLPRA

SEQ ID NO: 119350 - protein, 9 aa, Homo Sapiens
GVSQRGDLE

SEQ ID NO: 119351 - protein, 9 aa, Homo Sapiens
PPAPTPCTD

SEQ ID NO: 119352 - protein, 9 aa, Homo Sapiens
MPTRRSLAP

SEQ ID NO: 119353 - protein, 9 aa, Homo Sapiens
AMPVPVIMN

SEQ ID NO: 119354 - protein, 9 aa, Homo Sapiens
RSTAATGHT

SEQ ID NO: 119355 - protein, 9 aa, Homo Sapiens
APFLPYTCL

SEQ ID NO: 119356 - protein, 9 aa, Homo Sapiens
CLRWLCDSC

SEQ ID NO: 119357 - protein, 9 aa, Homo Sapiens
WGTWPLREA

SEQ ID NO: 119358 - protein, 9 aa, Homo Sapiens
GDLNPFPIR

SEQ ID NO: 119359 - protein, 9 aa, Homo Sapiens
SVHCLKQEN

SEQ ID NO: 119360 - protein, 9 aa, Homo Sapiens
LSGVQMAHA

SEQ ID NO: 119361 - protein, 9 aa, Homo Sapiens
EGVILSGEI

SEQ ID NO: 119362 - protein, 9 aa, Homo Sapiens
TQLEHLRKK

SEQ ID NO: 119363 - protein, 9 aa, Homo Sapiens
LTSVPLFVD

SEQ ID NO: 119364 - protein, 9 aa, Homo Sapiens
QPSAGYRCR

SEQ ID NO: 119365 - protein, 9 aa, Homo Sapiens
VVAFIFFRK

SEQ ID NO: 119366 - protein, 9 aa, Homo Sapiens
SYQGRGFVM

SEQ ID NO: 119367 - protein, 9 aa, Homo Sapiens
ESRATGRRV

SEQ ID NO: 119368 - protein, 9 aa, Homo Sapiens
QSTCALPSC

SEQ ID NO: 119369 - protein, 9 aa, Homo Sapiens
HFFCDLNPF

SEQ ID NO: 119370 - protein, 9 aa, Homo Sapiens
MNQENHPPY

SEQ ID NO: 119371 - protein, 9 aa, Homo Sapiens
AGRMGGRHP

SEQ ID NO: 119372 - protein, 9 aa, Homo Sapiens
SRDDELPAS

SEQ ID NO: 119373 - protein, 9 aa, Homo Sapiens
LPDFFRDYF

SEQ ID NO: 119374 - protein, 9 aa, Homo Sapiens
LPSGARSTS

SEQ ID NO: 119375 - protein, 9 aa, Homo Sapiens
STCSRLYVP

SEQ ID NO: 119376 - protein, 9 aa, Homo Sapiens
VSSSAGQMP

SEQ ID NO: 119377 - protein, 9 aa, Homo Sapiens
NLQRRLKEA

SEQ ID NO: 119378 - protein, 9 aa, Homo Sapiens
AAARGLLLA

SEQ ID NO: 119379 - protein, 9 aa, Homo Sapiens
ILVVPVLNL

SEQ ID NO: 119380 - protein, 9 aa, Homo Sapiens
FDIIPSPNF

SEQ ID NO: 119381 - protein, 9 aa, Homo Sapiens
FPLGTADQS

SEQ ID NO: 119382 - protein, 9 aa, Homo Sapiens
TDFLAVKGL

SEQ ID NO: 119383 - protein, 9 aa, Homo Sapiens
LRESEHFLY

SEQ ID NO: 119384 - protein, 9 aa, Homo Sapiens
DFHMAPNGD

SEQ ID NO: 119385 - protein, 9 aa, Homo Sapiens
KKLQSSLKN

SEQ ID NO: 119386 - protein, 9 aa, Homo Sapiens
VVHHHLIGQ

SEQ ID NO: 119387 - protein, 9 aa, Homo Sapiens
CWGTWPLRE

SEQ ID NO: 119388 - protein, 9 aa, Homo Sapiens
LEALGLVST

SEQ ID NO: 119389 - protein, 9 aa, Homo Sapiens
DKRKYVFSL

SEQ ID NO: 119390 - protein, 9 aa, Homo Sapiens
QIRTKAMDV

SEQ ID NO: 119391 - protein, 9 aa, Homo Sapiens
LLFDMGLRK

SEQ ID NO: 119392 - protein, 9 aa, Homo Sapiens
EVANIPVDR

SEQ ID NO: 119393 - protein, 9 aa, Homo Sapiens
PSKKSPQPM

SEQ ID NO: 119394 - protein, 9 aa, Homo Sapiens
GVEDGDGLS

SEQ ID NO: 119395 - protein, 9 aa, Homo Sapiens
SAPSRKLNT

SEQ ID NO: 119396 - protein, 9 aa, Homo Sapiens
ATSADGAHG

SEQ ID NO: 119397 - protein, 9 aa, Homo Sapiens
AEPEAKEAE

SEQ ID NO: 119398 - protein, 9 aa, Homo Sapiens
DTSAQPPGE

SEQ ID NO: 119399 - protein, 9 aa, Homo Sapiens
MRMQTFQVT

SEQ ID NO: 119400 - protein, 9 aa, Homo Sapiens
TTRKERKKQ

SEQ ID NO: 119401 - protein, 9 aa, Homo Sapiens
KMEKNRQLK

SEQ ID NO: 119402 - protein, 9 aa, Homo Sapiens
AVEPGKLEQ

SEQ ID NO: 119403 - protein, 9 aa, Homo Sapiens
QAQLTKPAL

SEQ ID NO: 119404 - protein, 9 aa, Homo Sapiens
VKDCRGCVL

SEQ ID NO: 119405 - protein, 9 aa, Homo Sapiens
TEVEKEMSL

SEQ ID NO: 119406 - protein, 9 aa, Homo Sapiens
EELNEEFTS

SEQ ID NO: 119407 - protein, 9 aa, Homo Sapiens
RRTDGCCLI

SEQ ID NO: 119408 - protein, 9 aa, Homo Sapiens
NKDLRRHML

SEQ ID NO: 119409 - protein, 9 aa, Homo Sapiens
RVMSQWSRS

SEQ ID NO: 119410 - protein, 9 aa, Homo Sapiens
PPGFYNVSP

SEQ ID NO: 119411 - protein, 9 aa, Homo Sapiens
QVLVEQVAE

SEQ ID NO: 119412 - protein, 9 aa, Homo Sapiens
VEFKISGHL

SEQ ID NO: 119413 - protein, 9 aa, Homo Sapiens
ILLYLLRLW

SEQ ID NO: 119414 - protein, 9 aa, Homo Sapiens
VKALPLPMV

SEQ ID NO: 119415 - protein, 9 aa, Homo Sapiens
EEYLIDMAS

SEQ ID NO: 119416 - protein, 9 aa, Homo Sapiens
PIEVLYLWK

SEQ ID NO: 119417 - protein, 9 aa, Homo Sapiens
NEKTPWSTW

SEQ ID NO: 119418 - protein, 9 aa, Homo Sapiens
LRPAQSLDY

SEQ ID NO: 119419 - protein, 9 aa, Homo Sapiens
RCLAPQELS

SEQ ID NO: 119420 - protein, 9 aa, Homo Sapiens
VSTNNCPHG

SEQ ID NO: 119421 - protein, 9 aa, Homo Sapiens
IFTCFNIFF

SEQ ID NO: 119422 - protein, 9 aa, Homo Sapiens
GASTSSVTA

SEQ ID NO: 119423 - protein, 9 aa, Homo Sapiens
ALRDITAAH

SEQ ID NO: 119424 - protein, 9 aa, Homo Sapiens
GEDQVHIIE

SEQ ID NO: 119425 - protein, 9 aa, Homo Sapiens
PKILNFNCC

SEQ ID NO: 119426 - protein, 9 aa, Homo Sapiens
VPEAEAGAA

SEQ ID NO: 119427 - protein, 9 aa, Homo Sapiens
DGALRAVER

SEQ ID NO: 119428 - protein, 9 aa, Homo Sapiens
GIVRSRGLG

SEQ ID NO: 119429 - protein, 9 aa, Homo Sapiens
NLEFGDPAS

SEQ ID NO: 119430 - protein, 9 aa, Homo Sapiens
IGSFSVRLF

SEQ ID NO: 119431 - protein, 9 aa, Homo Sapiens
RRQSSPGRP

SEQ ID NO: 119432 - protein, 9 aa, Homo Sapiens
VVEIRHRHS

SEQ ID NO: 119433 - protein, 9 aa, Homo Sapiens
MFWAAYSAA

SEQ ID NO: 119434 - protein, 9 aa, Homo Sapiens
KKIKKGHKC

SEQ ID NO: 119435 - protein, 9 aa, Homo Sapiens
ESQGLYSNF

SEQ ID NO: 119436 - protein, 9 aa, Homo Sapiens
HVLVVHLLL

SEQ ID NO: 119437 - protein, 9 aa, Homo Sapiens
PGGTADPYA

SEQ ID NO: 119438 - protein, 9 aa, Homo Sapiens
KVYALKVEA

SEQ ID NO: 119439 - protein, 9 aa, Homo Sapiens
KTSLGVSQR

SEQ ID NO: 119440 - protein, 9 aa, Homo Sapiens
GAFKTSELI

SEQ ID NO: 119441 - protein, 9 aa, Homo Sapiens
PLPCLCPSS

SEQ ID NO: 119442 - protein, 9 aa, Homo Sapiens
QGFQQIKAR

SEQ ID NO: 119443 - protein, 9 aa, Homo Sapiens
KCPAVASAR

SEQ ID NO: 119444 - protein, 9 aa, Homo Sapiens
FSVHNNGEA

SEQ ID NO: 119445 - protein, 9 aa, Homo Sapiens
QYWPITAFH

SEQ ID NO: 119446 - protein, 9 aa, Homo Sapiens
YLLCKRYCS

SEQ ID NO: 119447 - protein, 9 aa, Homo Sapiens
QPRVMSQWS

SEQ ID NO: 119448 - protein, 9 aa, Homo Sapiens
QAACFQLNE

SEQ ID NO: 119449 - protein, 9 aa, Homo Sapiens
CTARRGRRA

SEQ ID NO: 119450 - protein, 9 aa, Homo Sapiens
PLDGNPYAQ

SEQ ID NO: 119451 - protein, 9 aa, Homo Sapiens
PATAFFSVF

SEQ ID NO: 119452 - protein, 9 aa, Homo Sapiens
VGGIQKVLC

SEQ ID NO: 119453 - protein, 9 aa, Homo Sapiens
LPRWWELGG

SEQ ID NO: 119454 - protein, 9 aa, Homo Sapiens
LSLPMQESQ

SEQ ID NO: 119455 - protein, 9 aa, Homo Sapiens
NNHGTVKIP

SEQ ID NO: 119456 - protein, 9 aa, Homo Sapiens
FYVGWAEAT

SEQ ID NO: 119457 - protein, 9 aa, Homo Sapiens
DIKTYFGAE

SEQ ID NO: 119458 - protein, 9 aa, Homo Sapiens
GADSSSTLV

SEQ ID NO: 119459 - protein, 9 aa, Homo Sapiens
GCQVPGGNQ

SEQ ID NO: 119460 - protein, 9 aa, Homo Sapiens
PRSCERSPS

SEQ ID NO: 119461 - protein, 9 aa, Homo Sapiens
TMYQVQSPM

SEQ ID NO: 119462 - protein, 9 aa, Homo Sapiens
VTGGHEEAE

SEQ ID NO: 119463 - protein, 9 aa, Homo Sapiens
AQNETFVLL

SEQ ID NO: 119464 - protein, 9 aa, Homo Sapiens
RDYVNCSQR

SEQ ID NO: 119465 - protein, 9 aa, Homo Sapiens
LLLWAGASC

SEQ ID NO: 119466 - protein, 9 aa, Homo Sapiens
PACEIQAPH

SEQ ID NO: 119467 - protein, 9 aa, Homo Sapiens
FSFDNHCQE

SEQ ID NO: 119468 - protein, 9 aa, Homo Sapiens
ATFNFELGI

SEQ ID NO: 119469 - protein, 9 aa, Homo Sapiens
LLAKGKKPR

SEQ ID NO: 119470 - protein, 9 aa, Homo Sapiens
LQKTSIIRD

SEQ ID NO: 119471 - protein, 9 aa, Homo Sapiens
PTKMWHQSR

SEQ ID NO: 119472 - protein, 9 aa, Homo Sapiens
TFPGSQPQT

SEQ ID NO: 119473 - protein, 9 aa, Homo Sapiens
PMNVMNVGR

SEQ ID NO: 119474 - protein, 9 aa, Homo Sapiens
THTWRARST

SEQ ID NO: 119475 - protein, 9 aa, Homo Sapiens
AITCIFFTF

SEQ ID NO: 119476 - protein, 9 aa, Homo Sapiens
QGLQLLLNY

SEQ ID NO: 119477 - protein, 9 aa, Homo Sapiens
FTQEEWVMM

SEQ ID NO: 119478 - protein, 9 aa, Homo Sapiens
TEAGVSLAT

SEQ ID NO: 119479 - protein, 9 aa, Homo Sapiens
LSPGATLTS

SEQ ID NO: 119480 - protein, 9 aa, Homo Sapiens
ILLVRDRML

SEQ ID NO: 119481 - protein, 9 aa, Homo Sapiens
DGARPVGML

SEQ ID NO: 119482 - protein, 9 aa, Homo Sapiens
GQPAEAVGH

SEQ ID NO: 119483 - protein, 9 aa, Homo Sapiens
KFNVWRKRH

SEQ ID NO: 119484 - protein, 9 aa, Homo Sapiens
DLRETITER

SEQ ID NO: 119485 - protein, 9 aa, Homo Sapiens
ETERIFELA

SEQ ID NO: 119486 - protein, 9 aa, Homo Sapiens
WKTDLKINH

SEQ ID NO: 119487 - protein, 9 aa, Homo Sapiens
SFAAPPRSH

SEQ ID NO: 119488 - protein, 9 aa, Homo Sapiens
VKSQPLLNI

SEQ ID NO: 119489 - protein, 9 aa, Homo Sapiens
RRLIGGATR

SEQ ID NO: 119490 - protein, 9 aa, Homo Sapiens
RGRLAEVKD

SEQ ID NO: 119491 - protein, 9 aa, Homo Sapiens
SRVLCIFMF

SEQ ID NO: 119492 - protein, 9 aa, Homo Sapiens
CSYAPHVQI

SEQ ID NO: 119493 - protein, 9 aa, Homo Sapiens
VSGGHCWVT

SEQ ID NO: 119494 - protein, 9 aa, Homo Sapiens
NPFLQLSCS

SEQ ID NO: 119495 - protein, 9 aa, Homo Sapiens
VLTKMMKRA

SEQ ID NO: 119496 - protein, 9 aa, Homo Sapiens
WVSQLLGGC

SEQ ID NO: 119497 - protein, 9 aa, Homo Sapiens
CCAWSRTCK

SEQ ID NO: 119498 - protein, 9 aa, Homo Sapiens
AIGKNSTEG

SEQ ID NO: 119499 - protein, 9 aa, Homo Sapiens
ALYVYEYML

SEQ ID NO: 119500 - protein, 9 aa, Homo Sapiens
PKKTGPPVL

SEQ ID NO: 119501 - protein, 9 aa, Homo Sapiens
WKGVVADWR

SEQ ID NO: 119502 - protein, 9 aa, Homo Sapiens
VGSCPHGQA

SEQ ID NO: 119503 - protein, 9 aa, Homo Sapiens
LLQRCLAPQ

SEQ ID NO: 119504 - protein, 9 aa, Homo Sapiens
KEERKMEKN

SEQ ID NO: 119505 - protein, 9 aa, Homo Sapiens
YLSVSLPAE

SEQ ID NO: 119506 - protein, 9 aa, Homo Sapiens
NQHQYILVV

SEQ ID NO: 119507 - protein, 9 aa, Homo Sapiens
LFCIWMSLG

SEQ ID NO: 119508 - protein, 9 aa, Homo Sapiens
EEDLTIEVK

SEQ ID NO: 119509 - protein, 9 aa, Homo Sapiens
HDEQRAKAL

SEQ ID NO: 119510 - protein, 9 aa, Homo Sapiens
PGAEGSGGG

SEQ ID NO: 119511 - protein, 9 aa, Homo Sapiens
WALSQCQLL

SEQ ID NO: 119512 - protein, 9 aa, Homo Sapiens
NYSVRYRPD

SEQ ID NO: 119513 - protein, 9 aa, Homo Sapiens
YTHLSVQCE

SEQ ID NO: 119514 - protein, 9 aa, Homo Sapiens
GDSGGINGE

SEQ ID NO: 119515 - protein, 9 aa, Homo Sapiens
ENRAPKEGH

SEQ ID NO: 119516 - protein, 9 aa, Homo Sapiens
LTGRVPGQD

SEQ ID NO: 119517 - protein, 9 aa, Homo Sapiens
LDPNLYRIR

SEQ ID NO: 119518 - protein, 9 aa, Homo Sapiens
SGATTTAPL

SEQ ID NO: 119519 - protein, 9 aa, Homo Sapiens
PHAGGHRQR

SEQ ID NO: 119520 - protein, 9 aa, Homo Sapiens
TTEEALAWL

SEQ ID NO: 119521 - protein, 9 aa, Homo Sapiens
FEVTPSLAG

SEQ ID NO: 119522 - protein, 9 aa, Homo Sapiens
LWTIRLPRK

SEQ ID NO: 119523 - protein, 9 aa, Homo Sapiens
TLTVSRWMT

SEQ ID NO: 119524 - protein, 9 aa, Homo Sapiens
SMTSSQIYM

SEQ ID NO: 119525 - protein, 9 aa, Homo Sapiens
DFAPGMRMQ

SEQ ID NO: 119526 - protein, 9 aa, Homo Sapiens
NGTLVAFQG

SEQ ID NO: 119527 - protein, 9 aa, Homo Sapiens
LYQQCILWT

SEQ ID NO: 119528 - protein, 9 aa, Homo Sapiens
TGACKFDEY

SEQ ID NO: 119529 - protein, 9 aa, Homo Sapiens
PDFPYPTAA

SEQ ID NO: 119530 - protein, 9 aa, Homo Sapiens
PRGPMPLRI

SEQ ID NO: 119531 - protein, 9 aa, Homo Sapiens
PQTPASPVL

SEQ ID NO: 119532 - protein, 9 aa, Homo Sapiens
LWRIHRRTP

SEQ ID NO: 119533 - protein, 9 aa, Homo Sapiens
QALLSSINQ

SEQ ID NO: 119534 - protein, 9 aa, Homo Sapiens
KHLLYPAIM

SEQ ID NO: 119535 - protein, 9 aa, Homo Sapiens
EFVRNYVPW

SEQ ID NO: 119536 - protein, 9 aa, Homo Sapiens
WMSSVPVSM

SEQ ID NO: 119537 - protein, 9 aa, Homo Sapiens
KPGKDGEMA

SEQ ID NO: 119538 - protein, 9 aa, Homo Sapiens
HTREIFVLF

SEQ ID NO: 119539 - protein, 9 aa, Homo Sapiens
AEFMCVPAQ

SEQ ID NO: 119540 - protein, 9 aa, Homo Sapiens
SVPVSMLQT

SEQ ID NO: 119541 - protein, 9 aa, Homo Sapiens
SAVWNFFTL

SEQ ID NO: 119542 - protein, 9 aa, Homo Sapiens
LIGGATRDV

SEQ ID NO: 119543 - protein, 9 aa, Homo Sapiens
FLLRLHRPW

SEQ ID NO: 119544 - protein, 9 aa, Homo Sapiens
GDIYTPEEF

SEQ ID NO: 119545 - protein, 9 aa, Homo Sapiens
LGITLRQCD

SEQ ID NO: 119546 - protein, 9 aa, Homo Sapiens
ASTQISFVV

SEQ ID NO: 119547 - protein, 9 aa, Homo Sapiens
TRGIGETCK

SEQ ID NO: 119548 - protein, 9 aa, Homo Sapiens
GINMSLLTV

SEQ ID NO: 119549 - protein, 9 aa, Homo Sapiens
GELGGIWPE

SEQ ID NO: 119550 - protein, 9 aa, Homo Sapiens
ELVILGKGG

SEQ ID NO: 119551 - protein, 9 aa, Homo Sapiens
PGTGHIPHL

SEQ ID NO: 119552 - protein, 9 aa, Homo Sapiens
MTSFSLNIM

SEQ ID NO: 119553 - protein, 9 aa, Homo Sapiens
LLSPCRCYG

SEQ ID NO: 119554 - protein, 9 aa, Homo Sapiens
VHRPPVLPP

SEQ ID NO: 119555 - protein, 9 aa, Homo Sapiens
RTEITIVKL

SEQ ID NO: 119556 - protein, 9 aa, Homo Sapiens
KAAVWRVPG

SEQ ID NO: 119557 - protein, 9 aa, Homo Sapiens
NSSNWKQDG

SEQ ID NO: 119558 - protein, 9 aa, Homo Sapiens
EEVPDEVLG

SEQ ID NO: 119559 - protein, 9 aa, Homo Sapiens
PSRKRRRGS

SEQ ID NO: 119560 - protein, 9 aa, Homo Sapiens
TQPHRLHLH

SEQ ID NO: 119561 - protein, 9 aa, Homo Sapiens
LQVVKILAV

SEQ ID NO: 119562 - protein, 9 aa, Homo Sapiens
LHVSNVMLD

SEQ ID NO: 119563 - protein, 9 aa, Homo Sapiens
DSGYNTWLS

SEQ ID NO: 119564 - protein, 9 aa, Homo Sapiens
VVSGISRFL

SEQ ID NO: 119565 - protein, 9 aa, Homo Sapiens
MKRAVIWLD

SEQ ID NO: 119566 - protein, 9 aa, Homo Sapiens
VDAPVTDVD

SEQ ID NO: 119567 - protein, 9 aa, Homo Sapiens
EDLLRESEH

SEQ ID NO: 119568 - protein, 9 aa, Homo Sapiens
LRAVERSQH

SEQ ID NO: 119569 - protein, 9 aa, Homo Sapiens
LSDFQINVD

SEQ ID NO: 119570 - protein, 9 aa, Homo Sapiens
ALRLLCPPV

SEQ ID NO: 119571 - protein, 9 aa, Homo Sapiens
HLKEAGTVG

SEQ ID NO: 119572 - protein, 9 aa, Homo Sapiens
RKCRTLQRR

SEQ ID NO: 119573 - protein, 9 aa, Homo Sapiens
MDESSRLDF

SEQ ID NO: 119574 - protein, 9 aa, Homo Sapiens
RHWLCPQTR

SEQ ID NO: 119575 - protein, 9 aa, Homo Sapiens
LYPMTSRPY

SEQ ID NO: 119576 - protein, 9 aa, Homo Sapiens
WEEGLDRCN

SEQ ID NO: 119577 - protein, 9 aa, Homo Sapiens
ACEKKMLSV

SEQ ID NO: 119578 - protein, 9 aa, Homo Sapiens
GPEGQLCGR

SEQ ID NO: 119579 - protein, 9 aa, Homo Sapiens
EMKSSGKIN

SEQ ID NO: 119580 - protein, 9 aa, Homo Sapiens
PGLSRKLLP

SEQ ID NO: 119581 - protein, 9 aa, Homo Sapiens
PSRVKELIL

SEQ ID NO: 119582 - protein, 9 aa, Homo Sapiens
LRRVRQKCF

SEQ ID NO: 119583 - protein, 9 aa, Homo Sapiens
EEEEKGLLP

SEQ ID NO: 119584 - protein, 9 aa, Homo Sapiens
SSSGGDCSP

SEQ ID NO: 119585 - protein, 9 aa, Homo Sapiens
RALCVPPSP

SEQ ID NO: 119586 - protein, 9 aa, Homo Sapiens
MGPEPSFPP

SEQ ID NO: 119587 - protein, 9 aa, Homo Sapiens
LSTMANLAI

SEQ ID NO: 119588 - protein, 9 aa, Homo Sapiens
KCKNVGRPL

SEQ ID NO: 119589 - protein, 9 aa, Homo Sapiens
HHHQCQPWS

SEQ ID NO: 119590 - protein, 9 aa, Homo Sapiens
GVPLPTEPS

SEQ ID NO: 119591 - protein, 9 aa, Homo Sapiens
LPVHHLHRP

SEQ ID NO: 119592 - protein, 9 aa, Homo Sapiens
LDTVQPLKC

SEQ ID NO: 119593 - protein, 9 aa, Homo Sapiens
SPRLNGGVW

SEQ ID NO: 119594 - protein, 9 aa, Homo Sapiens
LSHCLGDPG

SEQ ID NO: 119595 - protein, 9 aa, Homo Sapiens
EMVGQVCGQ

SEQ ID NO: 119596 - protein, 9 aa, Homo Sapiens
TLQVACLNQ

SEQ ID NO: 119597 - protein, 9 aa, Homo Sapiens
DHRSLVLQI

SEQ ID NO: 119598 - protein, 9 aa, Homo Sapiens
IQRQHTISP

SEQ ID NO: 119599 - protein, 9 aa, Homo Sapiens
CDDNEIDTM

SEQ ID NO: 119600 - protein, 9 aa, Homo Sapiens
WLIYYSFDV

SEQ ID NO: 119601 - protein, 9 aa, Homo Sapiens
VEENILKRQ

SEQ ID NO: 119602 - protein, 9 aa, Homo Sapiens
YYKVDNSRF

SEQ ID NO: 119603 - protein, 9 aa, Homo Sapiens
RLAEVKDNL

SEQ ID NO: 119604 - protein, 9 aa, Homo Sapiens
LLNPNPHMY

SEQ ID NO: 119605 - protein, 9 aa, Homo Sapiens
ARPVGMLGK

SEQ ID NO: 119606 - protein, 9 aa, Homo Sapiens
YFIHLESWA

SEQ ID NO: 119607 - protein, 9 aa, Homo Sapiens
KSLQLTEKY

SEQ ID NO: 119608 - protein, 9 aa, Homo Sapiens
RGSSPPCLT

SEQ ID NO: 119609 - protein, 9 aa, Homo Sapiens
GKATKPKEE

SEQ ID NO: 119610 - protein, 9 aa, Homo Sapiens
LPSLCRLNL

SEQ ID NO: 119611 - protein, 9 aa, Homo Sapiens
FTVLLFCIW

SEQ ID NO: 119612 - protein, 9 aa, Homo Sapiens
VSKNILFIL

SEQ ID NO: 119613 - protein, 9 aa, Homo Sapiens
TEARSKMVL

SEQ ID NO: 119614 - protein, 9 aa, Homo Sapiens
LTNDKVNSM

SEQ ID NO: 119615 - protein, 9 aa, Homo Sapiens
VWISWFESY

SEQ ID NO: 119616 - protein, 9 aa, Homo Sapiens
FYVKKDKGE

SEQ ID NO: 119617 - protein, 9 aa, Homo Sapiens
LPHCQLQGA

SEQ ID NO: 119618 - protein, 9 aa, Homo Sapiens
PMTVGERSW

SEQ ID NO: 119619 - protein, 9 aa, Homo Sapiens
VLCLQVARF

SEQ ID NO: 119620 - protein, 9 aa, Homo Sapiens
EKHEESSWG

SEQ ID NO: 119621 - protein, 9 aa, Homo Sapiens
SSGTAAPGP

SEQ ID NO: 119622 - protein, 9 aa, Homo Sapiens
RSDVHRPPV

SEQ ID NO: 119623 - protein, 9 aa, Homo Sapiens
PRPRCRPHQ

SEQ ID NO: 119624 - protein, 9 aa, Homo Sapiens
TITAVSSQP

SEQ ID NO: 119625 - protein, 9 aa, Homo Sapiens
TRKPPRLDA

SEQ ID NO: 119626 - protein, 9 aa, Homo Sapiens
KTQPVRSPP

SEQ ID NO: 119627 - protein, 9 aa, Homo Sapiens
GQEVGLSHC

SEQ ID NO: 119628 - protein, 9 aa, Homo Sapiens
TQNSVREPR

SEQ ID NO: 119629 - protein, 9 aa, Homo Sapiens
ENFWGEKIV

SEQ ID NO: 119630 - protein, 9 aa, Homo Sapiens
RIRQSKIFF

SEQ ID NO: 119631 - protein, 9 aa, Homo Sapiens
APSPSSAIP

SEQ ID NO: 119632 - protein, 9 aa, Homo Sapiens
SLSYNSSGL

SEQ ID NO: 119633 - protein, 9 aa, Homo Sapiens
SPAFCSRRW

SEQ ID NO: 119634 - protein, 9 aa, Homo Sapiens
LTDIWLEAL

SEQ ID NO: 119635 - protein, 9 aa, Homo Sapiens
TARATQPHR

SEQ ID NO: 119636 - protein, 9 aa, Homo Sapiens
VIWLDTSLR

SEQ ID NO: 119637 - protein, 9 aa, Homo Sapiens
EQGTENLCI

SEQ ID NO: 119638 - protein, 9 aa, Homo Sapiens
LIRSVLQRD

SEQ ID NO: 119639 - protein, 9 aa, Homo Sapiens
SVMEILCTV

SEQ ID NO: 119640 - protein, 9 aa, Homo Sapiens
IFSFDNHCQ

SEQ ID NO: 119641 - protein, 9 aa, Homo Sapiens
KRRQSSPGR

SEQ ID NO: 119642 - protein, 9 aa, Homo Sapiens
KDLIRSVLQ

SEQ ID NO: 119643 - protein, 9 aa, Homo Sapiens
MIPIARSLQ

SEQ ID NO: 119644 - protein, 9 aa, Homo Sapiens
GEQYGSPIH

SEQ ID NO: 119645 - protein, 9 aa, Homo Sapiens
GKGRGNKAT

SEQ ID NO: 119646 - protein, 9 aa, Homo Sapiens
GDPGSDLLP

SEQ ID NO: 119647 - protein, 9 aa, Homo Sapiens
SSHIAGNLP

SEQ ID NO: 119648 - protein, 9 aa, Homo Sapiens
RNDKVFLPQ

SEQ ID NO: 119649 - protein, 9 aa, Homo Sapiens
GLLSKSAQL

SEQ ID NO: 119650 - protein, 9 aa, Homo Sapiens
LLNYFSGDT

SEQ ID NO: 119651 - protein, 9 aa, Homo Sapiens
AFSHRSAAA

SEQ ID NO: 119652 - protein, 9 aa, Homo Sapiens
DRHEEVLPF

SEQ ID NO: 119653 - protein, 9 aa, Homo Sapiens
GQATAVLNL

SEQ ID NO: 119654 - protein, 9 aa, Homo Sapiens
INDIRSPCI

SEQ ID NO: 119655 - protein, 9 aa, Homo Sapiens
RYRQVITVH

SEQ ID NO: 119656 - protein, 9 aa, Homo Sapiens
QRPPRSILS

SEQ ID NO: 119657 - protein, 9 aa, Homo Sapiens
FTCTSSIIE

SEQ ID NO: 119658 - protein, 9 aa, Homo Sapiens
VVGAGDVGK

SEQ ID NO: 119659 - protein, 9 aa, Homo Sapiens
VLQKKHLRN

SEQ ID NO: 119660 - protein, 9 aa, Homo Sapiens
RPGWAALQR

SEQ ID NO: 119661 - protein, 9 aa, Homo Sapiens
SMSYQRKDS

SEQ ID NO: 119662 - protein, 9 aa, Homo Sapiens
SHCLGDPGL

SEQ ID NO: 119663 - protein, 9 aa, Homo Sapiens
FLQLSCSDV

SEQ ID NO: 119664 - protein, 9 aa, Homo Sapiens
TSNNHLQQL

SEQ ID NO: 119665 - protein, 9 aa, Homo Sapiens
RKGGGRESV

SEQ ID NO: 119666 - protein, 9 aa, Homo Sapiens
NTRRNEDGS

SEQ ID NO: 119667 - protein, 9 aa, Homo Sapiens
THTTKVNGS

SEQ ID NO: 119668 - protein, 9 aa, Homo Sapiens
LYLDSHKLP

SEQ ID NO: 119669 - protein, 9 aa, Homo Sapiens
APPGPPTVP

SEQ ID NO: 119670 - protein, 9 aa, Homo Sapiens
FGMLLCCSQ

SEQ ID NO: 119671 - protein, 9 aa, Homo Sapiens
PVTAANDSD

SEQ ID NO: 119672 - protein, 9 aa, Homo Sapiens
CPRVGCLHS

SEQ ID NO: 119673 - protein, 9 aa, Homo Sapiens
SCPGFRQCV

SEQ ID NO: 119674 - protein, 9 aa, Homo Sapiens
SQARVDAHM

SEQ ID NO: 119675 - protein, 9 aa, Homo Sapiens
SPRTSLLCS

SEQ ID NO: 119676 - protein, 9 aa, Homo Sapiens
DTLSPRHGN

SEQ ID NO: 119677 - protein, 9 aa, Homo Sapiens
PALGAVALV

SEQ ID NO: 119678 - protein, 9 aa, Homo Sapiens
AQTGINPFV

SEQ ID NO: 119679 - protein, 9 aa, Homo Sapiens
LHPWTCFVQ

SEQ ID NO: 119680 - protein, 9 aa, Homo Sapiens
LQRCLAPQE

SEQ ID NO: 119681 - protein, 9 aa, Homo Sapiens
EGPGQIWRA

SEQ ID NO: 119682 - protein, 9 aa, Homo Sapiens
DVTLNFRRN

SEQ ID NO: 119683 - protein, 9 aa, Homo Sapiens
MCIVRALKD

SEQ ID NO: 119684 - protein, 9 aa, Homo Sapiens
SALYRESDL

SEQ ID NO: 119685 - protein, 9 aa, Homo Sapiens
DSIDICHRV

SEQ ID NO: 119686 - protein, 9 aa, Homo Sapiens
DRNEESVDR

SEQ ID NO: 119687 - protein, 9 aa, Homo Sapiens
CSNIMKPTP

SEQ ID NO: 119688 - protein, 9 aa, Homo Sapiens
GKDLDVLEV

SEQ ID NO: 119689 - protein, 9 aa, Homo Sapiens
KSPSAGPSP

SEQ ID NO: 119690 - protein, 9 aa, Homo Sapiens
EKGLALEVA

SEQ ID NO: 119691 - protein, 9 aa, Homo Sapiens
IQITSTSVR

SEQ ID NO: 119692 - protein, 9 aa, Homo Sapiens
GPPLAVLEF

SEQ ID NO: 119693 - protein, 9 aa, Homo Sapiens
PNYTVDWYY

SEQ ID NO: 119694 - protein, 9 aa, Homo Sapiens
HIAGNLPSD

SEQ ID NO: 119695 - protein, 9 aa, Homo Sapiens
EVQFEISTT

SEQ ID NO: 119696 - protein, 9 aa, Homo Sapiens
HHLHRPVAH

SEQ ID NO: 119697 - protein, 9 aa, Homo Sapiens
RAKIRSVKM

SEQ ID NO: 119698 - protein, 9 aa, Homo Sapiens
NILEEIASF

SEQ ID NO: 119699 - protein, 9 aa, Homo Sapiens
AAEARSMTL

SEQ ID NO: 119700 - protein, 9 aa, Homo Sapiens
GGGGQCCRH

SEQ ID NO: 119701 - protein, 9 aa, Homo Sapiens
HEESSWGGS

SEQ ID NO: 119702 - protein, 9 aa, Homo Sapiens
SDYGMKLSI

SEQ ID NO: 119703 - protein, 9 aa, Homo Sapiens
RNISTVRAI

SEQ ID NO: 119704 - protein, 9 aa, Homo Sapiens
KKAKDRMGI

SEQ ID NO: 119705 - protein, 9 aa, Homo Sapiens
RDDISLCKA

SEQ ID NO: 119706 - protein, 9 aa, Homo Sapiens
ETRISLHEK

SEQ ID NO: 119707 - protein, 9 aa, Homo Sapiens
NLPPTQTSV

SEQ ID NO: 119708 - protein, 9 aa, Homo Sapiens
MWLSNTSLG

SEQ ID NO: 119709 - protein, 9 aa, Homo Sapiens
GGPATSHPD

SEQ ID NO: 119710 - protein, 9 aa, Homo Sapiens
DGVPIYITV

SEQ ID NO: 119711 - protein, 9 aa, Homo Sapiens
EFSPDVRSH

SEQ ID NO: 119712 - protein, 9 aa, Homo Sapiens
RSLVELRGT

SEQ ID NO: 119713 - protein, 9 aa, Homo Sapiens
IMTLTNSCL

SEQ ID NO: 119714 - protein, 9 aa, Homo Sapiens
LAEPALSDY

SEQ ID NO: 119715 - protein, 9 aa, Homo Sapiens
VAVEWESNG

SEQ ID NO: 119716 - protein, 9 aa, Homo Sapiens
EGVDLLGLL

SEQ ID NO: 119717 - protein, 9 aa, Homo Sapiens
GLAKLLLGF

SEQ ID NO: 119718 - protein, 9 aa, Homo Sapiens
NGFGGMCLT

SEQ ID NO: 119719 - protein, 9 aa, Homo Sapiens
NKKENTLVQ

SEQ ID NO: 119720 - protein, 9 aa, Homo Sapiens
NFLPLLVEV

SEQ ID NO: 119721 - protein, 9 aa, Homo Sapiens
VFCLLGTFR

SEQ ID NO: 119722 - protein, 9 aa, Homo Sapiens
KQQEKQKTE

SEQ ID NO: 119723 - protein, 9 aa, Homo Sapiens
EKDPNELQA

SEQ ID NO: 119724 - protein, 9 aa, Homo Sapiens
FVVRNYWRG

SEQ ID NO: 119725 - protein, 9 aa, Homo Sapiens
GLSFRLESV

SEQ ID NO: 119726 - protein, 9 aa, Homo Sapiens
GGPLSPCKD

SEQ ID NO: 119727 - protein, 9 aa, Homo Sapiens
LGCIQAAST

SEQ ID NO: 119728 - protein, 9 aa, Homo Sapiens
TLDSFWGHS

SEQ ID NO: 119729 - protein, 9 aa, Homo Sapiens
VGRIDREEL

SEQ ID NO: 119730 - protein, 9 aa, Homo Sapiens
EEATNNGYS

SEQ ID NO: 119731 - protein, 9 aa, Homo Sapiens
DRGLHKRTY

SEQ ID NO: 119732 - protein, 9 aa, Homo Sapiens
QHLQVVKIL

SEQ ID NO: 119733 - protein, 9 aa, Homo Sapiens
PLCWHGGFQ

SEQ ID NO: 119734 - protein, 9 aa, Homo Sapiens
RAATQRPST

SEQ ID NO: 119735 - protein, 9 aa, Homo Sapiens
NILFILRFC

SEQ ID NO: 119736 - protein, 9 aa, Homo Sapiens
VADLVEALY

SEQ ID NO: 119737 - protein, 9 aa, Homo Sapiens
EKVKKDRGW

SEQ ID NO: 119738 - protein, 9 aa, Homo Sapiens
MSGNYLPSC

SEQ ID NO: 119739 - protein, 9 aa, Homo Sapiens
RPTLSPAIT

SEQ ID NO: 119740 - protein, 9 aa, Homo Sapiens
QCGLHDLEY

SEQ ID NO: 119741 - protein, 9 aa, Homo Sapiens
RRLDFQEEP

SEQ ID NO: 119742 - protein, 9 aa, Homo Sapiens
AHYNFSLPG

SEQ ID NO: 119743 - protein, 9 aa, Homo Sapiens
VPVPKKLLM

SEQ ID NO: 119744 - protein, 9 aa, Homo Sapiens
TIQQAIKAQ

SEQ ID NO: 119745 - protein, 9 aa, Homo Sapiens
HGGPRGRAQ

SEQ ID NO: 119746 - protein, 9 aa, Homo Sapiens
DVEGNDVIE

SEQ ID NO: 119747 - protein, 9 aa, Homo Sapiens
KLGSPSTSI

SEQ ID NO: 119748 - protein, 9 aa, Homo Sapiens
IHNQTTRKR

SEQ ID NO: 119749 - protein, 9 aa, Homo Sapiens
VDDKFETLE

SEQ ID NO: 119750 - protein, 9 aa, Homo Sapiens
EASSVTLAS

SEQ ID NO: 119751 - protein, 9 aa, Homo Sapiens
ALNYTHLSV

SEQ ID NO: 119752 - protein, 9 aa, Homo Sapiens
SKNILFILR

SEQ ID NO: 119753 - protein, 9 aa, Homo Sapiens
FLLTHRTGP

SEQ ID NO: 119754 - protein, 9 aa, Homo Sapiens
TLMTLTLFP

SEQ ID NO: 119755 - protein, 9 aa, Homo Sapiens
DPDIGINGV

SEQ ID NO: 119756 - protein, 9 aa, Homo Sapiens
RQCDAEVTR

SEQ ID NO: 119757 - protein, 9 aa, Homo Sapiens
GHGRVILGQ

SEQ ID NO: 119758 - protein, 9 aa, Homo Sapiens
LLGWLINDQ

SEQ ID NO: 119759 - protein, 9 aa, Homo Sapiens
HVTTIFPPL

SEQ ID NO: 119760 - protein, 9 aa, Homo Sapiens
FHRQLDKVN

SEQ ID NO: 119761 - protein, 9 aa, Homo Sapiens
HALIVLPGE

SEQ ID NO: 119762 - protein, 9 aa, Homo Sapiens
LLIAYYGLK

SEQ ID NO: 119763 - protein, 9 aa, Homo Sapiens
MYSDALMVT

SEQ ID NO: 119764 - protein, 9 aa, Homo Sapiens
AAHGGPRGR

SEQ ID NO: 119765 - protein, 9 aa, Homo Sapiens
PPPQIEAPP

SEQ ID NO: 119766 - protein, 9 aa, Homo Sapiens
VMNVGRPSI

SEQ ID NO: 119767 - protein, 9 aa, Homo Sapiens
VLLAHIMSR

SEQ ID NO: 119768 - protein, 9 aa, Homo Sapiens
RNEDGSGEP

SEQ ID NO: 119769 - protein, 9 aa, Homo Sapiens
GWAALQRLT

SEQ ID NO: 119770 - protein, 9 aa, Homo Sapiens
ICPTHGQMT

SEQ ID NO: 119771 - protein, 9 aa, Homo Sapiens
PGSSHLPTL

SEQ ID NO: 119772 - protein, 9 aa, Homo Sapiens
LEMHMRGLL

SEQ ID NO: 119773 - protein, 9 aa, Homo Sapiens
DLTNENKHG

SEQ ID NO: 119774 - protein, 9 aa, Homo Sapiens
GLLIITLNC

SEQ ID NO: 119775 - protein, 9 aa, Homo Sapiens
THPLATQEA

SEQ ID NO: 119776 - protein, 9 aa, Homo Sapiens
AFQVVGWGD

SEQ ID NO: 119777 - protein, 9 aa, Homo Sapiens
IRIQTSLNI

SEQ ID NO: 119778 - protein, 9 aa, Homo Sapiens
MRLHPWWRE

SEQ ID NO: 119779 - protein, 9 aa, Homo Sapiens
GEVSGGHCW

SEQ ID NO: 119780 - protein, 9 aa, Homo Sapiens
RRLLAHSGA

SEQ ID NO: 119781 - protein, 9 aa, Homo Sapiens
AARRPPGVP

SEQ ID NO: 119782 - protein, 9 aa, Homo Sapiens
WELLGVAGS

SEQ ID NO: 119783 - protein, 9 aa, Homo Sapiens
TSFLTETSL

SEQ ID NO: 119784 - protein, 9 aa, Homo Sapiens
QHPVFPEQP

SEQ ID NO: 119785 - protein, 9 aa, Homo Sapiens
CASTGSSTA

SEQ ID NO: 119786 - protein, 9 aa, Homo Sapiens
QRTLYSMSC

SEQ ID NO: 119787 - protein, 9 aa, Homo Sapiens
DAFEEVLHK

SEQ ID NO: 119788 - protein, 9 aa, Homo Sapiens
CQADGASAD

SEQ ID NO: 119789 - protein, 9 aa, Homo Sapiens
THISGDKSG

SEQ ID NO: 119790 - protein, 9 aa, Homo Sapiens
SRVSFAARD

SEQ ID NO: 119791 - protein, 9 aa, Homo Sapiens
TGEETPLNK

SEQ ID NO: 119792 - protein, 9 aa, Homo Sapiens
LAGMIVKFP

SEQ ID NO: 119793 - protein, 9 aa, Homo Sapiens
SMCDCEGAA

SEQ ID NO: 119794 - protein, 9 aa, Homo Sapiens
KARTKKLWP

SEQ ID NO: 119795 - protein, 9 aa, Homo Sapiens
MEKNRQLKK

SEQ ID NO: 119796 - protein, 9 aa, Homo Sapiens
EATVAAARG

SEQ ID NO: 119797 - protein, 9 aa, Homo Sapiens
VTDVDFLRA

SEQ ID NO: 119798 - protein, 9 aa, Homo Sapiens
SLDLVLHFL

SEQ ID NO: 119799 - protein, 9 aa, Homo Sapiens
MMVSDWYKQ

SEQ ID NO: 119800 - protein, 9 aa, Homo Sapiens
LPGACNIPT

SEQ ID NO: 119801 - protein, 9 aa, Homo Sapiens
EVGLSHCLG

SEQ ID NO: 119802 - protein, 9 aa, Homo Sapiens
EPCFFSGKS

SEQ ID NO: 119803 - protein, 9 aa, Homo Sapiens
CRRPPPPLS

SEQ ID NO: 119804 - protein, 9 aa, Homo Sapiens
YRLVSAAAA

SEQ ID NO: 119805 - protein, 9 aa, Homo Sapiens
ANPIRKYQD

SEQ ID NO: 119806 - protein, 9 aa, Homo Sapiens
TGVGSGLQG

SEQ ID NO: 119807 - protein, 9 aa, Homo Sapiens
EGSAVKKVV

SEQ ID NO: 119808 - protein, 9 aa, Homo Sapiens
YFGISMDPD

SEQ ID NO: 119809 - protein, 9 aa, Homo Sapiens
NRNLLNPNP

SEQ ID NO: 119810 - protein, 9 aa, Homo Sapiens
DPSFSSKVK

SEQ ID NO: 119811 - protein, 9 aa, Homo Sapiens
HRRNLTEWF

SEQ ID NO: 119812 - protein, 9 aa, Homo Sapiens
QTVRLMEAP

SEQ ID NO: 119813 - protein, 9 aa, Homo Sapiens
NSCNTSVYS

SEQ ID NO: 119814 - protein, 9 aa, Homo Sapiens
SIVITRSGG

SEQ ID NO: 119815 - protein, 9 aa, Homo Sapiens
AAKPLPRKA

SEQ ID NO: 119816 - protein, 9 aa, Homo Sapiens
PCRCYGSVK

SEQ ID NO: 119817 - protein, 9 aa, Homo Sapiens
QVLPPCSDL

SEQ ID NO: 119818 - protein, 9 aa, Homo Sapiens
AGFQMTRTV

SEQ ID NO: 119819 - protein, 9 aa, Homo Sapiens
MCESNSAMP

SEQ ID NO: 119820 - protein, 9 aa, Homo Sapiens
HHNDDVHHQ

SEQ ID NO: 119821 - protein, 9 aa, Homo Sapiens
GCPHRYERE

SEQ ID NO: 119822 - protein, 9 aa, Homo Sapiens
PIPSANTPF

SEQ ID NO: 119823 - protein, 9 aa, Homo Sapiens
IDLHNPKGN

SEQ ID NO: 119824 - protein, 9 aa, Homo Sapiens
TPKVSSLAR

SEQ ID NO: 119825 - protein, 9 aa, Homo Sapiens
RPGAAASLR

SEQ ID NO: 119826 - protein, 9 aa, Homo Sapiens
RMEEERLHP

SEQ ID NO: 119827 - protein, 9 aa, Homo Sapiens
RLAADVGEA

SEQ ID NO: 119828 - protein, 9 aa, Homo Sapiens
HLVPTGPGG

SEQ ID NO: 119829 - protein, 9 aa, Homo Sapiens
KIRMKKSLS

SEQ ID NO: 119830 - protein, 9 aa, Homo Sapiens
STPKSPSAG

SEQ ID NO: 119831 - protein, 9 aa, Homo Sapiens
MVNSIKMPL

SEQ ID NO: 119832 - protein, 9 aa, Homo Sapiens
LPLHVLAAL

SEQ ID NO: 119833 - protein, 9 aa, Homo Sapiens
CSGCHTPQI

SEQ ID NO: 119834 - protein, 9 aa, Homo Sapiens
APGMRMQTF

SEQ ID NO: 119835 - protein, 9 aa, Homo Sapiens
LVELRGTEA

SEQ ID NO: 119836 - protein, 9 aa, Homo Sapiens
ELDSSLPEY

SEQ ID NO: 119837 - protein, 9 aa, Homo Sapiens
SGRHTTGTT

SEQ ID NO: 119838 - protein, 9 aa, Homo Sapiens
PRENWTHLL

SEQ ID NO: 119839 - protein, 9 aa, Homo Sapiens
SHKLPMIDF

SEQ ID NO: 119840 - protein, 9 aa, Homo Sapiens
LGVGATRIE

SEQ ID NO: 119841 - protein, 9 aa, Homo Sapiens
HSHLAVTPD

SEQ ID NO: 119842 - protein, 9 aa, Homo Sapiens
CPAPDGQPQ

SEQ ID NO: 119843 - protein, 9 aa, Homo Sapiens
PTTREVTAR

SEQ ID NO: 119844 - protein, 9 aa, Homo Sapiens
AFLGHCQEL

SEQ ID NO: 119845 - protein, 9 aa, Homo Sapiens
GCCLIWGRK

SEQ ID NO: 119846 - protein, 9 aa, Homo Sapiens
LKFLLFDMG

SEQ ID NO: 119847 - protein, 9 aa, Homo Sapiens
GETALPTRR

SEQ ID NO: 119848 - protein, 9 aa, Homo Sapiens
RQFCVKLSK

SEQ ID NO: 119849 - protein, 9 aa, Homo Sapiens
RVFCLLGTF

SEQ ID NO: 119850 - protein, 9 aa, Homo Sapiens
GLPGKMDRS

SEQ ID NO: 119851 - protein, 9 aa, Homo Sapiens
KDYTITCGK

SEQ ID NO: 119852 - protein, 9 aa, Homo Sapiens
DPFPRYDLT

SEQ ID NO: 119853 - protein, 9 aa, Homo Sapiens
YRVCMLAAN

SEQ ID NO: 119854 - protein, 9 aa, Homo Sapiens
GRREVTSGD

SEQ ID NO: 119855 - protein, 9 aa, Homo Sapiens
KEFIQGRDL

SEQ ID NO: 119856 - protein, 9 aa, Homo Sapiens
GAKARSAWD

SEQ ID NO: 119857 - protein, 9 aa, Homo Sapiens
GCLHSQLPH

SEQ ID NO: 119858 - protein, 9 aa, Homo Sapiens
DYKNNDGYI

SEQ ID NO: 119859 - protein, 9 aa, Homo Sapiens
PQGQPREDD

SEQ ID NO: 119860 - protein, 9 aa, Homo Sapiens
QPVRSPPPP

SEQ ID NO: 119861 - protein, 9 aa, Homo Sapiens
ALLSSINQE

SEQ ID NO: 119862 - protein, 9 aa, Homo Sapiens
PSGARSTSA

SEQ ID NO: 119863 - protein, 9 aa, Homo Sapiens
EDGSGEPEG

SEQ ID NO: 119864 - protein, 9 aa, Homo Sapiens
SKIKQAGLI

SEQ ID NO: 119865 - protein, 9 aa, Homo Sapiens
LGLLIITLN

SEQ ID NO: 119866 - protein, 9 aa, Homo Sapiens
TVGRIDREE

SEQ ID NO: 119867 - protein, 9 aa, Homo Sapiens
TGPLPPLPP

SEQ ID NO: 119868 - protein, 9 aa, Homo Sapiens
RPQPKFRLA

SEQ ID NO: 119869 - protein, 9 aa, Homo Sapiens
VADFLLDIS

SEQ ID NO: 119870 - protein, 9 aa, Homo Sapiens
VNQWCEAGI

SEQ ID NO: 119871 - protein, 9 aa, Homo Sapiens
ASRGPSTGS

SEQ ID NO: 119872 - protein, 9 aa, Homo Sapiens
YDAHAVDIW

SEQ ID NO: 119873 - protein, 9 aa, Homo Sapiens
SFPGSSHLP

SEQ ID NO: 119874 - protein, 9 aa, Homo Sapiens
RWTGKQKLY

SEQ ID NO: 119875 - protein, 9 aa, Homo Sapiens
FSLNIMKKS

SEQ ID NO: 119876 - protein, 9 aa, Homo Sapiens
EENGRKNLQ

SEQ ID NO: 119877 - protein, 9 aa, Homo Sapiens
DKKRRSKIE

SEQ ID NO: 119878 - protein, 9 aa, Homo Sapiens
DGFLSDSLL

SEQ ID NO: 119879 - protein, 9 aa, Homo Sapiens
RLSDFYVIH

SEQ ID NO: 119880 - protein, 9 aa, Homo Sapiens
DGLQSVQPT

SEQ ID NO: 119881 - protein, 9 aa, Homo Sapiens
NVWRKRHLE

SEQ ID NO: 119882 - protein, 9 aa, Homo Sapiens
QKMKKRVKI

SEQ ID NO: 119883 - protein, 9 aa, Homo Sapiens
HRLDPIMEK

SEQ ID NO: 119884 - protein, 9 aa, Homo Sapiens
PRDDELFGQ

SEQ ID NO: 119885 - protein, 9 aa, Homo Sapiens
VMRLTRIFR

SEQ ID NO: 119886 - protein, 9 aa, Homo Sapiens
EYFGSVLED

SEQ ID NO: 119887 - protein, 9 aa, Homo Sapiens
WPLGKMCLS

SEQ ID NO: 119888 - protein, 9 aa, Homo Sapiens
ECWGTWPLR

SEQ ID NO: 119889 - protein, 9 aa, Homo Sapiens
QLQQHNFSS

SEQ ID NO: 119890 - protein, 9 aa, Homo Sapiens
SFAQTGINP

SEQ ID NO: 119891 - protein, 9 aa, Homo Sapiens
QKICSLLIL

SEQ ID NO: 119892 - protein, 9 aa, Homo Sapiens
RNLDFSEGH

SEQ ID NO: 119893 - protein, 9 aa, Homo Sapiens
WPSYVKHVC

SEQ ID NO: 119894 - protein, 9 aa, Homo Sapiens
SDRPRKRQC

SEQ ID NO: 119895 - protein, 9 aa, Homo Sapiens
LLQPGKKKT

SEQ ID NO: 119896 - protein, 9 aa, Homo Sapiens
PTPGPTPPA

SEQ ID NO: 119897 - protein, 9 aa, Homo Sapiens
SHGGPPKAR

SEQ ID NO: 119898 - protein, 9 aa, Homo Sapiens
VTILVSLTL

SEQ ID NO: 119899 - protein, 9 aa, Homo Sapiens
VTFLMSDLE

SEQ ID NO: 119900 - protein, 9 aa, Homo Sapiens
CHVPGSVSH

SEQ ID NO: 119901 - protein, 9 aa, Homo Sapiens
GVRLYLSPS

SEQ ID NO: 119902 - protein, 9 aa, Homo Sapiens
ADKVFTYIS

SEQ ID NO: 119903 - protein, 9 aa, Homo Sapiens
IMPTQQQRQ

SEQ ID NO: 119904 - protein, 9 aa, Homo Sapiens
SGKINGLVT

SEQ ID NO: 119905 - protein, 9 aa, Homo Sapiens
ISSLRVERS

SEQ ID NO: 119906 - protein, 9 aa, Homo Sapiens
TIVKLQESA

SEQ ID NO: 119907 - protein, 9 aa, Homo Sapiens
WVAGFQMTR

SEQ ID NO: 119908 - protein, 9 aa, Homo Sapiens
RDKPSERLG

SEQ ID NO: 119909 - protein, 9 aa, Homo Sapiens
PPFPLGTAD

SEQ ID NO: 119910 - protein, 9 aa, Homo Sapiens
YGHLHVSNV

SEQ ID NO: 119911 - protein, 9 aa, Homo Sapiens
AKKVTLAHL

SEQ ID NO: 119912 - protein, 9 aa, Homo Sapiens
NPCPSTAMY

SEQ ID NO: 119913 - protein, 9 aa, Homo Sapiens
EEETPEVAE

SEQ ID NO: 119914 - protein, 9 aa, Homo Sapiens
LATFMCAVE

SEQ ID NO: 119915 - protein, 9 aa, Homo Sapiens
SSTGLVPCS

SEQ ID NO: 119916 - protein, 9 aa, Homo Sapiens
DPGPFRHLA

SEQ ID NO: 119917 - protein, 9 aa, Homo Sapiens
ADINECLTS

SEQ ID NO: 119918 - protein, 9 aa, Homo Sapiens
QGLLLAVSS

SEQ ID NO: 119919 - protein, 9 aa, Homo Sapiens
KGAAQHEFH

SEQ ID NO: 119920 - protein, 9 aa, Homo Sapiens
EDEWRFRLR

SEQ ID NO: 119921 - protein, 9 aa, Homo Sapiens
WQTGTNPLC

SEQ ID NO: 119922 - protein, 9 aa, Homo Sapiens
LLCLIALLS

SEQ ID NO: 119923 - protein, 9 aa, Homo Sapiens
KKSTSSTSF

SEQ ID NO: 119924 - protein, 9 aa, Homo Sapiens
TDVDDKFET

SEQ ID NO: 119925 - protein, 9 aa, Homo Sapiens
ALVDYASDS

SEQ ID NO: 119926 - protein, 9 aa, Homo Sapiens
SHWLDEYWD

SEQ ID NO: 119927 - protein, 9 aa, Homo Sapiens
TLEVSMCDC

SEQ ID NO: 119928 - protein, 9 aa, Homo Sapiens
VGEKMDLNT

SEQ ID NO: 119929 - protein, 9 aa, Homo Sapiens
SCQADGASA

SEQ ID NO: 119930 - protein, 9 aa, Homo Sapiens
LLLQQPVIS

SEQ ID NO: 119931 - protein, 9 aa, Homo Sapiens
RTAAAHGGP

SEQ ID NO: 119932 - protein, 9 aa, Homo Sapiens
LSHFSASEE

SEQ ID NO: 119933 - protein, 9 aa, Homo Sapiens
LRILEKEED

SEQ ID NO: 119934 - protein, 9 aa, Homo Sapiens
LQHLKKEVQ

SEQ ID NO: 119935 - protein, 9 aa, Homo Sapiens
LRDYVNCSQ

SEQ ID NO: 119936 - protein, 9 aa, Homo Sapiens
YYAALLGSN

SEQ ID NO: 119937 - protein, 9 aa, Homo Sapiens
PLSTMANLA

SEQ ID NO: 119938 - protein, 9 aa, Homo Sapiens
PEQPGDGED

SEQ ID NO: 119939 - protein, 9 aa, Homo Sapiens
QEIQASESR

SEQ ID NO: 119940 - protein, 9 aa, Homo Sapiens
YPPFPLGTA

SEQ ID NO: 119941 - protein, 9 aa, Homo Sapiens
SYSLQAIKA

SEQ ID NO: 119942 - protein, 9 aa, Homo Sapiens
EGILIQQVL

SEQ ID NO: 119943 - protein, 9 aa, Homo Sapiens
RVLMSQCAH

SEQ ID NO: 119944 - protein, 9 aa, Homo Sapiens
TLENSHPNP

SEQ ID NO: 119945 - protein, 9 aa, Homo Sapiens
QHRADTVQL

SEQ ID NO: 119946 - protein, 9 aa, Homo Sapiens
VCTLTQFVS

SEQ ID NO: 119947 - protein, 9 aa, Homo Sapiens
DLLPGFPSS

SEQ ID NO: 119948 - protein, 9 aa, Homo Sapiens
LHEEARGRL

SEQ ID NO: 119949 - protein, 9 aa, Homo Sapiens
ARATQPHRL

SEQ ID NO: 119950 - protein, 9 aa, Homo Sapiens
GALGTAPAR

SEQ ID NO: 119951 - protein, 9 aa, Homo Sapiens
TVIRDITYY

SEQ ID NO: 119952 - protein, 9 aa, Homo Sapiens
GYKLARDAT

SEQ ID NO: 119953 - protein, 9 aa, Homo Sapiens
PGAERTAAA

SEQ ID NO: 119954 - protein, 9 aa, Homo Sapiens
QLPAPLNSH

SEQ ID NO: 119955 - protein, 9 aa, Homo Sapiens
CHSIAGGTS

SEQ ID NO: 119956 - protein, 9 aa, Homo Sapiens
GDEFYSDAA

SEQ ID NO: 119957 - protein, 9 aa, Homo Sapiens
SRELLRHHF

SEQ ID NO: 119958 - protein, 9 aa, Homo Sapiens
MCFLRRRSG

SEQ ID NO: 119959 - protein, 9 aa, Homo Sapiens
GGAGKYHSV

SEQ ID NO: 119960 - protein, 9 aa, Homo Sapiens
GNPERLNFS

SEQ ID NO: 119961 - protein, 9 aa, Homo Sapiens
EVKDNLEEA

SEQ ID NO: 119962 - protein, 9 aa, Homo Sapiens
TPETNGPRK

SEQ ID NO: 119963 - protein, 9 aa, Homo Sapiens
HHLHHTLPC

SEQ ID NO: 119964 - protein, 9 aa, Homo Sapiens
SVIENVIEG

SEQ ID NO: 119965 - protein, 9 aa, Homo Sapiens
VSLATLCSN

SEQ ID NO: 119966 - protein, 9 aa, Homo Sapiens
GVSSAPRPG

SEQ ID NO: 119967 - protein, 9 aa, Homo Sapiens
SLESGGAPA

SEQ ID NO: 119968 - protein, 9 aa, Homo Sapiens
LHHQTEPGQ

SEQ ID NO: 119969 - protein, 9 aa, Homo Sapiens
ETTTLVCDN

SEQ ID NO: 119970 - protein, 9 aa, Homo Sapiens
GLQKRLHNN

SEQ ID NO: 119971 - protein, 9 aa, Homo Sapiens
EEEKMFGSG

SEQ ID NO: 119972 - protein, 9 aa, Homo Sapiens
HRVLEAHPT

SEQ ID NO: 119973 - protein, 9 aa, Homo Sapiens
GGQCCRHQD

SEQ ID NO: 119974 - protein, 9 aa, Homo Sapiens
VQQLTLLQD

SEQ ID NO: 119975 - protein, 9 aa, Homo Sapiens
THTFEFWNL

SEQ ID NO: 119976 - protein, 9 aa, Homo Sapiens
AATSADGAH

SEQ ID NO: 119977 - protein, 9 aa, Homo Sapiens
FSVSFSQIT

SEQ ID NO: 119978 - protein, 9 aa, Homo Sapiens
KIENPLVSL

SEQ ID NO: 119979 - protein, 9 aa, Homo Sapiens
NGGESAPAT

SEQ ID NO: 119980 - protein, 9 aa, Homo Sapiens
FELGIRQGF

SEQ ID NO: 119981 - protein, 9 aa, Homo Sapiens
PWALAHLVP

SEQ ID NO: 119982 - protein, 9 aa, Homo Sapiens
RQAESGMSK

SEQ ID NO: 119983 - protein, 9 aa, Homo Sapiens
ESVDRNEEG

SEQ ID NO: 119984 - protein, 9 aa, Homo Sapiens
CDLNPFLQL

SEQ ID NO: 119985 - protein, 9 aa, Homo Sapiens
SLGYSGLSC

SEQ ID NO: 119986 - protein, 9 aa, Homo Sapiens
HNTLSGFSS

SEQ ID NO: 119987 - protein, 9 aa, Homo Sapiens
TDAMVWKDA

SEQ ID NO: 119988 - protein, 9 aa, Homo Sapiens
ALNHLGALP

SEQ ID NO: 119989 - protein, 9 aa, Homo Sapiens
DTVRVPMSA

SEQ ID NO: 119990 - protein, 9 aa, Homo Sapiens
PENKRYRFL

SEQ ID NO: 119991 - protein, 9 aa, Homo Sapiens
VTASHPTTR

SEQ ID NO: 119992 - protein, 9 aa, Homo Sapiens
FFFILVPRL

SEQ ID NO: 119993 - protein, 9 aa, Homo Sapiens
AITSNDISV

SEQ ID NO: 119994 - protein, 9 aa, Homo Sapiens
SDPLFSAQH

SEQ ID NO: 119995 - protein, 9 aa, Homo Sapiens
KSEVITGTV

SEQ ID NO: 119996 - protein, 9 aa, Homo Sapiens
ARCPRVGCL

SEQ ID NO: 119997 - protein, 9 aa, Homo Sapiens
KNVLLVMDT

SEQ ID NO: 119998 - protein, 9 aa, Homo Sapiens
AMRRPSSRH

SEQ ID NO: 119999 - protein, 9 aa, Homo Sapiens
SPIHGQHEV

SEQ ID NO: 120000 - protein, 9 aa, Homo Sapiens
WSGFSMEPL

SEQ ID NO: 120001 - protein, 9 aa, Homo Sapiens
RDLSRSLPA

SEQ ID NO: 120002 - protein, 9 aa, Homo Sapiens
RARHERRHN

SEQ ID NO: 120003 - protein, 9 aa, Homo Sapiens
SVASTLAPA

SEQ ID NO: 120004 - protein, 9 aa, Homo Sapiens
KEASTHISG

SEQ ID NO: 120005 - protein, 9 aa, Homo Sapiens
KTLLKMEEW

SEQ ID NO: 120006 - protein, 9 aa, Homo Sapiens
RVMRLTRIF

SEQ ID NO: 120007 - protein, 9 aa, Homo Sapiens
SEHFLYGGD

SEQ ID NO: 120008 - protein, 9 aa, Homo Sapiens
KGWRATRPF

SEQ ID NO: 120009 - protein, 9 aa, Homo Sapiens
RLGHGTEVH

SEQ ID NO: 120010 - protein, 9 aa, Homo Sapiens
SSSMGLQEC

SEQ ID NO: 120011 - protein, 9 aa, Homo Sapiens
LFFGCRLKG

SEQ ID NO: 120012 - protein, 9 aa, Homo Sapiens
TDELCLHVQ

SEQ ID NO: 120013 - protein, 9 aa, Homo Sapiens
TISHAIGKN

SEQ ID NO: 120014 - protein, 9 aa, Homo Sapiens
SNSGLGVRF

SEQ ID NO: 120015 - protein, 9 aa, Homo Sapiens
VTKEENRHL

SEQ ID NO: 120016 - protein, 9 aa, Homo Sapiens
ICSLLILIC

SEQ ID NO: 120017 - protein, 9 aa, Homo Sapiens
YDVMNDIMS

SEQ ID NO: 120018 - protein, 9 aa, Homo Sapiens
FLGHCQELL

SEQ ID NO: 120019 - protein, 9 aa, Homo Sapiens
RIAKKIKKG

SEQ ID NO: 120020 - protein, 9 aa, Homo Sapiens
PLKKGAKRS

SEQ ID NO: 120021 - protein, 9 aa, Homo Sapiens
KIKLIRPQP

SEQ ID NO: 120022 - protein, 9 aa, Homo Sapiens
RCCRRRRCC

SEQ ID NO: 120023 - protein, 9 aa, Homo Sapiens
GSLYFIHLE

SEQ ID NO: 120024 - protein, 9 aa, Homo Sapiens
LCNNEEQVG

SEQ ID NO: 120025 - protein, 9 aa, Homo Sapiens
RKWGALWLL

SEQ ID NO: 120026 - protein, 9 aa, Homo Sapiens
RRPPVLRLM

SEQ ID NO: 120027 - protein, 9 aa, Homo Sapiens
RLLLSLDRH

SEQ ID NO: 120028 - protein, 9 aa, Homo Sapiens
HLHLQAKRA

SEQ ID NO: 120029 - protein, 9 aa, Homo Sapiens
AMGTSFRSF

SEQ ID NO: 120030 - protein, 9 aa, Homo Sapiens
AVALVHAVQ

SEQ ID NO: 120031 - protein, 9 aa, Homo Sapiens
EETDLKATG

SEQ ID NO: 120032 - protein, 9 aa, Homo Sapiens
MVLAADHIR

SEQ ID NO: 120033 - protein, 9 aa, Homo Sapiens
AHTDIKTGY

SEQ ID NO: 120034 - protein, 9 aa, Homo Sapiens
SVVQVMTHA

SEQ ID NO: 120035 - protein, 9 aa, Homo Sapiens
SEASSVTLA

SEQ ID NO: 120036 - protein, 9 aa, Homo Sapiens
ARHASIELP

SEQ ID NO: 120037 - protein, 9 aa, Homo Sapiens
EKRRLCSPV

SEQ ID NO: 120038 - protein, 9 aa, Homo Sapiens
DEQLTVNIT

SEQ ID NO: 120039 - protein, 9 aa, Homo Sapiens
SRRGLLSQQ

SEQ ID NO: 120040 - protein, 9 aa, Homo Sapiens
APLSVGHDA

SEQ ID NO: 120041 - protein, 9 aa, Homo Sapiens
SWSQPDQTN

SEQ ID NO: 120042 - protein, 9 aa, Homo Sapiens
IKQKLSMNL

SEQ ID NO: 120043 - protein, 9 aa, Homo Sapiens
GIYLYGADT

SEQ ID NO: 120044 - protein, 9 aa, Homo Sapiens
ESIPNKCLW

SEQ ID NO: 120045 - protein, 9 aa, Homo Sapiens
GRRTTKSKK

SEQ ID NO: 120046 - protein, 9 aa, Homo Sapiens
RQGLYLTVP

SEQ ID NO: 120047 - protein, 9 aa, Homo Sapiens
WWCGGRQTP

SEQ ID NO: 120048 - protein, 9 aa, Homo Sapiens
HREGERERE

SEQ ID NO: 120049 - protein, 9 aa, Homo Sapiens
HTTGTTTTG

SEQ ID NO: 120050 - protein, 9 aa, Homo Sapiens
PPPNATLPP

SEQ ID NO: 120051 - protein, 9 aa, Homo Sapiens
GAALEAVSM

SEQ ID NO: 120052 - protein, 9 aa, Homo Sapiens
FLYKSKKTL

SEQ ID NO: 120053 - protein, 9 aa, Homo Sapiens
SQYSQVFQN

SEQ ID NO: 120054 - protein, 9 aa, Homo Sapiens
PALSDYRTN

SEQ ID NO: 120055 - protein, 9 aa, Homo Sapiens
VHLEWSLMK

SEQ ID NO: 120056 - protein, 9 aa, Homo Sapiens
TQNVEMRPL

SEQ ID NO: 120057 - protein, 9 aa, Homo Sapiens
RLEDLDELH

SEQ ID NO: 120058 - protein, 9 aa, Homo Sapiens
QEHRQRNDV

SEQ ID NO: 120059 - protein, 9 aa, Homo Sapiens
PRSHPPSPT

SEQ ID NO: 120060 - protein, 9 aa, Homo Sapiens
CYMALCSGP

SEQ ID NO: 120061 - protein, 9 aa, Homo Sapiens
TAVHLEWSL

SEQ ID NO: 120062 - protein, 9 aa, Homo Sapiens
SFIKDPSNQ

SEQ ID NO: 120063 - protein, 9 aa, Homo Sapiens
LRGCPQYLA

SEQ ID NO: 120064 - protein, 9 aa, Homo Sapiens
VITGTVQEE

SEQ ID NO: 120065 - protein, 9 aa, Homo Sapiens
RVILGQGTR

SEQ ID NO: 120066 - protein, 9 aa, Homo Sapiens
SLKKTKQRL

SEQ ID NO: 120067 - protein, 9 aa, Homo Sapiens
LAEFPVLLS

SEQ ID NO: 120068 - protein, 9 aa, Homo Sapiens
GKKCKPIDV

SEQ ID NO: 120069 - protein, 9 aa, Homo Sapiens
GKGNYGKVP

SEQ ID NO: 120070 - protein, 9 aa, Homo Sapiens
FPFFFILVP

SEQ ID NO: 120071 - protein, 9 aa, Homo Sapiens
VSTRNGYQG

SEQ ID NO: 120072 - protein, 9 aa, Homo Sapiens
GWHWGAAPM

SEQ ID NO: 120073 - protein, 9 aa, Homo Sapiens
YFILRNTHT

SEQ ID NO: 120074 - protein, 9 aa, Homo Sapiens
LDAAIGDRG

SEQ ID NO: 120075 - protein, 9 aa, Homo Sapiens
SQCECHRGR

SEQ ID NO: 120076 - protein, 9 aa, Homo Sapiens
KWEKLTDAM

SEQ ID NO: 120077 - protein, 9 aa, Homo Sapiens
DILRDSGSY

SEQ ID NO: 120078 - protein, 9 aa, Homo Sapiens
GPGQTTSDR

SEQ ID NO: 120079 - protein, 9 aa, Homo Sapiens
VDTASLRRQ

SEQ ID NO: 120080 - protein, 9 aa, Homo Sapiens
TIFLILLGI

SEQ ID NO: 120081 - protein, 9 aa, Homo Sapiens
PVYNDITHG

SEQ ID NO: 120082 - protein, 9 aa, Homo Sapiens
LRNEVLQLS

SEQ ID NO: 120083 - protein, 9 aa, Homo Sapiens
RSRVTSGGV

SEQ ID NO: 120084 - protein, 9 aa, Homo Sapiens
RVVGTQTLS

SEQ ID NO: 120085 - protein, 9 aa, Homo Sapiens
LPLCWAPGR

SEQ ID NO: 120086 - protein, 9 aa, Homo Sapiens
EHTNVCFGI

SEQ ID NO: 120087 - protein, 9 aa, Homo Sapiens
KENLPIIRN

SEQ ID NO: 120088 - protein, 9 aa, Homo Sapiens
WRDSSRESV

SEQ ID NO: 120089 - protein, 9 aa, Homo Sapiens
EYRASLLAV

SEQ ID NO: 120090 - protein, 9 aa, Homo Sapiens
AALLVAFIL

SEQ ID NO: 120091 - protein, 9 aa, Homo Sapiens
EEHRGMFRE

SEQ ID NO: 120092 - protein, 9 aa, Homo Sapiens
ATKHCKKLE

SEQ ID NO: 120093 - protein, 9 aa, Homo Sapiens
GANLTVSNV

SEQ ID NO: 120094 - protein, 9 aa, Homo Sapiens
QLGLCPSSA

SEQ ID NO: 120095 - protein, 9 aa, Homo Sapiens
TTMGDTVLV

SEQ ID NO: 120096 - protein, 9 aa, Homo Sapiens
IALNFAKLI

SEQ ID NO: 120097 - protein, 9 aa, Homo Sapiens
GHCWVTRHA

SEQ ID NO: 120098 - protein, 9 aa, Homo Sapiens
AASLETRFS

SEQ ID NO: 120099 - protein, 9 aa, Homo Sapiens
HLVRSILTA

SEQ ID NO: 120100 - protein, 9 aa, Homo Sapiens
DTVLVICHP

SEQ ID NO: 120101 - protein, 9 aa, Homo Sapiens
STFPSSFFI

SEQ ID NO: 120102 - protein, 9 aa, Homo Sapiens
GLESSPAKI

SEQ ID NO: 120103 - protein, 9 aa, Homo Sapiens
KDDSSENSS

SEQ ID NO: 120104 - protein, 9 aa, Homo Sapiens
FFTNKMKTQ

SEQ ID NO: 120105 - protein, 9 aa, Homo Sapiens
SYYACATQL

SEQ ID NO: 120106 - protein, 9 aa, Homo Sapiens
RDDYKNNDG

SEQ ID NO: 120107 - protein, 9 aa, Homo Sapiens
QLMAPLSPG

SEQ ID NO: 120108 - protein, 9 aa, Homo Sapiens
VSHLQPPGE

SEQ ID NO: 120109 - protein, 9 aa, Homo Sapiens
SKRISKLTY

SEQ ID NO: 120110 - protein, 9 aa, Homo Sapiens
RGVPDVGHF

SEQ ID NO: 120111 - protein, 9 aa, Homo Sapiens
RIGREPGHD

SEQ ID NO: 120112 - protein, 9 aa, Homo Sapiens
SPRRSPALR

SEQ ID NO: 120113 - protein, 9 aa, Homo Sapiens
RWGLKGGCR

SEQ ID NO: 120114 - protein, 9 aa, Homo Sapiens
RQCSQPLMN

SEQ ID NO: 120115 - protein, 9 aa, Homo Sapiens
QANLQRRLK

SEQ ID NO: 120116 - protein, 9 aa, Homo Sapiens
LYFIHLESW

SEQ ID NO: 120117 - protein, 9 aa, Homo Sapiens
KDKAGKKCK

SEQ ID NO: 120118 - protein, 9 aa, Homo Sapiens
PEQGALLRA

SEQ ID NO: 120119 - protein, 9 aa, Homo Sapiens
AWPGIPGGT

SEQ ID NO: 120120 - protein, 9 aa, Homo Sapiens
PVCYPPFPL

SEQ ID NO: 120121 - protein, 9 aa, Homo Sapiens
TGTVQEEAQ

SEQ ID NO: 120122 - protein, 9 aa, Homo Sapiens
LIQITSTSV

SEQ ID NO: 120123 - protein, 9 aa, Homo Sapiens
VGHHNDDVH

SEQ ID NO: 120124 - protein, 9 aa, Homo Sapiens
GKHNFTMAM

SEQ ID NO: 120125 - protein, 9 aa, Homo Sapiens
MAKHLIYEH

SEQ ID NO: 120126 - protein, 9 aa, Homo Sapiens
VSLLYLNSG

SEQ ID NO: 120127 - protein, 9 aa, Homo Sapiens
DAPPPKEPE

SEQ ID NO: 120128 - protein, 9 aa, Homo Sapiens
GYPSLATMM

SEQ ID NO: 120129 - protein, 9 aa, Homo Sapiens
MRTAPSVWN

SEQ ID NO: 120130 - protein, 9 aa, Homo Sapiens
ACFAFTFDH

SEQ ID NO: 120131 - protein, 9 aa, Homo Sapiens
PESLKNVLL

SEQ ID NO: 120132 - protein, 9 aa, Homo Sapiens
QEPGPRFPL

SEQ ID NO: 120133 - protein, 9 aa, Homo Sapiens
ILNFNCCAC

SEQ ID NO: 120134 - protein, 9 aa, Homo Sapiens
ITEVEKEMS

SEQ ID NO: 120135 - protein, 9 aa, Homo Sapiens
PLHMAALLR

SEQ ID NO: 120136 - protein, 9 aa, Homo Sapiens
SCWVAACVW

SEQ ID NO: 120137 - protein, 9 aa, Homo Sapiens
DAAPETTAV

SEQ ID NO: 120138 - protein, 9 aa, Homo Sapiens
VVDLAVNVC

SEQ ID NO: 120139 - protein, 9 aa, Homo Sapiens
CNYDQLIEI

SEQ ID NO: 120140 - protein, 9 aa, Homo Sapiens
TLSPRHGNH

SEQ ID NO: 120141 - protein, 9 aa, Homo Sapiens
NFASYPFCY

SEQ ID NO: 120142 - protein, 9 aa, Homo Sapiens
PLHVLAALQ

SEQ ID NO: 120143 - protein, 9 aa, Homo Sapiens
RKTANYERQ

SEQ ID NO: 120144 - protein, 9 aa, Homo Sapiens
LKPILDEIY

SEQ ID NO: 120145 - protein, 9 aa, Homo Sapiens
VEKHLMRLH

SEQ ID NO: 120146 - protein, 9 aa, Homo Sapiens
VFRLLISMW

SEQ ID NO: 120147 - protein, 9 aa, Homo Sapiens
AAVARGAPQ

SEQ ID NO: 120148 - protein, 9 aa, Homo Sapiens
TALFLGGLI

SEQ ID NO: 120149 - protein, 9 aa, Homo Sapiens
VSSLARRLD

SEQ ID NO: 120150 - protein, 9 aa, Homo Sapiens
IAIGCFIFL

SEQ ID NO: 120151 - protein, 9 aa, Homo Sapiens
INECSTIPG

SEQ ID NO: 120152 - protein, 9 aa, Homo Sapiens
CSLSFPGSS

SEQ ID NO: 120153 - protein, 9 aa, Homo Sapiens
WVAACVWCN

SEQ ID NO: 120154 - protein, 9 aa, Homo Sapiens
KEEPCFFSG

SEQ ID NO: 120155 - protein, 9 aa, Homo Sapiens
REFYNARRQ

SEQ ID NO: 120156 - protein, 9 aa, Homo Sapiens
GVGATRIET

SEQ ID NO: 120157 - protein, 9 aa, Homo Sapiens
GVDWAPKSD

SEQ ID NO: 120158 - protein, 9 aa, Homo Sapiens
EKLRQKLQC

SEQ ID NO: 120159 - protein, 9 aa, Homo Sapiens
LTGTSHPVW

SEQ ID NO: 120160 - protein, 9 aa, Homo Sapiens
PKTKKIYNE

SEQ ID NO: 120161 - protein, 9 aa, Homo Sapiens
HHSPTCLRA

SEQ ID NO: 120162 - protein, 9 aa, Homo Sapiens
EMANQEFLV

SEQ ID NO: 120163 - protein, 9 aa, Homo Sapiens
PLPTEPSTP

SEQ ID NO: 120164 - protein, 9 aa, Homo Sapiens
LLKEITARK

SEQ ID NO: 120165 - protein, 9 aa, Homo Sapiens
NRGGALGTA

SEQ ID NO: 120166 - protein, 9 aa, Homo Sapiens
LATMMVSDW

SEQ ID NO: 120167 - protein, 9 aa, Homo Sapiens
ENGASLDDP

SEQ ID NO: 120168 - protein, 9 aa, Homo Sapiens
CPRAPALEG

SEQ ID NO: 120169 - protein, 9 aa, Homo Sapiens
ATGRKTTEE

SEQ ID NO: 120170 - protein, 9 aa, Homo Sapiens
MMKRAVIWL

SEQ ID NO: 120171 - protein, 9 aa, Homo Sapiens
FAVYESICG

SEQ ID NO: 120172 - protein, 9 aa, Homo Sapiens
IHTGVKPYN

SEQ ID NO: 120173 - protein, 9 aa, Homo Sapiens
FDGEVSWDK

SEQ ID NO: 120174 - protein, 9 aa, Homo Sapiens
ISLPLVPDF

SEQ ID NO: 120175 - protein, 9 aa, Homo Sapiens
SQSIVITRS

SEQ ID NO: 120176 - protein, 9 aa, Homo Sapiens
FDGLMNSCK

SEQ ID NO: 120177 - protein, 9 aa, Homo Sapiens
HAGNKQGKD

SEQ ID NO: 120178 - protein, 9 aa, Homo Sapiens
KARCPRVGC

SEQ ID NO: 120179 - protein, 9 aa, Homo Sapiens
VVAHLSHLL

SEQ ID NO: 120180 - protein, 9 aa, Homo Sapiens
PFFLLFTWQ

SEQ ID NO: 120181 - protein, 9 aa, Homo Sapiens
SQASSVRTT

SEQ ID NO: 120182 - protein, 9 aa, Homo Sapiens
HCQELLAWA

SEQ ID NO: 120183 - protein, 9 aa, Homo Sapiens
ASHLSRPTA

SEQ ID NO: 120184 - protein, 9 aa, Homo Sapiens
KVDNSRFHK

SEQ ID NO: 120185 - protein, 9 aa, Homo Sapiens
FSSALYRES

SEQ ID NO: 120186 - protein, 9 aa, Homo Sapiens
WKRPQMRLG

SEQ ID NO: 120187 - protein, 9 aa, Homo Sapiens
PRRLLAHSG

SEQ ID NO: 120188 - protein, 9 aa, Homo Sapiens
ADERLPLHV

SEQ ID NO: 120189 - protein, 9 aa, Homo Sapiens
EDTEEEQGK

SEQ ID NO: 120190 - protein, 9 aa, Homo Sapiens
SALANSETS

SEQ ID NO: 120191 - protein, 9 aa, Homo Sapiens
KALCVLAPI

SEQ ID NO: 120192 - protein, 9 aa, Homo Sapiens
AAAAAGPDS

SEQ ID NO: 120193 - protein, 9 aa, Homo Sapiens
NEVLQLSTN

SEQ ID NO: 120194 - protein, 9 aa, Homo Sapiens
AVKKVVSAE

SEQ ID NO: 120195 - protein, 9 aa, Homo Sapiens
SSLQPLPPF

SEQ ID NO: 120196 - protein, 9 aa, Homo Sapiens
RGETTFAFH

SEQ ID NO: 120197 - protein, 9 aa, Homo Sapiens
SPAMAHRSR

SEQ ID NO: 120198 - protein, 9 aa, Homo Sapiens
LKKLILILR

SEQ ID NO: 120199 - protein, 9 aa, Homo Sapiens
QDNRTTPSY

SEQ ID NO: 120200 - protein, 9 aa, Homo Sapiens
PDVENLVST

SEQ ID NO: 120201 - protein, 9 aa, Homo Sapiens
FIIRSFDGE

SEQ ID NO: 120202 - protein, 9 aa, Homo Sapiens
TNRNVASPT

SEQ ID NO: 120203 - protein, 9 aa, Homo Sapiens
TKALCVLAP

SEQ ID NO: 120204 - protein, 9 aa, Homo Sapiens
TGAALASPT

SEQ ID NO: 120205 - protein, 9 aa, Homo Sapiens
LLEVLEDAE

SEQ ID NO: 120206 - protein, 9 aa, Homo Sapiens
GLASPLGHH

SEQ ID NO: 120207 - protein, 9 aa, Homo Sapiens
TRKGRKKTK

SEQ ID NO: 120208 - protein, 9 aa, Homo Sapiens
RGGNQAGGS

SEQ ID NO: 120209 - protein, 9 aa, Homo Sapiens
ERLHPPSPP

SEQ ID NO: 120210 - protein, 9 aa, Homo Sapiens
GEMHLKEAG

SEQ ID NO: 120211 - protein, 9 aa, Homo Sapiens
IENPLVSLA

SEQ ID NO: 120212 - protein, 9 aa, Homo Sapiens
SKKSPQPMG

SEQ ID NO: 120213 - protein, 9 aa, Homo Sapiens
ATSNTEEII

SEQ ID NO: 120214 - protein, 9 aa, Homo Sapiens
HKASGVCQT

SEQ ID NO: 120215 - protein, 9 aa, Homo Sapiens
IHPAFSHRS

SEQ ID NO: 120216 - protein, 9 aa, Homo Sapiens
LAVDFTAAS

SEQ ID NO: 120217 - protein, 9 aa, Homo Sapiens
LRNTHTFEF

SEQ ID NO: 120218 - protein, 9 aa, Homo Sapiens
TSLHFPFNP

SEQ ID NO: 120219 - protein, 9 aa, Homo Sapiens
SRGNGEYAR

SEQ ID NO: 120220 - protein, 9 aa, Homo Sapiens
RHIDSAHLC

SEQ ID NO: 120221 - protein, 9 aa, Homo Sapiens
TPASPVLPA

SEQ ID NO: 120222 - protein, 9 aa, Homo Sapiens
LLQACSPSA

SEQ ID NO: 120223 - protein, 9 aa, Homo Sapiens
MAGFRRVTN

SEQ ID NO: 120224 - protein, 9 aa, Homo Sapiens
VYEYMLHIG

SEQ ID NO: 120225 - protein, 9 aa, Homo Sapiens
LTEPRNVVI

SEQ ID NO: 120226 - protein, 9 aa, Homo Sapiens
VIQPGPIKP

SEQ ID NO: 120227 - protein, 9 aa, Homo Sapiens
QTLQKSEPS

SEQ ID NO: 120228 - protein, 9 aa, Homo Sapiens
LCPSGRRCR

SEQ ID NO: 120229 - protein, 9 aa, Homo Sapiens
KRKRERRRK

SEQ ID NO: 120230 - protein, 9 aa, Homo Sapiens
PHPHPTPTS

SEQ ID NO: 120231 - protein, 9 aa, Homo Sapiens
ARSGSAWAS

SEQ ID NO: 120232 - protein, 9 aa, Homo Sapiens
NCISLNSLN

SEQ ID NO: 120233 - protein, 9 aa, Homo Sapiens
PWVPHTETP

SEQ ID NO: 120234 - protein, 9 aa, Homo Sapiens
RYRFLLLEN

SEQ ID NO: 120235 - protein, 9 aa, Homo Sapiens
PNAVDRDAV

SEQ ID NO: 120236 - protein, 9 aa, Homo Sapiens
SNGDFYNNN

SEQ ID NO: 120237 - protein, 9 aa, Homo Sapiens
RLSLPMQES

SEQ ID NO: 120238 - protein, 9 aa, Homo Sapiens
ERKMEKNRQ

SEQ ID NO: 120239 - protein, 9 aa, Homo Sapiens
RLCGRSRAA

SEQ ID NO: 120240 - protein, 9 aa, Homo Sapiens
IIAATIENV

SEQ ID NO: 120241 - protein, 9 aa, Homo Sapiens
PLTVAFETA

SEQ ID NO: 120242 - protein, 9 aa, Homo Sapiens
QTRRSYPEF

SEQ ID NO: 120243 - protein, 9 aa, Homo Sapiens
NRHHYTEAE

SEQ ID NO: 120244 - protein, 9 aa, Homo Sapiens
PNSCNTSVY

SEQ ID NO: 120245 - protein, 9 aa, Homo Sapiens
AGEEGGAAV

SEQ ID NO: 120246 - protein, 9 aa, Homo Sapiens
SNTEEIIEG

SEQ ID NO: 120247 - protein, 9 aa, Homo Sapiens
HTAVMNQYR

SEQ ID NO: 120248 - protein, 9 aa, Homo Sapiens
PASGGAKAR

SEQ ID NO: 120249 - protein, 9 aa, Homo Sapiens
AATQRPSTR

SEQ ID NO: 120250 - protein, 9 aa, Homo Sapiens
PSTPKSPSA

SEQ ID NO: 120251 - protein, 9 aa, Homo Sapiens
RVDAHMCIV

SEQ ID NO: 120252 - protein, 9 aa, Homo Sapiens
TCFGMLLCC

SEQ ID NO: 120253 - protein, 9 aa, Homo Sapiens
VGNPSVKSQ

SEQ ID NO: 120254 - protein, 9 aa, Homo Sapiens
AFSLSFHLI

SEQ ID NO: 120255 - protein, 9 aa, Homo Sapiens
IPCKPSCDV

SEQ ID NO: 120256 - protein, 9 aa, Homo Sapiens
SIPNKCLWS

SEQ ID NO: 120257 - protein, 9 aa, Homo Sapiens
EELPDEIAA

SEQ ID NO: 120258 - protein, 9 aa, Homo Sapiens
IVNFSRTKS

SEQ ID NO: 120259 - protein, 9 aa, Homo Sapiens
AFILLSLVR

SEQ ID NO: 120260 - protein, 9 aa, Homo Sapiens
GLVQRVFPA

SEQ ID NO: 120261 - protein, 9 aa, Homo Sapiens
RQGGYGKKV

SEQ ID NO: 120262 - protein, 9 aa, Homo Sapiens
PPPTKKRGK

SEQ ID NO: 120263 - protein, 9 aa, Homo Sapiens
NKMVSNQKI

SEQ ID NO: 120264 - protein, 9 aa, Homo Sapiens
VHNNGEAVS

SEQ ID NO: 120265 - protein, 9 aa, Homo Sapiens
CSGLPWPRR

SEQ ID NO: 120266 - protein, 9 aa, Homo Sapiens
PEYNMFPRK

SEQ ID NO: 120267 - protein, 9 aa, Homo Sapiens
DNLEEAKQL

SEQ ID NO: 120268 - protein, 9 aa, Homo Sapiens
QPPRWHLRV

SEQ ID NO: 120269 - protein, 9 aa, Homo Sapiens
EATGSGTET

SEQ ID NO: 120270 - protein, 9 aa, Homo Sapiens
VVSAEIEPP

SEQ ID NO: 120271 - protein, 9 aa, Homo Sapiens
CGNHECASI

SEQ ID NO: 120272 - protein, 9 aa, Homo Sapiens
SASVATYFL

SEQ ID NO: 120273 - protein, 9 aa, Homo Sapiens
EMCTVEELN

SEQ ID NO: 120274 - protein, 9 aa, Homo Sapiens
PYQDDIDNL

SEQ ID NO: 120275 - protein, 9 aa, Homo Sapiens
GVLRDDYKN

SEQ ID NO: 120276 - protein, 9 aa, Homo Sapiens
TYPMVHLLQ

SEQ ID NO: 120277 - protein, 9 aa, Homo Sapiens
LYRIRQSKI

SEQ ID NO: 120278 - protein, 9 aa, Homo Sapiens
TTSSSGSCG

SEQ ID NO: 120279 - protein, 9 aa, Homo Sapiens
NAYIADETP

SEQ ID NO: 120280 - protein, 9 aa, Homo Sapiens
EIAAEIFAT

SEQ ID NO: 120281 - protein, 9 aa, Homo Sapiens
GALALHVCY

SEQ ID NO: 120282 - protein, 9 aa, Homo Sapiens
PHRHPPLHR

SEQ ID NO: 120283 - protein, 9 aa, Homo Sapiens
AYFLLKGVP

SEQ ID NO: 120284 - protein, 9 aa, Homo Sapiens
RLPWLMLLT

SEQ ID NO: 120285 - protein, 9 aa, Homo Sapiens
KFKTKTLTG

SEQ ID NO: 120286 - protein, 9 aa, Homo Sapiens
NHMNVMNVG

SEQ ID NO: 120287 - protein, 9 aa, Homo Sapiens
GVSLATLCS

SEQ ID NO: 120288 - protein, 9 aa, Homo Sapiens
WGAAPMMSS

SEQ ID NO: 120289 - protein, 9 aa, Homo Sapiens
AENFPQQHC

SEQ ID NO: 120290 - protein, 9 aa, Homo Sapiens
PNYSYEIGS

SEQ ID NO: 120291 - protein, 9 aa, Homo Sapiens
ILQTETMEA

SEQ ID NO: 120292 - protein, 9 aa, Homo Sapiens
SAGISSLIL

SEQ ID NO: 120293 - protein, 9 aa, Homo Sapiens
RHHFRQQRV

SEQ ID NO: 120294 - protein, 9 aa, Homo Sapiens
GAPQCPPPS

SEQ ID NO: 120295 - protein, 9 aa, Homo Sapiens
MGDTLSPRH

SEQ ID NO: 120296 - protein, 9 aa, Homo Sapiens
SNGKDDGQN

SEQ ID NO: 120297 - protein, 9 aa, Homo Sapiens
NLDFAPGMR

SEQ ID NO: 120298 - protein, 9 aa, Homo Sapiens
ARKYARKIC

SEQ ID NO: 120299 - protein, 9 aa, Homo Sapiens
KIVALMSST

SEQ ID NO: 120300 - protein, 9 aa, Homo Sapiens
REQCEPVFQ

SEQ ID NO: 120301 - protein, 9 aa, Homo Sapiens
TRVPPLMWK

SEQ ID NO: 120302 - protein, 9 aa, Homo Sapiens
YLEDIKTYF

SEQ ID NO: 120303 - protein, 9 aa, Homo Sapiens
HLIANNNQL

SEQ ID NO: 120304 - protein, 9 aa, Homo Sapiens
QSIVITRSG

SEQ ID NO: 120305 - protein, 9 aa, Homo Sapiens
GPLPPLPPR

SEQ ID NO: 120306 - protein, 9 aa, Homo Sapiens
TSISSMPSS

SEQ ID NO: 120307 - protein, 9 aa, Homo Sapiens
LNLSATHHH

SEQ ID NO: 120308 - protein, 9 aa, Homo Sapiens
GSLDRNLGS

SEQ ID NO: 120309 - protein, 9 aa, Homo Sapiens
LDYLARAAV

SEQ ID NO: 120310 - protein, 9 aa, Homo Sapiens
DWVLPVAKL

SEQ ID NO: 120311 - protein, 9 aa, Homo Sapiens
HLQVVKILA

SEQ ID NO: 120312 - protein, 9 aa, Homo Sapiens
PQKFHTEDL

SEQ ID NO: 120313 - protein, 9 aa, Homo Sapiens
PSLGSSPLP

SEQ ID NO: 120314 - protein, 9 aa, Homo Sapiens
CRNGENTDA

SEQ ID NO: 120315 - protein, 9 aa, Homo Sapiens
LLRQRAQAD

SEQ ID NO: 120316 - protein, 9 aa, Homo Sapiens
AAVGVEDGD

SEQ ID NO: 120317 - protein, 9 aa, Homo Sapiens
MKKIGSKKP

SEQ ID NO: 120318 - protein, 9 aa, Homo Sapiens
LPPPLLWPL

SEQ ID NO: 120319 - protein, 9 aa, Homo Sapiens
EDGDGLSKV

SEQ ID NO: 120320 - protein, 9 aa, Homo Sapiens
SPKKKPKLE

SEQ ID NO: 120321 - protein, 9 aa, Homo Sapiens
NYERQPREP

SEQ ID NO: 120322 - protein, 9 aa, Homo Sapiens
LRLVCADTT

SEQ ID NO: 120323 - protein, 9 aa, Homo Sapiens
ARSKANKEF

SEQ ID NO: 120324 - protein, 9 aa, Homo Sapiens
KDGEMANQE

SEQ ID NO: 120325 - protein, 9 aa, Homo Sapiens
VAHEEIDLH

SEQ ID NO: 120326 - protein, 9 aa, Homo Sapiens
LQMNLDVTT

SEQ ID NO: 120327 - protein, 9 aa, Homo Sapiens
SSCQADGAS

SEQ ID NO: 120328 - protein, 9 aa, Homo Sapiens
DKDGLQSVQ

SEQ ID NO: 120329 - protein, 9 aa, Homo Sapiens
NPINLTESG

SEQ ID NO: 120330 - protein, 9 aa, Homo Sapiens
EIHVLQHAQ

SEQ ID NO: 120331 - protein, 9 aa, Homo Sapiens
RGHLERVVC

SEQ ID NO: 120332 - protein, 9 aa, Homo Sapiens
GVKPYNCEE

SEQ ID NO: 120333 - protein, 9 aa, Homo Sapiens
AEALVAMPP

SEQ ID NO: 120334 - protein, 9 aa, Homo Sapiens
PAQYSVTLY

SEQ ID NO: 120335 - protein, 9 aa, Homo Sapiens
RDRDRSVRD

SEQ ID NO: 120336 - protein, 9 aa, Homo Sapiens
SDLESMCKE

SEQ ID NO: 120337 - protein, 9 aa, Homo Sapiens
YRCRWCSSW

SEQ ID NO: 120338 - protein, 9 aa, Homo Sapiens
LYVSTTKHV

SEQ ID NO: 120339 - protein, 9 aa, Homo Sapiens
LLACDDNEI

SEQ ID NO: 120340 - protein, 9 aa, Homo Sapiens
HRGRKASLE

SEQ ID NO: 120341 - protein, 9 aa, Homo Sapiens
GSVMEILCT

SEQ ID NO: 120342 - protein, 9 aa, Homo Sapiens
LSVGHDAHL

SEQ ID NO: 120343 - protein, 9 aa, Homo Sapiens
AITSLHFPF

SEQ ID NO: 120344 - protein, 9 aa, Homo Sapiens
HSRRQPRVM

SEQ ID NO: 120345 - protein, 9 aa, Homo Sapiens
KNYLSPSFK

SEQ ID NO: 120346 - protein, 9 aa, Homo Sapiens
NREEMAETR

SEQ ID NO: 120347 - protein, 9 aa, Homo Sapiens
LEASTLVHS

SEQ ID NO: 120348 - protein, 9 aa, Homo Sapiens
LPDPSFSSK

SEQ ID NO: 120349 - protein, 9 aa, Homo Sapiens
YVNCSQRSF

SEQ ID NO: 120350 - protein, 9 aa, Homo Sapiens
RCTTPPRGD

SEQ ID NO: 120351 - protein, 9 aa, Homo Sapiens
APADRLCFH

SEQ ID NO: 120352 - protein, 9 aa, Homo Sapiens
PSPAFCSRR

SEQ ID NO: 120353 - protein, 9 aa, Homo Sapiens
PMVCTLTQF

SEQ ID NO: 120354 - protein, 9 aa, Homo Sapiens
VLDPLHIRQ

SEQ ID NO: 120355 - protein, 9 aa, Homo Sapiens
PAPLNSHAH

SEQ ID NO: 120356 - protein, 9 aa, Homo Sapiens
EFFVDQLRD

SEQ ID NO: 120357 - protein, 9 aa, Homo Sapiens
LDRNLGSPL

SEQ ID NO: 120358 - protein, 9 aa, Homo Sapiens
PQPDSGSHR

SEQ ID NO: 120359 - protein, 9 aa, Homo Sapiens
LHSRVTASH

SEQ ID NO: 120360 - protein, 9 aa, Homo Sapiens
EDVTCQCLK

SEQ ID NO: 120361 - protein, 9 aa, Homo Sapiens
KVFLPQSAL

SEQ ID NO: 120362 - protein, 9 aa, Homo Sapiens
ELATFMCAV

SEQ ID NO: 120363 - protein, 9 aa, Homo Sapiens
SFRVFCLLG

SEQ ID NO: 120364 - protein, 9 aa, Homo Sapiens
CSCSSKSSA

SEQ ID NO: 120365 - protein, 9 aa, Homo Sapiens
IGSWMSSVP

SEQ ID NO: 120366 - protein, 9 aa, Homo Sapiens
DSWNSKAAA

SEQ ID NO: 120367 - protein, 9 aa, Homo Sapiens
PAGGPCLDP

SEQ ID NO: 120368 - protein, 9 aa, Homo Sapiens
ATVNYFTNI

SEQ ID NO: 120369 - protein, 9 aa, Homo Sapiens
ILFNKKENT

SEQ ID NO: 120370 - protein, 9 aa, Homo Sapiens
TVLGNFIHA

SEQ ID NO: 120371 - protein, 9 aa, Homo Sapiens
MTSSQIYMN

SEQ ID NO: 120372 - protein, 9 aa, Homo Sapiens
SKKNSLEDK

SEQ ID NO: 120373 - protein, 9 aa, Homo Sapiens
HSWDKYGLT

SEQ ID NO: 120374 - protein, 9 aa, Homo Sapiens
KYDVMNDIM

SEQ ID NO: 120375 - protein, 9 aa, Homo Sapiens
SQELMLKSF

SEQ ID NO: 120376 - protein, 9 aa, Homo Sapiens
REDVVHAMN

SEQ ID NO: 120377 - protein, 9 aa, Homo Sapiens
EVTPSLAGP

SEQ ID NO: 120378 - protein, 9 aa, Homo Sapiens
DKEGTSNSS

SEQ ID NO: 120379 - protein, 9 aa, Homo Sapiens
CSIKSCWVA

SEQ ID NO: 120380 - protein, 9 aa, Homo Sapiens
QDDIDNLNP

SEQ ID NO: 120381 - protein, 9 aa, Homo Sapiens
RFGIFTCFN

SEQ ID NO: 120382 - protein, 9 aa, Homo Sapiens
TSEEVQKKI

SEQ ID NO: 120383 - protein, 9 aa, Homo Sapiens
RWALLAPSS

SEQ ID NO: 120384 - protein, 9 aa, Homo Sapiens
TSQELCVIY

SEQ ID NO: 120385 - protein, 9 aa, Homo Sapiens
GLPRTNFQS

SEQ ID NO: 120386 - protein, 9 aa, Homo Sapiens
GSYQDLDGA

SEQ ID NO: 120387 - protein, 9 aa, Homo Sapiens
NGSKQLPAP

SEQ ID NO: 120388 - protein, 9 aa, Homo Sapiens
AKKIKKGHK

SEQ ID NO: 120389 - protein, 9 aa, Homo Sapiens
DSAPSRKLN

SEQ ID NO: 120390 - protein, 9 aa, Homo Sapiens
GGPCLDPAG

SEQ ID NO: 120391 - protein, 9 aa, Homo Sapiens
IWLEALSSA

SEQ ID NO: 120392 - protein, 9 aa, Homo Sapiens
HSDGDRRLI

SEQ ID NO: 120393 - protein, 9 aa, Homo Sapiens
HLRPANMYQ

SEQ ID NO: 120394 - protein, 9 aa, Homo Sapiens
DVSHGQDCY

SEQ ID NO: 120395 - protein, 9 aa, Homo Sapiens
QRLTWVCRR

SEQ ID NO: 120396 - protein, 9 aa, Homo Sapiens
ANSPRETSS

SEQ ID NO: 120397 - protein, 9 aa, Homo Sapiens
LSEIPNSVF

SEQ ID NO: 120398 - protein, 9 aa, Homo Sapiens
VGYEVLDNH

SEQ ID NO: 120399 - protein, 9 aa, Homo Sapiens
LLFLFRMTW

SEQ ID NO: 120400 - protein, 9 aa, Homo Sapiens
KTTDFKTTP

SEQ ID NO: 120401 - protein, 9 aa, Homo Sapiens
SGHLARALR

SEQ ID NO: 120402 - protein, 9 aa, Homo Sapiens
RLSSYFQQA

SEQ ID NO: 120403 - protein, 9 aa, Homo Sapiens
KPFKCKNVG

SEQ ID NO: 120404 - protein, 9 aa, Homo Sapiens
NIFSEVRYV

SEQ ID NO: 120405 - protein, 9 aa, Homo Sapiens
PEAEAGAAR

SEQ ID NO: 120406 - protein, 9 aa, Homo Sapiens
LLCIRKHTQ

SEQ ID NO: 120407 - protein, 9 aa, Homo Sapiens
GSHRRHWGE

SEQ ID NO: 120408 - protein, 9 aa, Homo Sapiens
RRSHFKVLI

SEQ ID NO: 120409 - protein, 9 aa, Homo Sapiens
HHPPSVRST

SEQ ID NO: 120410 - protein, 9 aa, Homo Sapiens
LDLTDTIEE

SEQ ID NO: 120411 - protein, 9 aa, Homo Sapiens
IARSLQKAL

SEQ ID NO: 120412 - protein, 9 aa, Homo Sapiens
TKKIYNEFI

SEQ ID NO: 120413 - protein, 9 aa, Homo Sapiens
KPLPECHVR

SEQ ID NO: 120414 - protein, 9 aa, Homo Sapiens
VLVTVDPAI

SEQ ID NO: 120415 - protein, 9 aa, Homo Sapiens
KKRKWGALW

SEQ ID NO: 120416 - protein, 9 aa, Homo Sapiens
PLLVEVQNI

SEQ ID NO: 120417 - protein, 9 aa, Homo Sapiens
RGPLDGNPY

SEQ ID NO: 120418 - protein, 9 aa, Homo Sapiens
LAATKKLSI

SEQ ID NO: 120419 - protein, 9 aa, Homo Sapiens
QHVLLCLAV

SEQ ID NO: 120420 - protein, 9 aa, Homo Sapiens
KSAMGTSFR

SEQ ID NO: 120421 - protein, 9 aa, Homo Sapiens
WPGSNHWNN

SEQ ID NO: 120422 - protein, 9 aa, Homo Sapiens
IMKFVTSFL

SEQ ID NO: 120423 - protein, 9 aa, Homo Sapiens
LSILRSNPE

SEQ ID NO: 120424 - protein, 9 aa, Homo Sapiens
IQEWGCLCG

SEQ ID NO: 120425 - protein, 9 aa, Homo Sapiens
AGKCTQGVY

SEQ ID NO: 120426 - protein, 9 aa, Homo Sapiens
SRRRTLNLK

SEQ ID NO: 120427 - protein, 9 aa, Homo Sapiens
RLTQPAHLT

SEQ ID NO: 120428 - protein, 9 aa, Homo Sapiens
SPGDMVNSI

SEQ ID NO: 120429 - protein, 9 aa, Homo Sapiens
LGGLIAGSL

SEQ ID NO: 120430 - protein, 9 aa, Homo Sapiens
ATPNMLHNF

SEQ ID NO: 120431 - protein, 9 aa, Homo Sapiens
PLHAIMEIE

SEQ ID NO: 120432 - protein, 9 aa, Homo Sapiens
VLEVIAETA

SEQ ID NO: 120433 - protein, 9 aa, Homo Sapiens
MVMEQAIPL

SEQ ID NO: 120434 - protein, 9 aa, Homo Sapiens
TKAMDVHDG

SEQ ID NO: 120435 - protein, 9 aa, Homo Sapiens
LVEELATFM

SEQ ID NO: 120436 - protein, 9 aa, Homo Sapiens
PVIKKPDAP

SEQ ID NO: 120437 - protein, 9 aa, Homo Sapiens
WHEEHRGMF

SEQ ID NO: 120438 - protein, 9 aa, Homo Sapiens
TEIMQLISI

SEQ ID NO: 120439 - protein, 9 aa, Homo Sapiens
WAILAGLCT

SEQ ID NO: 120440 - protein, 9 aa, Homo Sapiens
AATKKLSIN

SEQ ID NO: 120441 - protein, 9 aa, Homo Sapiens
KQPHLNSKR

SEQ ID NO: 120442 - protein, 9 aa, Homo Sapiens
IVLYLLGAA

SEQ ID NO: 120443 - protein, 9 aa, Homo Sapiens
SNSNTLSSN

SEQ ID NO: 120444 - protein, 9 aa, Homo Sapiens
KMGAGWRDS

SEQ ID NO: 120445 - protein, 9 aa, Homo Sapiens
YHPKPALHM

SEQ ID NO: 120446 - protein, 9 aa, Homo Sapiens
HFWPRRKCR

SEQ ID NO: 120447 - protein, 9 aa, Homo Sapiens
AQHPPLIHC

SEQ ID NO: 120448 - protein, 9 aa, Homo Sapiens
LVRQLLFFT

SEQ ID NO: 120449 - protein, 9 aa, Homo Sapiens
VGWAEATVA

SEQ ID NO: 120450 - protein, 9 aa, Homo Sapiens
LCVPPSPIL

SEQ ID NO: 120451 - protein, 9 aa, Homo Sapiens
RTDSHLVRS

SEQ ID NO: 120452 - protein, 9 aa, Homo Sapiens
EYPENKRYR

SEQ ID NO: 120453 - protein, 9 aa, Homo Sapiens
KKKAQLHFA

SEQ ID NO: 120454 - protein, 9 aa, Homo Sapiens
ACAAAVTPD

SEQ ID NO: 120455 - protein, 9 aa, Homo Sapiens
TPHGVPLPT

SEQ ID NO: 120456 - protein, 9 aa, Homo Sapiens
NVHLQDHHL

SEQ ID NO: 120457 - protein, 9 aa, Homo Sapiens
SLPEYNMFP

SEQ ID NO: 120458 - protein, 9 aa, Homo Sapiens
SKLSQVVRK

SEQ ID NO: 120459 - protein, 9 aa, Homo Sapiens
EDDKQIELM

SEQ ID NO: 120460 - protein, 9 aa, Homo Sapiens
WERRRTQRY

SEQ ID NO: 120461 - protein, 9 aa, Homo Sapiens
RERIAKKIK

SEQ ID NO: 120462 - protein, 9 aa, Homo Sapiens
TVISSKRRA

SEQ ID NO: 120463 - protein, 9 aa, Homo Sapiens
SNGASTATT

SEQ ID NO: 120464 - protein, 9 aa, Homo Sapiens
GEEAQEPEE

SEQ ID NO: 120465 - protein, 9 aa, Homo Sapiens
QSLFSVSFS

SEQ ID NO: 120466 - protein, 9 aa, Homo Sapiens
LQPEKPLVS

SEQ ID NO: 120467 - protein, 9 aa, Homo Sapiens
PFPLVGLAK

SEQ ID NO: 120468 - protein, 9 aa, Homo Sapiens
CKAFAPTCI

SEQ ID NO: 120469 - protein, 9 aa, Homo Sapiens
VKEKHSDHR

SEQ ID NO: 120470 - protein, 9 aa, Homo Sapiens
LAHIMSRLF

SEQ ID NO: 120471 - protein, 9 aa, Homo Sapiens
VKENLPIIR

SEQ ID NO: 120472 - protein, 9 aa, Homo Sapiens
YDYTKDLFQ

SEQ ID NO: 120473 - protein, 9 aa, Homo Sapiens
SGKVYKEDF

SEQ ID NO: 120474 - protein, 9 aa, Homo Sapiens
AIGSWMSSV

SEQ ID NO: 120475 - protein, 9 aa, Homo Sapiens
TLPALCPWQ

SEQ ID NO: 120476 - protein, 9 aa, Homo Sapiens
GNLQASYTT

SEQ ID NO: 120477 - protein, 9 aa, Homo Sapiens
TSLRKSFAS

SEQ ID NO: 120478 - protein, 9 aa, Homo Sapiens
EGYLLCKRY

SEQ ID NO: 120479 - protein, 9 aa, Homo Sapiens
RCALSHPKK

SEQ ID NO: 120480 - protein, 9 aa, Homo Sapiens
MYEKMVAVG

SEQ ID NO: 120481 - protein, 9 aa, Homo Sapiens
CDTQEGYLQ

SEQ ID NO: 120482 - protein, 9 aa, Homo Sapiens
NAAITEELF

SEQ ID NO: 120483 - protein, 9 aa, Homo Sapiens
SHLQKGNKG

SEQ ID NO: 120484 - protein, 9 aa, Homo Sapiens
RGGPGQAAG

SEQ ID NO: 120485 - protein, 9 aa, Homo Sapiens
EVIAETAFK

SEQ ID NO: 120486 - protein, 9 aa, Homo Sapiens
RGARRPAPL

SEQ ID NO: 120487 - protein, 9 aa, Homo Sapiens
FHTALFLGG

SEQ ID NO: 120488 - protein, 9 aa, Homo Sapiens
TTSDRKTEA

SEQ ID NO: 120489 - protein, 9 aa, Homo Sapiens
CLRMRPPRS

SEQ ID NO: 120490 - protein, 9 aa, Homo Sapiens
LLALSFASL

SEQ ID NO: 120491 - protein, 9 aa, Homo Sapiens
DVLEVIAET

SEQ ID NO: 120492 - protein, 9 aa, Homo Sapiens
TTRSQQHTP

SEQ ID NO: 120493 - protein, 9 aa, Homo Sapiens
LEYECLTGR

SEQ ID NO: 120494 - protein, 9 aa, Homo Sapiens
VYAITSNDI

SEQ ID NO: 120495 - protein, 9 aa, Homo Sapiens
LDAKRRGSS

SEQ ID NO: 120496 - protein, 9 aa, Homo Sapiens
DGSIVLSLA

SEQ ID NO: 120497 - protein, 9 aa, Homo Sapiens
QILCLLQQQ

SEQ ID NO: 120498 - protein, 9 aa, Homo Sapiens
QKNKKRRRI

SEQ ID NO: 120499 - protein, 9 aa, Homo Sapiens
FLMGPEPSF

SEQ ID NO: 120500 - protein, 9 aa, Homo Sapiens
RLPGLHLYP

SEQ ID NO: 120501 - protein, 9 aa, Homo Sapiens
LVAFILLSL

SEQ ID NO: 120502 - protein, 9 aa, Homo Sapiens
SVSSSAGQM

SEQ ID NO: 120503 - protein, 9 aa, Homo Sapiens
RRPAHTDIK

SEQ ID NO: 120504 - protein, 9 aa, Homo Sapiens
TSTVVCVGA

SEQ ID NO: 120505 - protein, 9 aa, Homo Sapiens
LSRLQKPHA

SEQ ID NO: 120506 - protein, 9 aa, Homo Sapiens
EDHSRRDMF

SEQ ID NO: 120507 - protein, 9 aa, Homo Sapiens
PDEIAAEIF

SEQ ID NO: 120508 - protein, 9 aa, Homo Sapiens
FKTKTLTGT

SEQ ID NO: 120509 - protein, 9 aa, Homo Sapiens
SAQEEGEPA

SEQ ID NO: 120510 - protein, 9 aa, Homo Sapiens
SSAIPKLQS

SEQ ID NO: 120511 - protein, 9 aa, Homo Sapiens
LAVSSVLLS

SEQ ID NO: 120512 - protein, 9 aa, Homo Sapiens
PLFSGRQPL

SEQ ID NO: 120513 - protein, 9 aa, Homo Sapiens
RAKKVTLAH

SEQ ID NO: 120514 - protein, 9 aa, Homo Sapiens
SVSHLQPPG

SEQ ID NO: 120515 - protein, 9 aa, Homo Sapiens
RHRSRCTTP

SEQ ID NO: 120516 - protein, 9 aa, Homo Sapiens
IQRHRRNLT

SEQ ID NO: 120517 - protein, 9 aa, Homo Sapiens
ILWNAHTQT

SEQ ID NO: 120518 - protein, 9 aa, Homo Sapiens
PQDDLCRYI

SEQ ID NO: 120519 - protein, 9 aa, Homo Sapiens
DTVQPLKCI

SEQ ID NO: 120520 - protein, 9 aa, Homo Sapiens
AMPNAVDRD

SEQ ID NO: 120521 - protein, 9 aa, Homo Sapiens
PGSDLLPPP

SEQ ID NO: 120522 - protein, 9 aa, Homo Sapiens
DRGWGPNGK

SEQ ID NO: 120523 - protein, 9 aa, Homo Sapiens
QGTRGIGET

SEQ ID NO: 120524 - protein, 9 aa, Homo Sapiens
HWCGAWRGH

SEQ ID NO: 120525 - protein, 9 aa, Homo Sapiens
LNSHEGKWD

SEQ ID NO: 120526 - protein, 9 aa, Homo Sapiens
SSKVSPSTE

SEQ ID NO: 120527 - protein, 9 aa, Homo Sapiens
WFRLFHTAL

SEQ ID NO: 120528 - protein, 9 aa, Homo Sapiens
SNPSMAVSA

SEQ ID NO: 120529 - protein, 9 aa, Homo Sapiens
QPPAKKNKE

SEQ ID NO: 120530 - protein, 9 aa, Homo Sapiens
FLDLTDTIE

SEQ ID NO: 120531 - protein, 9 aa, Homo Sapiens
PRDPPARPS

SEQ ID NO: 120532 - protein, 9 aa, Homo Sapiens
LVRDIRRCY

SEQ ID NO: 120533 - protein, 9 aa, Homo Sapiens
VLHGAPAAP

SEQ ID NO: 120534 - protein, 9 aa, Homo Sapiens
VHHHLIGQV

SEQ ID NO: 120535 - protein, 9 aa, Homo Sapiens
IWVAGFQMT

SEQ ID NO: 120536 - protein, 9 aa, Homo Sapiens
VQSETERIF

SEQ ID NO: 120537 - protein, 9 aa, Homo Sapiens
NFSRTKSLY

SEQ ID NO: 120538 - protein, 9 aa, Homo Sapiens
WRYLQQALD

SEQ ID NO: 120539 - protein, 9 aa, Homo Sapiens
DCFMVSSET

SEQ ID NO: 120540 - protein, 9 aa, Homo Sapiens
VKEEPCFFS

SEQ ID NO: 120541 - protein, 9 aa, Homo Sapiens
GHCFCLIFF

SEQ ID NO: 120542 - protein, 9 aa, Homo Sapiens
PMGPPPECC

SEQ ID NO: 120543 - protein, 9 aa, Homo Sapiens
IEKVHIDQH

SEQ ID NO: 120544 - protein, 9 aa, Homo Sapiens
SCCPAPDGQ

SEQ ID NO: 120545 - protein, 9 aa, Homo Sapiens
GSVSHLQPP

SEQ ID NO: 120546 - protein, 9 aa, Homo Sapiens
PKLNLEFGD

SEQ ID NO: 120547 - protein, 9 aa, Homo Sapiens
QILHDRFLM

SEQ ID NO: 120548 - protein, 9 aa, Homo Sapiens
EHLNKVQTT

SEQ ID NO: 120549 - protein, 9 aa, Homo Sapiens
DNREGVILS

SEQ ID NO: 120550 - protein, 9 aa, Homo Sapiens
PLCRGSTST

SEQ ID NO: 120551 - protein, 9 aa, Homo Sapiens
GLSFLKEVS

SEQ ID NO: 120552 - protein, 9 aa, Homo Sapiens
LRHRSRCTT

SEQ ID NO: 120553 - protein, 9 aa, Homo Sapiens
RACTAPRGL

SEQ ID NO: 120554 - protein, 9 aa, Homo Sapiens
PNQVRMRCL

SEQ ID NO: 120555 - protein, 9 aa, Homo Sapiens
FLAGVPKGP

SEQ ID NO: 120556 - protein, 9 aa, Homo Sapiens
KVLRKVMGS

SEQ ID NO: 120557 - protein, 9 aa, Homo Sapiens
NEVADRAYT

SEQ ID NO: 120558 - protein, 9 aa, Homo Sapiens
EQVCSVLKQ

SEQ ID NO: 120559 - protein, 9 aa, Homo Sapiens
GLGHSRDDE

SEQ ID NO: 120560 - protein, 9 aa, Homo Sapiens
QAMGTIGFN

SEQ ID NO: 120561 - protein, 9 aa, Homo Sapiens
VCKDPGLAG

SEQ ID NO: 120562 - protein, 9 aa, Homo Sapiens
NFVTSLYSM

SEQ ID NO: 120563 - protein, 9 aa, Homo Sapiens
SLQNLMRTM

SEQ ID NO: 120564 - protein, 9 aa, Homo Sapiens
DKGQKGSVD

SEQ ID NO: 120565 - protein, 9 aa, Homo Sapiens
PWAPADRLC

SEQ ID NO: 120566 - protein, 9 aa, Homo Sapiens
GLGSGDEKE

SEQ ID NO: 120567 - protein, 9 aa, Homo Sapiens
AAPSFPKTT

SEQ ID NO: 120568 - protein, 9 aa, Homo Sapiens
RNLLNPNPH

SEQ ID NO: 120569 - protein, 9 aa, Homo Sapiens
PFDQQNCAM

SEQ ID NO: 120570 - protein, 9 aa, Homo Sapiens
QNFFIAVTA

SEQ ID NO: 120571 - protein, 9 aa, Homo Sapiens
PPHPRDPPA

SEQ ID NO: 120572 - protein, 9 aa, Homo Sapiens
LVLGCNEKT

SEQ ID NO: 120573 - protein, 9 aa, Homo Sapiens
TDSHQQYLP

SEQ ID NO: 120574 - protein, 9 aa, Homo Sapiens
DKQRTLFLG

SEQ ID NO: 120575 - protein, 9 aa, Homo Sapiens
RKMEKNRQL

SEQ ID NO: 120576 - protein, 9 aa, Homo Sapiens
PVAACKVVA

SEQ ID NO: 120577 - protein, 9 aa, Homo Sapiens
EVSGGHCWV

SEQ ID NO: 120578 - protein, 9 aa, Homo Sapiens
HPHPTPTSD

SEQ ID NO: 120579 - protein, 9 aa, Homo Sapiens
AAHPSSVLG

SEQ ID NO: 120580 - protein, 9 aa, Homo Sapiens
LLISMWKTA

SEQ ID NO: 120581 - protein, 9 aa, Homo Sapiens
QCQPWSPTL

SEQ ID NO: 120582 - protein, 9 aa, Homo Sapiens
EPQGQPRED

SEQ ID NO: 120583 - protein, 9 aa, Homo Sapiens
TVLPGTGHI

SEQ ID NO: 120584 - protein, 9 aa, Homo Sapiens
IPWLLQPLL

SEQ ID NO: 120585 - protein, 9 aa, Homo Sapiens
TQLAFFLMF

SEQ ID NO: 120586 - protein, 9 aa, Homo Sapiens
SRPGWAALQ

SEQ ID NO: 120587 - protein, 9 aa, Homo Sapiens
RCARWLHQP

SEQ ID NO: 120588 - protein, 9 aa, Homo Sapiens
MMCLKKRDL

SEQ ID NO: 120589 - protein, 9 aa, Homo Sapiens
KPHAFILKS

SEQ ID NO: 120590 - protein, 9 aa, Homo Sapiens
PLAEPFPLV

SEQ ID NO: 120591 - protein, 9 aa, Homo Sapiens
KINGLVTSS

SEQ ID NO: 120592 - protein, 9 aa, Homo Sapiens
KMEIPPCRR

SEQ ID NO: 120593 - protein, 9 aa, Homo Sapiens
LRVVPLLPR

SEQ ID NO: 120594 - protein, 9 aa, Homo Sapiens
RLHEEARGR

SEQ ID NO: 120595 - protein, 9 aa, Homo Sapiens
SREFNPGSS

SEQ ID NO: 120596 - protein, 9 aa, Homo Sapiens
GFTSDHHCQ

SEQ ID NO: 120597 - protein, 9 aa, Homo Sapiens
TAILRQVHG

SEQ ID NO: 120598 - protein, 9 aa, Homo Sapiens
KNQKLGSPS

SEQ ID NO: 120599 - protein, 9 aa, Homo Sapiens
CLLSPLVGE

SEQ ID NO: 120600 - protein, 9 aa, Homo Sapiens
MRERIAKKI

SEQ ID NO: 120601 - protein, 9 aa, Homo Sapiens
FVWISWFES

SEQ ID NO: 120602 - protein, 9 aa, Homo Sapiens
CFSMPGDNE

SEQ ID NO: 120603 - protein, 9 aa, Homo Sapiens
SHRLDPIME

SEQ ID NO: 120604 - protein, 9 aa, Homo Sapiens
PDLDLVLRD

SEQ ID NO: 120605 - protein, 9 aa, Homo Sapiens
LNKYKYKSS

SEQ ID NO: 120606 - protein, 9 aa, Homo Sapiens
NSQWENGAS

SEQ ID NO: 120607 - protein, 9 aa, Homo Sapiens
EEENGRKNL

SEQ ID NO: 120608 - protein, 9 aa, Homo Sapiens
TILAYCSLS

SEQ ID NO: 120609 - protein, 9 aa, Homo Sapiens
EVTSGDSPR

SEQ ID NO: 120610 - protein, 9 aa, Homo Sapiens
QEEWVMMDT

SEQ ID NO: 120611 - protein, 9 aa, Homo Sapiens
GERSWARCV

SEQ ID NO: 120612 - protein, 9 aa, Homo Sapiens
AAPPPPQIE

SEQ ID NO: 120613 - protein, 9 aa, Homo Sapiens
CPGLSRKLL

SEQ ID NO: 120614 - protein, 9 aa, Homo Sapiens
VTRRSLDYA

SEQ ID NO: 120615 - protein, 9 aa, Homo Sapiens
VVTQATPQG

SEQ ID NO: 120616 - protein, 9 aa, Homo Sapiens
KISGHLQYM

SEQ ID NO: 120617 - protein, 9 aa, Homo Sapiens
GCSANDFRD

SEQ ID NO: 120618 - protein, 9 aa, Homo Sapiens
KYARKICCK

SEQ ID NO: 120619 - protein, 9 aa, Homo Sapiens
VDEKEVVVD

SEQ ID NO: 120620 - protein, 9 aa, Homo Sapiens
EDLTIEVKE

SEQ ID NO: 120621 - protein, 9 aa, Homo Sapiens
TLGCSSNSS

SEQ ID NO: 120622 - protein, 9 aa, Homo Sapiens
RMEKDPNEL

SEQ ID NO: 120623 - protein, 9 aa, Homo Sapiens
GSANIFSEV

SEQ ID NO: 120624 - protein, 9 aa, Homo Sapiens
RKSASVATY

SEQ ID NO: 120625 - protein, 9 aa, Homo Sapiens
VGAPIHRLM

SEQ ID NO: 120626 - protein, 9 aa, Homo Sapiens
VHEGGSEEE

SEQ ID NO: 120627 - protein, 9 aa, Homo Sapiens
EITIVKLQE

SEQ ID NO: 120628 - protein, 9 aa, Homo Sapiens
FMAKHLIYE

SEQ ID NO: 120629 - protein, 9 aa, Homo Sapiens
ACEHHSPTC

SEQ ID NO: 120630 - protein, 9 aa, Homo Sapiens
LLLGDEQRD

SEQ ID NO: 120631 - protein, 9 aa, Homo Sapiens
SFFIQDGHH

SEQ ID NO: 120632 - protein, 9 aa, Homo Sapiens
IIPYNSQYE

SEQ ID NO: 120633 - protein, 9 aa, Homo Sapiens
DQRPPEGLA

SEQ ID NO: 120634 - protein, 9 aa, Homo Sapiens
GFGVTLCVV

SEQ ID NO: 120635 - protein, 9 aa, Homo Sapiens
FPGSSHLPT

SEQ ID NO: 120636 - protein, 9 aa, Homo Sapiens
IKIGRSVAH

SEQ ID NO: 120637 - protein, 9 aa, Homo Sapiens
GPRPQTEHT

SEQ ID NO: 120638 - protein, 9 aa, Homo Sapiens
QRKKKYQKR

SEQ ID NO: 120639 - protein, 9 aa, Homo Sapiens
TLLDLINFF

SEQ ID NO: 120640 - protein, 9 aa, Homo Sapiens
KPNYTVDWY

SEQ ID NO: 120641 - protein, 9 aa, Homo Sapiens
SSLTREKIK

SEQ ID NO: 120642 - protein, 9 aa, Homo Sapiens
KVVPLHDGA

SEQ ID NO: 120643 - protein, 9 aa, Homo Sapiens
DGTVDTPPA

SEQ ID NO: 120644 - protein, 9 aa, Homo Sapiens
SILEMLLKW

SEQ ID NO: 120645 - protein, 9 aa, Homo Sapiens
GCSSNSSCS

SEQ ID NO: 120646 - protein, 9 aa, Homo Sapiens
FFFSKIKQA

SEQ ID NO: 120647 - protein, 9 aa, Homo Sapiens
PATLTQQTA

SEQ ID NO: 120648 - protein, 9 aa, Homo Sapiens
AGVSLATLC

SEQ ID NO: 120649 - protein, 9 aa, Homo Sapiens
ENPLVSLAR

SEQ ID NO: 120650 - protein, 9 aa, Homo Sapiens
GLLRMEADF

SEQ ID NO: 120651 - protein, 9 aa, Homo Sapiens
YPFCYLPKS

SEQ ID NO: 120652 - protein, 9 aa, Homo Sapiens
ILWTIRLPR

SEQ ID NO: 120653 - protein, 9 aa, Homo Sapiens
VQEYRRSEQ

SEQ ID NO: 120654 - protein, 9 aa, Homo Sapiens
SNIQAKGVH

SEQ ID NO: 120655 - protein, 9 aa, Homo Sapiens
EQLKKKHLK

SEQ ID NO: 120656 - protein, 9 aa, Homo Sapiens
TRGPLDGNP

SEQ ID NO: 120657 - protein, 9 aa, Homo Sapiens
YYLSPPEYF

SEQ ID NO: 120658 - protein, 9 aa, Homo Sapiens
LVSTRNGYQ

SEQ ID NO: 120659 - protein, 9 aa, Homo Sapiens
LTKHLWNGT

SEQ ID NO: 120660 - protein, 9 aa, Homo Sapiens
VDLAVNVCI

SEQ ID NO: 120661 - protein, 9 aa, Homo Sapiens
KTHPLATQE

SEQ ID NO: 120662 - protein, 9 aa, Homo Sapiens
APQWVLTAT

SEQ ID NO: 120663 - protein, 9 aa, Homo Sapiens
GVPIYITVK

SEQ ID NO: 120664 - protein, 9 aa, Homo Sapiens
IAPKIKERA

SEQ ID NO: 120665 - protein, 9 aa, Homo Sapiens
HLARCETDG

SEQ ID NO: 120666 - protein, 9 aa, Homo Sapiens
ASSILCTLI

SEQ ID NO: 120667 - protein, 9 aa, Homo Sapiens
LWQRCAIQI

SEQ ID NO: 120668 - protein, 9 aa, Homo Sapiens
KKISLKLFP

SEQ ID NO: 120669 - protein, 9 aa, Homo Sapiens
AVQDAAVAR

SEQ ID NO: 120670 - protein, 9 aa, Homo Sapiens
SPCRCYGSV

SEQ ID NO: 120671 - protein, 9 aa, Homo Sapiens
FNIVNFSRT

SEQ ID NO: 120672 - protein, 9 aa, Homo Sapiens
NDIRSPCIK

SEQ ID NO: 120673 - protein, 9 aa, Homo Sapiens
KSASVATYF

SEQ ID NO: 120674 - protein, 9 aa, Homo Sapiens
APPKCPAVA

SEQ ID NO: 120675 - protein, 9 aa, Homo Sapiens
GPCGPPPTM

SEQ ID NO: 120676 - protein, 9 aa, Homo Sapiens
SLIDLLIKS

SEQ ID NO: 120677 - protein, 9 aa, Homo Sapiens
VDPAIRTRG

SEQ ID NO: 120678 - protein, 9 aa, Homo Sapiens
RDLYNKFKG

SEQ ID NO: 120679 - protein, 9 aa, Homo Sapiens
DHILQGFQQ

SEQ ID NO: 120680 - protein, 9 aa, Homo Sapiens
LLGLLNWHS

SEQ ID NO: 120681 - protein, 9 aa, Homo Sapiens
QHKGEDFTC

SEQ ID NO: 120682 - protein, 9 aa, Homo Sapiens
EKVLELTGL

SEQ ID NO: 120683 - protein, 9 aa, Homo Sapiens
SIDMDTVHP

SEQ ID NO: 120684 - protein, 9 aa, Homo Sapiens
LCFHPPQPA

SEQ ID NO: 120685 - protein, 9 aa, Homo Sapiens
VEMRPLGCC

SEQ ID NO: 120686 - protein, 9 aa, Homo Sapiens
ACLAIDPLA

SEQ ID NO: 120687 - protein, 9 aa, Homo Sapiens
VEIKQKLSM

SEQ ID NO: 120688 - protein, 9 aa, Homo Sapiens
RCILLFPMG

SEQ ID NO: 120689 - protein, 9 aa, Homo Sapiens
QLAAVGTRI

SEQ ID NO: 120690 - protein, 9 aa, Homo Sapiens
CYLPKSRHF

SEQ ID NO: 120691 - protein, 9 aa, Homo Sapiens
NSSSEDGPG

SEQ ID NO: 120692 - protein, 9 aa, Homo Sapiens
GRSISTKAP

SEQ ID NO: 120693 - protein, 9 aa, Homo Sapiens
FNGNNLIFQ

SEQ ID NO: 120694 - protein, 9 aa, Homo Sapiens
AMNATIQQA

SEQ ID NO: 120695 - protein, 9 aa, Homo Sapiens
STKAPTTSR

SEQ ID NO: 120696 - protein, 9 aa, Homo Sapiens
NLYRIRQSK

SEQ ID NO: 120697 - protein, 9 aa, Homo Sapiens
MKPTPGPTP

SEQ ID NO: 120698 - protein, 9 aa, Homo Sapiens
PSPLPPQLS

SEQ ID NO: 120699 - protein, 9 aa, Homo Sapiens
DDEKRWIVF

SEQ ID NO: 120700 - protein, 9 aa, Homo Sapiens
VLVSLETLN

SEQ ID NO: 120701 - protein, 9 aa, Homo Sapiens
EGKWDYVCE

SEQ ID NO: 120702 - protein, 9 aa, Homo Sapiens
SHSLRSQPL

SEQ ID NO: 120703 - protein, 9 aa, Homo Sapiens
SHWCGAWRG

SEQ ID NO: 120704 - protein, 9 aa, Homo Sapiens
FSHSSTLTK

SEQ ID NO: 120705 - protein, 9 aa, Homo Sapiens
QEEPMTGFY

SEQ ID NO: 120706 - protein, 9 aa, Homo Sapiens
GAGWRDSSR

SEQ ID NO: 120707 - protein, 9 aa, Homo Sapiens
PLRVYTHKK

SEQ ID NO: 120708 - protein, 9 aa, Homo Sapiens
ISTVRAINV

SEQ ID NO: 120709 - protein, 9 aa, Homo Sapiens
ITVSWSQPD

SEQ ID NO: 120710 - protein, 9 aa, Homo Sapiens
GKKKGPNTN

SEQ ID NO: 120711 - protein, 9 aa, Homo Sapiens
PLSDSPPLQ

SEQ ID NO: 120712 - protein, 9 aa, Homo Sapiens
PDAAGTGLY

SEQ ID NO: 120713 - protein, 9 aa, Homo Sapiens
PSYVKHVCL

SEQ ID NO: 120714 - protein, 9 aa, Homo Sapiens
REGYLLCKR

SEQ ID NO: 120715 - protein, 9 aa, Homo Sapiens
ADGFLSDSL

SEQ ID NO: 120716 - protein, 9 aa, Homo Sapiens
FPYAVPLPH

SEQ ID NO: 120717 - protein, 9 aa, Homo Sapiens
NSPRETSSW

SEQ ID NO: 120718 - protein, 9 aa, Homo Sapiens
GLGWEGPRC

SEQ ID NO: 120719 - protein, 9 aa, Homo Sapiens
SIPTSLVGS

SEQ ID NO: 120720 - protein, 9 aa, Homo Sapiens
RLVATVWAC

SEQ ID NO: 120721 - protein, 9 aa, Homo Sapiens
NCCACVGNV

SEQ ID NO: 120722 - protein, 9 aa, Homo Sapiens
LRAICQKVA

SEQ ID NO: 120723 - protein, 9 aa, Homo Sapiens
AESLPGLAA

SEQ ID NO: 120724 - protein, 9 aa, Homo Sapiens
KFQCVEKSR

SEQ ID NO: 120725 - protein, 9 aa, Homo Sapiens
GRHRYVYVC

SEQ ID NO: 120726 - protein, 9 aa, Homo Sapiens
AANVLHGLS

SEQ ID NO: 120727 - protein, 9 aa, Homo Sapiens
KKNKENQKE

SEQ ID NO: 120728 - protein, 9 aa, Homo Sapiens
RVVKDDSSE

SEQ ID NO: 120729 - protein, 9 aa, Homo Sapiens
SGMSKPPCY

SEQ ID NO: 120730 - protein, 9 aa, Homo Sapiens
PISNSRPSE

SEQ ID NO: 120731 - protein, 9 aa, Homo Sapiens
YTNPLPGII

SEQ ID NO: 120732 - protein, 9 aa, Homo Sapiens
FLAQCLRWL

SEQ ID NO: 120733 - protein, 9 aa, Homo Sapiens
DKYFCENRH

SEQ ID NO: 120734 - protein, 9 aa, Homo Sapiens
YTSSTGLVP

SEQ ID NO: 120735 - protein, 9 aa, Homo Sapiens
EEEQTCPAP

SEQ ID NO: 120736 - protein, 9 aa, Homo Sapiens
TIAVRNTHL

SEQ ID NO: 120737 - protein, 9 aa, Homo Sapiens
DDGQNFIQN

SEQ ID NO: 120738 - protein, 9 aa, Homo Sapiens
EDFFGAKHI

SEQ ID NO: 120739 - protein, 9 aa, Homo Sapiens
DLGGPCPQT

SEQ ID NO: 120740 - protein, 9 aa, Homo Sapiens
VTPSLAGPW

SEQ ID NO: 120741 - protein, 9 aa, Homo Sapiens
GPALRRLYT

SEQ ID NO: 120742 - protein, 9 aa, Homo Sapiens
MSLGIYSPC

SEQ ID NO: 120743 - protein, 9 aa, Homo Sapiens
ARWWEAQAP

SEQ ID NO: 120744 - protein, 9 aa, Homo Sapiens
RLIFWSRHC

SEQ ID NO: 120745 - protein, 9 aa, Homo Sapiens
TSYSLQAIK

SEQ ID NO: 120746 - protein, 9 aa, Homo Sapiens
SADGVFEED

SEQ ID NO: 120747 - protein, 9 aa, Homo Sapiens
QIVNALDKM

SEQ ID NO: 120748 - protein, 9 aa, Homo Sapiens
VSEYTSSTG

SEQ ID NO: 120749 - protein, 9 aa, Homo Sapiens
IQLVAKLRL

SEQ ID NO: 120750 - protein, 9 aa, Homo Sapiens
NPGSSGRSA

SEQ ID NO: 120751 - protein, 9 aa, Homo Sapiens
KKHLGKLRV

SEQ ID NO: 120752 - protein, 9 aa, Homo Sapiens
SSEDGPGDG

SEQ ID NO: 120753 - protein, 9 aa, Homo Sapiens
INTRLNMGI

SEQ ID NO: 120754 - protein, 9 aa, Homo Sapiens
NGGNANPHL

SEQ ID NO: 120755 - protein, 9 aa, Homo Sapiens
TQYGSPATW

SEQ ID NO: 120756 - protein, 9 aa, Homo Sapiens
GDRKGVHPV

SEQ ID NO: 120757 - protein, 9 aa, Homo Sapiens
VGSFRTLRL

SEQ ID NO: 120758 - protein, 9 aa, Homo Sapiens
ETSLMKVHQ

SEQ ID NO: 120759 - protein, 9 aa, Homo Sapiens
GTSNSSSED

SEQ ID NO: 120760 - protein, 9 aa, Homo Sapiens
HTVLIAIGC

SEQ ID NO: 120761 - protein, 9 aa, Homo Sapiens
VAFILLSLV

SEQ ID NO: 120762 - protein, 9 aa, Homo Sapiens
WVPHTETPS

SEQ ID NO: 120763 - protein, 9 aa, Homo Sapiens
RPRKRQCAP

SEQ ID NO: 120764 - protein, 9 aa, Homo Sapiens
RVLQQVPCS

SEQ ID NO: 120765 - protein, 9 aa, Homo Sapiens
SLATMMVSD

SEQ ID NO: 120766 - protein, 9 aa, Homo Sapiens
QSSLVVTQR

SEQ ID NO: 120767 - protein, 9 aa, Homo Sapiens
LLLAPPPRA

SEQ ID NO: 120768 - protein, 9 aa, Homo Sapiens
QQDCLQHRA

SEQ ID NO: 120769 - protein, 9 aa, Homo Sapiens
GAPATEVGC

SEQ ID NO: 120770 - protein, 9 aa, Homo Sapiens
MIQKTRKQK

SEQ ID NO: 120771 - protein, 9 aa, Homo Sapiens
ICYSSNATP

SEQ ID NO: 120772 - protein, 9 aa, Homo Sapiens
PFPIRQIRN

SEQ ID NO: 120773 - protein, 9 aa, Homo Sapiens
TNPLPGIIM

SEQ ID NO: 120774 - protein, 9 aa, Homo Sapiens
RGWAWDDKK

SEQ ID NO: 120775 - protein, 9 aa, Homo Sapiens
STSAHLPPP

SEQ ID NO: 120776 - protein, 9 aa, Homo Sapiens
KVLHMDRSP

SEQ ID NO: 120777 - protein, 9 aa, Homo Sapiens
VRAAGRAVV

SEQ ID NO: 120778 - protein, 9 aa, Homo Sapiens
WGLKGGCRP

SEQ ID NO: 120779 - protein, 9 aa, Homo Sapiens
RKGRGLPRT

SEQ ID NO: 120780 - protein, 9 aa, Homo Sapiens
RPGGTADPY

SEQ ID NO: 120781 - protein, 9 aa, Homo Sapiens
TVDPAIRTR

SEQ ID NO: 120782 - protein, 9 aa, Homo Sapiens
LLPPAPGDL

SEQ ID NO: 120783 - protein, 9 aa, Homo Sapiens
WLINDQLPF

SEQ ID NO: 120784 - protein, 9 aa, Homo Sapiens
LEVIAETAF

SEQ ID NO: 120785 - protein, 9 aa, Homo Sapiens
HYGQVSKNI

SEQ ID NO: 120786 - protein, 9 aa, Homo Sapiens
GGMCLTFTS

SEQ ID NO: 120787 - protein, 9 aa, Homo Sapiens
KATKHCKKL

SEQ ID NO: 120788 - protein, 9 aa, Homo Sapiens
IPQTRRQRS

SEQ ID NO: 120789 - protein, 9 aa, Homo Sapiens
GHVVFSIEP

SEQ ID NO: 120790 - protein, 9 aa, Homo Sapiens
KVFTQSSQL

SEQ ID NO: 120791 - protein, 9 aa, Homo Sapiens
GGHRQRWGG

SEQ ID NO: 120792 - protein, 9 aa, Homo Sapiens
AGGPCLDPA

SEQ ID NO: 120793 - protein, 9 aa, Homo Sapiens
PQPMGPPPE

SEQ ID NO: 120794 - protein, 9 aa, Homo Sapiens
MVNAGVMSG

SEQ ID NO: 120795 - protein, 9 aa, Homo Sapiens
LGLVREVTG

SEQ ID NO: 120796 - protein, 9 aa, Homo Sapiens
VSLARRRKN

SEQ ID NO: 120797 - protein, 9 aa, Homo Sapiens
GLSSYCNES

SEQ ID NO: 120798 - protein, 9 aa, Homo Sapiens
RKEDVNKKR

SEQ ID NO: 120799 - protein, 9 aa, Homo Sapiens
CGQCGLHDL

SEQ ID NO: 120800 - protein, 9 aa, Homo Sapiens
NFCLVSKVV

SEQ ID NO: 120801 - protein, 9 aa, Homo Sapiens
MEMNKCLTE

SEQ ID NO: 120802 - protein, 9 aa, Homo Sapiens
FRMTWKPFL

SEQ ID NO: 120803 - protein, 9 aa, Homo Sapiens
PGGNQELVQ

SEQ ID NO: 120804 - protein, 9 aa, Homo Sapiens
LPEYNMFPR

SEQ ID NO: 120805 - protein, 9 aa, Homo Sapiens
DPGGAEPHP

SEQ ID NO: 120806 - protein, 9 aa, Homo Sapiens
FVRTRKGQE

SEQ ID NO: 120807 - protein, 9 aa, Homo Sapiens
LYRSFCLQN

SEQ ID NO: 120808 - protein, 9 aa, Homo Sapiens
RGRRAGNRG

SEQ ID NO: 120809 - protein, 9 aa, Homo Sapiens
DVNKKRKTA

SEQ ID NO: 120810 - protein, 9 aa, Homo Sapiens
VEPGKLEQV

SEQ ID NO: 120811 - protein, 9 aa, Homo Sapiens
PTCTQLFTS

SEQ ID NO: 120812 - protein, 9 aa, Homo Sapiens
IRQIRNRRA

SEQ ID NO: 120813 - protein, 9 aa, Homo Sapiens
SSLRVERSP

SEQ ID NO: 120814 - protein, 9 aa, Homo Sapiens
EIQAPHPGP

SEQ ID NO: 120815 - protein, 9 aa, Homo Sapiens
FAQNETFVL

SEQ ID NO: 120816 - protein, 9 aa, Homo Sapiens
FNDHKANDH

SEQ ID NO: 120817 - protein, 9 aa, Homo Sapiens
ITCIFFTFW

SEQ ID NO: 120818 - protein, 9 aa, Homo Sapiens
GLGRWGLKG

SEQ ID NO: 120819 - protein, 9 aa, Homo Sapiens
HRHSEHRVH

SEQ ID NO: 120820 - protein, 9 aa, Homo Sapiens
NQWCEAGIY

SEQ ID NO: 120821 - protein, 9 aa, Homo Sapiens
CSANDFRDV

SEQ ID NO: 120822 - protein, 9 aa, Homo Sapiens
WYRAVGDSA

SEQ ID NO: 120823 - protein, 9 aa, Homo Sapiens
KSSASSSSS

SEQ ID NO: 120824 - protein, 9 aa, Homo Sapiens
LSSYFQQAE

SEQ ID NO: 120825 - protein, 9 aa, Homo Sapiens
KTQRTSVHC

SEQ ID NO: 120826 - protein, 9 aa, Homo Sapiens
HTRPKPGEP

SEQ ID NO: 120827 - protein, 9 aa, Homo Sapiens
SIPKRPAGS

SEQ ID NO: 120828 - protein, 9 aa, Homo Sapiens
PCANTSLYP

SEQ ID NO: 120829 - protein, 9 aa, Homo Sapiens
VTAANDSDS

SEQ ID NO: 120830 - protein, 9 aa, Homo Sapiens
ERIAKKIKK

SEQ ID NO: 120831 - protein, 9 aa, Homo Sapiens
LSRVFFQAG

SEQ ID NO: 120832 - protein, 9 aa, Homo Sapiens
PWRNLLAHP

SEQ ID NO: 120833 - protein, 9 aa, Homo Sapiens
TGHEYAVKI

SEQ ID NO: 120834 - protein, 9 aa, Homo Sapiens
ILFILRFCP

SEQ ID NO: 120835 - protein, 9 aa, Homo Sapiens
EKKEYKMSS

SEQ ID NO: 120836 - protein, 9 aa, Homo Sapiens
VNFVVVDEI

SEQ ID NO: 120837 - protein, 9 aa, Homo Sapiens
GLDESCLVI

SEQ ID NO: 120838 - protein, 9 aa, Homo Sapiens
ALSGVEGIR

SEQ ID NO: 120839 - protein, 9 aa, Homo Sapiens
QKLGSPSTS

SEQ ID NO: 120840 - protein, 9 aa, Homo Sapiens
YDYISEWQQ

SEQ ID NO: 120841 - protein, 9 aa, Homo Sapiens
KILSSIQTM

SEQ ID NO: 120842 - protein, 9 aa, Homo Sapiens
PRVMSQWSR

SEQ ID NO: 120843 - protein, 9 aa, Homo Sapiens
FLRRHVHPE

SEQ ID NO: 120844 - protein, 9 aa, Homo Sapiens
IRKYQDLEI

SEQ ID NO: 120845 - protein, 9 aa, Homo Sapiens
FRPIIGTVN

SEQ ID NO: 120846 - protein, 9 aa, Homo Sapiens
IHVLQHAQD

SEQ ID NO: 120847 - protein, 9 aa, Homo Sapiens
ETSHDAALE

SEQ ID NO: 120848 - protein, 9 aa, Homo Sapiens
APEPLTYDY

SEQ ID NO: 120849 - protein, 9 aa, Homo Sapiens
QHGKIARKQ

SEQ ID NO: 120850 - protein, 9 aa, Homo Sapiens
ASGGAKARS

SEQ ID NO: 120851 - protein, 9 aa, Homo Sapiens
DFGVVSSRM

SEQ ID NO: 120852 - protein, 9 aa, Homo Sapiens
PSFKEVIPH

SEQ ID NO: 120853 - protein, 9 aa, Homo Sapiens
MDTEVTKAR

SEQ ID NO: 120854 - protein, 9 aa, Homo Sapiens
WPLRVYTHK

SEQ ID NO: 120855 - protein, 9 aa, Homo Sapiens
SEGWHWGAA

SEQ ID NO: 120856 - protein, 9 aa, Homo Sapiens
TGTNPLCRG

SEQ ID NO: 120857 - protein, 9 aa, Homo Sapiens
GQRCRCVCL

SEQ ID NO: 120858 - protein, 9 aa, Homo Sapiens
GSCDMRYWP

SEQ ID NO: 120859 - protein, 9 aa, Homo Sapiens
ATWYELQMW

SEQ ID NO: 120860 - protein, 9 aa, Homo Sapiens
SLGVSQRGD

SEQ ID NO: 120861 - protein, 9 aa, Homo Sapiens
KLQVITASS

SEQ ID NO: 120862 - protein, 9 aa, Homo Sapiens
VDRSLLLYR

SEQ ID NO: 120863 - protein, 9 aa, Homo Sapiens
YFLSMSGNY

SEQ ID NO: 120864 - protein, 9 aa, Homo Sapiens
ILSRDHLLP

SEQ ID NO: 120865 - protein, 9 aa, Homo Sapiens
RPQMRLGYF

SEQ ID NO: 120866 - protein, 9 aa, Homo Sapiens
LEAQKFFVI

SEQ ID NO: 120867 - protein, 9 aa, Homo Sapiens
TKGRTSVHV

SEQ ID NO: 120868 - protein, 9 aa, Homo Sapiens
FHRPTGLRI

SEQ ID NO: 120869 - protein, 9 aa, Homo Sapiens
MEPLTFVLS

SEQ ID NO: 120870 - protein, 9 aa, Homo Sapiens
IKQAGLIDK

SEQ ID NO: 120871 - protein, 9 aa, Homo Sapiens
ASLLGKKLG

SEQ ID NO: 120872 - protein, 9 aa, Homo Sapiens
VRDIRRCYP

SEQ ID NO: 120873 - protein, 9 aa, Homo Sapiens
SSLPKAIMT

SEQ ID NO: 120874 - protein, 9 aa, Homo Sapiens
KRHLESSNS

SEQ ID NO: 120875 - protein, 9 aa, Homo Sapiens
NSHRATSNT

SEQ ID NO: 120876 - protein, 9 aa, Homo Sapiens
NPFPIRQIR

SEQ ID NO: 120877 - protein, 9 aa, Homo Sapiens
SPPSRPPSS

SEQ ID NO: 120878 - protein, 9 aa, Homo Sapiens
KLSQVVRKT

SEQ ID NO: 120879 - protein, 9 aa, Homo Sapiens
AGTGESGDL

SEQ ID NO: 120880 - protein, 9 aa, Homo Sapiens
LGGAPGGGG

SEQ ID NO: 120881 - protein, 9 aa, Homo Sapiens
GGSRRRSLG

SEQ ID NO: 120882 - protein, 9 aa, Homo Sapiens
TLSPELPPD

SEQ ID NO: 120883 - protein, 9 aa, Homo Sapiens
KIKERAHNV

SEQ ID NO: 120884 - protein, 9 aa, Homo Sapiens
GEEKSLSKK

SEQ ID NO: 120885 - protein, 9 aa, Homo Sapiens
DDNEIDTMF

SEQ ID NO: 120886 - protein, 9 aa, Homo Sapiens
RYYEGRNGW

SEQ ID NO: 120887 - protein, 9 aa, Homo Sapiens
RGRLPNNNS

SEQ ID NO: 120888 - protein, 9 aa, Homo Sapiens
RWCSSWRSS

SEQ ID NO: 120889 - protein, 9 aa, Homo Sapiens
QEVDVILED

SEQ ID NO: 120890 - protein, 9 aa, Homo Sapiens
KRRRIHGQY

SEQ ID NO: 120891 - protein, 9 aa, Homo Sapiens
TSVRLVSQE

SEQ ID NO: 120892 - protein, 9 aa, Homo Sapiens
ATLTQQTAV

SEQ ID NO: 120893 - protein, 9 aa, Homo Sapiens
LFEYAGNDN

SEQ ID NO: 120894 - protein, 9 aa, Homo Sapiens
LVGVSCVGG

SEQ ID NO: 120895 - protein, 9 aa, Homo Sapiens
TGRASCPGF

SEQ ID NO: 120896 - protein, 9 aa, Homo Sapiens
SIKSCWVAA

SEQ ID NO: 120897 - protein, 9 aa, Homo Sapiens
SQGTLAQED

SEQ ID NO: 120898 - protein, 9 aa, Homo Sapiens
GELEGEIRH

SEQ ID NO: 120899 - protein, 9 aa, Homo Sapiens
AALASCPTS

SEQ ID NO: 120900 - protein, 9 aa, Homo Sapiens
PRPGSPRSS

SEQ ID NO: 120901 - protein, 9 aa, Homo Sapiens
ILSLIHFFV

SEQ ID NO: 120902 - protein, 9 aa, Homo Sapiens
ENIMEMNKC

SEQ ID NO: 120903 - protein, 9 aa, Homo Sapiens
CGRCGATSS

SEQ ID NO: 120904 - protein, 9 aa, Homo Sapiens
QASHVLMKI

SEQ ID NO: 120905 - protein, 9 aa, Homo Sapiens
DLINHQKNT

SEQ ID NO: 120906 - protein, 9 aa, Homo Sapiens
GTVQEEAQL

SEQ ID NO: 120907 - protein, 9 aa, Homo Sapiens
QIWFQNQRS

SEQ ID NO: 120908 - protein, 9 aa, Homo Sapiens
PGPFRHLAQ

SEQ ID NO: 120909 - protein, 9 aa, Homo Sapiens
TTNEVKQAV

SEQ ID NO: 120910 - protein, 9 aa, Homo Sapiens
KSVSFFVKG

SEQ ID NO: 120911 - protein, 9 aa, Homo Sapiens
VPKGPLLEK

SEQ ID NO: 120912 - protein, 9 aa, Homo Sapiens
QGPPRPQGQ

SEQ ID NO: 120913 - protein, 9 aa, Homo Sapiens
QRSFLVLLL

SEQ ID NO: 120914 - protein, 9 aa, Homo Sapiens
PSLVIVLGL

SEQ ID NO: 120915 - protein, 9 aa, Homo Sapiens
DRGPPEPQG

SEQ ID NO: 120916 - protein, 9 aa, Homo Sapiens
QRIRSKKRK

SEQ ID NO: 120917 - protein, 9 aa, Homo Sapiens
IRGKSFHNI

SEQ ID NO: 120918 - protein, 9 aa, Homo Sapiens
PPAMRRPSS

SEQ ID NO: 120919 - protein, 9 aa, Homo Sapiens
RFNDHKAND

SEQ ID NO: 120920 - protein, 9 aa, Homo Sapiens
ISMDPDDIL

SEQ ID NO: 120921 - protein, 9 aa, Homo Sapiens
LKQKRLVTE

SEQ ID NO: 120922 - protein, 9 aa, Homo Sapiens
RESVNAHFW

SEQ ID NO: 120923 - protein, 9 aa, Homo Sapiens
GRHLSHHHQ

SEQ ID NO: 120924 - protein, 9 aa, Homo Sapiens
AIGCFIFLI

SEQ ID NO: 120925 - protein, 9 aa, Homo Sapiens
EAGVSLATL

SEQ ID NO: 120926 - protein, 9 aa, Homo Sapiens
DLATEKEVI

SEQ ID NO: 120927 - protein, 9 aa, Homo Sapiens
RAWLWLALN

SEQ ID NO: 120928 - protein, 9 aa, Homo Sapiens
QQEKQKTEL

SEQ ID NO: 120929 - protein, 9 aa, Homo Sapiens
QRPAARNLT

SEQ ID NO: 120930 - protein, 9 aa, Homo Sapiens
YNMFPRKGR

SEQ ID NO: 120931 - protein, 9 aa, Homo Sapiens
VDSIDICHR

SEQ ID NO: 120932 - protein, 9 aa, Homo Sapiens
TTTSSPRRS

SEQ ID NO: 120933 - protein, 9 aa, Homo Sapiens
PEFNSVKEN

SEQ ID NO: 120934 - protein, 9 aa, Homo Sapiens
VQPPRPRLN

SEQ ID NO: 120935 - protein, 9 aa, Homo Sapiens
DDYKNNDGY

SEQ ID NO: 120936 - protein, 9 aa, Homo Sapiens
NTEAGVSLA

SEQ ID NO: 120937 - protein, 9 aa, Homo Sapiens
LHPGTPGHP

SEQ ID NO: 120938 - protein, 9 aa, Homo Sapiens
VSSKNSLEP

SEQ ID NO: 120939 - protein, 9 aa, Homo Sapiens
EENEGEEAQ

SEQ ID NO: 120940 - protein, 9 aa, Homo Sapiens
FKEKCHICV

SEQ ID NO: 120941 - protein, 9 aa, Homo Sapiens
DEKRWIVFS

SEQ ID NO: 120942 - protein, 9 aa, Homo Sapiens
LDSRVVLDL

SEQ ID NO: 120943 - protein, 9 aa, Homo Sapiens
DLRYIETQH

SEQ ID NO: 120944 - protein, 9 aa, Homo Sapiens
GATAVTTRP

SEQ ID NO: 120945 - protein, 9 aa, Homo Sapiens
SPPSKKSPQ

SEQ ID NO: 120946 - protein, 9 aa, Homo Sapiens
PKTQRTSVH

SEQ ID NO: 120947 - protein, 9 aa, Homo Sapiens
LLLLAPPPR

SEQ ID NO: 120948 - protein, 9 aa, Homo Sapiens
STATLHVLL

SEQ ID NO: 120949 - protein, 9 aa, Homo Sapiens
TCDRCKHGW

SEQ ID NO: 120950 - protein, 9 aa, Homo Sapiens
PDGDGKQRS

SEQ ID NO: 120951 - protein, 9 aa, Homo Sapiens
QSLLSLYSV

SEQ ID NO: 120952 - protein, 9 aa, Homo Sapiens
SNQKIKLIR

SEQ ID NO: 120953 - protein, 9 aa, Homo Sapiens
SPHHHQCQP

SEQ ID NO: 120954 - protein, 9 aa, Homo Sapiens
RRHNDVSLA

SEQ ID NO: 120955 - protein, 9 aa, Homo Sapiens
ARSDVHRPP

SEQ ID NO: 120956 - protein, 9 aa, Homo Sapiens
PMVRGSRCY

SEQ ID NO: 120957 - protein, 9 aa, Homo Sapiens
VDRVKIHQD

SEQ ID NO: 120958 - protein, 9 aa, Homo Sapiens
IDLSEIPNS

SEQ ID NO: 120959 - protein, 9 aa, Homo Sapiens
ENVQPILQI

SEQ ID NO: 120960 - protein, 9 aa, Homo Sapiens
PSVWNASRP

SEQ ID NO: 120961 - protein, 9 aa, Homo Sapiens
FVLSVRTGN

SEQ ID NO: 120962 - protein, 9 aa, Homo Sapiens
YVPWWATHT

SEQ ID NO: 120963 - protein, 9 aa, Homo Sapiens
LDSFWGHSQ

SEQ ID NO: 120964 - protein, 9 aa, Homo Sapiens
LGNKSILGY

SEQ ID NO: 120965 - protein, 9 aa, Homo Sapiens
IVSTVQNIL

SEQ ID NO: 120966 - protein, 9 aa, Homo Sapiens
NGASLDDPP

SEQ ID NO: 120967 - protein, 9 aa, Homo Sapiens
HLHVSNVML

SEQ ID NO: 120968 - protein, 9 aa, Homo Sapiens
DIPPIQTNV

SEQ ID NO: 120969 - protein, 9 aa, Homo Sapiens
PPSPGSSAR

SEQ ID NO: 120970 - protein, 9 aa, Homo Sapiens
IPLLITVTL

SEQ ID NO: 120971 - protein, 9 aa, Homo Sapiens
VGLVLWSGA

SEQ ID NO: 120972 - protein, 9 aa, Homo Sapiens
KTVDNWIDH

SEQ ID NO: 120973 - protein, 9 aa, Homo Sapiens
QQHNFSSQI

SEQ ID NO: 120974 - protein, 9 aa, Homo Sapiens
CLICPWRNL

SEQ ID NO: 120975 - protein, 9 aa, Homo Sapiens
HTDPKETNF

SEQ ID NO: 120976 - protein, 9 aa, Homo Sapiens
ACPVRGAWF

SEQ ID NO: 120977 - protein, 9 aa, Homo Sapiens
MRYWPQEAG

SEQ ID NO: 120978 - protein, 9 aa, Homo Sapiens
GCVPTREPQ

SEQ ID NO: 120979 - protein, 9 aa, Homo Sapiens
PYLLKTGHF

SEQ ID NO: 120980 - protein, 9 aa, Homo Sapiens
PMMDFLCCV

SEQ ID NO: 120981 - protein, 9 aa, Homo Sapiens
KTGPPVLSS

SEQ ID NO: 120982 - protein, 9 aa, Homo Sapiens
GTLAQEDEA

SEQ ID NO: 120983 - protein, 9 aa, Homo Sapiens
LAHLDLLDL

SEQ ID NO: 120984 - protein, 9 aa, Homo Sapiens
VAMPPGASP

SEQ ID NO: 120985 - protein, 9 aa, Homo Sapiens
SSSPTSTTS

SEQ ID NO: 120986 - protein, 9 aa, Homo Sapiens
SLQKTNEEV

SEQ ID NO: 120987 - protein, 9 aa, Homo Sapiens
SAMLCAVLY

SEQ ID NO: 120988 - protein, 9 aa, Homo Sapiens
SHGRKKKTH

SEQ ID NO: 120989 - protein, 9 aa, Homo Sapiens
KKIGSKKPQ

SEQ ID NO: 120990 - protein, 9 aa, Homo Sapiens
KEHLTRLKA

SEQ ID NO: 120991 - protein, 9 aa, Homo Sapiens
SAMGTSFRS

SEQ ID NO: 120992 - protein, 9 aa, Homo Sapiens
SFAARDGSF

SEQ ID NO: 120993 - protein, 9 aa, Homo Sapiens
LVRVISEAG

SEQ ID NO: 120994 - protein, 9 aa, Homo Sapiens
MRCCRRRRC

SEQ ID NO: 120995 - protein, 9 aa, Homo Sapiens
WTAIEWIIE

SEQ ID NO: 120996 - protein, 9 aa, Homo Sapiens
IVLSLARGS

SEQ ID NO: 120997 - protein, 9 aa, Homo Sapiens
HALPFFLLF

SEQ ID NO: 120998 - protein, 9 aa, Homo Sapiens
ERVLMSQCA

SEQ ID NO: 120999 - protein, 9 aa, Homo Sapiens
VRESHITLA

SEQ ID NO: 121000 - protein, 9 aa, Homo Sapiens
RWWELGGPC

SEQ ID NO: 121001 - protein, 9 aa, Homo Sapiens
HSMKDKAGK

SEQ ID NO: 121002 - protein, 9 aa, Homo Sapiens
CLAVFRVLP

SEQ ID NO: 121003 - protein, 9 aa, Homo Sapiens
DLNPFLQLS

SEQ ID NO: 121004 - protein, 9 aa, Homo Sapiens
ELLRAICQK

SEQ ID NO: 121005 - protein, 9 aa, Homo Sapiens
DLMDVMNVG

SEQ ID NO: 121006 - protein, 9 aa, Homo Sapiens
PAGHLGRSG

SEQ ID NO: 121007 - protein, 9 aa, Homo Sapiens
YNNNRTSFH

SEQ ID NO: 121008 - protein, 9 aa, Homo Sapiens
SHSHQDHGI

SEQ ID NO: 121009 - protein, 9 aa, Homo Sapiens
RRECWGTWP

SEQ ID NO: 121010 - protein, 9 aa, Homo Sapiens
FLSLPGAEG

SEQ ID NO: 121011 - protein, 9 aa, Homo Sapiens
VQVMTHAGN

SEQ ID NO: 121012 - protein, 9 aa, Homo Sapiens
SESCLICPW

SEQ ID NO: 121013 - protein, 9 aa, Homo Sapiens
FLACPFLVF

SEQ ID NO: 121014 - protein, 9 aa, Homo Sapiens
ERKLLGADA

SEQ ID NO: 121015 - protein, 9 aa, Homo Sapiens
CTYDCPCRW

SEQ ID NO: 121016 - protein, 9 aa, Homo Sapiens
LKYHQYIPQ

SEQ ID NO: 121017 - protein, 9 aa, Homo Sapiens
LSTSQELCV

SEQ ID NO: 121018 - protein, 9 aa, Homo Sapiens
SHFSDLSQP

SEQ ID NO: 121019 - protein, 9 aa, Homo Sapiens
PAMAHRSRA

SEQ ID NO: 121020 - protein, 9 aa, Homo Sapiens
IAIHAMIIG

SEQ ID NO: 121021 - protein, 9 aa, Homo Sapiens
QVPGGNQEL

SEQ ID NO: 121022 - protein, 9 aa, Homo Sapiens
KNALWRKAL

SEQ ID NO: 121023 - protein, 9 aa, Homo Sapiens
TLVCDNGSG

SEQ ID NO: 121024 - protein, 9 aa, Homo Sapiens
GDLQPPDGS

SEQ ID NO: 121025 - protein, 9 aa, Homo Sapiens
RDAVVTSAC

SEQ ID NO: 121026 - protein, 9 aa, Homo Sapiens
SDFCHHCGQ

SEQ ID NO: 121027 - protein, 9 aa, Homo Sapiens
PGGAEPHPE

SEQ ID NO: 121028 - protein, 9 aa, Homo Sapiens
DQDNRTTPS

SEQ ID NO: 121029 - protein, 9 aa, Homo Sapiens
SDVDLATSV

SEQ ID NO: 121030 - protein, 9 aa, Homo Sapiens
PLAVLEFPV

SEQ ID NO: 121031 - protein, 9 aa, Homo Sapiens
RDPPARPSG

SEQ ID NO: 121032 - protein, 9 aa, Homo Sapiens
VMYRETEGS

SEQ ID NO: 121033 - protein, 9 aa, Homo Sapiens
PCLTWAESL

SEQ ID NO: 121034 - protein, 9 aa, Homo Sapiens
LYHALPFFL

SEQ ID NO: 121035 - protein, 9 aa, Homo Sapiens
TVSNVTLED

SEQ ID NO: 121036 - protein, 9 aa, Homo Sapiens
EEVKPLGEE

SEQ ID NO: 121037 - protein, 9 aa, Homo Sapiens
NVVKILRAL

SEQ ID NO: 121038 - protein, 9 aa, Homo Sapiens
EDIKTYFGA

SEQ ID NO: 121039 - protein, 9 aa, Homo Sapiens
GDPPEKRQG

SEQ ID NO: 121040 - protein, 9 aa, Homo Sapiens
VSSILITSM

SEQ ID NO: 121041 - protein, 9 aa, Homo Sapiens
LCKRYCSTL

SEQ ID NO: 121042 - protein, 9 aa, Homo Sapiens
EGTASSNIR

SEQ ID NO: 121043 - protein, 9 aa, Homo Sapiens
KEKCHICVP

SEQ ID NO: 121044 - protein, 9 aa, Homo Sapiens
VVVDEIHVL

SEQ ID NO: 121045 - protein, 9 aa, Homo Sapiens
KVARDEDDP

SEQ ID NO: 121046 - protein, 9 aa, Homo Sapiens
FLRRRSGLH

SEQ ID NO: 121047 - protein, 9 aa, Homo Sapiens
VVGTQTLSG

SEQ ID NO: 121048 - protein, 9 aa, Homo Sapiens
VYIPLPEEA

SEQ ID NO: 121049 - protein, 9 aa, Homo Sapiens
PPPTMVQGP

SEQ ID NO: 121050 - protein, 9 aa, Homo Sapiens
LRKSFASRS

SEQ ID NO: 121051 - protein, 9 aa, Homo Sapiens
FRDISNSSN

SEQ ID NO: 121052 - protein, 9 aa, Homo Sapiens
DPVNVTPQF

SEQ ID NO: 121053 - protein, 9 aa, Homo Sapiens
PQAQLTKPA

SEQ ID NO: 121054 - protein, 9 aa, Homo Sapiens
CPFQSPTKR

SEQ ID NO: 121055 - protein, 9 aa, Homo Sapiens
GGPPKARCP

SEQ ID NO: 121056 - protein, 9 aa, Homo Sapiens
HMKGCDTLD

SEQ ID NO: 121057 - protein, 9 aa, Homo Sapiens
GHPSASPPS

SEQ ID NO: 121058 - protein, 9 aa, Homo Sapiens
DGEEKSLSK

SEQ ID NO: 121059 - protein, 9 aa, Homo Sapiens
HAAGPAAER

SEQ ID NO: 121060 - protein, 9 aa, Homo Sapiens
PCGDTRIMY

SEQ ID NO: 121061 - protein, 9 aa, Homo Sapiens
TPGSGTSGQ

SEQ ID NO: 121062 - protein, 9 aa, Homo Sapiens
QRTLFLGIT

SEQ ID NO: 121063 - protein, 9 aa, Homo Sapiens
DYFLSMSGN

SEQ ID NO: 121064 - protein, 9 aa, Homo Sapiens
NPNVQHQNR

SEQ ID NO: 121065 - protein, 9 aa, Homo Sapiens
QQVHLAQHQ

SEQ ID NO: 121066 - protein, 9 aa, Homo Sapiens
RSFLVLLLG

SEQ ID NO: 121067 - protein, 9 aa, Homo Sapiens
HQNRNPGIQ

SEQ ID NO: 121068 - protein, 9 aa, Homo Sapiens
SSNSQQKKH

SEQ ID NO: 121069 - protein, 9 aa, Homo Sapiens
STTSSSGSC

SEQ ID NO: 121070 - protein, 9 aa, Homo Sapiens
HLHHTLPCQ

SEQ ID NO: 121071 - protein, 9 aa, Homo Sapiens
MAVQEDLYC

SEQ ID NO: 121072 - protein, 9 aa, Homo Sapiens
LFFTNKMKT

SEQ ID NO: 121073 - protein, 9 aa, Homo Sapiens
GTLVAFQGH

SEQ ID NO: 121074 - protein, 9 aa, Homo Sapiens
GAWGSVSIP

SEQ ID NO: 121075 - protein, 9 aa, Homo Sapiens
GEDPGGAEP

SEQ ID NO: 121076 - protein, 9 aa, Homo Sapiens
GDMESVMAV

SEQ ID NO: 121077 - protein, 9 aa, Homo Sapiens
RVGNLCKSH

SEQ ID NO: 121078 - protein, 9 aa, Homo Sapiens
EEPLECEVT

SEQ ID NO: 121079 - protein, 9 aa, Homo Sapiens
AADGAFKTS

SEQ ID NO: 121080 - protein, 9 aa, Homo Sapiens
LLHHQTEPG

SEQ ID NO: 121081 - protein, 9 aa, Homo Sapiens
CKDCKIRWE

SEQ ID NO: 121082 - protein, 9 aa, Homo Sapiens
ANIDEAVNK

SEQ ID NO: 121083 - protein, 9 aa, Homo Sapiens
EAKEAEARE

SEQ ID NO: 121084 - protein, 9 aa, Homo Sapiens
AHLSHLLEV

SEQ ID NO: 121085 - protein, 9 aa, Homo Sapiens
GQCGLHDLE

SEQ ID NO: 121086 - protein, 9 aa, Homo Sapiens
IMSRLFYGK

SEQ ID NO: 121087 - protein, 9 aa, Homo Sapiens
LLAPSSCPT

SEQ ID NO: 121088 - protein, 9 aa, Homo Sapiens
QTPASPVLP

SEQ ID NO: 121089 - protein, 9 aa, Homo Sapiens
PQLSVTPTV

SEQ ID NO: 121090 - protein, 9 aa, Homo Sapiens
STPSYLSVS

SEQ ID NO: 121091 - protein, 9 aa, Homo Sapiens
SMLEIWDVK

SEQ ID NO: 121092 - protein, 9 aa, Homo Sapiens
QPLGNKSIL

SEQ ID NO: 121093 - protein, 9 aa, Homo Sapiens
SANDFRDVF

SEQ ID NO: 121094 - protein, 9 aa, Homo Sapiens
PGPLKIRAS

SEQ ID NO: 121095 - protein, 9 aa, Homo Sapiens
KSKEATPVK

SEQ ID NO: 121096 - protein, 9 aa, Homo Sapiens
ASRLIFWSR

SEQ ID NO: 121097 - protein, 9 aa, Homo Sapiens
SGTQNDVDR

SEQ ID NO: 121098 - protein, 9 aa, Homo Sapiens
ADERYGKEL

SEQ ID NO: 121099 - protein, 9 aa, Homo Sapiens
TPRSCERSP

SEQ ID NO: 121100 - protein, 9 aa, Homo Sapiens
EALFLAGVP

SEQ ID NO: 121101 - protein, 9 aa, Homo Sapiens
VVKGVASDL

SEQ ID NO: 121102 - protein, 9 aa, Homo Sapiens
TQKILTKFK

SEQ ID NO: 121103 - protein, 9 aa, Homo Sapiens
SDVAVEWES

SEQ ID NO: 121104 - protein, 9 aa, Homo Sapiens
KIYKIGQGC

SEQ ID NO: 121105 - protein, 9 aa, Homo Sapiens
SPRPPPLVR

SEQ ID NO: 121106 - protein, 9 aa, Homo Sapiens
YKIVRTDSH

SEQ ID NO: 121107 - protein, 9 aa, Homo Sapiens
PPSKKSPQP

SEQ ID NO: 121108 - protein, 9 aa, Homo Sapiens
CCLIWGRKP

SEQ ID NO: 121109 - protein, 9 aa, Homo Sapiens
TGVYTGSEF

SEQ ID NO: 121110 - protein, 9 aa, Homo Sapiens
LDRRGGPGQ

SEQ ID NO: 121111 - protein, 9 aa, Homo Sapiens
LITVTLCSF

SEQ ID NO: 121112 - protein, 9 aa, Homo Sapiens
SKIEASPIG

SEQ ID NO: 121113 - protein, 9 aa, Homo Sapiens
EYAVKIINT

SEQ ID NO: 121114 - protein, 9 aa, Homo Sapiens
MAVFCLLCW

SEQ ID NO: 121115 - protein, 9 aa, Homo Sapiens
DTKMTKLEQ

SEQ ID NO: 121116 - protein, 9 aa, Homo Sapiens
DHADDIQCV

SEQ ID NO: 121117 - protein, 9 aa, Homo Sapiens
HPKPALHMV

SEQ ID NO: 121118 - protein, 9 aa, Homo Sapiens
RQKLQCNAA

SEQ ID NO: 121119 - protein, 9 aa, Homo Sapiens
FQVLPPCSD

SEQ ID NO: 121120 - protein, 9 aa, Homo Sapiens
VPRKGLIVM

SEQ ID NO: 121121 - protein, 9 aa, Homo Sapiens
NFNCCACVG

SEQ ID NO: 121122 - protein, 9 aa, Homo Sapiens
EHQKTFWTE

SEQ ID NO: 121123 - protein, 9 aa, Homo Sapiens
RMEKRRLRA

SEQ ID NO: 121124 - protein, 9 aa, Homo Sapiens
NYTNRNVAS

SEQ ID NO: 121125 - protein, 9 aa, Homo Sapiens
ANTTKHTYD

SEQ ID NO: 121126 - protein, 9 aa, Homo Sapiens
DNFTIILYG

SEQ ID NO: 121127 - protein, 9 aa, Homo Sapiens
DVGKSALTI

SEQ ID NO: 121128 - protein, 9 aa, Homo Sapiens
CSPVGSCPH

SEQ ID NO: 121129 - protein, 9 aa, Homo Sapiens
IPLSDSPPL

SEQ ID NO: 121130 - protein, 9 aa, Homo Sapiens
RKPLFYIID

SEQ ID NO: 121131 - protein, 9 aa, Homo Sapiens
LSASQIWNL

SEQ ID NO: 121132 - protein, 9 aa, Homo Sapiens
TTTDLLQSS

SEQ ID NO: 121133 - protein, 9 aa, Homo Sapiens
HHTLPCQRT

SEQ ID NO: 121134 - protein, 9 aa, Homo Sapiens
GRILLQRNL

SEQ ID NO: 121135 - protein, 9 aa, Homo Sapiens
PLSLWVQSL

SEQ ID NO: 121136 - protein, 9 aa, Homo Sapiens
LCRLNLSSN

SEQ ID NO: 121137 - protein, 9 aa, Homo Sapiens
CERNDKVFL

SEQ ID NO: 121138 - protein, 9 aa, Homo Sapiens
PLVSLARRR

SEQ ID NO: 121139 - protein, 9 aa, Homo Sapiens
RAEQLKKKH

SEQ ID NO: 121140 - protein, 9 aa, Homo Sapiens
QVLRVMRLT

SEQ ID NO: 121141 - protein, 9 aa, Homo Sapiens
GGKLNKREE

SEQ ID NO: 121142 - protein, 9 aa, Homo Sapiens
VFGAQECRL

SEQ ID NO: 121143 - protein, 9 aa, Homo Sapiens
QKVGAEEAA

SEQ ID NO: 121144 - protein, 9 aa, Homo Sapiens
GYNTWLSYE

SEQ ID NO: 121145 - protein, 9 aa, Homo Sapiens
ARLTQPAHL

SEQ ID NO: 121146 - protein, 9 aa, Homo Sapiens
ILVTLVNPE

SEQ ID NO: 121147 - protein, 9 aa, Homo Sapiens
RPPSSSTPK

SEQ ID NO: 121148 - protein, 9 aa, Homo Sapiens
LARDATALT

SEQ ID NO: 121149 - protein, 9 aa, Homo Sapiens
ANNNQLGGI

SEQ ID NO: 121150 - protein, 9 aa, Homo Sapiens
QVKLGSVAD

SEQ ID NO: 121151 - protein, 9 aa, Homo Sapiens
LHPPQQLHH

SEQ ID NO: 121152 - protein, 9 aa, Homo Sapiens
RHRRNLTEW

SEQ ID NO: 121153 - protein, 9 aa, Homo Sapiens
LGHSLPHTS

SEQ ID NO: 121154 - protein, 9 aa, Homo Sapiens
YMDKHPGGC

SEQ ID NO: 121155 - protein, 9 aa, Homo Sapiens
SWARCVPSL

SEQ ID NO: 121156 - protein, 9 aa, Homo Sapiens
PRAGGAEPV

SEQ ID NO: 121157 - protein, 9 aa, Homo Sapiens
LLVVGGIQK

SEQ ID NO: 121158 - protein, 9 aa, Homo Sapiens
ETSLQERLP

SEQ ID NO: 121159 - protein, 9 aa, Homo Sapiens
HCQLQGAGA

SEQ ID NO: 121160 - protein, 9 aa, Homo Sapiens
ISAMLCAVL

SEQ ID NO: 121161 - protein, 9 aa, Homo Sapiens
EKHYYKVDN

SEQ ID NO: 121162 - protein, 9 aa, Homo Sapiens
EALSCLYAT

SEQ ID NO: 121163 - protein, 9 aa, Homo Sapiens
PLHASLPPT

SEQ ID NO: 121164 - protein, 9 aa, Homo Sapiens
NSHPPTTTT

SEQ ID NO: 121165 - protein, 9 aa, Homo Sapiens
RSGSLITVG

SEQ ID NO: 121166 - protein, 9 aa, Homo Sapiens
AHFWPRRKC

SEQ ID NO: 121167 - protein, 9 aa, Homo Sapiens
GSSALSGVE

SEQ ID NO: 121168 - protein, 9 aa, Homo Sapiens
ISSLILTVW

SEQ ID NO: 121169 - protein, 9 aa, Homo Sapiens
QVDRVKIHQ

SEQ ID NO: 121170 - protein, 9 aa, Homo Sapiens
MASDTGKTC

SEQ ID NO: 121171 - protein, 9 aa, Homo Sapiens
SGSFKAAVW

SEQ ID NO: 121172 - protein, 9 aa, Homo Sapiens
YMNLAYNSS

SEQ ID NO: 121173 - protein, 9 aa, Homo Sapiens
KATLSHFSA

SEQ ID NO: 121174 - protein, 9 aa, Homo Sapiens
DGDGKQRSP

SEQ ID NO: 121175 - protein, 9 aa, Homo Sapiens
PIIGTVNMD

SEQ ID NO: 121176 - protein, 9 aa, Homo Sapiens
DIRSPCIKE

SEQ ID NO: 121177 - protein, 9 aa, Homo Sapiens
GQPREDDPD

SEQ ID NO: 121178 - protein, 9 aa, Homo Sapiens
PRAPALEGL

SEQ ID NO: 121179 - protein, 9 aa, Homo Sapiens
SLDYAYVNF

SEQ ID NO: 121180 - protein, 9 aa, Homo Sapiens
TSNAYIADE

SEQ ID NO: 121181 - protein, 9 aa, Homo Sapiens
VVGRIRNKH

SEQ ID NO: 121182 - protein, 9 aa, Homo Sapiens
RGGQRCRCV

SEQ ID NO: 121183 - protein, 9 aa, Homo Sapiens
KFGQIVNAL

SEQ ID NO: 121184 - protein, 9 aa, Homo Sapiens
LLNIKERTQ

SEQ ID NO: 121185 - protein, 9 aa, Homo Sapiens
FPLVGLAKL

SEQ ID NO: 121186 - protein, 9 aa, Homo Sapiens
CLIFFQQLR

SEQ ID NO: 121187 - protein, 9 aa, Homo Sapiens
AVVEKVRRQ

SEQ ID NO: 121188 - protein, 9 aa, Homo Sapiens
LSSINQEER

SEQ ID NO: 121189 - protein, 9 aa, Homo Sapiens
DLSVGGQLT

SEQ ID NO: 121190 - protein, 9 aa, Homo Sapiens
IWASLLGKK

SEQ ID NO: 121191 - protein, 9 aa, Homo Sapiens
SLGSQVHYA

SEQ ID NO: 121192 - protein, 9 aa, Homo Sapiens
GKINGLVTS

SEQ ID NO: 121193 - protein, 9 aa, Homo Sapiens
WAALQRLTW

SEQ ID NO: 121194 - protein, 9 aa, Homo Sapiens
PSTSIPHLS

SEQ ID NO: 121195 - protein, 9 aa, Homo Sapiens
GDKQRTLFL

SEQ ID NO: 121196 - protein, 9 aa, Homo Sapiens
LLQEGGPQR

SEQ ID NO: 121197 - protein, 9 aa, Homo Sapiens
VVSVVAHLS

SEQ ID NO: 121198 - protein, 9 aa, Homo Sapiens
VTTLEVSMC

SEQ ID NO: 121199 - protein, 9 aa, Homo Sapiens
TGRKTTEEA

SEQ ID NO: 121200 - protein, 9 aa, Homo Sapiens
PMTGFYVGW

SEQ ID NO: 121201 - protein, 9 aa, Homo Sapiens
HFLKKLILI

SEQ ID NO: 121202 - protein, 9 aa, Homo Sapiens
CLKTWNELP

SEQ ID NO: 121203 - protein, 9 aa, Homo Sapiens
PVNSSKWNS

SEQ ID NO: 121204 - protein, 9 aa, Homo Sapiens
AIDFGSASH

SEQ ID NO: 121205 - protein, 9 aa, Homo Sapiens
PKIRMKKSL

SEQ ID NO: 121206 - protein, 9 aa, Homo Sapiens
LARRLDFQE

SEQ ID NO: 121207 - protein, 9 aa, Homo Sapiens
RSLPNDISS

SEQ ID NO: 121208 - protein, 9 aa, Homo Sapiens
MLERGEAEW

SEQ ID NO: 121209 - protein, 9 aa, Homo Sapiens
PYEPSTPVL

SEQ ID NO: 121210 - protein, 9 aa, Homo Sapiens
KLIDVNNYA

SEQ ID NO: 121211 - protein, 9 aa, Homo Sapiens
SRDHSINYC

SEQ ID NO: 121212 - protein, 9 aa, Homo Sapiens
EGDETETPT

SEQ ID NO: 121213 - protein, 9 aa, Homo Sapiens
REPTPRLGH

SEQ ID NO: 121214 - protein, 9 aa, Homo Sapiens
TATDKKREQ

SEQ ID NO: 121215 - protein, 9 aa, Homo Sapiens
LACTSTNIW

SEQ ID NO: 121216 - protein, 9 aa, Homo Sapiens
QQCANSPRE

SEQ ID NO: 121217 - protein, 9 aa, Homo Sapiens
PQMRLGYFW

SEQ ID NO: 121218 - protein, 9 aa, Homo Sapiens
EAWWCRCPL

SEQ ID NO: 121219 - protein, 9 aa, Homo Sapiens
RPQRLWKRT

SEQ ID NO: 121220 - protein, 9 aa, Homo Sapiens
IKKLCRDKP

SEQ ID NO: 121221 - protein, 9 aa, Homo Sapiens
KVHGRDREI

SEQ ID NO: 121222 - protein, 9 aa, Homo Sapiens
SSVRTTRSQ

SEQ ID NO: 121223 - protein, 9 aa, Homo Sapiens
PERLNFSAM

SEQ ID NO: 121224 - protein, 9 aa, Homo Sapiens
LQSSLKNWL

SEQ ID NO: 121225 - protein, 9 aa, Homo Sapiens
QVTNNHGTV

SEQ ID NO: 121226 - protein, 9 aa, Homo Sapiens
KIVPFLNYA

SEQ ID NO: 121227 - protein, 9 aa, Homo Sapiens
LRALWLVWE

SEQ ID NO: 121228 - protein, 9 aa, Homo Sapiens
YPGLNPRIQ

SEQ ID NO: 121229 - protein, 9 aa, Homo Sapiens
ASVCHHHGI

SEQ ID NO: 121230 - protein, 9 aa, Homo Sapiens
LESSRDHSI

SEQ ID NO: 121231 - protein, 9 aa, Homo Sapiens
ALLRACSCP

SEQ ID NO: 121232 - protein, 9 aa, Homo Sapiens
RYLFYSEHG

SEQ ID NO: 121233 - protein, 9 aa, Homo Sapiens
VLPPCSDLS

SEQ ID NO: 121234 - protein, 9 aa, Homo Sapiens
APIEVLYLW

SEQ ID NO: 121235 - protein, 9 aa, Homo Sapiens
YLGSSHQIL

SEQ ID NO: 121236 - protein, 9 aa, Homo Sapiens
SEWQQLSER

SEQ ID NO: 121237 - protein, 9 aa, Homo Sapiens
QQYLPTYTL

SEQ ID NO: 121238 - protein, 9 aa, Homo Sapiens
TEGSEIKDT

SEQ ID NO: 121239 - protein, 9 aa, Homo Sapiens
GMLLCCSQS

SEQ ID NO: 121240 - protein, 9 aa, Homo Sapiens
LQVGALARP

SEQ ID NO: 121241 - protein, 9 aa, Homo Sapiens
LIPQEPGPR

SEQ ID NO: 121242 - protein, 9 aa, Homo Sapiens
FIAVTAKDK

SEQ ID NO: 121243 - protein, 9 aa, Homo Sapiens
ERSIHNFCL

SEQ ID NO: 121244 - protein, 9 aa, Homo Sapiens
GVPLQFSVC

SEQ ID NO: 121245 - protein, 9 aa, Homo Sapiens
MAALLRLPW

SEQ ID NO: 121246 - protein, 9 aa, Homo Sapiens
PWQPLGNKS

SEQ ID NO: 121247 - protein, 9 aa, Homo Sapiens
PKCHTSYEE

SEQ ID NO: 121248 - protein, 9 aa, Homo Sapiens
SSAQGVSSA

SEQ ID NO: 121249 - protein, 9 aa, Homo Sapiens
LENIVGVDV

SEQ ID NO: 121250 - protein, 9 aa, Homo Sapiens
AITDAAMTA

SEQ ID NO: 121251 - protein, 9 aa, Homo Sapiens
EKKTWYLLA

SEQ ID NO: 121252 - protein, 9 aa, Homo Sapiens
ETSLSFGKT

SEQ ID NO: 121253 - protein, 9 aa, Homo Sapiens
TFLCRPVKA

SEQ ID NO: 121254 - protein, 9 aa, Homo Sapiens
DASRTMLFN

SEQ ID NO: 121255 - protein, 9 aa, Homo Sapiens
AVQAPSPSS

SEQ ID NO: 121256 - protein, 9 aa, Homo Sapiens
RSRSQSPPQ

SEQ ID NO: 121257 - protein, 9 aa, Homo Sapiens
GALLRGCPQ

SEQ ID NO: 121258 - protein, 9 aa, Homo Sapiens
IHIKTSTVS

SEQ ID NO: 121259 - protein, 9 aa, Homo Sapiens
AKGVHSSGQ

SEQ ID NO: 121260 - protein, 9 aa, Homo Sapiens
ATYFLPGVT

SEQ ID NO: 121261 - protein, 9 aa, Homo Sapiens
FFLLIGIPG

SEQ ID NO: 121262 - protein, 9 aa, Homo Sapiens
LLVRDRMLA

SEQ ID NO: 121263 - protein, 9 aa, Homo Sapiens
LRSQCECHR

SEQ ID NO: 121264 - protein, 9 aa, Homo Sapiens
ISWELESST

SEQ ID NO: 121265 - protein, 9 aa, Homo Sapiens
FHLHRKGPL

SEQ ID NO: 121266 - protein, 9 aa, Homo Sapiens
SLRILRKSS

SEQ ID NO: 121267 - protein, 9 aa, Homo Sapiens
VNALDKMIR

SEQ ID NO: 121268 - protein, 9 aa, Homo Sapiens
TSVHCLKQE

SEQ ID NO: 121269 - protein, 9 aa, Homo Sapiens
CGHLYRSFC

SEQ ID NO: 121270 - protein, 9 aa, Homo Sapiens
THTHTLTHT

SEQ ID NO: 121271 - protein, 9 aa, Homo Sapiens
RERVRGGKR

SEQ ID NO: 121272 - protein, 9 aa, Homo Sapiens
IRKHTQGRS

SEQ ID NO: 121273 - protein, 9 aa, Homo Sapiens
IAGCRHSVP

SEQ ID NO: 121274 - protein, 9 aa, Homo Sapiens
QSTPASSRV

SEQ ID NO: 121275 - protein, 9 aa, Homo Sapiens
LLLSFRVFC

SEQ ID NO: 121276 - protein, 9 aa, Homo Sapiens
WALTILKDS

SEQ ID NO: 121277 - protein, 9 aa, Homo Sapiens
SRQIRTKAM

SEQ ID NO: 121278 - protein, 9 aa, Homo Sapiens
LQKNTDVVT

SEQ ID NO: 121279 - protein, 9 aa, Homo Sapiens
LLKTGHFEE

SEQ ID NO: 121280 - protein, 9 aa, Homo Sapiens
YAITSNDIS

SEQ ID NO: 121281 - protein, 9 aa, Homo Sapiens
QIQALLQRS

SEQ ID NO: 121282 - protein, 9 aa, Homo Sapiens
AMKFGSWTY

SEQ ID NO: 121283 - protein, 9 aa, Homo Sapiens
AGPAAERAG

SEQ ID NO: 121284 - protein, 9 aa, Homo Sapiens
ELILSPGCW

SEQ ID NO: 121285 - protein, 9 aa, Homo Sapiens
DDVHHQGGG

SEQ ID NO: 121286 - protein, 9 aa, Homo Sapiens
HIKNSRNHQ

SEQ ID NO: 121287 - protein, 9 aa, Homo Sapiens
NIDLSEIPN

SEQ ID NO: 121288 - protein, 9 aa, Homo Sapiens
MTGFYVGWA

SEQ ID NO: 121289 - protein, 9 aa, Homo Sapiens
YRQVITVHQ

SEQ ID NO: 121290 - protein, 9 aa, Homo Sapiens
SGEPEGRAS

SEQ ID NO: 121291 - protein, 9 aa, Homo Sapiens
LVRTQHPTL

SEQ ID NO: 121292 - protein, 9 aa, Homo Sapiens
VFQGKKNTF

SEQ ID NO: 121293 - protein, 9 aa, Homo Sapiens
CKVSEYTSS

SEQ ID NO: 121294 - protein, 9 aa, Homo Sapiens
TFPSVYAIT

SEQ ID NO: 121295 - protein, 9 aa, Homo Sapiens
RRKGGGRES

SEQ ID NO: 121296 - protein, 9 aa, Homo Sapiens
HLMRLHPWW

SEQ ID NO: 121297 - protein, 9 aa, Homo Sapiens
DEPMDVRSA

SEQ ID NO: 121298 - protein, 9 aa, Homo Sapiens
LCDTQEGYL

SEQ ID NO: 121299 - protein, 9 aa, Homo Sapiens
GDYEDVLVS

SEQ ID NO: 121300 - protein, 9 aa, Homo Sapiens
DILVPCVLI

SEQ ID NO: 121301 - protein, 9 aa, Homo Sapiens
RASSGTAAP

SEQ ID NO: 121302 - protein, 9 aa, Homo Sapiens
TAPDKMGIR

SEQ ID NO: 121303 - protein, 9 aa, Homo Sapiens
EEPMTGFYV

SEQ ID NO: 121304 - protein, 9 aa, Homo Sapiens
RVQTEGRLY

SEQ ID NO: 121305 - protein, 9 aa, Homo Sapiens
APQRCGWWR

SEQ ID NO: 121306 - protein, 9 aa, Homo Sapiens
FVNLLSNGT

SEQ ID NO: 121307 - protein, 9 aa, Homo Sapiens
VDRTKTQTR

SEQ ID NO: 121308 - protein, 9 aa, Homo Sapiens
CPLAARKLQ

SEQ ID NO: 121309 - protein, 9 aa, Homo Sapiens
TVRPGTQAA

SEQ ID NO: 121310 - protein, 9 aa, Homo Sapiens
HQQYLPTYT

SEQ ID NO: 121311 - protein, 9 aa, Homo Sapiens
ERRHNDVSL

SEQ ID NO: 121312 - protein, 9 aa, Homo Sapiens
NVASPTSVR

SEQ ID NO: 121313 - protein, 9 aa, Homo Sapiens
CLLGTFRRV

SEQ ID NO: 121314 - protein, 9 aa, Homo Sapiens
WPGIPGGTA

SEQ ID NO: 121315 - protein, 9 aa, Homo Sapiens
LVWELLGVA

SEQ ID NO: 121316 - protein, 9 aa, Homo Sapiens
VPQAQLTKP

SEQ ID NO: 121317 - protein, 9 aa, Homo Sapiens
WRQWEGEAE

SEQ ID NO: 121318 - protein, 9 aa, Homo Sapiens
NLPSDEDEG

SEQ ID NO: 121319 - protein, 9 aa, Homo Sapiens
DVFTKGRTS

SEQ ID NO: 121320 - protein, 9 aa, Homo Sapiens
ASGVCQTAL

SEQ ID NO: 121321 - protein, 9 aa, Homo Sapiens
DCSPTRMLA

SEQ ID NO: 121322 - protein, 9 aa, Homo Sapiens
NHQRPAARN

SEQ ID NO: 121323 - protein, 9 aa, Homo Sapiens
PPLQDGSLD

SEQ ID NO: 121324 - protein, 9 aa, Homo Sapiens
YDSSKSCEI

SEQ ID NO: 121325 - protein, 9 aa, Homo Sapiens
TRSHRKRNT

SEQ ID NO: 121326 - protein, 9 aa, Homo Sapiens
KSPQPMGPP

SEQ ID NO: 121327 - protein, 9 aa, Homo Sapiens
LTLARPFTK

SEQ ID NO: 121328 - protein, 9 aa, Homo Sapiens
KTLTGTSHP

SEQ ID NO: 121329 - protein, 9 aa, Homo Sapiens
KVSPSTESS

SEQ ID NO: 121330 - protein, 9 aa, Homo Sapiens
DGLGHSRDD

SEQ ID NO: 121331 - protein, 9 aa, Homo Sapiens
QKTHTREKP

SEQ ID NO: 121332 - protein, 9 aa, Homo Sapiens
IQVKRDLNA

SEQ ID NO: 121333 - protein, 9 aa, Homo Sapiens
CLHFLACPF

SEQ ID NO: 121334 - protein, 9 aa, Homo Sapiens
ASSPYVNTV

SEQ ID NO: 121335 - protein, 9 aa, Homo Sapiens
YFFPFFFIL

SEQ ID NO: 121336 - protein, 9 aa, Homo Sapiens
VLYTSVKEE

SEQ ID NO: 121337 - protein, 9 aa, Homo Sapiens
SVCLAGMIV

SEQ ID NO: 121338 - protein, 9 aa, Homo Sapiens
IPKLFRPAE

SEQ ID NO: 121339 - protein, 9 aa, Homo Sapiens
SLEAEQASV

SEQ ID NO: 121340 - protein, 9 aa, Homo Sapiens
TRARKGREE

SEQ ID NO: 121341 - protein, 9 aa, Homo Sapiens
VKIPRRTVT

SEQ ID NO: 121342 - protein, 9 aa, Homo Sapiens
AAVAEVIRS

SEQ ID NO: 121343 - protein, 9 aa, Homo Sapiens
GKCTQGVYM

SEQ ID NO: 121344 - protein, 9 aa, Homo Sapiens
CGALLRGCP

SEQ ID NO: 121345 - protein, 9 aa, Homo Sapiens
GISSLILTV

SEQ ID NO: 121346 - protein, 9 aa, Homo Sapiens
NFSSQIFSL

SEQ ID NO: 121347 - protein, 9 aa, Homo Sapiens
GLAPPAGLV

SEQ ID NO: 121348 - protein, 9 aa, Homo Sapiens
EDGTEARSK

SEQ ID NO: 121349 - protein, 9 aa, Homo Sapiens
VDALVEELA

SEQ ID NO: 121350 - protein, 9 aa, Homo Sapiens
RNLGSPLMS

SEQ ID NO: 121351 - protein, 9 aa, Homo Sapiens
NHCQERPSE

SEQ ID NO: 121352 - protein, 9 aa, Homo Sapiens
EILCTVFAT

SEQ ID NO: 121353 - protein, 9 aa, Homo Sapiens
PGRHWLCPQ

SEQ ID NO: 121354 - protein, 9 aa, Homo Sapiens
REVTARATQ

SEQ ID NO: 121355 - protein, 9 aa, Homo Sapiens
LDPIMEKFG

SEQ ID NO: 121356 - protein, 9 aa, Homo Sapiens
HPPTTTTSS

SEQ ID NO: 121357 - protein, 9 aa, Homo Sapiens
WIPTCTQLF

SEQ ID NO: 121358 - protein, 9 aa, Homo Sapiens
GVQMAHAGQ

SEQ ID NO: 121359 - protein, 9 aa, Homo Sapiens
HLGIWGEGT

SEQ ID NO: 121360 - protein, 9 aa, Homo Sapiens
DAADGAFKT

SEQ ID NO: 121361 - protein, 9 aa, Homo Sapiens
NALGMNCTL

SEQ ID NO: 121362 - protein, 9 aa, Homo Sapiens
FNSVKENLP

SEQ ID NO: 121363 - protein, 9 aa, Homo Sapiens
PNNCLTPGL

SEQ ID NO: 121364 - protein, 9 aa, Homo Sapiens
ARKNEWPLG

SEQ ID NO: 121365 - protein, 9 aa, Homo Sapiens
PVKASVVTV

SEQ ID NO: 121366 - protein, 9 aa, Homo Sapiens
QSIPKRPAG

SEQ ID NO: 121367 - protein, 9 aa, Homo Sapiens
KDEQGTENL

SEQ ID NO: 121368 - protein, 9 aa, Homo Sapiens
QSPPQRPEG

SEQ ID NO: 121369 - protein, 9 aa, Homo Sapiens
SREDVVHAM

SEQ ID NO: 121370 - protein, 9 aa, Homo Sapiens
PAAPPKCPA

SEQ ID NO: 121371 - protein, 9 aa, Homo Sapiens
QELCAQHNG

SEQ ID NO: 121372 - protein, 9 aa, Homo Sapiens
NHRYLFYSE

SEQ ID NO: 121373 - protein, 9 aa, Homo Sapiens
QPWQPLGNK

SEQ ID NO: 121374 - protein, 9 aa, Homo Sapiens
WTIRLPRKE

SEQ ID NO: 121375 - protein, 9 aa, Homo Sapiens
QPQGEQRHT

SEQ ID NO: 121376 - protein, 9 aa, Homo Sapiens
LISSLRVER

SEQ ID NO: 121377 - protein, 9 aa, Homo Sapiens
SHPPTTTTS

SEQ ID NO: 121378 - protein, 9 aa, Homo Sapiens
SLSSVWPSP

SEQ ID NO: 121379 - protein, 9 aa, Homo Sapiens
VLTSNNHLQ

SEQ ID NO: 121380 - protein, 9 aa, Homo Sapiens
IKSCWVAAC

SEQ ID NO: 121381 - protein, 9 aa, Homo Sapiens
DQKICKGCP

SEQ ID NO: 121382 - protein, 9 aa, Homo Sapiens
NIDELHHKA

SEQ ID NO: 121383 - protein, 9 aa, Homo Sapiens
WWKEHLTRL

SEQ ID NO: 121384 - protein, 9 aa, Homo Sapiens
VLPGEMIKD

SEQ ID NO: 121385 - protein, 9 aa, Homo Sapiens
PPGGKEEAQ

SEQ ID NO: 121386 - protein, 9 aa, Homo Sapiens
ILIIGDLHV

SEQ ID NO: 121387 - protein, 9 aa, Homo Sapiens
RNEESVDRN

SEQ ID NO: 121388 - protein, 9 aa, Homo Sapiens
EFRKNFVTS

SEQ ID NO: 121389 - protein, 9 aa, Homo Sapiens
SIDGSIVLS

SEQ ID NO: 121390 - protein, 9 aa, Homo Sapiens
VRAGNLQAS

SEQ ID NO: 121391 - protein, 9 aa, Homo Sapiens
TDTYYRARM

SEQ ID NO: 121392 - protein, 9 aa, Homo Sapiens
EALWQRCAI

SEQ ID NO: 121393 - protein, 9 aa, Homo Sapiens
RVVAHSDTI

SEQ ID NO: 121394 - protein, 9 aa, Homo Sapiens
LKAQSERKS

SEQ ID NO: 121395 - protein, 9 aa, Homo Sapiens
IFLILLGII

SEQ ID NO: 121396 - protein, 9 aa, Homo Sapiens
CSPLQRSFL

SEQ ID NO: 121397 - protein, 9 aa, Homo Sapiens
KEGCTGDMI

SEQ ID NO: 121398 - protein, 9 aa, Homo Sapiens
KHLKAGCRS

SEQ ID NO: 121399 - protein, 9 aa, Homo Sapiens
EDTKNNLLR

SEQ ID NO: 121400 - protein, 9 aa, Homo Sapiens
GVKYSYQQN

SEQ ID NO: 121401 - protein, 9 aa, Homo Sapiens
EANDHTQAV

SEQ ID NO: 121402 - protein, 9 aa, Homo Sapiens
MELHRQVHY

SEQ ID NO: 121403 - protein, 9 aa, Homo Sapiens
TIFDHIVRR

SEQ ID NO: 121404 - protein, 9 aa, Homo Sapiens
AILRQVHGA

SEQ ID NO: 121405 - protein, 9 aa, Homo Sapiens
LQVLVEQVA

SEQ ID NO: 121406 - protein, 9 aa, Homo Sapiens
DKTRPLSTM

SEQ ID NO: 121407 - protein, 9 aa, Homo Sapiens
PEAYCLVGY

SEQ ID NO: 121408 - protein, 9 aa, Homo Sapiens
SVDAAKPLP

SEQ ID NO: 121409 - protein, 9 aa, Homo Sapiens
MVKRAKKVT

SEQ ID NO: 121410 - protein, 9 aa, Homo Sapiens
VDAHMCIVR

SEQ ID NO: 121411 - protein, 9 aa, Homo Sapiens
QKRALLCLI

SEQ ID NO: 121412 - protein, 9 aa, Homo Sapiens
FGRRTTKSK

SEQ ID NO: 121413 - protein, 9 aa, Homo Sapiens
YLSPSFKEV

SEQ ID NO: 121414 - protein, 9 aa, Homo Sapiens
QIYMNGSPT

SEQ ID NO: 121415 - protein, 9 aa, Homo Sapiens
AVRNTHLVG

SEQ ID NO: 121416 - protein, 9 aa, Homo Sapiens
LLQQQLQQI

SEQ ID NO: 121417 - protein, 9 aa, Homo Sapiens
NKKLGEMHL

SEQ ID NO: 121418 - protein, 9 aa, Homo Sapiens
PTRRSLAPT

SEQ ID NO: 121419 - protein, 9 aa, Homo Sapiens
RPPSKTTTD

SEQ ID NO: 121420 - protein, 9 aa, Homo Sapiens
LINDQLPFL

SEQ ID NO: 121421 - protein, 9 aa, Homo Sapiens
LDACCAWSR

SEQ ID NO: 121422 - protein, 9 aa, Homo Sapiens
GDEQRDDIS

SEQ ID NO: 121423 - protein, 9 aa, Homo Sapiens
CSPSACRCP

SEQ ID NO: 121424 - protein, 9 aa, Homo Sapiens
WNDMKRIWQ

SEQ ID NO: 121425 - protein, 9 aa, Homo Sapiens
CNNTAEITI

SEQ ID NO: 121426 - protein, 9 aa, Homo Sapiens
VGDKVSLDL

SEQ ID NO: 121427 - protein, 9 aa, Homo Sapiens
LWWCGGRQT

SEQ ID NO: 121428 - protein, 9 aa, Homo Sapiens
SELVVRAIG

SEQ ID NO: 121429 - protein, 9 aa, Homo Sapiens
PGTRPRDDE

SEQ ID NO: 121430 - protein, 9 aa, Homo Sapiens
RREIVSTAK

SEQ ID NO: 121431 - protein, 9 aa, Homo Sapiens
NYYNFLQCT

SEQ ID NO: 121432 - protein, 9 aa, Homo Sapiens
RRSCISVAT

SEQ ID NO: 121433 - protein, 9 aa, Homo Sapiens
STMTSCSMA

SEQ ID NO: 121434 - protein, 9 aa, Homo Sapiens
VIRVDRSLL

SEQ ID NO: 121435 - protein, 9 aa, Homo Sapiens
PMFQPTWKN

SEQ ID NO: 121436 - protein, 9 aa, Homo Sapiens
FLPCGDTRI

SEQ ID NO: 121437 - protein, 9 aa, Homo Sapiens
EESVDRNEE

SEQ ID NO: 121438 - protein, 9 aa, Homo Sapiens
LCGRCGATS

SEQ ID NO: 121439 - protein, 9 aa, Homo Sapiens
LSPPEYFGS

SEQ ID NO: 121440 - protein, 9 aa, Homo Sapiens
LLGLYLMSL

SEQ ID NO: 121441 - protein, 9 aa, Homo Sapiens
HHEQLVDRS

SEQ ID NO: 121442 - protein, 9 aa, Homo Sapiens
SRRMQNDTT

SEQ ID NO: 121443 - protein, 9 aa, Homo Sapiens
RWIVFSVKE

SEQ ID NO: 121444 - protein, 9 aa, Homo Sapiens
GYRMRCILQ

SEQ ID NO: 121445 - protein, 9 aa, Homo Sapiens
LNIKERTQG

SEQ ID NO: 121446 - protein, 9 aa, Homo Sapiens
APDGQPQGE

SEQ ID NO: 121447 - protein, 9 aa, Homo Sapiens
HPADRGPPE

SEQ ID NO: 121448 - protein, 9 aa, Homo Sapiens
WSQPDQTNG

SEQ ID NO: 121449 - protein, 9 aa, Homo Sapiens
LSLFFVMMK

SEQ ID NO: 121450 - protein, 9 aa, Homo Sapiens
SVRSTRKVS

SEQ ID NO: 121451 - protein, 9 aa, Homo Sapiens
KSKKTLNWK

SEQ ID NO: 121452 - protein, 9 aa, Homo Sapiens
TRKKDLYDV

SEQ ID NO: 121453 - protein, 9 aa, Homo Sapiens
KVTCFGMLL

SEQ ID NO: 121454 - protein, 9 aa, Homo Sapiens
TASAATSRG

SEQ ID NO: 121455 - protein, 9 aa, Homo Sapiens
AFSYSSVFR

SEQ ID NO: 121456 - protein, 9 aa, Homo Sapiens
VLPVAKLAI

SEQ ID NO: 121457 - protein, 9 aa, Homo Sapiens
GMFWAAYSA

SEQ ID NO: 121458 - protein, 9 aa, Homo Sapiens
RRRKFHRPT

SEQ ID NO: 121459 - protein, 9 aa, Homo Sapiens
TSDTPKVSS

SEQ ID NO: 121460 - protein, 9 aa, Homo Sapiens
LCIPLLITV

SEQ ID NO: 121461 - protein, 9 aa, Homo Sapiens
SKMEIPPCR

SEQ ID NO: 121462 - protein, 9 aa, Homo Sapiens
EARSKMVLS

SEQ ID NO: 121463 - protein, 9 aa, Homo Sapiens
GKWDYVCEK

SEQ ID NO: 121464 - protein, 9 aa, Homo Sapiens
HNLDIERPT

SEQ ID NO: 121465 - protein, 9 aa, Homo Sapiens
AFLTVGTMW

SEQ ID NO: 121466 - protein, 9 aa, Homo Sapiens
LLRAICQKV

SEQ ID NO: 121467 - protein, 9 aa, Homo Sapiens
QGFRDAVVT

SEQ ID NO: 121468 - protein, 9 aa, Homo Sapiens
VEVIGGAGK

SEQ ID NO: 121469 - protein, 9 aa, Homo Sapiens
ESHMKGCDT

SEQ ID NO: 121470 - protein, 9 aa, Homo Sapiens
AEPFLTQAR

SEQ ID NO: 121471 - protein, 9 aa, Homo Sapiens
VQTTNEVKQ

SEQ ID NO: 121472 - protein, 9 aa, Homo Sapiens
PTPQFGRRT

SEQ ID NO: 121473 - protein, 9 aa, Homo Sapiens
PMHSHHRPH

SEQ ID NO: 121474 - protein, 9 aa, Homo Sapiens
NHAQLLRRS

SEQ ID NO: 121475 - protein, 9 aa, Homo Sapiens
MPPSTSAVD

SEQ ID NO: 121476 - protein, 9 aa, Homo Sapiens
VQSPEPSVI

SEQ ID NO: 121477 - protein, 9 aa, Homo Sapiens
YDRYLARHQ

SEQ ID NO: 121478 - protein, 9 aa, Homo Sapiens
MGTIGFNQR

SEQ ID NO: 121479 - protein, 9 aa, Homo Sapiens
TGNPPVTYP

SEQ ID NO: 121480 - protein, 9 aa, Homo Sapiens
VKQTQYSSI

SEQ ID NO: 121481 - protein, 9 aa, Homo Sapiens
IYKIGQGCL

SEQ ID NO: 121482 - protein, 9 aa, Homo Sapiens
VEELNEEFT

SEQ ID NO: 121483 - protein, 9 aa, Homo Sapiens
AVWYRAVGD

SEQ ID NO: 121484 - protein, 9 aa, Homo Sapiens
SHLVRSILT

SEQ ID NO: 121485 - protein, 9 aa, Homo Sapiens
RYCSTLDSF

SEQ ID NO: 121486 - protein, 9 aa, Homo Sapiens
EYINQSIPK

SEQ ID NO: 121487 - protein, 9 aa, Homo Sapiens
TRPWSSLER

SEQ ID NO: 121488 - protein, 9 aa, Homo Sapiens
EHFVQNCIS

SEQ ID NO: 121489 - protein, 9 aa, Homo Sapiens
VGLAKLLLG

SEQ ID NO: 121490 - protein, 9 aa, Homo Sapiens
SGISSIRAG

SEQ ID NO: 121491 - protein, 9 aa, Homo Sapiens
IPKRPAGSV

SEQ ID NO: 121492 - protein, 9 aa, Homo Sapiens
SDALMVTTY

SEQ ID NO: 121493 - protein, 9 aa, Homo Sapiens
TVLLFCIWM

SEQ ID NO: 121494 - protein, 9 aa, Homo Sapiens
ECRILPKCH

SEQ ID NO: 121495 - protein, 9 aa, Homo Sapiens
ADGEDAMAQ

SEQ ID NO: 121496 - protein, 9 aa, Homo Sapiens
RPSARSKAN

SEQ ID NO: 121497 - protein, 9 aa, Homo Sapiens
PNCDVSHGQ

SEQ ID NO: 121498 - protein, 9 aa, Homo Sapiens
HSRDDELPA

SEQ ID NO: 121499 - protein, 9 aa, Homo Sapiens
YLDMVIAEM

SEQ ID NO: 121500 - protein, 9 aa, Homo Sapiens
TALAAAAQP

SEQ ID NO: 121501 - protein, 9 aa, Homo Sapiens
YKNLQYGIE

SEQ ID NO: 121502 - protein, 9 aa, Homo Sapiens
TFYKRAACG

SEQ ID NO: 121503 - protein, 9 aa, Homo Sapiens
FSKLSQVVR

SEQ ID NO: 121504 - protein, 9 aa, Homo Sapiens
FSKIKQAGL

SEQ ID NO: 121505 - protein, 9 aa, Homo Sapiens
PSVKSQPLL

SEQ ID NO: 121506 - protein, 9 aa, Homo Sapiens
DTLYVSTTK

SEQ ID NO: 121507 - protein, 9 aa, Homo Sapiens
SPSLESGGA

SEQ ID NO: 121508 - protein, 9 aa, Homo Sapiens
AVILKRVKA

SEQ ID NO: 121509 - protein, 9 aa, Homo Sapiens
YVFSLAELG

SEQ ID NO: 121510 - protein, 9 aa, Homo Sapiens
INDQLPFLV

SEQ ID NO: 121511 - protein, 9 aa, Homo Sapiens
EARGRLPHP

SEQ ID NO: 121512 - protein, 9 aa, Homo Sapiens
DHGLLHVRM

SEQ ID NO: 121513 - protein, 9 aa, Homo Sapiens
AGFVESAES

SEQ ID NO: 121514 - protein, 9 aa, Homo Sapiens
EFQLTKHLW

SEQ ID NO: 121515 - protein, 9 aa, Homo Sapiens
FLMTTFWKT

SEQ ID NO: 121516 - protein, 9 aa, Homo Sapiens
SEQDGPAPA

SEQ ID NO: 121517 - protein, 9 aa, Homo Sapiens
KVKDVQQVE

SEQ ID NO: 121518 - protein, 9 aa, Homo Sapiens
PDAPPPKEP

SEQ ID NO: 121519 - protein, 9 aa, Homo Sapiens
HPGPLKIRA

SEQ ID NO: 121520 - protein, 9 aa, Homo Sapiens
TIPDGVPIY

SEQ ID NO: 121521 - protein, 9 aa, Homo Sapiens
RKYQDLEIK

SEQ ID NO: 121522 - protein, 9 aa, Homo Sapiens
LVPRLECSG

SEQ ID NO: 121523 - protein, 9 aa, Homo Sapiens
FCFRQCRYL

SEQ ID NO: 121524 - protein, 9 aa, Homo Sapiens
PSCSGCHTP

SEQ ID NO: 121525 - protein, 9 aa, Homo Sapiens
FGSANIFSE

SEQ ID NO: 121526 - protein, 9 aa, Homo Sapiens
REAAEKKKE

SEQ ID NO: 121527 - protein, 9 aa, Homo Sapiens
SACPGHVDA

SEQ ID NO: 121528 - protein, 9 aa, Homo Sapiens
PLPPNSSSS

SEQ ID NO: 121529 - protein, 9 aa, Homo Sapiens
VTLAHLDLL

SEQ ID NO: 121530 - protein, 9 aa, Homo Sapiens
EYDAHAVDI

SEQ ID NO: 121531 - protein, 9 aa, Homo Sapiens
LNFHRSPRI

SEQ ID NO: 121532 - protein, 9 aa, Homo Sapiens
MAYRLIMPP

SEQ ID NO: 121533 - protein, 9 aa, Homo Sapiens
VAGTAGARH

SEQ ID NO: 121534 - protein, 9 aa, Homo Sapiens
KGRGLPRTN

SEQ ID NO: 121535 - protein, 9 aa, Homo Sapiens
FQEEPMTGF

SEQ ID NO: 121536 - protein, 9 aa, Homo Sapiens
VGPEKKTWY

SEQ ID NO: 121537 - protein, 9 aa, Homo Sapiens
LKCQLEHNA

SEQ ID NO: 121538 - protein, 9 aa, Homo Sapiens
IVKRHYAFQ

SEQ ID NO: 121539 - protein, 9 aa, Homo Sapiens
CFNIFFYDP

SEQ ID NO: 121540 - protein, 9 aa, Homo Sapiens
RESVLQKMK

SEQ ID NO: 121541 - protein, 9 aa, Homo Sapiens
ILSLVTREK

SEQ ID NO: 121542 - protein, 9 aa, Homo Sapiens
DKDAMNATI

SEQ ID NO: 121543 - protein, 9 aa, Homo Sapiens
TSHDAALEP

SEQ ID NO: 121544 - protein, 9 aa, Homo Sapiens
SEYPENKRY

SEQ ID NO: 121545 - protein, 9 aa, Homo Sapiens
CENRHHYTE

SEQ ID NO: 121546 - protein, 9 aa, Homo Sapiens
RSQRLPWAG

SEQ ID NO: 121547 - protein, 9 aa, Homo Sapiens
YTRWLQKSK

SEQ ID NO: 121548 - protein, 9 aa, Homo Sapiens
LVSCPNYSY

SEQ ID NO: 121549 - protein, 9 aa, Homo Sapiens
FRPPSKTTT

SEQ ID NO: 121550 - protein, 9 aa, Homo Sapiens
LSAIQNREI

SEQ ID NO: 121551 - protein, 9 aa, Homo Sapiens
VLGLFFHAP

SEQ ID NO: 121552 - protein, 9 aa, Homo Sapiens
ALLAPSSCP

SEQ ID NO: 121553 - protein, 9 aa, Homo Sapiens
AQLNGLTLK

SEQ ID NO: 121554 - protein, 9 aa, Homo Sapiens
KTTTKKILC

SEQ ID NO: 121555 - protein, 9 aa, Homo Sapiens
NQELIEKKE

SEQ ID NO: 121556 - protein, 9 aa, Homo Sapiens
HQIQHALIV

SEQ ID NO: 121557 - protein, 9 aa, Homo Sapiens
SQELCVIYV

SEQ ID NO: 121558 - protein, 9 aa, Homo Sapiens
FNNFIFNGN

SEQ ID NO: 121559 - protein, 9 aa, Homo Sapiens
LTMDMPQVN

SEQ ID NO: 121560 - protein, 9 aa, Homo Sapiens
CDFLVRGGS

SEQ ID NO: 121561 - protein, 9 aa, Homo Sapiens
EYARYYEGR

SEQ ID NO: 121562 - protein, 9 aa, Homo Sapiens
LQDAHQLLS

SEQ ID NO: 121563 - protein, 9 aa, Homo Sapiens
LKGGCRPGR

SEQ ID NO: 121564 - protein, 9 aa, Homo Sapiens
HRKRMEKDP

SEQ ID NO: 121565 - protein, 9 aa, Homo Sapiens
YSRLKASCQ

SEQ ID NO: 121566 - protein, 9 aa, Homo Sapiens
RHRYVYVCI

SEQ ID NO: 121567 - protein, 9 aa, Homo Sapiens
FYKRAACGS

SEQ ID NO: 121568 - protein, 9 aa, Homo Sapiens
TVSPSLRKQ

SEQ ID NO: 121569 - protein, 9 aa, Homo Sapiens
SAIIQHGKI

SEQ ID NO: 121570 - protein, 9 aa, Homo Sapiens
ADCQPGTGF

SEQ ID NO: 121571 - protein, 9 aa, Homo Sapiens
TPLGCIQAA

SEQ ID NO: 121572 - protein, 9 aa, Homo Sapiens
FSKPNVISQ

SEQ ID NO: 121573 - protein, 9 aa, Homo Sapiens
TWYLLAVDF

SEQ ID NO: 121574 - protein, 9 aa, Homo Sapiens
RKQHPWHPA

SEQ ID NO: 121575 - protein, 9 aa, Homo Sapiens
KRYRFLLLE

SEQ ID NO: 121576 - protein, 9 aa, Homo Sapiens
FGKAILTRY

SEQ ID NO: 121577 - protein, 9 aa, Homo Sapiens
LSPSTPDFS

SEQ ID NO: 121578 - protein, 9 aa, Homo Sapiens
ATYYLYMKC

SEQ ID NO: 121579 - protein, 9 aa, Homo Sapiens
QNIDELHHK

SEQ ID NO: 121580 - protein, 9 aa, Homo Sapiens
HTWLLDVEP

SEQ ID NO: 121581 - protein, 9 aa, Homo Sapiens
LICRSMEVL

SEQ ID NO: 121582 - protein, 9 aa, Homo Sapiens
RSLPALGLV

SEQ ID NO: 121583 - protein, 9 aa, Homo Sapiens
SSSRLPPTY

SEQ ID NO: 121584 - protein, 9 aa, Homo Sapiens
FPSSFFIQD

SEQ ID NO: 121585 - protein, 9 aa, Homo Sapiens
GGAAPGPEG

SEQ ID NO: 121586 - protein, 9 aa, Homo Sapiens
SSAPRPGAA

SEQ ID NO: 121587 - protein, 9 aa, Homo Sapiens
VMFLSATHR

SEQ ID NO: 121588 - protein, 9 aa, Homo Sapiens
DAIGPREQC

SEQ ID NO: 121589 - protein, 9 aa, Homo Sapiens
SRKSASVAT

SEQ ID NO: 121590 - protein, 9 aa, Homo Sapiens
TTENETTEK

SEQ ID NO: 121591 - protein, 9 aa, Homo Sapiens
SWATGELGG

SEQ ID NO: 121592 - protein, 9 aa, Homo Sapiens
RLDFPEATE

SEQ ID NO: 121593 - protein, 9 aa, Homo Sapiens
VWRRVWSRS

SEQ ID NO: 121594 - protein, 9 aa, Homo Sapiens
DGDRRLIGG

SEQ ID NO: 121595 - protein, 9 aa, Homo Sapiens
KTGINMSLL

SEQ ID NO: 121596 - protein, 9 aa, Homo Sapiens
LACEHHSPT

SEQ ID NO: 121597 - protein, 9 aa, Homo Sapiens
KDLTTEIMQ

SEQ ID NO: 121598 - protein, 9 aa, Homo Sapiens
CLTDELCLH

SEQ ID NO: 121599 - protein, 9 aa, Homo Sapiens
KASIPTSLV

SEQ ID NO: 121600 - protein, 9 aa, Homo Sapiens
STPGSGPSS

SEQ ID NO: 121601 - protein, 9 aa, Homo Sapiens
MKLSILRSN

SEQ ID NO: 121602 - protein, 9 aa, Homo Sapiens
GPLPASHPL

SEQ ID NO: 121603 - protein, 9 aa, Homo Sapiens
RKYARKICC

SEQ ID NO: 121604 - protein, 9 aa, Homo Sapiens
GAEEAAESL

SEQ ID NO: 121605 - protein, 9 aa, Homo Sapiens
LTSNNHLQQ

SEQ ID NO: 121606 - protein, 9 aa, Homo Sapiens
AHLACEHHS

SEQ ID NO: 121607 - protein, 9 aa, Homo Sapiens
TKNNLLRQQ

SEQ ID NO: 121608 - protein, 9 aa, Homo Sapiens
CGLCVGYNS

SEQ ID NO: 121609 - protein, 9 aa, Homo Sapiens
HGRVILGQG

SEQ ID NO: 121610 - protein, 9 aa, Homo Sapiens
AMVWKDAAT

SEQ ID NO: 121611 - protein, 9 aa, Homo Sapiens
LMVDSDVAF

SEQ ID NO: 121612 - protein, 9 aa, Homo Sapiens
HCRGAATSA

SEQ ID NO: 121613 - protein, 9 aa, Homo Sapiens
AKRRGSSPP

SEQ ID NO: 121614 - protein, 9 aa, Homo Sapiens
YTLHVTTIF

SEQ ID NO: 121615 - protein, 9 aa, Homo Sapiens
VEELKKKIR

SEQ ID NO: 121616 - protein, 9 aa, Homo Sapiens
EPAILLLGD

SEQ ID NO: 121617 - protein, 9 aa, Homo Sapiens
RCGWWRLLC

SEQ ID NO: 121618 - protein, 9 aa, Homo Sapiens
EKNGKRRLI

SEQ ID NO: 121619 - protein, 9 aa, Homo Sapiens
NGYRCAALN

SEQ ID NO: 121620 - protein, 9 aa, Homo Sapiens
VCKVNTDLL

SEQ ID NO: 121621 - protein, 9 aa, Homo Sapiens
FSFSRSQRD

SEQ ID NO: 121622 - protein, 9 aa, Homo Sapiens
GCSLEKLPV

SEQ ID NO: 121623 - protein, 9 aa, Homo Sapiens
VEKTGESVQ

SEQ ID NO: 121624 - protein, 9 aa, Homo Sapiens
YVAICKHLL

SEQ ID NO: 121625 - protein, 9 aa, Homo Sapiens
TSTNIWPHG

SEQ ID NO: 121626 - protein, 9 aa, Homo Sapiens
VCVGAQHDQ

SEQ ID NO: 121627 - protein, 9 aa, Homo Sapiens
STLPALCPW

SEQ ID NO: 121628 - protein, 9 aa, Homo Sapiens
WLLSPSRKR

SEQ ID NO: 121629 - protein, 9 aa, Homo Sapiens
QWENGASLD

SEQ ID NO: 121630 - protein, 9 aa, Homo Sapiens
IPIARSLQK

SEQ ID NO: 121631 - protein, 9 aa, Homo Sapiens
ILRFCPKIL

SEQ ID NO: 121632 - protein, 9 aa, Homo Sapiens
SEEGYYPEL

SEQ ID NO: 121633 - protein, 9 aa, Homo Sapiens
NVMNVGSHS

SEQ ID NO: 121634 - protein, 9 aa, Homo Sapiens
KMPYEPSTP

SEQ ID NO: 121635 - protein, 9 aa, Homo Sapiens
DNLNPVLRD

SEQ ID NO: 121636 - protein, 9 aa, Homo Sapiens
AAEIFATEI

SEQ ID NO: 121637 - protein, 9 aa, Homo Sapiens
LLRLPWLML

SEQ ID NO: 121638 - protein, 9 aa, Homo Sapiens
IPEQSFYTN

SEQ ID NO: 121639 - protein, 9 aa, Homo Sapiens
FSDLSQPRK

SEQ ID NO: 121640 - protein, 9 aa, Homo Sapiens
EAQGILWTI

SEQ ID NO: 121641 - protein, 9 aa, Homo Sapiens
SPSSSLSYN

SEQ ID NO: 121642 - protein, 9 aa, Homo Sapiens
RSKIEASPI

SEQ ID NO: 121643 - protein, 9 aa, Homo Sapiens
TSREDVVHA

SEQ ID NO: 121644 - protein, 9 aa, Homo Sapiens
RPAHTDIKT

SEQ ID NO: 121645 - protein, 9 aa, Homo Sapiens
PPVTLGRGR

SEQ ID NO: 121646 - protein, 9 aa, Homo Sapiens
GDLHVVHHH

SEQ ID NO: 121647 - protein, 9 aa, Homo Sapiens
SETERIFEL

SEQ ID NO: 121648 - protein, 9 aa, Homo Sapiens
SSILITSMG

SEQ ID NO: 121649 - protein, 9 aa, Homo Sapiens
QKTFWTERP

SEQ ID NO: 121650 - protein, 9 aa, Homo Sapiens
EHFRTTVGS

SEQ ID NO: 121651 - protein, 9 aa, Homo Sapiens
RSRELLRHH

SEQ ID NO: 121652 - protein, 9 aa, Homo Sapiens
HQCQPWSPT

SEQ ID NO: 121653 - protein, 9 aa, Homo Sapiens
QHPPLIHCY

SEQ ID NO: 121654 - protein, 9 aa, Homo Sapiens
GASLDDPPK

SEQ ID NO: 121655 - protein, 9 aa, Homo Sapiens
CSTMSCLSR

SEQ ID NO: 121656 - protein, 9 aa, Homo Sapiens
DHSINYCET

SEQ ID NO: 121657 - protein, 9 aa, Homo Sapiens
KDVLCEILS

SEQ ID NO: 121658 - protein, 9 aa, Homo Sapiens
WALAHLVPT

SEQ ID NO: 121659 - protein, 9 aa, Homo Sapiens
RKRLREEEV

SEQ ID NO: 121660 - protein, 9 aa, Homo Sapiens
RATQPHRLH

SEQ ID NO: 121661 - protein, 9 aa, Homo Sapiens
RARKGREER

SEQ ID NO: 121662 - protein, 9 aa, Homo Sapiens
NKCKAMEAA

SEQ ID NO: 121663 - protein, 9 aa, Homo Sapiens
PASRGPSTG

SEQ ID NO: 121664 - protein, 9 aa, Homo Sapiens
YISILEMLL

SEQ ID NO: 121665 - protein, 9 aa, Homo Sapiens
ICGFLVIEE

SEQ ID NO: 121666 - protein, 9 aa, Homo Sapiens
VPTREPQHP

SEQ ID NO: 121667 - protein, 9 aa, Homo Sapiens
TLCVVPIAQ

SEQ ID NO: 121668 - protein, 9 aa, Homo Sapiens
SAQGVSSAP

SEQ ID NO: 121669 - protein, 9 aa, Homo Sapiens
KGGPLSPCK

SEQ ID NO: 121670 - protein, 9 aa, Homo Sapiens
PFLRDYVNC

SEQ ID NO: 121671 - protein, 9 aa, Homo Sapiens
LVAMPPGAS

SEQ ID NO: 121672 - protein, 9 aa, Homo Sapiens
VVCVACEKK

SEQ ID NO: 121673 - protein, 9 aa, Homo Sapiens
ILAEELQKN

SEQ ID NO: 121674 - protein, 9 aa, Homo Sapiens
RSDGRSRIR

SEQ ID NO: 121675 - protein, 9 aa, Homo Sapiens
TQAVGGMRR

SEQ ID NO: 121676 - protein, 9 aa, Homo Sapiens
EMNKCKAME

SEQ ID NO: 121677 - protein, 9 aa, Homo Sapiens
KPFLRDYVN

SEQ ID NO: 121678 - protein, 9 aa, Homo Sapiens
VSLPAEPSP

SEQ ID NO: 121679 - protein, 9 aa, Homo Sapiens
VLTTRKERK

SEQ ID NO: 121680 - protein, 9 aa, Homo Sapiens
PPSGTPPSP

SEQ ID NO: 121681 - protein, 9 aa, Homo Sapiens
PQPAGVSCC

SEQ ID NO: 121682 - protein, 9 aa, Homo Sapiens
NDMKRIWQY

SEQ ID NO: 121683 - protein, 9 aa, Homo Sapiens
EAEQASVRH

SEQ ID NO: 121684 - protein, 9 aa, Homo Sapiens
LLGGCSGLP

SEQ ID NO: 121685 - protein, 9 aa, Homo Sapiens
NPATAFFSV

SEQ ID NO: 121686 - protein, 9 aa, Homo Sapiens
GMRELCQGL

SEQ ID NO: 121687 - protein, 9 aa, Homo Sapiens
VLRREIVST

SEQ ID NO: 121688 - protein, 9 aa, Homo Sapiens
LAFIIRSFD

SEQ ID NO: 121689 - protein, 9 aa, Homo Sapiens
KSLGLSSYC

SEQ ID NO: 121690 - protein, 9 aa, Homo Sapiens
SIKDSVMFL

SEQ ID NO: 121691 - protein, 9 aa, Homo Sapiens
NFFLLCGNH

SEQ ID NO: 121692 - protein, 9 aa, Homo Sapiens
WQQLSEREA

SEQ ID NO: 121693 - protein, 9 aa, Homo Sapiens
SNCLVSLDS

SEQ ID NO: 121694 - protein, 9 aa, Homo Sapiens
DICHRVLEA

SEQ ID NO: 121695 - protein, 9 aa, Homo Sapiens
GRPVPDGDG

SEQ ID NO: 121696 - protein, 9 aa, Homo Sapiens
LHRPTLSPA

SEQ ID NO: 121697 - protein, 9 aa, Homo Sapiens
LKSRIALNF

SEQ ID NO: 121698 - protein, 9 aa, Homo Sapiens
HVLLCLAVF

SEQ ID NO: 121699 - protein, 9 aa, Homo Sapiens
PLFPYAVPL

SEQ ID NO: 121700 - protein, 9 aa, Homo Sapiens
GTVDTPPAC

SEQ ID NO: 121701 - protein, 9 aa, Homo Sapiens
CLAGMIVKF

SEQ ID NO: 121702 - protein, 9 aa, Homo Sapiens
LIANNNQLG

SEQ ID NO: 121703 - protein, 9 aa, Homo Sapiens
LPAPLNSHA

SEQ ID NO: 121704 - protein, 9 aa, Homo Sapiens
LALEVLLSK

SEQ ID NO: 121705 - protein, 9 aa, Homo Sapiens
ILTSEDSNA

SEQ ID NO: 121706 - protein, 9 aa, Homo Sapiens
RDDELFGQT

SEQ ID NO: 121707 - protein, 9 aa, Homo Sapiens
KVSTMTSCS

SEQ ID NO: 121708 - protein, 9 aa, Homo Sapiens
WVFAIRRPP

SEQ ID NO: 121709 - protein, 9 aa, Homo Sapiens
CADSQSHIM

SEQ ID NO: 121710 - protein, 9 aa, Homo Sapiens
DLLDFVLSA

SEQ ID NO: 121711 - protein, 9 aa, Homo Sapiens
GMRMQTFQV

SEQ ID NO: 121712 - protein, 9 aa, Homo Sapiens
VTSFLTETS

SEQ ID NO: 121713 - protein, 9 aa, Homo Sapiens
NSHAHEDPG

SEQ ID NO: 121714 - protein, 9 aa, Homo Sapiens
PTDYARWWE

SEQ ID NO: 121715 - protein, 9 aa, Homo Sapiens
QRPEGPGQI

SEQ ID NO: 121716 - protein, 9 aa, Homo Sapiens
CFLRRRSGL

SEQ ID NO: 121717 - protein, 9 aa, Homo Sapiens
VKLGSVADF

SEQ ID NO: 121718 - protein, 9 aa, Homo Sapiens
QIYIVLTTR

SEQ ID NO: 121719 - protein, 9 aa, Homo Sapiens
TLGSFPLYL

SEQ ID NO: 121720 - protein, 9 aa, Homo Sapiens
DAHMCIVRA

SEQ ID NO: 121721 - protein, 9 aa, Homo Sapiens
QAVVEKVRR

SEQ ID NO: 121722 - protein, 9 aa, Homo Sapiens
LTKMMKRAV

SEQ ID NO: 121723 - protein, 9 aa, Homo Sapiens
WRSKGADLE

SEQ ID NO: 121724 - protein, 9 aa, Homo Sapiens
YAVPLPHAL

SEQ ID NO: 121725 - protein, 9 aa, Homo Sapiens
LASTILSDP

SEQ ID NO: 121726 - protein, 9 aa, Homo Sapiens
IGINGVQNY

SEQ ID NO: 121727 - protein, 9 aa, Homo Sapiens
GYSVRQSVP

SEQ ID NO: 121728 - protein, 9 aa, Homo Sapiens
SNLGPCCEA

SEQ ID NO: 121729 - protein, 9 aa, Homo Sapiens
GRMGGRHPS

SEQ ID NO: 121730 - protein, 9 aa, Homo Sapiens
SWDKYGLTS

SEQ ID NO: 121731 - protein, 9 aa, Homo Sapiens
AYCLVGYEV

SEQ ID NO: 121732 - protein, 9 aa, Homo Sapiens
YYACATQLA

SEQ ID NO: 121733 - protein, 9 aa, Homo Sapiens
NNETPEERE

SEQ ID NO: 121734 - protein, 9 aa, Homo Sapiens
LLTLARPFT

SEQ ID NO: 121735 - protein, 9 aa, Homo Sapiens
LITVGRIDR

SEQ ID NO: 121736 - protein, 9 aa, Homo Sapiens
LSFRVFCLL

SEQ ID NO: 121737 - protein, 9 aa, Homo Sapiens
HHNLSQSPR

SEQ ID NO: 121738 - protein, 9 aa, Homo Sapiens
HRTGPRSPD

SEQ ID NO: 121739 - protein, 9 aa, Homo Sapiens
GRGEAGRPV

SEQ ID NO: 121740 - protein, 9 aa, Homo Sapiens
QSPSVPKKT

SEQ ID NO: 121741 - protein, 9 aa, Homo Sapiens
YELQMWVCN

SEQ ID NO: 121742 - protein, 9 aa, Homo Sapiens
GGNRSICLT

SEQ ID NO: 121743 - protein, 9 aa, Homo Sapiens
LDSHKLPMI

SEQ ID NO: 121744 - protein, 9 aa, Homo Sapiens
NSNPYPRRE

SEQ ID NO: 121745 - protein, 9 aa, Homo Sapiens
CCLEMHMRG

SEQ ID NO: 121746 - protein, 9 aa, Homo Sapiens
MWRVGNLCK

SEQ ID NO: 121747 - protein, 9 aa, Homo Sapiens
CISEGEDVT

SEQ ID NO: 121748 - protein, 9 aa, Homo Sapiens
SLDLAPALA

SEQ ID NO: 121749 - protein, 9 aa, Homo Sapiens
WSRTCKPRC

SEQ ID NO: 121750 - protein, 9 aa, Homo Sapiens
FTDNDQGSM

SEQ ID NO: 121751 - protein, 9 aa, Homo Sapiens
ATPSCCRRW

SEQ ID NO: 121752 - protein, 9 aa, Homo Sapiens
FPYGHLHVS

SEQ ID NO: 121753 - protein, 9 aa, Homo Sapiens
PGTPGHPSA

SEQ ID NO: 121754 - protein, 9 aa, Homo Sapiens
IFPKGLPEG

SEQ ID NO: 121755 - protein, 9 aa, Homo Sapiens
FLTQARLAW

SEQ ID NO: 121756 - protein, 9 aa, Homo Sapiens
SGGAPAPPA

SEQ ID NO: 121757 - protein, 9 aa, Homo Sapiens
LEKTMELDS

SEQ ID NO: 121758 - protein, 9 aa, Homo Sapiens
SRSLFFCGA

SEQ ID NO: 121759 - protein, 9 aa, Homo Sapiens
DLRSKSVDK

SEQ ID NO: 121760 - protein, 9 aa, Homo Sapiens
TISAHYNFS

SEQ ID NO: 121761 - protein, 9 aa, Homo Sapiens
TTAVLHGAP

SEQ ID NO: 121762 - protein, 9 aa, Homo Sapiens
HRPTLSPAI

SEQ ID NO: 121763 - protein, 9 aa, Homo Sapiens
ENFPQQHCA

SEQ ID NO: 121764 - protein, 9 aa, Homo Sapiens
SPILYAWQV

SEQ ID NO: 121765 - protein, 9 aa, Homo Sapiens
PIQTNVVPM

SEQ ID NO: 121766 - protein, 9 aa, Homo Sapiens
LDAYSIQRQ

SEQ ID NO: 121767 - protein, 9 aa, Homo Sapiens
EFLYKSKKT

SEQ ID NO: 121768 - protein, 9 aa, Homo Sapiens
PDPHGQGGQ

SEQ ID NO: 121769 - protein, 9 aa, Homo Sapiens
KDCRGCVLV

SEQ ID NO: 121770 - protein, 9 aa, Homo Sapiens
RNLDFAPGM

SEQ ID NO: 121771 - protein, 9 aa, Homo Sapiens
EINSDLVSV

SEQ ID NO: 121772 - protein, 9 aa, Homo Sapiens
AERTAAAHG

SEQ ID NO: 121773 - protein, 9 aa, Homo Sapiens
EIATEAYED

SEQ ID NO: 121774 - protein, 9 aa, Homo Sapiens
EFPVLLSDT

SEQ ID NO: 121775 - protein, 9 aa, Homo Sapiens
HTHTWRARS

SEQ ID NO: 121776 - protein, 9 aa, Homo Sapiens
DPPCPLAAR

SEQ ID NO: 121777 - protein, 9 aa, Homo Sapiens
FLRALVDYA

SEQ ID NO: 121778 - protein, 9 aa, Homo Sapiens
STSVRLVSQ

SEQ ID NO: 121779 - protein, 9 aa, Homo Sapiens
VVTQRPPPT

SEQ ID NO: 121780 - protein, 9 aa, Homo Sapiens
PGDLQPPDG

SEQ ID NO: 121781 - protein, 9 aa, Homo Sapiens
CPTTSTCTR

SEQ ID NO: 121782 - protein, 9 aa, Homo Sapiens
DDDEKRWIV

SEQ ID NO: 121783 - protein, 9 aa, Homo Sapiens
GATPGTHRV

SEQ ID NO: 121784 - protein, 9 aa, Homo Sapiens
SDVHRPPVL

SEQ ID NO: 121785 - protein, 9 aa, Homo Sapiens
CGYKLCGRT

SEQ ID NO: 121786 - protein, 9 aa, Homo Sapiens
LSKSAQLNG

SEQ ID NO: 121787 - protein, 9 aa, Homo Sapiens
GSPIHGQHE

SEQ ID NO: 121788 - protein, 9 aa, Homo Sapiens
RLQQRLEDE

SEQ ID NO: 121789 - protein, 9 aa, Homo Sapiens
FLVAAALCI

SEQ ID NO: 121790 - protein, 9 aa, Homo Sapiens
KLARDATAL

SEQ ID NO: 121791 - protein, 9 aa, Homo Sapiens
EHRGMFRED

SEQ ID NO: 121792 - protein, 9 aa, Homo Sapiens
VHHQGGGHS

SEQ ID NO: 121793 - protein, 9 aa, Homo Sapiens
PPHVDEEPE

SEQ ID NO: 121794 - protein, 9 aa, Homo Sapiens
PRLDTGCSV

SEQ ID NO: 121795 - protein, 9 aa, Homo Sapiens
VTYPGLSTV

SEQ ID NO: 121796 - protein, 9 aa, Homo Sapiens
FLLFTWQVF

SEQ ID NO: 121797 - protein, 9 aa, Homo Sapiens
TRLNMGILG

SEQ ID NO: 121798 - protein, 9 aa, Homo Sapiens
THRASEPLP

SEQ ID NO: 121799 - protein, 9 aa, Homo Sapiens
SVNLDSLGL

SEQ ID NO: 121800 - protein, 9 aa, Homo Sapiens
AEVQSETER

SEQ ID NO: 121801 - protein, 9 aa, Homo Sapiens
TAKVCGAAS

SEQ ID NO: 121802 - protein, 9 aa, Homo Sapiens
LYKSKKTLN

SEQ ID NO: 121803 - protein, 9 aa, Homo Sapiens
YRRPQRLWK

SEQ ID NO: 121804 - protein, 9 aa, Homo Sapiens
SSMACGSAE

SEQ ID NO: 121805 - protein, 9 aa, Homo Sapiens
GVTKVHGRD

SEQ ID NO: 121806 - protein, 9 aa, Homo Sapiens
GDVGKSALT

SEQ ID NO: 121807 - protein, 9 aa, Homo Sapiens
KRQIRRECW

SEQ ID NO: 121808 - protein, 9 aa, Homo Sapiens
GCPQYLAVL

SEQ ID NO: 121809 - protein, 9 aa, Homo Sapiens
SLQEIRERQ

SEQ ID NO: 121810 - protein, 9 aa, Homo Sapiens
GDSPRGSTS

SEQ ID NO: 121811 - protein, 9 aa, Homo Sapiens
SPSKLSPKT

SEQ ID NO: 121812 - protein, 9 aa, Homo Sapiens
NAKCASLKK

SEQ ID NO: 121813 - protein, 9 aa, Homo Sapiens
QAAANVLHG

SEQ ID NO: 121814 - protein, 9 aa, Homo Sapiens
QWVLTATHC

SEQ ID NO: 121815 - protein, 9 aa, Homo Sapiens
NLCKSHIVE

SEQ ID NO: 121816 - protein, 9 aa, Homo Sapiens
ENSHPPTTT

SEQ ID NO: 121817 - protein, 9 aa, Homo Sapiens
GLQSVQPTE

SEQ ID NO: 121818 - protein, 9 aa, Homo Sapiens
FLILLGIIL

SEQ ID NO: 121819 - protein, 9 aa, Homo Sapiens
PITAFHAKG

SEQ ID NO: 121820 - protein, 9 aa, Homo Sapiens
RGRGEAGRP

SEQ ID NO: 121821 - protein, 9 aa, Homo Sapiens
GLLHVRMVN

SEQ ID NO: 121822 - protein, 9 aa, Homo Sapiens
TQNIDELHH

SEQ ID NO: 121823 - protein, 9 aa, Homo Sapiens
PWMTGVQPS

SEQ ID NO: 121824 - protein, 9 aa, Homo Sapiens
MDRSTAATG

SEQ ID NO: 121825 - protein, 9 aa, Homo Sapiens
GFRDAVVTS

SEQ ID NO: 121826 - protein, 9 aa, Homo Sapiens
QKVLCAIQV

SEQ ID NO: 121827 - protein, 9 aa, Homo Sapiens
KAWWKKHLM

SEQ ID NO: 121828 - protein, 9 aa, Homo Sapiens
QGSGCQCHV

SEQ ID NO: 121829 - protein, 9 aa, Homo Sapiens
ARSLQKALH

SEQ ID NO: 121830 - protein, 9 aa, Homo Sapiens
RGNGEYARY

SEQ ID NO: 121831 - protein, 9 aa, Homo Sapiens
APSVWNASR

SEQ ID NO: 121832 - protein, 9 aa, Homo Sapiens
RPALRLLCP

SEQ ID NO: 121833 - protein, 9 aa, Homo Sapiens
SNSITVSWS

SEQ ID NO: 121834 - protein, 9 aa, Homo Sapiens
RNLSHDEQR

SEQ ID NO: 121835 - protein, 9 aa, Homo Sapiens
RSNSGLGVR

SEQ ID NO: 121836 - protein, 9 aa, Homo Sapiens
AGCRHSVPE

SEQ ID NO: 121837 - protein, 9 aa, Homo Sapiens
YCSTLDSFW

SEQ ID NO: 121838 - protein, 9 aa, Homo Sapiens
PRGRASSLC

SEQ ID NO: 121839 - protein, 9 aa, Homo Sapiens
PTFLCRPVK

SEQ ID NO: 121840 - protein, 9 aa, Homo Sapiens
AIAAGAGAI

SEQ ID NO: 121841 - protein, 9 aa, Homo Sapiens
NFLQCTEPE

SEQ ID NO: 121842 - protein, 9 aa, Homo Sapiens
GLVREVTGG

SEQ ID NO: 121843 - protein, 9 aa, Homo Sapiens
ARSRGARRP

SEQ ID NO: 121844 - protein, 9 aa, Homo Sapiens
LPTTMGATA

SEQ ID NO: 121845 - protein, 9 aa, Homo Sapiens
SCCMTTCCR

SEQ ID NO: 121846 - protein, 9 aa, Homo Sapiens
TFPSSFFIQ

SEQ ID NO: 121847 - protein, 9 aa, Homo Sapiens
LSRDHLLPR

SEQ ID NO: 121848 - protein, 9 aa, Homo Sapiens
NLLRMFFDT

SEQ ID NO: 121849 - protein, 9 aa, Homo Sapiens
NSFGQMSLS

SEQ ID NO: 121850 - protein, 9 aa, Homo Sapiens
PADRGPPEP

SEQ ID NO: 121851 - protein, 9 aa, Homo Sapiens
GSGLQGCLH

SEQ ID NO: 121852 - protein, 9 aa, Homo Sapiens
IPGTPHGVP

SEQ ID NO: 121853 - protein, 9 aa, Homo Sapiens
RQWEGEAEA

SEQ ID NO: 121854 - protein, 9 aa, Homo Sapiens
AMGTIGFNQ

SEQ ID NO: 121855 - protein, 9 aa, Homo Sapiens
NVKQTQYSS

SEQ ID NO: 121856 - protein, 9 aa, Homo Sapiens
GAACIRGET

SEQ ID NO: 121857 - protein, 9 aa, Homo Sapiens
LEQEQRHVA

SEQ ID NO: 121858 - protein, 9 aa, Homo Sapiens
LRFCPKILN

SEQ ID NO: 121859 - protein, 9 aa, Homo Sapiens
MYQPQTKPE

SEQ ID NO: 121860 - protein, 9 aa, Homo Sapiens
AAVEYVELT

SEQ ID NO: 121861 - protein, 9 aa, Homo Sapiens
DKPSERLGN

SEQ ID NO: 121862 - protein, 9 aa, Homo Sapiens
ERAAQTRRS

SEQ ID NO: 121863 - protein, 9 aa, Homo Sapiens
PRADLVRPI

SEQ ID NO: 121864 - protein, 9 aa, Homo Sapiens
TILSDPENN

SEQ ID NO: 121865 - protein, 9 aa, Homo Sapiens
SAHYNFSLP

SEQ ID NO: 121866 - protein, 9 aa, Homo Sapiens
LMIMKFVTS

SEQ ID NO: 121867 - protein, 9 aa, Homo Sapiens
LGHRAAQIR

SEQ ID NO: 121868 - protein, 9 aa, Homo Sapiens
QIRRECWGT

SEQ ID NO: 121869 - protein, 9 aa, Homo Sapiens
SSRDIEEPI

SEQ ID NO: 121870 - protein, 9 aa, Homo Sapiens
QARVDAHMC

SEQ ID NO: 121871 - protein, 9 aa, Homo Sapiens
MAIGSWMSS

SEQ ID NO: 121872 - protein, 9 aa, Homo Sapiens
HFTSREDVV

SEQ ID NO: 121873 - protein, 9 aa, Homo Sapiens
ALQYHKWLL

SEQ ID NO: 121874 - protein, 9 aa, Homo Sapiens
KVFRVRQQL

SEQ ID NO: 121875 - protein, 9 aa, Homo Sapiens
LQSLLSLYS

SEQ ID NO: 121876 - protein, 9 aa, Homo Sapiens
TSLKFPLSS

SEQ ID NO: 121877 - protein, 9 aa, Homo Sapiens
ILCVLRSSE

SEQ ID NO: 121878 - protein, 9 aa, Homo Sapiens
YIHCHAKET

SEQ ID NO: 121879 - protein, 9 aa, Homo Sapiens
NAGVMSGSG

SEQ ID NO: 121880 - protein, 9 aa, Homo Sapiens
AGLPLAMAQ

SEQ ID NO: 121881 - protein, 9 aa, Homo Sapiens
RRCYPYYLS

SEQ ID NO: 121882 - protein, 9 aa, Homo Sapiens
GVPLAGWAR

SEQ ID NO: 121883 - protein, 9 aa, Homo Sapiens
PKPGEPAFR

SEQ ID NO: 121884 - protein, 9 aa, Homo Sapiens
VGDPPEKRQ

SEQ ID NO: 121885 - protein, 9 aa, Homo Sapiens
RESEHFLYG

SEQ ID NO: 121886 - protein, 9 aa, Homo Sapiens
CSSKVSPST

SEQ ID NO: 121887 - protein, 9 aa, Homo Sapiens
GRQPLTHVF

SEQ ID NO: 121888 - protein, 9 aa, Homo Sapiens
MACGSAESS

SEQ ID NO: 121889 - protein, 9 aa, Homo Sapiens
LKESMIPIA

SEQ ID NO: 121890 - protein, 9 aa, Homo Sapiens
RVGCLHSQL

SEQ ID NO: 121891 - protein, 9 aa, Homo Sapiens
CFCLIFFQQ

SEQ ID NO: 121892 - protein, 9 aa, Homo Sapiens
FPPLEKTME

SEQ ID NO: 121893 - protein, 9 aa, Homo Sapiens
SPAITSISS

SEQ ID NO: 121894 - protein, 9 aa, Homo Sapiens
KAVAVLGNL

SEQ ID NO: 121895 - protein, 9 aa, Homo Sapiens
RSVVIQQPP

SEQ ID NO: 121896 - protein, 9 aa, Homo Sapiens
TSTTGRRSR

SEQ ID NO: 121897 - protein, 9 aa, Homo Sapiens
ARRSQRLPW

SEQ ID NO: 121898 - protein, 9 aa, Homo Sapiens
PFSVVWRQG

SEQ ID NO: 121899 - protein, 9 aa, Homo Sapiens
AVRLCGRSR

SEQ ID NO: 121900 - protein, 9 aa, Homo Sapiens
TLLDTPDVE

SEQ ID NO: 121901 - protein, 9 aa, Homo Sapiens
RPRTAGRNP

SEQ ID NO: 121902 - protein, 9 aa, Homo Sapiens
ANKIVPFLN

SEQ ID NO: 121903 - protein, 9 aa, Homo Sapiens
ASPLWGFRS

SEQ ID NO: 121904 - protein, 9 aa, Homo Sapiens
IRSPCIKEQ

SEQ ID NO: 121905 - protein, 9 aa, Homo Sapiens
CFVAKDSHG

SEQ ID NO: 121906 - protein, 9 aa, Homo Sapiens
CCACVGNVK

SEQ ID NO: 121907 - protein, 9 aa, Homo Sapiens
QYIPQTRRQ

SEQ ID NO: 121908 - protein, 9 aa, Homo Sapiens
LPDEIAAEI

SEQ ID NO: 121909 - protein, 9 aa, Homo Sapiens
DTPKVSSLA

SEQ ID NO: 121910 - protein, 9 aa, Homo Sapiens
SSRDHIWIR

SEQ ID NO: 121911 - protein, 9 aa, Homo Sapiens
RLHLHHHLP

SEQ ID NO: 121912 - protein, 9 aa, Homo Sapiens
DHHLHHTLP

SEQ ID NO: 121913 - protein, 9 aa, Homo Sapiens
RPGLIPQEP

SEQ ID NO: 121914 - protein, 9 aa, Homo Sapiens
IKNTHPLLQ

SEQ ID NO: 121915 - protein, 9 aa, Homo Sapiens
CLTTEVSHL

SEQ ID NO: 121916 - protein, 9 aa, Homo Sapiens
ARDEDDPGK

SEQ ID NO: 121917 - protein, 9 aa, Homo Sapiens
EGGTVSVAT

SEQ ID NO: 121918 - protein, 9 aa, Homo Sapiens
RIDTLTWLS

SEQ ID NO: 121919 - protein, 9 aa, Homo Sapiens
WALLAPSSC

SEQ ID NO: 121920 - protein, 9 aa, Homo Sapiens
SLARRRKNI

SEQ ID NO: 121921 - protein, 9 aa, Homo Sapiens
SEVITGTVQ

SEQ ID NO: 121922 - protein, 9 aa, Homo Sapiens
SDQKICKGC

SEQ ID NO: 121923 - protein, 9 aa, Homo Sapiens
KEQAIVYTK

SEQ ID NO: 121924 - protein, 9 aa, Homo Sapiens
KGLALEVAD

SEQ ID NO: 121925 - protein, 9 aa, Homo Sapiens
NDLRYIETQ

SEQ ID NO: 121926 - protein, 9 aa, Homo Sapiens
VHKQLVRGN

SEQ ID NO: 121927 - protein, 9 aa, Homo Sapiens
THTLTHTHT

SEQ ID NO: 121928 - protein, 9 aa, Homo Sapiens
PCKLDFFRS

SEQ ID NO: 121929 - protein, 9 aa, Homo Sapiens
NATLEKHFF

SEQ ID NO: 121930 - protein, 9 aa, Homo Sapiens
HHHGIEYCL

SEQ ID NO: 121931 - protein, 9 aa, Homo Sapiens
YKIGQGCLI

SEQ ID NO: 121932 - protein, 9 aa, Homo Sapiens
PLPRKAIQI

SEQ ID NO: 121933 - protein, 9 aa, Homo Sapiens
PDIGINGVQ

SEQ ID NO: 121934 - protein, 9 aa, Homo Sapiens
LMRTMGFLL

SEQ ID NO: 121935 - protein, 9 aa, Homo Sapiens
SPSTPDFSR

SEQ ID NO: 121936 - protein, 9 aa, Homo Sapiens
ILVRTQHPT

SEQ ID NO: 121937 - protein, 9 aa, Homo Sapiens
SNTSTQSTP

SEQ ID NO: 121938 - protein, 9 aa, Homo Sapiens
YLFYSEHGR

SEQ ID NO: 121939 - protein, 9 aa, Homo Sapiens
LPRAGGAEP

SEQ ID NO: 121940 - protein, 9 aa, Homo Sapiens
KASVCHHHG

SEQ ID NO: 121941 - protein, 9 aa, Homo Sapiens
EFKTQPVRS

SEQ ID NO: 121942 - protein, 9 aa, Homo Sapiens
PECEGSPPS

SEQ ID NO: 121943 - protein, 9 aa, Homo Sapiens
SALIVSLLY

SEQ ID NO: 121944 - protein, 9 aa, Homo Sapiens
ERAGAARAS

SEQ ID NO: 121945 - protein, 9 aa, Homo Sapiens
TRRSLDYAY

SEQ ID NO: 121946 - protein, 9 aa, Homo Sapiens
RVEFVDGVK

SEQ ID NO: 121947 - protein, 9 aa, Homo Sapiens
GLETIFDHI

SEQ ID NO: 121948 - protein, 9 aa, Homo Sapiens
ELLAWDPPP

SEQ ID NO: 121949 - protein, 9 aa, Homo Sapiens
PNATLPPPP

SEQ ID NO: 121950 - protein, 9 aa, Homo Sapiens
SVDFTCTSS

SEQ ID NO: 121951 - protein, 9 aa, Homo Sapiens
PPLRLRSMC

SEQ ID NO: 121952 - protein, 9 aa, Homo Sapiens
IPPPYYSTS

SEQ ID NO: 121953 - protein, 9 aa, Homo Sapiens
NCTLNLPFP

SEQ ID NO: 121954 - protein, 9 aa, Homo Sapiens
QSPRSSCSR

SEQ ID NO: 121955 - protein, 9 aa, Homo Sapiens
TTTGATPGT

SEQ ID NO: 121956 - protein, 9 aa, Homo Sapiens
HSQLPHPHP

SEQ ID NO: 121957 - protein, 9 aa, Homo Sapiens
RACSCPRAR

SEQ ID NO: 121958 - protein, 9 aa, Homo Sapiens
PLASRSCTA

SEQ ID NO: 121959 - protein, 9 aa, Homo Sapiens
GYNSQGEDV

SEQ ID NO: 121960 - protein, 9 aa, Homo Sapiens
LDHVHRIGR

SEQ ID NO: 121961 - protein, 9 aa, Homo Sapiens
QPPVVQLHN

SEQ ID NO: 121962 - protein, 9 aa, Homo Sapiens
YVPEVRSDG

SEQ ID NO: 121963 - protein, 9 aa, Homo Sapiens
LSIKDSVMF

SEQ ID NO: 121964 - protein, 9 aa, Homo Sapiens
RPIIGTVNM

SEQ ID NO: 121965 - protein, 9 aa, Homo Sapiens
WMSLGMTSI

SEQ ID NO: 121966 - protein, 9 aa, Homo Sapiens
PPPPPTKKR

SEQ ID NO: 121967 - protein, 9 aa, Homo Sapiens
MPLRIDTLT

SEQ ID NO: 121968 - protein, 9 aa, Homo Sapiens
YDLTNENKH

SEQ ID NO: 121969 - protein, 9 aa, Homo Sapiens
EVEFTGLET

SEQ ID NO: 121970 - protein, 9 aa, Homo Sapiens
KQFSPILVV

SEQ ID NO: 121971 - protein, 9 aa, Homo Sapiens
PPHEYRFPK

SEQ ID NO: 121972 - protein, 9 aa, Homo Sapiens
GGALGTAPA

SEQ ID NO: 121973 - protein, 9 aa, Homo Sapiens
IYITVKLMV

SEQ ID NO: 121974 - protein, 9 aa, Homo Sapiens
VPLPTEPST

SEQ ID NO: 121975 - protein, 9 aa, Homo Sapiens
TTTKKILCF

SEQ ID NO: 121976 - protein, 9 aa, Homo Sapiens
RRSSFIKDP

SEQ ID NO: 121977 - protein, 9 aa, Homo Sapiens
VIQQPPSPL

SEQ ID NO: 121978 - protein, 9 aa, Homo Sapiens
CHSTLKCQL

SEQ ID NO: 121979 - protein, 9 aa, Homo Sapiens
NLPVGAPIH

SEQ ID NO: 121980 - protein, 9 aa, Homo Sapiens
EYGGQKCST

SEQ ID NO: 121981 - protein, 9 aa, Homo Sapiens
VPDGDDRPG

SEQ ID NO: 121982 - protein, 9 aa, Homo Sapiens
LLLQEGGPQ

SEQ ID NO: 121983 - protein, 9 aa, Homo Sapiens
KRNGAEAVL

SEQ ID NO: 121984 - protein, 9 aa, Homo Sapiens
SGPEKNPSL

SEQ ID NO: 121985 - protein, 9 aa, Homo Sapiens
CHVLEQVCS

SEQ ID NO: 121986 - protein, 9 aa, Homo Sapiens
HGLGTCMWP

SEQ ID NO: 121987 - protein, 9 aa, Homo Sapiens
PDIPPIQTN

SEQ ID NO: 121988 - protein, 9 aa, Homo Sapiens
LVFLTSLKF

SEQ ID NO: 121989 - protein, 9 aa, Homo Sapiens
SVPKKTGPP

SEQ ID NO: 121990 - protein, 9 aa, Homo Sapiens
LPPCSDLST

SEQ ID NO: 121991 - protein, 9 aa, Homo Sapiens
PRMKDPRVL

SEQ ID NO: 121992 - protein, 9 aa, Homo Sapiens
PPYYSTSQP

SEQ ID NO: 121993 - protein, 9 aa, Homo Sapiens
SDLLDFVLS

SEQ ID NO: 121994 - protein, 9 aa, Homo Sapiens
VPAAPAAMR

SEQ ID NO: 121995 - protein, 9 aa, Homo Sapiens
EISNSDGAR

SEQ ID NO: 121996 - protein, 9 aa, Homo Sapiens
TGIVSVPVP

SEQ ID NO: 121997 - protein, 9 aa, Homo Sapiens
CNGKSASGH

SEQ ID NO: 121998 - protein, 9 aa, Homo Sapiens
VTCMQSQRN

SEQ ID NO: 121999 - protein, 9 aa, Homo Sapiens
PLCPSGRRC

SEQ ID NO: 122000 - protein, 9 aa, Homo Sapiens
SHHPPSVRS

SEQ ID NO: 122001 - protein, 9 aa, Homo Sapiens
TNEVKQAVE

SEQ ID NO: 122002 - protein, 9 aa, Homo Sapiens
SACRCPCHQ

SEQ ID NO: 122003 - protein, 9 aa, Homo Sapiens
RLEDAGMRE

SEQ ID NO: 122004 - protein, 9 aa, Homo Sapiens
MVWKDAATQ

SEQ ID NO: 122005 - protein, 9 aa, Homo Sapiens
ALKVEASNP

SEQ ID NO: 122006 - protein, 9 aa, Homo Sapiens
PGDREGYLL

SEQ ID NO: 122007 - protein, 9 aa, Homo Sapiens
EILDKPHKA

SEQ ID NO: 122008 - protein, 9 aa, Homo Sapiens
QYSQLISFC

SEQ ID NO: 122009 - protein, 9 aa, Homo Sapiens
MRYSRLKAS

SEQ ID NO: 122010 - protein, 9 aa, Homo Sapiens
HLRNLRGQQ

SEQ ID NO: 122011 - protein, 9 aa, Homo Sapiens
HYYKVDNSR

SEQ ID NO: 122012 - protein, 9 aa, Homo Sapiens
GVIISPNMS

SEQ ID NO: 122013 - protein, 9 aa, Homo Sapiens
LLLAVSSVL

SEQ ID NO: 122014 - protein, 9 aa, Homo Sapiens
NLAYNSSLQ

SEQ ID NO: 122015 - protein, 9 aa, Homo Sapiens
WLSNTSLGY

SEQ ID NO: 122016 - protein, 9 aa, Homo Sapiens
YGQVSKNIL

SEQ ID NO: 122017 - protein, 9 aa, Homo Sapiens
ADLHMSAMA

SEQ ID NO: 122018 - protein, 9 aa, Homo Sapiens
VTSLYSMIK

SEQ ID NO: 122019 - protein, 9 aa, Homo Sapiens
LFFVLVNLE

SEQ ID NO: 122020 - protein, 9 aa, Homo Sapiens
PPPTALAAA

SEQ ID NO: 122021 - protein, 9 aa, Homo Sapiens
WLTQQPECE

SEQ ID NO: 122022 - protein, 9 aa, Homo Sapiens
PEANSTWTG

SEQ ID NO: 122023 - protein, 9 aa, Homo Sapiens
AWNYTVDAP

SEQ ID NO: 122024 - protein, 9 aa, Homo Sapiens
SPAGPQPRP

SEQ ID NO: 122025 - protein, 9 aa, Homo Sapiens
YRMKHHYKS

SEQ ID NO: 122026 - protein, 9 aa, Homo Sapiens
TNMIMTMNP

SEQ ID NO: 122027 - protein, 9 aa, Homo Sapiens
GPQRPLQIC

SEQ ID NO: 122028 - protein, 9 aa, Homo Sapiens
QISFVVGEK

SEQ ID NO: 122029 - protein, 9 aa, Homo Sapiens
QAMPNAVDR

SEQ ID NO: 122030 - protein, 9 aa, Homo Sapiens
ETNFSDVNT

SEQ ID NO: 122031 - protein, 9 aa, Homo Sapiens
LLPGPLPAS

SEQ ID NO: 122032 - protein, 9 aa, Homo Sapiens
IGSSLMVDS

SEQ ID NO: 122033 - protein, 9 aa, Homo Sapiens
LPPSQDEEA

SEQ ID NO: 122034 - protein, 9 aa, Homo Sapiens
EERKLLGAD

SEQ ID NO: 122035 - protein, 9 aa, Homo Sapiens
SCISVATSF

SEQ ID NO: 122036 - protein, 9 aa, Homo Sapiens
GDVETSHDA

SEQ ID NO: 122037 - protein, 9 aa, Homo Sapiens
QRLPWAGAP

SEQ ID NO: 122038 - protein, 9 aa, Homo Sapiens
PHGQAFQVV

SEQ ID NO: 122039 - protein, 9 aa, Homo Sapiens
PSPILYAWQ

SEQ ID NO: 122040 - protein, 9 aa, Homo Sapiens
AFSSVEMLV

SEQ ID NO: 122041 - protein, 9 aa, Homo Sapiens
RAAPATVRP

SEQ ID NO: 122042 - protein, 9 aa, Homo Sapiens
LMWKLGWSP

SEQ ID NO: 122043 - protein, 9 aa, Homo Sapiens
AISLMHKFI

SEQ ID NO: 122044 - protein, 9 aa, Homo Sapiens
HLSQSLLCI

SEQ ID NO: 122045 - protein, 9 aa, Homo Sapiens
SSLGSQVHY

SEQ ID NO: 122046 - protein, 9 aa, Homo Sapiens
APPPRAPKP

SEQ ID NO: 122047 - protein, 9 aa, Homo Sapiens
QPKSMHVSE

SEQ ID NO: 122048 - protein, 9 aa, Homo Sapiens
PVKKPKIRM

SEQ ID NO: 122049 - protein, 9 aa, Homo Sapiens
NEYGKAFSH

SEQ ID NO: 122050 - protein, 9 aa, Homo Sapiens
NSPIPPHAG

SEQ ID NO: 122051 - protein, 9 aa, Homo Sapiens
RGPMPLRID

SEQ ID NO: 122052 - protein, 9 aa, Homo Sapiens
KCKFRDLTV

SEQ ID NO: 122053 - protein, 9 aa, Homo Sapiens
LKAWWKKHL

SEQ ID NO: 122054 - protein, 9 aa, Homo Sapiens
LVLWSGAFY

SEQ ID NO: 122055 - protein, 9 aa, Homo Sapiens
IIRSPTMAG

SEQ ID NO: 122056 - protein, 9 aa, Homo Sapiens
EDVVHAMNN

SEQ ID NO: 122057 - protein, 9 aa, Homo Sapiens
GRLAEVKDN

SEQ ID NO: 122058 - protein, 9 aa, Homo Sapiens
MRELCQGLG

SEQ ID NO: 122059 - protein, 9 aa, Homo Sapiens
PFHIAAAAP

SEQ ID NO: 122060 - protein, 9 aa, Homo Sapiens
ETVRLGFLV

SEQ ID NO: 122061 - protein, 9 aa, Homo Sapiens
QKYLSFTPL

SEQ ID NO: 122062 - protein, 9 aa, Homo Sapiens
PSRMIQKTR

SEQ ID NO: 122063 - protein, 9 aa, Homo Sapiens
ISEATPLGC

SEQ ID NO: 122064 - protein, 9 aa, Homo Sapiens
SLANIDEAV

SEQ ID NO: 122065 - protein, 9 aa, Homo Sapiens
NGVRHEQEV

SEQ ID NO: 122066 - protein, 9 aa, Homo Sapiens
DAWVIALLK

SEQ ID NO: 122067 - protein, 9 aa, Homo Sapiens
GSEFYTGLE

SEQ ID NO: 122068 - protein, 9 aa, Homo Sapiens
LETPVDLAE

SEQ ID NO: 122069 - protein, 9 aa, Homo Sapiens
DLIRSVLQR

SEQ ID NO: 122070 - protein, 9 aa, Homo Sapiens
KNVGRPLDT

SEQ ID NO: 122071 - protein, 9 aa, Homo Sapiens
FGMFWAAYS

SEQ ID NO: 122072 - protein, 9 aa, Homo Sapiens
RVKTRDFTS

SEQ ID NO: 122073 - protein, 9 aa, Homo Sapiens
TLQKSEPSH

SEQ ID NO: 122074 - protein, 9 aa, Homo Sapiens
WLQDAHQLL

SEQ ID NO: 122075 - protein, 9 aa, Homo Sapiens
HVRMVNLQV

SEQ ID NO: 122076 - protein, 9 aa, Homo Sapiens
SKLLYSQGS

SEQ ID NO: 122077 - protein, 9 aa, Homo Sapiens
KEMCTVEEL

SEQ ID NO: 122078 - protein, 9 aa, Homo Sapiens
RCAIQITHA

SEQ ID NO: 122079 - protein, 9 aa, Homo Sapiens
EPMDVRSAY

SEQ ID NO: 122080 - protein, 9 aa, Homo Sapiens
GPDSTPAEP

SEQ ID NO: 122081 - protein, 9 aa, Homo Sapiens
ALQPGEKKS

SEQ ID NO: 122082 - protein, 9 aa, Homo Sapiens
KKGKSHLVI

SEQ ID NO: 122083 - protein, 9 aa, Homo Sapiens
NTVLCLQVA

SEQ ID NO: 122084 - protein, 9 aa, Homo Sapiens
CCSSWLRRI

SEQ ID NO: 122085 - protein, 9 aa, Homo Sapiens
TYSLCPSRS

SEQ ID NO: 122086 - protein, 9 aa, Homo Sapiens
HCGQCGLHD

SEQ ID NO: 122087 - protein, 9 aa, Homo Sapiens
QHDASRLEF

SEQ ID NO: 122088 - protein, 9 aa, Homo Sapiens
QKNGYRCAA

SEQ ID NO: 122089 - protein, 9 aa, Homo Sapiens
PAFHKTSTG

SEQ ID NO: 122090 - protein, 9 aa, Homo Sapiens
GEMIKDVAA

SEQ ID NO: 122091 - protein, 9 aa, Homo Sapiens
ACPWCNAIN

SEQ ID NO: 122092 - protein, 9 aa, Homo Sapiens
LDEIYDSSK

SEQ ID NO: 122093 - protein, 9 aa, Homo Sapiens
AGRGGTTCP

SEQ ID NO: 122094 - protein, 9 aa, Homo Sapiens
PEYINQSIP

SEQ ID NO: 122095 - protein, 9 aa, Homo Sapiens
STPVLYLSL

SEQ ID NO: 122096 - protein, 9 aa, Homo Sapiens
DDVVNKRNG

SEQ ID NO: 122097 - protein, 9 aa, Homo Sapiens
LMAVQEDLY

SEQ ID NO: 122098 - protein, 9 aa, Homo Sapiens
SPGATLTST

SEQ ID NO: 122099 - protein, 9 aa, Homo Sapiens
SRLALGSEV

SEQ ID NO: 122100 - protein, 9 aa, Homo Sapiens
FDAPPPTPP

SEQ ID NO: 122101 - protein, 9 aa, Homo Sapiens
IQQPPSPLP

SEQ ID NO: 122102 - protein, 9 aa, Homo Sapiens
QATAVLNLL

SEQ ID NO: 122103 - protein, 9 aa, Homo Sapiens
AQVTHPLVH

SEQ ID NO: 122104 - protein, 9 aa, Homo Sapiens
KFHGKKVKR

SEQ ID NO: 122105 - protein, 9 aa, Homo Sapiens
AQDLDRGLH

SEQ ID NO: 122106 - protein, 9 aa, Homo Sapiens
KPGNFSCAD

SEQ ID NO: 122107 - protein, 9 aa, Homo Sapiens
LPYPQFEQS

SEQ ID NO: 122108 - protein, 9 aa, Homo Sapiens
FVDGMLRVV

SEQ ID NO: 122109 - protein, 9 aa, Homo Sapiens
FIHLESWAL

SEQ ID NO: 122110 - protein, 9 aa, Homo Sapiens
ALGLVSTRN

SEQ ID NO: 122111 - protein, 9 aa, Homo Sapiens
HLNSHEGKW

SEQ ID NO: 122112 - protein, 9 aa, Homo Sapiens
GTCMWPDGS

SEQ ID NO: 122113 - protein, 9 aa, Homo Sapiens
LVVVGAGDV

SEQ ID NO: 122114 - protein, 9 aa, Homo Sapiens
VSLDLAPAL

SEQ ID NO: 122115 - protein, 9 aa, Homo Sapiens
MSSVPVSML

SEQ ID NO: 122116 - protein, 9 aa, Homo Sapiens
KDSVMFLSA

SEQ ID NO: 122117 - protein, 9 aa, Homo Sapiens
QDDVPHQIQ

SEQ ID NO: 122118 - protein, 9 aa, Homo Sapiens
VNVTPQFHT

SEQ ID NO: 122119 - protein, 9 aa, Homo Sapiens
GVNAVRLFP

SEQ ID NO: 122120 - protein, 9 aa, Homo Sapiens
LLLMWQFPA

SEQ ID NO: 122121 - protein, 9 aa, Homo Sapiens
SETDTYYRA

SEQ ID NO: 122122 - protein, 9 aa, Homo Sapiens
GEKQKMLLE

SEQ ID NO: 122123 - protein, 9 aa, Homo Sapiens
GVGDKVSLD

SEQ ID NO: 122124 - protein, 9 aa, Homo Sapiens
PLLYSLVRV

SEQ ID NO: 122125 - protein, 9 aa, Homo Sapiens
NEVMVLAAD

SEQ ID NO: 122126 - protein, 9 aa, Homo Sapiens
LGPGWKRRK

SEQ ID NO: 122127 - protein, 9 aa, Homo Sapiens
IRGFPSRSR

SEQ ID NO: 122128 - protein, 9 aa, Homo Sapiens
SGDEKEMER

SEQ ID NO: 122129 - protein, 9 aa, Homo Sapiens
ILIQQVLES

SEQ ID NO: 122130 - protein, 9 aa, Homo Sapiens
NESNHLKEK

SEQ ID NO: 122131 - protein, 9 aa, Homo Sapiens
LPLAMAQVT

SEQ ID NO: 122132 - protein, 9 aa, Homo Sapiens
NDSMTYEKL

SEQ ID NO: 122133 - protein, 9 aa, Homo Sapiens
TSFNLKADF

SEQ ID NO: 122134 - protein, 9 aa, Homo Sapiens
RSWARCVPS

SEQ ID NO: 122135 - protein, 9 aa, Homo Sapiens
GGSEEEEEE

SEQ ID NO: 122136 - protein, 9 aa, Homo Sapiens
EQLHVRRAA

SEQ ID NO: 122137 - protein, 9 aa, Homo Sapiens
CKGCPHRYE

SEQ ID NO: 122138 - protein, 9 aa, Homo Sapiens
RKNFVTSLY

SEQ ID NO: 122139 - protein, 9 aa, Homo Sapiens
GKKRKRERR

SEQ ID NO: 122140 - protein, 9 aa, Homo Sapiens
QQEEENEGE

SEQ ID NO: 122141 - protein, 9 aa, Homo Sapiens
PKAIMTSVF

SEQ ID NO: 122142 - protein, 9 aa, Homo Sapiens
IVTPRAIGL

SEQ ID NO: 122143 - protein, 9 aa, Homo Sapiens
HCYMALCSG

SEQ ID NO: 122144 - protein, 9 aa, Homo Sapiens
GALRAVERS

SEQ ID NO: 122145 - protein, 9 aa, Homo Sapiens
PRLDHVHRI

SEQ ID NO: 122146 - protein, 9 aa, Homo Sapiens
RSRCTTPPR

SEQ ID NO: 122147 - protein, 9 aa, Homo Sapiens
PVPGVPGRL

SEQ ID NO: 122148 - protein, 9 aa, Homo Sapiens
EVSHLKRGF

SEQ ID NO: 122149 - protein, 9 aa, Homo Sapiens
RSGSAWASW

SEQ ID NO: 122150 - protein, 9 aa, Homo Sapiens
GDLEKVRSV

SEQ ID NO: 122151 - protein, 9 aa, Homo Sapiens
GKVFRVRQQ

SEQ ID NO: 122152 - protein, 9 aa, Homo Sapiens
GWPGSNHWN

SEQ ID NO: 122153 - protein, 9 aa, Homo Sapiens
LGQGTRGIG

SEQ ID NO: 122154 - protein, 9 aa, Homo Sapiens
VIAEMLRMY

SEQ ID NO: 122155 - protein, 9 aa, Homo Sapiens
LGVTSPSAD

SEQ ID NO: 122156 - protein, 9 aa, Homo Sapiens
QLPEAWPGI

SEQ ID NO: 122157 - protein, 9 aa, Homo Sapiens
RTKAMDVHD

SEQ ID NO: 122158 - protein, 9 aa, Homo Sapiens
GHFEEAAGA

SEQ ID NO: 122159 - protein, 9 aa, Homo Sapiens
ESLKNVLLV

SEQ ID NO: 122160 - protein, 9 aa, Homo Sapiens
LEIWDVKDP

SEQ ID NO: 122161 - protein, 9 aa, Homo Sapiens
NRQLKKKET

SEQ ID NO: 122162 - protein, 9 aa, Homo Sapiens
ESLVGSWQV

SEQ ID NO: 122163 - protein, 9 aa, Homo Sapiens
DIVSTVQNI

SEQ ID NO: 122164 - protein, 9 aa, Homo Sapiens
DNRTTPSYV

SEQ ID NO: 122165 - protein, 9 aa, Homo Sapiens
LNFSAMVLA

SEQ ID NO: 122166 - protein, 9 aa, Homo Sapiens
REGEREREP

SEQ ID NO: 122167 - protein, 9 aa, Homo Sapiens
ECGKVFRVR

SEQ ID NO: 122168 - protein, 9 aa, Homo Sapiens
FLKIRIQQL

SEQ ID NO: 122169 - protein, 9 aa, Homo Sapiens
VMTHAGNKQ

SEQ ID NO: 122170 - protein, 9 aa, Homo Sapiens
FKMEEKMKT

SEQ ID NO: 122171 - protein, 9 aa, Homo Sapiens
RCISEGEDV

SEQ ID NO: 122172 - protein, 9 aa, Homo Sapiens
HEEIDLHNP

SEQ ID NO: 122173 - protein, 9 aa, Homo Sapiens
GEADTKMTK

SEQ ID NO: 122174 - protein, 9 aa, Homo Sapiens
VDAPHGIFA

SEQ ID NO: 122175 - protein, 9 aa, Homo Sapiens
NIVNFSRTK

SEQ ID NO: 122176 - protein, 9 aa, Homo Sapiens
ARAGLPSGA

SEQ ID NO: 122177 - protein, 9 aa, Homo Sapiens
HINTRLNMG

SEQ ID NO: 122178 - protein, 9 aa, Homo Sapiens
LIGQVAAIL

SEQ ID NO: 122179 - protein, 9 aa, Homo Sapiens
GNRTWYQEV

SEQ ID NO: 122180 - protein, 9 aa, Homo Sapiens
SLALEKFEE

SEQ ID NO: 122181 - protein, 9 aa, Homo Sapiens
CAWSRTCKP

SEQ ID NO: 122182 - protein, 9 aa, Homo Sapiens
VLHMDRSPY

SEQ ID NO: 122183 - protein, 9 aa, Homo Sapiens
VMDEDTRHL

SEQ ID NO: 122184 - protein, 9 aa, Homo Sapiens
VAYFGISMD

SEQ ID NO: 122185 - protein, 9 aa, Homo Sapiens
TLILSTSQE

SEQ ID NO: 122186 - protein, 9 aa, Homo Sapiens
VREEVFGAQ

SEQ ID NO: 122187 - protein, 9 aa, Homo Sapiens
RPGTQAARR

SEQ ID NO: 122188 - protein, 9 aa, Homo Sapiens
LPGAEGSGG

SEQ ID NO: 122189 - protein, 9 aa, Homo Sapiens
FRRVLQQVP

SEQ ID NO: 122190 - protein, 9 aa, Homo Sapiens
LQECHSRAR

SEQ ID NO: 122191 - protein, 9 aa, Homo Sapiens
ETQHFREKL

SEQ ID NO: 122192 - protein, 9 aa, Homo Sapiens
LSLVTREKH

SEQ ID NO: 122193 - protein, 9 aa, Homo Sapiens
PLVPDFPYP

SEQ ID NO: 122194 - protein, 9 aa, Homo Sapiens
QTEHTPALP

SEQ ID NO: 122195 - protein, 9 aa, Homo Sapiens
LIHCYMALC

SEQ ID NO: 122196 - protein, 9 aa, Homo Sapiens
APIRGKKWY

SEQ ID NO: 122197 - protein, 9 aa, Homo Sapiens
SPKVGTKPK

SEQ ID NO: 122198 - protein, 9 aa, Homo Sapiens
EARSMTLPT

SEQ ID NO: 122199 - protein, 9 aa, Homo Sapiens
EEYVEEEVA

SEQ ID NO: 122200 - protein, 9 aa, Homo Sapiens
LCRDKPSER

SEQ ID NO: 122201 - protein, 9 aa, Homo Sapiens
KTSEEQAET

SEQ ID NO: 122202 - protein, 9 aa, Homo Sapiens
RILEKEEDE

SEQ ID NO: 122203 - protein, 9 aa, Homo Sapiens
VLTQLARAF

SEQ ID NO: 122204 - protein, 9 aa, Homo Sapiens
PECSEILLL

SEQ ID NO: 122205 - protein, 9 aa, Homo Sapiens
RSVLQRDEE

SEQ ID NO: 122206 - protein, 9 aa, Homo Sapiens
GFSMEPLTF

SEQ ID NO: 122207 - protein, 9 aa, Homo Sapiens
EWRFRLRDE

SEQ ID NO: 122208 - protein, 9 aa, Homo Sapiens
GSSSGGDCS

SEQ ID NO: 122209 - protein, 9 aa, Homo Sapiens
LKCTSVGWY

SEQ ID NO: 122210 - protein, 9 aa, Homo Sapiens
PFLQLSCSD

SEQ ID NO: 122211 - protein, 9 aa, Homo Sapiens
VDSPAERCG

SEQ ID NO: 122212 - protein, 9 aa, Homo Sapiens
LEKATKHCK

SEQ ID NO: 122213 - protein, 9 aa, Homo Sapiens
ESKKHKRKP

SEQ ID NO: 122214 - protein, 9 aa, Homo Sapiens
KRAACGSRG

SEQ ID NO: 122215 - protein, 9 aa, Homo Sapiens
KASGVSKVT

SEQ ID NO: 122216 - protein, 9 aa, Homo Sapiens
IFFRKFYNK

SEQ ID NO: 122217 - protein, 9 aa, Homo Sapiens
LPTLASRVA

SEQ ID NO: 122218 - protein, 9 aa, Homo Sapiens
SPFFIQIRS

SEQ ID NO: 122219 - protein, 9 aa, Homo Sapiens
TVPSAPEPL

SEQ ID NO: 122220 - protein, 9 aa, Homo Sapiens
RVVDHYENP

SEQ ID NO: 122221 - protein, 9 aa, Homo Sapiens
PHVQICMPL

SEQ ID NO: 122222 - protein, 9 aa, Homo Sapiens
CSFASKNKD

SEQ ID NO: 122223 - protein, 9 aa, Homo Sapiens
VRTRKGQEV

SEQ ID NO: 122224 - protein, 9 aa, Homo Sapiens
RIRNKHEVD

SEQ ID NO: 122225 - protein, 9 aa, Homo Sapiens
RRKRLWPAS

SEQ ID NO: 122226 - protein, 9 aa, Homo Sapiens
HHSRVSFAA

SEQ ID NO: 122227 - protein, 9 aa, Homo Sapiens
KAGCRSYTG

SEQ ID NO: 122228 - protein, 9 aa, Homo Sapiens
QGYSVRQSV

SEQ ID NO: 122229 - protein, 9 aa, Homo Sapiens
PQTRRSPCP

SEQ ID NO: 122230 - protein, 9 aa, Homo Sapiens
TRIPFRVGL

SEQ ID NO: 122231 - protein, 9 aa, Homo Sapiens
PWWKEHLTR

SEQ ID NO: 122232 - protein, 9 aa, Homo Sapiens
GCVLVHCQA

SEQ ID NO: 122233 - protein, 9 aa, Homo Sapiens
SGRQPLTHV

SEQ ID NO: 122234 - protein, 9 aa, Homo Sapiens
LWVSYLGCV

SEQ ID NO: 122235 - protein, 9 aa, Homo Sapiens
LNEFEELVI

SEQ ID NO: 122236 - protein, 9 aa, Homo Sapiens
QMGSVHEGG

SEQ ID NO: 122237 - protein, 9 aa, Homo Sapiens
RPGPSGRLR

SEQ ID NO: 122238 - protein, 9 aa, Homo Sapiens
TGLRIPLPP

SEQ ID NO: 122239 - protein, 9 aa, Homo Sapiens
KYKSSGHDS

SEQ ID NO: 122240 - protein, 9 aa, Homo Sapiens
STILSDPEN

SEQ ID NO: 122241 - protein, 9 aa, Homo Sapiens
GLCGVIISP

SEQ ID NO: 122242 - protein, 9 aa, Homo Sapiens
FTNKMKTQN

SEQ ID NO: 122243 - protein, 9 aa, Homo Sapiens
MNQYRMRGL

SEQ ID NO: 122244 - protein, 9 aa, Homo Sapiens
NPGRGSWFV

SEQ ID NO: 122245 - protein, 9 aa, Homo Sapiens
QLTETSLQE

SEQ ID NO: 122246 - protein, 9 aa, Homo Sapiens
CSFGLWFRL

SEQ ID NO: 122247 - protein, 9 aa, Homo Sapiens
TVDALVEEL

SEQ ID NO: 122248 - protein, 9 aa, Homo Sapiens
LYPVGSGPP

SEQ ID NO: 122249 - protein, 9 aa, Homo Sapiens
PQPKFRLAS

SEQ ID NO: 122250 - protein, 9 aa, Homo Sapiens
SSTPKRPRT

SEQ ID NO: 122251 - protein, 9 aa, Homo Sapiens
QDKSVSFFV

SEQ ID NO: 122252 - protein, 9 aa, Homo Sapiens
SLKFPLSSG

SEQ ID NO: 122253 - protein, 9 aa, Homo Sapiens
NFRRNKNPS

SEQ ID NO: 122254 - protein, 9 aa, Homo Sapiens
TRSGGGGIS

SEQ ID NO: 122255 - protein, 9 aa, Homo Sapiens
HDHGLLHVR

SEQ ID NO: 122256 - protein, 9 aa, Homo Sapiens
KLRVKTRDF

SEQ ID NO: 122257 - protein, 9 aa, Homo Sapiens
HRTFPAYDY

SEQ ID NO: 122258 - protein, 9 aa, Homo Sapiens
RNVVIPQYQ

SEQ ID NO: 122259 - protein, 9 aa, Homo Sapiens
VILEDGAAD

SEQ ID NO: 122260 - protein, 9 aa, Homo Sapiens
EDPGPFRHL

SEQ ID NO: 122261 - protein, 9 aa, Homo Sapiens
LLSLYSVAV

SEQ ID NO: 122262 - protein, 9 aa, Homo Sapiens
FWISRVEKM

SEQ ID NO: 122263 - protein, 9 aa, Homo Sapiens
LAVNVCIRV

SEQ ID NO: 122264 - protein, 9 aa, Homo Sapiens
TAGRNPKRR

SEQ ID NO: 122265 - protein, 9 aa, Homo Sapiens
YRFPKNVNW

SEQ ID NO: 122266 - protein, 9 aa, Homo Sapiens
PKRSRKSAS

SEQ ID NO: 122267 - protein, 9 aa, Homo Sapiens
GPTPPAAST

SEQ ID NO: 122268 - protein, 9 aa, Homo Sapiens
EKQKMLLEK

SEQ ID NO: 122269 - protein, 9 aa, Homo Sapiens
HEEARGRLP

SEQ ID NO: 122270 - protein, 9 aa, Homo Sapiens
EKFGILIIG

SEQ ID NO: 122271 - protein, 9 aa, Homo Sapiens
LATEKEVIC

SEQ ID NO: 122272 - protein, 9 aa, Homo Sapiens
EVGAHKVVS

SEQ ID NO: 122273 - protein, 9 aa, Homo Sapiens
LFIHFPDHR

SEQ ID NO: 122274 - protein, 9 aa, Homo Sapiens
FYVLTKMMK

SEQ ID NO: 122275 - protein, 9 aa, Homo Sapiens
VEGARKYAR

SEQ ID NO: 122276 - protein, 9 aa, Homo Sapiens
QNCISLNSL

SEQ ID NO: 122277 - protein, 9 aa, Homo Sapiens
EEWAIEVDS

SEQ ID NO: 122278 - protein, 9 aa, Homo Sapiens
FLVSCPNYS

SEQ ID NO: 122279 - protein, 9 aa, Homo Sapiens
NQQVHLAQH

SEQ ID NO: 122280 - protein, 9 aa, Homo Sapiens
FPKTTTTTP

SEQ ID NO: 122281 - protein, 9 aa, Homo Sapiens
CLLLLSFRV

SEQ ID NO: 122282 - protein, 9 aa, Homo Sapiens
VDHLDAKRR

SEQ ID NO: 122283 - protein, 9 aa, Homo Sapiens
EIVPVELEP

SEQ ID NO: 122284 - protein, 9 aa, Homo Sapiens
PYEDKVCVW

SEQ ID NO: 122285 - protein, 9 aa, Homo Sapiens
VLQLSTNCP

SEQ ID NO: 122286 - protein, 9 aa, Homo Sapiens
SANTSTPPS

SEQ ID NO: 122287 - protein, 9 aa, Homo Sapiens
ADPYARVSV

SEQ ID NO: 122288 - protein, 9 aa, Homo Sapiens
PPDEPQLET

SEQ ID NO: 122289 - protein, 9 aa, Homo Sapiens
QNQRSKWRK

SEQ ID NO: 122290 - protein, 9 aa, Homo Sapiens
GENEVADRA

SEQ ID NO: 122291 - protein, 9 aa, Homo Sapiens
SVPVPKKLL

SEQ ID NO: 122292 - protein, 9 aa, Homo Sapiens
SRVFFQAGT

SEQ ID NO: 122293 - protein, 9 aa, Homo Sapiens
ATAISLMHK

SEQ ID NO: 122294 - protein, 9 aa, Homo Sapiens
TKKRGKSQG

SEQ ID NO: 122295 - protein, 9 aa, Homo Sapiens
GLCPSSAEP

SEQ ID NO: 122296 - protein, 9 aa, Homo Sapiens
GTPGHPSAS

SEQ ID NO: 122297 - protein, 9 aa, Homo Sapiens
PCPTDSLLC

SEQ ID NO: 122298 - protein, 9 aa, Homo Sapiens
LFLQKTSII

SEQ ID NO: 122299 - protein, 9 aa, Homo Sapiens
RQQRMIKIE

SEQ ID NO: 122300 - protein, 9 aa, Homo Sapiens
ASGQAVRPC

SEQ ID NO: 122301 - protein, 9 aa, Homo Sapiens
PNTGDIYTP

SEQ ID NO: 122302 - protein, 9 aa, Homo Sapiens
LCRTHSQQC

SEQ ID NO: 122303 - protein, 9 aa, Homo Sapiens
LQCTEPEDQ

SEQ ID NO: 122304 - protein, 9 aa, Homo Sapiens
DYGVTKVHG

SEQ ID NO: 122305 - protein, 9 aa, Homo Sapiens
SRPTAGGPR

SEQ ID NO: 122306 - protein, 9 aa, Homo Sapiens
PPPYYSTSQ

SEQ ID NO: 122307 - protein, 9 aa, Homo Sapiens
VKHVCLHFL

SEQ ID NO: 122308 - protein, 9 aa, Homo Sapiens
NGDGLKNTP

SEQ ID NO: 122309 - protein, 9 aa, Homo Sapiens
TCDGQQYGA

SEQ ID NO: 122310 - protein, 9 aa, Homo Sapiens
CPKLNLEFG

SEQ ID NO: 122311 - protein, 9 aa, Homo Sapiens
CPAGGPCLD

SEQ ID NO: 122312 - protein, 9 aa, Homo Sapiens
SVRPLSSIR

SEQ ID NO: 122313 - protein, 9 aa, Homo Sapiens
KMKRISVQP

SEQ ID NO: 122314 - protein, 9 aa, Homo Sapiens
CRHQDSPSP

SEQ ID NO: 122315 - protein, 9 aa, Homo Sapiens
GQKLIDVNN

SEQ ID NO: 122316 - protein, 9 aa, Homo Sapiens
CLQVARFLV

SEQ ID NO: 122317 - protein, 9 aa, Homo Sapiens
INHTVLIAI

SEQ ID NO: 122318 - protein, 9 aa, Homo Sapiens
CYVKELGVC

SEQ ID NO: 122319 - protein, 9 aa, Homo Sapiens
AGCRSYTGA

SEQ ID NO: 122320 - protein, 9 aa, Homo Sapiens
YSDAAKGIL

SEQ ID NO: 122321 - protein, 9 aa, Homo Sapiens
NPEGMVKRA

SEQ ID NO: 122322 - protein, 9 aa, Homo Sapiens
RSHPPSPTI

SEQ ID NO: 122323 - protein, 9 aa, Homo Sapiens
FAVGSFRTL

SEQ ID NO: 122324 - protein, 9 aa, Homo Sapiens
PGDMVNSIK

SEQ ID NO: 122325 - protein, 9 aa, Homo Sapiens
TILSLVTRE

SEQ ID NO: 122326 - protein, 9 aa, Homo Sapiens
WARCVPSLG

SEQ ID NO: 122327 - protein, 9 aa, Homo Sapiens
EDINECSTI

SEQ ID NO: 122328 - protein, 9 aa, Homo Sapiens
TRISLHEKM

SEQ ID NO: 122329 - protein, 9 aa, Homo Sapiens
DAVVTSACS

SEQ ID NO: 122330 - protein, 9 aa, Homo Sapiens
FLNYAMSSS

SEQ ID NO: 122331 - protein, 9 aa, Homo Sapiens
GLSKVVPLH

SEQ ID NO: 122332 - protein, 9 aa, Homo Sapiens
RDEIATEAY

SEQ ID NO: 122333 - protein, 9 aa, Homo Sapiens
NYTHLSVQC

SEQ ID NO: 122334 - protein, 9 aa, Homo Sapiens
EPGKRSSIS

SEQ ID NO: 122335 - protein, 9 aa, Homo Sapiens
RKRRAPRRT

SEQ ID NO: 122336 - protein, 9 aa, Homo Sapiens
TAKKKAQLH

SEQ ID NO: 122337 - protein, 9 aa, Homo Sapiens
ATSFQSQSD

SEQ ID NO: 122338 - protein, 9 aa, Homo Sapiens
QLKKKHLKA

SEQ ID NO: 122339 - protein, 9 aa, Homo Sapiens
SQVVRKTSS

SEQ ID NO: 122340 - protein, 9 aa, Homo Sapiens
SRPPSSSTP

SEQ ID NO: 122341 - protein, 9 aa, Homo Sapiens
IFDEPMDVR

SEQ ID NO: 122342 - protein, 9 aa, Homo Sapiens
ARRRQRERV

SEQ ID NO: 122343 - protein, 9 aa, Homo Sapiens
EHLTRLKAW

SEQ ID NO: 122344 - protein, 9 aa, Homo Sapiens
LRSMCGAHK

SEQ ID NO: 122345 - protein, 9 aa, Homo Sapiens
RDSSRESVN

SEQ ID NO: 122346 - protein, 9 aa, Homo Sapiens
PRRSPALRA

SEQ ID NO: 122347 - protein, 9 aa, Homo Sapiens
TESGCVTKI

SEQ ID NO: 122348 - protein, 9 aa, Homo Sapiens
FKAAVWRVP

SEQ ID NO: 122349 - protein, 9 aa, Homo Sapiens
GGIGQKGDL

SEQ ID NO: 122350 - protein, 9 aa, Homo Sapiens
QPYRVKAID

SEQ ID NO: 122351 - protein, 9 aa, Homo Sapiens
MAPLSPGAT

SEQ ID NO: 122352 - protein, 9 aa, Homo Sapiens
GHDAHLCLK

SEQ ID NO: 122353 - protein, 9 aa, Homo Sapiens
SVEMLVDCV

SEQ ID NO: 122354 - protein, 9 aa, Homo Sapiens
NTERDQTDK

SEQ ID NO: 122355 - protein, 9 aa, Homo Sapiens
CRTLQRRML

SEQ ID NO: 122356 - protein, 9 aa, Homo Sapiens
QASVRHLGD

SEQ ID NO: 122357 - protein, 9 aa, Homo Sapiens
AITSISSMP

SEQ ID NO: 122358 - protein, 9 aa, Homo Sapiens
SPTVFVAYA

SEQ ID NO: 122359 - protein, 9 aa, Homo Sapiens
ACKFDEYFS

SEQ ID NO: 122360 - protein, 9 aa, Homo Sapiens
AGNRGGALG

SEQ ID NO: 122361 - protein, 9 aa, Homo Sapiens
HTGVKPYNC

SEQ ID NO: 122362 - protein, 9 aa, Homo Sapiens
DAHAVDIWS

SEQ ID NO: 122363 - protein, 9 aa, Homo Sapiens
GPDGYKRDL

SEQ ID NO: 122364 - protein, 9 aa, Homo Sapiens
FKAWTIFKG

SEQ ID NO: 122365 - protein, 9 aa, Homo Sapiens
NVLTMDMPQ

SEQ ID NO: 122366 - protein, 9 aa, Homo Sapiens
CAIHPWRSK

SEQ ID NO: 122367 - protein, 9 aa, Homo Sapiens
YQANGAYSR

SEQ ID NO: 122368 - protein, 9 aa, Homo Sapiens
QPRFNDHKA

SEQ ID NO: 122369 - protein, 9 aa, Homo Sapiens
ENQHQYILV

SEQ ID NO: 122370 - protein, 9 aa, Homo Sapiens
FPESRVTRS

SEQ ID NO: 122371 - protein, 9 aa, Homo Sapiens
FNIFFYDPG

SEQ ID NO: 122372 - protein, 9 aa, Homo Sapiens
LRTCDRCKH

SEQ ID NO: 122373 - protein, 9 aa, Homo Sapiens
PAGPQPRPP

SEQ ID NO: 122374 - protein, 9 aa, Homo Sapiens
NVEHSVGYV

SEQ ID NO: 122375 - protein, 9 aa, Homo Sapiens
SHHRPHQLS

SEQ ID NO: 122376 - protein, 9 aa, Homo Sapiens
TVTGGLAAP

SEQ ID NO: 122377 - protein, 9 aa, Homo Sapiens
GCQKSLQKI

SEQ ID NO: 122378 - protein, 9 aa, Homo Sapiens
ENSSSADGV

SEQ ID NO: 122379 - protein, 9 aa, Homo Sapiens
ACFQLNEQL

SEQ ID NO: 122380 - protein, 9 aa, Homo Sapiens
ALANSETSK

SEQ ID NO: 122381 - protein, 9 aa, Homo Sapiens
ALLRLPWLM

SEQ ID NO: 122382 - protein, 9 aa, Homo Sapiens
PNETLEEAV

SEQ ID NO: 122383 - protein, 9 aa, Homo Sapiens
REEMAETRI

SEQ ID NO: 122384 - protein, 9 aa, Homo Sapiens
VCGQDDVPH

SEQ ID NO: 122385 - protein, 9 aa, Homo Sapiens
TAISLMHKF

SEQ ID NO: 122386 - protein, 9 aa, Homo Sapiens
RATAISLMH

SEQ ID NO: 122387 - protein, 9 aa, Homo Sapiens
KPTPGPTPP

SEQ ID NO: 122388 - protein, 9 aa, Homo Sapiens
TRPPIPHRH

SEQ ID NO: 122389 - protein, 9 aa, Homo Sapiens
KLEWERRRT

SEQ ID NO: 122390 - protein, 9 aa, Homo Sapiens
QGFCCSVNF

SEQ ID NO: 122391 - protein, 9 aa, Homo Sapiens
EGIRLPNGK

SEQ ID NO: 122392 - protein, 9 aa, Homo Sapiens
AQVTGDVET

SEQ ID NO: 122393 - protein, 9 aa, Homo Sapiens
SSKNSLEPY

SEQ ID NO: 122394 - protein, 9 aa, Homo Sapiens
DVGRHRYVY

SEQ ID NO: 122395 - protein, 9 aa, Homo Sapiens
ERRRKGGGR

SEQ ID NO: 122396 - protein, 9 aa, Homo Sapiens
EDLQAVVEK

SEQ ID NO: 122397 - protein, 9 aa, Homo Sapiens
DLDVLEVVG

SEQ ID NO: 122398 - protein, 9 aa, Homo Sapiens
DPRVLVPPI

SEQ ID NO: 122399 - protein, 9 aa, Homo Sapiens
YESICGGDV

SEQ ID NO: 122400 - protein, 9 aa, Homo Sapiens
DSSLPEYNM

SEQ ID NO: 122401 - protein, 9 aa, Homo Sapiens
WIVFSVKEK

SEQ ID NO: 122402 - protein, 9 aa, Homo Sapiens
ELACKQLSQ

SEQ ID NO: 122403 - protein, 9 aa, Homo Sapiens
TCMWPDGSS

SEQ ID NO: 122404 - protein, 9 aa, Homo Sapiens
GSGEPEGRA

SEQ ID NO: 122405 - protein, 9 aa, Homo Sapiens
NGKDDGQNF

SEQ ID NO: 122406 - protein, 9 aa, Homo Sapiens
NPNQVRMRC

SEQ ID NO: 122407 - protein, 9 aa, Homo Sapiens
HIRQHSDGD

SEQ ID NO: 122408 - protein, 9 aa, Homo Sapiens
HRTKPRGER

SEQ ID NO: 122409 - protein, 9 aa, Homo Sapiens
LTEKYKNLQ

SEQ ID NO: 122410 - protein, 9 aa, Homo Sapiens
QLLPLLPRE

SEQ ID NO: 122411 - protein, 9 aa, Homo Sapiens
HKKLYHHKS

SEQ ID NO: 122412 - protein, 9 aa, Homo Sapiens
KVWRDKDGP

SEQ ID NO: 122413 - protein, 9 aa, Homo Sapiens
HPDPHGQGG

SEQ ID NO: 122414 - protein, 9 aa, Homo Sapiens
LLSFRVFCL

SEQ ID NO: 122415 - protein, 9 aa, Homo Sapiens
GRVILGQGT

SEQ ID NO: 122416 - protein, 9 aa, Homo Sapiens
YTKGFVWIS

SEQ ID NO: 122417 - protein, 9 aa, Homo Sapiens
LAARKLQQK

SEQ ID NO: 122418 - protein, 9 aa, Homo Sapiens
WGCLCGRCG

SEQ ID NO: 122419 - protein, 9 aa, Homo Sapiens
NCAVFKAGQ

SEQ ID NO: 122420 - protein, 9 aa, Homo Sapiens
EVRAAGRAV

SEQ ID NO: 122421 - protein, 9 aa, Homo Sapiens
GPRPRCRPH

SEQ ID NO: 122422 - protein, 9 aa, Homo Sapiens
SDSLHFSDV

SEQ ID NO: 122423 - protein, 9 aa, Homo Sapiens
DKSCSSHSN

SEQ ID NO: 122424 - protein, 9 aa, Homo Sapiens
TKKLSINNY

SEQ ID NO: 122425 - protein, 9 aa, Homo Sapiens
PEVAEDRQP

SEQ ID NO: 122426 - protein, 9 aa, Homo Sapiens
PEGPGDREG

SEQ ID NO: 122427 - protein, 9 aa, Homo Sapiens
GATLTSTSC

SEQ ID NO: 122428 - protein, 9 aa, Homo Sapiens
VVKILRALR

SEQ ID NO: 122429 - protein, 9 aa, Homo Sapiens
GETTFAFHL

SEQ ID NO: 122430 - protein, 9 aa, Homo Sapiens
PVHNLRLSV

SEQ ID NO: 122431 - protein, 9 aa, Homo Sapiens
FCLLCWEAL

SEQ ID NO: 122432 - protein, 9 aa, Homo Sapiens
QKCSTCSRL

SEQ ID NO: 122433 - protein, 9 aa, Homo Sapiens
KIRWESAYV

SEQ ID NO: 122434 - protein, 9 aa, Homo Sapiens
AMAQVTHPL

SEQ ID NO: 122435 - protein, 9 aa, Homo Sapiens
VEHSVGYVE

SEQ ID NO: 122436 - protein, 9 aa, Homo Sapiens
LENWKRPQM

SEQ ID NO: 122437 - protein, 9 aa, Homo Sapiens
EVKPLGEEE

SEQ ID NO: 122438 - protein, 9 aa, Homo Sapiens
LPAAVDPDI

SEQ ID NO: 122439 - protein, 9 aa, Homo Sapiens
FLEEVRAAG

SEQ ID NO: 122440 - protein, 9 aa, Homo Sapiens
DVDFLRAQN

SEQ ID NO: 122441 - protein, 9 aa, Homo Sapiens
QYIHCHAKE

SEQ ID NO: 122442 - protein, 9 aa, Homo Sapiens
STNLLTLSP

SEQ ID NO: 122443 - protein, 9 aa, Homo Sapiens
CTGHEYAVK

SEQ ID NO: 122444 - protein, 9 aa, Homo Sapiens
RKPPRLDAC

SEQ ID NO: 122445 - protein, 9 aa, Homo Sapiens
LRRLLGKCK

SEQ ID NO: 122446 - protein, 9 aa, Homo Sapiens
IPAGPKQEL

SEQ ID NO: 122447 - protein, 9 aa, Homo Sapiens
RLQSLLSLY

SEQ ID NO: 122448 - protein, 9 aa, Homo Sapiens
ESGDLATEK

SEQ ID NO: 122449 - protein, 9 aa, Homo Sapiens
QHSDGEEEE

SEQ ID NO: 122450 - protein, 9 aa, Homo Sapiens
KRAEQLKKK

SEQ ID NO: 122451 - protein, 9 aa, Homo Sapiens
HCAKETPRL

SEQ ID NO: 122452 - protein, 9 aa, Homo Sapiens
ANMYQANGA

SEQ ID NO: 122453 - protein, 9 aa, Homo Sapiens
LVATVWACA

SEQ ID NO: 122454 - protein, 9 aa, Homo Sapiens
LEFEEKSRG

SEQ ID NO: 122455 - protein, 9 aa, Homo Sapiens
TPVHVHIKN

SEQ ID NO: 122456 - protein, 9 aa, Homo Sapiens
VEGNDVIEE

SEQ ID NO: 122457 - protein, 9 aa, Homo Sapiens
PGGAAPGPE

SEQ ID NO: 122458 - protein, 9 aa, Homo Sapiens
TDLKINHVM

SEQ ID NO: 122459 - protein, 9 aa, Homo Sapiens
LCNCAVFKA

SEQ ID NO: 122460 - protein, 9 aa, Homo Sapiens
RPRDDELFG

SEQ ID NO: 122461 - protein, 9 aa, Homo Sapiens
TRYRANASR

SEQ ID NO: 122462 - protein, 9 aa, Homo Sapiens
VYTQNVEMR

SEQ ID NO: 122463 - protein, 9 aa, Homo Sapiens
FALKQEDHS

SEQ ID NO: 122464 - protein, 9 aa, Homo Sapiens
DGTEGSEIK

SEQ ID NO: 122465 - protein, 9 aa, Homo Sapiens
LTETSLQER

SEQ ID NO: 122466 - protein, 9 aa, Homo Sapiens
HPRDPPARP

SEQ ID NO: 122467 - protein, 9 aa, Homo Sapiens
THPAFFLLI

SEQ ID NO: 122468 - protein, 9 aa, Homo Sapiens
EESREFNPG

SEQ ID NO: 122469 - protein, 9 aa, Homo Sapiens
QQSKLKEYR

SEQ ID NO: 122470 - protein, 9 aa, Homo Sapiens
GHHMQLESR

SEQ ID NO: 122471 - protein, 9 aa, Homo Sapiens
EPGQGRAVN

SEQ ID NO: 122472 - protein, 9 aa, Homo Sapiens
DLNARNVLK

SEQ ID NO: 122473 - protein, 9 aa, Homo Sapiens
SVRVSPQMV

SEQ ID NO: 122474 - protein, 9 aa, Homo Sapiens
GGGEAATAA

SEQ ID NO: 122475 - protein, 9 aa, Homo Sapiens
ALTILKDSG

SEQ ID NO: 122476 - protein, 9 aa, Homo Sapiens
CFLTQLADF

SEQ ID NO: 122477 - protein, 9 aa, Homo Sapiens
CLCGRCGAT

SEQ ID NO: 122478 - protein, 9 aa, Homo Sapiens
PLAGWARDG

SEQ ID NO: 122479 - protein, 9 aa, Homo Sapiens
DIGINGVQN

SEQ ID NO: 122480 - protein, 9 aa, Homo Sapiens
GFGGMCLTF

SEQ ID NO: 122481 - protein, 9 aa, Homo Sapiens
IKDGEMVFL

SEQ ID NO: 122482 - protein, 9 aa, Homo Sapiens
AMDVHDGKV

SEQ ID NO: 122483 - protein, 9 aa, Homo Sapiens
HSSNNPRDE

SEQ ID NO: 122484 - protein, 9 aa, Homo Sapiens
KQEYLSMSY

SEQ ID NO: 122485 - protein, 9 aa, Homo Sapiens
LQKNKKRRR

SEQ ID NO: 122486 - protein, 9 aa, Homo Sapiens
KHLRNLRGQ

SEQ ID NO: 122487 - protein, 9 aa, Homo Sapiens
RKNVFRLLI

SEQ ID NO: 122488 - protein, 9 aa, Homo Sapiens
PSRSRWPGS

SEQ ID NO: 122489 - protein, 9 aa, Homo Sapiens
DIDNPTLTI

SEQ ID NO: 122490 - protein, 9 aa, Homo Sapiens
CWAEAWWCR

SEQ ID NO: 122491 - protein, 9 aa, Homo Sapiens
ELPDEIAAE

SEQ ID NO: 122492 - protein, 9 aa, Homo Sapiens
CSSWRSSSP

SEQ ID NO: 122493 - protein, 9 aa, Homo Sapiens
VTREKHPDG

SEQ ID NO: 122494 - protein, 9 aa, Homo Sapiens
GPREQCEPV

SEQ ID NO: 122495 - protein, 9 aa, Homo Sapiens
SVNTPVCKD

SEQ ID NO: 122496 - protein, 9 aa, Homo Sapiens
TLCSFGLWF

SEQ ID NO: 122497 - protein, 9 aa, Homo Sapiens
VPKLQVITA

SEQ ID NO: 122498 - protein, 9 aa, Homo Sapiens
VAQYNTTKD

SEQ ID NO: 122499 - protein, 9 aa, Homo Sapiens
VNTVGGTSF

SEQ ID NO: 122500 - protein, 9 aa, Homo Sapiens
HRPHQLSPM

SEQ ID NO: 122501 - protein, 9 aa, Homo Sapiens
SGTPPSPVS

SEQ ID NO: 122502 - protein, 9 aa, Homo Sapiens
DLRNEVLQL

SEQ ID NO: 122503 - protein, 9 aa, Homo Sapiens
KRCIVSHLQ

SEQ ID NO: 122504 - protein, 9 aa, Homo Sapiens
KELKLTDIW

SEQ ID NO: 122505 - protein, 9 aa, Homo Sapiens
MMRCCRRRR

SEQ ID NO: 122506 - protein, 9 aa, Homo Sapiens
IGQVAAILS

SEQ ID NO: 122507 - protein, 9 aa, Homo Sapiens
TGNDKGESN

SEQ ID NO: 122508 - protein, 9 aa, Homo Sapiens
KKHLMRLHP

SEQ ID NO: 122509 - protein, 9 aa, Homo Sapiens
VKIHQDLVF

SEQ ID NO: 122510 - protein, 9 aa, Homo Sapiens
LAELQRVQT

SEQ ID NO: 122511 - protein, 9 aa, Homo Sapiens
CGKVFRVRQ

SEQ ID NO: 122512 - protein, 9 aa, Homo Sapiens
VFLDGGCES

SEQ ID NO: 122513 - protein, 9 aa, Homo Sapiens
KEQTALYRG

SEQ ID NO: 122514 - protein, 9 aa, Homo Sapiens
SSGTSTIRT

SEQ ID NO: 122515 - protein, 9 aa, Homo Sapiens
VRLRLRDNG

SEQ ID NO: 122516 - protein, 9 aa, Homo Sapiens
FHPPQPAGV

SEQ ID NO: 122517 - protein, 9 aa, Homo Sapiens
KGVPLQFSV

SEQ ID NO: 122518 - protein, 9 aa, Homo Sapiens
EAKKEAGFV

SEQ ID NO: 122519 - protein, 9 aa, Homo Sapiens
SDLGGPCPQ

SEQ ID NO: 122520 - protein, 9 aa, Homo Sapiens
TALQIFNNN

SEQ ID NO: 122521 - protein, 9 aa, Homo Sapiens
ALSDYRTNA

SEQ ID NO: 122522 - protein, 9 aa, Homo Sapiens
SLLIALGML

SEQ ID NO: 122523 - protein, 9 aa, Homo Sapiens
ISILEMLLK

SEQ ID NO: 122524 - protein, 9 aa, Homo Sapiens
PIEWLQLED

SEQ ID NO: 122525 - protein, 9 aa, Homo Sapiens
KELGVCGNV

SEQ ID NO: 122526 - protein, 9 aa, Homo Sapiens
PETHPDPHG

SEQ ID NO: 122527 - protein, 9 aa, Homo Sapiens
RSQRSVPET

SEQ ID NO: 122528 - protein, 9 aa, Homo Sapiens
LRGETTFAF

SEQ ID NO: 122529 - protein, 9 aa, Homo Sapiens
ASGHNTLSG

SEQ ID NO: 122530 - protein, 9 aa, Homo Sapiens
LQPGKKKTS

SEQ ID NO: 122531 - protein, 9 aa, Homo Sapiens
YKVDNSRFH

SEQ ID NO: 122532 - protein, 9 aa, Homo Sapiens
VRMRCLLKV

SEQ ID NO: 122533 - protein, 9 aa, Homo Sapiens
SSLCGPSQR

SEQ ID NO: 122534 - protein, 9 aa, Homo Sapiens
LGRWGLKGG

SEQ ID NO: 122535 - protein, 9 aa, Homo Sapiens
SPPHRAAPA

SEQ ID NO: 122536 - protein, 9 aa, Homo Sapiens
TSLYPGLNP

SEQ ID NO: 122537 - protein, 9 aa, Homo Sapiens
VSSSQKRAL

SEQ ID NO: 122538 - protein, 9 aa, Homo Sapiens
EYTSSTGLV

SEQ ID NO: 122539 - protein, 9 aa, Homo Sapiens
APPAGLVWT

SEQ ID NO: 122540 - protein, 9 aa, Homo Sapiens
ILFSKPNVI

SEQ ID NO: 122541 - protein, 9 aa, Homo Sapiens
HTPALPGPR

SEQ ID NO: 122542 - protein, 9 aa, Homo Sapiens
ATAVLNLLI

SEQ ID NO: 122543 - protein, 9 aa, Homo Sapiens
PLLPRLGVG

SEQ ID NO: 122544 - protein, 9 aa, Homo Sapiens
ARNVLKGLC

SEQ ID NO: 122545 - protein, 9 aa, Homo Sapiens
SRKRRAPRR

SEQ ID NO: 122546 - protein, 9 aa, Homo Sapiens
TSPGDMVNS

SEQ ID NO: 122547 - protein, 9 aa, Homo Sapiens
LEVSMCDCE

SEQ ID NO: 122548 - protein, 9 aa, Homo Sapiens
YLSMSYQRK

SEQ ID NO: 122549 - protein, 9 aa, Homo Sapiens
AYSHLTEFV

SEQ ID NO: 122550 - protein, 9 aa, Homo Sapiens
YQQDQSSLV

SEQ ID NO: 122551 - protein, 9 aa, Homo Sapiens
TPKSPSAGP

SEQ ID NO: 122552 - protein, 9 aa, Homo Sapiens
HKNNLVSGM

SEQ ID NO: 122553 - protein, 9 aa, Homo Sapiens
RGTPGSGTS

SEQ ID NO: 122554 - protein, 9 aa, Homo Sapiens
PLDAYSIQR

SEQ ID NO: 122555 - protein, 9 aa, Homo Sapiens
LTDTIEEGT

SEQ ID NO: 122556 - protein, 9 aa, Homo Sapiens
FEKRVYIPL

SEQ ID NO: 122557 - protein, 9 aa, Homo Sapiens
MLRMYPPAF

SEQ ID NO: 122558 - protein, 9 aa, Homo Sapiens
FVVEVWATI

SEQ ID NO: 122559 - protein, 9 aa, Homo Sapiens
FLGGLIAGS

SEQ ID NO: 122560 - protein, 9 aa, Homo Sapiens
VDFSLFCAP

SEQ ID NO: 122561 - protein, 9 aa, Homo Sapiens
LASPLGHHM

SEQ ID NO: 122562 - protein, 9 aa, Homo Sapiens
CRAWLWLAL

SEQ ID NO: 122563 - protein, 9 aa, Homo Sapiens
PHLNSKRNE

SEQ ID NO: 122564 - protein, 9 aa, Homo Sapiens
LFAVGSFRT

SEQ ID NO: 122565 - protein, 9 aa, Homo Sapiens
TAVLNLLIM

SEQ ID NO: 122566 - protein, 9 aa, Homo Sapiens
IHPWRSKGA

SEQ ID NO: 122567 - protein, 9 aa, Homo Sapiens
SEILLLAPH

SEQ ID NO: 122568 - protein, 9 aa, Homo Sapiens
PGSGTSGQS

SEQ ID NO: 122569 - protein, 9 aa, Homo Sapiens
EDLGRSHGR

SEQ ID NO: 122570 - protein, 9 aa, Homo Sapiens
GDMIRMLQC

SEQ ID NO: 122571 - protein, 9 aa, Homo Sapiens
VEDGDGLSK

SEQ ID NO: 122572 - protein, 9 aa, Homo Sapiens
IADETPVCA

SEQ ID NO: 122573 - protein, 9 aa, Homo Sapiens
SWELESSTR

SEQ ID NO: 122574 - protein, 9 aa, Homo Sapiens
WATIGEARE

SEQ ID NO: 122575 - protein, 9 aa, Homo Sapiens
EMKDYTITC

SEQ ID NO: 122576 - protein, 9 aa, Homo Sapiens
VRHEQEVAM

SEQ ID NO: 122577 - protein, 9 aa, Homo Sapiens
YYSWRNPGR

SEQ ID NO: 122578 - protein, 9 aa, Homo Sapiens
GSRSLFFCG

SEQ ID NO: 122579 - protein, 9 aa, Homo Sapiens
DPPEKRQGL

SEQ ID NO: 122580 - protein, 9 aa, Homo Sapiens
LTFNSIFIL

SEQ ID NO: 122581 - protein, 9 aa, Homo Sapiens
SCGQPCPGR

SEQ ID NO: 122582 - protein, 9 aa, Homo Sapiens
IMYPVESVA

SEQ ID NO: 122583 - protein, 9 aa, Homo Sapiens
TPVSSSRLP

SEQ ID NO: 122584 - protein, 9 aa, Homo Sapiens
APARSRGAR

SEQ ID NO: 122585 - protein, 9 aa, Homo Sapiens
RKMPPSTSA

SEQ ID NO: 122586 - protein, 9 aa, Homo Sapiens
MKDKAGKKC

SEQ ID NO: 122587 - protein, 9 aa, Homo Sapiens
LWSGFSMEP

SEQ ID NO: 122588 - protein, 9 aa, Homo Sapiens
PSVYAITSN

SEQ ID NO: 122589 - protein, 9 aa, Homo Sapiens
TDTESASGQ

SEQ ID NO: 122590 - protein, 9 aa, Homo Sapiens
SMSNLGSRN

SEQ ID NO: 122591 - protein, 9 aa, Homo Sapiens
LYDVVWIQV

SEQ ID NO: 122592 - protein, 9 aa, Homo Sapiens
GQMPRKMRH

SEQ ID NO: 122593 - protein, 9 aa, Homo Sapiens
MICPTHGQM

SEQ ID NO: 122594 - protein, 9 aa, Homo Sapiens
RLKTHISNN

SEQ ID NO: 122595 - protein, 9 aa, Homo Sapiens
QKIHNQTTR

SEQ ID NO: 122596 - protein, 9 aa, Homo Sapiens
STSFNLKAD

SEQ ID NO: 122597 - protein, 9 aa, Homo Sapiens
ENIDKYRAP

SEQ ID NO: 122598 - protein, 9 aa, Homo Sapiens
LCSPVGIVR

SEQ ID NO: 122599 - protein, 9 aa, Homo Sapiens
EIKQKLSMN

SEQ ID NO: 122600 - protein, 9 aa, Homo Sapiens
CQLQATASH

SEQ ID NO: 122601 - protein, 9 aa, Homo Sapiens
GGEAATAAV

SEQ ID NO: 122602 - protein, 9 aa, Homo Sapiens
QAKKFEILD

SEQ ID NO: 122603 - protein, 9 aa, Homo Sapiens
TQNDVDREF

SEQ ID NO: 122604 - protein, 9 aa, Homo Sapiens
TVDAPHGIF

SEQ ID NO: 122605 - protein, 9 aa, Homo Sapiens
KAQSERKSG

SEQ ID NO: 122606 - protein, 9 aa, Homo Sapiens
SSRENRAPK

SEQ ID NO: 122607 - protein, 9 aa, Homo Sapiens
QGWPGSNHW

SEQ ID NO: 122608 - protein, 9 aa, Homo Sapiens
QTPASLMIT

SEQ ID NO: 122609 - protein, 9 aa, Homo Sapiens
VKAGVPAGW

SEQ ID NO: 122610 - protein, 9 aa, Homo Sapiens
GTSFLSPTV

SEQ ID NO: 122611 - protein, 9 aa, Homo Sapiens
STPASSRVQ

SEQ ID NO: 122612 - protein, 9 aa, Homo Sapiens
IQQLPMFQP

SEQ ID NO: 122613 - protein, 9 aa, Homo Sapiens
LCAQHNGSE

SEQ ID NO: 122614 - protein, 9 aa, Homo Sapiens
PKEVLLKRV

SEQ ID NO: 122615 - protein, 9 aa, Homo Sapiens
HAEQYRIDA

SEQ ID NO: 122616 - protein, 9 aa, Homo Sapiens
INTCARFCK

SEQ ID NO: 122617 - protein, 9 aa, Homo Sapiens
SMYSDALMV

SEQ ID NO: 122618 - protein, 9 aa, Homo Sapiens
RVLQVGALA

SEQ ID NO: 122619 - protein, 9 aa, Homo Sapiens
ESHITLASP

SEQ ID NO: 122620 - protein, 9 aa, Homo Sapiens
EKQLELLDL

SEQ ID NO: 122621 - protein, 9 aa, Homo Sapiens
NLGKMAYLT

SEQ ID NO: 122622 - protein, 9 aa, Homo Sapiens
NYNINTCAR

SEQ ID NO: 122623 - protein, 9 aa, Homo Sapiens
CVRIIPYNS

SEQ ID NO: 122624 - protein, 9 aa, Homo Sapiens
CHICVPCGL

SEQ ID NO: 122625 - protein, 9 aa, Homo Sapiens
SSALANSET

SEQ ID NO: 122626 - protein, 9 aa, Homo Sapiens
VNLDSLGLS

SEQ ID NO: 122627 - protein, 9 aa, Homo Sapiens
HVTVRPPGS

SEQ ID NO: 122628 - protein, 9 aa, Homo Sapiens
PAPDGQPQG

SEQ ID NO: 122629 - protein, 9 aa, Homo Sapiens
THAGNKQGK

SEQ ID NO: 122630 - protein, 9 aa, Homo Sapiens
LVGPEKKTW

SEQ ID NO: 122631 - protein, 9 aa, Homo Sapiens
KRLVNESNH

SEQ ID NO: 122632 - protein, 9 aa, Homo Sapiens
LMLKSFTYE

SEQ ID NO: 122633 - protein, 9 aa, Homo Sapiens
RNVLKGLCG

SEQ ID NO: 122634 - protein, 9 aa, Homo Sapiens
FGSGSRHRK

SEQ ID NO: 122635 - protein, 9 aa, Homo Sapiens
MSNLGSRNH

SEQ ID NO: 122636 - protein, 9 aa, Homo Sapiens
PELPLEARH

SEQ ID NO: 122637 - protein, 9 aa, Homo Sapiens
PNVISQLEQ

SEQ ID NO: 122638 - protein, 9 aa, Homo Sapiens
EPEAKEAEA

SEQ ID NO: 122639 - protein, 9 aa, Homo Sapiens
EEDEEYVEE

SEQ ID NO: 122640 - protein, 9 aa, Homo Sapiens
KKDEQISGS

SEQ ID NO: 122641 - protein, 9 aa, Homo Sapiens
CVYDLTSLA

SEQ ID NO: 122642 - protein, 9 aa, Homo Sapiens
KKAFSQYAH

SEQ ID NO: 122643 - protein, 9 aa, Homo Sapiens
VPPLMWKLG

SEQ ID NO: 122644 - protein, 9 aa, Homo Sapiens
IHIIAFFPF

SEQ ID NO: 122645 - protein, 9 aa, Homo Sapiens
KLHRRIHTG

SEQ ID NO: 122646 - protein, 9 aa, Homo Sapiens
IAVFQGKKN

SEQ ID NO: 122647 - protein, 9 aa, Homo Sapiens
ENFFLLCGN

SEQ ID NO: 122648 - protein, 9 aa, Homo Sapiens
FQVDNVLTM

SEQ ID NO: 122649 - protein, 9 aa, Homo Sapiens
ECSEILLLA

SEQ ID NO: 122650 - protein, 9 aa, Homo Sapiens
APANKHRAD

SEQ ID NO: 122651 - protein, 9 aa, Homo Sapiens
HLWTQPTLG

SEQ ID NO: 122652 - protein, 9 aa, Homo Sapiens
AVWRVPGCA

SEQ ID NO: 122653 - protein, 9 aa, Homo Sapiens
ELFAVGSFR

SEQ ID NO: 122654 - protein, 9 aa, Homo Sapiens
TSAVDFFQL

SEQ ID NO: 122655 - protein, 9 aa, Homo Sapiens
GQGLQLLLN

SEQ ID NO: 122656 - protein, 9 aa, Homo Sapiens
NCQDSWRWA

SEQ ID NO: 122657 - protein, 9 aa, Homo Sapiens
HPLQRSWRK

SEQ ID NO: 122658 - protein, 9 aa, Homo Sapiens
YLDSHKLPM

SEQ ID NO: 122659 - protein, 9 aa, Homo Sapiens
RGFPSRSRW

SEQ ID NO: 122660 - protein, 9 aa, Homo Sapiens
IDNLNPVLR

SEQ ID NO: 122661 - protein, 9 aa, Homo Sapiens
VPHSTFFDP

SEQ ID NO: 122662 - protein, 9 aa, Homo Sapiens
APVTDVDFL

SEQ ID NO: 122663 - protein, 9 aa, Homo Sapiens
DVFKKNIEK

SEQ ID NO: 122664 - protein, 9 aa, Homo Sapiens
DKKREQRKK

SEQ ID NO: 122665 - protein, 9 aa, Homo Sapiens
SGRLRDPVT

SEQ ID NO: 122666 - protein, 9 aa, Homo Sapiens
LTRIFRILK

SEQ ID NO: 122667 - protein, 9 aa, Homo Sapiens
LESYVTDKE

SEQ ID NO: 122668 - protein, 9 aa, Homo Sapiens
RARSTSTST

SEQ ID NO: 122669 - protein, 9 aa, Homo Sapiens
LQQVPCSPL

SEQ ID NO: 122670 - protein, 9 aa, Homo Sapiens
TREKELTRH

SEQ ID NO: 122671 - protein, 9 aa, Homo Sapiens
SDGARPVGM

SEQ ID NO: 122672 - protein, 9 aa, Homo Sapiens
LNFAKLIQE

SEQ ID NO: 122673 - protein, 9 aa, Homo Sapiens
GAPGGGGSP

SEQ ID NO: 122674 - protein, 9 aa, Homo Sapiens
VSNQKIKLI

SEQ ID NO: 122675 - protein, 9 aa, Homo Sapiens
SGSHRRHWG

SEQ ID NO: 122676 - protein, 9 aa, Homo Sapiens
FGGMCLTFT

SEQ ID NO: 122677 - protein, 9 aa, Homo Sapiens
TNGSKQLPA

SEQ ID NO: 122678 - protein, 9 aa, Homo Sapiens
PQYLAVLNL

SEQ ID NO: 122679 - protein, 9 aa, Homo Sapiens
GMSKPPCYE

SEQ ID NO: 122680 - protein, 9 aa, Homo Sapiens
FRTLQPNGS

SEQ ID NO: 122681 - protein, 9 aa, Homo Sapiens
LPQDFLRIM

SEQ ID NO: 122682 - protein, 9 aa, Homo Sapiens
WKPFLSNSL

SEQ ID NO: 122683 - protein, 9 aa, Homo Sapiens
ESVLRAHRL

SEQ ID NO: 122684 - protein, 9 aa, Homo Sapiens
TLVAFQGHY

SEQ ID NO: 122685 - protein, 9 aa, Homo Sapiens
KSVVLLVVS

SEQ ID NO: 122686 - protein, 9 aa, Homo Sapiens
CWGWHWEGW

SEQ ID NO: 122687 - protein, 9 aa, Homo Sapiens
VAFQGHYFW

SEQ ID NO: 122688 - protein, 9 aa, Homo Sapiens
SFLEEVRAA

SEQ ID NO: 122689 - protein, 9 aa, Homo Sapiens
CTKAGGVCF

SEQ ID NO: 122690 - protein, 9 aa, Homo Sapiens
SLLGKKLGR

SEQ ID NO: 122691 - protein, 9 aa, Homo Sapiens
NKKKIIKVW

SEQ ID NO: 122692 - protein, 9 aa, Homo Sapiens
HCRPAQNNA

SEQ ID NO: 122693 - protein, 9 aa, Homo Sapiens
IEEPIQVKR

SEQ ID NO: 122694 - protein, 9 aa, Homo Sapiens
LHSNCLVSL

SEQ ID NO: 122695 - protein, 9 aa, Homo Sapiens
RGPWRAATQ

SEQ ID NO: 122696 - protein, 9 aa, Homo Sapiens
TQPHVTVRP

SEQ ID NO: 122697 - protein, 9 aa, Homo Sapiens
NGNNLIFQY

SEQ ID NO: 122698 - protein, 9 aa, Homo Sapiens
NHWNNPSAP

SEQ ID NO: 122699 - protein, 9 aa, Homo Sapiens
CGLGNRGSK

SEQ ID NO: 122700 - protein, 9 aa, Homo Sapiens
VTTLKKIRR

SEQ ID NO: 122701 - protein, 9 aa, Homo Sapiens
YYNFLQCTE

SEQ ID NO: 122702 - protein, 9 aa, Homo Sapiens
TRVVDHYEN

SEQ ID NO: 122703 - protein, 9 aa, Homo Sapiens
SLFSVSFSQ

SEQ ID NO: 122704 - protein, 9 aa, Homo Sapiens
FLRIMPTQQ

SEQ ID NO: 122705 - protein, 9 aa, Homo Sapiens
VEIIEGEYN

SEQ ID NO: 122706 - protein, 9 aa, Homo Sapiens
NYSYEIGSW

SEQ ID NO: 122707 - protein, 9 aa, Homo Sapiens
RVLQKKHLR

SEQ ID NO: 122708 - protein, 9 aa, Homo Sapiens
LRPCKLDFF

SEQ ID NO: 122709 - protein, 9 aa, Homo Sapiens
ELQLPGNRL

SEQ ID NO: 122710 - protein, 9 aa, Homo Sapiens
INPTISCPF

SEQ ID NO: 122711 - protein, 9 aa, Homo Sapiens
QGILWTIRL

SEQ ID NO: 122712 - protein, 9 aa, Homo Sapiens
GDCSPTRML

SEQ ID NO: 122713 - protein, 9 aa, Homo Sapiens
TETSLQERL

SEQ ID NO: 122714 - protein, 9 aa, Homo Sapiens
MDSSLQEIR

SEQ ID NO: 122715 - protein, 9 aa, Homo Sapiens
EALPGAERT

SEQ ID NO: 122716 - protein, 9 aa, Homo Sapiens
ETDTYYRAR

SEQ ID NO: 122717 - protein, 9 aa, Homo Sapiens
GQKCSTCSR

SEQ ID NO: 122718 - protein, 9 aa, Homo Sapiens
LLVLRNIST

SEQ ID NO: 122719 - protein, 9 aa, Homo Sapiens
RTNMIMTMN

SEQ ID NO: 122720 - protein, 9 aa, Homo Sapiens
AVAPPWVPH

SEQ ID NO: 122721 - protein, 9 aa, Homo Sapiens
EFDIIPSPN

SEQ ID NO: 122722 - protein, 9 aa, Homo Sapiens
LGWLINDQL

SEQ ID NO: 122723 - protein, 9 aa, Homo Sapiens
KQVIKPNSE

SEQ ID NO: 122724 - protein, 9 aa, Homo Sapiens
SFSSKVKDW

SEQ ID NO: 122725 - protein, 9 aa, Homo Sapiens
TLVNPEGMV

SEQ ID NO: 122726 - protein, 9 aa, Homo Sapiens
HAIMEIEEY

SEQ ID NO: 122727 - protein, 9 aa, Homo Sapiens
TPVCKDPGL

SEQ ID NO: 122728 - protein, 9 aa, Homo Sapiens
YRALCVPPS

SEQ ID NO: 122729 - protein, 9 aa, Homo Sapiens
RPAARNLTS

SEQ ID NO: 122730 - protein, 9 aa, Homo Sapiens
QLIPCKPSC

SEQ ID NO: 122731 - protein, 9 aa, Homo Sapiens
ALEGLPRLP

SEQ ID NO: 122732 - protein, 9 aa, Homo Sapiens
LLAHIMSRL

SEQ ID NO: 122733 - protein, 9 aa, Homo Sapiens
QLHFAAESI

SEQ ID NO: 122734 - protein, 9 aa, Homo Sapiens
ACGLGNRGS

SEQ ID NO: 122735 - protein, 9 aa, Homo Sapiens
LFLAQCLRW

SEQ ID NO: 122736 - protein, 9 aa, Homo Sapiens
TKFNVWRKR

SEQ ID NO: 122737 - protein, 9 aa, Homo Sapiens
PFLPYTCLT

SEQ ID NO: 122738 - protein, 9 aa, Homo Sapiens
SNSSNWKQD

SEQ ID NO: 122739 - protein, 9 aa, Homo Sapiens
FIAVMYRET

SEQ ID NO: 122740 - protein, 9 aa, Homo Sapiens
KRHYAFQTE

SEQ ID NO: 122741 - protein, 9 aa, Homo Sapiens
LFLFRMTWK

SEQ ID NO: 122742 - protein, 9 aa, Homo Sapiens
KYKNLQYGI

SEQ ID NO: 122743 - protein, 9 aa, Homo Sapiens
LIKLFGMFW

SEQ ID NO: 122744 - protein, 9 aa, Homo Sapiens
PGPTPPAAS

SEQ ID NO: 122745 - protein, 9 aa, Homo Sapiens
SLPGSSDSP

SEQ ID NO: 122746 - protein, 9 aa, Homo Sapiens
WEKLTDAMV

SEQ ID NO: 122747 - protein, 9 aa, Homo Sapiens
VGRPLDTVQ

SEQ ID NO: 122748 - protein, 9 aa, Homo Sapiens
MTLTNSCLI

SEQ ID NO: 122749 - protein, 9 aa, Homo Sapiens
VVNFDLPSD

SEQ ID NO: 122750 - protein, 9 aa, Homo Sapiens
CPKILNFNC

SEQ ID NO: 122751 - protein, 9 aa, Homo Sapiens
SEPVTSKVS

SEQ ID NO: 122752 - protein, 9 aa, Homo Sapiens
DRNLGSPLM

SEQ ID NO: 122753 - protein, 9 aa, Homo Sapiens
LIHIIAFFP

SEQ ID NO: 122754 - protein, 9 aa, Homo Sapiens
STLIKLFGM

SEQ ID NO: 122755 - protein, 9 aa, Homo Sapiens
PTMVQGPAG

SEQ ID NO: 122756 - protein, 9 aa, Homo Sapiens
TDVVTTLKK

SEQ ID NO: 122757 - protein, 9 aa, Homo Sapiens
STNNCPHGM

SEQ ID NO: 122758 - protein, 9 aa, Homo Sapiens
RELLRHHFR

SEQ ID NO: 122759 - protein, 9 aa, Homo Sapiens
RLQEPLERR

SEQ ID NO: 122760 - protein, 9 aa, Homo Sapiens
AARAGRFGT

SEQ ID NO: 122761 - protein, 9 aa, Homo Sapiens
RFPTLTVSR

SEQ ID NO: 122762 - protein, 9 aa, Homo Sapiens
SSDLLDFVL

SEQ ID NO: 122763 - protein, 9 aa, Homo Sapiens
IFNGNNLIF

SEQ ID NO: 122764 - protein, 9 aa, Homo Sapiens
EPEFNSVKE

SEQ ID NO: 122765 - protein, 9 aa, Homo Sapiens
PPEPQGQPR

SEQ ID NO: 122766 - protein, 9 aa, Homo Sapiens
VSTMTSCSM

SEQ ID NO: 122767 - protein, 9 aa, Homo Sapiens
LALIAGPYV

SEQ ID NO: 122768 - protein, 9 aa, Homo Sapiens
RACGLGNRG

SEQ ID NO: 122769 - protein, 9 aa, Homo Sapiens
GRSSDSEWP

SEQ ID NO: 122770 - protein, 9 aa, Homo Sapiens
SQGSLIDLL

SEQ ID NO: 122771 - protein, 9 aa, Homo Sapiens
PLKKSRQCS

SEQ ID NO: 122772 - protein, 9 aa, Homo Sapiens
GSALCPFQD

SEQ ID NO: 122773 - protein, 9 aa, Homo Sapiens
MNKCLTEEQ

SEQ ID NO: 122774 - protein, 9 aa, Homo Sapiens
PCWGWHWEG

SEQ ID NO: 122775 - protein, 9 aa, Homo Sapiens
FVPPPTPMV

SEQ ID NO: 122776 - protein, 9 aa, Homo Sapiens
RVSFAARDG

SEQ ID NO: 122777 - protein, 9 aa, Homo Sapiens
VSVPVPKKL

SEQ ID NO: 122778 - protein, 9 aa, Homo Sapiens
SAVKKVVSA

SEQ ID NO: 122779 - protein, 9 aa, Homo Sapiens
SPLPPQLSV

SEQ ID NO: 122780 - protein, 9 aa, Homo Sapiens
IPSRMIQKT

SEQ ID NO: 122781 - protein, 9 aa, Homo Sapiens
DGDGLSKVV

SEQ ID NO: 122782 - protein, 9 aa, Homo Sapiens
AEPVADPEQ

SEQ ID NO: 122783 - protein, 9 aa, Homo Sapiens
GTGFFRDIS

SEQ ID NO: 122784 - protein, 9 aa, Homo Sapiens
IEEYLIDMA

SEQ ID NO: 122785 - protein, 9 aa, Homo Sapiens
AAHLACEHH

SEQ ID NO: 122786 - protein, 9 aa, Homo Sapiens
NRICGFLVI

SEQ ID NO: 122787 - protein, 9 aa, Homo Sapiens
PSVPKKTGP

SEQ ID NO: 122788 - protein, 9 aa, Homo Sapiens
AQLYDRYLA

SEQ ID NO: 122789 - protein, 9 aa, Homo Sapiens
RHHTREIFV

SEQ ID NO: 122790 - protein, 9 aa, Homo Sapiens
LSVRTGNDK

SEQ ID NO: 122791 - protein, 9 aa, Homo Sapiens
EACPPGFYN

SEQ ID NO: 122792 - protein, 9 aa, Homo Sapiens
EIQASESRA

SEQ ID NO: 122793 - protein, 9 aa, Homo Sapiens
LRIMPTQQQ

SEQ ID NO: 122794 - protein, 9 aa, Homo Sapiens
RPGRICSPV

SEQ ID NO: 122795 - protein, 9 aa, Homo Sapiens
FFPFFFILV

SEQ ID NO: 122796 - protein, 9 aa, Homo Sapiens
RSMEVLTQL

SEQ ID NO: 122797 - protein, 9 aa, Homo Sapiens
AVYESICGG

SEQ ID NO: 122798 - protein, 9 aa, Homo Sapiens
LWLALMVVH

SEQ ID NO: 122799 - protein, 9 aa, Homo Sapiens
ECGRAFFIS

SEQ ID NO: 122800 - protein, 9 aa, Homo Sapiens
SVQCEGVLQ

SEQ ID NO: 122801 - protein, 9 aa, Homo Sapiens
DPYLLKTGH

SEQ ID NO: 122802 - protein, 9 aa, Homo Sapiens
PSGDFILVR

SEQ ID NO: 122803 - protein, 9 aa, Homo Sapiens
ETRFSNENY

SEQ ID NO: 122804 - protein, 9 aa, Homo Sapiens
RLFVNRFGR

SEQ ID NO: 122805 - protein, 9 aa, Homo Sapiens
NTHTFEFWN

SEQ ID NO: 122806 - protein, 9 aa, Homo Sapiens
ELKAEASLI

SEQ ID NO: 122807 - protein, 9 aa, Homo Sapiens
FPASSPYVN

SEQ ID NO: 122808 - protein, 9 aa, Homo Sapiens
CLVIQHFCN

SEQ ID NO: 122809 - protein, 9 aa, Homo Sapiens
LEKHFFTEG

SEQ ID NO: 122810 - protein, 9 aa, Homo Sapiens
RHQDSPSPD

SEQ ID NO: 122811 - protein, 9 aa, Homo Sapiens
EYFVCTKAG

SEQ ID NO: 122812 - protein, 9 aa, Homo Sapiens
MTAKKKAQL

SEQ ID NO: 122813 - protein, 9 aa, Homo Sapiens
CEKKMLSVF

SEQ ID NO: 122814 - protein, 9 aa, Homo Sapiens
VQHQNRNPG

SEQ ID NO: 122815 - protein, 9 aa, Homo Sapiens
KRKTANYER

SEQ ID NO: 122816 - protein, 9 aa, Homo Sapiens
IWNLNPVFG

SEQ ID NO: 122817 - protein, 9 aa, Homo Sapiens
PKTTTTTPG

SEQ ID NO: 122818 - protein, 9 aa, Homo Sapiens
SMEPLTFVL

SEQ ID NO: 122819 - protein, 9 aa, Homo Sapiens
ETFSAPLEL

SEQ ID NO: 122820 - protein, 9 aa, Homo Sapiens
KNNLLRQQL

SEQ ID NO: 122821 - protein, 9 aa, Homo Sapiens
GGEEDLTIE

SEQ ID NO: 122822 - protein, 9 aa, Homo Sapiens
AAARGASTS

SEQ ID NO: 122823 - protein, 9 aa, Homo Sapiens
YQRKDSQQS

SEQ ID NO: 122824 - protein, 9 aa, Homo Sapiens
EYAGNDNYC

SEQ ID NO: 122825 - protein, 9 aa, Homo Sapiens
DRPGRVQCF

SEQ ID NO: 122826 - protein, 9 aa, Homo Sapiens
VGRQYLVQQ

SEQ ID NO: 122827 - protein, 9 aa, Homo Sapiens
DWCCVPVPT

SEQ ID NO: 122828 - protein, 9 aa, Homo Sapiens
GPLSPCKDA

SEQ ID NO: 122829 - protein, 9 aa, Homo Sapiens
AAFSSALYR

SEQ ID NO: 122830 - protein, 9 aa, Homo Sapiens
GAVPERVVK

SEQ ID NO: 122831 - protein, 9 aa, Homo Sapiens
FCTQYGSPA

SEQ ID NO: 122832 - protein, 9 aa, Homo Sapiens
MYNNTQGSF

SEQ ID NO: 122833 - protein, 9 aa, Homo Sapiens
RGDTAVREA

SEQ ID NO: 122834 - protein, 9 aa, Homo Sapiens
WDKYGLTSV

SEQ ID NO: 122835 - protein, 9 aa, Homo Sapiens
SQLISFCLS

SEQ ID NO: 122836 - protein, 9 aa, Homo Sapiens
VVAPEEQNS

SEQ ID NO: 122837 - protein, 9 aa, Homo Sapiens
KFETLEPEV

SEQ ID NO: 122838 - protein, 9 aa, Homo Sapiens
DPLHIRQHS

SEQ ID NO: 122839 - protein, 9 aa, Homo Sapiens
SHHGSRSQS

SEQ ID NO: 122840 - protein, 9 aa, Homo Sapiens
QTSLNIKEY

SEQ ID NO: 122841 - protein, 9 aa, Homo Sapiens
FSYSSVFRK

SEQ ID NO: 122842 - protein, 9 aa, Homo Sapiens
TCSRRPPSA

SEQ ID NO: 122843 - protein, 9 aa, Homo Sapiens
DPDSNTWHT

SEQ ID NO: 122844 - protein, 9 aa, Homo Sapiens
IDFGSANIF

SEQ ID NO: 122845 - protein, 9 aa, Homo Sapiens
ASFPSTNLQ

SEQ ID NO: 122846 - protein, 9 aa, Homo Sapiens
PQDFLRIMP

SEQ ID NO: 122847 - protein, 9 aa, Homo Sapiens
LQHDASRLE

SEQ ID NO: 122848 - protein, 9 aa, Homo Sapiens
YLLAVDFTA

SEQ ID NO: 122849 - protein, 9 aa, Homo Sapiens
NGRDRKQFS

SEQ ID NO: 122850 - protein, 9 aa, Homo Sapiens
LFSRSLSSS

SEQ ID NO: 122851 - protein, 9 aa, Homo Sapiens
SVILKDVVK

SEQ ID NO: 122852 - protein, 9 aa, Homo Sapiens
QLADFLANR

SEQ ID NO: 122853 - protein, 9 aa, Homo Sapiens
MARRNALRE

SEQ ID NO: 122854 - protein, 9 aa, Homo Sapiens
ALAAAAQPP

SEQ ID NO: 122855 - protein, 9 aa, Homo Sapiens
HMDITGEET

SEQ ID NO: 122856 - protein, 9 aa, Homo Sapiens
FGKKKGPNT

SEQ ID NO: 122857 - protein, 9 aa, Homo Sapiens
YSQDVLMLP

SEQ ID NO: 122858 - protein, 9 aa, Homo Sapiens
GMYQRFLRR

SEQ ID NO: 122859 - protein, 9 aa, Homo Sapiens
TRFSNENYV

SEQ ID NO: 122860 - protein, 9 aa, Homo Sapiens
DKVNSMVQQ

SEQ ID NO: 122861 - protein, 9 aa, Homo Sapiens
VKDVQQVEP

SEQ ID NO: 122862 - protein, 9 aa, Homo Sapiens
ALCVPPSPI

SEQ ID NO: 122863 - protein, 9 aa, Homo Sapiens
KPNSEHFRT

SEQ ID NO: 122864 - protein, 9 aa, Homo Sapiens
TEEHVLVVH

SEQ ID NO: 122865 - protein, 9 aa, Homo Sapiens
KKRRRIHGQ

SEQ ID NO: 122866 - protein, 9 aa, Homo Sapiens
ILLLGDEQR

SEQ ID NO: 122867 - protein, 9 aa, Homo Sapiens
SLKNVLLVM

SEQ ID NO: 122868 - protein, 9 aa, Homo Sapiens
KKLEWERRR

SEQ ID NO: 122869 - protein, 9 aa, Homo Sapiens
PDHREGHLT

SEQ ID NO: 122870 - protein, 9 aa, Homo Sapiens
EPSNPSMAV

SEQ ID NO: 122871 - protein, 9 aa, Homo Sapiens
LNALCKAVA

SEQ ID NO: 122872 - protein, 9 aa, Homo Sapiens
ESIEFDIIP

SEQ ID NO: 122873 - protein, 9 aa, Homo Sapiens
GKCKFRDLT

SEQ ID NO: 122874 - protein, 9 aa, Homo Sapiens
SITVSWSQP

SEQ ID NO: 122875 - protein, 9 aa, Homo Sapiens
PLRLRSMCG

SEQ ID NO: 122876 - protein, 9 aa, Homo Sapiens
QTRRSPCPP

SEQ ID NO: 122877 - protein, 9 aa, Homo Sapiens
QMTRTVTTI

SEQ ID NO: 122878 - protein, 9 aa, Homo Sapiens
GTEFVPGTA

SEQ ID NO: 122879 - protein, 9 aa, Homo Sapiens
STGLVPCSA

SEQ ID NO: 122880 - protein, 9 aa, Homo Sapiens
SCARLEKFT

SEQ ID NO: 122881 - protein, 9 aa, Homo Sapiens
SEATPLGCI

SEQ ID NO: 122882 - protein, 9 aa, Homo Sapiens
RKRRRGSSP

SEQ ID NO: 122883 - protein, 9 aa, Homo Sapiens
FILVRTQHP

SEQ ID NO: 122884 - protein, 9 aa, Homo Sapiens
KVQTTNEVK

SEQ ID NO: 122885 - protein, 9 aa, Homo Sapiens
ACVGNVKQT

SEQ ID NO: 122886 - protein, 9 aa, Homo Sapiens
NESPKKKPK

SEQ ID NO: 122887 - protein, 9 aa, Homo Sapiens
ARRTDPGPW

SEQ ID NO: 122888 - protein, 9 aa, Homo Sapiens
GAGERLFTP

SEQ ID NO: 122889 - protein, 9 aa, Homo Sapiens
LRQVHGADA

SEQ ID NO: 122890 - protein, 9 aa, Homo Sapiens
HWQKKGDKQ

SEQ ID NO: 122891 - protein, 9 aa, Homo Sapiens
LAPASRGPS

SEQ ID NO: 122892 - protein, 9 aa, Homo Sapiens
KHALNHHPL

SEQ ID NO: 122893 - protein, 9 aa, Homo Sapiens
KISLKLFPE

SEQ ID NO: 122894 - protein, 9 aa, Homo Sapiens
SGTILAYCS

SEQ ID NO: 122895 - protein, 9 aa, Homo Sapiens
SKASIPTSL

SEQ ID NO: 122896 - protein, 9 aa, Homo Sapiens
SAHLCNNEE

SEQ ID NO: 122897 - protein, 9 aa, Homo Sapiens
IKKPDAPPP

SEQ ID NO: 122898 - protein, 9 aa, Homo Sapiens
KDPRVLVPP

SEQ ID NO: 122899 - protein, 9 aa, Homo Sapiens
SSEGTASSN

SEQ ID NO: 122900 - protein, 9 aa, Homo Sapiens
VSVQVDRVK

SEQ ID NO: 122901 - protein, 9 aa, Homo Sapiens
VVRNYWRGF

SEQ ID NO: 122902 - protein, 9 aa, Homo Sapiens
PLVGLAKLL

SEQ ID NO: 122903 - protein, 9 aa, Homo Sapiens
ATAHGLFRR

SEQ ID NO: 122904 - protein, 9 aa, Homo Sapiens
TEEERKLLG

SEQ ID NO: 122905 - protein, 9 aa, Homo Sapiens
LLGKKLGRT

SEQ ID NO: 122906 - protein, 9 aa, Homo Sapiens
EELQKNKKR

SEQ ID NO: 122907 - protein, 9 aa, Homo Sapiens
IDELHHKAG

SEQ ID NO: 122908 - protein, 9 aa, Homo Sapiens
VNKLRVKTR

SEQ ID NO: 122909 - protein, 9 aa, Homo Sapiens
WKPAVIFST

SEQ ID NO: 122910 - protein, 9 aa, Homo Sapiens
DKVCVWQLY

SEQ ID NO: 122911 - protein, 9 aa, Homo Sapiens
QLPFLVAAA

SEQ ID NO: 122912 - protein, 9 aa, Homo Sapiens
KGRSISTKA

SEQ ID NO: 122913 - protein, 9 aa, Homo Sapiens
VVLEDGTEA

SEQ ID NO: 122914 - protein, 9 aa, Homo Sapiens
PGRICSPVG

SEQ ID NO: 122915 - protein, 9 aa, Homo Sapiens
KKQKCIKPK

SEQ ID NO: 122916 - protein, 9 aa, Homo Sapiens
TRIKKVVGQ

SEQ ID NO: 122917 - protein, 9 aa, Homo Sapiens
GGATRDVAP

SEQ ID NO: 122918 - protein, 9 aa, Homo Sapiens
HTYPVCYPP

SEQ ID NO: 122919 - protein, 9 aa, Homo Sapiens
KKILSSIQT

SEQ ID NO: 122920 - protein, 9 aa, Homo Sapiens
PQASLTAAH

SEQ ID NO: 122921 - protein, 9 aa, Homo Sapiens
APQEEEEEV

SEQ ID NO: 122922 - protein, 9 aa, Homo Sapiens
MNATIQQAI

SEQ ID NO: 122923 - protein, 9 aa, Homo Sapiens
GLLQVSLGE

SEQ ID NO: 122924 - protein, 9 aa, Homo Sapiens
LSPLVGEDD

SEQ ID NO: 122925 - protein, 9 aa, Homo Sapiens
KCSTCSRLY

SEQ ID NO: 122926 - protein, 9 aa, Homo Sapiens
RRTLNLKAA

SEQ ID NO: 122927 - protein, 9 aa, Homo Sapiens
RLAELQRVQ

SEQ ID NO: 122928 - protein, 9 aa, Homo Sapiens
LHHHLPTTM

SEQ ID NO: 122929 - protein, 9 aa, Homo Sapiens
GEKPFKCKN

SEQ ID NO: 122930 - protein, 9 aa, Homo Sapiens
LLVNMGGNR

SEQ ID NO: 122931 - protein, 9 aa, Homo Sapiens
KGLPEGYSV

SEQ ID NO: 122932 - protein, 9 aa, Homo Sapiens
RSAQEEGEP

SEQ ID NO: 122933 - protein, 9 aa, Homo Sapiens
NLNPVLRDN

SEQ ID NO: 122934 - protein, 9 aa, Homo Sapiens
PSFPKTTTT

SEQ ID NO: 122935 - protein, 9 aa, Homo Sapiens
KEAGFVESA

SEQ ID NO: 122936 - protein, 9 aa, Homo Sapiens
PPDDLLQDM

SEQ ID NO: 122937 - protein, 9 aa, Homo Sapiens
CHLKERVLM

SEQ ID NO: 122938 - protein, 9 aa, Homo Sapiens
RNLHPPRMK

SEQ ID NO: 122939 - protein, 9 aa, Homo Sapiens
MKVSLLFLF

SEQ ID NO: 122940 - protein, 9 aa, Homo Sapiens
IPERAFQST

SEQ ID NO: 122941 - protein, 9 aa, Homo Sapiens
VDSDVAFIA

SEQ ID NO: 122942 - protein, 9 aa, Homo Sapiens
SSRDHSINY

SEQ ID NO: 122943 - protein, 9 aa, Homo Sapiens
RVDRSLLLY

SEQ ID NO: 122944 - protein, 9 aa, Homo Sapiens
SCSTMSCLS

SEQ ID NO: 122945 - protein, 9 aa, Homo Sapiens
PMTAKKKAQ

SEQ ID NO: 122946 - protein, 9 aa, Homo Sapiens
EEFSKLQNT

SEQ ID NO: 122947 - protein, 9 aa, Homo Sapiens
WLKNGDRLN

SEQ ID NO: 122948 - protein, 9 aa, Homo Sapiens
AKKFEILDS

SEQ ID NO: 122949 - protein, 9 aa, Homo Sapiens
EQLTVNITP

SEQ ID NO: 122950 - protein, 9 aa, Homo Sapiens
AVIWLDTSL

SEQ ID NO: 122951 - protein, 9 aa, Homo Sapiens
KVFNQQVHL

SEQ ID NO: 122952 - protein, 9 aa, Homo Sapiens
CTTPPRGDF

SEQ ID NO: 122953 - protein, 9 aa, Homo Sapiens
ALLQRSGDQ

SEQ ID NO: 122954 - protein, 9 aa, Homo Sapiens
IHGQHEVHG

SEQ ID NO: 122955 - protein, 9 aa, Homo Sapiens
RLHRPWAPA

SEQ ID NO: 122956 - protein, 9 aa, Homo Sapiens
GMVGRAGPA

SEQ ID NO: 122957 - protein, 9 aa, Homo Sapiens
PERVVKDDS

SEQ ID NO: 122958 - protein, 9 aa, Homo Sapiens
HPPQQLHHP

SEQ ID NO: 122959 - protein, 9 aa, Homo Sapiens
YRQFCVKLS

SEQ ID NO: 122960 - protein, 9 aa, Homo Sapiens
LPCAPPPPI

SEQ ID NO: 122961 - protein, 9 aa, Homo Sapiens
LHRAARAGR

SEQ ID NO: 122962 - protein, 9 aa, Homo Sapiens
EDKYFCENR

SEQ ID NO: 122963 - protein, 9 aa, Homo Sapiens
VYTLLLTLA

SEQ ID NO: 122964 - protein, 9 aa, Homo Sapiens
SSQPLLDRS

SEQ ID NO: 122965 - protein, 9 aa, Homo Sapiens
GYKRDLMTA

SEQ ID NO: 122966 - protein, 9 aa, Homo Sapiens
RILRKSSAV

SEQ ID NO: 122967 - protein, 9 aa, Homo Sapiens
QLVAKLRLN

SEQ ID NO: 122968 - protein, 9 aa, Homo Sapiens
VHGRDREIK

SEQ ID NO: 122969 - protein, 9 aa, Homo Sapiens
AESLVEKHL

SEQ ID NO: 122970 - protein, 9 aa, Homo Sapiens
VSKVTEVSK

SEQ ID NO: 122971 - protein, 9 aa, Homo Sapiens
GDGSCDMRY

SEQ ID NO: 122972 - protein, 9 aa, Homo Sapiens
CPWRNLLAH

SEQ ID NO: 122973 - protein, 9 aa, Homo Sapiens
LVTVDPAIR

SEQ ID NO: 122974 - protein, 9 aa, Homo Sapiens
VTLNFRRNK

SEQ ID NO: 122975 - protein, 9 aa, Homo Sapiens
SSLSYNSSG

SEQ ID NO: 122976 - protein, 9 aa, Homo Sapiens
QRKDSQQSK

SEQ ID NO: 122977 - protein, 9 aa, Homo Sapiens
ARGAPQSVR

SEQ ID NO: 122978 - protein, 9 aa, Homo Sapiens
VTHPLVHIT

SEQ ID NO: 122979 - protein, 9 aa, Homo Sapiens
DLPYLNLDT

SEQ ID NO: 122980 - protein, 9 aa, Homo Sapiens
MLKVTCFGM

SEQ ID NO: 122981 - protein, 9 aa, Homo Sapiens
AAQLIVTKE

SEQ ID NO: 122982 - protein, 9 aa, Homo Sapiens
VSKLFWLSS

SEQ ID NO: 122983 - protein, 9 aa, Homo Sapiens
SQVKLGSVA

SEQ ID NO: 122984 - protein, 9 aa, Homo Sapiens
STLKCQLEH

SEQ ID NO: 122985 - protein, 9 aa, Homo Sapiens
RLNFSAMVL

SEQ ID NO: 122986 - protein, 9 aa, Homo Sapiens
LDFQEEPMT

SEQ ID NO: 122987 - protein, 9 aa, Homo Sapiens
ENDPKENKV

SEQ ID NO: 122988 - protein, 9 aa, Homo Sapiens
TTGPTATPS

SEQ ID NO: 122989 - protein, 9 aa, Homo Sapiens
MHKFIAYQF

SEQ ID NO: 122990 - protein, 9 aa, Homo Sapiens
VQICMPLTD

SEQ ID NO: 122991 - protein, 9 aa, Homo Sapiens
AIRLLLSLD

SEQ ID NO: 122992 - protein, 9 aa, Homo Sapiens
KRAGQNSDA

SEQ ID NO: 122993 - protein, 9 aa, Homo Sapiens
TKARSLDLV

SEQ ID NO: 122994 - protein, 9 aa, Homo Sapiens
YSDQKICKG

SEQ ID NO: 122995 - protein, 9 aa, Homo Sapiens
KAGVPAGWG

SEQ ID NO: 122996 - protein, 9 aa, Homo Sapiens
GRAFSLSFH

SEQ ID NO: 122997 - protein, 9 aa, Homo Sapiens
LSSHWLDEY

SEQ ID NO: 122998 - protein, 9 aa, Homo Sapiens
KEENQAVKG

SEQ ID NO: 122999 - protein, 9 aa, Homo Sapiens
NYTVDWYYS

SEQ ID NO: 123000 - protein, 9 aa, Homo Sapiens
YGKKRKWGA

SEQ ID NO: 123001 - protein, 9 aa, Homo Sapiens
LLILICDQL

SEQ ID NO: 123002 - protein, 9 aa, Homo Sapiens
AEPALSDYR

SEQ ID NO: 123003 - protein, 9 aa, Homo Sapiens
AGLCNCAVF

SEQ ID NO: 123004 - protein, 9 aa, Homo Sapiens
AVSSQPLLD

SEQ ID NO: 123005 - protein, 9 aa, Homo Sapiens
VSGMRVPKS

SEQ ID NO: 123006 - protein, 9 aa, Homo Sapiens
TNKMKTQNV

SEQ ID NO: 123007 - protein, 9 aa, Homo Sapiens
FAWRTLTGG

SEQ ID NO: 123008 - protein, 9 aa, Homo Sapiens
HVSEASLIR

SEQ ID NO: 123009 - protein, 9 aa, Homo Sapiens
LSSPNSNLS

SEQ ID NO: 123010 - protein, 9 aa, Homo Sapiens
SGVQMAHAG

SEQ ID NO: 123011 - protein, 9 aa, Homo Sapiens
HLPIMRKRK

SEQ ID NO: 123012 - protein, 9 aa, Homo Sapiens
ALWQRCAIQ

SEQ ID NO: 123013 - protein, 9 aa, Homo Sapiens
GTGIVSVPV

SEQ ID NO: 123014 - protein, 9 aa, Homo Sapiens
PSAEGGEED

SEQ ID NO: 123015 - protein, 9 aa, Homo Sapiens
IAGIAIHAM

SEQ ID NO: 123016 - protein, 9 aa, Homo Sapiens
WGALWLLSP

SEQ ID NO: 123017 - protein, 9 aa, Homo Sapiens
LNDCFKKVA

SEQ ID NO: 123018 - protein, 9 aa, Homo Sapiens
ALIAGPYVI

SEQ ID NO: 123019 - protein, 9 aa, Homo Sapiens
DLLRESEHF

SEQ ID NO: 123020 - protein, 9 aa, Homo Sapiens
ITLRQCDAE

SEQ ID NO: 123021 - protein, 9 aa, Homo Sapiens
LNHHPLQRS

SEQ ID NO: 123022 - protein, 9 aa, Homo Sapiens
PNSPQGTLY

SEQ ID NO: 123023 - protein, 9 aa, Homo Sapiens
DEKEVVVDT

SEQ ID NO: 123024 - protein, 9 aa, Homo Sapiens
FYNARRQEH

SEQ ID NO: 123025 - protein, 9 aa, Homo Sapiens
LNSHFSDLS

SEQ ID NO: 123026 - protein, 9 aa, Homo Sapiens
ERLNFSAMV

SEQ ID NO: 123027 - protein, 9 aa, Homo Sapiens
GPGDREGYL

SEQ ID NO: 123028 - protein, 9 aa, Homo Sapiens
ASGAACIRG

SEQ ID NO: 123029 - protein, 9 aa, Homo Sapiens
PRLPHCQLQ

SEQ ID NO: 123030 - protein, 9 aa, Homo Sapiens
RGAATSADG

SEQ ID NO: 123031 - protein, 9 aa, Homo Sapiens
WACPWCNAI

SEQ ID NO: 123032 - protein, 9 aa, Homo Sapiens
LGTCMWPDG

SEQ ID NO: 123033 - protein, 9 aa, Homo Sapiens
FLCRPVKAG

SEQ ID NO: 123034 - protein, 9 aa, Homo Sapiens
LGCNEKTPW

SEQ ID NO: 123035 - protein, 9 aa, Homo Sapiens
KDKGEDQVH

SEQ ID NO: 123036 - protein, 9 aa, Homo Sapiens
LSPCRCYGS

SEQ ID NO: 123037 - protein, 9 aa, Homo Sapiens
YLLCLSRLV

SEQ ID NO: 123038 - protein, 9 aa, Homo Sapiens
RAGPAPRVP

SEQ ID NO: 123039 - protein, 9 aa, Homo Sapiens
TSFQSQSDG

SEQ ID NO: 123040 - protein, 9 aa, Homo Sapiens
DLSRSLPAL

SEQ ID NO: 123041 - protein, 9 aa, Homo Sapiens
DRAGRMGGR

SEQ ID NO: 123042 - protein, 9 aa, Homo Sapiens
LSSVSTGHT

SEQ ID NO: 123043 - protein, 9 aa, Homo Sapiens
LLYSLVRVI

SEQ ID NO: 123044 - protein, 9 aa, Homo Sapiens
PLKIRASAS

SEQ ID NO: 123045 - protein, 9 aa, Homo Sapiens
MPPGASPQR

SEQ ID NO: 123046 - protein, 9 aa, Homo Sapiens
SVKMTFVIV

SEQ ID NO: 123047 - protein, 9 aa, Homo Sapiens
LDLPQPLAE

SEQ ID NO: 123048 - protein, 9 aa, Homo Sapiens
TGHFEEAAG

SEQ ID NO: 123049 - protein, 9 aa, Homo Sapiens
SSTASAATS

SEQ ID NO: 123050 - protein, 9 aa, Homo Sapiens
LHLHHHLPT

SEQ ID NO: 123051 - protein, 9 aa, Homo Sapiens
QESVRAGNL

SEQ ID NO: 123052 - protein, 9 aa, Homo Sapiens
PRETSSWSG

SEQ ID NO: 123053 - protein, 9 aa, Homo Sapiens
LVQQLTLLQ

SEQ ID NO: 123054 - protein, 9 aa, Homo Sapiens
EVTDPSTLE

SEQ ID NO: 123055 - protein, 9 aa, Homo Sapiens
AYRLIMPPI

SEQ ID NO: 123056 - protein, 9 aa, Homo Sapiens
RRSPALRAR

SEQ ID NO: 123057 - protein, 9 aa, Homo Sapiens
HCVGQKMKR

SEQ ID NO: 123058 - protein, 9 aa, Homo Sapiens
TPVDLAEFP

SEQ ID NO: 123059 - protein, 9 aa, Homo Sapiens
GIPVALLHH

SEQ ID NO: 123060 - protein, 9 aa, Homo Sapiens
SGDLATEKE

SEQ ID NO: 123061 - protein, 9 aa, Homo Sapiens
QRSKWRKQE

SEQ ID NO: 123062 - protein, 9 aa, Homo Sapiens
LPPQLSVTP

SEQ ID NO: 123063 - protein, 9 aa, Homo Sapiens
QAESGMSKP

SEQ ID NO: 123064 - protein, 9 aa, Homo Sapiens
RLLGKCKFR

SEQ ID NO: 123065 - protein, 9 aa, Homo Sapiens
FQSTCALPS

SEQ ID NO: 123066 - protein, 9 aa, Homo Sapiens
PANMYQANG

SEQ ID NO: 123067 - protein, 9 aa, Homo Sapiens
ILEEIASFG

SEQ ID NO: 123068 - protein, 9 aa, Homo Sapiens
AEKRRLCSP

SEQ ID NO: 123069 - protein, 9 aa, Homo Sapiens
FSNLPPTQT

SEQ ID NO: 123070 - protein, 9 aa, Homo Sapiens
HNFCLVSKV

SEQ ID NO: 123071 - protein, 9 aa, Homo Sapiens
PPAGHLGRS

SEQ ID NO: 123072 - protein, 9 aa, Homo Sapiens
SVSIPTGKG

SEQ ID NO: 123073 - protein, 9 aa, Homo Sapiens
SPILVVLAS

SEQ ID NO: 123074 - protein, 9 aa, Homo Sapiens
GRHTTGTTT

SEQ ID NO: 123075 - protein, 9 aa, Homo Sapiens
HLACEHHSP

SEQ ID NO: 123076 - protein, 9 aa, Homo Sapiens
EWQQLSERE

SEQ ID NO: 123077 - protein, 9 aa, Homo Sapiens
GQGGQPAEA

SEQ ID NO: 123078 - protein, 9 aa, Homo Sapiens
MHMRGLLEP

SEQ ID NO: 123079 - protein, 9 aa, Homo Sapiens
MWQFPAHYR

SEQ ID NO: 123080 - protein, 9 aa, Homo Sapiens
LQHLIANNN

SEQ ID NO: 123081 - protein, 9 aa, Homo Sapiens
RTLRLCDKT

SEQ ID NO: 123082 - protein, 9 aa, Homo Sapiens
SSSPPIKNT

SEQ ID NO: 123083 - protein, 9 aa, Homo Sapiens
YADASGHNT

SEQ ID NO: 123084 - protein, 9 aa, Homo Sapiens
KTREKELTR

SEQ ID NO: 123085 - protein, 9 aa, Homo Sapiens
MMRRRRRDG

SEQ ID NO: 123086 - protein, 9 aa, Homo Sapiens
EYMLHIGAQ

SEQ ID NO: 123087 - protein, 9 aa, Homo Sapiens
SAGPSPHLL

SEQ ID NO: 123088 - protein, 9 aa, Homo Sapiens
HFCTQYGSP

SEQ ID NO: 123089 - protein, 9 aa, Homo Sapiens
PVKAGVPAG

SEQ ID NO: 123090 - protein, 9 aa, Homo Sapiens
MGDKFKGQL

SEQ ID NO: 123091 - protein, 9 aa, Homo Sapiens
PVYYRLSSY

SEQ ID NO: 123092 - protein, 9 aa, Homo Sapiens
SKNGDGLKN

SEQ ID NO: 123093 - protein, 9 aa, Homo Sapiens
HGGGGGEAA

SEQ ID NO: 123094 - protein, 9 aa, Homo Sapiens
ADSQSHIME

SEQ ID NO: 123095 - protein, 9 aa, Homo Sapiens
ISMHYFCLI

SEQ ID NO: 123096 - protein, 9 aa, Homo Sapiens
DSRVVLDLP

SEQ ID NO: 123097 - protein, 9 aa, Homo Sapiens
LQAVVEKVR

SEQ ID NO: 123098 - protein, 9 aa, Homo Sapiens
DLHNFQNMF

SEQ ID NO: 123099 - protein, 9 aa, Homo Sapiens
VRPLSSIRN

SEQ ID NO: 123100 - protein, 9 aa, Homo Sapiens
LAHDGLGHS

SEQ ID NO: 123101 - protein, 9 aa, Homo Sapiens
RPAEFLPFM

SEQ ID NO: 123102 - protein, 9 aa, Homo Sapiens
LSDSPPLQD

SEQ ID NO: 123103 - protein, 9 aa, Homo Sapiens
GSSARWRSS

SEQ ID NO: 123104 - protein, 9 aa, Homo Sapiens
LTEHLARCE

SEQ ID NO: 123105 - protein, 9 aa, Homo Sapiens
MCTVEELNE

SEQ ID NO: 123106 - protein, 9 aa, Homo Sapiens
VTGDVETSH

SEQ ID NO: 123107 - protein, 9 aa, Homo Sapiens
LQSVQPTEG

SEQ ID NO: 123108 - protein, 9 aa, Homo Sapiens
MEELRSLVE

SEQ ID NO: 123109 - protein, 9 aa, Homo Sapiens
SLETRFSNE

SEQ ID NO: 123110 - protein, 9 aa, Homo Sapiens
IRLPRKEEN

SEQ ID NO: 123111 - protein, 9 aa, Homo Sapiens
LMCFLRRRS

SEQ ID NO: 123112 - protein, 9 aa, Homo Sapiens
TKGFVWISW

SEQ ID NO: 123113 - protein, 9 aa, Homo Sapiens
RQHTISPLD

SEQ ID NO: 123114 - protein, 9 aa, Homo Sapiens
RISSKQEYL

SEQ ID NO: 123115 - protein, 9 aa, Homo Sapiens
AEGGLLACS

SEQ ID NO: 123116 - protein, 9 aa, Homo Sapiens
LNKVQTTNE

SEQ ID NO: 123117 - protein, 9 aa, Homo Sapiens
LEDGTEARS

SEQ ID NO: 123118 - protein, 9 aa, Homo Sapiens
DVGEAGAER

SEQ ID NO: 123119 - protein, 9 aa, Homo Sapiens
NTSVSSILI

SEQ ID NO: 123120 - protein, 9 aa, Homo Sapiens
LLAHSGAVA

SEQ ID NO: 123121 - protein, 9 aa, Homo Sapiens
EVLKNIYRK

SEQ ID NO: 123122 - protein, 9 aa, Homo Sapiens
GPPPTMVQG

SEQ ID NO: 123123 - protein, 9 aa, Homo Sapiens
LAVAKALTN

SEQ ID NO: 123124 - protein, 9 aa, Homo Sapiens
VTLYSQDVL

SEQ ID NO: 123125 - protein, 9 aa, Homo Sapiens
RLPHCQLQG

SEQ ID NO: 123126 - protein, 9 aa, Homo Sapiens
RAGNRGGAL

SEQ ID NO: 123127 - protein, 9 aa, Homo Sapiens
EDLEKVLEL

SEQ ID NO: 123128 - protein, 9 aa, Homo Sapiens
AIDVNKVVE

SEQ ID NO: 123129 - protein, 9 aa, Homo Sapiens
GRQTPASLM

SEQ ID NO: 123130 - protein, 9 aa, Homo Sapiens
RSPCPPMPT

SEQ ID NO: 123131 - protein, 9 aa, Homo Sapiens
SFGQGAEGG

SEQ ID NO: 123132 - protein, 9 aa, Homo Sapiens
PSSWDYSSG

SEQ ID NO: 123133 - protein, 9 aa, Homo Sapiens
AQHEFHGLG

SEQ ID NO: 123134 - protein, 9 aa, Homo Sapiens
LHRQVHYPF

SEQ ID NO: 123135 - protein, 9 aa, Homo Sapiens
SHMKGCDTL

SEQ ID NO: 123136 - protein, 9 aa, Homo Sapiens
TGCHVPGSV

SEQ ID NO: 123137 - protein, 9 aa, Homo Sapiens
CPPTSCPSW

SEQ ID NO: 123138 - protein, 9 aa, Homo Sapiens
LVDPRKVLI

SEQ ID NO: 123139 - protein, 9 aa, Homo Sapiens
IEKCDCSLG

SEQ ID NO: 123140 - protein, 9 aa, Homo Sapiens
KYLSFTPLE

SEQ ID NO: 123141 - protein, 9 aa, Homo Sapiens
YTITCGKAD

SEQ ID NO: 123142 - protein, 9 aa, Homo Sapiens
LHRPWAPAD

SEQ ID NO: 123143 - protein, 9 aa, Homo Sapiens
RPPSAASRP

SEQ ID NO: 123144 - protein, 9 aa, Homo Sapiens
WDPPPGAAG

SEQ ID NO: 123145 - protein, 9 aa, Homo Sapiens
MNEDAQEEP

SEQ ID NO: 123146 - protein, 9 aa, Homo Sapiens
SKVTEVSKT

SEQ ID NO: 123147 - protein, 9 aa, Homo Sapiens
AQLTKPALK

SEQ ID NO: 123148 - protein, 9 aa, Homo Sapiens
TSGDSPRGS

SEQ ID NO: 123149 - protein, 9 aa, Homo Sapiens
LTQLADFLA

SEQ ID NO: 123150 - protein, 9 aa, Homo Sapiens
VTISHAIGK

SEQ ID NO: 123151 - protein, 9 aa, Homo Sapiens
QEPLERRKG

SEQ ID NO: 123152 - protein, 9 aa, Homo Sapiens
DRKQFSPIL

SEQ ID NO: 123153 - protein, 9 aa, Homo Sapiens
MGGRHPSWP

SEQ ID NO: 123154 - protein, 9 aa, Homo Sapiens
NASADLMSY

SEQ ID NO: 123155 - protein, 9 aa, Homo Sapiens
AGPVGEMVP

SEQ ID NO: 123156 - protein, 9 aa, Homo Sapiens
ALIAGIAIH

SEQ ID NO: 123157 - protein, 9 aa, Homo Sapiens
ETFSQHLQV

SEQ ID NO: 123158 - protein, 9 aa, Homo Sapiens
LLVVSVVAH

SEQ ID NO: 123159 - protein, 9 aa, Homo Sapiens
WRRPKTPCG

SEQ ID NO: 123160 - protein, 9 aa, Homo Sapiens
SLHFSDVFR

SEQ ID NO: 123161 - protein, 9 aa, Homo Sapiens
RPLAHSVAS

SEQ ID NO: 123162 - protein, 9 aa, Homo Sapiens
LGKCKFRDL

SEQ ID NO: 123163 - protein, 9 aa, Homo Sapiens
RCPRQGKPN

SEQ ID NO: 123164 - protein, 9 aa, Homo Sapiens
TLSHFSASE

SEQ ID NO: 123165 - protein, 9 aa, Homo Sapiens
VGVSCVGGF

SEQ ID NO: 123166 - protein, 9 aa, Homo Sapiens
GPEGPGDRE

SEQ ID NO: 123167 - protein, 9 aa, Homo Sapiens
NEMTHKFNQ

SEQ ID NO: 123168 - protein, 9 aa, Homo Sapiens
IFPPLEKTM

SEQ ID NO: 123169 - protein, 9 aa, Homo Sapiens
FPQQHCAKE

SEQ ID NO: 123170 - protein, 9 aa, Homo Sapiens
KKEAGFVES

SEQ ID NO: 123171 - protein, 9 aa, Homo Sapiens
VHLQDHHLH

SEQ ID NO: 123172 - protein, 9 aa, Homo Sapiens
ALASPTVLG

SEQ ID NO: 123173 - protein, 9 aa, Homo Sapiens
PPGEGKGQS

SEQ ID NO: 123174 - protein, 9 aa, Homo Sapiens
QGAEGGLLA

SEQ ID NO: 123175 - protein, 9 aa, Homo Sapiens
PPSVRSTRK

SEQ ID NO: 123176 - protein, 9 aa, Homo Sapiens
SRRQPRVMS

SEQ ID NO: 123177 - protein, 9 aa, Homo Sapiens
PLSPCKDAG

SEQ ID NO: 123178 - protein, 9 aa, Homo Sapiens
KRRAPRRTR

SEQ ID NO: 123179 - protein, 9 aa, Homo Sapiens
AALASTILS

SEQ ID NO: 123180 - protein, 9 aa, Homo Sapiens
YKKILEISP

SEQ ID NO: 123181 - protein, 9 aa, Homo Sapiens
QENGFGSLY

SEQ ID NO: 123182 - protein, 9 aa, Homo Sapiens
RYSRLKASC

SEQ ID NO: 123183 - protein, 9 aa, Homo Sapiens
QQKKHLGKL

SEQ ID NO: 123184 - protein, 9 aa, Homo Sapiens
IHFPDHREG

SEQ ID NO: 123185 - protein, 9 aa, Homo Sapiens
KNGDGLKNT

SEQ ID NO: 123186 - protein, 9 aa, Homo Sapiens
TPEVAEDRQ

SEQ ID NO: 123187 - protein, 9 aa, Homo Sapiens
PCPLPLKRR

SEQ ID NO: 123188 - protein, 9 aa, Homo Sapiens
PKPGPGQTT

SEQ ID NO: 123189 - protein, 9 aa, Homo Sapiens
IEVDSPAER

SEQ ID NO: 123190 - protein, 9 aa, Homo Sapiens
LILEFEEKS

SEQ ID NO: 123191 - protein, 9 aa, Homo Sapiens
TATHCFPRR

SEQ ID NO: 123192 - protein, 9 aa, Homo Sapiens
AYSLCRYRQ

SEQ ID NO: 123193 - protein, 9 aa, Homo Sapiens
RLQPRLDHV

SEQ ID NO: 123194 - protein, 9 aa, Homo Sapiens
LSPRHGNHR

SEQ ID NO: 123195 - protein, 9 aa, Homo Sapiens
GPGAPTPEE

SEQ ID NO: 123196 - protein, 9 aa, Homo Sapiens
QTQTSTFSG

SEQ ID NO: 123197 - protein, 9 aa, Homo Sapiens
CRGAATSAD

SEQ ID NO: 123198 - protein, 9 aa, Homo Sapiens
AILLLGDEQ

SEQ ID NO: 123199 - protein, 9 aa, Homo Sapiens
FFETSTYPK

SEQ ID NO: 123200 - protein, 9 aa, Homo Sapiens
KAQVTLMTL

SEQ ID NO: 123201 - protein, 9 aa, Homo Sapiens
GHLYRSFCL

SEQ ID NO: 123202 - protein, 9 aa, Homo Sapiens
AEFLPFMAP

SEQ ID NO: 123203 - protein, 9 aa, Homo Sapiens
NSMTSSQIY

SEQ ID NO: 123204 - protein, 9 aa, Homo Sapiens
EVVGELQVL

SEQ ID NO: 123205 - protein, 9 aa, Homo Sapiens
TSTYPKDGE

SEQ ID NO: 123206 - protein, 9 aa, Homo Sapiens
AHDGLGHSR

SEQ ID NO: 123207 - protein, 9 aa, Homo Sapiens
SVEIIEGEY

SEQ ID NO: 123208 - protein, 9 aa, Homo Sapiens
RNMLERGEA

SEQ ID NO: 123209 - protein, 9 aa, Homo Sapiens
AIGPREQCE

SEQ ID NO: 123210 - protein, 9 aa, Homo Sapiens
KRLHNNLIS

SEQ ID NO: 123211 - protein, 9 aa, Homo Sapiens
IYGLIERIE

SEQ ID NO: 123212 - protein, 9 aa, Homo Sapiens
TMTSCSMAP

SEQ ID NO: 123213 - protein, 9 aa, Homo Sapiens
APATEVGCP

SEQ ID NO: 123214 - protein, 9 aa, Homo Sapiens
RAVGDSAYS

SEQ ID NO: 123215 - protein, 9 aa, Homo Sapiens
GGPRGRAQL

SEQ ID NO: 123216 - protein, 9 aa, Homo Sapiens
VPINSVNLD

SEQ ID NO: 123217 - protein, 9 aa, Homo Sapiens
PPMPTRRSL

SEQ ID NO: 123218 - protein, 9 aa, Homo Sapiens
LQPGEKKSQ

SEQ ID NO: 123219 - protein, 9 aa, Homo Sapiens
LSCLFLKHE

SEQ ID NO: 123220 - protein, 9 aa, Homo Sapiens
GGRCAIHPW

SEQ ID NO: 123221 - protein, 9 aa, Homo Sapiens
QFSPILVVL

SEQ ID NO: 123222 - protein, 9 aa, Homo Sapiens
NSQGEDVIY

SEQ ID NO: 123223 - protein, 9 aa, Homo Sapiens
EEEEENGRK

SEQ ID NO: 123224 - protein, 9 aa, Homo Sapiens
MQEQQANLQ

SEQ ID NO: 123225 - protein, 9 aa, Homo Sapiens
ALMPRLDTG

SEQ ID NO: 123226 - protein, 9 aa, Homo Sapiens
TLIKLFGMF

SEQ ID NO: 123227 - protein, 9 aa, Homo Sapiens
VLEFPVCGL

SEQ ID NO: 123228 - protein, 9 aa, Homo Sapiens
ERIKVSNAS

SEQ ID NO: 123229 - protein, 9 aa, Homo Sapiens
YNSQGEDVI

SEQ ID NO: 123230 - protein, 9 aa, Homo Sapiens
KVHIDQHKG

SEQ ID NO: 123231 - protein, 9 aa, Homo Sapiens
VDPDIGING

SEQ ID NO: 123232 - protein, 9 aa, Homo Sapiens
ILVSLTLAF

SEQ ID NO: 123233 - protein, 9 aa, Homo Sapiens
KLFGMFWAA

SEQ ID NO: 123234 - protein, 9 aa, Homo Sapiens
QCLRWLCDS

SEQ ID NO: 123235 - protein, 9 aa, Homo Sapiens
LARHASIEL

SEQ ID NO: 123236 - protein, 9 aa, Homo Sapiens
TPSYLSVSL

SEQ ID NO: 123237 - protein, 9 aa, Homo Sapiens
QKEQTALYR

SEQ ID NO: 123238 - protein, 9 aa, Homo Sapiens
VVCASVVQV

SEQ ID NO: 123239 - protein, 9 aa, Homo Sapiens
PRGTPGSGT

SEQ ID NO: 123240 - protein, 9 aa, Homo Sapiens
HTYDYDGDG

SEQ ID NO: 123241 - protein, 9 aa, Homo Sapiens
GAGDVGKSA

SEQ ID NO: 123242 - protein, 9 aa, Homo Sapiens
GRCGATSSR

SEQ ID NO: 123243 - protein, 9 aa, Homo Sapiens
RWRPAARSG

SEQ ID NO: 123244 - protein, 9 aa, Homo Sapiens
HVTCMQSQR

SEQ ID NO: 123245 - protein, 9 aa, Homo Sapiens
EELKKKIRD

SEQ ID NO: 123246 - protein, 9 aa, Homo Sapiens
HVLQHAQDG

SEQ ID NO: 123247 - protein, 9 aa, Homo Sapiens
CMNKCWEIY

SEQ ID NO: 123248 - protein, 9 aa, Homo Sapiens
LGSEVWRRV

SEQ ID NO: 123249 - protein, 9 aa, Homo Sapiens
STPGRGRQS

SEQ ID NO: 123250 - protein, 9 aa, Homo Sapiens
AEQLKKKHL

SEQ ID NO: 123251 - protein, 9 aa, Homo Sapiens
THTGCHVPG

SEQ ID NO: 123252 - protein, 9 aa, Homo Sapiens
RAPALEGLP

SEQ ID NO: 123253 - protein, 9 aa, Homo Sapiens
AQYSVTLYS

SEQ ID NO: 123254 - protein, 9 aa, Homo Sapiens
TLLLTLARP

SEQ ID NO: 123255 - protein, 9 aa, Homo Sapiens
IDTLTWLST

SEQ ID NO: 123256 - protein, 9 aa, Homo Sapiens
EGWHWGAAP

SEQ ID NO: 123257 - protein, 9 aa, Homo Sapiens
GPYANTTKH

SEQ ID NO: 123258 - protein, 9 aa, Homo Sapiens
LPLEARHAV

SEQ ID NO: 123259 - protein, 9 aa, Homo Sapiens
DVALLEDVD

SEQ ID NO: 123260 - protein, 9 aa, Homo Sapiens
HEEAEEKSV

SEQ ID NO: 123261 - protein, 9 aa, Homo Sapiens
YTQVKNLMN

SEQ ID NO: 123262 - protein, 9 aa, Homo Sapiens
LEKKLEWER

SEQ ID NO: 123263 - protein, 9 aa, Homo Sapiens
ICHRVLEAH

SEQ ID NO: 123264 - protein, 9 aa, Homo Sapiens
FLCCVTAAL

SEQ ID NO: 123265 - protein, 9 aa, Homo Sapiens
AHQLLSGED

SEQ ID NO: 123266 - protein, 9 aa, Homo Sapiens
SPPQRPEGP

SEQ ID NO: 123267 - protein, 9 aa, Homo Sapiens
LGKMCLSVE

SEQ ID NO: 123268 - protein, 9 aa, Homo Sapiens
ASKVKSLKS

SEQ ID NO: 123269 - protein, 9 aa, Homo Sapiens
LNGFGGMCL

SEQ ID NO: 123270 - protein, 9 aa, Homo Sapiens
RWVKIITPY

SEQ ID NO: 123271 - protein, 9 aa, Homo Sapiens
IFPLVYATP

SEQ ID NO: 123272 - protein, 9 aa, Homo Sapiens
GKEEAQEAQ

SEQ ID NO: 123273 - protein, 9 aa, Homo Sapiens
MVCTLTQFV

SEQ ID NO: 123274 - protein, 9 aa, Homo Sapiens
QHSDGDRRL

SEQ ID NO: 123275 - protein, 9 aa, Homo Sapiens
QVTRRSLDY

SEQ ID NO: 123276 - protein, 9 aa, Homo Sapiens
EPYAFNMKA

SEQ ID NO: 123277 - protein, 9 aa, Homo Sapiens
GVLDPLHIR

SEQ ID NO: 123278 - protein, 9 aa, Homo Sapiens
PPCRRPPPP

SEQ ID NO: 123279 - protein, 9 aa, Homo Sapiens
SVQEYRRSE

SEQ ID NO: 123280 - protein, 9 aa, Homo Sapiens
PESRVTRSR

SEQ ID NO: 123281 - protein, 9 aa, Homo Sapiens
RQSKIFFRT

SEQ ID NO: 123282 - protein, 9 aa, Homo Sapiens
LCPSRSDSE

SEQ ID NO: 123283 - protein, 9 aa, Homo Sapiens
QNQLAHILA

SEQ ID NO: 123284 - protein, 9 aa, Homo Sapiens
SDEVTCQLQ

SEQ ID NO: 123285 - protein, 9 aa, Homo Sapiens
ILGQGTRGI

SEQ ID NO: 123286 - protein, 9 aa, Homo Sapiens
LVRDRMLAQ

SEQ ID NO: 123287 - protein, 9 aa, Homo Sapiens
ANSTWTGMV

SEQ ID NO: 123288 - protein, 9 aa, Homo Sapiens
LGFLVREEV

SEQ ID NO: 123289 - protein, 9 aa, Homo Sapiens
GACKAKYNV

SEQ ID NO: 123290 - protein, 9 aa, Homo Sapiens
YPQLPGQEA

SEQ ID NO: 123291 - protein, 9 aa, Homo Sapiens
ITDSHQQYL

SEQ ID NO: 123292 - protein, 9 aa, Homo Sapiens
IIKVWRDKD

SEQ ID NO: 123293 - protein, 9 aa, Homo Sapiens
RQVRSRESN

SEQ ID NO: 123294 - protein, 9 aa, Homo Sapiens
NFHRSPRIR

SEQ ID NO: 123295 - protein, 9 aa, Homo Sapiens
LLSPSRKRR

SEQ ID NO: 123296 - protein, 9 aa, Homo Sapiens
SVGHDAHLC

SEQ ID NO: 123297 - protein, 9 aa, Homo Sapiens
GPQPRPPTA

SEQ ID NO: 123298 - protein, 9 aa, Homo Sapiens
ENCLTNFHG

SEQ ID NO: 123299 - protein, 9 aa, Homo Sapiens
KKTWYLLAV

SEQ ID NO: 123300 - protein, 9 aa, Homo Sapiens
VKIIQFIAH

SEQ ID NO: 123301 - protein, 9 aa, Homo Sapiens
SSEVLYTSV

SEQ ID NO: 123302 - protein, 9 aa, Homo Sapiens
GASPLWGFR

SEQ ID NO: 123303 - protein, 9 aa, Homo Sapiens
TVTLCSFGL

SEQ ID NO: 123304 - protein, 9 aa, Homo Sapiens
CSLLVGVSC

SEQ ID NO: 123305 - protein, 9 aa, Homo Sapiens
KRGKSQGGR

SEQ ID NO: 123306 - protein, 9 aa, Homo Sapiens
HNQTTRKRF

SEQ ID NO: 123307 - protein, 9 aa, Homo Sapiens
HLFKQAWEA

SEQ ID NO: 123308 - protein, 9 aa, Homo Sapiens
FLFYVLTKM

SEQ ID NO: 123309 - protein, 9 aa, Homo Sapiens
GARSTSAHL

SEQ ID NO: 123310 - protein, 9 aa, Homo Sapiens
TVWACAAAV

SEQ ID NO: 123311 - protein, 9 aa, Homo Sapiens
LCKAVAVLG

SEQ ID NO: 123312 - protein, 9 aa, Homo Sapiens
WKRTEFAGD

SEQ ID NO: 123313 - protein, 9 aa, Homo Sapiens
VVTFLMSDL

SEQ ID NO: 123314 - protein, 9 aa, Homo Sapiens
LSRQRCALS

SEQ ID NO: 123315 - protein, 9 aa, Homo Sapiens
PRKRQCAPS

SEQ ID NO: 123316 - protein, 9 aa, Homo Sapiens
PPAGLVWTH

SEQ ID NO: 123317 - protein, 9 aa, Homo Sapiens
SSIRNFPQQ

SEQ ID NO: 123318 - protein, 9 aa, Homo Sapiens
SHQQYLPTY

SEQ ID NO: 123319 - protein, 9 aa, Homo Sapiens
AVAYFGISM

SEQ ID NO: 123320 - protein, 9 aa, Homo Sapiens
DGTEARSKM

SEQ ID NO: 123321 - protein, 9 aa, Homo Sapiens
EVSMCDCEG

SEQ ID NO: 123322 - protein, 9 aa, Homo Sapiens
VPDAAGTGL

SEQ ID NO: 123323 - protein, 9 aa, Homo Sapiens
AETRISLHE

SEQ ID NO: 123324 - protein, 9 aa, Homo Sapiens
LAKLLLGFL

SEQ ID NO: 123325 - protein, 9 aa, Homo Sapiens
MPVPVIMNN

SEQ ID NO: 123326 - protein, 9 aa, Homo Sapiens
TRKMPPSTS

SEQ ID NO: 123327 - protein, 9 aa, Homo Sapiens
HGLLHVRMV

SEQ ID NO: 123328 - protein, 9 aa, Homo Sapiens
KKPRASQEL

SEQ ID NO: 123329 - protein, 9 aa, Homo Sapiens
HNIPVYNDI

SEQ ID NO: 123330 - protein, 9 aa, Homo Sapiens
KVPVIKKPD

SEQ ID NO: 123331 - protein, 9 aa, Homo Sapiens
HAVQDAAVA

SEQ ID NO: 123332 - protein, 9 aa, Homo Sapiens
FVMMKGPND

SEQ ID NO: 123333 - protein, 9 aa, Homo Sapiens
PWTRCLRMR

SEQ ID NO: 123334 - protein, 9 aa, Homo Sapiens
QTGTNPLCR

SEQ ID NO: 123335 - protein, 9 aa, Homo Sapiens
ASSVRTTRS

SEQ ID NO: 123336 - protein, 9 aa, Homo Sapiens
ESGMSKPPC

SEQ ID NO: 123337 - protein, 9 aa, Homo Sapiens
LAEPFPLVG

SEQ ID NO: 123338 - protein, 9 aa, Homo Sapiens
AVVTSACSL

SEQ ID NO: 123339 - protein, 9 aa, Homo Sapiens
HVVHHHLIG

SEQ ID NO: 123340 - protein, 9 aa, Homo Sapiens
CSLGYSGLS

SEQ ID NO: 123341 - protein, 9 aa, Homo Sapiens
LLCGNHECA

SEQ ID NO: 123342 - protein, 9 aa, Homo Sapiens
LGDPGSDLL

SEQ ID NO: 123343 - protein, 9 aa, Homo Sapiens
TNPLCRGST

SEQ ID NO: 123344 - protein, 9 aa, Homo Sapiens
AQSERKSGG

SEQ ID NO: 123345 - protein, 9 aa, Homo Sapiens
SISQELMLK

SEQ ID NO: 123346 - protein, 9 aa, Homo Sapiens
FAIRRPPVL

SEQ ID NO: 123347 - protein, 9 aa, Homo Sapiens
YDYRLVSAA

SEQ ID NO: 123348 - protein, 9 aa, Homo Sapiens
QSGKVYKED

SEQ ID NO: 123349 - protein, 9 aa, Homo Sapiens
KHLMRLHPW

SEQ ID NO: 123350 - protein, 9 aa, Homo Sapiens
DHCHGLGTC

SEQ ID NO: 123351 - protein, 9 aa, Homo Sapiens
ELLGVAGSC

SEQ ID NO: 123352 - protein, 9 aa, Homo Sapiens
SPYVNTVGG

SEQ ID NO: 123353 - protein, 9 aa, Homo Sapiens
TTDFKTTPP

SEQ ID NO: 123354 - protein, 9 aa, Homo Sapiens
SMELPDFFR

SEQ ID NO: 123355 - protein, 9 aa, Homo Sapiens
ERVRGGKRR

SEQ ID NO: 123356 - protein, 9 aa, Homo Sapiens
WRENRPYYF

SEQ ID NO: 123357 - protein, 9 aa, Homo Sapiens
QQYGAVPGS

SEQ ID NO: 123358 - protein, 9 aa, Homo Sapiens
RRRFEKRVY

SEQ ID NO: 123359 - protein, 9 aa, Homo Sapiens
AYLTVAFCW

SEQ ID NO: 123360 - protein, 9 aa, Homo Sapiens
ATVAAARGL

SEQ ID NO: 123361 - protein, 9 aa, Homo Sapiens
EEKSLSKKK

SEQ ID NO: 123362 - protein, 9 aa, Homo Sapiens
PPGARCARW

SEQ ID NO: 123363 - protein, 9 aa, Homo Sapiens
SCSIKSCWV

SEQ ID NO: 123364 - protein, 9 aa, Homo Sapiens
RYADASGHN

SEQ ID NO: 123365 - protein, 9 aa, Homo Sapiens
LLFNQTGAC

SEQ ID NO: 123366 - protein, 9 aa, Homo Sapiens
KLTDIWLEA

SEQ ID NO: 123367 - protein, 9 aa, Homo Sapiens
VVQLHNSNP

SEQ ID NO: 123368 - protein, 9 aa, Homo Sapiens
HKANDHKPL

SEQ ID NO: 123369 - protein, 9 aa, Homo Sapiens
EPKPGPGQT

SEQ ID NO: 123370 - protein, 9 aa, Homo Sapiens
EPAAARGAS

SEQ ID NO: 123371 - protein, 9 aa, Homo Sapiens
RVTASHPTT

SEQ ID NO: 123372 - protein, 9 aa, Homo Sapiens
LAHSGAVAT

SEQ ID NO: 123373 - protein, 9 aa, Homo Sapiens
VTVLGNFIH

SEQ ID NO: 123374 - protein, 9 aa, Homo Sapiens
AGNLQASYT

SEQ ID NO: 123375 - protein, 9 aa, Homo Sapiens
KMQSGKVYK

SEQ ID NO: 123376 - protein, 9 aa, Homo Sapiens
TETSLMKVH

SEQ ID NO: 123377 - protein, 9 aa, Homo Sapiens
NSCKPNHGQ

SEQ ID NO: 123378 - protein, 9 aa, Homo Sapiens
QILTEPRNV

SEQ ID NO: 123379 - protein, 9 aa, Homo Sapiens
KGVHSSGQK

SEQ ID NO: 123380 - protein, 9 aa, Homo Sapiens
SAGQMPRKM

SEQ ID NO: 123381 - protein, 9 aa, Homo Sapiens
VGLFYTSRV

SEQ ID NO: 123382 - protein, 9 aa, Homo Sapiens
TSSVTASCA

SEQ ID NO: 123383 - protein, 9 aa, Homo Sapiens
ALREQGPPE

SEQ ID NO: 123384 - protein, 9 aa, Homo Sapiens
NSEHFRTTV

SEQ ID NO: 123385 - protein, 9 aa, Homo Sapiens
YLLKTGHFE

SEQ ID NO: 123386 - protein, 9 aa, Homo Sapiens
CNHRYLFYS

SEQ ID NO: 123387 - protein, 9 aa, Homo Sapiens
QENKFQMEN

SEQ ID NO: 123388 - protein, 9 aa, Homo Sapiens
HRFRGHLER

SEQ ID NO: 123389 - protein, 9 aa, Homo Sapiens
QPDWCCVPV

SEQ ID NO: 123390 - protein, 9 aa, Homo Sapiens
TFRRVLQQV

SEQ ID NO: 123391 - protein, 9 aa, Homo Sapiens
YSPRTSLLC

SEQ ID NO: 123392 - protein, 9 aa, Homo Sapiens
SPCANTSLY

SEQ ID NO: 123393 - protein, 9 aa, Homo Sapiens
FMDLHNFQN

SEQ ID NO: 123394 - protein, 9 aa, Homo Sapiens
NCLLSPLVG

SEQ ID NO: 123395 - protein, 9 aa, Homo Sapiens
QAKGVHSSG

SEQ ID NO: 123396 - protein, 9 aa, Homo Sapiens
SYQDLDGAG

SEQ ID NO: 123397 - protein, 9 aa, Homo Sapiens
PVIYGVSTK

SEQ ID NO: 123398 - protein, 9 aa, Homo Sapiens
KGWALGCKR

SEQ ID NO: 123399 - protein, 9 aa, Homo Sapiens
IYDSSKSCE

SEQ ID NO: 123400 - protein, 9 aa, Homo Sapiens
RKGLIVMLR

SEQ ID NO: 123401 - protein, 9 aa, Homo Sapiens
LDAAKRCIV

SEQ ID NO: 123402 - protein, 9 aa, Homo Sapiens
EQGKKRKRE

SEQ ID NO: 123403 - protein, 9 aa, Homo Sapiens
NREGVILSG

SEQ ID NO: 123404 - protein, 9 aa, Homo Sapiens
WTCFVQLTE

SEQ ID NO: 123405 - protein, 9 aa, Homo Sapiens
GVTSPSADT

SEQ ID NO: 123406 - protein, 9 aa, Homo Sapiens
QALEMNKCK

SEQ ID NO: 123407 - protein, 9 aa, Homo Sapiens
VAPLKTHFQ

SEQ ID NO: 123408 - protein, 9 aa, Homo Sapiens
PEFSDMPRI

SEQ ID NO: 123409 - protein, 9 aa, Homo Sapiens
CCPAPDGQP

SEQ ID NO: 123410 - protein, 9 aa, Homo Sapiens
LEDAGMREL

SEQ ID NO: 123411 - protein, 9 aa, Homo Sapiens
NNKLSSEKN

SEQ ID NO: 123412 - protein, 9 aa, Homo Sapiens
RDYSGGKPI

SEQ ID NO: 123413 - protein, 9 aa, Homo Sapiens
FLDGGCESS

SEQ ID NO: 123414 - protein, 9 aa, Homo Sapiens
LSPPWALAH

SEQ ID NO: 123415 - protein, 9 aa, Homo Sapiens
GPGWKRRKV

SEQ ID NO: 123416 - protein, 9 aa, Homo Sapiens
SPLPCLCPS

SEQ ID NO: 123417 - protein, 9 aa, Homo Sapiens
AQHLPPHGY

SEQ ID NO: 123418 - protein, 9 aa, Homo Sapiens
RFTIRGFPS

SEQ ID NO: 123419 - protein, 9 aa, Homo Sapiens
VVPIAQKSE

SEQ ID NO: 123420 - protein, 9 aa, Homo Sapiens
IMEKFGILI

SEQ ID NO: 123421 - protein, 9 aa, Homo Sapiens
RQGKPNYTV

SEQ ID NO: 123422 - protein, 9 aa, Homo Sapiens
IMKPTPGPT

SEQ ID NO: 123423 - protein, 9 aa, Homo Sapiens
TGRVLRELK

SEQ ID NO: 123424 - protein, 9 aa, Homo Sapiens
IDAGTEFVP

SEQ ID NO: 123425 - protein, 9 aa, Homo Sapiens
TSAHLPPPL

SEQ ID NO: 123426 - protein, 9 aa, Homo Sapiens
SRLQEPLER

SEQ ID NO: 123427 - protein, 9 aa, Homo Sapiens
VLLLGWLIN

SEQ ID NO: 123428 - protein, 9 aa, Homo Sapiens
TSAVWNFFT

SEQ ID NO: 123429 - protein, 9 aa, Homo Sapiens
YHQYIPQTR

SEQ ID NO: 123430 - protein, 9 aa, Homo Sapiens
QPELPLEAR

SEQ ID NO: 123431 - protein, 9 aa, Homo Sapiens
ELTSAQLDD

SEQ ID NO: 123432 - protein, 9 aa, Homo Sapiens
PEKKTWYLL

SEQ ID NO: 123433 - protein, 9 aa, Homo Sapiens
EVLEDAEMV

SEQ ID NO: 123434 - protein, 9 aa, Homo Sapiens
CFFSGKSED

SEQ ID NO: 123435 - protein, 9 aa, Homo Sapiens
ITPQTTLEF

SEQ ID NO: 123436 - protein, 9 aa, Homo Sapiens
IIATALSLK

SEQ ID NO: 123437 - protein, 9 aa, Homo Sapiens
KKKHLKAGC

SEQ ID NO: 123438 - protein, 9 aa, Homo Sapiens
EEVLHKMLM

SEQ ID NO: 123439 - protein, 9 aa, Homo Sapiens
PTNVSNCNW

SEQ ID NO: 123440 - protein, 9 aa, Homo Sapiens
HTPQIEQAV

SEQ ID NO: 123441 - protein, 9 aa, Homo Sapiens
ALLCLIALL

SEQ ID NO: 123442 - protein, 9 aa, Homo Sapiens
NREKAVGDK

SEQ ID NO: 123443 - protein, 9 aa, Homo Sapiens
LADHFDSRK

SEQ ID NO: 123444 - protein, 9 aa, Homo Sapiens
WSRHCVGQK

SEQ ID NO: 123445 - protein, 9 aa, Homo Sapiens
RAGRMGGRH

SEQ ID NO: 123446 - protein, 9 aa, Homo Sapiens
APASRGPST

SEQ ID NO: 123447 - protein, 9 aa, Homo Sapiens
VQPAYAATG

SEQ ID NO: 123448 - protein, 9 aa, Homo Sapiens
WTGPPHEYR

SEQ ID NO: 123449 - protein, 9 aa, Homo Sapiens
VAAILSLIH

SEQ ID NO: 123450 - protein, 9 aa, Homo Sapiens
IFWSRHCVG

SEQ ID NO: 123451 - protein, 9 aa, Homo Sapiens
EEEKDLIRS

SEQ ID NO: 123452 - protein, 9 aa, Homo Sapiens
FATLLDTPD

SEQ ID NO: 123453 - protein, 9 aa, Homo Sapiens
PPARPSGRH

SEQ ID NO: 123454 - protein, 9 aa, Homo Sapiens
KFGILIIGD

SEQ ID NO: 123455 - protein, 9 aa, Homo Sapiens
ERQIQEKLI

SEQ ID NO: 123456 - protein, 9 aa, Homo Sapiens
CTDVTDASR

SEQ ID NO: 123457 - protein, 9 aa, Homo Sapiens
RLLAHSGAV

SEQ ID NO: 123458 - protein, 9 aa, Homo Sapiens
QTKPEEEQE

SEQ ID NO: 123459 - protein, 9 aa, Homo Sapiens
DYEDVLVSL

SEQ ID NO: 123460 - protein, 9 aa, Homo Sapiens
GCQCHVTRA

SEQ ID NO: 123461 - protein, 9 aa, Homo Sapiens
LLATMACDR

SEQ ID NO: 123462 - protein, 9 aa, Homo Sapiens
ELGGPCAWT

SEQ ID NO: 123463 - protein, 9 aa, Homo Sapiens
CRPVKAGVP

SEQ ID NO: 123464 - protein, 9 aa, Homo Sapiens
PQEPGPRFP

SEQ ID NO: 123465 - protein, 9 aa, Homo Sapiens
SLTREKIKA

SEQ ID NO: 123466 - protein, 9 aa, Homo Sapiens
VTLTVSTNN

SEQ ID NO: 123467 - protein, 9 aa, Homo Sapiens
KTTTTTPGF

SEQ ID NO: 123468 - protein, 9 aa, Homo Sapiens
PAGWGLTSP

SEQ ID NO: 123469 - protein, 9 aa, Homo Sapiens
NVQPILQID

SEQ ID NO: 123470 - protein, 9 aa, Homo Sapiens
IFSTITLIK

SEQ ID NO: 123471 - protein, 9 aa, Homo Sapiens
LIETSLSFG

SEQ ID NO: 123472 - protein, 9 aa, Homo Sapiens
PPVTYPGLS

SEQ ID NO: 123473 - protein, 9 aa, Homo Sapiens
PECGRAFFI

SEQ ID NO: 123474 - protein, 9 aa, Homo Sapiens
INQEERDLR

SEQ ID NO: 123475 - protein, 9 aa, Homo Sapiens
VKQEPAPPA

SEQ ID NO: 123476 - protein, 9 aa, Homo Sapiens
DIHILYGYS

SEQ ID NO: 123477 - protein, 9 aa, Homo Sapiens
EVAIMAPFL

SEQ ID NO: 123478 - protein, 9 aa, Homo Sapiens
AFETALQIF

SEQ ID NO: 123479 - protein, 9 aa, Homo Sapiens
TYPKDGEVE

SEQ ID NO: 123480 - protein, 9 aa, Homo Sapiens
CFQSAVLYA

SEQ ID NO: 123481 - protein, 9 aa, Homo Sapiens
GLRRLLGKC

SEQ ID NO: 123482 - protein, 9 aa, Homo Sapiens
LCEILSGNS

SEQ ID NO: 123483 - protein, 9 aa, Homo Sapiens
TAAPPGPPT

SEQ ID NO: 123484 - protein, 9 aa, Homo Sapiens
CWHGGFQPE

SEQ ID NO: 123485 - protein, 9 aa, Homo Sapiens
GTASSNIRA

SEQ ID NO: 123486 - protein, 9 aa, Homo Sapiens
KWLLELNQM

SEQ ID NO: 123487 - protein, 9 aa, Homo Sapiens
SRCWNTERD

SEQ ID NO: 123488 - protein, 9 aa, Homo Sapiens
AGPDSTPAE

SEQ ID NO: 123489 - protein, 9 aa, Homo Sapiens
PRKGRGLPR

SEQ ID NO: 123490 - protein, 9 aa, Homo Sapiens
LEKDGFPSG

SEQ ID NO: 123491 - protein, 9 aa, Homo Sapiens
TALTNRSVS

SEQ ID NO: 123492 - protein, 9 aa, Homo Sapiens
QCLTDELCL

SEQ ID NO: 123493 - protein, 9 aa, Homo Sapiens
FTGLETYKQ

SEQ ID NO: 123494 - protein, 9 aa, Homo Sapiens
ALGCKRWAG

SEQ ID NO: 123495 - protein, 9 aa, Homo Sapiens
MNPFLMTTF

SEQ ID NO: 123496 - protein, 9 aa, Homo Sapiens
REVTGGHEE

SEQ ID NO: 123497 - protein, 9 aa, Homo Sapiens
GKVYKEDFE

SEQ ID NO: 123498 - protein, 9 aa, Homo Sapiens
ARSTSAHLP

SEQ ID NO: 123499 - protein, 9 aa, Homo Sapiens
RLYLSPSTP

SEQ ID NO: 123500 - protein, 9 aa, Homo Sapiens
GYLLCKRYC

SEQ ID NO: 123501 - protein, 9 aa, Homo Sapiens
ERKLAGLGL

SEQ ID NO: 123502 - protein, 9 aa, Homo Sapiens
GADAAYEEL

SEQ ID NO: 123503 - protein, 9 aa, Homo Sapiens
GMIGSFSVR

SEQ ID NO: 123504 - protein, 9 aa, Homo Sapiens
SKVVPLHDG

SEQ ID NO: 123505 - protein, 9 aa, Homo Sapiens
ADTTLFEIY

SEQ ID NO: 123506 - protein, 9 aa, Homo Sapiens
TASSNIRAL

SEQ ID NO: 123507 - protein, 9 aa, Homo Sapiens
LVSAAAAAG

SEQ ID NO: 123508 - protein, 9 aa, Homo Sapiens
SAIQNREIC

SEQ ID NO: 123509 - protein, 9 aa, Homo Sapiens
ELNFHRSPR

SEQ ID NO: 123510 - protein, 9 aa, Homo Sapiens
DKEEEKHEE

SEQ ID NO: 123511 - protein, 9 aa, Homo Sapiens
RLAEYSPPS

SEQ ID NO: 123512 - protein, 9 aa, Homo Sapiens
ESSRLDFPE

SEQ ID NO: 123513 - protein, 9 aa, Homo Sapiens
LLAVKGFAV

SEQ ID NO: 123514 - protein, 9 aa, Homo Sapiens
LLCLSRLVS

SEQ ID NO: 123515 - protein, 9 aa, Homo Sapiens
AATQRLAEY

SEQ ID NO: 123516 - protein, 9 aa, Homo Sapiens
NGYCLPDPS

SEQ ID NO: 123517 - protein, 9 aa, Homo Sapiens
QPAGVSCCP

SEQ ID NO: 123518 - protein, 9 aa, Homo Sapiens
AQEEGEPAA

SEQ ID NO: 123519 - protein, 9 aa, Homo Sapiens
PLLLQQPVI

SEQ ID NO: 123520 - protein, 9 aa, Homo Sapiens
IVITRSGGG

SEQ ID NO: 123521 - protein, 9 aa, Homo Sapiens
ILLQRNLLR

SEQ ID NO: 123522 - protein, 9 aa, Homo Sapiens
GSSHQILHI

SEQ ID NO: 123523 - protein, 9 aa, Homo Sapiens
NLSAIQNRE

SEQ ID NO: 123524 - protein, 9 aa, Homo Sapiens
IIFDEPMDV

SEQ ID NO: 123525 - protein, 9 aa, Homo Sapiens
FSIKPFHIA

SEQ ID NO: 123526 - protein, 9 aa, Homo Sapiens
PSMVTVDRT

SEQ ID NO: 123527 - protein, 9 aa, Homo Sapiens
AGWARDGGA

SEQ ID NO: 123528 - protein, 9 aa, Homo Sapiens
PGKKKTSEN

SEQ ID NO: 123529 - protein, 9 aa, Homo Sapiens
RGNKATKRD

SEQ ID NO: 123530 - protein, 9 aa, Homo Sapiens
FPVCPKLNL

SEQ ID NO: 123531 - protein, 9 aa, Homo Sapiens
SPKRSRKSA

SEQ ID NO: 123532 - protein, 9 aa, Homo Sapiens
LTDAMVWKD

SEQ ID NO: 123533 - protein, 9 aa, Homo Sapiens
RFEKRVYIP

SEQ ID NO: 123534 - protein, 9 aa, Homo Sapiens
FALPLCWAP

SEQ ID NO: 123535 - protein, 9 aa, Homo Sapiens
KFYFRFTSH

SEQ ID NO: 123536 - protein, 9 aa, Homo Sapiens
WTIFKGKYK

SEQ ID NO: 123537 - protein, 9 aa, Homo Sapiens
QCSQPLMNS

SEQ ID NO: 123538 - protein, 9 aa, Homo Sapiens
FLTVGTMWL

SEQ ID NO: 123539 - protein, 9 aa, Homo Sapiens
NFLFSNLPP

SEQ ID NO: 123540 - protein, 9 aa, Homo Sapiens
KEGTSNSSS

SEQ ID NO: 123541 - protein, 9 aa, Homo Sapiens
TISRAKIRS

SEQ ID NO: 123542 - protein, 9 aa, Homo Sapiens
RLAVAKALT

SEQ ID NO: 123543 - protein, 9 aa, Homo Sapiens
RLCAPGAPA

SEQ ID NO: 123544 - protein, 9 aa, Homo Sapiens
LDLPSDHTE

SEQ ID NO: 123545 - protein, 9 aa, Homo Sapiens
TSCYSPRTS

SEQ ID NO: 123546 - protein, 9 aa, Homo Sapiens
GWAEATVAA

SEQ ID NO: 123547 - protein, 9 aa, Homo Sapiens
VIENVIEGV

SEQ ID NO: 123548 - protein, 9 aa, Homo Sapiens
LRACGLGNR

SEQ ID NO: 123549 - protein, 9 aa, Homo Sapiens
TVQEEAQLC

SEQ ID NO: 123550 - protein, 9 aa, Homo Sapiens
QMVSSSQKR

SEQ ID NO: 123551 - protein, 9 aa, Homo Sapiens
SEGTASSNI

SEQ ID NO: 123552 - protein, 9 aa, Homo Sapiens
QLHHPQQQL

SEQ ID NO: 123553 - protein, 9 aa, Homo Sapiens
VQMAHAGQP

SEQ ID NO: 123554 - protein, 9 aa, Homo Sapiens
THLSLFFVM

SEQ ID NO: 123555 - protein, 9 aa, Homo Sapiens
LASVAAPAN

SEQ ID NO: 123556 - protein, 9 aa, Homo Sapiens
ISEDLKKAK

SEQ ID NO: 123557 - protein, 9 aa, Homo Sapiens
GPWPRPLPR

SEQ ID NO: 123558 - protein, 9 aa, Homo Sapiens
KILNFNCCA

SEQ ID NO: 123559 - protein, 9 aa, Homo Sapiens
TQEGYLQML

SEQ ID NO: 123560 - protein, 9 aa, Homo Sapiens
VLEDGTEAR

SEQ ID NO: 123561 - protein, 9 aa, Homo Sapiens
LKTRMEKRR

SEQ ID NO: 123562 - protein, 9 aa, Homo Sapiens
LASRVAGTA

SEQ ID NO: 123563 - protein, 9 aa, Homo Sapiens
PTGLRIPLP

SEQ ID NO: 123564 - protein, 9 aa, Homo Sapiens
MLRVVAHSD

SEQ ID NO: 123565 - protein, 9 aa, Homo Sapiens
LGWEGPRCE

SEQ ID NO: 123566 - protein, 9 aa, Homo Sapiens
SQSLLCIRK

SEQ ID NO: 123567 - protein, 9 aa, Homo Sapiens
SGHNTLSGF

SEQ ID NO: 123568 - protein, 9 aa, Homo Sapiens
DAMVWKDAA

SEQ ID NO: 123569 - protein, 9 aa, Homo Sapiens
HIGYRMRCI

SEQ ID NO: 123570 - protein, 9 aa, Homo Sapiens
HYSTVVPLD

SEQ ID NO: 123571 - protein, 9 aa, Homo Sapiens
RTGNDKGES

SEQ ID NO: 123572 - protein, 9 aa, Homo Sapiens
KFVTSFLTE

SEQ ID NO: 123573 - protein, 9 aa, Homo Sapiens
RCYCDTLDL

SEQ ID NO: 123574 - protein, 9 aa, Homo Sapiens
NFSCADINE

SEQ ID NO: 123575 - protein, 9 aa, Homo Sapiens
DGQNFIQNL

SEQ ID NO: 123576 - protein, 9 aa, Homo Sapiens
WKPLQTVRL

SEQ ID NO: 123577 - protein, 9 aa, Homo Sapiens
IDSAHLCNN

SEQ ID NO: 123578 - protein, 9 aa, Homo Sapiens
IRNKHEVDE

SEQ ID NO: 123579 - protein, 9 aa, Homo Sapiens
ENCQDSWRW

SEQ ID NO: 123580 - protein, 9 aa, Homo Sapiens
WTRCLRMRP

SEQ ID NO: 123581 - protein, 9 aa, Homo Sapiens
KMKKRVKIP

SEQ ID NO: 123582 - protein, 9 aa, Homo Sapiens
KMLKFLLFD

SEQ ID NO: 123583 - protein, 9 aa, Homo Sapiens
ILSGNSCPL

SEQ ID NO: 123584 - protein, 9 aa, Homo Sapiens
ATPQGAIQI

SEQ ID NO: 123585 - protein, 9 aa, Homo Sapiens
RCGATSSRP

SEQ ID NO: 123586 - protein, 9 aa, Homo Sapiens
GTETPSARR

SEQ ID NO: 123587 - protein, 9 aa, Homo Sapiens
VVGELQVLV

SEQ ID NO: 123588 - protein, 9 aa, Homo Sapiens
GHGHCFCLI

SEQ ID NO: 123589 - protein, 9 aa, Homo Sapiens
VDRPGRRLY

SEQ ID NO: 123590 - protein, 9 aa, Homo Sapiens
LNFNCCACV

SEQ ID NO: 123591 - protein, 9 aa, Homo Sapiens
TYFLPGVTS

SEQ ID NO: 123592 - protein, 9 aa, Homo Sapiens
ELEALSCLY

SEQ ID NO: 123593 - protein, 9 aa, Homo Sapiens
RVLEAHPTY

SEQ ID NO: 123594 - protein, 9 aa, Homo Sapiens
GRGNKATKR

SEQ ID NO: 123595 - protein, 9 aa, Homo Sapiens
RGSRCYCDT

SEQ ID NO: 123596 - protein, 9 aa, Homo Sapiens
SQAMPNAVD

SEQ ID NO: 123597 - protein, 9 aa, Homo Sapiens
NMCGSRRVT

SEQ ID NO: 123598 - protein, 9 aa, Homo Sapiens
LALMVVHGA

SEQ ID NO: 123599 - protein, 9 aa, Homo Sapiens
STRKPPRLD

SEQ ID NO: 123600 - protein, 9 aa, Homo Sapiens
LSNEDAADG

SEQ ID NO: 123601 - protein, 9 aa, Homo Sapiens
MSSSLPKAI

SEQ ID NO: 123602 - protein, 9 aa, Homo Sapiens
RRVTNSQKC

SEQ ID NO: 123603 - protein, 9 aa, Homo Sapiens
FILRNTHTF

SEQ ID NO: 123604 - protein, 9 aa, Homo Sapiens
AIMTSVFGL

SEQ ID NO: 123605 - protein, 9 aa, Homo Sapiens
ELLVNMGGN

SEQ ID NO: 123606 - protein, 9 aa, Homo Sapiens
EAGSRRQVR

SEQ ID NO: 123607 - protein, 9 aa, Homo Sapiens
LPPGGKEEA

SEQ ID NO: 123608 - protein, 9 aa, Homo Sapiens
VAPEEQNSP

SEQ ID NO: 123609 - protein, 9 aa, Homo Sapiens
NNSRPSTPT

SEQ ID NO: 123610 - protein, 9 aa, Homo Sapiens
GDDGREYEG

SEQ ID NO: 123611 - protein, 9 aa, Homo Sapiens
LPTEPSTPK

SEQ ID NO: 123612 - protein, 9 aa, Homo Sapiens
RDATALTNR

SEQ ID NO: 123613 - protein, 9 aa, Homo Sapiens
PGVCKVNTD

SEQ ID NO: 123614 - protein, 9 aa, Homo Sapiens
KKDKTQKVQ

SEQ ID NO: 123615 - protein, 9 aa, Homo Sapiens
TLPPPPTLL

SEQ ID NO: 123616 - protein, 9 aa, Homo Sapiens
EYVELTFLA

SEQ ID NO: 123617 - protein, 9 aa, Homo Sapiens
YNFLQCTEP

SEQ ID NO: 123618 - protein, 9 aa, Homo Sapiens
QQLPMFQPT

SEQ ID NO: 123619 - protein, 9 aa, Homo Sapiens
FGQGAEGGL

SEQ ID NO: 123620 - protein, 9 aa, Homo Sapiens
INVHLQDHH

SEQ ID NO: 123621 - protein, 9 aa, Homo Sapiens
DLAEFPVLL

SEQ ID NO: 123622 - protein, 9 aa, Homo Sapiens
GKSFHNIAV

SEQ ID NO: 123623 - protein, 9 aa, Homo Sapiens
GLHPWTCFV

SEQ ID NO: 123624 - protein, 9 aa, Homo Sapiens
FPSPAFCSR

SEQ ID NO: 123625 - protein, 9 aa, Homo Sapiens
ADLVRPIDP

SEQ ID NO: 123626 - protein, 9 aa, Homo Sapiens
YRFAWRTLT

SEQ ID NO: 123627 - protein, 9 aa, Homo Sapiens
YQEVPKCEW

SEQ ID NO: 123628 - protein, 9 aa, Homo Sapiens
WGDDNTAIL

SEQ ID NO: 123629 - protein, 9 aa, Homo Sapiens
ATMMVSDWY

SEQ ID NO: 123630 - protein, 9 aa, Homo Sapiens
SCSSKSSAS

SEQ ID NO: 123631 - protein, 9 aa, Homo Sapiens
KIGRSVAHC

SEQ ID NO: 123632 - protein, 9 aa, Homo Sapiens
LSSMVVTAN

SEQ ID NO: 123633 - protein, 9 aa, Homo Sapiens
SPIEWLQLE

SEQ ID NO: 123634 - protein, 9 aa, Homo Sapiens
AAATPSCCR

SEQ ID NO: 123635 - protein, 9 aa, Homo Sapiens
DDLSNSFGQ

SEQ ID NO: 123636 - protein, 9 aa, Homo Sapiens
IKVSNASAD

SEQ ID NO: 123637 - protein, 9 aa, Homo Sapiens
ELTRHPDSQ

SEQ ID NO: 123638 - protein, 9 aa, Homo Sapiens
TPGRGRQSV

SEQ ID NO: 123639 - protein, 9 aa, Homo Sapiens
SDQFFTVLT

SEQ ID NO: 123640 - protein, 9 aa, Homo Sapiens
GTRRYSERV

SEQ ID NO: 123641 - protein, 9 aa, Homo Sapiens
QAGTLARLE

SEQ ID NO: 123642 - protein, 9 aa, Homo Sapiens
ASTHISGDK

SEQ ID NO: 123643 - protein, 9 aa, Homo Sapiens
GPCPQTPCW

SEQ ID NO: 123644 - protein, 9 aa, Homo Sapiens
RILPKCHTS

SEQ ID NO: 123645 - protein, 9 aa, Homo Sapiens
MSPAGPQPR

SEQ ID NO: 123646 - protein, 9 aa, Homo Sapiens
PPWVPHTET

SEQ ID NO: 123647 - protein, 9 aa, Homo Sapiens
LDYAYVNFL

SEQ ID NO: 123648 - protein, 9 aa, Homo Sapiens
AWLWLALND

SEQ ID NO: 123649 - protein, 9 aa, Homo Sapiens
ADSGYNTWL

SEQ ID NO: 123650 - protein, 9 aa, Homo Sapiens
TSSRPLAHS

SEQ ID NO: 123651 - protein, 9 aa, Homo Sapiens
NNYAKDEVA

SEQ ID NO: 123652 - protein, 9 aa, Homo Sapiens
AVARGAPQS

SEQ ID NO: 123653 - protein, 9 aa, Homo Sapiens
LSNQELIEK

SEQ ID NO: 123654 - protein, 9 aa, Homo Sapiens
YSDALMVTT

SEQ ID NO: 123655 - protein, 9 aa, Homo Sapiens
FGAKHIFST

SEQ ID NO: 123656 - protein, 9 aa, Homo Sapiens
FLLFDMGLR

SEQ ID NO: 123657 - protein, 9 aa, Homo Sapiens
QHALIVLPG

SEQ ID NO: 123658 - protein, 9 aa, Homo Sapiens
LSRPGWAAL

SEQ ID NO: 123659 - protein, 9 aa, Homo Sapiens
TFLMSDLES

SEQ ID NO: 123660 - protein, 9 aa, Homo Sapiens
VSEFHSRYI

SEQ ID NO: 123661 - protein, 9 aa, Homo Sapiens
LEGEIRHSA

SEQ ID NO: 123662 - protein, 9 aa, Homo Sapiens
KKRSVVLGE

SEQ ID NO: 123663 - protein, 9 aa, Homo Sapiens
CRCYGSVKC

SEQ ID NO: 123664 - protein, 9 aa, Homo Sapiens
CGRAFSLSF

SEQ ID NO: 123665 - protein, 9 aa, Homo Sapiens
CPFQDNFTI

SEQ ID NO: 123666 - protein, 9 aa, Homo Sapiens
SMCGAHKYQ

SEQ ID NO: 123667 - protein, 9 aa, Homo Sapiens
FLSMSGNYL

SEQ ID NO: 123668 - protein, 9 aa, Homo Sapiens
QICMPLTDG

SEQ ID NO: 123669 - protein, 9 aa, Homo Sapiens
SSNAKKGWT

SEQ ID NO: 123670 - protein, 9 aa, Homo Sapiens
VPSLGSSPL

SEQ ID NO: 123671 - protein, 9 aa, Homo Sapiens
INHVMTSFS

SEQ ID NO: 123672 - protein, 9 aa, Homo Sapiens
HLLYPAIMT

SEQ ID NO: 123673 - protein, 9 aa, Homo Sapiens
VIHQEIGRG

SEQ ID NO: 123674 - protein, 9 aa, Homo Sapiens
TLGRGRGEA

SEQ ID NO: 123675 - protein, 9 aa, Homo Sapiens
RQRAQADER

SEQ ID NO: 123676 - protein, 9 aa, Homo Sapiens
ASLIGACKA

SEQ ID NO: 123677 - protein, 9 aa, Homo Sapiens
GHSRDDELP

SEQ ID NO: 123678 - protein, 9 aa, Homo Sapiens
APMYTDTVQ

SEQ ID NO: 123679 - protein, 9 aa, Homo Sapiens
FAAESIIII

SEQ ID NO: 123680 - protein, 9 aa, Homo Sapiens
ELQRVQTEG

SEQ ID NO: 123681 - protein, 9 aa, Homo Sapiens
EVLGLFFHA

SEQ ID NO: 123682 - protein, 9 aa, Homo Sapiens
AGPQPRPPT

SEQ ID NO: 123683 - protein, 9 aa, Homo Sapiens
LMASDTGKT

SEQ ID NO: 123684 - protein, 9 aa, Homo Sapiens
FGEKQKMLL

SEQ ID NO: 123685 - protein, 9 aa, Homo Sapiens
IFNIVNFSR

SEQ ID NO: 123686 - protein, 9 aa, Homo Sapiens
LAPIEVLYL

SEQ ID NO: 123687 - protein, 9 aa, Homo Sapiens
QLLFFTNKM

SEQ ID NO: 123688 - protein, 9 aa, Homo Sapiens
YGGQKCSTC

SEQ ID NO: 123689 - protein, 9 aa, Homo Sapiens
TGSEFYTGL

SEQ ID NO: 123690 - protein, 9 aa, Homo Sapiens
KMMTTKRLN

SEQ ID NO: 123691 - protein, 9 aa, Homo Sapiens
PLQRSFLVL

SEQ ID NO: 123692 - protein, 9 aa, Homo Sapiens
IPSPNFSVV

SEQ ID NO: 123693 - protein, 9 aa, Homo Sapiens
DMDSLEDVA

SEQ ID NO: 123694 - protein, 9 aa, Homo Sapiens
HLDAADLHM

SEQ ID NO: 123695 - protein, 9 aa, Homo Sapiens
TLPTQAQVV

SEQ ID NO: 123696 - protein, 9 aa, Homo Sapiens
FIQRSTQTQ

SEQ ID NO: 123697 - protein, 9 aa, Homo Sapiens
CTSTNIWPH

SEQ ID NO: 123698 - protein, 9 aa, Homo Sapiens
NLSSMVVTA

SEQ ID NO: 123699 - protein, 9 aa, Homo Sapiens
LVLHFLKKL

SEQ ID NO: 123700 - protein, 9 aa, Homo Sapiens
VCHQIFEGK

SEQ ID NO: 123701 - protein, 9 aa, Homo Sapiens
VLCEILSGN

SEQ ID NO: 123702 - protein, 9 aa, Homo Sapiens
QVKKRKKRE

SEQ ID NO: 123703 - protein, 9 aa, Homo Sapiens
PPWALAHLV

SEQ ID NO: 123704 - protein, 9 aa, Homo Sapiens
PPLMWKLGW

SEQ ID NO: 123705 - protein, 9 aa, Homo Sapiens
EVKTSLGVS

SEQ ID NO: 123706 - protein, 9 aa, Homo Sapiens
SRLAELQRV

SEQ ID NO: 123707 - protein, 9 aa, Homo Sapiens
YERQPREPT

SEQ ID NO: 123708 - protein, 9 aa, Homo Sapiens
SFSRSQRDM

SEQ ID NO: 123709 - protein, 9 aa, Homo Sapiens
STAATGHTV

SEQ ID NO: 123710 - protein, 9 aa, Homo Sapiens
GGPDDGAIT

SEQ ID NO: 123711 - protein, 9 aa, Homo Sapiens
CPQTPCWGW

SEQ ID NO: 123712 - protein, 9 aa, Homo Sapiens
AKCASLKKT

SEQ ID NO: 123713 - protein, 9 aa, Homo Sapiens
FPAYDYFKD

SEQ ID NO: 123714 - protein, 9 aa, Homo Sapiens
LRWTGKQKL

SEQ ID NO: 123715 - protein, 9 aa, Homo Sapiens
VCFPFSVVW

SEQ ID NO: 123716 - protein, 9 aa, Homo Sapiens
SIKCDRCHK

SEQ ID NO: 123717 - protein, 9 aa, Homo Sapiens
LHHTLPCQR

SEQ ID NO: 123718 - protein, 9 aa, Homo Sapiens
LGEEFFVDQ

SEQ ID NO: 123719 - protein, 9 aa, Homo Sapiens
WRNLLAHPC

SEQ ID NO: 123720 - protein, 9 aa, Homo Sapiens
MDSLEDVAL

SEQ ID NO: 123721 - protein, 9 aa, Homo Sapiens
SQRDMQSTF

SEQ ID NO: 123722 - protein, 9 aa, Homo Sapiens
SQPDQTNGN

SEQ ID NO: 123723 - protein, 9 aa, Homo Sapiens
QDTPRGTPG

SEQ ID NO: 123724 - protein, 9 aa, Homo Sapiens
GCRSYTGAP

SEQ ID NO: 123725 - protein, 9 aa, Homo Sapiens
NIKEFIQGR

SEQ ID NO: 123726 - protein, 9 aa, Homo Sapiens
LNRWLSLQN

SEQ ID NO: 123727 - protein, 9 aa, Homo Sapiens
MHNIPVYND

SEQ ID NO: 123728 - protein, 9 aa, Homo Sapiens
DHLDAKRRG

SEQ ID NO: 123729 - protein, 9 aa, Homo Sapiens
TVAAARGLL

SEQ ID NO: 123730 - protein, 9 aa, Homo Sapiens
QIQEWGCLC

SEQ ID NO: 123731 - protein, 9 aa, Homo Sapiens
AADGFLSDS

SEQ ID NO: 123732 - protein, 9 aa, Homo Sapiens
KMQEQQANL

SEQ ID NO: 123733 - protein, 9 aa, Homo Sapiens
KVVSAEIEP

SEQ ID NO: 123734 - protein, 9 aa, Homo Sapiens
IDVQTRDLG

SEQ ID NO: 123735 - protein, 9 aa, Homo Sapiens
CKRWAGILS

SEQ ID NO: 123736 - protein, 9 aa, Homo Sapiens
FDQQNCAMK

SEQ ID NO: 123737 - protein, 9 aa, Homo Sapiens
CAKETPRLA

SEQ ID NO: 123738 - protein, 9 aa, Homo Sapiens
GAAAGAPRD

SEQ ID NO: 123739 - protein, 9 aa, Homo Sapiens
DLGRSHGRK

SEQ ID NO: 123740 - protein, 9 aa, Homo Sapiens
EVAFSSVEM

SEQ ID NO: 123741 - protein, 9 aa, Homo Sapiens
SVQVDRVKI

SEQ ID NO: 123742 - protein, 9 aa, Homo Sapiens
GTRIPFRVG

SEQ ID NO: 123743 - protein, 9 aa, Homo Sapiens
ECGKVFTQS

SEQ ID NO: 123744 - protein, 9 aa, Homo Sapiens
RSQRDMQST

SEQ ID NO: 123745 - protein, 9 aa, Homo Sapiens
SRLVSSTDG

SEQ ID NO: 123746 - protein, 9 aa, Homo Sapiens
ELLLQEGGP

SEQ ID NO: 123747 - protein, 9 aa, Homo Sapiens
EEEKGLLPG

SEQ ID NO: 123748 - protein, 9 aa, Homo Sapiens
FCVKLSKKN

SEQ ID NO: 123749 - protein, 9 aa, Homo Sapiens
EMAGFRRVT

SEQ ID NO: 123750 - protein, 9 aa, Homo Sapiens
HTGCHVPGS

SEQ ID NO: 123751 - protein, 9 aa, Homo Sapiens
CCVPVPTHC

SEQ ID NO: 123752 - protein, 9 aa, Homo Sapiens
CGPPPTMVQ

SEQ ID NO: 123753 - protein, 9 aa, Homo Sapiens
RLRELQLPG

SEQ ID NO: 123754 - protein, 9 aa, Homo Sapiens
HWNNPSAPS

SEQ ID NO: 123755 - protein, 9 aa, Homo Sapiens
SGCQCHVTR

SEQ ID NO: 123756 - protein, 9 aa, Homo Sapiens
MIVTPRAIG

SEQ ID NO: 123757 - protein, 9 aa, Homo Sapiens
LTEWFSRLP

SEQ ID NO: 123758 - protein, 9 aa, Homo Sapiens
DTQEGYLQM

SEQ ID NO: 123759 - protein, 9 aa, Homo Sapiens
QVVKILAVR

SEQ ID NO: 123760 - protein, 9 aa, Homo Sapiens
PQGEQRHTY

SEQ ID NO: 123761 - protein, 9 aa, Homo Sapiens
QRNLLRLQS

SEQ ID NO: 123762 - protein, 9 aa, Homo Sapiens
KHTYDYDGD

SEQ ID NO: 123763 - protein, 9 aa, Homo Sapiens
CKFRDLTVE

SEQ ID NO: 123764 - protein, 9 aa, Homo Sapiens
GNKSILGYN

SEQ ID NO: 123765 - protein, 9 aa, Homo Sapiens
VCYGMTLDE

SEQ ID NO: 123766 - protein, 9 aa, Homo Sapiens
REEVFGAQE

SEQ ID NO: 123767 - protein, 9 aa, Homo Sapiens
KRLCLALIA

SEQ ID NO: 123768 - protein, 9 aa, Homo Sapiens
DFLVTKTVD

SEQ ID NO: 123769 - protein, 9 aa, Homo Sapiens
DHSRRDMFE

SEQ ID NO: 123770 - protein, 9 aa, Homo Sapiens
TLTGTSHPV

SEQ ID NO: 123771 - protein, 9 aa, Homo Sapiens
RQTPASLMI

SEQ ID NO: 123772 - protein, 9 aa, Homo Sapiens
EQPKSMHVS

SEQ ID NO: 123773 - protein, 9 aa, Homo Sapiens
NASLLAEVC

SEQ ID NO: 123774 - protein, 9 aa, Homo Sapiens
GGAEPHPET

SEQ ID NO: 123775 - protein, 9 aa, Homo Sapiens
LIPWLLQPL

SEQ ID NO: 123776 - protein, 9 aa, Homo Sapiens
VILGKGGYG

SEQ ID NO: 123777 - protein, 9 aa, Homo Sapiens
RRNALREQG

SEQ ID NO: 123778 - protein, 9 aa, Homo Sapiens
VLELTGLKV

SEQ ID NO: 123779 - protein, 9 aa, Homo Sapiens
HHKSSSKAL

SEQ ID NO: 123780 - protein, 9 aa, Homo Sapiens
DPHGQGGQP

SEQ ID NO: 123781 - protein, 9 aa, Homo Sapiens
RSLLLYRHH

SEQ ID NO: 123782 - protein, 9 aa, Homo Sapiens
RICSPVGSC

SEQ ID NO: 123783 - protein, 9 aa, Homo Sapiens
REGKHNFTM

SEQ ID NO: 123784 - protein, 9 aa, Homo Sapiens
PARPSGRHL

SEQ ID NO: 123785 - protein, 9 aa, Homo Sapiens
SLITVGRID

SEQ ID NO: 123786 - protein, 9 aa, Homo Sapiens
SGVTLQSML

SEQ ID NO: 123787 - protein, 9 aa, Homo Sapiens
RRFEKRVYI

SEQ ID NO: 123788 - protein, 9 aa, Homo Sapiens
ASQSIVITR

SEQ ID NO: 123789 - protein, 9 aa, Homo Sapiens
EVTKARSLD

SEQ ID NO: 123790 - protein, 9 aa, Homo Sapiens
DMESVMAVD

SEQ ID NO: 123791 - protein, 9 aa, Homo Sapiens
PQSVRLQPR

SEQ ID NO: 123792 - protein, 9 aa, Homo Sapiens
PFRHLAQEG

SEQ ID NO: 123793 - protein, 9 aa, Homo Sapiens
YVKKDKGED

SEQ ID NO: 123794 - protein, 9 aa, Homo Sapiens
RVEKTGESV

SEQ ID NO: 123795 - protein, 9 aa, Homo Sapiens
KRRKRLWPA

SEQ ID NO: 123796 - protein, 9 aa, Homo Sapiens
ASGHLARAL

SEQ ID NO: 123797 - protein, 9 aa, Homo Sapiens
NFEVAFSSV

SEQ ID NO: 123798 - protein, 9 aa, Homo Sapiens
MCVPAQKIW

SEQ ID NO: 123799 - protein, 9 aa, Homo Sapiens
GGYGKKVVV

SEQ ID NO: 123800 - protein, 9 aa, Homo Sapiens
EHLFKQAWE

SEQ ID NO: 123801 - protein, 9 aa, Homo Sapiens
DSSSTLVSQ

SEQ ID NO: 123802 - protein, 9 aa, Homo Sapiens
PSAMTLPYP

SEQ ID NO: 123803 - protein, 9 aa, Homo Sapiens
FPHVDGEAD

SEQ ID NO: 123804 - protein, 9 aa, Homo Sapiens
LSPCKDAGR

SEQ ID NO: 123805 - protein, 9 aa, Homo Sapiens
TYRISMQCV

SEQ ID NO: 123806 - protein, 9 aa, Homo Sapiens
KKPKIRMKK

SEQ ID NO: 123807 - protein, 9 aa, Homo Sapiens
RSTRKVSTM

SEQ ID NO: 123808 - protein, 9 aa, Homo Sapiens
LGHGTEVHV

SEQ ID NO: 123809 - protein, 9 aa, Homo Sapiens
QQESVRAGN

SEQ ID NO: 123810 - protein, 9 aa, Homo Sapiens
AIRRPPVLR

SEQ ID NO: 123811 - protein, 9 aa, Homo Sapiens
NNLVSGMRV

SEQ ID NO: 123812 - protein, 9 aa, Homo Sapiens
DTGCSVSRN

SEQ ID NO: 123813 - protein, 9 aa, Homo Sapiens
HKQLVRGNA

SEQ ID NO: 123814 - protein, 9 aa, Homo Sapiens
KAFSYSSVF

SEQ ID NO: 123815 - protein, 9 aa, Homo Sapiens
KVLKQAHPD

SEQ ID NO: 123816 - protein, 9 aa, Homo Sapiens
LALMCFLRR

SEQ ID NO: 123817 - protein, 9 aa, Homo Sapiens
KRVADLVEA

SEQ ID NO: 123818 - protein, 9 aa, Homo Sapiens
GPSQRGAAT

SEQ ID NO: 123819 - protein, 9 aa, Homo Sapiens
DPPARPSGR

SEQ ID NO: 123820 - protein, 9 aa, Homo Sapiens
VDKEFFSDW

SEQ ID NO: 123821 - protein, 9 aa, Homo Sapiens
RFPQDDLCR

SEQ ID NO: 123822 - protein, 9 aa, Homo Sapiens
RRQEHRQRN

SEQ ID NO: 123823 - protein, 9 aa, Homo Sapiens
VKKPRASQE

SEQ ID NO: 123824 - protein, 9 aa, Homo Sapiens
CRHNLDIER

SEQ ID NO: 123825 - protein, 9 aa, Homo Sapiens
QPADFLLRL

SEQ ID NO: 123826 - protein, 9 aa, Homo Sapiens
AEKFVHLEE

SEQ ID NO: 123827 - protein, 9 aa, Homo Sapiens
QNVEMRPLG

SEQ ID NO: 123828 - protein, 9 aa, Homo Sapiens
SDSKQKRND

SEQ ID NO: 123829 - protein, 9 aa, Homo Sapiens
EIDVQTRDL

SEQ ID NO: 123830 - protein, 9 aa, Homo Sapiens
APGPRPGSP

SEQ ID NO: 123831 - protein, 9 aa, Homo Sapiens
HDPFPRYDL

SEQ ID NO: 123832 - protein, 9 aa, Homo Sapiens
MTTFWKTDL

SEQ ID NO: 123833 - protein, 9 aa, Homo Sapiens
TDRTRLLAK

SEQ ID NO: 123834 - protein, 9 aa, Homo Sapiens
EASTLVHSS

SEQ ID NO: 123835 - protein, 9 aa, Homo Sapiens
CAPGAPAVP

SEQ ID NO: 123836 - protein, 9 aa, Homo Sapiens
GTLYSLQPP

SEQ ID NO: 123837 - protein, 9 aa, Homo Sapiens
TTIFPPLEK

SEQ ID NO: 123838 - protein, 9 aa, Homo Sapiens
VVGWGDDNT

SEQ ID NO: 123839 - protein, 9 aa, Homo Sapiens
LVGHLDAIG

SEQ ID NO: 123840 - protein, 9 aa, Homo Sapiens
RIETESTTR

SEQ ID NO: 123841 - protein, 9 aa, Homo Sapiens
ECEVTDPST

SEQ ID NO: 123842 - protein, 9 aa, Homo Sapiens
LERPSEWPG

SEQ ID NO: 123843 - protein, 9 aa, Homo Sapiens
VCVTKAFSV

SEQ ID NO: 123844 - protein, 9 aa, Homo Sapiens
LSPELPPDE

SEQ ID NO: 123845 - protein, 9 aa, Homo Sapiens
HTDIKTGYL

SEQ ID NO: 123846 - protein, 9 aa, Homo Sapiens
ALKQEDHSR

SEQ ID NO: 123847 - protein, 9 aa, Homo Sapiens
WSLMKVSLL

SEQ ID NO: 123848 - protein, 9 aa, Homo Sapiens
LREATSPQP

SEQ ID NO: 123849 - protein, 9 aa, Homo Sapiens
GFKVPQAQL

SEQ ID NO: 123850 - protein, 9 aa, Homo Sapiens
ALFLAGVPK

SEQ ID NO: 123851 - protein, 9 aa, Homo Sapiens
SVKSQPLLN

SEQ ID NO: 123852 - protein, 9 aa, Homo Sapiens
FIIHQKTHT

SEQ ID NO: 123853 - protein, 9 aa, Homo Sapiens
YTQNVEMRP

SEQ ID NO: 123854 - protein, 9 aa, Homo Sapiens
LSHDEQRAK

SEQ ID NO: 123855 - protein, 9 aa, Homo Sapiens
CDGQQYGAV

SEQ ID NO: 123856 - protein, 9 aa, Homo Sapiens
SLILTVWYT

SEQ ID NO: 123857 - protein, 9 aa, Homo Sapiens
NLTEWFSRL

SEQ ID NO: 123858 - protein, 9 aa, Homo Sapiens
ASEGWHWGA

SEQ ID NO: 123859 - protein, 9 aa, Homo Sapiens
HSDGEEEEE

SEQ ID NO: 123860 - protein, 9 aa, Homo Sapiens
GKMCLSVEV

SEQ ID NO: 123861 - protein, 9 aa, Homo Sapiens
SADKRKYVF

SEQ ID NO: 123862 - protein, 9 aa, Homo Sapiens
QGLYSNFWC

SEQ ID NO: 123863 - protein, 9 aa, Homo Sapiens
MNVGSHSLR

SEQ ID NO: 123864 - protein, 9 aa, Homo Sapiens
LQKDNISMH

SEQ ID NO: 123865 - protein, 9 aa, Homo Sapiens
ITLIKLYQQ

SEQ ID NO: 123866 - protein, 9 aa, Homo Sapiens
PHGGGGGEA

SEQ ID NO: 123867 - protein, 9 aa, Homo Sapiens
EEIVHKLMG

SEQ ID NO: 123868 - protein, 9 aa, Homo Sapiens
SQKRALLCL

SEQ ID NO: 123869 - protein, 9 aa, Homo Sapiens
EVSEFHSRY

SEQ ID NO: 123870 - protein, 9 aa, Homo Sapiens
RSSSPRRAS

SEQ ID NO: 123871 - protein, 9 aa, Homo Sapiens
TPASLMITR

SEQ ID NO: 123872 - protein, 9 aa, Homo Sapiens
TGHTKRITF

SEQ ID NO: 123873 - protein, 9 aa, Homo Sapiens
SYAPHVQIC

SEQ ID NO: 123874 - protein, 9 aa, Homo Sapiens
EHHSPTCLR

SEQ ID NO: 123875 - protein, 9 aa, Homo Sapiens
QMRLLRLQQ

SEQ ID NO: 123876 - protein, 9 aa, Homo Sapiens
CECHRGRKA

SEQ ID NO: 123877 - protein, 9 aa, Homo Sapiens
FFIQIRSVA

SEQ ID NO: 123878 - protein, 9 aa, Homo Sapiens
YMWKTTNRY

SEQ ID NO: 123879 - protein, 9 aa, Homo Sapiens
RKGPLNLQG

SEQ ID NO: 123880 - protein, 9 aa, Homo Sapiens
GKLRVLQKK

SEQ ID NO: 123881 - protein, 9 aa, Homo Sapiens
GPSPHLLHP

SEQ ID NO: 123882 - protein, 9 aa, Homo Sapiens
FQAGTLARL

SEQ ID NO: 123883 - protein, 9 aa, Homo Sapiens
SLPNDISSE

SEQ ID NO: 123884 - protein, 9 aa, Homo Sapiens
HSTATCSRR

SEQ ID NO: 123885 - protein, 9 aa, Homo Sapiens
VYESICGGD

SEQ ID NO: 123886 - protein, 9 aa, Homo Sapiens
APPPPNATL

SEQ ID NO: 123887 - protein, 9 aa, Homo Sapiens
VCYPPFPLG

SEQ ID NO: 123888 - protein, 9 aa, Homo Sapiens
EPAFRKGDV

SEQ ID NO: 123889 - protein, 9 aa, Homo Sapiens
VNFDLPSDI

SEQ ID NO: 123890 - protein, 9 aa, Homo Sapiens
SSGLGSYLL

SEQ ID NO: 123891 - protein, 9 aa, Homo Sapiens
AVPHSTFFD

SEQ ID NO: 123892 - protein, 9 aa, Homo Sapiens
KIMNEHLFK

SEQ ID NO: 123893 - protein, 9 aa, Homo Sapiens
AIILFSRSL

SEQ ID NO: 123894 - protein, 9 aa, Homo Sapiens
PPRPQGQQN

SEQ ID NO: 123895 - protein, 9 aa, Homo Sapiens
ALIGSLIHI

SEQ ID NO: 123896 - protein, 9 aa, Homo Sapiens
VLEDAEMVG

SEQ ID NO: 123897 - protein, 9 aa, Homo Sapiens
APATVRPGT

SEQ ID NO: 123898 - protein, 9 aa, Homo Sapiens
DVLVSLETL

SEQ ID NO: 123899 - protein, 9 aa, Homo Sapiens
CAVLYPNVV

SEQ ID NO: 123900 - protein, 9 aa, Homo Sapiens
ENEGEEAQE

SEQ ID NO: 123901 - protein, 9 aa, Homo Sapiens
GLYVRPVLI

SEQ ID NO: 123902 - protein, 9 aa, Homo Sapiens
RNGTLVAFQ

SEQ ID NO: 123903 - protein, 9 aa, Homo Sapiens
TRMNDLPYL

SEQ ID NO: 123904 - protein, 9 aa, Homo Sapiens
KKLWPMKGE

SEQ ID NO: 123905 - protein, 9 aa, Homo Sapiens
GIGQKGDLE

SEQ ID NO: 123906 - protein, 9 aa, Homo Sapiens
SGGEREERG

SEQ ID NO: 123907 - protein, 9 aa, Homo Sapiens
LVDYASDSA

SEQ ID NO: 123908 - protein, 9 aa, Homo Sapiens
WYELQMWVC

SEQ ID NO: 123909 - protein, 9 aa, Homo Sapiens
DIIDLSVGG

SEQ ID NO: 123910 - protein, 9 aa, Homo Sapiens
TTTTPGFVD

SEQ ID NO: 123911 - protein, 9 aa, Homo Sapiens
HLKERVLMS

SEQ ID NO: 123912 - protein, 9 aa, Homo Sapiens
AWLQDAHQL

SEQ ID NO: 123913 - protein, 9 aa, Homo Sapiens
NPTFPNFFS

SEQ ID NO: 123914 - protein, 9 aa, Homo Sapiens
CQNLHDVSV

SEQ ID NO: 123915 - protein, 9 aa, Homo Sapiens
HTLDAAKRC

SEQ ID NO: 123916 - protein, 9 aa, Homo Sapiens
PRSSTATLH

SEQ ID NO: 123917 - protein, 9 aa, Homo Sapiens
KEAHLTSYS

SEQ ID NO: 123918 - protein, 9 aa, Homo Sapiens
PKAVEPGKL

SEQ ID NO: 123919 - protein, 9 aa, Homo Sapiens
RRSLDYAYV

SEQ ID NO: 123920 - protein, 9 aa, Homo Sapiens
LMDESSRLD

SEQ ID NO: 123921 - protein, 9 aa, Homo Sapiens
ELQVLVEQV

SEQ ID NO: 123922 - protein, 9 aa, Homo Sapiens
LDFSEGHQG

SEQ ID NO: 123923 - protein, 9 aa, Homo Sapiens
HYEFQHSHL

SEQ ID NO: 123924 - protein, 9 aa, Homo Sapiens
QQPECEAHA

SEQ ID NO: 123925 - protein, 9 aa, Homo Sapiens
KLALCETPA

SEQ ID NO: 123926 - protein, 9 aa, Homo Sapiens
GEQRHTYPV

SEQ ID NO: 123927 - protein, 9 aa, Homo Sapiens
FNLKADFNY

SEQ ID NO: 123928 - protein, 9 aa, Homo Sapiens
SVQPPRPRL

SEQ ID NO: 123929 - protein, 9 aa, Homo Sapiens
VTKVHGRDR

SEQ ID NO: 123930 - protein, 9 aa, Homo Sapiens
AMVIAYFSW

SEQ ID NO: 123931 - protein, 9 aa, Homo Sapiens
AVLNLLIML

SEQ ID NO: 123932 - protein, 9 aa, Homo Sapiens
HVDAWVIAL

SEQ ID NO: 123933 - protein, 9 aa, Homo Sapiens
GVVADWRYL

SEQ ID NO: 123934 - protein, 9 aa, Homo Sapiens
TQLADFLAN

SEQ ID NO: 123935 - protein, 9 aa, Homo Sapiens
RCLRMRPPR

SEQ ID NO: 123936 - protein, 9 aa, Homo Sapiens
VVEVWATIG

SEQ ID NO: 123937 - protein, 9 aa, Homo Sapiens
QYGSPATWL

SEQ ID NO: 123938 - protein, 9 aa, Homo Sapiens
DYSPEVINY

SEQ ID NO: 123939 - protein, 9 aa, Homo Sapiens
MNKEGGTVS

SEQ ID NO: 123940 - protein, 9 aa, Homo Sapiens
DNKKLGEMH

SEQ ID NO: 123941 - protein, 9 aa, Homo Sapiens
WHWEGWWSA

SEQ ID NO: 123942 - protein, 9 aa, Homo Sapiens
PECEAHARQ

SEQ ID NO: 123943 - protein, 9 aa, Homo Sapiens
DISSEAPVG

SEQ ID NO: 123944 - protein, 9 aa, Homo Sapiens
PGPCGPPPT

SEQ ID NO: 123945 - protein, 9 aa, Homo Sapiens
DLDRGLHKR

SEQ ID NO: 123946 - protein, 9 aa, Homo Sapiens
THFQTPRPM

SEQ ID NO: 123947 - protein, 9 aa, Homo Sapiens
VKIITPYFN

SEQ ID NO: 123948 - protein, 9 aa, Homo Sapiens
AKRAGQNSD

SEQ ID NO: 123949 - protein, 9 aa, Homo Sapiens
ASVRHLGDQ

SEQ ID NO: 123950 - protein, 9 aa, Homo Sapiens
SPPGRHWLC

SEQ ID NO: 123951 - protein, 9 aa, Homo Sapiens
TAVMNQYRM

SEQ ID NO: 123952 - protein, 9 aa, Homo Sapiens
EPLPPNSSS

SEQ ID NO: 123953 - protein, 9 aa, Homo Sapiens
QVYTQNVEM

SEQ ID NO: 123954 - protein, 9 aa, Homo Sapiens
PAEPRGRAS

SEQ ID NO: 123955 - protein, 9 aa, Homo Sapiens
ARLAVAKAL

SEQ ID NO: 123956 - protein, 9 aa, Homo Sapiens
DRERSIHNF

SEQ ID NO: 123957 - protein, 9 aa, Homo Sapiens
SLSREHLSV

SEQ ID NO: 123958 - protein, 9 aa, Homo Sapiens
EGCQVPGGN

SEQ ID NO: 123959 - protein, 9 aa, Homo Sapiens
LEKNGKRRL

SEQ ID NO: 123960 - protein, 9 aa, Homo Sapiens
ATMACDRYV

SEQ ID NO: 123961 - protein, 9 aa, Homo Sapiens
PVVIGPALC

SEQ ID NO: 123962 - protein, 9 aa, Homo Sapiens
DIHRTFPAY

SEQ ID NO: 123963 - protein, 9 aa, Homo Sapiens
GKNTLNDAL

SEQ ID NO: 123964 - protein, 9 aa, Homo Sapiens
EETPLNKLR

SEQ ID NO: 123965 - protein, 9 aa, Homo Sapiens
INFPRNKVC

SEQ ID NO: 123966 - protein, 9 aa, Homo Sapiens
WAWDDKKAL

SEQ ID NO: 123967 - protein, 9 aa, Homo Sapiens
FSNYKACFS

SEQ ID NO: 123968 - protein, 9 aa, Homo Sapiens
KREQRKKKY

SEQ ID NO: 123969 - protein, 9 aa, Homo Sapiens
LKQEKKDKT

SEQ ID NO: 123970 - protein, 9 aa, Homo Sapiens
ISNGDFYNN

SEQ ID NO: 123971 - protein, 9 aa, Homo Sapiens
TPKKISLKL

SEQ ID NO: 123972 - protein, 9 aa, Homo Sapiens
LAHSVASTL

SEQ ID NO: 123973 - protein, 9 aa, Homo Sapiens
QDEEAQTIG

SEQ ID NO: 123974 - protein, 9 aa, Homo Sapiens
FLNALCKAV

SEQ ID NO: 123975 - protein, 9 aa, Homo Sapiens
LLEETPIQG

SEQ ID NO: 123976 - protein, 9 aa, Homo Sapiens
EVWRRVWSR

SEQ ID NO: 123977 - protein, 9 aa, Homo Sapiens
GTNPLCRGS

SEQ ID NO: 123978 - protein, 9 aa, Homo Sapiens
QNTTKLTVL

SEQ ID NO: 123979 - protein, 9 aa, Homo Sapiens
TPGPTPPAA

SEQ ID NO: 123980 - protein, 9 aa, Homo Sapiens
FFVMMKGPN

SEQ ID NO: 123981 - protein, 9 aa, Homo Sapiens
HRKGPLNLQ

SEQ ID NO: 123982 - protein, 9 aa, Homo Sapiens
DRLNPEERI

SEQ ID NO: 123983 - protein, 9 aa, Homo Sapiens
VFLGFTSDH

SEQ ID NO: 123984 - protein, 9 aa, Homo Sapiens
SATSLGHRA

SEQ ID NO: 123985 - protein, 9 aa, Homo Sapiens
IQKFSPKRS

SEQ ID NO: 123986 - protein, 9 aa, Homo Sapiens
GLPRLPHCQ

SEQ ID NO: 123987 - protein, 9 aa, Homo Sapiens
GKLNKREEC

SEQ ID NO: 123988 - protein, 9 aa, Homo Sapiens
HLGKLRVLQ

SEQ ID NO: 123989 - protein, 9 aa, Homo Sapiens
HGPRSTLGA

SEQ ID NO: 123990 - protein, 9 aa, Homo Sapiens
FSQHLQVVK

SEQ ID NO: 123991 - protein, 9 aa, Homo Sapiens
TFERLQMNL

SEQ ID NO: 123992 - protein, 9 aa, Homo Sapiens
LHLFDLTPA

SEQ ID NO: 123993 - protein, 9 aa, Homo Sapiens
LQGKKSSVI

SEQ ID NO: 123994 - protein, 9 aa, Homo Sapiens
SVSSILITS

SEQ ID NO: 123995 - protein, 9 aa, Homo Sapiens
SMMCLKKRD

SEQ ID NO: 123996 - protein, 9 aa, Homo Sapiens
DAHLCLKTW

SEQ ID NO: 123997 - protein, 9 aa, Homo Sapiens
CTQLFTSRK

SEQ ID NO: 123998 - protein, 9 aa, Homo Sapiens
EEPAVAIKA

SEQ ID NO: 123999 - protein, 9 aa, Homo Sapiens
VQPSAGYRC

SEQ ID NO: 124000 - protein, 9 aa, Homo Sapiens
PPPPTKKRG

SEQ ID NO: 124001 - protein, 9 aa, Homo Sapiens
GAPPGARCA

SEQ ID NO: 124002 - protein, 9 aa, Homo Sapiens
PNELQALIE

SEQ ID NO: 124003 - protein, 9 aa, Homo Sapiens
NKEAKKEAG

SEQ ID NO: 124004 - protein, 9 aa, Homo Sapiens
YLMSLGIYS

SEQ ID NO: 124005 - protein, 9 aa, Homo Sapiens
EFNSVKENL

SEQ ID NO: 124006 - protein, 9 aa, Homo Sapiens
VHFTSREDV

SEQ ID NO: 124007 - protein, 9 aa, Homo Sapiens
GNELSDFQI

SEQ ID NO: 124008 - protein, 9 aa, Homo Sapiens
FPNFFSKLS

SEQ ID NO: 124009 - protein, 9 aa, Homo Sapiens
VKELGVCGN

SEQ ID NO: 124010 - protein, 9 aa, Homo Sapiens
NDKGESNDG

SEQ ID NO: 124011 - protein, 9 aa, Homo Sapiens
LASPTVLGF

SEQ ID NO: 124012 - protein, 9 aa, Homo Sapiens
GSGTSGQSS

SEQ ID NO: 124013 - protein, 9 aa, Homo Sapiens
KQLPAPLNS

SEQ ID NO: 124014 - protein, 9 aa, Homo Sapiens
PRRGVPDVG

SEQ ID NO: 124015 - protein, 9 aa, Homo Sapiens
EYSSSVDFS

SEQ ID NO: 124016 - protein, 9 aa, Homo Sapiens
YPMTSRPYY

SEQ ID NO: 124017 - protein, 9 aa, Homo Sapiens
VGWGDDNTA

SEQ ID NO: 124018 - protein, 9 aa, Homo Sapiens
SASQIWNLN

SEQ ID NO: 124019 - protein, 9 aa, Homo Sapiens
LFHLHRKGP

SEQ ID NO: 124020 - protein, 9 aa, Homo Sapiens
LSSIRNFPQ

SEQ ID NO: 124021 - protein, 9 aa, Homo Sapiens
ALCVLAPIE

SEQ ID NO: 124022 - protein, 9 aa, Homo Sapiens
ASSVTLASA

SEQ ID NO: 124023 - protein, 9 aa, Homo Sapiens
VMPHQMHQH

SEQ ID NO: 124024 - protein, 9 aa, Homo Sapiens
HGTEVHVRY

SEQ ID NO: 124025 - protein, 9 aa, Homo Sapiens
CVEKSRSCA

SEQ ID NO: 124026 - protein, 9 aa, Homo Sapiens
MFPRKGRGL

SEQ ID NO: 124027 - protein, 9 aa, Homo Sapiens
SGPRPRCRP

SEQ ID NO: 124028 - protein, 9 aa, Homo Sapiens
DFCYDYLWR

SEQ ID NO: 124029 - protein, 9 aa, Homo Sapiens
SLPAEPSPG

SEQ ID NO: 124030 - protein, 9 aa, Homo Sapiens
IIKSAMGTS

SEQ ID NO: 124031 - protein, 9 aa, Homo Sapiens
NEPQRPPRS

SEQ ID NO: 124032 - protein, 9 aa, Homo Sapiens
WELESSTRK

SEQ ID NO: 124033 - protein, 9 aa, Homo Sapiens
KLQSCLEAQ

SEQ ID NO: 124034 - protein, 9 aa, Homo Sapiens
QRTSVHCLK

SEQ ID NO: 124035 - protein, 9 aa, Homo Sapiens
LLRGCPQYL

SEQ ID NO: 124036 - protein, 9 aa, Homo Sapiens
TTREVTARA

SEQ ID NO: 124037 - protein, 9 aa, Homo Sapiens
ESVNTPVCK

SEQ ID NO: 124038 - protein, 9 aa, Homo Sapiens
PEKPLVSGT

SEQ ID NO: 124039 - protein, 9 aa, Homo Sapiens
LTSPAASAS

SEQ ID NO: 124040 - protein, 9 aa, Homo Sapiens
EDTTEYFVC

SEQ ID NO: 124041 - protein, 9 aa, Homo Sapiens
YGAQHPPLI

SEQ ID NO: 124042 - protein, 9 aa, Homo Sapiens
WGGTTAVLH

SEQ ID NO: 124043 - protein, 9 aa, Homo Sapiens
QPRPPTAVD

SEQ ID NO: 124044 - protein, 9 aa, Homo Sapiens
PSSLQPLPP

SEQ ID NO: 124045 - protein, 9 aa, Homo Sapiens
APKPPSDGH

SEQ ID NO: 124046 - protein, 9 aa, Homo Sapiens
DVLKTRMEK

SEQ ID NO: 124047 - protein, 9 aa, Homo Sapiens
VREVTGGHE

SEQ ID NO: 124048 - protein, 9 aa, Homo Sapiens
AGLSRQRCA

SEQ ID NO: 124049 - protein, 9 aa, Homo Sapiens
KENQKEQTA

SEQ ID NO: 124050 - protein, 9 aa, Homo Sapiens
GDRRLIGGA

SEQ ID NO: 124051 - protein, 9 aa, Homo Sapiens
THHHSSEGL

SEQ ID NO: 124052 - protein, 9 aa, Homo Sapiens
TRMEKRRLR

SEQ ID NO: 124053 - protein, 9 aa, Homo Sapiens
AQSLDYLAR

SEQ ID NO: 124054 - protein, 9 aa, Homo Sapiens
MMTTKRLNK

SEQ ID NO: 124055 - protein, 9 aa, Homo Sapiens
TPQFGRRTT

SEQ ID NO: 124056 - protein, 9 aa, Homo Sapiens
RPPPLVRCH

SEQ ID NO: 124057 - protein, 9 aa, Homo Sapiens
KIRSVKMTF

SEQ ID NO: 124058 - protein, 9 aa, Homo Sapiens
SPMNAMHVG

SEQ ID NO: 124059 - protein, 9 aa, Homo Sapiens
SNSRPSESC

SEQ ID NO: 124060 - protein, 9 aa, Homo Sapiens
RAAQTRRSY

SEQ ID NO: 124061 - protein, 9 aa, Homo Sapiens
SMQENYPFV

SEQ ID NO: 124062 - protein, 9 aa, Homo Sapiens
WTFLYHRMT

SEQ ID NO: 124063 - protein, 9 aa, Homo Sapiens
RTLQRRMLK

SEQ ID NO: 124064 - protein, 9 aa, Homo Sapiens
SVRQSVPYG

SEQ ID NO: 124065 - protein, 9 aa, Homo Sapiens
SLGLSSYCN

SEQ ID NO: 124066 - protein, 9 aa, Homo Sapiens
RCTGSRCAQ

SEQ ID NO: 124067 - protein, 9 aa, Homo Sapiens
ACKAKYNVH

SEQ ID NO: 124068 - protein, 9 aa, Homo Sapiens
TVGTMWLSN

SEQ ID NO: 124069 - protein, 9 aa, Homo Sapiens
QHSHLAVTP

SEQ ID NO: 124070 - protein, 9 aa, Homo Sapiens
MCLKKRDLY

SEQ ID NO: 124071 - protein, 9 aa, Homo Sapiens
HAFLGHCQE

SEQ ID NO: 124072 - protein, 9 aa, Homo Sapiens
ETKRLEREQ

SEQ ID NO: 124073 - protein, 9 aa, Homo Sapiens
LVREEVFGA

SEQ ID NO: 124074 - protein, 9 aa, Homo Sapiens
ATEVGCPAG

SEQ ID NO: 124075 - protein, 9 aa, Homo Sapiens
VTASCASTG

SEQ ID NO: 124076 - protein, 9 aa, Homo Sapiens
QDVEGNDVI

SEQ ID NO: 124077 - protein, 9 aa, Homo Sapiens
DAAKGILQY

SEQ ID NO: 124078 - protein, 9 aa, Homo Sapiens
LSPTVFVAY

SEQ ID NO: 124079 - protein, 9 aa, Homo Sapiens
KRITFLFDS

SEQ ID NO: 124080 - protein, 9 aa, Homo Sapiens
VIGGAGKYH

SEQ ID NO: 124081 - protein, 9 aa, Homo Sapiens
DHGIQSMRI

SEQ ID NO: 124082 - protein, 9 aa, Homo Sapiens
PEVEFSDQF

SEQ ID NO: 124083 - protein, 9 aa, Homo Sapiens
VVVTGRVLR

SEQ ID NO: 124084 - protein, 9 aa, Homo Sapiens
ASLRPCKLD

SEQ ID NO: 124085 - protein, 9 aa, Homo Sapiens
TVESHMKGC

SEQ ID NO: 124086 - protein, 9 aa, Homo Sapiens
IRRRFEKRV

SEQ ID NO: 124087 - protein, 9 aa, Homo Sapiens
PSTTIHASR

SEQ ID NO: 124088 - protein, 9 aa, Homo Sapiens
EPFLTQARL

SEQ ID NO: 124089 - protein, 9 aa, Homo Sapiens
ALFYHFLHH

SEQ ID NO: 124090 - protein, 9 aa, Homo Sapiens
DCFKKVARD

SEQ ID NO: 124091 - protein, 9 aa, Homo Sapiens
IRSFDGEVS

SEQ ID NO: 124092 - protein, 9 aa, Homo Sapiens
HRAVHDFPQ

SEQ ID NO: 124093 - protein, 9 aa, Homo Sapiens
ETFVLLGTI

SEQ ID NO: 124094 - protein, 9 aa, Homo Sapiens
ETSTYPKDG

SEQ ID NO: 124095 - protein, 9 aa, Homo Sapiens
PRSGSLITV

SEQ ID NO: 124096 - protein, 9 aa, Homo Sapiens
ERPSEWPGW

SEQ ID NO: 124097 - protein, 9 aa, Homo Sapiens
PRWVKIITP

SEQ ID NO: 124098 - protein, 9 aa, Homo Sapiens
VISEAGAPP

SEQ ID NO: 124099 - protein, 9 aa, Homo Sapiens
DGARKYFLW

SEQ ID NO: 124100 - protein, 9 aa, Homo Sapiens
TSLMIMKFV

SEQ ID NO: 124101 - protein, 9 aa, Homo Sapiens
NEWPLGKMC

SEQ ID NO: 124102 - protein, 9 aa, Homo Sapiens
KKGDKQRTL

SEQ ID NO: 124103 - protein, 9 aa, Homo Sapiens
LSVGGQLTT

SEQ ID NO: 124104 - protein, 9 aa, Homo Sapiens
RFDDDNSPF

SEQ ID NO: 124105 - protein, 9 aa, Homo Sapiens
SCGLCVGYN

SEQ ID NO: 124106 - protein, 9 aa, Homo Sapiens
FDTSVYPQL

SEQ ID NO: 124107 - protein, 9 aa, Homo Sapiens
CMLAANRAG

SEQ ID NO: 124108 - protein, 9 aa, Homo Sapiens
VNKRNGAEA

SEQ ID NO: 124109 - protein, 9 aa, Homo Sapiens
LSLYSVAVW

SEQ ID NO: 124110 - protein, 9 aa, Homo Sapiens
VNAKCASLK

SEQ ID NO: 124111 - protein, 9 aa, Homo Sapiens
GKPGNFSCA

SEQ ID NO: 124112 - protein, 9 aa, Homo Sapiens
QGLQKRLHN

SEQ ID NO: 124113 - protein, 9 aa, Homo Sapiens
NKENQKEQT

SEQ ID NO: 124114 - protein, 9 aa, Homo Sapiens
KCDCSLGYS

SEQ ID NO: 124115 - protein, 9 aa, Homo Sapiens
NSSCSCSSK

SEQ ID NO: 124116 - protein, 9 aa, Homo Sapiens
AKARSAWDA

SEQ ID NO: 124117 - protein, 9 aa, Homo Sapiens
IHGQYIHCH

SEQ ID NO: 124118 - protein, 9 aa, Homo Sapiens
HSVGYVERA

SEQ ID NO: 124119 - protein, 9 aa, Homo Sapiens
PFLVAAALC

SEQ ID NO: 124120 - protein, 9 aa, Homo Sapiens
DRERAAQTR

SEQ ID NO: 124121 - protein, 9 aa, Homo Sapiens
LTRLKAWWK

SEQ ID NO: 124122 - protein, 9 aa, Homo Sapiens
PGLFRTNGS

SEQ ID NO: 124123 - protein, 9 aa, Homo Sapiens
PQKFHGKKV

SEQ ID NO: 124124 - protein, 9 aa, Homo Sapiens
VQNILDVHT

SEQ ID NO: 124125 - protein, 9 aa, Homo Sapiens
LAEVCHQIF

SEQ ID NO: 124126 - protein, 9 aa, Homo Sapiens
GNPYAQVQR

SEQ ID NO: 124127 - protein, 9 aa, Homo Sapiens
DVRSAYKRL

SEQ ID NO: 124128 - protein, 9 aa, Homo Sapiens
TARKINFDH

SEQ ID NO: 124129 - protein, 9 aa, Homo Sapiens
FGKTSLMIM

SEQ ID NO: 124130 - protein, 9 aa, Homo Sapiens
KLSMNLMNE

SEQ ID NO: 124131 - protein, 9 aa, Homo Sapiens
TEDQLFFGC

SEQ ID NO: 124132 - protein, 9 aa, Homo Sapiens
LPFPFSIKP

SEQ ID NO: 124133 - protein, 9 aa, Homo Sapiens
DVNSIELCF

SEQ ID NO: 124134 - protein, 9 aa, Homo Sapiens
NAVWYRAVG

SEQ ID NO: 124135 - protein, 9 aa, Homo Sapiens
ITAAHPSSV

SEQ ID NO: 124136 - protein, 9 aa, Homo Sapiens
ATKIVQATW

SEQ ID NO: 124137 - protein, 9 aa, Homo Sapiens
DPAIRTRGN

SEQ ID NO: 124138 - protein, 9 aa, Homo Sapiens
HNSNPYPRR

SEQ ID NO: 124139 - protein, 9 aa, Homo Sapiens
CSDLSTFVC

SEQ ID NO: 124140 - protein, 9 aa, Homo Sapiens
QVKRDLNAR

SEQ ID NO: 124141 - protein, 9 aa, Homo Sapiens
STSHYWITV

SEQ ID NO: 124142 - protein, 9 aa, Homo Sapiens
FPSRSRWPG

SEQ ID NO: 124143 - protein, 9 aa, Homo Sapiens
AGRASQPMA

SEQ ID NO: 124144 - protein, 9 aa, Homo Sapiens
LRNISTVRA

SEQ ID NO: 124145 - protein, 9 aa, Homo Sapiens
RAMRAARLP

SEQ ID NO: 124146 - protein, 9 aa, Homo Sapiens
RPLSSIRNF

SEQ ID NO: 124147 - protein, 9 aa, Homo Sapiens
VDYASDSAE

SEQ ID NO: 124148 - protein, 9 aa, Homo Sapiens
SGSRHRKEV

SEQ ID NO: 124149 - protein, 9 aa, Homo Sapiens
VHCLKQENS

SEQ ID NO: 124150 - protein, 9 aa, Homo Sapiens
TGLYVRPVL

SEQ ID NO: 124151 - protein, 9 aa, Homo Sapiens
SRGARRPAP

SEQ ID NO: 124152 - protein, 9 aa, Homo Sapiens
SQMGSVHEG

SEQ ID NO: 124153 - protein, 9 aa, Homo Sapiens
TIEEGTLDG

SEQ ID NO: 124154 - protein, 9 aa, Homo Sapiens
SLDRNLGSP

SEQ ID NO: 124155 - protein, 9 aa, Homo Sapiens
NWHSNSQNI

SEQ ID NO: 124156 - protein, 9 aa, Homo Sapiens
ERTAAAHGG

SEQ ID NO: 124157 - protein, 9 aa, Homo Sapiens
KEEAQEAQG

SEQ ID NO: 124158 - protein, 9 aa, Homo Sapiens
STSQPNASV

SEQ ID NO: 124159 - protein, 9 aa, Homo Sapiens
AATSRGMWN

SEQ ID NO: 124160 - protein, 9 aa, Homo Sapiens
LVWTHTGCH

SEQ ID NO: 124161 - protein, 9 aa, Homo Sapiens
EVLYTSVKE

SEQ ID NO: 124162 - protein, 9 aa, Homo Sapiens
PLTYDYRLV

SEQ ID NO: 124163 - protein, 9 aa, Homo Sapiens
TEPSTPKSP

SEQ ID NO: 124164 - protein, 9 aa, Homo Sapiens
LGRGRGEAG

SEQ ID NO: 124165 - protein, 9 aa, Homo Sapiens
SESSTVSNG

SEQ ID NO: 124166 - protein, 9 aa, Homo Sapiens
LYHHKSSSK

SEQ ID NO: 124167 - protein, 9 aa, Homo Sapiens
CKAMEAAQL

SEQ ID NO: 124168 - protein, 9 aa, Homo Sapiens
EEKDLIRSV

SEQ ID NO: 124169 - protein, 9 aa, Homo Sapiens
SHLQPPGER

SEQ ID NO: 124170 - protein, 9 aa, Homo Sapiens
LKTHPLATQ

SEQ ID NO: 124171 - protein, 9 aa, Homo Sapiens
YTNRNVASP

SEQ ID NO: 124172 - protein, 9 aa, Homo Sapiens
VKPLACTST

SEQ ID NO: 124173 - protein, 9 aa, Homo Sapiens
CMWPDGSSF

SEQ ID NO: 124174 - protein, 9 aa, Homo Sapiens
DRYHPKPAL

SEQ ID NO: 124175 - protein, 9 aa, Homo Sapiens
LGLGRWGLK

SEQ ID NO: 124176 - protein, 9 aa, Homo Sapiens
APTCIEQIH

SEQ ID NO: 124177 - protein, 9 aa, Homo Sapiens
PWCNAINFP

SEQ ID NO: 124178 - protein, 9 aa, Homo Sapiens
HYACREGFF

SEQ ID NO: 124179 - protein, 9 aa, Homo Sapiens
GNCSNYPAI

SEQ ID NO: 124180 - protein, 9 aa, Homo Sapiens
YKSSGHDSA

SEQ ID NO: 124181 - protein, 9 aa, Homo Sapiens
HPCPLPLKR

SEQ ID NO: 124182 - protein, 9 aa, Homo Sapiens
SYPEFQSSS

SEQ ID NO: 124183 - protein, 9 aa, Homo Sapiens
VLPGTGHIP

SEQ ID NO: 124184 - protein, 9 aa, Homo Sapiens
QGRGFVMSR

SEQ ID NO: 124185 - protein, 9 aa, Homo Sapiens
STWTGMVGE

SEQ ID NO: 124186 - protein, 9 aa, Homo Sapiens
DKHPGGCIQ

SEQ ID NO: 124187 - protein, 9 aa, Homo Sapiens
PNRLGFEFN

SEQ ID NO: 124188 - protein, 9 aa, Homo Sapiens
MELGLETIF

SEQ ID NO: 124189 - protein, 9 aa, Homo Sapiens
TTTTTPGFV

SEQ ID NO: 124190 - protein, 9 aa, Homo Sapiens
TKKILCFKK

SEQ ID NO: 124191 - protein, 9 aa, Homo Sapiens
SGHDSARHH

SEQ ID NO: 124192 - protein, 9 aa, Homo Sapiens
LVLLLGWLI

SEQ ID NO: 124193 - protein, 9 aa, Homo Sapiens
SRVQTLPTS

SEQ ID NO: 124194 - protein, 9 aa, Homo Sapiens
VHNLRLSVE

SEQ ID NO: 124195 - protein, 9 aa, Homo Sapiens
PLHIRQHSD

SEQ ID NO: 124196 - protein, 9 aa, Homo Sapiens
TRWLQKSKP

SEQ ID NO: 124197 - protein, 9 aa, Homo Sapiens
WWRLLCSSL

SEQ ID NO: 124198 - protein, 9 aa, Homo Sapiens
LKTHISNNY

SEQ ID NO: 124199 - protein, 9 aa, Homo Sapiens
YSTVVPLDE

SEQ ID NO: 124200 - protein, 9 aa, Homo Sapiens
MYRETEGST

SEQ ID NO: 124201 - protein, 9 aa, Homo Sapiens
LQLTEKYKN

SEQ ID NO: 124202 - protein, 9 aa, Homo Sapiens
TPDVENLVS

SEQ ID NO: 124203 - protein, 9 aa, Homo Sapiens
ASPLGHHMQ

SEQ ID NO: 124204 - protein, 9 aa, Homo Sapiens
GCIQAASTE

SEQ ID NO: 124205 - protein, 9 aa, Homo Sapiens
ATSLLLPVQ

SEQ ID NO: 124206 - protein, 9 aa, Homo Sapiens
AGGTSSGLG

SEQ ID NO: 124207 - protein, 9 aa, Homo Sapiens
FDVFTKGRT

SEQ ID NO: 124208 - protein, 9 aa, Homo Sapiens
NLQGKKSSV

SEQ ID NO: 124209 - protein, 9 aa, Homo Sapiens
KKRSSITKP

SEQ ID NO: 124210 - protein, 9 aa, Homo Sapiens
VYKVLKQAH

SEQ ID NO: 124211 - protein, 9 aa, Homo Sapiens
TDVTDASRT

SEQ ID NO: 124212 - protein, 9 aa, Homo Sapiens
GNKGEKHFE

SEQ ID NO: 124213 - protein, 9 aa, Homo Sapiens
GWHWEGWWS

SEQ ID NO: 124214 - protein, 9 aa, Homo Sapiens
ASWSDDATC

SEQ ID NO: 124215 - protein, 9 aa, Homo Sapiens
CRPGRICSP

SEQ ID NO: 124216 - protein, 9 aa, Homo Sapiens
QLAHILAEF

SEQ ID NO: 124217 - protein, 9 aa, Homo Sapiens
IAATIENVQ

SEQ ID NO: 124218 - protein, 9 aa, Homo Sapiens
FEELVILGK

SEQ ID NO: 124219 - protein, 9 aa, Homo Sapiens
LGIRQGFCC

SEQ ID NO: 124220 - protein, 9 aa, Homo Sapiens
RERSIHNFC

SEQ ID NO: 124221 - protein, 9 aa, Homo Sapiens
YNNNEDAPP

SEQ ID NO: 124222 - protein, 9 aa, Homo Sapiens
TGAVQAPSP

SEQ ID NO: 124223 - protein, 9 aa, Homo Sapiens
QRSCGSGTR

SEQ ID NO: 124224 - protein, 9 aa, Homo Sapiens
SGSVSCQKQ

SEQ ID NO: 124225 - protein, 9 aa, Homo Sapiens
EGEVSGGHC

SEQ ID NO: 124226 - protein, 9 aa, Homo Sapiens
HNKYLEDIK

SEQ ID NO: 124227 - protein, 9 aa, Homo Sapiens
GRHPSWPWT

SEQ ID NO: 124228 - protein, 9 aa, Homo Sapiens
PKQELCAQH

SEQ ID NO: 124229 - protein, 9 aa, Homo Sapiens
QPTVIRDIT

SEQ ID NO: 124230 - protein, 9 aa, Homo Sapiens
TWPLREATS

SEQ ID NO: 124231 - protein, 9 aa, Homo Sapiens
VLMSQCAHR

SEQ ID NO: 124232 - protein, 9 aa, Homo Sapiens
RATRPFHDS

SEQ ID NO: 124233 - protein, 9 aa, Homo Sapiens
DKGEDQVHI

SEQ ID NO: 124234 - protein, 9 aa, Homo Sapiens
AMKKIGSKK

SEQ ID NO: 124235 - protein, 9 aa, Homo Sapiens
LEVADRIGD

SEQ ID NO: 124236 - protein, 9 aa, Homo Sapiens
VIWVRREDS

SEQ ID NO: 124237 - protein, 9 aa, Homo Sapiens
VLKGLCGVI

SEQ ID NO: 124238 - protein, 9 aa, Homo Sapiens
FLYHRMTQN

SEQ ID NO: 124239 - protein, 9 aa, Homo Sapiens
FRLFHTALF

SEQ ID NO: 124240 - protein, 9 aa, Homo Sapiens
RQYLVQQLT

SEQ ID NO: 124241 - protein, 9 aa, Homo Sapiens
GKMAYLTVA

SEQ ID NO: 124242 - protein, 9 aa, Homo Sapiens
VRVPMSAVN

SEQ ID NO: 124243 - protein, 9 aa, Homo Sapiens
IIDILVPCV

SEQ ID NO: 124244 - protein, 9 aa, Homo Sapiens
ELPRVVGTQ

SEQ ID NO: 124245 - protein, 9 aa, Homo Sapiens
VDTDKLRVT

SEQ ID NO: 124246 - protein, 9 aa, Homo Sapiens
YTAPDKMGI

SEQ ID NO: 124247 - protein, 9 aa, Homo Sapiens
EAQEAQGIL

SEQ ID NO: 124248 - protein, 9 aa, Homo Sapiens
RGLHKRTYS

SEQ ID NO: 124249 - protein, 9 aa, Homo Sapiens
QLSVTPTVS

SEQ ID NO: 124250 - protein, 9 aa, Homo Sapiens
NSHEGKWDY

SEQ ID NO: 124251 - protein, 9 aa, Homo Sapiens
KVNSMVQQH

SEQ ID NO: 124252 - protein, 9 aa, Homo Sapiens
KLQSSLKNW

SEQ ID NO: 124253 - protein, 9 aa, Homo Sapiens
RFLRRHVHP

SEQ ID NO: 124254 - protein, 9 aa, Homo Sapiens
RCPRVGCLH

SEQ ID NO: 124255 - protein, 9 aa, Homo Sapiens
EEAQTIGQI

SEQ ID NO: 124256 - protein, 9 aa, Homo Sapiens
LTVSRWMTS

SEQ ID NO: 124257 - protein, 9 aa, Homo Sapiens
EYRFAWRTL

SEQ ID NO: 124258 - protein, 9 aa, Homo Sapiens
FPSTNLQQM

SEQ ID NO: 124259 - protein, 9 aa, Homo Sapiens
ELESSTRKP

SEQ ID NO: 124260 - protein, 9 aa, Homo Sapiens
EISTTSNKC

SEQ ID NO: 124261 - protein, 9 aa, Homo Sapiens
MRRRRRDGF

SEQ ID NO: 124262 - protein, 9 aa, Homo Sapiens
TSLGVSQRG

SEQ ID NO: 124263 - protein, 9 aa, Homo Sapiens
PLSGKGNPE

SEQ ID NO: 124264 - protein, 9 aa, Homo Sapiens
LAMAQVTHP

SEQ ID NO: 124265 - protein, 9 aa, Homo Sapiens
NSITVSWSQ

SEQ ID NO: 124266 - protein, 9 aa, Homo Sapiens
FASYPFCYL

SEQ ID NO: 124267 - protein, 9 aa, Homo Sapiens
TPSSPPSPG

SEQ ID NO: 124268 - protein, 9 aa, Homo Sapiens
RAIGLSWVL

SEQ ID NO: 124269 - protein, 9 aa, Homo Sapiens
SHLSQSLLC

SEQ ID NO: 124270 - protein, 9 aa, Homo Sapiens
MSSRDIEEP

SEQ ID NO: 124271 - protein, 9 aa, Homo Sapiens
IVNALDKMI

SEQ ID NO: 124272 - protein, 9 aa, Homo Sapiens
QHIGYRMRC

SEQ ID NO: 124273 - protein, 9 aa, Homo Sapiens
SQRAPGKVL

SEQ ID NO: 124274 - protein, 9 aa, Homo Sapiens
ATDVDDKFE

SEQ ID NO: 124275 - protein, 9 aa, Homo Sapiens
VLRDDYKNN

SEQ ID NO: 124276 - protein, 9 aa, Homo Sapiens
CPQPDSGSH

SEQ ID NO: 124277 - protein, 9 aa, Homo Sapiens
IYDICRHNL

SEQ ID NO: 124278 - protein, 9 aa, Homo Sapiens
PPYISSRDH

SEQ ID NO: 124279 - protein, 9 aa, Homo Sapiens
NQRSKWRKQ

SEQ ID NO: 124280 - protein, 9 aa, Homo Sapiens
DLTVVDTAS

SEQ ID NO: 124281 - protein, 9 aa, Homo Sapiens
SMGSLRILR

SEQ ID NO: 124282 - protein, 9 aa, Homo Sapiens
VAFSSVEML

SEQ ID NO: 124283 - protein, 9 aa, Homo Sapiens
TYPGLSTVP

SEQ ID NO: 124284 - protein, 9 aa, Homo Sapiens
HHHLPTTMG

SEQ ID NO: 124285 - protein, 9 aa, Homo Sapiens
RARRCILLF

SEQ ID NO: 124286 - protein, 9 aa, Homo Sapiens
RVVCASVVQ

SEQ ID NO: 124287 - protein, 9 aa, Homo Sapiens
KARSLDLVL

SEQ ID NO: 124288 - protein, 9 aa, Homo Sapiens
GGRQTPASL

SEQ ID NO: 124289 - protein, 9 aa, Homo Sapiens
ESCLVIQHF

SEQ ID NO: 124290 - protein, 9 aa, Homo Sapiens
QPAHLTSII

SEQ ID NO: 124291 - protein, 9 aa, Homo Sapiens
GCFVAKDSH

SEQ ID NO: 124292 - protein, 9 aa, Homo Sapiens
LYLRPAQSL

SEQ ID NO: 124293 - protein, 9 aa, Homo Sapiens
SKRLVNESN

SEQ ID NO: 124294 - protein, 9 aa, Homo Sapiens
IIHQKTHTR

SEQ ID NO: 124295 - protein, 9 aa, Homo Sapiens
RRPKTPCGP

SEQ ID NO: 124296 - protein, 9 aa, Homo Sapiens
RRLIETSLS

SEQ ID NO: 124297 - protein, 9 aa, Homo Sapiens
KHFFTEGHR

SEQ ID NO: 124298 - protein, 9 aa, Homo Sapiens
RMQSPVDII

SEQ ID NO: 124299 - protein, 9 aa, Homo Sapiens
NPKRRQSSP

SEQ ID NO: 124300 - protein, 9 aa, Homo Sapiens
RSKWRKQEK

SEQ ID NO: 124301 - protein, 9 aa, Homo Sapiens
RDLNARNVL

SEQ ID NO: 124302 - protein, 9 aa, Homo Sapiens
TSNTEEIIE

SEQ ID NO: 124303 - protein, 9 aa, Homo Sapiens
WRKQHLLPP

SEQ ID NO: 124304 - protein, 9 aa, Homo Sapiens
VTSPSADTN

SEQ ID NO: 124305 - protein, 9 aa, Homo Sapiens
SNSSSEDGP

SEQ ID NO: 124306 - protein, 9 aa, Homo Sapiens
TTSTTGRRS

SEQ ID NO: 124307 - protein, 9 aa, Homo Sapiens
FEKKKVYAL

SEQ ID NO: 124308 - protein, 9 aa, Homo Sapiens
SRGLGLGRW

SEQ ID NO: 124309 - protein, 9 aa, Homo Sapiens
ACDFLVRGG

SEQ ID NO: 124310 - protein, 9 aa, Homo Sapiens
RQSILFSTD

SEQ ID NO: 124311 - protein, 9 aa, Homo Sapiens
EKSLSKKKK

SEQ ID NO: 124312 - protein, 9 aa, Homo Sapiens
LEVTVESHM

SEQ ID NO: 124313 - protein, 9 aa, Homo Sapiens
LDAVMPHQM

SEQ ID NO: 124314 - protein, 9 aa, Homo Sapiens
SDYRTNASI

SEQ ID NO: 124315 - protein, 9 aa, Homo Sapiens
CQPYRSEFY

SEQ ID NO: 124316 - protein, 9 aa, Homo Sapiens
PLGPLFSGR

SEQ ID NO: 124317 - protein, 9 aa, Homo Sapiens
QFEISTTSN

SEQ ID NO: 124318 - protein, 9 aa, Homo Sapiens
ALNFAKLIQ

SEQ ID NO: 124319 - protein, 9 aa, Homo Sapiens
KNRKVKDVQ

SEQ ID NO: 124320 - protein, 9 aa, Homo Sapiens
VPSCSGCHT

SEQ ID NO: 124321 - protein, 9 aa, Homo Sapiens
ERLPGLHLY

SEQ ID NO: 124322 - protein, 9 aa, Homo Sapiens
FKQAWEADK

SEQ ID NO: 124323 - protein, 9 aa, Homo Sapiens
AEFPVLLSD

SEQ ID NO: 124324 - protein, 9 aa, Homo Sapiens
PAGGRSSDS

SEQ ID NO: 124325 - protein, 9 aa, Homo Sapiens
RISLHEKMQ

SEQ ID NO: 124326 - protein, 9 aa, Homo Sapiens
NFTMAMNAF

SEQ ID NO: 124327 - protein, 9 aa, Homo Sapiens
GAEPHPETH

SEQ ID NO: 124328 - protein, 9 aa, Homo Sapiens
VEMLVDCVP

SEQ ID NO: 124329 - protein, 9 aa, Homo Sapiens
AGVSCCPAP

SEQ ID NO: 124330 - protein, 9 aa, Homo Sapiens
VVGGIQKVL

SEQ ID NO: 124331 - protein, 9 aa, Homo Sapiens
RKPQSGLYV

SEQ ID NO: 124332 - protein, 9 aa, Homo Sapiens
TPCGPPLGA

SEQ ID NO: 124333 - protein, 9 aa, Homo Sapiens
PHIVVVTLR

SEQ ID NO: 124334 - protein, 9 aa, Homo Sapiens
RCLPLLYLR

SEQ ID NO: 124335 - protein, 9 aa, Homo Sapiens
KTANYERQP

SEQ ID NO: 124336 - protein, 9 aa, Homo Sapiens
IKDVAAVGV

SEQ ID NO: 124337 - protein, 9 aa, Homo Sapiens
LVNYTNRNV

SEQ ID NO: 124338 - protein, 9 aa, Homo Sapiens
NMFPRKGRG

SEQ ID NO: 124339 - protein, 9 aa, Homo Sapiens
GLRRLRELQ

SEQ ID NO: 124340 - protein, 9 aa, Homo Sapiens
TISNGDFYN

SEQ ID NO: 124341 - protein, 9 aa, Homo Sapiens
RVVPLLPRL

SEQ ID NO: 124342 - protein, 9 aa, Homo Sapiens
SGLGVRFQV

SEQ ID NO: 124343 - protein, 9 aa, Homo Sapiens
AATSLLLPV

SEQ ID NO: 124344 - protein, 9 aa, Homo Sapiens
AVGHHNDDV

SEQ ID NO: 124345 - protein, 9 aa, Homo Sapiens
GLDRNEESV

SEQ ID NO: 124346 - protein, 9 aa, Homo Sapiens
VEEGYHLPA

SEQ ID NO: 124347 - protein, 9 aa, Homo Sapiens
TSRAAPPHV

SEQ ID NO: 124348 - protein, 9 aa, Homo Sapiens
NKVQTTNEV

SEQ ID NO: 124349 - protein, 9 aa, Homo Sapiens
CHSRARESE

SEQ ID NO: 124350 - protein, 9 aa, Homo Sapiens
KVGYEKLAD

SEQ ID NO: 124351 - protein, 9 aa, Homo Sapiens
HMSAMAPTP

SEQ ID NO: 124352 - protein, 9 aa, Homo Sapiens
WRADGCSLE

SEQ ID NO: 124353 - protein, 9 aa, Homo Sapiens
PPEKRQGLY

SEQ ID NO: 124354 - protein, 9 aa, Homo Sapiens
ECCLEMHMR

SEQ ID NO: 124355 - protein, 9 aa, Homo Sapiens
PENFFLLCG

SEQ ID NO: 124356 - protein, 9 aa, Homo Sapiens
AGPYVIGFI

SEQ ID NO: 124357 - protein, 9 aa, Homo Sapiens
APAAPGCLP

SEQ ID NO: 124358 - protein, 9 aa, Homo Sapiens
FSEEGDETE

SEQ ID NO: 124359 - protein, 9 aa, Homo Sapiens
TCLTTEVSH

SEQ ID NO: 124360 - protein, 9 aa, Homo Sapiens
DDISLCKAE

SEQ ID NO: 124361 - protein, 9 aa, Homo Sapiens
DGHAQPSCT

SEQ ID NO: 124362 - protein, 9 aa, Homo Sapiens
KTWASLSNT

SEQ ID NO: 124363 - protein, 9 aa, Homo Sapiens
QRCLAPQEL

SEQ ID NO: 124364 - protein, 9 aa, Homo Sapiens
RLVGPEKKT

SEQ ID NO: 124365 - protein, 9 aa, Homo Sapiens
RLRDPVTPT

SEQ ID NO: 124366 - protein, 9 aa, Homo Sapiens
EFQHSHLAV

SEQ ID NO: 124367 - protein, 9 aa, Homo Sapiens
ENGFGSLYF

SEQ ID NO: 124368 - protein, 9 aa, Homo Sapiens
CEGSPPSTA

SEQ ID NO: 124369 - protein, 9 aa, Homo Sapiens
DGLSKVVPL

SEQ ID NO: 124370 - protein, 9 aa, Homo Sapiens
ILGVTSPSA

SEQ ID NO: 124371 - protein, 9 aa, Homo Sapiens
DACCAWSRT

SEQ ID NO: 124372 - protein, 9 aa, Homo Sapiens
CLYTLPSLC

SEQ ID NO: 124373 - protein, 9 aa, Homo Sapiens
GQAVRPCVK

SEQ ID NO: 124374 - protein, 9 aa, Homo Sapiens
FVVGEKMDL

SEQ ID NO: 124375 - protein, 9 aa, Homo Sapiens
GKDGEMANQ

SEQ ID NO: 124376 - protein, 9 aa, Homo Sapiens
VVTGRVLRE

SEQ ID NO: 124377 - protein, 9 aa, Homo Sapiens
RENRAPKEG

SEQ ID NO: 124378 - protein, 9 aa, Homo Sapiens
RYDLTNENK

SEQ ID NO: 124379 - protein, 9 aa, Homo Sapiens
TREIFVLFL

SEQ ID NO: 124380 - protein, 9 aa, Homo Sapiens
VDGEEWAIE

SEQ ID NO: 124381 - protein, 9 aa, Homo Sapiens
SQWDMFTTP

SEQ ID NO: 124382 - protein, 9 aa, Homo Sapiens
WRARSTSTS

SEQ ID NO: 124383 - protein, 9 aa, Homo Sapiens
EETPEVAED

SEQ ID NO: 124384 - protein, 9 aa, Homo Sapiens
PECHVRIAG

SEQ ID NO: 124385 - protein, 9 aa, Homo Sapiens
LEKQLELLD

SEQ ID NO: 124386 - protein, 9 aa, Homo Sapiens
SLVLQIDMK

SEQ ID NO: 124387 - protein, 9 aa, Homo Sapiens
ARGVLELTS

SEQ ID NO: 124388 - protein, 9 aa, Homo Sapiens
QPPRPRLNR

SEQ ID NO: 124389 - protein, 9 aa, Homo Sapiens
DTLYDEDVV

SEQ ID NO: 124390 - protein, 9 aa, Homo Sapiens
PLQDGSLDR

SEQ ID NO: 124391 - protein, 9 aa, Homo Sapiens
AMHVGKPFS

SEQ ID NO: 124392 - protein, 9 aa, Homo Sapiens
YLINDIRSP

SEQ ID NO: 124393 - protein, 9 aa, Homo Sapiens
SDTPKVSSL

SEQ ID NO: 124394 - protein, 9 aa, Homo Sapiens
QRSVPETFS

SEQ ID NO: 124395 - protein, 9 aa, Homo Sapiens
QPGTGFFRD

SEQ ID NO: 124396 - protein, 9 aa, Homo Sapiens
TSSTSFNLK

SEQ ID NO: 124397 - protein, 9 aa, Homo Sapiens
SCLICPWRN

SEQ ID NO: 124398 - protein, 9 aa, Homo Sapiens
TPCWGWHWE

SEQ ID NO: 124399 - protein, 9 aa, Homo Sapiens
VQPTEGQGS

SEQ ID NO: 124400 - protein, 9 aa, Homo Sapiens
GAAPGPEGQ

SEQ ID NO: 124401 - protein, 9 aa, Homo Sapiens
IAKKIKKGH

SEQ ID NO: 124402 - protein, 9 aa, Homo Sapiens
CRGGPATSH

SEQ ID NO: 124403 - protein, 9 aa, Homo Sapiens
HRPTGLRIP

SEQ ID NO: 124404 - protein, 9 aa, Homo Sapiens
VLHGLSRSS

SEQ ID NO: 124405 - protein, 9 aa, Homo Sapiens
RPHAEQYRI

SEQ ID NO: 124406 - protein, 9 aa, Homo Sapiens
ALCKAVAVL

SEQ ID NO: 124407 - protein, 9 aa, Homo Sapiens
AGAARRSQR

SEQ ID NO: 124408 - protein, 9 aa, Homo Sapiens
LPCGDTRIM

SEQ ID NO: 124409 - protein, 9 aa, Homo Sapiens
TNSVEIIEG

SEQ ID NO: 124410 - protein, 9 aa, Homo Sapiens
GWEKCWSWR

SEQ ID NO: 124411 - protein, 9 aa, Homo Sapiens
SINAIDVNK

SEQ ID NO: 124412 - protein, 9 aa, Homo Sapiens
KKVVGQLLP

SEQ ID NO: 124413 - protein, 9 aa, Homo Sapiens
GSRCYCDTL

SEQ ID NO: 124414 - protein, 9 aa, Homo Sapiens
TWAILAGLC

SEQ ID NO: 124415 - protein, 9 aa, Homo Sapiens
ARRNALREQ

SEQ ID NO: 124416 - protein, 9 aa, Homo Sapiens
TTAPLSGKG

SEQ ID NO: 124417 - protein, 9 aa, Homo Sapiens
THLLQRCLA

SEQ ID NO: 124418 - protein, 9 aa, Homo Sapiens
AVKDCRGCV

SEQ ID NO: 124419 - protein, 9 aa, Homo Sapiens
QHEFHGLGD

SEQ ID NO: 124420 - protein, 9 aa, Homo Sapiens
LWLIYYSFD

SEQ ID NO: 124421 - protein, 9 aa, Homo Sapiens
VLSKPTDYS

SEQ ID NO: 124422 - protein, 9 aa, Homo Sapiens
LSSIQTMRA

SEQ ID NO: 124423 - protein, 9 aa, Homo Sapiens
IKTSTVSPS

SEQ ID NO: 124424 - protein, 9 aa, Homo Sapiens
GSHHEQLVD

SEQ ID NO: 124425 - protein, 9 aa, Homo Sapiens
AKVGYEKLA

SEQ ID NO: 124426 - protein, 9 aa, Homo Sapiens
GFLVDPRKV

SEQ ID NO: 124427 - protein, 9 aa, Homo Sapiens
QTGACKFDE

SEQ ID NO: 124428 - protein, 9 aa, Homo Sapiens
DRNLSHDEQ

SEQ ID NO: 124429 - protein, 9 aa, Homo Sapiens
LSLQNLMRT

SEQ ID NO: 124430 - protein, 9 aa, Homo Sapiens
KIKKGHKCE

SEQ ID NO: 124431 - protein, 9 aa, Homo Sapiens
GQDDVPHQI

SEQ ID NO: 124432 - protein, 9 aa, Homo Sapiens
LFLGITDSH

SEQ ID NO: 124433 - protein, 9 aa, Homo Sapiens
VNYTNRNVA

SEQ ID NO: 124434 - protein, 9 aa, Homo Sapiens
LYMKCVHPF

SEQ ID NO: 124435 - protein, 9 aa, Homo Sapiens
STSCSTMSC

SEQ ID NO: 124436 - protein, 9 aa, Homo Sapiens
ESCEKKENG

SEQ ID NO: 124437 - protein, 9 aa, Homo Sapiens
IQGRDLMDV

SEQ ID NO: 124438 - protein, 9 aa, Homo Sapiens
KFRLASVDT

SEQ ID NO: 124439 - protein, 9 aa, Homo Sapiens
LANKIVPFL

SEQ ID NO: 124440 - protein, 9 aa, Homo Sapiens
EDETTTLVC

SEQ ID NO: 124441 - protein, 9 aa, Homo Sapiens
LLNWHSNSQ

SEQ ID NO: 124442 - protein, 9 aa, Homo Sapiens
YDSINAIDV

SEQ ID NO: 124443 - protein, 9 aa, Homo Sapiens
QMVNRIVDS

SEQ ID NO: 124444 - protein, 9 aa, Homo Sapiens
KMNEDAQEE

SEQ ID NO: 124445 - protein, 9 aa, Homo Sapiens
VVKILAVRD

SEQ ID NO: 124446 - protein, 9 aa, Homo Sapiens
PSRRGLLSQ

SEQ ID NO: 124447 - protein, 9 aa, Homo Sapiens
MDKHPGGCI

SEQ ID NO: 124448 - protein, 9 aa, Homo Sapiens
HRQLDKVNQ

SEQ ID NO: 124449 - protein, 9 aa, Homo Sapiens
LTATHCFPR

SEQ ID NO: 124450 - protein, 9 aa, Homo Sapiens
GMLLALVCV

SEQ ID NO: 124451 - protein, 9 aa, Homo Sapiens
DLWVSYLGC

SEQ ID NO: 124452 - protein, 9 aa, Homo Sapiens
IFHKASGVC

SEQ ID NO: 124453 - protein, 9 aa, Homo Sapiens
LEQILCLLQ

SEQ ID NO: 124454 - protein, 9 aa, Homo Sapiens
PSSSPTSTT

SEQ ID NO: 124455 - protein, 9 aa, Homo Sapiens
DLLSMELPD

SEQ ID NO: 124456 - protein, 9 aa, Homo Sapiens
LQEGGPQRP

SEQ ID NO: 124457 - protein, 9 aa, Homo Sapiens
SISGILGVT

SEQ ID NO: 124458 - protein, 9 aa, Homo Sapiens
EWAAELMHR

SEQ ID NO: 124459 - protein, 9 aa, Homo Sapiens
PKGLPEGYS

SEQ ID NO: 124460 - protein, 9 aa, Homo Sapiens
NPTLTIMDI

SEQ ID NO: 124461 - protein, 9 aa, Homo Sapiens
RAPIRGKKW

SEQ ID NO: 124462 - protein, 9 aa, Homo Sapiens
NHGTVKIPP

SEQ ID NO: 124463 - protein, 9 aa, Homo Sapiens
PTSCPSWSP

SEQ ID NO: 124464 - protein, 9 aa, Homo Sapiens
SDMPRISKL

SEQ ID NO: 124465 - protein, 9 aa, Homo Sapiens
PSFSSKVKD

SEQ ID NO: 124466 - protein, 9 aa, Homo Sapiens
IPKLQSCLE

SEQ ID NO: 124467 - protein, 9 aa, Homo Sapiens
PLPPGGKEE

SEQ ID NO: 124468 - protein, 9 aa, Homo Sapiens
NVMNVGRPS

SEQ ID NO: 124469 - protein, 9 aa, Homo Sapiens
CRCQTLNFV

SEQ ID NO: 124470 - protein, 9 aa, Homo Sapiens
QELSQLQPF

SEQ ID NO: 124471 - protein, 9 aa, Homo Sapiens
QLFFGCRLK

SEQ ID NO: 124472 - protein, 9 aa, Homo Sapiens
RKYVFSLAE

SEQ ID NO: 124473 - protein, 9 aa, Homo Sapiens
SRELLRAIC

SEQ ID NO: 124474 - protein, 9 aa, Homo Sapiens
SLTLAFLAC

SEQ ID NO: 124475 - protein, 9 aa, Homo Sapiens
QLISFCLST

SEQ ID NO: 124476 - protein, 9 aa, Homo Sapiens
VSQKCEDIN

SEQ ID NO: 124477 - protein, 9 aa, Homo Sapiens
SMAVSAQVE

SEQ ID NO: 124478 - protein, 9 aa, Homo Sapiens
PPAASTTSS

SEQ ID NO: 124479 - protein, 9 aa, Homo Sapiens
ASSRVQTLP

SEQ ID NO: 124480 - protein, 9 aa, Homo Sapiens
GTIGFNQRN

SEQ ID NO: 124481 - protein, 9 aa, Homo Sapiens
STLVHSSTG

SEQ ID NO: 124482 - protein, 9 aa, Homo Sapiens
IAAEIFATE

SEQ ID NO: 124483 - protein, 9 aa, Homo Sapiens
PRCTGSRCA

SEQ ID NO: 124484 - protein, 9 aa, Homo Sapiens
SASVVSGIS

SEQ ID NO: 124485 - protein, 9 aa, Homo Sapiens
ISSLLCDTQ

SEQ ID NO: 124486 - protein, 9 aa, Homo Sapiens
CARLEKFTH

SEQ ID NO: 124487 - protein, 9 aa, Homo Sapiens
LIIGDLHVV

SEQ ID NO: 124488 - protein, 9 aa, Homo Sapiens
TFVPINSVN

SEQ ID NO: 124489 - protein, 9 aa, Homo Sapiens
APAPKLALC

SEQ ID NO: 124490 - protein, 9 aa, Homo Sapiens
CYKKILEIS

SEQ ID NO: 124491 - protein, 9 aa, Homo Sapiens
VLRNISTVR

SEQ ID NO: 124492 - protein, 9 aa, Homo Sapiens
RFAWRTLTG

SEQ ID NO: 124493 - protein, 9 aa, Homo Sapiens
RDVGRHRYV

SEQ ID NO: 124494 - protein, 9 aa, Homo Sapiens
KQLELLDLM

SEQ ID NO: 124495 - protein, 9 aa, Homo Sapiens
GLGGAPGGG

SEQ ID NO: 124496 - protein, 9 aa, Homo Sapiens
LLGADAAYE

SEQ ID NO: 124497 - protein, 9 aa, Homo Sapiens
GDETETPTL

SEQ ID NO: 124498 - protein, 9 aa, Homo Sapiens
EVDSPAERC

SEQ ID NO: 124499 - protein, 9 aa, Homo Sapiens
KRQMMSATV

SEQ ID NO: 124500 - protein, 9 aa, Homo Sapiens
SNPQLPEAW

SEQ ID NO: 124501 - protein, 9 aa, Homo Sapiens
KRKMRRTNM

SEQ ID NO: 124502 - protein, 9 aa, Homo Sapiens
VTSTYFVVR

SEQ ID NO: 124503 - protein, 9 aa, Homo Sapiens
CDVSHGQDC

SEQ ID NO: 124504 - protein, 9 aa, Homo Sapiens
GLIERIEDL

SEQ ID NO: 124505 - protein, 9 aa, Homo Sapiens
RGCVLVHCQ

SEQ ID NO: 124506 - protein, 9 aa, Homo Sapiens
AKLLACDDN

SEQ ID NO: 124507 - protein, 9 aa, Homo Sapiens
GAANCADCQ

SEQ ID NO: 124508 - protein, 9 aa, Homo Sapiens
TPSARRRQR

SEQ ID NO: 124509 - protein, 9 aa, Homo Sapiens
FHAPSRRGL

SEQ ID NO: 124510 - protein, 9 aa, Homo Sapiens
YNFSLPGSS

SEQ ID NO: 124511 - protein, 9 aa, Homo Sapiens
LRGQQKEDL

SEQ ID NO: 124512 - protein, 9 aa, Homo Sapiens
TRRSYPEFQ

SEQ ID NO: 124513 - protein, 9 aa, Homo Sapiens
APMMSSMAC

SEQ ID NO: 124514 - protein, 9 aa, Homo Sapiens
FPAVGLELL

SEQ ID NO: 124515 - protein, 9 aa, Homo Sapiens
TTTAPLSGK

SEQ ID NO: 124516 - protein, 9 aa, Homo Sapiens
LIGSSLMVD

SEQ ID NO: 124517 - protein, 9 aa, Homo Sapiens
ARRPAPLSV

SEQ ID NO: 124518 - protein, 9 aa, Homo Sapiens
QEKKDKTQK

SEQ ID NO: 124519 - protein, 9 aa, Homo Sapiens
LSTNCPECN

SEQ ID NO: 124520 - protein, 9 aa, Homo Sapiens
RLVSSTDGS

SEQ ID NO: 124521 - protein, 9 aa, Homo Sapiens
LAGWARDGG

SEQ ID NO: 124522 - protein, 9 aa, Homo Sapiens
DFASFPSTN

SEQ ID NO: 124523 - protein, 9 aa, Homo Sapiens
MLSGVQMAH

SEQ ID NO: 124524 - protein, 9 aa, Homo Sapiens
HTQAVGGMR

SEQ ID NO: 124525 - protein, 9 aa, Homo Sapiens
HTIQVSEEQ

SEQ ID NO: 124526 - protein, 9 aa, Homo Sapiens
LPVYYRLSS

SEQ ID NO: 124527 - protein, 9 aa, Homo Sapiens
ASHVDDLPH

SEQ ID NO: 124528 - protein, 9 aa, Homo Sapiens
PGTTYRVCM

SEQ ID NO: 124529 - protein, 9 aa, Homo Sapiens
GLALEVADR

SEQ ID NO: 124530 - protein, 9 aa, Homo Sapiens
EDAMAQDLT

SEQ ID NO: 124531 - protein, 9 aa, Homo Sapiens
NDVSLANAD

SEQ ID NO: 124532 - protein, 9 aa, Homo Sapiens
IGGAGKYHS

SEQ ID NO: 124533 - protein, 9 aa, Homo Sapiens
GQGCLIKDG

SEQ ID NO: 124534 - protein, 9 aa, Homo Sapiens
PSTSAVDFF

SEQ ID NO: 124535 - protein, 9 aa, Homo Sapiens
LLGDEQRDD

SEQ ID NO: 124536 - protein, 9 aa, Homo Sapiens
CRWCSSWRS

SEQ ID NO: 124537 - protein, 9 aa, Homo Sapiens
LGNFIHAMG

SEQ ID NO: 124538 - protein, 9 aa, Homo Sapiens
EYREGKHNF

SEQ ID NO: 124539 - protein, 9 aa, Homo Sapiens
KIRTCLRRV

SEQ ID NO: 124540 - protein, 9 aa, Homo Sapiens
RIAFTTQRS

SEQ ID NO: 124541 - protein, 9 aa, Homo Sapiens
LLPRLGVGA

SEQ ID NO: 124542 - protein, 9 aa, Homo Sapiens
LAPPAGLVW

SEQ ID NO: 124543 - protein, 9 aa, Homo Sapiens
VILKRVKAL

SEQ ID NO: 124544 - protein, 9 aa, Homo Sapiens
ECRLVGPEK

SEQ ID NO: 124545 - protein, 9 aa, Homo Sapiens
GCVRIIPYN

SEQ ID NO: 124546 - protein, 9 aa, Homo Sapiens
TNSCLISLS

SEQ ID NO: 124547 - protein, 9 aa, Homo Sapiens
RDVNSIELC

SEQ ID NO: 124548 - protein, 9 aa, Homo Sapiens
EDLKKAKDR

SEQ ID NO: 124549 - protein, 9 aa, Homo Sapiens
LIVLYLLGA

SEQ ID NO: 124550 - protein, 9 aa, Homo Sapiens
KKDRGWGPN

SEQ ID NO: 124551 - protein, 9 aa, Homo Sapiens
LSLPGAEGS

SEQ ID NO: 124552 - protein, 9 aa, Homo Sapiens
LRALRVLRP

SEQ ID NO: 124553 - protein, 9 aa, Homo Sapiens
PFLSLPGAE

SEQ ID NO: 124554 - protein, 9 aa, Homo Sapiens
DDSWNSKAA

SEQ ID NO: 124555 - protein, 9 aa, Homo Sapiens
SVRYRPDLD

SEQ ID NO: 124556 - protein, 9 aa, Homo Sapiens
YSWRNPGRG

SEQ ID NO: 124557 - protein, 9 aa, Homo Sapiens
PLECEVTDP

SEQ ID NO: 124558 - protein, 9 aa, Homo Sapiens
GPPLGASPL

SEQ ID NO: 124559 - protein, 9 aa, Homo Sapiens
DLDELHRAA

SEQ ID NO: 124560 - protein, 9 aa, Homo Sapiens
HVLEQVCSV

SEQ ID NO: 124561 - protein, 9 aa, Homo Sapiens
PKETNFSDV

SEQ ID NO: 124562 - protein, 9 aa, Homo Sapiens
FLVIEEHEN

SEQ ID NO: 124563 - protein, 9 aa, Homo Sapiens
LGMLLALVC

SEQ ID NO: 124564 - protein, 9 aa, Homo Sapiens
LISMWKTAV

SEQ ID NO: 124565 - protein, 9 aa, Homo Sapiens
RNHMNVMNV

SEQ ID NO: 124566 - protein, 9 aa, Homo Sapiens
SLRKSFASR

SEQ ID NO: 124567 - protein, 9 aa, Homo Sapiens
QLRSAQEEG

SEQ ID NO: 124568 - protein, 9 aa, Homo Sapiens
PPSPLPPQL

SEQ ID NO: 124569 - protein, 9 aa, Homo Sapiens
PQTKPEEEQ

SEQ ID NO: 124570 - protein, 9 aa, Homo Sapiens
GVYMQLLKV

SEQ ID NO: 124571 - protein, 9 aa, Homo Sapiens
RAKRACTAP

SEQ ID NO: 124572 - protein, 9 aa, Homo Sapiens
DELHHKAGT

SEQ ID NO: 124573 - protein, 9 aa, Homo Sapiens
DTQEAFEVS

SEQ ID NO: 124574 - protein, 9 aa, Homo Sapiens
ELLSPCRCY

SEQ ID NO: 124575 - protein, 9 aa, Homo Sapiens
AARSGSAWA

SEQ ID NO: 124576 - protein, 9 aa, Homo Sapiens
VGEDAPKIR

SEQ ID NO: 124577 - protein, 9 aa, Homo Sapiens
FASWSDDAT

SEQ ID NO: 124578 - protein, 9 aa, Homo Sapiens
EKRWIVFSV

SEQ ID NO: 124579 - protein, 9 aa, Homo Sapiens
NQAGGSGSA

SEQ ID NO: 124580 - protein, 9 aa, Homo Sapiens
SSSSSSNTD

SEQ ID NO: 124581 - protein, 9 aa, Homo Sapiens
PSSCPTTST

SEQ ID NO: 124582 - protein, 9 aa, Homo Sapiens
GWLHLFDLT

SEQ ID NO: 124583 - protein, 9 aa, Homo Sapiens
CIWMSLGMT

SEQ ID NO: 124584 - protein, 9 aa, Homo Sapiens
CPRARAAAT

SEQ ID NO: 124585 - protein, 9 aa, Homo Sapiens
LCKAFAPTC

SEQ ID NO: 124586 - protein, 9 aa, Homo Sapiens
GASCGQPCP

SEQ ID NO: 124587 - protein, 9 aa, Homo Sapiens
FFSKLSQVV

SEQ ID NO: 124588 - protein, 9 aa, Homo Sapiens
VSHHPPSVR

SEQ ID NO: 124589 - protein, 9 aa, Homo Sapiens
SLLCIRKHT

SEQ ID NO: 124590 - protein, 9 aa, Homo Sapiens
GCAQGLQKR

SEQ ID NO: 124591 - protein, 9 aa, Homo Sapiens
EYLINDIRS

SEQ ID NO: 124592 - protein, 9 aa, Homo Sapiens
YQPQTKPEE

SEQ ID NO: 124593 - protein, 9 aa, Homo Sapiens
RLCSPVGIV

SEQ ID NO: 124594 - protein, 9 aa, Homo Sapiens
RQRSPLHLW

SEQ ID NO: 124595 - protein, 9 aa, Homo Sapiens
SSTSFNLKA

SEQ ID NO: 124596 - protein, 9 aa, Homo Sapiens
ASTSSVTAS

SEQ ID NO: 124597 - protein, 9 aa, Homo Sapiens
APKEGHRQD

SEQ ID NO: 124598 - protein, 9 aa, Homo Sapiens
KGVHPVVVG

SEQ ID NO: 124599 - protein, 9 aa, Homo Sapiens
FTFDHDCKF

SEQ ID NO: 124600 - protein, 9 aa, Homo Sapiens
KRLREEEVA

SEQ ID NO: 124601 - protein, 9 aa, Homo Sapiens
DALFYHFLH

SEQ ID NO: 124602 - protein, 9 aa, Homo Sapiens
KKSPQPMGP

SEQ ID NO: 124603 - protein, 9 aa, Homo Sapiens
NPVIYGVST

SEQ ID NO: 124604 - protein, 9 aa, Homo Sapiens
QASESRATG

SEQ ID NO: 124605 - protein, 9 aa, Homo Sapiens
AAPMMSSMA

SEQ ID NO: 124606 - protein, 9 aa, Homo Sapiens
NDFLVTKTV

SEQ ID NO: 124607 - protein, 9 aa, Homo Sapiens
LEDIKTYFG

SEQ ID NO: 124608 - protein, 9 aa, Homo Sapiens
FLCKAFAPT

SEQ ID NO: 124609 - protein, 9 aa, Homo Sapiens
SLSFPGSSH

SEQ ID NO: 124610 - protein, 9 aa, Homo Sapiens
PSVVVTGRV

SEQ ID NO: 124611 - protein, 9 aa, Homo Sapiens
DAMNATIQQ

SEQ ID NO: 124612 - protein, 9 aa, Homo Sapiens
HLLHPGTPG

SEQ ID NO: 124613 - protein, 9 aa, Homo Sapiens
DMSVDLSTR

SEQ ID NO: 124614 - protein, 9 aa, Homo Sapiens
TMGATAVTT

SEQ ID NO: 124615 - protein, 9 aa, Homo Sapiens
CNNEEQVGL

SEQ ID NO: 124616 - protein, 9 aa, Homo Sapiens
SMEVLTQLA

SEQ ID NO: 124617 - protein, 9 aa, Homo Sapiens
LQYHKWLLE

SEQ ID NO: 124618 - protein, 9 aa, Homo Sapiens
TIPCPTDSL

SEQ ID NO: 124619 - protein, 9 aa, Homo Sapiens
SPCKDAGRA

SEQ ID NO: 124620 - protein, 9 aa, Homo Sapiens
KKREQRKKK

SEQ ID NO: 124621 - protein, 9 aa, Homo Sapiens
TKDLFQQRY

SEQ ID NO: 124622 - protein, 9 aa, Homo Sapiens
GPALCNNTA

SEQ ID NO: 124623 - protein, 9 aa, Homo Sapiens
FATVNYFTN

SEQ ID NO: 124624 - protein, 9 aa, Homo Sapiens
VCLAGMIVK

SEQ ID NO: 124625 - protein, 9 aa, Homo Sapiens
ALWLLSPSR

SEQ ID NO: 124626 - protein, 9 aa, Homo Sapiens
TPGTHRVAQ

SEQ ID NO: 124627 - protein, 9 aa, Homo Sapiens
PEVRSDGRS

SEQ ID NO: 124628 - protein, 9 aa, Homo Sapiens
VLQQVPCSP

SEQ ID NO: 124629 - protein, 9 aa, Homo Sapiens
NLGSPLMSE

SEQ ID NO: 124630 - protein, 9 aa, Homo Sapiens
STIRTRASG

SEQ ID NO: 124631 - protein, 9 aa, Homo Sapiens
FGIFHKASG

SEQ ID NO: 124632 - protein, 9 aa, Homo Sapiens
ELMLKSFTY

SEQ ID NO: 124633 - protein, 9 aa, Homo Sapiens
YEKTVISSK

SEQ ID NO: 124634 - protein, 9 aa, Homo Sapiens
RGKDYFLSM

SEQ ID NO: 124635 - protein, 9 aa, Homo Sapiens
APSPWSCSN

SEQ ID NO: 124636 - protein, 9 aa, Homo Sapiens
GMNCTLNLP

SEQ ID NO: 124637 - protein, 9 aa, Homo Sapiens
KGGCRPGRI

SEQ ID NO: 124638 - protein, 9 aa, Homo Sapiens
TGFFRDISN

SEQ ID NO: 124639 - protein, 9 aa, Homo Sapiens
LAVNYRFLT

SEQ ID NO: 124640 - protein, 9 aa, Homo Sapiens
STYPKDGEV

SEQ ID NO: 124641 - protein, 9 aa, Homo Sapiens
LKTWNELPL

SEQ ID NO: 124642 - protein, 9 aa, Homo Sapiens
SLGIYSPCI

SEQ ID NO: 124643 - protein, 9 aa, Homo Sapiens
DSTPAEPRG

SEQ ID NO: 124644 - protein, 9 aa, Homo Sapiens
VSAEIEPPS

SEQ ID NO: 124645 - protein, 9 aa, Homo Sapiens
GCTYDCPCR

SEQ ID NO: 124646 - protein, 9 aa, Homo Sapiens
VPVIMNNFG

SEQ ID NO: 124647 - protein, 9 aa, Homo Sapiens
SVMAYRLIM

SEQ ID NO: 124648 - protein, 9 aa, Homo Sapiens
LRHLNLSAT

SEQ ID NO: 124649 - protein, 9 aa, Homo Sapiens
LLVEVQNIL

SEQ ID NO: 124650 - protein, 9 aa, Homo Sapiens
PPCPLAARK

SEQ ID NO: 124651 - protein, 9 aa, Homo Sapiens
LIGACKAKY

SEQ ID NO: 124652 - protein, 9 aa, Homo Sapiens
PINLTESGC

SEQ ID NO: 124653 - protein, 9 aa, Homo Sapiens
CGWWRLLCS

SEQ ID NO: 124654 - protein, 9 aa, Homo Sapiens
GDRLNPEER

SEQ ID NO: 124655 - protein, 9 aa, Homo Sapiens
APQCPPPSS

SEQ ID NO: 124656 - protein, 9 aa, Homo Sapiens
PFLKIRIQQ

SEQ ID NO: 124657 - protein, 9 aa, Homo Sapiens
LAGAPPGAR

SEQ ID NO: 124658 - protein, 9 aa, Homo Sapiens
GEKGSRKNV

SEQ ID NO: 124659 - protein, 9 aa, Homo Sapiens
HPWHPAVVF

SEQ ID NO: 124660 - protein, 9 aa, Homo Sapiens
SHLPTLASR

SEQ ID NO: 124661 - protein, 9 aa, Homo Sapiens
FFQQLRVRR

SEQ ID NO: 124662 - protein, 9 aa, Homo Sapiens
ACLYLRPAQ

SEQ ID NO: 124663 - protein, 9 aa, Homo Sapiens
ERAHNVTEK

SEQ ID NO: 124664 - protein, 9 aa, Homo Sapiens
PRGRAQLHL

SEQ ID NO: 124665 - protein, 9 aa, Homo Sapiens
IGTVNMDDM

SEQ ID NO: 124666 - protein, 9 aa, Homo Sapiens
STRNGYQGL

SEQ ID NO: 124667 - protein, 9 aa, Homo Sapiens
SLVVTQRPP

SEQ ID NO: 124668 - protein, 9 aa, Homo Sapiens
EEKMFGSGS

SEQ ID NO: 124669 - protein, 9 aa, Homo Sapiens
QSLDLPSDH

SEQ ID NO: 124670 - protein, 9 aa, Homo Sapiens
ASQIWNLNP

SEQ ID NO: 124671 - protein, 9 aa, Homo Sapiens
IQALLQRSG

SEQ ID NO: 124672 - protein, 9 aa, Homo Sapiens
LSYNSSGLQ

SEQ ID NO: 124673 - protein, 9 aa, Homo Sapiens
PPPPNATLP

SEQ ID NO: 124674 - protein, 9 aa, Homo Sapiens
PGHPSASPP

SEQ ID NO: 124675 - protein, 9 aa, Homo Sapiens
DRLCFHPPQ

SEQ ID NO: 124676 - protein, 9 aa, Homo Sapiens
NTCDGQQYG

SEQ ID NO: 124677 - protein, 9 aa, Homo Sapiens
PLPTARTPS

SEQ ID NO: 124678 - protein, 9 aa, Homo Sapiens
QKPHAFILK

SEQ ID NO: 124679 - protein, 9 aa, Homo Sapiens
DFCHHCGQC

SEQ ID NO: 124680 - protein, 9 aa, Homo Sapiens
EFNNEIKKE

SEQ ID NO: 124681 - protein, 9 aa, Homo Sapiens
LPPDEPQLE

SEQ ID NO: 124682 - protein, 9 aa, Homo Sapiens
YLYMKCVHP

SEQ ID NO: 124683 - protein, 9 aa, Homo Sapiens
LQHAQDGHG

SEQ ID NO: 124684 - protein, 9 aa, Homo Sapiens
VLRSSEEGY

SEQ ID NO: 124685 - protein, 9 aa, Homo Sapiens
TDNDQGSMQ

SEQ ID NO: 124686 - protein, 9 aa, Homo Sapiens
YIEVDSPAE

SEQ ID NO: 124687 - protein, 9 aa, Homo Sapiens
IANNNQLGG

SEQ ID NO: 124688 - protein, 9 aa, Homo Sapiens
RSCTAPEKT

SEQ ID NO: 124689 - protein, 9 aa, Homo Sapiens
YTGLLLIAY

SEQ ID NO: 124690 - protein, 9 aa, Homo Sapiens
HERRHNDVS

SEQ ID NO: 124691 - protein, 9 aa, Homo Sapiens
CRLVGPEKK

SEQ ID NO: 124692 - protein, 9 aa, Homo Sapiens
VMSGSGNLM

SEQ ID NO: 124693 - protein, 9 aa, Homo Sapiens
DGDDRPGRV

SEQ ID NO: 124694 - protein, 9 aa, Homo Sapiens
HNPKGNKKN

SEQ ID NO: 124695 - protein, 9 aa, Homo Sapiens
LSPSFKEVI

SEQ ID NO: 124696 - protein, 9 aa, Homo Sapiens
KNMCGSRRV

SEQ ID NO: 124697 - protein, 9 aa, Homo Sapiens
SIVPKLQVI

SEQ ID NO: 124698 - protein, 9 aa, Homo Sapiens
KIIKVWRDK

SEQ ID NO: 124699 - protein, 9 aa, Homo Sapiens
YQDDIDNLN

SEQ ID NO: 124700 - protein, 9 aa, Homo Sapiens
LAAVAEVIR

SEQ ID NO: 124701 - protein, 9 aa, Homo Sapiens
HAVDIWSLG

SEQ ID NO: 124702 - protein, 9 aa, Homo Sapiens
VSRWMTSLI

SEQ ID NO: 124703 - protein, 9 aa, Homo Sapiens
YFHCKDCKI

SEQ ID NO: 124704 - protein, 9 aa, Homo Sapiens
PSTAMYNNT

SEQ ID NO: 124705 - protein, 9 aa, Homo Sapiens
KNILFILRF

SEQ ID NO: 124706 - protein, 9 aa, Homo Sapiens
GTQNDVDRE

SEQ ID NO: 124707 - protein, 9 aa, Homo Sapiens
HPAFSHRSA

SEQ ID NO: 124708 - protein, 9 aa, Homo Sapiens
KPQSGLYVS

SEQ ID NO: 124709 - protein, 9 aa, Homo Sapiens
IELMTVENI

SEQ ID NO: 124710 - protein, 9 aa, Homo Sapiens
LCGPSQRGA

SEQ ID NO: 124711 - protein, 9 aa, Homo Sapiens
CPQYLAVLN

SEQ ID NO: 124712 - protein, 9 aa, Homo Sapiens
LSVSLPAEP

SEQ ID NO: 124713 - protein, 9 aa, Homo Sapiens
AHLVPTGPG

SEQ ID NO: 124714 - protein, 9 aa, Homo Sapiens
IKDQDYNMC

SEQ ID NO: 124715 - protein, 9 aa, Homo Sapiens
FMVSSETDT

SEQ ID NO: 124716 - protein, 9 aa, Homo Sapiens
HYLLPTQSK

SEQ ID NO: 124717 - protein, 9 aa, Homo Sapiens
VTNSQKCVR

SEQ ID NO: 124718 - protein, 9 aa, Homo Sapiens
SSTPGSGPS

SEQ ID NO: 124719 - protein, 9 aa, Homo Sapiens
LAGVPKGPL

SEQ ID NO: 124720 - protein, 9 aa, Homo Sapiens
CQLEHNAYH

SEQ ID NO: 124721 - protein, 9 aa, Homo Sapiens
FGDLNPFPI

SEQ ID NO: 124722 - protein, 9 aa, Homo Sapiens
LSWVLCRTH

SEQ ID NO: 124723 - protein, 9 aa, Homo Sapiens
RDHILQGFQ

SEQ ID NO: 124724 - protein, 9 aa, Homo Sapiens
GDDNTAILR

SEQ ID NO: 124725 - protein, 9 aa, Homo Sapiens
ELHRQVHYP

SEQ ID NO: 124726 - protein, 9 aa, Homo Sapiens
PHTSLVQAW

SEQ ID NO: 124727 - protein, 9 aa, Homo Sapiens
PCFFSGKSE

SEQ ID NO: 124728 - protein, 9 aa, Homo Sapiens
ESICGGDVK

SEQ ID NO: 124729 - protein, 9 aa, Homo Sapiens
GPPHPRDPP

SEQ ID NO: 124730 - protein, 9 aa, Homo Sapiens
EPVNSSKWN

SEQ ID NO: 124731 - protein, 9 aa, Homo Sapiens
VMEQAIPLT

SEQ ID NO: 124732 - protein, 9 aa, Homo Sapiens
NINTCARFC

SEQ ID NO: 124733 - protein, 9 aa, Homo Sapiens
VIMNNFGMY

SEQ ID NO: 124734 - protein, 9 aa, Homo Sapiens
NIQAKGVHS

SEQ ID NO: 124735 - protein, 9 aa, Homo Sapiens
RQSHHGSRS

SEQ ID NO: 124736 - protein, 9 aa, Homo Sapiens
NDMKKLNML

SEQ ID NO: 124737 - protein, 9 aa, Homo Sapiens
DGYYAMVCQ

SEQ ID NO: 124738 - protein, 9 aa, Homo Sapiens
QHVNEEQES

SEQ ID NO: 124739 - protein, 9 aa, Homo Sapiens
GMCLTFTSL

SEQ ID NO: 124740 - protein, 9 aa, Homo Sapiens
DYGMKLSIL

SEQ ID NO: 124741 - protein, 9 aa, Homo Sapiens
FTSHGSPFT

SEQ ID NO: 124742 - protein, 9 aa, Homo Sapiens
KKVVSAEIE

SEQ ID NO: 124743 - protein, 9 aa, Homo Sapiens
VVADWRYLQ

SEQ ID NO: 124744 - protein, 9 aa, Homo Sapiens
ESGCVTKIY

SEQ ID NO: 124745 - protein, 9 aa, Homo Sapiens
ASYPFCYLP

SEQ ID NO: 124746 - protein, 9 aa, Homo Sapiens
SSPYVNTVG

SEQ ID NO: 124747 - protein, 9 aa, Homo Sapiens
KEAKKEAGF

SEQ ID NO: 124748 - protein, 9 aa, Homo Sapiens
YSVTLYSQD

SEQ ID NO: 124749 - protein, 9 aa, Homo Sapiens
ANYERQPRE

SEQ ID NO: 124750 - protein, 9 aa, Homo Sapiens
HIFAGILEK

SEQ ID NO: 124751 - protein, 9 aa, Homo Sapiens
PRDYSGGKP

SEQ ID NO: 124752 - protein, 9 aa, Homo Sapiens
RAVERSQHR

SEQ ID NO: 124753 - protein, 9 aa, Homo Sapiens
STQISFVVG

SEQ ID NO: 124754 - protein, 9 aa, Homo Sapiens
SVLRAHRLR

SEQ ID NO: 124755 - protein, 9 aa, Homo Sapiens
LHLYPVGSG

SEQ ID NO: 124756 - protein, 9 aa, Homo Sapiens
GLESYVTDK

SEQ ID NO: 124757 - protein, 9 aa, Homo Sapiens
NMLERGEAE

SEQ ID NO: 124758 - protein, 9 aa, Homo Sapiens
FEQNSFEQF

SEQ ID NO: 124759 - protein, 9 aa, Homo Sapiens
IAGLCNCAV

SEQ ID NO: 124760 - protein, 9 aa, Homo Sapiens
CFRQCRYLE

SEQ ID NO: 124761 - protein, 9 aa, Homo Sapiens
LLGKCKFRD

SEQ ID NO: 124762 - protein, 9 aa, Homo Sapiens
TMGDTVLVI

SEQ ID NO: 124763 - protein, 9 aa, Homo Sapiens
MLFVDGMLR

SEQ ID NO: 124764 - protein, 9 aa, Homo Sapiens
RPHQLSPMA

SEQ ID NO: 124765 - protein, 9 aa, Homo Sapiens
TTLVCDNGS

SEQ ID NO: 124766 - protein, 9 aa, Homo Sapiens
AMTLPYPQF

SEQ ID NO: 124767 - protein, 9 aa, Homo Sapiens
ELPLPNRET

SEQ ID NO: 124768 - protein, 9 aa, Homo Sapiens
EMKLYMKLI

SEQ ID NO: 124769 - protein, 9 aa, Homo Sapiens
GEDAPKIRI

SEQ ID NO: 124770 - protein, 9 aa, Homo Sapiens
LPLPMVCTL

SEQ ID NO: 124771 - protein, 9 aa, Homo Sapiens
AASTTSSSG

SEQ ID NO: 124772 - protein, 9 aa, Homo Sapiens
KGSVDRHGK

SEQ ID NO: 124773 - protein, 9 aa, Homo Sapiens
QQHSDGEEE

SEQ ID NO: 124774 - protein, 9 aa, Homo Sapiens
RLQMNLDVT

SEQ ID NO: 124775 - protein, 9 aa, Homo Sapiens
HLHRPVAHG

SEQ ID NO: 124776 - protein, 9 aa, Homo Sapiens
IFGENEVAD

SEQ ID NO: 124777 - protein, 9 aa, Homo Sapiens
PAPKLALCE

SEQ ID NO: 124778 - protein, 9 aa, Homo Sapiens
GAGASLRPC

SEQ ID NO: 124779 - protein, 9 aa, Homo Sapiens
PTVFVAYAR

SEQ ID NO: 124780 - protein, 9 aa, Homo Sapiens
SGHLQYMWW

SEQ ID NO: 124781 - protein, 9 aa, Homo Sapiens
MLQHIGYRM

SEQ ID NO: 124782 - protein, 9 aa, Homo Sapiens
MWKLGWSPK

SEQ ID NO: 124783 - protein, 9 aa, Homo Sapiens
CPHGQAFQV

SEQ ID NO: 124784 - protein, 9 aa, Homo Sapiens
LQRSFLVLL

SEQ ID NO: 124785 - protein, 9 aa, Homo Sapiens
AAALCIPLL

SEQ ID NO: 124786 - protein, 9 aa, Homo Sapiens
FRRVTNSQK

SEQ ID NO: 124787 - protein, 9 aa, Homo Sapiens
RLIGGATRD

SEQ ID NO: 124788 - protein, 9 aa, Homo Sapiens
MVRGSRCYC

SEQ ID NO: 124789 - protein, 9 aa, Homo Sapiens
AKRSRVTSG

SEQ ID NO: 124790 - protein, 9 aa, Homo Sapiens
DILLVRDRM

SEQ ID NO: 124791 - protein, 9 aa, Homo Sapiens
NMGGNRSIC

SEQ ID NO: 124792 - protein, 9 aa, Homo Sapiens
NCWAEAWWC

SEQ ID NO: 124793 - protein, 9 aa, Homo Sapiens
LLRMEADFY

SEQ ID NO: 124794 - protein, 9 aa, Homo Sapiens
QTALYRGGQ

SEQ ID NO: 124795 - protein, 9 aa, Homo Sapiens
QALLQRSGD

SEQ ID NO: 124796 - protein, 9 aa, Homo Sapiens
KQKLSMNLM

SEQ ID NO: 124797 - protein, 9 aa, Homo Sapiens
HFEEAAGAA

SEQ ID NO: 124798 - protein, 9 aa, Homo Sapiens
ISYYACATQ

SEQ ID NO: 124799 - protein, 9 aa, Homo Sapiens
SRSWRKQHL

SEQ ID NO: 124800 - protein, 9 aa, Homo Sapiens
INVLQAKKF

SEQ ID NO: 124801 - protein, 9 aa, Homo Sapiens
EGDPSPHHH

SEQ ID NO: 124802 - protein, 9 aa, Homo Sapiens
IQTSLNIKE

SEQ ID NO: 124803 - protein, 9 aa, Homo Sapiens
LPIMRKRKM

SEQ ID NO: 124804 - protein, 9 aa, Homo Sapiens
LHMSAMAPT

SEQ ID NO: 124805 - protein, 9 aa, Homo Sapiens
NDGKSYTRW

SEQ ID NO: 124806 - protein, 9 aa, Homo Sapiens
GLTSVPLFV

SEQ ID NO: 124807 - protein, 9 aa, Homo Sapiens
VFTYISILE

SEQ ID NO: 124808 - protein, 9 aa, Homo Sapiens
YQPPAKKNK

SEQ ID NO: 124809 - protein, 9 aa, Homo Sapiens
WRAATQRPS

SEQ ID NO: 124810 - protein, 9 aa, Homo Sapiens
EVAEDRQPN

SEQ ID NO: 124811 - protein, 9 aa, Homo Sapiens
SSALYRESD

SEQ ID NO: 124812 - protein, 9 aa, Homo Sapiens
PPLIHCYMA

SEQ ID NO: 124813 - protein, 9 aa, Homo Sapiens
VGRIRNKHE

SEQ ID NO: 124814 - protein, 9 aa, Homo Sapiens
QCNAAGRLE

SEQ ID NO: 124815 - protein, 9 aa, Homo Sapiens
LPVGAPIHR

SEQ ID NO: 124816 - protein, 9 aa, Homo Sapiens
KLTYHQGVV

SEQ ID NO: 124817 - protein, 9 aa, Homo Sapiens
HCKKLEAVY

SEQ ID NO: 124818 - protein, 9 aa, Homo Sapiens
SFLKEVSEF

SEQ ID NO: 124819 - protein, 9 aa, Homo Sapiens
LGTSFLSPT

SEQ ID NO: 124820 - protein, 9 aa, Homo Sapiens
WNCWAEAWW

SEQ ID NO: 124821 - protein, 9 aa, Homo Sapiens
QIEAPPPTA

SEQ ID NO: 124822 - protein, 9 aa, Homo Sapiens
QLTEKYKNL

SEQ ID NO: 124823 - protein, 9 aa, Homo Sapiens
PPLGASPLW

SEQ ID NO: 124824 - protein, 9 aa, Homo Sapiens
KNTLNDALF

SEQ ID NO: 124825 - protein, 9 aa, Homo Sapiens
SSEFEVVAP

SEQ ID NO: 124826 - protein, 9 aa, Homo Sapiens
MALKGSVME

SEQ ID NO: 124827 - protein, 9 aa, Homo Sapiens
GSLDSRVVL

SEQ ID NO: 124828 - protein, 9 aa, Homo Sapiens
QWEGEAEAV

SEQ ID NO: 124829 - protein, 9 aa, Homo Sapiens
ATLPPPPTL

SEQ ID NO: 124830 - protein, 9 aa, Homo Sapiens
SHLGETALP

SEQ ID NO: 124831 - protein, 9 aa, Homo Sapiens
HGKIARKQG

SEQ ID NO: 124832 - protein, 9 aa, Homo Sapiens
QSPLSLWVQ

SEQ ID NO: 124833 - protein, 9 aa, Homo Sapiens
EDEEYVEEE

SEQ ID NO: 124834 - protein, 9 aa, Homo Sapiens
GWWRLLCSS

SEQ ID NO: 124835 - protein, 9 aa, Homo Sapiens
LEDLRSKSV

SEQ ID NO: 124836 - protein, 9 aa, Homo Sapiens
AERAGAARA

SEQ ID NO: 124837 - protein, 9 aa, Homo Sapiens
STAKGDIIC

SEQ ID NO: 124838 - protein, 9 aa, Homo Sapiens
YLLGAAAVF

SEQ ID NO: 124839 - protein, 9 aa, Homo Sapiens
SATVQNREP

SEQ ID NO: 124840 - protein, 9 aa, Homo Sapiens
ENWKRPQMR

SEQ ID NO: 124841 - protein, 9 aa, Homo Sapiens
PVRGAWFCW

SEQ ID NO: 124842 - protein, 9 aa, Homo Sapiens
PSGPAGGRS

SEQ ID NO: 124843 - protein, 9 aa, Homo Sapiens
PIRQIRNRR

SEQ ID NO: 124844 - protein, 9 aa, Homo Sapiens
DAEMVGQVC

SEQ ID NO: 124845 - protein, 9 aa, Homo Sapiens
KRVKIPRRT

SEQ ID NO: 124846 - protein, 9 aa, Homo Sapiens
DAAKPLPRK

SEQ ID NO: 124847 - protein, 9 aa, Homo Sapiens
ASRLEFSPD

SEQ ID NO: 124848 - protein, 9 aa, Homo Sapiens
LLLSLDRHE

SEQ ID NO: 124849 - protein, 9 aa, Homo Sapiens
ASVAAPANK

SEQ ID NO: 124850 - protein, 9 aa, Homo Sapiens
GQVKTGINM

SEQ ID NO: 124851 - protein, 9 aa, Homo Sapiens
CSPVGIVRS

SEQ ID NO: 124852 - protein, 9 aa, Homo Sapiens
LCPSSSPTS

SEQ ID NO: 124853 - protein, 9 aa, Homo Sapiens
ALSLALEKF

SEQ ID NO: 124854 - protein, 9 aa, Homo Sapiens
DPGCNYDQL

SEQ ID NO: 124855 - protein, 9 aa, Homo Sapiens
VTVRPPGSV

SEQ ID NO: 124856 - protein, 9 aa, Homo Sapiens
FPQDDLCRY

SEQ ID NO: 124857 - protein, 9 aa, Homo Sapiens
PFLMTTFWK

SEQ ID NO: 124858 - protein, 9 aa, Homo Sapiens
THHNLSQSP

SEQ ID NO: 124859 - protein, 9 aa, Homo Sapiens
NKEGGTVSV

SEQ ID NO: 124860 - protein, 9 aa, Homo Sapiens
PRNVVIPQY

SEQ ID NO: 124861 - protein, 9 aa, Homo Sapiens
ILLSLVRML

SEQ ID NO: 124862 - protein, 9 aa, Homo Sapiens
QLYDRYLAR

SEQ ID NO: 124863 - protein, 9 aa, Homo Sapiens
LCWEALPGA

SEQ ID NO: 124864 - protein, 9 aa, Homo Sapiens
SRPHAEQYR

SEQ ID NO: 124865 - protein, 9 aa, Homo Sapiens
VPAAPPKCP

SEQ ID NO: 124866 - protein, 9 aa, Homo Sapiens
KICSLLILI

SEQ ID NO: 124867 - protein, 9 aa, Homo Sapiens
DYTKDLFQQ

SEQ ID NO: 124868 - protein, 9 aa, Homo Sapiens
SAATALHSR

SEQ ID NO: 124869 - protein, 9 aa, Homo Sapiens
WVYTLLLTL

SEQ ID NO: 124870 - protein, 9 aa, Homo Sapiens
EKKDKTQKV

SEQ ID NO: 124871 - protein, 9 aa, Homo Sapiens
DLSNSFGQM

SEQ ID NO: 124872 - protein, 9 aa, Homo Sapiens
EWAIEVDSD

SEQ ID NO: 124873 - protein, 9 aa, Homo Sapiens
EDVNKKRKT

SEQ ID NO: 124874 - protein, 9 aa, Homo Sapiens
TNIWPHGTS

SEQ ID NO: 124875 - protein, 9 aa, Homo Sapiens
YSYEIGSWI

SEQ ID NO: 124876 - protein, 9 aa, Homo Sapiens
PGPGQTTSD

SEQ ID NO: 124877 - protein, 9 aa, Homo Sapiens
FKKGKSHLV

SEQ ID NO: 124878 - protein, 9 aa, Homo Sapiens
ITSMGSLRI

SEQ ID NO: 124879 - protein, 9 aa, Homo Sapiens
PMPMPIPSA

SEQ ID NO: 124880 - protein, 9 aa, Homo Sapiens
MFSTLPALC

SEQ ID NO: 124881 - protein, 9 aa, Homo Sapiens
LCRPVKAGV

SEQ ID NO: 124882 - protein, 9 aa, Homo Sapiens
HSEASSVTL

SEQ ID NO: 124883 - protein, 9 aa, Homo Sapiens
GTPHGVPLP

SEQ ID NO: 124884 - protein, 9 aa, Homo Sapiens
LIKDGEMVF

SEQ ID NO: 124885 - protein, 9 aa, Homo Sapiens
VASDLRETI

SEQ ID NO: 124886 - protein, 9 aa, Homo Sapiens
WAEAWWCRC

SEQ ID NO: 124887 - protein, 9 aa, Homo Sapiens
PEPSFPPDI

SEQ ID NO: 124888 - protein, 9 aa, Homo Sapiens
AKAGRSRGQ

SEQ ID NO: 124889 - protein, 9 aa, Homo Sapiens
QELIEKKEY

SEQ ID NO: 124890 - protein, 9 aa, Homo Sapiens
VPFLNYAMS

SEQ ID NO: 124891 - protein, 9 aa, Homo Sapiens
LRPANMYQA

SEQ ID NO: 124892 - protein, 9 aa, Homo Sapiens
DAADLHMSA

SEQ ID NO: 124893 - protein, 9 aa, Homo Sapiens
LSKKKKKIQ

SEQ ID NO: 124894 - protein, 9 aa, Homo Sapiens
NDKVFLPQS

SEQ ID NO: 124895 - protein, 9 aa, Homo Sapiens
QGPAGLPLA

SEQ ID NO: 124896 - protein, 9 aa, Homo Sapiens
THCFPRRAL

SEQ ID NO: 124897 - protein, 9 aa, Homo Sapiens
KEAEARENV

SEQ ID NO: 124898 - protein, 9 aa, Homo Sapiens
NPLKSPTMY

SEQ ID NO: 124899 - protein, 9 aa, Homo Sapiens
PNVQHQNRN

SEQ ID NO: 124900 - protein, 9 aa, Homo Sapiens
GRSRAASVG

SEQ ID NO: 124901 - protein, 9 aa, Homo Sapiens
DCLQHRADT

SEQ ID NO: 124902 - protein, 9 aa, Homo Sapiens
QKRLHNNLI

SEQ ID NO: 124903 - protein, 9 aa, Homo Sapiens
REVASGAAC

SEQ ID NO: 124904 - protein, 9 aa, Homo Sapiens
GTSTIRTRA

SEQ ID NO: 124905 - protein, 9 aa, Homo Sapiens
ILFHLHRKG

SEQ ID NO: 124906 - protein, 9 aa, Homo Sapiens
KAITDAAMT

SEQ ID NO: 124907 - protein, 9 aa, Homo Sapiens
REEEVARLF

SEQ ID NO: 124908 - protein, 9 aa, Homo Sapiens
DFPYPTAAT

SEQ ID NO: 124909 - protein, 9 aa, Homo Sapiens
KSFASRSIM

SEQ ID NO: 124910 - protein, 9 aa, Homo Sapiens
SSFLYPMTS

SEQ ID NO: 124911 - protein, 9 aa, Homo Sapiens
EEHVLVVHL

SEQ ID NO: 124912 - protein, 9 aa, Homo Sapiens
YISSRDHIW

SEQ ID NO: 124913 - protein, 9 aa, Homo Sapiens
RMGGRHPSW

SEQ ID NO: 124914 - protein, 9 aa, Homo Sapiens
SCWYFGVSY

SEQ ID NO: 124915 - protein, 9 aa, Homo Sapiens
PSCCMTTCC

SEQ ID NO: 124916 - protein, 9 aa, Homo Sapiens
PFKCKNVGR

SEQ ID NO: 124917 - protein, 9 aa, Homo Sapiens
RDMQSTFDN

SEQ ID NO: 124918 - protein, 9 aa, Homo Sapiens
YCLFEYAGN

SEQ ID NO: 124919 - protein, 9 aa, Homo Sapiens
HVDGEADTK

SEQ ID NO: 124920 - protein, 9 aa, Homo Sapiens
AGLGLRMRR

SEQ ID NO: 124921 - protein, 9 aa, Homo Sapiens
ETLFLPYDL

SEQ ID NO: 124922 - protein, 9 aa, Homo Sapiens
QELMLKSFT

SEQ ID NO: 124923 - protein, 9 aa, Homo Sapiens
RPSEWPGWC

SEQ ID NO: 124924 - protein, 9 aa, Homo Sapiens
TEDEEATNN

SEQ ID NO: 124925 - protein, 9 aa, Homo Sapiens
QDGSLDRNL

SEQ ID NO: 124926 - protein, 9 aa, Homo Sapiens
DPPAMRRPS

SEQ ID NO: 124927 - protein, 9 aa, Homo Sapiens
AWGSVSIPT

SEQ ID NO: 124928 - protein, 9 aa, Homo Sapiens
FYTNPLPGI

SEQ ID NO: 124929 - protein, 9 aa, Homo Sapiens
EERLHPPSP

SEQ ID NO: 124930 - protein, 9 aa, Homo Sapiens
IFCRCQTLN

SEQ ID NO: 124931 - protein, 9 aa, Homo Sapiens
REKIINPTI

SEQ ID NO: 124932 - protein, 9 aa, Homo Sapiens
PSKLSPKTK

SEQ ID NO: 124933 - protein, 9 aa, Homo Sapiens
RCYPYYLSD

SEQ ID NO: 124934 - protein, 9 aa, Homo Sapiens
LDPAGPLGA

SEQ ID NO: 124935 - protein, 9 aa, Homo Sapiens
AGYRCRWCS

SEQ ID NO: 124936 - protein, 9 aa, Homo Sapiens
VDGMLRVVA

SEQ ID NO: 124937 - protein, 9 aa, Homo Sapiens
FQVVGWGDD

SEQ ID NO: 124938 - protein, 9 aa, Homo Sapiens
CQPWSPTLP

SEQ ID NO: 124939 - protein, 9 aa, Homo Sapiens
EIKDTDDSP

SEQ ID NO: 124940 - protein, 9 aa, Homo Sapiens
QTRRQRSPL

SEQ ID NO: 124941 - protein, 9 aa, Homo Sapiens
VSMCDCEGA

SEQ ID NO: 124942 - protein, 9 aa, Homo Sapiens
DGYKRDLMT

SEQ ID NO: 124943 - protein, 9 aa, Homo Sapiens
HLESSNSQQ

SEQ ID NO: 124944 - protein, 9 aa, Homo Sapiens
DYYACARLP

SEQ ID NO: 124945 - protein, 9 aa, Homo Sapiens
LQLLLNYFS

SEQ ID NO: 124946 - protein, 9 aa, Homo Sapiens
CQCHVTRAK

SEQ ID NO: 124947 - protein, 9 aa, Homo Sapiens
QSLLCIRKH

SEQ ID NO: 124948 - protein, 9 aa, Homo Sapiens
PAPTPCTDT

SEQ ID NO: 124949 - protein, 9 aa, Homo Sapiens
ARSKMVLSN

SEQ ID NO: 124950 - protein, 9 aa, Homo Sapiens
TRENCGYKL

SEQ ID NO: 124951 - protein, 9 aa, Homo Sapiens
FNQQVHLAQ

SEQ ID NO: 124952 - protein, 9 aa, Homo Sapiens
DAAKRCIVS

SEQ ID NO: 124953 - protein, 9 aa, Homo Sapiens
LARRRKNIC

SEQ ID NO: 124954 - protein, 9 aa, Homo Sapiens
QVRARRCIL

SEQ ID NO: 124955 - protein, 9 aa, Homo Sapiens
GKKRKWGAL

SEQ ID NO: 124956 - protein, 9 aa, Homo Sapiens
RGAPHPADR

SEQ ID NO: 124957 - protein, 9 aa, Homo Sapiens
KPGPGQTTS

SEQ ID NO: 124958 - protein, 9 aa, Homo Sapiens
SKKAKERQN

SEQ ID NO: 124959 - protein, 9 aa, Homo Sapiens
RALRVLRPL

SEQ ID NO: 124960 - protein, 9 aa, Homo Sapiens
GDKVSLDLA

SEQ ID NO: 124961 - protein, 9 aa, Homo Sapiens
GRAVNFVVV

SEQ ID NO: 124962 - protein, 9 aa, Homo Sapiens
FKKVARDED

SEQ ID NO: 124963 - protein, 9 aa, Homo Sapiens
GTLIPGTPH

SEQ ID NO: 124964 - protein, 9 aa, Homo Sapiens
KNDSMTYEK

SEQ ID NO: 124965 - protein, 9 aa, Homo Sapiens
AAPATVRPG

SEQ ID NO: 124966 - protein, 9 aa, Homo Sapiens
GHTKGVNAV

SEQ ID NO: 124967 - protein, 9 aa, Homo Sapiens
QRLWKRTEF

SEQ ID NO: 124968 - protein, 9 aa, Homo Sapiens
RAGNLQASY

SEQ ID NO: 124969 - protein, 9 aa, Homo Sapiens
TSLVGSLRR

SEQ ID NO: 124970 - protein, 9 aa, Homo Sapiens
KHEVDEAAV

SEQ ID NO: 124971 - protein, 9 aa, Homo Sapiens
QGRAVNFVV

SEQ ID NO: 124972 - protein, 9 aa, Homo Sapiens
ACFSMPGDN

SEQ ID NO: 124973 - protein, 9 aa, Homo Sapiens
AELMHRQGQ

SEQ ID NO: 124974 - protein, 9 aa, Homo Sapiens
GRTPKLARH

SEQ ID NO: 124975 - protein, 9 aa, Homo Sapiens
SGISRFLEE

SEQ ID NO: 124976 - protein, 9 aa, Homo Sapiens
LVGHQKKIL

SEQ ID NO: 124977 - protein, 9 aa, Homo Sapiens
LELAELVQH

SEQ ID NO: 124978 - protein, 9 aa, Homo Sapiens
FLLCGNHEC

SEQ ID NO: 124979 - protein, 9 aa, Homo Sapiens
PDPPCPLAA

SEQ ID NO: 124980 - protein, 9 aa, Homo Sapiens
QAPHPGPLK

SEQ ID NO: 124981 - protein, 9 aa, Homo Sapiens
SLGHRAAQI

SEQ ID NO: 124982 - protein, 9 aa, Homo Sapiens
PRAKRACTA

SEQ ID NO: 124983 - protein, 9 aa, Homo Sapiens
KVPRKGLIV

SEQ ID NO: 124984 - protein, 9 aa, Homo Sapiens
RVSPQMVNR

SEQ ID NO: 124985 - protein, 9 aa, Homo Sapiens
YGMKLSILR

SEQ ID NO: 124986 - protein, 9 aa, Homo Sapiens
SSSAGQMPR

SEQ ID NO: 124987 - protein, 9 aa, Homo Sapiens
IGADSSSTL

SEQ ID NO: 124988 - protein, 9 aa, Homo Sapiens
GRSHGRKKK

SEQ ID NO: 124989 - protein, 9 aa, Homo Sapiens
RHSVPEAEA

SEQ ID NO: 124990 - protein, 9 aa, Homo Sapiens
LNYAMSSSL

SEQ ID NO: 124991 - protein, 9 aa, Homo Sapiens
HTLPCQRTS

SEQ ID NO: 124992 - protein, 9 aa, Homo Sapiens
RSSAQGVSS

SEQ ID NO: 124993 - protein, 9 aa, Homo Sapiens
PSAPWPSYV

SEQ ID NO: 124994 - protein, 9 aa, Homo Sapiens
KPSERLGNL

SEQ ID NO: 124995 - protein, 9 aa, Homo Sapiens
TNVSNCNWF

SEQ ID NO: 124996 - protein, 9 aa, Homo Sapiens
LLSKSAQLN

SEQ ID NO: 124997 - protein, 9 aa, Homo Sapiens
CGVIISPNM

SEQ ID NO: 124998 - protein, 9 aa, Homo Sapiens
EDEPPRMGE

SEQ ID NO: 124999 - protein, 9 aa, Homo Sapiens
LRISWELES

SEQ ID NO: 125000 - protein, 9 aa, Homo Sapiens
RFPKNVNWE

SEQ ID NO: 125001 - protein, 9 aa, Homo Sapiens
FRRNKNPSL

SEQ ID NO: 125002 - protein, 9 aa, Homo Sapiens
GTPTQKILT

SEQ ID NO: 125003 - protein, 9 aa, Homo Sapiens
LCSGPRPRC

SEQ ID NO: 125004 - protein, 9 aa, Homo Sapiens
QRRERRYGI

SEQ ID NO: 125005 - protein, 9 aa, Homo Sapiens
DFFGGCSDF

SEQ ID NO: 125006 - protein, 9 aa, Homo Sapiens
TPRLGHVVF

SEQ ID NO: 125007 - protein, 9 aa, Homo Sapiens
DKEFFSDWF

SEQ ID NO: 125008 - protein, 9 aa, Homo Sapiens
YSSNATPNM

SEQ ID NO: 125009 - protein, 9 aa, Homo Sapiens
VPIYITVKL

SEQ ID NO: 125010 - protein, 9 aa, Homo Sapiens
CLDPAGPLG

SEQ ID NO: 125011 - protein, 9 aa, Homo Sapiens
EALCFRRDS

SEQ ID NO: 125012 - protein, 9 aa, Homo Sapiens
HLSHSSGYA

SEQ ID NO: 125013 - protein, 9 aa, Homo Sapiens
VDQLRDLSR

SEQ ID NO: 125014 - protein, 9 aa, Homo Sapiens
CLPGPTCPA

SEQ ID NO: 125015 - protein, 9 aa, Homo Sapiens
HGSPFTSAN

SEQ ID NO: 125016 - protein, 9 aa, Homo Sapiens
WRNPGRGSW

SEQ ID NO: 125017 - protein, 9 aa, Homo Sapiens
YRPDLDLVL

SEQ ID NO: 125018 - protein, 9 aa, Homo Sapiens
VPRADLVRP

SEQ ID NO: 125019 - protein, 9 aa, Homo Sapiens
TPGHPSASP

SEQ ID NO: 125020 - protein, 9 aa, Homo Sapiens
VEARFLPKD

SEQ ID NO: 125021 - protein, 9 aa, Homo Sapiens
SQCQLLGVF

SEQ ID NO: 125022 - protein, 9 aa, Homo Sapiens
HLTSIIFAE

SEQ ID NO: 125023 - protein, 9 aa, Homo Sapiens
LQKMKKRVK

SEQ ID NO: 125024 - protein, 9 aa, Homo Sapiens
HLSVDGEEW

SEQ ID NO: 125025 - protein, 9 aa, Homo Sapiens
CPTHGQMTV

SEQ ID NO: 125026 - protein, 9 aa, Homo Sapiens
CVACEKKML

SEQ ID NO: 125027 - protein, 9 aa, Homo Sapiens
KILCVLRSS

SEQ ID NO: 125028 - protein, 9 aa, Homo Sapiens
ECEGSPPST

SEQ ID NO: 125029 - protein, 9 aa, Homo Sapiens
RSAAALAAA

SEQ ID NO: 125030 - protein, 9 aa, Homo Sapiens
YTSVKEELK

SEQ ID NO: 125031 - protein, 9 aa, Homo Sapiens
AKINEVVQV

SEQ ID NO: 125032 - protein, 9 aa, Homo Sapiens
IQRSTQTQT

SEQ ID NO: 125033 - protein, 9 aa, Homo Sapiens
HYCHSTLKC

SEQ ID NO: 125034 - protein, 9 aa, Homo Sapiens
PVGSGPPHP

SEQ ID NO: 125035 - protein, 9 aa, Homo Sapiens
GKRRLIETS

SEQ ID NO: 125036 - protein, 9 aa, Homo Sapiens
DLVSVMKKE

SEQ ID NO: 125037 - protein, 9 aa, Homo Sapiens
LCYRCLPLL

SEQ ID NO: 125038 - protein, 9 aa, Homo Sapiens
FPSSLQPLP

SEQ ID NO: 125039 - protein, 9 aa, Homo Sapiens
VDICYSSNA

SEQ ID NO: 125040 - protein, 9 aa, Homo Sapiens
SHHEQLVDR

SEQ ID NO: 125041 - protein, 9 aa, Homo Sapiens
LAPSSCPTT

SEQ ID NO: 125042 - protein, 9 aa, Homo Sapiens
NTWLSYELQ

SEQ ID NO: 125043 - protein, 9 aa, Homo Sapiens
DKFETLEPE

SEQ ID NO: 125044 - protein, 9 aa, Homo Sapiens
YNIALRWTG

SEQ ID NO: 125045 - protein, 9 aa, Homo Sapiens
NKREECDKA

SEQ ID NO: 125046 - protein, 9 aa, Homo Sapiens
ASHWCGAWR

SEQ ID NO: 125047 - protein, 9 aa, Homo Sapiens
KSRQCSQPL

SEQ ID NO: 125048 - protein, 9 aa, Homo Sapiens
RASASRGDT

SEQ ID NO: 125049 - protein, 9 aa, Homo Sapiens
REDLQAVVE

SEQ ID NO: 125050 - protein, 9 aa, Homo Sapiens
RPSRMCTAR

SEQ ID NO: 125051 - protein, 9 aa, Homo Sapiens
YAGGVGAQL

SEQ ID NO: 125052 - protein, 9 aa, Homo Sapiens
GPWRAATQR

SEQ ID NO: 125053 - protein, 9 aa, Homo Sapiens
LCPSSAEPN

SEQ ID NO: 125054 - protein, 9 aa, Homo Sapiens
SKSVDKCMD

SEQ ID NO: 125055 - protein, 9 aa, Homo Sapiens
LHSQLPHPH

SEQ ID NO: 125056 - protein, 9 aa, Homo Sapiens
TVLCLQVAR

SEQ ID NO: 125057 - protein, 9 aa, Homo Sapiens
VQPILQIDN

SEQ ID NO: 125058 - protein, 9 aa, Homo Sapiens
YGSVKCTHQ

SEQ ID NO: 125059 - protein, 9 aa, Homo Sapiens
MANQEFLVC

SEQ ID NO: 125060 - protein, 9 aa, Homo Sapiens
SEILDKPHK

SEQ ID NO: 125061 - protein, 9 aa, Homo Sapiens
AGEQDVEGN

SEQ ID NO: 125062 - protein, 9 aa, Homo Sapiens
FLKMICPTH

SEQ ID NO: 125063 - protein, 9 aa, Homo Sapiens
RRMLKVTCF

SEQ ID NO: 125064 - protein, 9 aa, Homo Sapiens
SCADSQSHI

SEQ ID NO: 125065 - protein, 9 aa, Homo Sapiens
VKGFAVMAL

SEQ ID NO: 125066 - protein, 9 aa, Homo Sapiens
GCSDFCHHC

SEQ ID NO: 125067 - protein, 9 aa, Homo Sapiens
VPCSPLQRS

SEQ ID NO: 125068 - protein, 9 aa, Homo Sapiens
LPGKMDRST

SEQ ID NO: 125069 - protein, 9 aa, Homo Sapiens
VKKDKGEDQ

SEQ ID NO: 125070 - protein, 9 aa, Homo Sapiens
ATCSRRPPS

SEQ ID NO: 125071 - protein, 9 aa, Homo Sapiens
QRWGGTTAV

SEQ ID NO: 125072 - protein, 9 aa, Homo Sapiens
EDQLFFGCR

SEQ ID NO: 125073 - protein, 9 aa, Homo Sapiens
SPELPPDEP

SEQ ID NO: 125074 - protein, 9 aa, Homo Sapiens
LIAYYGLKS

SEQ ID NO: 125075 - protein, 9 aa, Homo Sapiens
RRLYTSSWR

SEQ ID NO: 125076 - protein, 9 aa, Homo Sapiens
QQKEDLGRS

SEQ ID NO: 125077 - protein, 9 aa, Homo Sapiens
TERDQTDKN

SEQ ID NO: 125078 - protein, 9 aa, Homo Sapiens
LTSEDSNAQ

SEQ ID NO: 125079 - protein, 9 aa, Homo Sapiens
WVSVRPLSS

SEQ ID NO: 125080 - protein, 9 aa, Homo Sapiens
GQQYGAVPG

SEQ ID NO: 125081 - protein, 9 aa, Homo Sapiens
VEPVHTSEN

SEQ ID NO: 125082 - protein, 9 aa, Homo Sapiens
EPCLPGPTC

SEQ ID NO: 125083 - protein, 9 aa, Homo Sapiens
GHLHLQAKR

SEQ ID NO: 125084 - protein, 9 aa, Homo Sapiens
VKGMSPAVL

SEQ ID NO: 125085 - protein, 9 aa, Homo Sapiens
AQLLRRSHF

SEQ ID NO: 125086 - protein, 9 aa, Homo Sapiens
ILAYCSLSF

SEQ ID NO: 125087 - protein, 9 aa, Homo Sapiens
VILVTLVNP

SEQ ID NO: 125088 - protein, 9 aa, Homo Sapiens
SLPKAIMTS

SEQ ID NO: 125089 - protein, 9 aa, Homo Sapiens
LGLFFHAPS

SEQ ID NO: 125090 - protein, 9 aa, Homo Sapiens
HVDEEPESS

SEQ ID NO: 125091 - protein, 9 aa, Homo Sapiens
QYLPTYTLH

SEQ ID NO: 125092 - protein, 9 aa, Homo Sapiens
NVKHVVNFD

SEQ ID NO: 125093 - protein, 9 aa, Homo Sapiens
VKKPKIRMK

SEQ ID NO: 125094 - protein, 9 aa, Homo Sapiens
VNLLSNGTY

SEQ ID NO: 125095 - protein, 9 aa, Homo Sapiens
VTTYTVFTP

SEQ ID NO: 125096 - protein, 9 aa, Homo Sapiens
GVLELTSAQ

SEQ ID NO: 125097 - protein, 9 aa, Homo Sapiens
LEDEWRFRL

SEQ ID NO: 125098 - protein, 9 aa, Homo Sapiens
LHNFQNMFL

SEQ ID NO: 125099 - protein, 9 aa, Homo Sapiens
VGNVKQTQY

SEQ ID NO: 125100 - protein, 9 aa, Homo Sapiens
RHGNHRESS

SEQ ID NO: 125101 - protein, 9 aa, Homo Sapiens
PSGPRLRLA

SEQ ID NO: 125102 - protein, 9 aa, Homo Sapiens
RASSLCGPS

SEQ ID NO: 125103 - protein, 9 aa, Homo Sapiens
LGPLFSGRQ

SEQ ID NO: 125104 - protein, 9 aa, Homo Sapiens
GGRSSDSEW

SEQ ID NO: 125105 - protein, 9 aa, Homo Sapiens
AHPSSVLGP

SEQ ID NO: 125106 - protein, 9 aa, Homo Sapiens
PGCLPRAGG

SEQ ID NO: 125107 - protein, 9 aa, Homo Sapiens
LGTAPARSR

SEQ ID NO: 125108 - protein, 9 aa, Homo Sapiens
ITVPECSEI

SEQ ID NO: 125109 - protein, 9 aa, Homo Sapiens
LRPRSVVIQ

SEQ ID NO: 125110 - protein, 9 aa, Homo Sapiens
GPTCPAFSA

SEQ ID NO: 125111 - protein, 9 aa, Homo Sapiens
FNTLKNMCG

SEQ ID NO: 125112 - protein, 9 aa, Homo Sapiens
IVPVELEPK

SEQ ID NO: 125113 - protein, 9 aa, Homo Sapiens
SATAGDSSC

SEQ ID NO: 125114 - protein, 9 aa, Homo Sapiens
MVNRIVDSA

SEQ ID NO: 125115 - protein, 9 aa, Homo Sapiens
VIVQRVNNE

SEQ ID NO: 125116 - protein, 9 aa, Homo Sapiens
YEKMVAVGP

SEQ ID NO: 125117 - protein, 9 aa, Homo Sapiens
LQSLTCGKP

SEQ ID NO: 125118 - protein, 9 aa, Homo Sapiens
EEAAESLPG

SEQ ID NO: 125119 - protein, 9 aa, Homo Sapiens
ACPFLVFLT

SEQ ID NO: 125120 - protein, 9 aa, Homo Sapiens
LFSKPNVIS

SEQ ID NO: 125121 - protein, 9 aa, Homo Sapiens
EESKKHKRK

SEQ ID NO: 125122 - protein, 9 aa, Homo Sapiens
LGLVSTRNG

SEQ ID NO: 125123 - protein, 9 aa, Homo Sapiens
CFVQLTETS

SEQ ID NO: 125124 - protein, 9 aa, Homo Sapiens
QRKKNDSMT

SEQ ID NO: 125125 - protein, 9 aa, Homo Sapiens
NLTESGCVT

SEQ ID NO: 125126 - protein, 9 aa, Homo Sapiens
CEIQAPHPG

SEQ ID NO: 125127 - protein, 9 aa, Homo Sapiens
DGLKNTPRF

SEQ ID NO: 125128 - protein, 9 aa, Homo Sapiens
KDDGQNFIQ

SEQ ID NO: 125129 - protein, 9 aa, Homo Sapiens
HNDDVHHQG

SEQ ID NO: 125130 - protein, 9 aa, Homo Sapiens
VAARLAVAK

SEQ ID NO: 125131 - protein, 9 aa, Homo Sapiens
PDEVLGLFF

SEQ ID NO: 125132 - protein, 9 aa, Homo Sapiens
NSRFHKTYE

SEQ ID NO: 125133 - protein, 9 aa, Homo Sapiens
GGCSDFCHH

SEQ ID NO: 125134 - protein, 9 aa, Homo Sapiens
KTLPELCSH

SEQ ID NO: 125135 - protein, 9 aa, Homo Sapiens
SLPGAEGSG

SEQ ID NO: 125136 - protein, 9 aa, Homo Sapiens
LKRVADLVE

SEQ ID NO: 125137 - protein, 9 aa, Homo Sapiens
SPVGSCPHG

SEQ ID NO: 125138 - protein, 9 aa, Homo Sapiens
CARWLHQPD

SEQ ID NO: 125139 - protein, 9 aa, Homo Sapiens
TLTHTHTWR

SEQ ID NO: 125140 - protein, 9 aa, Homo Sapiens
PASHPLFGR

SEQ ID NO: 125141 - protein, 9 aa, Homo Sapiens
NEWKPAVIF

SEQ ID NO: 125142 - protein, 9 aa, Homo Sapiens
VDVPLVNEE

SEQ ID NO: 125143 - protein, 9 aa, Homo Sapiens
YCSLSFPGS

SEQ ID NO: 125144 - protein, 9 aa, Homo Sapiens
PTMYQVQSP

SEQ ID NO: 125145 - protein, 9 aa, Homo Sapiens
APALEGLPR

SEQ ID NO: 125146 - protein, 9 aa, Homo Sapiens
GAGKYHSVC

SEQ ID NO: 125147 - protein, 9 aa, Homo Sapiens
TAGARHHTR

SEQ ID NO: 125148 - protein, 9 aa, Homo Sapiens
RNTHTFEFW

SEQ ID NO: 125149 - protein, 9 aa, Homo Sapiens
EKMFGSGSR

SEQ ID NO: 125150 - protein, 9 aa, Homo Sapiens
LHKNQQLTL

SEQ ID NO: 125151 - protein, 9 aa, Homo Sapiens
KNRQLKKKE

SEQ ID NO: 125152 - protein, 9 aa, Homo Sapiens
LHQPDWCCV

SEQ ID NO: 125153 - protein, 9 aa, Homo Sapiens
YRLSSYFQQ

SEQ ID NO: 125154 - protein, 9 aa, Homo Sapiens
SRLSASQIW

SEQ ID NO: 125155 - protein, 9 aa, Homo Sapiens
NAWVDKEFF

SEQ ID NO: 125156 - protein, 9 aa, Homo Sapiens
CPPMPTRRS

SEQ ID NO: 125157 - protein, 9 aa, Homo Sapiens
EQILCLLQQ

SEQ ID NO: 125158 - protein, 9 aa, Homo Sapiens
SDGYYAMVC

SEQ ID NO: 125159 - protein, 9 aa, Homo Sapiens
SVCHHHGIE

SEQ ID NO: 125160 - protein, 9 aa, Homo Sapiens
SAEGGEEDL

SEQ ID NO: 125161 - protein, 9 aa, Homo Sapiens
VWRVPGCAR

SEQ ID NO: 125162 - protein, 9 aa, Homo Sapiens
PLLNIKERT

SEQ ID NO: 125163 - protein, 9 aa, Homo Sapiens
MVQGPAGLP

SEQ ID NO: 125164 - protein, 9 aa, Homo Sapiens
TCALPSCAP

SEQ ID NO: 125165 - protein, 9 aa, Homo Sapiens
LAGAHAAGP

SEQ ID NO: 125166 - protein, 9 aa, Homo Sapiens
SQLCSTDSP

SEQ ID NO: 125167 - protein, 9 aa, Homo Sapiens
RAQALAVNY

SEQ ID NO: 125168 - protein, 9 aa, Homo Sapiens
VHSSGQKIT

SEQ ID NO: 125169 - protein, 9 aa, Homo Sapiens
DEHYLLPTQ

SEQ ID NO: 125170 - protein, 9 aa, Homo Sapiens
TVRVPMSAV

SEQ ID NO: 125171 - protein, 9 aa, Homo Sapiens
AQGHAFLGH

SEQ ID NO: 125172 - protein, 9 aa, Homo Sapiens
MGKQLHMHL

SEQ ID NO: 125173 - protein, 9 aa, Homo Sapiens
NVIEGVRNL

SEQ ID NO: 125174 - protein, 9 aa, Homo Sapiens
GTAPARSRG

SEQ ID NO: 125175 - protein, 9 aa, Homo Sapiens
GEKIVALMS

SEQ ID NO: 125176 - protein, 9 aa, Homo Sapiens
NFSNYKACF

SEQ ID NO: 125177 - protein, 9 aa, Homo Sapiens
IEDFFGAKH

SEQ ID NO: 125178 - protein, 9 aa, Homo Sapiens
TKRGWAWDD

SEQ ID NO: 125179 - protein, 9 aa, Homo Sapiens
PLREATSPQ

SEQ ID NO: 125180 - protein, 9 aa, Homo Sapiens
VEGIRLPNG

SEQ ID NO: 125181 - protein, 9 aa, Homo Sapiens
KAIMTSVFG

SEQ ID NO: 125182 - protein, 9 aa, Homo Sapiens
QKMKRISVQ

SEQ ID NO: 125183 - protein, 9 aa, Homo Sapiens
HSRVSFAAR

SEQ ID NO: 125184 - protein, 9 aa, Homo Sapiens
PLSSIRNFP

SEQ ID NO: 125185 - protein, 9 aa, Homo Sapiens
PRPQTEHTP

SEQ ID NO: 125186 - protein, 9 aa, Homo Sapiens
LTILKDSGY

SEQ ID NO: 125187 - protein, 9 aa, Homo Sapiens
MTMNPFLMT

SEQ ID NO: 125188 - protein, 9 aa, Homo Sapiens
RKGVHPVVV

SEQ ID NO: 125189 - protein, 9 aa, Homo Sapiens
MKVHQENGF

SEQ ID NO: 125190 - protein, 9 aa, Homo Sapiens
MKSSGKING

SEQ ID NO: 125191 - protein, 9 aa, Homo Sapiens
DECLIIATA

SEQ ID NO: 125192 - protein, 9 aa, Homo Sapiens
TLCYELNFH

SEQ ID NO: 125193 - protein, 9 aa, Homo Sapiens
RLWRIHRRT

SEQ ID NO: 125194 - protein, 9 aa, Homo Sapiens
IRRPPVLRL

SEQ ID NO: 125195 - protein, 9 aa, Homo Sapiens
QVSKNILFI

SEQ ID NO: 125196 - protein, 9 aa, Homo Sapiens
GEAEWHKLL

SEQ ID NO: 125197 - protein, 9 aa, Homo Sapiens
ILHDRFLMD

SEQ ID NO: 125198 - protein, 9 aa, Homo Sapiens
GLLAAVEYV

SEQ ID NO: 125199 - protein, 9 aa, Homo Sapiens
WLQLEDVCV

SEQ ID NO: 125200 - protein, 9 aa, Homo Sapiens
IYGVSTKQI

SEQ ID NO: 125201 - protein, 9 aa, Homo Sapiens
CSHLGETAL

SEQ ID NO: 125202 - protein, 9 aa, Homo Sapiens
RNKNPSLLG

SEQ ID NO: 125203 - protein, 9 aa, Homo Sapiens
ATKPKEEKD

SEQ ID NO: 125204 - protein, 9 aa, Homo Sapiens
IPDGVPIYI

SEQ ID NO: 125205 - protein, 9 aa, Homo Sapiens
FNFASYPFC

SEQ ID NO: 125206 - protein, 9 aa, Homo Sapiens
MTWKPFLSN

SEQ ID NO: 125207 - protein, 9 aa, Homo Sapiens
QSVRLQPRL

SEQ ID NO: 125208 - protein, 9 aa, Homo Sapiens
NATDEEARD

SEQ ID NO: 125209 - protein, 9 aa, Homo Sapiens
HAMIIGIPV

SEQ ID NO: 125210 - protein, 9 aa, Homo Sapiens
GPDYVPQKF

SEQ ID NO: 125211 - protein, 9 aa, Homo Sapiens
TKRLEREQK

SEQ ID NO: 125212 - protein, 9 aa, Homo Sapiens
LVAAALCIP

SEQ ID NO: 125213 - protein, 9 aa, Homo Sapiens
QLQGAGAAA

SEQ ID NO: 125214 - protein, 9 aa, Homo Sapiens
TVSNGASTA

SEQ ID NO: 125215 - protein, 9 aa, Homo Sapiens
VRLEDLDEL

SEQ ID NO: 125216 - protein, 9 aa, Homo Sapiens
FFVLVNLEV

SEQ ID NO: 125217 - protein, 9 aa, Homo Sapiens
VSCPNYSYE

SEQ ID NO: 125218 - protein, 9 aa, Homo Sapiens
AIHAMIIGI

SEQ ID NO: 125219 - protein, 9 aa, Homo Sapiens
PRYDLTNEN

SEQ ID NO: 125220 - protein, 9 aa, Homo Sapiens
ELPPDEPQL

SEQ ID NO: 125221 - protein, 9 aa, Homo Sapiens
GILFSKPNV

SEQ ID NO: 125222 - protein, 9 aa, Homo Sapiens
LKLTDIWLE

SEQ ID NO: 125223 - protein, 9 aa, Homo Sapiens
HPWWREHLT

SEQ ID NO: 125224 - protein, 9 aa, Homo Sapiens
LRVMRLTRI

SEQ ID NO: 125225 - protein, 9 aa, Homo Sapiens
RALVDYASD

SEQ ID NO: 125226 - protein, 9 aa, Homo Sapiens
LPHTSLVQA

SEQ ID NO: 125227 - protein, 9 aa, Homo Sapiens
ALIVSLLYL

SEQ ID NO: 125228 - protein, 9 aa, Homo Sapiens
PVDRPGRRL

SEQ ID NO: 125229 - protein, 9 aa, Homo Sapiens
PSPEFSDMP

SEQ ID NO: 125230 - protein, 9 aa, Homo Sapiens
LDRGLHKRT

SEQ ID NO: 125231 - protein, 9 aa, Homo Sapiens
VQLHNSNPY

SEQ ID NO: 125232 - protein, 9 aa, Homo Sapiens
LPGPTCPAF

SEQ ID NO: 125233 - protein, 9 aa, Homo Sapiens
NKYKYKSSG

SEQ ID NO: 125234 - protein, 9 aa, Homo Sapiens
KSRRNNETP

SEQ ID NO: 125235 - protein, 9 aa, Homo Sapiens
NANPHLPIM

SEQ ID NO: 125236 - protein, 9 aa, Homo Sapiens
SYTAPDKMG

SEQ ID NO: 125237 - protein, 9 aa, Homo Sapiens
MSVDLSTRV

SEQ ID NO: 125238 - protein, 9 aa, Homo Sapiens
TDSHLVRSI

SEQ ID NO: 125239 - protein, 9 aa, Homo Sapiens
GFCCSVNFS

SEQ ID NO: 125240 - protein, 9 aa, Homo Sapiens
LMATDVDDK

SEQ ID NO: 125241 - protein, 9 aa, Homo Sapiens
EPLASRSCT

SEQ ID NO: 125242 - protein, 9 aa, Homo Sapiens
EIPPCRRPP

SEQ ID NO: 125243 - protein, 9 aa, Homo Sapiens
TSDRKTEAT

SEQ ID NO: 125244 - protein, 9 aa, Homo Sapiens
AIRTRGNAN

SEQ ID NO: 125245 - protein, 9 aa, Homo Sapiens
LSFASLRPR

SEQ ID NO: 125246 - protein, 9 aa, Homo Sapiens
EEQTCPAPQ

SEQ ID NO: 125247 - protein, 9 aa, Homo Sapiens
EAYCLVGYE

SEQ ID NO: 125248 - protein, 9 aa, Homo Sapiens
GTHRVAQVH

SEQ ID NO: 125249 - protein, 9 aa, Homo Sapiens
LFDNPATAF

SEQ ID NO: 125250 - protein, 9 aa, Homo Sapiens
TTEVSHLKR

SEQ ID NO: 125251 - protein, 9 aa, Homo Sapiens
HHQCQPWSP

SEQ ID NO: 125252 - protein, 9 aa, Homo Sapiens
PGKMDRSTA

SEQ ID NO: 125253 - protein, 9 aa, Homo Sapiens
MRLHPWWKE

SEQ ID NO: 125254 - protein, 9 aa, Homo Sapiens
EWERRRTQR

SEQ ID NO: 125255 - protein, 9 aa, Homo Sapiens
ANATDEEAR

SEQ ID NO: 125256 - protein, 9 aa, Homo Sapiens
ACTAPRGLT

SEQ ID NO: 125257 - protein, 9 aa, Homo Sapiens
LLLALSFAS

SEQ ID NO: 125258 - protein, 9 aa, Homo Sapiens
PEAWPGIPG

SEQ ID NO: 125259 - protein, 9 aa, Homo Sapiens
LRDGARKYF

SEQ ID NO: 125260 - protein, 9 aa, Homo Sapiens
DKYSDDTPL

SEQ ID NO: 125261 - protein, 9 aa, Homo Sapiens
YEFQHSHLA

SEQ ID NO: 125262 - protein, 9 aa, Homo Sapiens
PRRASGCRP

SEQ ID NO: 125263 - protein, 9 aa, Homo Sapiens
PTQKILTKF

SEQ ID NO: 125264 - protein, 9 aa, Homo Sapiens
LQKAQVTLM

SEQ ID NO: 125265 - protein, 9 aa, Homo Sapiens
APPGARCAR

SEQ ID NO: 125266 - protein, 9 aa, Homo Sapiens
SDDLTVVDT

SEQ ID NO: 125267 - protein, 9 aa, Homo Sapiens
TSTPPSAAT

SEQ ID NO: 125268 - protein, 9 aa, Homo Sapiens
FVLLAHIMS

SEQ ID NO: 125269 - protein, 9 aa, Homo Sapiens
LLLTLARPF

SEQ ID NO: 125270 - protein, 9 aa, Homo Sapiens
ANDSDSESE

SEQ ID NO: 125271 - protein, 9 aa, Homo Sapiens
WPTFLCRPV

SEQ ID NO: 125272 - protein, 9 aa, Homo Sapiens
YLSFTPLEK

SEQ ID NO: 125273 - protein, 9 aa, Homo Sapiens
KLYMKLIVE

SEQ ID NO: 125274 - protein, 9 aa, Homo Sapiens
RSCERSPSP

SEQ ID NO: 125275 - protein, 9 aa, Homo Sapiens
QKDNISMHY

SEQ ID NO: 125276 - protein, 9 aa, Homo Sapiens
GSGSRHRKE

SEQ ID NO: 125277 - protein, 9 aa, Homo Sapiens
TVSTNNCPH

SEQ ID NO: 125278 - protein, 9 aa, Homo Sapiens
DVQTRDLGP

SEQ ID NO: 125279 - protein, 9 aa, Homo Sapiens
PLIHCYMAL

SEQ ID NO: 125280 - protein, 9 aa, Homo Sapiens
RPPVLPPPL

SEQ ID NO: 125281 - protein, 9 aa, Homo Sapiens
KLMGDKFKG

SEQ ID NO: 125282 - protein, 9 aa, Homo Sapiens
LSMSYQRKD

SEQ ID NO: 125283 - protein, 9 aa, Homo Sapiens
ELLRHHFRQ

SEQ ID NO: 125284 - protein, 9 aa, Homo Sapiens
RALLCLIAL

SEQ ID NO: 125285 - protein, 9 aa, Homo Sapiens
GRRAGNRGG

SEQ ID NO: 125286 - protein, 9 aa, Homo Sapiens
RRSGLHPWT

SEQ ID NO: 125287 - protein, 9 aa, Homo Sapiens
RRGSSPPGR

SEQ ID NO: 125288 - protein, 9 aa, Homo Sapiens
NQEFLVCLV

SEQ ID NO: 125289 - protein, 9 aa, Homo Sapiens
SRPLAHSVA

SEQ ID NO: 125290 - protein, 9 aa, Homo Sapiens
KVKSLKSID

SEQ ID NO: 125291 - protein, 9 aa, Homo Sapiens
HDLEYECLT

SEQ ID NO: 125292 - protein, 9 aa, Homo Sapiens
TGLETYKQV

SEQ ID NO: 125293 - protein, 9 aa, Homo Sapiens
TPALPGPRD

SEQ ID NO: 125294 - protein, 9 aa, Homo Sapiens
SRTCKPRCT

SEQ ID NO: 125295 - protein, 9 aa, Homo Sapiens
AEELPPCFG

SEQ ID NO: 125296 - protein, 9 aa, Homo Sapiens
KPKIRMKKS

SEQ ID NO: 125297 - protein, 9 aa, Homo Sapiens
MFGSGSRHR

SEQ ID NO: 125298 - protein, 9 aa, Homo Sapiens
NNKSAEAVL

SEQ ID NO: 125299 - protein, 9 aa, Homo Sapiens
LHHKAGTKN

SEQ ID NO: 125300 - protein, 9 aa, Homo Sapiens
ETSNAYIAD

SEQ ID NO: 125301 - protein, 9 aa, Homo Sapiens
GETCKIGVN

SEQ ID NO: 125302 - protein, 9 aa, Homo Sapiens
VYPQLPGQE

SEQ ID NO: 125303 - protein, 9 aa, Homo Sapiens
IIQHGKIAR

SEQ ID NO: 125304 - protein, 9 aa, Homo Sapiens
MWKTTNRYV

SEQ ID NO: 125305 - protein, 9 aa, Homo Sapiens
RQSSPGRPT

SEQ ID NO: 125306 - protein, 9 aa, Homo Sapiens
RVLRELKQV

SEQ ID NO: 125307 - protein, 9 aa, Homo Sapiens
AWSRTCKPR

SEQ ID NO: 125308 - protein, 9 aa, Homo Sapiens
AGGAEPVAD

SEQ ID NO: 125309 - protein, 9 aa, Homo Sapiens
VGERSWARC

SEQ ID NO: 125310 - protein, 9 aa, Homo Sapiens
LLLLLAPPP

SEQ ID NO: 125311 - protein, 9 aa, Homo Sapiens
ARAKGFPNV

SEQ ID NO: 125312 - protein, 9 aa, Homo Sapiens
QGLESSPAK

SEQ ID NO: 125313 - protein, 9 aa, Homo Sapiens
KDPNELQAL

SEQ ID NO: 125314 - protein, 9 aa, Homo Sapiens
PIYITVKLM

SEQ ID NO: 125315 - protein, 9 aa, Homo Sapiens
PVGAPIHRL

SEQ ID NO: 125316 - protein, 9 aa, Homo Sapiens
HPGTPGHPS

SEQ ID NO: 125317 - protein, 9 aa, Homo Sapiens
SGDFILVRT

SEQ ID NO: 125318 - protein, 9 aa, Homo Sapiens
SNVKHVVNF

SEQ ID NO: 125319 - protein, 9 aa, Homo Sapiens
SSMPSSGTS

SEQ ID NO: 125320 - protein, 9 aa, Homo Sapiens
GTENLCIKL

SEQ ID NO: 125321 - protein, 9 aa, Homo Sapiens
KAKTGPLPP

SEQ ID NO: 125322 - protein, 9 aa, Homo Sapiens
GGAEPVADP

SEQ ID NO: 125323 - protein, 9 aa, Homo Sapiens
YDPDSNTWH

SEQ ID NO: 125324 - protein, 9 aa, Homo Sapiens
EAEASTPGR

SEQ ID NO: 125325 - protein, 9 aa, Homo Sapiens
PVVQLHNSN

SEQ ID NO: 125326 - protein, 9 aa, Homo Sapiens
NYGKVPLAK

SEQ ID NO: 125327 - protein, 9 aa, Homo Sapiens
LAVKGFAVM

SEQ ID NO: 125328 - protein, 9 aa, Homo Sapiens
SSTATLHVL

SEQ ID NO: 125329 - protein, 9 aa, Homo Sapiens
EEVRAAGRA

SEQ ID NO: 125330 - protein, 9 aa, Homo Sapiens
PYTCLTTEV

SEQ ID NO: 125331 - protein, 9 aa, Homo Sapiens
DQLFFGCRL

SEQ ID NO: 125332 - protein, 9 aa, Homo Sapiens
EMERVSEPC

SEQ ID NO: 125333 - protein, 9 aa, Homo Sapiens
AIGADSSST

SEQ ID NO: 125334 - protein, 9 aa, Homo Sapiens
YVGWAEATV

SEQ ID NO: 125335 - protein, 9 aa, Homo Sapiens
LTHRTGPRS

SEQ ID NO: 125336 - protein, 9 aa, Homo Sapiens
TRRPPAPTP

SEQ ID NO: 125337 - protein, 9 aa, Homo Sapiens
KNKKRRRIH

SEQ ID NO: 125338 - protein, 9 aa, Homo Sapiens
LCLHVQQNR

SEQ ID NO: 125339 - protein, 9 aa, Homo Sapiens
RECWGTWPL

SEQ ID NO: 125340 - protein, 9 aa, Homo Sapiens
GTPSPAMAH

SEQ ID NO: 125341 - protein, 9 aa, Homo Sapiens
PPGVPLAGW

SEQ ID NO: 125342 - protein, 9 aa, Homo Sapiens
TREKIKAKI

SEQ ID NO: 125343 - protein, 9 aa, Homo Sapiens
PAAPGCLPR

SEQ ID NO: 125344 - protein, 9 aa, Homo Sapiens
ILAGLCTSL

SEQ ID NO: 125345 - protein, 9 aa, Homo Sapiens
EKTMELDSS

SEQ ID NO: 125346 - protein, 9 aa, Homo Sapiens
LYMKLIVEE

SEQ ID NO: 125347 - protein, 9 aa, Homo Sapiens
DWNDMKRIW

SEQ ID NO: 125348 - protein, 9 aa, Homo Sapiens
YDVTLNFRR

SEQ ID NO: 125349 - protein, 9 aa, Homo Sapiens
PHVDGEADT

SEQ ID NO: 125350 - protein, 9 aa, Homo Sapiens
GPPPECCSS

SEQ ID NO: 125351 - protein, 9 aa, Homo Sapiens
KYLEDIKTY

SEQ ID NO: 125352 - protein, 9 aa, Homo Sapiens
ASLDDPPKG

SEQ ID NO: 125353 - protein, 9 aa, Homo Sapiens
LSREHLSVV

SEQ ID NO: 125354 - protein, 9 aa, Homo Sapiens
RQHSDGDRR

SEQ ID NO: 125355 - protein, 9 aa, Homo Sapiens
GFFAVYESI

SEQ ID NO: 125356 - protein, 9 aa, Homo Sapiens
SFDGEVSWD

SEQ ID NO: 125357 - protein, 9 aa, Homo Sapiens
QDPGLGLWL

SEQ ID NO: 125358 - protein, 9 aa, Homo Sapiens
GGDCSPTRM

SEQ ID NO: 125359 - protein, 9 aa, Homo Sapiens
VHCTDVTDA

SEQ ID NO: 125360 - protein, 9 aa, Homo Sapiens
EVLTQLARA

SEQ ID NO: 125361 - protein, 9 aa, Homo Sapiens
TTIHASRTM

SEQ ID NO: 125362 - protein, 9 aa, Homo Sapiens
STVQNILEE

SEQ ID NO: 125363 - protein, 9 aa, Homo Sapiens
SPSAGPSPH

SEQ ID NO: 125364 - protein, 9 aa, Homo Sapiens
EDLRSKSVD

SEQ ID NO: 125365 - protein, 9 aa, Homo Sapiens
DFGEKQKML

SEQ ID NO: 125366 - protein, 9 aa, Homo Sapiens
CPASGGAKA

SEQ ID NO: 125367 - protein, 9 aa, Homo Sapiens
KMNLSAIQN

SEQ ID NO: 125368 - protein, 9 aa, Homo Sapiens
LPHIVVVTL

SEQ ID NO: 125369 - protein, 9 aa, Homo Sapiens
LTNSCLISL

SEQ ID NO: 125370 - protein, 9 aa, Homo Sapiens
CISLNSLNE

SEQ ID NO: 125371 - protein, 9 aa, Homo Sapiens
QDDLCRYIT

SEQ ID NO: 125372 - protein, 9 aa, Homo Sapiens
SFRTLRLCD

SEQ ID NO: 125373 - protein, 9 aa, Homo Sapiens
GQRKKNDSM

SEQ ID NO: 125374 - protein, 9 aa, Homo Sapiens
DLHNPKGNK

SEQ ID NO: 125375 - protein, 9 aa, Homo Sapiens
GFPVCPKLN

SEQ ID NO: 125376 - protein, 9 aa, Homo Sapiens
EDSAPSRKL

SEQ ID NO: 125377 - protein, 9 aa, Homo Sapiens
RTLYSMSCM

SEQ ID NO: 125378 - protein, 9 aa, Homo Sapiens
LSVQCEGVL

SEQ ID NO: 125379 - protein, 9 aa, Homo Sapiens
VRYRPDLDL

SEQ ID NO: 125380 - protein, 9 aa, Homo Sapiens
PGQGRAVNF

SEQ ID NO: 125381 - protein, 9 aa, Homo Sapiens
TWASLSNTS

SEQ ID NO: 125382 - protein, 9 aa, Homo Sapiens
GPPKARCPR

SEQ ID NO: 125383 - protein, 9 aa, Homo Sapiens
NVCFGIFHK

SEQ ID NO: 125384 - protein, 9 aa, Homo Sapiens
YPCNEYGKA

SEQ ID NO: 125385 - protein, 9 aa, Homo Sapiens
AGAHAAGPA

SEQ ID NO: 125386 - protein, 9 aa, Homo Sapiens
TSAQPPGEG

SEQ ID NO: 125387 - protein, 9 aa, Homo Sapiens
VQSMYQPQT

SEQ ID NO: 125388 - protein, 9 aa, Homo Sapiens
MGATAVTTR

SEQ ID NO: 125389 - protein, 9 aa, Homo Sapiens
DKYGLTSVP

SEQ ID NO: 125390 - protein, 9 aa, Homo Sapiens
TKKLWPMKG

SEQ ID NO: 125391 - protein, 9 aa, Homo Sapiens
PLGASPLWG

SEQ ID NO: 125392 - protein, 9 aa, Homo Sapiens
GCSGLPWPR

SEQ ID NO: 125393 - protein, 9 aa, Homo Sapiens
AVGSFRTLR

SEQ ID NO: 125394 - protein, 9 aa, Homo Sapiens
YTRVPPLMW

SEQ ID NO: 125395 - protein, 9 aa, Homo Sapiens
THPLLQACS

SEQ ID NO: 125396 - protein, 9 aa, Homo Sapiens
LESSNSQQK

SEQ ID NO: 125397 - protein, 9 aa, Homo Sapiens
ESNHLKEKE

SEQ ID NO: 125398 - protein, 9 aa, Homo Sapiens
AQECRLVGP

SEQ ID NO: 125399 - protein, 9 aa, Homo Sapiens
FQCVEKSRS

SEQ ID NO: 125400 - protein, 9 aa, Homo Sapiens
EQAIPLTRW

SEQ ID NO: 125401 - protein, 9 aa, Homo Sapiens
SPSFKEVIP

SEQ ID NO: 125402 - protein, 9 aa, Homo Sapiens
VQPAAKVGY

SEQ ID NO: 125403 - protein, 9 aa, Homo Sapiens
IAGPYVIGF

SEQ ID NO: 125404 - protein, 9 aa, Homo Sapiens
EQCEPVFQN

SEQ ID NO: 125405 - protein, 9 aa, Homo Sapiens
NAGPVGEMV

SEQ ID NO: 125406 - protein, 9 aa, Homo Sapiens
KGNYGKVPL

SEQ ID NO: 125407 - protein, 9 aa, Homo Sapiens
PHKASKLDD

SEQ ID NO: 125408 - protein, 9 aa, Homo Sapiens
LDTSLRKSF

SEQ ID NO: 125409 - protein, 9 aa, Homo Sapiens
RKRMEKDPN

SEQ ID NO: 125410 - protein, 9 aa, Homo Sapiens
NWTHLLQRC

SEQ ID NO: 125411 - protein, 9 aa, Homo Sapiens
KKILTSEDS

SEQ ID NO: 125412 - protein, 9 aa, Homo Sapiens
SQPQTPASP

SEQ ID NO: 125413 - protein, 9 aa, Homo Sapiens
ETNGPRKGT

SEQ ID NO: 125414 - protein, 9 aa, Homo Sapiens
CYDYLWRVS

SEQ ID NO: 125415 - protein, 9 aa, Homo Sapiens
SANIFSEVR

SEQ ID NO: 125416 - protein, 9 aa, Homo Sapiens
LKLFPESRV

SEQ ID NO: 125417 - protein, 9 aa, Homo Sapiens
SDGRSRIRH

SEQ ID NO: 125418 - protein, 9 aa, Homo Sapiens
VGHLDAIGP

SEQ ID NO: 125419 - protein, 9 aa, Homo Sapiens
SVDFSLFCA

SEQ ID NO: 125420 - protein, 9 aa, Homo Sapiens
PLHDGALRA

SEQ ID NO: 125421 - protein, 9 aa, Homo Sapiens
RRPPSAASR

SEQ ID NO: 125422 - protein, 9 aa, Homo Sapiens
GTVNMDDMM

SEQ ID NO: 125423 - protein, 9 aa, Homo Sapiens
NVLKGLCGV

SEQ ID NO: 125424 - protein, 9 aa, Homo Sapiens
EKVHIDQHK

SEQ ID NO: 125425 - protein, 9 aa, Homo Sapiens
FGLWFRLFH

SEQ ID NO: 125426 - protein, 9 aa, Homo Sapiens
QQHCAKETP

SEQ ID NO: 125427 - protein, 9 aa, Homo Sapiens
LLQDMLSPN

SEQ ID NO: 125428 - protein, 9 aa, Homo Sapiens
ENILKRQIR

SEQ ID NO: 125429 - protein, 9 aa, Homo Sapiens
HIPHLTCDS

SEQ ID NO: 125430 - protein, 9 aa, Homo Sapiens
PSGDAFASW

SEQ ID NO: 125431 - protein, 9 aa, Homo Sapiens
NLGPCCEAL

SEQ ID NO: 125432 - protein, 9 aa, Homo Sapiens
ELKKKIRDM

SEQ ID NO: 125433 - protein, 9 aa, Homo Sapiens
NKLSSEKNS

SEQ ID NO: 125434 - protein, 9 aa, Homo Sapiens
PLISYIEVD

SEQ ID NO: 125435 - protein, 9 aa, Homo Sapiens
GFLSDSLLD

SEQ ID NO: 125436 - protein, 9 aa, Homo Sapiens
SLAKEQAIV

SEQ ID NO: 125437 - protein, 9 aa, Homo Sapiens
IATALSLKN

SEQ ID NO: 125438 - protein, 9 aa, Homo Sapiens
SGIDFGVVS

SEQ ID NO: 125439 - protein, 9 aa, Homo Sapiens
CKPSCCMTT

SEQ ID NO: 125440 - protein, 9 aa, Homo Sapiens
SGALIPWLL

SEQ ID NO: 125441 - protein, 9 aa, Homo Sapiens
VVVDTDKLR

SEQ ID NO: 125442 - protein, 9 aa, Homo Sapiens
ELPDFFRDY

SEQ ID NO: 125443 - protein, 9 aa, Homo Sapiens
ELMHRQGQD

SEQ ID NO: 125444 - protein, 9 aa, Homo Sapiens
PSLESGGAP

SEQ ID NO: 125445 - protein, 9 aa, Homo Sapiens
LNPFLQLSC

SEQ ID NO: 125446 - protein, 9 aa, Homo Sapiens
LPFFLLFTW

SEQ ID NO: 125447 - protein, 9 aa, Homo Sapiens
RTAKKSRRN

SEQ ID NO: 125448 - protein, 9 aa, Homo Sapiens
PSPTIPCPT

SEQ ID NO: 125449 - protein, 9 aa, Homo Sapiens
LREEEVARL

SEQ ID NO: 125450 - protein, 9 aa, Homo Sapiens
ESLVEKHLM

SEQ ID NO: 125451 - protein, 9 aa, Homo Sapiens
GSLAKEQAI

SEQ ID NO: 125452 - protein, 9 aa, Homo Sapiens
KQKTELDTF

SEQ ID NO: 125453 - protein, 9 aa, Homo Sapiens
VCASVVQVM

SEQ ID NO: 125454 - protein, 9 aa, Homo Sapiens
EKQKTELDT

SEQ ID NO: 125455 - protein, 9 aa, Homo Sapiens
YKQDRDITL

SEQ ID NO: 125456 - protein, 9 aa, Homo Sapiens
FEFNNEIKK

SEQ ID NO: 125457 - protein, 9 aa, Homo Sapiens
LLLIAYYGL

SEQ ID NO: 125458 - protein, 9 aa, Homo Sapiens
PSDVAVEWE

SEQ ID NO: 125459 - protein, 9 aa, Homo Sapiens
GHLDAIGPR

SEQ ID NO: 125460 - protein, 9 aa, Homo Sapiens
STGHTKRIT

SEQ ID NO: 125461 - protein, 9 aa, Homo Sapiens
KVSSTSTPE

SEQ ID NO: 125462 - protein, 9 aa, Homo Sapiens
LVLRNISTV

SEQ ID NO: 125463 - protein, 9 aa, Homo Sapiens
ARSLDLVLH

SEQ ID NO: 125464 - protein, 9 aa, Homo Sapiens
ATQLAFFLM

SEQ ID NO: 125465 - protein, 9 aa, Homo Sapiens
RSTSTSTIS

SEQ ID NO: 125466 - protein, 9 aa, Homo Sapiens
SPQGTLYSL

SEQ ID NO: 125467 - protein, 9 aa, Homo Sapiens
WVLCRTHSQ

SEQ ID NO: 125468 - protein, 9 aa, Homo Sapiens
KKLILILRI

SEQ ID NO: 125469 - protein, 9 aa, Homo Sapiens
DIWLEALSS

SEQ ID NO: 125470 - protein, 9 aa, Homo Sapiens
LCLALIAGP

SEQ ID NO: 125471 - protein, 9 aa, Homo Sapiens
PPHTIQVSE

SEQ ID NO: 125472 - protein, 9 aa, Homo Sapiens
QDAHQLLSG

SEQ ID NO: 125473 - protein, 9 aa, Homo Sapiens
PGTHRVAQV

SEQ ID NO: 125474 - protein, 9 aa, Homo Sapiens
LQPNGSLFY

SEQ ID NO: 125475 - protein, 9 aa, Homo Sapiens
IYAIYGLIE

SEQ ID NO: 125476 - protein, 9 aa, Homo Sapiens
RISWELESS

SEQ ID NO: 125477 - protein, 9 aa, Homo Sapiens
KKTKQRLQN

SEQ ID NO: 125478 - protein, 9 aa, Homo Sapiens
CSQVKLGSV

SEQ ID NO: 125479 - protein, 9 aa, Homo Sapiens
PTRKMPPST

SEQ ID NO: 125480 - protein, 9 aa, Homo Sapiens
GQLLPLLPR

SEQ ID NO: 125481 - protein, 9 aa, Homo Sapiens
LLSNGTYWW

SEQ ID NO: 125482 - protein, 9 aa, Homo Sapiens
HPWTCFVQL

SEQ ID NO: 125483 - protein, 9 aa, Homo Sapiens
PVDLAEFPV

SEQ ID NO: 125484 - protein, 9 aa, Homo Sapiens
YSVRYRPDL

SEQ ID NO: 125485 - protein, 9 aa, Homo Sapiens
AISEKTTDF

SEQ ID NO: 125486 - protein, 9 aa, Homo Sapiens
DELPASPAN

SEQ ID NO: 125487 - protein, 9 aa, Homo Sapiens
QGGCLLLLS

SEQ ID NO: 125488 - protein, 9 aa, Homo Sapiens
YVELTFLAP

SEQ ID NO: 125489 - protein, 9 aa, Homo Sapiens
EAEEKSVVL

SEQ ID NO: 125490 - protein, 9 aa, Homo Sapiens
VSLGEEFFV

SEQ ID NO: 125491 - protein, 9 aa, Homo Sapiens
TPRRSSFIK

SEQ ID NO: 125492 - protein, 9 aa, Homo Sapiens
MSGKATKPK

SEQ ID NO: 125493 - protein, 9 aa, Homo Sapiens
LDAADLHMS

SEQ ID NO: 125494 - protein, 9 aa, Homo Sapiens
PFPLGTADQ

SEQ ID NO: 125495 - protein, 9 aa, Homo Sapiens
EKQLGLCPS

SEQ ID NO: 125496 - protein, 9 aa, Homo Sapiens
RHSEHRVHG

SEQ ID NO: 125497 - protein, 9 aa, Homo Sapiens
FVCTKAGGV

SEQ ID NO: 125498 - protein, 9 aa, Homo Sapiens
AQLIVTKEE

SEQ ID NO: 125499 - protein, 9 aa, Homo Sapiens
NQENHPPYP

SEQ ID NO: 125500 - protein, 9 aa, Homo Sapiens
FKLNTKHFL

SEQ ID NO: 125501 - protein, 9 aa, Homo Sapiens
FSIEPAILL

SEQ ID NO: 125502 - protein, 9 aa, Homo Sapiens
TSLGHRAAQ

SEQ ID NO: 125503 - protein, 9 aa, Homo Sapiens
KNPSLALMC

SEQ ID NO: 125504 - protein, 9 aa, Homo Sapiens
MRCLLKVQF

SEQ ID NO: 125505 - protein, 9 aa, Homo Sapiens
GVQPSAGYR

SEQ ID NO: 125506 - protein, 9 aa, Homo Sapiens
LPKAIMTSV

SEQ ID NO: 125507 - protein, 9 aa, Homo Sapiens
RAAPPPPQI

SEQ ID NO: 125508 - protein, 9 aa, Homo Sapiens
AILAGLCTS

SEQ ID NO: 125509 - protein, 9 aa, Homo Sapiens
ALVHAVQDA

SEQ ID NO: 125510 - protein, 9 aa, Homo Sapiens
LFNKKENTL

SEQ ID NO: 125511 - protein, 9 aa, Homo Sapiens
QVYIPKSLG

SEQ ID NO: 125512 - protein, 9 aa, Homo Sapiens
NIMKPTPGP

SEQ ID NO: 125513 - protein, 9 aa, Homo Sapiens
RSTQTQTST

SEQ ID NO: 125514 - protein, 9 aa, Homo Sapiens
HQDELDFLM

SEQ ID NO: 125515 - protein, 9 aa, Homo Sapiens
ISEKTTDFK

SEQ ID NO: 125516 - protein, 9 aa, Homo Sapiens
VPLHDGALR

SEQ ID NO: 125517 - protein, 9 aa, Homo Sapiens
PRSSCSRPS

SEQ ID NO: 125518 - protein, 9 aa, Homo Sapiens
IRSVKMTFV

SEQ ID NO: 125519 - protein, 9 aa, Homo Sapiens
ALEQEQRHV

SEQ ID NO: 125520 - protein, 9 aa, Homo Sapiens
DTKNNLLRQ

SEQ ID NO: 125521 - protein, 9 aa, Homo Sapiens
LRLALRALL

SEQ ID NO: 125522 - protein, 9 aa, Homo Sapiens
MVDSDVAFI

SEQ ID NO: 125523 - protein, 9 aa, Homo Sapiens
QKFHTEDLL

SEQ ID NO: 125524 - protein, 9 aa, Homo Sapiens
AEATVAAAR

SEQ ID NO: 125525 - protein, 9 aa, Homo Sapiens
TTVTALEDE

SEQ ID NO: 125526 - protein, 9 aa, Homo Sapiens
ASLIDQMSS

SEQ ID NO: 125527 - protein, 9 aa, Homo Sapiens
AKTGPLPPL

SEQ ID NO: 125528 - protein, 9 aa, Homo Sapiens
EALVAMPPG

SEQ ID NO: 125529 - protein, 9 aa, Homo Sapiens
VMEILCTVF

SEQ ID NO: 125530 - protein, 9 aa, Homo Sapiens
NWAQYRQVE

SEQ ID NO: 125531 - protein, 9 aa, Homo Sapiens
TEYSSSVDF

SEQ ID NO: 125532 - protein, 9 aa, Homo Sapiens
VVNKRNGAE

SEQ ID NO: 125533 - protein, 9 aa, Homo Sapiens
DYASDSAEK

SEQ ID NO: 125534 - protein, 9 aa, Homo Sapiens
RGGTTIGEV

SEQ ID NO: 125535 - protein, 9 aa, Homo Sapiens
TVQNILEEI

SEQ ID NO: 125536 - protein, 9 aa, Homo Sapiens
NYVPWWATH

SEQ ID NO: 125537 - protein, 9 aa, Homo Sapiens
MKDYTITCG

SEQ ID NO: 125538 - protein, 9 aa, Homo Sapiens
AATPSCCRR

SEQ ID NO: 125539 - protein, 9 aa, Homo Sapiens
EPTPRLGHV

SEQ ID NO: 125540 - protein, 9 aa, Homo Sapiens
EVVKKPRAS

SEQ ID NO: 125541 - protein, 9 aa, Homo Sapiens
DTYLHRAAR

SEQ ID NO: 125542 - protein, 9 aa, Homo Sapiens
PGVPGRLCA

SEQ ID NO: 125543 - protein, 9 aa, Homo Sapiens
EVITGTVQE

SEQ ID NO: 125544 - protein, 9 aa, Homo Sapiens
EEEDEEYVE

SEQ ID NO: 125545 - protein, 9 aa, Homo Sapiens
LIVLPGEMI

SEQ ID NO: 125546 - protein, 9 aa, Homo Sapiens
SNSDGARPV

SEQ ID NO: 125547 - protein, 9 aa, Homo Sapiens
ATQRPSTRP

SEQ ID NO: 125548 - protein, 9 aa, Homo Sapiens
FVRNYVPWW

SEQ ID NO: 125549 - protein, 9 aa, Homo Sapiens
VVRDWNDMK

SEQ ID NO: 125550 - protein, 9 aa, Homo Sapiens
EEVARLFKQ

SEQ ID NO: 125551 - protein, 9 aa, Homo Sapiens
EAFEVSQRA

SEQ ID NO: 125552 - protein, 9 aa, Homo Sapiens
GRGLPRTNF

SEQ ID NO: 125553 - protein, 9 aa, Homo Sapiens
DKTQKVQMK

SEQ ID NO: 125554 - protein, 9 aa, Homo Sapiens
MSHLGIWGE

SEQ ID NO: 125555 - protein, 9 aa, Homo Sapiens
DQGSMQENY

SEQ ID NO: 125556 - protein, 9 aa, Homo Sapiens
LFVVVDFFG

SEQ ID NO: 125557 - protein, 9 aa, Homo Sapiens
AGASLRPCK

SEQ ID NO: 125558 - protein, 9 aa, Homo Sapiens
KGKSHLVIV

SEQ ID NO: 125559 - protein, 9 aa, Homo Sapiens
HLRVVPLLP

SEQ ID NO: 125560 - protein, 9 aa, Homo Sapiens
TYRVCMLAA

SEQ ID NO: 125561 - protein, 9 aa, Homo Sapiens
YRLIMPPIK

SEQ ID NO: 125562 - protein, 9 aa, Homo Sapiens
AGVPAGWGL

SEQ ID NO: 125563 - protein, 9 aa, Homo Sapiens
KMDRSTAAT

SEQ ID NO: 125564 - protein, 9 aa, Homo Sapiens
SSTRKPPRL

SEQ ID NO: 125565 - protein, 9 aa, Homo Sapiens
KECGKVFTQ

SEQ ID NO: 125566 - protein, 9 aa, Homo Sapiens
TETPTLQPT

SEQ ID NO: 125567 - protein, 9 aa, Homo Sapiens
AGKYHSVCR

SEQ ID NO: 125568 - protein, 9 aa, Homo Sapiens
TSLLIALGM

SEQ ID NO: 125569 - protein, 9 aa, Homo Sapiens
KPFHIAAAA

SEQ ID NO: 125570 - protein, 9 aa, Homo Sapiens
IHCYMALCS

SEQ ID NO: 125571 - protein, 9 aa, Homo Sapiens
FRFTSHGSP

SEQ ID NO: 125572 - protein, 9 aa, Homo Sapiens
WKRRKVFRK

SEQ ID NO: 125573 - protein, 9 aa, Homo Sapiens
RSEQDGPAP

SEQ ID NO: 125574 - protein, 9 aa, Homo Sapiens
VVKFMAKHL

SEQ ID NO: 125575 - protein, 9 aa, Homo Sapiens
RSIHNFCLV

SEQ ID NO: 125576 - protein, 9 aa, Homo Sapiens
LPHPHPTPT

SEQ ID NO: 125577 - protein, 9 aa, Homo Sapiens
WAEATVAAA

SEQ ID NO: 125578 - protein, 9 aa, Homo Sapiens
KKLYHHKSS

SEQ ID NO: 125579 - protein, 9 aa, Homo Sapiens
PHGLLSKSA

SEQ ID NO: 125580 - protein, 9 aa, Homo Sapiens
SYMNLAYNS

SEQ ID NO: 125581 - protein, 9 aa, Homo Sapiens
VASPTSVRQ

SEQ ID NO: 125582 - protein, 9 aa, Homo Sapiens
LLAVSSVLL

SEQ ID NO: 125583 - protein, 9 aa, Homo Sapiens
EGQRLALEV

SEQ ID NO: 125584 - protein, 9 aa, Homo Sapiens
FTLILSTSQ

SEQ ID NO: 125585 - protein, 9 aa, Homo Sapiens
WGQRKKNDS

SEQ ID NO: 125586 - protein, 9 aa, Homo Sapiens
CADTTLFEI

SEQ ID NO: 125587 - protein, 9 aa, Homo Sapiens
PVGEMVPTF

SEQ ID NO: 125588 - protein, 9 aa, Homo Sapiens
IENVQPILQ

SEQ ID NO: 125589 - protein, 9 aa, Homo Sapiens
DEQISGSVS

SEQ ID NO: 125590 - protein, 9 aa, Homo Sapiens
KPTDYSPEV

SEQ ID NO: 125591 - protein, 9 aa, Homo Sapiens
EWGCLCGRC

SEQ ID NO: 125592 - protein, 9 aa, Homo Sapiens
WWCRCPLSY

SEQ ID NO: 125593 - protein, 9 aa, Homo Sapiens
NTSVYSSSK

SEQ ID NO: 125594 - protein, 9 aa, Homo Sapiens
ATPGTHRVA

SEQ ID NO: 125595 - protein, 9 aa, Homo Sapiens
LLRLHRPWA

SEQ ID NO: 125596 - protein, 9 aa, Homo Sapiens
KQKMLLEKQ

SEQ ID NO: 125597 - protein, 9 aa, Homo Sapiens
YMKCVHPFI

SEQ ID NO: 125598 - protein, 9 aa, Homo Sapiens
CRYLESARC

SEQ ID NO: 125599 - protein, 9 aa, Homo Sapiens
HGGPPKARC

SEQ ID NO: 125600 - protein, 9 aa, Homo Sapiens
HTHTHTLTH

SEQ ID NO: 125601 - protein, 9 aa, Homo Sapiens
GEKSFEYKE

SEQ ID NO: 125602 - protein, 9 aa, Homo Sapiens
GKVFNQQVH

SEQ ID NO: 125603 - protein, 9 aa, Homo Sapiens
LQACSPSAC

SEQ ID NO: 125604 - protein, 9 aa, Homo Sapiens
LMVTTYTVF

SEQ ID NO: 125605 - protein, 9 aa, Homo Sapiens
EVTGGHEEA

SEQ ID NO: 125606 - protein, 9 aa, Homo Sapiens
WAGSVAIAA

SEQ ID NO: 125607 - protein, 9 aa, Homo Sapiens
SSANTSTPP

SEQ ID NO: 125608 - protein, 9 aa, Homo Sapiens
SSSRRNRSS

SEQ ID NO: 125609 - protein, 9 aa, Homo Sapiens
ARAAVSPPA

SEQ ID NO: 125610 - protein, 9 aa, Homo Sapiens
PQSALGAAA

SEQ ID NO: 125611 - protein, 9 aa, Homo Sapiens
RVPGCARGP

SEQ ID NO: 125612 - protein, 9 aa, Homo Sapiens
AYSIQRQHT

SEQ ID NO: 125613 - protein, 9 aa, Homo Sapiens
TALSLKNFF

SEQ ID NO: 125614 - protein, 9 aa, Homo Sapiens
STLAPASRG

SEQ ID NO: 125615 - protein, 9 aa, Homo Sapiens
ADGAFKTSE

SEQ ID NO: 125616 - protein, 9 aa, Homo Sapiens
KLVVVGAGD

SEQ ID NO: 125617 - protein, 9 aa, Homo Sapiens
TPGSGPSSP

SEQ ID NO: 125618 - protein, 9 aa, Homo Sapiens
KINLRTCDR

SEQ ID NO: 125619 - protein, 9 aa, Homo Sapiens
GGQPRFNDH

SEQ ID NO: 125620 - protein, 9 aa, Homo Sapiens
EKLQEVVKK

SEQ ID NO: 125621 - protein, 9 aa, Homo Sapiens
RQVHSPSLL

SEQ ID NO: 125622 - protein, 9 aa, Homo Sapiens
PPSAMTLPY

SEQ ID NO: 125623 - protein, 9 aa, Homo Sapiens
PGEMIKDVA

SEQ ID NO: 125624 - protein, 9 aa, Homo Sapiens
PFIVKRHYA

SEQ ID NO: 125625 - protein, 9 aa, Homo Sapiens
VELRGTEAV

SEQ ID NO: 125626 - protein, 9 aa, Homo Sapiens
VQGPAGLPL

SEQ ID NO: 125627 - protein, 9 aa, Homo Sapiens
ENGVRHEQE

SEQ ID NO: 125628 - protein, 9 aa, Homo Sapiens
YQDLDGAGV

SEQ ID NO: 125629 - protein, 9 aa, Homo Sapiens
SSLSSVWPS

SEQ ID NO: 125630 - protein, 9 aa, Homo Sapiens
QMAHAGQPG

SEQ ID NO: 125631 - protein, 9 aa, Homo Sapiens
HRAARAGRF

SEQ ID NO: 125632 - protein, 9 aa, Homo Sapiens
FFHAPSRRG

SEQ ID NO: 125633 - protein, 9 aa, Homo Sapiens
TGTTTTGAT

SEQ ID NO: 125634 - protein, 9 aa, Homo Sapiens
LRYIETQHF

SEQ ID NO: 125635 - protein, 9 aa, Homo Sapiens
MVSNQKIKL

SEQ ID NO: 125636 - protein, 9 aa, Homo Sapiens
LHHCSMRYS

SEQ ID NO: 125637 - protein, 9 aa, Homo Sapiens
ELSDFQINV

SEQ ID NO: 125638 - protein, 9 aa, Homo Sapiens
TVSWSQPDQ

SEQ ID NO: 125639 - protein, 9 aa, Homo Sapiens
GLSQYSQVF

SEQ ID NO: 125640 - protein, 9 aa, Homo Sapiens
LFGMFWAAY

SEQ ID NO: 125641 - protein, 9 aa, Homo Sapiens
SEFYSLQEQ

SEQ ID NO: 125642 - protein, 9 aa, Homo Sapiens
LESQGLYSN

SEQ ID NO: 125643 - protein, 9 aa, Homo Sapiens
MIMTMNPFL

SEQ ID NO: 125644 - protein, 9 aa, Homo Sapiens
IGGATRDVA

SEQ ID NO: 125645 - protein, 9 aa, Homo Sapiens
AFSSALYRE

SEQ ID NO: 125646 - protein, 9 aa, Homo Sapiens
FLPQSALGA

SEQ ID NO: 125647 - protein, 9 aa, Homo Sapiens
RPCKLDFFR

SEQ ID NO: 125648 - protein, 9 aa, Homo Sapiens
LDAIGPREQ

SEQ ID NO: 125649 - protein, 9 aa, Homo Sapiens
YLNEFEELV

SEQ ID NO: 125650 - protein, 9 aa, Homo Sapiens
KPLQTVRLM

SEQ ID NO: 125651 - protein, 9 aa, Homo Sapiens
EEEIVHKLM

SEQ ID NO: 125652 - protein, 9 aa, Homo Sapiens
GGTSSGLGS

SEQ ID NO: 125653 - protein, 9 aa, Homo Sapiens
NITPQTTLE

SEQ ID NO: 125654 - protein, 9 aa, Homo Sapiens
QMATKIVQA

SEQ ID NO: 125655 - protein, 9 aa, Homo Sapiens
RKSGTHQMR

SEQ ID NO: 125656 - protein, 9 aa, Homo Sapiens
ERLQMNLDV

SEQ ID NO: 125657 - protein, 9 aa, Homo Sapiens
LGLWLIYYS

SEQ ID NO: 125658 - protein, 9 aa, Homo Sapiens
VVLDLPQPL

SEQ ID NO: 125659 - protein, 9 aa, Homo Sapiens
HKWLLELNQ

SEQ ID NO: 125660 - protein, 9 aa, Homo Sapiens
SPPASHLSR

SEQ ID NO: 125661 - protein, 9 aa, Homo Sapiens
EEFFVDQLR

SEQ ID NO: 125662 - protein, 9 aa, Homo Sapiens
EKAAWHHMP

SEQ ID NO: 125663 - protein, 9 aa, Homo Sapiens
GFRQCVNTF

SEQ ID NO: 125664 - protein, 9 aa, Homo Sapiens
KLLLGFLVR

SEQ ID NO: 125665 - protein, 9 aa, Homo Sapiens
LPQPLAEPF

SEQ ID NO: 125666 - protein, 9 aa, Homo Sapiens
PVRSPPPPA

SEQ ID NO: 125667 - protein, 9 aa, Homo Sapiens
NSRPSESCL

SEQ ID NO: 125668 - protein, 9 aa, Homo Sapiens
MLKSFTYEY

SEQ ID NO: 125669 - protein, 9 aa, Homo Sapiens
SCVGGFLHA

SEQ ID NO: 125670 - protein, 9 aa, Homo Sapiens
FSNENYVPH

SEQ ID NO: 125671 - protein, 9 aa, Homo Sapiens
AWRGHGHCF

SEQ ID NO: 125672 - protein, 9 aa, Homo Sapiens
DPIMEKFGI

SEQ ID NO: 125673 - protein, 9 aa, Homo Sapiens
LHFLKKLIL

SEQ ID NO: 125674 - protein, 9 aa, Homo Sapiens
KMPLKKSRQ

SEQ ID NO: 125675 - protein, 9 aa, Homo Sapiens
PTLSPAITS

SEQ ID NO: 125676 - protein, 9 aa, Homo Sapiens
YFTVPRADL

SEQ ID NO: 125677 - protein, 9 aa, Homo Sapiens
IHTHTHTHT

SEQ ID NO: 125678 - protein, 9 aa, Homo Sapiens
IETESTTRP

SEQ ID NO: 125679 - protein, 9 aa, Homo Sapiens
KFYRMKHHY

SEQ ID NO: 125680 - protein, 9 aa, Homo Sapiens
VDNWIDHWC

SEQ ID NO: 125681 - protein, 9 aa, Homo Sapiens
APPHVDEEP

SEQ ID NO: 125682 - protein, 9 aa, Homo Sapiens
PPVVQLHNS

SEQ ID NO: 125683 - protein, 9 aa, Homo Sapiens
HCWVTRHAV

SEQ ID NO: 125684 - protein, 9 aa, Homo Sapiens
WASLLGKKL

SEQ ID NO: 125685 - protein, 9 aa, Homo Sapiens
RCQTLNFVS

SEQ ID NO: 125686 - protein, 9 aa, Homo Sapiens
FEKICPGED

SEQ ID NO: 125687 - protein, 9 aa, Homo Sapiens
RSVIENVIE

SEQ ID NO: 125688 - protein, 9 aa, Homo Sapiens
HRSRCTTPP

SEQ ID NO: 125689 - protein, 9 aa, Homo Sapiens
HLFRVASKR

SEQ ID NO: 125690 - protein, 9 aa, Homo Sapiens
KLSILRSNP

SEQ ID NO: 125691 - protein, 9 aa, Homo Sapiens
PPSPILYAW

SEQ ID NO: 125692 - protein, 9 aa, Homo Sapiens
CAQGLQKRL

SEQ ID NO: 125693 - protein, 9 aa, Homo Sapiens
AKETWNCWA

SEQ ID NO: 125694 - protein, 9 aa, Homo Sapiens
DEVLGLFFH

SEQ ID NO: 125695 - protein, 9 aa, Homo Sapiens
PNYQFVCQN

SEQ ID NO: 125696 - protein, 9 aa, Homo Sapiens
QSALGAAAK

SEQ ID NO: 125697 - protein, 9 aa, Homo Sapiens
RRPPGVPLA

SEQ ID NO: 125698 - protein, 9 aa, Homo Sapiens
CSSTPGSGP

SEQ ID NO: 125699 - protein, 9 aa, Homo Sapiens
EGYSVAAMF

SEQ ID NO: 125700 - protein, 9 aa, Homo Sapiens
FVLLGTIIQ

SEQ ID NO: 125701 - protein, 9 aa, Homo Sapiens
GYKLCGRTH

SEQ ID NO: 125702 - protein, 9 aa, Homo Sapiens
YEGENTVLC

SEQ ID NO: 125703 - protein, 9 aa, Homo Sapiens
SEVAIMAPF

SEQ ID NO: 125704 - protein, 9 aa, Homo Sapiens
NLDVTTTQL

SEQ ID NO: 125705 - protein, 9 aa, Homo Sapiens
IVAPMLESQ

SEQ ID NO: 125706 - protein, 9 aa, Homo Sapiens
QLHMHLVWG

SEQ ID NO: 125707 - protein, 9 aa, Homo Sapiens
PTKKRGKSQ

SEQ ID NO: 125708 - protein, 9 aa, Homo Sapiens
SFKEVIPHM

SEQ ID NO: 125709 - protein, 9 aa, Homo Sapiens
PSPWSCSNI

SEQ ID NO: 125710 - protein, 9 aa, Homo Sapiens
CFPFSVVWR

SEQ ID NO: 125711 - protein, 9 aa, Homo Sapiens
LINDIRSPC

SEQ ID NO: 125712 - protein, 9 aa, Homo Sapiens
HPQQQLQPF

SEQ ID NO: 125713 - protein, 9 aa, Homo Sapiens
KTKKIYNEF

SEQ ID NO: 125714 - protein, 9 aa, Homo Sapiens
EEEQGKKRK

SEQ ID NO: 125715 - protein, 9 aa, Homo Sapiens
RAALAGAHA

SEQ ID NO: 125716 - protein, 9 aa, Homo Sapiens
ICRSMEVLT

SEQ ID NO: 125717 - protein, 9 aa, Homo Sapiens
IELCFQSAV

SEQ ID NO: 125718 - protein, 9 aa, Homo Sapiens
FYSYMNLAY

SEQ ID NO: 125719 - protein, 9 aa, Homo Sapiens
VEQVAEVGD

SEQ ID NO: 125720 - protein, 9 aa, Homo Sapiens
DMFTTPQYR

SEQ ID NO: 125721 - protein, 9 aa, Homo Sapiens
HRQRWGGTT

SEQ ID NO: 125722 - protein, 9 aa, Homo Sapiens
LQKRLHNNL

SEQ ID NO: 125723 - protein, 9 aa, Homo Sapiens
SGVSKVTEV

SEQ ID NO: 125724 - protein, 9 aa, Homo Sapiens
IKAINTFFC

SEQ ID NO: 125725 - protein, 9 aa, Homo Sapiens
GFPNVYIKN

SEQ ID NO: 125726 - protein, 9 aa, Homo Sapiens
CFALPLCWA

SEQ ID NO: 125727 - protein, 9 aa, Homo Sapiens
ILLGIILWL

SEQ ID NO: 125728 - protein, 9 aa, Homo Sapiens
NASRPPQAT

SEQ ID NO: 125729 - protein, 9 aa, Homo Sapiens
AHGGPRGRA

SEQ ID NO: 125730 - protein, 9 aa, Homo Sapiens
PSRPPSSST

SEQ ID NO: 125731 - protein, 9 aa, Homo Sapiens
LGHVVFSIE

SEQ ID NO: 125732 - protein, 9 aa, Homo Sapiens
ATGFPAWEV

SEQ ID NO: 125733 - protein, 9 aa, Homo Sapiens
QESKKNSLE

SEQ ID NO: 125734 - protein, 9 aa, Homo Sapiens
ELEKATKHC

SEQ ID NO: 125735 - protein, 9 aa, Homo Sapiens
AGTAGARHH

SEQ ID NO: 125736 - protein, 9 aa, Homo Sapiens
KTFWTERPV

SEQ ID NO: 125737 - protein, 9 aa, Homo Sapiens
REQRKKKYQ

SEQ ID NO: 125738 - protein, 9 aa, Homo Sapiens
APGRPYGPP

SEQ ID NO: 125739 - protein, 9 aa, Homo Sapiens
NTLNDALFY

SEQ ID NO: 125740 - protein, 9 aa, Homo Sapiens
QKGSVDRHG

SEQ ID NO: 125741 - protein, 9 aa, Homo Sapiens
ALQKAQVTL

SEQ ID NO: 125742 - protein, 9 aa, Homo Sapiens
TSGPEKNPS

SEQ ID NO: 125743 - protein, 9 aa, Homo Sapiens
EKIINPTIS

SEQ ID NO: 125744 - protein, 9 aa, Homo Sapiens
RYSGTQNDV

SEQ ID NO: 125745 - protein, 9 aa, Homo Sapiens
VLGCQPDFH

SEQ ID NO: 125746 - protein, 9 aa, Homo Sapiens
LFWLSSCPA

SEQ ID NO: 125747 - protein, 9 aa, Homo Sapiens
NGEYARYYE

SEQ ID NO: 125748 - protein, 9 aa, Homo Sapiens
DKEASTHIS

SEQ ID NO: 125749 - protein, 9 aa, Homo Sapiens
ILKRQIRRE

SEQ ID NO: 125750 - protein, 9 aa, Homo Sapiens
PPIKNTHPL

SEQ ID NO: 125751 - protein, 9 aa, Homo Sapiens
RRKFHRPTG

SEQ ID NO: 125752 - protein, 9 aa, Homo Sapiens
LACDFLVRG

SEQ ID NO: 125753 - protein, 9 aa, Homo Sapiens
LQQRLEDEL

SEQ ID NO: 125754 - protein, 9 aa, Homo Sapiens
SGPDGYKRD

SEQ ID NO: 125755 - protein, 9 aa, Homo Sapiens
RDITLLDLI

SEQ ID NO: 125756 - protein, 9 aa, Homo Sapiens
LRRRSGLHP

SEQ ID NO: 125757 - protein, 9 aa, Homo Sapiens
FKVLRDGAR

SEQ ID NO: 125758 - protein, 9 aa, Homo Sapiens
LEISPKLQT

SEQ ID NO: 125759 - protein, 9 aa, Homo Sapiens
ANIFSEVRY

SEQ ID NO: 125760 - protein, 9 aa, Homo Sapiens
AEVGDRKGV

SEQ ID NO: 125761 - protein, 9 aa, Homo Sapiens
KDEQISGSV

SEQ ID NO: 125762 - protein, 9 aa, Homo Sapiens
GANAVWYRA

SEQ ID NO: 125763 - protein, 9 aa, Homo Sapiens
EMHMRGLLE

SEQ ID NO: 125764 - protein, 9 aa, Homo Sapiens
PAMSPAGPQ

SEQ ID NO: 125765 - protein, 9 aa, Homo Sapiens
CVPAQKIWK

SEQ ID NO: 125766 - protein, 9 aa, Homo Sapiens
EEGYHLPAP

SEQ ID NO: 125767 - protein, 9 aa, Homo Sapiens
NNFIFNGNN

SEQ ID NO: 125768 - protein, 9 aa, Homo Sapiens
GNKEAKKEA

SEQ ID NO: 125769 - protein, 9 aa, Homo Sapiens
PLHRPTLSP

SEQ ID NO: 125770 - protein, 9 aa, Homo Sapiens
FEISTTSNK

SEQ ID NO: 125771 - protein, 9 aa, Homo Sapiens
LDKPHKASK

SEQ ID NO: 125772 - protein, 9 aa, Homo Sapiens
WREHLTKFN

SEQ ID NO: 125773 - protein, 9 aa, Homo Sapiens
EMAETRISL

SEQ ID NO: 125774 - protein, 9 aa, Homo Sapiens
GCQPDFHMA

SEQ ID NO: 125775 - protein, 9 aa, Homo Sapiens
VGKPSHLSQ

SEQ ID NO: 125776 - protein, 9 aa, Homo Sapiens
MNKCKAMEA

SEQ ID NO: 125777 - protein, 9 aa, Homo Sapiens
RRQRERVRG

SEQ ID NO: 125778 - protein, 9 aa, Homo Sapiens
SVVLGEILE

SEQ ID NO: 125779 - protein, 9 aa, Homo Sapiens
GGCSGLPWP

SEQ ID NO: 125780 - protein, 9 aa, Homo Sapiens
LGADAAYEE

SEQ ID NO: 125781 - protein, 9 aa, Homo Sapiens
VPHQIQHAL

SEQ ID NO: 125782 - protein, 9 aa, Homo Sapiens
GDTVLVICH

SEQ ID NO: 125783 - protein, 9 aa, Homo Sapiens
KTSLMIMKF

SEQ ID NO: 125784 - protein, 9 aa, Homo Sapiens
EGGEEDLTI

SEQ ID NO: 125785 - protein, 9 aa, Homo Sapiens
GPPRPQGQQ

SEQ ID NO: 125786 - protein, 9 aa, Homo Sapiens
DELHRAARS

SEQ ID NO: 125787 - protein, 9 aa, Homo Sapiens
RGMFREDSM

SEQ ID NO: 125788 - protein, 9 aa, Homo Sapiens
KERVLMSQC

SEQ ID NO: 125789 - protein, 9 aa, Homo Sapiens
DLSQPRKNL

SEQ ID NO: 125790 - protein, 9 aa, Homo Sapiens
TAPLSGKGN

SEQ ID NO: 125791 - protein, 9 aa, Homo Sapiens
PHDEHYLLP

SEQ ID NO: 125792 - protein, 9 aa, Homo Sapiens
HSSGQKITH

SEQ ID NO: 125793 - protein, 9 aa, Homo Sapiens
RRKVFRKSG

SEQ ID NO: 125794 - protein, 9 aa, Homo Sapiens
LGGPCPQTP

SEQ ID NO: 125795 - protein, 9 aa, Homo Sapiens
KRLWPASRL

SEQ ID NO: 125796 - protein, 9 aa, Homo Sapiens
TIFPPLEKT

SEQ ID NO: 125797 - protein, 9 aa, Homo Sapiens
LQGGCLLLL

SEQ ID NO: 125798 - protein, 9 aa, Homo Sapiens
SQPLMNSCM

SEQ ID NO: 125799 - protein, 9 aa, Homo Sapiens
DAPHGIFAA

SEQ ID NO: 125800 - protein, 9 aa, Homo Sapiens
GEEWAIEVD

SEQ ID NO: 125801 - protein, 9 aa, Homo Sapiens
IEFQLTKHL

SEQ ID NO: 125802 - protein, 9 aa, Homo Sapiens
DSDSESETS

SEQ ID NO: 125803 - protein, 9 aa, Homo Sapiens
VLLGTIIQL

SEQ ID NO: 125804 - protein, 9 aa, Homo Sapiens
VKRDLNARN

SEQ ID NO: 125805 - protein, 9 aa, Homo Sapiens
VPLAKRKSD

SEQ ID NO: 125806 - protein, 9 aa, Homo Sapiens
GDPGLFRTN

SEQ ID NO: 125807 - protein, 9 aa, Homo Sapiens
PPSQDEEAQ

SEQ ID NO: 125808 - protein, 9 aa, Homo Sapiens
LYSQGSLID

SEQ ID NO: 125809 - protein, 9 aa, Homo Sapiens
SPQPISNSR

SEQ ID NO: 125810 - protein, 9 aa, Homo Sapiens
NTGDIYTPE

SEQ ID NO: 125811 - protein, 9 aa, Homo Sapiens
SHRKRNTNK

SEQ ID NO: 125812 - protein, 9 aa, Homo Sapiens
TTLFEIYAI

SEQ ID NO: 125813 - protein, 9 aa, Homo Sapiens
RSDSEFVSC

SEQ ID NO: 125814 - protein, 9 aa, Homo Sapiens
SQQEEENEG

SEQ ID NO: 125815 - protein, 9 aa, Homo Sapiens
TETPSARRR

SEQ ID NO: 125816 - protein, 9 aa, Homo Sapiens
EEETDLKAT

SEQ ID NO: 125817 - protein, 9 aa, Homo Sapiens
MCDCEGAAG

SEQ ID NO: 125818 - protein, 9 aa, Homo Sapiens
PVAHGLLQV

SEQ ID NO: 125819 - protein, 9 aa, Homo Sapiens
WVLTATHCF

SEQ ID NO: 125820 - protein, 9 aa, Homo Sapiens
WGPNGKERK

SEQ ID NO: 125821 - protein, 9 aa, Homo Sapiens
QQLRVRRRE

SEQ ID NO: 125822 - protein, 9 aa, Homo Sapiens
NLLRLQSLL

SEQ ID NO: 125823 - protein, 9 aa, Homo Sapiens
DSGSYQDLD

SEQ ID NO: 125824 - protein, 9 aa, Homo Sapiens
LNFRRNKNP

SEQ ID NO: 125825 - protein, 9 aa, Homo Sapiens
TAFFSVFMA

SEQ ID NO: 125826 - protein, 9 aa, Homo Sapiens
ENLTFNSIF

SEQ ID NO: 125827 - protein, 9 aa, Homo Sapiens
HLPPPLLWP

SEQ ID NO: 125828 - protein, 9 aa, Homo Sapiens
SRCYCDTLD

SEQ ID NO: 125829 - protein, 9 aa, Homo Sapiens
VRDWNDMKR

SEQ ID NO: 125830 - protein, 9 aa, Homo Sapiens
TSPAASASS

SEQ ID NO: 125831 - protein, 9 aa, Homo Sapiens
LNLEFGDPA

SEQ ID NO: 125832 - protein, 9 aa, Homo Sapiens
LVPTGPGGG

SEQ ID NO: 125833 - protein, 9 aa, Homo Sapiens
LYQQAMEKA

SEQ ID NO: 125834 - protein, 9 aa, Homo Sapiens
EQAETKRLE

SEQ ID NO: 125835 - protein, 9 aa, Homo Sapiens
YTHKKREGQ

SEQ ID NO: 125836 - protein, 9 aa, Homo Sapiens
CQTALNDGK

SEQ ID NO: 125837 - protein, 9 aa, Homo Sapiens
RTWYQEVPK

SEQ ID NO: 125838 - protein, 9 aa, Homo Sapiens
VTLQSMLIS

SEQ ID NO: 125839 - protein, 9 aa, Homo Sapiens
VEKLQEVVK

SEQ ID NO: 125840 - protein, 9 aa, Homo Sapiens
LHNSNPYPR

SEQ ID NO: 125841 - protein, 9 aa, Homo Sapiens
GRPSIRIQT

SEQ ID NO: 125842 - protein, 9 aa, Homo Sapiens
AITEELFFK

SEQ ID NO: 125843 - protein, 9 aa, Homo Sapiens
PSACRCPCH

SEQ ID NO: 125844 - protein, 9 aa, Homo Sapiens
YAKTILSLV

SEQ ID NO: 125845 - protein, 9 aa, Homo Sapiens
VTSKVSSTS

SEQ ID NO: 125846 - protein, 9 aa, Homo Sapiens
VNESNHLKE

SEQ ID NO: 125847 - protein, 9 aa, Homo Sapiens
SARSKANKE

SEQ ID NO: 125848 - protein, 9 aa, Homo Sapiens
LLRHHFRQQ

SEQ ID NO: 125849 - protein, 9 aa, Homo Sapiens
EEAQEAQGI

SEQ ID NO: 125850 - protein, 9 aa, Homo Sapiens
GAKHIFSTI

SEQ ID NO: 125851 - protein, 9 aa, Homo Sapiens
LPEAWPGIP

SEQ ID NO: 125852 - protein, 9 aa, Homo Sapiens
NYAMSSSLP

SEQ ID NO: 125853 - protein, 9 aa, Homo Sapiens
AKEAEAREN

SEQ ID NO: 125854 - protein, 9 aa, Homo Sapiens
AAHEFGHTL

SEQ ID NO: 125855 - protein, 9 aa, Homo Sapiens
WALGCKRWA

SEQ ID NO: 125856 - protein, 9 aa, Homo Sapiens
ACDDNEIDT

SEQ ID NO: 125857 - protein, 9 aa, Homo Sapiens
EAWPGIPGG

SEQ ID NO: 125858 - protein, 9 aa, Homo Sapiens
KWVSVRPLS

SEQ ID NO: 125859 - protein, 9 aa, Homo Sapiens
ENTDASASA

SEQ ID NO: 125860 - protein, 9 aa, Homo Sapiens
SGQAVRPCV

SEQ ID NO: 125861 - protein, 9 aa, Homo Sapiens
LMTVENING

SEQ ID NO: 125862 - protein, 9 aa, Homo Sapiens
QVPCSPLQR

SEQ ID NO: 125863 - protein, 9 aa, Homo Sapiens
REVTSGDSP

SEQ ID NO: 125864 - protein, 9 aa, Homo Sapiens
PSSAIPKLQ

SEQ ID NO: 125865 - protein, 9 aa, Homo Sapiens
YKLCGRTHM

SEQ ID NO: 125866 - protein, 9 aa, Homo Sapiens
LAWDPPPGA

SEQ ID NO: 125867 - protein, 9 aa, Homo Sapiens
DLLQDMLSP

SEQ ID NO: 125868 - protein, 9 aa, Homo Sapiens
VLAPIEVLY

SEQ ID NO: 125869 - protein, 9 aa, Homo Sapiens
NFWGEKIVA

SEQ ID NO: 125870 - protein, 9 aa, Homo Sapiens
TLTSRRRTL

SEQ ID NO: 125871 - protein, 9 aa, Homo Sapiens
MMSATVQNR

SEQ ID NO: 125872 - protein, 9 aa, Homo Sapiens
GWRATRPFH

SEQ ID NO: 125873 - protein, 9 aa, Homo Sapiens
LCCSQSPLS

SEQ ID NO: 125874 - protein, 9 aa, Homo Sapiens
LQRSGDQLA

SEQ ID NO: 125875 - protein, 9 aa, Homo Sapiens
VLRDGARKY

SEQ ID NO: 125876 - protein, 9 aa, Homo Sapiens
GLIVMLRDT

SEQ ID NO: 125877 - protein, 9 aa, Homo Sapiens
VNAVRLFPL

SEQ ID NO: 125878 - protein, 9 aa, Homo Sapiens
SREELETLF

SEQ ID NO: 125879 - protein, 9 aa, Homo Sapiens
ALREMKDYT

SEQ ID NO: 125880 - protein, 9 aa, Homo Sapiens
GPRGRAQLH

SEQ ID NO: 125881 - protein, 9 aa, Homo Sapiens
SDELVGHLD

SEQ ID NO: 125882 - protein, 9 aa, Homo Sapiens
SKMQEQQAN

SEQ ID NO: 125883 - protein, 9 aa, Homo Sapiens
GPRSPDIPQ

SEQ ID NO: 125884 - protein, 9 aa, Homo Sapiens
EPPRSSTAT

SEQ ID NO: 125885 - protein, 9 aa, Homo Sapiens
CGLHDLEYE

SEQ ID NO: 125886 - protein, 9 aa, Homo Sapiens
IKMPLKKSR

SEQ ID NO: 125887 - protein, 9 aa, Homo Sapiens
LSFLKEVSE

SEQ ID NO: 125888 - protein, 9 aa, Homo Sapiens
ANLPVGAPI

SEQ ID NO: 125889 - protein, 9 aa, Homo Sapiens
TRLLAKGKK

SEQ ID NO: 125890 - protein, 9 aa, Homo Sapiens
SHPNPFLTN

SEQ ID NO: 125891 - protein, 9 aa, Homo Sapiens
KTQKVQMKF

SEQ ID NO: 125892 - protein, 9 aa, Homo Sapiens
DITLLDLIN

SEQ ID NO: 125893 - protein, 9 aa, Homo Sapiens
FPSVYAITS

SEQ ID NO: 125894 - protein, 9 aa, Homo Sapiens
QVVRKTSSN

SEQ ID NO: 125895 - protein, 9 aa, Homo Sapiens
VLRAHRLRH

SEQ ID NO: 125896 - protein, 9 aa, Homo Sapiens
RLGVGATRI

SEQ ID NO: 125897 - protein, 9 aa, Homo Sapiens
PRMGELKAE

SEQ ID NO: 125898 - protein, 9 aa, Homo Sapiens
RPEGPGQIW

SEQ ID NO: 125899 - protein, 9 aa, Homo Sapiens
QSTNSVEII

SEQ ID NO: 125900 - protein, 9 aa, Homo Sapiens
NGKSASGHL

SEQ ID NO: 125901 - protein, 9 aa, Homo Sapiens
SNALGMNCT

SEQ ID NO: 125902 - protein, 9 aa, Homo Sapiens
SSPPGRHWL

SEQ ID NO: 125903 - protein, 9 aa, Homo Sapiens
DVAAVGVED

SEQ ID NO: 125904 - protein, 9 aa, Homo Sapiens
DEEYPCSSK

SEQ ID NO: 125905 - protein, 9 aa, Homo Sapiens
SRPPQATRA

SEQ ID NO: 125906 - protein, 9 aa, Homo Sapiens
EGPGDREGY

SEQ ID NO: 125907 - protein, 9 aa, Homo Sapiens
LFNQTGACK

SEQ ID NO: 125908 - protein, 9 aa, Homo Sapiens
MLEIWDVKD

SEQ ID NO: 125909 - protein, 9 aa, Homo Sapiens
EFVVEVWAT

SEQ ID NO: 125910 - protein, 9 aa, Homo Sapiens
TLAPASRGP

SEQ ID NO: 125911 - protein, 9 aa, Homo Sapiens
AGHLGRSGS

SEQ ID NO: 125912 - protein, 9 aa, Homo Sapiens
VRTTRSQQH

SEQ ID NO: 125913 - protein, 9 aa, Homo Sapiens
HHRPHQLSP

SEQ ID NO: 125914 - protein, 9 aa, Homo Sapiens
VPEANSTWT

SEQ ID NO: 125915 - protein, 9 aa, Homo Sapiens
VTKTVDNWI

SEQ ID NO: 125916 - protein, 9 aa, Homo Sapiens
FLFSNLPPT

SEQ ID NO: 125917 - protein, 9 aa, Homo Sapiens
ETESTTRPM

SEQ ID NO: 125918 - protein, 9 aa, Homo Sapiens
LKVEPNNCL

SEQ ID NO: 125919 - protein, 9 aa, Homo Sapiens
PCKDAGRAK

SEQ ID NO: 125920 - protein, 9 aa, Homo Sapiens
RPWAPADRL

SEQ ID NO: 125921 - protein, 9 aa, Homo Sapiens
FDEPMDVRS

SEQ ID NO: 125922 - protein, 9 aa, Homo Sapiens
WHSNSQNIK

SEQ ID NO: 125923 - protein, 9 aa, Homo Sapiens
MQSQRNYMV

SEQ ID NO: 125924 - protein, 9 aa, Homo Sapiens
RGTGIVSVP

SEQ ID NO: 125925 - protein, 9 aa, Homo Sapiens
GTGLYVRPV

SEQ ID NO: 125926 - protein, 9 aa, Homo Sapiens
LLRMFFDTL

SEQ ID NO: 125927 - protein, 9 aa, Homo Sapiens
DIVHRHPRF

SEQ ID NO: 125928 - protein, 9 aa, Homo Sapiens
DSWRWAVST

SEQ ID NO: 125929 - protein, 9 aa, Homo Sapiens
LDVHTGVGS

SEQ ID NO: 125930 - protein, 9 aa, Homo Sapiens
LTNHHRIHT

SEQ ID NO: 125931 - protein, 9 aa, Homo Sapiens
PPKCPAVAS

SEQ ID NO: 125932 - protein, 9 aa, Homo Sapiens
QPDFHMAPN

SEQ ID NO: 125933 - protein, 9 aa, Homo Sapiens
VHDFPQFST

SEQ ID NO: 125934 - protein, 9 aa, Homo Sapiens
YRVKAIDFG

SEQ ID NO: 125935 - protein, 9 aa, Homo Sapiens
EFTGLETYK

SEQ ID NO: 125936 - protein, 9 aa, Homo Sapiens
HAPSRRGLL

SEQ ID NO: 125937 - protein, 9 aa, Homo Sapiens
TRPRDDELF

SEQ ID NO: 125938 - protein, 9 aa, Homo Sapiens
FAADGFLSD

SEQ ID NO: 125939 - protein, 9 aa, Homo Sapiens
LYTVVAFIF

SEQ ID NO: 125940 - protein, 9 aa, Homo Sapiens
TAMYNNTQG

SEQ ID NO: 125941 - protein, 9 aa, Homo Sapiens
THFGAVLAL

SEQ ID NO: 125942 - protein, 9 aa, Homo Sapiens
TLTSTSCST

SEQ ID NO: 125943 - protein, 9 aa, Homo Sapiens
KVRLRLRDN

SEQ ID NO: 125944 - protein, 9 aa, Homo Sapiens
CVLVHCQAG

SEQ ID NO: 125945 - protein, 9 aa, Homo Sapiens
RPQGQQNPA

SEQ ID NO: 125946 - protein, 9 aa, Homo Sapiens
NRSSSNTSS

SEQ ID NO: 125947 - protein, 9 aa, Homo Sapiens
SEAAQLIVT

SEQ ID NO: 125948 - protein, 9 aa, Homo Sapiens
SSPLPCLCP

SEQ ID NO: 125949 - protein, 9 aa, Homo Sapiens
KTILSLVTR

SEQ ID NO: 125950 - protein, 9 aa, Homo Sapiens
MRKRKMRRT

SEQ ID NO: 125951 - protein, 9 aa, Homo Sapiens
VGDDGREYE

SEQ ID NO: 125952 - protein, 9 aa, Homo Sapiens
YDHYGREGL

SEQ ID NO: 125953 - protein, 9 aa, Homo Sapiens
PGSNHWNNP

SEQ ID NO: 125954 - protein, 9 aa, Homo Sapiens
TGGHEEAEE

SEQ ID NO: 125955 - protein, 9 aa, Homo Sapiens
QLRVRRREP

SEQ ID NO: 125956 - protein, 9 aa, Homo Sapiens
EKASVCHHH

SEQ ID NO: 125957 - protein, 9 aa, Homo Sapiens
DKGDGSCDM

SEQ ID NO: 125958 - protein, 9 aa, Homo Sapiens
FSMEPLTFV

SEQ ID NO: 125959 - protein, 9 aa, Homo Sapiens
AIYGLIERI

SEQ ID NO: 125960 - protein, 9 aa, Homo Sapiens
GTAAPGPRP

SEQ ID NO: 125961 - protein, 9 aa, Homo Sapiens
FQMTRTVTT

SEQ ID NO: 125962 - protein, 9 aa, Homo Sapiens
RHHYTEAER

SEQ ID NO: 125963 - protein, 9 aa, Homo Sapiens
PRNMIYMSH

SEQ ID NO: 125964 - protein, 9 aa, Homo Sapiens
VIAYFSWAG

SEQ ID NO: 125965 - protein, 9 aa, Homo Sapiens
TGSRCAQVR

SEQ ID NO: 125966 - protein, 9 aa, Homo Sapiens
GKQRSPKMR

SEQ ID NO: 125967 - protein, 9 aa, Homo Sapiens
DLEKVLELT

SEQ ID NO: 125968 - protein, 9 aa, Homo Sapiens
VIKKPDAPP

SEQ ID NO: 125969 - protein, 9 aa, Homo Sapiens
IGLSQYSQV

SEQ ID NO: 125970 - protein, 9 aa, Homo Sapiens
CWVAACVWC

SEQ ID NO: 125971 - protein, 9 aa, Homo Sapiens
TTNRYVQQK

SEQ ID NO: 125972 - protein, 9 aa, Homo Sapiens
RHLNLSATH

SEQ ID NO: 125973 - protein, 9 aa, Homo Sapiens
IRRCYPYYL

SEQ ID NO: 125974 - protein, 9 aa, Homo Sapiens
IVPKLQVIT

SEQ ID NO: 125975 - protein, 9 aa, Homo Sapiens
VHLLLKHLH

SEQ ID NO: 125976 - protein, 9 aa, Homo Sapiens
DRPGRRLYN

SEQ ID NO: 125977 - protein, 9 aa, Homo Sapiens
GANATDEEA

SEQ ID NO: 125978 - protein, 9 aa, Homo Sapiens
LQAACFQLN

SEQ ID NO: 125979 - protein, 9 aa, Homo Sapiens
RKMRRTNMI

SEQ ID NO: 125980 - protein, 9 aa, Homo Sapiens
PAPLSVGHD

SEQ ID NO: 125981 - protein, 9 aa, Homo Sapiens
KIINPTISC

SEQ ID NO: 125982 - protein, 9 aa, Homo Sapiens
TLFEIYAIV

SEQ ID NO: 125983 - protein, 9 aa, Homo Sapiens
LRARGGTTI

SEQ ID NO: 125984 - protein, 9 aa, Homo Sapiens
CDEDETTTL

SEQ ID NO: 125985 - protein, 9 aa, Homo Sapiens
VIVLGLGYF

SEQ ID NO: 125986 - protein, 9 aa, Homo Sapiens
LYTSVKEEL

SEQ ID NO: 125987 - protein, 9 aa, Homo Sapiens
TSLISSLRV

SEQ ID NO: 125988 - protein, 9 aa, Homo Sapiens
LGHCQELLA

SEQ ID NO: 125989 - protein, 9 aa, Homo Sapiens
HRYLFYSEH

SEQ ID NO: 125990 - protein, 9 aa, Homo Sapiens
TAKGDIICY

SEQ ID NO: 125991 - protein, 9 aa, Homo Sapiens
FFCGAANCA

SEQ ID NO: 125992 - protein, 9 aa, Homo Sapiens
TLHVTTIFP

SEQ ID NO: 125993 - protein, 9 aa, Homo Sapiens
RSQSPPQRP

SEQ ID NO: 125994 - protein, 9 aa, Homo Sapiens
HQNLQGKKS

SEQ ID NO: 125995 - protein, 9 aa, Homo Sapiens
CWINVHLQD

SEQ ID NO: 125996 - protein, 9 aa, Homo Sapiens
SFLYPMTSR

SEQ ID NO: 125997 - protein, 9 aa, Homo Sapiens
DVRLEDLDE

SEQ ID NO: 125998 - protein, 9 aa, Homo Sapiens
QEYREGKHN

SEQ ID NO: 125999 - protein, 9 aa, Homo Sapiens
SFHTAVMNQ

SEQ ID NO: 126000 - protein, 9 aa, Homo Sapiens
VTALEDELT

SEQ ID NO: 126001 - protein, 9 aa, Homo Sapiens
LQKPHAFIL

SEQ ID NO: 126002 - protein, 9 aa, Homo Sapiens
PGLLMAVQE

SEQ ID NO: 126003 - protein, 9 aa, Homo Sapiens
VPECSEILL

SEQ ID NO: 126004 - protein, 9 aa, Homo Sapiens
LHRPVAHGL

SEQ ID NO: 126005 - protein, 9 aa, Homo Sapiens
SRCAQVRKP

SEQ ID NO: 126006 - protein, 9 aa, Homo Sapiens
GWKRRKVFR

SEQ ID NO: 126007 - protein, 9 aa, Homo Sapiens
GRASQPMAP

SEQ ID NO: 126008 - protein, 9 aa, Homo Sapiens
GSVADFLLD

SEQ ID NO: 126009 - protein, 9 aa, Homo Sapiens
DKPFMCPFD

SEQ ID NO: 126010 - protein, 9 aa, Homo Sapiens
RDHLLPRPG

SEQ ID NO: 126011 - protein, 9 aa, Homo Sapiens
TPSMVTVDR

SEQ ID NO: 126012 - protein, 9 aa, Homo Sapiens
SFASKNKDL

SEQ ID NO: 126013 - protein, 9 aa, Homo Sapiens
LQESAHRRM

SEQ ID NO: 126014 - protein, 9 aa, Homo Sapiens
PETNGPRKG

SEQ ID NO: 126015 - protein, 9 aa, Homo Sapiens
GPRLRLALR

SEQ ID NO: 126016 - protein, 9 aa, Homo Sapiens
CLLKVQFNF

SEQ ID NO: 126017 - protein, 9 aa, Homo Sapiens
PALRLMNAA

SEQ ID NO: 126018 - protein, 9 aa, Homo Sapiens
SLVIVLGLG

SEQ ID NO: 126019 - protein, 9 aa, Homo Sapiens
SRVTRSRGT

SEQ ID NO: 126020 - protein, 9 aa, Homo Sapiens
LLVAFILLS

SEQ ID NO: 126021 - protein, 9 aa, Homo Sapiens
HSNSNTLSS

SEQ ID NO: 126022 - protein, 9 aa, Homo Sapiens
TKTLTGTSH

SEQ ID NO: 126023 - protein, 9 aa, Homo Sapiens
TLWWKKTVA

SEQ ID NO: 126024 - protein, 9 aa, Homo Sapiens
NSTFSPISD

SEQ ID NO: 126025 - protein, 9 aa, Homo Sapiens
ILCLLQQQL

SEQ ID NO: 126026 - protein, 9 aa, Homo Sapiens
QARGVLELT

SEQ ID NO: 126027 - protein, 9 aa, Homo Sapiens
NLLNPNPHM

SEQ ID NO: 126028 - protein, 9 aa, Homo Sapiens
RTQHPTLRL

SEQ ID NO: 126029 - protein, 9 aa, Homo Sapiens
QGWDWVLPV

SEQ ID NO: 126030 - protein, 9 aa, Homo Sapiens
HHTREIFVL

SEQ ID NO: 126031 - protein, 9 aa, Homo Sapiens
THTHTWRAR

SEQ ID NO: 126032 - protein, 9 aa, Homo Sapiens
TLGAALEAV

SEQ ID NO: 126033 - protein, 9 aa, Homo Sapiens
RHLESSNSQ

SEQ ID NO: 126034 - protein, 9 aa, Homo Sapiens
DLEGESELV

SEQ ID NO: 126035 - protein, 9 aa, Homo Sapiens
PAVIFSTLG

SEQ ID NO: 126036 - protein, 9 aa, Homo Sapiens
SPIPPHAGG

SEQ ID NO: 126037 - protein, 9 aa, Homo Sapiens
MEADFYQVQ

SEQ ID NO: 126038 - protein, 9 aa, Homo Sapiens
NSHFSDLSQ

SEQ ID NO: 126039 - protein, 9 aa, Homo Sapiens
PWRSKGADL

SEQ ID NO: 126040 - protein, 9 aa, Homo Sapiens
CEILSGNSC

SEQ ID NO: 126041 - protein, 9 aa, Homo Sapiens
HDAHLCLKT

SEQ ID NO: 126042 - protein, 9 aa, Homo Sapiens
SPPSTARSR

SEQ ID NO: 126043 - protein, 9 aa, Homo Sapiens
EEKHEESSW

SEQ ID NO: 126044 - protein, 9 aa, Homo Sapiens
RHSAEAQRG

SEQ ID NO: 126045 - protein, 9 aa, Homo Sapiens
GWARDGGAW

SEQ ID NO: 126046 - protein, 9 aa, Homo Sapiens
IKEFIQGRD

SEQ ID NO: 126047 - protein, 9 aa, Homo Sapiens
SDFQINVDP

SEQ ID NO: 126048 - protein, 9 aa, Homo Sapiens
PMPLRIDTL

SEQ ID NO: 126049 - protein, 9 aa, Homo Sapiens
KVSNASADL

SEQ ID NO: 126050 - protein, 9 aa, Homo Sapiens
SPLQRSFLV

SEQ ID NO: 126051 - protein, 9 aa, Homo Sapiens
SAPWPSYVK

SEQ ID NO: 126052 - protein, 9 aa, Homo Sapiens
RLRSMCGAH

SEQ ID NO: 126053 - protein, 9 aa, Homo Sapiens
GILWTIRLP

SEQ ID NO: 126054 - protein, 9 aa, Homo Sapiens
GALLRACSC

SEQ ID NO: 126055 - protein, 9 aa, Homo Sapiens
YKVLKQAHP

SEQ ID NO: 126056 - protein, 9 aa, Homo Sapiens
SEYTSSTGL

SEQ ID NO: 126057 - protein, 9 aa, Homo Sapiens
LGSGDEKEM

SEQ ID NO: 126058 - protein, 9 aa, Homo Sapiens
LHDLEYECL

SEQ ID NO: 126059 - protein, 9 aa, Homo Sapiens
CSEILLLAP

SEQ ID NO: 126060 - protein, 9 aa, Homo Sapiens
ELVQHLFRV

SEQ ID NO: 126061 - protein, 9 aa, Homo Sapiens
SPTLPRTPL

SEQ ID NO: 126062 - protein, 9 aa, Homo Sapiens
LKCARDLCS

SEQ ID NO: 126063 - protein, 9 aa, Homo Sapiens
FPFSIKPFH

SEQ ID NO: 126064 - protein, 9 aa, Homo Sapiens
SCASTGSST

SEQ ID NO: 126065 - protein, 9 aa, Homo Sapiens
ERNIENISM

SEQ ID NO: 126066 - protein, 9 aa, Homo Sapiens
PTFPNFFSK

SEQ ID NO: 126067 - protein, 9 aa, Homo Sapiens
SRVVLDLPQ

SEQ ID NO: 126068 - protein, 9 aa, Homo Sapiens
TYDLSPIEW

SEQ ID NO: 126069 - protein, 9 aa, Homo Sapiens
VENFWGEKI

SEQ ID NO: 126070 - protein, 9 aa, Homo Sapiens
SLRPRSVVI

SEQ ID NO: 126071 - protein, 9 aa, Homo Sapiens
NQKIKLIRP

SEQ ID NO: 126072 - protein, 9 aa, Homo Sapiens
GHAQPSCTG

SEQ ID NO: 126073 - protein, 9 aa, Homo Sapiens
ADWRYLQQA

SEQ ID NO: 126074 - protein, 9 aa, Homo Sapiens
LPGPRDASP

SEQ ID NO: 126075 - protein, 9 aa, Homo Sapiens
NRYSGTQND

SEQ ID NO: 126076 - protein, 9 aa, Homo Sapiens
SSVFRKHQI

SEQ ID NO: 126077 - protein, 9 aa, Homo Sapiens
RMEADFYQV

SEQ ID NO: 126078 - protein, 9 aa, Homo Sapiens
VQTRDLGPN

SEQ ID NO: 126079 - protein, 9 aa, Homo Sapiens
KASKLDDHV

SEQ ID NO: 126080 - protein, 9 aa, Homo Sapiens
SASRGDTAV

SEQ ID NO: 126081 - protein, 9 aa, Homo Sapiens
AEEHVCVTK

SEQ ID NO: 126082 - protein, 9 aa, Homo Sapiens
GSVHEGGSE

SEQ ID NO: 126083 - protein, 9 aa, Homo Sapiens
EFVDGVKLN

SEQ ID NO: 126084 - protein, 9 aa, Homo Sapiens
QTRMNDLPY

SEQ ID NO: 126085 - protein, 9 aa, Homo Sapiens
VEKEMSLQK

SEQ ID NO: 126086 - protein, 9 aa, Homo Sapiens
PKVSSLARR

SEQ ID NO: 126087 - protein, 9 aa, Homo Sapiens
VALVHAVQD

SEQ ID NO: 126088 - protein, 9 aa, Homo Sapiens
KHVCLHFLA

SEQ ID NO: 126089 - protein, 9 aa, Homo Sapiens
DGRSRIRHR

SEQ ID NO: 126090 - protein, 9 aa, Homo Sapiens
KRDLNARNV

SEQ ID NO: 126091 - protein, 9 aa, Homo Sapiens
ASTGSSTAS

SEQ ID NO: 126092 - protein, 9 aa, Homo Sapiens
GPAPGRPYG

SEQ ID NO: 126093 - protein, 9 aa, Homo Sapiens
EKIKAKIKE

SEQ ID NO: 126094 - protein, 9 aa, Homo Sapiens
EDTDRNLSH

SEQ ID NO: 126095 - protein, 9 aa, Homo Sapiens
KKLGEMHLK

SEQ ID NO: 126096 - protein, 9 aa, Homo Sapiens
GSHSEASSV

SEQ ID NO: 126097 - protein, 9 aa, Homo Sapiens
GPLDGNPYA

SEQ ID NO: 126098 - protein, 9 aa, Homo Sapiens
CKQLSQQDH

SEQ ID NO: 126099 - protein, 9 aa, Homo Sapiens
QLLSGEDVG

SEQ ID NO: 126100 - protein, 9 aa, Homo Sapiens
EFIQGRDLM

SEQ ID NO: 126101 - protein, 9 aa, Homo Sapiens
LQPRLDHVH

SEQ ID NO: 126102 - protein, 9 aa, Homo Sapiens
VKKVVSAEI

SEQ ID NO: 126103 - protein, 9 aa, Homo Sapiens
SLELRACGL

SEQ ID NO: 126104 - protein, 9 aa, Homo Sapiens
CASLKKTKQ

SEQ ID NO: 126105 - protein, 9 aa, Homo Sapiens
KRSRKSASV

SEQ ID NO: 126106 - protein, 9 aa, Homo Sapiens
GQVCGQDDV

SEQ ID NO: 126107 - protein, 9 aa, Homo Sapiens
EKHFFTEGH

SEQ ID NO: 126108 - protein, 9 aa, Homo Sapiens
TRLAADVGE

SEQ ID NO: 126109 - protein, 9 aa, Homo Sapiens
FVQLTETSL

SEQ ID NO: 126110 - protein, 9 aa, Homo Sapiens
KRAKKVTLA

SEQ ID NO: 126111 - protein, 9 aa, Homo Sapiens
HPPRMKDPR

SEQ ID NO: 126112 - protein, 9 aa, Homo Sapiens
SQGGRILLQ

SEQ ID NO: 126113 - protein, 9 aa, Homo Sapiens
TSDEYRFAW

SEQ ID NO: 126114 - protein, 9 aa, Homo Sapiens
WCCVPVPTH

SEQ ID NO: 126115 - protein, 9 aa, Homo Sapiens
RAIEGLALS

SEQ ID NO: 126116 - protein, 9 aa, Homo Sapiens
GAPQSVRLQ

SEQ ID NO: 126117 - protein, 9 aa, Homo Sapiens
LVIVLGLGY

SEQ ID NO: 126118 - protein, 9 aa, Homo Sapiens
SPSACRCPC

SEQ ID NO: 126119 - protein, 9 aa, Homo Sapiens
GRGVKYSYQ

SEQ ID NO: 126120 - protein, 9 aa, Homo Sapiens
EISPKLQTQ

SEQ ID NO: 126121 - protein, 9 aa, Homo Sapiens
LTTEIMQLI

SEQ ID NO: 126122 - protein, 9 aa, Homo Sapiens
WAGASCGQP

SEQ ID NO: 126123 - protein, 9 aa, Homo Sapiens
QDCLQHRAD

SEQ ID NO: 126124 - protein, 9 aa, Homo Sapiens
AAPGPRPGS

SEQ ID NO: 126125 - protein, 9 aa, Homo Sapiens
SKQEYLSMS

SEQ ID NO: 126126 - protein, 9 aa, Homo Sapiens
NLQASYTTE

SEQ ID NO: 126127 - protein, 9 aa, Homo Sapiens
TSVYSSSKG

SEQ ID NO: 126128 - protein, 9 aa, Homo Sapiens
PHPGPLKIR

SEQ ID NO: 126129 - protein, 9 aa, Homo Sapiens
SQRLPWAGA

SEQ ID NO: 126130 - protein, 9 aa, Homo Sapiens
VGAQLMAPL

SEQ ID NO: 126131 - protein, 9 aa, Homo Sapiens
MDFLCCVTA

SEQ ID NO: 126132 - protein, 9 aa, Homo Sapiens
GLHKRTYSL

SEQ ID NO: 126133 - protein, 9 aa, Homo Sapiens
PFMCPFDVC

SEQ ID NO: 126134 - protein, 9 aa, Homo Sapiens
AGIYLYGAD

SEQ ID NO: 126135 - protein, 9 aa, Homo Sapiens
QRWHWQKKG

SEQ ID NO: 126136 - protein, 9 aa, Homo Sapiens
SVRLQPRLD

SEQ ID NO: 126137 - protein, 9 aa, Homo Sapiens
HAGGHRQRW

SEQ ID NO: 126138 - protein, 9 aa, Homo Sapiens
DLNPFPIRQ

SEQ ID NO: 126139 - protein, 9 aa, Homo Sapiens
RRERRYGIS

SEQ ID NO: 126140 - protein, 9 aa, Homo Sapiens
SVRHLGDQM

SEQ ID NO: 126141 - protein, 9 aa, Homo Sapiens
YMKLIVEEK

SEQ ID NO: 126142 - protein, 9 aa, Homo Sapiens
GAVQAPSPS

SEQ ID NO: 126143 - protein, 9 aa, Homo Sapiens
KECGKVFRV

SEQ ID NO: 126144 - protein, 9 aa, Homo Sapiens
WISWFESYL

SEQ ID NO: 126145 - protein, 9 aa, Homo Sapiens
TRCLRMRPP

SEQ ID NO: 126146 - protein, 9 aa, Homo Sapiens
RKDVLCEIL

SEQ ID NO: 126147 - protein, 9 aa, Homo Sapiens
WHWQKKGDK

SEQ ID NO: 126148 - protein, 9 aa, Homo Sapiens
GEEETDLKA

SEQ ID NO: 126149 - protein, 9 aa, Homo Sapiens
QAHPDTGIS

SEQ ID NO: 126150 - protein, 9 aa, Homo Sapiens
SPSLRKQPS

SEQ ID NO: 126151 - protein, 9 aa, Homo Sapiens
HLGETALPT

SEQ ID NO: 126152 - protein, 9 aa, Homo Sapiens
TTSTCTRPW

SEQ ID NO: 126153 - protein, 9 aa, Homo Sapiens
AKPLPRKAI

SEQ ID NO: 126154 - protein, 9 aa, Homo Sapiens
IDEAVNKIR

SEQ ID NO: 126155 - protein, 9 aa, Homo Sapiens
LAQCLRWLC

SEQ ID NO: 126156 - protein, 9 aa, Homo Sapiens
SIVLSLARG

SEQ ID NO: 126157 - protein, 9 aa, Homo Sapiens
CGYHPIRFY

SEQ ID NO: 126158 - protein, 9 aa, Homo Sapiens
SPPAGHLGR

SEQ ID NO: 126159 - protein, 9 aa, Homo Sapiens
KSPTMYQVQ

SEQ ID NO: 126160 - protein, 9 aa, Homo Sapiens
PWVFAIRRP

SEQ ID NO: 126161 - protein, 9 aa, Homo Sapiens
AHSGAVATS

SEQ ID NO: 126162 - protein, 9 aa, Homo Sapiens
FLVFLTSLK

SEQ ID NO: 126163 - protein, 9 aa, Homo Sapiens
PHQMHQHKS

SEQ ID NO: 126164 - protein, 9 aa, Homo Sapiens
AILFSGALI

SEQ ID NO: 126165 - protein, 9 aa, Homo Sapiens
TFNFELGIR

SEQ ID NO: 126166 - protein, 9 aa, Homo Sapiens
PPPTPPLPT

SEQ ID NO: 126167 - protein, 9 aa, Homo Sapiens
VATSFQSQS

SEQ ID NO: 126168 - protein, 9 aa, Homo Sapiens
EKFQCVEKS

SEQ ID NO: 126169 - protein, 9 aa, Homo Sapiens
SSHWLDEYW

SEQ ID NO: 126170 - protein, 9 aa, Homo Sapiens
ALPTPQFGR

SEQ ID NO: 126171 - protein, 9 aa, Homo Sapiens
NCTPVSSSR

SEQ ID NO: 126172 - protein, 9 aa, Homo Sapiens
LVHSSTGSP

SEQ ID NO: 126173 - protein, 9 aa, Homo Sapiens
AINFPRNKV

SEQ ID NO: 126174 - protein, 9 aa, Homo Sapiens
NSSGLQDGA

SEQ ID NO: 126175 - protein, 9 aa, Homo Sapiens
GQRHRAVHD

SEQ ID NO: 126176 - protein, 9 aa, Homo Sapiens
QVKNLMNVM

SEQ ID NO: 126177 - protein, 9 aa, Homo Sapiens
WQKKGDKQR

SEQ ID NO: 126178 - protein, 9 aa, Homo Sapiens
DYAYVNFLQ

SEQ ID NO: 126179 - protein, 9 aa, Homo Sapiens
TSLQERLPH

SEQ ID NO: 126180 - protein, 9 aa, Homo Sapiens
TEPRNVVIP

SEQ ID NO: 126181 - protein, 9 aa, Homo Sapiens
QLFVRTRKG

SEQ ID NO: 126182 - protein, 9 aa, Homo Sapiens
HAFILKSKG

SEQ ID NO: 126183 - protein, 9 aa, Homo Sapiens
TAESLVEKH

SEQ ID NO: 126184 - protein, 9 aa, Homo Sapiens
VPPPTPMVD

SEQ ID NO: 126185 - protein, 9 aa, Homo Sapiens
KEYTQVKNL

SEQ ID NO: 126186 - protein, 9 aa, Homo Sapiens
LESSTRKPP

SEQ ID NO: 126187 - protein, 9 aa, Homo Sapiens
QFVCQNLHD

SEQ ID NO: 126188 - protein, 9 aa, Homo Sapiens
EVLQLSTNC

SEQ ID NO: 126189 - protein, 9 aa, Homo Sapiens
KRWIVFSVK

SEQ ID NO: 126190 - protein, 9 aa, Homo Sapiens
LRRFTIRGF

SEQ ID NO: 126191 - protein, 9 aa, Homo Sapiens
LAPPPRAPK

SEQ ID NO: 126192 - protein, 9 aa, Homo Sapiens
TCKIGVNGS

SEQ ID NO: 126193 - protein, 9 aa, Homo Sapiens
LGAPGHELS

SEQ ID NO: 126194 - protein, 9 aa, Homo Sapiens
RPTGLRIPL

SEQ ID NO: 126195 - protein, 9 aa, Homo Sapiens
FVEFKISGH

SEQ ID NO: 126196 - protein, 9 aa, Homo Sapiens
NGDRLNPEE

SEQ ID NO: 126197 - protein, 9 aa, Homo Sapiens
EDVLVSLET

SEQ ID NO: 126198 - protein, 9 aa, Homo Sapiens
LFLKMICPT

SEQ ID NO: 126199 - protein, 9 aa, Homo Sapiens
EREREPKPG

SEQ ID NO: 126200 - protein, 9 aa, Homo Sapiens
KNSLEPYAF

SEQ ID NO: 126201 - protein, 9 aa, Homo Sapiens
VVHLLLKHL

SEQ ID NO: 126202 - protein, 9 aa, Homo Sapiens
GMRQGYSVR

SEQ ID NO: 126203 - protein, 9 aa, Homo Sapiens
VTVDRTKTQ

SEQ ID NO: 126204 - protein, 9 aa, Homo Sapiens
FLMSDLESM

SEQ ID NO: 126205 - protein, 9 aa, Homo Sapiens
PSLATMMVS

SEQ ID NO: 126206 - protein, 9 aa, Homo Sapiens
SLTAAHSST

SEQ ID NO: 126207 - protein, 9 aa, Homo Sapiens
TFDHDCKFP

SEQ ID NO: 126208 - protein, 9 aa, Homo Sapiens
QQQMATKIV

SEQ ID NO: 126209 - protein, 9 aa, Homo Sapiens
PRHGNHRES

SEQ ID NO: 126210 - protein, 9 aa, Homo Sapiens
CLVSLDSGL

SEQ ID NO: 126211 - protein, 9 aa, Homo Sapiens
RSRKSASVA

SEQ ID NO: 126212 - protein, 9 aa, Homo Sapiens
HSPPASHLS

SEQ ID NO: 126213 - protein, 9 aa, Homo Sapiens
RTPSSPPSP

SEQ ID NO: 126214 - protein, 9 aa, Homo Sapiens
SRRQVRSRE

SEQ ID NO: 126215 - protein, 9 aa, Homo Sapiens
PFLTQARLA

SEQ ID NO: 126216 - protein, 9 aa, Homo Sapiens
CSSWLRRIE

SEQ ID NO: 126217 - protein, 9 aa, Homo Sapiens
QHIIRREVM

SEQ ID NO: 126218 - protein, 9 aa, Homo Sapiens
GGGPEGPGD

SEQ ID NO: 126219 - protein, 9 aa, Homo Sapiens
LCETPAPLA

SEQ ID NO: 126220 - protein, 9 aa, Homo Sapiens
HVCLHFLAC

SEQ ID NO: 126221 - protein, 9 aa, Homo Sapiens
PLPECHVRI

SEQ ID NO: 126222 - protein, 9 aa, Homo Sapiens
AAVWRVPGC

SEQ ID NO: 126223 - protein, 9 aa, Homo Sapiens
KLQNTTKLT

SEQ ID NO: 126224 - protein, 9 aa, Homo Sapiens
AFFLLIGIP

SEQ ID NO: 126225 - protein, 9 aa, Homo Sapiens
RLHNNLISI

SEQ ID NO: 126226 - protein, 9 aa, Homo Sapiens
VLLCLAVFR

SEQ ID NO: 126227 - protein, 9 aa, Homo Sapiens
LCLKTWNEL

SEQ ID NO: 126228 - protein, 9 aa, Homo Sapiens
TFGEVEFTG

SEQ ID NO: 126229 - protein, 9 aa, Homo Sapiens
CDAEVTRLR

SEQ ID NO: 126230 - protein, 9 aa, Homo Sapiens
PGLSFLKEV

SEQ ID NO: 126231 - protein, 9 aa, Homo Sapiens
RCKHGWVAH

SEQ ID NO: 126232 - protein, 9 aa, Homo Sapiens
EAAQLIVTK

SEQ ID NO: 126233 - protein, 9 aa, Homo Sapiens
KEGGTVSVA

SEQ ID NO: 126234 - protein, 9 aa, Homo Sapiens
PTHKKLYHH

SEQ ID NO: 126235 - protein, 9 aa, Homo Sapiens
HFSDVFRSV

SEQ ID NO: 126236 - protein, 9 aa, Homo Sapiens
NIENISMLE

SEQ ID NO: 126237 - protein, 9 aa, Homo Sapiens
SLLYLNSGY

SEQ ID NO: 126238 - protein, 9 aa, Homo Sapiens
VSLETLNHS

SEQ ID NO: 126239 - protein, 9 aa, Homo Sapiens
GRDRKQFSP

SEQ ID NO: 126240 - protein, 9 aa, Homo Sapiens
CCRHQDSPS

SEQ ID NO: 126241 - protein, 9 aa, Homo Sapiens
PSAATALHS

SEQ ID NO: 126242 - protein, 9 aa, Homo Sapiens
VHTGVGSGL

SEQ ID NO: 126243 - protein, 9 aa, Homo Sapiens
EPALSDYRT

SEQ ID NO: 126244 - protein, 9 aa, Homo Sapiens
NKYLEDIKT

SEQ ID NO: 126245 - protein, 9 aa, Homo Sapiens
DSGGINGEQ

SEQ ID NO: 126246 - protein, 9 aa, Homo Sapiens
AVLCYRCLP

SEQ ID NO: 126247 - protein, 9 aa, Homo Sapiens
DFGSANIFS

SEQ ID NO: 126248 - protein, 9 aa, Homo Sapiens
ALAHSTATC

SEQ ID NO: 126249 - protein, 9 aa, Homo Sapiens
HPGGCIQIM

SEQ ID NO: 126250 - protein, 9 aa, Homo Sapiens
CLLCWEALP

SEQ ID NO: 126251 - protein, 9 aa, Homo Sapiens
SAWASWPTF

SEQ ID NO: 126252 - protein, 9 aa, Homo Sapiens
FSRSQRDMQ

SEQ ID NO: 126253 - protein, 9 aa, Homo Sapiens
IKVWRDKDG

SEQ ID NO: 126254 - protein, 9 aa, Homo Sapiens
GEAVSFQFF

SEQ ID NO: 126255 - protein, 9 aa, Homo Sapiens
LRRLYTSSW

SEQ ID NO: 126256 - protein, 9 aa, Homo Sapiens
SGAFYLFHV

SEQ ID NO: 126257 - protein, 9 aa, Homo Sapiens
YSSVFRKHQ

SEQ ID NO: 126258 - protein, 9 aa, Homo Sapiens
QPQTPASPV

SEQ ID NO: 126259 - protein, 9 aa, Homo Sapiens
LEEVRAAGR

SEQ ID NO: 126260 - protein, 9 aa, Homo Sapiens
SAFEVGAHK

SEQ ID NO: 126261 - protein, 9 aa, Homo Sapiens
DGREYEGVG

SEQ ID NO: 126262 - protein, 9 aa, Homo Sapiens
KRSRVTSGG

SEQ ID NO: 126263 - protein, 9 aa, Homo Sapiens
DEALFLAGV

SEQ ID NO: 126264 - protein, 9 aa, Homo Sapiens
VSKNGDGLK

SEQ ID NO: 126265 - protein, 9 aa, Homo Sapiens
AEAGAARRS

SEQ ID NO: 126266 - protein, 9 aa, Homo Sapiens
KTPCGPPLG

SEQ ID NO: 126267 - protein, 9 aa, Homo Sapiens
PSASPPSRP

SEQ ID NO: 126268 - protein, 9 aa, Homo Sapiens
PWSCSNIMK

SEQ ID NO: 126269 - protein, 9 aa, Homo Sapiens
RFFQVLPPC

SEQ ID NO: 126270 - protein, 9 aa, Homo Sapiens
IHYGQVSKN

SEQ ID NO: 126271 - protein, 9 aa, Homo Sapiens
EAKAGRSRG

SEQ ID NO: 126272 - protein, 9 aa, Homo Sapiens
EAAEKKKER

SEQ ID NO: 126273 - protein, 9 aa, Homo Sapiens
SLVTREKHP

SEQ ID NO: 126274 - protein, 9 aa, Homo Sapiens
IRTKAMDVH

SEQ ID NO: 126275 - protein, 9 aa, Homo Sapiens
VHAVQDAAV

SEQ ID NO: 126276 - protein, 9 aa, Homo Sapiens
GGHEEAEEK

SEQ ID NO: 126277 - protein, 9 aa, Homo Sapiens
EHTPALPGP

SEQ ID NO: 126278 - protein, 9 aa, Homo Sapiens
KAMDVHDGK

SEQ ID NO: 126279 - protein, 9 aa, Homo Sapiens
VKRAKKVTL

SEQ ID NO: 126280 - protein, 9 aa, Homo Sapiens
LVHESFLYN

SEQ ID NO: 126281 - protein, 9 aa, Homo Sapiens
VTDSACSST

SEQ ID NO: 126282 - protein, 9 aa, Homo Sapiens
ERVVCASVV

SEQ ID NO: 126283 - protein, 9 aa, Homo Sapiens
GCPAGGPCL

SEQ ID NO: 126284 - protein, 9 aa, Homo Sapiens
SVYPQLPGQ

SEQ ID NO: 126285 - protein, 9 aa, Homo Sapiens
STLDSFWGH

SEQ ID NO: 126286 - protein, 9 aa, Homo Sapiens
FPRKGRGLP

SEQ ID NO: 126287 - protein, 9 aa, Homo Sapiens
TPPSAATAL

SEQ ID NO: 126288 - protein, 9 aa, Homo Sapiens
RADGCSLEK

SEQ ID NO: 126289 - protein, 9 aa, Homo Sapiens
SRVTSGGVS

SEQ ID NO: 126290 - protein, 9 aa, Homo Sapiens
RSVRDKYSD

SEQ ID NO: 126291 - protein, 9 aa, Homo Sapiens
KRALLCLIA

SEQ ID NO: 126292 - protein, 9 aa, Homo Sapiens
FFKAWTIFK

SEQ ID NO: 126293 - protein, 9 aa, Homo Sapiens
QGHYFWMLS

SEQ ID NO: 126294 - protein, 9 aa, Homo Sapiens
RNHQRPAAR

SEQ ID NO: 126295 - protein, 9 aa, Homo Sapiens
VCQVHGGLM

SEQ ID NO: 126296 - protein, 9 aa, Homo Sapiens
HHTFYKRAA

SEQ ID NO: 126297 - protein, 9 aa, Homo Sapiens
VIGPALCNN

SEQ ID NO: 126298 - protein, 9 aa, Homo Sapiens
AACIRGETL

SEQ ID NO: 126299 - protein, 9 aa, Homo Sapiens
LNVHLQVYT

SEQ ID NO: 126300 - protein, 9 aa, Homo Sapiens
YNCTPVSSS

SEQ ID NO: 126301 - protein, 9 aa, Homo Sapiens
KFQMENSHL

SEQ ID NO: 126302 - protein, 9 aa, Homo Sapiens
DLEYECLTG

SEQ ID NO: 126303 - protein, 9 aa, Homo Sapiens
SRWMTSLIS

SEQ ID NO: 126304 - protein, 9 aa, Homo Sapiens
VSSETDTYY

SEQ ID NO: 126305 - protein, 9 aa, Homo Sapiens
QEWGCLCGR

SEQ ID NO: 126306 - protein, 9 aa, Homo Sapiens
YGHVTCMQS

SEQ ID NO: 126307 - protein, 9 aa, Homo Sapiens
PIKNTHPLL

SEQ ID NO: 126308 - protein, 9 aa, Homo Sapiens
EPRNVVIPQ

SEQ ID NO: 126309 - protein, 9 aa, Homo Sapiens
ILRKSSAVL

SEQ ID NO: 126310 - protein, 9 aa, Homo Sapiens
MHVSEASLI

SEQ ID NO: 126311 - protein, 9 aa, Homo Sapiens
VAHLSHLLE

SEQ ID NO: 126312 - protein, 9 aa, Homo Sapiens
MNVMNVGRP

SEQ ID NO: 126313 - protein, 9 aa, Homo Sapiens
SPTIPCPTD

SEQ ID NO: 126314 - protein, 9 aa, Homo Sapiens
SEIKDTDDS

SEQ ID NO: 126315 - protein, 9 aa, Homo Sapiens
IDQHKGEDF

SEQ ID NO: 126316 - protein, 9 aa, Homo Sapiens
DGQVKTGIN

SEQ ID NO: 126317 - protein, 9 aa, Homo Sapiens
KTHFQTPRP

SEQ ID NO: 126318 - protein, 9 aa, Homo Sapiens
DPPSGTPPS

SEQ ID NO: 126319 - protein, 9 aa, Homo Sapiens
EKKMLSVFS

SEQ ID NO: 126320 - protein, 9 aa, Homo Sapiens
TSSSFLYPM

SEQ ID NO: 126321 - protein, 9 aa, Homo Sapiens
FRVERGRGV

SEQ ID NO: 126322 - protein, 9 aa, Homo Sapiens
AQGVSSAPR

SEQ ID NO: 126323 - protein, 9 aa, Homo Sapiens
NFVVVDEIH

SEQ ID NO: 126324 - protein, 9 aa, Homo Sapiens
PPKARCPRV

SEQ ID NO: 126325 - protein, 9 aa, Homo Sapiens
FAAPPRSHP

SEQ ID NO: 126326 - protein, 9 aa, Homo Sapiens
EIMTLTNSC

SEQ ID NO: 126327 - protein, 9 aa, Homo Sapiens
YLSPSTPDF

SEQ ID NO: 126328 - protein, 9 aa, Homo Sapiens
HIDSAHLCN

SEQ ID NO: 126329 - protein, 9 aa, Homo Sapiens
TSVYPQLPG

SEQ ID NO: 126330 - protein, 9 aa, Homo Sapiens
LPLLYLRMF

SEQ ID NO: 126331 - protein, 9 aa, Homo Sapiens
NFSLPGSSD

SEQ ID NO: 126332 - protein, 9 aa, Homo Sapiens
TFPNFFSKL

SEQ ID NO: 126333 - protein, 9 aa, Homo Sapiens
KNNKSAEAV

SEQ ID NO: 126334 - protein, 9 aa, Homo Sapiens
IFLFDGLMN

SEQ ID NO: 126335 - protein, 9 aa, Homo Sapiens
RSTLGAALE

SEQ ID NO: 126336 - protein, 9 aa, Homo Sapiens
HFQTPRPMT

SEQ ID NO: 126337 - protein, 9 aa, Homo Sapiens
FAGILEKDL

SEQ ID NO: 126338 - protein, 9 aa, Homo Sapiens
LTVSNVTLE

SEQ ID NO: 126339 - protein, 9 aa, Homo Sapiens
CGQDDVPHQ

SEQ ID NO: 126340 - protein, 9 aa, Homo Sapiens
LASRSCTAP

SEQ ID NO: 126341 - protein, 9 aa, Homo Sapiens
NIMEMNKCL

SEQ ID NO: 126342 - protein, 9 aa, Homo Sapiens
QYILVVPVL

SEQ ID NO: 126343 - protein, 9 aa, Homo Sapiens
KWGALWLLS

SEQ ID NO: 126344 - protein, 9 aa, Homo Sapiens
SCGHLYRSF

SEQ ID NO: 126345 - protein, 9 aa, Homo Sapiens
RTAKLWALS

SEQ ID NO: 126346 - protein, 9 aa, Homo Sapiens
QKRLVTEMP

SEQ ID NO: 126347 - protein, 9 aa, Homo Sapiens
KKQGWDWVL

SEQ ID NO: 126348 - protein, 9 aa, Homo Sapiens
AAPMYTDTV

SEQ ID NO: 126349 - protein, 9 aa, Homo Sapiens
PLYLEKNGK

SEQ ID NO: 126350 - protein, 9 aa, Homo Sapiens
MSDLESMCK

SEQ ID NO: 126351 - protein, 9 aa, Homo Sapiens
KRKYVFSLA

SEQ ID NO: 126352 - protein, 9 aa, Homo Sapiens
VHVFRKALC

SEQ ID NO: 126353 - protein, 9 aa, Homo Sapiens
GTHQMRTAP

SEQ ID NO: 126354 - protein, 9 aa, Homo Sapiens
QVSHHPPSV

SEQ ID NO: 126355 - protein, 9 aa, Homo Sapiens
TRHPDSQQP

SEQ ID NO: 126356 - protein, 9 aa, Homo Sapiens
VREASSLLK

SEQ ID NO: 126357 - protein, 9 aa, Homo Sapiens
YGVLDPLHI

SEQ ID NO: 126358 - protein, 9 aa, Homo Sapiens
ALMVTTYTV

SEQ ID NO: 126359 - protein, 9 aa, Homo Sapiens
PAAERAGAA

SEQ ID NO: 126360 - protein, 9 aa, Homo Sapiens
ILTVWYTKE

SEQ ID NO: 126361 - protein, 9 aa, Homo Sapiens
HYNFSLPGS

SEQ ID NO: 126362 - protein, 9 aa, Homo Sapiens
LITEDVQGE

SEQ ID NO: 126363 - protein, 9 aa, Homo Sapiens
KGKKPRQRY

SEQ ID NO: 126364 - protein, 9 aa, Homo Sapiens
PVHVHIKNS

SEQ ID NO: 126365 - protein, 9 aa, Homo Sapiens
NALCKAVAV

SEQ ID NO: 126366 - protein, 9 aa, Homo Sapiens
AHAMKLNVP

SEQ ID NO: 126367 - protein, 9 aa, Homo Sapiens
HHGIEYCLD

SEQ ID NO: 126368 - protein, 9 aa, Homo Sapiens
GAILFHLHR

SEQ ID NO: 126369 - protein, 9 aa, Homo Sapiens
NDHKANDHK

SEQ ID NO: 126370 - protein, 9 aa, Homo Sapiens
NEDGSGEPE

SEQ ID NO: 126371 - protein, 9 aa, Homo Sapiens
LPRKAIQIS

SEQ ID NO: 126372 - protein, 9 aa, Homo Sapiens
GSPRSSAQG

SEQ ID NO: 126373 - protein, 9 aa, Homo Sapiens
YHKWLLELN

SEQ ID NO: 126374 - protein, 9 aa, Homo Sapiens
RLWPASRLI

SEQ ID NO: 126375 - protein, 9 aa, Homo Sapiens
SWRENRPYY

SEQ ID NO: 126376 - protein, 9 aa, Homo Sapiens
AQVRKPFLR

SEQ ID NO: 126377 - protein, 9 aa, Homo Sapiens
PQPLAEPFP

SEQ ID NO: 126378 - protein, 9 aa, Homo Sapiens
VLLSKGAEA

SEQ ID NO: 126379 - protein, 9 aa, Homo Sapiens
AATGRKTTE

SEQ ID NO: 126380 - protein, 9 aa, Homo Sapiens
VNSMVQQHL

SEQ ID NO: 126381 - protein, 9 aa, Homo Sapiens
SPRSSCSRP

SEQ ID NO: 126382 - protein, 9 aa, Homo Sapiens
ALPGPRDAS

SEQ ID NO: 126383 - protein, 9 aa, Homo Sapiens
LTQARLAWE

SEQ ID NO: 126384 - protein, 9 aa, Homo Sapiens
NGHITGVDW

SEQ ID NO: 126385 - protein, 9 aa, Homo Sapiens
RQVEARFLP

SEQ ID NO: 126386 - protein, 9 aa, Homo Sapiens
TALNDGKSY

SEQ ID NO: 126387 - protein, 9 aa, Homo Sapiens
KCHTSYEEF

SEQ ID NO: 126388 - protein, 9 aa, Homo Sapiens
WELGGPCAW

SEQ ID NO: 126389 - protein, 9 aa, Homo Sapiens
LSPKTKKIY

SEQ ID NO: 126390 - protein, 9 aa, Homo Sapiens
PFPRYDLTN

SEQ ID NO: 126391 - protein, 9 aa, Homo Sapiens
IGSKKPQKP

SEQ ID NO: 126392 - protein, 9 aa, Homo Sapiens
KCWSWRENR

SEQ ID NO: 126393 - protein, 9 aa, Homo Sapiens
EIVHKLMGD

SEQ ID NO: 126394 - protein, 9 aa, Homo Sapiens
SSRLPPTYM

SEQ ID NO: 126395 - protein, 9 aa, Homo Sapiens
GPGQIWRAE

SEQ ID NO: 126396 - protein, 9 aa, Homo Sapiens
GDIICYYGN

SEQ ID NO: 126397 - protein, 9 aa, Homo Sapiens
DFVLSASRP

SEQ ID NO: 126398 - protein, 9 aa, Homo Sapiens
VEFTGLETY

SEQ ID NO: 126399 - protein, 9 aa, Homo Sapiens
RCAALNHLG

SEQ ID NO: 126400 - protein, 9 aa, Homo Sapiens
DTASLRRQI

SEQ ID NO: 126401 - protein, 9 aa, Homo Sapiens
ETVTLTVST

SEQ ID NO: 126402 - protein, 9 aa, Homo Sapiens
HLSSHWLDE

SEQ ID NO: 126403 - protein, 9 aa, Homo Sapiens
RRGSSPPCL

SEQ ID NO: 126404 - protein, 9 aa, Homo Sapiens
KQIELMTVE

SEQ ID NO: 126405 - protein, 9 aa, Homo Sapiens
QCDAEVTRL

SEQ ID NO: 126406 - protein, 9 aa, Homo Sapiens
VQSSTNLLT

SEQ ID NO: 126407 - protein, 9 aa, Homo Sapiens
VIQLVAKLR

SEQ ID NO: 126408 - protein, 9 aa, Homo Sapiens
VVPVLNLNL

SEQ ID NO: 126409 - protein, 9 aa, Homo Sapiens
SHGSPFTSA

SEQ ID NO: 126410 - protein, 9 aa, Homo Sapiens
TKHTYDYDG

SEQ ID NO: 126411 - protein, 9 aa, Homo Sapiens
TIIKSAMGT

SEQ ID NO: 126412 - protein, 9 aa, Homo Sapiens
LAEVQSETE

SEQ ID NO: 126413 - protein, 9 aa, Homo Sapiens
GLMNSCKPN

SEQ ID NO: 126414 - protein, 9 aa, Homo Sapiens
GAQHPPLIH

SEQ ID NO: 126415 - protein, 9 aa, Homo Sapiens
CASVVQVMT

SEQ ID NO: 126416 - protein, 9 aa, Homo Sapiens
VAVSAEGWL

SEQ ID NO: 126417 - protein, 9 aa, Homo Sapiens
LLNEMTHKF

SEQ ID NO: 126418 - protein, 9 aa, Homo Sapiens
VPQKFHGKK

SEQ ID NO: 126419 - protein, 9 aa, Homo Sapiens
LLAPPPRAP

SEQ ID NO: 126420 - protein, 9 aa, Homo Sapiens
ALSREELET

SEQ ID NO: 126421 - protein, 9 aa, Homo Sapiens
AVFQGKKNT

SEQ ID NO: 126422 - protein, 9 aa, Homo Sapiens
VIRDITYYK

SEQ ID NO: 126423 - protein, 9 aa, Homo Sapiens
DMLSPNSSC

SEQ ID NO: 126424 - protein, 9 aa, Homo Sapiens
IQQVLESGG

SEQ ID NO: 126425 - protein, 9 aa, Homo Sapiens
NLQGGCLLL

SEQ ID NO: 126426 - protein, 9 aa, Homo Sapiens
SGVEGIRLP

SEQ ID NO: 126427 - protein, 9 aa, Homo Sapiens
CACVGNVKQ

SEQ ID NO: 126428 - protein, 9 aa, Homo Sapiens
SHPTTREVT

SEQ ID NO: 126429 - protein, 9 aa, Homo Sapiens
GAPHPADRG

SEQ ID NO: 126430 - protein, 9 aa, Homo Sapiens
KKMLSVFST

SEQ ID NO: 126431 - protein, 9 aa, Homo Sapiens
GSEVWRRVW

SEQ ID NO: 126432 - protein, 9 aa, Homo Sapiens
VQEVDVILE

SEQ ID NO: 126433 - protein, 9 aa, Homo Sapiens
FYTSRVLCI

SEQ ID NO: 126434 - protein, 9 aa, Homo Sapiens
DCQPGTGFF

SEQ ID NO: 126435 - protein, 9 aa, Homo Sapiens
TYHQGVVIV

SEQ ID NO: 126436 - protein, 9 aa, Homo Sapiens
SWRKQHLLP

SEQ ID NO: 126437 - protein, 9 aa, Homo Sapiens
ERSRSWRKQ

SEQ ID NO: 126438 - protein, 9 aa, Homo Sapiens
HTALFLGGL

SEQ ID NO: 126439 - protein, 9 aa, Homo Sapiens
ILKDVVKFM

SEQ ID NO: 126440 - protein, 9 aa, Homo Sapiens
KEDLGRSHG

SEQ ID NO: 126441 - protein, 9 aa, Homo Sapiens
AFACACGLG

SEQ ID NO: 126442 - protein, 9 aa, Homo Sapiens
QRLAEYSPP

SEQ ID NO: 126443 - protein, 9 aa, Homo Sapiens
SSDSEWPCW

SEQ ID NO: 126444 - protein, 9 aa, Homo Sapiens
PGQIWRAES

SEQ ID NO: 126445 - protein, 9 aa, Homo Sapiens
ARNAGPVGE

SEQ ID NO: 126446 - protein, 9 aa, Homo Sapiens
ADSSSTLVS

SEQ ID NO: 126447 - protein, 9 aa, Homo Sapiens
CVHPFIFAL

SEQ ID NO: 126448 - protein, 9 aa, Homo Sapiens
FLSDSLLDI

SEQ ID NO: 126449 - protein, 9 aa, Homo Sapiens
SRPSESCLI

SEQ ID NO: 126450 - protein, 9 aa, Homo Sapiens
VTSRAAPPH

SEQ ID NO: 126451 - protein, 9 aa, Homo Sapiens
YTHHNLSQS

SEQ ID NO: 126452 - protein, 9 aa, Homo Sapiens
YVIHQEIGR

SEQ ID NO: 126453 - protein, 9 aa, Homo Sapiens
RKEENQAVK

SEQ ID NO: 126454 - protein, 9 aa, Homo Sapiens
TKPKIEHTY

SEQ ID NO: 126455 - protein, 9 aa, Homo Sapiens
LQPPIAEEG

SEQ ID NO: 126456 - protein, 9 aa, Homo Sapiens
LQDHHLHHT

SEQ ID NO: 126457 - protein, 9 aa, Homo Sapiens
KLGSVADFL

SEQ ID NO: 126458 - protein, 9 aa, Homo Sapiens
LSQCQLLGV

SEQ ID NO: 126459 - protein, 9 aa, Homo Sapiens
RLFHTALFL

SEQ ID NO: 126460 - protein, 9 aa, Homo Sapiens
TLQRRMLKV

SEQ ID NO: 126461 - protein, 9 aa, Homo Sapiens
PQQLHHPQQ

SEQ ID NO: 126462 - protein, 9 aa, Homo Sapiens
SQHRFRGHL

SEQ ID NO: 126463 - protein, 9 aa, Homo Sapiens
LPMQESQLC

SEQ ID NO: 126464 - protein, 9 aa, Homo Sapiens
DATALTNRS

SEQ ID NO: 126465 - protein, 9 aa, Homo Sapiens
KMLQHIGYR

SEQ ID NO: 126466 - protein, 9 aa, Homo Sapiens
VLVEQVAEV

SEQ ID NO: 126467 - protein, 9 aa, Homo Sapiens
SDLLPPPPP

SEQ ID NO: 126468 - protein, 9 aa, Homo Sapiens
GATSSRPLA

SEQ ID NO: 126469 - protein, 9 aa, Homo Sapiens
IMEMNKCLT

SEQ ID NO: 126470 - protein, 9 aa, Homo Sapiens
ATGCFVAKD

SEQ ID NO: 126471 - protein, 9 aa, Homo Sapiens
RKKKTHLGK

SEQ ID NO: 126472 - protein, 9 aa, Homo Sapiens
THRTGPRSP

SEQ ID NO: 126473 - protein, 9 aa, Homo Sapiens
DQDYNMCVA

SEQ ID NO: 126474 - protein, 9 aa, Homo Sapiens
PQTEHTPAL

SEQ ID NO: 126475 - protein, 9 aa, Homo Sapiens
LHMHLVWGS

SEQ ID NO: 126476 - protein, 9 aa, Homo Sapiens
VDGEADTKM

SEQ ID NO: 126477 - protein, 9 aa, Homo Sapiens
LQVACLNQE

SEQ ID NO: 126478 - protein, 9 aa, Homo Sapiens
RANLPVGAP

SEQ ID NO: 126479 - protein, 9 aa, Homo Sapiens
MKFVTSFLT

SEQ ID NO: 126480 - protein, 9 aa, Homo Sapiens
PYAGGVGAQ

SEQ ID NO: 126481 - protein, 9 aa, Homo Sapiens
YCSYAPHVQ

SEQ ID NO: 126482 - protein, 9 aa, Homo Sapiens
SVDRHGKIG

SEQ ID NO: 126483 - protein, 9 aa, Homo Sapiens
PTSMLILSN

SEQ ID NO: 126484 - protein, 9 aa, Homo Sapiens
EKLTDAMVW

SEQ ID NO: 126485 - protein, 9 aa, Homo Sapiens
RRCRNGENT

SEQ ID NO: 126486 - protein, 9 aa, Homo Sapiens
SVRAGNLQA

SEQ ID NO: 126487 - protein, 9 aa, Homo Sapiens
SIEFDIIPS

SEQ ID NO: 126488 - protein, 9 aa, Homo Sapiens
SPSLLRAGV

SEQ ID NO: 126489 - protein, 9 aa, Homo Sapiens
PGCNYDQLI

SEQ ID NO: 126490 - protein, 9 aa, Homo Sapiens
DAYSIQRQH

SEQ ID NO: 126491 - protein, 9 aa, Homo Sapiens
EDLDELHRA

SEQ ID NO: 126492 - protein, 9 aa, Homo Sapiens
SHDEQRAKA

SEQ ID NO: 126493 - protein, 9 aa, Homo Sapiens
PHVTVRPPG

SEQ ID NO: 126494 - protein, 9 aa, Homo Sapiens
WLSLQNLMR

SEQ ID NO: 126495 - protein, 9 aa, Homo Sapiens
KEKELEALS

SEQ ID NO: 126496 - protein, 9 aa, Homo Sapiens
ASHPLFGRL

SEQ ID NO: 126497 - protein, 9 aa, Homo Sapiens
SISTKAPTT

SEQ ID NO: 126498 - protein, 9 aa, Homo Sapiens
GIRQGFCCS

SEQ ID NO: 126499 - protein, 9 aa, Homo Sapiens
TEGNCSNYP

SEQ ID NO: 126500 - protein, 9 aa, Homo Sapiens
TGVKPYNCE

SEQ ID NO: 126501 - protein, 9 aa, Homo Sapiens
CPSGRRCRN

SEQ ID NO: 126502 - protein, 9 aa, Homo Sapiens
DIDNLNPVL

SEQ ID NO: 126503 - protein, 9 aa, Homo Sapiens
IPPHAGGHR

SEQ ID NO: 126504 - protein, 9 aa, Homo Sapiens
KSRIALNFA

SEQ ID NO: 126505 - protein, 9 aa, Homo Sapiens
IMNEHLFKQ

SEQ ID NO: 126506 - protein, 9 aa, Homo Sapiens
EGLAPPAGL

SEQ ID NO: 126507 - protein, 9 aa, Homo Sapiens
YSGTQNDVD

SEQ ID NO: 126508 - protein, 9 aa, Homo Sapiens
METSNAYIA

SEQ ID NO: 126509 - protein, 9 aa, Homo Sapiens
SMSGNYLPS

SEQ ID NO: 126510 - protein, 9 aa, Homo Sapiens
IDTLKQKRL

SEQ ID NO: 126511 - protein, 9 aa, Homo Sapiens
VVATSPSLE

SEQ ID NO: 126512 - protein, 9 aa, Homo Sapiens
VVNNFFVTE

SEQ ID NO: 126513 - protein, 9 aa, Homo Sapiens
WDAWKVRLR

SEQ ID NO: 126514 - protein, 9 aa, Homo Sapiens
KSCSSHSNS

SEQ ID NO: 126515 - protein, 9 aa, Homo Sapiens
APVTAANDS

SEQ ID NO: 126516 - protein, 9 aa, Homo Sapiens
APGGAAPGP

SEQ ID NO: 126517 - protein, 9 aa, Homo Sapiens
ITLLDLINF

SEQ ID NO: 126518 - protein, 9 aa, Homo Sapiens
VCDDSWNSK

SEQ ID NO: 126519 - protein, 9 aa, Homo Sapiens
HSNCLVSLD

SEQ ID NO: 126520 - protein, 9 aa, Homo Sapiens
KKVLHMDRS

SEQ ID NO: 126521 - protein, 9 aa, Homo Sapiens
SHVLMKICL

SEQ ID NO: 126522 - protein, 9 aa, Homo Sapiens
QEVPKCEWE

SEQ ID NO: 126523 - protein, 9 aa, Homo Sapiens
IWLDTSLRK

SEQ ID NO: 126524 - protein, 9 aa, Homo Sapiens
TTRPPIPHR

SEQ ID NO: 126525 - protein, 9 aa, Homo Sapiens
QPRDYSGGK

SEQ ID NO: 126526 - protein, 9 aa, Homo Sapiens
GYGGPAPGR

SEQ ID NO: 126527 - protein, 9 aa, Homo Sapiens
TILVSLTLA

SEQ ID NO: 126528 - protein, 9 aa, Homo Sapiens
LRMEADFYQ

SEQ ID NO: 126529 - protein, 9 aa, Homo Sapiens
DKVNQWCEA

SEQ ID NO: 126530 - protein, 9 aa, Homo Sapiens
LSHLLEVLE

SEQ ID NO: 126531 - protein, 9 aa, Homo Sapiens
GTTCPPTSC

SEQ ID NO: 126532 - protein, 9 aa, Homo Sapiens
DDTLGSFPL

SEQ ID NO: 126533 - protein, 9 aa, Homo Sapiens
SPCQTSCYS

SEQ ID NO: 126534 - protein, 9 aa, Homo Sapiens
VSLTLAFLA

SEQ ID NO: 126535 - protein, 9 aa, Homo Sapiens
LLFKLNTKH

SEQ ID NO: 126536 - protein, 9 aa, Homo Sapiens
LGEMHLKEA

SEQ ID NO: 126537 - protein, 9 aa, Homo Sapiens
DSRKRRAPR

SEQ ID NO: 126538 - protein, 9 aa, Homo Sapiens
GLLNWHSNS

SEQ ID NO: 126539 - protein, 9 aa, Homo Sapiens
CRHSVPEAE

SEQ ID NO: 126540 - protein, 9 aa, Homo Sapiens
GSFLMGPEP

SEQ ID NO: 126541 - protein, 9 aa, Homo Sapiens
SDFYVIHQE

SEQ ID NO: 126542 - protein, 9 aa, Homo Sapiens
TAVREASSL

SEQ ID NO: 126543 - protein, 9 aa, Homo Sapiens
PVFGKAILT

SEQ ID NO: 126544 - protein, 9 aa, Homo Sapiens
PLQTDYYAA

SEQ ID NO: 126545 - protein, 9 aa, Homo Sapiens
FEVVAPEEQ

SEQ ID NO: 126546 - protein, 9 aa, Homo Sapiens
KVSEYTSST

SEQ ID NO: 126547 - protein, 9 aa, Homo Sapiens
LYLMSLGIY

SEQ ID NO: 126548 - protein, 9 aa, Homo Sapiens
EQRDDISLC

SEQ ID NO: 126549 - protein, 9 aa, Homo Sapiens
KRRGSSPPC

SEQ ID NO: 126550 - protein, 9 aa, Homo Sapiens
LSQYSQVFQ

SEQ ID NO: 126551 - protein, 9 aa, Homo Sapiens
QQDQSSLVV

SEQ ID NO: 126552 - protein, 9 aa, Homo Sapiens
PSTNLQQML

SEQ ID NO: 126553 - protein, 9 aa, Homo Sapiens
FFILVPRLE

SEQ ID NO: 126554 - protein, 9 aa, Homo Sapiens
SLMKVSLLF

SEQ ID NO: 126555 - protein, 9 aa, Homo Sapiens
PPRAAPPPP

SEQ ID NO: 126556 - protein, 9 aa, Homo Sapiens
VRARRCILL

SEQ ID NO: 126557 - protein, 9 aa, Homo Sapiens
GIGETCKIG

SEQ ID NO: 126558 - protein, 9 aa, Homo Sapiens
LERVVCASV

SEQ ID NO: 126559 - protein, 9 aa, Homo Sapiens
EIYDHYGRE

SEQ ID NO: 126560 - protein, 9 aa, Homo Sapiens
FQLTKHLWN

SEQ ID NO: 126561 - protein, 9 aa, Homo Sapiens
FQGKKNTFD

SEQ ID NO: 126562 - protein, 9 aa, Homo Sapiens
PPRWHLRVV

SEQ ID NO: 126563 - protein, 9 aa, Homo Sapiens
YNSSGLQDG

SEQ ID NO: 126564 - protein, 9 aa, Homo Sapiens
ANDFRDVFK

SEQ ID NO: 126565 - protein, 9 aa, Homo Sapiens
AHMTGSVDF

SEQ ID NO: 126566 - protein, 9 aa, Homo Sapiens
GVTLQSMLI

SEQ ID NO: 126567 - protein, 9 aa, Homo Sapiens
LLRACSCPR

SEQ ID NO: 126568 - protein, 9 aa, Homo Sapiens
EVTVESHMK

SEQ ID NO: 126569 - protein, 9 aa, Homo Sapiens
ALQSLTCGK

SEQ ID NO: 126570 - protein, 9 aa, Homo Sapiens
CKKEFEVNP

SEQ ID NO: 126571 - protein, 9 aa, Homo Sapiens
NTTTEDQLF

SEQ ID NO: 126572 - protein, 9 aa, Homo Sapiens
SYSSVFRKH

SEQ ID NO: 126573 - protein, 9 aa, Homo Sapiens
GRTSVHVFR

SEQ ID NO: 126574 - protein, 9 aa, Homo Sapiens
FVQNCISLN

SEQ ID NO: 126575 - protein, 9 aa, Homo Sapiens
LTKFNVWRK

SEQ ID NO: 126576 - protein, 9 aa, Homo Sapiens
VPEYINQSI

SEQ ID NO: 126577 - protein, 9 aa, Homo Sapiens
LCQPYRSEF

SEQ ID NO: 126578 - protein, 9 aa, Homo Sapiens
VERAMRAAR

SEQ ID NO: 126579 - protein, 9 aa, Homo Sapiens
LVSLETLNH

SEQ ID NO: 126580 - protein, 9 aa, Homo Sapiens
QQLTLQVAC

SEQ ID NO: 126581 - protein, 9 aa, Homo Sapiens
RVCMLAANR

SEQ ID NO: 126582 - protein, 9 aa, Homo Sapiens
SCERSPSPL

SEQ ID NO: 126583 - protein, 9 aa, Homo Sapiens
PLSPGATLT

SEQ ID NO: 126584 - protein, 9 aa, Homo Sapiens
MRDKKRRSK

SEQ ID NO: 126585 - protein, 9 aa, Homo Sapiens
MVSDWYKQH

SEQ ID NO: 126586 - protein, 9 aa, Homo Sapiens
SAMTLPYPQ

SEQ ID NO: 126587 - protein, 9 aa, Homo Sapiens
RSQCECHRG

SEQ ID NO: 126588 - protein, 9 aa, Homo Sapiens
PQLPEAWPG

SEQ ID NO: 126589 - protein, 9 aa, Homo Sapiens
TLPYPQFEQ

SEQ ID NO: 126590 - protein, 9 aa, Homo Sapiens
PQGTLYSLQ

SEQ ID NO: 126591 - protein, 9 aa, Homo Sapiens
QGALLRACS

SEQ ID NO: 126592 - protein, 9 aa, Homo Sapiens
RRCCRQPPH

SEQ ID NO: 126593 - protein, 9 aa, Homo Sapiens
RKTTEEALA

SEQ ID NO: 126594 - protein, 9 aa, Homo Sapiens
DFYNNNRTS

SEQ ID NO: 126595 - protein, 9 aa, Homo Sapiens
LLGTFRRVL

SEQ ID NO: 126596 - protein, 9 aa, Homo Sapiens
LVSLTLAFL

SEQ ID NO: 126597 - protein, 9 aa, Homo Sapiens
GSIVLSLAR

SEQ ID NO: 126598 - protein, 9 aa, Homo Sapiens
RNLRGQQKE

SEQ ID NO: 126599 - protein, 9 aa, Homo Sapiens
LVSGMRVPK

SEQ ID NO: 126600 - protein, 9 aa, Homo Sapiens
CHAKETWNC

SEQ ID NO: 126601 - protein, 9 aa, Homo Sapiens
SFASRSIMS

SEQ ID NO: 126602 - protein, 9 aa, Homo Sapiens
IKLYQQCIL

SEQ ID NO: 126603 - protein, 9 aa, Homo Sapiens
NLDSLGLSG

SEQ ID NO: 126604 - protein, 9 aa, Homo Sapiens
SSPRLNGGV

SEQ ID NO: 126605 - protein, 9 aa, Homo Sapiens
PSADKRKYV

SEQ ID NO: 126606 - protein, 9 aa, Homo Sapiens
KHTQGRSPM

SEQ ID NO: 126607 - protein, 9 aa, Homo Sapiens
PRVGCLHSQ

SEQ ID NO: 126608 - protein, 9 aa, Homo Sapiens
NDALFYHFL

SEQ ID NO: 126609 - protein, 9 aa, Homo Sapiens
EQRHTYPVC

SEQ ID NO: 126610 - protein, 9 aa, Homo Sapiens
SKLFWLSSC

SEQ ID NO: 126611 - protein, 9 aa, Homo Sapiens
DRSTAATGH

SEQ ID NO: 126612 - protein, 9 aa, Homo Sapiens
RGASTSSVT

SEQ ID NO: 126613 - protein, 9 aa, Homo Sapiens
GKTSLMIMK

SEQ ID NO: 126614 - protein, 9 aa, Homo Sapiens
RISKLTYHQ

SEQ ID NO: 126615 - protein, 9 aa, Homo Sapiens
LTIMDISPP

SEQ ID NO: 126616 - protein, 9 aa, Homo Sapiens
LVGLAKLLL

SEQ ID NO: 126617 - protein, 9 aa, Homo Sapiens
LPNNNSRPS

SEQ ID NO: 126618 - protein, 9 aa, Homo Sapiens
PPIQTNVVP

SEQ ID NO: 126619 - protein, 9 aa, Homo Sapiens
GAAAVFSAL

SEQ ID NO: 126620 - protein, 9 aa, Homo Sapiens
GFLVIEEHE

SEQ ID NO: 126621 - protein, 9 aa, Homo Sapiens
LAVTPDAYS

SEQ ID NO: 126622 - protein, 9 aa, Homo Sapiens
VIGTPTQKI

SEQ ID NO: 126623 - protein, 9 aa, Homo Sapiens
KTEATGSGT

SEQ ID NO: 126624 - protein, 9 aa, Homo Sapiens
AIIQHGKIA

SEQ ID NO: 126625 - protein, 9 aa, Homo Sapiens
GKAILTRYR

SEQ ID NO: 126626 - protein, 9 aa, Homo Sapiens
PSWPWTRCL

SEQ ID NO: 126627 - protein, 9 aa, Homo Sapiens
YYRLSSYFQ

SEQ ID NO: 126628 - protein, 9 aa, Homo Sapiens
YFLLKGVPL

SEQ ID NO: 126629 - protein, 9 aa, Homo Sapiens
PLVSGTAVT

SEQ ID NO: 126630 - protein, 9 aa, Homo Sapiens
NKEAHLTSY

SEQ ID NO: 126631 - protein, 9 aa, Homo Sapiens
CLKCTSVGW

SEQ ID NO: 126632 - protein, 9 aa, Homo Sapiens
TVCDDSWNS

SEQ ID NO: 126633 - protein, 9 aa, Homo Sapiens
KPALHMVSS

SEQ ID NO: 126634 - protein, 9 aa, Homo Sapiens
SFLYNREKA

SEQ ID NO: 126635 - protein, 9 aa, Homo Sapiens
NKHRADGGL

SEQ ID NO: 126636 - protein, 9 aa, Homo Sapiens
NPQLPEAWP

SEQ ID NO: 126637 - protein, 9 aa, Homo Sapiens
RGPPEPQGQ

SEQ ID NO: 126638 - protein, 9 aa, Homo Sapiens
PRVPLCPSG

SEQ ID NO: 126639 - protein, 9 aa, Homo Sapiens
GHCQELLAW

SEQ ID NO: 126640 - protein, 9 aa, Homo Sapiens
NPHLPIMRK

SEQ ID NO: 126641 - protein, 9 aa, Homo Sapiens
ASASAIIQH

SEQ ID NO: 126642 - protein, 9 aa, Homo Sapiens
AKIMNEHLF

SEQ ID NO: 126643 - protein, 9 aa, Homo Sapiens
DGEDPGGAE

SEQ ID NO: 126644 - protein, 9 aa, Homo Sapiens
TTCPPTSCP

SEQ ID NO: 126645 - protein, 9 aa, Homo Sapiens
RTRKGQEVL

SEQ ID NO: 126646 - protein, 9 aa, Homo Sapiens
YEDKVCVWQ

SEQ ID NO: 126647 - protein, 9 aa, Homo Sapiens
TGHIPHLTC

SEQ ID NO: 126648 - protein, 9 aa, Homo Sapiens
NECSTIPGI

SEQ ID NO: 126649 - protein, 9 aa, Homo Sapiens
GLSHCLGDP

SEQ ID NO: 126650 - protein, 9 aa, Homo Sapiens
SLLAEVCHQ

SEQ ID NO: 126651 - protein, 9 aa, Homo Sapiens
PCLCPSSSP

SEQ ID NO: 126652 - protein, 9 aa, Homo Sapiens
SSPAKINEV

SEQ ID NO: 126653 - protein, 9 aa, Homo Sapiens
ALDRRGGPG

SEQ ID NO: 126654 - protein, 9 aa, Homo Sapiens
GPRLRGETT

SEQ ID NO: 126655 - protein, 9 aa, Homo Sapiens
LLKTLLKME

SEQ ID NO: 126656 - protein, 9 aa, Homo Sapiens
RYSERVEKT

SEQ ID NO: 126657 - protein, 9 aa, Homo Sapiens
LMWRVGNLC

SEQ ID NO: 126658 - protein, 9 aa, Homo Sapiens
GLPAGEQDV

SEQ ID NO: 126659 - protein, 9 aa, Homo Sapiens
HVMHLSSHW

SEQ ID NO: 126660 - protein, 9 aa, Homo Sapiens
EGLESYVTD

SEQ ID NO: 126661 - protein, 9 aa, Homo Sapiens
PAYAATGFP

SEQ ID NO: 126662 - protein, 9 aa, Homo Sapiens
LSHINTRLN

SEQ ID NO: 126663 - protein, 9 aa, Homo Sapiens
FFHSVCLAG

SEQ ID NO: 126664 - protein, 9 aa, Homo Sapiens
GSHRLDPIM

SEQ ID NO: 126665 - protein, 9 aa, Homo Sapiens
DFTQEEWVM

SEQ ID NO: 126666 - protein, 9 aa, Homo Sapiens
HEYAVKIIN

SEQ ID NO: 126667 - protein, 9 aa, Homo Sapiens
PGAPAVPAA

SEQ ID NO: 126668 - protein, 9 aa, Homo Sapiens
GFYPSDVAV

SEQ ID NO: 126669 - protein, 9 aa, Homo Sapiens
SHQDHGIQS

SEQ ID NO: 126670 - protein, 9 aa, Homo Sapiens
HVQICMPLT

SEQ ID NO: 126671 - protein, 9 aa, Homo Sapiens
QQPPSPLPP

SEQ ID NO: 126672 - protein, 9 aa, Homo Sapiens
LKKAKDRMG

SEQ ID NO: 126673 - protein, 9 aa, Homo Sapiens
PQRCGWWRL

SEQ ID NO: 126674 - protein, 9 aa, Homo Sapiens
TGRRSRRSK

SEQ ID NO: 126675 - protein, 9 aa, Homo Sapiens
QDLDRGLHK

SEQ ID NO: 126676 - protein, 9 aa, Homo Sapiens
EPIQVKRDL

SEQ ID NO: 126677 - protein, 9 aa, Homo Sapiens
ESGVTLQSM

SEQ ID NO: 126678 - protein, 9 aa, Homo Sapiens
LEFPVCGLY

SEQ ID NO: 126679 - protein, 9 aa, Homo Sapiens
SMRDKKRRS

SEQ ID NO: 126680 - protein, 9 aa, Homo Sapiens
EKTVISSKR

SEQ ID NO: 126681 - protein, 9 aa, Homo Sapiens
CLAIDPLAG

SEQ ID NO: 126682 - protein, 9 aa, Homo Sapiens
LPSPRPPPL

SEQ ID NO: 126683 - protein, 9 aa, Homo Sapiens
ASLPPTSPQ

SEQ ID NO: 126684 - protein, 9 aa, Homo Sapiens
GQVSKNILF

SEQ ID NO: 126685 - protein, 9 aa, Homo Sapiens
PDDGAITPW

SEQ ID NO: 126686 - protein, 9 aa, Homo Sapiens
KKDKGEDQV

SEQ ID NO: 126687 - protein, 9 aa, Homo Sapiens
SVRLFVNRF

SEQ ID NO: 126688 - protein, 9 aa, Homo Sapiens
LSRKQTWKI

SEQ ID NO: 126689 - protein, 9 aa, Homo Sapiens
GGIQKVLCA

SEQ ID NO: 126690 - protein, 9 aa, Homo Sapiens
ALGLVREVT

SEQ ID NO: 126691 - protein, 9 aa, Homo Sapiens
SSKQEYLSM

SEQ ID NO: 126692 - protein, 9 aa, Homo Sapiens
NSETSKATS

SEQ ID NO: 126693 - protein, 9 aa, Homo Sapiens
DFSLFCAPW

SEQ ID NO: 126694 - protein, 9 aa, Homo Sapiens
AAETESGVT

SEQ ID NO: 126695 - protein, 9 aa, Homo Sapiens
FVVDLAVNV

SEQ ID NO: 126696 - protein, 9 aa, Homo Sapiens
FEEVLHKML

SEQ ID NO: 126697 - protein, 9 aa, Homo Sapiens
IVHRHPRFD

SEQ ID NO: 126698 - protein, 9 aa, Homo Sapiens
CAVLAAVAE

SEQ ID NO: 126699 - protein, 9 aa, Homo Sapiens
NGEICLKCT

SEQ ID NO: 126700 - protein, 9 aa, Homo Sapiens
CSGNRTWYQ

SEQ ID NO: 126701 - protein, 9 aa, Homo Sapiens
QSCLEAQKF

SEQ ID NO: 126702 - protein, 9 aa, Homo Sapiens
MNAAITEEL

SEQ ID NO: 126703 - protein, 9 aa, Homo Sapiens
GRLPNNNSR

SEQ ID NO: 126704 - protein, 9 aa, Homo Sapiens
CKRICRGGP

SEQ ID NO: 126705 - protein, 9 aa, Homo Sapiens
NIMKKSQRG

SEQ ID NO: 126706 - protein, 9 aa, Homo Sapiens
QNESPKKKP

SEQ ID NO: 126707 - protein, 9 aa, Homo Sapiens
TATTGPTAT

SEQ ID NO: 126708 - protein, 9 aa, Homo Sapiens
IQHFCTQYG

SEQ ID NO: 126709 - protein, 9 aa, Homo Sapiens
RFDGRPSSH

SEQ ID NO: 126710 - protein, 9 aa, Homo Sapiens
MDLHNFQNM

SEQ ID NO: 126711 - protein, 9 aa, Homo Sapiens
AVKGLVQRV

SEQ ID NO: 126712 - protein, 9 aa, Homo Sapiens
NREREIVPV

SEQ ID NO: 126713 - protein, 9 aa, Homo Sapiens
INGLVTSSP

SEQ ID NO: 126714 - protein, 9 aa, Homo Sapiens
IYIVLTTRK

SEQ ID NO: 126715 - protein, 9 aa, Homo Sapiens
SPCIKEQML

SEQ ID NO: 126716 - protein, 9 aa, Homo Sapiens
NYKACFSMP

SEQ ID NO: 126717 - protein, 9 aa, Homo Sapiens
LPLPNRETG

SEQ ID NO: 126718 - protein, 9 aa, Homo Sapiens
RSKSVDKCM

SEQ ID NO: 126719 - protein, 9 aa, Homo Sapiens
STCALPSCA

SEQ ID NO: 126720 - protein, 9 aa, Homo Sapiens
PWPSYVKHV

SEQ ID NO: 126721 - protein, 9 aa, Homo Sapiens
EYRRSEQDG

SEQ ID NO: 126722 - protein, 9 aa, Homo Sapiens
GVQVRARRC

SEQ ID NO: 126723 - protein, 9 aa, Homo Sapiens
ATAVTTRPP

SEQ ID NO: 126724 - protein, 9 aa, Homo Sapiens
KGLCGVIIS

SEQ ID NO: 126725 - protein, 9 aa, Homo Sapiens
HTSYEEFTH

SEQ ID NO: 126726 - protein, 9 aa, Homo Sapiens
VKELILSPG

SEQ ID NO: 126727 - protein, 9 aa, Homo Sapiens
GTSTVVCVG

SEQ ID NO: 126728 - protein, 9 aa, Homo Sapiens
VIKPNSEHF

SEQ ID NO: 126729 - protein, 9 aa, Homo Sapiens
RAVCTAPCG

SEQ ID NO: 126730 - protein, 9 aa, Homo Sapiens
IEIYDFPQK

SEQ ID NO: 126731 - protein, 9 aa, Homo Sapiens
IKDSVMFLS

SEQ ID NO: 126732 - protein, 9 aa, Homo Sapiens
HHHLIGQVA

SEQ ID NO: 126733 - protein, 9 aa, Homo Sapiens
CLGDPGLFR

SEQ ID NO: 126734 - protein, 9 aa, Homo Sapiens
LSDYRTNAS

SEQ ID NO: 126735 - protein, 9 aa, Homo Sapiens
VLVICHPDS

SEQ ID NO: 126736 - protein, 9 aa, Homo Sapiens
NARRQEHRQ

SEQ ID NO: 126737 - protein, 9 aa, Homo Sapiens
LSTAKGDII

SEQ ID NO: 126738 - protein, 9 aa, Homo Sapiens
QARNAGPVG

SEQ ID NO: 126739 - protein, 9 aa, Homo Sapiens
DDLCRYITS

SEQ ID NO: 126740 - protein, 9 aa, Homo Sapiens
VCADTTLFE

SEQ ID NO: 126741 - protein, 9 aa, Homo Sapiens
ELRLFLAQC

SEQ ID NO: 126742 - protein, 9 aa, Homo Sapiens
NEHLFKQAW

SEQ ID NO: 126743 - protein, 9 aa, Homo Sapiens
LREMKDYTI

SEQ ID NO: 126744 - protein, 9 aa, Homo Sapiens
TVPECSEIL

SEQ ID NO: 126745 - protein, 9 aa, Homo Sapiens
LVGDDGREY

SEQ ID NO: 126746 - protein, 9 aa, Homo Sapiens
DEVTCQLQA

SEQ ID NO: 126747 - protein, 9 aa, Homo Sapiens
LILICDQLF

SEQ ID NO: 126748 - protein, 9 aa, Homo Sapiens
KEAQKMQSG

SEQ ID NO: 126749 - protein, 9 aa, Homo Sapiens
PALHMVSSE

SEQ ID NO: 126750 - protein, 9 aa, Homo Sapiens
DIEEPIQVK

SEQ ID NO: 126751 - protein, 9 aa, Homo Sapiens
QPPSPLPPQ

SEQ ID NO: 126752 - protein, 9 aa, Homo Sapiens
DPGLFRTNG

SEQ ID NO: 126753 - protein, 9 aa, Homo Sapiens
GDKPFMCPF

SEQ ID NO: 126754 - protein, 9 aa, Homo Sapiens
GMVKRAKKV

SEQ ID NO: 126755 - protein, 9 aa, Homo Sapiens
HQILHILAV

SEQ ID NO: 126756 - protein, 9 aa, Homo Sapiens
PPLEKTMEL

SEQ ID NO: 126757 - protein, 9 aa, Homo Sapiens
PCGPPLGAS

SEQ ID NO: 126758 - protein, 9 aa, Homo Sapiens
KTQVTNNHG

SEQ ID NO: 126759 - protein, 9 aa, Homo Sapiens
RISVQPPRP

SEQ ID NO: 126760 - protein, 9 aa, Homo Sapiens
KKCKPIDVF

SEQ ID NO: 126761 - protein, 9 aa, Homo Sapiens
AKLLLGFLV

SEQ ID NO: 126762 - protein, 9 aa, Homo Sapiens
MPLKKSRQC

SEQ ID NO: 126763 - protein, 9 aa, Homo Sapiens
GQKMKRISV

SEQ ID NO: 126764 - protein, 9 aa, Homo Sapiens
SFDNHCQER

SEQ ID NO: 126765 - protein, 9 aa, Homo Sapiens
TFDTSVYPQ

SEQ ID NO: 126766 - protein, 9 aa, Homo Sapiens
GEETPLNKL

SEQ ID NO: 126767 - protein, 9 aa, Homo Sapiens
VSLQPEKPL

SEQ ID NO: 126768 - protein, 9 aa, Homo Sapiens
GVRHEQEVA

SEQ ID NO: 126769 - protein, 9 aa, Homo Sapiens
LQEPLERRK

SEQ ID NO: 126770 - protein, 9 aa, Homo Sapiens
IEWLQLEDV

SEQ ID NO: 126771 - protein, 9 aa, Homo Sapiens
NVDHLDAKR

SEQ ID NO: 126772 - protein, 9 aa, Homo Sapiens
DAVMPHQMH

SEQ ID NO: 126773 - protein, 9 aa, Homo Sapiens
VLGNFIHAM

SEQ ID NO: 126774 - protein, 9 aa, Homo Sapiens
GARKYARKI

SEQ ID NO: 126775 - protein, 9 aa, Homo Sapiens
RRPSSRHAA

SEQ ID NO: 126776 - protein, 9 aa, Homo Sapiens
VSPSLRKQP

SEQ ID NO: 126777 - protein, 9 aa, Homo Sapiens
DEEETPEVA

SEQ ID NO: 126778 - protein, 9 aa, Homo Sapiens
DLLGLLNWH

SEQ ID NO: 126779 - protein, 9 aa, Homo Sapiens
RPPGVPLAG

SEQ ID NO: 126780 - protein, 9 aa, Homo Sapiens
AVHDFPQFS

SEQ ID NO: 126781 - protein, 9 aa, Homo Sapiens
TQEAFEVSQ

SEQ ID NO: 126782 - protein, 9 aa, Homo Sapiens
TDYARWWEA

SEQ ID NO: 126783 - protein, 9 aa, Homo Sapiens
HLKAGCRSY

SEQ ID NO: 126784 - protein, 9 aa, Homo Sapiens
ICKHLLYPA

SEQ ID NO: 126785 - protein, 9 aa, Homo Sapiens
SSHSNSNTL

SEQ ID NO: 126786 - protein, 9 aa, Homo Sapiens
LGAALEAVS

SEQ ID NO: 126787 - protein, 9 aa, Homo Sapiens
AGWGLTSPA

SEQ ID NO: 126788 - protein, 9 aa, Homo Sapiens
RLLLHSNCL

SEQ ID NO: 126789 - protein, 9 aa, Homo Sapiens
PASHLSRPT

SEQ ID NO: 126790 - protein, 9 aa, Homo Sapiens
QVHGADASH

SEQ ID NO: 126791 - protein, 9 aa, Homo Sapiens
RWLSLQNLM

SEQ ID NO: 126792 - protein, 9 aa, Homo Sapiens
LGSSHQILH

SEQ ID NO: 126793 - protein, 9 aa, Homo Sapiens
RSVKMTFVI

SEQ ID NO: 126794 - protein, 9 aa, Homo Sapiens
AEQASVRHL

SEQ ID NO: 126795 - protein, 9 aa, Homo Sapiens
RLREEEVAR

SEQ ID NO: 126796 - protein, 9 aa, Homo Sapiens
TKVHGRDRE

SEQ ID NO: 126797 - protein, 9 aa, Homo Sapiens
NDHTQAVGG

SEQ ID NO: 126798 - protein, 9 aa, Homo Sapiens
PASSPYVNT

SEQ ID NO: 126799 - protein, 9 aa, Homo Sapiens
TLEKHFFTE

SEQ ID NO: 126800 - protein, 9 aa, Homo Sapiens
LGDEYDAHA

SEQ ID NO: 126801 - protein, 9 aa, Homo Sapiens
DSSDLLDFV

SEQ ID NO: 126802 - protein, 9 aa, Homo Sapiens
ATPLGCIQA

SEQ ID NO: 126803 - protein, 9 aa, Homo Sapiens
RAWNYTVDA

SEQ ID NO: 126804 - protein, 9 aa, Homo Sapiens
GDDRPGRVQ

SEQ ID NO: 126805 - protein, 9 aa, Homo Sapiens
VGIVRSRGL

SEQ ID NO: 126806 - protein, 9 aa, Homo Sapiens
ALLHHQTEP

SEQ ID NO: 126807 - protein, 9 aa, Homo Sapiens
FTHFGAVLA

SEQ ID NO: 126808 - protein, 9 aa, Homo Sapiens
PLHLWTQPT

SEQ ID NO: 126809 - protein, 9 aa, Homo Sapiens
AMTAEELKK

SEQ ID NO: 126810 - protein, 9 aa, Homo Sapiens
NHVMTSFSL

SEQ ID NO: 126811 - protein, 9 aa, Homo Sapiens
EHIFAGILE

SEQ ID NO: 126812 - protein, 9 aa, Homo Sapiens
LVREVTGGH

SEQ ID NO: 126813 - protein, 9 aa, Homo Sapiens
VATVWACAA

SEQ ID NO: 126814 - protein, 9 aa, Homo Sapiens
SKVSSTSTP

SEQ ID NO: 126815 - protein, 9 aa, Homo Sapiens
CVPPSPILY

SEQ ID NO: 126816 - protein, 9 aa, Homo Sapiens
SGTAAPGPR

SEQ ID NO: 126817 - protein, 9 aa, Homo Sapiens
SSNNGDSGG

SEQ ID NO: 126818 - protein, 9 aa, Homo Sapiens
TQPTLGCSS

SEQ ID NO: 126819 - protein, 9 aa, Homo Sapiens
RGKPLPECH

SEQ ID NO: 126820 - protein, 9 aa, Homo Sapiens
TRWKPLQTV

SEQ ID NO: 126821 - protein, 9 aa, Homo Sapiens
CARLPCAPP

SEQ ID NO: 126822 - protein, 9 aa, Homo Sapiens
SEFEVVAPE

SEQ ID NO: 126823 - protein, 9 aa, Homo Sapiens
QLLLNYFSG

SEQ ID NO: 126824 - protein, 9 aa, Homo Sapiens
ASACPGHVD

SEQ ID NO: 126825 - protein, 9 aa, Homo Sapiens
SNYYNFLQC

SEQ ID NO: 126826 - protein, 9 aa, Homo Sapiens
MSFAQTGIN

SEQ ID NO: 126827 - protein, 9 aa, Homo Sapiens
CLTWAESLV

SEQ ID NO: 126828 - protein, 9 aa, Homo Sapiens
YANTTKHTY

SEQ ID NO: 126829 - protein, 9 aa, Homo Sapiens
AFIFFRKFY

SEQ ID NO: 126830 - protein, 9 aa, Homo Sapiens
LHVLAALQE

SEQ ID NO: 126831 - protein, 9 aa, Homo Sapiens
FFLLFTWQV

SEQ ID NO: 126832 - protein, 9 aa, Homo Sapiens
HIPSPKVGT

SEQ ID NO: 126833 - protein, 9 aa, Homo Sapiens
TSFLSPTVF

SEQ ID NO: 126834 - protein, 9 aa, Homo Sapiens
VAPMLESQG

SEQ ID NO: 126835 - protein, 9 aa, Homo Sapiens
LVSVMKKEF

SEQ ID NO: 126836 - protein, 9 aa, Homo Sapiens
FSLPGSSDS

SEQ ID NO: 126837 - protein, 9 aa, Homo Sapiens
EWKPAVIFS

SEQ ID NO: 126838 - protein, 9 aa, Homo Sapiens
PDFFRDYFL

SEQ ID NO: 126839 - protein, 9 aa, Homo Sapiens
HTRGPLDGN

SEQ ID NO: 126840 - protein, 9 aa, Homo Sapiens
FDLEGESEL

SEQ ID NO: 126841 - protein, 9 aa, Homo Sapiens
CLVVEIRHR

SEQ ID NO: 126842 - protein, 9 aa, Homo Sapiens
TGELGGIWP

SEQ ID NO: 126843 - protein, 9 aa, Homo Sapiens
SNSLSNTSV

SEQ ID NO: 126844 - protein, 9 aa, Homo Sapiens
LTVAFETAL

SEQ ID NO: 126845 - protein, 9 aa, Homo Sapiens
GCVYDLTSL

SEQ ID NO: 126846 - protein, 9 aa, Homo Sapiens
RMIKIENPL

SEQ ID NO: 126847 - protein, 9 aa, Homo Sapiens
VKNLMNVMN

SEQ ID NO: 126848 - protein, 9 aa, Homo Sapiens
VEFVDGVKL

SEQ ID NO: 126849 - protein, 9 aa, Homo Sapiens
RDLMDVMNV

SEQ ID NO: 126850 - protein, 9 aa, Homo Sapiens
RRCILLFPM

SEQ ID NO: 126851 - protein, 9 aa, Homo Sapiens
KMRRTNMIM

SEQ ID NO: 126852 - protein, 9 aa, Homo Sapiens
QIKYIVAQY

SEQ ID NO: 126853 - protein, 9 aa, Homo Sapiens
ISMWKTAVH

SEQ ID NO: 126854 - protein, 9 aa, Homo Sapiens
HNLSQSPRS

SEQ ID NO: 126855 - protein, 9 aa, Homo Sapiens
LYVSVRSSG

SEQ ID NO: 126856 - protein, 9 aa, Homo Sapiens
GTEGSEIKD

SEQ ID NO: 126857 - protein, 9 aa, Homo Sapiens
SPSDSYQGR

SEQ ID NO: 126858 - protein, 9 aa, Homo Sapiens
LAVWTQLEH

SEQ ID NO: 126859 - protein, 9 aa, Homo Sapiens
PRRSSFIKD

SEQ ID NO: 126860 - protein, 9 aa, Homo Sapiens
WPDPPCPLA

SEQ ID NO: 126861 - protein, 9 aa, Homo Sapiens
LIFFQQLRV

SEQ ID NO: 126862 - protein, 9 aa, Homo Sapiens
HQKTHTREK

SEQ ID NO: 126863 - protein, 9 aa, Homo Sapiens
SREHLSVVR

SEQ ID NO: 126864 - protein, 9 aa, Homo Sapiens
ATDKKREQR

SEQ ID NO: 126865 - protein, 9 aa, Homo Sapiens
TLYSMSCMN

SEQ ID NO: 126866 - protein, 9 aa, Homo Sapiens
YTCLTTEVS

SEQ ID NO: 126867 - protein, 9 aa, Homo Sapiens
LCGRSRAAS

SEQ ID NO: 126868 - protein, 9 aa, Homo Sapiens
VRLGFLVDP

SEQ ID NO: 126869 - protein, 9 aa, Homo Sapiens
YIPQTRRQR

SEQ ID NO: 126870 - protein, 9 aa, Homo Sapiens
QKFHGKKVK

SEQ ID NO: 126871 - protein, 9 aa, Homo Sapiens
GHEEAEEKS

SEQ ID NO: 126872 - protein, 9 aa, Homo Sapiens
TREPQHPVF

SEQ ID NO: 126873 - protein, 9 aa, Homo Sapiens
RQKTTRSHR

SEQ ID NO: 126874 - protein, 9 aa, Homo Sapiens
WASWPTFLC

SEQ ID NO: 126875 - protein, 9 aa, Homo Sapiens
TLIKLYQQC

SEQ ID NO: 126876 - protein, 9 aa, Homo Sapiens
NPRAVCTAP

SEQ ID NO: 126877 - protein, 9 aa, Homo Sapiens
GQAAGRGGT

SEQ ID NO: 126878 - protein, 9 aa, Homo Sapiens
KRACTAPRG

SEQ ID NO: 126879 - protein, 9 aa, Homo Sapiens
MNDLPYLNL

SEQ ID NO: 126880 - protein, 9 aa, Homo Sapiens
AELQRVQTE

SEQ ID NO: 126881 - protein, 9 aa, Homo Sapiens
KSAEAVLKR

SEQ ID NO: 126882 - protein, 9 aa, Homo Sapiens
CLYLRPAQS

SEQ ID NO: 126883 - protein, 9 aa, Homo Sapiens
EKGLLPGAL

SEQ ID NO: 126884 - protein, 9 aa, Homo Sapiens
SSSPRRASG

SEQ ID NO: 126885 - protein, 9 aa, Homo Sapiens
ESKKNSLED

SEQ ID NO: 126886 - protein, 9 aa, Homo Sapiens
SLNIKEFIQ

SEQ ID NO: 126887 - protein, 9 aa, Homo Sapiens
MHVGKPFSE

SEQ ID NO: 126888 - protein, 9 aa, Homo Sapiens
AWKVRLRLR

SEQ ID NO: 126889 - protein, 9 aa, Homo Sapiens
QMNLDVTTT

SEQ ID NO: 126890 - protein, 9 aa, Homo Sapiens
LPEGYSVAA

SEQ ID NO: 126891 - protein, 9 aa, Homo Sapiens
QAMELGLET

SEQ ID NO: 126892 - protein, 9 aa, Homo Sapiens
FRDVFKKNI

SEQ ID NO: 126893 - protein, 9 aa, Homo Sapiens
PKLQVITAS

SEQ ID NO: 126894 - protein, 9 aa, Homo Sapiens
LYSLVRVIS

SEQ ID NO: 126895 - protein, 9 aa, Homo Sapiens
TLKQKRLVT

SEQ ID NO: 126896 - protein, 9 aa, Homo Sapiens
CVPVPTHCP

SEQ ID NO: 126897 - protein, 9 aa, Homo Sapiens
MCTARRGRR

SEQ ID NO: 126898 - protein, 9 aa, Homo Sapiens
PTPRLGHVV

SEQ ID NO: 126899 - protein, 9 aa, Homo Sapiens
APLQTDYYA

SEQ ID NO: 126900 - protein, 9 aa, Homo Sapiens
QILNREREI

SEQ ID NO: 126901 - protein, 9 aa, Homo Sapiens
SVVAHLSHL

SEQ ID NO: 126902 - protein, 9 aa, Homo Sapiens
VTLMTLTLF

SEQ ID NO: 126903 - protein, 9 aa, Homo Sapiens
LPRLGVGAT

SEQ ID NO: 126904 - protein, 9 aa, Homo Sapiens
WFCWTSWSP

SEQ ID NO: 126905 - protein, 9 aa, Homo Sapiens
SPSVPKKTG

SEQ ID NO: 126906 - protein, 9 aa, Homo Sapiens
GWALGCKRW

SEQ ID NO: 126907 - protein, 9 aa, Homo Sapiens
KSYTRWLQK

SEQ ID NO: 126908 - protein, 9 aa, Homo Sapiens
ILSPGCWAR

SEQ ID NO: 126909 - protein, 9 aa, Homo Sapiens
EQTCPAPQE

SEQ ID NO: 126910 - protein, 9 aa, Homo Sapiens
MTTKRLNKM

SEQ ID NO: 126911 - protein, 9 aa, Homo Sapiens
RWKPLQTVR

SEQ ID NO: 126912 - protein, 9 aa, Homo Sapiens
RRLCSPVGI

SEQ ID NO: 126913 - protein, 9 aa, Homo Sapiens
KKREKIINP

SEQ ID NO: 126914 - protein, 9 aa, Homo Sapiens
NEDDKQIEL

SEQ ID NO: 126915 - protein, 9 aa, Homo Sapiens
KGDKQRTLF

SEQ ID NO: 126916 - protein, 9 aa, Homo Sapiens
FSPILVVLA

SEQ ID NO: 126917 - protein, 9 aa, Homo Sapiens
EKELTRHPD

SEQ ID NO: 126918 - protein, 9 aa, Homo Sapiens
HMNVMNVGK

SEQ ID NO: 126919 - protein, 9 aa, Homo Sapiens
RWLHQPDWC

SEQ ID NO: 126920 - protein, 9 aa, Homo Sapiens
TLYDEDVVK

SEQ ID NO: 126921 - protein, 9 aa, Homo Sapiens
PPTPKKISL

SEQ ID NO: 126922 - protein, 9 aa, Homo Sapiens
HSHHRPHQL

SEQ ID NO: 126923 - protein, 9 aa, Homo Sapiens
WEAKAGRSR

SEQ ID NO: 126924 - protein, 9 aa, Homo Sapiens
VGRHRYVYV

SEQ ID NO: 126925 - protein, 9 aa, Homo Sapiens
GGTTAVLHG

SEQ ID NO: 126926 - protein, 9 aa, Homo Sapiens
DLNQNFFIA

SEQ ID NO: 126927 - protein, 9 aa, Homo Sapiens
KKHKRKPYR

SEQ ID NO: 126928 - protein, 9 aa, Homo Sapiens
EEWVMMDTS

SEQ ID NO: 126929 - protein, 9 aa, Homo Sapiens
YGGAEFMCV

SEQ ID NO: 126930 - protein, 9 aa, Homo Sapiens
FRDAVVTSA

SEQ ID NO: 126931 - protein, 9 aa, Homo Sapiens
YTETQPHVT

SEQ ID NO: 126932 - protein, 9 aa, Homo Sapiens
VQQVEPEGQ

SEQ ID NO: 126933 - protein, 9 aa, Homo Sapiens
LQQHNFSSQ

SEQ ID NO: 126934 - protein, 9 aa, Homo Sapiens
CTVEELNEE

SEQ ID NO: 126935 - protein, 9 aa, Homo Sapiens
SLQKICSLL

SEQ ID NO: 126936 - protein, 9 aa, Homo Sapiens
RERSRSWRK

SEQ ID NO: 126937 - protein, 9 aa, Homo Sapiens
LRELQLPGN

SEQ ID NO: 126938 - protein, 9 aa, Homo Sapiens
MNNFGMYYS

SEQ ID NO: 126939 - protein, 9 aa, Homo Sapiens
PLLQACSPS

SEQ ID NO: 126940 - protein, 9 aa, Homo Sapiens
TVFVAYARN

SEQ ID NO: 126941 - protein, 9 aa, Homo Sapiens
KPFMCPFDV

SEQ ID NO: 126942 - protein, 9 aa, Homo Sapiens
EIWDVKDPS

SEQ ID NO: 126943 - protein, 9 aa, Homo Sapiens
DGRASHVDD

SEQ ID NO: 126944 - protein, 9 aa, Homo Sapiens
AVERSQHRF

SEQ ID NO: 126945 - protein, 9 aa, Homo Sapiens
NFFIAVTAK

SEQ ID NO: 126946 - protein, 9 aa, Homo Sapiens
TIRLPRKEE

SEQ ID NO: 126947 - protein, 9 aa, Homo Sapiens
QENGEICLK

SEQ ID NO: 126948 - protein, 9 aa, Homo Sapiens
VARGAPQSV

SEQ ID NO: 126949 - protein, 9 aa, Homo Sapiens
RISSLLCDT

SEQ ID NO: 126950 - protein, 9 aa, Homo Sapiens
GPAAERAGA

SEQ ID NO: 126951 - protein, 9 aa, Homo Sapiens
NDKVNSMVQ

SEQ ID NO: 126952 - protein, 9 aa, Homo Sapiens
GGLLACSQC

SEQ ID NO: 126953 - protein, 9 aa, Homo Sapiens
LFSGALIPW

SEQ ID NO: 126954 - protein, 9 aa, Homo Sapiens
SWRWAVSTG

SEQ ID NO: 126955 - protein, 9 aa, Homo Sapiens
PQGWPGSNH

SEQ ID NO: 126956 - protein, 9 aa, Homo Sapiens
PWWREHLTK

SEQ ID NO: 126957 - protein, 9 aa, Homo Sapiens
IHAMIIGIP

SEQ ID NO: 126958 - protein, 9 aa, Homo Sapiens
DFLANRQKK

SEQ ID NO: 126959 - protein, 9 aa, Homo Sapiens
SSRESVNAH

SEQ ID NO: 126960 - protein, 9 aa, Homo Sapiens
IGPALCNNT

SEQ ID NO: 126961 - protein, 9 aa, Homo Sapiens
DVLEVVGEL

SEQ ID NO: 126962 - protein, 9 aa, Homo Sapiens
EKATKHCKK

SEQ ID NO: 126963 - protein, 9 aa, Homo Sapiens
KKTGPPVLS

SEQ ID NO: 126964 - protein, 9 aa, Homo Sapiens
IGREPGHDA

SEQ ID NO: 126965 - protein, 9 aa, Homo Sapiens
RRNLTEWFS

SEQ ID NO: 126966 - protein, 9 aa, Homo Sapiens
LLLLMWQFP

SEQ ID NO: 126967 - protein, 9 aa, Homo Sapiens
WLCPQTRRS

SEQ ID NO: 126968 - protein, 9 aa, Homo Sapiens
ESSPAKINE

SEQ ID NO: 126969 - protein, 9 aa, Homo Sapiens
CLKKRDLYN

SEQ ID NO: 126970 - protein, 9 aa, Homo Sapiens
EAEARENVP

SEQ ID NO: 126971 - protein, 9 aa, Homo Sapiens
APVAACKVV

SEQ ID NO: 126972 - protein, 9 aa, Homo Sapiens
TRKVSTMTS

SEQ ID NO: 126973 - protein, 9 aa, Homo Sapiens
HIGEKSFEY

SEQ ID NO: 126974 - protein, 9 aa, Homo Sapiens
AELVQHLFR

SEQ ID NO: 126975 - protein, 9 aa, Homo Sapiens
DVERAMRAA

SEQ ID NO: 126976 - protein, 9 aa, Homo Sapiens
PTLPRTPLL

SEQ ID NO: 126977 - protein, 9 aa, Homo Sapiens
RGFVMSRAM

SEQ ID NO: 126978 - protein, 9 aa, Homo Sapiens
GQIMGKQLH

SEQ ID NO: 126979 - protein, 9 aa, Homo Sapiens
PEQGLAPPL

SEQ ID NO: 126980 - protein, 9 aa, Homo Sapiens
TTGTTTTGA

SEQ ID NO: 126981 - protein, 9 aa, Homo Sapiens
TRNGYQGLV

SEQ ID NO: 126982 - protein, 9 aa, Homo Sapiens
RAIGADSSS

SEQ ID NO: 126983 - protein, 9 aa, Homo Sapiens
RIKVSNASA

SEQ ID NO: 126984 - protein, 9 aa, Homo Sapiens
DPRLLFKLN

SEQ ID NO: 126985 - protein, 9 aa, Homo Sapiens
RERRYGISS

SEQ ID NO: 126986 - protein, 9 aa, Homo Sapiens
PLERRKGEA

SEQ ID NO: 126987 - protein, 9 aa, Homo Sapiens
GGQPAEAVG

SEQ ID NO: 126988 - protein, 9 aa, Homo Sapiens
SSALIVSLL

SEQ ID NO: 126989 - protein, 9 aa, Homo Sapiens
YAPHVQICM

SEQ ID NO: 126990 - protein, 9 aa, Homo Sapiens
LRQKLQCNA

SEQ ID NO: 126991 - protein, 9 aa, Homo Sapiens
TPRAIGLSW

SEQ ID NO: 126992 - protein, 9 aa, Homo Sapiens
LRQRAQADE

SEQ ID NO: 126993 - protein, 9 aa, Homo Sapiens
PTLTVSRWM

SEQ ID NO: 126994 - protein, 9 aa, Homo Sapiens
PQGFRDAVV

SEQ ID NO: 126995 - protein, 9 aa, Homo Sapiens
HLTRLKAWW

SEQ ID NO: 126996 - protein, 9 aa, Homo Sapiens
DSDVAFIAA

SEQ ID NO: 126997 - protein, 9 aa, Homo Sapiens
ENASLIGAC

SEQ ID NO: 126998 - protein, 9 aa, Homo Sapiens
IRLLLSLDR

SEQ ID NO: 126999 - protein, 9 aa, Homo Sapiens
ELSQLQPFL

SEQ ID NO: 127000 - protein, 9 aa, Homo Sapiens
YSHLTEFVP

SEQ ID NO: 127001 - protein, 9 aa, Homo Sapiens
PLLYLRMFK

SEQ ID NO: 127002 - protein, 9 aa, Homo Sapiens
FDFGEKQKM

SEQ ID NO: 127003 - protein, 9 aa, Homo Sapiens
LWSGAFYLF

SEQ ID NO: 127004 - protein, 9 aa, Homo Sapiens
FYIIDILVP

SEQ ID NO: 127005 - protein, 9 aa, Homo Sapiens
RGLLLALSF

SEQ ID NO: 127006 - protein, 9 aa, Homo Sapiens
YGKVPLAKR

SEQ ID NO: 127007 - protein, 9 aa, Homo Sapiens
SIKPFHIAA

SEQ ID NO: 127008 - protein, 9 aa, Homo Sapiens
DEQRDDISL

SEQ ID NO: 127009 - protein, 9 aa, Homo Sapiens
ALHMVSSEQ

SEQ ID NO: 127010 - protein, 9 aa, Homo Sapiens
NELPLPNRE

SEQ ID NO: 127011 - protein, 9 aa, Homo Sapiens
FLGFTSDHH

SEQ ID NO: 127012 - protein, 9 aa, Homo Sapiens
PRWWELGGP

SEQ ID NO: 127013 - protein, 9 aa, Homo Sapiens
TLNDALFYH

SEQ ID NO: 127014 - protein, 9 aa, Homo Sapiens
LCRYITSDD

SEQ ID NO: 127015 - protein, 9 aa, Homo Sapiens
RQCAPSPDR

SEQ ID NO: 127016 - protein, 9 aa, Homo Sapiens
PIPHRHPPL

SEQ ID NO: 127017 - protein, 9 aa, Homo Sapiens
LLYLNSGYI

SEQ ID NO: 127018 - protein, 9 aa, Homo Sapiens
TEATGSGTE

SEQ ID NO: 127019 - protein, 9 aa, Homo Sapiens
RHPSWPWTR

SEQ ID NO: 127020 - protein, 9 aa, Homo Sapiens
VWKGVVADW

SEQ ID NO: 127021 - protein, 9 aa, Homo Sapiens
PKLQSCLEA

SEQ ID NO: 127022 - protein, 9 aa, Homo Sapiens
DRDITLLDL

SEQ ID NO: 127023 - protein, 9 aa, Homo Sapiens
LTHTHTWRA

SEQ ID NO: 127024 - protein, 9 aa, Homo Sapiens
NYFSGDTLV

SEQ ID NO: 127025 - protein, 9 aa, Homo Sapiens
KRTRIKKVV

SEQ ID NO: 127026 - protein, 9 aa, Homo Sapiens
ICPGEDELL

SEQ ID NO: 127027 - protein, 9 aa, Homo Sapiens
VLQAKKFEI

SEQ ID NO: 127028 - protein, 9 aa, Homo Sapiens
DASHWCGAW

SEQ ID NO: 127029 - protein, 9 aa, Homo Sapiens
KPLACTSTN

SEQ ID NO: 127030 - protein, 9 aa, Homo Sapiens
RSPCIKEQM

SEQ ID NO: 127031 - protein, 9 aa, Homo Sapiens
GHITGVDWA

SEQ ID NO: 127032 - protein, 9 aa, Homo Sapiens
AAQPPRWHL

SEQ ID NO: 127033 - protein, 9 aa, Homo Sapiens
RELLRAICQ

SEQ ID NO: 127034 - protein, 9 aa, Homo Sapiens
SLSNTSTQS

SEQ ID NO: 127035 - protein, 9 aa, Homo Sapiens
IMAPFLPYT

SEQ ID NO: 127036 - protein, 9 aa, Homo Sapiens
RSHRKRNTN

SEQ ID NO: 127037 - protein, 9 aa, Homo Sapiens
APLKTHFQT

SEQ ID NO: 127038 - protein, 9 aa, Homo Sapiens
QTGINPFVC

SEQ ID NO: 127039 - protein, 9 aa, Homo Sapiens
DLTPETNGP

SEQ ID NO: 127040 - protein, 9 aa, Homo Sapiens
QCRYLESAR

SEQ ID NO: 127041 - protein, 9 aa, Homo Sapiens
AATIENVQP

SEQ ID NO: 127042 - protein, 9 aa, Homo Sapiens
GPPHEYRFP

SEQ ID NO: 127043 - protein, 9 aa, Homo Sapiens
ISTKAPTTS

SEQ ID NO: 127044 - protein, 9 aa, Homo Sapiens
AKGFPNVYI

SEQ ID NO: 127045 - protein, 9 aa, Homo Sapiens
SSIKCDRCH

SEQ ID NO: 127046 - protein, 9 aa, Homo Sapiens
LYATGCFVA

SEQ ID NO: 127047 - protein, 9 aa, Homo Sapiens
ESGGAPAPP

SEQ ID NO: 127048 - protein, 9 aa, Homo Sapiens
LNLLIMLGT

SEQ ID NO: 127049 - protein, 9 aa, Homo Sapiens
VSFSQITSG

SEQ ID NO: 127050 - protein, 9 aa, Homo Sapiens
CAALNHLGA

SEQ ID NO: 127051 - protein, 9 aa, Homo Sapiens
TSADGAHGM

SEQ ID NO: 127052 - protein, 9 aa, Homo Sapiens
FLTETSLMK

SEQ ID NO: 127053 - protein, 9 aa, Homo Sapiens
CWYFGVSYC

SEQ ID NO: 127054 - protein, 9 aa, Homo Sapiens
PVHHLHRPV

SEQ ID NO: 127055 - protein, 9 aa, Homo Sapiens
QGLYLTVPQ

SEQ ID NO: 127056 - protein, 9 aa, Homo Sapiens
KPILDEIYD

SEQ ID NO: 127057 - protein, 9 aa, Homo Sapiens
RSSPRLNGG

SEQ ID NO: 127058 - protein, 9 aa, Homo Sapiens
CAAAVTPDH

SEQ ID NO: 127059 - protein, 9 aa, Homo Sapiens
SGQATAVLN

SEQ ID NO: 127060 - protein, 9 aa, Homo Sapiens
TDGCCLIWG

SEQ ID NO: 127061 - protein, 9 aa, Homo Sapiens
AATAAVAPP

SEQ ID NO: 127062 - protein, 9 aa, Homo Sapiens
DFILVRTQH

SEQ ID NO: 127063 - protein, 9 aa, Homo Sapiens
SVGYVERAV

SEQ ID NO: 127064 - protein, 9 aa, Homo Sapiens
HCTDVTDAS

SEQ ID NO: 127065 - protein, 9 aa, Homo Sapiens
YKLARDATA

SEQ ID NO: 127066 - protein, 9 aa, Homo Sapiens
AHPDTGISS

SEQ ID NO: 127067 - protein, 9 aa, Homo Sapiens
QKMLLEKQL

SEQ ID NO: 127068 - protein, 9 aa, Homo Sapiens
MTLPTQAQV

SEQ ID NO: 127069 - protein, 9 aa, Homo Sapiens
FLKKLILIL

SEQ ID NO: 127070 - protein, 9 aa, Homo Sapiens
SPNMSKRTR

SEQ ID NO: 127071 - protein, 9 aa, Homo Sapiens
FIKAKTGPL

SEQ ID NO: 127072 - protein, 9 aa, Homo Sapiens
TQLFTSRKE

SEQ ID NO: 127073 - protein, 9 aa, Homo Sapiens
GLLLLMWQF

SEQ ID NO: 127074 - protein, 9 aa, Homo Sapiens
AVDFTAASG

SEQ ID NO: 127075 - protein, 9 aa, Homo Sapiens
LLHSNCLVS

SEQ ID NO: 127076 - protein, 9 aa, Homo Sapiens
PASRLIFWS

SEQ ID NO: 127077 - protein, 9 aa, Homo Sapiens
ADFCFRQCR

SEQ ID NO: 127078 - protein, 9 aa, Homo Sapiens
FHAITSLHF

SEQ ID NO: 127079 - protein, 9 aa, Homo Sapiens
LYELACKQL

SEQ ID NO: 127080 - protein, 9 aa, Homo Sapiens
YRSFCLQNK

SEQ ID NO: 127081 - protein, 9 aa, Homo Sapiens
AVLKRESGA

SEQ ID NO: 127082 - protein, 9 aa, Homo Sapiens
HRPLCQRFP

SEQ ID NO: 127083 - protein, 9 aa, Homo Sapiens
TESASGQAV

SEQ ID NO: 127084 - protein, 9 aa, Homo Sapiens
QVCGQDDVP

SEQ ID NO: 127085 - protein, 9 aa, Homo Sapiens
PSPAMAHRS

SEQ ID NO: 127086 - protein, 9 aa, Homo Sapiens
SPLHLWTQP

SEQ ID NO: 127087 - protein, 9 aa, Homo Sapiens
NTAILRQVH

SEQ ID NO: 127088 - protein, 9 aa, Homo Sapiens
ILDKPHKAS

SEQ ID NO: 127089 - protein, 9 aa, Homo Sapiens
RGQQKEDLG

SEQ ID NO: 127090 - protein, 9 aa, Homo Sapiens
GGHCWVTRH

SEQ ID NO: 127091 - protein, 9 aa, Homo Sapiens
GLYVSVRSS

SEQ ID NO: 127092 - protein, 9 aa, Homo Sapiens
AVWTQLEHL

SEQ ID NO: 127093 - protein, 9 aa, Homo Sapiens
RKRQCAPSP

SEQ ID NO: 127094 - protein, 9 aa, Homo Sapiens
LTVNITPQT

SEQ ID NO: 127095 - protein, 9 aa, Homo Sapiens
LCAVLYPNV

SEQ ID NO: 127096 - protein, 9 aa, Homo Sapiens
IHRTFPAYD

SEQ ID NO: 127097 - protein, 9 aa, Homo Sapiens
GSRCAQVRK

SEQ ID NO: 127098 - protein, 9 aa, Homo Sapiens
FIHAMGGFD

SEQ ID NO: 127099 - protein, 9 aa, Homo Sapiens
GQKGDLEKV

SEQ ID NO: 127100 - protein, 9 aa, Homo Sapiens
TKEIDRERA

SEQ ID NO: 127101 - protein, 9 aa, Homo Sapiens
RKNEWPLGK

SEQ ID NO: 127102 - protein, 9 aa, Homo Sapiens
YELEPLASR

SEQ ID NO: 127103 - protein, 9 aa, Homo Sapiens
MTDIVHRHP

SEQ ID NO: 127104 - protein, 9 aa, Homo Sapiens
QTTRKRFVQ

SEQ ID NO: 127105 - protein, 9 aa, Homo Sapiens
HTGENPMNV

SEQ ID NO: 127106 - protein, 9 aa, Homo Sapiens
DVQGENCLT

SEQ ID NO: 127107 - protein, 9 aa, Homo Sapiens
GGNANPHLP

SEQ ID NO: 127108 - protein, 9 aa, Homo Sapiens
CGAANCADC

SEQ ID NO: 127109 - protein, 9 aa, Homo Sapiens
GYCLPDPSF

SEQ ID NO: 127110 - protein, 9 aa, Homo Sapiens
THVHRTKPR

SEQ ID NO: 127111 - protein, 9 aa, Homo Sapiens
YSIQRQHTI

SEQ ID NO: 127112 - protein, 9 aa, Homo Sapiens
FVVVDEIHV

SEQ ID NO: 127113 - protein, 9 aa, Homo Sapiens
KQIKFYRMK

SEQ ID NO: 127114 - protein, 9 aa, Homo Sapiens
AAPPGPPTV

SEQ ID NO: 127115 - protein, 9 aa, Homo Sapiens
YAATGFPAW

SEQ ID NO: 127116 - protein, 9 aa, Homo Sapiens
TMDMPQVNI

SEQ ID NO: 127117 - protein, 9 aa, Homo Sapiens
KPLPRKAIQ

SEQ ID NO: 127118 - protein, 9 aa, Homo Sapiens
PPPRAPKPS

SEQ ID NO: 127119 - protein, 9 aa, Homo Sapiens
FGIFTCFNI

SEQ ID NO: 127120 - protein, 9 aa, Homo Sapiens
THQMRTAPS

SEQ ID NO: 127121 - protein, 9 aa, Homo Sapiens
GSRRVTALL

SEQ ID NO: 127122 - protein, 9 aa, Homo Sapiens
QSHIMEYIH

SEQ ID NO: 127123 - protein, 9 aa, Homo Sapiens
DPGSDLLPP

SEQ ID NO: 127124 - protein, 9 aa, Homo Sapiens
RRYSERVEK

SEQ ID NO: 127125 - protein, 9 aa, Homo Sapiens
KDLESSRDH

SEQ ID NO: 127126 - protein, 9 aa, Homo Sapiens
VRLYLSPST

SEQ ID NO: 127127 - protein, 9 aa, Homo Sapiens
GNSSIKCDR

SEQ ID NO: 127128 - protein, 9 aa, Homo Sapiens
ISHAIGKNS

SEQ ID NO: 127129 - protein, 9 aa, Homo Sapiens
AGGRSSDSE

SEQ ID NO: 127130 - protein, 9 aa, Homo Sapiens
AWVIALLKG

SEQ ID NO: 127131 - protein, 9 aa, Homo Sapiens
PHTIQVSEE

SEQ ID NO: 127132 - protein, 9 aa, Homo Sapiens
THTGENPMN

SEQ ID NO: 127133 - protein, 9 aa, Homo Sapiens
GSVSIPTGK

SEQ ID NO: 127134 - protein, 9 aa, Homo Sapiens
REMKDYTIT

SEQ ID NO: 127135 - protein, 9 aa, Homo Sapiens
YRCLPLLYL

SEQ ID NO: 127136 - protein, 9 aa, Homo Sapiens
AGSSSGGDC

SEQ ID NO: 127137 - protein, 9 aa, Homo Sapiens
RLIETSLSF

SEQ ID NO: 127138 - protein, 9 aa, Homo Sapiens
AAGPAAERA

SEQ ID NO: 127139 - protein, 9 aa, Homo Sapiens
MDPDDILPG

SEQ ID NO: 127140 - protein, 9 aa, Homo Sapiens
PQRLWKRTE

SEQ ID NO: 127141 - protein, 9 aa, Homo Sapiens
ARSAWDAPP

SEQ ID NO: 127142 - protein, 9 aa, Homo Sapiens
QENHPPYPG

SEQ ID NO: 127143 - protein, 9 aa, Homo Sapiens
RNEVLQLST

SEQ ID NO: 127144 - protein, 9 aa, Homo Sapiens
VDVILEDGA

SEQ ID NO: 127145 - protein, 9 aa, Homo Sapiens
RGAPQGPCP

SEQ ID NO: 127146 - protein, 9 aa, Homo Sapiens
SQIWNLNPV

SEQ ID NO: 127147 - protein, 9 aa, Homo Sapiens
KEELPRVVG

SEQ ID NO: 127148 - protein, 9 aa, Homo Sapiens
HERLDFAMK

SEQ ID NO: 127149 - protein, 9 aa, Homo Sapiens
PATEVGCPA

SEQ ID NO: 127150 - protein, 9 aa, Homo Sapiens
SPEFSDMPR

SEQ ID NO: 127151 - protein, 9 aa, Homo Sapiens
GLSWVLCRT

SEQ ID NO: 127152 - protein, 9 aa, Homo Sapiens
YTIAVRNTH

SEQ ID NO: 127153 - protein, 9 aa, Homo Sapiens
EGENTVLCL

SEQ ID NO: 127154 - protein, 9 aa, Homo Sapiens
PCSDLSTFV

SEQ ID NO: 127155 - protein, 9 aa, Homo Sapiens
PRPRLNRWL

SEQ ID NO: 127156 - protein, 9 aa, Homo Sapiens
YECLTGRVP

SEQ ID NO: 127157 - protein, 9 aa, Homo Sapiens
RYLARHQRN

SEQ ID NO: 127158 - protein, 9 aa, Homo Sapiens
FSWAGLPSW

SEQ ID NO: 127159 - protein, 9 aa, Homo Sapiens
FRRTDGCCL

SEQ ID NO: 127160 - protein, 9 aa, Homo Sapiens
AWHHSRVSF

SEQ ID NO: 127161 - protein, 9 aa, Homo Sapiens
IWMSLGMTS

SEQ ID NO: 127162 - protein, 9 aa, Homo Sapiens
KIHNQTTRK

SEQ ID NO: 127163 - protein, 9 aa, Homo Sapiens
LHVRRAALA

SEQ ID NO: 127164 - protein, 9 aa, Homo Sapiens
AQTRRSYPE

SEQ ID NO: 127165 - protein, 9 aa, Homo Sapiens
CPPVPGVPG

SEQ ID NO: 127166 - protein, 9 aa, Homo Sapiens
GILIIGDLH

SEQ ID NO: 127167 - protein, 9 aa, Homo Sapiens
SGFSMEPLT

SEQ ID NO: 127168 - protein, 9 aa, Homo Sapiens
VADPEQPGD

SEQ ID NO: 127169 - protein, 9 aa, Homo Sapiens
PLGCIQAAS

SEQ ID NO: 127170 - protein, 9 aa, Homo Sapiens
SHFKVLIFQ

SEQ ID NO: 127171 - protein, 9 aa, Homo Sapiens
CMTTCCRPS

SEQ ID NO: 127172 - protein, 9 aa, Homo Sapiens
SLWVQSLDL

SEQ ID NO: 127173 - protein, 9 aa, Homo Sapiens
DAEKKATLS

SEQ ID NO: 127174 - protein, 9 aa, Homo Sapiens
LCWHGGFQP

SEQ ID NO: 127175 - protein, 9 aa, Homo Sapiens
STTSNKCPK

SEQ ID NO: 127176 - protein, 9 aa, Homo Sapiens
RDLTPETNG

SEQ ID NO: 127177 - protein, 9 aa, Homo Sapiens
RNAITCIFF

SEQ ID NO: 127178 - protein, 9 aa, Homo Sapiens
GRCAIHPWR

SEQ ID NO: 127179 - protein, 9 aa, Homo Sapiens
ARWRSSLSS

SEQ ID NO: 127180 - protein, 9 aa, Homo Sapiens
ETHCYDPDS

SEQ ID NO: 127181 - protein, 9 aa, Homo Sapiens
EKCWSWREN

SEQ ID NO: 127182 - protein, 9 aa, Homo Sapiens
PPPYISSRD

SEQ ID NO: 127183 - protein, 9 aa, Homo Sapiens
GPATSHPDT

SEQ ID NO: 127184 - protein, 9 aa, Homo Sapiens
AGIAIHAMI

SEQ ID NO: 127185 - protein, 9 aa, Homo Sapiens
YIIDILVPC

SEQ ID NO: 127186 - protein, 9 aa, Homo Sapiens
RMRRCPGLS

SEQ ID NO: 127187 - protein, 9 aa, Homo Sapiens
GVCQTALND

SEQ ID NO: 127188 - protein, 9 aa, Homo Sapiens
ARRLDFQEE

SEQ ID NO: 127189 - protein, 9 aa, Homo Sapiens
ESSRDHSIN

SEQ ID NO: 127190 - protein, 9 aa, Homo Sapiens
NMIYMSHLG

SEQ ID NO: 127191 - protein, 9 aa, Homo Sapiens
SDAAKGILQ

SEQ ID NO: 127192 - protein, 9 aa, Homo Sapiens
HWGAAPMMS

SEQ ID NO: 127193 - protein, 9 aa, Homo Sapiens
QEFLVCLVI

SEQ ID NO: 127194 - protein, 9 aa, Homo Sapiens
LLLGFLVRE

SEQ ID NO: 127195 - protein, 9 aa, Homo Sapiens
PVTSKVSST

SEQ ID NO: 127196 - protein, 9 aa, Homo Sapiens
HVDDLPHLL

SEQ ID NO: 127197 - protein, 9 aa, Homo Sapiens
QASLTAAHS

SEQ ID NO: 127198 - protein, 9 aa, Homo Sapiens
NLMNVMNVG

SEQ ID NO: 127199 - protein, 9 aa, Homo Sapiens
TVVAFIFFR

SEQ ID NO: 127200 - protein, 9 aa, Homo Sapiens
FTTPQYRGV

SEQ ID NO: 127201 - protein, 9 aa, Homo Sapiens
PAKKNKENQ

SEQ ID NO: 127202 - protein, 9 aa, Homo Sapiens
ITFDTSVYP

SEQ ID NO: 127203 - protein, 9 aa, Homo Sapiens
VHLEEHLEK

SEQ ID NO: 127204 - protein, 9 aa, Homo Sapiens
SLLAVKGFA

SEQ ID NO: 127205 - protein, 9 aa, Homo Sapiens
KMFGSGSRH

SEQ ID NO: 127206 - protein, 9 aa, Homo Sapiens
ILGHSLPHT

SEQ ID NO: 127207 - protein, 9 aa, Homo Sapiens
HKLMASDTG

SEQ ID NO: 127208 - protein, 9 aa, Homo Sapiens
EHVCVTKAF

SEQ ID NO: 127209 - protein, 9 aa, Homo Sapiens
VCPKLNLEF

SEQ ID NO: 127210 - protein, 9 aa, Homo Sapiens
QEGGVEPAF

SEQ ID NO: 127211 - protein, 9 aa, Homo Sapiens
KSREALWQR

SEQ ID NO: 127212 - protein, 9 aa, Homo Sapiens
LLCSHLGET

SEQ ID NO: 127213 - protein, 9 aa, Homo Sapiens
TLIPGTPHG

SEQ ID NO: 127214 - protein, 9 aa, Homo Sapiens
FIHFPDHRE

SEQ ID NO: 127215 - protein, 9 aa, Homo Sapiens
NSNLSSMVV

SEQ ID NO: 127216 - protein, 9 aa, Homo Sapiens
LLPTQSKQE

SEQ ID NO: 127217 - protein, 9 aa, Homo Sapiens
IKKGHKCEC

SEQ ID NO: 127218 - protein, 9 aa, Homo Sapiens
SQPADFLLR

SEQ ID NO: 127219 - protein, 9 aa, Homo Sapiens
WSCSNIMKP

SEQ ID NO: 127220 - protein, 9 aa, Homo Sapiens
MRAARLPRY

SEQ ID NO: 127221 - protein, 9 aa, Homo Sapiens
CCRRRRCCR

SEQ ID NO: 127222 - protein, 9 aa, Homo Sapiens
TLKNMCGSR

SEQ ID NO: 127223 - protein, 9 aa, Homo Sapiens
NSSNNGDSG

SEQ ID NO: 127224 - protein, 9 aa, Homo Sapiens
TPVQSSTNL

SEQ ID NO: 127225 - protein, 9 aa, Homo Sapiens
VNSIKMPLK

SEQ ID NO: 127226 - protein, 9 aa, Homo Sapiens
SPSPEFSDM

SEQ ID NO: 127227 - protein, 9 aa, Homo Sapiens
PAILLLGDE

SEQ ID NO: 127228 - protein, 9 aa, Homo Sapiens
AKALTNLVF

SEQ ID NO: 127229 - protein, 9 aa, Homo Sapiens
NDQGSMQEN

SEQ ID NO: 127230 - protein, 9 aa, Homo Sapiens
NPSMAVSAQ

SEQ ID NO: 127231 - protein, 9 aa, Homo Sapiens
GEGKGQSPP

SEQ ID NO: 127232 - protein, 9 aa, Homo Sapiens
VLDLPQPLA

SEQ ID NO: 127233 - protein, 9 aa, Homo Sapiens
SGILGVTSP

SEQ ID NO: 127234 - protein, 9 aa, Homo Sapiens
GFVWISWFE

SEQ ID NO: 127235 - protein, 9 aa, Homo Sapiens
DMPRISKLG

SEQ ID NO: 127236 - protein, 9 aa, Homo Sapiens
KRPQMRLGY

SEQ ID NO: 127237 - protein, 9 aa, Homo Sapiens
FYRMKHHYK

SEQ ID NO: 127238 - protein, 9 aa, Homo Sapiens
LGHHMQLES

SEQ ID NO: 127239 - protein, 9 aa, Homo Sapiens
QFIAHERLD

SEQ ID NO: 127240 - protein, 9 aa, Homo Sapiens
AGWEKCWSW

SEQ ID NO: 127241 - protein, 9 aa, Homo Sapiens
NLPFPFSIK

SEQ ID NO: 127242 - protein, 9 aa, Homo Sapiens
KPAVIFSTL

SEQ ID NO: 127243 - protein, 9 aa, Homo Sapiens
GPMCESNSA

SEQ ID NO: 127244 - protein, 9 aa, Homo Sapiens
PTTTTSSPR

SEQ ID NO: 127245 - protein, 9 aa, Homo Sapiens
PAMRRPSSR

SEQ ID NO: 127246 - protein, 9 aa, Homo Sapiens
DMYPMTVGE

SEQ ID NO: 127247 - protein, 9 aa, Homo Sapiens
RLPWAGAPA

SEQ ID NO: 127248 - protein, 9 aa, Homo Sapiens
QGRNHMNVM

SEQ ID NO: 127249 - protein, 9 aa, Homo Sapiens
GTSFRSFCI

SEQ ID NO: 127250 - protein, 9 aa, Homo Sapiens
IGQGCLIKD

SEQ ID NO: 127251 - protein, 9 aa, Homo Sapiens
LAQLYDRYL

SEQ ID NO: 127252 - protein, 9 aa, Homo Sapiens
RRRTLNLKA

SEQ ID NO: 127253 - protein, 9 aa, Homo Sapiens
EEGLDRCNA

SEQ ID NO: 127254 - protein, 9 aa, Homo Sapiens
LPLLVEVQN

SEQ ID NO: 127255 - protein, 9 aa, Homo Sapiens
DETETPTLQ

SEQ ID NO: 127256 - protein, 9 aa, Homo Sapiens
LRDLSRSLP

SEQ ID NO: 127257 - protein, 9 aa, Homo Sapiens
LSRLVSSTD

SEQ ID NO: 127258 - protein, 9 aa, Homo Sapiens
RATGRRVMD

SEQ ID NO: 127259 - protein, 9 aa, Homo Sapiens
KGAKRSRVT

SEQ ID NO: 127260 - protein, 9 aa, Homo Sapiens
QVAEVGDRK

SEQ ID NO: 127261 - protein, 9 aa, Homo Sapiens
LFILRFCPK

SEQ ID NO: 127262 - protein, 9 aa, Homo Sapiens
LKKRDLYNK

SEQ ID NO: 127263 - protein, 9 aa, Homo Sapiens
KVFTYISIL

SEQ ID NO: 127264 - protein, 9 aa, Homo Sapiens
VRDRMLAQV

SEQ ID NO: 127265 - protein, 9 aa, Homo Sapiens
LTSTSCSTM

SEQ ID NO: 127266 - protein, 9 aa, Homo Sapiens
RSLDLVLHF

SEQ ID NO: 127267 - protein, 9 aa, Homo Sapiens
RREVTSGDS

SEQ ID NO: 127268 - protein, 9 aa, Homo Sapiens
QKFSPKRSR

SEQ ID NO: 127269 - protein, 9 aa, Homo Sapiens
TASLRRQII

SEQ ID NO: 127270 - protein, 9 aa, Homo Sapiens
KDQDYNMCV

SEQ ID NO: 127271 - protein, 9 aa, Homo Sapiens
LAAAAQPPR

SEQ ID NO: 127272 - protein, 9 aa, Homo Sapiens
IRHSAEAQR

SEQ ID NO: 127273 - protein, 9 aa, Homo Sapiens
RLRGETTFA

SEQ ID NO: 127274 - protein, 9 aa, Homo Sapiens
PAHTDIKTG

SEQ ID NO: 127275 - protein, 9 aa, Homo Sapiens
LWFRLFHTA

SEQ ID NO: 127276 - protein, 9 aa, Homo Sapiens
PDWCCVPVP

SEQ ID NO: 127277 - protein, 9 aa, Homo Sapiens
LVVSVVAHL

SEQ ID NO: 127278 - protein, 9 aa, Homo Sapiens
AAILSRDHL

SEQ ID NO: 127279 - protein, 9 aa, Homo Sapiens
RLHPWWKEH

SEQ ID NO: 127280 - protein, 9 aa, Homo Sapiens
MIRGKSFHN

SEQ ID NO: 127281 - protein, 9 aa, Homo Sapiens
GSLIHIIAF

SEQ ID NO: 127282 - protein, 9 aa, Homo Sapiens
AVLGLLLLM

SEQ ID NO: 127283 - protein, 9 aa, Homo Sapiens
YRQVEARFL

SEQ ID NO: 127284 - protein, 9 aa, Homo Sapiens
DVPLVNEEA

SEQ ID NO: 127285 - protein, 9 aa, Homo Sapiens
WLALMVVHG

SEQ ID NO: 127286 - protein, 9 aa, Homo Sapiens
RLALEVLLS

SEQ ID NO: 127287 - protein, 9 aa, Homo Sapiens
HRHPPLHRP

SEQ ID NO: 127288 - protein, 9 aa, Homo Sapiens
WNASRPPQA

SEQ ID NO: 127289 - protein, 9 aa, Homo Sapiens
YRKSGTHQM

SEQ ID NO: 127290 - protein, 9 aa, Homo Sapiens
VSCVGGFLH

SEQ ID NO: 127291 - protein, 9 aa, Homo Sapiens
CNAAGRLEL

SEQ ID NO: 127292 - protein, 9 aa, Homo Sapiens
REIVPVELE

SEQ ID NO: 127293 - protein, 9 aa, Homo Sapiens
LCVGYNSQG

SEQ ID NO: 127294 - protein, 9 aa, Homo Sapiens
RDHIWIRFH

SEQ ID NO: 127295 - protein, 9 aa, Homo Sapiens
LSGVEGIRL

SEQ ID NO: 127296 - protein, 9 aa, Homo Sapiens
QRQIQEWGC

SEQ ID NO: 127297 - protein, 9 aa, Homo Sapiens
KEGDKPSTT

SEQ ID NO: 127298 - protein, 9 aa, Homo Sapiens
GYRCRWCSS

SEQ ID NO: 127299 - protein, 9 aa, Homo Sapiens
SGARSTSAH

SEQ ID NO: 127300 - protein, 9 aa, Homo Sapiens
PALEGLPRL

SEQ ID NO: 127301 - protein, 9 aa, Homo Sapiens
VSATFNFEL

SEQ ID NO: 127302 - protein, 9 aa, Homo Sapiens
FLTSLKFPL

SEQ ID NO: 127303 - protein, 9 aa, Homo Sapiens
TWLSYELQP

SEQ ID NO: 127304 - protein, 9 aa, Homo Sapiens
HRSLVLQID

SEQ ID NO: 127305 - protein, 9 aa, Homo Sapiens
EDKDGLQSV

SEQ ID NO: 127306 - protein, 9 aa, Homo Sapiens
PNIYAIYGL

SEQ ID NO: 127307 - protein, 9 aa, Homo Sapiens
VTARATQPH

SEQ ID NO: 127308 - protein, 9 aa, Homo Sapiens
REATSPQPI

SEQ ID NO: 127309 - protein, 9 aa, Homo Sapiens
ESAEDLEKV

SEQ ID NO: 127310 - protein, 9 aa, Homo Sapiens
GFFRDISNS

SEQ ID NO: 127311 - protein, 9 aa, Homo Sapiens
DVVWIQVSR

SEQ ID NO: 127312 - protein, 9 aa, Homo Sapiens
DEIATEAYE

SEQ ID NO: 127313 - protein, 9 aa, Homo Sapiens
TYISILEML

SEQ ID NO: 127314 - protein, 9 aa, Homo Sapiens
CLVGYEVLD

SEQ ID NO: 127315 - protein, 9 aa, Homo Sapiens
SGVCQTALN

SEQ ID NO: 127316 - protein, 9 aa, Homo Sapiens
RIHIGEKSF

SEQ ID NO: 127317 - protein, 9 aa, Homo Sapiens
PSDSYQGRG

SEQ ID NO: 127318 - protein, 9 aa, Homo Sapiens
PLKTHFQTP

SEQ ID NO: 127319 - protein, 9 aa, Homo Sapiens
RPANMYQAN

SEQ ID NO: 127320 - protein, 9 aa, Homo Sapiens
DEEAQTIGQ

SEQ ID NO: 127321 - protein, 9 aa, Homo Sapiens
VTVDPAIRT

SEQ ID NO: 127322 - protein, 9 aa, Homo Sapiens
ASRPPQATR

SEQ ID NO: 127323 - protein, 9 aa, Homo Sapiens
PTCPAFSAH

SEQ ID NO: 127324 - protein, 9 aa, Homo Sapiens
LGLCPSSAE

SEQ ID NO: 127325 - protein, 9 aa, Homo Sapiens
VCHHHGIEY

SEQ ID NO: 127326 - protein, 9 aa, Homo Sapiens
HFNIKDQDY

SEQ ID NO: 127327 - protein, 9 aa, Homo Sapiens
KRERRRKGG

SEQ ID NO: 127328 - protein, 9 aa, Homo Sapiens
LAAPMYTDT

SEQ ID NO: 127329 - protein, 9 aa, Homo Sapiens
GILIQQVLE

SEQ ID NO: 127330 - protein, 9 aa, Homo Sapiens
HGLLQVSLG

SEQ ID NO: 127331 - protein, 9 aa, Homo Sapiens
SALQKAQVT

SEQ ID NO: 127332 - protein, 9 aa, Homo Sapiens
SQWENGASL

SEQ ID NO: 127333 - protein, 9 aa, Homo Sapiens
IAVRNTHLV

SEQ ID NO: 127334 - protein, 9 aa, Homo Sapiens
RPRSVVIQQ

SEQ ID NO: 127335 - protein, 9 aa, Homo Sapiens
AEMVGQVCG

SEQ ID NO: 127336 - protein, 9 aa, Homo Sapiens
SCPRARAAA

SEQ ID NO: 127337 - protein, 9 aa, Homo Sapiens
HAQDGHGRV

SEQ ID NO: 127338 - protein, 9 aa, Homo Sapiens
PTPCTDTES

SEQ ID NO: 127339 - protein, 9 aa, Homo Sapiens
RRRIHGQYI

SEQ ID NO: 127340 - protein, 9 aa, Homo Sapiens
AHGLLQVSL

SEQ ID NO: 127341 - protein, 9 aa, Homo Sapiens
RMGELKAEG

SEQ ID NO: 127342 - protein, 9 aa, Homo Sapiens
IMGKQLHMH

SEQ ID NO: 127343 - protein, 9 aa, Homo Sapiens
GPPPAHAMK

SEQ ID NO: 127344 - protein, 9 aa, Homo Sapiens
NSCLISLSC

SEQ ID NO: 127345 - protein, 9 aa, Homo Sapiens
SASPPSRPP

SEQ ID NO: 127346 - protein, 9 aa, Homo Sapiens
MNSCKPNHG

SEQ ID NO: 127347 - protein, 9 aa, Homo Sapiens
GAPAAPGCL

SEQ ID NO: 127348 - protein, 9 aa, Homo Sapiens
EGRQLQQHN

SEQ ID NO: 127349 - protein, 9 aa, Homo Sapiens
HVHIKNSRN

SEQ ID NO: 127350 - protein, 9 aa, Homo Sapiens
LISAMLCAV

SEQ ID NO: 127351 - protein, 9 aa, Homo Sapiens
PQLPGQEAF

SEQ ID NO: 127352 - protein, 9 aa, Homo Sapiens
IKPQGFRDA

SEQ ID NO: 127353 - protein, 9 aa, Homo Sapiens
LTDELCLHV

SEQ ID NO: 127354 - protein, 9 aa, Homo Sapiens
GLIAGSLDS

SEQ ID NO: 127355 - protein, 9 aa, Homo Sapiens
GGQEVGLSH

SEQ ID NO: 127356 - protein, 9 aa, Homo Sapiens
PSARSKANK

SEQ ID NO: 127357 - protein, 9 aa, Homo Sapiens
FVAKDSHGV

SEQ ID NO: 127358 - protein, 9 aa, Homo Sapiens
VLKNIYRKS

SEQ ID NO: 127359 - protein, 9 aa, Homo Sapiens
PCPPMPTRR

SEQ ID NO: 127360 - protein, 9 aa, Homo Sapiens
PPSDGHAQP

SEQ ID NO: 127361 - protein, 9 aa, Homo Sapiens
MGLSRVFFQ

SEQ ID NO: 127362 - protein, 9 aa, Homo Sapiens
ELLDLMFCD

SEQ ID NO: 127363 - protein, 9 aa, Homo Sapiens
PMQESQLCS

SEQ ID NO: 127364 - protein, 9 aa, Homo Sapiens
AAATQRLAE

SEQ ID NO: 127365 - protein, 9 aa, Homo Sapiens
PIHPAFSHR

SEQ ID NO: 127366 - protein, 9 aa, Homo Sapiens
ADDIQCVFG

SEQ ID NO: 127367 - protein, 9 aa, Homo Sapiens
VTDASRTML

SEQ ID NO: 127368 - protein, 9 aa, Homo Sapiens
QPPIAEEGR

SEQ ID NO: 127369 - protein, 9 aa, Homo Sapiens
LRSQPLLNI

SEQ ID NO: 127370 - protein, 9 aa, Homo Sapiens
DTVFRDPCH

SEQ ID NO: 127371 - protein, 9 aa, Homo Sapiens
ALVEELATF

SEQ ID NO: 127372 - protein, 9 aa, Homo Sapiens
FVPINSVNL

SEQ ID NO: 127373 - protein, 9 aa, Homo Sapiens
VTEHKNNLV

SEQ ID NO: 127374 - protein, 9 aa, Homo Sapiens
KSMSNLGSR

SEQ ID NO: 127375 - protein, 9 aa, Homo Sapiens
KNVFRLLIS

SEQ ID NO: 127376 - protein, 9 aa, Homo Sapiens
LSDELPPRA

SEQ ID NO: 127377 - protein, 9 aa, Homo Sapiens
KLSPKTKKI

SEQ ID NO: 127378 - protein, 9 aa, Homo Sapiens
SGPPSAMTL

SEQ ID NO: 127379 - protein, 9 aa, Homo Sapiens
FAKLIQEQR

SEQ ID NO: 127380 - protein, 9 aa, Homo Sapiens
TAGDSSCQA

SEQ ID NO: 127381 - protein, 9 aa, Homo Sapiens
GKKKTSENT

SEQ ID NO: 127382 - protein, 9 aa, Homo Sapiens
SPRRASGCR

SEQ ID NO: 127383 - protein, 9 aa, Homo Sapiens
FDHDCKFPE

SEQ ID NO: 127384 - protein, 9 aa, Homo Sapiens
SQSHIMEYI

SEQ ID NO: 127385 - protein, 9 aa, Homo Sapiens
VTEGNCSNY

SEQ ID NO: 127386 - protein, 9 aa, Homo Sapiens
RSPALRARG

SEQ ID NO: 127387 - protein, 9 aa, Homo Sapiens
QYSVTLYSQ

SEQ ID NO: 127388 - protein, 9 aa, Homo Sapiens
LIARSDVHR

SEQ ID NO: 127389 - protein, 9 aa, Homo Sapiens
TVVDTASLR

SEQ ID NO: 127390 - protein, 9 aa, Homo Sapiens
RKVFRKSGA

SEQ ID NO: 127391 - protein, 9 aa, Homo Sapiens
EVEFSDQFF

SEQ ID NO: 127392 - protein, 9 aa, Homo Sapiens
DPNLYRIRQ

SEQ ID NO: 127393 - protein, 9 aa, Homo Sapiens
KIVRTDSHL

SEQ ID NO: 127394 - protein, 9 aa, Homo Sapiens
WKVRLRLRD

SEQ ID NO: 127395 - protein, 9 aa, Homo Sapiens
TRPFHDSAV

SEQ ID NO: 127396 - protein, 9 aa, Homo Sapiens
QCVFGKPFA

SEQ ID NO: 127397 - protein, 9 aa, Homo Sapiens
SNEPGKRSS

SEQ ID NO: 127398 - protein, 9 aa, Homo Sapiens
QNSVREPRG

SEQ ID NO: 127399 - protein, 9 aa, Homo Sapiens
ILWSGFSME

SEQ ID NO: 127400 - protein, 9 aa, Homo Sapiens
YPCSSKVSP

SEQ ID NO: 127401 - protein, 9 aa, Homo Sapiens
MLCAVLYPN

SEQ ID NO: 127402 - protein, 9 aa, Homo Sapiens
FWKTDLKIN

SEQ ID NO: 127403 - protein, 9 aa, Homo Sapiens
MCGSRRVTA

SEQ ID NO: 127404 - protein, 9 aa, Homo Sapiens
ETLEEAVRE

SEQ ID NO: 127405 - protein, 9 aa, Homo Sapiens
QNCAMKFGS

SEQ ID NO: 127406 - protein, 9 aa, Homo Sapiens
LQTVRLMEA

SEQ ID NO: 127407 - protein, 9 aa, Homo Sapiens
PKARCPRVG

SEQ ID NO: 127408 - protein, 9 aa, Homo Sapiens
SAIPKLQSC

SEQ ID NO: 127409 - protein, 9 aa, Homo Sapiens
TCPAPQEEE

SEQ ID NO: 127410 - protein, 9 aa, Homo Sapiens
GAEPVADPE

SEQ ID NO: 127411 - protein, 9 aa, Homo Sapiens
TLEEAVREA

SEQ ID NO: 127412 - protein, 9 aa, Homo Sapiens
ALAVNYRFL

SEQ ID NO: 127413 - protein, 9 aa, Homo Sapiens
DLHMSAMAP

SEQ ID NO: 127414 - protein, 9 aa, Homo Sapiens
ELCLHVQQN

SEQ ID NO: 127415 - protein, 9 aa, Homo Sapiens
GEEPKMGAG

SEQ ID NO: 127416 - protein, 9 aa, Homo Sapiens
EDAGMRELC

SEQ ID NO: 127417 - protein, 9 aa, Homo Sapiens
ATKRDLPPA

SEQ ID NO: 127418 - protein, 9 aa, Homo Sapiens
ERLLLHSNC

SEQ ID NO: 127419 - protein, 9 aa, Homo Sapiens
FRLLISMWK

SEQ ID NO: 127420 - protein, 9 aa, Homo Sapiens
FGVSYCKFH

SEQ ID NO: 127421 - protein, 9 aa, Homo Sapiens
LSFGKTSLM

SEQ ID NO: 127422 - protein, 9 aa, Homo Sapiens
DELVGHLDA

SEQ ID NO: 127423 - protein, 9 aa, Homo Sapiens
SNGRGGNQA

SEQ ID NO: 127424 - protein, 9 aa, Homo Sapiens
IALLSRKQT

SEQ ID NO: 127425 - protein, 9 aa, Homo Sapiens
KSLQKICSL

SEQ ID NO: 127426 - protein, 9 aa, Homo Sapiens
YMPLHASLP

SEQ ID NO: 127427 - protein, 9 aa, Homo Sapiens
SVVVTGRVL

SEQ ID NO: 127428 - protein, 9 aa, Homo Sapiens
WYQEVPKCE

SEQ ID NO: 127429 - protein, 9 aa, Homo Sapiens
HPNIYAIYG

SEQ ID NO: 127430 - protein, 9 aa, Homo Sapiens
LVEVQNILD

SEQ ID NO: 127431 - protein, 9 aa, Homo Sapiens
TVNMDDMML

SEQ ID NO: 127432 - protein, 9 aa, Homo Sapiens
PPRAPKPSA

SEQ ID NO: 127433 - protein, 9 aa, Homo Sapiens
DHREGHLTL

SEQ ID NO: 127434 - protein, 9 aa, Homo Sapiens
NDRYHPKPA

SEQ ID NO: 127435 - protein, 9 aa, Homo Sapiens
AAKRCIVSH

SEQ ID NO: 127436 - protein, 9 aa, Homo Sapiens
LPMARRNAL

SEQ ID NO: 127437 - protein, 9 aa, Homo Sapiens
YGVPEANST

SEQ ID NO: 127438 - protein, 9 aa, Homo Sapiens
SSSNTDSAT

SEQ ID NO: 127439 - protein, 9 aa, Homo Sapiens
FKAISEKTT

SEQ ID NO: 127440 - protein, 9 aa, Homo Sapiens
FFRVERGRG

SEQ ID NO: 127441 - protein, 9 aa, Homo Sapiens
PLGAPGHEL

SEQ ID NO: 127442 - protein, 9 aa, Homo Sapiens
GRKKKTHLG

SEQ ID NO: 127443 - protein, 9 aa, Homo Sapiens
LLSRKQTWK

SEQ ID NO: 127444 - protein, 9 aa, Homo Sapiens
LQPELPLEA

SEQ ID NO: 127445 - protein, 9 aa, Homo Sapiens
ETHPDPHGQ

SEQ ID NO: 127446 - protein, 9 aa, Homo Sapiens
AVKGFAVMA

SEQ ID NO: 127447 - protein, 9 aa, Homo Sapiens
GHLGRSGSF

SEQ ID NO: 127448 - protein, 9 aa, Homo Sapiens
FERLQMNLD

SEQ ID NO: 127449 - protein, 9 aa, Homo Sapiens
HSLRSQPLL

SEQ ID NO: 127450 - protein, 9 aa, Homo Sapiens
FDDTLGSFP

SEQ ID NO: 127451 - protein, 9 aa, Homo Sapiens
MFYVKKDKG

SEQ ID NO: 127452 - protein, 9 aa, Homo Sapiens
YVYVCIAME

SEQ ID NO: 127453 - protein, 9 aa, Homo Sapiens
IVLGLGYFA

SEQ ID NO: 127454 - protein, 9 aa, Homo Sapiens
STTSSEGTA

SEQ ID NO: 127455 - protein, 9 aa, Homo Sapiens
RIAGLCNCA

SEQ ID NO: 127456 - protein, 9 aa, Homo Sapiens
VVAQSTNSV

SEQ ID NO: 127457 - protein, 9 aa, Homo Sapiens
DFLMHKLMA

SEQ ID NO: 127458 - protein, 9 aa, Homo Sapiens
SCPTTSTCT

SEQ ID NO: 127459 - protein, 9 aa, Homo Sapiens
DLSNQELIE

SEQ ID NO: 127460 - protein, 9 aa, Homo Sapiens
VPDGDGKQR

SEQ ID NO: 127461 - protein, 9 aa, Homo Sapiens
MCGAHKYQA

SEQ ID NO: 127462 - protein, 9 aa, Homo Sapiens
WNELPLPNR

SEQ ID NO: 127463 - protein, 9 aa, Homo Sapiens
PGGGGSPRS

SEQ ID NO: 127464 - protein, 9 aa, Homo Sapiens
ASSGTAAPG

SEQ ID NO: 127465 - protein, 9 aa, Homo Sapiens
KACRNLGKM

SEQ ID NO: 127466 - protein, 9 aa, Homo Sapiens
NIKDQDYNM

SEQ ID NO: 127467 - protein, 9 aa, Homo Sapiens
HPPLIHCYM

SEQ ID NO: 127468 - protein, 9 aa, Homo Sapiens
DGNPYAQVQ

SEQ ID NO: 127469 - protein, 9 aa, Homo Sapiens
DVVKFMAKH

SEQ ID NO: 127470 - protein, 9 aa, Homo Sapiens
SFIFCRCQT

SEQ ID NO: 127471 - protein, 9 aa, Homo Sapiens
PHHHQCQPW

SEQ ID NO: 127472 - protein, 9 aa, Homo Sapiens
PPKMPPPRS

SEQ ID NO: 127473 - protein, 9 aa, Homo Sapiens
VFTDNDQGS

SEQ ID NO: 127474 - protein, 9 aa, Homo Sapiens
PIARSLQKA

SEQ ID NO: 127475 - protein, 9 aa, Homo Sapiens
WHWGAAPMM

SEQ ID NO: 127476 - protein, 9 aa, Homo Sapiens
KGCPHRYER

SEQ ID NO: 127477 - protein, 9 aa, Homo Sapiens
LYNREKAVG

SEQ ID NO: 127478 - protein, 9 aa, Homo Sapiens
VGPPPAHAM

SEQ ID NO: 127479 - protein, 9 aa, Homo Sapiens
LSGFRVEFV

SEQ ID NO: 127480 - protein, 9 aa, Homo Sapiens
STHISGDKS

SEQ ID NO: 127481 - protein, 9 aa, Homo Sapiens
HFLACPFLV

SEQ ID NO: 127482 - protein, 9 aa, Homo Sapiens
CILWTTVCK

SEQ ID NO: 127483 - protein, 9 aa, Homo Sapiens
VSTKQIREQ

SEQ ID NO: 127484 - protein, 9 aa, Homo Sapiens
RRGRRAGNR

SEQ ID NO: 127485 - protein, 9 aa, Homo Sapiens
CKAKYNVHA

SEQ ID NO: 127486 - protein, 9 aa, Homo Sapiens
DRCKHGWVA

SEQ ID NO: 127487 - protein, 9 aa, Homo Sapiens
SNASADLMS

SEQ ID NO: 127488 - protein, 9 aa, Homo Sapiens
SRRWRPAAR

SEQ ID NO: 127489 - protein, 9 aa, Homo Sapiens
LLRLQSLLS

SEQ ID NO: 127490 - protein, 9 aa, Homo Sapiens
RCRNGENTD

SEQ ID NO: 127491 - protein, 9 aa, Homo Sapiens
TMQLTNDKV

SEQ ID NO: 127492 - protein, 9 aa, Homo Sapiens
LIDVNNYAK

SEQ ID NO: 127493 - protein, 9 aa, Homo Sapiens
NRAPKEGHR

SEQ ID NO: 127494 - protein, 9 aa, Homo Sapiens
EQVAEVGDR

SEQ ID NO: 127495 - protein, 9 aa, Homo Sapiens
TTRKRFVQK

SEQ ID NO: 127496 - protein, 9 aa, Homo Sapiens
APENGVRHE

SEQ ID NO: 127497 - protein, 9 aa, Homo Sapiens
APGDLQPPD

SEQ ID NO: 127498 - protein, 9 aa, Homo Sapiens
GISSVHDMD

SEQ ID NO: 127499 - protein, 9 aa, Homo Sapiens
WPRRKCRTL

SEQ ID NO: 127500 - protein, 9 aa, Homo Sapiens
QTQYSSIQY

SEQ ID NO: 127501 - protein, 9 aa, Homo Sapiens
EGNSSIKCD

SEQ ID NO: 127502 - protein, 9 aa, Homo Sapiens
WLVWELLGV

SEQ ID NO: 127503 - protein, 9 aa, Homo Sapiens
PSLCRLNLS

SEQ ID NO: 127504 - protein, 9 aa, Homo Sapiens
HQLLSGEDV

SEQ ID NO: 127505 - protein, 9 aa, Homo Sapiens
QTNPFLSLP

SEQ ID NO: 127506 - protein, 9 aa, Homo Sapiens
DGMLRVVAH

SEQ ID NO: 127507 - protein, 9 aa, Homo Sapiens
WLLELNQMR

SEQ ID NO: 127508 - protein, 9 aa, Homo Sapiens
PKMPYEPST

SEQ ID NO: 127509 - protein, 9 aa, Homo Sapiens
LRQCDAEVT

SEQ ID NO: 127510 - protein, 9 aa, Homo Sapiens
IVPFLNYAM

SEQ ID NO: 127511 - protein, 9 aa, Homo Sapiens
VMNVGKPSH

SEQ ID NO: 127512 - protein, 9 aa, Homo Sapiens
MVLVCFPFS

SEQ ID NO: 127513 - protein, 9 aa, Homo Sapiens
DAAVARGAP

SEQ ID NO: 127514 - protein, 9 aa, Homo Sapiens
PGAAASLRI

SEQ ID NO: 127515 - protein, 9 aa, Homo Sapiens
MMSSMACGS

SEQ ID NO: 127516 - protein, 9 aa, Homo Sapiens
AHERLDFAM

SEQ ID NO: 127517 - protein, 9 aa, Homo Sapiens
SAHLPPPLL

SEQ ID NO: 127518 - protein, 9 aa, Homo Sapiens
DQQNCAMKF

SEQ ID NO: 127519 - protein, 9 aa, Homo Sapiens
ASQPTVIRD

SEQ ID NO: 127520 - protein, 9 aa, Homo Sapiens
GSDLLPPPP

SEQ ID NO: 127521 - protein, 9 aa, Homo Sapiens
SYQRKDSQQ

SEQ ID NO: 127522 - protein, 9 aa, Homo Sapiens
CSSNSSCSC

SEQ ID NO: 127523 - protein, 9 aa, Homo Sapiens
PKVPLAVWT

SEQ ID NO: 127524 - protein, 9 aa, Homo Sapiens
ICFVVDLAV

SEQ ID NO: 127525 - protein, 9 aa, Homo Sapiens
ADVGLALAH

SEQ ID NO: 127526 - protein, 9 aa, Homo Sapiens
RPQTEHTPA

SEQ ID NO: 127527 - protein, 9 aa, Homo Sapiens
LLTHRTGPR

SEQ ID NO: 127528 - protein, 9 aa, Homo Sapiens
SAPEPLTYD

SEQ ID NO: 127529 - protein, 9 aa, Homo Sapiens
IGSLIHIIA

SEQ ID NO: 127530 - protein, 9 aa, Homo Sapiens
DVMNDIMSL

SEQ ID NO: 127531 - protein, 9 aa, Homo Sapiens
VGYNSQGED

SEQ ID NO: 127532 - protein, 9 aa, Homo Sapiens
TSVRSDMAS

SEQ ID NO: 127533 - protein, 9 aa, Homo Sapiens
INLTESGCV

SEQ ID NO: 127534 - protein, 9 aa, Homo Sapiens
LDMQLYDYT

SEQ ID NO: 127535 - protein, 9 aa, Homo Sapiens
INNYRFQMK

SEQ ID NO: 127536 - protein, 9 aa, Homo Sapiens
RENSSSADG

SEQ ID NO: 127537 - protein, 9 aa, Homo Sapiens
QRQHTISPL

SEQ ID NO: 127538 - protein, 9 aa, Homo Sapiens
KKVTLAHLD

SEQ ID NO: 127539 - protein, 9 aa, Homo Sapiens
FCSRRWRPA

SEQ ID NO: 127540 - protein, 9 aa, Homo Sapiens
KAISEKTTD

SEQ ID NO: 127541 - protein, 9 aa, Homo Sapiens
PHRAAPATV

SEQ ID NO: 127542 - protein, 9 aa, Homo Sapiens
PFQSPTKRL

SEQ ID NO: 127543 - protein, 9 aa, Homo Sapiens
HPPSPPPVV

SEQ ID NO: 127544 - protein, 9 aa, Homo Sapiens
LRLPWLMLL

SEQ ID NO: 127545 - protein, 9 aa, Homo Sapiens
WGLTSPAAS

SEQ ID NO: 127546 - protein, 9 aa, Homo Sapiens
GSVDRHGKI

SEQ ID NO: 127547 - protein, 9 aa, Homo Sapiens
QGGMQGPPR

SEQ ID NO: 127548 - protein, 9 aa, Homo Sapiens
FVIDPVHNL

SEQ ID NO: 127549 - protein, 9 aa, Homo Sapiens
AQGSGCQCH

SEQ ID NO: 127550 - protein, 9 aa, Homo Sapiens
CRGSTSTFK

SEQ ID NO: 127551 - protein, 9 aa, Homo Sapiens
TSSEGTASS

SEQ ID NO: 127552 - protein, 9 aa, Homo Sapiens
IVSQWDMFT

SEQ ID NO: 127553 - protein, 9 aa, Homo Sapiens
QPGEKKSQA

SEQ ID NO: 127554 - protein, 9 aa, Homo Sapiens
LHKRTYSLT

SEQ ID NO: 127555 - protein, 9 aa, Homo Sapiens
VGELQVLVE

SEQ ID NO: 127556 - protein, 9 aa, Homo Sapiens
GRGGTTCPP

SEQ ID NO: 127557 - protein, 9 aa, Homo Sapiens
VKALAGQSV

SEQ ID NO: 127558 - protein, 9 aa, Homo Sapiens
LTSAQLDDA

SEQ ID NO: 127559 - protein, 9 aa, Homo Sapiens
NGRKNLQTA

SEQ ID NO: 127560 - protein, 9 aa, Homo Sapiens
NLLIMLGTL

SEQ ID NO: 127561 - protein, 9 aa, Homo Sapiens
TFLFDSTLT

SEQ ID NO: 127562 - protein, 9 aa, Homo Sapiens
HAIGKNSTE

SEQ ID NO: 127563 - protein, 9 aa, Homo Sapiens
CLTGRVPGQ

SEQ ID NO: 127564 - protein, 9 aa, Homo Sapiens
GRLRDPVTP

SEQ ID NO: 127565 - protein, 9 aa, Homo Sapiens
DGCCLIWGR

SEQ ID NO: 127566 - protein, 9 aa, Homo Sapiens
GTEVHVRYP

SEQ ID NO: 127567 - protein, 9 aa, Homo Sapiens
GVMSGSGNL

SEQ ID NO: 127568 - protein, 9 aa, Homo Sapiens
EIVSTAKVC

SEQ ID NO: 127569 - protein, 9 aa, Homo Sapiens
QNREICCYS

SEQ ID NO: 127570 - protein, 9 aa, Homo Sapiens
TGCSVSRNL

SEQ ID NO: 127571 - protein, 9 aa, Homo Sapiens
QPHVTVRPP

SEQ ID NO: 127572 - protein, 9 aa, Homo Sapiens
RVVLDLPQP

SEQ ID NO: 127573 - protein, 9 aa, Homo Sapiens
YCEGNPLLL

SEQ ID NO: 127574 - protein, 9 aa, Homo Sapiens
ALGMNCTLN

SEQ ID NO: 127575 - protein, 9 aa, Homo Sapiens
GLWLIYYSF

SEQ ID NO: 127576 - protein, 9 aa, Homo Sapiens
LTTEVSHLK

SEQ ID NO: 127577 - protein, 9 aa, Homo Sapiens
LQAPGGAAP

SEQ ID NO: 127578 - protein, 9 aa, Homo Sapiens
KRSVVLGEI

SEQ ID NO: 127579 - protein, 9 aa, Homo Sapiens
DLAPALAAC

SEQ ID NO: 127580 - protein, 9 aa, Homo Sapiens
FTGVRLYLS

SEQ ID NO: 127581 - protein, 9 aa, Homo Sapiens
SSRRNRSSS

SEQ ID NO: 127582 - protein, 9 aa, Homo Sapiens
ILKCARDLC

SEQ ID NO: 127583 - protein, 9 aa, Homo Sapiens
LVSLARRRK

SEQ ID NO: 127584 - protein, 9 aa, Homo Sapiens
NRETGAVQA

SEQ ID NO: 127585 - protein, 9 aa, Homo Sapiens
GVKGRSIST

SEQ ID NO: 127586 - protein, 9 aa, Homo Sapiens
MVLALSPPW

SEQ ID NO: 127587 - protein, 9 aa, Homo Sapiens
GAWFCWTSW

SEQ ID NO: 127588 - protein, 9 aa, Homo Sapiens
GQNFIQNLS

SEQ ID NO: 127589 - protein, 9 aa, Homo Sapiens
RALDILLVR

SEQ ID NO: 127590 - protein, 9 aa, Homo Sapiens
VLSAMTEEP

SEQ ID NO: 127591 - protein, 9 aa, Homo Sapiens
YLLPTQSKQ

SEQ ID NO: 127592 - protein, 9 aa, Homo Sapiens
LFFVMMKGP

SEQ ID NO: 127593 - protein, 9 aa, Homo Sapiens
DWRYLQQAL

SEQ ID NO: 127594 - protein, 9 aa, Homo Sapiens
EVFGAQECR

SEQ ID NO: 127595 - protein, 9 aa, Homo Sapiens
ENPEKFQCV

SEQ ID NO: 127596 - protein, 9 aa, Homo Sapiens
VTLGRGRGE

SEQ ID NO: 127597 - protein, 9 aa, Homo Sapiens
HMTGSVDFT

SEQ ID NO: 127598 - protein, 9 aa, Homo Sapiens
MNLDVTTTQ

SEQ ID NO: 127599 - protein, 9 aa, Homo Sapiens
PTDSLLCSH

SEQ ID NO: 127600 - protein, 9 aa, Homo Sapiens
RGHGHCFCL

SEQ ID NO: 127601 - protein, 9 aa, Homo Sapiens
ALAHLVPTG

SEQ ID NO: 127602 - protein, 9 aa, Homo Sapiens
HTSLVQAWP

SEQ ID NO: 127603 - protein, 9 aa, Homo Sapiens
PNSNLSSMV

SEQ ID NO: 127604 - protein, 9 aa, Homo Sapiens
GEICLKCTS

SEQ ID NO: 127605 - protein, 9 aa, Homo Sapiens
ATNNGYSWL

SEQ ID NO: 127606 - protein, 9 aa, Homo Sapiens
EKCHICVPC

SEQ ID NO: 127607 - protein, 9 aa, Homo Sapiens
PGKDGEMAN

SEQ ID NO: 127608 - protein, 9 aa, Homo Sapiens
PSPGSSARW

SEQ ID NO: 127609 - protein, 9 aa, Homo Sapiens
AEVKDNLEE

SEQ ID NO: 127610 - protein, 9 aa, Homo Sapiens
GEPSNPSMA

SEQ ID NO: 127611 - protein, 9 aa, Homo Sapiens
AKLWALSQC

SEQ ID NO: 127612 - protein, 9 aa, Homo Sapiens
GLVWTHTGC

SEQ ID NO: 127613 - protein, 9 aa, Homo Sapiens
SCCRRWALL

SEQ ID NO: 127614 - protein, 9 aa, Homo Sapiens
FSENQTSLN

SEQ ID NO: 127615 - protein, 9 aa, Homo Sapiens
GHEYAVKII

SEQ ID NO: 127616 - protein, 9 aa, Homo Sapiens
KAKDRMGID

SEQ ID NO: 127617 - protein, 9 aa, Homo Sapiens
VPEVRSDGR

SEQ ID NO: 127618 - protein, 9 aa, Homo Sapiens
SGPRLRLAL

SEQ ID NO: 127619 - protein, 9 aa, Homo Sapiens
GFEYFEQNS

SEQ ID NO: 127620 - protein, 9 aa, Homo Sapiens
LETRFSNEN

SEQ ID NO: 127621 - protein, 9 aa, Homo Sapiens
RLRLALRAL

SEQ ID NO: 127622 - protein, 9 aa, Homo Sapiens
RKQTWKIRT

SEQ ID NO: 127623 - protein, 9 aa, Homo Sapiens
VCLVILVTL

SEQ ID NO: 127624 - protein, 9 aa, Homo Sapiens
KAIDFGSAS

SEQ ID NO: 127625 - protein, 9 aa, Homo Sapiens
EGGLLACSQ

SEQ ID NO: 127626 - protein, 9 aa, Homo Sapiens
ADHIRRLQL

SEQ ID NO: 127627 - protein, 9 aa, Homo Sapiens
MELPDFFRD

SEQ ID NO: 127628 - protein, 9 aa, Homo Sapiens
NFAKLIQEQ

SEQ ID NO: 127629 - protein, 9 aa, Homo Sapiens
LTNLYELAC

SEQ ID NO: 127630 - protein, 9 aa, Homo Sapiens
WEAQAPYRV

SEQ ID NO: 127631 - protein, 9 aa, Homo Sapiens
QPEKPLVSG

SEQ ID NO: 127632 - protein, 9 aa, Homo Sapiens
PSRPHAEQY

SEQ ID NO: 127633 - protein, 9 aa, Homo Sapiens
KAFDAPPPT

SEQ ID NO: 127634 - protein, 9 aa, Homo Sapiens
CLSRPGWAA

SEQ ID NO: 127635 - protein, 9 aa, Homo Sapiens
NTPVCKDPG

SEQ ID NO: 127636 - protein, 9 aa, Homo Sapiens
SIRKQHPWH

SEQ ID NO: 127637 - protein, 9 aa, Homo Sapiens
MVCQVHGGL

SEQ ID NO: 127638 - protein, 9 aa, Homo Sapiens
SKNSLEPYA

SEQ ID NO: 127639 - protein, 9 aa, Homo Sapiens
EDPGGAEPH

SEQ ID NO: 127640 - protein, 9 aa, Homo Sapiens
HRADTVQLP

SEQ ID NO: 127641 - protein, 9 aa, Homo Sapiens
VGSHSLRSQ

SEQ ID NO: 127642 - protein, 9 aa, Homo Sapiens
QTSCYSPRT

SEQ ID NO: 127643 - protein, 9 aa, Homo Sapiens
LEDLDELHR

SEQ ID NO: 127644 - protein, 9 aa, Homo Sapiens
LLGDEYDAH

SEQ ID NO: 127645 - protein, 9 aa, Homo Sapiens
ILTEHLARC

SEQ ID NO: 127646 - protein, 9 aa, Homo Sapiens
LSFTPLEKD

SEQ ID NO: 127647 - protein, 9 aa, Homo Sapiens
ADFLLRLHR

SEQ ID NO: 127648 - protein, 9 aa, Homo Sapiens
AHEDPGPFR

SEQ ID NO: 127649 - protein, 9 aa, Homo Sapiens
CGRCRGAPQ

SEQ ID NO: 127650 - protein, 9 aa, Homo Sapiens
LHDRFLMDQ

SEQ ID NO: 127651 - protein, 9 aa, Homo Sapiens
AAITEELFF

SEQ ID NO: 127652 - protein, 9 aa, Homo Sapiens
ALHSRVTAS

SEQ ID NO: 127653 - protein, 9 aa, Homo Sapiens
PYRSEFYSL

SEQ ID NO: 127654 - protein, 9 aa, Homo Sapiens
KNIYRKSGT

SEQ ID NO: 127655 - protein, 9 aa, Homo Sapiens
CPTSMLILS

SEQ ID NO: 127656 - protein, 9 aa, Homo Sapiens
SSVDFSLFC

SEQ ID NO: 127657 - protein, 9 aa, Homo Sapiens
QDAEKKATL

SEQ ID NO: 127658 - protein, 9 aa, Homo Sapiens
LVPDPGCNY

SEQ ID NO: 127659 - protein, 9 aa, Homo Sapiens
VLGEILEQL

SEQ ID NO: 127660 - protein, 9 aa, Homo Sapiens
GSCPHGQAF

SEQ ID NO: 127661 - protein, 9 aa, Homo Sapiens
PAGLPLAMA

SEQ ID NO: 127662 - protein, 9 aa, Homo Sapiens
DTRIMYPVE

SEQ ID NO: 127663 - protein, 9 aa, Homo Sapiens
LLVGVSCVG

SEQ ID NO: 127664 - protein, 9 aa, Homo Sapiens
SNLGSRNHV

SEQ ID NO: 127665 - protein, 9 aa, Homo Sapiens
LNKMVSNQK

SEQ ID NO: 127666 - protein, 9 aa, Homo Sapiens
PGEGKGQSP

SEQ ID NO: 127667 - protein, 9 aa, Homo Sapiens
AVTTRPPIP

SEQ ID NO: 127668 - protein, 9 aa, Homo Sapiens
RELQLPGNR

SEQ ID NO: 127669 - protein, 9 aa, Homo Sapiens
YSISGILGV

SEQ ID NO: 127670 - protein, 9 aa, Homo Sapiens
IDGSIVLSL

SEQ ID NO: 127671 - protein, 9 aa, Homo Sapiens
AIPKLQSCL

SEQ ID NO: 127672 - protein, 9 aa, Homo Sapiens
ARANLPVGA

SEQ ID NO: 127673 - protein, 9 aa, Homo Sapiens
TGQLFVRTR

SEQ ID NO: 127674 - protein, 9 aa, Homo Sapiens
IFAGILEKD

SEQ ID NO: 127675 - protein, 9 aa, Homo Sapiens
HCYDPDSNT

SEQ ID NO: 127676 - protein, 9 aa, Homo Sapiens
SCMNKCWEI

SEQ ID NO: 127677 - protein, 9 aa, Homo Sapiens
LNQNFFIAV

SEQ ID NO: 127678 - protein, 9 aa, Homo Sapiens
RNGAEAVLK

SEQ ID NO: 127679 - protein, 9 aa, Homo Sapiens
ARGRLPHPP

SEQ ID NO: 127680 - protein, 9 aa, Homo Sapiens
YSYMNLAYN

SEQ ID NO: 127681 - protein, 9 aa, Homo Sapiens
SSETDTYYR

SEQ ID NO: 127682 - protein, 9 aa, Homo Sapiens
LPMVRGSRC

SEQ ID NO: 127683 - protein, 9 aa, Homo Sapiens
EKNRQLKKK

SEQ ID NO: 127684 - protein, 9 aa, Homo Sapiens
AFQSTCALP

SEQ ID NO: 127685 - protein, 9 aa, Homo Sapiens
KSHLVIVQR

SEQ ID NO: 127686 - protein, 9 aa, Homo Sapiens
TESVNTPVC

SEQ ID NO: 127687 - protein, 9 aa, Homo Sapiens
LQLAAVGTR

SEQ ID NO: 127688 - protein, 9 aa, Homo Sapiens
KWIPTCTQL

SEQ ID NO: 127689 - protein, 9 aa, Homo Sapiens
LECEVTDPS

SEQ ID NO: 127690 - protein, 9 aa, Homo Sapiens
SLLILICDQ

SEQ ID NO: 127691 - protein, 9 aa, Homo Sapiens
RRPQRLWKR

SEQ ID NO: 127692 - protein, 9 aa, Homo Sapiens
PGCARGPWR

SEQ ID NO: 127693 - protein, 9 aa, Homo Sapiens
RELQEKMER

SEQ ID NO: 127694 - protein, 9 aa, Homo Sapiens
WLHQPDWCC

SEQ ID NO: 127695 - protein, 9 aa, Homo Sapiens
CISVATSFQ

SEQ ID NO: 127696 - protein, 9 aa, Homo Sapiens
SPLVGEDDS

SEQ ID NO: 127697 - protein, 9 aa, Homo Sapiens
SIRIQTSLN

SEQ ID NO: 127698 - protein, 9 aa, Homo Sapiens
EVGCPAGGP

SEQ ID NO: 127699 - protein, 9 aa, Homo Sapiens
YYSTSQPNA

SEQ ID NO: 127700 - protein, 9 aa, Homo Sapiens
LKDVVKFMA

SEQ ID NO: 127701 - protein, 9 aa, Homo Sapiens
IKLIRPQPK

SEQ ID NO: 127702 - protein, 9 aa, Homo Sapiens
MLHIGAQKS

SEQ ID NO: 127703 - protein, 9 aa, Homo Sapiens
GRAFFISHS

SEQ ID NO: 127704 - protein, 9 aa, Homo Sapiens
FYPSDVAVE

SEQ ID NO: 127705 - protein, 9 aa, Homo Sapiens
PSVGLVLWS

SEQ ID NO: 127706 - protein, 9 aa, Homo Sapiens
PDSGSHRRH

SEQ ID NO: 127707 - protein, 9 aa, Homo Sapiens
PWSPTLPRT

SEQ ID NO: 127708 - protein, 9 aa, Homo Sapiens
SCSRPSAPW

SEQ ID NO: 127709 - protein, 9 aa, Homo Sapiens
PEQIKYIVA

SEQ ID NO: 127710 - protein, 9 aa, Homo Sapiens
LPGPLPASH

SEQ ID NO: 127711 - protein, 9 aa, Homo Sapiens
WRWAVSTGV

SEQ ID NO: 127712 - protein, 9 aa, Homo Sapiens
NMSKRTRIK

SEQ ID NO: 127713 - protein, 9 aa, Homo Sapiens
VAAALCIPL

SEQ ID NO: 127714 - protein, 9 aa, Homo Sapiens
KCTSVGWYP

SEQ ID NO: 127715 - protein, 9 aa, Homo Sapiens
EPENYSKKA

SEQ ID NO: 127716 - protein, 9 aa, Homo Sapiens
CLSDELPPR

SEQ ID NO: 127717 - protein, 9 aa, Homo Sapiens
ISPKLQTQV

SEQ ID NO: 127718 - protein, 9 aa, Homo Sapiens
YEPSTPVLY

SEQ ID NO: 127719 - protein, 9 aa, Homo Sapiens
LESSPAKIN

SEQ ID NO: 127720 - protein, 9 aa, Homo Sapiens
AHKVVSCLS

SEQ ID NO: 127721 - protein, 9 aa, Homo Sapiens
RIRSKKRKL

SEQ ID NO: 127722 - protein, 9 aa, Homo Sapiens
VSVRSSGYG

SEQ ID NO: 127723 - protein, 9 aa, Homo Sapiens
LKKSRQCSQ

SEQ ID NO: 127724 - protein, 9 aa, Homo Sapiens
EITARKINF

SEQ ID NO: 127725 - protein, 9 aa, Homo Sapiens
TISYYACAT

SEQ ID NO: 127726 - protein, 9 aa, Homo Sapiens
PSSGTSTIR

SEQ ID NO: 127727 - protein, 9 aa, Homo Sapiens
PKDKKILTS

SEQ ID NO: 127728 - protein, 9 aa, Homo Sapiens
VSVMKKEFP

SEQ ID NO: 127729 - protein, 9 aa, Homo Sapiens
CLFLKHEVP

SEQ ID NO: 127730 - protein, 9 aa, Homo Sapiens
ITGEETPLN

SEQ ID NO: 127731 - protein, 9 aa, Homo Sapiens
QRAQADERY

SEQ ID NO: 127732 - protein, 9 aa, Homo Sapiens
ARCVPSLGS

SEQ ID NO: 127733 - protein, 9 aa, Homo Sapiens
QAARRPPGV

SEQ ID NO: 127734 - protein, 9 aa, Homo Sapiens
RQVHGADAS

SEQ ID NO: 127735 - protein, 9 aa, Homo Sapiens
EFKSIKKHH

SEQ ID NO: 127736 - protein, 9 aa, Homo Sapiens
PFLSNSLSN

SEQ ID NO: 127737 - protein, 9 aa, Homo Sapiens
HHMQLESRA

SEQ ID NO: 127738 - protein, 9 aa, Homo Sapiens
SPVKASVVT

SEQ ID NO: 127739 - protein, 9 aa, Homo Sapiens
TAFPSPAFC

SEQ ID NO: 127740 - protein, 9 aa, Homo Sapiens
RCPGLSRKL

SEQ ID NO: 127741 - protein, 9 aa, Homo Sapiens
NKIVPFLNY

SEQ ID NO: 127742 - protein, 9 aa, Homo Sapiens
RIHGQYIHC

SEQ ID NO: 127743 - protein, 9 aa, Homo Sapiens
FDSRKRRAP

SEQ ID NO: 127744 - protein, 9 aa, Homo Sapiens
DFCFRQCRY

SEQ ID NO: 127745 - protein, 9 aa, Homo Sapiens
VKAIDFGSA

SEQ ID NO: 127746 - protein, 9 aa, Homo Sapiens
HLTSYSLQA

SEQ ID NO: 127747 - protein, 9 aa, Homo Sapiens
PAHLTSIIF

SEQ ID NO: 127748 - protein, 9 aa, Homo Sapiens
GAATSADGA

SEQ ID NO: 127749 - protein, 9 aa, Homo Sapiens
PGRPYGPPA

SEQ ID NO: 127750 - protein, 9 aa, Homo Sapiens
DLSTAKGDI

SEQ ID NO: 127751 - protein, 9 aa, Homo Sapiens
HRPVAHGLL

SEQ ID NO: 127752 - protein, 9 aa, Homo Sapiens
YNVSPRRPL

SEQ ID NO: 127753 - protein, 9 aa, Homo Sapiens
ATPVKEKHS

SEQ ID NO: 127754 - protein, 9 aa, Homo Sapiens
AAAHGGPRG

SEQ ID NO: 127755 - protein, 9 aa, Homo Sapiens
YATGCFVAK

SEQ ID NO: 127756 - protein, 9 aa, Homo Sapiens
MAQDLTSRE

SEQ ID NO: 127757 - protein, 9 aa, Homo Sapiens
CQDSWRWAV

SEQ ID NO: 127758 - protein, 9 aa, Homo Sapiens
AGPLGAPGH

SEQ ID NO: 127759 - protein, 9 aa, Homo Sapiens
VSTAKVCGA

SEQ ID NO: 127760 - protein, 9 aa, Homo Sapiens
QPYRSEFYS

SEQ ID NO: 127761 - protein, 9 aa, Homo Sapiens
TKPEGPGGP

SEQ ID NO: 127762 - protein, 9 aa, Homo Sapiens
MEIEEYLID

SEQ ID NO: 127763 - protein, 9 aa, Homo Sapiens
KERTQGRNH

SEQ ID NO: 127764 - protein, 9 aa, Homo Sapiens
SRQCSQPLM

SEQ ID NO: 127765 - protein, 9 aa, Homo Sapiens
AAGPDSTPA

SEQ ID NO: 127766 - protein, 9 aa, Homo Sapiens
WTQPTLGCS

SEQ ID NO: 127767 - protein, 9 aa, Homo Sapiens
VAGFQMTRT

SEQ ID NO: 127768 - protein, 9 aa, Homo Sapiens
PLLQAPGGA

SEQ ID NO: 127769 - protein, 9 aa, Homo Sapiens
HVPGSVSHL

SEQ ID NO: 127770 - protein, 9 aa, Homo Sapiens
TETPSAGVV

SEQ ID NO: 127771 - protein, 9 aa, Homo Sapiens
VSHLKRGFL

SEQ ID NO: 127772 - protein, 9 aa, Homo Sapiens
KAWTIFKGK

SEQ ID NO: 127773 - protein, 9 aa, Homo Sapiens
VEPAFHKTS

SEQ ID NO: 127774 - protein, 9 aa, Homo Sapiens
FSEGHQGIT

SEQ ID NO: 127775 - protein, 9 aa, Homo Sapiens
AIEGLALSL

SEQ ID NO: 127776 - protein, 9 aa, Homo Sapiens
AKIRSVKMT

SEQ ID NO: 127777 - protein, 9 aa, Homo Sapiens
LGKMAYLTV

SEQ ID NO: 127778 - protein, 9 aa, Homo Sapiens
FNNEIKKEN

SEQ ID NO: 127779 - protein, 9 aa, Homo Sapiens
PAIRTRGNA

SEQ ID NO: 127780 - protein, 9 aa, Homo Sapiens
ERAMRAARL

SEQ ID NO: 127781 - protein, 9 aa, Homo Sapiens
SLQLTEKYK

SEQ ID NO: 127782 - protein, 9 aa, Homo Sapiens
ADLLQPELP

SEQ ID NO: 127783 - protein, 9 aa, Homo Sapiens
RLWKRTEFA

SEQ ID NO: 127784 - protein, 9 aa, Homo Sapiens
LPKCHTSYE

SEQ ID NO: 127785 - protein, 9 aa, Homo Sapiens
LSLARGSPK

SEQ ID NO: 127786 - protein, 9 aa, Homo Sapiens
VYTHKKREG

SEQ ID NO: 127787 - protein, 9 aa, Homo Sapiens
GDFILVRTQ

SEQ ID NO: 127788 - protein, 9 aa, Homo Sapiens
TNHHRIHTG

SEQ ID NO: 127789 - protein, 9 aa, Homo Sapiens
QTALNDGKS

SEQ ID NO: 127790 - protein, 9 aa, Homo Sapiens
RARGGTTIG

SEQ ID NO: 127791 - protein, 9 aa, Homo Sapiens
ERNMLERGE

SEQ ID NO: 127792 - protein, 9 aa, Homo Sapiens
NISMHYFCL

SEQ ID NO: 127793 - protein, 9 aa, Homo Sapiens
LKKQGWDWV

SEQ ID NO: 127794 - protein, 9 aa, Homo Sapiens
GSVAIAAGA

SEQ ID NO: 127795 - protein, 9 aa, Homo Sapiens
ALPTRRPPA

SEQ ID NO: 127796 - protein, 9 aa, Homo Sapiens
VQCEGVLQA

SEQ ID NO: 127797 - protein, 9 aa, Homo Sapiens
ERLPLHVLA

SEQ ID NO: 127798 - protein, 9 aa, Homo Sapiens
NCADCQPGT

SEQ ID NO: 127799 - protein, 9 aa, Homo Sapiens
AAPPKCPAV

SEQ ID NO: 127800 - protein, 9 aa, Homo Sapiens
SRLEFSPDV

SEQ ID NO: 127801 - protein, 9 aa, Homo Sapiens
PSSSLSYNS

SEQ ID NO: 127802 - protein, 9 aa, Homo Sapiens
CIPLLITVT

SEQ ID NO: 127803 - protein, 9 aa, Homo Sapiens
PSGRHLSHH

SEQ ID NO: 127804 - protein, 9 aa, Homo Sapiens
GCLLLLSFR

SEQ ID NO: 127805 - protein, 9 aa, Homo Sapiens
EAASLETRF

SEQ ID NO: 127806 - protein, 9 aa, Homo Sapiens
LCSFGLWFR

SEQ ID NO: 127807 - protein, 9 aa, Homo Sapiens
KKKTSENTP

SEQ ID NO: 127808 - protein, 9 aa, Homo Sapiens
NDTTENETT

SEQ ID NO: 127809 - protein, 9 aa, Homo Sapiens
QKMQSGKVY

SEQ ID NO: 127810 - protein, 9 aa, Homo Sapiens
PPPAHAMKL

SEQ ID NO: 127811 - protein, 9 aa, Homo Sapiens
VRLQPRLDH

SEQ ID NO: 127812 - protein, 9 aa, Homo Sapiens
DAGEAEAST

SEQ ID NO: 127813 - protein, 9 aa, Homo Sapiens
RTKPRGERA

SEQ ID NO: 127814 - protein, 9 aa, Homo Sapiens
TGSVDFTCT

SEQ ID NO: 127815 - protein, 9 aa, Homo Sapiens
NIKARTKKL

SEQ ID NO: 127816 - protein, 9 aa, Homo Sapiens
DLCRYITSD

SEQ ID NO: 127817 - protein, 9 aa, Homo Sapiens
DQHKGEDFT

SEQ ID NO: 127818 - protein, 9 aa, Homo Sapiens
CPQASLTAA

SEQ ID NO: 127819 - protein, 9 aa, Homo Sapiens
FWSRHCVGQ

SEQ ID NO: 127820 - protein, 9 aa, Homo Sapiens
AIMEIEEYL

SEQ ID NO: 127821 - protein, 9 aa, Homo Sapiens
RVEKMMTTK

SEQ ID NO: 127822 - protein, 9 aa, Homo Sapiens
GRQYLVQQL

SEQ ID NO: 127823 - protein, 9 aa, Homo Sapiens
LILTVWYTK

SEQ ID NO: 127824 - protein, 9 aa, Homo Sapiens
SFVVGEKMD

SEQ ID NO: 127825 - protein, 9 aa, Homo Sapiens
GRIRNKHEV

SEQ ID NO: 127826 - protein, 9 aa, Homo Sapiens
RRGLLSQQV

SEQ ID NO: 127827 - protein, 9 aa, Homo Sapiens
PAFFLLIGI

SEQ ID NO: 127828 - protein, 9 aa, Homo Sapiens
ALRVLRPLR

SEQ ID NO: 127829 - protein, 9 aa, Homo Sapiens
CSCPRARAA

SEQ ID NO: 127830 - protein, 9 aa, Homo Sapiens
NELSDFQIN

SEQ ID NO: 127831 - protein, 9 aa, Homo Sapiens
FKTQPVRSP

SEQ ID NO: 127832 - protein, 9 aa, Homo Sapiens
GGPCAWTGQ

SEQ ID NO: 127833 - protein, 9 aa, Homo Sapiens
DCKIRWESA

SEQ ID NO: 127834 - protein, 9 aa, Homo Sapiens
PSSHLSHSS

SEQ ID NO: 127835 - protein, 9 aa, Homo Sapiens
PMPMPMPIP

SEQ ID NO: 127836 - protein, 9 aa, Homo Sapiens
LFDGLMNSC

SEQ ID NO: 127837 - protein, 9 aa, Homo Sapiens
DPRSSPRLN

SEQ ID NO: 127838 - protein, 9 aa, Homo Sapiens
HHLPTTMGA

SEQ ID NO: 127839 - protein, 9 aa, Homo Sapiens
RLGHVVFSI

SEQ ID NO: 127840 - protein, 9 aa, Homo Sapiens
EVTSTYFVV

SEQ ID NO: 127841 - protein, 9 aa, Homo Sapiens
SRKQTWKIR

SEQ ID NO: 127842 - protein, 9 aa, Homo Sapiens
NGSHRLDPI

SEQ ID NO: 127843 - protein, 9 aa, Homo Sapiens
QSHGGPPKA

SEQ ID NO: 127844 - protein, 9 aa, Homo Sapiens
LGGIWPEQQ

SEQ ID NO: 127845 - protein, 9 aa, Homo Sapiens
PPRPRLNRW

SEQ ID NO: 127846 - protein, 9 aa, Homo Sapiens
FFVIQLVAK

SEQ ID NO: 127847 - protein, 9 aa, Homo Sapiens
LIAIGCFIF

SEQ ID NO: 127848 - protein, 9 aa, Homo Sapiens
NATPNMLHN

SEQ ID NO: 127849 - protein, 9 aa, Homo Sapiens
CKVNTDLLR

SEQ ID NO: 127850 - protein, 9 aa, Homo Sapiens
HGQHEVHGM

SEQ ID NO: 127851 - protein, 9 aa, Homo Sapiens
TGINPFVCI

SEQ ID NO: 127852 - protein, 9 aa, Homo Sapiens
DTPDVENLV

SEQ ID NO: 127853 - protein, 9 aa, Homo Sapiens
GRHWLCPQT

SEQ ID NO: 127854 - protein, 9 aa, Homo Sapiens
NDQDNRTTP

SEQ ID NO: 127855 - protein, 9 aa, Homo Sapiens
WLSSCPAPN

SEQ ID NO: 127856 - protein, 9 aa, Homo Sapiens
WRGHGHCFC

SEQ ID NO: 127857 - protein, 9 aa, Homo Sapiens
QEVGLSHCL

SEQ ID NO: 127858 - protein, 9 aa, Homo Sapiens
VRGAWFCWT

SEQ ID NO: 127859 - protein, 9 aa, Homo Sapiens
SNFLFSNLP

SEQ ID NO: 127860 - protein, 9 aa, Homo Sapiens
SLPALGLVR

SEQ ID NO: 127861 - protein, 9 aa, Homo Sapiens
MQSPVDIIR

SEQ ID NO: 127862 - protein, 9 aa, Homo Sapiens
GSLIDLLIK

SEQ ID NO: 127863 - protein, 9 aa, Homo Sapiens
SQLPHPHPT

SEQ ID NO: 127864 - protein, 9 aa, Homo Sapiens
ATAFFSVFM

SEQ ID NO: 127865 - protein, 9 aa, Homo Sapiens
PEKFQCVEK

SEQ ID NO: 127866 - protein, 9 aa, Homo Sapiens
VILSGEIKT

SEQ ID NO: 127867 - protein, 9 aa, Homo Sapiens
LQALLSSIN

SEQ ID NO: 127868 - protein, 9 aa, Homo Sapiens
GVDVPLVNE

SEQ ID NO: 127869 - protein, 9 aa, Homo Sapiens
TVLIAIGCF

SEQ ID NO: 127870 - protein, 9 aa, Homo Sapiens
TFSQHLQVV

SEQ ID NO: 127871 - protein, 9 aa, Homo Sapiens
CARFCKCCR

SEQ ID NO: 127872 - protein, 9 aa, Homo Sapiens
LYVYEYMLH

SEQ ID NO: 127873 - protein, 9 aa, Homo Sapiens
LIYEHIFAG

SEQ ID NO: 127874 - protein, 9 aa, Homo Sapiens
PSTARSRGA

SEQ ID NO: 127875 - protein, 9 aa, Homo Sapiens
NNRLEDAGM

SEQ ID NO: 127876 - protein, 9 aa, Homo Sapiens
LIKLYQQCI

SEQ ID NO: 127877 - protein, 9 aa, Homo Sapiens
LDFAPGMRM

SEQ ID NO: 127878 - protein, 9 aa, Homo Sapiens
SGLHPWTCF

SEQ ID NO: 127879 - protein, 9 aa, Homo Sapiens
ETFLCKAFA

SEQ ID NO: 127880 - protein, 9 aa, Homo Sapiens
RRLLGKCKF

SEQ ID NO: 127881 - protein, 9 aa, Homo Sapiens
NRTWYQEVP

SEQ ID NO: 127882 - protein, 9 aa, Homo Sapiens
DDLLQDMLS

SEQ ID NO: 127883 - protein, 9 aa, Homo Sapiens
DGSLDRNLG

SEQ ID NO: 127884 - protein, 9 aa, Homo Sapiens
TTKHVFEKK

SEQ ID NO: 127885 - protein, 9 aa, Homo Sapiens
LQARNAGPV

SEQ ID NO: 127886 - protein, 9 aa, Homo Sapiens
NLRGQQKED

SEQ ID NO: 127887 - protein, 9 aa, Homo Sapiens
SLVELRGTE

SEQ ID NO: 127888 - protein, 9 aa, Homo Sapiens
RFRGHLERV

SEQ ID NO: 127889 - protein, 9 aa, Homo Sapiens
YKYKSSGHD

SEQ ID NO: 127890 - protein, 9 aa, Homo Sapiens
RSHFKVLIF

SEQ ID NO: 127891 - protein, 9 aa, Homo Sapiens
GRSVAHCRP

SEQ ID NO: 127892 - protein, 9 aa, Homo Sapiens
SGEIKTFTF

SEQ ID NO: 127893 - protein, 9 aa, Homo Sapiens
KYIVAQYNT

SEQ ID NO: 127894 - protein, 9 aa, Homo Sapiens
VVHAMNNLN

SEQ ID NO: 127895 - protein, 9 aa, Homo Sapiens
EEELPDEIA

SEQ ID NO: 127896 - protein, 9 aa, Homo Sapiens
YNAMKKIGS

SEQ ID NO: 127897 - protein, 9 aa, Homo Sapiens
LTRALEQEQ

SEQ ID NO: 127898 - protein, 9 aa, Homo Sapiens
IPHRHPPLH

SEQ ID NO: 127899 - protein, 9 aa, Homo Sapiens
YGLIERIED

SEQ ID NO: 127900 - protein, 9 aa, Homo Sapiens
TGAQAGRAS

SEQ ID NO: 127901 - protein, 9 aa, Homo Sapiens
HITLASPEE

SEQ ID NO: 127902 - protein, 9 aa, Homo Sapiens
RETSSWSGV

SEQ ID NO: 127903 - protein, 9 aa, Homo Sapiens
KVVATSPSL

SEQ ID NO: 127904 - protein, 9 aa, Homo Sapiens
RDISNSSNW

SEQ ID NO: 127905 - protein, 9 aa, Homo Sapiens
ASAIIQHGK

SEQ ID NO: 127906 - protein, 9 aa, Homo Sapiens
NGTYWWMNA

SEQ ID NO: 127907 - protein, 9 aa, Homo Sapiens
RSYTAPDKM

SEQ ID NO: 127908 - protein, 9 aa, Homo Sapiens
LCTSLLQVI

SEQ ID NO: 127909 - protein, 9 aa, Homo Sapiens
DDKFETLEP

SEQ ID NO: 127910 - protein, 9 aa, Homo Sapiens
APTAEKREW

SEQ ID NO: 127911 - protein, 9 aa, Homo Sapiens
TEFVPGTAY

SEQ ID NO: 127912 - protein, 9 aa, Homo Sapiens
LCLAVFRVL

SEQ ID NO: 127913 - protein, 9 aa, Homo Sapiens
REPTKMWHQ

SEQ ID NO: 127914 - protein, 9 aa, Homo Sapiens
PFFFILVPR

SEQ ID NO: 127915 - protein, 9 aa, Homo Sapiens
LSSRENRAP

SEQ ID NO: 127916 - protein, 9 aa, Homo Sapiens
APPPTALAA

SEQ ID NO: 127917 - protein, 9 aa, Homo Sapiens
LALHVCYGM

SEQ ID NO: 127918 - protein, 9 aa, Homo Sapiens
PHGVPLPTE

SEQ ID NO: 127919 - protein, 9 aa, Homo Sapiens
YRSEFYSLQ

SEQ ID NO: 127920 - protein, 9 aa, Homo Sapiens
MPMPIPSAN

SEQ ID NO: 127921 - protein, 9 aa, Homo Sapiens
STPAEPRGR

SEQ ID NO: 127922 - protein, 9 aa, Homo Sapiens
ITVFATDQG

SEQ ID NO: 127923 - protein, 9 aa, Homo Sapiens
LESCEKKEN

SEQ ID NO: 127924 - protein, 9 aa, Homo Sapiens
ARVDAHMCI

SEQ ID NO: 127925 - protein, 9 aa, Homo Sapiens
QVKTGINMS

SEQ ID NO: 127926 - protein, 9 aa, Homo Sapiens
AHTLDAAKR

SEQ ID NO: 127927 - protein, 9 aa, Homo Sapiens
DAQEEPGKS

SEQ ID NO: 127928 - protein, 9 aa, Homo Sapiens
ISQVYTQNV

SEQ ID NO: 127929 - protein, 9 aa, Homo Sapiens
QESQLCSTD

SEQ ID NO: 127930 - protein, 9 aa, Homo Sapiens
GSPSTSIPH

SEQ ID NO: 127931 - protein, 9 aa, Homo Sapiens
SNEDAADGA

SEQ ID NO: 127932 - protein, 9 aa, Homo Sapiens
EYGKAFSHI

SEQ ID NO: 127933 - protein, 9 aa, Homo Sapiens
DYGGAEFMC

SEQ ID NO: 127934 - protein, 9 aa, Homo Sapiens
EELPRVVGT

SEQ ID NO: 127935 - protein, 9 aa, Homo Sapiens
LNRYSGTQN

SEQ ID NO: 127936 - protein, 9 aa, Homo Sapiens
SYPFCYLPK

SEQ ID NO: 127937 - protein, 9 aa, Homo Sapiens
RSRGLGLGR

SEQ ID NO: 127938 - protein, 9 aa, Homo Sapiens
RRAGNRGGA

SEQ ID NO: 127939 - protein, 9 aa, Homo Sapiens
CFEKICPGE

SEQ ID NO: 127940 - protein, 9 aa, Homo Sapiens
MHRQGQDES

SEQ ID NO: 127941 - protein, 9 aa, Homo Sapiens
EMHLKEAGT

SEQ ID NO: 127942 - protein, 9 aa, Homo Sapiens
AHLCLKTWN

SEQ ID NO: 127943 - protein, 9 aa, Homo Sapiens
SGRRCRNGE

SEQ ID NO: 127944 - protein, 9 aa, Homo Sapiens
HKGEDFTCF

SEQ ID NO: 127945 - protein, 9 aa, Homo Sapiens
AEMLRMYPP

SEQ ID NO: 127946 - protein, 9 aa, Homo Sapiens
YMALCSGPR

SEQ ID NO: 127947 - protein, 9 aa, Homo Sapiens
WVKIITPYF

SEQ ID NO: 127948 - protein, 9 aa, Homo Sapiens
WTERPVNSA

SEQ ID NO: 127949 - protein, 9 aa, Homo Sapiens
PAAARGAST

SEQ ID NO: 127950 - protein, 9 aa, Homo Sapiens
GQVAAILSL

SEQ ID NO: 127951 - protein, 9 aa, Homo Sapiens
LLPVHHLHR

SEQ ID NO: 127952 - protein, 9 aa, Homo Sapiens
PASLMITRA

SEQ ID NO: 127953 - protein, 9 aa, Homo Sapiens
FRTLRLCDK

SEQ ID NO: 127954 - protein, 9 aa, Homo Sapiens
VPSAPEPLT

SEQ ID NO: 127955 - protein, 9 aa, Homo Sapiens
NIPTNVSNC

SEQ ID NO: 127956 - protein, 9 aa, Homo Sapiens
LPPNSSSSV

SEQ ID NO: 127957 - protein, 9 aa, Homo Sapiens
LNWKRGPSV

SEQ ID NO: 127958 - protein, 9 aa, Homo Sapiens
AEDLEKVLE

SEQ ID NO: 127959 - protein, 9 aa, Homo Sapiens
YRAVGDSAY

SEQ ID NO: 127960 - protein, 9 aa, Homo Sapiens
APALGAVAL

SEQ ID NO: 127961 - protein, 9 aa, Homo Sapiens
NCSNYPAII

SEQ ID NO: 127962 - protein, 9 aa, Homo Sapiens
AVGVEDGDG

SEQ ID NO: 127963 - protein, 9 aa, Homo Sapiens
RQPLTHVFS

SEQ ID NO: 127964 - protein, 9 aa, Homo Sapiens
PVCPKLNLE

SEQ ID NO: 127965 - protein, 9 aa, Homo Sapiens
CNCAVFKAG

SEQ ID NO: 127966 - protein, 9 aa, Homo Sapiens
AVHLEWSLM

SEQ ID NO: 127967 - protein, 9 aa, Homo Sapiens
VGCPAGGPC

SEQ ID NO: 127968 - protein, 9 aa, Homo Sapiens
TPPAASTTS

SEQ ID NO: 127969 - protein, 9 aa, Homo Sapiens
KVSVQVDRV

SEQ ID NO: 127970 - protein, 9 aa, Homo Sapiens
SRNHQRPAA

SEQ ID NO: 127971 - protein, 9 aa, Homo Sapiens
NTLVQMADG

SEQ ID NO: 127972 - protein, 9 aa, Homo Sapiens
SPLMSEFRK

SEQ ID NO: 127973 - protein, 9 aa, Homo Sapiens
SSTVSNGAS

SEQ ID NO: 127974 - protein, 9 aa, Homo Sapiens
GSLFYYASG

SEQ ID NO: 127975 - protein, 9 aa, Homo Sapiens
FLYPMTSRP

SEQ ID NO: 127976 - protein, 9 aa, Homo Sapiens
VPDFPYPTA

SEQ ID NO: 127977 - protein, 9 aa, Homo Sapiens
DIQASHVLM

SEQ ID NO: 127978 - protein, 9 aa, Homo Sapiens
GLLLALSFA

SEQ ID NO: 127979 - protein, 9 aa, Homo Sapiens
PSLLRAGVD

SEQ ID NO: 127980 - protein, 9 aa, Homo Sapiens
SRGSSSSRC

SEQ ID NO: 127981 - protein, 9 aa, Homo Sapiens
RNRSSSNTS

SEQ ID NO: 127982 - protein, 9 aa, Homo Sapiens
SCADINECL

SEQ ID NO: 127983 - protein, 9 aa, Homo Sapiens
GGQKCSTCS

SEQ ID NO: 127984 - protein, 9 aa, Homo Sapiens
WVCNSAGCA

SEQ ID NO: 127985 - protein, 9 aa, Homo Sapiens
WDMFTTPQY

SEQ ID NO: 127986 - protein, 9 aa, Homo Sapiens
VMTDIVHRH

SEQ ID NO: 127987 - protein, 9 aa, Homo Sapiens
DFLAVKGLV

SEQ ID NO: 127988 - protein, 9 aa, Homo Sapiens
RLPHIVVVT

SEQ ID NO: 127989 - protein, 9 aa, Homo Sapiens
GAAGRRRPA

SEQ ID NO: 127990 - protein, 9 aa, Homo Sapiens
SFAHLQPPI

SEQ ID NO: 127991 - protein, 9 aa, Homo Sapiens
GPSGRLRDP

SEQ ID NO: 127992 - protein, 9 aa, Homo Sapiens
SWPWTRCLR

SEQ ID NO: 127993 - protein, 9 aa, Homo Sapiens
ALQRLTWVC

SEQ ID NO: 127994 - protein, 9 aa, Homo Sapiens
SPPCLTWAE

SEQ ID NO: 127995 - protein, 9 aa, Homo Sapiens
SLEDLRSKS

SEQ ID NO: 127996 - protein, 9 aa, Homo Sapiens
KGDGSCDMR

SEQ ID NO: 127997 - protein, 9 aa, Homo Sapiens
VTGAALASP

SEQ ID NO: 127998 - protein, 9 aa, Homo Sapiens
CTLNLPFPF

SEQ ID NO: 127999 - protein, 9 aa, Homo Sapiens
QMRQQQMAT

SEQ ID NO: 128000 - protein, 9 aa, Homo Sapiens
IKPFHIAAA

SEQ ID NO: 128001 - protein, 9 aa, Homo Sapiens
VGTRIPFRV

SEQ ID NO: 128002 - protein, 9 aa, Homo Sapiens
TLYSLQPPT

SEQ ID NO: 128003 - protein, 9 aa, Homo Sapiens
GCARGPWRA

SEQ ID NO: 128004 - protein, 9 aa, Homo Sapiens
NQVRMRCLL

SEQ ID NO: 128005 - protein, 9 aa, Homo Sapiens
DFDVFTKGR

SEQ ID NO: 128006 - protein, 9 aa, Homo Sapiens
PPSSSTPKR

SEQ ID NO: 128007 - protein, 9 aa, Homo Sapiens
LVRALQSLT

SEQ ID NO: 128008 - protein, 9 aa, Homo Sapiens
AHLCNNEEQ

SEQ ID NO: 128009 - protein, 9 aa, Homo Sapiens
HGTVKIPPK

SEQ ID NO: 128010 - protein, 9 aa, Homo Sapiens
LILILRISW

SEQ ID NO: 128011 - protein, 9 aa, Homo Sapiens
GAEFMCVPA

SEQ ID NO: 128012 - protein, 9 aa, Homo Sapiens
TVDTPPACA

SEQ ID NO: 128013 - protein, 9 aa, Homo Sapiens
SYIEVDSPA

SEQ ID NO: 128014 - protein, 9 aa, Homo Sapiens
DKAGKKCKP

SEQ ID NO: 128015 - protein, 9 aa, Homo Sapiens
PGLHLYPVG

SEQ ID NO: 128016 - protein, 9 aa, Homo Sapiens
PQSGLYVSV

SEQ ID NO: 128017 - protein, 9 aa, Homo Sapiens
GDEKEMERV

SEQ ID NO: 128018 - protein, 9 aa, Homo Sapiens
RTAPSVWNA

SEQ ID NO: 128019 - protein, 9 aa, Homo Sapiens
NDLPYLNLD

SEQ ID NO: 128020 - protein, 9 aa, Homo Sapiens
ENEVADRAY

SEQ ID NO: 128021 - protein, 9 aa, Homo Sapiens
DDNSPFFIQ

SEQ ID NO: 128022 - protein, 9 aa, Homo Sapiens
SPRSSAQGV

SEQ ID NO: 128023 - protein, 9 aa, Homo Sapiens
WMTGVQPSA

SEQ ID NO: 128024 - protein, 9 aa, Homo Sapiens
FKMNEDAQE

SEQ ID NO: 128025 - protein, 9 aa, Homo Sapiens
GEVEFTGLE

SEQ ID NO: 128026 - protein, 9 aa, Homo Sapiens
RRPALRLLC

SEQ ID NO: 128027 - protein, 9 aa, Homo Sapiens
QRKIEFQLT

SEQ ID NO: 128028 - protein, 9 aa, Homo Sapiens
KRRLIETSL

SEQ ID NO: 128029 - protein, 9 aa, Homo Sapiens
QESIEFDII

SEQ ID NO: 128030 - protein, 9 aa, Homo Sapiens
MKCVHPFIF

SEQ ID NO: 128031 - protein, 9 aa, Homo Sapiens
GSRGAPHPA

SEQ ID NO: 128032 - protein, 9 aa, Homo Sapiens
TQATPQGAI

SEQ ID NO: 128033 - protein, 9 aa, Homo Sapiens
FERQIQEKL

SEQ ID NO: 128034 - protein, 9 aa, Homo Sapiens
LEHQKTFWT

SEQ ID NO: 128035 - protein, 9 aa, Homo Sapiens
FILLSLVRM

SEQ ID NO: 128036 - protein, 9 aa, Homo Sapiens
KQLGLCPSS

SEQ ID NO: 128037 - protein, 9 aa, Homo Sapiens
GTGESGDLA

SEQ ID NO: 128038 - protein, 9 aa, Homo Sapiens
GRGFVMSRA

SEQ ID NO: 128039 - protein, 9 aa, Homo Sapiens
KQTWKIRTC

SEQ ID NO: 128040 - protein, 9 aa, Homo Sapiens
RMTWKPFLS

SEQ ID NO: 128041 - protein, 9 aa, Homo Sapiens
GLLDTPRSC

SEQ ID NO: 128042 - protein, 9 aa, Homo Sapiens
TATCSRRPP

SEQ ID NO: 128043 - protein, 9 aa, Homo Sapiens
QKFFVIQLV

SEQ ID NO: 128044 - protein, 9 aa, Homo Sapiens
RLLISMWKT

SEQ ID NO: 128045 - protein, 9 aa, Homo Sapiens
APGCLPRAG

SEQ ID NO: 128046 - protein, 9 aa, Homo Sapiens
DVTDASRTM

SEQ ID NO: 128047 - protein, 9 aa, Homo Sapiens
KPSCCMTTC

SEQ ID NO: 128048 - protein, 9 aa, Homo Sapiens
VSHGQDCYR

SEQ ID NO: 128049 - protein, 9 aa, Homo Sapiens
DYARWWEAQ

SEQ ID NO: 128050 - protein, 9 aa, Homo Sapiens
SRSCTAPEK

SEQ ID NO: 128051 - protein, 9 aa, Homo Sapiens
EEKSVVLLV

SEQ ID NO: 128052 - protein, 9 aa, Homo Sapiens
RLLRLQQRL

SEQ ID NO: 128053 - protein, 9 aa, Homo Sapiens
EEPCFFSGK

SEQ ID NO: 128054 - protein, 9 aa, Homo Sapiens
DSSCQADGA

SEQ ID NO: 128055 - protein, 9 aa, Homo Sapiens
EYPCSSKVS

SEQ ID NO: 128056 - protein, 9 aa, Homo Sapiens
KGVNAVRLF

SEQ ID NO: 128057 - protein, 9 aa, Homo Sapiens
TNGPRKGTQ

SEQ ID NO: 128058 - protein, 9 aa, Homo Sapiens
TVVPLDEIT

SEQ ID NO: 128059 - protein, 9 aa, Homo Sapiens
LYRGGQRCR

SEQ ID NO: 128060 - protein, 9 aa, Homo Sapiens
CADCQPGTG

SEQ ID NO: 128061 - protein, 9 aa, Homo Sapiens
ADHADDIQC

SEQ ID NO: 128062 - protein, 9 aa, Homo Sapiens
GKVFTQSSQ

SEQ ID NO: 128063 - protein, 9 aa, Homo Sapiens
LPTQSKQEQ

SEQ ID NO: 128064 - protein, 9 aa, Homo Sapiens
YQVQSPMLG

SEQ ID NO: 128065 - protein, 9 aa, Homo Sapiens
GHRAAQIRF

SEQ ID NO: 128066 - protein, 9 aa, Homo Sapiens
SAAAAAGPD

SEQ ID NO: 128067 - protein, 9 aa, Homo Sapiens
TVEELNEEF

SEQ ID NO: 128068 - protein, 9 aa, Homo Sapiens
KAAWHHMPH

SEQ ID NO: 128069 - protein, 8 aa, Homo Sapiens
GGAGALGG

SEQ ID NO: 128070 - protein, 9 aa, Homo Sapiens
TSLLLPVQS

SEQ ID NO: 128071 - protein, 9 aa, Homo Sapiens
RLPNNNSRP

SEQ ID NO: 128072 - protein, 9 aa, Homo Sapiens
PWLLQPLLT

SEQ ID NO: 128073 - protein, 9 aa, Homo Sapiens
YTLPSLCRL

SEQ ID NO: 128074 - protein, 9 aa, Homo Sapiens
VFLPQSALG

SEQ ID NO: 128075 - protein, 9 aa, Homo Sapiens
HVSNVMLDG

SEQ ID NO: 128076 - protein, 9 aa, Homo Sapiens
PPVPGVPGR

SEQ ID NO: 128077 - protein, 9 aa, Homo Sapiens
DIIPSPNFS

SEQ ID NO: 128078 - protein, 9 aa, Homo Sapiens
IANDQDNRT

SEQ ID NO: 128079 - protein, 9 aa, Homo Sapiens
VLKRESGAA

SEQ ID NO: 128080 - protein, 9 aa, Homo Sapiens
SIDYVFEEP

SEQ ID NO: 128081 - protein, 9 aa, Homo Sapiens
KVGAEEAAE

SEQ ID NO: 128082 - protein, 9 aa, Homo Sapiens
GYVERAVSD

SEQ ID NO: 128083 - protein, 9 aa, Homo Sapiens
YHHKSSSKA

SEQ ID NO: 128084 - protein, 9 aa, Homo Sapiens
LFPYAVPLP

SEQ ID NO: 128085 - protein, 9 aa, Homo Sapiens
DFLLRLHRP

SEQ ID NO: 128086 - protein, 9 aa, Homo Sapiens
QDNFTIILY

SEQ ID NO: 128087 - protein, 9 aa, Homo Sapiens
AMRAALAGA

SEQ ID NO: 128088 - protein, 9 aa, Homo Sapiens
QSETERIFE

SEQ ID NO: 128089 - protein, 9 aa, Homo Sapiens
FYTGLLLIA

SEQ ID NO: 128090 - protein, 9 aa, Homo Sapiens
AHIMSRLFY

SEQ ID NO: 128091 - protein, 9 aa, Homo Sapiens
FLSATHRYK

SEQ ID NO: 128092 - protein, 9 aa, Homo Sapiens
ENERPSARS

SEQ ID NO: 128093 - protein, 9 aa, Homo Sapiens
VVQVMTHAG

SEQ ID NO: 128094 - protein, 9 aa, Homo Sapiens
PHPSDLREY

SEQ ID NO: 128095 - protein, 9 aa, Homo Sapiens
IGSHFNIKD

SEQ ID NO: 128096 - protein, 9 aa, Homo Sapiens
SNYPAIILF

SEQ ID NO: 128097 - protein, 9 aa, Homo Sapiens
SLSKKKKKI

SEQ ID NO: 128098 - protein, 9 aa, Homo Sapiens
SPPWALAHL

SEQ ID NO: 128099 - protein, 9 aa, Homo Sapiens
SVEEGYHLP

SEQ ID NO: 128100 - protein, 9 aa, Homo Sapiens
APHPADRGP

SEQ ID NO: 128101 - protein, 9 aa, Homo Sapiens
FLLVRERKL

SEQ ID NO: 128102 - protein, 9 aa, Homo Sapiens
PCSPLQRSF

SEQ ID NO: 128103 - protein, 9 aa, Homo Sapiens
QVIKPNSEH

SEQ ID NO: 128104 - protein, 9 aa, Homo Sapiens
PKCPAVASA

SEQ ID NO: 128105 - protein, 9 aa, Homo Sapiens
LVNPEGMVK

SEQ ID NO: 128106 - protein, 9 aa, Homo Sapiens
PLAARKLQQ

SEQ ID NO: 128107 - protein, 9 aa, Homo Sapiens
SESRATGRR

SEQ ID NO: 128108 - protein, 9 aa, Homo Sapiens
EEENEGEEA

SEQ ID NO: 128109 - protein, 9 aa, Homo Sapiens
VADLLQPEL

SEQ ID NO: 128110 - protein, 9 aa, Homo Sapiens
FPGSQPQTP

SEQ ID NO: 128111 - protein, 9 aa, Homo Sapiens
NFQNMFLQA

SEQ ID NO: 128112 - protein, 9 aa, Homo Sapiens
YACARLPCA

SEQ ID NO: 128113 - protein, 9 aa, Homo Sapiens
AFCSRRWRP

SEQ ID NO: 128114 - protein, 9 aa, Homo Sapiens
RFTSHGSPF

SEQ ID NO: 128115 - protein, 9 aa, Homo Sapiens
VEKMMTTKR

SEQ ID NO: 128116 - protein, 9 aa, Homo Sapiens
ASESRATGR

SEQ ID NO: 128117 - protein, 9 aa, Homo Sapiens
ANQEFLVCL

SEQ ID NO: 128118 - protein, 9 aa, Homo Sapiens
IDEINSDLV

SEQ ID NO: 128119 - protein, 9 aa, Homo Sapiens
QGSMQENYP

SEQ ID NO: 128120 - protein, 9 aa, Homo Sapiens
RNLTEWFSR

SEQ ID NO: 128121 - protein, 9 aa, Homo Sapiens
AHSSTLAEE

SEQ ID NO: 128122 - protein, 9 aa, Homo Sapiens
SIAGGTSSG

SEQ ID NO: 128123 - protein, 9 aa, Homo Sapiens
RASLLAVKG

SEQ ID NO: 128124 - protein, 9 aa, Homo Sapiens
AVMYRETEG

SEQ ID NO: 128125 - protein, 9 aa, Homo Sapiens
ESWALTILK

SEQ ID NO: 128126 - protein, 9 aa, Homo Sapiens
SCLFLKHEV

SEQ ID NO: 128127 - protein, 9 aa, Homo Sapiens
NVLQAKKFE

SEQ ID NO: 128128 - protein, 9 aa, Homo Sapiens
LETLFLPYD

SEQ ID NO: 128129 - protein, 9 aa, Homo Sapiens
SVNAHFWPR

SEQ ID NO: 128130 - protein, 9 aa, Homo Sapiens
SASAIIQHG

SEQ ID NO: 128131 - protein, 9 aa, Homo Sapiens
PQFGRRTTK

SEQ ID NO: 128132 - protein, 9 aa, Homo Sapiens
TEDVQGENC

SEQ ID NO: 128133 - protein, 9 aa, Homo Sapiens
KDVVKFMAK

SEQ ID NO: 128134 - protein, 9 aa, Homo Sapiens
SSLMVDSDV

SEQ ID NO: 128135 - protein, 9 aa, Homo Sapiens
KREKIINPT

SEQ ID NO: 128136 - protein, 9 aa, Homo Sapiens
HVMTSFSLN

SEQ ID NO: 128137 - protein, 9 aa, Homo Sapiens
ANSETSKAT

SEQ ID NO: 128138 - protein, 9 aa, Homo Sapiens
SALSGVEGI

SEQ ID NO: 128139 - protein, 9 aa, Homo Sapiens
GSHSLRSQP

SEQ ID NO: 128140 - protein, 9 aa, Homo Sapiens
IDVNNYAKD

SEQ ID NO: 128141 - protein, 9 aa, Homo Sapiens
RLALRALLG

SEQ ID NO: 128142 - protein, 9 aa, Homo Sapiens
MAYLTVAFC

SEQ ID NO: 128143 - protein, 9 aa, Homo Sapiens
LKTHFQTPR

SEQ ID NO: 128144 - protein, 9 aa, Homo Sapiens
QKLQCNAAG

SEQ ID NO: 128145 - protein, 9 aa, Homo Sapiens
GHSQPADFL

SEQ ID NO: 128146 - protein, 9 aa, Homo Sapiens
HPKQTLENS

SEQ ID NO: 128147 - protein, 9 aa, Homo Sapiens
ATVWACAAA

SEQ ID NO: 128148 - protein, 9 aa, Homo Sapiens
ELCVIYVKE

SEQ ID NO: 128149 - protein, 9 aa, Homo Sapiens
LNDALFYHF

SEQ ID NO: 128150 - protein, 9 aa, Homo Sapiens
KALPLPMVC

SEQ ID NO: 128151 - protein, 9 aa, Homo Sapiens
EYFEQNSFE

SEQ ID NO: 128152 - protein, 9 aa, Homo Sapiens
SGPAGGRSS

SEQ ID NO: 128153 - protein, 9 aa, Homo Sapiens
DSVGLFYTS

SEQ ID NO: 128154 - protein, 9 aa, Homo Sapiens
MDITGEETP

SEQ ID NO: 128155 - protein, 9 aa, Homo Sapiens
SGKATKPKE

SEQ ID NO: 128156 - protein, 9 aa, Homo Sapiens
VGQLLPLLP

SEQ ID NO: 128157 - protein, 9 aa, Homo Sapiens
GNQAGGSGS

SEQ ID NO: 128158 - protein, 9 aa, Homo Sapiens
FPCNHRYLF

SEQ ID NO: 128159 - protein, 9 aa, Homo Sapiens
SRHAAHRPL

SEQ ID NO: 128160 - protein, 9 aa, Homo Sapiens
SLRVERSPS

SEQ ID NO: 128161 - protein, 9 aa, Homo Sapiens
RREVMDEDT

SEQ ID NO: 128162 - protein, 9 aa, Homo Sapiens
IRVDRSLLL

SEQ ID NO: 128163 - protein, 9 aa, Homo Sapiens
HLEWSLMKV

SEQ ID NO: 128164 - protein, 9 aa, Homo Sapiens
LLSMELPDF

SEQ ID NO: 128165 - protein, 9 aa, Homo Sapiens
FSVVWRQGK

SEQ ID NO: 128166 - protein, 9 aa, Homo Sapiens
AWWKKHLMR

SEQ ID NO: 128167 - protein, 9 aa, Homo Sapiens
HLQKGNKGE

SEQ ID NO: 128168 - protein, 9 aa, Homo Sapiens
GGRHPSWPW

SEQ ID NO: 128169 - protein, 9 aa, Homo Sapiens
HEQLVDRSG

SEQ ID NO: 128170 - protein, 9 aa, Homo Sapiens
CIRGETLGL

SEQ ID NO: 128171 - protein, 9 aa, Homo Sapiens
WNLNPVFGG

SEQ ID NO: 128172 - protein, 9 aa, Homo Sapiens
LCNNTAEIT

SEQ ID NO: 128173 - protein, 9 aa, Homo Sapiens
GRPSSHLSH

SEQ ID NO: 128174 - protein, 9 aa, Homo Sapiens
ESYVTDKEF

SEQ ID NO: 128175 - protein, 9 aa, Homo Sapiens
QRCAIQITH

SEQ ID NO: 128176 - protein, 9 aa, Homo Sapiens
PFSIKPFHI

SEQ ID NO: 128177 - protein, 9 aa, Homo Sapiens
SFRLESVLR

SEQ ID NO: 128178 - protein, 9 aa, Homo Sapiens
SARWRSSLS

SEQ ID NO: 128179 - protein, 9 aa, Homo Sapiens
FFVDQLRDL

SEQ ID NO: 128180 - protein, 9 aa, Homo Sapiens
LRSLVELRG

SEQ ID NO: 128181 - protein, 9 aa, Homo Sapiens
KVSLDLAPA

SEQ ID NO: 128182 - protein, 9 aa, Homo Sapiens
VGKGAAQHE

SEQ ID NO: 128183 - protein, 9 aa, Homo Sapiens
KDVQQVEPE

SEQ ID NO: 128184 - protein, 9 aa, Homo Sapiens
QTSLNIKEF

SEQ ID NO: 128185 - protein, 9 aa, Homo Sapiens
SSPPCLTWA

SEQ ID NO: 128186 - protein, 9 aa, Homo Sapiens
VPRLECSGT

SEQ ID NO: 128187 - protein, 9 aa, Homo Sapiens
CLLQQQLQQ

SEQ ID NO: 128188 - protein, 9 aa, Homo Sapiens
KIKQAGLID

SEQ ID NO: 128189 - protein, 9 aa, Homo Sapiens
EVSQRAPGK

SEQ ID NO: 128190 - protein, 9 aa, Homo Sapiens
LDTVFRDPC

SEQ ID NO: 128191 - protein, 9 aa, Homo Sapiens
VEYVELTFL

SEQ ID NO: 128192 - protein, 9 aa, Homo Sapiens
EIPNSVFLD

SEQ ID NO: 128193 - protein, 9 aa, Homo Sapiens
RDGARKYFL

SEQ ID NO: 128194 - protein, 9 aa, Homo Sapiens
PLGHHMQLE

SEQ ID NO: 128195 - protein, 9 aa, Homo Sapiens
CRRWALLAP

SEQ ID NO: 128196 - protein, 9 aa, Homo Sapiens
RAGAARASS

SEQ ID NO: 128197 - protein, 9 aa, Homo Sapiens
SLATLCSNL

SEQ ID NO: 128198 - protein, 9 aa, Homo Sapiens
VHSPSLLRA

SEQ ID NO: 128199 - protein, 9 aa, Homo Sapiens
HIFSTITLI

SEQ ID NO: 128200 - protein, 9 aa, Homo Sapiens
RAGLPSGAR

SEQ ID NO: 128201 - protein, 9 aa, Homo Sapiens
LVVPVLNLN

SEQ ID NO: 128202 - protein, 9 aa, Homo Sapiens
LHPPRMKDP

SEQ ID NO: 128203 - protein, 9 aa, Homo Sapiens
PEGDPSPHH

SEQ ID NO: 128204 - protein, 9 aa, Homo Sapiens
LAHLVPTGP

SEQ ID NO: 128205 - protein, 9 aa, Homo Sapiens
CTAPRGLTP

SEQ ID NO: 128206 - protein, 9 aa, Homo Sapiens
DDIQCVFGK

SEQ ID NO: 128207 - protein, 9 aa, Homo Sapiens
QNILEEIAS

SEQ ID NO: 128208 - protein, 9 aa, Homo Sapiens
EHVLVVHLL

SEQ ID NO: 128209 - protein, 9 aa, Homo Sapiens
ECSGTILAY

SEQ ID NO: 128210 - protein, 9 aa, Homo Sapiens
NTDVVTTLK

SEQ ID NO: 128211 - protein, 9 aa, Homo Sapiens
PVGSCPHGQ

SEQ ID NO: 128212 - protein, 9 aa, Homo Sapiens
VRKPFLRDY

SEQ ID NO: 128213 - protein, 9 aa, Homo Sapiens
ALALHVCYG

SEQ ID NO: 128214 - protein, 9 aa, Homo Sapiens
AGPAPRVPL

SEQ ID NO: 128215 - protein, 9 aa, Homo Sapiens
TAAVAPPWV

SEQ ID NO: 128216 - protein, 9 aa, Homo Sapiens
EEVLKNIYR

SEQ ID NO: 128217 - protein, 9 aa, Homo Sapiens
KVCVWQLYG

SEQ ID NO: 128218 - protein, 9 aa, Homo Sapiens
LRMFFDTLY

SEQ ID NO: 128219 - protein, 9 aa, Homo Sapiens
RFCPKILNF

SEQ ID NO: 128220 - protein, 9 aa, Homo Sapiens
KKPRWVKII

SEQ ID NO: 128221 - protein, 9 aa, Homo Sapiens
RYIETQHFR

SEQ ID NO: 128222 - protein, 9 aa, Homo Sapiens
VQEDLYCFS

SEQ ID NO: 128223 - protein, 9 aa, Homo Sapiens
PGGGGPEGP

SEQ ID NO: 128224 - protein, 9 aa, Homo Sapiens
QLPMFQPTW

SEQ ID NO: 128225 - protein, 9 aa, Homo Sapiens
VNKVLRKVM

SEQ ID NO: 128226 - protein, 9 aa, Homo Sapiens
SYTGAPQCP

SEQ ID NO: 128227 - protein, 9 aa, Homo Sapiens
KYYNAMKKI

SEQ ID NO: 128228 - protein, 9 aa, Homo Sapiens
LQDMLSPNS

SEQ ID NO: 128229 - protein, 9 aa, Homo Sapiens
HMRGLLEPL

SEQ ID NO: 128230 - protein, 9 aa, Homo Sapiens
LALGSEVWR

SEQ ID NO: 128231 - protein, 9 aa, Homo Sapiens
VGTMWLSNT

SEQ ID NO: 128232 - protein, 9 aa, Homo Sapiens
AADLHMSAM

SEQ ID NO: 128233 - protein, 9 aa, Homo Sapiens
SRTKSLYRD

SEQ ID NO: 128234 - protein, 9 aa, Homo Sapiens
CGLGWEGPR

SEQ ID NO: 128235 - protein, 9 aa, Homo Sapiens
VNHPFIVKR

SEQ ID NO: 128236 - protein, 9 aa, Homo Sapiens
RAFFISHSL

SEQ ID NO: 128237 - protein, 9 aa, Homo Sapiens
SPPIKNTHP

SEQ ID NO: 128238 - protein, 9 aa, Homo Sapiens
LTCGKPTQR

SEQ ID NO: 128239 - protein, 9 aa, Homo Sapiens
AWRTLTGGS

SEQ ID NO: 128240 - protein, 9 aa, Homo Sapiens
ASRGDTAVR

SEQ ID NO: 128241 - protein, 9 aa, Homo Sapiens
GNFIHAMGG

SEQ ID NO: 128242 - protein, 9 aa, Homo Sapiens
YSPEVINYL

SEQ ID NO: 128243 - protein, 9 aa, Homo Sapiens
QRFPTLTVS

SEQ ID NO: 128244 - protein, 9 aa, Homo Sapiens
NSAMPGPSL

SEQ ID NO: 128245 - protein, 9 aa, Homo Sapiens
LRVKTRDFT

SEQ ID NO: 128246 - protein, 9 aa, Homo Sapiens
HTFYKRAAC

SEQ ID NO: 128247 - protein, 9 aa, Homo Sapiens
ARRPPGVPL

SEQ ID NO: 128248 - protein, 9 aa, Homo Sapiens
SISSMPSSG

SEQ ID NO: 128249 - protein, 9 aa, Homo Sapiens
ASDLRETIT

SEQ ID NO: 128250 - protein, 9 aa, Homo Sapiens
GFGSLYFIH

SEQ ID NO: 128251 - protein, 9 aa, Homo Sapiens
ITVGRIDRE

SEQ ID NO: 128252 - protein, 9 aa, Homo Sapiens
EVDVILEDG

SEQ ID NO: 128253 - protein, 9 aa, Homo Sapiens
EIEEYLIDM

SEQ ID NO: 128254 - protein, 9 aa, Homo Sapiens
VIISPNMSK

SEQ ID NO: 128255 - protein, 9 aa, Homo Sapiens
ANCADCQPG

SEQ ID NO: 128256 - protein, 9 aa, Homo Sapiens
GFQVDNVLT

SEQ ID NO: 128257 - protein, 9 aa, Homo Sapiens
LVIVQRVNN

SEQ ID NO: 128258 - protein, 9 aa, Homo Sapiens
YGKAFSHIS

SEQ ID NO: 128259 - protein, 9 aa, Homo Sapiens
YPSDVAVEW

SEQ ID NO: 128260 - protein, 9 aa, Homo Sapiens
EATAHGLFR

SEQ ID NO: 128261 - protein, 9 aa, Homo Sapiens
KKSRQCSQP

SEQ ID NO: 128262 - protein, 9 aa, Homo Sapiens
KNLENAISQ

SEQ ID NO: 128263 - protein, 9 aa, Homo Sapiens
VLELTSAQL

SEQ ID NO: 128264 - protein, 9 aa, Homo Sapiens
SHPPSPTIP

SEQ ID NO: 128265 - protein, 9 aa, Homo Sapiens
PMPIPSANT

SEQ ID NO: 128266 - protein, 9 aa, Homo Sapiens
WQRCAIQIT

SEQ ID NO: 128267 - protein, 9 aa, Homo Sapiens
DPVHNLRLS

SEQ ID NO: 128268 - protein, 9 aa, Homo Sapiens
ELGLETIFD

SEQ ID NO: 128269 - protein, 9 aa, Homo Sapiens
FWLSSCPAP

SEQ ID NO: 128270 - protein, 9 aa, Homo Sapiens
NGEPPRSST

SEQ ID NO: 128271 - protein, 9 aa, Homo Sapiens
LVIEEHENS

SEQ ID NO: 128272 - protein, 9 aa, Homo Sapiens
YVRQGLLLA

SEQ ID NO: 128273 - protein, 9 aa, Homo Sapiens
KEMERVSEP

SEQ ID NO: 128274 - protein, 9 aa, Homo Sapiens
ISKLTYHQG

SEQ ID NO: 128275 - protein, 9 aa, Homo Sapiens
NSIELCFQS

SEQ ID NO: 128276 - protein, 9 aa, Homo Sapiens
SALCPFQDN

SEQ ID NO: 128277 - protein, 9 aa, Homo Sapiens
DKSVSFFVK

SEQ ID NO: 128278 - protein, 9 aa, Homo Sapiens
KNEPQRPPR

SEQ ID NO: 128279 - protein, 9 aa, Homo Sapiens
AAELMHRQG

SEQ ID NO: 128280 - protein, 9 aa, Homo Sapiens
RHPRFDLSH

SEQ ID NO: 128281 - protein, 9 aa, Homo Sapiens
INVIFLGAP

SEQ ID NO: 128282 - protein, 9 aa, Homo Sapiens
GRCSDEVTC

SEQ ID NO: 128283 - protein, 9 aa, Homo Sapiens
GGCLLLLSF

SEQ ID NO: 128284 - protein, 9 aa, Homo Sapiens
LLRAGVDIC

SEQ ID NO: 128285 - protein, 9 aa, Homo Sapiens
QPPGEGKGQ

SEQ ID NO: 128286 - protein, 9 aa, Homo Sapiens
YLTWTFLYH

SEQ ID NO: 128287 - protein, 9 aa, Homo Sapiens
DKKILTSED

SEQ ID NO: 128288 - protein, 9 aa, Homo Sapiens
KPLFYIIDI

SEQ ID NO: 128289 - protein, 9 aa, Homo Sapiens
EFEEKSRGS

SEQ ID NO: 128290 - protein, 9 aa, Homo Sapiens
IYEHIFAGI

SEQ ID NO: 128291 - protein, 9 aa, Homo Sapiens
IRTCLRRVR

SEQ ID NO: 128292 - protein, 9 aa, Homo Sapiens
FVVVDFFGG

SEQ ID NO: 128293 - protein, 9 aa, Homo Sapiens
MVFLDGGCE

SEQ ID NO: 128294 - protein, 9 aa, Homo Sapiens
RGSSPPGRH

SEQ ID NO: 128295 - protein, 9 aa, Homo Sapiens
LEALSCLYA

SEQ ID NO: 128296 - protein, 9 aa, Homo Sapiens
LLEASTLVH

SEQ ID NO: 128297 - protein, 9 aa, Homo Sapiens
NISKQPVSN

SEQ ID NO: 128298 - protein, 9 aa, Homo Sapiens
PAEAVGHHN

SEQ ID NO: 128299 - protein, 9 aa, Homo Sapiens
KKRKTANYE

SEQ ID NO: 128300 - protein, 9 aa, Homo Sapiens
PREQCEPVF

SEQ ID NO: 128301 - protein, 9 aa, Homo Sapiens
DPKENKVVE

SEQ ID NO: 128302 - protein, 9 aa, Homo Sapiens
IVFLGFTSD

SEQ ID NO: 128303 - protein, 9 aa, Homo Sapiens
SWPTFLCRP

SEQ ID NO: 128304 - protein, 9 aa, Homo Sapiens
WNYTVDAPH

SEQ ID NO: 128305 - protein, 9 aa, Homo Sapiens
GGPAPGRPY

SEQ ID NO: 128306 - protein, 9 aa, Homo Sapiens
VATITAVSS

SEQ ID NO: 128307 - protein, 9 aa, Homo Sapiens
AAVSPPAGH

SEQ ID NO: 128308 - protein, 9 aa, Homo Sapiens
PHQIQHALI

SEQ ID NO: 128309 - protein, 9 aa, Homo Sapiens
TISQAMPNA

SEQ ID NO: 128310 - protein, 9 aa, Homo Sapiens
AVRPCVKTW

SEQ ID NO: 128311 - protein, 9 aa, Homo Sapiens
PLNSHAHED

SEQ ID NO: 128312 - protein, 9 aa, Homo Sapiens
GTAGARHHT

SEQ ID NO: 128313 - protein, 9 aa, Homo Sapiens
AEPRGRASS

SEQ ID NO: 128314 - protein, 9 aa, Homo Sapiens
IMTMNPFLM

SEQ ID NO: 128315 - protein, 9 aa, Homo Sapiens
KELTRHPDS

SEQ ID NO: 128316 - protein, 9 aa, Homo Sapiens
RKGREERRE

SEQ ID NO: 128317 - protein, 9 aa, Homo Sapiens
LSSVWPSPR

SEQ ID NO: 128318 - protein, 9 aa, Homo Sapiens
CHHCGQCGL

SEQ ID NO: 128319 - protein, 9 aa, Homo Sapiens
MVSSSQKRA

SEQ ID NO: 128320 - protein, 9 aa, Homo Sapiens
EVASGAACI

SEQ ID NO: 128321 - protein, 9 aa, Homo Sapiens
GYGKKVVVV

SEQ ID NO: 128322 - protein, 9 aa, Homo Sapiens
FRTNGSKQL

SEQ ID NO: 128323 - protein, 9 aa, Homo Sapiens
DASRLEFSP

SEQ ID NO: 128324 - protein, 9 aa, Homo Sapiens
KGRTSVHVF

SEQ ID NO: 128325 - protein, 9 aa, Homo Sapiens
ECHSRARES

SEQ ID NO: 128326 - protein, 9 aa, Homo Sapiens
CLTEEQARK

SEQ ID NO: 128327 - protein, 9 aa, Homo Sapiens
QSCRQSHHG

SEQ ID NO: 128328 - protein, 9 aa, Homo Sapiens
PVPVIMNNF

SEQ ID NO: 128329 - protein, 9 aa, Homo Sapiens
NALREQGPP

SEQ ID NO: 128330 - protein, 9 aa, Homo Sapiens
RLALGSEVW

SEQ ID NO: 128331 - protein, 9 aa, Homo Sapiens
NHSPVKASV

SEQ ID NO: 128332 - protein, 9 aa, Homo Sapiens
RDSGSYQDL

SEQ ID NO: 128333 - protein, 9 aa, Homo Sapiens
QPKTQRTSV

SEQ ID NO: 128334 - protein, 9 aa, Homo Sapiens
IEFDIIPSP

SEQ ID NO: 128335 - protein, 9 aa, Homo Sapiens
HAGIYLYGA

SEQ ID NO: 128336 - protein, 9 aa, Homo Sapiens
LHASLPPTS

SEQ ID NO: 128337 - protein, 9 aa, Homo Sapiens
LSTRVVDHY

SEQ ID NO: 128338 - protein, 9 aa, Homo Sapiens
GRLHEEARG

SEQ ID NO: 128339 - protein, 9 aa, Homo Sapiens
VASTLAPAS

SEQ ID NO: 128340 - protein, 9 aa, Homo Sapiens
HLAVTPDAY

SEQ ID NO: 128341 - protein, 9 aa, Homo Sapiens
VSQRGDLED

SEQ ID NO: 128342 - protein, 9 aa, Homo Sapiens
NLRTCDRCK

SEQ ID NO: 128343 - protein, 9 aa, Homo Sapiens
RLLFKLNTK

SEQ ID NO: 128344 - protein, 9 aa, Homo Sapiens
YRFSIRKQH

SEQ ID NO: 128345 - protein, 9 aa, Homo Sapiens
FGQIVNALD

SEQ ID NO: 128346 - protein, 9 aa, Homo Sapiens
SLRSQPLLN

SEQ ID NO: 128347 - protein, 9 aa, Homo Sapiens
TGKQKLYSR

SEQ ID NO: 128348 - protein, 9 aa, Homo Sapiens
LLLGWLIND

SEQ ID NO: 128349 - protein, 9 aa, Homo Sapiens
STRPSRMCT

SEQ ID NO: 128350 - protein, 9 aa, Homo Sapiens
PRVLVPPIS

SEQ ID NO: 128351 - protein, 9 aa, Homo Sapiens
GKQYDIHIL

SEQ ID NO: 128352 - protein, 9 aa, Homo Sapiens
PGTGFFRDI

SEQ ID NO: 128353 - protein, 9 aa, Homo Sapiens
NNEIKKENL

SEQ ID NO: 128354 - protein, 9 aa, Homo Sapiens
PPRSHPPSP

SEQ ID NO: 128355 - protein, 9 aa, Homo Sapiens
ISGHLQYMW

SEQ ID NO: 128356 - protein, 9 aa, Homo Sapiens
RISMQCVTS

SEQ ID NO: 128357 - protein, 9 aa, Homo Sapiens
CGRSRAASV

SEQ ID NO: 128358 - protein, 9 aa, Homo Sapiens
KTKDPPAMR

SEQ ID NO: 128359 - protein, 9 aa, Homo Sapiens
TVNITPQTT

SEQ ID NO: 128360 - protein, 9 aa, Homo Sapiens
LRLFLAQCL

SEQ ID NO: 128361 - protein, 9 aa, Homo Sapiens
AFTFDHDCK

SEQ ID NO: 128362 - protein, 9 aa, Homo Sapiens
EMWRQLIPC

SEQ ID NO: 128363 - protein, 9 aa, Homo Sapiens
EAVNKIRLK

SEQ ID NO: 128364 - protein, 9 aa, Homo Sapiens
GWAWDDKKA

SEQ ID NO: 128365 - protein, 9 aa, Homo Sapiens
CGLDESCLV

SEQ ID NO: 128366 - protein, 9 aa, Homo Sapiens
RLVCADTTL

SEQ ID NO: 128367 - protein, 9 aa, Homo Sapiens
HLYPVGSGP

SEQ ID NO: 128368 - protein, 9 aa, Homo Sapiens
ATPLALSTE

SEQ ID NO: 128369 - protein, 9 aa, Homo Sapiens
SSSTPKRPR

SEQ ID NO: 128370 - protein, 9 aa, Homo Sapiens
MAQVTHPLV

SEQ ID NO: 128371 - protein, 9 aa, Homo Sapiens
NRNPGIQSN

SEQ ID NO: 128372 - protein, 9 aa, Homo Sapiens
SITKPEGPG

SEQ ID NO: 128373 - protein, 9 aa, Homo Sapiens
YHALPFFLL

SEQ ID NO: 128374 - protein, 9 aa, Homo Sapiens
SQAAANVLH

SEQ ID NO: 128375 - protein, 9 aa, Homo Sapiens
APAVPAAPA

SEQ ID NO: 128376 - protein, 9 aa, Homo Sapiens
STSSTSFNL

SEQ ID NO: 128377 - protein, 9 aa, Homo Sapiens
QYSSIQYSI

SEQ ID NO: 128378 - protein, 9 aa, Homo Sapiens
YFSWAGLPS

SEQ ID NO: 128379 - protein, 9 aa, Homo Sapiens
VEKQLGLCP

SEQ ID NO: 128380 - protein, 9 aa, Homo Sapiens
PPSTSAVDF

SEQ ID NO: 128381 - protein, 9 aa, Homo Sapiens
HLHRKGPLN

SEQ ID NO: 128382 - protein, 9 aa, Homo Sapiens
CPLPLKRRK

SEQ ID NO: 128383 - protein, 9 aa, Homo Sapiens
WENGASLDD

SEQ ID NO: 128384 - protein, 9 aa, Homo Sapiens
KQYDIHILY

SEQ ID NO: 128385 - protein, 9 aa, Homo Sapiens
MVSSETDTY

SEQ ID NO: 128386 - protein, 9 aa, Homo Sapiens
CHGLGTCMW

SEQ ID NO: 128387 - protein, 9 aa, Homo Sapiens
GRSGSFKAA

SEQ ID NO: 128388 - protein, 9 aa, Homo Sapiens
EREIVPVEL

SEQ ID NO: 128389 - protein, 9 aa, Homo Sapiens
MQESQLCST

SEQ ID NO: 128390 - protein, 9 aa, Homo Sapiens
TIFKGKYKE

SEQ ID NO: 128391 - protein, 9 aa, Homo Sapiens
AQPPRWHLR

SEQ ID NO: 128392 - protein, 9 aa, Homo Sapiens
TVSVATGPD

SEQ ID NO: 128393 - protein, 9 aa, Homo Sapiens
IGIFGENEV

SEQ ID NO: 128394 - protein, 9 aa, Homo Sapiens
GGKEEAQEA

SEQ ID NO: 128395 - protein, 9 aa, Homo Sapiens
DELCLHVQQ

SEQ ID NO: 128396 - protein, 9 aa, Homo Sapiens
GAPRDGRAS

SEQ ID NO: 128397 - protein, 9 aa, Homo Sapiens
PSESCLICP

SEQ ID NO: 128398 - protein, 9 aa, Homo Sapiens
PPGRHWLCP

SEQ ID NO: 128399 - protein, 9 aa, Homo Sapiens
VCFGIFHKA

SEQ ID NO: 128400 - protein, 9 aa, Homo Sapiens
VPGYYSWRN

SEQ ID NO: 128401 - protein, 9 aa, Homo Sapiens
PFLNYAMSS

SEQ ID NO: 128402 - protein, 9 aa, Homo Sapiens
DEVQFEIST

SEQ ID NO: 128403 - protein, 9 aa, Homo Sapiens
ASLLAEVCH

SEQ ID NO: 128404 - protein, 9 aa, Homo Sapiens
RDKKRRSKI

SEQ ID NO: 128405 - protein, 9 aa, Homo Sapiens
KAWLQDAHQ

SEQ ID NO: 128406 - protein, 9 aa, Homo Sapiens
QEAQGILWT

SEQ ID NO: 128407 - protein, 9 aa, Homo Sapiens
NSLEPYAFN

SEQ ID NO: 128408 - protein, 9 aa, Homo Sapiens
EEGDETETP

SEQ ID NO: 128409 - protein, 9 aa, Homo Sapiens
GARRPAPLS

SEQ ID NO: 128410 - protein, 9 aa, Homo Sapiens
VTTIFPPLE

SEQ ID NO: 128411 - protein, 9 aa, Homo Sapiens
GQIVNALDK

SEQ ID NO: 128412 - protein, 9 aa, Homo Sapiens
MYQANGAYS

SEQ ID NO: 128413 - protein, 9 aa, Homo Sapiens
QSPVDIIRS

SEQ ID NO: 128414 - protein, 9 aa, Homo Sapiens
SSATIQNES

SEQ ID NO: 128415 - protein, 9 aa, Homo Sapiens
ILRDSGSYQ

SEQ ID NO: 128416 - protein, 9 aa, Homo Sapiens
ENSHLKHIY

SEQ ID NO: 128417 - protein, 9 aa, Homo Sapiens
LSRSLPALG

SEQ ID NO: 128418 - protein, 9 aa, Homo Sapiens
SAGYRCRWC

SEQ ID NO: 128419 - protein, 9 aa, Homo Sapiens
VNAHFWPRR

SEQ ID NO: 128420 - protein, 9 aa, Homo Sapiens
TCLRRVRQK

SEQ ID NO: 128421 - protein, 9 aa, Homo Sapiens
MGLFLQKTS

SEQ ID NO: 128422 - protein, 9 aa, Homo Sapiens
CPSSAEPNY

SEQ ID NO: 128423 - protein, 9 aa, Homo Sapiens
HPSSVLGPV

SEQ ID NO: 128424 - protein, 9 aa, Homo Sapiens
GVIRVDRSL

SEQ ID NO: 128425 - protein, 9 aa, Homo Sapiens
KTRMEKRRL

SEQ ID NO: 128426 - protein, 9 aa, Homo Sapiens
VKDEQGTEN

SEQ ID NO: 128427 - protein, 9 aa, Homo Sapiens
TTLKKIRRY

SEQ ID NO: 128428 - protein, 9 aa, Homo Sapiens
LNLPFPFSI

SEQ ID NO: 128429 - protein, 9 aa, Homo Sapiens
FHNKYLEDI

SEQ ID NO: 128430 - protein, 9 aa, Homo Sapiens
EKPFKCKNV

SEQ ID NO: 128431 - protein, 9 aa, Homo Sapiens
RNAGPVGEM

SEQ ID NO: 128432 - protein, 9 aa, Homo Sapiens
IWVRREDSA

SEQ ID NO: 128433 - protein, 9 aa, Homo Sapiens
NNPRDEIAT

SEQ ID NO: 128434 - protein, 9 aa, Homo Sapiens
PLDTVQPLK

SEQ ID NO: 128435 - protein, 9 aa, Homo Sapiens
QRERVRGGK

SEQ ID NO: 128436 - protein, 9 aa, Homo Sapiens
ARLPCAPPP

SEQ ID NO: 128437 - protein, 9 aa, Homo Sapiens
MAGLSRQRC

SEQ ID NO: 128438 - protein, 9 aa, Homo Sapiens
FLSNSLSNT

SEQ ID NO: 128439 - protein, 9 aa, Homo Sapiens
SVVLLVVSV

SEQ ID NO: 128440 - protein, 9 aa, Homo Sapiens
IVTKEENRH

SEQ ID NO: 128441 - protein, 9 aa, Homo Sapiens
SVFRKHQII

SEQ ID NO: 128442 - protein, 9 aa, Homo Sapiens
AFIIRSFDG

SEQ ID NO: 128443 - protein, 9 aa, Homo Sapiens
VMNQYRMRG

SEQ ID NO: 128444 - protein, 9 aa, Homo Sapiens
RRVLQQVPC

SEQ ID NO: 128445 - protein, 9 aa, Homo Sapiens
NDSDSESET

SEQ ID NO: 128446 - protein, 9 aa, Homo Sapiens
MGDYEDVLV

SEQ ID NO: 128447 - protein, 9 aa, Homo Sapiens
MKKRVKIPR

SEQ ID NO: 128448 - protein, 9 aa, Homo Sapiens
PLPNRETGA

SEQ ID NO: 128449 - protein, 9 aa, Homo Sapiens
TRIMYPVES

SEQ ID NO: 128450 - protein, 9 aa, Homo Sapiens
VLEVVGELQ

SEQ ID NO: 128451 - protein, 9 aa, Homo Sapiens
TGENPMNVM

SEQ ID NO: 128452 - protein, 9 aa, Homo Sapiens
GSLITVGRI

SEQ ID NO: 128453 - protein, 9 aa, Homo Sapiens
IARSDVHRP

SEQ ID NO: 128454 - protein, 9 aa, Homo Sapiens
LGANAVWYR

SEQ ID NO: 128455 - protein, 9 aa, Homo Sapiens
FVTSFLTET

SEQ ID NO: 128456 - protein, 9 aa, Homo Sapiens
SRAKIRSVK

SEQ ID NO: 128457 - protein, 9 aa, Homo Sapiens
FVTSLYSMI

SEQ ID NO: 128458 - protein, 9 aa, Homo Sapiens
PPASHLSRP

SEQ ID NO: 128459 - protein, 9 aa, Homo Sapiens
HMDRSPYYG

SEQ ID NO: 128460 - protein, 9 aa, Homo Sapiens
NDDVHHQGG

SEQ ID NO: 128461 - protein, 9 aa, Homo Sapiens
FMCPFDVCN

SEQ ID NO: 128462 - protein, 9 aa, Homo Sapiens
QDLEIKSSD

SEQ ID NO: 128463 - protein, 9 aa, Homo Sapiens
GIFGENEVA

SEQ ID NO: 128464 - protein, 9 aa, Homo Sapiens
HLTKFNVWR

SEQ ID NO: 128465 - protein, 9 aa, Homo Sapiens
LGLRMRRCP

SEQ ID NO: 128466 - protein, 9 aa, Homo Sapiens
PPAPGDLQP

SEQ ID NO: 128467 - protein, 9 aa, Homo Sapiens
VSSTSTPEP

SEQ ID NO: 128468 - protein, 9 aa, Homo Sapiens
QPLAEPFPL

SEQ ID NO: 128469 - protein, 9 aa, Homo Sapiens
RASCPGFRQ

SEQ ID NO: 128470 - protein, 9 aa, Homo Sapiens
ILEFEEKSR

SEQ ID NO: 128471 - protein, 9 aa, Homo Sapiens
IDILVPCVL

SEQ ID NO: 128472 - protein, 9 aa, Homo Sapiens
FSDMPRISK

SEQ ID NO: 128473 - protein, 9 aa, Homo Sapiens
ESKMEIPPC

SEQ ID NO: 128474 - protein, 9 aa, Homo Sapiens
PHRLHLHHH

SEQ ID NO: 128475 - protein, 9 aa, Homo Sapiens
KCASLKKTK

SEQ ID NO: 128476 - protein, 9 aa, Homo Sapiens
VRPCVKTWA

SEQ ID NO: 128477 - protein, 9 aa, Homo Sapiens
HFFTEGHRP

SEQ ID NO: 128478 - protein, 9 aa, Homo Sapiens
VVPLLPRLG

SEQ ID NO: 128479 - protein, 9 aa, Homo Sapiens
LNEEFTSRH

SEQ ID NO: 128480 - protein, 9 aa, Homo Sapiens
PLAVWTQLE

SEQ ID NO: 128481 - protein, 9 aa, Homo Sapiens
VFQNHLVDG

SEQ ID NO: 128482 - protein, 9 aa, Homo Sapiens
QKKGDKQRT

SEQ ID NO: 128483 - protein, 9 aa, Homo Sapiens
PFPFSIKPF

SEQ ID NO: 128484 - protein, 9 aa, Homo Sapiens
PYRVKAIDF

SEQ ID NO: 128485 - protein, 9 aa, Homo Sapiens
LQEQLHVRR

SEQ ID NO: 128486 - protein, 9 aa, Homo Sapiens
YVSVRSSGY

SEQ ID NO: 128487 - protein, 9 aa, Homo Sapiens
LRDHICFVV

SEQ ID NO: 128488 - protein, 9 aa, Homo Sapiens
SSHQILHIL

SEQ ID NO: 128489 - protein, 9 aa, Homo Sapiens
YLRPAQSLD

SEQ ID NO: 128490 - protein, 9 aa, Homo Sapiens
LQTDYYAAL

SEQ ID NO: 128491 - protein, 9 aa, Homo Sapiens
VSPQMVNRI

SEQ ID NO: 128492 - protein, 9 aa, Homo Sapiens
RYRPDLDLV

SEQ ID NO: 128493 - protein, 9 aa, Homo Sapiens
RGLPRTNFQ

SEQ ID NO: 128494 - protein, 9 aa, Homo Sapiens
LVGEDDSFL

SEQ ID NO: 128495 - protein, 9 aa, Homo Sapiens
HQYIPQTRR

SEQ ID NO: 128496 - protein, 9 aa, Homo Sapiens
NEGEEAQEP

SEQ ID NO: 128497 - protein, 9 aa, Homo Sapiens
IPPNETLEE

SEQ ID NO: 128498 - protein, 9 aa, Homo Sapiens
AGRNPKRRQ

SEQ ID NO: 128499 - protein, 9 aa, Homo Sapiens
NGKRRLIET

SEQ ID NO: 128500 - protein, 9 aa, Homo Sapiens
NGSRSLFFC

SEQ ID NO: 128501 - protein, 9 aa, Homo Sapiens
HTLTHTHTW

SEQ ID NO: 128502 - protein, 9 aa, Homo Sapiens
DRKTEATGS

SEQ ID NO: 128503 - protein, 9 aa, Homo Sapiens
KRRSKIEAS

SEQ ID NO: 128504 - protein, 9 aa, Homo Sapiens
YLPTYTLHV

SEQ ID NO: 128505 - protein, 9 aa, Homo Sapiens
VRENSSSAD

SEQ ID NO: 128506 - protein, 9 aa, Homo Sapiens
RHPPLHRPT

SEQ ID NO: 128507 - protein, 9 aa, Homo Sapiens
SLCRLNLSS

SEQ ID NO: 128508 - protein, 9 aa, Homo Sapiens
YTFKMNEDA

SEQ ID NO: 128509 - protein, 9 aa, Homo Sapiens
QKTTRSHRK

SEQ ID NO: 128510 - protein, 9 aa, Homo Sapiens
IPNCDVSHG

SEQ ID NO: 128511 - protein, 9 aa, Homo Sapiens
PRPGAAASL

SEQ ID NO: 128512 - protein, 9 aa, Homo Sapiens
SCLSRPGWA

SEQ ID NO: 128513 - protein, 9 aa, Homo Sapiens
AEEAAESLP

SEQ ID NO: 128514 - protein, 9 aa, Homo Sapiens
AFCWINVHL

SEQ ID NO: 128515 - protein, 9 aa, Homo Sapiens
DSLHFSDVF

SEQ ID NO: 128516 - protein, 9 aa, Homo Sapiens
EGDKPSTTI

SEQ ID NO: 128517 - protein, 9 aa, Homo Sapiens
SWRNPGRGS

SEQ ID NO: 128518 - protein, 9 aa, Homo Sapiens
VTKARSLDL

SEQ ID NO: 128519 - protein, 9 aa, Homo Sapiens
YGLTSVPLF

SEQ ID NO: 128520 - protein, 9 aa, Homo Sapiens
EASLIDQMS

SEQ ID NO: 128521 - protein, 9 aa, Homo Sapiens
YRFQMKFYF

SEQ ID NO: 128522 - protein, 9 aa, Homo Sapiens
MVAVGPGAP

SEQ ID NO: 128523 - protein, 9 aa, Homo Sapiens
AHLPPPLLW

SEQ ID NO: 128524 - protein, 9 aa, Homo Sapiens
LMRLHPWWK

SEQ ID NO: 128525 - protein, 9 aa, Homo Sapiens
PAHAMKLNV

SEQ ID NO: 128526 - protein, 9 aa, Homo Sapiens
KYGLTSVPL

SEQ ID NO: 128527 - protein, 9 aa, Homo Sapiens
VMMDTSKRK

SEQ ID NO: 128528 - protein, 9 aa, Homo Sapiens
EKPYPCNEY

SEQ ID NO: 128529 - protein, 9 aa, Homo Sapiens
HVVFSIEPA

SEQ ID NO: 128530 - protein, 9 aa, Homo Sapiens
SSTFPSVYA

SEQ ID NO: 128531 - protein, 9 aa, Homo Sapiens
SCDMRYWPQ

SEQ ID NO: 128532 - protein, 9 aa, Homo Sapiens
TIQVSEEQS

SEQ ID NO: 128533 - protein, 9 aa, Homo Sapiens
SRVLQVGAL

SEQ ID NO: 128534 - protein, 9 aa, Homo Sapiens
NPFLSLPGA

SEQ ID NO: 128535 - protein, 9 aa, Homo Sapiens
RSVPETFSA

SEQ ID NO: 128536 - protein, 9 aa, Homo Sapiens
KRDLYNKFK

SEQ ID NO: 128537 - protein, 9 aa, Homo Sapiens
RFALKQEDH

SEQ ID NO: 128538 - protein, 9 aa, Homo Sapiens
LEAGSRRQV

SEQ ID NO: 128539 - protein, 9 aa, Homo Sapiens
PLPASHPLF

SEQ ID NO: 128540 - protein, 9 aa, Homo Sapiens
MLSPNSSCG

SEQ ID NO: 128541 - protein, 9 aa, Homo Sapiens
RIMPTQQQR

SEQ ID NO: 128542 - protein, 9 aa, Homo Sapiens
MNVGRPSIR

SEQ ID NO: 128543 - protein, 9 aa, Homo Sapiens
GNQELVQLW

SEQ ID NO: 128544 - protein, 9 aa, Homo Sapiens
SSFFIQDGH

SEQ ID NO: 128545 - protein, 9 aa, Homo Sapiens
NSVNLDSLG

SEQ ID NO: 128546 - protein, 9 aa, Homo Sapiens
EQYGSPIHG

SEQ ID NO: 128547 - protein, 9 aa, Homo Sapiens
SLISSLRVE

SEQ ID NO: 128548 - protein, 9 aa, Homo Sapiens
EPPRMGELK

SEQ ID NO: 128549 - protein, 9 aa, Homo Sapiens
KDGLQSVQP

SEQ ID NO: 128550 - protein, 9 aa, Homo Sapiens
PPRMKDPRV

SEQ ID NO: 128551 - protein, 9 aa, Homo Sapiens
ILHILAVVM

SEQ ID NO: 128552 - protein, 9 aa, Homo Sapiens
KCRTLQRRM

SEQ ID NO: 128553 - protein, 9 aa, Homo Sapiens
MLLEKQLEL

SEQ ID NO: 128554 - protein, 9 aa, Homo Sapiens
ALRARGGTT

SEQ ID NO: 128555 - protein, 9 aa, Homo Sapiens
PTDYSPEVI

SEQ ID NO: 128556 - protein, 9 aa, Homo Sapiens
YYYMWKTTN

SEQ ID NO: 128557 - protein, 9 aa, Homo Sapiens
NIDKYRAPI

SEQ ID NO: 128558 - protein, 9 aa, Homo Sapiens
KGFFAVYES

SEQ ID NO: 128559 - protein, 9 aa, Homo Sapiens
SIELCFQSA

SEQ ID NO: 128560 - protein, 9 aa, Homo Sapiens
LRILRKSSA

SEQ ID NO: 128561 - protein, 9 aa, Homo Sapiens
VMNVGNPSV

SEQ ID NO: 128562 - protein, 9 aa, Homo Sapiens
TTRSHRKRN

SEQ ID NO: 128563 - protein, 9 aa, Homo Sapiens
YATPLALST

SEQ ID NO: 128564 - protein, 9 aa, Homo Sapiens
ACKQLSQQD

SEQ ID NO: 128565 - protein, 9 aa, Homo Sapiens
HWLCPQTRR

SEQ ID NO: 128566 - protein, 9 aa, Homo Sapiens
GVILSGEIK

SEQ ID NO: 128567 - protein, 9 aa, Homo Sapiens
NQQLTLQVA

SEQ ID NO: 128568 - protein, 9 aa, Homo Sapiens
SATHHHSSE

SEQ ID NO: 128569 - protein, 9 aa, Homo Sapiens
DITAAHPSS

SEQ ID NO: 128570 - protein, 9 aa, Homo Sapiens
CENPEKFQC

SEQ ID NO: 128571 - protein, 9 aa, Homo Sapiens
NIPVYNDIT

SEQ ID NO: 128572 - protein, 9 aa, Homo Sapiens
VHGADASHW

SEQ ID NO: 128573 - protein, 9 aa, Homo Sapiens
AHAGQPGKM

SEQ ID NO: 128574 - protein, 9 aa, Homo Sapiens
KFHRPTGLR

SEQ ID NO: 128575 - protein, 9 aa, Homo Sapiens
VSWSQPDQT

SEQ ID NO: 128576 - protein, 9 aa, Homo Sapiens
EELATFMCA

SEQ ID NO: 128577 - protein, 9 aa, Homo Sapiens
PGARCARWL

SEQ ID NO: 128578 - protein, 9 aa, Homo Sapiens
TVLVICHPD

SEQ ID NO: 128579 - protein, 9 aa, Homo Sapiens
LFRPAEFLP

SEQ ID NO: 128580 - protein, 9 aa, Homo Sapiens
NFSAMVLAA

SEQ ID NO: 128581 - protein, 9 aa, Homo Sapiens
DELSHINTR

SEQ ID NO: 128582 - protein, 9 aa, Homo Sapiens
PSTRPSRMC

SEQ ID NO: 128583 - protein, 9 aa, Homo Sapiens
KPYPCNEYG

SEQ ID NO: 128584 - protein, 9 aa, Homo Sapiens
RNPGRGSWF

SEQ ID NO: 128585 - protein, 9 aa, Homo Sapiens
WDEQLTVNI

SEQ ID NO: 128586 - protein, 9 aa, Homo Sapiens
RALWLVWEL

SEQ ID NO: 128587 - protein, 9 aa, Homo Sapiens
GAERTAAAH

SEQ ID NO: 128588 - protein, 9 aa, Homo Sapiens
VAIMAPFLP

SEQ ID NO: 128589 - protein, 9 aa, Homo Sapiens
PILDEIYDS

SEQ ID NO: 128590 - protein, 9 aa, Homo Sapiens
DVVNKRNGA

SEQ ID NO: 128591 - protein, 9 aa, Homo Sapiens
WRFRLRDEF

SEQ ID NO: 128592 - protein, 9 aa, Homo Sapiens
DAPVTDVDF

SEQ ID NO: 128593 - protein, 9 aa, Homo Sapiens
IPQEPGPRF

SEQ ID NO: 128594 - protein, 9 aa, Homo Sapiens
ATSVRSDMA

SEQ ID NO: 128595 - protein, 9 aa, Homo Sapiens
QDAAVARGA

SEQ ID NO: 128596 - protein, 9 aa, Homo Sapiens
GTTTTGATP

SEQ ID NO: 128597 - protein, 9 aa, Homo Sapiens
QNFLRILEK

SEQ ID NO: 128598 - protein, 9 aa, Homo Sapiens
QQMATKIVQ

SEQ ID NO: 128599 - protein, 9 aa, Homo Sapiens
PCQTSCYSP

SEQ ID NO: 128600 - protein, 9 aa, Homo Sapiens
QTPCWGWHW

SEQ ID NO: 128601 - protein, 9 aa, Homo Sapiens
NTTVTALED

SEQ ID NO: 128602 - protein, 9 aa, Homo Sapiens
RAVAGSGSS

SEQ ID NO: 128603 - protein, 9 aa, Homo Sapiens
RFQMKFYFR

SEQ ID NO: 128604 - protein, 9 aa, Homo Sapiens
PIRGKKWYS

SEQ ID NO: 128605 - protein, 9 aa, Homo Sapiens
PGPPTVPSA

SEQ ID NO: 128606 - protein, 9 aa, Homo Sapiens
AVAEVIRSQ

SEQ ID NO: 128607 - protein, 9 aa, Homo Sapiens
IPPPYISSR

SEQ ID NO: 128608 - protein, 9 aa, Homo Sapiens
KSLKSIDYV

SEQ ID NO: 128609 - protein, 9 aa, Homo Sapiens
YNYNINTCA

SEQ ID NO: 128610 - protein, 9 aa, Homo Sapiens
KMMTRNFPE

SEQ ID NO: 128611 - protein, 9 aa, Homo Sapiens
LPYEDKVCV

SEQ ID NO: 128612 - protein, 9 aa, Homo Sapiens
HGQGGQPAE

SEQ ID NO: 128613 - protein, 9 aa, Homo Sapiens
PSQGTLAQE

SEQ ID NO: 128614 - protein, 9 aa, Homo Sapiens
PAASTTSSS

SEQ ID NO: 128615 - protein, 9 aa, Homo Sapiens
AQAGRASQP

SEQ ID NO: 128616 - protein, 9 aa, Homo Sapiens
SSNATPNML

SEQ ID NO: 128617 - protein, 9 aa, Homo Sapiens
PGPEGQLCG

SEQ ID NO: 128618 - protein, 9 aa, Homo Sapiens
FEYAGNDNY

SEQ ID NO: 128619 - protein, 9 aa, Homo Sapiens
TWKPFLSNS

SEQ ID NO: 128620 - protein, 9 aa, Homo Sapiens
VTRSRGTPG

SEQ ID NO: 128621 - protein, 9 aa, Homo Sapiens
ARGASTSSV

SEQ ID NO: 128622 - protein, 9 aa, Homo Sapiens
CHRGRKASL

SEQ ID NO: 128623 - protein, 9 aa, Homo Sapiens
PCLDPAGPL

SEQ ID NO: 128624 - protein, 9 aa, Homo Sapiens
LEDTKNNLL

SEQ ID NO: 128625 - protein, 9 aa, Homo Sapiens
GPLNLQGGC

SEQ ID NO: 128626 - protein, 9 aa, Homo Sapiens
NILKRQIRR

SEQ ID NO: 128627 - protein, 9 aa, Homo Sapiens
NSTWTGMVG

SEQ ID NO: 128628 - protein, 9 aa, Homo Sapiens
SLNIMKKSQ

SEQ ID NO: 128629 - protein, 9 aa, Homo Sapiens
LLKMEEWVL

SEQ ID NO: 128630 - protein, 9 aa, Homo Sapiens
KATKPKEEK

SEQ ID NO: 128631 - protein, 9 aa, Homo Sapiens
PELPPDEPQ

SEQ ID NO: 128632 - protein, 9 aa, Homo Sapiens
SSGHDSARH

SEQ ID NO: 128633 - protein, 9 aa, Homo Sapiens
VLIAIGCFI

SEQ ID NO: 128634 - protein, 9 aa, Homo Sapiens
DWDAWKVRL

SEQ ID NO: 128635 - protein, 9 aa, Homo Sapiens
VSFAARDGS

SEQ ID NO: 128636 - protein, 9 aa, Homo Sapiens
GAWRGHGHC

SEQ ID NO: 128637 - protein, 9 aa, Homo Sapiens
FHSVCLAGM

SEQ ID NO: 128638 - protein, 9 aa, Homo Sapiens
VLVVHLLLK

SEQ ID NO: 128639 - protein, 9 aa, Homo Sapiens
NLSQSPRSS

SEQ ID NO: 128640 - protein, 9 aa, Homo Sapiens
CGFLVIEEH

SEQ ID NO: 128641 - protein, 9 aa, Homo Sapiens
APRDHSPPH

SEQ ID NO: 128642 - protein, 9 aa, Homo Sapiens
LQERLPHIV

SEQ ID NO: 128643 - protein, 9 aa, Homo Sapiens
ILKQEKKDK

SEQ ID NO: 128644 - protein, 9 aa, Homo Sapiens
DLSPIEWLQ

SEQ ID NO: 128645 - protein, 9 aa, Homo Sapiens
LRRSHFKVL

SEQ ID NO: 128646 - protein, 9 aa, Homo Sapiens
QARLTQPAH

SEQ ID NO: 128647 - protein, 9 aa, Homo Sapiens
KTWNELPLP

SEQ ID NO: 128648 - protein, 9 aa, Homo Sapiens
ANLTVSNVT

SEQ ID NO: 128649 - protein, 9 aa, Homo Sapiens
YTGAPQCPP

SEQ ID NO: 128650 - protein, 9 aa, Homo Sapiens
KMLLEKQLE

SEQ ID NO: 128651 - protein, 9 aa, Homo Sapiens
STPWMTGVQ

SEQ ID NO: 128652 - protein, 9 aa, Homo Sapiens
KAQLHFAAE

SEQ ID NO: 128653 - protein, 9 aa, Homo Sapiens
SLLCDTQEG

SEQ ID NO: 128654 - protein, 9 aa, Homo Sapiens
VGRPSIRIQ

SEQ ID NO: 128655 - protein, 9 aa, Homo Sapiens
DSLEDVALL

SEQ ID NO: 128656 - protein, 9 aa, Homo Sapiens
YKSKKTLNW

SEQ ID NO: 128657 - protein, 9 aa, Homo Sapiens
AEEEQTCPA

SEQ ID NO: 128658 - protein, 9 aa, Homo Sapiens
RPKTCGYHP

SEQ ID NO: 128659 - protein, 9 aa, Homo Sapiens
IDNPTLTIM

SEQ ID NO: 128660 - protein, 9 aa, Homo Sapiens
TDAAMTAEE

SEQ ID NO: 128661 - protein, 9 aa, Homo Sapiens
CSPTRMLAS

SEQ ID NO: 128662 - protein, 9 aa, Homo Sapiens
QGTENLCIK

SEQ ID NO: 128663 - protein, 9 aa, Homo Sapiens
MWKTAVHLE

SEQ ID NO: 128664 - protein, 9 aa, Homo Sapiens
HRRHWGEEG

SEQ ID NO: 128665 - protein, 9 aa, Homo Sapiens
VDKDAMNAT

SEQ ID NO: 128666 - protein, 9 aa, Homo Sapiens
LKKKHLKAG

SEQ ID NO: 128667 - protein, 9 aa, Homo Sapiens
WRKRHLESS

SEQ ID NO: 128668 - protein, 9 aa, Homo Sapiens
SVTLASAED

SEQ ID NO: 128669 - protein, 9 aa, Homo Sapiens
VKTSLGVSQ

SEQ ID NO: 128670 - protein, 9 aa, Homo Sapiens
TTEIMQLIS

SEQ ID NO: 128671 - protein, 9 aa, Homo Sapiens
DTTGQLFVR

SEQ ID NO: 128672 - protein, 9 aa, Homo Sapiens
EMNKCLTEE

SEQ ID NO: 128673 - protein, 9 aa, Homo Sapiens
LLQPELPLE

SEQ ID NO: 128674 - protein, 9 aa, Homo Sapiens
PHAFILKSK

SEQ ID NO: 128675 - protein, 9 aa, Homo Sapiens
CYYLSPPEY

SEQ ID NO: 128676 - protein, 9 aa, Homo Sapiens
AGNKQGKDL

SEQ ID NO: 128677 - protein, 9 aa, Homo Sapiens
KLFWLSSCP

SEQ ID NO: 128678 - protein, 9 aa, Homo Sapiens
GLLFNQTGA

SEQ ID NO: 128679 - protein, 9 aa, Homo Sapiens
KDTDDSPKP

SEQ ID NO: 128680 - protein, 9 aa, Homo Sapiens
SSSQKRALL

SEQ ID NO: 128681 - protein, 9 aa, Homo Sapiens
ISMQCVTSR

SEQ ID NO: 128682 - protein, 9 aa, Homo Sapiens
MHYFCLILS

SEQ ID NO: 128683 - protein, 9 aa, Homo Sapiens
PEEPLECEV

SEQ ID NO: 128684 - protein, 9 aa, Homo Sapiens
YLPMVRGSR

SEQ ID NO: 128685 - protein, 9 aa, Homo Sapiens
SRHCVGQKM

SEQ ID NO: 128686 - protein, 9 aa, Homo Sapiens
CQTSCYSPR

SEQ ID NO: 128687 - protein, 9 aa, Homo Sapiens
FPKGLPEGY

SEQ ID NO: 128688 - protein, 9 aa, Homo Sapiens
QGKPNYTVD

SEQ ID NO: 128689 - protein, 9 aa, Homo Sapiens
RPSGRHLSH

SEQ ID NO: 128690 - protein, 9 aa, Homo Sapiens
QTLNFVSRT

SEQ ID NO: 128691 - protein, 9 aa, Homo Sapiens
TSRRRTLNL

SEQ ID NO: 128692 - protein, 9 aa, Homo Sapiens
RRSPCPPMP

SEQ ID NO: 128693 - protein, 9 aa, Homo Sapiens
CQPGTGFFR

SEQ ID NO: 128694 - protein, 9 aa, Homo Sapiens
RRPAPLSVG

SEQ ID NO: 128695 - protein, 9 aa, Homo Sapiens
PPGPPTVPS

SEQ ID NO: 128696 - protein, 9 aa, Homo Sapiens
LLDVEPVHT

SEQ ID NO: 128697 - protein, 9 aa, Homo Sapiens
PQATRARSL

SEQ ID NO: 128698 - protein, 9 aa, Homo Sapiens
GLSRQRCAL

SEQ ID NO: 128699 - protein, 9 aa, Homo Sapiens
ASHPTTREV

SEQ ID NO: 128700 - protein, 9 aa, Homo Sapiens
IKDTDDSPK

SEQ ID NO: 128701 - protein, 9 aa, Homo Sapiens
APPRSHPPS

SEQ ID NO: 128702 - protein, 9 aa, Homo Sapiens
PGFPSSLQP

SEQ ID NO: 128703 - protein, 9 aa, Homo Sapiens
DFLCCVTAA

SEQ ID NO: 128704 - protein, 9 aa, Homo Sapiens
TFSAPLELS

SEQ ID NO: 128705 - protein, 9 aa, Homo Sapiens
RGGALGTAP

SEQ ID NO: 128706 - protein, 9 aa, Homo Sapiens
QRVQTEGRL

SEQ ID NO: 128707 - protein, 9 aa, Homo Sapiens
SSFIKDPSN

SEQ ID NO: 128708 - protein, 9 aa, Homo Sapiens
AFPSPAFCS

SEQ ID NO: 128709 - protein, 9 aa, Homo Sapiens
IRQHSDGDR

SEQ ID NO: 128710 - protein, 9 aa, Homo Sapiens
SKKTLNWKR

SEQ ID NO: 128711 - protein, 9 aa, Homo Sapiens
FNVWRKRHL

SEQ ID NO: 128712 - protein, 9 aa, Homo Sapiens
SHRRHWGEE

SEQ ID NO: 128713 - protein, 9 aa, Homo Sapiens
MHLSSHWLD

SEQ ID NO: 128714 - protein, 9 aa, Homo Sapiens
KLFRPAEFL

SEQ ID NO: 128715 - protein, 9 aa, Homo Sapiens
TKHVFEKKL

SEQ ID NO: 128716 - protein, 9 aa, Homo Sapiens
LEMNKCKAM

SEQ ID NO: 128717 - protein, 9 aa, Homo Sapiens
QKTELDTFS

SEQ ID NO: 128718 - protein, 9 aa, Homo Sapiens
HLPAPMGCP

SEQ ID NO: 128719 - protein, 9 aa, Homo Sapiens
HDQRPPEGL

SEQ ID NO: 128720 - protein, 9 aa, Homo Sapiens
ALRWTGKQK

SEQ ID NO: 128721 - protein, 9 aa, Homo Sapiens
HAQLLRRSH

SEQ ID NO: 128722 - protein, 9 aa, Homo Sapiens
GPCPRAPAL

SEQ ID NO: 128723 - protein, 9 aa, Homo Sapiens
LFKLNTKHF

SEQ ID NO: 128724 - protein, 9 aa, Homo Sapiens
QGHAFLGHC

SEQ ID NO: 128725 - protein, 9 aa, Homo Sapiens
RETEGSTPG

SEQ ID NO: 128726 - protein, 9 aa, Homo Sapiens
LLSSINQEE

SEQ ID NO: 128727 - protein, 9 aa, Homo Sapiens
LNSSNNGDS

SEQ ID NO: 128728 - protein, 9 aa, Homo Sapiens
RIKKVVGQL

SEQ ID NO: 128729 - protein, 9 aa, Homo Sapiens
CVLAPIEVL

SEQ ID NO: 128730 - protein, 9 aa, Homo Sapiens
PIMEKFGIL

SEQ ID NO: 128731 - protein, 9 aa, Homo Sapiens
FSAQHLPPH

SEQ ID NO: 128732 - protein, 9 aa, Homo Sapiens
CLEAQKFFV

SEQ ID NO: 128733 - protein, 9 aa, Homo Sapiens
QQLIQITST

SEQ ID NO: 128734 - protein, 9 aa, Homo Sapiens
CRCPLSYQA

SEQ ID NO: 128735 - protein, 9 aa, Homo Sapiens
VSPSQGTLA

SEQ ID NO: 128736 - protein, 9 aa, Homo Sapiens
HAGQPGKMP

SEQ ID NO: 128737 - protein, 9 aa, Homo Sapiens
SEGHQGITG

SEQ ID NO: 128738 - protein, 9 aa, Homo Sapiens
RGGPATSHP

SEQ ID NO: 128739 - protein, 9 aa, Homo Sapiens
NDITHGNRQ

SEQ ID NO: 128740 - protein, 9 aa, Homo Sapiens
KIGVNGSHR

SEQ ID NO: 128741 - protein, 9 aa, Homo Sapiens
FHAALASCP

SEQ ID NO: 128742 - protein, 9 aa, Homo Sapiens
PTQSKQEQS

SEQ ID NO: 128743 - protein, 9 aa, Homo Sapiens
KSTLTSRRR

SEQ ID NO: 128744 - protein, 9 aa, Homo Sapiens
TYPVCYPPF

SEQ ID NO: 128745 - protein, 9 aa, Homo Sapiens
LNIKEFIQG

SEQ ID NO: 128746 - protein, 9 aa, Homo Sapiens
RLEFSPDVR

SEQ ID NO: 128747 - protein, 9 aa, Homo Sapiens
YEYMLHIGA

SEQ ID NO: 128748 - protein, 9 aa, Homo Sapiens
KRQCAPSPD

SEQ ID NO: 128749 - protein, 9 aa, Homo Sapiens
GHLERVVCA

SEQ ID NO: 128750 - protein, 9 aa, Homo Sapiens
VTGRVLREL

SEQ ID NO: 128751 - protein, 9 aa, Homo Sapiens
SNNGDSGGI

SEQ ID NO: 128752 - protein, 9 aa, Homo Sapiens
VGCLHSQLP

SEQ ID NO: 128753 - protein, 9 aa, Homo Sapiens
RKSSAVLLI

SEQ ID NO: 128754 - protein, 9 aa, Homo Sapiens
SSVTLASAE

SEQ ID NO: 128755 - protein, 9 aa, Homo Sapiens
YDVVWIQVS

SEQ ID NO: 128756 - protein, 9 aa, Homo Sapiens
NRKVKDVQQ

SEQ ID NO: 128757 - protein, 9 aa, Homo Sapiens
TIMDISPPS

SEQ ID NO: 128758 - protein, 9 aa, Homo Sapiens
GFPSRSRWP

SEQ ID NO: 128759 - protein, 9 aa, Homo Sapiens
TRRSPCPPM

SEQ ID NO: 128760 - protein, 9 aa, Homo Sapiens
LIVSLLYLN

SEQ ID NO: 128761 - protein, 9 aa, Homo Sapiens
MDIQASHVL

SEQ ID NO: 128762 - protein, 9 aa, Homo Sapiens
LALCETPAP

SEQ ID NO: 128763 - protein, 9 aa, Homo Sapiens
SFGLWFRLF

SEQ ID NO: 128764 - protein, 9 aa, Homo Sapiens
YIVLTTRKE

SEQ ID NO: 128765 - protein, 9 aa, Homo Sapiens
GYEVLDNHP

SEQ ID NO: 128766 - protein, 9 aa, Homo Sapiens
MTHKFNQEM

SEQ ID NO: 128767 - protein, 9 aa, Homo Sapiens
AQSTNSVEI

SEQ ID NO: 128768 - protein, 9 aa, Homo Sapiens
LSNTSVSSI

SEQ ID NO: 128769 - protein, 9 aa, Homo Sapiens
MVTTYTVFT

SEQ ID NO: 128770 - protein, 9 aa, Homo Sapiens
VRDKYSDDT

SEQ ID NO: 128771 - protein, 9 aa, Homo Sapiens
GHTLGLDHS

SEQ ID NO: 128772 - protein, 9 aa, Homo Sapiens
HMQLESRAH

SEQ ID NO: 128773 - protein, 9 aa, Homo Sapiens
SRVAGTAGA

SEQ ID NO: 128774 - protein, 9 aa, Homo Sapiens
TTGQLFVRT

SEQ ID NO: 128775 - protein, 9 aa, Homo Sapiens
TRKERKKQF

SEQ ID NO: 128776 - protein, 9 aa, Homo Sapiens
HSLELRACG

SEQ ID NO: 128777 - protein, 9 aa, Homo Sapiens
LKRQIRREC

SEQ ID NO: 128778 - protein, 9 aa, Homo Sapiens
PPPECCSSW

SEQ ID NO: 128779 - protein, 9 aa, Homo Sapiens
DLQPPDGSS

SEQ ID NO: 128780 - protein, 9 aa, Homo Sapiens
PGERLPGLH

SEQ ID NO: 128781 - protein, 9 aa, Homo Sapiens
LKNRKVKDV

SEQ ID NO: 128782 - protein, 9 aa, Homo Sapiens
IKKVVGQLL

SEQ ID NO: 128783 - protein, 9 aa, Homo Sapiens
ELIEKKEYK

SEQ ID NO: 128784 - protein, 9 aa, Homo Sapiens
KDLLYATGC

SEQ ID NO: 128785 - protein, 9 aa, Homo Sapiens
DINECSTIP

SEQ ID NO: 128786 - protein, 9 aa, Homo Sapiens
QKCEDINEC

SEQ ID NO: 128787 - protein, 9 aa, Homo Sapiens
ANAVWYRAV

SEQ ID NO: 128788 - protein, 9 aa, Homo Sapiens
PRAVCTAPC

SEQ ID NO: 128789 - protein, 9 aa, Homo Sapiens
WLDEYWDRQ

SEQ ID NO: 128790 - protein, 9 aa, Homo Sapiens
WLLQPLLTV

SEQ ID NO: 128791 - protein, 9 aa, Homo Sapiens
RSQHRFRGH

SEQ ID NO: 128792 - protein, 9 aa, Homo Sapiens
DKVFTYISI

SEQ ID NO: 128793 - protein, 9 aa, Homo Sapiens
ELQEQLHVR

SEQ ID NO: 128794 - protein, 9 aa, Homo Sapiens
LAADVGEAG

SEQ ID NO: 128795 - protein, 9 aa, Homo Sapiens
KKRKRERRR

SEQ ID NO: 128796 - protein, 9 aa, Homo Sapiens
LVGEDAPKI

SEQ ID NO: 128797 - protein, 9 aa, Homo Sapiens
DLHVVHHHL

SEQ ID NO: 128798 - protein, 9 aa, Homo Sapiens
DPSRPHAEQ

SEQ ID NO: 128799 - protein, 9 aa, Homo Sapiens
PRYADASGH

SEQ ID NO: 128800 - protein, 9 aa, Homo Sapiens
AACKVVATS

SEQ ID NO: 128801 - protein, 9 aa, Homo Sapiens
SYKQDRDIT

SEQ ID NO: 128802 - protein, 9 aa, Homo Sapiens
LLHPGTPGH

SEQ ID NO: 128803 - protein, 9 aa, Homo Sapiens
AVQEDLYCF

SEQ ID NO: 128804 - protein, 9 aa, Homo Sapiens
SMTLPTQAQ

SEQ ID NO: 128805 - protein, 9 aa, Homo Sapiens
YPENKRYRF

SEQ ID NO: 128806 - protein, 9 aa, Homo Sapiens
MRKPRRGVP

SEQ ID NO: 128807 - protein, 9 aa, Homo Sapiens
QGGQPAEAV

SEQ ID NO: 128808 - protein, 9 aa, Homo Sapiens
LVYATPLAL

SEQ ID NO: 128809 - protein, 9 aa, Homo Sapiens
WAPADRLCF

SEQ ID NO: 128810 - protein, 9 aa, Homo Sapiens
RKSGGEREE

SEQ ID NO: 128811 - protein, 9 aa, Homo Sapiens
QGSHHEQLV

SEQ ID NO: 128812 - protein, 9 aa, Homo Sapiens
CKKAFSQYA

SEQ ID NO: 128813 - protein, 9 aa, Homo Sapiens
WLEALSSAH

SEQ ID NO: 128814 - protein, 9 aa, Homo Sapiens
HDRFLMDQH

SEQ ID NO: 128815 - protein, 9 aa, Homo Sapiens
RETGAVQAP

SEQ ID NO: 128816 - protein, 9 aa, Homo Sapiens
WCNAINFPR

SEQ ID NO: 128817 - protein, 9 aa, Homo Sapiens
GALIPWLLQ

SEQ ID NO: 128818 - protein, 9 aa, Homo Sapiens
MILTEHLAR

SEQ ID NO: 128819 - protein, 9 aa, Homo Sapiens
CSNYYNFLQ

SEQ ID NO: 128820 - protein, 9 aa, Homo Sapiens
ELCSHQDEL

SEQ ID NO: 128821 - protein, 9 aa, Homo Sapiens
SHPLFGRLV

SEQ ID NO: 128822 - protein, 9 aa, Homo Sapiens
KKILEISPK

SEQ ID NO: 128823 - protein, 9 aa, Homo Sapiens
KRMEKDPNE

SEQ ID NO: 128824 - protein, 9 aa, Homo Sapiens
HRKRNTNKK

SEQ ID NO: 128825 - protein, 9 aa, Homo Sapiens
TGPRSPDIP

SEQ ID NO: 128826 - protein, 9 aa, Homo Sapiens
AHSVASTLA

SEQ ID NO: 128827 - protein, 9 aa, Homo Sapiens
QVGALARPM

SEQ ID NO: 128828 - protein, 9 aa, Homo Sapiens
IMSLGIHRV

SEQ ID NO: 128829 - protein, 9 aa, Homo Sapiens
PSAASRPCS

SEQ ID NO: 128830 - protein, 9 aa, Homo Sapiens
MSAVNFEKP

SEQ ID NO: 128831 - protein, 9 aa, Homo Sapiens
AELLEETPI

SEQ ID NO: 128832 - protein, 9 aa, Homo Sapiens
TRKRFVQKC

SEQ ID NO: 128833 - protein, 9 aa, Homo Sapiens
EGSPPSTAR

SEQ ID NO: 128834 - protein, 9 aa, Homo Sapiens
APDKMGIRV

SEQ ID NO: 128835 - protein, 9 aa, Homo Sapiens
LKQAHPDTG

SEQ ID NO: 128836 - protein, 9 aa, Homo Sapiens
LNPFPIRQI

SEQ ID NO: 128837 - protein, 9 aa, Homo Sapiens
IYMNGSPTY

SEQ ID NO: 128838 - protein, 9 aa, Homo Sapiens
PGSSGRSAR

SEQ ID NO: 128839 - protein, 9 aa, Homo Sapiens
LGLETIFDH

SEQ ID NO: 128840 - protein, 9 aa, Homo Sapiens
KDKTQKVQM

SEQ ID NO: 128841 - protein, 9 aa, Homo Sapiens
YVKHVCLHF

SEQ ID NO: 128842 - protein, 9 aa, Homo Sapiens
DHTQAVGGM

SEQ ID NO: 128843 - protein, 9 aa, Homo Sapiens
SRESVNAHF

SEQ ID NO: 128844 - protein, 9 aa, Homo Sapiens
LHLQAKRAG

SEQ ID NO: 128845 - protein, 9 aa, Homo Sapiens
PKEGHRQDG

SEQ ID NO: 128846 - protein, 9 aa, Homo Sapiens
MGGSRRRSL

SEQ ID NO: 128847 - protein, 9 aa, Homo Sapiens
EMIKDVAAV

SEQ ID NO: 128848 - protein, 9 aa, Homo Sapiens
RREDSAPSR

SEQ ID NO: 128849 - protein, 9 aa, Homo Sapiens
NKTREKELT

SEQ ID NO: 128850 - protein, 9 aa, Homo Sapiens
VVVGAGDVG

SEQ ID NO: 128851 - protein, 9 aa, Homo Sapiens
PCCEALCFR

SEQ ID NO: 128852 - protein, 9 aa, Homo Sapiens
TASHPTTRE

SEQ ID NO: 128853 - protein, 9 aa, Homo Sapiens
SGSAWASWP

SEQ ID NO: 128854 - protein, 9 aa, Homo Sapiens
CRILPKCHT

SEQ ID NO: 128855 - protein, 9 aa, Homo Sapiens
IHILYGYSM

SEQ ID NO: 128856 - protein, 9 aa, Homo Sapiens
GYGSSFGCY

SEQ ID NO: 128857 - protein, 9 aa, Homo Sapiens
GISRFLEEY

SEQ ID NO: 128858 - protein, 9 aa, Homo Sapiens
TTGATPGTH

SEQ ID NO: 128859 - protein, 9 aa, Homo Sapiens
PVTDVDFLR

SEQ ID NO: 128860 - protein, 9 aa, Homo Sapiens
LDEITVIYR

SEQ ID NO: 128861 - protein, 9 aa, Homo Sapiens
FASKNKDLR

SEQ ID NO: 128862 - protein, 9 aa, Homo Sapiens
GSATSLGHR

SEQ ID NO: 128863 - protein, 9 aa, Homo Sapiens
SRSDSEFVS

SEQ ID NO: 128864 - protein, 9 aa, Homo Sapiens
SNSAMPGPS

SEQ ID NO: 128865 - protein, 9 aa, Homo Sapiens
DLKINHVMT

SEQ ID NO: 128866 - protein, 9 aa, Homo Sapiens
GRQKTTRSH

SEQ ID NO: 128867 - protein, 9 aa, Homo Sapiens
QVSKLFWLS

SEQ ID NO: 128868 - protein, 9 aa, Homo Sapiens
CGKVFNQQV

SEQ ID NO: 128869 - protein, 9 aa, Homo Sapiens
QQVLESGGS

SEQ ID NO: 128870 - protein, 9 aa, Homo Sapiens
APMLESQGL

SEQ ID NO: 128871 - protein, 9 aa, Homo Sapiens
GRALDILLV

SEQ ID NO: 128872 - protein, 9 aa, Homo Sapiens
TKGVNAVRL

SEQ ID NO: 128873 - protein, 9 aa, Homo Sapiens
ILITSMGSL

SEQ ID NO: 128874 - protein, 9 aa, Homo Sapiens
SGFRVEFVD

SEQ ID NO: 128875 - protein, 9 aa, Homo Sapiens
TSHPDTSAQ

SEQ ID NO: 128876 - protein, 9 aa, Homo Sapiens
LGIILWLFI

SEQ ID NO: 128877 - protein, 9 aa, Homo Sapiens
WRTLTGGSL

SEQ ID NO: 128878 - protein, 9 aa, Homo Sapiens
EFSDQFFTV

SEQ ID NO: 128879 - protein, 9 aa, Homo Sapiens
PEGQLCGRC

SEQ ID NO: 128880 - protein, 9 aa, Homo Sapiens
FLFDGLMNS

SEQ ID NO: 128881 - protein, 9 aa, Homo Sapiens
ESSNSQQKK

SEQ ID NO: 128882 - protein, 9 aa, Homo Sapiens
EKEEDEQLQ

SEQ ID NO: 128883 - protein, 9 aa, Homo Sapiens
CWSWRENRP

SEQ ID NO: 128884 - protein, 9 aa, Homo Sapiens
QQRMIKIEN

SEQ ID NO: 128885 - protein, 9 aa, Homo Sapiens
PSQDEEAQT

SEQ ID NO: 128886 - protein, 9 aa, Homo Sapiens
ACRNLGKMA

SEQ ID NO: 128887 - protein, 9 aa, Homo Sapiens
RAVNFVVVD

SEQ ID NO: 128888 - protein, 9 aa, Homo Sapiens
GFLVREEVF

SEQ ID NO: 128889 - protein, 9 aa, Homo Sapiens
AALIGSLIH

SEQ ID NO: 128890 - protein, 9 aa, Homo Sapiens
QRDDISLCK

SEQ ID NO: 128891 - protein, 9 aa, Homo Sapiens
LSREELETL

SEQ ID NO: 128892 - protein, 9 aa, Homo Sapiens
IGFNQRNRI

SEQ ID NO: 128893 - protein, 9 aa, Homo Sapiens
LLDTPRSCE

SEQ ID NO: 128894 - protein, 9 aa, Homo Sapiens
LDMVIAEML

SEQ ID NO: 128895 - protein, 9 aa, Homo Sapiens
SSISVILKD

SEQ ID NO: 128896 - protein, 9 aa, Homo Sapiens
PFVNLLSNG

SEQ ID NO: 128897 - protein, 9 aa, Homo Sapiens
TNPNTGDIY

SEQ ID NO: 128898 - protein, 9 aa, Homo Sapiens
RSRRSKASI

SEQ ID NO: 128899 - protein, 9 aa, Homo Sapiens
GKGAAQHEF

SEQ ID NO: 128900 - protein, 9 aa, Homo Sapiens
ISRAKIRSV

SEQ ID NO: 128901 - protein, 9 aa, Homo Sapiens
HCSMRYSRL

SEQ ID NO: 128902 - protein, 9 aa, Homo Sapiens
CNAEEHVCV

SEQ ID NO: 128903 - protein, 9 aa, Homo Sapiens
IDPWVFAIR

SEQ ID NO: 128904 - protein, 9 aa, Homo Sapiens
ATKKLSINN

SEQ ID NO: 128905 - protein, 9 aa, Homo Sapiens
PGSPRSSAQ

SEQ ID NO: 128906 - protein, 9 aa, Homo Sapiens
SVMFLSATH

SEQ ID NO: 128907 - protein, 9 aa, Homo Sapiens
PVLVAVPHS

SEQ ID NO: 128908 - protein, 9 aa, Homo Sapiens
PAGLVWTHT

SEQ ID NO: 128909 - protein, 9 aa, Homo Sapiens
KDKKILTSE

SEQ ID NO: 128910 - protein, 9 aa, Homo Sapiens
ENKRYRFLL

SEQ ID NO: 128911 - protein, 9 aa, Homo Sapiens
GCNEKTPWS

SEQ ID NO: 128912 - protein, 9 aa, Homo Sapiens
ATAGDSSCQ

SEQ ID NO: 128913 - protein, 9 aa, Homo Sapiens
FGILIIGDL

SEQ ID NO: 128914 - protein, 9 aa, Homo Sapiens
SIERIKVSN

SEQ ID NO: 128915 - protein, 9 aa, Homo Sapiens
LKNMCGSRR

SEQ ID NO: 128916 - protein, 9 aa, Homo Sapiens
GKQKLYSRT

SEQ ID NO: 128917 - protein, 9 aa, Homo Sapiens
VPRMIVTPR

SEQ ID NO: 128918 - protein, 9 aa, Homo Sapiens
DGAITPWQS

SEQ ID NO: 128919 - protein, 9 aa, Homo Sapiens
KVLELTGLK

SEQ ID NO: 128920 - protein, 9 aa, Homo Sapiens
SGNRTWYQE

SEQ ID NO: 128921 - protein, 9 aa, Homo Sapiens
QNMFLQAVK

SEQ ID NO: 128922 - protein, 9 aa, Homo Sapiens
PPNETLEEA

SEQ ID NO: 128923 - protein, 9 aa, Homo Sapiens
MIRMLQCDV

SEQ ID NO: 128924 - protein, 9 aa, Homo Sapiens
VTVFFHAIT

SEQ ID NO: 128925 - protein, 9 aa, Homo Sapiens
RDKYSDDTP

SEQ ID NO: 128926 - protein, 9 aa, Homo Sapiens
ESVNAHFWP

SEQ ID NO: 128927 - protein, 9 aa, Homo Sapiens
GVHPVVVGG

SEQ ID NO: 128928 - protein, 9 aa, Homo Sapiens
GVPEANSTW

SEQ ID NO: 128929 - protein, 9 aa, Homo Sapiens
QMRTAPSVW

SEQ ID NO: 128930 - protein, 9 aa, Homo Sapiens
FCDLNPFLQ

SEQ ID NO: 128931 - protein, 9 aa, Homo Sapiens
DSFWGHSQP

SEQ ID NO: 128932 - protein, 9 aa, Homo Sapiens
EQDGPAPAE

SEQ ID NO: 128933 - protein, 9 aa, Homo Sapiens
SSRVQTLPT

SEQ ID NO: 128934 - protein, 9 aa, Homo Sapiens
RADLVRPID

SEQ ID NO: 128935 - protein, 9 aa, Homo Sapiens
LTQQPECEA

SEQ ID NO: 128936 - protein, 9 aa, Homo Sapiens
LCWAPGRPL

SEQ ID NO: 128937 - protein, 9 aa, Homo Sapiens
AAKGILQYV

SEQ ID NO: 128938 - protein, 9 aa, Homo Sapiens
PEYFGSVLE

SEQ ID NO: 128939 - protein, 9 aa, Homo Sapiens
ELQLAAVGT

SEQ ID NO: 128940 - protein, 9 aa, Homo Sapiens
DVHHQGGGH

SEQ ID NO: 128941 - protein, 9 aa, Homo Sapiens
MIDAGTEFV

SEQ ID NO: 128942 - protein, 9 aa, Homo Sapiens
DNISMHYFC

SEQ ID NO: 128943 - protein, 9 aa, Homo Sapiens
ASTTSSSGS

SEQ ID NO: 128944 - protein, 9 aa, Homo Sapiens
PSLAGPWAN

SEQ ID NO: 128945 - protein, 9 aa, Homo Sapiens
TLRQCDAEV

SEQ ID NO: 128946 - protein, 9 aa, Homo Sapiens
RKHTQGRSP

SEQ ID NO: 128947 - protein, 9 aa, Homo Sapiens
SNAKKGWTA

SEQ ID NO: 128948 - protein, 9 aa, Homo Sapiens
RWAVSTGVQ

SEQ ID NO: 128949 - protein, 9 aa, Homo Sapiens
TGGLAAPMY

SEQ ID NO: 128950 - protein, 9 aa, Homo Sapiens
VLEQILCLL

SEQ ID NO: 128951 - protein, 9 aa, Homo Sapiens
SGGHCWVTR

SEQ ID NO: 128952 - protein, 9 aa, Homo Sapiens
DSVMFLSAT

SEQ ID NO: 128953 - protein, 9 aa, Homo Sapiens
DEYDAHAVD

SEQ ID NO: 128954 - protein, 9 aa, Homo Sapiens
KKATLSHFS

SEQ ID NO: 128955 - protein, 9 aa, Homo Sapiens
QECHSRARE

SEQ ID NO: 128956 - protein, 9 aa, Homo Sapiens
SSSLSYNSS

SEQ ID NO: 128957 - protein, 9 aa, Homo Sapiens
LQNFLRILE

SEQ ID NO: 128958 - protein, 9 aa, Homo Sapiens
YEMPYAGGV

SEQ ID NO: 128959 - protein, 9 aa, Homo Sapiens
TALHSRVTA

SEQ ID NO: 128960 - protein, 9 aa, Homo Sapiens
AGEAEASTP

SEQ ID NO: 128961 - protein, 9 aa, Homo Sapiens
LFFCGAANC

SEQ ID NO: 128962 - protein, 9 aa, Homo Sapiens
GGGRESVLQ

SEQ ID NO: 128963 - protein, 9 aa, Homo Sapiens
GSQPQTPAS

SEQ ID NO: 128964 - protein, 9 aa, Homo Sapiens
HTLGLDHSS

SEQ ID NO: 128965 - protein, 9 aa, Homo Sapiens
LGAAAKFTS

SEQ ID NO: 128966 - protein, 9 aa, Homo Sapiens
FSTLPALCP

SEQ ID NO: 128967 - protein, 9 aa, Homo Sapiens
HHCSMRYSR

SEQ ID NO: 128968 - protein, 9 aa, Homo Sapiens
SSLQEIRER

SEQ ID NO: 128969 - protein, 9 aa, Homo Sapiens
GPPSAMTLP

SEQ ID NO: 128970 - protein, 9 aa, Homo Sapiens
LSFRLESVL

SEQ ID NO: 128971 - protein, 9 aa, Homo Sapiens
NMDDMMLEM

SEQ ID NO: 128972 - protein, 9 aa, Homo Sapiens
CADINECLT

SEQ ID NO: 128973 - protein, 9 aa, Homo Sapiens
NSRPSTPTI

SEQ ID NO: 128974 - protein, 9 aa, Homo Sapiens
KTPEEVLKN

SEQ ID NO: 128975 - protein, 9 aa, Homo Sapiens
VVGQLLPLL

SEQ ID NO: 128976 - protein, 9 aa, Homo Sapiens
KGQKGSVDR

SEQ ID NO: 128977 - protein, 9 aa, Homo Sapiens
LFSCLSLPS

SEQ ID NO: 128978 - protein, 9 aa, Homo Sapiens
QLTVNITPQ

SEQ ID NO: 128979 - protein, 9 aa, Homo Sapiens
CSTCSRLYV

SEQ ID NO: 128980 - protein, 9 aa, Homo Sapiens
RDVFKKNIE

SEQ ID NO: 128981 - protein, 9 aa, Homo Sapiens
IKLFGMFWA

SEQ ID NO: 128982 - protein, 9 aa, Homo Sapiens
QVAAILSLI

SEQ ID NO: 128983 - protein, 9 aa, Homo Sapiens
HLLQRCLAP

SEQ ID NO: 128984 - protein, 9 aa, Homo Sapiens
DQVTRRSLD

SEQ ID NO: 128985 - protein, 9 aa, Homo Sapiens
TGESGDLAT

SEQ ID NO: 128986 - protein, 9 aa, Homo Sapiens
VKENELQHL

SEQ ID NO: 128987 - protein, 9 aa, Homo Sapiens
EELEKEKKS

SEQ ID NO: 128988 - protein, 9 aa, Homo Sapiens
AAGRGGTTC

SEQ ID NO: 128989 - protein, 9 aa, Homo Sapiens
LMVVHGAIF

SEQ ID NO: 128990 - protein, 9 aa, Homo Sapiens
PLAHSVAST

SEQ ID NO: 128991 - protein, 9 aa, Homo Sapiens
ACSPSACRC

SEQ ID NO: 128992 - protein, 9 aa, Homo Sapiens
FVLVNLEVT

SEQ ID NO: 128993 - protein, 9 aa, Homo Sapiens
ITFLFDSTL

SEQ ID NO: 128994 - protein, 9 aa, Homo Sapiens
PRDHSPPHR

SEQ ID NO: 128995 - protein, 9 aa, Homo Sapiens
VNITPQTTL

SEQ ID NO: 128996 - protein, 9 aa, Homo Sapiens
ALKGSVMEI

SEQ ID NO: 128997 - protein, 9 aa, Homo Sapiens
CSMRYSRLK

SEQ ID NO: 128998 - protein, 9 aa, Homo Sapiens
MVVTFLMSD

SEQ ID NO: 128999 - protein, 9 aa, Homo Sapiens
EMGLLRMEA

SEQ ID NO: 129000 - protein, 9 aa, Homo Sapiens
RLRLRDNGL

SEQ ID NO: 129001 - protein, 9 aa, Homo Sapiens
HLHHHLPTT

SEQ ID NO: 129002 - protein, 9 aa, Homo Sapiens
RHDPSRPHA

SEQ ID NO: 129003 - protein, 9 aa, Homo Sapiens
TENLCIKLS

SEQ ID NO: 129004 - protein, 9 aa, Homo Sapiens
PTRRPPAPT

SEQ ID NO: 129005 - protein, 9 aa, Homo Sapiens
RNMIYMSHL

SEQ ID NO: 129006 - protein, 9 aa, Homo Sapiens
APGGGGSPR

SEQ ID NO: 129007 - protein, 9 aa, Homo Sapiens
QKTSIIRDY

SEQ ID NO: 129008 - protein, 9 aa, Homo Sapiens
ADFLANRQK

SEQ ID NO: 129009 - protein, 9 aa, Homo Sapiens
DRHGKIGPI

SEQ ID NO: 129010 - protein, 9 aa, Homo Sapiens
MHKLMASDT

SEQ ID NO: 129011 - protein, 9 aa, Homo Sapiens
PGLWLALMV

SEQ ID NO: 129012 - protein, 9 aa, Homo Sapiens
LKGVPLQFS

SEQ ID NO: 129013 - protein, 9 aa, Homo Sapiens
PLDEITVIY

SEQ ID NO: 129014 - protein, 9 aa, Homo Sapiens
GKGWRATRP

SEQ ID NO: 129015 - protein, 9 aa, Homo Sapiens
RPPEGLAPP

SEQ ID NO: 129016 - protein, 9 aa, Homo Sapiens
IEVTSTYFV

SEQ ID NO: 129017 - protein, 9 aa, Homo Sapiens
TYDCPCRWL

SEQ ID NO: 129018 - protein, 9 aa, Homo Sapiens
AEDRQPNSL

SEQ ID NO: 129019 - protein, 9 aa, Homo Sapiens
CFFHSVCLA

SEQ ID NO: 129020 - protein, 9 aa, Homo Sapiens
ALFLGGLIA

SEQ ID NO: 129021 - protein, 9 aa, Homo Sapiens
CAEALVAMP

SEQ ID NO: 129022 - protein, 9 aa, Homo Sapiens
TLNLPFPFS

SEQ ID NO: 129023 - protein, 9 aa, Homo Sapiens
RSPPPPASA

SEQ ID NO: 129024 - protein, 9 aa, Homo Sapiens
VTCFGMLLC

SEQ ID NO: 129025 - protein, 9 aa, Homo Sapiens
SSSEDGPGD

SEQ ID NO: 129026 - protein, 9 aa, Homo Sapiens
PQPISNSRP

SEQ ID NO: 129027 - protein, 9 aa, Homo Sapiens
ARHHTREIF

SEQ ID NO: 129028 - protein, 9 aa, Homo Sapiens
HLARALRPD

SEQ ID NO: 129029 - protein, 9 aa, Homo Sapiens
YSVRQSVPY

SEQ ID NO: 129030 - protein, 9 aa, Homo Sapiens
LPRVVGTQT

SEQ ID NO: 129031 - protein, 9 aa, Homo Sapiens
EVEVIGGAG

SEQ ID NO: 129032 - protein, 9 aa, Homo Sapiens
LAPQELSQL

SEQ ID NO: 129033 - protein, 9 aa, Homo Sapiens
LIGSLIHII

SEQ ID NO: 129034 - protein, 9 aa, Homo Sapiens
GGGVIRVDR

SEQ ID NO: 129035 - protein, 9 aa, Homo Sapiens
NIYRKSGTH

SEQ ID NO: 129036 - protein, 9 aa, Homo Sapiens
GAGAAAGAP

SEQ ID NO: 129037 - protein, 9 aa, Homo Sapiens
SSKSSASSS

SEQ ID NO: 129038 - protein, 9 aa, Homo Sapiens
DTEVTKARS

SEQ ID NO: 129039 - protein, 9 aa, Homo Sapiens
AMAHRSRAA

SEQ ID NO: 129040 - protein, 9 aa, Homo Sapiens
AHAAGPAAE

SEQ ID NO: 129041 - protein, 9 aa, Homo Sapiens
KDVNKVLRK

SEQ ID NO: 129042 - protein, 9 aa, Homo Sapiens
GLYLMSLGI

SEQ ID NO: 129043 - protein, 9 aa, Homo Sapiens
TSTIRTRAS

SEQ ID NO: 129044 - protein, 9 aa, Homo Sapiens
QKLSMNLMN

SEQ ID NO: 129045 - protein, 9 aa, Homo Sapiens
ATITAVSSQ

SEQ ID NO: 129046 - protein, 9 aa, Homo Sapiens
GPLGAPGHE

SEQ ID NO: 129047 - protein, 9 aa, Homo Sapiens
GAEAVLKHI

SEQ ID NO: 129048 - protein, 9 aa, Homo Sapiens
IHCRGAATS

SEQ ID NO: 129049 - protein, 9 aa, Homo Sapiens
LAGLCTSLL

SEQ ID NO: 129050 - protein, 9 aa, Homo Sapiens
RMIVTPRAI

SEQ ID NO: 129051 - protein, 9 aa, Homo Sapiens
EGPPLAVLE

SEQ ID NO: 129052 - protein, 9 aa, Homo Sapiens
VIDPVHNLR

SEQ ID NO: 129053 - protein, 9 aa, Homo Sapiens
VVTTLKKIR

SEQ ID NO: 129054 - protein, 9 aa, Homo Sapiens
CGAWRGHGH

SEQ ID NO: 129055 - protein, 9 aa, Homo Sapiens
SQVHYACRE

SEQ ID NO: 129056 - protein, 9 aa, Homo Sapiens
DSHLVRSIL

SEQ ID NO: 129057 - protein, 9 aa, Homo Sapiens
WKTAVHLEW

SEQ ID NO: 129058 - protein, 9 aa, Homo Sapiens
TGVRLYLSP

SEQ ID NO: 129059 - protein, 9 aa, Homo Sapiens
SHAGIYLYG

SEQ ID NO: 129060 - protein, 9 aa, Homo Sapiens
ESSTVSNGA

SEQ ID NO: 129061 - protein, 9 aa, Homo Sapiens
SEFKSIKKH

SEQ ID NO: 129062 - protein, 9 aa, Homo Sapiens
VMAVDLNPW

SEQ ID NO: 129063 - protein, 9 aa, Homo Sapiens
LFYTSRVLC

SEQ ID NO: 129064 - protein, 9 aa, Homo Sapiens
REALWQRCA

SEQ ID NO: 129065 - protein, 9 aa, Homo Sapiens
RATPRRSSF

SEQ ID NO: 129066 - protein, 9 aa, Homo Sapiens
MNLAYNSSL

SEQ ID NO: 129067 - protein, 9 aa, Homo Sapiens
FPDHREGHL

SEQ ID NO: 129068 - protein, 9 aa, Homo Sapiens
REVMDEDTR

SEQ ID NO: 129069 - protein, 9 aa, Homo Sapiens
IHDVIGTPT

SEQ ID NO: 129070 - protein, 9 aa, Homo Sapiens
GLRPGPSGR

SEQ ID NO: 129071 - protein, 9 aa, Homo Sapiens
HTHTHTHTL

SEQ ID NO: 129072 - protein, 9 aa, Homo Sapiens
TTTTGATPG

SEQ ID NO: 129073 - protein, 9 aa, Homo Sapiens
IRDITYYKA

SEQ ID NO: 129074 - protein, 9 aa, Homo Sapiens
CSRLQEPLE

SEQ ID NO: 129075 - protein, 9 aa, Homo Sapiens
GLKGGCRPG

SEQ ID NO: 129076 - protein, 9 aa, Homo Sapiens
NPERLNFSA

SEQ ID NO: 129077 - protein, 9 aa, Homo Sapiens
PTALAAAAQ

SEQ ID NO: 129078 - protein, 9 aa, Homo Sapiens
LVRGGSFIT

SEQ ID NO: 129079 - protein, 9 aa, Homo Sapiens
FNQTGACKF

SEQ ID NO: 129080 - protein, 9 aa, Homo Sapiens
RICGFLVIE

SEQ ID NO: 129081 - protein, 9 aa, Homo Sapiens
EVCHQIFEG

SEQ ID NO: 129082 - protein, 9 aa, Homo Sapiens
GQGTRGIGE

SEQ ID NO: 129083 - protein, 9 aa, Homo Sapiens
LTLYDSINA

SEQ ID NO: 129084 - protein, 9 aa, Homo Sapiens
DDDNSPFFI

SEQ ID NO: 129085 - protein, 9 aa, Homo Sapiens
AHEFGHTLG

SEQ ID NO: 129086 - protein, 9 aa, Homo Sapiens
NETFVLLGT

SEQ ID NO: 129087 - protein, 9 aa, Homo Sapiens
WKEHLTRLK

SEQ ID NO: 129088 - protein, 9 aa, Homo Sapiens
RRSKIEASP

SEQ ID NO: 129089 - protein, 9 aa, Homo Sapiens
AFRPPSKTT

SEQ ID NO: 129090 - protein, 9 aa, Homo Sapiens
TLYVSTTKH

SEQ ID NO: 129091 - protein, 9 aa, Homo Sapiens
ACNIPTNVS

SEQ ID NO: 129092 - protein, 9 aa, Homo Sapiens
HFVQNCISL

SEQ ID NO: 129093 - protein, 9 aa, Homo Sapiens
FFDTLYDED

SEQ ID NO: 129094 - protein, 9 aa, Homo Sapiens
GLALSLALE

SEQ ID NO: 129095 - protein, 9 aa, Homo Sapiens
SMGLQECHS

SEQ ID NO: 129096 - protein, 9 aa, Homo Sapiens
NEESVDRNE

SEQ ID NO: 129097 - protein, 9 aa, Homo Sapiens
QSFYTNPLP

SEQ ID NO: 129098 - protein, 9 aa, Homo Sapiens
LQLWWCGGR

SEQ ID NO: 129099 - protein, 9 aa, Homo Sapiens
VVHGAIFLA

SEQ ID NO: 129100 - protein, 9 aa, Homo Sapiens
SVAAPANKH

SEQ ID NO: 129101 - protein, 9 aa, Homo Sapiens
EMLRMYPPA

SEQ ID NO: 129102 - protein, 9 aa, Homo Sapiens
QTWKIRTCL

SEQ ID NO: 129103 - protein, 9 aa, Homo Sapiens
KVPLAVWTQ

SEQ ID NO: 129104 - protein, 9 aa, Homo Sapiens
ALSPPWALA

SEQ ID NO: 129105 - protein, 9 aa, Homo Sapiens
TSSGLGSYL

SEQ ID NO: 129106 - protein, 9 aa, Homo Sapiens
MENSHLKHI

SEQ ID NO: 129107 - protein, 9 aa, Homo Sapiens
ELPASPANH

SEQ ID NO: 129108 - protein, 9 aa, Homo Sapiens
GKPGKDGEM

SEQ ID NO: 129109 - protein, 9 aa, Homo Sapiens
YGSPATWLQ

SEQ ID NO: 129110 - protein, 9 aa, Homo Sapiens
NTTKLTVLE

SEQ ID NO: 129111 - protein, 9 aa, Homo Sapiens
EALGLVSTR

SEQ ID NO: 129112 - protein, 9 aa, Homo Sapiens
QSMYQPQTK

SEQ ID NO: 129113 - protein, 9 aa, Homo Sapiens
VRVISEAGA

SEQ ID NO: 129114 - protein, 9 aa, Homo Sapiens
RRNEDGSGE

SEQ ID NO: 129115 - protein, 9 aa, Homo Sapiens
HGRDREIKV

SEQ ID NO: 129116 - protein, 9 aa, Homo Sapiens
VVVKNGRRY

SEQ ID NO: 129117 - protein, 9 aa, Homo Sapiens
TVVKGVASD

SEQ ID NO: 129118 - protein, 9 aa, Homo Sapiens
SQPLLNIKE

SEQ ID NO: 129119 - protein, 9 aa, Homo Sapiens
SHLSHSSGY

SEQ ID NO: 129120 - protein, 9 aa, Homo Sapiens
KDSGYFRLQ

SEQ ID NO: 129121 - protein, 9 aa, Homo Sapiens
RENCGYKLC

SEQ ID NO: 129122 - protein, 9 aa, Homo Sapiens
KFSPKRSRK

SEQ ID NO: 129123 - protein, 9 aa, Homo Sapiens
KLFPESRVT

SEQ ID NO: 129124 - protein, 9 aa, Homo Sapiens
RPKPGEPAF

SEQ ID NO: 129125 - protein, 9 aa, Homo Sapiens
QKEDLGRSH

SEQ ID NO: 129126 - protein, 9 aa, Homo Sapiens
VFRKHQIIH

SEQ ID NO: 129127 - protein, 9 aa, Homo Sapiens
QLPGNRLAA

SEQ ID NO: 129128 - protein, 9 aa, Homo Sapiens
AGAPPGARC

SEQ ID NO: 129129 - protein, 9 aa, Homo Sapiens
QVRKPFLRD

SEQ ID NO: 129130 - protein, 9 aa, Homo Sapiens
LDLAPALAA

SEQ ID NO: 129131 - protein, 9 aa, Homo Sapiens
QALREMKDY

SEQ ID NO: 129132 - protein, 9 aa, Homo Sapiens
LMHKLMASD

SEQ ID NO: 129133 - protein, 9 aa, Homo Sapiens
WNTEAGVSL

SEQ ID NO: 129134 - protein, 9 aa, Homo Sapiens
VPVPTHCPQ

SEQ ID NO: 129135 - protein, 9 aa, Homo Sapiens
QYHKWLLEL

SEQ ID NO: 129136 - protein, 9 aa, Homo Sapiens
STSSVTASC

SEQ ID NO: 129137 - protein, 9 aa, Homo Sapiens
SIPPGTRPR

SEQ ID NO: 129138 - protein, 9 aa, Homo Sapiens
TVSKNGDGL

SEQ ID NO: 129139 - protein, 9 aa, Homo Sapiens
EEFKEKCHI

SEQ ID NO: 129140 - protein, 9 aa, Homo Sapiens
RFLDLTDTI

SEQ ID NO: 129141 - protein, 9 aa, Homo Sapiens
SPRETSSWS

SEQ ID NO: 129142 - protein, 9 aa, Homo Sapiens
REELETLFL

SEQ ID NO: 129143 - protein, 9 aa, Homo Sapiens
VSTTKHVFE

SEQ ID NO: 129144 - protein, 9 aa, Homo Sapiens
DLRPGGTAD

SEQ ID NO: 129145 - protein, 9 aa, Homo Sapiens
HLVGKEVAA

SEQ ID NO: 129146 - protein, 9 aa, Homo Sapiens
GSGTETPSA

SEQ ID NO: 129147 - protein, 9 aa, Homo Sapiens
GPLFSGRQP

SEQ ID NO: 129148 - protein, 9 aa, Homo Sapiens
MSSMACGSA

SEQ ID NO: 129149 - protein, 9 aa, Homo Sapiens
PGYYSWRNP

SEQ ID NO: 129150 - protein, 9 aa, Homo Sapiens
LFYVLTKMM

SEQ ID NO: 129151 - protein, 9 aa, Homo Sapiens
MFFDTLYDE

SEQ ID NO: 129152 - protein, 9 aa, Homo Sapiens
SHLGIWGEG

SEQ ID NO: 129153 - protein, 9 aa, Homo Sapiens
DAEELPPCF

SEQ ID NO: 129154 - protein, 9 aa, Homo Sapiens
HNGHITGVD

SEQ ID NO: 129155 - protein, 9 aa, Homo Sapiens
TMWLSNTSL

SEQ ID NO: 129156 - protein, 9 aa, Homo Sapiens
ELRACGLGN

SEQ ID NO: 129157 - protein, 9 aa, Homo Sapiens
HIAALASTI

SEQ ID NO: 129158 - protein, 9 aa, Homo Sapiens
YIADETPVC

SEQ ID NO: 129159 - protein, 9 aa, Homo Sapiens
FRVEFVDGV

SEQ ID NO: 129160 - protein, 9 aa, Homo Sapiens
AAPQRCGWW

SEQ ID NO: 129161 - protein, 9 aa, Homo Sapiens
GSKQLPAPL

SEQ ID NO: 129162 - protein, 9 aa, Homo Sapiens
GHVDAAPET

SEQ ID NO: 129163 - protein, 9 aa, Homo Sapiens
DAFACACGL

SEQ ID NO: 129164 - protein, 9 aa, Homo Sapiens
SHGVMSSRD

SEQ ID NO: 129165 - protein, 9 aa, Homo Sapiens
LRLRSMCGA

SEQ ID NO: 129166 - protein, 9 aa, Homo Sapiens
KKHLRNLRG

SEQ ID NO: 129167 - protein, 9 aa, Homo Sapiens
YPVGSGPPH

SEQ ID NO: 129168 - protein, 9 aa, Homo Sapiens
MPWENQEVE

SEQ ID NO: 129169 - protein, 9 aa, Homo Sapiens
KHNFTMAMN

SEQ ID NO: 129170 - protein, 9 aa, Homo Sapiens
NHTVLIAIG

SEQ ID NO: 129171 - protein, 9 aa, Homo Sapiens
LKNYLSPSF

SEQ ID NO: 129172 - protein, 9 aa, Homo Sapiens
AICKHLLYP

SEQ ID NO: 129173 - protein, 9 aa, Homo Sapiens
VPLLPRLGV

SEQ ID NO: 129174 - protein, 9 aa, Homo Sapiens
ARTPSSPPS

SEQ ID NO: 129175 - protein, 9 aa, Homo Sapiens
SSNNPRDEI

SEQ ID NO: 129176 - protein, 9 aa, Homo Sapiens
DISNSSNWK

SEQ ID NO: 129177 - protein, 9 aa, Homo Sapiens
LVIQHFCNC

SEQ ID NO: 129178 - protein, 9 aa, Homo Sapiens
CYGSVKCTH

SEQ ID NO: 129179 - protein, 9 aa, Homo Sapiens
RDGRASHVD

SEQ ID NO: 129180 - protein, 9 aa, Homo Sapiens
IDLSVGGQL

SEQ ID NO: 129181 - protein, 9 aa, Homo Sapiens
LQRRMLKVT

SEQ ID NO: 129182 - protein, 9 aa, Homo Sapiens
RTNGSKQLP

SEQ ID NO: 129183 - protein, 9 aa, Homo Sapiens
ASTPGRGRQ

SEQ ID NO: 129184 - protein, 9 aa, Homo Sapiens
TAASGISSI

SEQ ID NO: 129185 - protein, 9 aa, Homo Sapiens
DQTDKNPCL

SEQ ID NO: 129186 - protein, 9 aa, Homo Sapiens
LHPWWREHL

SEQ ID NO: 129187 - protein, 9 aa, Homo Sapiens
GNDNYCLQI

SEQ ID NO: 129188 - protein, 9 aa, Homo Sapiens
PHPTPTSDT

SEQ ID NO: 129189 - protein, 9 aa, Homo Sapiens
VIFLGAPHP

SEQ ID NO: 129190 - protein, 9 aa, Homo Sapiens
NTRLNMGIL

SEQ ID NO: 129191 - protein, 9 aa, Homo Sapiens
HRYVYVCIA

SEQ ID NO: 129192 - protein, 9 aa, Homo Sapiens
EEERLHPPS

SEQ ID NO: 129193 - protein, 9 aa, Homo Sapiens
NSVEIIEGE

SEQ ID NO: 129194 - protein, 9 aa, Homo Sapiens
LPNDISSEA

SEQ ID NO: 129195 - protein, 9 aa, Homo Sapiens
LEQVCSVLK

SEQ ID NO: 129196 - protein, 9 aa, Homo Sapiens
NISMLEKIY

SEQ ID NO: 129197 - protein, 9 aa, Homo Sapiens
EATPLGCIQ

SEQ ID NO: 129198 - protein, 9 aa, Homo Sapiens
QHPWHPAVV

SEQ ID NO: 129199 - protein, 9 aa, Homo Sapiens
NPYAQVQRP

SEQ ID NO: 129200 - protein, 9 aa, Homo Sapiens
SKSSASSSS

SEQ ID NO: 129201 - protein, 9 aa, Homo Sapiens
VIQHFCNCD

SEQ ID NO: 129202 - protein, 9 aa, Homo Sapiens
PPLISYIEV

SEQ ID NO: 129203 - protein, 9 aa, Homo Sapiens
GVGSGLQGC

SEQ ID NO: 129204 - protein, 9 aa, Homo Sapiens
KCHICVPCG

SEQ ID NO: 129205 - protein, 9 aa, Homo Sapiens
RHYAFQTEG

SEQ ID NO: 129206 - protein, 9 aa, Homo Sapiens
CGDTRIMYP

SEQ ID NO: 129207 - protein, 9 aa, Homo Sapiens
ISSVEEGYH

SEQ ID NO: 129208 - protein, 9 aa, Homo Sapiens
VWRKRHLES

SEQ ID NO: 129209 - protein, 9 aa, Homo Sapiens
PYAFNMKAT

SEQ ID NO: 129210 - protein, 9 aa, Homo Sapiens
VWPDPPCPL

SEQ ID NO: 129211 - protein, 9 aa, Homo Sapiens
NQKEQTALY

SEQ ID NO: 129212 - protein, 9 aa, Homo Sapiens
GLVLWSGAF

SEQ ID NO: 129213 - protein, 9 aa, Homo Sapiens
SSLILTVWY

SEQ ID NO: 129214 - protein, 9 aa, Homo Sapiens
EHLTKFNVW

SEQ ID NO: 129215 - protein, 9 aa, Homo Sapiens
DGEVSWDKS

SEQ ID NO: 129216 - protein, 9 aa, Homo Sapiens
MNCTLNLPF

SEQ ID NO: 129217 - protein, 9 aa, Homo Sapiens
FYFRFTSHG

SEQ ID NO: 129218 - protein, 9 aa, Homo Sapiens
GNKATKRDL

SEQ ID NO: 129219 - protein, 9 aa, Homo Sapiens
AFKMLKFLL

SEQ ID NO: 129220 - protein, 9 aa, Homo Sapiens
PHPRDPPAR

SEQ ID NO: 129221 - protein, 9 aa, Homo Sapiens
NIFFYDPGV

SEQ ID NO: 129222 - protein, 9 aa, Homo Sapiens
IRMLQCDVP

SEQ ID NO: 129223 - protein, 9 aa, Homo Sapiens
VINRNLLNP

SEQ ID NO: 129224 - protein, 9 aa, Homo Sapiens
VDRNEEGLD

SEQ ID NO: 129225 - protein, 9 aa, Homo Sapiens
FAPTCIEQI

SEQ ID NO: 129226 - protein, 9 aa, Homo Sapiens
PDSNTWHTL

SEQ ID NO: 129227 - protein, 9 aa, Homo Sapiens
RRNRSSSNT

SEQ ID NO: 129228 - protein, 9 aa, Homo Sapiens
NSVKENLPI

SEQ ID NO: 129229 - protein, 9 aa, Homo Sapiens
AQCLRWLCD

SEQ ID NO: 129230 - protein, 9 aa, Homo Sapiens
YDYFKDTGG

SEQ ID NO: 129231 - protein, 9 aa, Homo Sapiens
LLAHPCPLP

SEQ ID NO: 129232 - protein, 9 aa, Homo Sapiens
TSDHHCQSP

SEQ ID NO: 129233 - protein, 9 aa, Homo Sapiens
CEYFILRNT

SEQ ID NO: 129234 - protein, 9 aa, Homo Sapiens
FGSLYFIHL

SEQ ID NO: 129235 - protein, 9 aa, Homo Sapiens
HPSASPPSR

SEQ ID NO: 129236 - protein, 9 aa, Homo Sapiens
GKSHLVIVQ

SEQ ID NO: 129237 - protein, 9 aa, Homo Sapiens
IPVYNDITH

SEQ ID NO: 129238 - protein, 9 aa, Homo Sapiens
CSNYPAIIL

SEQ ID NO: 129239 - protein, 9 aa, Homo Sapiens
DSDTYLHRA

SEQ ID NO: 129240 - protein, 9 aa, Homo Sapiens
RVKAIDFGS

SEQ ID NO: 129241 - protein, 9 aa, Homo Sapiens
KRQGLYLTV

SEQ ID NO: 129242 - protein, 9 aa, Homo Sapiens
SCSCSSKSS

SEQ ID NO: 129243 - protein, 9 aa, Homo Sapiens
GAQECRLVG

SEQ ID NO: 129244 - protein, 9 aa, Homo Sapiens
WVLPVAKLA

SEQ ID NO: 129245 - protein, 9 aa, Homo Sapiens
KCNAEEHVC

SEQ ID NO: 129246 - protein, 9 aa, Homo Sapiens
LIRPQPKFR

SEQ ID NO: 129247 - protein, 9 aa, Homo Sapiens
ILGITLRQC

SEQ ID NO: 129248 - protein, 9 aa, Homo Sapiens
LPPTQTSVR

SEQ ID NO: 129249 - protein, 9 aa, Homo Sapiens
LGEEETDLK

SEQ ID NO: 129250 - protein, 9 aa, Homo Sapiens
HSLPHTSLV

SEQ ID NO: 129251 - protein, 9 aa, Homo Sapiens
KPSTTIHAS

SEQ ID NO: 129252 - protein, 9 aa, Homo Sapiens
HICVPCGLR

SEQ ID NO: 129253 - protein, 9 aa, Homo Sapiens
SEEQAETKR

SEQ ID NO: 129254 - protein, 9 aa, Homo Sapiens
PCTDTESAS

SEQ ID NO: 129255 - protein, 9 aa, Homo Sapiens
LVQHLFRVA

SEQ ID NO: 129256 - protein, 9 aa, Homo Sapiens
SVYSSSKGT

SEQ ID NO: 129257 - protein, 9 aa, Homo Sapiens
VAKDSHGVM

SEQ ID NO: 129258 - protein, 9 aa, Homo Sapiens
MEEERLHPP

SEQ ID NO: 129259 - protein, 9 aa, Homo Sapiens
PTPPLPTAR

SEQ ID NO: 129260 - protein, 9 aa, Homo Sapiens
SGAVATSAV

SEQ ID NO: 129261 - protein, 9 aa, Homo Sapiens
TSKVSSTST

SEQ ID NO: 129262 - protein, 9 aa, Homo Sapiens
TGFPAWEVY

SEQ ID NO: 129263 - protein, 9 aa, Homo Sapiens
QHQNRNPGI

SEQ ID NO: 129264 - protein, 9 aa, Homo Sapiens
VVEKVRRQI

SEQ ID NO: 129265 - protein, 9 aa, Homo Sapiens
RNPGIQSNG

SEQ ID NO: 129266 - protein, 9 aa, Homo Sapiens
VDKEASTHI

SEQ ID NO: 129267 - protein, 9 aa, Homo Sapiens
VKDDSSENS

SEQ ID NO: 129268 - protein, 9 aa, Homo Sapiens
FPSVVVTGR

SEQ ID NO: 129269 - protein, 9 aa, Homo Sapiens
KPPSDGHAQ

SEQ ID NO: 129270 - protein, 9 aa, Homo Sapiens
PREPTKMWH

SEQ ID NO: 129271 - protein, 9 aa, Homo Sapiens
EIRHSAEAQ

SEQ ID NO: 129272 - protein, 9 aa, Homo Sapiens
SPALRARGG

SEQ ID NO: 129273 - protein, 9 aa, Homo Sapiens
FHRSPRIRK

SEQ ID NO: 129274 - protein, 9 aa, Homo Sapiens
TSIVPKLQV

SEQ ID NO: 129275 - protein, 9 aa, Homo Sapiens
LPKMPYEPS

SEQ ID NO: 129276 - protein, 9 aa, Homo Sapiens
KENTLVQMA

SEQ ID NO: 129277 - protein, 9 aa, Homo Sapiens
RLQKPHAFI

SEQ ID NO: 129278 - protein, 9 aa, Homo Sapiens
SVTASCAST

SEQ ID NO: 129279 - protein, 9 aa, Homo Sapiens
PPIPHRHPP

SEQ ID NO: 129280 - protein, 9 aa, Homo Sapiens
SRLKASCQR

SEQ ID NO: 129281 - protein, 9 aa, Homo Sapiens
SVRDKYSDD

SEQ ID NO: 129282 - protein, 9 aa, Homo Sapiens
VVIQQPPSP

SEQ ID NO: 129283 - protein, 9 aa, Homo Sapiens
RGEAEWHKL

SEQ ID NO: 129284 - protein, 9 aa, Homo Sapiens
QACSPSACR

SEQ ID NO: 129285 - protein, 9 aa, Homo Sapiens
PLFYIIDIL

SEQ ID NO: 129286 - protein, 9 aa, Homo Sapiens
SRVEKMMTT

SEQ ID NO: 129287 - protein, 9 aa, Homo Sapiens
LAAVEYVEL

SEQ ID NO: 129288 - protein, 9 aa, Homo Sapiens
QRPSTRPSR

SEQ ID NO: 129289 - protein, 9 aa, Homo Sapiens
LNDGKSYTR

SEQ ID NO: 129290 - protein, 9 aa, Homo Sapiens
QQNCAMKFG

SEQ ID NO: 129291 - protein, 9 aa, Homo Sapiens
GDTRIMYPV

SEQ ID NO: 129292 - protein, 9 aa, Homo Sapiens
ERVVKDDSS

SEQ ID NO: 129293 - protein, 9 aa, Homo Sapiens
LKRRKRLWP

SEQ ID NO: 129294 - protein, 9 aa, Homo Sapiens
HAITSLHFP

SEQ ID NO: 129295 - protein, 9 aa, Homo Sapiens
SMIPIARSL

SEQ ID NO: 129296 - protein, 9 aa, Homo Sapiens
HLIGQVAAI

SEQ ID NO: 129297 - protein, 9 aa, Homo Sapiens
SVSFSQITS

SEQ ID NO: 129298 - protein, 9 aa, Homo Sapiens
LMHKFIAYQ

SEQ ID NO: 129299 - protein, 9 aa, Homo Sapiens
VPDEVLGLF

SEQ ID NO: 129300 - protein, 9 aa, Homo Sapiens
AALLRLPWL

SEQ ID NO: 129301 - protein, 9 aa, Homo Sapiens
LMPRLDTGC

SEQ ID NO: 129302 - protein, 9 aa, Homo Sapiens
EIMQLISIA

SEQ ID NO: 129303 - protein, 9 aa, Homo Sapiens
HGTGVYTGS

SEQ ID NO: 129304 - protein, 9 aa, Homo Sapiens
KMVSNQKIK

SEQ ID NO: 129305 - protein, 9 aa, Homo Sapiens
RSRSWRKQH

SEQ ID NO: 129306 - protein, 9 aa, Homo Sapiens
SCNTSVYSS

SEQ ID NO: 129307 - protein, 9 aa, Homo Sapiens
NELQHLKKE

SEQ ID NO: 129308 - protein, 9 aa, Homo Sapiens
QADERYGKE

SEQ ID NO: 129309 - protein, 9 aa, Homo Sapiens
GTTYRVCML

SEQ ID NO: 129310 - protein, 9 aa, Homo Sapiens
VHLAQHQRV

SEQ ID NO: 129311 - protein, 9 aa, Homo Sapiens
EDAEMVGQV

SEQ ID NO: 129312 - protein, 9 aa, Homo Sapiens
YDCPCRWLQ

SEQ ID NO: 129313 - protein, 9 aa, Homo Sapiens
TDRNLSHDE

SEQ ID NO: 129314 - protein, 9 aa, Homo Sapiens
AMAQDLTSR

SEQ ID NO: 129315 - protein, 9 aa, Homo Sapiens
RIQTSLNIK

SEQ ID NO: 129316 - protein, 9 aa, Homo Sapiens
LEGESELVV

SEQ ID NO: 129317 - protein, 9 aa, Homo Sapiens
SHLLEVLED

SEQ ID NO: 129318 - protein, 9 aa, Homo Sapiens
SITPVQSST

SEQ ID NO: 129319 - protein, 9 aa, Homo Sapiens
ETTFAFHLR

SEQ ID NO: 129320 - protein, 9 aa, Homo Sapiens
KKVYALKVE

SEQ ID NO: 129321 - protein, 9 aa, Homo Sapiens
QSHHGSRSQ

SEQ ID NO: 129322 - protein, 9 aa, Homo Sapiens
ARELQEKME

SEQ ID NO: 129323 - protein, 9 aa, Homo Sapiens
RQIRTKAMD

SEQ ID NO: 129324 - protein, 9 aa, Homo Sapiens
LKMMTRNFP

SEQ ID NO: 129325 - protein, 9 aa, Homo Sapiens
DVILEDGAA

SEQ ID NO: 129326 - protein, 9 aa, Homo Sapiens
IKAKTGPLP

SEQ ID NO: 129327 - protein, 9 aa, Homo Sapiens
CFGMLLCCS

SEQ ID NO: 129328 - protein, 9 aa, Homo Sapiens
SQADDLSNS

SEQ ID NO: 129329 - protein, 9 aa, Homo Sapiens
CQVPGGNQE

SEQ ID NO: 129330 - protein, 9 aa, Homo Sapiens
ATLTSTSCS

SEQ ID NO: 129331 - protein, 9 aa, Homo Sapiens
VAEVGDRKG

SEQ ID NO: 129332 - protein, 9 aa, Homo Sapiens
SQQCANSPR

SEQ ID NO: 129333 - protein, 9 aa, Homo Sapiens
GLLLAVSSV

SEQ ID NO: 129334 - protein, 9 aa, Homo Sapiens
QPREPTKMW

SEQ ID NO: 129335 - protein, 9 aa, Homo Sapiens
LESGGSKKC

SEQ ID NO: 129336 - protein, 9 aa, Homo Sapiens
RITEDEEAT

SEQ ID NO: 129337 - protein, 9 aa, Homo Sapiens
KVNQWCEAG

SEQ ID NO: 129338 - protein, 9 aa, Homo Sapiens
MEEVPDEVL

SEQ ID NO: 129339 - protein, 9 aa, Homo Sapiens
CPSTAMYNN

SEQ ID NO: 129340 - protein, 9 aa, Homo Sapiens
TGFYVGWAE

SEQ ID NO: 129341 - protein, 9 aa, Homo Sapiens
LTLAFLACI

SEQ ID NO: 129342 - protein, 9 aa, Homo Sapiens
ISPNMSKRT

SEQ ID NO: 129343 - protein, 9 aa, Homo Sapiens
PAAPAAMRA

SEQ ID NO: 129344 - protein, 9 aa, Homo Sapiens
TDSACSSTP

SEQ ID NO: 129345 - protein, 9 aa, Homo Sapiens
ELLQIQALL

SEQ ID NO: 129346 - protein, 9 aa, Homo Sapiens
LPYTCLTTE

SEQ ID NO: 129347 - protein, 9 aa, Homo Sapiens
LVNMGGNRS

SEQ ID NO: 129348 - protein, 9 aa, Homo Sapiens
SPRHGNHRE

SEQ ID NO: 129349 - protein, 9 aa, Homo Sapiens
YRSVIENVI

SEQ ID NO: 129350 - protein, 9 aa, Homo Sapiens
MEEWVLVLP

SEQ ID NO: 129351 - protein, 9 aa, Homo Sapiens
TILKDSGYF

SEQ ID NO: 129352 - protein, 9 aa, Homo Sapiens
DLSTRVVDH

SEQ ID NO: 129353 - protein, 9 aa, Homo Sapiens
SSSLPKAIM

SEQ ID NO: 129354 - protein, 9 aa, Homo Sapiens
ESFLYNREK

SEQ ID NO: 129355 - protein, 9 aa, Homo Sapiens
TEVSHLKRG

SEQ ID NO: 129356 - protein, 9 aa, Homo Sapiens
ELGKQYWPI

SEQ ID NO: 129357 - protein, 9 aa, Homo Sapiens
PHGQGGQPA

SEQ ID NO: 129358 - protein, 9 aa, Homo Sapiens
GTTIGEVTS

SEQ ID NO: 129359 - protein, 9 aa, Homo Sapiens
RPAARSGSA

SEQ ID NO: 129360 - protein, 9 aa, Homo Sapiens
MPRLDTGCS

SEQ ID NO: 129361 - protein, 9 aa, Homo Sapiens
LPGAERTAA

SEQ ID NO: 129362 - protein, 9 aa, Homo Sapiens
EIDRERAAQ

SEQ ID NO: 129363 - protein, 9 aa, Homo Sapiens
FDDDNSPFF

SEQ ID NO: 129364 - protein, 9 aa, Homo Sapiens
ECEAHARQV

SEQ ID NO: 129365 - protein, 9 aa, Homo Sapiens
QTTSDRKTE

SEQ ID NO: 129366 - protein, 9 aa, Homo Sapiens
THKFNQEMD

SEQ ID NO: 129367 - protein, 9 aa, Homo Sapiens
VVDTDKLRV

SEQ ID NO: 129368 - protein, 9 aa, Homo Sapiens
GSPLMSEFR

SEQ ID NO: 129369 - protein, 9 aa, Homo Sapiens
LGRSGSFKA

SEQ ID NO: 129370 - protein, 9 aa, Homo Sapiens
SGYNTWLSY

SEQ ID NO: 129371 - protein, 9 aa, Homo Sapiens
IQFIAHERL

SEQ ID NO: 129372 - protein, 9 aa, Homo Sapiens
ADRERSIHN

SEQ ID NO: 129373 - protein, 9 aa, Homo Sapiens
ETVSKNGDG

SEQ ID NO: 129374 - protein, 9 aa, Homo Sapiens
FTEGHRPKE

SEQ ID NO: 129375 - protein, 9 aa, Homo Sapiens
CCMTTCCRP

SEQ ID NO: 129376 - protein, 9 aa, Homo Sapiens
PTEPSTPKS

SEQ ID NO: 129377 - protein, 9 aa, Homo Sapiens
APRDGRASH

SEQ ID NO: 129378 - protein, 9 aa, Homo Sapiens
SQLSCLFLK

SEQ ID NO: 129379 - protein, 9 aa, Homo Sapiens
TAAHSSTLA

SEQ ID NO: 129380 - protein, 9 aa, Homo Sapiens
AVWMSFAQT

SEQ ID NO: 129381 - protein, 9 aa, Homo Sapiens
GHLARALRP

SEQ ID NO: 129382 - protein, 9 aa, Homo Sapiens
CPQTRRSPC

SEQ ID NO: 129383 - protein, 9 aa, Homo Sapiens
SPKLQTQVK

SEQ ID NO: 129384 - protein, 9 aa, Homo Sapiens
DEDDDEKRW

SEQ ID NO: 129385 - protein, 9 aa, Homo Sapiens
VIDFGSANI

SEQ ID NO: 129386 - protein, 9 aa, Homo Sapiens
VLLKRVADL

SEQ ID NO: 129387 - protein, 9 aa, Homo Sapiens
FLLQSQLSC

SEQ ID NO: 129388 - protein, 9 aa, Homo Sapiens
RSSITKPEG

SEQ ID NO: 129389 - protein, 9 aa, Homo Sapiens
IQHGKIARK

SEQ ID NO: 129390 - protein, 9 aa, Homo Sapiens
VGYEKLADP

SEQ ID NO: 129391 - protein, 9 aa, Homo Sapiens
ALQIFNNNF

SEQ ID NO: 129392 - protein, 9 aa, Homo Sapiens
PRFNDHKAN

SEQ ID NO: 129393 - protein, 9 aa, Homo Sapiens
GSNSPIPPH

SEQ ID NO: 129394 - protein, 9 aa, Homo Sapiens
LANIDEAVN

SEQ ID NO: 129395 - protein, 9 aa, Homo Sapiens
FLLATMACD

SEQ ID NO: 129396 - protein, 9 aa, Homo Sapiens
VICHPDSIT

SEQ ID NO: 129397 - protein, 9 aa, Homo Sapiens
TPQGAIQIQ

SEQ ID NO: 129398 - protein, 9 aa, Homo Sapiens
SFSLNIMKK

SEQ ID NO: 129399 - protein, 9 aa, Homo Sapiens
TQAARRPPG

SEQ ID NO: 129400 - protein, 9 aa, Homo Sapiens
SEVLYTSVK

SEQ ID NO: 129401 - protein, 9 aa, Homo Sapiens
TEVANIPVD

SEQ ID NO: 129402 - protein, 9 aa, Homo Sapiens
CPGHVDAAP

SEQ ID NO: 129403 - protein, 9 aa, Homo Sapiens
IVSLLYLNS

SEQ ID NO: 129404 - protein, 9 aa, Homo Sapiens
GKSYTRWLQ

SEQ ID NO: 129405 - protein, 9 aa, Homo Sapiens
SWSDDATCR

SEQ ID NO: 129406 - protein, 9 aa, Homo Sapiens
WVPDAAGTG

SEQ ID NO: 129407 - protein, 9 aa, Homo Sapiens
ITRKGRKKT

SEQ ID NO: 129408 - protein, 9 aa, Homo Sapiens
NRTLWWKKT

SEQ ID NO: 129409 - protein, 9 aa, Homo Sapiens
KLYHHKSSS

SEQ ID NO: 129410 - protein, 9 aa, Homo Sapiens
RHTYPVCYP

SEQ ID NO: 129411 - protein, 9 aa, Homo Sapiens
WVRESHITL

SEQ ID NO: 129412 - protein, 9 aa, Homo Sapiens
RATSNTEEI

SEQ ID NO: 129413 - protein, 9 aa, Homo Sapiens
AAQKCHKKT

SEQ ID NO: 129414 - protein, 9 aa, Homo Sapiens
AWASWPTFL

SEQ ID NO: 129415 - protein, 9 aa, Homo Sapiens
TQRPSTRPS

SEQ ID NO: 129416 - protein, 9 aa, Homo Sapiens
PPSTARSRG

SEQ ID NO: 129417 - protein, 9 aa, Homo Sapiens
VHIDQHKGE

SEQ ID NO: 129418 - protein, 9 aa, Homo Sapiens
STSTSTISA

SEQ ID NO: 129419 - protein, 9 aa, Homo Sapiens
FPQKFHTED

SEQ ID NO: 129420 - protein, 9 aa, Homo Sapiens
QTDYYAALL

SEQ ID NO: 129421 - protein, 9 aa, Homo Sapiens
PALRLLCPP

SEQ ID NO: 129422 - protein, 9 aa, Homo Sapiens
EARSLPNDI

SEQ ID NO: 129423 - protein, 9 aa, Homo Sapiens
KQEKKDKTQ

SEQ ID NO: 129424 - protein, 9 aa, Homo Sapiens
TIRGFPSRS

SEQ ID NO: 129425 - protein, 9 aa, Homo Sapiens
PIPSRMIQK

SEQ ID NO: 129426 - protein, 9 aa, Homo Sapiens
RCRGAPQGP

SEQ ID NO: 129427 - protein, 9 aa, Homo Sapiens
PGNFSCADI

SEQ ID NO: 129428 - protein, 9 aa, Homo Sapiens
HLQPPIAEE

SEQ ID NO: 129429 - protein, 9 aa, Homo Sapiens
QGVYMQLLK

SEQ ID NO: 129430 - protein, 9 aa, Homo Sapiens
KLYQQCILW

SEQ ID NO: 129431 - protein, 9 aa, Homo Sapiens
SEDLKKAKD

SEQ ID NO: 129432 - protein, 9 aa, Homo Sapiens
HLFDNPATA

SEQ ID NO: 129433 - protein, 9 aa, Homo Sapiens
RDQTDKNPC

SEQ ID NO: 129434 - protein, 9 aa, Homo Sapiens
GLETYKQVA

SEQ ID NO: 129435 - protein, 9 aa, Homo Sapiens
RRRSGLHPW

SEQ ID NO: 129436 - protein, 9 aa, Homo Sapiens
VRPGTQAAR

SEQ ID NO: 129437 - protein, 9 aa, Homo Sapiens
RLVLTSNNH

SEQ ID NO: 129438 - protein, 9 aa, Homo Sapiens
KEFFSDWFH

SEQ ID NO: 129439 - protein, 9 aa, Homo Sapiens
QIDMKHMSQ

SEQ ID NO: 129440 - protein, 9 aa, Homo Sapiens
GERLPGLHL

SEQ ID NO: 129441 - protein, 9 aa, Homo Sapiens
SLGEEFFVD

SEQ ID NO: 129442 - protein, 9 aa, Homo Sapiens
EHSVGYVER

SEQ ID NO: 129443 - protein, 9 aa, Homo Sapiens
ARSLPNDIS

SEQ ID NO: 129444 - protein, 9 aa, Homo Sapiens
WRVGNLCKS

SEQ ID NO: 129445 - protein, 9 aa, Homo Sapiens
FVIQLVAKL

SEQ ID NO: 129446 - protein, 9 aa, Homo Sapiens
RRSKASIPT

SEQ ID NO: 129447 - protein, 9 aa, Homo Sapiens
AAPPRSHPP

SEQ ID NO: 129448 - protein, 9 aa, Homo Sapiens
ESCWYFGVS

SEQ ID NO: 129449 - protein, 9 aa, Homo Sapiens
TPSPAMAHR

SEQ ID NO: 129450 - protein, 9 aa, Homo Sapiens
NKHEVDEAA

SEQ ID NO: 129451 - protein, 9 aa, Homo Sapiens
PLEKTMELD

SEQ ID NO: 129452 - protein, 9 aa, Homo Sapiens
TSTTSTTGR

SEQ ID NO: 129453 - protein, 9 aa, Homo Sapiens
CKVVATSPS

SEQ ID NO: 129454 - protein, 9 aa, Homo Sapiens
SASGQAVRP

SEQ ID NO: 129455 - protein, 9 aa, Homo Sapiens
NATIQQAIK

SEQ ID NO: 129456 - protein, 9 aa, Homo Sapiens
LTYHQGVVI

SEQ ID NO: 129457 - protein, 9 aa, Homo Sapiens
GGQRCRCVC

SEQ ID NO: 129458 - protein, 9 aa, Homo Sapiens
LIEKKEYKM

SEQ ID NO: 129459 - protein, 9 aa, Homo Sapiens
IYMSHLGIW

SEQ ID NO: 129460 - protein, 9 aa, Homo Sapiens
HGVPLPTEP

SEQ ID NO: 129461 - protein, 9 aa, Homo Sapiens
VRRREPTPR

SEQ ID NO: 129462 - protein, 9 aa, Homo Sapiens
DEDLLRESE

SEQ ID NO: 129463 - protein, 9 aa, Homo Sapiens
SSVPVSMLQ

SEQ ID NO: 129464 - protein, 9 aa, Homo Sapiens
YELACKQLS

SEQ ID NO: 129465 - protein, 9 aa, Homo Sapiens
RNGENTDAS

SEQ ID NO: 129466 - protein, 9 aa, Homo Sapiens
KYQDLEIKS

SEQ ID NO: 129467 - protein, 9 aa, Homo Sapiens
YDIHILYGY

SEQ ID NO: 129468 - protein, 9 aa, Homo Sapiens
SPNSPQGTL

SEQ ID NO: 129469 - protein, 9 aa, Homo Sapiens
GVMSSRDIE

SEQ ID NO: 129470 - protein, 9 aa, Homo Sapiens
KFMAKHLIY

SEQ ID NO: 129471 - protein, 9 aa, Homo Sapiens
FASRSIMSP

SEQ ID NO: 129472 - protein, 9 aa, Homo Sapiens
SSLLCDTQE

SEQ ID NO: 129473 - protein, 9 aa, Homo Sapiens
CGSRGAPHP

SEQ ID NO: 129474 - protein, 9 aa, Homo Sapiens
SWAGLPSWQ

SEQ ID NO: 129475 - protein, 9 aa, Homo Sapiens
AKDRMGIDS

SEQ ID NO: 129476 - protein, 9 aa, Homo Sapiens
KRVKALAGQ

SEQ ID NO: 129477 - protein, 9 aa, Homo Sapiens
GNPSVKSQP

SEQ ID NO: 129478 - protein, 9 aa, Homo Sapiens
SPSSAIPKL

SEQ ID NO: 129479 - protein, 9 aa, Homo Sapiens
ALCPFQDNF

SEQ ID NO: 129480 - protein, 9 aa, Homo Sapiens
LALSFASLR

SEQ ID NO: 129481 - protein, 9 aa, Homo Sapiens
SLDRHEEVL

SEQ ID NO: 129482 - protein, 9 aa, Homo Sapiens
GSRRQVRSR

SEQ ID NO: 129483 - protein, 9 aa, Homo Sapiens
GFIPPNETL

SEQ ID NO: 129484 - protein, 9 aa, Homo Sapiens
RTSPGDMVN

SEQ ID NO: 129485 - protein, 9 aa, Homo Sapiens
EGLDRCNAG

SEQ ID NO: 129486 - protein, 9 aa, Homo Sapiens
GLQECHSRA

SEQ ID NO: 129487 - protein, 9 aa, Homo Sapiens
TQGRNHMNV

SEQ ID NO: 129488 - protein, 9 aa, Homo Sapiens
TSAQLDDAG

SEQ ID NO: 129489 - protein, 9 aa, Homo Sapiens
QLSTNCPEC

SEQ ID NO: 129490 - protein, 9 aa, Homo Sapiens
PAEQPKSMH

SEQ ID NO: 129491 - protein, 9 aa, Homo Sapiens
GPEKNPSLA

SEQ ID NO: 129492 - protein, 9 aa, Homo Sapiens
KTTNRYVQQ

SEQ ID NO: 129493 - protein, 9 aa, Homo Sapiens
WNAHTQTYP

SEQ ID NO: 129494 - protein, 9 aa, Homo Sapiens
AGLVWTHTG

SEQ ID NO: 129495 - protein, 9 aa, Homo Sapiens
SPWSCSNIM

SEQ ID NO: 129496 - protein, 9 aa, Homo Sapiens
LLAAVEYVE

SEQ ID NO: 129497 - protein, 9 aa, Homo Sapiens
PEGCTYDCP

SEQ ID NO: 129498 - protein, 9 aa, Homo Sapiens
LMKVHQENG

SEQ ID NO: 129499 - protein, 9 aa, Homo Sapiens
GPIPSRMIQ

SEQ ID NO: 129500 - protein, 9 aa, Homo Sapiens
EQGLAPPLC

SEQ ID NO: 129501 - protein, 9 aa, Homo Sapiens
IDAFEEVLH

SEQ ID NO: 129502 - protein, 9 aa, Homo Sapiens
CPWCNAINF

SEQ ID NO: 129503 - protein, 9 aa, Homo Sapiens
HRIGREPGH

SEQ ID NO: 129504 - protein, 9 aa, Homo Sapiens
RQSTLKLHR

SEQ ID NO: 129505 - protein, 9 aa, Homo Sapiens
TPPTPKKIS

SEQ ID NO: 129506 - protein, 9 aa, Homo Sapiens
GACNIPTNV

SEQ ID NO: 129507 - protein, 9 aa, Homo Sapiens
VAICKHLLY

SEQ ID NO: 129508 - protein, 9 aa, Homo Sapiens
PTLTIMDIS

SEQ ID NO: 129509 - protein, 9 aa, Homo Sapiens
LRFALKQED

SEQ ID NO: 129510 - protein, 9 aa, Homo Sapiens
AAAGANATD

SEQ ID NO: 129511 - protein, 9 aa, Homo Sapiens
GWGLTSPAA

SEQ ID NO: 129512 - protein, 9 aa, Homo Sapiens
QCSISQELM

SEQ ID NO: 129513 - protein, 9 aa, Homo Sapiens
LPTRRPPAP

SEQ ID NO: 129514 - protein, 9 aa, Homo Sapiens
VWNASRPPQ

SEQ ID NO: 129515 - protein, 9 aa, Homo Sapiens
HKFIAYQFT

SEQ ID NO: 129516 - protein, 9 aa, Homo Sapiens
QERLPHIVV

SEQ ID NO: 129517 - protein, 9 aa, Homo Sapiens
AHRSRAAGT

SEQ ID NO: 129518 - protein, 9 aa, Homo Sapiens
AHILAEFEM

SEQ ID NO: 129519 - protein, 9 aa, Homo Sapiens
QNETFVLLG

SEQ ID NO: 129520 - protein, 9 aa, Homo Sapiens
SHLAVTPDA

SEQ ID NO: 129521 - protein, 9 aa, Homo Sapiens
LLPLLPREN

SEQ ID NO: 129522 - protein, 9 aa, Homo Sapiens
PTTMGATAV

SEQ ID NO: 129523 - protein, 9 aa, Homo Sapiens
CKDPGLAGR

SEQ ID NO: 129524 - protein, 9 aa, Homo Sapiens
GPCAWTGQG

SEQ ID NO: 129525 - protein, 9 aa, Homo Sapiens
RKPRAKRAC

SEQ ID NO: 129526 - protein, 9 aa, Homo Sapiens
VVDFFGGCS

SEQ ID NO: 129527 - protein, 9 aa, Homo Sapiens
EVEKEMSLQ

SEQ ID NO: 129528 - protein, 9 aa, Homo Sapiens
DPGPWPRPL

SEQ ID NO: 129529 - protein, 9 aa, Homo Sapiens
TAPARSRGA

SEQ ID NO: 129530 - protein, 9 aa, Homo Sapiens
HHQGGGHSS

SEQ ID NO: 129531 - protein, 9 aa, Homo Sapiens
SNSPIPPHA

SEQ ID NO: 129532 - protein, 9 aa, Homo Sapiens
GIVFLGFTS

SEQ ID NO: 129533 - protein, 9 aa, Homo Sapiens
GSGPPHPRD

SEQ ID NO: 129534 - protein, 9 aa, Homo Sapiens
APSRRGLLS

SEQ ID NO: 129535 - protein, 9 aa, Homo Sapiens
KKVARDEDD

SEQ ID NO: 129536 - protein, 9 aa, Homo Sapiens
PALCNNTAE

SEQ ID NO: 129537 - protein, 9 aa, Homo Sapiens
INAIDVNKV

SEQ ID NO: 129538 - protein, 9 aa, Homo Sapiens
YKRDLMTAG

SEQ ID NO: 129539 - protein, 9 aa, Homo Sapiens
FTGAQAGRA

SEQ ID NO: 129540 - protein, 9 aa, Homo Sapiens
VPLPHALHG

SEQ ID NO: 129541 - protein, 9 aa, Homo Sapiens
QCAPSPDRS

SEQ ID NO: 129542 - protein, 9 aa, Homo Sapiens
EVTARATQP

SEQ ID NO: 129543 - protein, 9 aa, Homo Sapiens
TGGKLNKRE

SEQ ID NO: 129544 - protein, 9 aa, Homo Sapiens
NSIPPPYYS

SEQ ID NO: 129545 - protein, 9 aa, Homo Sapiens
ASWPTFLCR

SEQ ID NO: 129546 - protein, 9 aa, Homo Sapiens
VKEELKRFE

SEQ ID NO: 129547 - protein, 9 aa, Homo Sapiens
FFAVYESIC

SEQ ID NO: 129548 - protein, 9 aa, Homo Sapiens
GTRPRDDEL

SEQ ID NO: 129549 - protein, 9 aa, Homo Sapiens
LRDSGSYQD

SEQ ID NO: 129550 - protein, 9 aa, Homo Sapiens
WTGKQKLYS

SEQ ID NO: 129551 - protein, 9 aa, Homo Sapiens
SVLQKMKKR

SEQ ID NO: 129552 - protein, 9 aa, Homo Sapiens
SSPPSPGSS

SEQ ID NO: 129553 - protein, 9 aa, Homo Sapiens
STSAVDFFQ

SEQ ID NO: 129554 - protein, 9 aa, Homo Sapiens
MGLQECHSR

SEQ ID NO: 129555 - protein, 9 aa, Homo Sapiens
APPPTPPLP

SEQ ID NO: 129556 - protein, 9 aa, Homo Sapiens
KSGTHQMRT

SEQ ID NO: 129557 - protein, 9 aa, Homo Sapiens
ALAGAHAAG

SEQ ID NO: 129558 - protein, 9 aa, Homo Sapiens
IRRECWGTW

SEQ ID NO: 129559 - protein, 9 aa, Homo Sapiens
SLLVGVSCV

SEQ ID NO: 129560 - protein, 9 aa, Homo Sapiens
TSVKEELKR

SEQ ID NO: 129561 - protein, 9 aa, Homo Sapiens
SGRHLSHHH

SEQ ID NO: 129562 - protein, 9 aa, Homo Sapiens
ASGRHTTGT

SEQ ID NO: 129563 - protein, 9 aa, Homo Sapiens
WGKQYDIHI

SEQ ID NO: 129564 - protein, 9 aa, Homo Sapiens
HSQAAANVL

SEQ ID NO: 129565 - protein, 9 aa, Homo Sapiens
ESPKKKPKL

SEQ ID NO: 129566 - protein, 9 aa, Homo Sapiens
LWAGASCGQ

SEQ ID NO: 129567 - protein, 9 aa, Homo Sapiens
THKKREGQR

SEQ ID NO: 129568 - protein, 9 aa, Homo Sapiens
RQRWGGTTA

SEQ ID NO: 129569 - protein, 9 aa, Homo Sapiens
SCPFQSPTK

SEQ ID NO: 129570 - protein, 9 aa, Homo Sapiens
PINSVNLDS

SEQ ID NO: 129571 - protein, 9 aa, Homo Sapiens
AVPLPHALH

SEQ ID NO: 129572 - protein, 9 aa, Homo Sapiens
EKELEALSC

SEQ ID NO: 129573 - protein, 9 aa, Homo Sapiens
TELEKATKH

SEQ ID NO: 129574 - protein, 9 aa, Homo Sapiens
MGDTVLVIC

SEQ ID NO: 129575 - protein, 9 aa, Homo Sapiens
DQLRDLSRS

SEQ ID NO: 129576 - protein, 9 aa, Homo Sapiens
ISSKQEYLS

SEQ ID NO: 129577 - protein, 9 aa, Homo Sapiens
AQRISCRLK

SEQ ID NO: 129578 - protein, 9 aa, Homo Sapiens
RKDSQQSKL

SEQ ID NO: 129579 - protein, 9 aa, Homo Sapiens
LQKGNKGEK

SEQ ID NO: 129580 - protein, 9 aa, Homo Sapiens
GRKTTEEAL

SEQ ID NO: 129581 - protein, 9 aa, Homo Sapiens
GAVATSAVA

SEQ ID NO: 129582 - protein, 9 aa, Homo Sapiens
LPQSALGAA

SEQ ID NO: 129583 - protein, 9 aa, Homo Sapiens
ASRVAGTAG

SEQ ID NO: 129584 - protein, 9 aa, Homo Sapiens
SSLPEYNMF

SEQ ID NO: 129585 - protein, 9 aa, Homo Sapiens
ELPPRAAPP

SEQ ID NO: 129586 - protein, 9 aa, Homo Sapiens
EYTQVKNLM

SEQ ID NO: 129587 - protein, 9 aa, Homo Sapiens
LGETALPTR

SEQ ID NO: 129588 - protein, 9 aa, Homo Sapiens
MITRARKGR

SEQ ID NO: 129589 - protein, 9 aa, Homo Sapiens
LSRPTAGGP

SEQ ID NO: 129590 - protein, 9 aa, Homo Sapiens
AAQTRRSYP

SEQ ID NO: 129591 - protein, 9 aa, Homo Sapiens
KDFASFPST

SEQ ID NO: 129592 - protein, 9 aa, Homo Sapiens
LGMNCTLNL

SEQ ID NO: 129593 - protein, 9 aa, Homo Sapiens
GPRPGSPRS

SEQ ID NO: 129594 - protein, 9 aa, Homo Sapiens
CKAVAVLGN

SEQ ID NO: 129595 - protein, 9 aa, Homo Sapiens
PPSAATALH

SEQ ID NO: 129596 - protein, 9 aa, Homo Sapiens
PRARAAATP

SEQ ID NO: 129597 - protein, 9 aa, Homo Sapiens
IPVALLHHQ

SEQ ID NO: 129598 - protein, 9 aa, Homo Sapiens
DLLQPELPL

SEQ ID NO: 129599 - protein, 9 aa, Homo Sapiens
ACSCPRARA

SEQ ID NO: 129600 - protein, 9 aa, Homo Sapiens
HSVPEAEAG

SEQ ID NO: 129601 - protein, 9 aa, Homo Sapiens
AHNVTEKVT

SEQ ID NO: 129602 - protein, 9 aa, Homo Sapiens
AVLYPNVVQ

SEQ ID NO: 129603 - protein, 9 aa, Homo Sapiens
SNLSSMVVT

SEQ ID NO: 129604 - protein, 9 aa, Homo Sapiens
SNLPPTQTS

SEQ ID NO: 129605 - protein, 9 aa, Homo Sapiens
QPFLKIRIQ

SEQ ID NO: 129606 - protein, 9 aa, Homo Sapiens
LKRVKALAG

SEQ ID NO: 129607 - protein, 9 aa, Homo Sapiens
LGAVALVHA

SEQ ID NO: 129608 - protein, 9 aa, Homo Sapiens
AATALHSRV

SEQ ID NO: 129609 - protein, 9 aa, Homo Sapiens
IAALASTIL

SEQ ID NO: 129610 - protein, 9 aa, Homo Sapiens
SFIAVMYRE

SEQ ID NO: 129611 - protein, 9 aa, Homo Sapiens
CANSPRETS

SEQ ID NO: 129612 - protein, 9 aa, Homo Sapiens
TYFVVRNYW

SEQ ID NO: 129613 - protein, 9 aa, Homo Sapiens
GLPYEDKVC

SEQ ID NO: 129614 - protein, 9 aa, Homo Sapiens
NPLLLQQPV

SEQ ID NO: 129615 - protein, 9 aa, Homo Sapiens
AHLTSIIFA

SEQ ID NO: 129616 - protein, 9 aa, Homo Sapiens
YVKELGVCG

SEQ ID NO: 129617 - protein, 9 aa, Homo Sapiens
IHAMGGFDG

SEQ ID NO: 129618 - protein, 9 aa, Homo Sapiens
MGLLRMEAD

SEQ ID NO: 129619 - protein, 9 aa, Homo Sapiens
PALPGPRDA

SEQ ID NO: 129620 - protein, 9 aa, Homo Sapiens
RNLGKMAYL

SEQ ID NO: 129621 - protein, 9 aa, Homo Sapiens
SMSCMNKCW

SEQ ID NO: 129622 - protein, 9 aa, Homo Sapiens
RVFFQAGTL

SEQ ID NO: 129623 - protein, 9 aa, Homo Sapiens
GNGEYARYY

SEQ ID NO: 129624 - protein, 9 aa, Homo Sapiens
KRLNKMVSN

SEQ ID NO: 129625 - protein, 9 aa, Homo Sapiens
FVPSCSGCH

SEQ ID NO: 129626 - protein, 9 aa, Homo Sapiens
CRSYTGAPQ

SEQ ID NO: 129627 - protein, 9 aa, Homo Sapiens
PCVKTWASL

SEQ ID NO: 129628 - protein, 9 aa, Homo Sapiens
LVEQVAEVG

SEQ ID NO: 129629 - protein, 9 aa, Homo Sapiens
PDFLMHKLM

SEQ ID NO: 129630 - protein, 9 aa, Homo Sapiens
KDPVNVTPQ

SEQ ID NO: 129631 - protein, 9 aa, Homo Sapiens
RTSVHVFRK

SEQ ID NO: 129632 - protein, 9 aa, Homo Sapiens
RVPPLMWKL

SEQ ID NO: 129633 - protein, 9 aa, Homo Sapiens
APHPGPLKI

SEQ ID NO: 129634 - protein, 9 aa, Homo Sapiens
SRSRWPGSS

SEQ ID NO: 129635 - protein, 9 aa, Homo Sapiens
LAHTLDAAK

SEQ ID NO: 129636 - protein, 9 aa, Homo Sapiens
ILDVHTGVG

SEQ ID NO: 129637 - protein, 9 aa, Homo Sapiens
HLLEVLEDA

SEQ ID NO: 129638 - protein, 9 aa, Homo Sapiens
ARSMTLPTQ

SEQ ID NO: 129639 - protein, 9 aa, Homo Sapiens
FHGKKVKRE

SEQ ID NO: 129640 - protein, 9 aa, Homo Sapiens
VYYKSMSNL

SEQ ID NO: 129641 - protein, 9 aa, Homo Sapiens
SRDHIWIRF

SEQ ID NO: 129642 - protein, 9 aa, Homo Sapiens
NPPHTIQVS

SEQ ID NO: 129643 - protein, 9 aa, Homo Sapiens
REIVSTAKV

SEQ ID NO: 129644 - protein, 9 aa, Homo Sapiens
VNPEGMVKR

SEQ ID NO: 129645 - protein, 9 aa, Homo Sapiens
TSFSLNIMK

SEQ ID NO: 129646 - protein, 9 aa, Homo Sapiens
RGGTTCPPT

SEQ ID NO: 129647 - protein, 9 aa, Homo Sapiens
RCCRQPPHA

SEQ ID NO: 129648 - protein, 9 aa, Homo Sapiens
FTIRGFPSR

SEQ ID NO: 129649 - protein, 9 aa, Homo Sapiens
VGHDAHLCL

SEQ ID NO: 129650 - protein, 9 aa, Homo Sapiens
AAESLPGLA

SEQ ID NO: 129651 - protein, 9 aa, Homo Sapiens
HTGGKLNKR

SEQ ID NO: 129652 - protein, 9 aa, Homo Sapiens
GSVDFTCTS

SEQ ID NO: 129653 - protein, 9 aa, Homo Sapiens
DALMVTTYT

SEQ ID NO: 129654 - protein, 9 aa, Homo Sapiens
QTPRPMTAE

SEQ ID NO: 129655 - protein, 9 aa, Homo Sapiens
LCPQTRRSP

SEQ ID NO: 129656 - protein, 9 aa, Homo Sapiens
FSVRLFVNR

SEQ ID NO: 129657 - protein, 9 aa, Homo Sapiens
YYAMVCQVH

SEQ ID NO: 129658 - protein, 9 aa, Homo Sapiens
VSPPAGHLG

SEQ ID NO: 129659 - protein, 9 aa, Homo Sapiens
PVQSPEPSV

SEQ ID NO: 129660 - protein, 9 aa, Homo Sapiens
RSLAPTAAG

SEQ ID NO: 129661 - protein, 9 aa, Homo Sapiens
HRMTQNPNY

SEQ ID NO: 129662 - protein, 9 aa, Homo Sapiens
ALSFASLRP

SEQ ID NO: 129663 - protein, 9 aa, Homo Sapiens
SLARRLDFQ

SEQ ID NO: 129664 - protein, 9 aa, Homo Sapiens
KTGPLPPLP

SEQ ID NO: 129665 - protein, 9 aa, Homo Sapiens
QKTRKQKYF

SEQ ID NO: 129666 - protein, 9 aa, Homo Sapiens
TAPSVWNAS

SEQ ID NO: 129667 - protein, 9 aa, Homo Sapiens
GHSLPHTSL

SEQ ID NO: 129668 - protein, 9 aa, Homo Sapiens
AAPGPEGQL

SEQ ID NO: 129669 - protein, 9 aa, Homo Sapiens
YTWLKNGDR

SEQ ID NO: 129670 - protein, 9 aa, Homo Sapiens
LTVSTNNCP

SEQ ID NO: 129671 - protein, 9 aa, Homo Sapiens
WSWRENRPY

SEQ ID NO: 129672 - protein, 9 aa, Homo Sapiens
LAALLVAFI

SEQ ID NO: 129673 - protein, 9 aa, Homo Sapiens
PMPTRRSLA

SEQ ID NO: 129674 - protein, 9 aa, Homo Sapiens
NKKRRRIHG

SEQ ID NO: 129675 - protein, 9 aa, Homo Sapiens
SRLQKPHAF

SEQ ID NO: 129676 - protein, 9 aa, Homo Sapiens
AQEEPGKSE

SEQ ID NO: 129677 - protein, 9 aa, Homo Sapiens
LENSHPNPF

SEQ ID NO: 129678 - protein, 9 aa, Homo Sapiens
VLKTRMEKR

SEQ ID NO: 129679 - protein, 9 aa, Homo Sapiens
YWITVFATD

SEQ ID NO: 129680 - protein, 9 aa, Homo Sapiens
NLKTHPLAT

SEQ ID NO: 129681 - protein, 9 aa, Homo Sapiens
QGVSSAPRP

SEQ ID NO: 129682 - protein, 9 aa, Homo Sapiens
TLAQEDEAR

SEQ ID NO: 129683 - protein, 9 aa, Homo Sapiens
VTTRPPIPH

SEQ ID NO: 129684 - protein, 9 aa, Homo Sapiens
RAVIWLDTS

SEQ ID NO: 129685 - protein, 9 aa, Homo Sapiens
VTGGLAAPM

SEQ ID NO: 129686 - protein, 9 aa, Homo Sapiens
IITGDMESV

SEQ ID NO: 129687 - protein, 9 aa, Homo Sapiens
NLDFSEGHQ

SEQ ID NO: 129688 - protein, 9 aa, Homo Sapiens
LYLLGAAAV

SEQ ID NO: 129689 - protein, 9 aa, Homo Sapiens
FCHHCGQCG

SEQ ID NO: 129690 - protein, 9 aa, Homo Sapiens
HVDAAPETT

SEQ ID NO: 129691 - protein, 9 aa, Homo Sapiens
RVRGGKRRR

SEQ ID NO: 129692 - protein, 9 aa, Homo Sapiens
CDRCKHGWV

SEQ ID NO: 129693 - protein, 9 aa, Homo Sapiens
VGLSHCLGD

SEQ ID NO: 129694 - protein, 9 aa, Homo Sapiens
QHNFSSQIF

SEQ ID NO: 129695 - protein, 9 aa, Homo Sapiens
PPSPTIPCP

SEQ ID NO: 129696 - protein, 9 aa, Homo Sapiens
SLARGSPKA

SEQ ID NO: 129697 - protein, 9 aa, Homo Sapiens
LVPDGDDRP

SEQ ID NO: 129698 - protein, 9 aa, Homo Sapiens
NAMKKIGSK

SEQ ID NO: 129699 - protein, 9 aa, Homo Sapiens
PLLPRENWT

SEQ ID NO: 129700 - protein, 9 aa, Homo Sapiens
VSSAPRPGA

SEQ ID NO: 129701 - protein, 9 aa, Homo Sapiens
VQNILEEIA

SEQ ID NO: 129702 - protein, 9 aa, Homo Sapiens
TTEDQLFFG

SEQ ID NO: 129703 - protein, 9 aa, Homo Sapiens
SLMHKFIAY

SEQ ID NO: 129704 - protein, 9 aa, Homo Sapiens
GRGRGEAGR

SEQ ID NO: 129705 - protein, 9 aa, Homo Sapiens
VNSIELCFQ

SEQ ID NO: 129706 - protein, 9 aa, Homo Sapiens
PPTALAAAA

SEQ ID NO: 129707 - protein, 9 aa, Homo Sapiens
DYVNCSQRS

SEQ ID NO: 129708 - protein, 9 aa, Homo Sapiens
PSGRLRDPV

SEQ ID NO: 129709 - protein, 9 aa, Homo Sapiens
YARYYEGRN

SEQ ID NO: 129710 - protein, 9 aa, Homo Sapiens
TCFVQLTET

SEQ ID NO: 129711 - protein, 9 aa, Homo Sapiens
PPTVPSAPE

SEQ ID NO: 129712 - protein, 9 aa, Homo Sapiens
RPSESCLIC

SEQ ID NO: 129713 - protein, 9 aa, Homo Sapiens
WQPLDTVFR

SEQ ID NO: 129714 - protein, 9 aa, Homo Sapiens
VPLAVWTQL

SEQ ID NO: 129715 - protein, 9 aa, Homo Sapiens
GRWGLKGGC

SEQ ID NO: 129716 - protein, 9 aa, Homo Sapiens
AQKFFVIQL

SEQ ID NO: 129717 - protein, 9 aa, Homo Sapiens
EGMVKRAKK

SEQ ID NO: 129718 - protein, 9 aa, Homo Sapiens
WGKVPRKGL

SEQ ID NO: 129719 - protein, 9 aa, Homo Sapiens
HVCVTKAFS

SEQ ID NO: 129720 - protein, 9 aa, Homo Sapiens
GGMQGPPRP

SEQ ID NO: 129721 - protein, 9 aa, Homo Sapiens
YQFVCQNLH

SEQ ID NO: 129722 - protein, 9 aa, Homo Sapiens
WKKHLMRLH

SEQ ID NO: 129723 - protein, 9 aa, Homo Sapiens
RVKENELQH

SEQ ID NO: 129724 - protein, 9 aa, Homo Sapiens
DGANLTVSN

SEQ ID NO: 129725 - protein, 9 aa, Homo Sapiens
WINVHLQDH

SEQ ID NO: 129726 - protein, 9 aa, Homo Sapiens
FGAQECRLV

SEQ ID NO: 129727 - protein, 9 aa, Homo Sapiens
ETPTLQPTP

SEQ ID NO: 129728 - protein, 9 aa, Homo Sapiens
DSINAIDVN

SEQ ID NO: 129729 - protein, 9 aa, Homo Sapiens
YERNIENIS

SEQ ID NO: 129730 - protein, 9 aa, Homo Sapiens
SARAVAGSG

SEQ ID NO: 129731 - protein, 9 aa, Homo Sapiens
ERRYGISSV

SEQ ID NO: 129732 - protein, 9 aa, Homo Sapiens
AGAPRDGRA

SEQ ID NO: 129733 - protein, 9 aa, Homo Sapiens
VQEEAQLCG

SEQ ID NO: 129734 - protein, 9 aa, Homo Sapiens
VRSDGRSRI

SEQ ID NO: 129735 - protein, 9 aa, Homo Sapiens
SSRPLAHSV

SEQ ID NO: 129736 - protein, 9 aa, Homo Sapiens
TFLCKAFAP

SEQ ID NO: 129737 - protein, 9 aa, Homo Sapiens
LDRHEEVLP

SEQ ID NO: 129738 - protein, 9 aa, Homo Sapiens
MIYMSHLGI

SEQ ID NO: 129739 - protein, 9 aa, Homo Sapiens
MTGSVDFTC

SEQ ID NO: 129740 - protein, 9 aa, Homo Sapiens
VLSASRPES

SEQ ID NO: 129741 - protein, 9 aa, Homo Sapiens
GHNTLSGFS

SEQ ID NO: 129742 - protein, 9 aa, Homo Sapiens
LAKGKKPRQ

SEQ ID NO: 129743 - protein, 9 aa, Homo Sapiens
GGAKARSAW

SEQ ID NO: 129744 - protein, 9 aa, Homo Sapiens
LACPFLVFL

SEQ ID NO: 129745 - protein, 9 aa, Homo Sapiens
RNLLAHPCP

SEQ ID NO: 129746 - protein, 9 aa, Homo Sapiens
MNLSAIQNR

SEQ ID NO: 129747 - protein, 9 aa, Homo Sapiens
HPSWPWTRC

SEQ ID NO: 129748 - protein, 9 aa, Homo Sapiens
LITSMGSLR

SEQ ID NO: 129749 - protein, 9 aa, Homo Sapiens
AMELGLETI

SEQ ID NO: 129750 - protein, 9 aa, Homo Sapiens
HKKREGQRL

SEQ ID NO: 129751 - protein, 9 aa, Homo Sapiens
LALEVADRI

SEQ ID NO: 129752 - protein, 9 aa, Homo Sapiens
PSGRRCRNG

SEQ ID NO: 129753 - protein, 9 aa, Homo Sapiens
LFRRTDGCC

SEQ ID NO: 129754 - protein, 9 aa, Homo Sapiens
TARRGRRAG

SEQ ID NO: 129755 - protein, 9 aa, Homo Sapiens
DTSLRKSFA

SEQ ID NO: 129756 - protein, 9 aa, Homo Sapiens
RHERRHNDV

SEQ ID NO: 129757 - protein, 9 aa, Homo Sapiens
KQKCIKPKE

SEQ ID NO: 129758 - protein, 9 aa, Homo Sapiens
LLPVQSPEP

SEQ ID NO: 129759 - protein, 9 aa, Homo Sapiens
SSRQIRTKA

SEQ ID NO: 129760 - protein, 9 aa, Homo Sapiens
QEDLYCFSY

SEQ ID NO: 129761 - protein, 9 aa, Homo Sapiens
QAPVLVAVP

SEQ ID NO: 129762 - protein, 9 aa, Homo Sapiens
CSISQELML

SEQ ID NO: 129763 - protein, 9 aa, Homo Sapiens
ILKRVKALA

SEQ ID NO: 129764 - protein, 9 aa, Homo Sapiens
AMNKEGGTV

SEQ ID NO: 129765 - protein, 9 aa, Homo Sapiens
CFHPPQPAG

SEQ ID NO: 129766 - protein, 9 aa, Homo Sapiens
SVKEELKRF

SEQ ID NO: 129767 - protein, 9 aa, Homo Sapiens
PNNNSRPST

SEQ ID NO: 129768 - protein, 9 aa, Homo Sapiens
SRATGRRVM

SEQ ID NO: 129769 - protein, 9 aa, Homo Sapiens
PVKEKHSDH

SEQ ID NO: 129770 - protein, 9 aa, Homo Sapiens
PVDIIRSPT

SEQ ID NO: 129771 - protein, 9 aa, Homo Sapiens
HFDSRKRRA

SEQ ID NO: 129772 - protein, 9 aa, Homo Sapiens
DVGLALAHS

SEQ ID NO: 129773 - protein, 9 aa, Homo Sapiens
YQDLEIKSS

SEQ ID NO: 129774 - protein, 9 aa, Homo Sapiens
LQGAGAAAG

SEQ ID NO: 129775 - protein, 9 aa, Homo Sapiens
RVADLVEAL

SEQ ID NO: 129776 - protein, 9 aa, Homo Sapiens
RYVYVCIAM

SEQ ID NO: 129777 - protein, 9 aa, Homo Sapiens
AARGASTSS

SEQ ID NO: 129778 - protein, 9 aa, Homo Sapiens
TNLYELACK

SEQ ID NO: 129779 - protein, 9 aa, Homo Sapiens
APQSVRLQP

SEQ ID NO: 129780 - protein, 9 aa, Homo Sapiens
GGTADPYAR

SEQ ID NO: 129781 - protein, 9 aa, Homo Sapiens
VQNCISLNS

SEQ ID NO: 129782 - protein, 9 aa, Homo Sapiens
VAAPANKHR

SEQ ID NO: 129783 - protein, 9 aa, Homo Sapiens
ESMIPIARS

SEQ ID NO: 129784 - protein, 9 aa, Homo Sapiens
VLNLLIMLG

SEQ ID NO: 129785 - protein, 9 aa, Homo Sapiens
LPLGMTCSI

SEQ ID NO: 129786 - protein, 9 aa, Homo Sapiens
CAQVRKPFL

SEQ ID NO: 129787 - protein, 9 aa, Homo Sapiens
RDRIEDFFG

SEQ ID NO: 129788 - protein, 9 aa, Homo Sapiens
KHLIYEHIF

SEQ ID NO: 129789 - protein, 9 aa, Homo Sapiens
YGVTKVHGR

SEQ ID NO: 129790 - protein, 9 aa, Homo Sapiens
VDGKDLTTE

SEQ ID NO: 129791 - protein, 9 aa, Homo Sapiens
VFFQAGTLA

SEQ ID NO: 129792 - protein, 9 aa, Homo Sapiens
PCPRAPALE

SEQ ID NO: 129793 - protein, 9 aa, Homo Sapiens
KEDVNKKRK

SEQ ID NO: 129794 - protein, 9 aa, Homo Sapiens
APEEQNSPE

SEQ ID NO: 129795 - protein, 9 aa, Homo Sapiens
EPTKMWHQS

SEQ ID NO: 129796 - protein, 9 aa, Homo Sapiens
TSEEQAETK

SEQ ID NO: 129797 - protein, 9 aa, Homo Sapiens
LNARNVLKG

SEQ ID NO: 129798 - protein, 9 aa, Homo Sapiens
IKERTQGRN

SEQ ID NO: 129799 - protein, 9 aa, Homo Sapiens
LPRTNFQSH

SEQ ID NO: 129800 - protein, 9 aa, Homo Sapiens
DKQIELMTV

SEQ ID NO: 129801 - protein, 9 aa, Homo Sapiens
SLIGACKAK

SEQ ID NO: 129802 - protein, 9 aa, Homo Sapiens
RAKGFPNVY

SEQ ID NO: 129803 - protein, 9 aa, Homo Sapiens
NEFEELVIL

SEQ ID NO: 129804 - protein, 9 aa, Homo Sapiens
ASLSNTSTQ

SEQ ID NO: 129805 - protein, 9 aa, Homo Sapiens
EATNNGYSW

SEQ ID NO: 129806 - protein, 9 aa, Homo Sapiens
VGSGPPHPR

SEQ ID NO: 129807 - protein, 9 aa, Homo Sapiens
HREGHLTLL

SEQ ID NO: 129808 - protein, 9 aa, Homo Sapiens
VRNYVPWWA

SEQ ID NO: 129809 - protein, 9 aa, Homo Sapiens
VLLFCIWMS

SEQ ID NO: 129810 - protein, 9 aa, Homo Sapiens
NFLRILEKE

SEQ ID NO: 129811 - protein, 9 aa, Homo Sapiens
RPSSRHAAH

SEQ ID NO: 129812 - protein, 9 aa, Homo Sapiens
GGVIRVDRS

SEQ ID NO: 129813 - protein, 9 aa, Homo Sapiens
RSKANKEFG

SEQ ID NO: 129814 - protein, 9 aa, Homo Sapiens
LFSAQHLPP

SEQ ID NO: 129815 - protein, 9 aa, Homo Sapiens
PYNSQYEEA

SEQ ID NO: 129816 - protein, 9 aa, Homo Sapiens
RAFSLSFHL

SEQ ID NO: 129817 - protein, 9 aa, Homo Sapiens
KKKGPNTNS

SEQ ID NO: 129818 - protein, 9 aa, Homo Sapiens
KHCKKLEAV

SEQ ID NO: 129819 - protein, 9 aa, Homo Sapiens
FSDVFRSVM

SEQ ID NO: 129820 - protein, 9 aa, Homo Sapiens
AVMNQYRMR

SEQ ID NO: 129821 - protein, 9 aa, Homo Sapiens
IGLSWVLCR

SEQ ID NO: 129822 - protein, 9 aa, Homo Sapiens
WEGEAEAVG

SEQ ID NO: 129823 - protein, 9 aa, Homo Sapiens
ACACGLGWE

SEQ ID NO: 129824 - protein, 9 aa, Homo Sapiens
LSDVDLATS

SEQ ID NO: 129825 - protein, 9 aa, Homo Sapiens
ALGTAPARS

SEQ ID NO: 129826 - protein, 9 aa, Homo Sapiens
IMNNFGMYY

SEQ ID NO: 129827 - protein, 9 aa, Homo Sapiens
MGSVHEGGS

SEQ ID NO: 129828 - protein, 9 aa, Homo Sapiens
VETSHDAAL

SEQ ID NO: 129829 - protein, 9 aa, Homo Sapiens
ARKGREERR

SEQ ID NO: 129830 - protein, 9 aa, Homo Sapiens
GGVGAQLMA

SEQ ID NO: 129831 - protein, 9 aa, Homo Sapiens
DVHTGVGSG

SEQ ID NO: 129832 - protein, 9 aa, Homo Sapiens
SGYGSSFGC

SEQ ID NO: 129833 - protein, 9 aa, Homo Sapiens
GLFRTNGSK

SEQ ID NO: 129834 - protein, 9 aa, Homo Sapiens
ERAFQSTCA

SEQ ID NO: 129835 - protein, 9 aa, Homo Sapiens
HPWRSKGAD

SEQ ID NO: 129836 - protein, 9 aa, Homo Sapiens
GMTCSIDMD

SEQ ID NO: 129837 - protein, 9 aa, Homo Sapiens
ELHHKAGTK

SEQ ID NO: 129838 - protein, 9 aa, Homo Sapiens
TLFSCLSLP

SEQ ID NO: 129839 - protein, 9 aa, Homo Sapiens
RQLLFFTNK

SEQ ID NO: 129840 - protein, 9 aa, Homo Sapiens
EIYDSSKSC

SEQ ID NO: 129841 - protein, 9 aa, Homo Sapiens
KCEDINECS

SEQ ID NO: 129842 - protein, 9 aa, Homo Sapiens
VDNVLTMDM

SEQ ID NO: 129843 - protein, 9 aa, Homo Sapiens
QAPGGAAPG

SEQ ID NO: 129844 - protein, 9 aa, Homo Sapiens
FRKDVLCEI

SEQ ID NO: 129845 - protein, 9 aa, Homo Sapiens
KNKDLRRHM

SEQ ID NO: 129846 - protein, 9 aa, Homo Sapiens
FPLVYATPL

SEQ ID NO: 129847 - protein, 9 aa, Homo Sapiens
NNFFVTEGN

SEQ ID NO: 129848 - protein, 9 aa, Homo Sapiens
IYDFPQKFH

SEQ ID NO: 129849 - protein, 9 aa, Homo Sapiens
QSFFETSTY

SEQ ID NO: 129850 - protein, 9 aa, Homo Sapiens
SSPNSNLSS

SEQ ID NO: 129851 - protein, 9 aa, Homo Sapiens
TGSSTASAA

SEQ ID NO: 129852 - protein, 9 aa, Homo Sapiens
VRLFVNRFG

SEQ ID NO: 129853 - protein, 9 aa, Homo Sapiens
PVGIVRSRG

SEQ ID NO: 129854 - protein, 9 aa, Homo Sapiens
VNYRFLTPF

SEQ ID NO: 129855 - protein, 9 aa, Homo Sapiens
NKGEKHFEC

SEQ ID NO: 129856 - protein, 9 aa, Homo Sapiens
SFPKTTTTT

SEQ ID NO: 129857 - protein, 9 aa, Homo Sapiens
RGVKYSYQQ

SEQ ID NO: 129858 - protein, 9 aa, Homo Sapiens
RRGVPDVGH

SEQ ID NO: 129859 - protein, 9 aa, Homo Sapiens
EEEEEEKGL

SEQ ID NO: 129860 - protein, 9 aa, Homo Sapiens
KPHKASKLD

SEQ ID NO: 129861 - protein, 9 aa, Homo Sapiens
PEFVRNYVP

SEQ ID NO: 129862 - protein, 9 aa, Homo Sapiens
GSMRDKKRR

SEQ ID NO: 129863 - protein, 9 aa, Homo Sapiens
HLQAKRAGQ

SEQ ID NO: 129864 - protein, 9 aa, Homo Sapiens
PQHPVFPEQ

SEQ ID NO: 129865 - protein, 9 aa, Homo Sapiens
PTGPGGGGP

SEQ ID NO: 129866 - protein, 9 aa, Homo Sapiens
PGGKEEAQE

SEQ ID NO: 129867 - protein, 9 aa, Homo Sapiens
FFTLILSTS

SEQ ID NO: 129868 - protein, 9 aa, Homo Sapiens
VPPSPILYA

SEQ ID NO: 129869 - protein, 9 aa, Homo Sapiens
EQASVRHLG

SEQ ID NO: 129870 - protein, 9 aa, Homo Sapiens
HKREIYDHY

SEQ ID NO: 129871 - protein, 9 aa, Homo Sapiens
PDGDDRPGR

SEQ ID NO: 129872 - protein, 9 aa, Homo Sapiens
PHLLHPGTP

SEQ ID NO: 129873 - protein, 9 aa, Homo Sapiens
GLHDLEYEC

SEQ ID NO: 129874 - protein, 9 aa, Homo Sapiens
DEIHVLQHA

SEQ ID NO: 129875 - protein, 9 aa, Homo Sapiens
TDVDFLRAQ

SEQ ID NO: 129876 - protein, 9 aa, Homo Sapiens
LTRWKPLQT

SEQ ID NO: 129877 - protein, 9 aa, Homo Sapiens
TCMQSQRNY

SEQ ID NO: 129878 - protein, 9 aa, Homo Sapiens
DRCNAGWLQ

SEQ ID NO: 129879 - protein, 9 aa, Homo Sapiens
AGWRDSSRE

SEQ ID NO: 129880 - protein, 9 aa, Homo Sapiens
ITAVSSQPL

SEQ ID NO: 129881 - protein, 9 aa, Homo Sapiens
RLEDTKNNL

SEQ ID NO: 129882 - protein, 9 aa, Homo Sapiens
KMPPSTSAV

SEQ ID NO: 129883 - protein, 9 aa, Homo Sapiens
PGEPAFRKG

SEQ ID NO: 129884 - protein, 9 aa, Homo Sapiens
FVPGTAYGN

SEQ ID NO: 129885 - protein, 9 aa, Homo Sapiens
GFPCNHRYL

SEQ ID NO: 129886 - protein, 9 aa, Homo Sapiens
QEFPAVGLE

SEQ ID NO: 129887 - protein, 9 aa, Homo Sapiens
AEASLIDQM

SEQ ID NO: 129888 - protein, 9 aa, Homo Sapiens
ALPLCWAPG

SEQ ID NO: 129889 - protein, 9 aa, Homo Sapiens
TMMVSDWYK

SEQ ID NO: 129890 - protein, 9 aa, Homo Sapiens
LIAGSLDSR

SEQ ID NO: 129891 - protein, 9 aa, Homo Sapiens
RPLCQRFPT

SEQ ID NO: 129892 - protein, 9 aa, Homo Sapiens
LTTRKERKK

SEQ ID NO: 129893 - protein, 9 aa, Homo Sapiens
SRIALNFAK

SEQ ID NO: 129894 - protein, 9 aa, Homo Sapiens
SPEGDPSPH

SEQ ID NO: 129895 - protein, 9 aa, Homo Sapiens
PDGYKRDLM

SEQ ID NO: 129896 - protein, 9 aa, Homo Sapiens
WAVSTGVQA

SEQ ID NO: 129897 - protein, 9 aa, Homo Sapiens
LKDSGYFRL

SEQ ID NO: 129898 - protein, 9 aa, Homo Sapiens
DFPEATEEE

SEQ ID NO: 129899 - protein, 9 aa, Homo Sapiens
VFSCGHLYR

SEQ ID NO: 129900 - protein, 9 aa, Homo Sapiens
RDITAAHPS

SEQ ID NO: 129901 - protein, 9 aa, Homo Sapiens
GFYSYMNLA

SEQ ID NO: 129902 - protein, 9 aa, Homo Sapiens
WVEGNSSIK

SEQ ID NO: 129903 - protein, 9 aa, Homo Sapiens
IDKYRAPIR

SEQ ID NO: 129904 - protein, 9 aa, Homo Sapiens
PQTRRQRSP

SEQ ID NO: 129905 - protein, 9 aa, Homo Sapiens
LHPWWKEHL

SEQ ID NO: 129906 - protein, 9 aa, Homo Sapiens
PCPLAARKL

SEQ ID NO: 129907 - protein, 9 aa, Homo Sapiens
LANSETSKA

SEQ ID NO: 129908 - protein, 9 aa, Homo Sapiens
DFRDVFKKN

SEQ ID NO: 129909 - protein, 9 aa, Homo Sapiens
VMPEVEFSD

SEQ ID NO: 129910 - protein, 9 aa, Homo Sapiens
FGEVEFTGL

SEQ ID NO: 129911 - protein, 9 aa, Homo Sapiens
FTPLEKDGF

SEQ ID NO: 129912 - protein, 9 aa, Homo Sapiens
DGEADTKMT

SEQ ID NO: 129913 - protein, 9 aa, Homo Sapiens
TSSPRRSPA

SEQ ID NO: 129914 - protein, 9 aa, Homo Sapiens
SVRTTRSQQ

SEQ ID NO: 129915 - protein, 9 aa, Homo Sapiens
AMVLVCFPF

SEQ ID NO: 129916 - protein, 9 aa, Homo Sapiens
EVSATFNFE

SEQ ID NO: 129917 - protein, 9 aa, Homo Sapiens
AMTEEPAVA

SEQ ID NO: 129918 - protein, 9 aa, Homo Sapiens
FKMLKFLLF

SEQ ID NO: 129919 - protein, 9 aa, Homo Sapiens
YSMSCMNKC

SEQ ID NO: 129920 - protein, 9 aa, Homo Sapiens
LSATHHHSS

SEQ ID NO: 129921 - protein, 9 aa, Homo Sapiens
GFNQRNRID

SEQ ID NO: 129922 - protein, 9 aa, Homo Sapiens
KLQESAHRR

SEQ ID NO: 129923 - protein, 9 aa, Homo Sapiens
IEASPIGSI

SEQ ID NO: 129924 - protein, 9 aa, Homo Sapiens
SDLINHQKN

SEQ ID NO: 129925 - protein, 9 aa, Homo Sapiens
TMETSNAYI

SEQ ID NO: 129926 - protein, 9 aa, Homo Sapiens
LAVKGLVQR

SEQ ID NO: 129927 - protein, 9 aa, Homo Sapiens
SFLVLLLGW

SEQ ID NO: 129928 - protein, 9 aa, Homo Sapiens
PWTCFVQLT

SEQ ID NO: 129929 - protein, 9 aa, Homo Sapiens
EEQAETKRL

SEQ ID NO: 129930 - protein, 9 aa, Homo Sapiens
KATKRDLPP

SEQ ID NO: 129931 - protein, 9 aa, Homo Sapiens
PWVRESHIT

SEQ ID NO: 129932 - protein, 9 aa, Homo Sapiens
FLQKTSIIR

SEQ ID NO: 129933 - protein, 9 aa, Homo Sapiens
TEVGCPAGG

SEQ ID NO: 129934 - protein, 9 aa, Homo Sapiens
DEYRFAWRT

SEQ ID NO: 129935 - protein, 9 aa, Homo Sapiens
HPNSCNTSV

SEQ ID NO: 129936 - protein, 9 aa, Homo Sapiens
PPEGLAPPA

SEQ ID NO: 129937 - protein, 9 aa, Homo Sapiens
PPSGPRLRL

SEQ ID NO: 129938 - protein, 9 aa, Homo Sapiens
LDFVLSASR

SEQ ID NO: 129939 - protein, 9 aa, Homo Sapiens
QKCIFSFDN

SEQ ID NO: 129940 - protein, 9 aa, Homo Sapiens
AHEEIDLHN

SEQ ID NO: 129941 - protein, 9 aa, Homo Sapiens
KPLGEEETD

SEQ ID NO: 129942 - protein, 9 aa, Homo Sapiens
YPPKDPRSS

SEQ ID NO: 129943 - protein, 9 aa, Homo Sapiens
RLLAKGKKP

SEQ ID NO: 129944 - protein, 9 aa, Homo Sapiens
KPNVISQLE

SEQ ID NO: 129945 - protein, 9 aa, Homo Sapiens
KSVDKCMDG

SEQ ID NO: 129946 - protein, 9 aa, Homo Sapiens
YISEWQQLS

SEQ ID NO: 129947 - protein, 9 aa, Homo Sapiens
ICKGCPHRY

SEQ ID NO: 129948 - protein, 9 aa, Homo Sapiens
LRDITAAHP

SEQ ID NO: 129949 - protein, 9 aa, Homo Sapiens
IVSTAKVCG

SEQ ID NO: 129950 - protein, 9 aa, Homo Sapiens
CLVRENSSS

SEQ ID NO: 129951 - protein, 9 aa, Homo Sapiens
LRREIVSTA

SEQ ID NO: 129952 - protein, 9 aa, Homo Sapiens
PTISCPFQS

SEQ ID NO: 129953 - protein, 9 aa, Homo Sapiens
AVCTAPCGG

SEQ ID NO: 129954 - protein, 9 aa, Homo Sapiens
DPGLGLWLI

SEQ ID NO: 129955 - protein, 9 aa, Homo Sapiens
CQVHGGLMG

SEQ ID NO: 129956 - protein, 9 aa, Homo Sapiens
EFSDMPRIS

SEQ ID NO: 129957 - protein, 9 aa, Homo Sapiens
TQARLAWEA

SEQ ID NO: 129958 - protein, 9 aa, Homo Sapiens
EMPYAGGVG

SEQ ID NO: 129959 - protein, 9 aa, Homo Sapiens
RLPLHVLAA

SEQ ID NO: 129960 - protein, 9 aa, Homo Sapiens
GKPNYTVDW

SEQ ID NO: 129961 - protein, 9 aa, Homo Sapiens
DAFASWSDD

SEQ ID NO: 129962 - protein, 9 aa, Homo Sapiens
KRPRTAGRN

SEQ ID NO: 129963 - protein, 9 aa, Homo Sapiens
LTESGCVTK

SEQ ID NO: 129964 - protein, 9 aa, Homo Sapiens
ASANHSPVK

SEQ ID NO: 129965 - protein, 9 aa, Homo Sapiens
NGEEPKMGA

SEQ ID NO: 129966 - protein, 9 aa, Homo Sapiens
CSQSPLSLW

SEQ ID NO: 129967 - protein, 9 aa, Homo Sapiens
RICRGGPAT

SEQ ID NO: 129968 - protein, 9 aa, Homo Sapiens
CYDPDSNTW

SEQ ID NO: 129969 - protein, 9 aa, Homo Sapiens
ISLNSLNEV

SEQ ID NO: 129970 - protein, 9 aa, Homo Sapiens
NYPAIILFS

SEQ ID NO: 129971 - protein, 9 aa, Homo Sapiens
GLGLRMRRC

SEQ ID NO: 129972 - protein, 9 aa, Homo Sapiens
IQCVFGKPF

SEQ ID NO: 129973 - protein, 9 aa, Homo Sapiens
GPCCEALCF

SEQ ID NO: 129974 - protein, 9 aa, Homo Sapiens
KKPDAPPPK

SEQ ID NO: 129975 - protein, 9 aa, Homo Sapiens
VDDNLKTHP

SEQ ID NO: 129976 - protein, 9 aa, Homo Sapiens
TSLNIKEFI

SEQ ID NO: 129977 - protein, 9 aa, Homo Sapiens
AIQNREICC

SEQ ID NO: 129978 - protein, 9 aa, Homo Sapiens
KESMIPIAR

SEQ ID NO: 129979 - protein, 9 aa, Homo Sapiens
STRVVDHYE

SEQ ID NO: 129980 - protein, 9 aa, Homo Sapiens
ENTLVQMAD

SEQ ID NO: 129981 - protein, 9 aa, Homo Sapiens
HGSRSQSSS

SEQ ID NO: 129982 - protein, 9 aa, Homo Sapiens
KGFVWISWF

SEQ ID NO: 129983 - protein, 9 aa, Homo Sapiens
IGAVILKRV

SEQ ID NO: 129984 - protein, 9 aa, Homo Sapiens
ASQPMAPGV

SEQ ID NO: 129985 - protein, 9 aa, Homo Sapiens
FPFDQQNCA

SEQ ID NO: 129986 - protein, 9 aa, Homo Sapiens
MAEKFVHLE

SEQ ID NO: 129987 - protein, 9 aa, Homo Sapiens
QELCVIYVK

SEQ ID NO: 129988 - protein, 9 aa, Homo Sapiens
IIGDLHVVH

SEQ ID NO: 129989 - protein, 9 aa, Homo Sapiens
AEARENVPQ

SEQ ID NO: 129990 - protein, 9 aa, Homo Sapiens
GARELQEKM

SEQ ID NO: 129991 - protein, 9 aa, Homo Sapiens
IRSVLQRDE

SEQ ID NO: 129992 - protein, 9 aa, Homo Sapiens
SHIMEYIHK

SEQ ID NO: 129993 - protein, 9 aa, Homo Sapiens
FYSDAAKGI

SEQ ID NO: 129994 - protein, 9 aa, Homo Sapiens
TRPSRMCTA

SEQ ID NO: 129995 - protein, 9 aa, Homo Sapiens
AVEYVELTF

SEQ ID NO: 129996 - protein, 9 aa, Homo Sapiens
LLAGAPPGA

SEQ ID NO: 129997 - protein, 9 aa, Homo Sapiens
DKPHKASKL

SEQ ID NO: 129998 - protein, 9 aa, Homo Sapiens
RFRLRDEFQ

SEQ ID NO: 129999 - protein, 9 aa, Homo Sapiens
EEQESKKNS

SEQ ID NO: 130000 - protein, 9 aa, Homo Sapiens
HPKLKTTTK

SEQ ID NO: 130001 - protein, 9 aa, Homo Sapiens
SFASLRPRS

SEQ ID NO: 130002 - protein, 9 aa, Homo Sapiens
CSRRWRPAA

SEQ ID NO: 130003 - protein, 9 aa, Homo Sapiens
FFGCRLKGM

SEQ ID NO: 130004 - protein, 9 aa, Homo Sapiens
WTQLEHLRK

SEQ ID NO: 130005 - protein, 9 aa, Homo Sapiens
YFVVRNYWR

SEQ ID NO: 130006 - protein, 9 aa, Homo Sapiens
QNRICGFLV

SEQ ID NO: 130007 - protein, 9 aa, Homo Sapiens
RRQRSPLHL

SEQ ID NO: 130008 - protein, 9 aa, Homo Sapiens
QVHLAQHQR

SEQ ID NO: 130009 - protein, 9 aa, Homo Sapiens
LYDYTKDLF

SEQ ID NO: 130010 - protein, 9 aa, Homo Sapiens
PNSEHFRTT

SEQ ID NO: 130011 - protein, 9 aa, Homo Sapiens
PYPCNEYGK

SEQ ID NO: 130012 - protein, 9 aa, Homo Sapiens
CARGPWRAA

SEQ ID NO: 130013 - protein, 9 aa, Homo Sapiens
ARKINFDHS

SEQ ID NO: 130014 - protein, 9 aa, Homo Sapiens
ALAPLQTDY

SEQ ID NO: 130015 - protein, 9 aa, Homo Sapiens
GEAGAEREF

SEQ ID NO: 130016 - protein, 9 aa, Homo Sapiens
DGEDAMAQD

SEQ ID NO: 130017 - protein, 9 aa, Homo Sapiens
ANIPVDRPG

SEQ ID NO: 130018 - protein, 9 aa, Homo Sapiens
IVRSRGLGL

SEQ ID NO: 130019 - protein, 9 aa, Homo Sapiens
ADDLSNSFG

SEQ ID NO: 130020 - protein, 9 aa, Homo Sapiens
SPPEYFGSV

SEQ ID NO: 130021 - protein, 9 aa, Homo Sapiens
QATNTCDGQ

SEQ ID NO: 130022 - protein, 9 aa, Homo Sapiens
EAQKFFVIQ

SEQ ID NO: 130023 - protein, 9 aa, Homo Sapiens
LEPYAFNMK

SEQ ID NO: 130024 - protein, 9 aa, Homo Sapiens
PPHAGGHRQ

SEQ ID NO: 130025 - protein, 9 aa, Homo Sapiens
ENIDLSEIP

SEQ ID NO: 130026 - protein, 9 aa, Homo Sapiens
STVVCVGAQ

SEQ ID NO: 130027 - protein, 9 aa, Homo Sapiens
ILEKEEDEQ

SEQ ID NO: 130028 - protein, 9 aa, Homo Sapiens
HLESWALTI

SEQ ID NO: 130029 - protein, 9 aa, Homo Sapiens
SAEDLEKVL

SEQ ID NO: 130030 - protein, 9 aa, Homo Sapiens
KKRDLYNKF

SEQ ID NO: 130031 - protein, 9 aa, Homo Sapiens
QVHYACREG

SEQ ID NO: 130032 - protein, 9 aa, Homo Sapiens
LPPRAAPPP

SEQ ID NO: 130033 - protein, 9 aa, Homo Sapiens
QMPRKMRHV

SEQ ID NO: 130034 - protein, 9 aa, Homo Sapiens
HKLMGDKFK

SEQ ID NO: 130035 - protein, 9 aa, Homo Sapiens
DSHGVMSSR

SEQ ID NO: 130036 - protein, 9 aa, Homo Sapiens
VGAEEAAES

SEQ ID NO: 130037 - protein, 9 aa, Homo Sapiens
EYNVEHSVG

SEQ ID NO: 130038 - protein, 9 aa, Homo Sapiens
LVCADTTLF

SEQ ID NO: 130039 - protein, 9 aa, Homo Sapiens
RPCVKTWAS

SEQ ID NO: 130040 - protein, 9 aa, Homo Sapiens
VCQNLHDVS

SEQ ID NO: 130041 - protein, 9 aa, Homo Sapiens
NAVRLFPLS

SEQ ID NO: 130042 - protein, 9 aa, Homo Sapiens
ALASTILSD

SEQ ID NO: 130043 - protein, 9 aa, Homo Sapiens
QSGLYVSVR

SEQ ID NO: 130044 - protein, 9 aa, Homo Sapiens
KTMELDSSL

SEQ ID NO: 130045 - protein, 9 aa, Homo Sapiens
PDTSAQPPG

SEQ ID NO: 130046 - protein, 9 aa, Homo Sapiens
STRKVSTMT

SEQ ID NO: 130047 - protein, 9 aa, Homo Sapiens
MDVRSAYKR

SEQ ID NO: 130048 - protein, 9 aa, Homo Sapiens
LGCQPDFHM

SEQ ID NO: 130049 - protein, 9 aa, Homo Sapiens
KPEGPGGPN

SEQ ID NO: 130050 - protein, 9 aa, Homo Sapiens
HGADASHWC

SEQ ID NO: 130051 - protein, 9 aa, Homo Sapiens
RQRERVRGG

SEQ ID NO: 130052 - protein, 9 aa, Homo Sapiens
GYRCAALNH

SEQ ID NO: 130053 - protein, 9 aa, Homo Sapiens
VTLCSFGLW

SEQ ID NO: 130054 - protein, 9 aa, Homo Sapiens
LPGTGHIPH

SEQ ID NO: 130055 - protein, 9 aa, Homo Sapiens
EPHPETHPD

SEQ ID NO: 130056 - protein, 9 aa, Homo Sapiens
KGVVADWRY

SEQ ID NO: 130057 - protein, 9 aa, Homo Sapiens
AILGHSLPH

SEQ ID NO: 130058 - protein, 9 aa, Homo Sapiens
LYSMSCMNK

SEQ ID NO: 130059 - protein, 9 aa, Homo Sapiens
AILSLIHFF

SEQ ID NO: 130060 - protein, 9 aa, Homo Sapiens
LRPGGTADP

SEQ ID NO: 130061 - protein, 9 aa, Homo Sapiens
VNSSKWNST

SEQ ID NO: 130062 - protein, 9 aa, Homo Sapiens
IPKAVEPGK

SEQ ID NO: 130063 - protein, 9 aa, Homo Sapiens
QLVRGNADL

SEQ ID NO: 130064 - protein, 9 aa, Homo Sapiens
LWLLSPSRK

SEQ ID NO: 130065 - protein, 9 aa, Homo Sapiens
VDLAEFPVL

SEQ ID NO: 130066 - protein, 9 aa, Homo Sapiens
LSKPTDYSP

SEQ ID NO: 130067 - protein, 9 aa, Homo Sapiens
LFRTNGSKQ

SEQ ID NO: 130068 - protein, 9 aa, Homo Sapiens
ILEISPKLQ

SEQ ID NO: 130069 - protein, 9 aa, Homo Sapiens
NIALRWTGK

SEQ ID NO: 130070 - protein, 9 aa, Homo Sapiens
SIDICHRVL

SEQ ID NO: 130071 - protein, 9 aa, Homo Sapiens
RERRRKGGG

SEQ ID NO: 130072 - protein, 9 aa, Homo Sapiens
FTKGRTSVH

SEQ ID NO: 130073 - protein, 9 aa, Homo Sapiens
EEVSATFNF

SEQ ID NO: 130074 - protein, 9 aa, Homo Sapiens
RNNETPEER

SEQ ID NO: 130075 - protein, 9 aa, Homo Sapiens
TSNSSSEDG

SEQ ID NO: 130076 - protein, 9 aa, Homo Sapiens
LLGFLVREE

SEQ ID NO: 130077 - protein, 9 aa, Homo Sapiens
KTDLKINHV

SEQ ID NO: 130078 - protein, 9 aa, Homo Sapiens
EKICPGEDE

SEQ ID NO: 130079 - protein, 9 aa, Homo Sapiens
LDNDMKKLN

SEQ ID NO: 130080 - protein, 9 aa, Homo Sapiens
KGLIVMLRD

SEQ ID NO: 130081 - protein, 9 aa, Homo Sapiens
YNREKAVGD

SEQ ID NO: 130082 - protein, 9 aa, Homo Sapiens
KNGYRCAAL

SEQ ID NO: 130083 - protein, 9 aa, Homo Sapiens
GFVIDPVHN

SEQ ID NO: 130084 - protein, 9 aa, Homo Sapiens
AHLTSYSLQ

SEQ ID NO: 130085 - protein, 9 aa, Homo Sapiens
IDPVHNLRL

SEQ ID NO: 130086 - protein, 9 aa, Homo Sapiens
SSALSGVEG

SEQ ID NO: 130087 - protein, 9 aa, Homo Sapiens
GAAQHEFHG

SEQ ID NO: 130088 - protein, 9 aa, Homo Sapiens
HLIYEHIFA

SEQ ID NO: 130089 - protein, 9 aa, Homo Sapiens
LNWHSNSQN

SEQ ID NO: 130090 - protein, 9 aa, Homo Sapiens
LEEAVREAA

SEQ ID NO: 130091 - protein, 9 aa, Homo Sapiens
VMNDIMSLG

SEQ ID NO: 130092 - protein, 9 aa, Homo Sapiens
FWAGSVAIA

SEQ ID NO: 130093 - protein, 9 aa, Homo Sapiens
YSERVEKTG

SEQ ID NO: 130094 - protein, 9 aa, Homo Sapiens
FIPPNETLE

SEQ ID NO: 130095 - protein, 9 aa, Homo Sapiens
TDYYAALLG

SEQ ID NO: 130096 - protein, 9 aa, Homo Sapiens
PAAVDPDIG

SEQ ID NO: 130097 - protein, 9 aa, Homo Sapiens
LCPPVPGVP

SEQ ID NO: 130098 - protein, 9 aa, Homo Sapiens
GAKRSRVTS

SEQ ID NO: 130099 - protein, 9 aa, Homo Sapiens
TNRYVQQKR

SEQ ID NO: 130100 - protein, 9 aa, Homo Sapiens
SWMSSVPVS

SEQ ID NO: 130101 - protein, 9 aa, Homo Sapiens
KGNKGEKHF

SEQ ID NO: 130102 - protein, 9 aa, Homo Sapiens
NCEECGKAY

SEQ ID NO: 130103 - protein, 9 aa, Homo Sapiens
LCRYRQVIT

SEQ ID NO: 130104 - protein, 9 aa, Homo Sapiens
TPTSDTPKV

SEQ ID NO: 130105 - protein, 9 aa, Homo Sapiens
EVHVRYPKL

SEQ ID NO: 130106 - protein, 9 aa, Homo Sapiens
SSIRAGQCG

SEQ ID NO: 130107 - protein, 9 aa, Homo Sapiens
KLNKREECD

SEQ ID NO: 130108 - protein, 9 aa, Homo Sapiens
PPQIEAPPP

SEQ ID NO: 130109 - protein, 9 aa, Homo Sapiens
IFQYSQLIS

SEQ ID NO: 130110 - protein, 9 aa, Homo Sapiens
VVCVGAQHD

SEQ ID NO: 130111 - protein, 9 aa, Homo Sapiens
LRNLRGQQK

SEQ ID NO: 130112 - protein, 9 aa, Homo Sapiens
LSNLGPCCE

SEQ ID NO: 130113 - protein, 9 aa, Homo Sapiens
LEKVLELTG

SEQ ID NO: 130114 - protein, 9 aa, Homo Sapiens
MKSTLTSRR

SEQ ID NO: 130115 - protein, 9 aa, Homo Sapiens
RKICCKTFL

SEQ ID NO: 130116 - protein, 9 aa, Homo Sapiens
SSQKRALLC

SEQ ID NO: 130117 - protein, 9 aa, Homo Sapiens
GDFYNNNRT

SEQ ID NO: 130118 - protein, 9 aa, Homo Sapiens
SEWPGWCLV

SEQ ID NO: 130119 - protein, 9 aa, Homo Sapiens
ADPEQPGDG

SEQ ID NO: 130120 - protein, 9 aa, Homo Sapiens
VLTATHCFP

SEQ ID NO: 130121 - protein, 9 aa, Homo Sapiens
GKDDGQNFI

SEQ ID NO: 130122 - protein, 9 aa, Homo Sapiens
STQTQTSTF

SEQ ID NO: 130123 - protein, 9 aa, Homo Sapiens
LQNTTKLTV

SEQ ID NO: 130124 - protein, 9 aa, Homo Sapiens
NVLLVMDTA

SEQ ID NO: 130125 - protein, 9 aa, Homo Sapiens
SEMKSSGKI

SEQ ID NO: 130126 - protein, 9 aa, Homo Sapiens
RTGPRSPDI

SEQ ID NO: 130127 - protein, 9 aa, Homo Sapiens
QVFQNHLVD

SEQ ID NO: 130128 - protein, 9 aa, Homo Sapiens
RGRLPHPPI

SEQ ID NO: 130129 - protein, 9 aa, Homo Sapiens
EQPGDGEDP

SEQ ID NO: 130130 - protein, 9 aa, Homo Sapiens
VAPPWVPHT

SEQ ID NO: 130131 - protein, 9 aa, Homo Sapiens
GIILWLFIR

SEQ ID NO: 130132 - protein, 9 aa, Homo Sapiens
ATNTCDGQQ

SEQ ID NO: 130133 - protein, 9 aa, Homo Sapiens
NNHLQQLEH

SEQ ID NO: 130134 - protein, 9 aa, Homo Sapiens
AARRSQRLP

SEQ ID NO: 130135 - protein, 9 aa, Homo Sapiens
TCIFFTFWH

SEQ ID NO: 130136 - protein, 9 aa, Homo Sapiens
CIFFTFWHG

SEQ ID NO: 130137 - protein, 9 aa, Homo Sapiens
DTLKQKRLV

SEQ ID NO: 130138 - protein, 9 aa, Homo Sapiens
HDPSRPHAE

SEQ ID NO: 130139 - protein, 9 aa, Homo Sapiens
SCSGCHTPQ

SEQ ID NO: 130140 - protein, 9 aa, Homo Sapiens
LMWQFPAHY

SEQ ID NO: 130141 - protein, 9 aa, Homo Sapiens
EAVSFQFFF

SEQ ID NO: 130142 - protein, 9 aa, Homo Sapiens
MFQPTWKNS

SEQ ID NO: 130143 - protein, 9 aa, Homo Sapiens
SPKTKKIYN

SEQ ID NO: 130144 - protein, 9 aa, Homo Sapiens
LQMWVCNSA

SEQ ID NO: 130145 - protein, 9 aa, Homo Sapiens
IEKKEYKMS

SEQ ID NO: 130146 - protein, 9 aa, Homo Sapiens
EANSTWTGM

SEQ ID NO: 130147 - protein, 9 aa, Homo Sapiens
YDLSPIEWL

SEQ ID NO: 130148 - protein, 9 aa, Homo Sapiens
MVWENLTFN

SEQ ID NO: 130149 - protein, 9 aa, Homo Sapiens
RIALNFAKL

SEQ ID NO: 130150 - protein, 9 aa, Homo Sapiens
PRPPPLVRC

SEQ ID NO: 130151 - protein, 9 aa, Homo Sapiens
QSLANIDEA

SEQ ID NO: 130152 - protein, 9 aa, Homo Sapiens
PPCSDLSTF

SEQ ID NO: 130153 - protein, 9 aa, Homo Sapiens
GSGDEKEME

SEQ ID NO: 130154 - protein, 9 aa, Homo Sapiens
LLHVRMVNL

SEQ ID NO: 130155 - protein, 9 aa, Homo Sapiens
TVVCVGAQH

SEQ ID NO: 130156 - protein, 9 aa, Homo Sapiens
PSAGPSPHL

SEQ ID NO: 130157 - protein, 9 aa, Homo Sapiens
NVLHGLSRS

SEQ ID NO: 130158 - protein, 9 aa, Homo Sapiens
GHRQRWGGT

SEQ ID NO: 130159 - protein, 9 aa, Homo Sapiens
PRVVGTQTL

SEQ ID NO: 130160 - protein, 9 aa, Homo Sapiens
VPLAGWARD

SEQ ID NO: 130161 - protein, 9 aa, Homo Sapiens
AGAPATEVG

SEQ ID NO: 130162 - protein, 9 aa, Homo Sapiens
LLAEVCHQI

SEQ ID NO: 130163 - protein, 9 aa, Homo Sapiens
GMQGPPRPQ

SEQ ID NO: 130164 - protein, 9 aa, Homo Sapiens
RWWEAQAPY

SEQ ID NO: 130165 - protein, 9 aa, Homo Sapiens
SRSQSPPQR

SEQ ID NO: 130166 - protein, 9 aa, Homo Sapiens
DLEKVRSVF

SEQ ID NO: 130167 - protein, 9 aa, Homo Sapiens
WRSSLSSVW

SEQ ID NO: 130168 - protein, 9 aa, Homo Sapiens
EQRHVALQL

SEQ ID NO: 130169 - protein, 9 aa, Homo Sapiens
HVHRIGREP

SEQ ID NO: 130170 - protein, 9 aa, Homo Sapiens
KTSIIRDYL

SEQ ID NO: 130171 - protein, 9 aa, Homo Sapiens
NKRYRFLLL

SEQ ID NO: 130172 - protein, 9 aa, Homo Sapiens
LNYFSGDTL

SEQ ID NO: 130173 - protein, 9 aa, Homo Sapiens
SYPRQAESG

SEQ ID NO: 130174 - protein, 9 aa, Homo Sapiens
PSSFFIQDG

SEQ ID NO: 130175 - protein, 9 aa, Homo Sapiens
VVWIQVSRL

SEQ ID NO: 130176 - protein, 9 aa, Homo Sapiens
HQMRTAPSV

SEQ ID NO: 130177 - protein, 9 aa, Homo Sapiens
QGQVVTQAT

SEQ ID NO: 130178 - protein, 9 aa, Homo Sapiens
AITPWQSSF

SEQ ID NO: 130179 - protein, 9 aa, Homo Sapiens
TFVLLGTII

SEQ ID NO: 130180 - protein, 9 aa, Homo Sapiens
PPLPTARTP

SEQ ID NO: 130181 - protein, 9 aa, Homo Sapiens
YRCAALNHL

SEQ ID NO: 130182 - protein, 9 aa, Homo Sapiens
GILEKDLLY

SEQ ID NO: 130183 - protein, 9 aa, Homo Sapiens
LKTTTKKIL

SEQ ID NO: 130184 - protein, 9 aa, Homo Sapiens
DPPPGAAGR

SEQ ID NO: 130185 - protein, 9 aa, Homo Sapiens
QIWNLNPVF

SEQ ID NO: 130186 - protein, 9 aa, Homo Sapiens
ESPSSALAN

SEQ ID NO: 130187 - protein, 9 aa, Homo Sapiens
LPRKEENQA

SEQ ID NO: 130188 - protein, 9 aa, Homo Sapiens
SLAEVQSET

SEQ ID NO: 130189 - protein, 9 aa, Homo Sapiens
CNAINFPRN

SEQ ID NO: 130190 - protein, 9 aa, Homo Sapiens
TKPRGERAP

SEQ ID NO: 130191 - protein, 9 aa, Homo Sapiens
KSEPSHQNS

SEQ ID NO: 130192 - protein, 9 aa, Homo Sapiens
LLQRSGDQL

SEQ ID NO: 130193 - protein, 9 aa, Homo Sapiens
LIALLSRKQ

SEQ ID NO: 130194 - protein, 9 aa, Homo Sapiens
STSQELCVI

SEQ ID NO: 130195 - protein, 9 aa, Homo Sapiens
SKPNVISQL

SEQ ID NO: 130196 - protein, 9 aa, Homo Sapiens
EKPLVSGTA

SEQ ID NO: 130197 - protein, 9 aa, Homo Sapiens
HPTPTSDTP

SEQ ID NO: 130198 - protein, 9 aa, Homo Sapiens
DTPRGTPGS

SEQ ID NO: 130199 - protein, 9 aa, Homo Sapiens
SATFNFELG

SEQ ID NO: 130200 - protein, 9 aa, Homo Sapiens
PGTQAARRP

SEQ ID NO: 130201 - protein, 9 aa, Homo Sapiens
FPIRQIRNR

SEQ ID NO: 130202 - protein, 9 aa, Homo Sapiens
IRISSKQEY

SEQ ID NO: 130203 - protein, 9 aa, Homo Sapiens
GAHKVVSCL

SEQ ID NO: 130204 - protein, 9 aa, Homo Sapiens
ACTSTNIWP

SEQ ID NO: 130205 - protein, 9 aa, Homo Sapiens
MTSRPYYVD

SEQ ID NO: 130206 - protein, 9 aa, Homo Sapiens
HGVMSSRDI

SEQ ID NO: 130207 - protein, 9 aa, Homo Sapiens
SASSSSSSN

SEQ ID NO: 130208 - protein, 9 aa, Homo Sapiens
SLALMCFLR

SEQ ID NO: 130209 - protein, 9 aa, Homo Sapiens
SSSFLYPMT

SEQ ID NO: 130210 - protein, 9 aa, Homo Sapiens
YLHRAARAG

SEQ ID NO: 130211 - protein, 9 aa, Homo Sapiens
RRSLAPTAA

SEQ ID NO: 130212 - protein, 9 aa, Homo Sapiens
TSLYLDSHK

SEQ ID NO: 130213 - protein, 9 aa, Homo Sapiens
SRVKELILS

SEQ ID NO: 130214 - protein, 9 aa, Homo Sapiens
LFHTALFLG

SEQ ID NO: 130215 - protein, 9 aa, Homo Sapiens
RHVHPEETG

SEQ ID NO: 130216 - protein, 9 aa, Homo Sapiens
TSMGSLRIL

SEQ ID NO: 130217 - protein, 9 aa, Homo Sapiens
IVAQYNTTK

SEQ ID NO: 130218 - protein, 9 aa, Homo Sapiens
RGWGPNGKE

SEQ ID NO: 130219 - protein, 9 aa, Homo Sapiens
FQTPRPMTA

SEQ ID NO: 130220 - protein, 9 aa, Homo Sapiens
PMSAVNFEK

SEQ ID NO: 130221 - protein, 9 aa, Homo Sapiens
WWEAQAPYR

SEQ ID NO: 130222 - protein, 9 aa, Homo Sapiens
GLCTSLLQV

SEQ ID NO: 130223 - protein, 9 aa, Homo Sapiens
FIFFRKFYN

SEQ ID NO: 130224 - protein, 9 aa, Homo Sapiens
LTPETNGPR

SEQ ID NO: 130225 - protein, 9 aa, Homo Sapiens
HPFIVKRHY

SEQ ID NO: 130226 - protein, 9 aa, Homo Sapiens
PAGPKQELC

SEQ ID NO: 130227 - protein, 9 aa, Homo Sapiens
RRRCCRQPP

SEQ ID NO: 130228 - protein, 9 aa, Homo Sapiens
LAQHVDAWV

SEQ ID NO: 130229 - protein, 9 aa, Homo Sapiens
LCLSRLVSS

SEQ ID NO: 130230 - protein, 9 aa, Homo Sapiens
FGGCSDFCH

SEQ ID NO: 130231 - protein, 9 aa, Homo Sapiens
QFIKAKTGP

SEQ ID NO: 130232 - protein, 9 aa, Homo Sapiens
PQRPEGPGQ

SEQ ID NO: 130233 - protein, 9 aa, Homo Sapiens
NYLSPSFKE

SEQ ID NO: 130234 - protein, 9 aa, Homo Sapiens
RHASIELPS

SEQ ID NO: 130235 - protein, 9 aa, Homo Sapiens
KNQQLTLQV

SEQ ID NO: 130236 - protein, 9 aa, Homo Sapiens
RAVHDFPQF

SEQ ID NO: 130237 - protein, 9 aa, Homo Sapiens
ALASCPTSM

SEQ ID NO: 130238 - protein, 9 aa, Homo Sapiens
SAPATLTQQ

SEQ ID NO: 130239 - protein, 9 aa, Homo Sapiens
RLNSHFSDL

SEQ ID NO: 130240 - protein, 9 aa, Homo Sapiens
AAAQPPRWH

SEQ ID NO: 130241 - protein, 9 aa, Homo Sapiens
FFQAGTLAR

SEQ ID NO: 130242 - protein, 9 aa, Homo Sapiens
ILEDGAADV

SEQ ID NO: 130243 - protein, 9 aa, Homo Sapiens
SYTRVPPLM

SEQ ID NO: 130244 - protein, 9 aa, Homo Sapiens
GFYVGWAEA

SEQ ID NO: 130245 - protein, 9 aa, Homo Sapiens
YELNFHRSP

SEQ ID NO: 130246 - protein, 9 aa, Homo Sapiens
SHRSAAALA

SEQ ID NO: 130247 - protein, 9 aa, Homo Sapiens
KRAELLEET

SEQ ID NO: 130248 - protein, 9 aa, Homo Sapiens
HSTLKCQLE

SEQ ID NO: 130249 - protein, 9 aa, Homo Sapiens
LSNSFGQMS

SEQ ID NO: 130250 - protein, 9 aa, Homo Sapiens
LVEKHLMRL

SEQ ID NO: 130251 - protein, 9 aa, Homo Sapiens
SPSSALANS

SEQ ID NO: 130252 - protein, 9 aa, Homo Sapiens
NTHLVGKEV

SEQ ID NO: 130253 - protein, 9 aa, Homo Sapiens
ILRALRVLR

SEQ ID NO: 130254 - protein, 9 aa, Homo Sapiens
IQQHVLLCL

SEQ ID NO: 130255 - protein, 9 aa, Homo Sapiens
EEEENGRKN

SEQ ID NO: 130256 - protein, 9 aa, Homo Sapiens
ALCNNTAEI

SEQ ID NO: 130257 - protein, 9 aa, Homo Sapiens
AADGEDAMA

SEQ ID NO: 130258 - protein, 9 aa, Homo Sapiens
KIKAKIKEV

SEQ ID NO: 130259 - protein, 9 aa, Homo Sapiens
LSSCPAPNR

SEQ ID NO: 130260 - protein, 9 aa, Homo Sapiens
IQKTRKQKY

SEQ ID NO: 130261 - protein, 9 aa, Homo Sapiens
WGWHWEGWW

SEQ ID NO: 130262 - protein, 9 aa, Homo Sapiens
PSPNSPQGT

SEQ ID NO: 130263 - protein, 9 aa, Homo Sapiens
TTTTSSPRR

SEQ ID NO: 130264 - protein, 9 aa, Homo Sapiens
RWAGILSLT

SEQ ID NO: 130265 - protein, 9 aa, Homo Sapiens
LQGFQQIKA

SEQ ID NO: 130266 - protein, 9 aa, Homo Sapiens
AADVGEAGA

SEQ ID NO: 130267 - protein, 9 aa, Homo Sapiens
ISQELMLKS

SEQ ID NO: 130268 - protein, 9 aa, Homo Sapiens
KDNISMHYF

SEQ ID NO: 130269 - protein, 9 aa, Homo Sapiens
VLHKMLMVY

SEQ ID NO: 130270 - protein, 9 aa, Homo Sapiens
TLFLGITDS

SEQ ID NO: 130271 - protein, 9 aa, Homo Sapiens
KAGKKCKPI

SEQ ID NO: 130272 - protein, 9 aa, Homo Sapiens
FKTSGPEKN

SEQ ID NO: 130273 - protein, 9 aa, Homo Sapiens
DLFRRTDGC

SEQ ID NO: 130274 - protein, 9 aa, Homo Sapiens
VMNVGSHSL

SEQ ID NO: 130275 - protein, 9 aa, Homo Sapiens
KKGWTAIEW

SEQ ID NO: 130276 - protein, 9 aa, Homo Sapiens
CKSHIVEAH

SEQ ID NO: 130277 - protein, 9 aa, Homo Sapiens
MVGQVCGQD

SEQ ID NO: 130278 - protein, 9 aa, Homo Sapiens
IAGFEYFEQ

SEQ ID NO: 130279 - protein, 9 aa, Homo Sapiens
QFCVKLSKK

SEQ ID NO: 130280 - protein, 9 aa, Homo Sapiens
WDDKKALEA

SEQ ID NO: 130281 - protein, 9 aa, Homo Sapiens
NGEAVSFQF

SEQ ID NO: 130282 - protein, 9 aa, Homo Sapiens
TNFLPLLVE

SEQ ID NO: 130283 - protein, 9 aa, Homo Sapiens
VWACAAAVT

SEQ ID NO: 130284 - protein, 9 aa, Homo Sapiens
PRSTLGAAL

SEQ ID NO: 130285 - protein, 9 aa, Homo Sapiens
HRSPRIRKR

SEQ ID NO: 130286 - protein, 9 aa, Homo Sapiens
VGHQKKILS

SEQ ID NO: 130287 - protein, 9 aa, Homo Sapiens
DRYLARHQR

SEQ ID NO: 130288 - protein, 9 aa, Homo Sapiens
LQKSEPSHQ

SEQ ID NO: 130289 - protein, 9 aa, Homo Sapiens
KSTSSTSFN

SEQ ID NO: 130290 - protein, 9 aa, Homo Sapiens
RSWRKQHLL

SEQ ID NO: 130291 - protein, 9 aa, Homo Sapiens
VWRRPKTPC

SEQ ID NO: 130292 - protein, 9 aa, Homo Sapiens
WAGAPATEV

SEQ ID NO: 130293 - protein, 9 aa, Homo Sapiens
ARWLHQPDW

SEQ ID NO: 130294 - protein, 9 aa, Homo Sapiens
LQSCLEAQK

SEQ ID NO: 130295 - protein, 9 aa, Homo Sapiens
DTLGSFPLY

SEQ ID NO: 130296 - protein, 9 aa, Homo Sapiens
TDIKTGYLS

SEQ ID NO: 130297 - protein, 9 aa, Homo Sapiens
AALQRLTWV

SEQ ID NO: 130298 - protein, 9 aa, Homo Sapiens
EADFCFRQC

SEQ ID NO: 130299 - protein, 9 aa, Homo Sapiens
LDPLHIRQH

SEQ ID NO: 130300 - protein, 9 aa, Homo Sapiens
RGAWFCWTS

SEQ ID NO: 130301 - protein, 9 aa, Homo Sapiens
LAGEEGGAA

SEQ ID NO: 130302 - protein, 9 aa, Homo Sapiens
KNTDVVTTL

SEQ ID NO: 130303 - protein, 9 aa, Homo Sapiens
ATIQQAIKA

SEQ ID NO: 130304 - protein, 9 aa, Homo Sapiens
CVPTREPQH

SEQ ID NO: 130305 - protein, 9 aa, Homo Sapiens
TDYSPEVIN

SEQ ID NO: 130306 - protein, 9 aa, Homo Sapiens
SEVWRRVWS

SEQ ID NO: 130307 - protein, 9 aa, Homo Sapiens
VKTWASLSN

SEQ ID NO: 130308 - protein, 9 aa, Homo Sapiens
TCPAFSAHS

SEQ ID NO: 130309 - protein, 9 aa, Homo Sapiens
PRDGRASHV

SEQ ID NO: 130310 - protein, 9 aa, Homo Sapiens
SIFFFLFNN

SEQ ID NO: 130311 - protein, 9 aa, Homo Sapiens
VESCWYFGV

SEQ ID NO: 130312 - protein, 9 aa, Homo Sapiens
NLQHLIANN

SEQ ID NO: 130313 - protein, 9 aa, Homo Sapiens
YINQSIPKR

SEQ ID NO: 130314 - protein, 9 aa, Homo Sapiens
LMNAAITEE

SEQ ID NO: 130315 - protein, 9 aa, Homo Sapiens
GVSCCPAPD

SEQ ID NO: 130316 - protein, 9 aa, Homo Sapiens
MSASVVSGI

SEQ ID NO: 130317 - protein, 9 aa, Homo Sapiens
PAARNLTSE

SEQ ID NO: 130318 - protein, 9 aa, Homo Sapiens
EDEEATNNG

SEQ ID NO: 130319 - protein, 9 aa, Homo Sapiens
YGGPAPGRP

SEQ ID NO: 130320 - protein, 9 aa, Homo Sapiens
SLYPGLNPR

SEQ ID NO: 130321 - protein, 9 aa, Homo Sapiens
KGDIICYYG

SEQ ID NO: 130322 - protein, 9 aa, Homo Sapiens
PGDGEDPGG

SEQ ID NO: 130323 - protein, 9 aa, Homo Sapiens
LIQQVLESG

SEQ ID NO: 130324 - protein, 9 aa, Homo Sapiens
APPPPQIEA

SEQ ID NO: 130325 - protein, 9 aa, Homo Sapiens
EFKISGHLQ

SEQ ID NO: 130326 - protein, 9 aa, Homo Sapiens
FLFRMTWKP

SEQ ID NO: 130327 - protein, 9 aa, Homo Sapiens
TMEATAHGL

SEQ ID NO: 130328 - protein, 9 aa, Homo Sapiens
KVLCAIQVV

SEQ ID NO: 130329 - protein, 9 aa, Homo Sapiens
EREPKPGPG

SEQ ID NO: 130330 - protein, 9 aa, Homo Sapiens
SSHLSHSSG

SEQ ID NO: 130331 - protein, 9 aa, Homo Sapiens
FCYLPKSRH

SEQ ID NO: 130332 - protein, 9 aa, Homo Sapiens
LYRSVIENV

SEQ ID NO: 130333 - protein, 9 aa, Homo Sapiens
RLDACCAWS

SEQ ID NO: 130334 - protein, 9 aa, Homo Sapiens
VLVCFPFSV

SEQ ID NO: 130335 - protein, 9 aa, Homo Sapiens
NMIMTMNPF

SEQ ID NO: 130336 - protein, 9 aa, Homo Sapiens
LQVITASSA

SEQ ID NO: 130337 - protein, 9 aa, Homo Sapiens
PPQQLHHPQ

SEQ ID NO: 130338 - protein, 9 aa, Homo Sapiens
SLQPEKPLV

SEQ ID NO: 130339 - protein, 9 aa, Homo Sapiens
SHSSTLTKH

SEQ ID NO: 130340 - protein, 9 aa, Homo Sapiens
TILKCARDL

SEQ ID NO: 130341 - protein, 9 aa, Homo Sapiens
ATLEKHFFT

SEQ ID NO: 130342 - protein, 9 aa, Homo Sapiens
QVITASSAN

SEQ ID NO: 130343 - protein, 9 aa, Homo Sapiens
GQPRFNDHK

SEQ ID NO: 130344 - protein, 9 aa, Homo Sapiens
CEALCFRRD

SEQ ID NO: 130345 - protein, 9 aa, Homo Sapiens
WTHLLQRCL

SEQ ID NO: 130346 - protein, 9 aa, Homo Sapiens
LAAVGTRIP

SEQ ID NO: 130347 - protein, 9 aa, Homo Sapiens
NVGKPSHLS

SEQ ID NO: 130348 - protein, 9 aa, Homo Sapiens
FQDNFTIIL

SEQ ID NO: 130349 - protein, 9 aa, Homo Sapiens
MTGVQPSAG

SEQ ID NO: 130350 - protein, 9 aa, Homo Sapiens
KETNFSDVN

SEQ ID NO: 130351 - protein, 9 aa, Homo Sapiens
DVAVEWESN

SEQ ID NO: 130352 - protein, 9 aa, Homo Sapiens
YNVEHSVGY

SEQ ID NO: 130353 - protein, 9 aa, Homo Sapiens
VEPNNCLTP

SEQ ID NO: 130354 - protein, 9 aa, Homo Sapiens
ITPVQSSTN

SEQ ID NO: 130355 - protein, 9 aa, Homo Sapiens
AVSAEGWLH

SEQ ID NO: 130356 - protein, 9 aa, Homo Sapiens
RLQALLSSI

SEQ ID NO: 130357 - protein, 9 aa, Homo Sapiens
CAMKFGSWT

SEQ ID NO: 130358 - protein, 9 aa, Homo Sapiens
RMFFDTLYD

SEQ ID NO: 130359 - protein, 9 aa, Homo Sapiens
MEQAIPLTR

SEQ ID NO: 130360 - protein, 9 aa, Homo Sapiens
TCGYHPIRF

SEQ ID NO: 130361 - protein, 9 aa, Homo Sapiens
AWVDKEFFS

SEQ ID NO: 130362 - protein, 9 aa, Homo Sapiens
ENISMLEKI

SEQ ID NO: 130363 - protein, 9 aa, Homo Sapiens
GSAVKKVVS

SEQ ID NO: 130364 - protein, 9 aa, Homo Sapiens
QLIQITSTS

SEQ ID NO: 130365 - protein, 9 aa, Homo Sapiens
TVLSKPTDY

SEQ ID NO: 130366 - protein, 9 aa, Homo Sapiens
SVQPTEGQG

SEQ ID NO: 130367 - protein, 9 aa, Homo Sapiens
RGKSFHNIA

SEQ ID NO: 130368 - protein, 9 aa, Homo Sapiens
TERIFELAR

SEQ ID NO: 130369 - protein, 9 aa, Homo Sapiens
EIRHRHSEH

SEQ ID NO: 130370 - protein, 9 aa, Homo Sapiens
MRRTNMIMT

SEQ ID NO: 130371 - protein, 9 aa, Homo Sapiens
AMLCAVLYP

SEQ ID NO: 130372 - protein, 9 aa, Homo Sapiens
PRLLFKLNT

SEQ ID NO: 130373 - protein, 9 aa, Homo Sapiens
AIQNQLAHI

SEQ ID NO: 130374 - protein, 9 aa, Homo Sapiens
LRDVLEVIA

SEQ ID NO: 130375 - protein, 9 aa, Homo Sapiens
ADGCSLEKL

SEQ ID NO: 130376 - protein, 9 aa, Homo Sapiens
SQQKKHLGK

SEQ ID NO: 130377 - protein, 9 aa, Homo Sapiens
PSVRSTRKV

SEQ ID NO: 130378 - protein, 9 aa, Homo Sapiens
RRRQRERVR

SEQ ID NO: 130379 - protein, 9 aa, Homo Sapiens
PAGEQDVEG

SEQ ID NO: 130380 - protein, 9 aa, Homo Sapiens
RTFERLQMN

SEQ ID NO: 130381 - protein, 9 aa, Homo Sapiens
AWVEGNSSI

SEQ ID NO: 130382 - protein, 9 aa, Homo Sapiens
PALRARGGT

SEQ ID NO: 130383 - protein, 9 aa, Homo Sapiens
KHYYKVDNS

SEQ ID NO: 130384 - protein, 9 aa, Homo Sapiens
HRATSNTEE

SEQ ID NO: 130385 - protein, 9 aa, Homo Sapiens
GYHPIRFYA

SEQ ID NO: 130386 - protein, 9 aa, Homo Sapiens
KSAQLNGLT

SEQ ID NO: 130387 - protein, 9 aa, Homo Sapiens
AQHDQRPPE

SEQ ID NO: 130388 - protein, 9 aa, Homo Sapiens
VVGEKMDLN

SEQ ID NO: 130389 - protein, 9 aa, Homo Sapiens
WWREHLTKF

SEQ ID NO: 130390 - protein, 9 aa, Homo Sapiens
NVFRLLISM

SEQ ID NO: 130391 - protein, 9 aa, Homo Sapiens
PEGLAPPAG

SEQ ID NO: 130392 - protein, 9 aa, Homo Sapiens
GLVRDIRRC

SEQ ID NO: 130393 - protein, 9 aa, Homo Sapiens
ASSFHTAVM

SEQ ID NO: 130394 - protein, 9 aa, Homo Sapiens
TAYFLLKGV

SEQ ID NO: 130395 - protein, 9 aa, Homo Sapiens
DFYVIHQEI

SEQ ID NO: 130396 - protein, 9 aa, Homo Sapiens
SDLLPGFPS

SEQ ID NO: 130397 - protein, 9 aa, Homo Sapiens
RKKDLYDVV

SEQ ID NO: 130398 - protein, 9 aa, Homo Sapiens
FREDSMMEY

SEQ ID NO: 130399 - protein, 9 aa, Homo Sapiens
VDIIRSPTM

SEQ ID NO: 130400 - protein, 9 aa, Homo Sapiens
WHLRVVPLL

SEQ ID NO: 130401 - protein, 9 aa, Homo Sapiens
VQSLDLPSD

SEQ ID NO: 130402 - protein, 9 aa, Homo Sapiens
HEVDEAAVD

SEQ ID NO: 130403 - protein, 9 aa, Homo Sapiens
DKKALEAAK

SEQ ID NO: 130404 - protein, 9 aa, Homo Sapiens
FQMKFYFRF

SEQ ID NO: 130405 - protein, 9 aa, Homo Sapiens
GLALAHSTA

SEQ ID NO: 130406 - protein, 9 aa, Homo Sapiens
RQCRYLESA

SEQ ID NO: 130407 - protein, 9 aa, Homo Sapiens
SRDIEEPIQ

SEQ ID NO: 130408 - protein, 9 aa, Homo Sapiens
LCGNHECAS

SEQ ID NO: 130409 - protein, 9 aa, Homo Sapiens
DFLRAQNST

SEQ ID NO: 130410 - protein, 9 aa, Homo Sapiens
WYLLAVDFT

SEQ ID NO: 130411 - protein, 9 aa, Homo Sapiens
VTSGDSPRG

SEQ ID NO: 130412 - protein, 9 aa, Homo Sapiens
LKTGHFEEA

SEQ ID NO: 130413 - protein, 9 aa, Homo Sapiens
LPMFQPTWK

SEQ ID NO: 130414 - protein, 9 aa, Homo Sapiens
HLPTTMGAT

SEQ ID NO: 130415 - protein, 9 aa, Homo Sapiens
TEEALAWLH

SEQ ID NO: 130416 - protein, 9 aa, Homo Sapiens
QPAEAVGHH

SEQ ID NO: 130417 - protein, 9 aa, Homo Sapiens
LLCLAVFRV

SEQ ID NO: 130418 - protein, 9 aa, Homo Sapiens
TVNYFTNIQ

SEQ ID NO: 130419 - protein, 9 aa, Homo Sapiens
HRSRAAGTE

SEQ ID NO: 130420 - protein, 9 aa, Homo Sapiens
RIALQYHKW

SEQ ID NO: 130421 - protein, 9 aa, Homo Sapiens
TSTVSPSLR

SEQ ID NO: 130422 - protein, 9 aa, Homo Sapiens
GMKLSILRS

SEQ ID NO: 130423 - protein, 9 aa, Homo Sapiens
EVGPPPAHA

SEQ ID NO: 130424 - protein, 9 aa, Homo Sapiens
SGTHQMRTA

SEQ ID NO: 130425 - protein, 9 aa, Homo Sapiens
VTQATPQGA

SEQ ID NO: 130426 - protein, 9 aa, Homo Sapiens
AAAAQPPRW

SEQ ID NO: 130427 - protein, 9 aa, Homo Sapiens
PPTSCPSWS

SEQ ID NO: 130428 - protein, 9 aa, Homo Sapiens
ETPLNKLRV

SEQ ID NO: 130429 - protein, 9 aa, Homo Sapiens
LKQQEKQKT

SEQ ID NO: 130430 - protein, 9 aa, Homo Sapiens
YYNAMKKIG

SEQ ID NO: 130431 - protein, 9 aa, Homo Sapiens
NMYQANGAY

SEQ ID NO: 130432 - protein, 9 aa, Homo Sapiens
SPPLQDGSL

SEQ ID NO: 130433 - protein, 9 aa, Homo Sapiens
AHSTATCSR

SEQ ID NO: 130434 - protein, 9 aa, Homo Sapiens
RTCKPRCTG

SEQ ID NO: 130435 - protein, 9 aa, Homo Sapiens
TQTYPMVHL

SEQ ID NO: 130436 - protein, 9 aa, Homo Sapiens
LFLAGVPKG

SEQ ID NO: 130437 - protein, 9 aa, Homo Sapiens
LLLHSNCLV

SEQ ID NO: 130438 - protein, 9 aa, Homo Sapiens
FLPLLVEVQ

SEQ ID NO: 130439 - protein, 9 aa, Homo Sapiens
FHTAVMNQY

SEQ ID NO: 130440 - protein, 9 aa, Homo Sapiens
TNFSDVNTN

SEQ ID NO: 130441 - protein, 9 aa, Homo Sapiens
EYECLTGRV

SEQ ID NO: 130442 - protein, 9 aa, Homo Sapiens
AQPPGEGKG

SEQ ID NO: 130443 - protein, 9 aa, Homo Sapiens
NPLVSLARR

SEQ ID NO: 130444 - protein, 9 aa, Homo Sapiens
GIDFGVVSS

SEQ ID NO: 130445 - protein, 9 aa, Homo Sapiens
SCSNIMKPT

SEQ ID NO: 130446 - protein, 9 aa, Homo Sapiens
RAPKEGHRQ

SEQ ID NO: 130447 - protein, 9 aa, Homo Sapiens
KKKVYALKV

SEQ ID NO: 130448 - protein, 9 aa, Homo Sapiens
VVTAFPSPA

SEQ ID NO: 130449 - protein, 9 aa, Homo Sapiens
CYGMTLDEE

SEQ ID NO: 130450 - protein, 9 aa, Homo Sapiens
VLGLLLLMW

SEQ ID NO: 130451 - protein, 9 aa, Homo Sapiens
RESTSHYWI

SEQ ID NO: 130452 - protein, 9 aa, Homo Sapiens
CKPRCTGSR

SEQ ID NO: 130453 - protein, 9 aa, Homo Sapiens
SNNPRDEIA

SEQ ID NO: 130454 - protein, 9 aa, Homo Sapiens
MPNAVDRDA

SEQ ID NO: 130455 - protein, 9 aa, Homo Sapiens
GRNPKRRQS

SEQ ID NO: 130456 - protein, 9 aa, Homo Sapiens
SRRNRSSSN

SEQ ID NO: 130457 - protein, 9 aa, Homo Sapiens
ERSQHRFRG

SEQ ID NO: 130458 - protein, 9 aa, Homo Sapiens
IRTRASGRH

SEQ ID NO: 130459 - protein, 9 aa, Homo Sapiens
QVRSRESNK

SEQ ID NO: 130460 - protein, 9 aa, Homo Sapiens
AEGWLHLFD

SEQ ID NO: 130461 - protein, 9 aa, Homo Sapiens
SILCTLIVF

SEQ ID NO: 130462 - protein, 9 aa, Homo Sapiens
YSSSVDFSL

SEQ ID NO: 130463 - protein, 9 aa, Homo Sapiens
YAVKIINTK

SEQ ID NO: 130464 - protein, 9 aa, Homo Sapiens
TPASSRVQT

SEQ ID NO: 130465 - protein, 9 aa, Homo Sapiens
MTTCCRPSC

SEQ ID NO: 130466 - protein, 9 aa, Homo Sapiens
IQHALIVLP

SEQ ID NO: 130467 - protein, 9 aa, Homo Sapiens
ISRVEKMMT

SEQ ID NO: 130468 - protein, 9 aa, Homo Sapiens
QKIKLIRPQ

SEQ ID NO: 130469 - protein, 9 aa, Homo Sapiens
LENAISQLL

SEQ ID NO: 130470 - protein, 9 aa, Homo Sapiens
LEWSLMKVS

SEQ ID NO: 130471 - protein, 9 aa, Homo Sapiens
HCLGDPGLF

SEQ ID NO: 130472 - protein, 9 aa, Homo Sapiens
YLYTVVAFI

SEQ ID NO: 130473 - protein, 9 aa, Homo Sapiens
AVAKALTNL

SEQ ID NO: 130474 - protein, 9 aa, Homo Sapiens
CHVTRAKVS

SEQ ID NO: 130475 - protein, 9 aa, Homo Sapiens
QVVTQATPQ

SEQ ID NO: 130476 - protein, 9 aa, Homo Sapiens
TGAPQCPPP

SEQ ID NO: 130477 - protein, 9 aa, Homo Sapiens
INVDPAGDS

SEQ ID NO: 130478 - protein, 9 aa, Homo Sapiens
DMQLYDYTK

SEQ ID NO: 130479 - protein, 9 aa, Homo Sapiens
LGFTSDHHC

SEQ ID NO: 130480 - protein, 9 aa, Homo Sapiens
CGKVFTQSS

SEQ ID NO: 130481 - protein, 9 aa, Homo Sapiens
WNTERDQTD

SEQ ID NO: 130482 - protein, 9 aa, Homo Sapiens
QATRARSLR

SEQ ID NO: 130483 - protein, 9 aa, Homo Sapiens
AGGHRQRWG

SEQ ID NO: 130484 - protein, 9 aa, Homo Sapiens
GQREDLQAV

SEQ ID NO: 130485 - protein, 9 aa, Homo Sapiens
HEQEVAMRE

SEQ ID NO: 130486 - protein, 9 aa, Homo Sapiens
ENKFQMENS

SEQ ID NO: 130487 - protein, 9 aa, Homo Sapiens
LPALGLVRE

SEQ ID NO: 130488 - protein, 9 aa, Homo Sapiens
GKKQKCIKP

SEQ ID NO: 130489 - protein, 9 aa, Homo Sapiens
RMKHHYKSC

SEQ ID NO: 130490 - protein, 9 aa, Homo Sapiens
INSVNLDSL

SEQ ID NO: 130491 - protein, 9 aa, Homo Sapiens
PGPRPGSPR

SEQ ID NO: 130492 - protein, 9 aa, Homo Sapiens
TLTNSCLIS

SEQ ID NO: 130493 - protein, 9 aa, Homo Sapiens
GYSVAAMFR

SEQ ID NO: 130494 - protein, 9 aa, Homo Sapiens
NPLCRGSTS

SEQ ID NO: 130495 - protein, 9 aa, Homo Sapiens
LLRLQQRLE

SEQ ID NO: 130496 - protein, 9 aa, Homo Sapiens
RQPREPTKM

SEQ ID NO: 130497 - protein, 9 aa, Homo Sapiens
ALGMLLALV

SEQ ID NO: 130498 - protein, 9 aa, Homo Sapiens
THRVAQVHS

SEQ ID NO: 130499 - protein, 9 aa, Homo Sapiens
CLEMHMRGL

SEQ ID NO: 130500 - protein, 9 aa, Homo Sapiens
TPTQKILTK

SEQ ID NO: 130501 - protein, 9 aa, Homo Sapiens
YIVAQYNTT

SEQ ID NO: 130502 - protein, 9 aa, Homo Sapiens
IFFQQLRVR

SEQ ID NO: 130503 - protein, 9 aa, Homo Sapiens
EAGAARRSQ

SEQ ID NO: 130504 - protein, 9 aa, Homo Sapiens
QLHVRRAAL

SEQ ID NO: 130505 - protein, 9 aa, Homo Sapiens
CQRFPTLTV

SEQ ID NO: 130506 - protein, 9 aa, Homo Sapiens
KDPPAMRRP

SEQ ID NO: 130507 - protein, 9 aa, Homo Sapiens
DELPPRAAP

SEQ ID NO: 130508 - protein, 9 aa, Homo Sapiens
CHVRIAGFD

SEQ ID NO: 130509 - protein, 9 aa, Homo Sapiens
FSKLQNTTK

SEQ ID NO: 130510 - protein, 9 aa, Homo Sapiens
GVCKVNTDL

SEQ ID NO: 130511 - protein, 9 aa, Homo Sapiens
RTLWWKKTV

SEQ ID NO: 130512 - protein, 9 aa, Homo Sapiens
GSSLMVDSD

SEQ ID NO: 130513 - protein, 9 aa, Homo Sapiens
MSLQKTNEE

SEQ ID NO: 130514 - protein, 9 aa, Homo Sapiens
EFEELVILG

SEQ ID NO: 130515 - protein, 9 aa, Homo Sapiens
PPPGAAGRR

SEQ ID NO: 130516 - protein, 9 aa, Homo Sapiens
QIMGKQLHM

SEQ ID NO: 130517 - protein, 9 aa, Homo Sapiens
DYVPQKFHG

SEQ ID NO: 130518 - protein, 9 aa, Homo Sapiens
LLCDTQEGY

SEQ ID NO: 130519 - protein, 9 aa, Homo Sapiens
SVWNASRPP

SEQ ID NO: 130520 - protein, 9 aa, Homo Sapiens
EGNCSNYPA

SEQ ID NO: 130521 - protein, 9 aa, Homo Sapiens
VFNQQVHLA

SEQ ID NO: 130522 - protein, 9 aa, Homo Sapiens
TEHTPALPG

SEQ ID NO: 130523 - protein, 9 aa, Homo Sapiens
TREVTARAT

SEQ ID NO: 130524 - protein, 9 aa, Homo Sapiens
LEKEELPRV

SEQ ID NO: 130525 - protein, 9 aa, Homo Sapiens
YEDVLVSLE

SEQ ID NO: 130526 - protein, 9 aa, Homo Sapiens
PPSRPPSSS

SEQ ID NO: 130527 - protein, 9 aa, Homo Sapiens
ITRARKGRE

SEQ ID NO: 130528 - protein, 9 aa, Homo Sapiens
IDMKHMSQN

SEQ ID NO: 130529 - protein, 9 aa, Homo Sapiens
LQIDMKHMS

SEQ ID NO: 130530 - protein, 9 aa, Homo Sapiens
PPHGGGGGE

SEQ ID NO: 130531 - protein, 9 aa, Homo Sapiens
QPWSPTLPR

SEQ ID NO: 130532 - protein, 9 aa, Homo Sapiens
QRAQALAVN

SEQ ID NO: 130533 - protein, 9 aa, Homo Sapiens
CERSPSPLR

SEQ ID NO: 130534 - protein, 9 aa, Homo Sapiens
WMSFAQTGI

SEQ ID NO: 130535 - protein, 9 aa, Homo Sapiens
LTREKIKAK

SEQ ID NO: 130536 - protein, 9 aa, Homo Sapiens
SLTCGKPTQ

SEQ ID NO: 130537 - protein, 9 aa, Homo Sapiens
QRCGWWRLL

SEQ ID NO: 130538 - protein, 9 aa, Homo Sapiens
RDIEEPIQV

SEQ ID NO: 130539 - protein, 9 aa, Homo Sapiens
VKGLVQRVF

SEQ ID NO: 130540 - protein, 9 aa, Homo Sapiens
AHAVDIWSL

SEQ ID NO: 130541 - protein, 9 aa, Homo Sapiens
DMKKLNMLM

SEQ ID NO: 130542 - protein, 9 aa, Homo Sapiens
DRIEDFFGA

SEQ ID NO: 130543 - protein, 9 aa, Homo Sapiens
SVATSFQSQ

SEQ ID NO: 130544 - protein, 9 aa, Homo Sapiens
QGAGAAAGA

SEQ ID NO: 130545 - protein, 9 aa, Homo Sapiens
RRTNMIMTM

SEQ ID NO: 130546 - protein, 9 aa, Homo Sapiens
EICLKCTSV

SEQ ID NO: 130547 - protein, 9 aa, Homo Sapiens
ALCSGPRPR

SEQ ID NO: 130548 - protein, 9 aa, Homo Sapiens
EHKNNLVSG

SEQ ID NO: 130549 - protein, 9 aa, Homo Sapiens
QCANSPRET

SEQ ID NO: 130550 - protein, 9 aa, Homo Sapiens
ASLMITRAR

SEQ ID NO: 130551 - protein, 9 aa, Homo Sapiens
FRPAEFLPF

SEQ ID NO: 130552 - protein, 9 aa, Homo Sapiens
AAPANKHRA

SEQ ID NO: 130553 - protein, 9 aa, Homo Sapiens
WLLDVEPVH

SEQ ID NO: 130554 - protein, 9 aa, Homo Sapiens
AVGGMRRGN

SEQ ID NO: 130555 - protein, 9 aa, Homo Sapiens
HKNQQLTLQ

SEQ ID NO: 130556 - protein, 9 aa, Homo Sapiens
PLGKMCLSV

SEQ ID NO: 130557 - protein, 9 aa, Homo Sapiens
EEVFGAQEC

SEQ ID NO: 130558 - protein, 9 aa, Homo Sapiens
GGPGQAAGR

SEQ ID NO: 130559 - protein, 9 aa, Homo Sapiens
RRGRLPNNN

SEQ ID NO: 130560 - protein, 9 aa, Homo Sapiens
VHRTKPRGE

SEQ ID NO: 130561 - protein, 9 aa, Homo Sapiens
THTREKPFK

SEQ ID NO: 130562 - protein, 9 aa, Homo Sapiens
GTPGSGTSG

SEQ ID NO: 130563 - protein, 9 aa, Homo Sapiens
SLMKVHQEN

SEQ ID NO: 130564 - protein, 9 aa, Homo Sapiens
GAEDEPPRM

SEQ ID NO: 130565 - protein, 9 aa, Homo Sapiens
STLKLHRRI

SEQ ID NO: 130566 - protein, 9 aa, Homo Sapiens
KAGRSRGQE

SEQ ID NO: 130567 - protein, 9 aa, Homo Sapiens
CCKPSCCMT

SEQ ID NO: 130568 - protein, 9 aa, Homo Sapiens
GDLATEKEV

SEQ ID NO: 130569 - protein, 9 aa, Homo Sapiens
PNLYRIRQS

SEQ ID NO: 130570 - protein, 9 aa, Homo Sapiens
GSNEPGKRS

SEQ ID NO: 130571 - protein, 9 aa, Homo Sapiens
CRYRQVITV

SEQ ID NO: 130572 - protein, 9 aa, Homo Sapiens
NSSIKCDRC

SEQ ID NO: 130573 - protein, 9 aa, Homo Sapiens
ANHSPVKAS

SEQ ID NO: 130574 - protein, 9 aa, Homo Sapiens
KGEDQVHII

SEQ ID NO: 130575 - protein, 9 aa, Homo Sapiens
SLCGPSQRG

SEQ ID NO: 130576 - protein, 9 aa, Homo Sapiens
WVMMDTSKR

SEQ ID NO: 130577 - protein, 9 aa, Homo Sapiens
DTTLFEIYA

SEQ ID NO: 130578 - protein, 9 aa, Homo Sapiens
RSLVLQIDM

SEQ ID NO: 130579 - protein, 9 aa, Homo Sapiens
DCRGCVLVH

SEQ ID NO: 130580 - protein, 9 aa, Homo Sapiens
VRQGLLLAV

SEQ ID NO: 130581 - protein, 9 aa, Homo Sapiens
PCGPPPTMV

SEQ ID NO: 130582 - protein, 9 aa, Homo Sapiens
PDFHMAPNG

SEQ ID NO: 130583 - protein, 9 aa, Homo Sapiens
IGDLHVVHH

SEQ ID NO: 130584 - protein, 9 aa, Homo Sapiens
IFFFLFNNF

SEQ ID NO: 130585 - protein, 9 aa, Homo Sapiens
ICRHNLDIE

SEQ ID NO: 130586 - protein, 9 aa, Homo Sapiens
GDGEDPGGA

SEQ ID NO: 130587 - protein, 9 aa, Homo Sapiens
FETSTYPKD

SEQ ID NO: 130588 - protein, 9 aa, Homo Sapiens
YLFVVVDFF

SEQ ID NO: 130589 - protein, 9 aa, Homo Sapiens
ILNRYSGTQ

SEQ ID NO: 130590 - protein, 9 aa, Homo Sapiens
YDFPQKFHT

SEQ ID NO: 130591 - protein, 9 aa, Homo Sapiens
TLPELCSHQ

SEQ ID NO: 130592 - protein, 9 aa, Homo Sapiens
NAINFPRNK

SEQ ID NO: 130593 - protein, 9 aa, Homo Sapiens
EMSLQKTNE

SEQ ID NO: 130594 - protein, 9 aa, Homo Sapiens
YGKKVVVVK

SEQ ID NO: 130595 - protein, 9 aa, Homo Sapiens
PKNALWRKA

SEQ ID NO: 130596 - protein, 9 aa, Homo Sapiens
HAKETWNCW

SEQ ID NO: 130597 - protein, 9 aa, Homo Sapiens
DPEQPGDGE

SEQ ID NO: 130598 - protein, 9 aa, Homo Sapiens
GSSTASAAT

SEQ ID NO: 130599 - protein, 9 aa, Homo Sapiens
KQRTLFLGI

SEQ ID NO: 130600 - protein, 9 aa, Homo Sapiens
DGAFKTSEL

SEQ ID NO: 130601 - protein, 9 aa, Homo Sapiens
RRSRRSKAS

SEQ ID NO: 130602 - protein, 9 aa, Homo Sapiens
AHPCPLPLK

SEQ ID NO: 130603 - protein, 9 aa, Homo Sapiens
PKFRLASVD

SEQ ID NO: 130604 - protein, 9 aa, Homo Sapiens
HLQYMWWYH

SEQ ID NO: 130605 - protein, 9 aa, Homo Sapiens
EKRQGLYLT

SEQ ID NO: 130606 - protein, 9 aa, Homo Sapiens
RNYVPWWAT

SEQ ID NO: 130607 - protein, 9 aa, Homo Sapiens
PTSTTSTTG

SEQ ID NO: 130608 - protein, 9 aa, Homo Sapiens
PGATLTSTS

SEQ ID NO: 130609 - protein, 9 aa, Homo Sapiens
TDKEFHAPL

SEQ ID NO: 130610 - protein, 9 aa, Homo Sapiens
VALLEDVDL

SEQ ID NO: 130611 - protein, 9 aa, Homo Sapiens
REPRGLGLS

SEQ ID NO: 130612 - protein, 9 aa, Homo Sapiens
DFLRIMPTQ

SEQ ID NO: 130613 - protein, 9 aa, Homo Sapiens
LQNLMRTMG

SEQ ID NO: 130614 - protein, 9 aa, Homo Sapiens
RNKHEVDEA

SEQ ID NO: 130615 - protein, 9 aa, Homo Sapiens
ESREFNPGS

SEQ ID NO: 130616 - protein, 9 aa, Homo Sapiens
GKQLHMHLV

SEQ ID NO: 130617 - protein, 9 aa, Homo Sapiens
DVKDPSNAA

SEQ ID NO: 130618 - protein, 9 aa, Homo Sapiens
SHYWITVFA

SEQ ID NO: 130619 - protein, 9 aa, Homo Sapiens
DFQINVDPA

SEQ ID NO: 130620 - protein, 9 aa, Homo Sapiens
KEMSLQKTN

SEQ ID NO: 130621 - protein, 9 aa, Homo Sapiens
HQRPAARNL

SEQ ID NO: 130622 - protein, 9 aa, Homo Sapiens
PAGVSCCPA

SEQ ID NO: 130623 - protein, 9 aa, Homo Sapiens
IGVNGSHRL

SEQ ID NO: 130624 - protein, 9 aa, Homo Sapiens
HTGNPPVTY

SEQ ID NO: 130625 - protein, 9 aa, Homo Sapiens
ACGLGWEGP

SEQ ID NO: 130626 - protein, 9 aa, Homo Sapiens
IEGLALSLA

SEQ ID NO: 130627 - protein, 9 aa, Homo Sapiens
DQSSLVVTQ

SEQ ID NO: 130628 - protein, 9 aa, Homo Sapiens
GVNGSHRLD

SEQ ID NO: 130629 - protein, 9 aa, Homo Sapiens
GPRSTLGAA

SEQ ID NO: 130630 - protein, 9 aa, Homo Sapiens
RSSISVILK

SEQ ID NO: 130631 - protein, 9 aa, Homo Sapiens
NAITCIFFT

SEQ ID NO: 130632 - protein, 9 aa, Homo Sapiens
PTQNSVREP

SEQ ID NO: 130633 - protein, 9 aa, Homo Sapiens
TTQRSCGSG

SEQ ID NO: 130634 - protein, 9 aa, Homo Sapiens
EKEELPRVV

SEQ ID NO: 130635 - protein, 9 aa, Homo Sapiens
VFCLLCWEA

SEQ ID NO: 130636 - protein, 9 aa, Homo Sapiens
CPPGFYNVS

SEQ ID NO: 130637 - protein, 9 aa, Homo Sapiens
LDTPDVENL

SEQ ID NO: 130638 - protein, 9 aa, Homo Sapiens
PSSSPPIKN

SEQ ID NO: 130639 - protein, 9 aa, Homo Sapiens
ERKSGGERE

SEQ ID NO: 130640 - protein, 9 aa, Homo Sapiens
NDIMSLGIH

SEQ ID NO: 130641 - protein, 9 aa, Homo Sapiens
CSDFCHHCG

SEQ ID NO: 130642 - protein, 9 aa, Homo Sapiens
WPLAQHVDA

SEQ ID NO: 130643 - protein, 9 aa, Homo Sapiens
SLLKTLLKM

SEQ ID NO: 130644 - protein, 9 aa, Homo Sapiens
RKFHRPTGL

SEQ ID NO: 130645 - protein, 9 aa, Homo Sapiens
FIVKRHYAF

SEQ ID NO: 130646 - protein, 9 aa, Homo Sapiens
FRGHLERVV

SEQ ID NO: 130647 - protein, 9 aa, Homo Sapiens
VWTQLEHLR

SEQ ID NO: 130648 - protein, 9 aa, Homo Sapiens
LHFLACPFL

SEQ ID NO: 130649 - protein, 9 aa, Homo Sapiens
EKRVYIPLP

SEQ ID NO: 130650 - protein, 9 aa, Homo Sapiens
SLDSRVVLD

SEQ ID NO: 130651 - protein, 9 aa, Homo Sapiens
PGSEVAIMA

SEQ ID NO: 130652 - protein, 9 aa, Homo Sapiens
IETSLSFGK

SEQ ID NO: 130653 - protein, 9 aa, Homo Sapiens
YSQVFQNHL

SEQ ID NO: 130654 - protein, 9 aa, Homo Sapiens
PVADPEQPG

SEQ ID NO: 130655 - protein, 9 aa, Homo Sapiens
RTTRSQQHT

SEQ ID NO: 130656 - protein, 9 aa, Homo Sapiens
EKGSRKNVF

SEQ ID NO: 130657 - protein, 9 aa, Homo Sapiens
PLMWKLGWS

SEQ ID NO: 130658 - protein, 9 aa, Homo Sapiens
MELDSSLPE

SEQ ID NO: 130659 - protein, 9 aa, Homo Sapiens
GWGPNGKER

SEQ ID NO: 130660 - protein, 9 aa, Homo Sapiens
TRASGRHTT

SEQ ID NO: 130661 - protein, 9 aa, Homo Sapiens
STPKRPRTA

SEQ ID NO: 130662 - protein, 9 aa, Homo Sapiens
APATLTQQT

SEQ ID NO: 130663 - protein, 9 aa, Homo Sapiens
RQQLGAWGS

SEQ ID NO: 130664 - protein, 9 aa, Homo Sapiens
PCNEYGKAF

SEQ ID NO: 130665 - protein, 9 aa, Homo Sapiens
NNPRAVCTA

SEQ ID NO: 130666 - protein, 9 aa, Homo Sapiens
PYLNLDTWT

SEQ ID NO: 130667 - protein, 9 aa, Homo Sapiens
EEYPCSSKV

SEQ ID NO: 130668 - protein, 9 aa, Homo Sapiens
PYVNTVGGT

SEQ ID NO: 130669 - protein, 9 aa, Homo Sapiens
ATVRPGTQA

SEQ ID NO: 130670 - protein, 9 aa, Homo Sapiens
FVCQNLHDV

SEQ ID NO: 130671 - protein, 9 aa, Homo Sapiens
SEPSHQNSL

SEQ ID NO: 130672 - protein, 9 aa, Homo Sapiens
NDELSHINT

SEQ ID NO: 130673 - protein, 9 aa, Homo Sapiens
REHLTKFNV

SEQ ID NO: 130674 - protein, 9 aa, Homo Sapiens
QNDTTENET

SEQ ID NO: 130675 - protein, 9 aa, Homo Sapiens
VRAIGADSS

SEQ ID NO: 130676 - protein, 9 aa, Homo Sapiens
RLKAWWKKH

SEQ ID NO: 130677 - protein, 9 aa, Homo Sapiens
ELGARAKGF

SEQ ID NO: 130678 - protein, 9 aa, Homo Sapiens
WVRREDSAP

SEQ ID NO: 130679 - protein, 9 aa, Homo Sapiens
GARPVGMLG

SEQ ID NO: 130680 - protein, 9 aa, Homo Sapiens
WHHTFYKRA

SEQ ID NO: 130681 - protein, 9 aa, Homo Sapiens
RPVPDGDGK

SEQ ID NO: 130682 - protein, 9 aa, Homo Sapiens
WLWLALNDG

SEQ ID NO: 130683 - protein, 9 aa, Homo Sapiens
RVRAIGADS

SEQ ID NO: 130684 - protein, 9 aa, Homo Sapiens
SHLVIVQRV

SEQ ID NO: 130685 - protein, 9 aa, Homo Sapiens
EFFSDWFHH

SEQ ID NO: 130686 - protein, 9 aa, Homo Sapiens
HSQPADFLL

SEQ ID NO: 130687 - protein, 9 aa, Homo Sapiens
QPGPIKPKV

SEQ ID NO: 130688 - protein, 9 aa, Homo Sapiens
YRISMQCVT

SEQ ID NO: 130689 - protein, 9 aa, Homo Sapiens
LVPAAPPKC

SEQ ID NO: 130690 - protein, 9 aa, Homo Sapiens
RFSNENYVP

SEQ ID NO: 130691 - protein, 9 aa, Homo Sapiens
LLFFTNKMK

SEQ ID NO: 130692 - protein, 9 aa, Homo Sapiens
RVTRSRGTP

SEQ ID NO: 130693 - protein, 9 aa, Homo Sapiens
HAMGGFDGY

SEQ ID NO: 130694 - protein, 9 aa, Homo Sapiens
SMKDKAGKK

SEQ ID NO: 130695 - protein, 9 aa, Homo Sapiens
AAFFKAWTI

SEQ ID NO: 130696 - protein, 9 aa, Homo Sapiens
GLAAPMYTD

SEQ ID NO: 130697 - protein, 9 aa, Homo Sapiens
FFQVLPPCS

SEQ ID NO: 130698 - protein, 9 aa, Homo Sapiens
IENVIEGVR

SEQ ID NO: 130699 - protein, 9 aa, Homo Sapiens
GGGGEAATA

SEQ ID NO: 130700 - protein, 9 aa, Homo Sapiens
KINEVVQVH

SEQ ID NO: 130701 - protein, 9 aa, Homo Sapiens
PRKEENQAV

SEQ ID NO: 130702 - protein, 9 aa, Homo Sapiens
RLNRWLSLQ

SEQ ID NO: 130703 - protein, 9 aa, Homo Sapiens
SCPTSMLIL

SEQ ID NO: 130704 - protein, 9 aa, Homo Sapiens
EWPGWCLVR

SEQ ID NO: 130705 - protein, 9 aa, Homo Sapiens
YTVDAPHGI

SEQ ID NO: 130706 - protein, 9 aa, Homo Sapiens
ETESGVTLQ

SEQ ID NO: 130707 - protein, 9 aa, Homo Sapiens
KRKKREKII

SEQ ID NO: 130708 - protein, 9 aa, Homo Sapiens
SFYTNPLPG

SEQ ID NO: 130709 - protein, 9 aa, Homo Sapiens
HLCNNEEQV

SEQ ID NO: 130710 - protein, 9 aa, Homo Sapiens
RLDHVHRIG

SEQ ID NO: 130711 - protein, 9 aa, Homo Sapiens
EFKEKCHIC

SEQ ID NO: 130712 - protein, 9 aa, Homo Sapiens
VKPYNCEEC

SEQ ID NO: 130713 - protein, 9 aa, Homo Sapiens
REKIKAKIK

SEQ ID NO: 130714 - protein, 9 aa, Homo Sapiens
VILGQGTRG

SEQ ID NO: 130715 - protein, 9 aa, Homo Sapiens
IFLGAPHPS

SEQ ID NO: 130716 - protein, 9 aa, Homo Sapiens
PVWNNPRAV

SEQ ID NO: 130717 - protein, 9 aa, Homo Sapiens
SHAIGKNST

SEQ ID NO: 130718 - protein, 9 aa, Homo Sapiens
IVALMSSTI

SEQ ID NO: 130719 - protein, 9 aa, Homo Sapiens
SLFFVMMKG

SEQ ID NO: 130720 - protein, 9 aa, Homo Sapiens
RAKLLACDD

SEQ ID NO: 130721 - protein, 9 aa, Homo Sapiens
VAILFSGAL

SEQ ID NO: 130722 - protein, 9 aa, Homo Sapiens
ANPPHTIQV

SEQ ID NO: 130723 - protein, 9 aa, Homo Sapiens
EGCTYDCPC

SEQ ID NO: 130724 - protein, 9 aa, Homo Sapiens
ACPGHVDAA

SEQ ID NO: 130725 - protein, 9 aa, Homo Sapiens
QDHGIQSMR

SEQ ID NO: 130726 - protein, 9 aa, Homo Sapiens
EAVGHHNDD

SEQ ID NO: 130727 - protein, 9 aa, Homo Sapiens
SDELPPRAA

SEQ ID NO: 130728 - protein, 9 aa, Homo Sapiens
IHNFCLVSK

SEQ ID NO: 130729 - protein, 9 aa, Homo Sapiens
YMSHLGIWG

SEQ ID NO: 130730 - protein, 9 aa, Homo Sapiens
NRFLDLTDT

SEQ ID NO: 130731 - protein, 9 aa, Homo Sapiens
VDLSTRVVD

SEQ ID NO: 130732 - protein, 9 aa, Homo Sapiens
HLDAIGPRE

SEQ ID NO: 130733 - protein, 9 aa, Homo Sapiens
VYTGSEFYT

SEQ ID NO: 130734 - protein, 9 aa, Homo Sapiens
ECHVRIAGF

SEQ ID NO: 130735 - protein, 9 aa, Homo Sapiens
TGDMESVMA

SEQ ID NO: 130736 - protein, 9 aa, Homo Sapiens
EVTCQLQAT

SEQ ID NO: 130737 - protein, 9 aa, Homo Sapiens
HLQPPGERL

SEQ ID NO: 130738 - protein, 9 aa, Homo Sapiens
APAPPALGP

SEQ ID NO: 130739 - protein, 9 aa, Homo Sapiens
GQRLALEVL

SEQ ID NO: 130740 - protein, 9 aa, Homo Sapiens
TLQSMLISG

SEQ ID NO: 130741 - protein, 9 aa, Homo Sapiens
QEQRHVALQ

SEQ ID NO: 130742 - protein, 9 aa, Homo Sapiens
SMNLMNELK

SEQ ID NO: 130743 - protein, 9 aa, Homo Sapiens
EPFPLVGLA

SEQ ID NO: 130744 - protein, 9 aa, Homo Sapiens
AAEPFLTQA

SEQ ID NO: 130745 - protein, 9 aa, Homo Sapiens
AAGDLDAAI

SEQ ID NO: 130746 - protein, 9 aa, Homo Sapiens
SSTNLLTLS

SEQ ID NO: 130747 - protein, 9 aa, Homo Sapiens
IAYFSWAGL

SEQ ID NO: 130748 - protein, 9 aa, Homo Sapiens
PIRKYQDLE

SEQ ID NO: 130749 - protein, 9 aa, Homo Sapiens
CVWQLYGVR

SEQ ID NO: 130750 - protein, 9 aa, Homo Sapiens
LFSVSFSQI

SEQ ID NO: 130751 - protein, 9 aa, Homo Sapiens
REHLSVVRL

SEQ ID NO: 130752 - protein, 9 aa, Homo Sapiens
NDNYCLQIN

SEQ ID NO: 130753 - protein, 9 aa, Homo Sapiens
RSSTATLHV

SEQ ID NO: 130754 - protein, 9 aa, Homo Sapiens
DGHGRVILG

SEQ ID NO: 130755 - protein, 9 aa, Homo Sapiens
AKGDIICYY

SEQ ID NO: 130756 - protein, 9 aa, Homo Sapiens
LAVLEFPVC

SEQ ID NO: 130757 - protein, 9 aa, Homo Sapiens
TDASRTMLF

SEQ ID NO: 130758 - protein, 9 aa, Homo Sapiens
LSKKNQEIL

SEQ ID NO: 130759 - protein, 9 aa, Homo Sapiens
FLLKGVPLQ

SEQ ID NO: 130760 - protein, 9 aa, Homo Sapiens
RPSIRIQTS

SEQ ID NO: 130761 - protein, 9 aa, Homo Sapiens
RWMTSLISS

SEQ ID NO: 130762 - protein, 9 aa, Homo Sapiens
QVTHPLVHI

SEQ ID NO: 130763 - protein, 9 aa, Homo Sapiens
SLDLPSDHT

SEQ ID NO: 130764 - protein, 9 aa, Homo Sapiens
TSSLGSQVH

SEQ ID NO: 130765 - protein, 9 aa, Homo Sapiens
QGKKRKRER

SEQ ID NO: 130766 - protein, 9 aa, Homo Sapiens
TCARFCKCC

SEQ ID NO: 130767 - protein, 9 aa, Homo Sapiens
EETEESKKH

SEQ ID NO: 130768 - protein, 9 aa, Homo Sapiens
SVREPRGLG

SEQ ID NO: 130769 - protein, 9 aa, Homo Sapiens
YYKSMSNLG

SEQ ID NO: 130770 - protein, 9 aa, Homo Sapiens
VVGGIPVAL

SEQ ID NO: 130771 - protein, 9 aa, Homo Sapiens
SPVDIIRSP

SEQ ID NO: 130772 - protein, 9 aa, Homo Sapiens
MWRQLIPCK

SEQ ID NO: 130773 - protein, 9 aa, Homo Sapiens
DRSLLLYRH

SEQ ID NO: 130774 - protein, 9 aa, Homo Sapiens
ALEMNKCKA

SEQ ID NO: 130775 - protein, 9 aa, Homo Sapiens
IIDGANLTV

SEQ ID NO: 130776 - protein, 9 aa, Homo Sapiens
PKRRQSSPG

SEQ ID NO: 130777 - protein, 9 aa, Homo Sapiens
SYLSVSLPA

SEQ ID NO: 130778 - protein, 9 aa, Homo Sapiens
FCLIFFQQL

SEQ ID NO: 130779 - protein, 9 aa, Homo Sapiens
VADWRYLQQ

SEQ ID NO: 130780 - protein, 9 aa, Homo Sapiens
HIMSRLFYG

SEQ ID NO: 130781 - protein, 9 aa, Homo Sapiens
MIMKFVTSF

SEQ ID NO: 130782 - protein, 9 aa, Homo Sapiens
QYRQVEARF

SEQ ID NO: 130783 - protein, 9 aa, Homo Sapiens
LSHLQKGNK

SEQ ID NO: 130784 - protein, 9 aa, Homo Sapiens
QNDVDREFV

SEQ ID NO: 130785 - protein, 9 aa, Homo Sapiens
DSKRLVNES

SEQ ID NO: 130786 - protein, 9 aa, Homo Sapiens
QQIYIVLTT

SEQ ID NO: 130787 - protein, 9 aa, Homo Sapiens
GHVTCMQSQ

SEQ ID NO: 130788 - protein, 9 aa, Homo Sapiens
IQNESPKKK

SEQ ID NO: 130789 - protein, 9 aa, Homo Sapiens
STNLQQMLK

SEQ ID NO: 130790 - protein, 9 aa, Homo Sapiens
QKSLQKICS

SEQ ID NO: 130791 - protein, 9 aa, Homo Sapiens
EKMMTTKRL

SEQ ID NO: 130792 - protein, 9 aa, Homo Sapiens
EYEGVGWNI

SEQ ID NO: 130793 - protein, 9 aa, Homo Sapiens
DCSLGYSGL

SEQ ID NO: 130794 - protein, 9 aa, Homo Sapiens
WRLLCSSLG

SEQ ID NO: 130795 - protein, 9 aa, Homo Sapiens
FLKEVSEFH

SEQ ID NO: 130796 - protein, 9 aa, Homo Sapiens
RDITYYKAK

SEQ ID NO: 130797 - protein, 9 aa, Homo Sapiens
EYSPPSPAL

SEQ ID NO: 130798 - protein, 9 aa, Homo Sapiens
RTAGRNPKR

SEQ ID NO: 130799 - protein, 9 aa, Homo Sapiens
CCVTAALIY

SEQ ID NO: 130800 - protein, 9 aa, Homo Sapiens
SVDRNEEGL

SEQ ID NO: 130801 - protein, 9 aa, Homo Sapiens
LSKVVPLHD

SEQ ID NO: 130802 - protein, 9 aa, Homo Sapiens
DKVSLDLAP

SEQ ID NO: 130803 - protein, 9 aa, Homo Sapiens
SFTPLEKDG

SEQ ID NO: 130804 - protein, 9 aa, Homo Sapiens
VLCRTHSQQ

SEQ ID NO: 130805 - protein, 9 aa, Homo Sapiens
TYYLYMKCV

SEQ ID NO: 130806 - protein, 9 aa, Homo Sapiens
WSPTLPRTP

SEQ ID NO: 130807 - protein, 9 aa, Homo Sapiens
TTEYFVCTK

SEQ ID NO: 130808 - protein, 9 aa, Homo Sapiens
PPTTTTSSP

SEQ ID NO: 130809 - protein, 9 aa, Homo Sapiens
TQALEMNKC

SEQ ID NO: 130810 - protein, 9 aa, Homo Sapiens
KTAVHLEWS

SEQ ID NO: 130811 - protein, 9 aa, Homo Sapiens
NLTFNSIFI

SEQ ID NO: 130812 - protein, 9 aa, Homo Sapiens
LPSLVIVLG

SEQ ID NO: 130813 - protein, 9 aa, Homo Sapiens
YCHSTLKCQ

SEQ ID NO: 130814 - protein, 9 aa, Homo Sapiens
HDFPQFSTS

SEQ ID NO: 130815 - protein, 9 aa, Homo Sapiens
HSAEAQRGA

SEQ ID NO: 130816 - protein, 9 aa, Homo Sapiens
FYVIHQEIG

SEQ ID NO: 130817 - protein, 9 aa, Homo Sapiens
DRTRLLAKG

SEQ ID NO: 130818 - protein, 9 aa, Homo Sapiens
LHHPQQQLQ

SEQ ID NO: 130819 - protein, 9 aa, Homo Sapiens
VNFSRTKSL

SEQ ID NO: 130820 - protein, 9 aa, Homo Sapiens
KICPGEDEL

SEQ ID NO: 130821 - protein, 9 aa, Homo Sapiens
WVSYLGCVY

SEQ ID NO: 130822 - protein, 9 aa, Homo Sapiens
VRVSPQMVN

SEQ ID NO: 130823 - protein, 9 aa, Homo Sapiens
LSQSLLCIR

SEQ ID NO: 130824 - protein, 9 aa, Homo Sapiens
LYLEKNGKR

SEQ ID NO: 130825 - protein, 9 aa, Homo Sapiens
KRISKLTYH

SEQ ID NO: 130826 - protein, 9 aa, Homo Sapiens
VRGNADLRC

SEQ ID NO: 130827 - protein, 9 aa, Homo Sapiens
YPMTVGERS

SEQ ID NO: 130828 - protein, 9 aa, Homo Sapiens
LGKLRVLQK

SEQ ID NO: 130829 - protein, 9 aa, Homo Sapiens
VKTGINMSL

SEQ ID NO: 130830 - protein, 9 aa, Homo Sapiens
SLSDIPKAV

SEQ ID NO: 130831 - protein, 9 aa, Homo Sapiens
PGFYNVSPR

SEQ ID NO: 130832 - protein, 9 aa, Homo Sapiens
AEYSPPSPA

SEQ ID NO: 130833 - protein, 9 aa, Homo Sapiens
TVRPPGSVG

SEQ ID NO: 130834 - protein, 9 aa, Homo Sapiens
GRCRGAPQG

SEQ ID NO: 130835 - protein, 9 aa, Homo Sapiens
AFFKAWTIF

SEQ ID NO: 130836 - protein, 9 aa, Homo Sapiens
EAEWHKLLI

SEQ ID NO: 130837 - protein, 9 aa, Homo Sapiens
TLNFVSRTC

SEQ ID NO: 130838 - protein, 9 aa, Homo Sapiens
NQSIPKRPA

SEQ ID NO: 130839 - protein, 9 aa, Homo Sapiens
CSMMCLKKR

SEQ ID NO: 130840 - protein, 9 aa, Homo Sapiens
RQPRVMSQW

SEQ ID NO: 130841 - protein, 9 aa, Homo Sapiens
AEASTPGRG

SEQ ID NO: 130842 - protein, 9 aa, Homo Sapiens
HHYSTVVPL

SEQ ID NO: 130843 - protein, 9 aa, Homo Sapiens
GTSHPVWNE

SEQ ID NO: 130844 - protein, 9 aa, Homo Sapiens
RDHICFVVD

SEQ ID NO: 130845 - protein, 9 aa, Homo Sapiens
QVSEEQSST

SEQ ID NO: 130846 - protein, 9 aa, Homo Sapiens
YGSPIHGQH

SEQ ID NO: 130847 - protein, 9 aa, Homo Sapiens
SQSCRQSHH

SEQ ID NO: 130848 - protein, 9 aa, Homo Sapiens
LWPMKGERK

SEQ ID NO: 130849 - protein, 9 aa, Homo Sapiens
MRQGYSVRQ

SEQ ID NO: 130850 - protein, 9 aa, Homo Sapiens
LMHRQGQDE

SEQ ID NO: 130851 - protein, 9 aa, Homo Sapiens
GALARPMVR

SEQ ID NO: 130852 - protein, 9 aa, Homo Sapiens
SSCPTTSTC

SEQ ID NO: 130853 - protein, 9 aa, Homo Sapiens
HLKKEVQCL

SEQ ID NO: 130854 - protein, 9 aa, Homo Sapiens
PPQQHSDGE

SEQ ID NO: 130855 - protein, 9 aa, Homo Sapiens
PLPHALHGL

SEQ ID NO: 130856 - protein, 9 aa, Homo Sapiens
PCLPGPTCP

SEQ ID NO: 130857 - protein, 9 aa, Homo Sapiens
NDQLPFLVA

SEQ ID NO: 130858 - protein, 9 aa, Homo Sapiens
SLDAVMPHQ

SEQ ID NO: 130859 - protein, 9 aa, Homo Sapiens
TKIVQATWR

SEQ ID NO: 130860 - protein, 9 aa, Homo Sapiens
HITGVDWAP

SEQ ID NO: 130861 - protein, 9 aa, Homo Sapiens
IWDVKDPSN

SEQ ID NO: 130862 - protein, 9 aa, Homo Sapiens
VLRKVMGSK

SEQ ID NO: 130863 - protein, 9 aa, Homo Sapiens
ATSHPDTSA

SEQ ID NO: 130864 - protein, 9 aa, Homo Sapiens
QADDLSNSF

SEQ ID NO: 130865 - protein, 9 aa, Homo Sapiens
ASLRIAGCR

SEQ ID NO: 130866 - protein, 9 aa, Homo Sapiens
LTNENKHGT

SEQ ID NO: 130867 - protein, 9 aa, Homo Sapiens
LPSSARAVA

SEQ ID NO: 130868 - protein, 9 aa, Homo Sapiens
CGQPCPGRC

SEQ ID NO: 130869 - protein, 9 aa, Homo Sapiens
GVSYCKFHT

SEQ ID NO: 130870 - protein, 9 aa, Homo Sapiens
EEHVCVTKA

SEQ ID NO: 130871 - protein, 9 aa, Homo Sapiens
AATGFPAWE

SEQ ID NO: 130872 - protein, 9 aa, Homo Sapiens
SKTTTDLLQ

SEQ ID NO: 130873 - protein, 9 aa, Homo Sapiens
REREPKPGP

SEQ ID NO: 130874 - protein, 9 aa, Homo Sapiens
FSRTKSLYR

SEQ ID NO: 130875 - protein, 9 aa, Homo Sapiens
KRIWQYVYS

SEQ ID NO: 130876 - protein, 9 aa, Homo Sapiens
GYHLPAPMG

SEQ ID NO: 130877 - protein, 9 aa, Homo Sapiens
SGPPHPRDP

SEQ ID NO: 130878 - protein, 9 aa, Homo Sapiens
VLQKMKKRV

SEQ ID NO: 130879 - protein, 9 aa, Homo Sapiens
PGSQPQTPA

SEQ ID NO: 130880 - protein, 9 aa, Homo Sapiens
FGALALHVC

SEQ ID NO: 130881 - protein, 9 aa, Homo Sapiens
FFIAVTAKD

SEQ ID NO: 130882 - protein, 9 aa, Homo Sapiens
PQCPPPSSA

SEQ ID NO: 130883 - protein, 9 aa, Homo Sapiens
GGAPGGGGS

SEQ ID NO: 130884 - protein, 9 aa, Homo Sapiens
QDHHLHHTL

SEQ ID NO: 130885 - protein, 9 aa, Homo Sapiens
MNVGKPSHL

SEQ ID NO: 130886 - protein, 9 aa, Homo Sapiens
KRICRGGPA

SEQ ID NO: 130887 - protein, 9 aa, Homo Sapiens
CTQGVYMQL

SEQ ID NO: 130888 - protein, 9 aa, Homo Sapiens
WEKCWSWRE

SEQ ID NO: 130889 - protein, 9 aa, Homo Sapiens
GTKPKIEHT

SEQ ID NO: 130890 - protein, 9 aa, Homo Sapiens
LKSIDYVFE

SEQ ID NO: 130891 - protein, 9 aa, Homo Sapiens
PQIEAPPPT

SEQ ID NO: 130892 - protein, 9 aa, Homo Sapiens
GVSKVTEVS

SEQ ID NO: 130893 - protein, 9 aa, Homo Sapiens
HGHCFCLIF

SEQ ID NO: 130894 - protein, 9 aa, Homo Sapiens
NDISSEAPV

SEQ ID NO: 130895 - protein, 9 aa, Homo Sapiens
AIDPLAGEE

SEQ ID NO: 130896 - protein, 9 aa, Homo Sapiens
EEAEEKSVV

SEQ ID NO: 130897 - protein, 9 aa, Homo Sapiens
TRPKPGEPA

SEQ ID NO: 130898 - protein, 9 aa, Homo Sapiens
LPDIPPIQT

SEQ ID NO: 130899 - protein, 9 aa, Homo Sapiens
TPWMTGVQP

SEQ ID NO: 130900 - protein, 9 aa, Homo Sapiens
QKGNKGEKH

SEQ ID NO: 130901 - protein, 9 aa, Homo Sapiens
GKNSTEGRA

SEQ ID NO: 130902 - protein, 9 aa, Homo Sapiens
IITPYFNYM

SEQ ID NO: 130903 - protein, 9 aa, Homo Sapiens
TVAFETALQ

SEQ ID NO: 130904 - protein, 9 aa, Homo Sapiens
ALSCLYATV

SEQ ID NO: 130905 - protein, 9 aa, Homo Sapiens
IGGPDDGAI

SEQ ID NO: 130906 - protein, 9 aa, Homo Sapiens
SMVTVDRTK

SEQ ID NO: 130907 - protein, 9 aa, Homo Sapiens
RLCFHPPQP

SEQ ID NO: 130908 - protein, 9 aa, Homo Sapiens
IKARTKKLW

SEQ ID NO: 130909 - protein, 9 aa, Homo Sapiens
RAQGSGCQC

SEQ ID NO: 130910 - protein, 9 aa, Homo Sapiens
PADFLLRLH

SEQ ID NO: 130911 - protein, 9 aa, Homo Sapiens
EHYLLPTQS

SEQ ID NO: 130912 - protein, 9 aa, Homo Sapiens
PTSLVGSLR

SEQ ID NO: 130913 - protein, 9 aa, Homo Sapiens
VEIIANDQD

SEQ ID NO: 130914 - protein, 9 aa, Homo Sapiens
KRSSISVIL

SEQ ID NO: 130915 - protein, 9 aa, Homo Sapiens
DEQGTENLC

SEQ ID NO: 130916 - protein, 9 aa, Homo Sapiens
EAQTIGQIE

SEQ ID NO: 130917 - protein, 9 aa, Homo Sapiens
TNNGYSWLI

SEQ ID NO: 130918 - protein, 9 aa, Homo Sapiens
RVYTHKKRE

SEQ ID NO: 130919 - protein, 9 aa, Homo Sapiens
PSSRHAAHR

SEQ ID NO: 130920 - protein, 9 aa, Homo Sapiens
MKFYFRFTS

SEQ ID NO: 130921 - protein, 9 aa, Homo Sapiens
GAPAPPALG

SEQ ID NO: 130922 - protein, 9 aa, Homo Sapiens
GSSHLPTLA

SEQ ID NO: 130923 - protein, 9 aa, Homo Sapiens
AGSRRQVRS

SEQ ID NO: 130924 - protein, 9 aa, Homo Sapiens
CRYITSDDL

SEQ ID NO: 130925 - protein, 9 aa, Homo Sapiens
MRLLRLQQR

SEQ ID NO: 130926 - protein, 9 aa, Homo Sapiens
RTHTGENPM

SEQ ID NO: 130927 - protein, 9 aa, Homo Sapiens
AEAVGHHND

SEQ ID NO: 130928 - protein, 9 aa, Homo Sapiens
YLARAAVSP

SEQ ID NO: 130929 - protein, 9 aa, Homo Sapiens
NCLVSLDSG

SEQ ID NO: 130930 - protein, 9 aa, Homo Sapiens
DAHQLLSGE

SEQ ID NO: 130931 - protein, 9 aa, Homo Sapiens
FFVKGMSPA

SEQ ID NO: 130932 - protein, 9 aa, Homo Sapiens
LHNPKGNKK

SEQ ID NO: 130933 - protein, 9 aa, Homo Sapiens
AIAPSIFFF

SEQ ID NO: 130934 - protein, 9 aa, Homo Sapiens
GNAWVDKEF

SEQ ID NO: 130935 - protein, 9 aa, Homo Sapiens
FNCCACVGN

SEQ ID NO: 130936 - protein, 9 aa, Homo Sapiens
SLPPTSPQP

SEQ ID NO: 130937 - protein, 9 aa, Homo Sapiens
VDNSRFHKT

SEQ ID NO: 130938 - protein, 9 aa, Homo Sapiens
KPRCTGSRC

SEQ ID NO: 130939 - protein, 9 aa, Homo Sapiens
DMRYWPQEA

SEQ ID NO: 130940 - protein, 9 aa, Homo Sapiens
CTYRISMQC

SEQ ID NO: 130941 - protein, 9 aa, Homo Sapiens
QEGGPQRPL

SEQ ID NO: 130942 - protein, 9 aa, Homo Sapiens
LWVQSLDLP

SEQ ID NO: 130943 - protein, 9 aa, Homo Sapiens
KRYCSTLDS

SEQ ID NO: 130944 - protein, 9 aa, Homo Sapiens
DFLVRGGSF

SEQ ID NO: 130945 - protein, 9 aa, Homo Sapiens
GGAEFMCVP

SEQ ID NO: 130946 - protein, 9 aa, Homo Sapiens
LKNVLLVMD

SEQ ID NO: 130947 - protein, 9 aa, Homo Sapiens
LTQPAHLTS

SEQ ID NO: 130948 - protein, 9 aa, Homo Sapiens
GLSRKLLPS

SEQ ID NO: 130949 - protein, 9 aa, Homo Sapiens
INLRTCDRC

SEQ ID NO: 130950 - protein, 9 aa, Homo Sapiens
DNSPFFIQI

SEQ ID NO: 130951 - protein, 9 aa, Homo Sapiens
GKPLPECHV

SEQ ID NO: 130952 - protein, 9 aa, Homo Sapiens
ATGELGGIW

SEQ ID NO: 130953 - protein, 9 aa, Homo Sapiens
TTGRRSRRS

SEQ ID NO: 130954 - protein, 9 aa, Homo Sapiens
ISQAMPNAV

SEQ ID NO: 130955 - protein, 9 aa, Homo Sapiens
EGTSNSSSE

SEQ ID NO: 130956 - protein, 9 aa, Homo Sapiens
YEVLDNHPE

SEQ ID NO: 130957 - protein, 9 aa, Homo Sapiens
AAEKKKERG

SEQ ID NO: 130958 - protein, 9 aa, Homo Sapiens
PLQTVRLME

SEQ ID NO: 130959 - protein, 9 aa, Homo Sapiens
VTDKEFHAP

SEQ ID NO: 130960 - protein, 9 aa, Homo Sapiens
SSCPAPNRL

SEQ ID NO: 130961 - protein, 9 aa, Homo Sapiens
HVLMKICLK

SEQ ID NO: 130962 - protein, 9 aa, Homo Sapiens
EHNGHITGV

SEQ ID NO: 130963 - protein, 9 aa, Homo Sapiens
SLEKKLEWE

SEQ ID NO: 130964 - protein, 9 aa, Homo Sapiens
DGLMNSCKP

SEQ ID NO: 130965 - protein, 9 aa, Homo Sapiens
FGHTLGLDH

SEQ ID NO: 130966 - protein, 9 aa, Homo Sapiens
KVIDFGSAN

SEQ ID NO: 130967 - protein, 9 aa, Homo Sapiens
ATGSGTETP

SEQ ID NO: 130968 - protein, 9 aa, Homo Sapiens
SVSLPAEPS

SEQ ID NO: 130969 - protein, 9 aa, Homo Sapiens
ALSQCQLLG

SEQ ID NO: 130970 - protein, 9 aa, Homo Sapiens
RVQPAAKVG

SEQ ID NO: 130971 - protein, 9 aa, Homo Sapiens
QPTLGCSSN

SEQ ID NO: 130972 - protein, 9 aa, Homo Sapiens
GNYGKVPLA

SEQ ID NO: 130973 - protein, 9 aa, Homo Sapiens
VVVGGIPVA

SEQ ID NO: 130974 - protein, 9 aa, Homo Sapiens
CLSHLQKGN

SEQ ID NO: 130975 - protein, 9 aa, Homo Sapiens
SSGKINGLV

SEQ ID NO: 130976 - protein, 9 aa, Homo Sapiens
EELQEQLHV

SEQ ID NO: 130977 - protein, 9 aa, Homo Sapiens
RPVAHGLLQ

SEQ ID NO: 130978 - protein, 9 aa, Homo Sapiens
WCSSWRSSS

SEQ ID NO: 130979 - protein, 9 aa, Homo Sapiens
APQGPCPRA

SEQ ID NO: 130980 - protein, 9 aa, Homo Sapiens
MRRCPGLSR

SEQ ID NO: 130981 - protein, 9 aa, Homo Sapiens
LQLPGNRLA

SEQ ID NO: 130982 - protein, 9 aa, Homo Sapiens
WRPAARSGS

SEQ ID NO: 130983 - protein, 9 aa, Homo Sapiens
EDVYYKSMS

SEQ ID NO: 130984 - protein, 9 aa, Homo Sapiens
GGLAAPMYT

SEQ ID NO: 130985 - protein, 9 aa, Homo Sapiens
GRRSRRSKA

SEQ ID NO: 130986 - protein, 9 aa, Homo Sapiens
ILPKCHTSY

SEQ ID NO: 130987 - protein, 9 aa, Homo Sapiens
TNVCFGIFH

SEQ ID NO: 130988 - protein, 9 aa, Homo Sapiens
LGLLLLMWQ

SEQ ID NO: 130989 - protein, 9 aa, Homo Sapiens
GMLEIDVQT

SEQ ID NO: 130990 - protein, 9 aa, Homo Sapiens
LEDAEMVGQ

SEQ ID NO: 130991 - protein, 9 aa, Homo Sapiens
ASSNIRALD

SEQ ID NO: 130992 - protein, 9 aa, Homo Sapiens
AMSPAGPQP

SEQ ID NO: 130993 - protein, 9 aa, Homo Sapiens
SSWRSSSPR

SEQ ID NO: 130994 - protein, 9 aa, Homo Sapiens
CLIKDGKLI

SEQ ID NO: 130995 - protein, 9 aa, Homo Sapiens
RSTSAHLPP

SEQ ID NO: 130996 - protein, 9 aa, Homo Sapiens
PAAMRAALA

SEQ ID NO: 130997 - protein, 9 aa, Homo Sapiens
CQLQGAGAA

SEQ ID NO: 130998 - protein, 9 aa, Homo Sapiens
ECLTGRVPG

SEQ ID NO: 130999 - protein, 9 aa, Homo Sapiens
PMCESNSAM

SEQ ID NO: 131000 - protein, 9 aa, Homo Sapiens
PRLRGETTF

SEQ ID NO: 131001 - protein, 9 aa, Homo Sapiens
RQGFCCSVN

SEQ ID NO: 131002 - protein, 9 aa, Homo Sapiens
IPNKCLWSH

SEQ ID NO: 131003 - protein, 9 aa, Homo Sapiens
SEHFRTTVG

SEQ ID NO: 131004 - protein, 9 aa, Homo Sapiens
VQVRARRCI

SEQ ID NO: 131005 - protein, 9 aa, Homo Sapiens
YDICRHNLD

SEQ ID NO: 131006 - protein, 9 aa, Homo Sapiens
CKECGKVFT

SEQ ID NO: 131007 - protein, 9 aa, Homo Sapiens
DIRRCYPYY

SEQ ID NO: 131008 - protein, 9 aa, Homo Sapiens
LGDEQRDDI

SEQ ID NO: 131009 - protein, 9 aa, Homo Sapiens
EVLHKMLMV

SEQ ID NO: 131010 - protein, 9 aa, Homo Sapiens
STAKVCGAA

SEQ ID NO: 131011 - protein, 9 aa, Homo Sapiens
AGVMSGSGN

SEQ ID NO: 131012 - protein, 9 aa, Homo Sapiens
RLTRIFRIL

SEQ ID NO: 131013 - protein, 9 aa, Homo Sapiens
PPHRAAPAT

SEQ ID NO: 131014 - protein, 9 aa, Homo Sapiens
AWTIFKGKY

SEQ ID NO: 131015 - protein, 9 aa, Homo Sapiens
HWEGWWSAQ

SEQ ID NO: 131016 - protein, 9 aa, Homo Sapiens
PTPKKISLK

SEQ ID NO: 131017 - protein, 9 aa, Homo Sapiens
VKDNLEEAK

SEQ ID NO: 131018 - protein, 9 aa, Homo Sapiens
KKHLKAGCR

SEQ ID NO: 131019 - protein, 9 aa, Homo Sapiens
EFYSDAAKG

SEQ ID NO: 131020 - protein, 9 aa, Homo Sapiens
THTHTHTLT

SEQ ID NO: 131021 - protein, 9 aa, Homo Sapiens
RTFPAYDYF

SEQ ID NO: 131022 - protein, 9 aa, Homo Sapiens
SVHEGGSEE

SEQ ID NO: 131023 - protein, 9 aa, Homo Sapiens
NVGNPSVKS

SEQ ID NO: 131024 - protein, 9 aa, Homo Sapiens
VKGVASDLR

SEQ ID NO: 131025 - protein, 9 aa, Homo Sapiens
HPPQPAGVS

SEQ ID NO: 131026 - protein, 9 aa, Homo Sapiens
DDRPGRVQC

SEQ ID NO: 131027 - protein, 9 aa, Homo Sapiens
HHCGQCGLH

SEQ ID NO: 131028 - protein, 9 aa, Homo Sapiens
EELVILGKG

SEQ ID NO: 131029 - protein, 9 aa, Homo Sapiens
RRYGISSVH

SEQ ID NO: 131030 - protein, 9 aa, Homo Sapiens
EFSKLQNTT

SEQ ID NO: 131031 - protein, 9 aa, Homo Sapiens
LVTKTVDNW

SEQ ID NO: 131032 - protein, 9 aa, Homo Sapiens
QKKHLGKLR

SEQ ID NO: 131033 - protein, 9 aa, Homo Sapiens
TFWTERPVN

SEQ ID NO: 131034 - protein, 9 aa, Homo Sapiens
IKEYTQVKN

SEQ ID NO: 131035 - protein, 9 aa, Homo Sapiens
KLSINNYRF

SEQ ID NO: 131036 - protein, 9 aa, Homo Sapiens
IGYRMRCIL

SEQ ID NO: 131037 - protein, 9 aa, Homo Sapiens
PPAKKNKEN

SEQ ID NO: 131038 - protein, 9 aa, Homo Sapiens
SDSPPLQDG

SEQ ID NO: 131039 - protein, 9 aa, Homo Sapiens
LICDQLFLK

SEQ ID NO: 131040 - protein, 9 aa, Homo Sapiens
ACCAWSRTC

SEQ ID NO: 131041 - protein, 9 aa, Homo Sapiens
GIFTCFNIF

SEQ ID NO: 131042 - protein, 9 aa, Homo Sapiens
LPTYTLHVT

SEQ ID NO: 131043 - protein, 9 aa, Homo Sapiens
KRRLRAKLE

SEQ ID NO: 131044 - protein, 9 aa, Homo Sapiens
MRTMGFLLV

SEQ ID NO: 131045 - protein, 9 aa, Homo Sapiens
QVTLMTLTL

SEQ ID NO: 131046 - protein, 9 aa, Homo Sapiens
GALQAACFQ

SEQ ID NO: 131047 - protein, 9 aa, Homo Sapiens
YREGKHNFT

SEQ ID NO: 131048 - protein, 9 aa, Homo Sapiens
YLTVAFCWI

SEQ ID NO: 131049 - protein, 9 aa, Homo Sapiens
ESRLAELQR

SEQ ID NO: 131050 - protein, 9 aa, Homo Sapiens
DEPQLETVD

SEQ ID NO: 131051 - protein, 9 aa, Homo Sapiens
TRLKAWWKK

SEQ ID NO: 131052 - protein, 9 aa, Homo Sapiens
LSNGTYWWM

SEQ ID NO: 131053 - protein, 9 aa, Homo Sapiens
RHRAVHDFP

SEQ ID NO: 131054 - protein, 9 aa, Homo Sapiens
LHVRMVNLQ

SEQ ID NO: 131055 - protein, 9 aa, Homo Sapiens
RWHLRVVPL

SEQ ID NO: 131056 - protein, 9 aa, Homo Sapiens
SKLSPKTKK

SEQ ID NO: 131057 - protein, 9 aa, Homo Sapiens
NSQYEEAYR

SEQ ID NO: 131058 - protein, 9 aa, Homo Sapiens
CLIIATALS

SEQ ID NO: 131059 - protein, 9 aa, Homo Sapiens
LPGVCKVNT

SEQ ID NO: 131060 - protein, 9 aa, Homo Sapiens
REISNSDGA

SEQ ID NO: 131061 - protein, 9 aa, Homo Sapiens
FSPKRSRKS

SEQ ID NO: 131062 - protein, 9 aa, Homo Sapiens
ETIFDHIVR

SEQ ID NO: 131063 - protein, 9 aa, Homo Sapiens
PDPSFSSKV

SEQ ID NO: 131064 - protein, 9 aa, Homo Sapiens
ETKNLENAI

SEQ ID NO: 131065 - protein, 9 aa, Homo Sapiens
SLPLVPDFP

SEQ ID NO: 131066 - protein, 9 aa, Homo Sapiens
TAAAHGGPR

SEQ ID NO: 131067 - protein, 9 aa, Homo Sapiens
GSFRTLRLC

SEQ ID NO: 131068 - protein, 9 aa, Homo Sapiens
PRKAIQISQ

SEQ ID NO: 131069 - protein, 9 aa, Homo Sapiens
YVLTKMMKR

SEQ ID NO: 131070 - protein, 9 aa, Homo Sapiens
SPGSSARWR

SEQ ID NO: 131071 - protein, 9 aa, Homo Sapiens
RDDELPASP

SEQ ID NO: 131072 - protein, 9 aa, Homo Sapiens
EVRSDGRSR

SEQ ID NO: 131073 - protein, 9 aa, Homo Sapiens
SNTSVSSIL

SEQ ID NO: 131074 - protein, 9 aa, Homo Sapiens
ICRGGPATS

SEQ ID NO: 131075 - protein, 9 aa, Homo Sapiens
VGALARPMV

SEQ ID NO: 131076 - protein, 9 aa, Homo Sapiens
LLSLDRHEE

SEQ ID NO: 131077 - protein, 9 aa, Homo Sapiens
KRRRGSSPP

SEQ ID NO: 131078 - protein, 9 aa, Homo Sapiens
PATSHPDTS

SEQ ID NO: 131079 - protein, 9 aa, Homo Sapiens
KMEEWVLVL

SEQ ID NO: 131080 - protein, 9 aa, Homo Sapiens
PAGPLGAPG

SEQ ID NO: 131081 - protein, 9 aa, Homo Sapiens
LVVTQRPPP

SEQ ID NO: 131082 - protein, 9 aa, Homo Sapiens
CNMRRPAHT

SEQ ID NO: 131083 - protein, 9 aa, Homo Sapiens
NCGYKLCGR

SEQ ID NO: 131084 - protein, 9 aa, Homo Sapiens
LQKICSLLI

SEQ ID NO: 131085 - protein, 9 aa, Homo Sapiens
AAHTWLLDV

SEQ ID NO: 131086 - protein, 9 aa, Homo Sapiens
PPPPQIEAP

SEQ ID NO: 131087 - protein, 9 aa, Homo Sapiens
RPLDTVQPL

SEQ ID NO: 131088 - protein, 9 aa, Homo Sapiens
NARNVLKGL

SEQ ID NO: 131089 - protein, 9 aa, Homo Sapiens
VDAWVIALL

SEQ ID NO: 131090 - protein, 9 aa, Homo Sapiens
LRACSCPRA

SEQ ID NO: 131091 - protein, 9 aa, Homo Sapiens
RGRASSLCG

SEQ ID NO: 131092 - protein, 9 aa, Homo Sapiens
DISNVKHVV

SEQ ID NO: 131093 - protein, 9 aa, Homo Sapiens
VRERKLAGL

SEQ ID NO: 131094 - protein, 9 aa, Homo Sapiens
KGDLEKVRS

SEQ ID NO: 131095 - protein, 9 aa, Homo Sapiens
GHAFLGHCQ

SEQ ID NO: 131096 - protein, 9 aa, Homo Sapiens
CRQSHHGSR

SEQ ID NO: 131097 - protein, 9 aa, Homo Sapiens
YNDITHGNR

SEQ ID NO: 131098 - protein, 9 aa, Homo Sapiens
PQPRPPTAV

SEQ ID NO: 131099 - protein, 9 aa, Homo Sapiens
SPYYGGESA

SEQ ID NO: 131100 - protein, 9 aa, Homo Sapiens
QLLRRSHFK

SEQ ID NO: 131101 - protein, 9 aa, Homo Sapiens
VMHLSSHWL

SEQ ID NO: 131102 - protein, 9 aa, Homo Sapiens
RIAGCRHSV

SEQ ID NO: 131103 - protein, 9 aa, Homo Sapiens
AFKAISEKT

SEQ ID NO: 131104 - protein, 9 aa, Homo Sapiens
SPVGIVRSR

SEQ ID NO: 131105 - protein, 9 aa, Homo Sapiens
RLYTSSWRA

SEQ ID NO: 131106 - protein, 9 aa, Homo Sapiens
NIKEYTQVK

SEQ ID NO: 131107 - protein, 9 aa, Homo Sapiens
GVPKGPLLE

SEQ ID NO: 131108 - protein, 9 aa, Homo Sapiens
SACSSTPGS

SEQ ID NO: 131109 - protein, 9 aa, Homo Sapiens
GIAIHAMII

SEQ ID NO: 131110 - protein, 9 aa, Homo Sapiens
MTSLISSLR

SEQ ID NO: 131111 - protein, 9 aa, Homo Sapiens
QTETMEATA

SEQ ID NO: 131112 - protein, 9 aa, Homo Sapiens
LVAVPHSTF

SEQ ID NO: 131113 - protein, 9 aa, Homo Sapiens
VCLHFLACP

SEQ ID NO: 131114 - protein, 9 aa, Homo Sapiens
ADLRPGGTA

SEQ ID NO: 131115 - protein, 9 aa, Homo Sapiens
SWWVYTLLL

SEQ ID NO: 131116 - protein, 9 aa, Homo Sapiens
LLFCIWMSL

SEQ ID NO: 131117 - protein, 9 aa, Homo Sapiens
KLWPMKGER

SEQ ID NO: 131118 - protein, 9 aa, Homo Sapiens
LCLLQQQLQ

SEQ ID NO: 131119 - protein, 9 aa, Homo Sapiens
VKFMAKHLI

SEQ ID NO: 131120 - protein, 9 aa, Homo Sapiens
VTCQCLKGF

SEQ ID NO: 131121 - protein, 9 aa, Homo Sapiens
KTTRSHRKR

SEQ ID NO: 131122 - protein, 9 aa, Homo Sapiens
HTETPSAGV

SEQ ID NO: 131123 - protein, 9 aa, Homo Sapiens
AGASCGQPC

SEQ ID NO: 131124 - protein, 9 aa, Homo Sapiens
WTHTGCHVP

SEQ ID NO: 131125 - protein, 9 aa, Homo Sapiens
RHCVGQKMK

SEQ ID NO: 131126 - protein, 9 aa, Homo Sapiens
GAAPMMSSM

SEQ ID NO: 131127 - protein, 9 aa, Homo Sapiens
HVHRTKPRG

SEQ ID NO: 131128 - protein, 9 aa, Homo Sapiens
LCGRTHMYK

SEQ ID NO: 131129 - protein, 9 aa, Homo Sapiens
QETVSKNGD

SEQ ID NO: 131130 - protein, 9 aa, Homo Sapiens
AESGMSKPP

SEQ ID NO: 131131 - protein, 9 aa, Homo Sapiens
YVPQKFHGK

SEQ ID NO: 131132 - protein, 9 aa, Homo Sapiens
DRKGVHPVV

SEQ ID NO: 131133 - protein, 9 aa, Homo Sapiens
GARAKGFPN

SEQ ID NO: 131134 - protein, 9 aa, Homo Sapiens
LTLQVACLN

SEQ ID NO: 131135 - protein, 9 aa, Homo Sapiens
RRNNETPEE

SEQ ID NO: 131136 - protein, 9 aa, Homo Sapiens
DAGTEFVPG

SEQ ID NO: 131137 - protein, 9 aa, Homo Sapiens
ASGVSKVTE

SEQ ID NO: 131138 - protein, 9 aa, Homo Sapiens
FCENRHHYT

SEQ ID NO: 131139 - protein, 9 aa, Homo Sapiens
PSARRRQRE

SEQ ID NO: 131140 - protein, 9 aa, Homo Sapiens
FAHLQPPIA

SEQ ID NO: 131141 - protein, 9 aa, Homo Sapiens
FCWTSWSPC

SEQ ID NO: 131142 - protein, 9 aa, Homo Sapiens
AILFHLHRK

SEQ ID NO: 131143 - protein, 9 aa, Homo Sapiens
LCFQSAVLY

SEQ ID NO: 131144 - protein, 9 aa, Homo Sapiens
RPLPSLVIV

SEQ ID NO: 131145 - protein, 9 aa, Homo Sapiens
PSHQNSLRK

SEQ ID NO: 131146 - protein, 9 aa, Homo Sapiens
TSTSVRLVS

SEQ ID NO: 131147 - protein, 9 aa, Homo Sapiens
DHVHRIGRE

SEQ ID NO: 131148 - protein, 9 aa, Homo Sapiens
HLVLGCNEK

SEQ ID NO: 131149 - protein, 9 aa, Homo Sapiens
VSYCKFHTC

SEQ ID NO: 131150 - protein, 9 aa, Homo Sapiens
ARCARWLHQ

SEQ ID NO: 131151 - protein, 9 aa, Homo Sapiens
RPPAPTPCT

SEQ ID NO: 131152 - protein, 9 aa, Homo Sapiens
PLAGEEGGA

SEQ ID NO: 131153 - protein, 9 aa, Homo Sapiens
SSPRRSPAL

SEQ ID NO: 131154 - protein, 9 aa, Homo Sapiens
KNEWPLGKM

SEQ ID NO: 131155 - protein, 9 aa, Homo Sapiens
VFTKGRTSV

SEQ ID NO: 131156 - protein, 9 aa, Homo Sapiens
HLDAKRRGS

SEQ ID NO: 131157 - protein, 9 aa, Homo Sapiens
SPLSLWVQS

SEQ ID NO: 131158 - protein, 9 aa, Homo Sapiens
LAEELQKNK

SEQ ID NO: 131159 - protein, 9 aa, Homo Sapiens
IPSPKVGTK

SEQ ID NO: 131160 - protein, 9 aa, Homo Sapiens
LAGLGLRMR

SEQ ID NO: 131161 - protein, 9 aa, Homo Sapiens
HAHEDPGPF

SEQ ID NO: 131162 - protein, 9 aa, Homo Sapiens
AHMCIVRAL

SEQ ID NO: 131163 - protein, 9 aa, Homo Sapiens
ARSTSTSTI

SEQ ID NO: 131164 - protein, 9 aa, Homo Sapiens
AVAGSGSSP

SEQ ID NO: 131165 - protein, 9 aa, Homo Sapiens
IVGVDVPLV

SEQ ID NO: 131166 - protein, 9 aa, Homo Sapiens
GGTTIGEVT

SEQ ID NO: 131167 - protein, 9 aa, Homo Sapiens
PLPMVCTLT

SEQ ID NO: 131168 - protein, 9 aa, Homo Sapiens
PGTPHGVPL

SEQ ID NO: 131169 - protein, 9 aa, Homo Sapiens
DRSPYYGGE

SEQ ID NO: 131170 - protein, 9 aa, Homo Sapiens
MDVERAMRA

SEQ ID NO: 131171 - protein, 9 aa, Homo Sapiens
QDSWRWAVS

SEQ ID NO: 131172 - protein, 9 aa, Homo Sapiens
AARLAVAKA

SEQ ID NO: 131173 - protein, 9 aa, Homo Sapiens
ARHERRHND

SEQ ID NO: 131174 - protein, 9 aa, Homo Sapiens
CLQHRADTV

SEQ ID NO: 131175 - protein, 9 aa, Homo Sapiens
REREIVPVE

SEQ ID NO: 131176 - protein, 9 aa, Homo Sapiens
KTGHFEEAA

SEQ ID NO: 131177 - protein, 9 aa, Homo Sapiens
ANDQDNRTT

SEQ ID NO: 131178 - protein, 9 aa, Homo Sapiens
VGATRIETE

SEQ ID NO: 131179 - protein, 9 aa, Homo Sapiens
SGAACIRGE

SEQ ID NO: 131180 - protein, 9 aa, Homo Sapiens
GQAFQVVGW

SEQ ID NO: 131181 - protein, 9 aa, Homo Sapiens
VQTLPTSVV

SEQ ID NO: 131182 - protein, 9 aa, Homo Sapiens
CNIPTNVSN

SEQ ID NO: 131183 - protein, 9 aa, Homo Sapiens
SEELQEQLH

SEQ ID NO: 131184 - protein, 9 aa, Homo Sapiens
LNREREIVP

SEQ ID NO: 131185 - protein, 9 aa, Homo Sapiens
PRLRLALRA

SEQ ID NO: 131186 - protein, 9 aa, Homo Sapiens
KDLDVLEVV

SEQ ID NO: 131187 - protein, 9 aa, Homo Sapiens
ISKQPVSNV

SEQ ID NO: 131188 - protein, 9 aa, Homo Sapiens
SRSQRDMQS

SEQ ID NO: 131189 - protein, 9 aa, Homo Sapiens
VNAGVMSGS

SEQ ID NO: 131190 - protein, 9 aa, Homo Sapiens
QEQLHVRRA

SEQ ID NO: 131191 - protein, 9 aa, Homo Sapiens
YLVQQLTLL

SEQ ID NO: 131192 - protein, 9 aa, Homo Sapiens
LRRHVHPEE

SEQ ID NO: 131193 - protein, 9 aa, Homo Sapiens
LIAGIAIHA

SEQ ID NO: 131194 - protein, 9 aa, Homo Sapiens
GCSVSRNLP

SEQ ID NO: 131195 - protein, 9 aa, Homo Sapiens
ILVPRLECS

SEQ ID NO: 131196 - protein, 9 aa, Homo Sapiens
HILAEFEMT

SEQ ID NO: 131197 - protein, 9 aa, Homo Sapiens
APGPEGQLC

SEQ ID NO: 131198 - protein, 9 aa, Homo Sapiens
QAETKRLER

SEQ ID NO: 131199 - protein, 9 aa, Homo Sapiens
TGDMIRMLQ

SEQ ID NO: 131200 - protein, 9 aa, Homo Sapiens
RKQFSPILV

SEQ ID NO: 131201 - protein, 9 aa, Homo Sapiens
CCEALCFRR

SEQ ID NO: 131202 - protein, 9 aa, Homo Sapiens
FLFNNFIFN

SEQ ID NO: 131203 - protein, 9 aa, Homo Sapiens
MLEIDVQTR

SEQ ID NO: 131204 - protein, 9 aa, Homo Sapiens
HEDPGPFRH

SEQ ID NO: 131205 - protein, 9 aa, Homo Sapiens
VMSSRDIEE

SEQ ID NO: 131206 - protein, 9 aa, Homo Sapiens
FLTQLADFL

SEQ ID NO: 131207 - protein, 9 aa, Homo Sapiens
EFNPGSSGR

SEQ ID NO: 131208 - protein, 9 aa, Homo Sapiens
ERLPHIVVV

SEQ ID NO: 131209 - protein, 9 aa, Homo Sapiens
ESELVVRAI

SEQ ID NO: 131210 - protein, 9 aa, Homo Sapiens
GKDYFLSMS

SEQ ID NO: 131211 - protein, 9 aa, Homo Sapiens
AAMTAEELK

SEQ ID NO: 131212 - protein, 9 aa, Homo Sapiens
CKLDFFRSE

SEQ ID NO: 131213 - protein, 9 aa, Homo Sapiens
ALVAMPPGA

SEQ ID NO: 131214 - protein, 9 aa, Homo Sapiens
WPLREATSP

SEQ ID NO: 131215 - protein, 9 aa, Homo Sapiens
DFKMEEKMK

SEQ ID NO: 131216 - protein, 9 aa, Homo Sapiens
MKLYMKLIV

SEQ ID NO: 131217 - protein, 9 aa, Homo Sapiens
IHTDPKETN

SEQ ID NO: 131218 - protein, 9 aa, Homo Sapiens
VNKKRKTAN

SEQ ID NO: 131219 - protein, 9 aa, Homo Sapiens
PSPRPPPLV

SEQ ID NO: 131220 - protein, 9 aa, Homo Sapiens
TKAPTTSRA

SEQ ID NO: 131221 - protein, 9 aa, Homo Sapiens
SQQSKLKEY

SEQ ID NO: 131222 - protein, 9 aa, Homo Sapiens
HQTEPGQGR

SEQ ID NO: 131223 - protein, 9 aa, Homo Sapiens
PHCQLQGAG

SEQ ID NO: 131224 - protein, 9 aa, Homo Sapiens
LSNSLSNTS

SEQ ID NO: 131225 - protein, 9 aa, Homo Sapiens
VSQRAPGKV

SEQ ID NO: 131226 - protein, 9 aa, Homo Sapiens
NSDSLHFSD

SEQ ID NO: 131227 - protein, 9 aa, Homo Sapiens
HFAAESIII

SEQ ID NO: 131228 - protein, 9 aa, Homo Sapiens
AALASPTVL

SEQ ID NO: 131229 - protein, 9 aa, Homo Sapiens
NLMRTMGFL

SEQ ID NO: 131230 - protein, 9 aa, Homo Sapiens
SSADGVFEE

SEQ ID NO: 131231 - protein, 9 aa, Homo Sapiens
RLIMPPIKE

SEQ ID NO: 131232 - protein, 9 aa, Homo Sapiens
NFFSKLSQV

SEQ ID NO: 131233 - protein, 9 aa, Homo Sapiens
SINQEERDL

SEQ ID NO: 131234 - protein, 9 aa, Homo Sapiens
FVAVRLCGR

SEQ ID NO: 131235 - protein, 9 aa, Homo Sapiens
DGEMVFLDG

SEQ ID NO: 131236 - protein, 9 aa, Homo Sapiens
KKGAKRSRV

SEQ ID NO: 131237 - protein, 9 aa, Homo Sapiens
MNVGNPSVK

SEQ ID NO: 131238 - protein, 9 aa, Homo Sapiens
TSIIRDYLE

SEQ ID NO: 131239 - protein, 9 aa, Homo Sapiens
PSKTTTDLL

SEQ ID NO: 131240 - protein, 9 aa, Homo Sapiens
IRPGLIPQE

SEQ ID NO: 131241 - protein, 9 aa, Homo Sapiens
KRDLMTAGV

SEQ ID NO: 131242 - protein, 9 aa, Homo Sapiens
RMRWRADGC

SEQ ID NO: 131243 - protein, 9 aa, Homo Sapiens
DNDQGSMQE

SEQ ID NO: 131244 - protein, 9 aa, Homo Sapiens
QINVDPAGD

SEQ ID NO: 131245 - protein, 9 aa, Homo Sapiens
FIQKFSPKR

SEQ ID NO: 131246 - protein, 9 aa, Homo Sapiens
FQMENSHLK

SEQ ID NO: 131247 - protein, 9 aa, Homo Sapiens
MGPPPECCS

SEQ ID NO: 131248 - protein, 9 aa, Homo Sapiens
PNFFSKLSQ

SEQ ID NO: 131249 - protein, 9 aa, Homo Sapiens
ELCFQSAVL

SEQ ID NO: 131250 - protein, 9 aa, Homo Sapiens
SIKMPLKKS

SEQ ID NO: 131251 - protein, 9 aa, Homo Sapiens
QEYRRSEQD

SEQ ID NO: 131252 - protein, 9 aa, Homo Sapiens
VMTSFSLNI

SEQ ID NO: 131253 - protein, 9 aa, Homo Sapiens
ETWNCWAEA

SEQ ID NO: 131254 - protein, 9 aa, Homo Sapiens
VPGTAYGNA

SEQ ID NO: 131255 - protein, 9 aa, Homo Sapiens
RNPKRRQSS

SEQ ID NO: 131256 - protein, 9 aa, Homo Sapiens
EKNPSLALM

SEQ ID NO: 131257 - protein, 9 aa, Homo Sapiens
TTFWKTDLK

SEQ ID NO: 131258 - protein, 9 aa, Homo Sapiens
INVVKILRA

SEQ ID NO: 131259 - protein, 9 aa, Homo Sapiens
AIHPWRSKG

SEQ ID NO: 131260 - protein, 9 aa, Homo Sapiens
STTSTTGRR

SEQ ID NO: 131261 - protein, 9 aa, Homo Sapiens
FPLYLEKNG

SEQ ID NO: 131262 - protein, 9 aa, Homo Sapiens
FLVTKTVDN

SEQ ID NO: 131263 - protein, 9 aa, Homo Sapiens
AAAGAPRDG

SEQ ID NO: 131264 - protein, 9 aa, Homo Sapiens
QGGYGKKVV

SEQ ID NO: 131265 - protein, 9 aa, Homo Sapiens
NLYELACKQ

SEQ ID NO: 131266 - protein, 9 aa, Homo Sapiens
PMNAMHVGK

SEQ ID NO: 131267 - protein, 9 aa, Homo Sapiens
FEVGAHKVV

SEQ ID NO: 131268 - protein, 9 aa, Homo Sapiens
GAPIHRLML

SEQ ID NO: 131269 - protein, 9 aa, Homo Sapiens
TGPGGGGPE

SEQ ID NO: 131270 - protein, 9 aa, Homo Sapiens
VRTQHPTLR

SEQ ID NO: 131271 - protein, 9 aa, Homo Sapiens
YTKDLFQQR

SEQ ID NO: 131272 - protein, 9 aa, Homo Sapiens
MHSHHRPHQ

SEQ ID NO: 131273 - protein, 9 aa, Homo Sapiens
QVHYPFHCS

SEQ ID NO: 131274 - protein, 9 aa, Homo Sapiens
CPGEDELLK

SEQ ID NO: 131275 - protein, 9 aa, Homo Sapiens
RRMEEERLH

SEQ ID NO: 131276 - protein, 9 aa, Homo Sapiens
GWRDSSRES

SEQ ID NO: 131277 - protein, 9 aa, Homo Sapiens
AAAFNTTVT

SEQ ID NO: 131278 - protein, 9 aa, Homo Sapiens
HKSKEATPV

SEQ ID NO: 131279 - protein, 9 aa, Homo Sapiens
RTHSQQCAN

SEQ ID NO: 131280 - protein, 9 aa, Homo Sapiens
SWVLCRTHS

SEQ ID NO: 131281 - protein, 9 aa, Homo Sapiens
RNLLRLQSL

SEQ ID NO: 131282 - protein, 9 aa, Homo Sapiens
TISCPFQSP

SEQ ID NO: 131283 - protein, 9 aa, Homo Sapiens
LPTPQFGRR

SEQ ID NO: 131284 - protein, 9 aa, Homo Sapiens
LGSPSTSIP

SEQ ID NO: 131285 - protein, 9 aa, Homo Sapiens
DRTKTQTRL

SEQ ID NO: 131286 - protein, 9 aa, Homo Sapiens
YCLVGYEVL

SEQ ID NO: 131287 - protein, 9 aa, Homo Sapiens
LEVLEDAEM

SEQ ID NO: 131288 - protein, 9 aa, Homo Sapiens
SLCRYRQVI

SEQ ID NO: 131289 - protein, 9 aa, Homo Sapiens
HGQYIHCHA

SEQ ID NO: 131290 - protein, 9 aa, Homo Sapiens
GPPTVPSAP

SEQ ID NO: 131291 - protein, 9 aa, Homo Sapiens
PHTETPSAG

SEQ ID NO: 131292 - protein, 9 aa, Homo Sapiens
AVLHGAPAA

SEQ ID NO: 131293 - protein, 9 aa, Homo Sapiens
AIGDRGPQA

SEQ ID NO: 131294 - protein, 9 aa, Homo Sapiens
LTETSLMKV

SEQ ID NO: 131295 - protein, 9 aa, Homo Sapiens
DRVKIHQDL

SEQ ID NO: 131296 - protein, 9 aa, Homo Sapiens
PAFCSRRWR

SEQ ID NO: 131297 - protein, 9 aa, Homo Sapiens
SRMIQKTRK

SEQ ID NO: 131298 - protein, 9 aa, Homo Sapiens
SLCPSRSDS

SEQ ID NO: 131299 - protein, 9 aa, Homo Sapiens
PPGERLPGL

SEQ ID NO: 131300 - protein, 9 aa, Homo Sapiens
KCQLEHNAY

SEQ ID NO: 131301 - protein, 9 aa, Homo Sapiens
KEVLLKRVA

SEQ ID NO: 131302 - protein, 9 aa, Homo Sapiens
LALSLALEK

SEQ ID NO: 131303 - protein, 9 aa, Homo Sapiens
PTPTSDTPK

SEQ ID NO: 131304 - protein, 9 aa, Homo Sapiens
RGVLELTSA

SEQ ID NO: 131305 - protein, 9 aa, Homo Sapiens
RSISTKAPT

SEQ ID NO: 131306 - protein, 9 aa, Homo Sapiens
WQPLGNKSI

SEQ ID NO: 131307 - protein, 9 aa, Homo Sapiens
KGRKKTKLE

SEQ ID NO: 131308 - protein, 9 aa, Homo Sapiens
SGDAFASWS

SEQ ID NO: 131309 - protein, 9 aa, Homo Sapiens
LRLWRIHRR

SEQ ID NO: 131310 - protein, 9 aa, Homo Sapiens
IPKSLGLSS

SEQ ID NO: 131311 - protein, 9 aa, Homo Sapiens
VSNVTLEDQ

SEQ ID NO: 131312 - protein, 9 aa, Homo Sapiens
ASGISSIRA

SEQ ID NO: 131313 - protein, 9 aa, Homo Sapiens
IALGMLLAL

SEQ ID NO: 131314 - protein, 9 aa, Homo Sapiens
HLQDHHLHH

SEQ ID NO: 131315 - protein, 9 aa, Homo Sapiens
AEDEPPRMG

SEQ ID NO: 131316 - protein, 9 aa, Homo Sapiens
VLMKICLKA

SEQ ID NO: 131317 - protein, 9 aa, Homo Sapiens
EPKMGAGWR

SEQ ID NO: 131318 - protein, 9 aa, Homo Sapiens
EVQSETERI

SEQ ID NO: 131319 - protein, 9 aa, Homo Sapiens
VRGGSFITK

SEQ ID NO: 131320 - protein, 9 aa, Homo Sapiens
FHCKDCKIR

SEQ ID NO: 131321 - protein, 9 aa, Homo Sapiens
GNPLLLQQP

SEQ ID NO: 131322 - protein, 9 aa, Homo Sapiens
MEKAAWHHM

SEQ ID NO: 131323 - protein, 9 aa, Homo Sapiens
SMHYFCLIL

SEQ ID NO: 131324 - protein, 9 aa, Homo Sapiens
FQEMGLLRM

SEQ ID NO: 131325 - protein, 9 aa, Homo Sapiens
ESVRAGNLQ

SEQ ID NO: 131326 - protein, 9 aa, Homo Sapiens
SDHHCQSPG

SEQ ID NO: 131327 - protein, 9 aa, Homo Sapiens
KLRVLQKKH

SEQ ID NO: 131328 - protein, 9 aa, Homo Sapiens
NSGIDFGVV

SEQ ID NO: 131329 - protein, 9 aa, Homo Sapiens
MSATVQNRE

SEQ ID NO: 131330 - protein, 9 aa, Homo Sapiens
SGHTKGVNA

SEQ ID NO: 131331 - protein, 9 aa, Homo Sapiens
RSGLHPWTC

SEQ ID NO: 131332 - protein, 9 aa, Homo Sapiens
DERYGKELV

SEQ ID NO: 131333 - protein, 9 aa, Homo Sapiens
EGYHLPAPM

SEQ ID NO: 131334 - protein, 9 aa, Homo Sapiens
ENYSKKAKE

SEQ ID NO: 131335 - protein, 9 aa, Homo Sapiens
VRIIPYNSQ

SEQ ID NO: 131336 - protein, 9 aa, Homo Sapiens
AFNTTVTAL

SEQ ID NO: 131337 - protein, 9 aa, Homo Sapiens
SPHLLHPGT

SEQ ID NO: 131338 - protein, 9 aa, Homo Sapiens
GSSPLPCLC

SEQ ID NO: 131339 - protein, 9 aa, Homo Sapiens
GDGLKNTPR

SEQ ID NO: 131340 - protein, 9 aa, Homo Sapiens
ASLETRFSN

SEQ ID NO: 131341 - protein, 9 aa, Homo Sapiens
TLSPAITSI

SEQ ID NO: 131342 - protein, 9 aa, Homo Sapiens
NTHPLLQAC

SEQ ID NO: 131343 - protein, 9 aa, Homo Sapiens
FCPKILNFN

SEQ ID NO: 131344 - protein, 9 aa, Homo Sapiens
TTFAFHLRV

SEQ ID NO: 131345 - protein, 9 aa, Homo Sapiens
EGARKYARK

SEQ ID NO: 131346 - protein, 9 aa, Homo Sapiens
LEDGAADVR

SEQ ID NO: 131347 - protein, 9 aa, Homo Sapiens
VTLCVVPIA

SEQ ID NO: 131348 - protein, 9 aa, Homo Sapiens
FFCDLNPFL

SEQ ID NO: 131349 - protein, 9 aa, Homo Sapiens
SDSLLDIIT

SEQ ID NO: 131350 - protein, 9 aa, Homo Sapiens
LVVGGIQKV

SEQ ID NO: 131351 - protein, 9 aa, Homo Sapiens
LMNSCMSRS

SEQ ID NO: 131352 - protein, 9 aa, Homo Sapiens
TIRTRASGR

SEQ ID NO: 131353 - protein, 9 aa, Homo Sapiens
TANYERQPR

SEQ ID NO: 131354 - protein, 9 aa, Homo Sapiens
PQTPCWGWH

SEQ ID NO: 131355 - protein, 9 aa, Homo Sapiens
VVPLDEITV

SEQ ID NO: 131356 - protein, 9 aa, Homo Sapiens
RPKTPCGPP

SEQ ID NO: 131357 - protein, 9 aa, Homo Sapiens
PSMAVSAQV

SEQ ID NO: 131358 - protein, 9 aa, Homo Sapiens
GLWLALMVV

SEQ ID NO: 131359 - protein, 9 aa, Homo Sapiens
DHLLPRPGP

SEQ ID NO: 131360 - protein, 9 aa, Homo Sapiens
GGRESVLQK

SEQ ID NO: 131361 - protein, 9 aa, Homo Sapiens
QKKHLRNLR

SEQ ID NO: 131362 - protein, 9 aa, Homo Sapiens
AILTRYRAN

SEQ ID NO: 131363 - protein, 9 aa, Homo Sapiens
LTKPALKSE

SEQ ID NO: 131364 - protein, 9 aa, Homo Sapiens
LRGALQAAC

SEQ ID NO: 131365 - protein, 9 aa, Homo Sapiens
VRSAYKRLS

SEQ ID NO: 131366 - protein, 9 aa, Homo Sapiens
SDEYRFAWR

SEQ ID NO: 131367 - protein, 9 aa, Homo Sapiens
VHYACREGF

SEQ ID NO: 131368 - protein, 9 aa, Homo Sapiens
RCVLGCQPD

SEQ ID NO: 131369 - protein, 9 aa, Homo Sapiens
ITSTSVRLV

SEQ ID NO: 131370 - protein, 9 aa, Homo Sapiens
CYSPRTSLL

SEQ ID NO: 131371 - protein, 9 aa, Homo Sapiens
STAMYNNTQ

SEQ ID NO: 131372 - protein, 9 aa, Homo Sapiens
PRLGHVVFS

SEQ ID NO: 131373 - protein, 9 aa, Homo Sapiens
REFNPGSSG

SEQ ID NO: 131374 - protein, 9 aa, Homo Sapiens
KVNTDLLRE

SEQ ID NO: 131375 - protein, 9 aa, Homo Sapiens
NTSLYPGLN

SEQ ID NO: 131376 - protein, 9 aa, Homo Sapiens
TGVDWAPKS

SEQ ID NO: 131377 - protein, 9 aa, Homo Sapiens
TYTLHVTTI

SEQ ID NO: 131378 - protein, 9 aa, Homo Sapiens
CLPRAGGAE

SEQ ID NO: 131379 - protein, 9 aa, Homo Sapiens
VKDPSNAAN

SEQ ID NO: 131380 - protein, 9 aa, Homo Sapiens
TGPPHEYRF

SEQ ID NO: 131381 - protein, 9 aa, Homo Sapiens
SMRYSRLKA

SEQ ID NO: 131382 - protein, 9 aa, Homo Sapiens
CLVILVTLV

SEQ ID NO: 131383 - protein, 9 aa, Homo Sapiens
EPLERRKGE

SEQ ID NO: 131384 - protein, 9 aa, Homo Sapiens
CLPLLYLRM

SEQ ID NO: 131385 - protein, 9 aa, Homo Sapiens
ASCGQPCPG

SEQ ID NO: 131386 - protein, 9 aa, Homo Sapiens
AAANVLHGL

SEQ ID NO: 131387 - protein, 9 aa, Homo Sapiens
HVGKPFSEN

SEQ ID NO: 131388 - protein, 9 aa, Homo Sapiens
HSVASTLAP

SEQ ID NO: 131389 - protein, 9 aa, Homo Sapiens
HQDHGIQSM

SEQ ID NO: 131390 - protein, 9 aa, Homo Sapiens
VAGSGSSPG

SEQ ID NO: 131391 - protein, 9 aa, Homo Sapiens
ATIGEAREA

SEQ ID NO: 131392 - protein, 9 aa, Homo Sapiens
VPMSAVNFE

SEQ ID NO: 131393 - protein, 9 aa, Homo Sapiens
NFPQQHCAK

SEQ ID NO: 131394 - protein, 9 aa, Homo Sapiens
RENWTHLLQ

SEQ ID NO: 131395 - protein, 9 aa, Homo Sapiens
VSEEQSSTP

SEQ ID NO: 131396 - protein, 9 aa, Homo Sapiens
EEEVSATFN

SEQ ID NO: 131397 - protein, 9 aa, Homo Sapiens
RQLQQHNFS

SEQ ID NO: 131398 - protein, 9 aa, Homo Sapiens
KLCRDKPSE

SEQ ID NO: 131399 - protein, 9 aa, Homo Sapiens
QRLALEVLL

SEQ ID NO: 131400 - protein, 9 aa, Homo Sapiens
RDHRDHILQ

SEQ ID NO: 131401 - protein, 9 aa, Homo Sapiens
QHVDAWVIA

SEQ ID NO: 131402 - protein, 9 aa, Homo Sapiens
IERIKVSNA

SEQ ID NO: 131403 - protein, 9 aa, Homo Sapiens
DFEKKKVYA

SEQ ID NO: 131404 - protein, 9 aa, Homo Sapiens
LDKVNQWCE

SEQ ID NO: 131405 - protein, 9 aa, Homo Sapiens
QCHVTRAKV

SEQ ID NO: 131406 - protein, 9 aa, Homo Sapiens
WGHSQPADF

SEQ ID NO: 131407 - protein, 9 aa, Homo Sapiens
KVEELKKKI

SEQ ID NO: 131408 - protein, 9 aa, Homo Sapiens
FNKKENTLV

SEQ ID NO: 131409 - protein, 9 aa, Homo Sapiens
FFGAKHIFS

SEQ ID NO: 131410 - protein, 9 aa, Homo Sapiens
NVGRPSIRI

SEQ ID NO: 131411 - protein, 9 aa, Homo Sapiens
HQDSPSPDF

SEQ ID NO: 131412 - protein, 9 aa, Homo Sapiens
IKFYRMKHH

SEQ ID NO: 131413 - protein, 9 aa, Homo Sapiens
AMEKAAWHH

SEQ ID NO: 131414 - protein, 9 aa, Homo Sapiens
QRCALSHPK

SEQ ID NO: 131415 - protein, 9 aa, Homo Sapiens
FQYSQLISF

SEQ ID NO: 131416 - protein, 9 aa, Homo Sapiens
ADFKMEEKM

SEQ ID NO: 131417 - protein, 9 aa, Homo Sapiens
ECSRLQEPL

SEQ ID NO: 131418 - protein, 9 aa, Homo Sapiens
HILYGYSMA

SEQ ID NO: 131419 - protein, 9 aa, Homo Sapiens
LRHHFRQQR

SEQ ID NO: 131420 - protein, 9 aa, Homo Sapiens
LGSVADFLL

SEQ ID NO: 131421 - protein, 9 aa, Homo Sapiens
FCYDYLWRV

SEQ ID NO: 131422 - protein, 9 aa, Homo Sapiens
DYRLVSAAA

SEQ ID NO: 131423 - protein, 9 aa, Homo Sapiens
MVIAYFSWA

SEQ ID NO: 131424 - protein, 9 aa, Homo Sapiens
KQDRDITLL

SEQ ID NO: 131425 - protein, 9 aa, Homo Sapiens
AVSPPAGHL

SEQ ID NO: 131426 - protein, 9 aa, Homo Sapiens
SAQLNGLTL

SEQ ID NO: 131427 - protein, 9 aa, Homo Sapiens
GLLMAVQED

SEQ ID NO: 131428 - protein, 9 aa, Homo Sapiens
ENGRKNLQT

SEQ ID NO: 131429 - protein, 9 aa, Homo Sapiens
TDIVHRHPR

SEQ ID NO: 131430 - protein, 9 aa, Homo Sapiens
YVYEYMLHI

SEQ ID NO: 131431 - protein, 9 aa, Homo Sapiens
EKCDCSLGY

SEQ ID NO: 131432 - protein, 9 aa, Homo Sapiens
FKCKNVGRP

SEQ ID NO: 131433 - protein, 9 aa, Homo Sapiens
FCWINVHLQ

SEQ ID NO: 131434 - protein, 9 aa, Homo Sapiens
TALPTRRPP

SEQ ID NO: 131435 - protein, 9 aa, Homo Sapiens
AGQMPRKMR

SEQ ID NO: 131436 - protein, 9 aa, Homo Sapiens
LRVERSPSP

SEQ ID NO: 131437 - protein, 9 aa, Homo Sapiens
TQHFREKLP

SEQ ID NO: 131438 - protein, 9 aa, Homo Sapiens
SCLEAQKFF

SEQ ID NO: 131439 - protein, 9 aa, Homo Sapiens
GGTVSVATG

SEQ ID NO: 131440 - protein, 9 aa, Homo Sapiens
LLIALGMLL

SEQ ID NO: 131441 - protein, 9 aa, Homo Sapiens
IVLPGEMIK

SEQ ID NO: 131442 - protein, 9 aa, Homo Sapiens
ALMCFLRRR

SEQ ID NO: 131443 - protein, 9 aa, Homo Sapiens
VLRVMRLTR

SEQ ID NO: 131444 - protein, 9 aa, Homo Sapiens
FEVSQRAPG

SEQ ID NO: 131445 - protein, 9 aa, Homo Sapiens
IWFQNQRSK

SEQ ID NO: 131446 - protein, 9 aa, Homo Sapiens
IKGKKQKCI

SEQ ID NO: 131447 - protein, 9 aa, Homo Sapiens
MIKIENPLV

SEQ ID NO: 131448 - protein, 9 aa, Homo Sapiens
SDVFRSVMA

SEQ ID NO: 131449 - protein, 9 aa, Homo Sapiens
QPAYAATGF

SEQ ID NO: 131450 - protein, 9 aa, Homo Sapiens
TLNFRRNKN

SEQ ID NO: 131451 - protein, 9 aa, Homo Sapiens
RRQPRVMSQ

SEQ ID NO: 131452 - protein, 9 aa, Homo Sapiens
WNFFTLILS

SEQ ID NO: 131453 - protein, 9 aa, Homo Sapiens
WMTSLISSL

SEQ ID NO: 131454 - protein, 9 aa, Homo Sapiens
LILSTSQEL

SEQ ID NO: 131455 - protein, 9 aa, Homo Sapiens
GLSRVFFQA

SEQ ID NO: 131456 - protein, 9 aa, Homo Sapiens
PLRIDTLTW

SEQ ID NO: 131457 - protein, 9 aa, Homo Sapiens
VPETFSAPL

SEQ ID NO: 131458 - protein, 9 aa, Homo Sapiens
LVLQIDMKH

SEQ ID NO: 131459 - protein, 9 aa, Homo Sapiens
LAPLQTDYY

SEQ ID NO: 131460 - protein, 9 aa, Homo Sapiens
CEAHARQVL

SEQ ID NO: 131461 - protein, 9 aa, Homo Sapiens
QRHVALQLE

SEQ ID NO: 131462 - protein, 9 aa, Homo Sapiens
YSQGSLIDL

SEQ ID NO: 131463 - protein, 9 aa, Homo Sapiens
PDYVPQKFH

SEQ ID NO: 131464 - protein, 9 aa, Homo Sapiens
SSPTSTTST

SEQ ID NO: 131465 - protein, 9 aa, Homo Sapiens
NRWLSLQNL

SEQ ID NO: 131466 - protein, 9 aa, Homo Sapiens
FRQCRYLES

SEQ ID NO: 131467 - protein, 9 aa, Homo Sapiens
PKLKTTTKK

SEQ ID NO: 131468 - protein, 9 aa, Homo Sapiens
DVPHQIQHA

SEQ ID NO: 131469 - protein, 9 aa, Homo Sapiens
LQSQLSCLF

SEQ ID NO: 131470 - protein, 9 aa, Homo Sapiens
RRQQRMIKI

SEQ ID NO: 131471 - protein, 9 aa, Homo Sapiens
KKKTHLGKL

SEQ ID NO: 131472 - protein, 9 aa, Homo Sapiens
EVQPAYAAT

SEQ ID NO: 131473 - protein, 9 aa, Homo Sapiens
GLGLWLIYY

SEQ ID NO: 131474 - protein, 9 aa, Homo Sapiens
IQASESRAT

SEQ ID NO: 131475 - protein, 9 aa, Homo Sapiens
GSLRILRKS

SEQ ID NO: 131476 - protein, 9 aa, Homo Sapiens
PETFSAPLE

SEQ ID NO: 131477 - protein, 9 aa, Homo Sapiens
DSPRGSTSP

SEQ ID NO: 131478 - protein, 9 aa, Homo Sapiens
LWPASRLIF

SEQ ID NO: 131479 - protein, 9 aa, Homo Sapiens
PATVRPGTQ

SEQ ID NO: 131480 - protein, 9 aa, Homo Sapiens
VGGMRQGYS

SEQ ID NO: 131481 - protein, 9 aa, Homo Sapiens
ELGIRQGFC

SEQ ID NO: 131482 - protein, 9 aa, Homo Sapiens
ERDQTDKNP

SEQ ID NO: 131483 - protein, 9 aa, Homo Sapiens
WCRCPLSYQ

SEQ ID NO: 131484 - protein, 9 aa, Homo Sapiens
YLLLAGAPP

SEQ ID NO: 131485 - protein, 9 aa, Homo Sapiens
DLYDYISEW

SEQ ID NO: 131486 - protein, 9 aa, Homo Sapiens
DRSVRDKYS

SEQ ID NO: 131487 - protein, 9 aa, Homo Sapiens
QATPQGAIQ

SEQ ID NO: 131488 - protein, 9 aa, Homo Sapiens
VGVDVPLVN

SEQ ID NO: 131489 - protein, 9 aa, Homo Sapiens
EKDLIRSVL

SEQ ID NO: 131490 - protein, 9 aa, Homo Sapiens
LLGLLIITL

SEQ ID NO: 131491 - protein, 9 aa, Homo Sapiens
GTVSVATGP

SEQ ID NO: 131492 - protein, 9 aa, Homo Sapiens
YRFLLLENV

SEQ ID NO: 131493 - protein, 9 aa, Homo Sapiens
RTPKLARHA

SEQ ID NO: 131494 - protein, 9 aa, Homo Sapiens
LECFEKICP

SEQ ID NO: 131495 - protein, 9 aa, Homo Sapiens
GLTSPAASA

SEQ ID NO: 131496 - protein, 9 aa, Homo Sapiens
KTWYLLAVD

SEQ ID NO: 131497 - protein, 9 aa, Homo Sapiens
SHQDELDFL

SEQ ID NO: 131498 - protein, 9 aa, Homo Sapiens
ILQGFQQIK

SEQ ID NO: 131499 - protein, 9 aa, Homo Sapiens
KSQGGRILL

SEQ ID NO: 131500 - protein, 9 aa, Homo Sapiens
GDEYDAHAV

SEQ ID NO: 131501 - protein, 9 aa, Homo Sapiens
APEGCTYDC

SEQ ID NO: 131502 - protein, 9 aa, Homo Sapiens
TRIFRILKL

SEQ ID NO: 131503 - protein, 9 aa, Homo Sapiens
FLQKDNISM

SEQ ID NO: 131504 - protein, 9 aa, Homo Sapiens
ELRSLVELR

SEQ ID NO: 131505 - protein, 9 aa, Homo Sapiens
GAPHPSDLR

SEQ ID NO: 131506 - protein, 9 aa, Homo Sapiens
IKERAHNVT

SEQ ID NO: 131507 - protein, 9 aa, Homo Sapiens
PEPLTYDYR

SEQ ID NO: 131508 - protein, 9 aa, Homo Sapiens
IGCFIFLIP

SEQ ID NO: 131509 - protein, 9 aa, Homo Sapiens
DVETSHDAA

SEQ ID NO: 131510 - protein, 9 aa, Homo Sapiens
PGPIKPKVP

SEQ ID NO: 131511 - protein, 9 aa, Homo Sapiens
PGHVDAAPE

SEQ ID NO: 131512 - protein, 9 aa, Homo Sapiens
STTKHVFEK

SEQ ID NO: 131513 - protein, 9 aa, Homo Sapiens
GLPEGYSVA

SEQ ID NO: 131514 - protein, 9 aa, Homo Sapiens
QMKFYFRFT

SEQ ID NO: 131515 - protein, 9 aa, Homo Sapiens
VRNLHPPRM

SEQ ID NO: 131516 - protein, 9 aa, Homo Sapiens
ELCAQHNGS

SEQ ID NO: 131517 - protein, 9 aa, Homo Sapiens
SYTRWLQKS

SEQ ID NO: 131518 - protein, 9 aa, Homo Sapiens
CSGTILAYC

SEQ ID NO: 131519 - protein, 9 aa, Homo Sapiens
EQIKYIVAQ

SEQ ID NO: 131520 - protein, 9 aa, Homo Sapiens
LHILAVVML

SEQ ID NO: 131521 - protein, 9 aa, Homo Sapiens
LVTLVNPEG

SEQ ID NO: 131522 - protein, 9 aa, Homo Sapiens
NSSKWNSTF

SEQ ID NO: 131523 - protein, 9 aa, Homo Sapiens
SQPTVIRDI

SEQ ID NO: 131524 - protein, 9 aa, Homo Sapiens
YFCENRHHY

SEQ ID NO: 131525 - protein, 9 aa, Homo Sapiens
MSCLSRPGW

SEQ ID NO: 131526 - protein, 9 aa, Homo Sapiens
QKAQVTLMT

SEQ ID NO: 131527 - protein, 9 aa, Homo Sapiens
ILNREREIV

SEQ ID NO: 131528 - protein, 9 aa, Homo Sapiens
RKLLGADAA

SEQ ID NO: 131529 - protein, 9 aa, Homo Sapiens
SSRHAAHRP

SEQ ID NO: 131530 - protein, 9 aa, Homo Sapiens
RCLLKVQFN

SEQ ID NO: 131531 - protein, 9 aa, Homo Sapiens
QAVRPCVKT

SEQ ID NO: 131532 - protein, 9 aa, Homo Sapiens
VKIINTKKL

SEQ ID NO: 131533 - protein, 9 aa, Homo Sapiens
DPSPHHHQC

SEQ ID NO: 131534 - protein, 9 aa, Homo Sapiens
HIVVVTLRQ

SEQ ID NO: 131535 - protein, 9 aa, Homo Sapiens
PLGNKSILG

SEQ ID NO: 131536 - protein, 9 aa, Homo Sapiens
NPFLMTTFW

SEQ ID NO: 131537 - protein, 9 aa, Homo Sapiens
CSGPRPRCR

SEQ ID NO: 131538 - protein, 9 aa, Homo Sapiens
EIYDFPQKF

SEQ ID NO: 131539 - protein, 9 aa, Homo Sapiens
ALPFFLLFT

SEQ ID NO: 131540 - protein, 9 aa, Homo Sapiens
GRSPMNAMH

SEQ ID NO: 131541 - protein, 9 aa, Homo Sapiens
AAAVFSALE

SEQ ID NO: 131542 - protein, 9 aa, Homo Sapiens
PAYDYFKDT

SEQ ID NO: 131543 - protein, 9 aa, Homo Sapiens
HIKTSTVSP

SEQ ID NO: 131544 - protein, 9 aa, Homo Sapiens
CKHLLYPAI

SEQ ID NO: 131545 - protein, 9 aa, Homo Sapiens
ITKPEGPGG

SEQ ID NO: 131546 - protein, 9 aa, Homo Sapiens
PLGMTCSID

SEQ ID NO: 131547 - protein, 9 aa, Homo Sapiens
LMTTFWKTD

SEQ ID NO: 131548 - protein, 9 aa, Homo Sapiens
GCKRWAGIL

SEQ ID NO: 131549 - protein, 9 aa, Homo Sapiens
SVVIQQPPS

SEQ ID NO: 131550 - protein, 9 aa, Homo Sapiens
CFDLEGESE

SEQ ID NO: 131551 - protein, 9 aa, Homo Sapiens
LMGDKFKGQ

SEQ ID NO: 131552 - protein, 9 aa, Homo Sapiens
KVVGQLLPL

SEQ ID NO: 131553 - protein, 9 aa, Homo Sapiens
PGWKRRKVF

SEQ ID NO: 131554 - protein, 9 aa, Homo Sapiens
NKSILGYNL

SEQ ID NO: 131555 - protein, 9 aa, Homo Sapiens
ALRRLYTSS

SEQ ID NO: 131556 - protein, 9 aa, Homo Sapiens
NEDAADGAF

SEQ ID NO: 131557 - protein, 9 aa, Homo Sapiens
QMMSATVQN

SEQ ID NO: 131558 - protein, 9 aa, Homo Sapiens
KETWNCWAE

SEQ ID NO: 131559 - protein, 9 aa, Homo Sapiens
APAAMRAAL

SEQ ID NO: 131560 - protein, 9 aa, Homo Sapiens
TNWAQYRQV

SEQ ID NO: 131561 - protein, 9 aa, Homo Sapiens
NVGSHSLRS

SEQ ID NO: 131562 - protein, 9 aa, Homo Sapiens
VEIRHRHSE

SEQ ID NO: 131563 - protein, 9 aa, Homo Sapiens
DLDNDMKKL

SEQ ID NO: 131564 - protein, 9 aa, Homo Sapiens
ASDSAEKRR

SEQ ID NO: 131565 - protein, 9 aa, Homo Sapiens
SISVILKDV

SEQ ID NO: 131566 - protein, 9 aa, Homo Sapiens
SSMGLQECH

SEQ ID NO: 131567 - protein, 9 aa, Homo Sapiens
NVVNNFFVT

SEQ ID NO: 131568 - protein, 9 aa, Homo Sapiens
WSGHTKGVN

SEQ ID NO: 131569 - protein, 9 aa, Homo Sapiens
HGGFQPEST

SEQ ID NO: 131570 - protein, 9 aa, Homo Sapiens
VPGVPGRLC

SEQ ID NO: 131571 - protein, 9 aa, Homo Sapiens
PWPRPLPRK

SEQ ID NO: 131572 - protein, 9 aa, Homo Sapiens
DPKETNFSD

SEQ ID NO: 131573 - protein, 9 aa, Homo Sapiens
HLPPHGYPL

SEQ ID NO: 131574 - protein, 9 aa, Homo Sapiens
CKRYCSTLD

SEQ ID NO: 131575 - protein, 9 aa, Homo Sapiens
EASTPGRGR

SEQ ID NO: 131576 - protein, 9 aa, Homo Sapiens
LEPLASRSC

SEQ ID NO: 131577 - protein, 9 aa, Homo Sapiens
QNSGIDFGV

SEQ ID NO: 131578 - protein, 9 aa, Homo Sapiens
NFFTLILST

SEQ ID NO: 131579 - protein, 9 aa, Homo Sapiens
QRRMLKVTC

SEQ ID NO: 131580 - protein, 9 aa, Homo Sapiens
ARGPWRAAT

SEQ ID NO: 131581 - protein, 9 aa, Homo Sapiens
REGVILSGE

SEQ ID NO: 131582 - protein, 9 aa, Homo Sapiens
LEIDVQTRD

SEQ ID NO: 131583 - protein, 9 aa, Homo Sapiens
LNKWIPTCT

SEQ ID NO: 131584 - protein, 9 aa, Homo Sapiens
IDFTQEEWV

SEQ ID NO: 131585 - protein, 9 aa, Homo Sapiens
SLAGPWANS

SEQ ID NO: 131586 - protein, 9 aa, Homo Sapiens
PDPGCNYDQ

SEQ ID NO: 131587 - protein, 9 aa, Homo Sapiens
EAGAEREFR

SEQ ID NO: 131588 - protein, 9 aa, Homo Sapiens
NLIFQYSQL

SEQ ID NO: 131589 - protein, 9 aa, Homo Sapiens
AGPKQELCA

SEQ ID NO: 131590 - protein, 9 aa, Homo Sapiens
VVDEIHVLQ

SEQ ID NO: 131591 - protein, 9 aa, Homo Sapiens
ANDHTQAVG

SEQ ID NO: 131592 - protein, 9 aa, Homo Sapiens
CTSLLQVIL

SEQ ID NO: 131593 - protein, 9 aa, Homo Sapiens
RVPLCPSGR

SEQ ID NO: 131594 - protein, 9 aa, Homo Sapiens
LIEKCDCSL

SEQ ID NO: 131595 - protein, 9 aa, Homo Sapiens
GAAEPFLTQ

SEQ ID NO: 131596 - protein, 9 aa, Homo Sapiens
TSSTGLVPC

SEQ ID NO: 131597 - protein, 9 aa, Homo Sapiens
KELILSPGC

SEQ ID NO: 131598 - protein, 9 aa, Homo Sapiens
TSTCTRPWS

SEQ ID NO: 131599 - protein, 9 aa, Homo Sapiens
DNLKTHPLA

SEQ ID NO: 131600 - protein, 9 aa, Homo Sapiens
DVTCQCLKG

SEQ ID NO: 131601 - protein, 9 aa, Homo Sapiens
VHRHPRFDL

SEQ ID NO: 131602 - protein, 9 aa, Homo Sapiens
MSQCAHREE

SEQ ID NO: 131603 - protein, 9 aa, Homo Sapiens
EWVMMDTSK

SEQ ID NO: 131604 - protein, 9 aa, Homo Sapiens
TKRITFLFD

SEQ ID NO: 131605 - protein, 9 aa, Homo Sapiens
ALDILLVRD

SEQ ID NO: 131606 - protein, 9 aa, Homo Sapiens
PQQHSDGEE

SEQ ID NO: 131607 - protein, 9 aa, Homo Sapiens
EEEEEKGLL

SEQ ID NO: 131608 - protein, 9 aa, Homo Sapiens
LLGIILWLF

SEQ ID NO: 131609 - protein, 9 aa, Homo Sapiens
LTVVDTASL

SEQ ID NO: 131610 - protein, 9 aa, Homo Sapiens
LIMPPIKEG

SEQ ID NO: 131611 - protein, 9 aa, Homo Sapiens
KYVFSLAEL

SEQ ID NO: 131612 - protein, 9 aa, Homo Sapiens
GDKPSTTIH

SEQ ID NO: 131613 - protein, 9 aa, Homo Sapiens
SSSNTSSGS

SEQ ID NO: 131614 - protein, 9 aa, Homo Sapiens
EPQRPPRSI

SEQ ID NO: 131615 - protein, 9 aa, Homo Sapiens
EIKGKKQKC

SEQ ID NO: 131616 - protein, 9 aa, Homo Sapiens
LGKQYWPIT

SEQ ID NO: 131617 - protein, 9 aa, Homo Sapiens
AEPHPETHP

SEQ ID NO: 131618 - protein, 9 aa, Homo Sapiens
QSERKSGGE

SEQ ID NO: 131619 - protein, 9 aa, Homo Sapiens
MAETRISLH

SEQ ID NO: 131620 - protein, 9 aa, Homo Sapiens
GQPQGEQRH

SEQ ID NO: 131621 - protein, 9 aa, Homo Sapiens
ITRSGGGGI

SEQ ID NO: 131622 - protein, 9 aa, Homo Sapiens
PSAGYRCRW

SEQ ID NO: 131623 - protein, 9 aa, Homo Sapiens
LKAGCRSYT

SEQ ID NO: 131624 - protein, 9 aa, Homo Sapiens
PPQLSVTPT

SEQ ID NO: 131625 - protein, 9 aa, Homo Sapiens
SHEGKWDYV

SEQ ID NO: 131626 - protein, 9 aa, Homo Sapiens
NPNPHMYED

SEQ ID NO: 131627 - protein, 9 aa, Homo Sapiens
DKYRAPIRG

SEQ ID NO: 131628 - protein, 9 aa, Homo Sapiens
SQVFQNHLV

SEQ ID NO: 131629 - protein, 9 aa, Homo Sapiens
LLKNYLSPS

SEQ ID NO: 131630 - protein, 9 aa, Homo Sapiens
SQVYTQNVE

SEQ ID NO: 131631 - protein, 9 aa, Homo Sapiens
WENLTFNSI

SEQ ID NO: 131632 - protein, 9 aa, Homo Sapiens
VPERVVKDD

SEQ ID NO: 131633 - protein, 9 aa, Homo Sapiens
MLKFLLFDM

SEQ ID NO: 131634 - protein, 9 aa, Homo Sapiens
ENSHPNPFL

SEQ ID NO: 131635 - protein, 9 aa, Homo Sapiens
RLFLAQCLR

SEQ ID NO: 131636 - protein, 9 aa, Homo Sapiens
DYSGGKPIQ

SEQ ID NO: 131637 - protein, 9 aa, Homo Sapiens
DKVFLPQSA

SEQ ID NO: 131638 - protein, 9 aa, Homo Sapiens
RGSNEPGKR

SEQ ID NO: 131639 - protein, 9 aa, Homo Sapiens
TAQRISCRL

SEQ ID NO: 131640 - protein, 9 aa, Homo Sapiens
RVYIPLPEE

SEQ ID NO: 131641 - protein, 9 aa, Homo Sapiens
PPTKKRGKS

SEQ ID NO: 131642 - protein, 9 aa, Homo Sapiens
VSCCPAPDG

SEQ ID NO: 131643 - protein, 9 aa, Homo Sapiens
RTKTQTRLV

SEQ ID NO: 131644 - protein, 9 aa, Homo Sapiens
PLPSLVIVL

SEQ ID NO: 131645 - protein, 9 aa, Homo Sapiens
TVFRDPCHD

SEQ ID NO: 131646 - protein, 9 aa, Homo Sapiens
NVEMRPLGC

SEQ ID NO: 131647 - protein, 9 aa, Homo Sapiens
SLMVDSDVA

SEQ ID NO: 131648 - protein, 9 aa, Homo Sapiens
GRCRAWLWL

SEQ ID NO: 131649 - protein, 9 aa, Homo Sapiens
CVFGKPFAT

SEQ ID NO: 131650 - protein, 9 aa, Homo Sapiens
EAATAAVAP

SEQ ID NO: 131651 - protein, 9 aa, Homo Sapiens
HTWRARSTS

SEQ ID NO: 131652 - protein, 9 aa, Homo Sapiens
GDSSCQADG

SEQ ID NO: 131653 - protein, 9 aa, Homo Sapiens
TDTIEEGTL

SEQ ID NO: 131654 - protein, 9 aa, Homo Sapiens
SLLNEMTHK

SEQ ID NO: 131655 - protein, 9 aa, Homo Sapiens
RLGFLVDPR

SEQ ID NO: 131656 - protein, 9 aa, Homo Sapiens
SISGPDGYK

SEQ ID NO: 131657 - protein, 9 aa, Homo Sapiens
RTCLRRVRQ

SEQ ID NO: 131658 - protein, 9 aa, Homo Sapiens
KIITPYFNY

SEQ ID NO: 131659 - protein, 9 aa, Homo Sapiens
GLLLIAYYG

SEQ ID NO: 131660 - protein, 9 aa, Homo Sapiens
EGWLHLFDL

SEQ ID NO: 131661 - protein, 9 aa, Homo Sapiens
TLGLDHSSV

SEQ ID NO: 131662 - protein, 9 aa, Homo Sapiens
SFGQMSLSR

SEQ ID NO: 131663 - protein, 9 aa, Homo Sapiens
CLCPSSSPT

SEQ ID NO: 131664 - protein, 9 aa, Homo Sapiens
RAICQKVAL

SEQ ID NO: 131665 - protein, 9 aa, Homo Sapiens
LHIRQHSDG

SEQ ID NO: 131666 - protein, 9 aa, Homo Sapiens
TSTQSTPWM

SEQ ID NO: 131667 - protein, 9 aa, Homo Sapiens
RNIENISML

SEQ ID NO: 131668 - protein, 9 aa, Homo Sapiens
CPAPQEEEE

SEQ ID NO: 131669 - protein, 9 aa, Homo Sapiens
LITVPECSE

SEQ ID NO: 131670 - protein, 9 aa, Homo Sapiens
YKRAACGSR

SEQ ID NO: 131671 - protein, 9 aa, Homo Sapiens
RRERSRSWR

SEQ ID NO: 131672 - protein, 9 aa, Homo Sapiens
FSLFCAPWS

SEQ ID NO: 131673 - protein, 9 aa, Homo Sapiens
SHLKRGFLH

SEQ ID NO: 131674 - protein, 9 aa, Homo Sapiens
MRWRADGCS

SEQ ID NO: 131675 - protein, 9 aa, Homo Sapiens
MYPMTVGER

SEQ ID NO: 131676 - protein, 9 aa, Homo Sapiens
DSLLCSHLG

SEQ ID NO: 131677 - protein, 9 aa, Homo Sapiens
AHTWLLDVE

SEQ ID NO: 131678 - protein, 9 aa, Homo Sapiens
PSPSSAIPK

SEQ ID NO: 131679 - protein, 9 aa, Homo Sapiens
DASGHNTLS

SEQ ID NO: 131680 - protein, 9 aa, Homo Sapiens
SSQIYMNGS

SEQ ID NO: 131681 - protein, 9 aa, Homo Sapiens
YAGNDNYCL

SEQ ID NO: 131682 - protein, 9 aa, Homo Sapiens
KICKGCPHR

SEQ ID NO: 131683 - protein, 9 aa, Homo Sapiens
FCRCQTLNF

SEQ ID NO: 131684 - protein, 9 aa, Homo Sapiens
SKQLPAPLN

SEQ ID NO: 131685 - protein, 9 aa, Homo Sapiens
GTGHIPHLT

SEQ ID NO: 131686 - protein, 9 aa, Homo Sapiens
KAFAPTCIE

SEQ ID NO: 131687 - protein, 9 aa, Homo Sapiens
NTCARFCKC

SEQ ID NO: 131688 - protein, 9 aa, Homo Sapiens
NHLQQLEHL

SEQ ID NO: 131689 - protein, 9 aa, Homo Sapiens
SVDKEASTH

SEQ ID NO: 131690 - protein, 9 aa, Homo Sapiens
AEELQKNKK

SEQ ID NO: 131691 - protein, 9 aa, Homo Sapiens
VLAADHIRR

SEQ ID NO: 131692 - protein, 9 aa, Homo Sapiens
VESHMKGCD

SEQ ID NO: 131693 - protein, 9 aa, Homo Sapiens
PRWHLRVVP

SEQ ID NO: 131694 - protein, 9 aa, Homo Sapiens
ASSLCGPSQ

SEQ ID NO: 131695 - protein, 9 aa, Homo Sapiens
TVQEVDVIL

SEQ ID NO: 131696 - protein, 9 aa, Homo Sapiens
KDYFLSMSG

SEQ ID NO: 131697 - protein, 9 aa, Homo Sapiens
HAMKLNVPR

SEQ ID NO: 131698 - protein, 9 aa, Homo Sapiens
DVMNVGNPS

SEQ ID NO: 131699 - protein, 9 aa, Homo Sapiens
DEINSDLVS

SEQ ID NO: 131700 - protein, 9 aa, Homo Sapiens
RVPMSAVNF

SEQ ID NO: 131701 - protein, 9 aa, Homo Sapiens
VAAHEFGHT

SEQ ID NO: 131702 - protein, 9 aa, Homo Sapiens
RRRKGGGRE

SEQ ID NO: 131703 - protein, 9 aa, Homo Sapiens
IQVSEEQSS

SEQ ID NO: 131704 - protein, 9 aa, Homo Sapiens
EAHLTSYSL

SEQ ID NO: 131705 - protein, 9 aa, Homo Sapiens
GACKFDEYF

SEQ ID NO: 131706 - protein, 9 aa, Homo Sapiens
PQWVLTATH

SEQ ID NO: 131707 - protein, 9 aa, Homo Sapiens
CQPDFHMAP

SEQ ID NO: 131708 - protein, 9 aa, Homo Sapiens
LLQSQLSCL

SEQ ID NO: 131709 - protein, 9 aa, Homo Sapiens
KLNLEFGDP

SEQ ID NO: 131710 - protein, 9 aa, Homo Sapiens
NFIFNGNNL

SEQ ID NO: 131711 - protein, 9 aa, Homo Sapiens
ASDYGMKLS

SEQ ID NO: 131712 - protein, 9 aa, Homo Sapiens
ATTGPTATP

SEQ ID NO: 131713 - protein, 9 aa, Homo Sapiens
WWVYTLLLT

SEQ ID NO: 131714 - protein, 9 aa, Homo Sapiens
HRSAAALAA

SEQ ID NO: 131715 - protein, 9 aa, Homo Sapiens
LYTSSWRAD

SEQ ID NO: 131716 - protein, 9 aa, Homo Sapiens
ADVGEAGAE

SEQ ID NO: 131717 - protein, 9 aa, Homo Sapiens
LKIRASASR

SEQ ID NO: 131718 - protein, 9 aa, Homo Sapiens
SRPSAPWPS

SEQ ID NO: 131719 - protein, 9 aa, Homo Sapiens
VLHFLKKLI

SEQ ID NO: 131720 - protein, 9 aa, Homo Sapiens
RSYPEFQSS

SEQ ID NO: 131721 - protein, 9 aa, Homo Sapiens
CTRPWSSLE

SEQ ID NO: 131722 - protein, 9 aa, Homo Sapiens
QVVGWGDDN

SEQ ID NO: 131723 - protein, 9 aa, Homo Sapiens
ARCETDGTS

SEQ ID NO: 131724 - protein, 9 aa, Homo Sapiens
ILCTLIVFW

SEQ ID NO: 131725 - protein, 9 aa, Homo Sapiens
AFEEVLHKM

SEQ ID NO: 131726 - protein, 9 aa, Homo Sapiens
MFLSATHRY

SEQ ID NO: 131727 - protein, 9 aa, Homo Sapiens
LLAVDFTAA

SEQ ID NO: 131728 - protein, 9 aa, Homo Sapiens
AFDIIDLSV

SEQ ID NO: 131729 - protein, 9 aa, Homo Sapiens
VMRKPRRGV

SEQ ID NO: 131730 - protein, 9 aa, Homo Sapiens
ESNSAMPGP

SEQ ID NO: 131731 - protein, 9 aa, Homo Sapiens
EPSTPVLYL

SEQ ID NO: 131732 - protein, 9 aa, Homo Sapiens
GRRLSDFYV

SEQ ID NO: 131733 - protein, 9 aa, Homo Sapiens
LHLWTQPTL

SEQ ID NO: 131734 - protein, 9 aa, Homo Sapiens
TRRNEDGSG

SEQ ID NO: 131735 - protein, 9 aa, Homo Sapiens
GEPAFRKGD

SEQ ID NO: 131736 - protein, 9 aa, Homo Sapiens
NHPFIVKRH

SEQ ID NO: 131737 - protein, 9 aa, Homo Sapiens
WGSVSIPTG

SEQ ID NO: 131738 - protein, 9 aa, Homo Sapiens
GLLEASTLV

SEQ ID NO: 131739 - protein, 9 aa, Homo Sapiens
RPPRSILSL

SEQ ID NO: 131740 - protein, 9 aa, Homo Sapiens
HLSHLLEVL

SEQ ID NO: 131741 - protein, 9 aa, Homo Sapiens
GRDLMDVMN

SEQ ID NO: 131742 - protein, 9 aa, Homo Sapiens
DTAVREASS

SEQ ID NO: 131743 - protein, 9 aa, Homo Sapiens
SVGLFYTSR

SEQ ID NO: 131744 - protein, 9 aa, Homo Sapiens
IGFGVTLCV

SEQ ID NO: 131745 - protein, 9 aa, Homo Sapiens
LVRPIDPAA

SEQ ID NO: 131746 - protein, 9 aa, Homo Sapiens
QTTNEVKQA

SEQ ID NO: 131747 - protein, 9 aa, Homo Sapiens
LLGAAAVFS

SEQ ID NO: 131748 - protein, 9 aa, Homo Sapiens
QITSTSVRL

SEQ ID NO: 131749 - protein, 9 aa, Homo Sapiens
IGETCKIGV

SEQ ID NO: 131750 - protein, 9 aa, Homo Sapiens
TESGVTLQS

SEQ ID NO: 131751 - protein, 9 aa, Homo Sapiens
CRGAPQGPC

SEQ ID NO: 131752 - protein, 9 aa, Homo Sapiens
ELNEEFTSR

SEQ ID NO: 131753 - protein, 9 aa, Homo Sapiens
EQNSFEQFC

SEQ ID NO: 131754 - protein, 9 aa, Homo Sapiens
RSMCGAHKY

SEQ ID NO: 131755 - protein, 9 aa, Homo Sapiens
HCFCLIFFQ

SEQ ID NO: 131756 - protein, 9 aa, Homo Sapiens
TSFRSFCII

SEQ ID NO: 131757 - protein, 9 aa, Homo Sapiens
GDTLSPRHG

SEQ ID NO: 131758 - protein, 9 aa, Homo Sapiens
PRSSAQGVS

SEQ ID NO: 131759 - protein, 9 aa, Homo Sapiens
LSLEKKLEW

SEQ ID NO: 131760 - protein, 9 aa, Homo Sapiens
APRVPLCPS

SEQ ID NO: 131761 - protein, 9 aa, Homo Sapiens
KMAYLTVAF

SEQ ID NO: 131762 - protein, 9 aa, Homo Sapiens
VLTMDMPQV

SEQ ID NO: 131763 - protein, 9 aa, Homo Sapiens
PPSKTTTDL

SEQ ID NO: 131764 - protein, 9 aa, Homo Sapiens
PDKMGIRVY

SEQ ID NO: 131765 - protein, 9 aa, Homo Sapiens
IAVTAKDKG

SEQ ID NO: 131766 - protein, 9 aa, Homo Sapiens
SVTLYSQDV

SEQ ID NO: 131767 - protein, 9 aa, Homo Sapiens
SINNYRFQM

SEQ ID NO: 131768 - protein, 9 aa, Homo Sapiens
GNANPHLPI

SEQ ID NO: 131769 - protein, 9 aa, Homo Sapiens
EECSRLQEP

SEQ ID NO: 131770 - protein, 9 aa, Homo Sapiens
TEYFVCTKA

SEQ ID NO: 131771 - protein, 9 aa, Homo Sapiens
QEQQANLQR

SEQ ID NO: 131772 - protein, 9 aa, Homo Sapiens
LQCNAAGRL

SEQ ID NO: 131773 - protein, 9 aa, Homo Sapiens
AWEEGLDRC

SEQ ID NO: 131774 - protein, 9 aa, Homo Sapiens
SFIQRSTQT

SEQ ID NO: 131775 - protein, 9 aa, Homo Sapiens
EGEREREPK

SEQ ID NO: 131776 - protein, 9 aa, Homo Sapiens
PERAFQSTC

SEQ ID NO: 131777 - protein, 9 aa, Homo Sapiens
IGQKGDLEK

SEQ ID NO: 131778 - protein, 9 aa, Homo Sapiens
FQNMFLQAV

SEQ ID NO: 131779 - protein, 9 aa, Homo Sapiens
IVYTKLCGV

SEQ ID NO: 131780 - protein, 9 aa, Homo Sapiens
PAVPAAPAA

SEQ ID NO: 131781 - protein, 9 aa, Homo Sapiens
THLSVQCEG

SEQ ID NO: 131782 - protein, 9 aa, Homo Sapiens
CFKKVARDE

SEQ ID NO: 131783 - protein, 9 aa, Homo Sapiens
ENVIEGVRN

SEQ ID NO: 131784 - protein, 9 aa, Homo Sapiens
VHKLMGDKF

SEQ ID NO: 131785 - protein, 9 aa, Homo Sapiens
MIVTGAALA

SEQ ID NO: 131786 - protein, 9 aa, Homo Sapiens
ADASHWCGA

SEQ ID NO: 131787 - protein, 9 aa, Homo Sapiens
VRNTHLVGK

SEQ ID NO: 131788 - protein, 9 aa, Homo Sapiens
PYAVPLPHA

SEQ ID NO: 131789 - protein, 9 aa, Homo Sapiens
VILKDVVKF

SEQ ID NO: 131790 - protein, 9 aa, Homo Sapiens
GQCCRHQDS

SEQ ID NO: 131791 - protein, 9 aa, Homo Sapiens
PAVAIKAMA

SEQ ID NO: 131792 - protein, 9 aa, Homo Sapiens
IVHKLMGDK

SEQ ID NO: 131793 - protein, 9 aa, Homo Sapiens
RREPTPRLG

SEQ ID NO: 131794 - protein, 9 aa, Homo Sapiens
KTCGYHPIR

SEQ ID NO: 131795 - protein, 9 aa, Homo Sapiens
RYERNIENI

SEQ ID NO: 131796 - protein, 9 aa, Homo Sapiens
GPGQAAGRG

SEQ ID NO: 131797 - protein, 9 aa, Homo Sapiens
IVRTDSHLV

SEQ ID NO: 131798 - protein, 9 aa, Homo Sapiens
RPFHDSAVT

SEQ ID NO: 131799 - protein, 9 aa, Homo Sapiens
MNAMHVGKP

SEQ ID NO: 131800 - protein, 9 aa, Homo Sapiens
LAHILAEFE

SEQ ID NO: 131801 - protein, 9 aa, Homo Sapiens
SAQHLPPHG

SEQ ID NO: 131802 - protein, 9 aa, Homo Sapiens
LYLLRLWRI

SEQ ID NO: 131803 - protein, 9 aa, Homo Sapiens
QWDMFTTPQ

SEQ ID NO: 131804 - protein, 9 aa, Homo Sapiens
SVPEAEAGA

SEQ ID NO: 131805 - protein, 9 aa, Homo Sapiens
LKAEASLID

SEQ ID NO: 131806 - protein, 9 aa, Homo Sapiens
KHHYKSCKK

SEQ ID NO: 131807 - protein, 9 aa, Homo Sapiens
RMLKVTCFG

SEQ ID NO: 131808 - protein, 9 aa, Homo Sapiens
SQSPLSLWV

SEQ ID NO: 131809 - protein, 9 aa, Homo Sapiens
RPYGPPAGG

SEQ ID NO: 131810 - protein, 9 aa, Homo Sapiens
VVDTASLRR

SEQ ID NO: 131811 - protein, 9 aa, Homo Sapiens
TRRQRSPLH

SEQ ID NO: 131812 - protein, 9 aa, Homo Sapiens
ITPYFNYMH

SEQ ID NO: 131813 - protein, 9 aa, Homo Sapiens
DVDDKFETL

SEQ ID NO: 131814 - protein, 9 aa, Homo Sapiens
RERAAQTRR

SEQ ID NO: 131815 - protein, 9 aa, Homo Sapiens
YLEKNGKRR

SEQ ID NO: 131816 - protein, 9 aa, Homo Sapiens
SERVEKTGE

SEQ ID NO: 131817 - protein, 9 aa, Homo Sapiens
FTSREDVVH

SEQ ID NO: 131818 - protein, 9 aa, Homo Sapiens
VDDLPHLLL

SEQ ID NO: 131819 - protein, 9 aa, Homo Sapiens
AICQKVALT

SEQ ID NO: 131820 - protein, 9 aa, Homo Sapiens
TDIWLEALS

SEQ ID NO: 131821 - protein, 9 aa, Homo Sapiens
HLLLKHLHA

SEQ ID NO: 131822 - protein, 9 aa, Homo Sapiens
RCRAWLWLA

SEQ ID NO: 131823 - protein, 9 aa, Homo Sapiens
QAVGGMRRG

SEQ ID NO: 131824 - protein, 9 aa, Homo Sapiens
AGNPERLNF

SEQ ID NO: 131825 - protein, 9 aa, Homo Sapiens
RCYGSVKCT

SEQ ID NO: 131826 - protein, 9 aa, Homo Sapiens
EEMAETRIS

SEQ ID NO: 131827 - protein, 9 aa, Homo Sapiens
SLSFHLIQH

SEQ ID NO: 131828 - protein, 9 aa, Homo Sapiens
IHQKTHTRE

SEQ ID NO: 131829 - protein, 9 aa, Homo Sapiens
LLQAPGGAA

SEQ ID NO: 131830 - protein, 9 aa, Homo Sapiens
VPGSVSHLQ

SEQ ID NO: 131831 - protein, 9 aa, Homo Sapiens
LHVVHHHLI

SEQ ID NO: 131832 - protein, 9 aa, Homo Sapiens
EWSLMKVSL

SEQ ID NO: 131833 - protein, 9 aa, Homo Sapiens
TYLHRAARA

SEQ ID NO: 131834 - protein, 9 aa, Homo Sapiens
PSTPVLYLS

SEQ ID NO: 131835 - protein, 9 aa, Homo Sapiens
TEWFSRLPR

SEQ ID NO: 131836 - protein, 9 aa, Homo Sapiens
TGDIYTPEE

SEQ ID NO: 131837 - protein, 9 aa, Homo Sapiens
SSKRISKLT

SEQ ID NO: 131838 - protein, 9 aa, Homo Sapiens
KSSGHDSAR

SEQ ID NO: 131839 - protein, 9 aa, Homo Sapiens
YVSTTKHVF

SEQ ID NO: 131840 - protein, 9 aa, Homo Sapiens
ILKVEPNNC

SEQ ID NO: 131841 - protein, 9 aa, Homo Sapiens
SKMLQHIGY

SEQ ID NO: 131842 - protein, 9 aa, Homo Sapiens
AARGLLLAL

SEQ ID NO: 131843 - protein, 9 aa, Homo Sapiens
FASLRPRSV

SEQ ID NO: 131844 - protein, 9 aa, Homo Sapiens
HMCIVRALK

SEQ ID NO: 131845 - protein, 9 aa, Homo Sapiens
AHTQTYPMV

SEQ ID NO: 131846 - protein, 9 aa, Homo Sapiens
LLAWDPPPG

SEQ ID NO: 131847 - protein, 9 aa, Homo Sapiens
GSPPSTARS

SEQ ID NO: 131848 - protein, 9 aa, Homo Sapiens
CEGNPLLLQ

SEQ ID NO: 131849 - protein, 9 aa, Homo Sapiens
IGTPTQKIL

SEQ ID NO: 131850 - protein, 9 aa, Homo Sapiens
KKSRRNNET

SEQ ID NO: 131851 - protein, 9 aa, Homo Sapiens
KDAMNATIQ

SEQ ID NO: 131852 - protein, 9 aa, Homo Sapiens
PAQSLDYLA

SEQ ID NO: 131853 - protein, 9 aa, Homo Sapiens
WLHLFDLTP

SEQ ID NO: 131854 - protein, 9 aa, Homo Sapiens
KNGDRLNPE

SEQ ID NO: 131855 - protein, 9 aa, Homo Sapiens
MQLYDYTKD

SEQ ID NO: 131856 - protein, 9 aa, Homo Sapiens
ERGRGVKYS

SEQ ID NO: 131857 - protein, 9 aa, Homo Sapiens
KIWHHTFYK

SEQ ID NO: 131858 - protein, 9 aa, Homo Sapiens
TFPAYDYFK

SEQ ID NO: 131859 - protein, 9 aa, Homo Sapiens
LTPPESIPN

SEQ ID NO: 131860 - protein, 9 aa, Homo Sapiens
LHVCYGMTL

SEQ ID NO: 131861 - protein, 9 aa, Homo Sapiens
WSGAFYLFH

SEQ ID NO: 131862 - protein, 9 aa, Homo Sapiens
KVSSLARRL

SEQ ID NO: 131863 - protein, 9 aa, Homo Sapiens
VCVWQLYGV

SEQ ID NO: 131864 - protein, 9 aa, Homo Sapiens
SVDDNLKTH

SEQ ID NO: 131865 - protein, 9 aa, Homo Sapiens
TVTLTVSTN

SEQ ID NO: 131866 - protein, 9 aa, Homo Sapiens
YNTWLSYEL

SEQ ID NO: 131867 - protein, 9 aa, Homo Sapiens
VEELATFMC

SEQ ID NO: 131868 - protein, 9 aa, Homo Sapiens
TPEEVLKNI

SEQ ID NO: 131869 - protein, 9 aa, Homo Sapiens
MWPLRVYTH

SEQ ID NO: 131870 - protein, 9 aa, Homo Sapiens
GKYHSVCRL

SEQ ID NO: 131871 - protein, 9 aa, Homo Sapiens
ISVQPPRPR

SEQ ID NO: 131872 - protein, 9 aa, Homo Sapiens
SLYLDSHKL

SEQ ID NO: 131873 - protein, 9 aa, Homo Sapiens
GAITPWQSS

SEQ ID NO: 131874 - protein, 9 aa, Homo Sapiens
SMHVSEASL

SEQ ID NO: 131875 - protein, 9 aa, Homo Sapiens
DTSVYPQLP

SEQ ID NO: 131876 - protein, 9 aa, Homo Sapiens
ETMEATAHG

SEQ ID NO: 131877 - protein, 9 aa, Homo Sapiens
PLMNSCMSR

SEQ ID NO: 131878 - protein, 9 aa, Homo Sapiens
EPVTSKVSS

SEQ ID NO: 131879 - protein, 9 aa, Homo Sapiens
FIQGRDLMD

SEQ ID NO: 131880 - protein, 9 aa, Homo Sapiens
KILRALRVL

SEQ ID NO: 131881 - protein, 9 aa, Homo Sapiens
IPTCTQLFT

SEQ ID NO: 131882 - protein, 9 aa, Homo Sapiens
VGTKPKIEH

SEQ ID NO: 131883 - protein, 9 aa, Homo Sapiens
REIYDHYGR

SEQ ID NO: 131884 - protein, 9 aa, Homo Sapiens
APGLLMAVQ

SEQ ID NO: 131885 - protein, 9 aa, Homo Sapiens
ALMVVHGAI

SEQ ID NO: 131886 - protein, 9 aa, Homo Sapiens
EQTALYRGG

SEQ ID NO: 131887 - protein, 9 aa, Homo Sapiens
QSCSIKSCW

SEQ ID NO: 131888 - protein, 9 aa, Homo Sapiens
KGWTAIEWI

SEQ ID NO: 131889 - protein, 9 aa, Homo Sapiens
SCSSHSNSN

SEQ ID NO: 131890 - protein, 9 aa, Homo Sapiens
ERPSARSKA

SEQ ID NO: 131891 - protein, 9 aa, Homo Sapiens
AGNDNYCLQ

SEQ ID NO: 131892 - protein, 9 aa, Homo Sapiens
QTRDLGPNP

SEQ ID NO: 131893 - protein, 9 aa, Homo Sapiens
PCAPPPPIH

SEQ ID NO: 131894 - protein, 9 aa, Homo Sapiens
GTMWLSNTS

SEQ ID NO: 131895 - protein, 9 aa, Homo Sapiens
AGAARASSG

SEQ ID NO: 131896 - protein, 9 aa, Homo Sapiens
CYSSNATPN

SEQ ID NO: 131897 - protein, 9 aa, Homo Sapiens
CPAVASARP

SEQ ID NO: 131898 - protein, 9 aa, Homo Sapiens
ELGVCGNVL

SEQ ID NO: 131899 - protein, 9 aa, Homo Sapiens
LDECLIIAT

SEQ ID NO: 131900 - protein, 9 aa, Homo Sapiens
SHLSRPTAG

SEQ ID NO: 131901 - protein, 9 aa, Homo Sapiens
FAARDGSFT

SEQ ID NO: 131902 - protein, 9 aa, Homo Sapiens
EEQGKKRKR

SEQ ID NO: 131903 - protein, 9 aa, Homo Sapiens
DDKKALEAA

SEQ ID NO: 131904 - protein, 9 aa, Homo Sapiens
QNLQGKKSS

SEQ ID NO: 131905 - protein, 9 aa, Homo Sapiens
LCVLAPIEV

SEQ ID NO: 131906 - protein, 9 aa, Homo Sapiens
LVVHLLLKH

SEQ ID NO: 131907 - protein, 9 aa, Homo Sapiens
TAKKSRRNN

SEQ ID NO: 131908 - protein, 9 aa, Homo Sapiens
HLVIVQRVN

SEQ ID NO: 131909 - protein, 9 aa, Homo Sapiens
QGQPREDDP

SEQ ID NO: 131910 - protein, 9 aa, Homo Sapiens
CPCRWLQMA

SEQ ID NO: 131911 - protein, 9 aa, Homo Sapiens
ENQTSLNIK

SEQ ID NO: 131912 - protein, 9 aa, Homo Sapiens
LATSVRSDM

SEQ ID NO: 131913 - protein, 9 aa, Homo Sapiens
CFMVSSETD

SEQ ID NO: 131914 - protein, 9 aa, Homo Sapiens
RRLRELQLP

SEQ ID NO: 131915 - protein, 9 aa, Homo Sapiens
VGEAGAERE

SEQ ID NO: 131916 - protein, 9 aa, Homo Sapiens
YARKICCKT

SEQ ID NO: 131917 - protein, 9 aa, Homo Sapiens
VVSSRMALR

SEQ ID NO: 131918 - protein, 9 aa, Homo Sapiens
SVGLVLWSG

SEQ ID NO: 131919 - protein, 9 aa, Homo Sapiens
SVMAVDLNP

SEQ ID NO: 131920 - protein, 9 aa, Homo Sapiens
AQYRQVEAR

SEQ ID NO: 131921 - protein, 9 aa, Homo Sapiens
RPAQSLDYL

SEQ ID NO: 131922 - protein, 9 aa, Homo Sapiens
TNTCDGQQY

SEQ ID NO: 131923 - protein, 9 aa, Homo Sapiens
PDEPQLETV

SEQ ID NO: 131924 - protein, 9 aa, Homo Sapiens
ASCPTSMLI

SEQ ID NO: 131925 - protein, 9 aa, Homo Sapiens
ANLQRRLKE

SEQ ID NO: 131926 - protein, 9 aa, Homo Sapiens
TTKHTYDYD

SEQ ID NO: 131927 - protein, 9 aa, Homo Sapiens
LYLSPSTPD

SEQ ID NO: 131928 - protein, 9 aa, Homo Sapiens
NSNTLSSNT

SEQ ID NO: 131929 - protein, 9 aa, Homo Sapiens
HSQQCANSP

SEQ ID NO: 131930 - protein, 9 aa, Homo Sapiens
EADTKMTKL

SEQ ID NO: 131931 - protein, 9 aa, Homo Sapiens
VQSLFSVSF

SEQ ID NO: 131932 - protein, 9 aa, Homo Sapiens
PLGEEETDL

SEQ ID NO: 131933 - protein, 9 aa, Homo Sapiens
SFNLKADFN

SEQ ID NO: 131934 - protein, 9 aa, Homo Sapiens
AVKIINTKK

SEQ ID NO: 131935 - protein, 9 aa, Homo Sapiens
TIENVQPIL

SEQ ID NO: 131936 - protein, 9 aa, Homo Sapiens
ELGGIWPEQ

SEQ ID NO: 131937 - protein, 9 aa, Homo Sapiens
STATCSRRP

SEQ ID NO: 131938 - protein, 9 aa, Homo Sapiens
QYSQVFQNH

SEQ ID NO: 131939 - protein, 9 aa, Homo Sapiens
TLPLGMTCS

SEQ ID NO: 131940 - protein, 9 aa, Homo Sapiens
HLNLSATHH

SEQ ID NO: 131941 - protein, 9 aa, Homo Sapiens
IHTGDKPFM

SEQ ID NO: 131942 - protein, 9 aa, Homo Sapiens
AVFCLLCWE

SEQ ID NO: 131943 - protein, 9 aa, Homo Sapiens
QVRMRCLLK

SEQ ID NO: 131944 - protein, 9 aa, Homo Sapiens
GAPQGPCPR

SEQ ID NO: 131945 - protein, 9 aa, Homo Sapiens
IIGTVNMDD

SEQ ID NO: 131946 - protein, 9 aa, Homo Sapiens
AGDSSCQAD

SEQ ID NO: 131947 - protein, 9 aa, Homo Sapiens
THCYDPDSN

SEQ ID NO: 131948 - protein, 9 aa, Homo Sapiens
IRIQQLPMF

SEQ ID NO: 131949 - protein, 9 aa, Homo Sapiens
QGTLAQEDE

SEQ ID NO: 131950 - protein, 9 aa, Homo Sapiens
LWALSQCQL

SEQ ID NO: 131951 - protein, 9 aa, Homo Sapiens
PKLALCETP

SEQ ID NO: 131952 - protein, 9 aa, Homo Sapiens
HGKNTLNDA

SEQ ID NO: 131953 - protein, 9 aa, Homo Sapiens
ARTSPGDMV

SEQ ID NO: 131954 - protein, 9 aa, Homo Sapiens
LQPPGERLP

SEQ ID NO: 131955 - protein, 9 aa, Homo Sapiens
EQDVEGNDV

SEQ ID NO: 131956 - protein, 9 aa, Homo Sapiens
MRLTRIFRI

SEQ ID NO: 131957 - protein, 9 aa, Homo Sapiens
LFVDGMLRV

SEQ ID NO: 131958 - protein, 9 aa, Homo Sapiens
KNGKRRLIE

SEQ ID NO: 131959 - protein, 9 aa, Homo Sapiens
MPSSGTSTI

SEQ ID NO: 131960 - protein, 9 aa, Homo Sapiens
GGPEGPGDR

SEQ ID NO: 131961 - protein, 9 aa, Homo Sapiens
RASQPMAPG

SEQ ID NO: 131962 - protein, 9 aa, Homo Sapiens
EFLPFMAPT

SEQ ID NO: 131963 - protein, 9 aa, Homo Sapiens
EDMDSLEDV

SEQ ID NO: 131964 - protein, 9 aa, Homo Sapiens
RKYFLWVVK

SEQ ID NO: 131965 - protein, 9 aa, Homo Sapiens
QIPNCDVSH

SEQ ID NO: 131966 - protein, 9 aa, Homo Sapiens
RALEQEQRH

SEQ ID NO: 131967 - protein, 9 aa, Homo Sapiens
LYSQDVLML

SEQ ID NO: 131968 - protein, 9 aa, Homo Sapiens
GQVVTQATP

SEQ ID NO: 131969 - protein, 9 aa, Homo Sapiens
QLTKHLWNG

SEQ ID NO: 131970 - protein, 9 aa, Homo Sapiens
ALLVAFILL

SEQ ID NO: 131971 - protein, 9 aa, Homo Sapiens
GVTLCVVPI

SEQ ID NO: 131972 - protein, 9 aa, Homo Sapiens
SFSVHNNGE

SEQ ID NO: 131973 - protein, 9 aa, Homo Sapiens
AETESGVTL

SEQ ID NO: 131974 - protein, 9 aa, Homo Sapiens
QSVQPTEGQ

SEQ ID NO: 131975 - protein, 9 aa, Homo Sapiens
HSHQDHGIQ

SEQ ID NO: 131976 - protein, 9 aa, Homo Sapiens
FLPYTCLTT

SEQ ID NO: 131977 - protein, 9 aa, Homo Sapiens
ELSHINTRL

SEQ ID NO: 131978 - protein, 9 aa, Homo Sapiens
SILITSMGS

SEQ ID NO: 131979 - protein, 9 aa, Homo Sapiens
QIQHALIVL

SEQ ID NO: 131980 - protein, 9 aa, Homo Sapiens
CEVTDPSTL

SEQ ID NO: 131981 - protein, 9 aa, Homo Sapiens
GFRRVTNSQ

SEQ ID NO: 131982 - protein, 9 aa, Homo Sapiens
QEGPPLAVL

SEQ ID NO: 131983 - protein, 9 aa, Homo Sapiens
STPPSAATA

SEQ ID NO: 131984 - protein, 9 aa, Homo Sapiens
WPRPLPRKV

SEQ ID NO: 131985 - protein, 9 aa, Homo Sapiens
RWGGTTAVL

SEQ ID NO: 131986 - protein, 9 aa, Homo Sapiens
FKISGHLQY

SEQ ID NO: 131987 - protein, 9 aa, Homo Sapiens
AQVTLMTLT

SEQ ID NO: 131988 - protein, 9 aa, Homo Sapiens
GARHHTREI

SEQ ID NO: 131989 - protein, 9 aa, Homo Sapiens
DGKSYTRWL

SEQ ID NO: 131990 - protein, 9 aa, Homo Sapiens
PVALLHHQT

SEQ ID NO: 131991 - protein, 9 aa, Homo Sapiens
RLDPIMEKF

SEQ ID NO: 131992 - protein, 9 aa, Homo Sapiens
QEAFEVSQR

SEQ ID NO: 131993 - protein, 9 aa, Homo Sapiens
PRSPDIPQD

SEQ ID NO: 131994 - protein, 9 aa, Homo Sapiens
WASLSNTST

SEQ ID NO: 131995 - protein, 9 aa, Homo Sapiens
TKAFDAPPP

SEQ ID NO: 131996 - protein, 9 aa, Homo Sapiens
DDNLKTHPL

SEQ ID NO: 131997 - protein, 9 aa, Homo Sapiens
LCLIALLSR

SEQ ID NO: 131998 - protein, 9 aa, Homo Sapiens
AFEVSQRAP

SEQ ID NO: 131999 - protein, 9 aa, Homo Sapiens
SSSSSNSSS

SEQ ID NO: 132000 - protein, 9 aa, Homo Sapiens
RAQADERYG

SEQ ID NO: 132001 - protein, 9 aa, Homo Sapiens
RGNADLRCE

SEQ ID NO: 132002 - protein, 9 aa, Homo Sapiens
ELVVRAIGT

SEQ ID NO: 132003 - protein, 9 aa, Homo Sapiens
KSSGKINGL

SEQ ID NO: 132004 - protein, 9 aa, Homo Sapiens
GVHCTDVTD

SEQ ID NO: 132005 - protein, 9 aa, Homo Sapiens
SQLQPFLKI

SEQ ID NO: 132006 - protein, 9 aa, Homo Sapiens
NKSAEAVLK

SEQ ID NO: 132007 - protein, 9 aa, Homo Sapiens
DVIGTPTQK

SEQ ID NO: 132008 - protein, 9 aa, Homo Sapiens
QLHNSNPYP

SEQ ID NO: 132009 - protein, 9 aa, Homo Sapiens
YNSQYEEAY

SEQ ID NO: 132010 - protein, 9 aa, Homo Sapiens
ARPSGRHLS

SEQ ID NO: 132011 - protein, 9 aa, Homo Sapiens
TDSLLCSHL

SEQ ID NO: 132012 - protein, 9 aa, Homo Sapiens
ATIENVQPI

SEQ ID NO: 132013 - protein, 9 aa, Homo Sapiens
LKEITARKI

SEQ ID NO: 132014 - protein, 9 aa, Homo Sapiens
PLNLQGGCL

SEQ ID NO: 132015 - protein, 9 aa, Homo Sapiens
FLRDYVNCS

SEQ ID NO: 132016 - protein, 9 aa, Homo Sapiens
ILYGYSMAV

SEQ ID NO: 132017 - protein, 9 aa, Homo Sapiens
SNSFGQMSL

SEQ ID NO: 132018 - protein, 9 aa, Homo Sapiens
LRLQSLLSL

SEQ ID NO: 132019 - protein, 9 aa, Homo Sapiens
LKKGAKRSR

SEQ ID NO: 132020 - protein, 9 aa, Homo Sapiens
GRASCPGFR

SEQ ID NO: 132021 - protein, 9 aa, Homo Sapiens
VNLQHLIAN

SEQ ID NO: 132022 - protein, 9 aa, Homo Sapiens
LCVIYVKEV

SEQ ID NO: 132023 - protein, 9 aa, Homo Sapiens
ARLEKFTHF

SEQ ID NO: 132024 - protein, 9 aa, Homo Sapiens
LTWTFLYHR

SEQ ID NO: 132025 - protein, 9 aa, Homo Sapiens
SHQILHILA

SEQ ID NO: 132026 - protein, 9 aa, Homo Sapiens
EPSHQNSLR

SEQ ID NO: 132027 - protein, 9 aa, Homo Sapiens
FGVTLCVVP

SEQ ID NO: 132028 - protein, 9 aa, Homo Sapiens
PIPPHAGGH

SEQ ID NO: 132029 - protein, 9 aa, Homo Sapiens
LILRISWEL

SEQ ID NO: 132030 - protein, 9 aa, Homo Sapiens
DLSEIPNSV

SEQ ID NO: 132031 - protein, 9 aa, Homo Sapiens
KKDLYDVVW

SEQ ID NO: 132032 - protein, 9 aa, Homo Sapiens
RHEQEVAMR

SEQ ID NO: 132033 - protein, 9 aa, Homo Sapiens
DNVLTMDMP

SEQ ID NO: 132034 - protein, 9 aa, Homo Sapiens
AVGPGAPTP

SEQ ID NO: 132035 - protein, 9 aa, Homo Sapiens
HDVIGTPTQ

SEQ ID NO: 132036 - protein, 9 aa, Homo Sapiens
LYLNSGYIT

SEQ ID NO: 132037 - protein, 9 aa, Homo Sapiens
VHVRYPKLL

SEQ ID NO: 132038 - protein, 9 aa, Homo Sapiens
VSAAAAAGP

SEQ ID NO: 132039 - protein, 9 aa, Homo Sapiens
INRNLLNPN

SEQ ID NO: 132040 - protein, 9 aa, Homo Sapiens
DEEYVEEEV

SEQ ID NO: 132041 - protein, 9 aa, Homo Sapiens
LGLLNWHSN

SEQ ID NO: 132042 - protein, 9 aa, Homo Sapiens
GPIKPKVPL

SEQ ID NO: 132043 - protein, 9 aa, Homo Sapiens
SNNHLQQLE

SEQ ID NO: 132044 - protein, 9 aa, Homo Sapiens
SVVSGISRF

SEQ ID NO: 132045 - protein, 9 aa, Homo Sapiens
RKSFASRSI

SEQ ID NO: 132046 - protein, 9 aa, Homo Sapiens
DFFGAKHIF

SEQ ID NO: 132047 - protein, 9 aa, Homo Sapiens
DTESASGQA

SEQ ID NO: 132048 - protein, 9 aa, Homo Sapiens
EERREVWVS

SEQ ID NO: 132049 - protein, 9 aa, Homo Sapiens
EPVADPEQP

SEQ ID NO: 132050 - protein, 9 aa, Homo Sapiens
NLSATHHHS

SEQ ID NO: 132051 - protein, 9 aa, Homo Sapiens
QTCPAPQEE

SEQ ID NO: 132052 - protein, 9 aa, Homo Sapiens
HLSRPTAGG

SEQ ID NO: 132053 - protein, 9 aa, Homo Sapiens
NRLEDAGMR

SEQ ID NO: 132054 - protein, 9 aa, Homo Sapiens
PGPWPRPLP

SEQ ID NO: 132055 - protein, 9 aa, Homo Sapiens
NIKERTQGR

SEQ ID NO: 132056 - protein, 9 aa, Homo Sapiens
DHSPPHRAA

SEQ ID NO: 132057 - protein, 9 aa, Homo Sapiens
GDPSPHHHQ

SEQ ID NO: 132058 - protein, 9 aa, Homo Sapiens
RAAQIRFPG

SEQ ID NO: 132059 - protein, 9 aa, Homo Sapiens
NSDLVSVMK

SEQ ID NO: 132060 - protein, 9 aa, Homo Sapiens
LPECHVRIA

SEQ ID NO: 132061 - protein, 9 aa, Homo Sapiens
YSLCRYRQV

SEQ ID NO: 132062 - protein, 9 aa, Homo Sapiens
PTIPCPTDS

SEQ ID NO: 132063 - protein, 9 aa, Homo Sapiens
NSSSADGVF

SEQ ID NO: 132064 - protein, 9 aa, Homo Sapiens
DGSCDMRYW

SEQ ID NO: 132065 - protein, 9 aa, Homo Sapiens
CPVRGAWFC

SEQ ID NO: 132066 - protein, 9 aa, Homo Sapiens
HWLDEYWDR

SEQ ID NO: 132067 - protein, 9 aa, Homo Sapiens
ATLSHFSAS

SEQ ID NO: 132068 - protein, 9 aa, Homo Sapiens
PNGSLFYYA

SEQ ID NO: 132069 - protein, 9 aa, Homo Sapiens
QGGRILLQR

SEQ ID NO: 132070 - protein, 9 aa, Homo Sapiens
SRGAPHPAD

SEQ ID NO: 132071 - protein, 9 aa, Homo Sapiens
ARGGTTIGE

SEQ ID NO: 132072 - protein, 9 aa, Homo Sapiens
GSGCQCHVT

SEQ ID NO: 132073 - protein, 9 aa, Homo Sapiens
KEITARKIN

SEQ ID NO: 132074 - protein, 9 aa, Homo Sapiens
NQTTRKRFV

SEQ ID NO: 132075 - protein, 9 aa, Homo Sapiens
VMMKGPNDA

SEQ ID NO: 132076 - protein, 9 aa, Homo Sapiens
SSLVVTQRP

SEQ ID NO: 132077 - protein, 9 aa, Homo Sapiens
YGVSTKQIR

SEQ ID NO: 132078 - protein, 9 aa, Homo Sapiens
QRDMQSTFD

SEQ ID NO: 132079 - protein, 9 aa, Homo Sapiens
SEAAAGANA

SEQ ID NO: 132080 - protein, 9 aa, Homo Sapiens
KAKIKEVEE

SEQ ID NO: 132081 - protein, 9 aa, Homo Sapiens
SMQCVTSRG

SEQ ID NO: 132082 - protein, 9 aa, Homo Sapiens
GAQHDQRPP

SEQ ID NO: 132083 - protein, 9 aa, Homo Sapiens
PLKRRKRLW

SEQ ID NO: 132084 - protein, 9 aa, Homo Sapiens
HRHPRFDLS

SEQ ID NO: 132085 - protein, 9 aa, Homo Sapiens
FAFTFDHDC

SEQ ID NO: 132086 - protein, 9 aa, Homo Sapiens
SEVGPPPAH

SEQ ID NO: 132087 - protein, 9 aa, Homo Sapiens
ASRSCTAPE

SEQ ID NO: 132088 - protein, 9 aa, Homo Sapiens
ASRSIMSPA

SEQ ID NO: 132089 - protein, 9 aa, Homo Sapiens
GSFKAAVWR

SEQ ID NO: 132090 - protein, 9 aa, Homo Sapiens
LPMVCTLTQ

SEQ ID NO: 132091 - protein, 9 aa, Homo Sapiens
WPWTRCLRM

SEQ ID NO: 132092 - protein, 9 aa, Homo Sapiens
YTGSEFYTG

SEQ ID NO: 132093 - protein, 9 aa, Homo Sapiens
GWLINDQLP

SEQ ID NO: 132094 - protein, 9 aa, Homo Sapiens
NKWIPTCTQ

SEQ ID NO: 132095 - protein, 9 aa, Homo Sapiens
IPTNVSNCN

SEQ ID NO: 132096 - protein, 9 aa, Homo Sapiens
AKGKKPRQR

SEQ ID NO: 132097 - protein, 9 aa, Homo Sapiens
AMPPGASPQ

SEQ ID NO: 132098 - protein, 9 aa, Homo Sapiens
RHNDVSLAN

SEQ ID NO: 132099 - protein, 9 aa, Homo Sapiens
YTSSWRADS

SEQ ID NO: 132100 - protein, 9 aa, Homo Sapiens
MQSGKVYKE

SEQ ID NO: 132101 - protein, 9 aa, Homo Sapiens
LVSSTDGSL

SEQ ID NO: 132102 - protein, 9 aa, Homo Sapiens
EDAQEEPGK

SEQ ID NO: 132103 - protein, 9 aa, Homo Sapiens
TCKPRCTGS

SEQ ID NO: 132104 - protein, 9 aa, Homo Sapiens
FRKNFVTSL

SEQ ID NO: 132105 - protein, 9 aa, Homo Sapiens
CEHHSPTCL

SEQ ID NO: 132106 - protein, 9 aa, Homo Sapiens
ECHRGRKAS

SEQ ID NO: 132107 - protein, 9 aa, Homo Sapiens
SDLRETITE

SEQ ID NO: 132108 - protein, 9 aa, Homo Sapiens
GHGTEVHVR

SEQ ID NO: 132109 - protein, 9 aa, Homo Sapiens
LEVMRKPRR

SEQ ID NO: 132110 - protein, 9 aa, Homo Sapiens
DIYTPEEFQ

SEQ ID NO: 132111 - protein, 9 aa, Homo Sapiens
HLVPDPGCN

SEQ ID NO: 132112 - protein, 9 aa, Homo Sapiens
TNSQKCVRA

SEQ ID NO: 132113 - protein, 9 aa, Homo Sapiens
ICQKVALTQ

SEQ ID NO: 132114 - protein, 9 aa, Homo Sapiens
WRVPGCARG

SEQ ID NO: 132115 - protein, 9 aa, Homo Sapiens
AKEQAIVYT

SEQ ID NO: 132116 - protein, 9 aa, Homo Sapiens
DQPRDYSGG

SEQ ID NO: 132117 - protein, 9 aa, Homo Sapiens
VDFTCTSSI

SEQ ID NO: 132118 - protein, 9 aa, Homo Sapiens
DFPQKFHTE

SEQ ID NO: 132119 - protein, 9 aa, Homo Sapiens
KTKTLTGTS

SEQ ID NO: 132120 - protein, 9 aa, Homo Sapiens
SGSLITVGR

SEQ ID NO: 132121 - protein, 9 aa, Homo Sapiens
RRTDPGPWP

SEQ ID NO: 132122 - protein, 9 aa, Homo Sapiens
CGGRQTPAS

SEQ ID NO: 132123 - protein, 9 aa, Homo Sapiens
EKKKVYALK

SEQ ID NO: 132124 - protein, 9 aa, Homo Sapiens
IILFSRSLS

SEQ ID NO: 132125 - protein, 9 aa, Homo Sapiens
TAEELKKEQ

SEQ ID NO: 132126 - protein, 9 aa, Homo Sapiens
LNPINLTES

SEQ ID NO: 132127 - protein, 9 aa, Homo Sapiens
KVHKQLVRG

SEQ ID NO: 132128 - protein, 9 aa, Homo Sapiens
VGAGDVGKS

SEQ ID NO: 132129 - protein, 9 aa, Homo Sapiens
EPMTGFYVG

SEQ ID NO: 132130 - protein, 9 aa, Homo Sapiens
DRRLIGGAT

SEQ ID NO: 132131 - protein, 9 aa, Homo Sapiens
PLVYATPLA

SEQ ID NO: 132132 - protein, 9 aa, Homo Sapiens
NDFRDVFKK

SEQ ID NO: 132133 - protein, 9 aa, Homo Sapiens
LTVGTMWLS

SEQ ID NO: 132134 - protein, 9 aa, Homo Sapiens
ECFEKICPG

SEQ ID NO: 132135 - protein, 9 aa, Homo Sapiens
MRQQQMATK

SEQ ID NO: 132136 - protein, 9 aa, Homo Sapiens
RCSDEVTCQ

SEQ ID NO: 132137 - protein, 9 aa, Homo Sapiens
GHIPHLTCD

SEQ ID NO: 132138 - protein, 9 aa, Homo Sapiens
RLLCPPVPG

SEQ ID NO: 132139 - protein, 9 aa, Homo Sapiens
SNIMKPTPG

SEQ ID NO: 132140 - protein, 9 aa, Homo Sapiens
LWLVWELLG

SEQ ID NO: 132141 - protein, 9 aa, Homo Sapiens
WCGAWRGHG

SEQ ID NO: 132142 - protein, 9 aa, Homo Sapiens
IRPQPKFRL

SEQ ID NO: 132143 - protein, 9 aa, Homo Sapiens
QAMEKAAWH

SEQ ID NO: 132144 - protein, 9 aa, Homo Sapiens
NMSLLTVIE

SEQ ID NO: 132145 - protein, 9 aa, Homo Sapiens
TEVTKARSL

SEQ ID NO: 132146 - protein, 9 aa, Homo Sapiens
SQKCEDINE

SEQ ID NO: 132147 - protein, 9 aa, Homo Sapiens
HDGALRAVE

SEQ ID NO: 132148 - protein, 9 aa, Homo Sapiens
KGKKQKCIK

SEQ ID NO: 132149 - protein, 9 aa, Homo Sapiens
DTDKLRVTG

SEQ ID NO: 132150 - protein, 9 aa, Homo Sapiens
EELRSLVEL

SEQ ID NO: 132151 - protein, 9 aa, Homo Sapiens
VRSRESNKP

SEQ ID NO: 132152 - protein, 9 aa, Homo Sapiens
HNDVSLANA

SEQ ID NO: 132153 - protein, 9 aa, Homo Sapiens
AGLPSGARS

SEQ ID NO: 132154 - protein, 9 aa, Homo Sapiens
VQAPSPSSA

SEQ ID NO: 132155 - protein, 9 aa, Homo Sapiens
ETEESKKHK

SEQ ID NO: 132156 - protein, 9 aa, Homo Sapiens
MNDIMSLGI

SEQ ID NO: 132157 - protein, 9 aa, Homo Sapiens
ISNSSNWKQ

SEQ ID NO: 132158 - protein, 9 aa, Homo Sapiens
VIFSTLGER

SEQ ID NO: 132159 - protein, 9 aa, Homo Sapiens
VFSIEPAIL

SEQ ID NO: 132160 - protein, 9 aa, Homo Sapiens
SSHLPTLAS

SEQ ID NO: 132161 - protein, 9 aa, Homo Sapiens
NASLIGACK

SEQ ID NO: 132162 - protein, 9 aa, Homo Sapiens
LETIFDHIV

SEQ ID NO: 132163 - protein, 9 aa, Homo Sapiens
LAPMHSHHR

SEQ ID NO: 132164 - protein, 9 aa, Homo Sapiens
QPDSGSHRR

SEQ ID NO: 132165 - protein, 9 aa, Homo Sapiens
IQNREICCY

SEQ ID NO: 132166 - protein, 9 aa, Homo Sapiens
MRRPAHTDI

SEQ ID NO: 132167 - protein, 9 aa, Homo Sapiens
HEYRFPKNV

SEQ ID NO: 132168 - protein, 9 aa, Homo Sapiens
SLLLPVQSP

SEQ ID NO: 132169 - protein, 9 aa, Homo Sapiens
RCCFALPLC

SEQ ID NO: 132170 - protein, 9 aa, Homo Sapiens
STITLIKLY

SEQ ID NO: 132171 - protein, 9 aa, Homo Sapiens
ECGRAFSLS

SEQ ID NO: 132172 - protein, 9 aa, Homo Sapiens
FCIWMSLGM

SEQ ID NO: 132173 - protein, 9 aa, Homo Sapiens
NVISQLEQG

SEQ ID NO: 132174 - protein, 9 aa, Homo Sapiens
ISNSDGARP

SEQ ID NO: 132175 - protein, 9 aa, Homo Sapiens
LGLSSYCNE

SEQ ID NO: 132176 - protein, 9 aa, Homo Sapiens
PRLDACCAW

SEQ ID NO: 132177 - protein, 9 aa, Homo Sapiens
VYYRLSSYF

SEQ ID NO: 132178 - protein, 9 aa, Homo Sapiens
GKQYWPITA

SEQ ID NO: 132179 - protein, 9 aa, Homo Sapiens
SEEEKDLIR

SEQ ID NO: 132180 - protein, 9 aa, Homo Sapiens
KPFSENQTS

SEQ ID NO: 132181 - protein, 9 aa, Homo Sapiens
VIAETAFKT

SEQ ID NO: 132182 - protein, 9 aa, Homo Sapiens
VSSTDGSLQ

SEQ ID NO: 132183 - protein, 9 aa, Homo Sapiens
CTPVSSSRL

SEQ ID NO: 132184 - protein, 9 aa, Homo Sapiens
FNDFLVTKT

SEQ ID NO: 132185 - protein, 9 aa, Homo Sapiens
SQRSVPETF

SEQ ID NO: 132186 - protein, 9 aa, Homo Sapiens
WWGKVPRKG

SEQ ID NO: 132187 - protein, 9 aa, Homo Sapiens
KLYRSVIEN

SEQ ID NO: 132188 - protein, 9 aa, Homo Sapiens
ILDEIYDSS

SEQ ID NO: 132189 - protein, 9 aa, Homo Sapiens
EGGVEPAFH

SEQ ID NO: 132190 - protein, 9 aa, Homo Sapiens
DMDVERAMR

SEQ ID NO: 132191 - protein, 9 aa, Homo Sapiens
GVSTKQIRE

SEQ ID NO: 132192 - protein, 9 aa, Homo Sapiens
PQMVNRIVD

SEQ ID NO: 132193 - protein, 9 aa, Homo Sapiens
AWFCWTSWS

SEQ ID NO: 132194 - protein, 9 aa, Homo Sapiens
NAIDVNKVV

SEQ ID NO: 132195 - protein, 9 aa, Homo Sapiens
ENTVLCLQV

SEQ ID NO: 132196 - protein, 9 aa, Homo Sapiens
NKRNGAEAV

SEQ ID NO: 132197 - protein, 9 aa, Homo Sapiens
GRKNLQTAR

SEQ ID NO: 132198 - protein, 9 aa, Homo Sapiens
PTPPAASTT

SEQ ID NO: 132199 - protein, 9 aa, Homo Sapiens
ARASSGTAA

SEQ ID NO: 132200 - protein, 9 aa, Homo Sapiens
FFVTEGNCS

SEQ ID NO: 132201 - protein, 9 aa, Homo Sapiens
GELQVLVEQ

SEQ ID NO: 132202 - protein, 9 aa, Homo Sapiens
QHLIANNNQ

SEQ ID NO: 132203 - protein, 9 aa, Homo Sapiens
EVVVDTDKL

SEQ ID NO: 132204 - protein, 9 aa, Homo Sapiens
GLPLAMAQV

SEQ ID NO: 132205 - protein, 9 aa, Homo Sapiens
ITDAAMTAE

SEQ ID NO: 132206 - protein, 9 aa, Homo Sapiens
TASCASTGS

SEQ ID NO: 132207 - protein, 9 aa, Homo Sapiens
IIANDQDNR

SEQ ID NO: 132208 - protein, 9 aa, Homo Sapiens
HPDTSAQPP

SEQ ID NO: 132209 - protein, 9 aa, Homo Sapiens
ESEHFLYGG

SEQ ID NO: 132210 - protein, 9 aa, Homo Sapiens
GQQKEDLGR

SEQ ID NO: 132211 - protein, 9 aa, Homo Sapiens
IHLESWALT

SEQ ID NO: 132212 - protein, 9 aa, Homo Sapiens
YRETEGSTP

SEQ ID NO: 132213 - protein, 9 aa, Homo Sapiens
PGEKKSQAS

SEQ ID NO: 132214 - protein, 9 aa, Homo Sapiens
NFVLLAHIM

SEQ ID NO: 132215 - protein, 9 aa, Homo Sapiens
YSLVRVISE

SEQ ID NO: 132216 - protein, 9 aa, Homo Sapiens
GSETKNLEN

SEQ ID NO: 132217 - protein, 9 aa, Homo Sapiens
TELGKQYWP

SEQ ID NO: 132218 - protein, 9 aa, Homo Sapiens
PLCQRFPTL

SEQ ID NO: 132219 - protein, 9 aa, Homo Sapiens
KGSVMEILC

SEQ ID NO: 132220 - protein, 9 aa, Homo Sapiens
TDPGPWPRP

SEQ ID NO: 132221 - protein, 9 aa, Homo Sapiens
TIGEAREAC

SEQ ID NO: 132222 - protein, 9 aa, Homo Sapiens
NVGRPLDTV

SEQ ID NO: 132223 - protein, 9 aa, Homo Sapiens
TTPPRGDFC

SEQ ID NO: 132224 - protein, 9 aa, Homo Sapiens
RAAVSPPAG

SEQ ID NO: 132225 - protein, 9 aa, Homo Sapiens
IVTGAALAS

SEQ ID NO: 132226 - protein, 9 aa, Homo Sapiens
EPSTPKSPS

SEQ ID NO: 132227 - protein, 9 aa, Homo Sapiens
GGIPVALLH

SEQ ID NO: 132228 - protein, 9 aa, Homo Sapiens
TPCTDTESA

SEQ ID NO: 132229 - protein, 9 aa, Homo Sapiens
PAAKVGYEK

SEQ ID NO: 132230 - protein, 9 aa, Homo Sapiens
SSCADSQSH

SEQ ID NO: 132231 - protein, 9 aa, Homo Sapiens
LLCPPVPGV

SEQ ID NO: 132232 - protein, 9 aa, Homo Sapiens
ISVILKDVV

SEQ ID NO: 132233 - protein, 9 aa, Homo Sapiens
DTEEEQGKK

SEQ ID NO: 132234 - protein, 9 aa, Homo Sapiens
TGFVIDPVH

SEQ ID NO: 132235 - protein, 9 aa, Homo Sapiens
LMSDLESMC

SEQ ID NO: 132236 - protein, 9 aa, Homo Sapiens
DFTCTSSII

SEQ ID NO: 132237 - protein, 9 aa, Homo Sapiens
PMLESQGLY

SEQ ID NO: 132238 - protein, 9 aa, Homo Sapiens
KRGWAWDDK

SEQ ID NO: 132239 - protein, 9 aa, Homo Sapiens
GRLPHPPIR

SEQ ID NO: 132240 - protein, 9 aa, Homo Sapiens
GVSCVGGFL

SEQ ID NO: 132241 - protein, 9 aa, Homo Sapiens
LGSFPLYLE

SEQ ID NO: 132242 - protein, 9 aa, Homo Sapiens
GKSASGHLA

SEQ ID NO: 132243 - protein, 9 aa, Homo Sapiens
FASFPSTNL

SEQ ID NO: 132244 - protein, 9 aa, Homo Sapiens
LSNSHRATS

SEQ ID NO: 132245 - protein, 9 aa, Homo Sapiens
PKTPCGPPL

SEQ ID NO: 132246 - protein, 9 aa, Homo Sapiens
SHVDDLPHL

SEQ ID NO: 132247 - protein, 9 aa, Homo Sapiens
LDVEPVHTS

SEQ ID NO: 132248 - protein, 9 aa, Homo Sapiens
SFFVKGMSP

SEQ ID NO: 132249 - protein, 9 aa, Homo Sapiens
DVYYKSMSN

SEQ ID NO: 132250 - protein, 9 aa, Homo Sapiens
SEKTTDFKT

SEQ ID NO: 132251 - protein, 9 aa, Homo Sapiens
YFRFTSHGS

SEQ ID NO: 132252 - protein, 9 aa, Homo Sapiens
WAAELMHRQ

SEQ ID NO: 132253 - protein, 9 aa, Homo Sapiens
SHITLASPE

SEQ ID NO: 132254 - protein, 9 aa, Homo Sapiens
SFRNLDFSE

SEQ ID NO: 132255 - protein, 9 aa, Homo Sapiens
QAAGRGGTT

SEQ ID NO: 132256 - protein, 9 aa, Homo Sapiens
VGSGLQGCL

SEQ ID NO: 132257 - protein, 9 aa, Homo Sapiens
LHDGALRAV

SEQ ID NO: 132258 - protein, 9 aa, Homo Sapiens
HLNKVQTTN

SEQ ID NO: 132259 - protein, 9 aa, Homo Sapiens
GGNQELVQL

SEQ ID NO: 132260 - protein, 9 aa, Homo Sapiens
TSHYWITVF

SEQ ID NO: 132261 - protein, 9 aa, Homo Sapiens
DGVLRDDYK

SEQ ID NO: 132262 - protein, 9 aa, Homo Sapiens
SQIPNCDVS

SEQ ID NO: 132263 - protein, 9 aa, Homo Sapiens
ASCASTGSS

SEQ ID NO: 132264 - protein, 9 aa, Homo Sapiens
LFSGRQPLT

SEQ ID NO: 132265 - protein, 9 aa, Homo Sapiens
DFQEEPMTG

SEQ ID NO: 132266 - protein, 9 aa, Homo Sapiens
MTCSIDMDT

SEQ ID NO: 132267 - protein, 9 aa, Homo Sapiens
NGPRKGTQT

SEQ ID NO: 132268 - protein, 9 aa, Homo Sapiens
EFGHTLGLD

SEQ ID NO: 132269 - protein, 9 aa, Homo Sapiens
AWWCRCPLS

SEQ ID NO: 132270 - protein, 9 aa, Homo Sapiens
RLLPPAPGD

SEQ ID NO: 132271 - protein, 9 aa, Homo Sapiens
ETGAVQAPS

SEQ ID NO: 132272 - protein, 9 aa, Homo Sapiens
ALYRGGQRC

SEQ ID NO: 132273 - protein, 9 aa, Homo Sapiens
SSSADGVFE

SEQ ID NO: 132274 - protein, 9 aa, Homo Sapiens
KKRKKREKI

SEQ ID NO: 132275 - protein, 9 aa, Homo Sapiens
TVAFCWINV

SEQ ID NO: 132276 - protein, 9 aa, Homo Sapiens
GAARASSGT

SEQ ID NO: 132277 - protein, 9 aa, Homo Sapiens
STYFVVRNY

SEQ ID NO: 132278 - protein, 9 aa, Homo Sapiens
NEEQESKKN

SEQ ID NO: 132279 - protein, 9 aa, Homo Sapiens
DGEMANQEF

SEQ ID NO: 132280 - protein, 9 aa, Homo Sapiens
LCCVTAALI

SEQ ID NO: 132281 - protein, 9 aa, Homo Sapiens
KCFLTQLAD

SEQ ID NO: 132282 - protein, 9 aa, Homo Sapiens
QYLVQQLTL

SEQ ID NO: 132283 - protein, 9 aa, Homo Sapiens
CTQYGSPAT

SEQ ID NO: 132284 - protein, 9 aa, Homo Sapiens
PVRNLHPPR

SEQ ID NO: 132285 - protein, 9 aa, Homo Sapiens
FSCADINEC

SEQ ID NO: 132286 - protein, 9 aa, Homo Sapiens
YYMWKTTNR

SEQ ID NO: 132287 - protein, 9 aa, Homo Sapiens
ASEPLPPNS

SEQ ID NO: 132288 - protein, 9 aa, Homo Sapiens
ETETPTLQP

SEQ ID NO: 132289 - protein, 9 aa, Homo Sapiens
LDFPEATEE

SEQ ID NO: 132290 - protein, 9 aa, Homo Sapiens
YACATQLAF

SEQ ID NO: 132291 - protein, 9 aa, Homo Sapiens
TKTVDNWID

SEQ ID NO: 132292 - protein, 9 aa, Homo Sapiens
NIDEAVNKI

SEQ ID NO: 132293 - protein, 9 aa, Homo Sapiens
AMPGPSLES

SEQ ID NO: 132294 - protein, 9 aa, Homo Sapiens
SLRPCKLDF

SEQ ID NO: 132295 - protein, 9 aa, Homo Sapiens
RGEKGSRKN

SEQ ID NO: 132296 - protein, 9 aa, Homo Sapiens
VRTDSHLVR

SEQ ID NO: 132297 - protein, 9 aa, Homo Sapiens
TTDLLQSST

SEQ ID NO: 132298 - protein, 9 aa, Homo Sapiens
LTAAHSSTL

SEQ ID NO: 132299 - protein, 9 aa, Homo Sapiens
VGAQHDQRP

SEQ ID NO: 132300 - protein, 9 aa, Homo Sapiens
KMLSVFSTC

SEQ ID NO: 132301 - protein, 9 aa, Homo Sapiens
ALFLKMICP

SEQ ID NO: 132302 - protein, 9 aa, Homo Sapiens
LPLKRRKRL

SEQ ID NO: 132303 - protein, 9 aa, Homo Sapiens
VTVESHMKG

SEQ ID NO: 132304 - protein, 9 aa, Homo Sapiens
RPVKAGVPA

SEQ ID NO: 132305 - protein, 9 aa, Homo Sapiens
TRRSLAPTA

SEQ ID NO: 132306 - protein, 9 aa, Homo Sapiens
QLYDYTKDL

SEQ ID NO: 132307 - protein, 9 aa, Homo Sapiens
IQDGHHSSD

SEQ ID NO: 132308 - protein, 9 aa, Homo Sapiens
SGCVTKIYG

SEQ ID NO: 132309 - protein, 9 aa, Homo Sapiens
VDAAKPLPR

SEQ ID NO: 132310 - protein, 9 aa, Homo Sapiens
DAAMTAEEL

SEQ ID NO: 132311 - protein, 9 aa, Homo Sapiens
MAPFLPYTC

SEQ ID NO: 132312 - protein, 9 aa, Homo Sapiens
GDTAVREAS

SEQ ID NO: 132313 - protein, 9 aa, Homo Sapiens
APKIKERAH

SEQ ID NO: 132314 - protein, 9 aa, Homo Sapiens
VVKDDSSEN

SEQ ID NO: 132315 - protein, 9 aa, Homo Sapiens
YNNTQGSFI

SEQ ID NO: 132316 - protein, 9 aa, Homo Sapiens
LNIKEYTQV

SEQ ID NO: 132317 - protein, 9 aa, Homo Sapiens
GGPCPQTPC

SEQ ID NO: 132318 - protein, 9 aa, Homo Sapiens
PPGAAGRRR

SEQ ID NO: 132319 - protein, 9 aa, Homo Sapiens
YMLHIGAQK

SEQ ID NO: 132320 - protein, 9 aa, Homo Sapiens
HASANHSPV

SEQ ID NO: 132321 - protein, 9 aa, Homo Sapiens
DGCSLEKLP

SEQ ID NO: 132322 - protein, 9 aa, Homo Sapiens
DLTDTIEEG

SEQ ID NO: 132323 - protein, 9 aa, Homo Sapiens
VATYFLPGV

SEQ ID NO: 132324 - protein, 9 aa, Homo Sapiens
CRSMEVLTQ

SEQ ID NO: 132325 - protein, 9 aa, Homo Sapiens
RTDPGPWPR

SEQ ID NO: 132326 - protein, 9 aa, Homo Sapiens
QGEQRHTYP

SEQ ID NO: 132327 - protein, 9 aa, Homo Sapiens
SEEVQKKII

SEQ ID NO: 132328 - protein, 9 aa, Homo Sapiens
LGLYLMSLG

SEQ ID NO: 132329 - protein, 9 aa, Homo Sapiens
CGRAFFISH

SEQ ID NO: 132330 - protein, 9 aa, Homo Sapiens
TESTTRPMC

SEQ ID NO: 132331 - protein, 9 aa, Homo Sapiens
AGFRRVTNS

SEQ ID NO: 132332 - protein, 9 aa, Homo Sapiens
STTGRRSRR

SEQ ID NO: 132333 - protein, 9 aa, Homo Sapiens
VDADSGYNT

SEQ ID NO: 132334 - protein, 9 aa, Homo Sapiens
RARAAATPS

SEQ ID NO: 132335 - protein, 9 aa, Homo Sapiens
PHVDEEPES

SEQ ID NO: 132336 - protein, 9 aa, Homo Sapiens
RSPYYGGES

SEQ ID NO: 132337 - protein, 9 aa, Homo Sapiens
AVMPEVEFS

SEQ ID NO: 132338 - protein, 9 aa, Homo Sapiens
DFSEGHQGI

SEQ ID NO: 132339 - protein, 9 aa, Homo Sapiens
CPGFRQCVN

SEQ ID NO: 132340 - protein, 9 aa, Homo Sapiens
DLEIKSSDQ

SEQ ID NO: 132341 - protein, 9 aa, Homo Sapiens
GHTKRITFL

SEQ ID NO: 132342 - protein, 9 aa, Homo Sapiens
NKVLRKVMG

SEQ ID NO: 132343 - protein, 9 aa, Homo Sapiens
HHQTEPGQG

SEQ ID NO: 132344 - protein, 9 aa, Homo Sapiens
PCKPSCDVR

SEQ ID NO: 132345 - protein, 9 aa, Homo Sapiens
RRSQRLPWA

SEQ ID NO: 132346 - protein, 9 aa, Homo Sapiens
TTKLTVLEG

SEQ ID NO: 132347 - protein, 9 aa, Homo Sapiens
NCDVSHGQD

SEQ ID NO: 132348 - protein, 9 aa, Homo Sapiens
DVEPVHTSE

SEQ ID NO: 132349 - protein, 9 aa, Homo Sapiens
RVERGRGVK

SEQ ID NO: 132350 - protein, 9 aa, Homo Sapiens
NETLEEAVR

SEQ ID NO: 132351 - protein, 9 aa, Homo Sapiens
KDVAAVGVE

SEQ ID NO: 132352 - protein, 9 aa, Homo Sapiens
YAMSSSLPK

SEQ ID NO: 132353 - protein, 9 aa, Homo Sapiens
MVVHGAIFL

SEQ ID NO: 132354 - protein, 9 aa, Homo Sapiens
GSFSVRLFV

SEQ ID NO: 132355 - protein, 9 aa, Homo Sapiens
SKSAQLNGL

SEQ ID NO: 132356 - protein, 9 aa, Homo Sapiens
PRRKCRTLQ

SEQ ID NO: 132357 - protein, 9 aa, Homo Sapiens
AAGAPRDGR

SEQ ID NO: 132358 - protein, 9 aa, Homo Sapiens
NISTVRAIN

SEQ ID NO: 132359 - protein, 9 aa, Homo Sapiens
GVYTGSEFY

SEQ ID NO: 132360 - protein, 9 aa, Homo Sapiens
FIFCRCQTL

SEQ ID NO: 132361 - protein, 9 aa, Homo Sapiens
RNVASPTSV

SEQ ID NO: 132362 - protein, 9 aa, Homo Sapiens
TVEENILKR

SEQ ID NO: 132363 - protein, 9 aa, Homo Sapiens
NKCLTEEQA

SEQ ID NO: 132364 - protein, 9 aa, Homo Sapiens
CTLIVFWKY

SEQ ID NO: 132365 - protein, 9 aa, Homo Sapiens
SFLTETSLM

SEQ ID NO: 132366 - protein, 9 aa, Homo Sapiens
VNGSHRLDP

SEQ ID NO: 132367 - protein, 9 aa, Homo Sapiens
EEERKLLGA

SEQ ID NO: 132368 - protein, 9 aa, Homo Sapiens
NLENAISQL

SEQ ID NO: 132369 - protein, 9 aa, Homo Sapiens
KVPLAKRKS

SEQ ID NO: 132370 - protein, 9 aa, Homo Sapiens
QCVEKSRSC

SEQ ID NO: 132371 - protein, 9 aa, Homo Sapiens
AQKMQSGKV

SEQ ID NO: 132372 - protein, 9 aa, Homo Sapiens
GSAWASWPT

SEQ ID NO: 132373 - protein, 9 aa, Homo Sapiens
KACFSMPGD

SEQ ID NO: 132374 - protein, 9 aa, Homo Sapiens
APSSCPTTS

SEQ ID NO: 132375 - protein, 9 aa, Homo Sapiens
MGGNRSICL

SEQ ID NO: 132376 - protein, 9 aa, Homo Sapiens
VLCYRCLPL

SEQ ID NO: 132377 - protein, 9 aa, Homo Sapiens
ASLRPRSVV

SEQ ID NO: 132378 - protein, 9 aa, Homo Sapiens
GLWFRLFHT

SEQ ID NO: 132379 - protein, 9 aa, Homo Sapiens
IMDISPPSR

SEQ ID NO: 132380 - protein, 9 aa, Homo Sapiens
VFGKAILTR

SEQ ID NO: 132381 - protein, 9 aa, Homo Sapiens
CSTLDSFWG

SEQ ID NO: 132382 - protein, 9 aa, Homo Sapiens
AACFQLNEQ

SEQ ID NO: 132383 - protein, 9 aa, Homo Sapiens
SLFYYASGS

SEQ ID NO: 132384 - protein, 9 aa, Homo Sapiens
SSEEGYYPE

SEQ ID NO: 132385 - protein, 9 aa, Homo Sapiens
FTTQRSCGS

SEQ ID NO: 132386 - protein, 9 aa, Homo Sapiens
DVGKGAAQH

SEQ ID NO: 132387 - protein, 9 aa, Homo Sapiens
HTHTLTHTH

SEQ ID NO: 132388 - protein, 9 aa, Homo Sapiens
VSQWDMFTT

SEQ ID NO: 132389 - protein, 9 aa, Homo Sapiens
HDGLGHSRD

SEQ ID NO: 132390 - protein, 9 aa, Homo Sapiens
LWNAHTQTY

SEQ ID NO: 132391 - protein, 9 aa, Homo Sapiens
GKDLTTEIM

SEQ ID NO: 132392 - protein, 9 aa, Homo Sapiens
ANPHLPIMR

SEQ ID NO: 132393 - protein, 9 aa, Homo Sapiens
MGFLLVRER

SEQ ID NO: 132394 - protein, 9 aa, Homo Sapiens
PVPDGDGKQ

SEQ ID NO: 132395 - protein, 9 aa, Homo Sapiens
GVVSSRMAL

SEQ ID NO: 132396 - protein, 9 aa, Homo Sapiens
DVVHAMNNL

SEQ ID NO: 132397 - protein, 9 aa, Homo Sapiens
LKEVSEFHS

SEQ ID NO: 132398 - protein, 9 aa, Homo Sapiens
HSGAVATSA

SEQ ID NO: 132399 - protein, 9 aa, Homo Sapiens
YKNNDGYID

SEQ ID NO: 132400 - protein, 9 aa, Homo Sapiens
LEETPIQGS

SEQ ID NO: 132401 - protein, 9 aa, Homo Sapiens
HIDQHKGED

SEQ ID NO: 132402 - protein, 9 aa, Homo Sapiens
TRRYSERVE

SEQ ID NO: 132403 - protein, 9 aa, Homo Sapiens
PKTCGYHPI

SEQ ID NO: 132404 - protein, 9 aa, Homo Sapiens
NVMNVGKPS

SEQ ID NO: 132405 - protein, 9 aa, Homo Sapiens
RGKSQGGRI

SEQ ID NO: 132406 - protein, 9 aa, Homo Sapiens
SSLARRLDF

SEQ ID NO: 132407 - protein, 9 aa, Homo Sapiens
TWLLDVEPV

SEQ ID NO: 132408 - protein, 9 aa, Homo Sapiens
ISSIRAGQC

SEQ ID NO: 132409 - protein, 9 aa, Homo Sapiens
PLSVGHDAH

SEQ ID NO: 132410 - protein, 9 aa, Homo Sapiens
SDLVSVMKK

SEQ ID NO: 132411 - protein, 9 aa, Homo Sapiens
ILTRYRANA

SEQ ID NO: 132412 - protein, 9 aa, Homo Sapiens
KMMKRAVIW

SEQ ID NO: 132413 - protein, 9 aa, Homo Sapiens
RDHSPPHRA

SEQ ID NO: 132414 - protein, 9 aa, Homo Sapiens
RPDLDLVLR

SEQ ID NO: 132415 - protein, 9 aa, Homo Sapiens
VADERLPLH

SEQ ID NO: 132416 - protein, 9 aa, Homo Sapiens
GGGGSPRST

SEQ ID NO: 132417 - protein, 9 aa, Homo Sapiens
VSNGASTAT

SEQ ID NO: 132418 - protein, 9 aa, Homo Sapiens
EWPLGKMCL

SEQ ID NO: 132419 - protein, 9 aa, Homo Sapiens
MGELKAEGA

SEQ ID NO: 132420 - protein, 9 aa, Homo Sapiens
GQIWRAESG

SEQ ID NO: 132421 - protein, 9 aa, Homo Sapiens
ACSSTPGSG

SEQ ID NO: 132422 - protein, 9 aa, Homo Sapiens
RSEFYSLQE

SEQ ID NO: 132423 - protein, 9 aa, Homo Sapiens
SCYSPRTSL

SEQ ID NO: 132424 - protein, 9 aa, Homo Sapiens
LSINNYRFQ

SEQ ID NO: 132425 - protein, 9 aa, Homo Sapiens
RSFDGEVSW

SEQ ID NO: 132426 - protein, 9 aa, Homo Sapiens
LRVVAHSDT

SEQ ID NO: 132427 - protein, 9 aa, Homo Sapiens
HKAGTKNLL

SEQ ID NO: 132428 - protein, 9 aa, Homo Sapiens
SKEATPVKE

SEQ ID NO: 132429 - protein, 9 aa, Homo Sapiens
FRNLDFSEG

SEQ ID NO: 132430 - protein, 9 aa, Homo Sapiens
FVLSASRPE

SEQ ID NO: 132431 - protein, 9 aa, Homo Sapiens
ELETLFLPY

SEQ ID NO: 132432 - protein, 9 aa, Homo Sapiens
QPECEAHAR

SEQ ID NO: 132433 - protein, 9 aa, Homo Sapiens
CWNTERDQT

SEQ ID NO: 132434 - protein, 9 aa, Homo Sapiens
PRLGVGATR

SEQ ID NO: 132435 - protein, 9 aa, Homo Sapiens
AMYNNTQGS

SEQ ID NO: 132436 - protein, 9 aa, Homo Sapiens
STQSTPWMT

SEQ ID NO: 132437 - protein, 9 aa, Homo Sapiens
ALGAAAKFT

SEQ ID NO: 132438 - protein, 9 aa, Homo Sapiens
GKRSSISVI

SEQ ID NO: 132439 - protein, 9 aa, Homo Sapiens
LHAIMEIEE

SEQ ID NO: 132440 - protein, 9 aa, Homo Sapiens
PALGLVREV

SEQ ID NO: 132441 - protein, 9 aa, Homo Sapiens
ATAAVAPPW

SEQ ID NO: 132442 - protein, 9 aa, Homo Sapiens
ISNFLFSNL

SEQ ID NO: 132443 - protein, 9 aa, Homo Sapiens
TMNPFLMTT

SEQ ID NO: 132444 - protein, 9 aa, Homo Sapiens
ETALQIFNN

SEQ ID NO: 132445 - protein, 9 aa, Homo Sapiens
SGTSTIRTR

SEQ ID NO: 132446 - protein, 9 aa, Homo Sapiens
LIPCKPSCD

SEQ ID NO: 132447 - protein, 9 aa, Homo Sapiens
EVPDEVLGL

SEQ ID NO: 132448 - protein, 9 aa, Homo Sapiens
KGLVQRVFP

SEQ ID NO: 132449 - protein, 9 aa, Homo Sapiens
VKGFYPSDV

SEQ ID NO: 132450 - protein, 9 aa, Homo Sapiens
SNVGRQYLV

SEQ ID NO: 132451 - protein, 9 aa, Homo Sapiens
GAQLMAPLS

SEQ ID NO: 132452 - protein, 9 aa, Homo Sapiens
QPFVNLLSN

SEQ ID NO: 132453 - protein, 9 aa, Homo Sapiens
LTVLPGTGH

SEQ ID NO: 132454 - protein, 9 aa, Homo Sapiens
VHESFLYNR

SEQ ID NO: 132455 - protein, 9 aa, Homo Sapiens
SPGRPTNLV

SEQ ID NO: 132456 - protein, 9 aa, Homo Sapiens
ILRISWELE

SEQ ID NO: 132457 - protein, 9 aa, Homo Sapiens
TEPGQGRAV

SEQ ID NO: 132458 - protein, 9 aa, Homo Sapiens
NSPFFIQIR

SEQ ID NO: 132459 - protein, 9 aa, Homo Sapiens
KGPLNLQGG

SEQ ID NO: 132460 - protein, 9 aa, Homo Sapiens
IDEDLLRES

SEQ ID NO: 132461 - protein, 9 aa, Homo Sapiens
PGPLPASHP

SEQ ID NO: 132462 - protein, 9 aa, Homo Sapiens
NATLPPPPT

SEQ ID NO: 132463 - protein, 9 aa, Homo Sapiens
LQRNLLRLQ

SEQ ID NO: 132464 - protein, 9 aa, Homo Sapiens
QMENSHLKH

SEQ ID NO: 132465 - protein, 9 aa, Homo Sapiens
MVTVDRTKT

SEQ ID NO: 132466 - protein, 9 aa, Homo Sapiens
VVVVKNGRR

SEQ ID NO: 132467 - protein, 9 aa, Homo Sapiens
GARCARWLH

SEQ ID NO: 132468 - protein, 9 aa, Homo Sapiens
VAFCWINVH

SEQ ID NO: 132469 - protein, 9 aa, Homo Sapiens
QAGRASQPM

SEQ ID NO: 132470 - protein, 9 aa, Homo Sapiens
RTRASGRHT

SEQ ID NO: 132471 - protein, 9 aa, Homo Sapiens
IMRKRKMRR

SEQ ID NO: 132472 - protein, 9 aa, Homo Sapiens
PFLVFLTSL

SEQ ID NO: 132473 - protein, 9 aa, Homo Sapiens
LSLWVQSLD

SEQ ID NO: 132474 - protein, 9 aa, Homo Sapiens
EGLALSLAL

SEQ ID NO: 132475 - protein, 9 aa, Homo Sapiens
FCLLGTFRR

SEQ ID NO: 132476 - protein, 9 aa, Homo Sapiens
LQHIGYRMR

SEQ ID NO: 132477 - protein, 9 aa, Homo Sapiens
HRLHLHHHL

SEQ ID NO: 132478 - protein, 9 aa, Homo Sapiens
IIRREVMDE

SEQ ID NO: 132479 - protein, 9 aa, Homo Sapiens
LGGPCAWTG

SEQ ID NO: 132480 - protein, 9 aa, Homo Sapiens
SKWNSTFSP

SEQ ID NO: 132481 - protein, 9 aa, Homo Sapiens
SKWRKQEKI

SEQ ID NO: 132482 - protein, 9 aa, Homo Sapiens
CVGQKMKRI

SEQ ID NO: 132483 - protein, 9 aa, Homo Sapiens
KYFCENRHH

SEQ ID NO: 132484 - protein, 9 aa, Homo Sapiens
ARRQEHRQR

SEQ ID NO: 132485 - protein, 9 aa, Homo Sapiens
PKRPRTAGR

SEQ ID NO: 132486 - protein, 9 aa, Homo Sapiens
ENCGYKLCG

SEQ ID NO: 132487 - protein, 9 aa, Homo Sapiens
FLGITDSHQ

SEQ ID NO: 132488 - protein, 9 aa, Homo Sapiens
GGLIAGSLD

SEQ ID NO: 132489 - protein, 9 aa, Homo Sapiens
TFAQNETFV

SEQ ID NO: 132490 - protein, 9 aa, Homo Sapiens
CSIDMDTVH

SEQ ID NO: 132491 - protein, 9 aa, Homo Sapiens
LNEMTHKFN

SEQ ID NO: 132492 - protein, 9 aa, Homo Sapiens
IPTSLVGSL

SEQ ID NO: 132493 - protein, 9 aa, Homo Sapiens
AYVRQGLLL

SEQ ID NO: 132494 - protein, 9 aa, Homo Sapiens
VCVACEKKM

SEQ ID NO: 132495 - protein, 9 aa, Homo Sapiens
IRTRGNANT

SEQ ID NO: 132496 - protein, 9 aa, Homo Sapiens
DMVIAEMLR

SEQ ID NO: 132497 - protein, 9 aa, Homo Sapiens
RLDTGCSVS

SEQ ID NO: 132498 - protein, 9 aa, Homo Sapiens
ISSEAPVGQ

SEQ ID NO: 132499 - protein, 9 aa, Homo Sapiens
RGALQAACF

SEQ ID NO: 132500 - protein, 9 aa, Homo Sapiens
FDGRPSSHL

SEQ ID NO: 132501 - protein, 9 aa, Homo Sapiens
SQRGAATQR

SEQ ID NO: 132502 - protein, 9 aa, Homo Sapiens
STFPSVYAI

SEQ ID NO: 132503 - protein, 9 aa, Homo Sapiens
GTEARSKMV

SEQ ID NO: 132504 - protein, 9 aa, Homo Sapiens
SALGAAAKF

SEQ ID NO: 132505 - protein, 9 aa, Homo Sapiens
DEHFVQNCI

SEQ ID NO: 132506 - protein, 9 aa, Homo Sapiens
RKPFLRDYV

SEQ ID NO: 132507 - protein, 9 aa, Homo Sapiens
HADDIQCVF

SEQ ID NO: 132508 - protein, 9 aa, Homo Sapiens
KKRRSKIEA

SEQ ID NO: 132509 - protein, 9 aa, Homo Sapiens
RRMQNDTTE

SEQ ID NO: 132510 - protein, 9 aa, Homo Sapiens
KDNLEEAKQ

SEQ ID NO: 132511 - protein, 9 aa, Homo Sapiens
AANDSDSES

SEQ ID NO: 132512 - protein, 9 aa, Homo Sapiens
DYRTNASIS

SEQ ID NO: 132513 - protein, 9 aa, Homo Sapiens
EMTHKFNQE

SEQ ID NO: 132514 - protein, 9 aa, Homo Sapiens
FLSPTVFVA

SEQ ID NO: 132515 - protein, 9 aa, Homo Sapiens
RGSSSSRCL

SEQ ID NO: 132516 - protein, 9 aa, Homo Sapiens
TVRLGFLVD

SEQ ID NO: 132517 - protein, 9 aa, Homo Sapiens
LKKTKQRLQ

SEQ ID NO: 132518 - protein, 9 aa, Homo Sapiens
SRVTASHPT

SEQ ID NO: 132519 - protein, 9 aa, Homo Sapiens
PPCLTWAES

SEQ ID NO: 132520 - protein, 9 aa, Homo Sapiens
LPGLHLYPV

SEQ ID NO: 132521 - protein, 9 aa, Homo Sapiens
EGEEAQEPE

SEQ ID NO: 132522 - protein, 9 aa, Homo Sapiens
IKPKVPLAV

SEQ ID NO: 132523 - protein, 9 aa, Homo Sapiens
LSQSPRSSC

SEQ ID NO: 132524 - protein, 9 aa, Homo Sapiens
QVITVHQIS

SEQ ID NO: 132525 - protein, 9 aa, Homo Sapiens
QGCLIKDGK

SEQ ID NO: 132526 - protein, 9 aa, Homo Sapiens
WWKKHLMRL

SEQ ID NO: 132527 - protein, 9 aa, Homo Sapiens
PYVPEVRSD

SEQ ID NO: 132528 - protein, 9 aa, Homo Sapiens
FSSLLNEMT

SEQ ID NO: 132529 - protein, 9 aa, Homo Sapiens
NVQHQNRNP

SEQ ID NO: 132530 - protein, 9 aa, Homo Sapiens
CGPPLGASP

SEQ ID NO: 132531 - protein, 9 aa, Homo Sapiens
MQPWQPLGN

SEQ ID NO: 132532 - protein, 9 aa, Homo Sapiens
DDKQIELMT

SEQ ID NO: 132533 - protein, 9 aa, Homo Sapiens
KKKRSVVLG

SEQ ID NO: 132534 - protein, 9 aa, Homo Sapiens
CLFEYAGND

SEQ ID NO: 132535 - protein, 9 aa, Homo Sapiens
LATMACDRY

SEQ ID NO: 132536 - protein, 9 aa, Homo Sapiens
RRCPGLSRK

SEQ ID NO: 132537 - protein, 9 aa, Homo Sapiens
MFREDSMME

SEQ ID NO: 132538 - protein, 9 aa, Homo Sapiens
YVNTVGGTS

SEQ ID NO: 132539 - protein, 9 aa, Homo Sapiens
MMTRNFPER

SEQ ID NO: 132540 - protein, 9 aa, Homo Sapiens
NYRFQMKFY

SEQ ID NO: 132541 - protein, 9 aa, Homo Sapiens
LGRSHGRKK

SEQ ID NO: 132542 - protein, 9 aa, Homo Sapiens
GEDAMAQDL

SEQ ID NO: 132543 - protein, 9 aa, Homo Sapiens
QMWVCNSAG

SEQ ID NO: 132544 - protein, 9 aa, Homo Sapiens
LLLLSFRVF

SEQ ID NO: 132545 - protein, 9 aa, Homo Sapiens
KDPSNAANP

SEQ ID NO: 132546 - protein, 9 aa, Homo Sapiens
TLLKMEEWV

SEQ ID NO: 132547 - protein, 9 aa, Homo Sapiens
PWRAATQRP

SEQ ID NO: 132548 - protein, 9 aa, Homo Sapiens
EFYSLQEQH

SEQ ID NO: 132549 - protein, 9 aa, Homo Sapiens
LEVVGELQV

SEQ ID NO: 132550 - protein, 9 aa, Homo Sapiens
EKMVAVGPG

SEQ ID NO: 132551 - protein, 9 aa, Homo Sapiens
KILWSGFSM

SEQ ID NO: 132552 - protein, 9 aa, Homo Sapiens
SLAPTAAGS

SEQ ID NO: 132553 - protein, 9 aa, Homo Sapiens
PGKRSSISV

SEQ ID NO: 132554 - protein, 9 aa, Homo Sapiens
VREPRGLGL

SEQ ID NO: 132555 - protein, 9 aa, Homo Sapiens
ETISQAMPN

SEQ ID NO: 132556 - protein, 9 aa, Homo Sapiens
KFFFSKIKQ

SEQ ID NO: 132557 - protein, 9 aa, Homo Sapiens
CYELNFHRS

SEQ ID NO: 132558 - protein, 9 aa, Homo Sapiens
SVAIAAGAG

SEQ ID NO: 132559 - protein, 9 aa, Homo Sapiens
QEDHSRRDM

SEQ ID NO: 132560 - protein, 9 aa, Homo Sapiens
LCQRFPTLT

SEQ ID NO: 132561 - protein, 9 aa, Homo Sapiens
RAAPPHVDE

SEQ ID NO: 132562 - protein, 9 aa, Homo Sapiens
GTRGIGETC

SEQ ID NO: 132563 - protein, 9 aa, Homo Sapiens
EGNPLLLQQ

SEQ ID NO: 132564 - protein, 9 aa, Homo Sapiens
NLSHDEQRA

SEQ ID NO: 132565 - protein, 9 aa, Homo Sapiens
SGLLEASTL

SEQ ID NO: 132566 - protein, 9 aa, Homo Sapiens
NKLRVKTRD

SEQ ID NO: 132567 - protein, 9 aa, Homo Sapiens
GGGSPRSTQ

SEQ ID NO: 132568 - protein, 9 aa, Homo Sapiens
YFGSVLEDP

SEQ ID NO: 132569 - protein, 9 aa, Homo Sapiens
FLVCLVILV

SEQ ID NO: 132570 - protein, 9 aa, Homo Sapiens
LGRPWRQWE

SEQ ID NO: 132571 - protein, 9 aa, Homo Sapiens
RENIDLSEI

SEQ ID NO: 132572 - protein, 9 aa, Homo Sapiens
CCRRWALLA

SEQ ID NO: 132573 - protein, 9 aa, Homo Sapiens
SRQRCALSH

SEQ ID NO: 132574 - protein, 9 aa, Homo Sapiens
IPPGTRPRD

SEQ ID NO: 132575 - protein, 9 aa, Homo Sapiens
PQRPPRSIL

SEQ ID NO: 132576 - protein, 9 aa, Homo Sapiens
VGKPFSENQ

SEQ ID NO: 132577 - protein, 9 aa, Homo Sapiens
PSRMCTARR

SEQ ID NO: 132578 - protein, 9 aa, Homo Sapiens
AFASWSDDA

SEQ ID NO: 132579 - protein, 9 aa, Homo Sapiens
LFVRTRKGQ

SEQ ID NO: 132580 - protein, 9 aa, Homo Sapiens
EAVLKRESG

SEQ ID NO: 132581 - protein, 9 aa, Homo Sapiens
YQEGGVEPA

SEQ ID NO: 132582 - protein, 9 aa, Homo Sapiens
FKVPQAQLT

SEQ ID NO: 132583 - protein, 9 aa, Homo Sapiens
ATRIETEST

SEQ ID NO: 132584 - protein, 9 aa, Homo Sapiens
FFGGCSDFC

SEQ ID NO: 132585 - protein, 9 aa, Homo Sapiens
EDDDEKRWI

SEQ ID NO: 132586 - protein, 9 aa, Homo Sapiens
TSHGSPFTS

SEQ ID NO: 132587 - protein, 9 aa, Homo Sapiens
DLCQPYRSE

SEQ ID NO: 132588 - protein, 9 aa, Homo Sapiens
HESFLYNRE

SEQ ID NO: 132589 - protein, 9 aa, Homo Sapiens
SGLYVSVRS

SEQ ID NO: 132590 - protein, 9 aa, Homo Sapiens
RLELEDEWR

SEQ ID NO: 132591 - protein, 9 aa, Homo Sapiens
MGTSFRSFC

SEQ ID NO: 132592 - protein, 9 aa, Homo Sapiens
SADGAHGMR

SEQ ID NO: 132593 - protein, 9 aa, Homo Sapiens
PSCCRRWAL

SEQ ID NO: 132594 - protein, 9 aa, Homo Sapiens
TALEDELTQ

SEQ ID NO: 132595 - protein, 9 aa, Homo Sapiens
KAEASLIDQ

SEQ ID NO: 132596 - protein, 9 aa, Homo Sapiens
SHTGNPPVT

SEQ ID NO: 132597 - protein, 9 aa, Homo Sapiens
DPWVFAIRR

SEQ ID NO: 132598 - protein, 9 aa, Homo Sapiens
WPITAFHAK

SEQ ID NO: 132599 - protein, 9 aa, Homo Sapiens
PPGTRPRDD

SEQ ID NO: 132600 - protein, 9 aa, Homo Sapiens
KLAGLGLRM

SEQ ID NO: 132601 - protein, 9 aa, Homo Sapiens
WPEFVRNYV

SEQ ID NO: 132602 - protein, 9 aa, Homo Sapiens
AVNFVVVDE

SEQ ID NO: 132603 - protein, 9 aa, Homo Sapiens
IINPTISCP

SEQ ID NO: 132604 - protein, 9 aa, Homo Sapiens
SSPRRASGC

SEQ ID NO: 132605 - protein, 9 aa, Homo Sapiens
MATDVDDKF

SEQ ID NO: 132606 - protein, 9 aa, Homo Sapiens
TQTQTSTFS

SEQ ID NO: 132607 - protein, 9 aa, Homo Sapiens
QHCAKETPR

SEQ ID NO: 132608 - protein, 9 aa, Homo Sapiens
PSPHLLHPG

SEQ ID NO: 132609 - protein, 9 aa, Homo Sapiens
VKPLGEEET

SEQ ID NO: 132610 - protein, 9 aa, Homo Sapiens
STKQIREQI

SEQ ID NO: 132611 - protein, 9 aa, Homo Sapiens
GLPSGARST

SEQ ID NO: 132612 - protein, 9 aa, Homo Sapiens
GSMQENYPF

SEQ ID NO: 132613 - protein, 9 aa, Homo Sapiens
LSMELPDFF

SEQ ID NO: 132614 - protein, 9 aa, Homo Sapiens
TTTLVCDNG

SEQ ID NO: 132615 - protein, 9 aa, Homo Sapiens
ESAPATLTQ

SEQ ID NO: 132616 - protein, 9 aa, Homo Sapiens
ATALSLKNF

SEQ ID NO: 132617 - protein, 9 aa, Homo Sapiens
EKHLMRLHP

SEQ ID NO: 132618 - protein, 9 aa, Homo Sapiens
QKLIDVNNY

SEQ ID NO: 132619 - protein, 9 aa, Homo Sapiens
VLECFEKIC

SEQ ID NO: 132620 - protein, 9 aa, Homo Sapiens
GNRGGALGT

SEQ ID NO: 132621 - protein, 9 aa, Homo Sapiens
EYLSMSYQR

SEQ ID NO: 132622 - protein, 9 aa, Homo Sapiens
YSNGKDDGQ

SEQ ID NO: 132623 - protein, 9 aa, Homo Sapiens
RLSASQIWN

SEQ ID NO: 132624 - protein, 9 aa, Homo Sapiens
QQHVLLCLA

SEQ ID NO: 132625 - protein, 9 aa, Homo Sapiens
PAEPEAKEA

SEQ ID NO: 132626 - protein, 9 aa, Homo Sapiens
PAPENGVRH

SEQ ID NO: 132627 - protein, 9 aa, Homo Sapiens
GQGRAVNFV

SEQ ID NO: 132628 - protein, 9 aa, Homo Sapiens
HHLIGQVAA

SEQ ID NO: 132629 - protein, 9 aa, Homo Sapiens
KAVEPGKLE

SEQ ID NO: 132630 - protein, 9 aa, Homo Sapiens
PEQSFYTNP

SEQ ID NO: 132631 - protein, 9 aa, Homo Sapiens
CSLEDLRSK

SEQ ID NO: 132632 - protein, 9 aa, Homo Sapiens
TRPLSTMAN

SEQ ID NO: 132633 - protein, 9 aa, Homo Sapiens
SFFETSTYP

SEQ ID NO: 132634 - protein, 9 aa, Homo Sapiens
YNARRQEHR

SEQ ID NO: 132635 - protein, 9 aa, Homo Sapiens
VGDRKGVHP

SEQ ID NO: 132636 - protein, 9 aa, Homo Sapiens
MRGLLEPLG

SEQ ID NO: 132637 - protein, 9 aa, Homo Sapiens
LLPRENWTH

SEQ ID NO: 132638 - protein, 9 aa, Homo Sapiens
DDGREYEGV

SEQ ID NO: 132639 - protein, 9 aa, Homo Sapiens
AIPESLKNV

SEQ ID NO: 132640 - protein, 9 aa, Homo Sapiens
EGGPQRPLQ

SEQ ID NO: 132641 - protein, 9 aa, Homo Sapiens
AVTAKDKGN

SEQ ID NO: 132642 - protein, 9 aa, Homo Sapiens
PELCSHQDE

SEQ ID NO: 132643 - protein, 9 aa, Homo Sapiens
IGDRGPQAT

SEQ ID NO: 132644 - protein, 9 aa, Homo Sapiens
DVNKVLRKV

SEQ ID NO: 132645 - protein, 9 aa, Homo Sapiens
AKLAQLYDR

SEQ ID NO: 132646 - protein, 9 aa, Homo Sapiens
LLYATGCFV

SEQ ID NO: 132647 - protein, 9 aa, Homo Sapiens
HSQASSVRT

SEQ ID NO: 132648 - protein, 9 aa, Homo Sapiens
PEGYSVAAM

SEQ ID NO: 132649 - protein, 9 aa, Homo Sapiens
DLIEKCDCS

SEQ ID NO: 132650 - protein, 9 aa, Homo Sapiens
AWDPPPGAA

SEQ ID NO: 132651 - protein, 9 aa, Homo Sapiens
TRIETESTT

SEQ ID NO: 132652 - protein, 9 aa, Homo Sapiens
ITEDVQGEN

SEQ ID NO: 132653 - protein, 9 aa, Homo Sapiens
KERAHNVTE

SEQ ID NO: 132654 - protein, 9 aa, Homo Sapiens
RRPPAPTPC

SEQ ID NO: 132655 - protein, 9 aa, Homo Sapiens
KVGTKPKIE

SEQ ID NO: 132656 - protein, 9 aa, Homo Sapiens
TWLKNGDRL

SEQ ID NO: 132657 - protein, 9 aa, Homo Sapiens
LCGRCRGAP

SEQ ID NO: 132658 - protein, 9 aa, Homo Sapiens
FFRDISNSS

SEQ ID NO: 132659 - protein, 9 aa, Homo Sapiens
ERVEKTGES

SEQ ID NO: 132660 - protein, 9 aa, Homo Sapiens
LEDVALLED

SEQ ID NO: 132661 - protein, 9 aa, Homo Sapiens
PIQVKRDLN

SEQ ID NO: 132662 - protein, 9 aa, Homo Sapiens
PSDGHAQPS

SEQ ID NO: 132663 - protein, 9 aa, Homo Sapiens
EFYNARRQE

SEQ ID NO: 132664 - protein, 9 aa, Homo Sapiens
FWGEKIVAL

SEQ ID NO: 132665 - protein, 9 aa, Homo Sapiens
GGAPAPPAL

SEQ ID NO: 132666 - protein, 9 aa, Homo Sapiens
QSQLSCLFL

SEQ ID NO: 132667 - protein, 9 aa, Homo Sapiens
DYQPPAKKN

SEQ ID NO: 132668 - protein, 9 aa, Homo Sapiens
AEMWRQLIP

SEQ ID NO: 132669 - protein, 9 aa, Homo Sapiens
DGSGEPEGR

SEQ ID NO: 132670 - protein, 9 aa, Homo Sapiens
LRLQQRLED

SEQ ID NO: 132671 - protein, 9 aa, Homo Sapiens
SVDLSTRVV

SEQ ID NO: 132672 - protein, 9 aa, Homo Sapiens
LAIAPSIFF

SEQ ID NO: 132673 - protein, 9 aa, Homo Sapiens
QDRDITLLD

SEQ ID NO: 132674 - protein, 9 aa, Homo Sapiens
QIRISSKQE

SEQ ID NO: 132675 - protein, 9 aa, Homo Sapiens
KIGSKKPQK

SEQ ID NO: 132676 - protein, 9 aa, Homo Sapiens
IDQMSSCDS

SEQ ID NO: 132677 - protein, 9 aa, Homo Sapiens
LVRGNADLR

SEQ ID NO: 132678 - protein, 9 aa, Homo Sapiens
LFDMGLRKQ

SEQ ID NO: 132679 - protein, 9 aa, Homo Sapiens
YKSMSNLGS

SEQ ID NO: 132680 - protein, 9 aa, Homo Sapiens
QSILFSTDV

SEQ ID NO: 132681 - protein, 9 aa, Homo Sapiens
ILSTSQELC

SEQ ID NO: 132682 - protein, 9 aa, Homo Sapiens
VCTKAGGVC

SEQ ID NO: 132683 - protein, 9 aa, Homo Sapiens
VFAIRRPPV

SEQ ID NO: 132684 - protein, 9 aa, Homo Sapiens
LALSPPWAL

SEQ ID NO: 132685 - protein, 9 aa, Homo Sapiens
GEVSPSQGT

SEQ ID NO: 132686 - protein, 9 aa, Homo Sapiens
GLDRCNAGW

SEQ ID NO: 132687 - protein, 9 aa, Homo Sapiens
DGSSHIAGN

SEQ ID NO: 132688 - protein, 9 aa, Homo Sapiens
SAVNFEKPK

SEQ ID NO: 132689 - protein, 9 aa, Homo Sapiens
QPHRLHLHH

SEQ ID NO: 132690 - protein, 9 aa, Homo Sapiens
PKSLGLSSY

SEQ ID NO: 132691 - protein, 9 aa, Homo Sapiens
PRQGKPNYT

SEQ ID NO: 132692 - protein, 9 aa, Homo Sapiens
LAHSTATCS

SEQ ID NO: 132693 - protein, 9 aa, Homo Sapiens
RRFTIRGFP

SEQ ID NO: 132694 - protein, 9 aa, Homo Sapiens
THPDPHGQG

SEQ ID NO: 132695 - protein, 9 aa, Homo Sapiens
SETKNLENA

SEQ ID NO: 132696 - protein, 9 aa, Homo Sapiens
IPESLKNVL

SEQ ID NO: 132697 - protein, 9 aa, Homo Sapiens
AVNFEKPKT

SEQ ID NO: 132698 - protein, 9 aa, Homo Sapiens
TCSRLYVPH

SEQ ID NO: 132699 - protein, 9 aa, Homo Sapiens
CLISLSCFL

SEQ ID NO: 132700 - protein, 9 aa, Homo Sapiens
RLHPPSPPP

SEQ ID NO: 132701 - protein, 9 aa, Homo Sapiens
RVKALAGQS

SEQ ID NO: 132702 - protein, 9 aa, Homo Sapiens
RLESVLRAH

SEQ ID NO: 132703 - protein, 9 aa, Homo Sapiens
NNGEAVSFQ

SEQ ID NO: 132704 - protein, 9 aa, Homo Sapiens
AADHIRRLQ

SEQ ID NO: 132705 - protein, 9 aa, Homo Sapiens
SHLTEFVPP

SEQ ID NO: 132706 - protein, 9 aa, Homo Sapiens
KHIFSTITL

SEQ ID NO: 132707 - protein, 9 aa, Homo Sapiens
KEIDRERAA

SEQ ID NO: 132708 - protein, 9 aa, Homo Sapiens
THLVGKEVA

SEQ ID NO: 132709 - protein, 9 aa, Homo Sapiens
ELQHLKKEV

SEQ ID NO: 132710 - protein, 9 aa, Homo Sapiens
MDEDTRHLS

SEQ ID NO: 132711 - protein, 9 aa, Homo Sapiens
RTSVHCLKQ

SEQ ID NO: 132712 - protein, 9 aa, Homo Sapiens
CFQLNEQLY

SEQ ID NO: 132713 - protein, 9 aa, Homo Sapiens
SIQRQHTIS

SEQ ID NO: 132714 - protein, 9 aa, Homo Sapiens
LGASPLWGF

SEQ ID NO: 132715 - protein, 9 aa, Homo Sapiens
NPSVKSQPL

SEQ ID NO: 132716 - protein, 9 aa, Homo Sapiens
DLTIEVKEK

SEQ ID NO: 132717 - protein, 9 aa, Homo Sapiens
IKTYFGAEP

SEQ ID NO: 132718 - protein, 9 aa, Homo Sapiens
PWAGAPATE

SEQ ID NO: 132719 - protein, 9 aa, Homo Sapiens
EDYMPLHAS

SEQ ID NO: 132720 - protein, 9 aa, Homo Sapiens
TRDLGPNPI

SEQ ID NO: 132721 - protein, 9 aa, Homo Sapiens
KQAHPDTGI

SEQ ID NO: 132722 - protein, 9 aa, Homo Sapiens
ASCPGFRQC

SEQ ID NO: 132723 - protein, 9 aa, Homo Sapiens
HEGGSEEEE

SEQ ID NO: 132724 - protein, 9 aa, Homo Sapiens
NPTISCPFQ

SEQ ID NO: 132725 - protein, 9 aa, Homo Sapiens
LGGCSGLPW

SEQ ID NO: 132726 - protein, 9 aa, Homo Sapiens
NDCFKKVAR

SEQ ID NO: 132727 - protein, 9 aa, Homo Sapiens
EVWATIGEA

SEQ ID NO: 132728 - protein, 9 aa, Homo Sapiens
HNFQNMFLQ

SEQ ID NO: 132729 - protein, 9 aa, Homo Sapiens
FNPGSSGRS

SEQ ID NO: 132730 - protein, 9 aa, Homo Sapiens
QEEGEPAAA

SEQ ID NO: 132731 - protein, 9 aa, Homo Sapiens
NGSLFYYAS

SEQ ID NO: 132732 - protein, 9 aa, Homo Sapiens
DHYGREGLT

SEQ ID NO: 132733 - protein, 9 aa, Homo Sapiens
DAAIGDRGP

SEQ ID NO: 132734 - protein, 9 aa, Homo Sapiens
PKVGTKPKI

SEQ ID NO: 132735 - protein, 9 aa, Homo Sapiens
QHLKKEVQC

SEQ ID NO: 132736 - protein, 9 aa, Homo Sapiens
LLQIQALLQ

SEQ ID NO: 132737 - protein, 9 aa, Homo Sapiens
SAEGWLHLF

SEQ ID NO: 132738 - protein, 9 aa, Homo Sapiens
PVQSSTNLL

SEQ ID NO: 132739 - protein, 9 aa, Homo Sapiens
FEVAFSSVE

SEQ ID NO: 132740 - protein, 9 aa, Homo Sapiens
IAHERLDFA

SEQ ID NO: 132741 - protein, 9 aa, Homo Sapiens
TKMWHQSRL

SEQ ID NO: 132742 - protein, 9 aa, Homo Sapiens
FLMHKLMAS

SEQ ID NO: 132743 - protein, 9 aa, Homo Sapiens
IENISMLEK

SEQ ID NO: 132744 - protein, 9 aa, Homo Sapiens
HYWITVFAT

SEQ ID NO: 132745 - protein, 9 aa, Homo Sapiens
SGDSPRGST

SEQ ID NO: 132746 - protein, 9 aa, Homo Sapiens
QSSPGRPTN

SEQ ID NO: 132747 - protein, 9 aa, Homo Sapiens
LLRLWRIHR

SEQ ID NO: 132748 - protein, 9 aa, Homo Sapiens
LPLLPRENW

SEQ ID NO: 132749 - protein, 9 aa, Homo Sapiens
LTVAFCWIN

SEQ ID NO: 132750 - protein, 9 aa, Homo Sapiens
EQEQRHVAL

SEQ ID NO: 132751 - protein, 9 aa, Homo Sapiens
KVTEVSKTP

SEQ ID NO: 132752 - protein, 9 aa, Homo Sapiens
RSKASIPTS

SEQ ID NO: 132753 - protein, 9 aa, Homo Sapiens
RKGRKKTKL

SEQ ID NO: 132754 - protein, 9 aa, Homo Sapiens
NNGDSGGIN

SEQ ID NO: 132755 - protein, 9 aa, Homo Sapiens
LCRGSTSTF

SEQ ID NO: 132756 - protein, 9 aa, Homo Sapiens
HIMEYIHKI

SEQ ID NO: 132757 - protein, 9 aa, Homo Sapiens
HQMHQHKSI

SEQ ID NO: 132758 - protein, 9 aa, Homo Sapiens
HLTEFVPPP

SEQ ID NO: 132759 - protein, 9 aa, Homo Sapiens
EGKHNFTMA

SEQ ID NO: 132760 - protein, 9 aa, Homo Sapiens
VYMQLLKVE

SEQ ID NO: 132761 - protein, 9 aa, Homo Sapiens
GNVKQTQYS

SEQ ID NO: 132762 - protein, 9 aa, Homo Sapiens
FILVPRLEC

SEQ ID NO: 132763 - protein, 9 aa, Homo Sapiens
SLEDVALLE

SEQ ID NO: 132764 - protein, 9 aa, Homo Sapiens
RRSEQDGPA

SEQ ID NO: 132765 - protein, 9 aa, Homo Sapiens
MERPKTCGY

SEQ ID NO: 132766 - protein, 9 aa, Homo Sapiens
QRSRELLRH

SEQ ID NO: 132767 - protein, 9 aa, Homo Sapiens
EGEDVTCQC

SEQ ID NO: 132768 - protein, 9 aa, Homo Sapiens
FSIRKQHPW

SEQ ID NO: 132769 - protein, 9 aa, Homo Sapiens
IAGGTSSGL

SEQ ID NO: 132770 - protein, 9 aa, Homo Sapiens
WNNPRAVCT

SEQ ID NO: 132771 - protein, 9 aa, Homo Sapiens
GPAGGRSSD

SEQ ID NO: 132772 - protein, 9 aa, Homo Sapiens
LFVAVRLCG

SEQ ID NO: 132773 - protein, 9 aa, Homo Sapiens
GSNHWNNPS

SEQ ID NO: 132774 - protein, 9 aa, Homo Sapiens
KSQPLLNIK

SEQ ID NO: 132775 - protein, 9 aa, Homo Sapiens
LMDVMNVGN

SEQ ID NO: 132776 - protein, 9 aa, Homo Sapiens
LQVCTTTPS

SEQ ID NO: 132777 - protein, 9 aa, Homo Sapiens
DYTITCGKA

SEQ ID NO: 132778 - protein, 9 aa, Homo Sapiens
TWNCWAEAW

SEQ ID NO: 132779 - protein, 9 aa, Homo Sapiens
HASIELPSM

SEQ ID NO: 132780 - protein, 9 aa, Homo Sapiens
SYVTDKEFH

SEQ ID NO: 132781 - protein, 9 aa, Homo Sapiens
CLHSQLPHP

SEQ ID NO: 132782 - protein, 9 aa, Homo Sapiens
QGKKNTFDD

SEQ ID NO: 132783 - protein, 9 aa, Homo Sapiens
NAEEHVCVT

SEQ ID NO: 132784 - protein, 9 aa, Homo Sapiens
LKTLLKMEE

SEQ ID NO: 132785 - protein, 9 aa, Homo Sapiens
MKRISVQPP

SEQ ID NO: 132786 - protein, 9 aa, Homo Sapiens
SVHVFRKAL

SEQ ID NO: 132787 - protein, 9 aa, Homo Sapiens
MSYQRKDSQ

SEQ ID NO: 132788 - protein, 9 aa, Homo Sapiens
SACFAFTFD

SEQ ID NO: 132789 - protein, 9 aa, Homo Sapiens
HPVVVGGIP

SEQ ID NO: 132790 - protein, 9 aa, Homo Sapiens
FQGHYFWML

SEQ ID NO: 132791 - protein, 9 aa, Homo Sapiens
RSMTLPTQA

SEQ ID NO: 132792 - protein, 9 aa, Homo Sapiens
RAGGAEPVA

SEQ ID NO: 132793 - protein, 9 aa, Homo Sapiens
LPGEMIKDV

SEQ ID NO: 132794 - protein, 9 aa, Homo Sapiens
STVVPLDEI

SEQ ID NO: 132795 - protein, 9 aa, Homo Sapiens
KQGWDWVLP

SEQ ID NO: 132796 - protein, 9 aa, Homo Sapiens
AAMRAALAG

SEQ ID NO: 132797 - protein, 9 aa, Homo Sapiens
PKSMHVSEA

SEQ ID NO: 132798 - protein, 9 aa, Homo Sapiens
RGRAQLHLQ

SEQ ID NO: 132799 - protein, 9 aa, Homo Sapiens
TITLIKLYQ

SEQ ID NO: 132800 - protein, 9 aa, Homo Sapiens
SMACGSAES

SEQ ID NO: 132801 - protein, 9 aa, Homo Sapiens
QPGDGEDPG

SEQ ID NO: 132802 - protein, 9 aa, Homo Sapiens
RCAIHPWRS

SEQ ID NO: 132803 - protein, 9 aa, Homo Sapiens
WHHSRVSFA

SEQ ID NO: 132804 - protein, 9 aa, Homo Sapiens
AAILSLIHF

SEQ ID NO: 132805 - protein, 9 aa, Homo Sapiens
RKLAGLGLR

SEQ ID NO: 132806 - protein, 9 aa, Homo Sapiens
RHTTGTTTT

SEQ ID NO: 132807 - protein, 9 aa, Homo Sapiens
SLVGSLRRT

SEQ ID NO: 132808 - protein, 9 aa, Homo Sapiens
DLTTEIMQL

SEQ ID NO: 132809 - protein, 9 aa, Homo Sapiens
TVFFHAITS

SEQ ID NO: 132810 - protein, 9 aa, Homo Sapiens
KPRAKRACT

SEQ ID NO: 132811 - protein, 9 aa, Homo Sapiens
LTRHPDSQQ

SEQ ID NO: 132812 - protein, 9 aa, Homo Sapiens
LKMEEWVLV

SEQ ID NO: 132813 - protein, 9 aa, Homo Sapiens
CQKSLQKIC

SEQ ID NO: 132814 - protein, 9 aa, Homo Sapiens
PQGPCPRAP

SEQ ID NO: 132815 - protein, 9 aa, Homo Sapiens
PSNPSMAVS

SEQ ID NO: 132816 - protein, 9 aa, Homo Sapiens
PENGVRHEQ

SEQ ID NO: 132817 - protein, 9 aa, Homo Sapiens
LPCLCPSSS

SEQ ID NO: 132818 - protein, 9 aa, Homo Sapiens
KDWDAWKVR

SEQ ID NO: 132819 - protein, 9 aa, Homo Sapiens
ELLERPSEW

SEQ ID NO: 132820 - protein, 9 aa, Homo Sapiens
WPMMDFLCC

SEQ ID NO: 132821 - protein, 9 aa, Homo Sapiens
VSVATGPDS

SEQ ID NO: 132822 - protein, 9 aa, Homo Sapiens
DERLPLHVL

SEQ ID NO: 132823 - protein, 9 aa, Homo Sapiens
ARTKKLWPM

SEQ ID NO: 132824 - protein, 9 aa, Homo Sapiens
QIELMTVEN

SEQ ID NO: 132825 - protein, 9 aa, Homo Sapiens
QSSTNLLTL

SEQ ID NO: 132826 - protein, 9 aa, Homo Sapiens
PMYTDTVQT

SEQ ID NO: 132827 - protein, 9 aa, Homo Sapiens
LLYSQGSLI

SEQ ID NO: 132828 - protein, 9 aa, Homo Sapiens
KQIRISSKQ

SEQ ID NO: 132829 - protein, 9 aa, Homo Sapiens
LMGPEPSFP

SEQ ID NO: 132830 - protein, 9 aa, Homo Sapiens
ISCKKEFEV

SEQ ID NO: 132831 - protein, 9 aa, Homo Sapiens
EENILKRQI

SEQ ID NO: 132832 - protein, 9 aa, Homo Sapiens
VQDAAVARG

SEQ ID NO: 132833 - protein, 9 aa, Homo Sapiens
RQMMSATVQ

SEQ ID NO: 132834 - protein, 9 aa, Homo Sapiens
TQPVRSPPP

SEQ ID NO: 132835 - protein, 9 aa, Homo Sapiens
KSPSPEFSD

SEQ ID NO: 132836 - protein, 9 aa, Homo Sapiens
AGSVAIAAG

SEQ ID NO: 132837 - protein, 9 aa, Homo Sapiens
FIQDGHHSS

SEQ ID NO: 132838 - protein, 9 aa, Homo Sapiens
DSAHLCNNE

SEQ ID NO: 132839 - protein, 9 aa, Homo Sapiens
STCTRPWSS

SEQ ID NO: 132840 - protein, 9 aa, Homo Sapiens
EYRFPKNVN

SEQ ID NO: 132841 - protein, 9 aa, Homo Sapiens
SSKMLQHIG

SEQ ID NO: 132842 - protein, 9 aa, Homo Sapiens
EMVFLDGGC

SEQ ID NO: 132843 - protein, 9 aa, Homo Sapiens
NKQGKDLDV

SEQ ID NO: 132844 - protein, 9 aa, Homo Sapiens
LGVSQRGDL

SEQ ID NO: 132845 - protein, 9 aa, Homo Sapiens
CCFALPLCW

SEQ ID NO: 132846 - protein, 9 aa, Homo Sapiens
CFAFTFDHD

SEQ ID NO: 132847 - protein, 9 aa, Homo Sapiens
MKGCDTLDI

SEQ ID NO: 132848 - protein, 9 aa, Homo Sapiens
SHDKEEEKH

SEQ ID NO: 132849 - protein, 9 aa, Homo Sapiens
EQESKKNSL

SEQ ID NO: 132850 - protein, 9 aa, Homo Sapiens
DCPCRWLQM

SEQ ID NO: 132851 - protein, 9 aa, Homo Sapiens
ACTYRISMQ

SEQ ID NO: 132852 - protein, 9 aa, Homo Sapiens
TETMEATAH

SEQ ID NO: 132853 - protein, 9 aa, Homo Sapiens
TALYRGGQR

SEQ ID NO: 132854 - protein, 9 aa, Homo Sapiens
FETISQAMP

SEQ ID NO: 132855 - protein, 9 aa, Homo Sapiens
FVHLEEHLE

SEQ ID NO: 132856 - protein, 9 aa, Homo Sapiens
CACGLGWEG

SEQ ID NO: 132857 - protein, 9 aa, Homo Sapiens
VAKTKDPPA

SEQ ID NO: 132858 - protein, 9 aa, Homo Sapiens
MMKGPNDAL

SEQ ID NO: 132859 - protein, 9 aa, Homo Sapiens
DLESSRDHS

SEQ ID NO: 132860 - protein, 9 aa, Homo Sapiens
LSLALEKFE

SEQ ID NO: 132861 - protein, 9 aa, Homo Sapiens
SSFHTAVMN

SEQ ID NO: 132862 - protein, 9 aa, Homo Sapiens
DSFIAVMYR

SEQ ID NO: 132863 - protein, 9 aa, Homo Sapiens
KFFVIQLVA

SEQ ID NO: 132864 - protein, 9 aa, Homo Sapiens
LAIDPLAGE

SEQ ID NO: 132865 - protein, 9 aa, Homo Sapiens
LKGSVMEIL

SEQ ID NO: 132866 - protein, 9 aa, Homo Sapiens
ITGVDWAPK

SEQ ID NO: 132867 - protein, 9 aa, Homo Sapiens
DFYEKTVIS

SEQ ID NO: 132868 - protein, 9 aa, Homo Sapiens
GMLRVVAHS

SEQ ID NO: 132869 - protein, 9 aa, Homo Sapiens
GLCVGYNSQ

SEQ ID NO: 132870 - protein, 9 aa, Homo Sapiens
CEDINECST

SEQ ID NO: 132871 - protein, 9 aa, Homo Sapiens
EKFVHLEEH

SEQ ID NO: 132872 - protein, 9 aa, Homo Sapiens
AAPVAACKV

SEQ ID NO: 132873 - protein, 9 aa, Homo Sapiens
ASTLAPASR

SEQ ID NO: 132874 - protein, 9 aa, Homo Sapiens
RVQTLPTSV

SEQ ID NO: 132875 - protein, 9 aa, Homo Sapiens
ACKVVATSP

SEQ ID NO: 132876 - protein, 9 aa, Homo Sapiens
RMNDLPYLN

SEQ ID NO: 132877 - protein, 9 aa, Homo Sapiens
HPAFFLLIG

SEQ ID NO: 132878 - protein, 9 aa, Homo Sapiens
NTLKNMCGS

SEQ ID NO: 132879 - protein, 9 aa, Homo Sapiens
GFPSSLQPL

SEQ ID NO: 132880 - protein, 9 aa, Homo Sapiens
GHHNDDVHH

SEQ ID NO: 132881 - protein, 9 aa, Homo Sapiens
LIALGMLLA

SEQ ID NO: 132882 - protein, 9 aa, Homo Sapiens
KLLACDDNE

SEQ ID NO: 132883 - protein, 9 aa, Homo Sapiens
FFSKIKQAG

SEQ ID NO: 132884 - protein, 9 aa, Homo Sapiens
IKPNSEHFR

SEQ ID NO: 132885 - protein, 9 aa, Homo Sapiens
KDPRSSPRL

SEQ ID NO: 132886 - protein, 9 aa, Homo Sapiens
RSHSHQDHG

SEQ ID NO: 132887 - protein, 9 aa, Homo Sapiens
ALNHHPLQR

SEQ ID NO: 132888 - protein, 9 aa, Homo Sapiens
VAFIFFRKF

SEQ ID NO: 132889 - protein, 9 aa, Homo Sapiens
TGDVETSHD

SEQ ID NO: 132890 - protein, 9 aa, Homo Sapiens
IRREVMDED

SEQ ID NO: 132891 - protein, 9 aa, Homo Sapiens
SCPNYSYEI

SEQ ID NO: 132892 - protein, 9 aa, Homo Sapiens
QEMGLLRME

SEQ ID NO: 132893 - protein, 9 aa, Homo Sapiens
TRALEQEQR

SEQ ID NO: 132894 - protein, 9 aa, Homo Sapiens
VAVRLCGRS

SEQ ID NO: 132895 - protein, 9 aa, Homo Sapiens
MRAALAGAH

SEQ ID NO: 132896 - protein, 9 aa, Homo Sapiens
IAVMYRETE

SEQ ID NO: 132897 - protein, 9 aa, Homo Sapiens
PPRMGELKA

SEQ ID NO: 132898 - protein, 9 aa, Homo Sapiens
AAVGTRIPF

SEQ ID NO: 132899 - protein, 9 aa, Homo Sapiens
ASIPTSLVG

SEQ ID NO: 132900 - protein, 9 aa, Homo Sapiens
NKATKRDLP

SEQ ID NO: 132901 - protein, 9 aa, Homo Sapiens
SLMITRARK

SEQ ID NO: 132902 - protein, 9 aa, Homo Sapiens
IIRSFDGEV

SEQ ID NO: 132903 - protein, 9 aa, Homo Sapiens
QPYQDDIDN

SEQ ID NO: 132904 - protein, 9 aa, Homo Sapiens
CLHVQQNRA

SEQ ID NO: 132905 - protein, 9 aa, Homo Sapiens
RHLAQEGRC

SEQ ID NO: 132906 - protein, 9 aa, Homo Sapiens
KIGQGCLIK

SEQ ID NO: 132907 - protein, 9 aa, Homo Sapiens
LQRLTWVCR

SEQ ID NO: 132908 - protein, 9 aa, Homo Sapiens
EHLARCETD

SEQ ID NO: 132909 - protein, 9 aa, Homo Sapiens
RKVKDVQQV

SEQ ID NO: 132910 - protein, 9 aa, Homo Sapiens
PKIKERAHN

SEQ ID NO: 132911 - protein, 9 aa, Homo Sapiens
NAMHVGKPF

SEQ ID NO: 132912 - protein, 9 aa, Homo Sapiens
LWKRTEFAG

SEQ ID NO: 132913 - protein, 9 aa, Homo Sapiens
ISEGEDVTC

SEQ ID NO: 132914 - protein, 9 aa, Homo Sapiens
DPLFSAQHL

SEQ ID NO: 132915 - protein, 9 aa, Homo Sapiens
NSLSNTSVS

SEQ ID NO: 132916 - protein, 9 aa, Homo Sapiens
SVATYFLPG

SEQ ID NO: 132917 - protein, 9 aa, Homo Sapiens
LSLDRHEEV

SEQ ID NO: 132918 - protein, 9 aa, Homo Sapiens
ITSLHFPFN

SEQ ID NO: 132919 - protein, 9 aa, Homo Sapiens
ESTTRPMCD

SEQ ID NO: 132920 - protein, 9 aa, Homo Sapiens
HRDLTPETN

SEQ ID NO: 132921 - protein, 9 aa, Homo Sapiens
AVWNFFTLI

SEQ ID NO: 132922 - protein, 9 aa, Homo Sapiens
VKTRDFTSS

SEQ ID NO: 132923 - protein, 9 aa, Homo Sapiens
PPEYFGSVL

SEQ ID NO: 132924 - protein, 9 aa, Homo Sapiens
DSNTWHTLA

SEQ ID NO: 132925 - protein, 9 aa, Homo Sapiens
RNALREQGP

SEQ ID NO: 132926 - protein, 9 aa, Homo Sapiens
GIFHKASGV

SEQ ID NO: 132927 - protein, 9 aa, Homo Sapiens
AKKNKENQK

SEQ ID NO: 132928 - protein, 9 aa, Homo Sapiens
QTHRASEPL

SEQ ID NO: 132929 - protein, 9 aa, Homo Sapiens
HCHAKETWN

SEQ ID NO: 132930 - protein, 9 aa, Homo Sapiens
SNHWNNPSA

SEQ ID NO: 132931 - protein, 9 aa, Homo Sapiens
SANHSPVKA

SEQ ID NO: 132932 - protein, 9 aa, Homo Sapiens
TSSEFEVVA

SEQ ID NO: 132933 - protein, 9 aa, Homo Sapiens
ASVATYFLP

SEQ ID NO: 132934 - protein, 9 aa, Homo Sapiens
LDTGCSVSR

SEQ ID NO: 132935 - protein, 9 aa, Homo Sapiens
LYDSINAID

SEQ ID NO: 132936 - protein, 9 aa, Homo Sapiens
IKCDRCHKS

SEQ ID NO: 132937 - protein, 9 aa, Homo Sapiens
YAMVCQVHG

SEQ ID NO: 132938 - protein, 9 aa, Homo Sapiens
TVTALEDEL

SEQ ID NO: 132939 - protein, 9 aa, Homo Sapiens
LQRVQTEGR

SEQ ID NO: 132940 - protein, 9 aa, Homo Sapiens
NPIRKYQDL

SEQ ID NO: 132941 - protein, 9 aa, Homo Sapiens
PIMRKRKMR

SEQ ID NO: 132942 - protein, 9 aa, Homo Sapiens
VAVPHSTFF

SEQ ID NO: 132943 - protein, 9 aa, Homo Sapiens
GEGLESYVT

SEQ ID NO: 132944 - protein, 9 aa, Homo Sapiens
WSDDATCRL

SEQ ID NO: 132945 - protein, 9 aa, Homo Sapiens
LWLALNDGL

SEQ ID NO: 132946 - protein, 9 aa, Homo Sapiens
PEPQGQPRE

SEQ ID NO: 132947 - protein, 9 aa, Homo Sapiens
RTRIKKVVG

SEQ ID NO: 132948 - protein, 9 aa, Homo Sapiens
YALKVEASN

SEQ ID NO: 132949 - protein, 9 aa, Homo Sapiens
GNSDSKQKR

SEQ ID NO: 132950 - protein, 9 aa, Homo Sapiens
QVNKLRVKT

SEQ ID NO: 132951 - protein, 9 aa, Homo Sapiens
GTGVYTGSE

SEQ ID NO: 132952 - protein, 9 aa, Homo Sapiens
GPEPSFPPD

SEQ ID NO: 132953 - protein, 9 aa, Homo Sapiens
GVGAQLMAP

SEQ ID NO: 132954 - protein, 9 aa, Homo Sapiens
ASVVSGISR

SEQ ID NO: 132955 - protein, 9 aa, Homo Sapiens
VSYLGCVYD

SEQ ID NO: 132956 - protein, 9 aa, Homo Sapiens
QPLLTVIFL

SEQ ID NO: 132957 - protein, 9 aa, Homo Sapiens
CTGDMIRML

SEQ ID NO: 132958 - protein, 9 aa, Homo Sapiens
RHRHSEHRV

SEQ ID NO: 132959 - protein, 9 aa, Homo Sapiens
ALNDGKSYT

SEQ ID NO: 132960 - protein, 9 aa, Homo Sapiens
KHPGGCIQI

SEQ ID NO: 132961 - protein, 9 aa, Homo Sapiens
LCAPGAPAV

SEQ ID NO: 132962 - protein, 9 aa, Homo Sapiens
SKRAELLEE

SEQ ID NO: 132963 - protein, 9 aa, Homo Sapiens
QPREDDPDH

SEQ ID NO: 132964 - protein, 9 aa, Homo Sapiens
SERKSGGER

SEQ ID NO: 132965 - protein, 9 aa, Homo Sapiens
KLARHASIE

SEQ ID NO: 132966 - protein, 9 aa, Homo Sapiens
LDELHRAAR

SEQ ID NO: 132967 - protein, 9 aa, Homo Sapiens
HEGKWDYVC

SEQ ID NO: 132968 - protein, 9 aa, Homo Sapiens
LPFLVAAAL

SEQ ID NO: 132969 - protein, 9 aa, Homo Sapiens
KHVVNFDLP

SEQ ID NO: 132970 - protein, 9 aa, Homo Sapiens
SWRSSSPRR

SEQ ID NO: 132971 - protein, 9 aa, Homo Sapiens
LFFHAPSRR

SEQ ID NO: 132972 - protein, 9 aa, Homo Sapiens
APGAPAVPA

SEQ ID NO: 132973 - protein, 9 aa, Homo Sapiens
ETSSWSGVK

SEQ ID NO: 132974 - protein, 9 aa, Homo Sapiens
DGQQYGAVP

SEQ ID NO: 132975 - protein, 9 aa, Homo Sapiens
QNSFEQFCI

SEQ ID NO: 132976 - protein, 9 aa, Homo Sapiens
HSNSQNIKH

SEQ ID NO: 132977 - protein, 9 aa, Homo Sapiens
KKKIIKVWR

SEQ ID NO: 132978 - protein, 9 aa, Homo Sapiens
GAGNPERLN

SEQ ID NO: 132979 - protein, 9 aa, Homo Sapiens
GVDLLGLLI

SEQ ID NO: 132980 - protein, 9 aa, Homo Sapiens
AQLHFAAES

SEQ ID NO: 132981 - protein, 9 aa, Homo Sapiens
RMIVTGAAL

SEQ ID NO: 132982 - protein, 9 aa, Homo Sapiens
ITIVKLQES

SEQ ID NO: 132983 - protein, 9 aa, Homo Sapiens
EPSFPPDIL

SEQ ID NO: 132984 - protein, 9 aa, Homo Sapiens
PLAMAQVTH

SEQ ID NO: 132985 - protein, 9 aa, Homo Sapiens
SLIDQMSSC

SEQ ID NO: 132986 - protein, 9 aa, Homo Sapiens
EKYKNLQYG

SEQ ID NO: 132987 - protein, 9 aa, Homo Sapiens
KMICPTHGQ

SEQ ID NO: 132988 - protein, 9 aa, Homo Sapiens
LRSSEEGYY

SEQ ID NO: 132989 - protein, 9 aa, Homo Sapiens
VDRHGKIGP

SEQ ID NO: 132990 - protein, 9 aa, Homo Sapiens
VGGIPVALL

SEQ ID NO: 132991 - protein, 9 aa, Homo Sapiens
ATALHSRVT

SEQ ID NO: 132992 - protein, 9 aa, Homo Sapiens
CGFPCNHRY

SEQ ID NO: 132993 - protein, 9 aa, Homo Sapiens
GSEIKDTDD

SEQ ID NO: 132994 - protein, 9 aa, Homo Sapiens
SRKNVFRLL

SEQ ID NO: 132995 - protein, 9 aa, Homo Sapiens
ILSSIQTMR

SEQ ID NO: 132996 - protein, 9 aa, Homo Sapiens
PRKGLIVML

SEQ ID NO: 132997 - protein, 9 aa, Homo Sapiens
TREKPFKCN

SEQ ID NO: 132998 - protein, 9 aa, Homo Sapiens
KLQEVVKKP

SEQ ID NO: 132999 - protein, 9 aa, Homo Sapiens
NERPSARSK

SEQ ID NO: 133000 - protein, 9 aa, Homo Sapiens
SPLPPGGKE

SEQ ID NO: 133001 - protein, 9 aa, Homo Sapiens
SWALTILKD

SEQ ID NO: 133002 - protein, 9 aa, Homo Sapiens
LGFLVDPRK

SEQ ID NO: 133003 - protein, 9 aa, Homo Sapiens
LRLMNAAIT

SEQ ID NO: 133004 - protein, 9 aa, Homo Sapiens
GPCLDPAGP

SEQ ID NO: 133005 - protein, 9 aa, Homo Sapiens
EGHQGITGD

SEQ ID NO: 133006 - protein, 9 aa, Homo Sapiens
RTMGFLLVR

SEQ ID NO: 133007 - protein, 9 aa, Homo Sapiens
LHMDRSPYY

SEQ ID NO: 133008 - protein, 9 aa, Homo Sapiens
ACEIQAPHP

SEQ ID NO: 133009 - protein, 9 aa, Homo Sapiens
SQRGDLEDL

SEQ ID NO: 133010 - protein, 9 aa, Homo Sapiens
DYLARAAVS

SEQ ID NO: 133011 - protein, 9 aa, Homo Sapiens
AQEAQGILW

SEQ ID NO: 133012 - protein, 9 aa, Homo Sapiens
SAATSRGMW

SEQ ID NO: 133013 - protein, 9 aa, Homo Sapiens
NGDFYNNNR

SEQ ID NO: 133014 - protein, 9 aa, Homo Sapiens
SDTYLHRAA

SEQ ID NO: 133015 - protein, 9 aa, Homo Sapiens
FLVREEVFG

SEQ ID NO: 133016 - protein, 9 aa, Homo Sapiens
SLIHIIAFF

SEQ ID NO: 133017 - protein, 9 aa, Homo Sapiens
LPYLNLDTW

SEQ ID NO: 133018 - protein, 9 aa, Homo Sapiens
RQCLTDELC

SEQ ID NO: 133019 - protein, 9 aa, Homo Sapiens
HDASRLEFS

SEQ ID NO: 133020 - protein, 9 aa, Homo Sapiens
GGRILLQRN

SEQ ID NO: 133021 - protein, 9 aa, Homo Sapiens
LGAWGSVSI

SEQ ID NO: 133022 - protein, 9 aa, Homo Sapiens
HQKTFWTER

SEQ ID NO: 133023 - protein, 9 aa, Homo Sapiens
RSSSNTSSG

SEQ ID NO: 133024 - protein, 9 aa, Homo Sapiens
VFFHAITSL

SEQ ID NO: 133025 - protein, 9 aa, Homo Sapiens
NEPGKRSSI

SEQ ID NO: 133026 - protein, 9 aa, Homo Sapiens
CVPSLGSSP

SEQ ID NO: 133027 - protein, 9 aa, Homo Sapiens
HHKAGTKNL

SEQ ID NO: 133028 - protein, 9 aa, Homo Sapiens
LLNSSNNGD

SEQ ID NO: 133029 - protein, 9 aa, Homo Sapiens
TEHKNNLVS

SEQ ID NO: 133030 - protein, 9 aa, Homo Sapiens
KQYWPITAF

SEQ ID NO: 133031 - protein, 9 aa, Homo Sapiens
LALYVYEYM

SEQ ID NO: 133032 - protein, 9 aa, Homo Sapiens
CCSQSPLSL

SEQ ID NO: 133033 - protein, 9 aa, Homo Sapiens
HPTTREVTA

SEQ ID NO: 133034 - protein, 9 aa, Homo Sapiens
GEREREPKP

SEQ ID NO: 133035 - protein, 9 aa, Homo Sapiens
KPRRGVPDV

SEQ ID NO: 133036 - protein, 9 aa, Homo Sapiens
GITLRQCDA

SEQ ID NO: 133037 - protein, 9 aa, Homo Sapiens
PLDTVFRDP

SEQ ID NO: 133038 - protein, 9 aa, Homo Sapiens
VAEDRQPNS

SEQ ID NO: 133039 - protein, 9 aa, Homo Sapiens
QQVPCSPLQ

SEQ ID NO: 133040 - protein, 9 aa, Homo Sapiens
IALQYHKWL

SEQ ID NO: 133041 - protein, 9 aa, Homo Sapiens
CQTLNFVSR

SEQ ID NO: 133042 - protein, 9 aa, Homo Sapiens
QSPPPQQHS

SEQ ID NO: 133043 - protein, 9 aa, Homo Sapiens
GCHTPQIEQ

SEQ ID NO: 133044 - protein, 9 aa, Homo Sapiens
HDKEEEKHE

SEQ ID NO: 133045 - protein, 9 aa, Homo Sapiens
NPEKFQCVE

SEQ ID NO: 133046 - protein, 9 aa, Homo Sapiens
ALPLCWHGG

SEQ ID NO: 133047 - protein, 9 aa, Homo Sapiens
LLASSILCT

SEQ ID NO: 133048 - protein, 9 aa, Homo Sapiens
LLRRSHFKV

SEQ ID NO: 133049 - protein, 9 aa, Homo Sapiens
SCLYATVEP

SEQ ID NO: 133050 - protein, 9 aa, Homo Sapiens
ISITPVQSS

SEQ ID NO: 133051 - protein, 9 aa, Homo Sapiens
FQNQRSKWR

SEQ ID NO: 133052 - protein, 9 aa, Homo Sapiens
VIYGVSTKQ

SEQ ID NO: 133053 - protein, 9 aa, Homo Sapiens
PREDDPDHV

SEQ ID NO: 133054 - protein, 9 aa, Homo Sapiens
DNTAILRQV

SEQ ID NO: 133055 - protein, 9 aa, Homo Sapiens
GCNYDQLIE

SEQ ID NO: 133056 - protein, 9 aa, Homo Sapiens
QALAVNYRF

SEQ ID NO: 133057 - protein, 9 aa, Homo Sapiens
SHRATSNTE

SEQ ID NO: 133058 - protein, 9 aa, Homo Sapiens
SMYQPQTKP

SEQ ID NO: 133059 - protein, 9 aa, Homo Sapiens
LRVYTHKKR

SEQ ID NO: 133060 - protein, 9 aa, Homo Sapiens
CYRCLPLLY

SEQ ID NO: 133061 - protein, 9 aa, Homo Sapiens
PPAHAMKLN

SEQ ID NO: 133062 - protein, 9 aa, Homo Sapiens
STVSNGAST

SEQ ID NO: 133063 - protein, 9 aa, Homo Sapiens
CRLNLSSNQ

SEQ ID NO: 133064 - protein, 9 aa, Homo Sapiens
QSLDYLARA

SEQ ID NO: 133065 - protein, 9 aa, Homo Sapiens
AIGLSWVLC

SEQ ID NO: 133066 - protein, 9 aa, Homo Sapiens
LQLSTNCPE

SEQ ID NO: 133067 - protein, 9 aa, Homo Sapiens
VPLQFSVCG

SEQ ID NO: 133068 - protein, 9 aa, Homo Sapiens
SDGDRRLIG

SEQ ID NO: 133069 - protein, 9 aa, Homo Sapiens
ENELQHLKK

SEQ ID NO: 133070 - protein, 9 aa, Homo Sapiens
AYFSWAGLP

SEQ ID NO: 133071 - protein, 9 aa, Homo Sapiens
PVSSSRLPP

SEQ ID NO: 133072 - protein, 9 aa, Homo Sapiens
ILICDQLFL

SEQ ID NO: 133073 - protein, 9 aa, Homo Sapiens
RHNLDIERP

SEQ ID NO: 133074 - protein, 9 aa, Homo Sapiens
IMPPIKEGK

SEQ ID NO: 133075 - protein, 9 aa, Homo Sapiens
LGPCCEALC

SEQ ID NO: 133076 - protein, 9 aa, Homo Sapiens
AQDGHGRVI

SEQ ID NO: 133077 - protein, 9 aa, Homo Sapiens
LVHAVQDAA

SEQ ID NO: 133078 - protein, 9 aa, Homo Sapiens
NQNFFIAVT

SEQ ID NO: 133079 - protein, 9 aa, Homo Sapiens
LSFPGSSHL

SEQ ID NO: 133080 - protein, 9 aa, Homo Sapiens
YVYKVLKQA

SEQ ID NO: 133081 - protein, 9 aa, Homo Sapiens
YLLRLWRIH

SEQ ID NO: 133082 - protein, 9 aa, Homo Sapiens
ISVATSFQS

SEQ ID NO: 133083 - protein, 9 aa, Homo Sapiens
LTWAESLVG

SEQ ID NO: 133084 - protein, 9 aa, Homo Sapiens
VFRVRQQLT

SEQ ID NO: 133085 - protein, 9 aa, Homo Sapiens
PSSARAVAG

SEQ ID NO: 133086 - protein, 9 aa, Homo Sapiens
DDLTVVDTA

SEQ ID NO: 133087 - protein, 9 aa, Homo Sapiens
HTQTYPMVH

SEQ ID NO: 133088 - protein, 9 aa, Homo Sapiens
ESTSHYWIT

SEQ ID NO: 133089 - protein, 9 aa, Homo Sapiens
TGTSHPVWN

SEQ ID NO: 133090 - protein, 9 aa, Homo Sapiens
HPPYPGPGP

SEQ ID NO: 133091 - protein, 9 aa, Homo Sapiens
ARRCILLFP

SEQ ID NO: 133092 - protein, 9 aa, Homo Sapiens
DICRHNLDI

SEQ ID NO: 133093 - protein, 9 aa, Homo Sapiens
WRSSSPRRA

SEQ ID NO: 133094 - protein, 9 aa, Homo Sapiens
GEPAAARGA

SEQ ID NO: 133095 - protein, 9 aa, Homo Sapiens
GEILEQLEG

SEQ ID NO: 133096 - protein, 9 aa, Homo Sapiens
ELQKNKKRR

SEQ ID NO: 133097 - protein, 9 aa, Homo Sapiens
EEEEEENGR

SEQ ID NO: 133098 - protein, 9 aa, Homo Sapiens
ATSSRPLAH

SEQ ID NO: 133099 - protein, 9 aa, Homo Sapiens
FFLLCGNHE

SEQ ID NO: 133100 - protein, 9 aa, Homo Sapiens
GNLCKSHIV

SEQ ID NO: 133101 - protein, 9 aa, Homo Sapiens
QGSLIDLLI

SEQ ID NO: 133102 - protein, 9 aa, Homo Sapiens
CKIGVNGSH

SEQ ID NO: 133103 - protein, 9 aa, Homo Sapiens
SKKNQEILW

SEQ ID NO: 133104 - protein, 9 aa, Homo Sapiens
EDAADGAFK

SEQ ID NO: 133105 - protein, 9 aa, Homo Sapiens
ALPGAERTA

SEQ ID NO: 133106 - protein, 9 aa, Homo Sapiens
KGSRKNVFR

SEQ ID NO: 133107 - protein, 9 aa, Homo Sapiens
VRSRGLGLG

SEQ ID NO: 133108 - protein, 9 aa, Homo Sapiens
EPLECEVTD

SEQ ID NO: 133109 - protein, 9 aa, Homo Sapiens
RAARAGRFG

SEQ ID NO: 133110 - protein, 9 aa, Homo Sapiens
FYCEGNPLL

SEQ ID NO: 133111 - protein, 9 aa, Homo Sapiens
NGASTATTS

SEQ ID NO: 133112 - protein, 9 aa, Homo Sapiens
FQINVDPAG

SEQ ID NO: 133113 - protein, 9 aa, Homo Sapiens
YPRQAESGM

SEQ ID NO: 133114 - protein, 9 aa, Homo Sapiens
LEAEQASVR

SEQ ID NO: 133115 - protein, 9 aa, Homo Sapiens
SYVKHVCLH

SEQ ID NO: 133116 - protein, 9 aa, Homo Sapiens
GSQVHYACR

SEQ ID NO: 133117 - protein, 9 aa, Homo Sapiens
KFVHLEEHL

SEQ ID NO: 133118 - protein, 9 aa, Homo Sapiens
YPVCYPPFP

SEQ ID NO: 133119 - protein, 9 aa, Homo Sapiens
TLKLHRRIH

SEQ ID NO: 133120 - protein, 9 aa, Homo Sapiens
ICPWRNLLA

SEQ ID NO: 133121 - protein, 9 aa, Homo Sapiens
GWGDDNTAI

SEQ ID NO: 133122 - protein, 9 aa, Homo Sapiens
TLTIMDISP

SEQ ID NO: 133123 - protein, 9 aa, Homo Sapiens
VLESGGSKK

SEQ ID NO: 133124 - protein, 9 aa, Homo Sapiens
GQTTSDRKT

SEQ ID NO: 133125 - protein, 9 aa, Homo Sapiens
QRHTYPVCY

SEQ ID NO: 133126 - protein, 9 aa, Homo Sapiens
LMKVSLLFL

SEQ ID NO: 133127 - protein, 9 aa, Homo Sapiens
GTWPLREAT

SEQ ID NO: 133128 - protein, 9 aa, Homo Sapiens
FTVPRADLV

SEQ ID NO: 133129 - protein, 9 aa, Homo Sapiens
LGTFRRVLQ

SEQ ID NO: 133130 - protein, 9 aa, Homo Sapiens
GVEPAFHKT

SEQ ID NO: 133131 - protein, 9 aa, Homo Sapiens
GGCRPGRIC

SEQ ID NO: 133132 - protein, 9 aa, Homo Sapiens
PLCWAPGRP

SEQ ID NO: 133133 - protein, 9 aa, Homo Sapiens
FIKDPSNQK

SEQ ID NO: 133134 - protein, 9 aa, Homo Sapiens
KQGKDLDVL

SEQ ID NO: 133135 - protein, 9 aa, Homo Sapiens
PEGPGQIWR

SEQ ID NO: 133136 - protein, 9 aa, Homo Sapiens
VDEIHVLQH

SEQ ID NO: 133137 - protein, 9 aa, Homo Sapiens
GLRSQCECH

SEQ ID NO: 133138 - protein, 9 aa, Homo Sapiens
PIKPKVPLA

SEQ ID NO: 133139 - protein, 9 aa, Homo Sapiens
MPYEPSTPV

SEQ ID NO: 133140 - protein, 9 aa, Homo Sapiens
KALTNLVFA

SEQ ID NO: 133141 - protein, 9 aa, Homo Sapiens
RCRCVCLRF

SEQ ID NO: 133142 - protein, 9 aa, Homo Sapiens
KRWAGILSL

SEQ ID NO: 133143 - protein, 9 aa, Homo Sapiens
LSNTSTQST

SEQ ID NO: 133144 - protein, 9 aa, Homo Sapiens
MWVCNSAGC

SEQ ID NO: 133145 - protein, 9 aa, Homo Sapiens
GRPLDTVQP

SEQ ID NO: 133146 - protein, 9 aa, Homo Sapiens
WKRGPSVVP

SEQ ID NO: 133147 - protein, 9 aa, Homo Sapiens
DGQPQGEQR

SEQ ID NO: 133148 - protein, 9 aa, Homo Sapiens
RRHVHPEET

SEQ ID NO: 133149 - protein, 9 aa, Homo Sapiens
TFAFHLRVL

SEQ ID NO: 133150 - protein, 9 aa, Homo Sapiens
SHFNIKDQD

SEQ ID NO: 133151 - protein, 9 aa, Homo Sapiens
FNTTVTALE

SEQ ID NO: 133152 - protein, 9 aa, Homo Sapiens
AQDLTSREK

SEQ ID NO: 133153 - protein, 9 aa, Homo Sapiens
DRDRSVRDK

SEQ ID NO: 133154 - protein, 9 aa, Homo Sapiens
LIDFYEKTV

SEQ ID NO: 133155 - protein, 9 aa, Homo Sapiens
IIQFIAHER

SEQ ID NO: 133156 - protein, 9 aa, Homo Sapiens
SDRKTEATG

SEQ ID NO: 133157 - protein, 9 aa, Homo Sapiens
RMQNDTTEN

SEQ ID NO: 133158 - protein, 9 aa, Homo Sapiens
PLFSAQHLP

SEQ ID NO: 133159 - protein, 9 aa, Homo Sapiens
LVAFQGHYF

SEQ ID NO: 133160 - protein, 9 aa, Homo Sapiens
TQEEWVMMD

SEQ ID NO: 133161 - protein, 9 aa, Homo Sapiens
LIGGPDDGA

SEQ ID NO: 133162 - protein, 9 aa, Homo Sapiens
TAAHPSSVL

SEQ ID NO: 133163 - protein, 9 aa, Homo Sapiens
GHLHVSNVM

SEQ ID NO: 133164 - protein, 9 aa, Homo Sapiens
ESCLICPWR

SEQ ID NO: 133165 - protein, 9 aa, Homo Sapiens
KGRGNKATK

SEQ ID NO: 133166 - protein, 9 aa, Homo Sapiens
ECKKAFSQY

SEQ ID NO: 133167 - protein, 9 aa, Homo Sapiens
VNMDDMMLE

SEQ ID NO: 133168 - protein, 9 aa, Homo Sapiens
IICYYGNRG

SEQ ID NO: 133169 - protein, 9 aa, Homo Sapiens
DDLPHLLLG

SEQ ID NO: 133170 - protein, 9 aa, Homo Sapiens
KRGPSVVPW

SEQ ID NO: 133171 - protein, 9 aa, Homo Sapiens
LCKSHIVEA

SEQ ID NO: 133172 - protein, 9 aa, Homo Sapiens
KSCWVAACV

SEQ ID NO: 133173 - protein, 9 aa, Homo Sapiens
MLLALVCVF

SEQ ID NO: 133174 - protein, 9 aa, Homo Sapiens
DKMGIRVYY

SEQ ID NO: 133175 - protein, 9 aa, Homo Sapiens
HTQGRSPMN

SEQ ID NO: 133176 - protein, 9 aa, Homo Sapiens
PTSDTPKVS

SEQ ID NO: 133177 - protein, 9 aa, Homo Sapiens
HGQRHRAVH

SEQ ID NO: 133178 - protein, 9 aa, Homo Sapiens
CSQPLMNSC

SEQ ID NO: 133179 - protein, 9 aa, Homo Sapiens
PLEKDGFPS

SEQ ID NO: 133180 - protein, 9 aa, Homo Sapiens
PSLALMCFL

SEQ ID NO: 133181 - protein, 9 aa, Homo Sapiens
PLAKRKSDG

SEQ ID NO: 133182 - protein, 9 aa, Homo Sapiens
DIICYYGNR

SEQ ID NO: 133183 - protein, 9 aa, Homo Sapiens
ARAVAGSGS

SEQ ID NO: 133184 - protein, 9 aa, Homo Sapiens
WDVKDPSNA

SEQ ID NO: 133185 - protein, 9 aa, Homo Sapiens
EIDLHNPKG

SEQ ID NO: 133186 - protein, 9 aa, Homo Sapiens
AFEVGAHKV

SEQ ID NO: 133187 - protein, 9 aa, Homo Sapiens
HRASEPLPP

SEQ ID NO: 133188 - protein, 9 aa, Homo Sapiens
RVKELILSP

SEQ ID NO: 133189 - protein, 9 aa, Homo Sapiens
YQGRGFVMS

SEQ ID NO: 133190 - protein, 9 aa, Homo Sapiens
LRMRRCPGL

SEQ ID NO: 133191 - protein, 9 aa, Homo Sapiens
QRMIKIENP

SEQ ID NO: 133192 - protein, 9 aa, Homo Sapiens
SAPRPGAAA

SEQ ID NO: 133193 - protein, 9 aa, Homo Sapiens
LIPGTPHGV

SEQ ID NO: 133194 - protein, 9 aa, Homo Sapiens
ANVLHGLSR

SEQ ID NO: 133195 - protein, 9 aa, Homo Sapiens
MQNDTTENE

SEQ ID NO: 133196 - protein, 9 aa, Homo Sapiens
NYSKKAKER

SEQ ID NO: 133197 - protein, 9 aa, Homo Sapiens
KYHQYIPQT

SEQ ID NO: 133198 - protein, 9 aa, Homo Sapiens
LEGLPRLPH

SEQ ID NO: 133199 - protein, 9 aa, Homo Sapiens
SKRTRIKKV

SEQ ID NO: 133200 - protein, 9 aa, Homo Sapiens
QAPSPSSAI

SEQ ID NO: 133201 - protein, 9 aa, Homo Sapiens
ETPEVAEDR

SEQ ID NO: 133202 - protein, 9 aa, Homo Sapiens
IQLAATKKL

SEQ ID NO: 133203 - protein, 9 aa, Homo Sapiens
VYNDITHGN

SEQ ID NO: 133204 - protein, 9 aa, Homo Sapiens
SKLQNTTKL

SEQ ID NO: 133205 - protein, 9 aa, Homo Sapiens
LMSQCAHRE

SEQ ID NO: 133206 - protein, 9 aa, Homo Sapiens
IQAKGVHSS

SEQ ID NO: 133207 - protein, 9 aa, Homo Sapiens
MHIAALAST

SEQ ID NO: 133208 - protein, 9 aa, Homo Sapiens
SSYFQQAET

SEQ ID NO: 133209 - protein, 9 aa, Homo Sapiens
TWYELQMWV

SEQ ID NO: 133210 - protein, 9 aa, Homo Sapiens
PSPHHHQCQ

SEQ ID NO: 133211 - protein, 9 aa, Homo Sapiens
SDLSQPRKN

SEQ ID NO: 133212 - protein, 9 aa, Homo Sapiens
WKIRTCLRR

SEQ ID NO: 133213 - protein, 9 aa, Homo Sapiens
RRRGSSPPG

SEQ ID NO: 133214 - protein, 9 aa, Homo Sapiens
YAIYGLIER

SEQ ID NO: 133215 - protein, 9 aa, Homo Sapiens
VMVLAADHI

SEQ ID NO: 133216 - protein, 9 aa, Homo Sapiens
MPPIKEGKE

SEQ ID NO: 133217 - protein, 9 aa, Homo Sapiens
QHQYILVVP

SEQ ID NO: 133218 - protein, 9 aa, Homo Sapiens
GTSSGLGSY

SEQ ID NO: 133219 - protein, 9 aa, Homo Sapiens
IAGNLPSDE

SEQ ID NO: 133220 - protein, 9 aa, Homo Sapiens
KSLSKKKKK

SEQ ID NO: 133221 - protein, 9 aa, Homo Sapiens
ARYYEGRNG

SEQ ID NO: 133222 - protein, 9 aa, Homo Sapiens
HKRKPYRPG

SEQ ID NO: 133223 - protein, 9 aa, Homo Sapiens
MGSLRILRK

SEQ ID NO: 133224 - protein, 9 aa, Homo Sapiens
GAAASLRIA

SEQ ID NO: 133225 - protein, 9 aa, Homo Sapiens
CHHHGIEYC

SEQ ID NO: 133226 - protein, 9 aa, Homo Sapiens
GYYAMVCQV

SEQ ID NO: 133227 - protein, 9 aa, Homo Sapiens
VAVGPGAPT

SEQ ID NO: 133228 - protein, 9 aa, Homo Sapiens
CIQAASTES

SEQ ID NO: 133229 - protein, 9 aa, Homo Sapiens
GKPFSENQT

SEQ ID NO: 133230 - protein, 9 aa, Homo Sapiens
LRVLQKKHL

SEQ ID NO: 133231 - protein, 9 aa, Homo Sapiens
AILSRDHLL

SEQ ID NO: 133232 - protein, 9 aa, Homo Sapiens
ILILRISWE

SEQ ID NO: 133233 - protein, 9 aa, Homo Sapiens
VSAEGWLHL

SEQ ID NO: 133234 - protein, 9 aa, Homo Sapiens
SLYSVAVWP

SEQ ID NO: 133235 - protein, 9 aa, Homo Sapiens
RRQVRSRES

SEQ ID NO: 133236 - protein, 9 aa, Homo Sapiens
GPMPLRIDT

SEQ ID NO: 133237 - protein, 9 aa, Homo Sapiens
KPKVPLAVW

SEQ ID NO: 133238 - protein, 9 aa, Homo Sapiens
QPPGERLPG

SEQ ID NO: 133239 - protein, 9 aa, Homo Sapiens
ISSMPSSGT

SEQ ID NO: 133240 - protein, 9 aa, Homo Sapiens
KQKRLVTEM

SEQ ID NO: 133241 - protein, 9 aa, Homo Sapiens
GMFREDSMM

SEQ ID NO: 133242 - protein, 9 aa, Homo Sapiens
TVTILVSLT

SEQ ID NO: 133243 - protein, 9 aa, Homo Sapiens
ADRGPPEPQ

SEQ ID NO: 133244 - protein, 9 aa, Homo Sapiens
DVHRPPVLP

SEQ ID NO: 133245 - protein, 9 aa, Homo Sapiens
STVRAINVA

SEQ ID NO: 133246 - protein, 9 aa, Homo Sapiens
VPAGWGLTS

SEQ ID NO: 133247 - protein, 9 aa, Homo Sapiens
LKERVLMSQ

SEQ ID NO: 133248 - protein, 9 aa, Homo Sapiens
DVDLATSVR

SEQ ID NO: 133249 - protein, 9 aa, Homo Sapiens
AQALAVNYR

SEQ ID NO: 133250 - protein, 9 aa, Homo Sapiens
KGFYPSDVA

SEQ ID NO: 133251 - protein, 9 aa, Homo Sapiens
AIVYTKLCG

SEQ ID NO: 133252 - protein, 9 aa, Homo Sapiens
MALFLKMIC

SEQ ID NO: 133253 - protein, 9 aa, Homo Sapiens
LHFAAESII

SEQ ID NO: 133254 - protein, 9 aa, Homo Sapiens
RSPLHLWTQ

SEQ ID NO: 133255 - protein, 9 aa, Homo Sapiens
DLLGLLIIT

SEQ ID NO: 133256 - protein, 9 aa, Homo Sapiens
PEGMVKRAK

SEQ ID NO: 133257 - protein, 9 aa, Homo Sapiens
TGLLLIAYY

SEQ ID NO: 133258 - protein, 9 aa, Homo Sapiens
FETALQIFN

SEQ ID NO: 133259 - protein, 9 aa, Homo Sapiens
DYMPLHASL

SEQ ID NO: 133260 - protein, 9 aa, Homo Sapiens
YIPKSLGLS

SEQ ID NO: 133261 - protein, 9 aa, Homo Sapiens
ALGSEVWRR

SEQ ID NO: 133262 - protein, 9 aa, Homo Sapiens
ATTTATTGP

SEQ ID NO: 133263 - protein, 9 aa, Homo Sapiens
DNGEPPRSS

SEQ ID NO: 133264 - protein, 9 aa, Homo Sapiens
PHEYRFPKN

SEQ ID NO: 133265 - protein, 9 aa, Homo Sapiens
KQLVRGNAD

SEQ ID NO: 133266 - protein, 9 aa, Homo Sapiens
NPRDEIATE

SEQ ID NO: 133267 - protein, 9 aa, Homo Sapiens
HVVNFDLPS

SEQ ID NO: 133268 - protein, 9 aa, Homo Sapiens
FFSFSRSQR

SEQ ID NO: 133269 - protein, 9 aa, Homo Sapiens
TLKCQLEHN

SEQ ID NO: 133270 - protein, 9 aa, Homo Sapiens
ARRGRRAGN

SEQ ID NO: 133271 - protein, 9 aa, Homo Sapiens
LDTPRSCER

SEQ ID NO: 133272 - protein, 9 aa, Homo Sapiens
RDVLEVIAE

SEQ ID NO: 133273 - protein, 9 aa, Homo Sapiens
AQADERYGK

SEQ ID NO: 133274 - protein, 9 aa, Homo Sapiens
IAPSIFFFL

SEQ ID NO: 133275 - protein, 9 aa, Homo Sapiens
HAAHRPLCQ

SEQ ID NO: 133276 - protein, 9 aa, Homo Sapiens
KSRGSSSSR

SEQ ID NO: 133277 - protein, 9 aa, Homo Sapiens
DREGYLLCK

SEQ ID NO: 133278 - protein, 9 aa, Homo Sapiens
TVRLMEAPP

SEQ ID NO: 133279 - protein, 9 aa, Homo Sapiens
KSMHVSEAS

SEQ ID NO: 133280 - protein, 9 aa, Homo Sapiens
MIKDVAAVG

SEQ ID NO: 133281 - protein, 9 aa, Homo Sapiens
SSINQEERD

SEQ ID NO: 133282 - protein, 9 aa, Homo Sapiens
LPRENWTHL

SEQ ID NO: 133283 - protein, 9 aa, Homo Sapiens
TTTEDQLFF

SEQ ID NO: 133284 - protein, 9 aa, Homo Sapiens
STDFLAVKG

SEQ ID NO: 133285 - protein, 9 aa, Homo Sapiens
MEILCTVFA

SEQ ID NO: 133286 - protein, 9 aa, Homo Sapiens
PKQTLENSH

SEQ ID NO: 133287 - protein, 9 aa, Homo Sapiens
VVLLVVSVV

SEQ ID NO: 133288 - protein, 9 aa, Homo Sapiens
GKKVVVVKN

SEQ ID NO: 133289 - protein, 9 aa, Homo Sapiens
NTSTQSTPW

SEQ ID NO: 133290 - protein, 9 aa, Homo Sapiens
NTDLLREGA

SEQ ID NO: 133291 - protein, 9 aa, Homo Sapiens
PSIFFFLFN

SEQ ID NO: 133292 - protein, 9 aa, Homo Sapiens
FLVRGGSFI

SEQ ID NO: 133293 - protein, 9 aa, Homo Sapiens
IPCPTDSLL

SEQ ID NO: 133294 - protein, 9 aa, Homo Sapiens
QGLAPPLCS

SEQ ID NO: 133295 - protein, 9 aa, Homo Sapiens
PTVIRDITY

SEQ ID NO: 133296 - protein, 9 aa, Homo Sapiens
KLSKKNQEI

SEQ ID NO: 133297 - protein, 9 aa, Homo Sapiens
GGESAPATL

SEQ ID NO: 133298 - protein, 9 aa, Homo Sapiens
FGVVSSRMA

SEQ ID NO: 133299 - protein, 9 aa, Homo Sapiens
EGEIRHSAE

SEQ ID NO: 133300 - protein, 9 aa, Homo Sapiens
LNPNPHMYE

SEQ ID NO: 133301 - protein, 9 aa, Homo Sapiens
ELKLTDIWL

SEQ ID NO: 133302 - protein, 9 aa, Homo Sapiens
KPRWVKIIT

SEQ ID NO: 133303 - protein, 9 aa, Homo Sapiens
VSNASADLM

SEQ ID NO: 133304 - protein, 9 aa, Homo Sapiens
IYNYNINTC

SEQ ID NO: 133305 - protein, 9 aa, Homo Sapiens
LSPAITSIS

SEQ ID NO: 133306 - protein, 9 aa, Homo Sapiens
YRRSEQDGP

SEQ ID NO: 133307 - protein, 9 aa, Homo Sapiens
MCDEDETTT

SEQ ID NO: 133308 - protein, 9 aa, Homo Sapiens
VNRIVDSAR

SEQ ID NO: 133309 - protein, 9 aa, Homo Sapiens
LFRMTWKPF

SEQ ID NO: 133310 - protein, 9 aa, Homo Sapiens
RSPMNAMHV

SEQ ID NO: 133311 - protein, 9 aa, Homo Sapiens
RPLSTMANL

SEQ ID NO: 133312 - protein, 9 aa, Homo Sapiens
QEGEVSGGH

SEQ ID NO: 133313 - protein, 9 aa, Homo Sapiens
GRAGPAPRV

SEQ ID NO: 133314 - protein, 9 aa, Homo Sapiens
WGEKIVALM

SEQ ID NO: 133315 - protein, 9 aa, Homo Sapiens
GSEVAIMAP

SEQ ID NO: 133316 - protein, 9 aa, Homo Sapiens
AGPSPHLLH

SEQ ID NO: 133317 - protein, 9 aa, Homo Sapiens
FFHAITSLH

SEQ ID NO: 133318 - protein, 9 aa, Homo Sapiens
QRHRAVHDF

SEQ ID NO: 133319 - protein, 9 aa, Homo Sapiens
WPASRLIFW

SEQ ID NO: 133320 - protein, 9 aa, Homo Sapiens
MAHRSRAAG

SEQ ID NO: 133321 - protein, 9 aa, Homo Sapiens
HQENGFGSL

SEQ ID NO: 133322 - protein, 9 aa, Homo Sapiens
PPSAASRPC

SEQ ID NO: 133323 - protein, 9 aa, Homo Sapiens
LQAPVLVAV

SEQ ID NO: 133324 - protein, 9 aa, Homo Sapiens
ELEDEWRFR

SEQ ID NO: 133325 - protein, 9 aa, Homo Sapiens
QGENCLTNF

SEQ ID NO: 133326 - protein, 9 aa, Homo Sapiens
HLPGVCKVN

SEQ ID NO: 133327 - protein, 9 aa, Homo Sapiens
QKICKGCPH

SEQ ID NO: 133328 - protein, 9 aa, Homo Sapiens
APLSPGATL

SEQ ID NO: 133329 - protein, 9 aa, Homo Sapiens
RQIRRECWG

SEQ ID NO: 133330 - protein, 9 aa, Homo Sapiens
AKKGWTAIE

SEQ ID NO: 133331 - protein, 9 aa, Homo Sapiens
NHPPYPGPG

SEQ ID NO: 133332 - protein, 9 aa, Homo Sapiens
DTDRNLSHD

SEQ ID NO: 133333 - protein, 9 aa, Homo Sapiens
CWAPGRPLD

SEQ ID NO: 133334 - protein, 9 aa, Homo Sapiens
AGLCTSLLQ

SEQ ID NO: 133335 - protein, 9 aa, Homo Sapiens
DLVRPIDPA

SEQ ID NO: 133336 - protein, 9 aa, Homo Sapiens
SIHNFCLVS

SEQ ID NO: 133337 - protein, 9 aa, Homo Sapiens
HTGDKPFMC

SEQ ID NO: 133338 - protein, 9 aa, Homo Sapiens
PAPRVPLCP

SEQ ID NO: 133339 - protein, 9 aa, Homo Sapiens
PFFIQIRSV

SEQ ID NO: 133340 - protein, 9 aa, Homo Sapiens
PGPTCPAFS

SEQ ID NO: 133341 - protein, 9 aa, Homo Sapiens
KEFRKNFVT

SEQ ID NO: 133342 - protein, 9 aa, Homo Sapiens
WHGGFQPES

SEQ ID NO: 133343 - protein, 9 aa, Homo Sapiens
PVPTHCPQG

SEQ ID NO: 133344 - protein, 9 aa, Homo Sapiens
PSSSTPKRP

SEQ ID NO: 133345 - protein, 9 aa, Homo Sapiens
MKRIWQYVY

SEQ ID NO: 133346 - protein, 9 aa, Homo Sapiens
PKSPSAGPS

SEQ ID NO: 133347 - protein, 9 aa, Homo Sapiens
LASCPTSML

SEQ ID NO: 133348 - protein, 9 aa, Homo Sapiens
ELQMWVCNS

SEQ ID NO: 133349 - protein, 9 aa, Homo Sapiens
LTVWYTKEI

SEQ ID NO: 133350 - protein, 9 aa, Homo Sapiens
LLMAVQEDL

SEQ ID NO: 133351 - protein, 9 aa, Homo Sapiens
LVEIKQKLS

SEQ ID NO: 133352 - protein, 9 aa, Homo Sapiens
NAHFWPRRK

SEQ ID NO: 133353 - protein, 9 aa, Homo Sapiens
EATSPQPIS

SEQ ID NO: 133354 - protein, 9 aa, Homo Sapiens
SLVRVISEA

SEQ ID NO: 133355 - protein, 9 aa, Homo Sapiens
GSSHIAGNL

SEQ ID NO: 133356 - protein, 9 aa, Homo Sapiens
VRALQSLTC

SEQ ID NO: 133357 - protein, 9 aa, Homo Sapiens
SFLSPTVFV

SEQ ID NO: 133358 - protein, 9 aa, Homo Sapiens
SYEIGSWIS

SEQ ID NO: 133359 - protein, 9 aa, Homo Sapiens
VALMSSTII

SEQ ID NO: 133360 - protein, 9 aa, Homo Sapiens
RRRPALRLL

SEQ ID NO: 133361 - protein, 9 aa, Homo Sapiens
EVLLKRVAD

SEQ ID NO: 133362 - protein, 9 aa, Homo Sapiens
MTAEELKKE

SEQ ID NO: 133363 - protein, 9 aa, Homo Sapiens
GVCGNVLRF

SEQ ID NO: 133364 - protein, 9 aa, Homo Sapiens
IPVDRPGRR

SEQ ID NO: 133365 - protein, 9 aa, Homo Sapiens
ALEVADRIG

SEQ ID NO: 133366 - protein, 9 aa, Homo Sapiens
FVDQLRDLS

SEQ ID NO: 133367 - protein, 9 aa, Homo Sapiens
DEIAAEIFA

SEQ ID NO: 133368 - protein, 9 aa, Homo Sapiens
ISFVVGEKM

SEQ ID NO: 133369 - protein, 9 aa, Homo Sapiens
LELTSAQLD

SEQ ID NO: 133370 - protein, 9 aa, Homo Sapiens
SHPDTSAQP

SEQ ID NO: 133371 - protein, 9 aa, Homo Sapiens
CVKTWASLS

SEQ ID NO: 133372 - protein, 9 aa, Homo Sapiens
LPLVPDFPY

SEQ ID NO: 133373 - protein, 9 aa, Homo Sapiens
GKSQGGRIL

SEQ ID NO: 133374 - protein, 9 aa, Homo Sapiens
NILDVHTGV

SEQ ID NO: 133375 - protein, 9 aa, Homo Sapiens
DPLAGEEGG

SEQ ID NO: 133376 - protein, 9 aa, Homo Sapiens
TEEPAVAIK

SEQ ID NO: 133377 - protein, 9 aa, Homo Sapiens
VSVVAHLSH

SEQ ID NO: 133378 - protein, 9 aa, Homo Sapiens
MYQVQSPML

SEQ ID NO: 133379 - protein, 9 aa, Homo Sapiens
KMVAVGPGA

SEQ ID NO: 133380 - protein, 9 aa, Homo Sapiens
ACATQLAFF

SEQ ID NO: 133381 - protein, 9 aa, Homo Sapiens
KPDAPPPKE

SEQ ID NO: 133382 - protein, 9 aa, Homo Sapiens
CSLLILICD

SEQ ID NO: 133383 - protein, 9 aa, Homo Sapiens
SPLGHHMQL

SEQ ID NO: 133384 - protein, 9 aa, Homo Sapiens
SYNSSGLQD

SEQ ID NO: 133385 - protein, 9 aa, Homo Sapiens
SAMPGPSLE

SEQ ID NO: 133386 - protein, 9 aa, Homo Sapiens
PGLGLWLIY

SEQ ID NO: 133387 - protein, 9 aa, Homo Sapiens
EKKATLSHF

SEQ ID NO: 133388 - protein, 9 aa, Homo Sapiens
QPLDTVFRD

SEQ ID NO: 133389 - protein, 9 aa, Homo Sapiens
SLPMQESQL

SEQ ID NO: 133390 - protein, 9 aa, Homo Sapiens
AARASSGTA

SEQ ID NO: 133391 - protein, 9 aa, Homo Sapiens
ELPLEARHA

SEQ ID NO: 133392 - protein, 9 aa, Homo Sapiens
QDFLRIMPT

SEQ ID NO: 133393 - protein, 9 aa, Homo Sapiens
HKASKLDDH

SEQ ID NO: 133394 - protein, 9 aa, Homo Sapiens
LLITVTLCS

SEQ ID NO: 133395 - protein, 9 aa, Homo Sapiens
HASLPPTSP

SEQ ID NO: 133396 - protein, 9 aa, Homo Sapiens
FHPNSCNTS

SEQ ID NO: 133397 - protein, 9 aa, Homo Sapiens
TNPFLSLPG

SEQ ID NO: 133398 - protein, 9 aa, Homo Sapiens
YSLCPSRSD

SEQ ID NO: 133399 - protein, 9 aa, Homo Sapiens
HQPDWCCVP

SEQ ID NO: 133400 - protein, 9 aa, Homo Sapiens
LAELVQHLF

SEQ ID NO: 133401 - protein, 9 aa, Homo Sapiens
HLERVVCAS

SEQ ID NO: 133402 - protein, 9 aa, Homo Sapiens
DRPRKRQCA

SEQ ID NO: 133403 - protein, 9 aa, Homo Sapiens
SLYFIHLES

SEQ ID NO: 133404 - protein, 9 aa, Homo Sapiens
ESRVTRSRG

SEQ ID NO: 133405 - protein, 9 aa, Homo Sapiens
VLEQVCSVL

SEQ ID NO: 133406 - protein, 9 aa, Homo Sapiens
GAPAVPAAP

SEQ ID NO: 133407 - protein, 9 aa, Homo Sapiens
RVISEAGAP

SEQ ID NO: 133408 - protein, 9 aa, Homo Sapiens
VDAAPETTA

SEQ ID NO: 133409 - protein, 9 aa, Homo Sapiens
TLASRVAGT

SEQ ID NO: 133410 - protein, 9 aa, Homo Sapiens
TQYSSIQYS

SEQ ID NO: 133411 - protein, 9 aa, Homo Sapiens
AKTILSLVT

SEQ ID NO: 133412 - protein, 9 aa, Homo Sapiens
LCSHQDELD

SEQ ID NO: 133413 - protein, 9 aa, Homo Sapiens
QQLHHPQQQ

SEQ ID NO: 133414 - protein, 9 aa, Homo Sapiens
ASPPSRPPS

SEQ ID NO: 133415 - protein, 9 aa, Homo Sapiens
TNNCPHGMA

SEQ ID NO: 133416 - protein, 9 aa, Homo Sapiens
LTSLKFPLS

SEQ ID NO: 133417 - protein, 9 aa, Homo Sapiens
ELEPLASRS

SEQ ID NO: 133418 - protein, 9 aa, Homo Sapiens
KVKKDRGWG

SEQ ID NO: 133419 - protein, 9 aa, Homo Sapiens
MYQRFLRRH

SEQ ID NO: 133420 - protein, 9 aa, Homo Sapiens
PQRPLQICT

SEQ ID NO: 133421 - protein, 9 aa, Homo Sapiens
IPYNSQYEE

SEQ ID NO: 133422 - protein, 9 aa, Homo Sapiens
CNTSVYSSS

SEQ ID NO: 133423 - protein, 9 aa, Homo Sapiens
FPTLTVSRW

SEQ ID NO: 133424 - protein, 9 aa, Homo Sapiens
VARLFKQIV

SEQ ID NO: 133425 - protein, 9 aa, Homo Sapiens
MQLTNDKVN

SEQ ID NO: 133426 - protein, 9 aa, Homo Sapiens
RTCDRCKHG

SEQ ID NO: 133427 - protein, 9 aa, Homo Sapiens
PEHTNVCFG

SEQ ID NO: 133428 - protein, 9 aa, Homo Sapiens
AQTIGQIEL

SEQ ID NO: 133429 - protein, 9 aa, Homo Sapiens
VVPLHDGAL

SEQ ID NO: 133430 - protein, 9 aa, Homo Sapiens
PFHDSAVTS

SEQ ID NO: 133431 - protein, 9 aa, Homo Sapiens
RFSIRKQHP

SEQ ID NO: 133432 - protein, 9 aa, Homo Sapiens
KYRAPIRGK

SEQ ID NO: 133433 - protein, 9 aa, Homo Sapiens
HNFSSQIFS

SEQ ID NO: 133434 - protein, 9 aa, Homo Sapiens
ILFSRSLSS

SEQ ID NO: 133435 - protein, 9 aa, Homo Sapiens
PFCYLPKSR

SEQ ID NO: 133436 - protein, 9 aa, Homo Sapiens
PYGHLHVSN

SEQ ID NO: 133437 - protein, 9 aa, Homo Sapiens
MGIRVYYSP

SEQ ID NO: 133438 - protein, 9 aa, Homo Sapiens
WAGLPSWQY

SEQ ID NO: 133439 - protein, 9 aa, Homo Sapiens
VSGISRFLE

SEQ ID NO: 133440 - protein, 9 aa, Homo Sapiens
DQVKKRKKR

SEQ ID NO: 133441 - protein, 9 aa, Homo Sapiens
ECLIIATAL

SEQ ID NO: 133442 - protein, 9 aa, Homo Sapiens
PTVPSAPEP

SEQ ID NO: 133443 - protein, 9 aa, Homo Sapiens
PLKSPTMYQ

SEQ ID NO: 133444 - protein, 9 aa, Homo Sapiens
VEWAAELMH

SEQ ID NO: 133445 - protein, 9 aa, Homo Sapiens
KEVSEFHSR

SEQ ID NO: 133446 - protein, 9 aa, Homo Sapiens
VGPGAPTPE

SEQ ID NO: 133447 - protein, 9 aa, Homo Sapiens
AALCIPLLI

SEQ ID NO: 133448 - protein, 9 aa, Homo Sapiens
LILLGIILW

SEQ ID NO: 133449 - protein, 9 aa, Homo Sapiens
IYRKSGTHQ

SEQ ID NO: 133450 - protein, 9 aa, Homo Sapiens
KCIFSFDNH

SEQ ID NO: 133451 - protein, 9 aa, Homo Sapiens
AKKEAGFVE

SEQ ID NO: 133452 - protein, 9 aa, Homo Sapiens
HGRKKKTHL

SEQ ID NO: 133453 - protein, 9 aa, Homo Sapiens
RYHPKPALH

SEQ ID NO: 133454 - protein, 9 aa, Homo Sapiens
GCRPGRICS

SEQ ID NO: 133455 - protein, 9 aa, Homo Sapiens
AEPCLPGPT

SEQ ID NO: 133456 - protein, 9 aa, Homo Sapiens
TVDNWIDHW

SEQ ID NO: 133457 - protein, 9 aa, Homo Sapiens
FLRILEKEE

SEQ ID NO: 133458 - protein, 9 aa, Homo Sapiens
GFLLVRERK

SEQ ID NO: 133459 - protein, 9 aa, Homo Sapiens
VNNYAKDEV

SEQ ID NO: 133460 - protein, 9 aa, Homo Sapiens
MHLKEAGTV

SEQ ID NO: 133461 - protein, 9 aa, Homo Sapiens
VGEKGLALE

SEQ ID NO: 133462 - protein, 9 aa, Homo Sapiens
VASGAACIR

SEQ ID NO: 133463 - protein, 9 aa, Homo Sapiens
LGSSPLPCL

SEQ ID NO: 133464 - protein, 9 aa, Homo Sapiens
SKASGVSKV

SEQ ID NO: 133465 - protein, 9 aa, Homo Sapiens
VGLALAHST

SEQ ID NO: 133466 - protein, 9 aa, Homo Sapiens
GEQDVEGND

SEQ ID NO: 133467 - protein, 9 aa, Homo Sapiens
VVKKPRASQ

SEQ ID NO: 133468 - protein, 9 aa, Homo Sapiens
TRSRGTPGF

SEQ ID NO: 133469 - protein, 9 aa, Homo Sapiens
IRQGFCCSV

SEQ ID NO: 133470 - protein, 9 aa, Homo Sapiens
STARSRGAP

SEQ ID NO: 133471 - protein, 9 aa, Homo Sapiens
IQNQLAHIL

SEQ ID NO: 133472 - protein, 9 aa, Homo Sapiens
DEIYDSSKS

SEQ ID NO: 133473 - protein, 9 aa, Homo Sapiens
RLMNAAITE

SEQ ID NO: 133474 - protein, 9 aa, Homo Sapiens
LKINHVMTS

SEQ ID NO: 133475 - protein, 9 aa, Homo Sapiens
TLDAAKRCI

SEQ ID NO: 133476 - protein, 9 aa, Homo Sapiens
DLAVNVCIR

SEQ ID NO: 133477 - protein, 9 aa, Homo Sapiens
HAPPPPNAT

SEQ ID NO: 133478 - protein, 9 aa, Homo Sapiens
RPAPLSVGH

SEQ ID NO: 133479 - protein, 9 aa, Homo Sapiens
ACPPGFYNV

SEQ ID NO: 133480 - protein, 9 aa, Homo Sapiens
ERTQGRNHM

SEQ ID NO: 133481 - protein, 9 aa, Homo Sapiens
PRSSPRLNG

SEQ ID NO: 133482 - protein, 9 aa, Homo Sapiens
QPLMNSCMS

SEQ ID NO: 133483 - protein, 9 aa, Homo Sapiens
VRGSRCYCD

SEQ ID NO: 133484 - protein, 9 aa, Homo Sapiens
PAFSHRSAA

SEQ ID NO: 133485 - protein, 9 aa, Homo Sapiens
NTDASASAP

SEQ ID NO: 133486 - protein, 9 aa, Homo Sapiens
HVFRKALCG

SEQ ID NO: 133487 - protein, 9 aa, Homo Sapiens
KKYDVMNDI

SEQ ID NO: 133488 - protein, 9 aa, Homo Sapiens
DHICFVVDL

SEQ ID NO: 133489 - protein, 9 aa, Homo Sapiens
PANKHRADG

SEQ ID NO: 133490 - protein, 9 aa, Homo Sapiens
HGLLSKSAQ

SEQ ID NO: 133491 - protein, 9 aa, Homo Sapiens
AASLRIAGC

SEQ ID NO: 133492 - protein, 9 aa, Homo Sapiens
QTYPMVHLL

SEQ ID NO: 133493 - protein, 9 aa, Homo Sapiens
LNPVIYGVS

SEQ ID NO: 133494 - protein, 9 aa, Homo Sapiens
KLCGRTHMY

SEQ ID NO: 133495 - protein, 9 aa, Homo Sapiens
LDRNEESVD

SEQ ID NO: 133496 - protein, 9 aa, Homo Sapiens
YQQCILWTT

SEQ ID NO: 133497 - protein, 9 aa, Homo Sapiens
QAIVYTKLC

SEQ ID NO: 133498 - protein, 9 aa, Homo Sapiens
KQAMGTIGF

SEQ ID NO: 133499 - protein, 9 aa, Homo Sapiens
SPCPPMPTR

SEQ ID NO: 133500 - protein, 9 aa, Homo Sapiens
VEVQNILDV

SEQ ID NO: 133501 - protein, 9 aa, Homo Sapiens
LMNVMNVGS

SEQ ID NO: 133502 - protein, 9 aa, Homo Sapiens
IHIGEKSFE

SEQ ID NO: 133503 - protein, 9 aa, Homo Sapiens
RVRRREPTP

SEQ ID NO: 133504 - protein, 9 aa, Homo Sapiens
NTTKHTYDY

SEQ ID NO: 133505 - protein, 9 aa, Homo Sapiens
SRENIDLSE

SEQ ID NO: 133506 - protein, 9 aa, Homo Sapiens
WRIHRRTPR

SEQ ID NO: 133507 - protein, 9 aa, Homo Sapiens
RLTWVCRRP

SEQ ID NO: 133508 - protein, 9 aa, Homo Sapiens
LPWAGAPAT

SEQ ID NO: 133509 - protein, 9 aa, Homo Sapiens
LVILGKGGY

SEQ ID NO: 133510 - protein, 9 aa, Homo Sapiens
EDGEEKSLS

SEQ ID NO: 133511 - protein, 9 aa, Homo Sapiens
LQAKKFEIL

SEQ ID NO: 133512 - protein, 9 aa, Homo Sapiens
QRPLQICTC

SEQ ID NO: 133513 - protein, 9 aa, Homo Sapiens
HSPTCLRAL

SEQ ID NO: 133514 - protein, 9 aa, Homo Sapiens
PPQATRARS

SEQ ID NO: 133515 - protein, 9 aa, Homo Sapiens
TTMGATAVT

SEQ ID NO: 133516 - protein, 9 aa, Homo Sapiens
KNTHPLLQA

SEQ ID NO: 133517 - protein, 9 aa, Homo Sapiens
DESSRLDFP

SEQ ID NO: 133518 - protein, 9 aa, Homo Sapiens
VCMLAANRA

SEQ ID NO: 133519 - protein, 9 aa, Homo Sapiens
FTAASGISS

SEQ ID NO: 133520 - protein, 9 aa, Homo Sapiens
EHASANHSP

SEQ ID NO: 133521 - protein, 9 aa, Homo Sapiens
VAACKVVAT

SEQ ID NO: 133522 - protein, 9 aa, Homo Sapiens
VSNVMLDGD

SEQ ID NO: 133523 - protein, 9 aa, Homo Sapiens
RKRHLESSN

SEQ ID NO: 133524 - protein, 9 aa, Homo Sapiens
ASLTAAHSS

SEQ ID NO: 133525 - protein, 9 aa, Homo Sapiens
DDVPHQIQH

SEQ ID NO: 133526 - protein, 9 aa, Homo Sapiens
RQQQMATKI

SEQ ID NO: 133527 - protein, 9 aa, Homo Sapiens
IWHHTFYKR

SEQ ID NO: 133528 - protein, 9 aa, Homo Sapiens
LGITDSHQQ

SEQ ID NO: 133529 - protein, 9 aa, Homo Sapiens
VEGNSSIKC

SEQ ID NO: 133530 - protein, 9 aa, Homo Sapiens
KVSLLFLFR

SEQ ID NO: 133531 - protein, 9 aa, Homo Sapiens
ENGEICLKC

SEQ ID NO: 133532 - protein, 9 aa, Homo Sapiens
KIIQFIAHE

SEQ ID NO: 133533 - protein, 9 aa, Homo Sapiens
MKDPRVLVP

SEQ ID NO: 133534 - protein, 9 aa, Homo Sapiens
SIPPPYYST

SEQ ID NO: 133535 - protein, 9 aa, Homo Sapiens
IVLTTRKER

SEQ ID NO: 133536 - protein, 9 aa, Homo Sapiens
IGRSVAHCR

SEQ ID NO: 133537 - protein, 9 aa, Homo Sapiens
LLQPLLTVI

SEQ ID NO: 133538 - protein, 9 aa, Homo Sapiens
SLSDVDLAT

SEQ ID NO: 133539 - protein, 9 aa, Homo Sapiens
GLLPVHHLH

SEQ ID NO: 133540 - protein, 9 aa, Homo Sapiens
LRLLCPPVP

SEQ ID NO: 133541 - protein, 9 aa, Homo Sapiens
VERGRGVKY

SEQ ID NO: 133542 - protein, 9 aa, Homo Sapiens
VYVCIAMEA

SEQ ID NO: 133543 - protein, 9 aa, Homo Sapiens
TPPLPTART

SEQ ID NO: 133544 - protein, 9 aa, Homo Sapiens
PLPPQLSVT

SEQ ID NO: 133545 - protein, 9 aa, Homo Sapiens
YWPITAFHA

SEQ ID NO: 133546 - protein, 9 aa, Homo Sapiens
LPVQSPEPS

SEQ ID NO: 133547 - protein, 9 aa, Homo Sapiens
DDNTAILRQ

SEQ ID NO: 133548 - protein, 9 aa, Homo Sapiens
LQSFFETST

SEQ ID NO: 133549 - protein, 9 aa, Homo Sapiens
LSDIPKAVE

SEQ ID NO: 133550 - protein, 9 aa, Homo Sapiens
GPLKIRASA

SEQ ID NO: 133551 - protein, 9 aa, Homo Sapiens
ARGLLLALS

SEQ ID NO: 133552 - protein, 9 aa, Homo Sapiens
RAACGSRGA

SEQ ID NO: 133553 - protein, 9 aa, Homo Sapiens
GNNLIFQYS

SEQ ID NO: 133554 - protein, 9 aa, Homo Sapiens
SSKWNSTFS

SEQ ID NO: 133555 - protein, 9 aa, Homo Sapiens
LIFQYSQLI

SEQ ID NO: 133556 - protein, 9 aa, Homo Sapiens
FWPRRKCRT

SEQ ID NO: 133557 - protein, 9 aa, Homo Sapiens
GDAFASWSD

SEQ ID NO: 133558 - protein, 9 aa, Homo Sapiens
SVPETFSAP

SEQ ID NO: 133559 - protein, 9 aa, Homo Sapiens
RGRGVKYSY

SEQ ID NO: 133560 - protein, 9 aa, Homo Sapiens
AVMPHQMHQ

SEQ ID NO: 133561 - protein, 9 aa, Homo Sapiens
DICYSSNAT

SEQ ID NO: 133562 - protein, 9 aa, Homo Sapiens
GQGAEGGLL

SEQ ID NO: 133563 - protein, 9 aa, Homo Sapiens
LHMAALLRL

SEQ ID NO: 133564 - protein, 9 aa, Homo Sapiens
GPEKKTWYL

SEQ ID NO: 133565 - protein, 9 aa, Homo Sapiens
LGCKRWAGI

SEQ ID NO: 133566 - protein, 9 aa, Homo Sapiens
LGSQVHYAC

SEQ ID NO: 133567 - protein, 9 aa, Homo Sapiens
GTQAARRPP

SEQ ID NO: 133568 - protein, 9 aa, Homo Sapiens
VWTHTGCHV

SEQ ID NO: 133569 - protein, 9 aa, Homo Sapiens
PDGVPIYIT

SEQ ID NO: 133570 - protein, 9 aa, Homo Sapiens
GISEDLKKA

SEQ ID NO: 133571 - protein, 9 aa, Homo Sapiens
SDSYQGRGF

SEQ ID NO: 133572 - protein, 9 aa, Homo Sapiens
ESASGQAVR

SEQ ID NO: 133573 - protein, 9 aa, Homo Sapiens
LIFWSRHCV

SEQ ID NO: 133574 - protein, 9 aa, Homo Sapiens
HLKRGFLHC

SEQ ID NO: 133575 - protein, 9 aa, Homo Sapiens
GIVSVPVPK

SEQ ID NO: 133576 - protein, 9 aa, Homo Sapiens
QRSPLHLWT

SEQ ID NO: 133577 - protein, 9 aa, Homo Sapiens
HIIRREVMD

SEQ ID NO: 133578 - protein, 9 aa, Homo Sapiens
LESGGAPAP

SEQ ID NO: 133579 - protein, 9 aa, Homo Sapiens
GCLCGRCGA

SEQ ID NO: 133580 - protein, 9 aa, Homo Sapiens
TLQPNGSLF

SEQ ID NO: 133581 - protein, 9 aa, Homo Sapiens
QRCRCVCLR

SEQ ID NO: 133582 - protein, 9 aa, Homo Sapiens
SPSTSIPHL

SEQ ID NO: 133583 - protein, 9 aa, Homo Sapiens
SNAYIADET

SEQ ID NO: 133584 - protein, 9 aa, Homo Sapiens
DEKEMERVS

SEQ ID NO: 133585 - protein, 9 aa, Homo Sapiens
LQKKHLRNL

SEQ ID NO: 133586 - protein, 9 aa, Homo Sapiens
AALAGAHAA

SEQ ID NO: 133587 - protein, 9 aa, Homo Sapiens
AMVCQVHGG

SEQ ID NO: 133588 - protein, 9 aa, Homo Sapiens
TEEEQGKKR

SEQ ID NO: 133589 - protein, 9 aa, Homo Sapiens
LVRENSSSA

SEQ ID NO: 133590 - protein, 9 aa, Homo Sapiens
AYDYFKDTG

SEQ ID NO: 133591 - protein, 9 aa, Homo Sapiens
DSSLQEIRE

SEQ ID NO: 133592 - protein, 9 aa, Homo Sapiens
PYANTTKHT

SEQ ID NO: 133593 - protein, 9 aa, Homo Sapiens
AVPAAPAAM

SEQ ID NO: 133594 - protein, 9 aa, Homo Sapiens
FFTEGHRPK

SEQ ID NO: 133595 - protein, 9 aa, Homo Sapiens
GATTTAPLS

SEQ ID NO: 133596 - protein, 9 aa, Homo Sapiens
SSITKPEGP

SEQ ID NO: 133597 - protein, 9 aa, Homo Sapiens
DSHQQYLPT

SEQ ID NO: 133598 - protein, 9 aa, Homo Sapiens
VPLVNEEAE

SEQ ID NO: 133599 - protein, 9 aa, Homo Sapiens
KRISVQPPR

SEQ ID NO: 133600 - protein, 9 aa, Homo Sapiens
AASGISSIR

SEQ ID NO: 133601 - protein, 9 aa, Homo Sapiens
ILLGLYLMS

SEQ ID NO: 133602 - protein, 9 aa, Homo Sapiens
EILSGNSCP

SEQ ID NO: 133603 - protein, 9 aa, Homo Sapiens
SATIQNESP

SEQ ID NO: 133604 - protein, 9 aa, Homo Sapiens
FFMDLHNFQ

SEQ ID NO: 133605 - protein, 9 aa, Homo Sapiens
KENERPSAR

SEQ ID NO: 133606 - protein, 9 aa, Homo Sapiens
MRRPSSRHA

SEQ ID NO: 133607 - protein, 9 aa, Homo Sapiens
VTLVNPEGM

SEQ ID NO: 133608 - protein, 9 aa, Homo Sapiens
REPQHPVFP

SEQ ID NO: 133609 - protein, 9 aa, Homo Sapiens
MVGRAGPAP

SEQ ID NO: 133610 - protein, 9 aa, Homo Sapiens
AVLAAVAEV

SEQ ID NO: 133611 - protein, 9 aa, Homo Sapiens
NAKKGWTAI

SEQ ID NO: 133612 - protein, 9 aa, Homo Sapiens
PFQDNFTII

SEQ ID NO: 133613 - protein, 9 aa, Homo Sapiens
MDRSPYYGG

SEQ ID NO: 133614 - protein, 9 aa, Homo Sapiens
EYNMFPRKG

SEQ ID NO: 133615 - protein, 9 aa, Homo Sapiens
ETCKIGVNG

SEQ ID NO: 133616 - protein, 9 aa, Homo Sapiens
HYGREGLTG

SEQ ID NO: 133617 - protein, 9 aa, Homo Sapiens
LGFEFNNEI

SEQ ID NO: 133618 - protein, 9 aa, Homo Sapiens
DHKANDHKP

SEQ ID NO: 133619 - protein, 9 aa, Homo Sapiens
FNIKDQDYN

SEQ ID NO: 133620 - protein, 9 aa, Homo Sapiens
PLRHRSRCT

SEQ ID NO: 133621 - protein, 9 aa, Homo Sapiens
LPNRETGAV

SEQ ID NO: 133622 - protein, 9 aa, Homo Sapiens
GGNQAGGSG

SEQ ID NO: 133623 - protein, 9 aa, Homo Sapiens
VGQKMKRIS

SEQ ID NO: 133624 - protein, 9 aa, Homo Sapiens
NSRNHQRPA

SEQ ID NO: 133625 - protein, 9 aa, Homo Sapiens
HRGMFREDS

SEQ ID NO: 133626 - protein, 9 aa, Homo Sapiens
FLGAPHPSD

SEQ ID NO: 133627 - protein, 9 aa, Homo Sapiens
REERREVWV

SEQ ID NO: 133628 - protein, 9 aa, Homo Sapiens
AAASLRIAG

SEQ ID NO: 133629 - protein, 9 aa, Homo Sapiens
KARSAWDAP

SEQ ID NO: 133630 - protein, 9 aa, Homo Sapiens
TVATITAVS

SEQ ID NO: 133631 - protein, 9 aa, Homo Sapiens
EVGDRKGVH

SEQ ID NO: 133632 - protein, 9 aa, Homo Sapiens
FLVDPRKVL

SEQ ID NO: 133633 - protein, 9 aa, Homo Sapiens
NYAKDEVAA

SEQ ID NO: 133634 - protein, 9 aa, Homo Sapiens
GENPMNVMN

SEQ ID NO: 133635 - protein, 9 aa, Homo Sapiens
LASSILCTL

SEQ ID NO: 133636 - protein, 9 aa, Homo Sapiens
RLPSSARAV

SEQ ID NO: 133637 - protein, 9 aa, Homo Sapiens
TKPEEEQEN

SEQ ID NO: 133638 - protein, 9 aa, Homo Sapiens
SLNIKEYTQ

SEQ ID NO: 133639 - protein, 9 aa, Homo Sapiens
DIMSLGIHR

SEQ ID NO: 133640 - protein, 9 aa, Homo Sapiens
GRNHMNVMN

SEQ ID NO: 133641 - protein, 9 aa, Homo Sapiens
GTILAYCSL

SEQ ID NO: 133642 - protein, 9 aa, Homo Sapiens
LCIRKHTQG

SEQ ID NO: 133643 - protein, 9 aa, Homo Sapiens
GQLFVRTRK

SEQ ID NO: 133644 - protein, 9 aa, Homo Sapiens
NEDAQEEPG

SEQ ID NO: 133645 - protein, 9 aa, Homo Sapiens
GSFEVTPSL

SEQ ID NO: 133646 - protein, 9 aa, Homo Sapiens
SAMTEEPAV

SEQ ID NO: 133647 - protein, 9 aa, Homo Sapiens
LDLVLHFLK

SEQ ID NO: 133648 - protein, 9 aa, Homo Sapiens
EVMDEDTRH

SEQ ID NO: 133649 - protein, 9 aa, Homo Sapiens
AEVIRSQGG

SEQ ID NO: 133650 - protein, 9 aa, Homo Sapiens
EEEVARLFK

SEQ ID NO: 133651 - protein, 9 aa, Homo Sapiens
PTARTPSSP

SEQ ID NO: 133652 - protein, 9 aa, Homo Sapiens
GVPAGWGLT

SEQ ID NO: 133653 - protein, 9 aa, Homo Sapiens
SLLFLFRMT

SEQ ID NO: 133654 - protein, 9 aa, Homo Sapiens
MSFLEEVRA

SEQ ID NO: 133655 - protein, 9 aa, Homo Sapiens
GPPEPQGQP

SEQ ID NO: 133656 - protein, 9 aa, Homo Sapiens
PSRSDSEFV

SEQ ID NO: 133657 - protein, 9 aa, Homo Sapiens
ATPRRSSFI

SEQ ID NO: 133658 - protein, 9 aa, Homo Sapiens
DAMAQDLTS

SEQ ID NO: 133659 - protein, 9 aa, Homo Sapiens
TWAESLVGS

SEQ ID NO: 133660 - protein, 9 aa, Homo Sapiens
VQHLFRVAS

SEQ ID NO: 133661 - protein, 9 aa, Homo Sapiens
TRYERNIEN

SEQ ID NO: 133662 - protein, 9 aa, Homo Sapiens
GAEGGLLAC

SEQ ID NO: 133663 - protein, 9 aa, Homo Sapiens
DSQQSKLKE

SEQ ID NO: 133664 - protein, 9 aa, Homo Sapiens
RQVHYPFHC

SEQ ID NO: 133665 - protein, 9 aa, Homo Sapiens
HMKDLDNDM

SEQ ID NO: 133666 - protein, 9 aa, Homo Sapiens
AFWAGSVAI

SEQ ID NO: 133667 - protein, 9 aa, Homo Sapiens
EEARGRLPH

SEQ ID NO: 133668 - protein, 9 aa, Homo Sapiens
TEESKKHKR

SEQ ID NO: 133669 - protein, 9 aa, Homo Sapiens
EECCLEMHM

SEQ ID NO: 133670 - protein, 9 aa, Homo Sapiens
GCLIKDGKL

SEQ ID NO: 133671 - protein, 9 aa, Homo Sapiens
ISGSVSCQK

SEQ ID NO: 133672 - protein, 9 aa, Homo Sapiens
NQKLGSPST

SEQ ID NO: 133673 - protein, 9 aa, Homo Sapiens
EVARLFKQI

SEQ ID NO: 133674 - protein, 9 aa, Homo Sapiens
MPIPSANTP

SEQ ID NO: 133675 - protein, 9 aa, Homo Sapiens
GDLDAAIGD

SEQ ID NO: 133676 - protein, 9 aa, Homo Sapiens
RYITSDDLT

SEQ ID NO: 133677 - protein, 9 aa, Homo Sapiens
MDVMNVGNP

SEQ ID NO: 133678 - protein, 9 aa, Homo Sapiens
DRYVAICKH

SEQ ID NO: 133679 - protein, 9 aa, Homo Sapiens
CPSSSPTST

SEQ ID NO: 133680 - protein, 9 aa, Homo Sapiens
VLGCNEKTP

SEQ ID NO: 133681 - protein, 9 aa, Homo Sapiens
SVADFLLDI

SEQ ID NO: 133682 - protein, 9 aa, Homo Sapiens
YSGGKPIQM

SEQ ID NO: 133683 - protein, 9 aa, Homo Sapiens
LACKQLSQQ

SEQ ID NO: 133684 - protein, 9 aa, Homo Sapiens
TAVLHGAPA

SEQ ID NO: 133685 - protein, 9 aa, Homo Sapiens
HIIAFFPFI

SEQ ID NO: 133686 - protein, 9 aa, Homo Sapiens
GRPYGPPAG

SEQ ID NO: 133687 - protein, 9 aa, Homo Sapiens
ALRAVERSQ

SEQ ID NO: 133688 - protein, 9 aa, Homo Sapiens
KLQCNAAGR

SEQ ID NO: 133689 - protein, 9 aa, Homo Sapiens
REPKPGPGQ

SEQ ID NO: 133690 - protein, 9 aa, Homo Sapiens
ENPMNVMNV

SEQ ID NO: 133691 - protein, 9 aa, Homo Sapiens
QPQTKPEEE

SEQ ID NO: 133692 - protein, 9 aa, Homo Sapiens
GSSGRSART

SEQ ID NO: 133693 - protein, 9 aa, Homo Sapiens
APIHRLMLD

SEQ ID NO: 133694 - protein, 9 aa, Homo Sapiens
TEITIVKLQ

SEQ ID NO: 133695 - protein, 9 aa, Homo Sapiens
AGTEFVPGT

SEQ ID NO: 133696 - protein, 9 aa, Homo Sapiens
SVGGQLTTD

SEQ ID NO: 133697 - protein, 9 aa, Homo Sapiens
NGENTDASA

SEQ ID NO: 133698 - protein, 9 aa, Homo Sapiens
VIEEHENSG

SEQ ID NO: 133699 - protein, 9 aa, Homo Sapiens
MQGPPRPQG

SEQ ID NO: 133700 - protein, 9 aa, Homo Sapiens
VKGRSISTK

SEQ ID NO: 133701 - protein, 9 aa, Homo Sapiens
TSTYFVVRN

SEQ ID NO: 133702 - protein, 9 aa, Homo Sapiens
RCNAGWLQD

SEQ ID NO: 133703 - protein, 9 aa, Homo Sapiens
DITYYKAKV

SEQ ID NO: 133704 - protein, 9 aa, Homo Sapiens
HMPNYQFVC

SEQ ID NO: 133705 - protein, 9 aa, Homo Sapiens
PGAAGRRRP

SEQ ID NO: 133706 - protein, 9 aa, Homo Sapiens
PLTRWKPLQ

SEQ ID NO: 133707 - protein, 9 aa, Homo Sapiens
ASLLAVKGF

SEQ ID NO: 133708 - protein, 9 aa, Homo Sapiens
IYFFPFFFI

SEQ ID NO: 133709 - protein, 9 aa, Homo Sapiens
RGAPQSVRL

SEQ ID NO: 133710 - protein, 9 aa, Homo Sapiens
RTDGCCLIW

SEQ ID NO: 133711 - protein, 9 aa, Homo Sapiens
TDPKETNFS

SEQ ID NO: 133712 - protein, 9 aa, Homo Sapiens
PTYTLHVTT

SEQ ID NO: 133713 - protein, 9 aa, Homo Sapiens
RLDFQEEPM

SEQ ID NO: 133714 - protein, 9 aa, Homo Sapiens
VPLRDVLEV

SEQ ID NO: 133715 - protein, 9 aa, Homo Sapiens
ANTSLYPGL

SEQ ID NO: 133716 - protein, 9 aa, Homo Sapiens
SEIPNSVFL

SEQ ID NO: 133717 - protein, 9 aa, Homo Sapiens
FLQCTEPED

SEQ ID NO: 133718 - protein, 9 aa, Homo Sapiens
LRKSSAVLL

SEQ ID NO: 133719 - protein, 9 aa, Homo Sapiens
CANTSLYPG

SEQ ID NO: 133720 - protein, 9 aa, Homo Sapiens
QRLGHGTEV

SEQ ID NO: 133721 - protein, 9 aa, Homo Sapiens
GEMANQEFL

SEQ ID NO: 133722 - protein, 9 aa, Homo Sapiens
MMDFLCCVT

SEQ ID NO: 133723 - protein, 9 aa, Homo Sapiens
RGCPQYLAV

SEQ ID NO: 133724 - protein, 9 aa, Homo Sapiens
NIHTDPKET

SEQ ID NO: 133725 - protein, 9 aa, Homo Sapiens
IRHRHSEHR

SEQ ID NO: 133726 - protein, 9 aa, Homo Sapiens
SARRRQRER

SEQ ID NO: 133727 - protein, 9 aa, Homo Sapiens
SLFFCGAAN

SEQ ID NO: 133728 - protein, 9 aa, Homo Sapiens
VRHLGDQME

SEQ ID NO: 133729 - protein, 9 aa, Homo Sapiens
RTKKLWPMK

SEQ ID NO: 133730 - protein, 9 aa, Homo Sapiens
RAHNVTEKV

SEQ ID NO: 133731 - protein, 9 aa, Homo Sapiens
TETQPHVTV

SEQ ID NO: 133732 - protein, 9 aa, Homo Sapiens
WGLLAAVEY

SEQ ID NO: 133733 - protein, 9 aa, Homo Sapiens
EELETLFLP

SEQ ID NO: 133734 - protein, 9 aa, Homo Sapiens
AIPLTRWKP

SEQ ID NO: 133735 - protein, 9 aa, Homo Sapiens
LIKKLCRDK

SEQ ID NO: 133736 - protein, 9 aa, Homo Sapiens
FDNPATAFF

SEQ ID NO: 133737 - protein, 9 aa, Homo Sapiens
GRGKPLPEC

SEQ ID NO: 133738 - protein, 9 aa, Homo Sapiens
THSQQCANS

SEQ ID NO: 133739 - protein, 9 aa, Homo Sapiens
SLPHTSLVQ

SEQ ID NO: 133740 - protein, 9 aa, Homo Sapiens
DGEEWAIEV

SEQ ID NO: 133741 - protein, 9 aa, Homo Sapiens
DMKRIWQYV

SEQ ID NO: 133742 - protein, 9 aa, Homo Sapiens
SNSSCSCSS

SEQ ID NO: 133743 - protein, 9 aa, Homo Sapiens
PYISSRDHI

SEQ ID NO: 133744 - protein, 9 aa, Homo Sapiens
LISLPLVPD

SEQ ID NO: 133745 - protein, 9 aa, Homo Sapiens
AEQPKSMHV

SEQ ID NO: 133746 - protein, 9 aa, Homo Sapiens
DLKKAKDRM

SEQ ID NO: 133747 - protein, 9 aa, Homo Sapiens
PPQRPEGPG

SEQ ID NO: 133748 - protein, 9 aa, Homo Sapiens
HLAEPALSD

SEQ ID NO: 133749 - protein, 9 aa, Homo Sapiens
LGEILEQLE

SEQ ID NO: 133750 - protein, 9 aa, Homo Sapiens
VDFFGGCSD

SEQ ID NO: 133751 - protein, 9 aa, Homo Sapiens
CSRPSAPWP

SEQ ID NO: 133752 - protein, 9 aa, Homo Sapiens
AMRAARLPR

SEQ ID NO: 133753 - protein, 9 aa, Homo Sapiens
PSPKVGTKP

SEQ ID NO: 133754 - protein, 9 aa, Homo Sapiens
TVGERSWAR

SEQ ID NO: 133755 - protein, 9 aa, Homo Sapiens
WYTWLKNGD

SEQ ID NO: 133756 - protein, 9 aa, Homo Sapiens
KTSTVSPSL

SEQ ID NO: 133757 - protein, 9 aa, Homo Sapiens
NLHPPRMKD

SEQ ID NO: 133758 - protein, 9 aa, Homo Sapiens
VMAYRLIMP

SEQ ID NO: 133759 - protein, 9 aa, Homo Sapiens
AAAAGPDST

SEQ ID NO: 133760 - protein, 9 aa, Homo Sapiens
QRLEDELGG

SEQ ID NO: 133761 - protein, 9 aa, Homo Sapiens
HTNVCFGIF

SEQ ID NO: 133762 - protein, 9 aa, Homo Sapiens
FSCGHLYRS

SEQ ID NO: 133763 - protein, 9 aa, Homo Sapiens
RRWALLAPS

SEQ ID NO: 133764 - protein, 9 aa, Homo Sapiens
YHLPAPMGC

SEQ ID NO: 133765 - protein, 9 aa, Homo Sapiens
KVTLAHLDL

SEQ ID NO: 133766 - protein, 9 aa, Homo Sapiens
VAEVIRSQG

SEQ ID NO: 133767 - protein, 9 aa, Homo Sapiens
KKNDSMTYE

SEQ ID NO: 133768 - protein, 9 aa, Homo Sapiens
ARDATALTN

SEQ ID NO: 133769 - protein, 9 aa, Homo Sapiens
TFWKTDLKI

SEQ ID NO: 133770 - protein, 9 aa, Homo Sapiens
SNASLLAEV

SEQ ID NO: 133771 - protein, 9 aa, Homo Sapiens
IHLVLGCNE

SEQ ID NO: 133772 - protein, 9 aa, Homo Sapiens
SCAEALVAM

SEQ ID NO: 133773 - protein, 9 aa, Homo Sapiens
YFGVSYCKF

SEQ ID NO: 133774 - protein, 9 aa, Homo Sapiens
HVNEEQESK

SEQ ID NO: 133775 - protein, 9 aa, Homo Sapiens
MTEEPAVAI

SEQ ID NO: 133776 - protein, 9 aa, Homo Sapiens
YTYSLCPSR

SEQ ID NO: 133777 - protein, 9 aa, Homo Sapiens
PAKINEVVQ

SEQ ID NO: 133778 - protein, 9 aa, Homo Sapiens
KLILILRIS

SEQ ID NO: 133779 - protein, 9 aa, Homo Sapiens
AGDVGKSAL

SEQ ID NO: 133780 - protein, 9 aa, Homo Sapiens
TPSLAGPWA

SEQ ID NO: 133781 - protein, 9 aa, Homo Sapiens
SNATPNMLH

SEQ ID NO: 133782 - protein, 9 aa, Homo Sapiens
VYALKVEAS

SEQ ID NO: 133783 - protein, 9 aa, Homo Sapiens
AQGLQKRLH

SEQ ID NO: 133784 - protein, 9 aa, Homo Sapiens
IRKQHPWHP

SEQ ID NO: 133785 - protein, 9 aa, Homo Sapiens
SQSPPQRPE

SEQ ID NO: 133786 - protein, 9 aa, Homo Sapiens
VSLLFLFRM

SEQ ID NO: 133787 - protein, 9 aa, Homo Sapiens
SSPPIKNTH

SEQ ID NO: 133788 - protein, 9 aa, Homo Sapiens
LCGVIISPN

SEQ ID NO: 133789 - protein, 9 aa, Homo Sapiens
ATHHHSSEG

SEQ ID NO: 133790 - protein, 9 aa, Homo Sapiens
ANTSTPPSA

SEQ ID NO: 133791 - protein, 9 aa, Homo Sapiens
SLDYLARAA

SEQ ID NO: 133792 - protein, 9 aa, Homo Sapiens
YILVVPVLN

SEQ ID NO: 133793 - protein, 9 aa, Homo Sapiens
HSIAGGTSS

SEQ ID NO: 133794 - protein, 9 aa, Homo Sapiens
VSFFVKGMS

SEQ ID NO: 133795 - protein, 9 aa, Homo Sapiens
GITDSHQQY

SEQ ID NO: 133796 - protein, 9 aa, Homo Sapiens
ARPLPSLVI

SEQ ID NO: 133797 - protein, 9 aa, Homo Sapiens
DAWKVRLRL

SEQ ID NO: 133798 - protein, 9 aa, Homo Sapiens
GRRCRNGEN

SEQ ID NO: 133799 - protein, 9 aa, Homo Sapiens
LLPVYYRLS

SEQ ID NO: 133800 - protein, 9 aa, Homo Sapiens
NPPVTYPGL

SEQ ID NO: 133801 - protein, 9 aa, Homo Sapiens
AKHLIYEHI

SEQ ID NO: 133802 - protein, 9 aa, Homo Sapiens
WLALNDGLM

SEQ ID NO: 133803 - protein, 9 aa, Homo Sapiens
EERKMEKNR

SEQ ID NO: 133804 - protein, 9 aa, Homo Sapiens
PLPLKRRKR

SEQ ID NO: 133805 - protein, 9 aa, Homo Sapiens
SLSGFRVEF

SEQ ID NO: 133806 - protein, 9 aa, Homo Sapiens
LTYDYRLVS

SEQ ID NO: 133807 - protein, 9 aa, Homo Sapiens
KKRGKSQGG

SEQ ID NO: 133808 - protein, 9 aa, Homo Sapiens
PMDVRSAYK

SEQ ID NO: 133809 - protein, 9 aa, Homo Sapiens
LCTLIVFWK

SEQ ID NO: 133810 - protein, 9 aa, Homo Sapiens
APKLALCET

SEQ ID NO: 133811 - protein, 9 aa, Homo Sapiens
SPQMVNRIV

SEQ ID NO: 133812 - protein, 9 aa, Homo Sapiens
RQVITVHQI

SEQ ID NO: 133813 - protein, 9 aa, Homo Sapiens
ARKYFLWVV

SEQ ID NO: 133814 - protein, 9 aa, Homo Sapiens
GGHLHLQAK

SEQ ID NO: 133815 - protein, 9 aa, Homo Sapiens
SPQPMGPPP

SEQ ID NO: 133816 - protein, 9 aa, Homo Sapiens
QPRLDHVHR

SEQ ID NO: 133817 - protein, 9 aa, Homo Sapiens
KPPRLDACC

SEQ ID NO: 133818 - protein, 9 aa, Homo Sapiens
PCPQTPCWG

SEQ ID NO: 133819 - protein, 9 aa, Homo Sapiens
AFSHSSTLT

SEQ ID NO: 133820 - protein, 9 aa, Homo Sapiens
REKELTRHP

SEQ ID NO: 133821 - protein, 9 aa, Homo Sapiens
TLVHSSTGS

SEQ ID NO: 133822 - protein, 9 aa, Homo Sapiens
VWENLTFNS

SEQ ID NO: 133823 - protein, 9 aa, Homo Sapiens
HALNHHPLQ

SEQ ID NO: 133824 - protein, 9 aa, Homo Sapiens
GEIRHSAEA

SEQ ID NO: 133825 - protein, 9 aa, Homo Sapiens
ESDRPRKRQ

SEQ ID NO: 133826 - protein, 9 aa, Homo Sapiens
VVFSIEPAI

SEQ ID NO: 133827 - protein, 9 aa, Homo Sapiens
TPKRPRTAG

SEQ ID NO: 133828 - protein, 9 aa, Homo Sapiens
IPGFYSYMN

SEQ ID NO: 133829 - protein, 9 aa, Homo Sapiens
KKLCRDKPS

SEQ ID NO: 133830 - protein, 9 aa, Homo Sapiens
VVVDFFGGC

SEQ ID NO: 133831 - protein, 9 aa, Homo Sapiens
IKAKIKEVE

SEQ ID NO: 133832 - protein, 9 aa, Homo Sapiens
MANLAIIIT

SEQ ID NO: 133833 - protein, 9 aa, Homo Sapiens
CTGSRCAQV

SEQ ID NO: 133834 - protein, 9 aa, Homo Sapiens
RPRLNRWLS

SEQ ID NO: 133835 - protein, 9 aa, Homo Sapiens
MPNYQFVCQ

SEQ ID NO: 133836 - protein, 9 aa, Homo Sapiens
MTRNFPERE

SEQ ID NO: 133837 - protein, 9 aa, Homo Sapiens
SNYKACFSM

SEQ ID NO: 133838 - protein, 9 aa, Homo Sapiens
NVGRQYLVQ

SEQ ID NO: 133839 - protein, 9 aa, Homo Sapiens
LICPWRNLL

SEQ ID NO: 133840 - protein, 9 aa, Homo Sapiens
VRREDSAPS

SEQ ID NO: 133841 - protein, 9 aa, Homo Sapiens
RKKNDSMTY

SEQ ID NO: 133842 - protein, 9 aa, Homo Sapiens
HPETHPDPH

SEQ ID NO: 133843 - protein, 9 aa, Homo Sapiens
LVPDFPYPT

SEQ ID NO: 133844 - protein, 9 aa, Homo Sapiens
MSCMNKCWE

SEQ ID NO: 133845 - protein, 9 aa, Homo Sapiens
TGPALRRLY

SEQ ID NO: 133846 - protein, 9 aa, Homo Sapiens
IIDLSVGGQ

SEQ ID NO: 133847 - protein, 9 aa, Homo Sapiens
VKKDRGWGP

SEQ ID NO: 133848 - protein, 9 aa, Homo Sapiens
NIYAIYGLI

SEQ ID NO: 133849 - protein, 9 aa, Homo Sapiens
LLCKRYCST

SEQ ID NO: 133850 - protein, 9 aa, Homo Sapiens
CVGGFLHAT

SEQ ID NO: 133851 - protein, 9 aa, Homo Sapiens
PPLHRPTLS

SEQ ID NO: 133852 - protein, 9 aa, Homo Sapiens
AALNHLGAL

SEQ ID NO: 133853 - protein, 9 aa, Homo Sapiens
EKSVVLLVV

SEQ ID NO: 133854 - protein, 9 aa, Homo Sapiens
AEVCHQIFE

SEQ ID NO: 133855 - protein, 9 aa, Homo Sapiens
SREALWQRC

SEQ ID NO: 133856 - protein, 9 aa, Homo Sapiens
SQSPRSSCS

SEQ ID NO: 133857 - protein, 9 aa, Homo Sapiens
EEEEKMFGS

SEQ ID NO: 133858 - protein, 9 aa, Homo Sapiens
EPAVAIKAM

SEQ ID NO: 133859 - protein, 9 aa, Homo Sapiens
HCKDCKIRW

SEQ ID NO: 133860 - protein, 9 aa, Homo Sapiens
VRSPPPPAS

SEQ ID NO: 133861 - protein, 9 aa, Homo Sapiens
TSVSSILIT

SEQ ID NO: 133862 - protein, 9 aa, Homo Sapiens
AYFGISMDP

SEQ ID NO: 133863 - protein, 9 aa, Homo Sapiens
KSGGEREER

SEQ ID NO: 133864 - protein, 9 aa, Homo Sapiens
HFPDHREGH

SEQ ID NO: 133865 - protein, 9 aa, Homo Sapiens
VPSADKRKY

SEQ ID NO: 133866 - protein, 9 aa, Homo Sapiens
KLLGADAAY

SEQ ID NO: 133867 - protein, 9 aa, Homo Sapiens
PGRLCAPGA

SEQ ID NO: 133868 - protein, 9 aa, Homo Sapiens
KKLSINNYR

SEQ ID NO: 133869 - protein, 9 aa, Homo Sapiens
FYEKTVISS

SEQ ID NO: 133870 - protein, 9 aa, Homo Sapiens
AVNKIRLKI

SEQ ID NO: 133871 - protein, 9 aa, Homo Sapiens
QISGSVSCQ

SEQ ID NO: 133872 - protein, 9 aa, Homo Sapiens
KLKTTTKKI

SEQ ID NO: 133873 - protein, 9 aa, Homo Sapiens
SPSRKRRRG

SEQ ID NO: 133874 - protein, 9 aa, Homo Sapiens
KQTLENSHP

SEQ ID NO: 133875 - protein, 9 aa, Homo Sapiens
LCVVPIAQK

SEQ ID NO: 133876 - protein, 9 aa, Homo Sapiens
QDGHGRVIL

SEQ ID NO: 133877 - protein, 9 aa, Homo Sapiens
DTTEYFVCT

SEQ ID NO: 133878 - protein, 9 aa, Homo Sapiens
GSFPLYLEK

SEQ ID NO: 133879 - protein, 9 aa, Homo Sapiens
AARNLTSEE

SEQ ID NO: 133880 - protein, 9 aa, Homo Sapiens
QTNVVPMMH

SEQ ID NO: 133881 - protein, 9 aa, Homo Sapiens
KPFLSNSLS

SEQ ID NO: 133882 - protein, 9 aa, Homo Sapiens
HNLRLSVEE

SEQ ID NO: 133883 - protein, 9 aa, Homo Sapiens
RRNKNPSLL

SEQ ID NO: 133884 - protein, 9 aa, Homo Sapiens
GISSIRAGQ

SEQ ID NO: 133885 - protein, 9 aa, Homo Sapiens
CLIALLSRK

SEQ ID NO: 133886 - protein, 9 aa, Homo Sapiens
LEKDLLYAT

SEQ ID NO: 133887 - protein, 9 aa, Homo Sapiens
FFSDWFHHI

SEQ ID NO: 133888 - protein, 9 aa, Homo Sapiens
LLERPSEWP

SEQ ID NO: 133889 - protein, 9 aa, Homo Sapiens
THPKLKTTT

SEQ ID NO: 133890 - protein, 9 aa, Homo Sapiens
EPLTYDYRL

SEQ ID NO: 133891 - protein, 9 aa, Homo Sapiens
LKLHRRIHT

SEQ ID NO: 133892 - protein, 9 aa, Homo Sapiens
KLNTKHFLE

SEQ ID NO: 133893 - protein, 9 aa, Homo Sapiens
PDGQPQGEQ

SEQ ID NO: 133894 - protein, 9 aa, Homo Sapiens
STVSPSLRK

SEQ ID NO: 133895 - protein, 9 aa, Homo Sapiens
CRNLGKMAY

SEQ ID NO: 133896 - protein, 9 aa, Homo Sapiens
HLPMARRNA

SEQ ID NO: 133897 - protein, 9 aa, Homo Sapiens
VPVIKKPDA

SEQ ID NO: 133898 - protein, 9 aa, Homo Sapiens
PSYLSVSLP

SEQ ID NO: 133899 - protein, 9 aa, Homo Sapiens
FEKASVCHH

SEQ ID NO: 133900 - protein, 9 aa, Homo Sapiens
LFNNFIFNG

SEQ ID NO: 133901 - protein, 9 aa, Homo Sapiens
PGVPLAGWA

SEQ ID NO: 133902 - protein, 9 aa, Homo Sapiens
RQDPGLGLW

SEQ ID NO: 133903 - protein, 9 aa, Homo Sapiens
LQDGSLDRN

SEQ ID NO: 133904 - protein, 9 aa, Homo Sapiens
YTSLYLDSH

SEQ ID NO: 133905 - protein, 9 aa, Homo Sapiens
LGSDLGGPC

SEQ ID NO: 133906 - protein, 9 aa, Homo Sapiens
SGVQVRARR

SEQ ID NO: 133907 - protein, 9 aa, Homo Sapiens
SKLTYHQGV

SEQ ID NO: 133908 - protein, 9 aa, Homo Sapiens
TQRTSVHCL

SEQ ID NO: 133909 - protein, 9 aa, Homo Sapiens
GRVLRELKQ

SEQ ID NO: 133910 - protein, 9 aa, Homo Sapiens
HDVRLEDLD

SEQ ID NO: 133911 - protein, 9 aa, Homo Sapiens
PECCSSWLR

SEQ ID NO: 133912 - protein, 9 aa, Homo Sapiens
STTIHASRT

SEQ ID NO: 133913 - protein, 9 aa, Homo Sapiens
SRRNNETPE

SEQ ID NO: 133914 - protein, 9 aa, Homo Sapiens
DSEPVTSKV

SEQ ID NO: 133915 - protein, 9 aa, Homo Sapiens
DIIRSPTMA

SEQ ID NO: 133916 - protein, 9 aa, Homo Sapiens
CIFSFDNHC

SEQ ID NO: 133917 - protein, 9 aa, Homo Sapiens
SPSQGTLAQ

SEQ ID NO: 133918 - protein, 9 aa, Homo Sapiens
IDFYEKTVI

SEQ ID NO: 133919 - protein, 9 aa, Homo Sapiens
LAKEQAIVY

SEQ ID NO: 133920 - protein, 9 aa, Homo Sapiens
ITSISSMPS

SEQ ID NO: 133921 - protein, 9 aa, Homo Sapiens
STNSVEIIE

SEQ ID NO: 133922 - protein, 9 aa, Homo Sapiens
GSVSCQKQP

SEQ ID NO: 133923 - protein, 9 aa, Homo Sapiens
IQPGPIKPK

SEQ ID NO: 133924 - protein, 9 aa, Homo Sapiens
YARWWEAQA

SEQ ID NO: 133925 - protein, 9 aa, Homo Sapiens
SRKRRRGSS

SEQ ID NO: 133926 - protein, 9 aa, Homo Sapiens
DRRGGPGQA

SEQ ID NO: 133927 - protein, 9 aa, Homo Sapiens
EFMCVPAQK

SEQ ID NO: 133928 - protein, 9 aa, Homo Sapiens
AHRPLCQRF

SEQ ID NO: 133929 - protein, 9 aa, Homo Sapiens
VAHCRPAQN

SEQ ID NO: 133930 - protein, 9 aa, Homo Sapiens
GCHVPGSVS

SEQ ID NO: 133931 - protein, 9 aa, Homo Sapiens
ASKNKDLRR

SEQ ID NO: 133932 - protein, 9 aa, Homo Sapiens
RDRKQFSPI

SEQ ID NO: 133933 - protein, 9 aa, Homo Sapiens
YTVVAFIFF

SEQ ID NO: 133934 - protein, 9 aa, Homo Sapiens
ALQAACFQL

SEQ ID NO: 133935 - protein, 9 aa, Homo Sapiens
TMANLAIII

SEQ ID NO: 133936 - protein, 9 aa, Homo Sapiens
ITLASPEET

SEQ ID NO: 133937 - protein, 9 aa, Homo Sapiens
DESCLVIQH

SEQ ID NO: 133938 - protein, 9 aa, Homo Sapiens
DMVNSIKMP

SEQ ID NO: 133939 - protein, 9 aa, Homo Sapiens
DEWRFRLRD

SEQ ID NO: 133940 - protein, 9 aa, Homo Sapiens
PRGLGLSPD

SEQ ID NO: 133941 - protein, 9 aa, Homo Sapiens
ILKDSGYFR

SEQ ID NO: 133942 - protein, 9 aa, Homo Sapiens
CWPMMDFLC

SEQ ID NO: 133943 - protein, 9 aa, Homo Sapiens
WITVFATDQ

SEQ ID NO: 133944 - protein, 9 aa, Homo Sapiens
MTHTTKVNG

SEQ ID NO: 133945 - protein, 9 aa, Homo Sapiens
TTSNKCPKK

SEQ ID NO: 133946 - protein, 9 aa, Homo Sapiens
QVCSVLKQG

SEQ ID NO: 133947 - protein, 9 aa, Homo Sapiens
PKLFRPAEF

SEQ ID NO: 133948 - protein, 9 aa, Homo Sapiens
IISPNMSKR

SEQ ID NO: 133949 - protein, 9 aa, Homo Sapiens
APMHSHHRP

SEQ ID NO: 133950 - protein, 9 aa, Homo Sapiens
RLLVPDGDD

SEQ ID NO: 133951 - protein, 9 aa, Homo Sapiens
RVKIPRRTV

SEQ ID NO: 133952 - protein, 9 aa, Homo Sapiens
HSAFEVGAH

SEQ ID NO: 133953 - protein, 9 aa, Homo Sapiens
KPVWNNPRA

SEQ ID NO: 133954 - protein, 9 aa, Homo Sapiens
GAVALVHAV

SEQ ID NO: 133955 - protein, 9 aa, Homo Sapiens
PPTPPLPTA

SEQ ID NO: 133956 - protein, 9 aa, Homo Sapiens
MEATAHGLF

SEQ ID NO: 133957 - protein, 9 aa, Homo Sapiens
KILEISPKL

SEQ ID NO: 133958 - protein, 9 aa, Homo Sapiens
PKLARHASI

SEQ ID NO: 133959 - protein, 9 aa, Homo Sapiens
IPPIQTNVV

SEQ ID NO: 133960 - protein, 9 aa, Homo Sapiens
PMDIQASHV

SEQ ID NO: 133961 - protein, 9 aa, Homo Sapiens
SRGDTAVRE

SEQ ID NO: 133962 - protein, 9 aa, Homo Sapiens
KKDLESSRD

SEQ ID NO: 133963 - protein, 9 aa, Homo Sapiens
SSSSSNTDS

SEQ ID NO: 133964 - protein, 9 aa, Homo Sapiens
PGWAALQRL

SEQ ID NO: 133965 - protein, 9 aa, Homo Sapiens
LVNLQHLIA

SEQ ID NO: 133966 - protein, 9 aa, Homo Sapiens
HPWWKEHLT

SEQ ID NO: 133967 - protein, 9 aa, Homo Sapiens
HCHGLGTCM

SEQ ID NO: 133968 - protein, 9 aa, Homo Sapiens
RMCTARRGR

SEQ ID NO: 133969 - protein, 9 aa, Homo Sapiens
FNQRNRIDT

SEQ ID NO: 133970 - protein, 9 aa, Homo Sapiens
APVLVAVPH

SEQ ID NO: 133971 - protein, 9 aa, Homo Sapiens
PAIILFSRS

SEQ ID NO: 133972 - protein, 9 aa, Homo Sapiens
HLSVQCEGV

SEQ ID NO: 133973 - protein, 9 aa, Homo Sapiens
ILTEPRNVV

SEQ ID NO: 133974 - protein, 9 aa, Homo Sapiens
PSHLSQSLL

SEQ ID NO: 133975 - protein, 9 aa, Homo Sapiens
VFTQSSQLR

SEQ ID NO: 133976 - protein, 9 aa, Homo Sapiens
PASSRVQTL

SEQ ID NO: 133977 - protein, 9 aa, Homo Sapiens
QTPPTPKKI

SEQ ID NO: 133978 - protein, 9 aa, Homo Sapiens
ATGRASCPG

SEQ ID NO: 133979 - protein, 9 aa, Homo Sapiens
PEKNPSLAL

SEQ ID NO: 133980 - protein, 9 aa, Homo Sapiens
TAIEWIIEH

SEQ ID NO: 133981 - protein, 9 aa, Homo Sapiens
AAIGDRGPQ

SEQ ID NO: 133982 - protein, 9 aa, Homo Sapiens
CSSHSNSNT

SEQ ID NO: 133983 - protein, 9 aa, Homo Sapiens
DDELPASPA

SEQ ID NO: 133984 - protein, 9 aa, Homo Sapiens
EVSPSQGTL

SEQ ID NO: 133985 - protein, 9 aa, Homo Sapiens
SCPHGQAFQ

SEQ ID NO: 133986 - protein, 9 aa, Homo Sapiens
VGEDDSFLL

SEQ ID NO: 133987 - protein, 9 aa, Homo Sapiens
IETQHFREK

SEQ ID NO: 133988 - protein, 9 aa, Homo Sapiens
RSYTGAPQC

SEQ ID NO: 133989 - protein, 9 aa, Homo Sapiens
FRLESVLRA

SEQ ID NO: 133990 - protein, 9 aa, Homo Sapiens
IDPLAGEEG

SEQ ID NO: 133991 - protein, 9 aa, Homo Sapiens
LNTKHFLEE

SEQ ID NO: 133992 - protein, 9 aa, Homo Sapiens
RIQQLPMFQ

SEQ ID NO: 133993 - protein, 9 aa, Homo Sapiens
RSLFFCGAA

SEQ ID NO: 133994 - protein, 9 aa, Homo Sapiens
ENLPIIRNS

SEQ ID NO: 133995 - protein, 9 aa, Homo Sapiens
PEEVLKNIY

SEQ ID NO: 133996 - protein, 9 aa, Homo Sapiens
ASVVQVMTH

SEQ ID NO: 133997 - protein, 9 aa, Homo Sapiens
GVEGIRLPN

SEQ ID NO: 133998 - protein, 9 aa, Homo Sapiens
SGCHTPQIE

SEQ ID NO: 133999 - protein, 9 aa, Homo Sapiens
ASTLVHSST

SEQ ID NO: 134000 - protein, 9 aa, Homo Sapiens
TWTFLYHRM

SEQ ID NO: 134001 - protein, 9 aa, Homo Sapiens
NIPVDRPGR

SEQ ID NO: 134002 - protein, 9 aa, Homo Sapiens
RMHNIPVYN

SEQ ID NO: 134003 - protein, 9 aa, Homo Sapiens
KTRPLSTMA

SEQ ID NO: 134004 - protein, 9 aa, Homo Sapiens
YGLKQQEKQ

SEQ ID NO: 134005 - protein, 9 aa, Homo Sapiens
MPMPMPIPS

SEQ ID NO: 134006 - protein, 9 aa, Homo Sapiens
LCPFQDNFT

SEQ ID NO: 134007 - protein, 9 aa, Homo Sapiens
SLKSIDYVF

SEQ ID NO: 134008 - protein, 9 aa, Homo Sapiens
CGAHKYQAE

SEQ ID NO: 134009 - protein, 9 aa, Homo Sapiens
LQEVVKKPR

SEQ ID NO: 134010 - protein, 9 aa, Homo Sapiens
CSDEVTCQL

SEQ ID NO: 134011 - protein, 9 aa, Homo Sapiens
AQHVDAWVI

SEQ ID NO: 134012 - protein, 9 aa, Homo Sapiens
RNTHLVGKE

SEQ ID NO: 134013 - protein, 9 aa, Homo Sapiens
CDCSLGYSG

SEQ ID NO: 134014 - protein, 9 aa, Homo Sapiens
SSILCTLIV

SEQ ID NO: 134015 - protein, 9 aa, Homo Sapiens
EVQNILDVH

SEQ ID NO: 134016 - protein, 9 aa, Homo Sapiens
LVCLVILVT

SEQ ID NO: 134017 - protein, 9 aa, Homo Sapiens
TGVQPSAGY

SEQ ID NO: 134018 - protein, 9 aa, Homo Sapiens
KVHQENGFG

SEQ ID NO: 134019 - protein, 9 aa, Homo Sapiens
SLKLFPESR

SEQ ID NO: 134020 - protein, 9 aa, Homo Sapiens
PARSRGARR

SEQ ID NO: 134021 - protein, 9 aa, Homo Sapiens
QKSEPSHQN

SEQ ID NO: 134022 - protein, 9 aa, Homo Sapiens
DGKDLTTEI

SEQ ID NO: 134023 - protein, 9 aa, Homo Sapiens
PKDPRSSPR

SEQ ID NO: 134024 - protein, 9 aa, Homo Sapiens
TQRLAEYSP

SEQ ID NO: 134025 - protein, 9 aa, Homo Sapiens
MESVMAVDL

SEQ ID NO: 134026 - protein, 9 aa, Homo Sapiens
KIEASPIGS

SEQ ID NO: 134027 - protein, 9 aa, Homo Sapiens
GEEDLTIEV

SEQ ID NO: 134028 - protein, 9 aa, Homo Sapiens
VDLLGLLII

SEQ ID NO: 134029 - protein, 9 aa, Homo Sapiens
MNISKQPVS

SEQ ID NO: 134030 - protein, 9 aa, Homo Sapiens
PPKDPRSSP

SEQ ID NO: 134031 - protein, 9 aa, Homo Sapiens
SGGDCSPTR

SEQ ID NO: 134032 - protein, 9 aa, Homo Sapiens
KNKENQKEQ

SEQ ID NO: 134033 - protein, 9 aa, Homo Sapiens
CNEKTPWST

SEQ ID NO: 134034 - protein, 9 aa, Homo Sapiens
VQNREPESV

SEQ ID NO: 134035 - protein, 9 aa, Homo Sapiens
LLCWEALPG

SEQ ID NO: 134036 - protein, 9 aa, Homo Sapiens
KRSSITKPE

SEQ ID NO: 134037 - protein, 9 aa, Homo Sapiens
RLVNESNHL

SEQ ID NO: 134038 - protein, 9 aa, Homo Sapiens
LMAPLSPGA

SEQ ID NO: 134039 - protein, 9 aa, Homo Sapiens
RQGLLLAVS

SEQ ID NO: 134040 - protein, 9 aa, Homo Sapiens
TQRSCGSGT

SEQ ID NO: 134041 - protein, 9 aa, Homo Sapiens
LMNSCKPNH

SEQ ID NO: 134042 - protein, 9 aa, Homo Sapiens
PLACTSTNI

SEQ ID NO: 134043 - protein, 9 aa, Homo Sapiens
KHKRKPYRP

SEQ ID NO: 134044 - protein, 9 aa, Homo Sapiens
QPAAKVGYE

SEQ ID NO: 134045 - protein, 9 aa, Homo Sapiens
NYDQLIEIN

SEQ ID NO: 134046 - protein, 9 aa, Homo Sapiens
FLENWKRPQ

SEQ ID NO: 134047 - protein, 9 aa, Homo Sapiens
AMSSSLPKA

SEQ ID NO: 134048 - protein, 9 aa, Homo Sapiens
GRPWRQWEG

SEQ ID NO: 134049 - protein, 9 aa, Homo Sapiens
SNGTYWWMN

SEQ ID NO: 134050 - protein, 9 aa, Homo Sapiens
IGEKSFEYK

SEQ ID NO: 134051 - protein, 9 aa, Homo Sapiens
GSRRRSLGN

SEQ ID NO: 134052 - protein, 9 aa, Homo Sapiens
LLLAGAPPG

SEQ ID NO: 134053 - protein, 9 aa, Homo Sapiens
GIQKVLCAI

SEQ ID NO: 134054 - protein, 9 aa, Homo Sapiens
SKNKDLRRH

SEQ ID NO: 134055 - protein, 9 aa, Homo Sapiens
VAIAAGAGA

SEQ ID NO: 134056 - protein, 9 aa, Homo Sapiens
MPLHASLPP

SEQ ID NO: 134057 - protein, 9 aa, Homo Sapiens
MPTQQQRQV

SEQ ID NO: 134058 - protein, 9 aa, Homo Sapiens
KCIKPKENN

SEQ ID NO: 134059 - protein, 9 aa, Homo Sapiens
RERKLAGLG

SEQ ID NO: 134060 - protein, 9 aa, Homo Sapiens
DFFRDYFLE

SEQ ID NO: 134061 - protein, 9 aa, Homo Sapiens
SSVTASCAS

SEQ ID NO: 134062 - protein, 9 aa, Homo Sapiens
KEATPVKEK

SEQ ID NO: 134063 - protein, 9 aa, Homo Sapiens
EEPIQVKRD

SEQ ID NO: 134064 - protein, 9 aa, Homo Sapiens
RLPRKEENQ

SEQ ID NO: 134065 - protein, 9 aa, Homo Sapiens
RSSFIKDPS

SEQ ID NO: 134066 - protein, 9 aa, Homo Sapiens
YVTDKEFHA

SEQ ID NO: 134067 - protein, 9 aa, Homo Sapiens
LKNGDRLNP

SEQ ID NO: 134068 - protein, 9 aa, Homo Sapiens
LWTQPTLGC

SEQ ID NO: 134069 - protein, 9 aa, Homo Sapiens
GISMDPDDI

SEQ ID NO: 134070 - protein, 9 aa, Homo Sapiens
VLVAVPHST

SEQ ID NO: 134071 - protein, 9 aa, Homo Sapiens
VKRHYAFQT

SEQ ID NO: 134072 - protein, 9 aa, Homo Sapiens
HLYRSFCLQ

SEQ ID NO: 134073 - protein, 9 aa, Homo Sapiens
MCPFDVCNR

SEQ ID NO: 134074 - protein, 9 aa, Homo Sapiens
MEVLTQLAR

SEQ ID NO: 134075 - protein, 9 aa, Homo Sapiens
KPGEPAFRK

SEQ ID NO: 134076 - protein, 9 aa, Homo Sapiens
RASEPLPPN

SEQ ID NO: 134077 - protein, 9 aa, Homo Sapiens
TCQLQATAS

SEQ ID NO: 134078 - protein, 9 aa, Homo Sapiens
EGLPRLPHC

SEQ ID NO: 134079 - protein, 9 aa, Homo Sapiens
IAEMLRMYP

SEQ ID NO: 134080 - protein, 9 aa, Homo Sapiens
VKHVVNFDL

SEQ ID NO: 134081 - protein, 9 aa, Homo Sapiens
GPKQELCAQ

SEQ ID NO: 134082 - protein, 9 aa, Homo Sapiens
RSCISVATS

SEQ ID NO: 134083 - protein, 9 aa, Homo Sapiens
VLSSPNSNL

SEQ ID NO: 134084 - protein, 9 aa, Homo Sapiens
FSDQFFTVL

SEQ ID NO: 134085 - protein, 9 aa, Homo Sapiens
SSVEMLVDC

SEQ ID NO: 134086 - protein, 9 aa, Homo Sapiens
TGCFVAKDS

SEQ ID NO: 134087 - protein, 9 aa, Homo Sapiens
QPNGSLFYY

SEQ ID NO: 134088 - protein, 9 aa, Homo Sapiens
PAPGDLQPP

SEQ ID NO: 134089 - protein, 9 aa, Homo Sapiens
PRLNRWLSL

SEQ ID NO: 134090 - protein, 9 aa, Homo Sapiens
AGMRELCQG

SEQ ID NO: 134091 - protein, 9 aa, Homo Sapiens
DVVTTLKKI

SEQ ID NO: 134092 - protein, 9 aa, Homo Sapiens
PFSENQTSL

SEQ ID NO: 134093 - protein, 9 aa, Homo Sapiens
HEFGHTLGL

SEQ ID NO: 134094 - protein, 9 aa, Homo Sapiens
LLIITLNCN

SEQ ID NO: 134095 - protein, 9 aa, Homo Sapiens
YRAPIRGKK

SEQ ID NO: 134096 - protein, 9 aa, Homo Sapiens
GGVEPAFHK

SEQ ID NO: 134097 - protein, 9 aa, Homo Sapiens
AYCSLSFPG

SEQ ID NO: 134098 - protein, 9 aa, Homo Sapiens
IPSANTPFS

SEQ ID NO: 134099 - protein, 9 aa, Homo Sapiens
GQKGSVDRH

SEQ ID NO: 134100 - protein, 9 aa, Homo Sapiens
GWTAIEWII

SEQ ID NO: 134101 - protein, 9 aa, Homo Sapiens
APHPSDLRE

SEQ ID NO: 134102 - protein, 9 aa, Homo Sapiens
SPNSNLSSM

SEQ ID NO: 134103 - protein, 9 aa, Homo Sapiens
NSPQGTLYS

SEQ ID NO: 134104 - protein, 9 aa, Homo Sapiens
QVSLGEEFF

SEQ ID NO: 134105 - protein, 9 aa, Homo Sapiens
IGACKAKYN

SEQ ID NO: 134106 - protein, 9 aa, Homo Sapiens
SIIRDYLED

SEQ ID NO: 134107 - protein, 9 aa, Homo Sapiens
FTYISILEM

SEQ ID NO: 134108 - protein, 9 aa, Homo Sapiens
ATILKCARD

SEQ ID NO: 134109 - protein, 9 aa, Homo Sapiens
QLDKVNQWC

SEQ ID NO: 134110 - protein, 9 aa, Homo Sapiens
AVGTRIPFR

SEQ ID NO: 134111 - protein, 9 aa, Homo Sapiens
LRPGPSGRL

SEQ ID NO: 134112 - protein, 9 aa, Homo Sapiens
SKSNGRGGN

SEQ ID NO: 134113 - protein, 9 aa, Homo Sapiens
NSESSTVSN

SEQ ID NO: 134114 - protein, 9 aa, Homo Sapiens
RDIRRCYPY

SEQ ID NO: 134115 - protein, 9 aa, Homo Sapiens
FTSDHHCQS

SEQ ID NO: 134116 - protein, 9 aa, Homo Sapiens
VSSQPLLDR

SEQ ID NO: 134117 - protein, 9 aa, Homo Sapiens
RKTEATGSG

SEQ ID NO: 134118 - protein, 9 aa, Homo Sapiens
MAVSAQVEA

SEQ ID NO: 134119 - protein, 9 aa, Homo Sapiens
EKEMSLQKT

SEQ ID NO: 134120 - protein, 9 aa, Homo Sapiens
VITRSGGGG

SEQ ID NO: 134121 - protein, 9 aa, Homo Sapiens
EVVAPEEQN

SEQ ID NO: 134122 - protein, 9 aa, Homo Sapiens
HRQVHYPFH

SEQ ID NO: 134123 - protein, 9 aa, Homo Sapiens
LLPGFPSSL

SEQ ID NO: 134124 - protein, 9 aa, Homo Sapiens
RGSFLMGPE

SEQ ID NO: 134125 - protein, 9 aa, Homo Sapiens
VCQTALNDG

SEQ ID NO: 134126 - protein, 9 aa, Homo Sapiens
LSVDGEEWA

SEQ ID NO: 134127 - protein, 9 aa, Homo Sapiens
RAWEEGLDR

SEQ ID NO: 134128 - protein, 9 aa, Homo Sapiens
GREERREVW

SEQ ID NO: 134129 - protein, 9 aa, Homo Sapiens
WRATRPFHD

SEQ ID NO: 134130 - protein, 9 aa, Homo Sapiens
LYDYISEWQ

SEQ ID NO: 134131 - protein, 9 aa, Homo Sapiens
DTTENETTE

SEQ ID NO: 134132 - protein, 9 aa, Homo Sapiens
FFFLFNNFI

SEQ ID NO: 134133 - protein, 9 aa, Homo Sapiens
ISGILGVTS

SEQ ID NO: 134134 - protein, 9 aa, Homo Sapiens
MVIAEMLRM

SEQ ID NO: 134135 - protein, 9 aa, Homo Sapiens
VSQLLGGCS

SEQ ID NO: 134136 - protein, 9 aa, Homo Sapiens
KKAQLHFAA

SEQ ID NO: 134137 - protein, 9 aa, Homo Sapiens
KFHTEDLLR

SEQ ID NO: 134138 - protein, 9 aa, Homo Sapiens
SRMCTARRG

SEQ ID NO: 134139 - protein, 9 aa, Homo Sapiens
ERPKTCGYH

SEQ ID NO: 134140 - protein, 9 aa, Homo Sapiens
WVQSLDLPS

SEQ ID NO: 134141 - protein, 9 aa, Homo Sapiens
IAFTTQRSC

SEQ ID NO: 134142 - protein, 9 aa, Homo Sapiens
ASEAAAGAN

SEQ ID NO: 134143 - protein, 9 aa, Homo Sapiens
DYHDHGLLH

SEQ ID NO: 134144 - protein, 9 aa, Homo Sapiens
QREDLQAVV

SEQ ID NO: 134145 - protein, 9 aa, Homo Sapiens
WRQLIPCKP

SEQ ID NO: 134146 - protein, 9 aa, Homo Sapiens
DQQDCLQHR

SEQ ID NO: 134147 - protein, 9 aa, Homo Sapiens
EALPLCWHG

SEQ ID NO: 134148 - protein, 9 aa, Homo Sapiens
GAVILKRVK

SEQ ID NO: 134149 - protein, 9 aa, Homo Sapiens
HSPSLLRAG

SEQ ID NO: 134150 - protein, 9 aa, Homo Sapiens
TQVKNLMNV

SEQ ID NO: 134151 - protein, 9 aa, Homo Sapiens
GKPSHLSQS

SEQ ID NO: 134152 - protein, 9 aa, Homo Sapiens
RLCLALIAG

SEQ ID NO: 134153 - protein, 9 aa, Homo Sapiens
EVMRKPRRG

SEQ ID NO: 134154 - protein, 9 aa, Homo Sapiens
VLKQAHPDT

SEQ ID NO: 134155 - protein, 9 aa, Homo Sapiens
VYATPLALS

SEQ ID NO: 134156 - protein, 9 aa, Homo Sapiens
TSFAAPPRS

SEQ ID NO: 134157 - protein, 9 aa, Homo Sapiens
ISSRDHIWI

SEQ ID NO: 134158 - protein, 9 aa, Homo Sapiens
TPSCCRRWA

SEQ ID NO: 134159 - protein, 9 aa, Homo Sapiens
DLQAVVEKV

SEQ ID NO: 134160 - protein, 9 aa, Homo Sapiens
HRQGQDEST

SEQ ID NO: 134161 - protein, 9 aa, Homo Sapiens
SSGGDCSPT

SEQ ID NO: 134162 - protein, 9 aa, Homo Sapiens
HYTHHNLSQ

SEQ ID NO: 134163 - protein, 9 aa, Homo Sapiens
AQRSRELLR

SEQ ID NO: 134164 - protein, 9 aa, Homo Sapiens
LKFPLSSGA

SEQ ID NO: 134165 - protein, 9 aa, Homo Sapiens
LCLQVARFL

SEQ ID NO: 134166 - protein, 9 aa, Homo Sapiens
QRSTQTQTS

SEQ ID NO: 134167 - protein, 9 aa, Homo Sapiens
ETQPHVTVR

SEQ ID NO: 134168 - protein, 9 aa, Homo Sapiens
MLAANRAGL

SEQ ID NO: 134169 - protein, 9 aa, Homo Sapiens
GLRMRRCPG

SEQ ID NO: 134170 - protein, 9 aa, Homo Sapiens
TLAHLDLLD

SEQ ID NO: 134171 - protein, 9 aa, Homo Sapiens
YNFSNYKAC

SEQ ID NO: 134172 - protein, 9 aa, Homo Sapiens
QHLFRVASK

SEQ ID NO: 134173 - protein, 9 aa, Homo Sapiens
TYDYRLVSA

SEQ ID NO: 134174 - protein, 9 aa, Homo Sapiens
GAHAAGPAA

SEQ ID NO: 134175 - protein, 9 aa, Homo Sapiens
WAQYRQVEA

SEQ ID NO: 134176 - protein, 9 aa, Homo Sapiens
HRPPVLPPP

SEQ ID NO: 134177 - protein, 9 aa, Homo Sapiens
CSSKSSASS

SEQ ID NO: 134178 - protein, 9 aa, Homo Sapiens
LLYLLRLWR

SEQ ID NO: 134179 - protein, 9 aa, Homo Sapiens
AGKKCKPID

SEQ ID NO: 134180 - protein, 9 aa, Homo Sapiens
LPRLPHCQL

SEQ ID NO: 134181 - protein, 9 aa, Homo Sapiens
CKDAGRAKD

SEQ ID NO: 134182 - protein, 9 aa, Homo Sapiens
DFTAASGIS

SEQ ID NO: 134183 - protein, 9 aa, Homo Sapiens
TTYRVCMLA

SEQ ID NO: 134184 - protein, 9 aa, Homo Sapiens
TNVVPMMHS

SEQ ID NO: 134185 - protein, 9 aa, Homo Sapiens
KHEESSWGG

SEQ ID NO: 134186 - protein, 9 aa, Homo Sapiens
ISAHYNFSL

SEQ ID NO: 134187 - protein, 9 aa, Homo Sapiens
LGAAAVFSA

SEQ ID NO: 134188 - protein, 9 aa, Homo Sapiens
VWNNPRAVC

SEQ ID NO: 134189 - protein, 9 aa, Homo Sapiens
CTDTESASG

SEQ ID NO: 134190 - protein, 9 aa, Homo Sapiens
KLWALSQCQ

SEQ ID NO: 134191 - protein, 9 aa, Homo Sapiens
SMPSSGTST

SEQ ID NO: 134192 - protein, 9 aa, Homo Sapiens
AGANATDEE

SEQ ID NO: 134193 - protein, 9 aa, Homo Sapiens
AGILEKDLL

SEQ ID NO: 134194 - protein, 9 aa, Homo Sapiens
RCVPSLGSS

SEQ ID NO: 134195 - protein, 9 aa, Homo Sapiens
AAPPHVDEE

SEQ ID NO: 134196 - protein, 9 aa, Homo Sapiens
AELGARAKG

SEQ ID NO: 134197 - protein, 9 aa, Homo Sapiens
NTKHFLEES

SEQ ID NO: 134198 - protein, 9 aa, Homo Sapiens
QLELLDLMF

SEQ ID NO: 134199 - protein, 9 aa, Homo Sapiens
YYLYMKCVH

SEQ ID NO: 134200 - protein, 9 aa, Homo Sapiens
FMCVPAQKI

SEQ ID NO: 134201 - protein, 9 aa, Homo Sapiens
AGSLDSRVV

SEQ ID NO: 134202 - protein, 9 aa, Homo Sapiens
TPKLARHAS

SEQ ID NO: 134203 - protein, 9 aa, Homo Sapiens
LLQQPVIST

SEQ ID NO: 134204 - protein, 9 aa, Homo Sapiens
ILRNTHTFE

SEQ ID NO: 134205 - protein, 9 aa, Homo Sapiens
QQAMEKAAW

SEQ ID NO: 134206 - protein, 9 aa, Homo Sapiens
PDSTPAEPR

SEQ ID NO: 134207 - protein, 9 aa, Homo Sapiens
PRSVVIQQP

SEQ ID NO: 134208 - protein, 9 aa, Homo Sapiens
YRGGQRCRC

SEQ ID NO: 134209 - protein, 9 aa, Homo Sapiens
PQELSQLQP

SEQ ID NO: 134210 - protein, 9 aa, Homo Sapiens
GLQLLLNYF

SEQ ID NO: 134211 - protein, 9 aa, Homo Sapiens
QRFLRRHVH

SEQ ID NO: 134212 - protein, 9 aa, Homo Sapiens
ACGSRGAPH

SEQ ID NO: 134213 - protein, 9 aa, Homo Sapiens
IMILTEHLA

SEQ ID NO: 134214 - protein, 9 aa, Homo Sapiens
LGARAKGFP

SEQ ID NO: 134215 - protein, 9 aa, Homo Sapiens
HVRRAALAA

SEQ ID NO: 134216 - protein, 9 aa, Homo Sapiens
LVILVTLVN

SEQ ID NO: 134217 - protein, 9 aa, Homo Sapiens
AGTGLYVRP

SEQ ID NO: 134218 - protein, 9 aa, Homo Sapiens
TFKMNEDAQ

SEQ ID NO: 134219 - protein, 9 aa, Homo Sapiens
TQSTPWMTG

SEQ ID NO: 134220 - protein, 9 aa, Homo Sapiens
SCKKEFEVN

SEQ ID NO: 134221 - protein, 9 aa, Homo Sapiens
LRALVDYAS

SEQ ID NO: 134222 - protein, 9 aa, Homo Sapiens
EVINRNLLN

SEQ ID NO: 134223 - protein, 9 aa, Homo Sapiens
TCPPTSCPS

SEQ ID NO: 134224 - protein, 9 aa, Homo Sapiens
SVAHCRPAQ

SEQ ID NO: 134225 - protein, 9 aa, Homo Sapiens
PIHGQHEVH

SEQ ID NO: 134226 - protein, 9 aa, Homo Sapiens
LQTRMNDLP

SEQ ID NO: 134227 - protein, 9 aa, Homo Sapiens
NLLSNGTYW

SEQ ID NO: 134228 - protein, 9 aa, Homo Sapiens
LSPLPPGGK

SEQ ID NO: 134229 - protein, 9 aa, Homo Sapiens
VGAHKVVSC

SEQ ID NO: 134230 - protein, 9 aa, Homo Sapiens
AFDAPPPTP

SEQ ID NO: 134231 - protein, 9 aa, Homo Sapiens
GVASDLRET

SEQ ID NO: 134232 - protein, 9 aa, Homo Sapiens
VFLTSLKFP

SEQ ID NO: 134233 - protein, 9 aa, Homo Sapiens
LEWERRRTQ

SEQ ID NO: 134234 - protein, 9 aa, Homo Sapiens
MEGVDLLGL

SEQ ID NO: 134235 - protein, 9 aa, Homo Sapiens
AEEKSVVLL

SEQ ID NO: 134236 - protein, 9 aa, Homo Sapiens
SSCSRPSAP

SEQ ID NO: 134237 - protein, 9 aa, Homo Sapiens
VVIPQYQAL

SEQ ID NO: 134238 - protein, 9 aa, Homo Sapiens
PQKIHNQTT

SEQ ID NO: 134239 - protein, 9 aa, Homo Sapiens
VKLSKKNQE

SEQ ID NO: 134240 - protein, 9 aa, Homo Sapiens
SPTMYQVQS

SEQ ID NO: 134241 - protein, 9 aa, Homo Sapiens
YPENFFLLC

SEQ ID NO: 134242 - protein, 9 aa, Homo Sapiens
QCCRHQDSP

SEQ ID NO: 134243 - protein, 9 aa, Homo Sapiens
ISYIEVDSP

SEQ ID NO: 134244 - protein, 9 aa, Homo Sapiens
DPAGPLGAP

SEQ ID NO: 134245 - protein, 9 aa, Homo Sapiens
HHPLQRSWR

SEQ ID NO: 134246 - protein, 9 aa, Homo Sapiens
LRLACDFLV

SEQ ID NO: 134247 - protein, 9 aa, Homo Sapiens
THKKLYHHK

SEQ ID NO: 134248 - protein, 9 aa, Homo Sapiens
ALWLVWELL

SEQ ID NO: 134249 - protein, 9 aa, Homo Sapiens
AGDLDAAIG

SEQ ID NO: 134250 - protein, 9 aa, Homo Sapiens
HEDGPTAKN

SEQ ID NO: 134251 - protein, 9 aa, Homo Sapiens
GGGQCCRHQ

SEQ ID NO: 134252 - protein, 9 aa, Homo Sapiens
MTLPYPQFE

SEQ ID NO: 134253 - protein, 9 aa, Homo Sapiens
AVIFSTLGE

SEQ ID NO: 134254 - protein, 9 aa, Homo Sapiens
PHLRPANMY

SEQ ID NO: 134255 - protein, 9 aa, Homo Sapiens
YNKEAHLTS

SEQ ID NO: 134256 - protein, 9 aa, Homo Sapiens
YEHIFAGIL

SEQ ID NO: 134257 - protein, 9 aa, Homo Sapiens
YHRMTQNPN

SEQ ID NO: 134258 - protein, 9 aa, Homo Sapiens
EAIYDICRH

SEQ ID NO: 134259 - protein, 9 aa, Homo Sapiens
RKKREKIIN

SEQ ID NO: 134260 - protein, 9 aa, Homo Sapiens
RPPIPHRHP

SEQ ID NO: 134261 - protein, 9 aa, Homo Sapiens
QIKFYRMKH

SEQ ID NO: 134262 - protein, 9 aa, Homo Sapiens
TSTSCSTMS

SEQ ID NO: 134263 - protein, 9 aa, Homo Sapiens
FRHLAQEGR

SEQ ID NO: 134264 - protein, 9 aa, Homo Sapiens
APTPCTDTE

SEQ ID NO: 134265 - protein, 9 aa, Homo Sapiens
CFVVDLAVN

SEQ ID NO: 134266 - protein, 9 aa, Homo Sapiens
AACTYRISM

SEQ ID NO: 134267 - protein, 9 aa, Homo Sapiens
RSVAHCRPA

SEQ ID NO: 134268 - protein, 9 aa, Homo Sapiens
PYYSTSQPN

SEQ ID NO: 134269 - protein, 9 aa, Homo Sapiens
KYQEGGVEP

SEQ ID NO: 134270 - protein, 9 aa, Homo Sapiens
SLLCSHLGE

SEQ ID NO: 134271 - protein, 9 aa, Homo Sapiens
HVCYGMTLD

SEQ ID NO: 134272 - protein, 9 aa, Homo Sapiens
RKRLWPASR

SEQ ID NO: 134273 - protein, 9 aa, Homo Sapiens
TLYSQDVLM

SEQ ID NO: 134274 - protein, 9 aa, Homo Sapiens
GGPQRPLQI

SEQ ID NO: 134275 - protein, 9 aa, Homo Sapiens
PGFYSYMNL

SEQ ID NO: 134276 - protein, 9 aa, Homo Sapiens
DVLCEILSG

SEQ ID NO: 134277 - protein, 9 aa, Homo Sapiens
LEYTKGFVW

SEQ ID NO: 134278 - protein, 9 aa, Homo Sapiens
TCGKPTQRV

SEQ ID NO: 134279 - protein, 9 aa, Homo Sapiens
EATPVKEKH

SEQ ID NO: 134280 - protein, 9 aa, Homo Sapiens
VGVEDGDGL

SEQ ID NO: 134281 - protein, 9 aa, Homo Sapiens
DEEATNNGY

SEQ ID NO: 134282 - protein, 9 aa, Homo Sapiens
TIQHFCTQY

SEQ ID NO: 134283 - protein, 9 aa, Homo Sapiens
LSQVVRKTS

SEQ ID NO: 134284 - protein, 9 aa, Homo Sapiens
SEPLPPNSS

SEQ ID NO: 134285 - protein, 9 aa, Homo Sapiens
PLAQHVDAW

SEQ ID NO: 134286 - protein, 9 aa, Homo Sapiens
NSHPNPFLT

SEQ ID NO: 134287 - protein, 9 aa, Homo Sapiens
IAYYGLKSP

SEQ ID NO: 134288 - protein, 9 aa, Homo Sapiens
VPHTETPSA

SEQ ID NO: 134289 - protein, 9 aa, Homo Sapiens
LSQLQPFLK

SEQ ID NO: 134290 - protein, 9 aa, Homo Sapiens
GQYIHCHAK

SEQ ID NO: 134291 - protein, 9 aa, Homo Sapiens
SRIAGLCNC

SEQ ID NO: 134292 - protein, 9 aa, Homo Sapiens
SSNTSSGSM

SEQ ID NO: 134293 - protein, 9 aa, Homo Sapiens
LARCETDGT

SEQ ID NO: 134294 - protein, 9 aa, Homo Sapiens
RMIQKTRKQ

SEQ ID NO: 134295 - protein, 9 aa, Homo Sapiens
HDEHYLLPT

SEQ ID NO: 134296 - protein, 9 aa, Homo Sapiens
KVEKQLGLC

SEQ ID NO: 134297 - protein, 9 aa, Homo Sapiens
EAQKMQSGK

SEQ ID NO: 134298 - protein, 9 aa, Homo Sapiens
YRIRQSKIF

SEQ ID NO: 134299 - protein, 9 aa, Homo Sapiens
HRAAPATVR

SEQ ID NO: 134300 - protein, 9 aa, Homo Sapiens
TPPESIPNK

SEQ ID NO: 134301 - protein, 9 aa, Homo Sapiens
QGRSPMNAM

SEQ ID NO: 134302 - protein, 9 aa, Homo Sapiens
QLCGRCRGA

SEQ ID NO: 134303 - protein, 9 aa, Homo Sapiens
SRDHLLPRP

SEQ ID NO: 134304 - protein, 9 aa, Homo Sapiens
IVKLQESAH

SEQ ID NO: 134305 - protein, 9 aa, Homo Sapiens
GRVQPAAKV

SEQ ID NO: 134306 - protein, 9 aa, Homo Sapiens
AIFPLVYAT

SEQ ID NO: 134307 - protein, 9 aa, Homo Sapiens
VQFEISTTS

SEQ ID NO: 134308 - protein, 9 aa, Homo Sapiens
RGLGLGRWG

SEQ ID NO: 134309 - protein, 9 aa, Homo Sapiens
VLQVGALAR

SEQ ID NO: 134310 - protein, 9 aa, Homo Sapiens
SKVSPSTES

SEQ ID NO: 134311 - protein, 9 aa, Homo Sapiens
ALCIPLLIT

SEQ ID NO: 134312 - protein, 9 aa, Homo Sapiens
MLLVLRNIS

SEQ ID NO: 134313 - protein, 9 aa, Homo Sapiens
LQPFLKIRI

SEQ ID NO: 134314 - protein, 9 aa, Homo Sapiens
VPKKTGPPV

SEQ ID NO: 134315 - protein, 9 aa, Homo Sapiens
VTPRAIGLS

SEQ ID NO: 134316 - protein, 9 aa, Homo Sapiens
QKNTDVVTT

SEQ ID NO: 134317 - protein, 9 aa, Homo Sapiens
RPSAPWPSY

SEQ ID NO: 134318 - protein, 9 aa, Homo Sapiens
KEVVVDTDK

SEQ ID NO: 134319 - protein, 9 aa, Homo Sapiens
RCWNTERDQ

SEQ ID NO: 134320 - protein, 9 aa, Homo Sapiens
IQKVLCAIQ

SEQ ID NO: 134321 - protein, 9 aa, Homo Sapiens
VARDEDDPG

SEQ ID NO: 134322 - protein, 9 aa, Homo Sapiens
WPGWCLVRT

SEQ ID NO: 134323 - protein, 9 aa, Homo Sapiens
EGGSEEEEE

SEQ ID NO: 134324 - protein, 9 aa, Homo Sapiens
VWYRAVGDS

SEQ ID NO: 134325 - protein, 9 aa, Homo Sapiens
EKFTHFGAV

SEQ ID NO: 134326 - protein, 9 aa, Homo Sapiens
VDFTAASGI

SEQ ID NO: 134327 - protein, 9 aa, Homo Sapiens
INQSIPKRP

SEQ ID NO: 134328 - protein, 9 aa, Homo Sapiens
RCRWCSSWR

SEQ ID NO: 134329 - protein, 9 aa, Homo Sapiens
VAFETALQI

SEQ ID NO: 134330 - protein, 9 aa, Homo Sapiens
EPQHPVFPE

SEQ ID NO: 134331 - protein, 9 aa, Homo Sapiens
ATALTNRSV

SEQ ID NO: 134332 - protein, 9 aa, Homo Sapiens
ERNDKVFLP

SEQ ID NO: 134333 - protein, 9 aa, Homo Sapiens
KPSHLSQSL

SEQ ID NO: 134334 - protein, 9 aa, Homo Sapiens
FSTITLIKL

SEQ ID NO: 134335 - protein, 9 aa, Homo Sapiens
LEFSPDVRS

SEQ ID NO: 134336 - protein, 9 aa, Homo Sapiens
DEPPRMGEL

SEQ ID NO: 134337 - protein, 9 aa, Homo Sapiens
SWNSKAAAV

SEQ ID NO: 134338 - protein, 9 aa, Homo Sapiens
TTPQYRGVR

SEQ ID NO: 134339 - protein, 9 aa, Homo Sapiens
CEPVFQNGK

SEQ ID NO: 134340 - protein, 9 aa, Homo Sapiens
GPTHKKLYH

SEQ ID NO: 134341 - protein, 9 aa, Homo Sapiens
KWNSTFSPI

SEQ ID NO: 134342 - protein, 9 aa, Homo Sapiens
AAPVTAAND

SEQ ID NO: 134343 - protein, 9 aa, Homo Sapiens
CSRRPPSAA

SEQ ID NO: 134344 - protein, 9 aa, Homo Sapiens
TSVHVFRKA

SEQ ID NO: 134345 - protein, 9 aa, Homo Sapiens
AKGGPLSPC

SEQ ID NO: 134346 - protein, 9 aa, Homo Sapiens
GRRRPALRL

SEQ ID NO: 134347 - protein, 9 aa, Homo Sapiens
QNILDVHTG

SEQ ID NO: 134348 - protein, 9 aa, Homo Sapiens
DSHKLPMID

SEQ ID NO: 134349 - protein, 9 aa, Homo Sapiens
QCTEPEDQL

SEQ ID NO: 134350 - protein, 9 aa, Homo Sapiens
PNMSKRTRI

SEQ ID NO: 134351 - protein, 9 aa, Homo Sapiens
LTQLARAFT

SEQ ID NO: 134352 - protein, 9 aa, Homo Sapiens
CPEEPLECE

SEQ ID NO: 134353 - protein, 9 aa, Homo Sapiens
LDESCLVIQ

SEQ ID NO: 134354 - protein, 9 aa, Homo Sapiens
MIGSFSVRL

SEQ ID NO: 134355 - protein, 9 aa, Homo Sapiens
VSTVQNILE

SEQ ID NO: 134356 - protein, 9 aa, Homo Sapiens
ALLSRKQTW

SEQ ID NO: 134357 - protein, 9 aa, Homo Sapiens
LGILFSKPN

SEQ ID NO: 134358 - protein, 9 aa, Homo Sapiens
HGQAFQVVG

SEQ ID NO: 134359 - protein, 9 aa, Homo Sapiens
YTLLLTLAR

SEQ ID NO: 134360 - protein, 9 aa, Homo Sapiens
QVEARFLPK

SEQ ID NO: 134361 - protein, 9 aa, Homo Sapiens
DVFRSVMAP

SEQ ID NO: 134362 - protein, 9 aa, Homo Sapiens
HTGVGSGLQ

SEQ ID NO: 134363 - protein, 9 aa, Homo Sapiens
VITASSANL

SEQ ID NO: 134364 - protein, 9 aa, Homo Sapiens
GLGTCMWPD

SEQ ID NO: 134365 - protein, 9 aa, Homo Sapiens
TLVQMADGN

SEQ ID NO: 134366 - protein, 9 aa, Homo Sapiens
QWLTQQPEC

SEQ ID NO: 134367 - protein, 9 aa, Homo Sapiens
LSDFYVIHQ

SEQ ID NO: 134368 - protein, 9 aa, Homo Sapiens
AFAPTCIEQ

SEQ ID NO: 134369 - protein, 9 aa, Homo Sapiens
CRRRRCCRQ

SEQ ID NO: 134370 - protein, 9 aa, Homo Sapiens
TAANDSDSE

SEQ ID NO: 134371 - protein, 9 aa, Homo Sapiens
VHVHIKNSR

SEQ ID NO: 134372 - protein, 9 aa, Homo Sapiens
SLMIMKFVT

SEQ ID NO: 134373 - protein, 9 aa, Homo Sapiens
VPLDEITVI

SEQ ID NO: 134374 - protein, 9 aa, Homo Sapiens
LEKEEDEQL

SEQ ID NO: 134375 - protein, 9 aa, Homo Sapiens
RTLFLGITD

SEQ ID NO: 134376 - protein, 9 aa, Homo Sapiens
VLLVMDTAE

SEQ ID NO: 134377 - protein, 9 aa, Homo Sapiens
HICFVVDLA

SEQ ID NO: 134378 - protein, 9 aa, Homo Sapiens
PSQRGAATQ

SEQ ID NO: 134379 - protein, 9 aa, Homo Sapiens
FGENEVADR

SEQ ID NO: 134380 - protein, 9 aa, Homo Sapiens
VHYPFHCSH

SEQ ID NO: 134381 - protein, 9 aa, Homo Sapiens
CNIDAFEEV

SEQ ID NO: 134382 - protein, 9 aa, Homo Sapiens
GVPGRLCAP

SEQ ID NO: 134383 - protein, 9 aa, Homo Sapiens
DHFDSRKRR

SEQ ID NO: 134384 - protein, 9 aa, Homo Sapiens
SSSTLVSQQ

SEQ ID NO: 134385 - protein, 9 aa, Homo Sapiens
PCNHRYLFY

SEQ ID NO: 134386 - protein, 9 aa, Homo Sapiens
WCRSHSHQD

SEQ ID NO: 134387 - protein, 9 aa, Homo Sapiens
SSNSSCSCS

SEQ ID NO: 134388 - protein, 9 aa, Homo Sapiens
MSKRTRIKK

SEQ ID NO: 134389 - protein, 9 aa, Homo Sapiens
GDGLSKVVP

SEQ ID NO: 134390 - protein, 9 aa, Homo Sapiens
RWRADGCSL

SEQ ID NO: 134391 - protein, 9 aa, Homo Sapiens
SASGHLARA

SEQ ID NO: 134392 - protein, 9 aa, Homo Sapiens
LIDQMSSCD

SEQ ID NO: 134393 - protein, 9 aa, Homo Sapiens
SSARAVAGS

SEQ ID NO: 134394 - protein, 9 aa, Homo Sapiens
GATRIETES

SEQ ID NO: 134395 - protein, 9 aa, Homo Sapiens
DSMTYEKLS

SEQ ID NO: 134396 - protein, 9 aa, Homo Sapiens
EAPPPTALA

SEQ ID NO: 134397 - protein, 9 aa, Homo Sapiens
AAGRRRPAL

SEQ ID NO: 134398 - protein, 9 aa, Homo Sapiens
KSASGHLAR

SEQ ID NO: 134399 - protein, 9 aa, Homo Sapiens
RQEHRQRND

SEQ ID NO: 134400 - protein, 9 aa, Homo Sapiens
ASLKKTKQR

SEQ ID NO: 134401 - protein, 9 aa, Homo Sapiens
TLYDSINAI

SEQ ID NO: 134402 - protein, 9 aa, Homo Sapiens
NCAMKFGSW

SEQ ID NO: 134403 - protein, 9 aa, Homo Sapiens
PSSALANSE

SEQ ID NO: 134404 - protein, 9 aa, Homo Sapiens
NSHLKHIYE

SEQ ID NO: 134405 - protein, 9 aa, Homo Sapiens
TMSCLSRPG

SEQ ID NO: 134406 - protein, 9 aa, Homo Sapiens
QQANLQRRL

SEQ ID NO: 134407 - protein, 9 aa, Homo Sapiens
FVKGMSPAV

SEQ ID NO: 134408 - protein, 9 aa, Homo Sapiens
LDAEELPPC

SEQ ID NO: 134409 - protein, 9 aa, Homo Sapiens
EETVRLGFL

SEQ ID NO: 134410 - protein, 9 aa, Homo Sapiens
VGQVCGQDD

SEQ ID NO: 134411 - protein, 9 aa, Homo Sapiens
NAHTQTYPM

SEQ ID NO: 134412 - protein, 9 aa, Homo Sapiens
TLEHQKTFW

SEQ ID NO: 134413 - protein, 9 aa, Homo Sapiens
HPRFDLSHP

SEQ ID NO: 134414 - protein, 9 aa, Homo Sapiens
LCTGHEYAV

SEQ ID NO: 134415 - protein, 9 aa, Homo Sapiens
PRAPKPSAQ

SEQ ID NO: 134416 - protein, 9 aa, Homo Sapiens
RKEFRKNFV

SEQ ID NO: 134417 - protein, 9 aa, Homo Sapiens
AFYTGLLLI

SEQ ID NO: 134418 - protein, 9 aa, Homo Sapiens
CMQSQRNYM

SEQ ID NO: 134419 - protein, 9 aa, Homo Sapiens
SQHLQVVKI

SEQ ID NO: 134420 - protein, 9 aa, Homo Sapiens
PQSHGGPPK

SEQ ID NO: 134421 - protein, 9 aa, Homo Sapiens
ESQLCSTDS

SEQ ID NO: 134422 - protein, 9 aa, Homo Sapiens
GESAPATLT

SEQ ID NO: 134423 - protein, 9 aa, Homo Sapiens
EPAFHKTST

SEQ ID NO: 134424 - protein, 9 aa, Homo Sapiens
LQAKRAGQN

SEQ ID NO: 134425 - protein, 9 aa, Homo Sapiens
YIETQHFRE

SEQ ID NO: 134426 - protein, 9 aa, Homo Sapiens
AYIADETPV

SEQ ID NO: 134427 - protein, 9 aa, Homo Sapiens
PADRLCFHP

SEQ ID NO: 134428 - protein, 9 aa, Homo Sapiens
LKMICPTHG

SEQ ID NO: 134429 - protein, 9 aa, Homo Sapiens
RQLDKVNQW

SEQ ID NO: 134430 - protein, 9 aa, Homo Sapiens
LCSHLGETA

SEQ ID NO: 134431 - protein, 9 aa, Homo Sapiens
QGPCPRAPA

SEQ ID NO: 134432 - protein, 9 aa, Homo Sapiens
TLIVFWKYR

SEQ ID NO: 134433 - protein, 9 aa, Homo Sapiens
RTLQPNGSL

SEQ ID NO: 134434 - protein, 9 aa, Homo Sapiens
IDGANLTVS

SEQ ID NO: 134435 - protein, 9 aa, Homo Sapiens
ISLMHKFIA

SEQ ID NO: 134436 - protein, 9 aa, Homo Sapiens
ALIPWLLQP

SEQ ID NO: 134437 - protein, 9 aa, Homo Sapiens
QVMTHAGNK

SEQ ID NO: 134438 - protein, 9 aa, Homo Sapiens
TSPQPISNS

SEQ ID NO: 134439 - protein, 9 aa, Homo Sapiens
YFEQNSFEQ

SEQ ID NO: 134440 - protein, 9 aa, Homo Sapiens
HTKRITFLF

SEQ ID NO: 134441 - protein, 9 aa, Homo Sapiens
VNMGGNRSI

SEQ ID NO: 134442 - protein, 9 aa, Homo Sapiens
NNNRTSFHN

SEQ ID NO: 134443 - protein, 9 aa, Homo Sapiens
QGTLYSLQP

SEQ ID NO: 134444 - protein, 9 aa, Homo Sapiens
SAAEARSMT

SEQ ID NO: 134445 - protein, 9 aa, Homo Sapiens
HWQPLDTVF

SEQ ID NO: 134446 - protein, 9 aa, Homo Sapiens
VWRDKDGPG

SEQ ID NO: 134447 - protein, 9 aa, Homo Sapiens
IHCHAKETW

SEQ ID NO: 134448 - protein, 9 aa, Homo Sapiens
SFLMGPEPS

SEQ ID NO: 134449 - protein, 9 aa, Homo Sapiens
TGDKPFMCP

SEQ ID NO: 134450 - protein, 9 aa, Homo Sapiens
QLWWCGGRQ

SEQ ID NO: 134451 - protein, 9 aa, Homo Sapiens
TKRDLPPAK

SEQ ID NO: 134452 - protein, 9 aa, Homo Sapiens
GWDWVLPVA

SEQ ID NO: 134453 - protein, 9 aa, Homo Sapiens
VATILKCAR

SEQ ID NO: 134454 - protein, 9 aa, Homo Sapiens
IYTPEEFQK

SEQ ID NO: 134455 - protein, 9 aa, Homo Sapiens
HTKGVNAVR

SEQ ID NO: 134456 - protein, 9 aa, Homo Sapiens
LGCVYDLTS

SEQ ID NO: 134457 - protein, 9 aa, Homo Sapiens
PNDISSEAP

SEQ ID NO: 134458 - protein, 9 aa, Homo Sapiens
IKYIVAQYN

SEQ ID NO: 134459 - protein, 9 aa, Homo Sapiens
AKHIFSTIT

SEQ ID NO: 134460 - protein, 9 aa, Homo Sapiens
YYACARLPC

SEQ ID NO: 134461 - protein, 9 aa, Homo Sapiens
AGAAAGAPR

SEQ ID NO: 134462 - protein, 9 aa, Homo Sapiens
RSHGRKKKT

SEQ ID NO: 134463 - protein, 9 aa, Homo Sapiens
CHTPQIEQA

SEQ ID NO: 134464 - protein, 9 aa, Homo Sapiens
GHLQYMWWY

SEQ ID NO: 134465 - protein, 9 aa, Homo Sapiens
LFPESRVTR

SEQ ID NO: 134466 - protein, 9 aa, Homo Sapiens
DADSGYNTW

SEQ ID NO: 134467 - protein, 9 aa, Homo Sapiens
VQLTETSLQ

SEQ ID NO: 134468 - protein, 9 aa, Homo Sapiens
RADTVQLPQ

SEQ ID NO: 134469 - protein, 9 aa, Homo Sapiens
ATQRLAEYS

SEQ ID NO: 134470 - protein, 9 aa, Homo Sapiens
APLSGKGNP

SEQ ID NO: 134471 - protein, 9 aa, Homo Sapiens
LVVEIRHRH

SEQ ID NO: 134472 - protein, 9 aa, Homo Sapiens
EQSFYTNPL

SEQ ID NO: 134473 - protein, 9 aa, Homo Sapiens
LDTLYVSTT

SEQ ID NO: 134474 - protein, 9 aa, Homo Sapiens
RNKDVNKVL

SEQ ID NO: 134475 - protein, 9 aa, Homo Sapiens
RPWRQWEGE

SEQ ID NO: 134476 - protein, 9 aa, Homo Sapiens
YGISSVHDM

SEQ ID NO: 134477 - protein, 9 aa, Homo Sapiens
LKVTCFGML

SEQ ID NO: 134478 - protein, 9 aa, Homo Sapiens
YNSMTSSQI

SEQ ID NO: 134479 - protein, 9 aa, Homo Sapiens
LSAMTEEPA

SEQ ID NO: 134480 - protein, 9 aa, Homo Sapiens
SCLVIQHFC

SEQ ID NO: 134481 - protein, 9 aa, Homo Sapiens
REYEGVGWN

SEQ ID NO: 134482 - protein, 9 aa, Homo Sapiens
EDMDVERAM

SEQ ID NO: 134483 - protein, 9 aa, Homo Sapiens
KNNLVSGMR

SEQ ID NO: 134484 - protein, 9 aa, Homo Sapiens
PGMRMQTFQ

SEQ ID NO: 134485 - protein, 9 aa, Homo Sapiens
SSVEEGYHL

SEQ ID NO: 134486 - protein, 9 aa, Homo Sapiens
SRENRAPKE

SEQ ID NO: 134487 - protein, 9 aa, Homo Sapiens
VAAARGLLL

SEQ ID NO: 134488 - protein, 9 aa, Homo Sapiens
AEAVLKRES

SEQ ID NO: 134489 - protein, 9 aa, Homo Sapiens
PMARRNALR

SEQ ID NO: 134490 - protein, 9 aa, Homo Sapiens
EPRGRASSL

SEQ ID NO: 134491 - protein, 9 aa, Homo Sapiens
LGSPLMSEF

SEQ ID NO: 134492 - protein, 9 aa, Homo Sapiens
MSRLFYGKS

SEQ ID NO: 134493 - protein, 9 aa, Homo Sapiens
DSSRESVNA

SEQ ID NO: 134494 - protein, 9 aa, Homo Sapiens
LFKQAWEAD

SEQ ID NO: 134495 - protein, 9 aa, Homo Sapiens
DQLPFLVAA

SEQ ID NO: 134496 - protein, 9 aa, Homo Sapiens
ELEGEIRHS

SEQ ID NO: 134497 - protein, 9 aa, Homo Sapiens
PKFGQIVNA

SEQ ID NO: 134498 - protein, 9 aa, Homo Sapiens
APTDYARWW

SEQ ID NO: 134499 - protein, 9 aa, Homo Sapiens
KQHPWHPAV

SEQ ID NO: 134500 - protein, 9 aa, Homo Sapiens
ISNSRPSES

SEQ ID NO: 134501 - protein, 9 aa, Homo Sapiens
PTAEKREWT

SEQ ID NO: 134502 - protein, 9 aa, Homo Sapiens
SHSEASSVT

SEQ ID NO: 134503 - protein, 9 aa, Homo Sapiens
LFSNLPPTQ

SEQ ID NO: 134504 - protein, 9 aa, Homo Sapiens
YHDHGLLHV

SEQ ID NO: 134505 - protein, 9 aa, Homo Sapiens
AVKDEQGTE

SEQ ID NO: 134506 - protein, 9 aa, Homo Sapiens
HRDHILQGF

SEQ ID NO: 134507 - protein, 9 aa, Homo Sapiens
KDLDNDMKK

SEQ ID NO: 134508 - protein, 9 aa, Homo Sapiens
HMAALLRLP

SEQ ID NO: 134509 - protein, 9 aa, Homo Sapiens
QRPPEGLAP

SEQ ID NO: 134510 - protein, 9 aa, Homo Sapiens
LMSLGIYSP

SEQ ID NO: 134511 - protein, 9 aa, Homo Sapiens
CGATSSRPL

SEQ ID NO: 134512 - protein, 9 aa, Homo Sapiens
WDYVCEKCT

SEQ ID NO: 134513 - protein, 9 aa, Homo Sapiens
SGGAKARSA

SEQ ID NO: 134514 - protein, 9 aa, Homo Sapiens
VPTGPGGGG

SEQ ID NO: 134515 - protein, 9 aa, Homo Sapiens
QFGRRTTKS

SEQ ID NO: 134516 - protein, 9 aa, Homo Sapiens
VDLATSVRS

SEQ ID NO: 134517 - protein, 9 aa, Homo Sapiens
APLNSHAHE

SEQ ID NO: 134518 - protein, 9 aa, Homo Sapiens
ALCETPAPL

SEQ ID NO: 134519 - protein, 9 aa, Homo Sapiens
SWNTEAGVS

SEQ ID NO: 134520 - protein, 9 aa, Homo Sapiens
ELAELVQHL

SEQ ID NO: 134521 - protein, 9 aa, Homo Sapiens
EQQANLQRR

SEQ ID NO: 134522 - protein, 9 aa, Homo Sapiens
HHGSRSQSS

SEQ ID NO: 134523 - protein, 9 aa, Homo Sapiens
MCLTFTSLT

SEQ ID NO: 134524 - protein, 9 aa, Homo Sapiens
HPLLQACSP

SEQ ID NO: 134525 - protein, 9 aa, Homo Sapiens
LISYIEVDS

SEQ ID NO: 134526 - protein, 9 aa, Homo Sapiens
GNFSCADIN

SEQ ID NO: 134527 - protein, 9 aa, Homo Sapiens
FQILHDRFL

SEQ ID NO: 134528 - protein, 9 aa, Homo Sapiens
NKNQKLGSP

SEQ ID NO: 134529 - protein, 9 aa, Homo Sapiens
LLKRVADLV

SEQ ID NO: 134530 - protein, 9 aa, Homo Sapiens
TKRLNKMVS

SEQ ID NO: 134531 - protein, 9 aa, Homo Sapiens
SSARWRSSL

SEQ ID NO: 134532 - protein, 9 aa, Homo Sapiens
HEEHRGMFR

SEQ ID NO: 134533 - protein, 9 aa, Homo Sapiens
GIQQHVLLC

SEQ ID NO: 134534 - protein, 9 aa, Homo Sapiens
KFTHFGAVL

SEQ ID NO: 134535 - protein, 9 aa, Homo Sapiens
MLLCCSQSP

SEQ ID NO: 134536 - protein, 9 aa, Homo Sapiens
TENETTEKE

SEQ ID NO: 134537 - protein, 9 aa, Homo Sapiens
VLSLARGSP

SEQ ID NO: 134538 - protein, 9 aa, Homo Sapiens
QEKQKTELD

SEQ ID NO: 134539 - protein, 9 aa, Homo Sapiens
DAAGTGLYV

SEQ ID NO: 134540 - protein, 9 aa, Homo Sapiens
DVNNYAKDE

SEQ ID NO: 134541 - protein, 9 aa, Homo Sapiens
KHKREIYDH

SEQ ID NO: 134542 - protein, 9 aa, Homo Sapiens
MEKDPNELQ

SEQ ID NO: 134543 - protein, 9 aa, Homo Sapiens
WRDKDGPGR

SEQ ID NO: 134544 - protein, 9 aa, Homo Sapiens
SFSVRLFVN

SEQ ID NO: 134545 - protein, 9 aa, Homo Sapiens
RAAATPSCC

SEQ ID NO: 134546 - protein, 9 aa, Homo Sapiens
LLWAGASCG

SEQ ID NO: 134547 - protein, 9 aa, Homo Sapiens
DVENLVSTL

SEQ ID NO: 134548 - protein, 9 aa, Homo Sapiens
WAESLVGSW

SEQ ID NO: 134549 - protein, 9 aa, Homo Sapiens
TSRVLCIFM

SEQ ID NO: 134550 - protein, 9 aa, Homo Sapiens
LLLPVQSPE

SEQ ID NO: 134551 - protein, 9 aa, Homo Sapiens
HQYILVVPV

SEQ ID NO: 134552 - protein, 9 aa, Homo Sapiens
ENRHHYTEA

SEQ ID NO: 134553 - protein, 9 aa, Homo Sapiens
PALRRLYTS

SEQ ID NO: 134554 - protein, 9 aa, Homo Sapiens
KLMASDTGK

SEQ ID NO: 134555 - protein, 9 aa, Homo Sapiens
VWNFFTLIL

SEQ ID NO: 134556 - protein, 9 aa, Homo Sapiens
FFIQDGHHS

SEQ ID NO: 134557 - protein, 9 aa, Homo Sapiens
PPESIPNKC

SEQ ID NO: 134558 - protein, 9 aa, Homo Sapiens
CPRQGKPNY

SEQ ID NO: 134559 - protein, 9 aa, Homo Sapiens
RLNKMVSNQ

SEQ ID NO: 134560 - protein, 9 aa, Homo Sapiens
GLGLGRWGL

SEQ ID NO: 134561 - protein, 9 aa, Homo Sapiens
KRAVIWLDT

SEQ ID NO: 134562 - protein, 9 aa, Homo Sapiens
ASASRGDTA

SEQ ID NO: 134563 - protein, 9 aa, Homo Sapiens
LALRALLGA

SEQ ID NO: 134564 - protein, 9 aa, Homo Sapiens
PGLIPQEPG

SEQ ID NO: 134565 - protein, 9 aa, Homo Sapiens
LESVLRAHR

SEQ ID NO: 134566 - protein, 9 aa, Homo Sapiens
FQQLRVRRR

SEQ ID NO: 134567 - protein, 9 aa, Homo Sapiens
CFGIFHKAS

SEQ ID NO: 134568 - protein, 9 aa, Homo Sapiens
QPLLNIKER

SEQ ID NO: 134569 - protein, 9 aa, Homo Sapiens
PVTYPGLST

SEQ ID NO: 134570 - protein, 9 aa, Homo Sapiens
LELEDEWRF

SEQ ID NO: 134571 - protein, 9 aa, Homo Sapiens
SAQPPGEGK

SEQ ID NO: 134572 - protein, 9 aa, Homo Sapiens
KLLYSQGSL

SEQ ID NO: 134573 - protein, 9 aa, Homo Sapiens
KDRGWGPNG

SEQ ID NO: 134574 - protein, 9 aa, Homo Sapiens
FDIIDLSVG

SEQ ID NO: 134575 - protein, 9 aa, Homo Sapiens
TGSGTETPS

SEQ ID NO: 134576 - protein, 9 aa, Homo Sapiens
ISSVHDMDS

SEQ ID NO: 134577 - protein, 9 aa, Homo Sapiens
KDSHGVMSS

SEQ ID NO: 134578 - protein, 9 aa, Homo Sapiens
LQVSLGEEF

SEQ ID NO: 134579 - protein, 9 aa, Homo Sapiens
NGDSGGING

SEQ ID NO: 134580 - protein, 9 aa, Homo Sapiens
RKVSTMTSC

SEQ ID NO: 134581 - protein, 9 aa, Homo Sapiens
YGSSFGCYY

SEQ ID NO: 134582 - protein, 9 aa, Homo Sapiens
SKPTDYSPE

SEQ ID NO: 134583 - protein, 9 aa, Homo Sapiens
INSDLVSVM

SEQ ID NO: 134584 - protein, 9 aa, Homo Sapiens
REDSAPSRK

SEQ ID NO: 134585 - protein, 9 aa, Homo Sapiens
NRLGFEFNN

SEQ ID NO: 134586 - protein, 9 aa, Homo Sapiens
ATHCFPRRA

SEQ ID NO: 134587 - protein, 9 aa, Homo Sapiens
ETPSARRRQ

SEQ ID NO: 134588 - protein, 9 aa, Homo Sapiens
HKRTYSLTT

SEQ ID NO: 134589 - protein, 9 aa, Homo Sapiens
TSLSFGKTS

SEQ ID NO: 134590 - protein, 9 aa, Homo Sapiens
EAAAGANAT

SEQ ID NO: 134591 - protein, 9 aa, Homo Sapiens
TLTVSTNNC

SEQ ID NO: 134592 - protein, 9 aa, Homo Sapiens
SPPPQQHSD

SEQ ID NO: 134593 - protein, 9 aa, Homo Sapiens
EEIDLHNPK

SEQ ID NO: 134594 - protein, 9 aa, Homo Sapiens
TKMMKRAVI

SEQ ID NO: 134595 - protein, 9 aa, Homo Sapiens
FIFNGNNLI

SEQ ID NO: 134596 - protein, 9 aa, Homo Sapiens
NSIKMPLKK

SEQ ID NO: 134597 - protein, 9 aa, Homo Sapiens
SSCSCSSKS

SEQ ID NO: 134598 - protein, 9 aa, Homo Sapiens
LTRYRANAS

SEQ ID NO: 134599 - protein, 9 aa, Homo Sapiens
VLQIDMKHM

SEQ ID NO: 134600 - protein, 9 aa, Homo Sapiens
QAIPLTRWK

SEQ ID NO: 134601 - protein, 9 aa, Homo Sapiens
YQQAMEKAA

SEQ ID NO: 134602 - protein, 9 aa, Homo Sapiens
DTPRSCERS

SEQ ID NO: 134603 - protein, 9 aa, Homo Sapiens
RVKIHQDLV

SEQ ID NO: 134604 - protein, 9 aa, Homo Sapiens
FWGHSQPAD

SEQ ID NO: 134605 - protein, 9 aa, Homo Sapiens
NSDSKQKRN

SEQ ID NO: 134606 - protein, 9 aa, Homo Sapiens
WACAAAVTP

SEQ ID NO: 134607 - protein, 9 aa, Homo Sapiens
ADTKMTKLE

SEQ ID NO: 134608 - protein, 9 aa, Homo Sapiens
FVTEGNCSN

SEQ ID NO: 134609 - protein, 9 aa, Homo Sapiens
ESVMAVDLN

SEQ ID NO: 134610 - protein, 9 aa, Homo Sapiens
PHPETHPDP

SEQ ID NO: 134611 - protein, 9 aa, Homo Sapiens
RDWNDMKRI

SEQ ID NO: 134612 - protein, 9 aa, Homo Sapiens
SLSFGKTSL

SEQ ID NO: 134613 - protein, 9 aa, Homo Sapiens
RQIQEWGCL

SEQ ID NO: 134614 - protein, 9 aa, Homo Sapiens
WATGELGGI

SEQ ID NO: 134615 - protein, 9 aa, Homo Sapiens
LAHPCPLPL

SEQ ID NO: 134616 - protein, 9 aa, Homo Sapiens
QLIVTKEEN

SEQ ID NO: 134617 - protein, 9 aa, Homo Sapiens
EVMVLAADH

SEQ ID NO: 134618 - protein, 9 aa, Homo Sapiens
AAFNTTVTA

SEQ ID NO: 134619 - protein, 9 aa, Homo Sapiens
SLLSLYSVA

SEQ ID NO: 134620 - protein, 9 aa, Homo Sapiens
ADHFDSRKR

SEQ ID NO: 134621 - protein, 9 aa, Homo Sapiens
HLGRPWRQW

SEQ ID NO: 134622 - protein, 9 aa, Homo Sapiens
PSIRIQTSL

SEQ ID NO: 134623 - protein, 9 aa, Homo Sapiens
FLAVKGLVQ

SEQ ID NO: 134624 - protein, 9 aa, Homo Sapiens
LTSRRRTLN

SEQ ID NO: 134625 - protein, 9 aa, Homo Sapiens
GEPPRSSTA

SEQ ID NO: 134626 - protein, 9 aa, Homo Sapiens
VISSKRRAQ

SEQ ID NO: 134627 - protein, 9 aa, Homo Sapiens
LSMNLMNEL

SEQ ID NO: 134628 - protein, 9 aa, Homo Sapiens
LFLGGLIAG

SEQ ID NO: 134629 - protein, 9 aa, Homo Sapiens
KKTSENTPF

SEQ ID NO: 134630 - protein, 9 aa, Homo Sapiens
QADVGLALA

SEQ ID NO: 134631 - protein, 9 aa, Homo Sapiens
SRLIFWSRH

SEQ ID NO: 134632 - protein, 9 aa, Homo Sapiens
CSHQDELDF

SEQ ID NO: 134633 - protein, 9 aa, Homo Sapiens
SLGSSPLPC

SEQ ID NO: 134634 - protein, 9 aa, Homo Sapiens
CPNYSYEIG

SEQ ID NO: 134635 - protein, 9 aa, Homo Sapiens
NGFGSLYFI

SEQ ID NO: 134636 - protein, 9 aa, Homo Sapiens
RDHSINYCE

SEQ ID NO: 134637 - protein, 9 aa, Homo Sapiens
MFTTPQYRG

SEQ ID NO: 134638 - protein, 9 aa, Homo Sapiens
NQELVQLWN

SEQ ID NO: 134639 - protein, 9 aa, Homo Sapiens
EPGPRFPLI

SEQ ID NO: 134640 - protein, 9 aa, Homo Sapiens
MKDLDNDMK

SEQ ID NO: 134641 - protein, 9 aa, Homo Sapiens
GTADPYARV

SEQ ID NO: 134642 - protein, 9 aa, Homo Sapiens
GRQVHSPSL

SEQ ID NO: 134643 - protein, 9 aa, Homo Sapiens
HMHLVWGSW

SEQ ID NO: 134644 - protein, 9 aa, Homo Sapiens
PNRETGAVQ

SEQ ID NO: 134645 - protein, 9 aa, Homo Sapiens
RIEDFFGAK

SEQ ID NO: 134646 - protein, 9 aa, Homo Sapiens
LTSYSLQAI

SEQ ID NO: 134647 - protein, 9 aa, Homo Sapiens
QAFQVVGWG

SEQ ID NO: 134648 - protein, 9 aa, Homo Sapiens
PRPQGQQNP

SEQ ID NO: 134649 - protein, 9 aa, Homo Sapiens
KCVHPFIFA

SEQ ID NO: 134650 - protein, 9 aa, Homo Sapiens
KSNGRGGNQ

SEQ ID NO: 134651 - protein, 9 aa, Homo Sapiens
QLTNDKVNS

SEQ ID NO: 134652 - protein, 9 aa, Homo Sapiens
SFPLYLEKN

SEQ ID NO: 134653 - protein, 9 aa, Homo Sapiens
LKSPTMYQV

SEQ ID NO: 134654 - protein, 9 aa, Homo Sapiens
NQTGACKFD

SEQ ID NO: 134655 - protein, 9 aa, Homo Sapiens
EKEVVVDTD

SEQ ID NO: 134656 - protein, 9 aa, Homo Sapiens
GRQLQQHNF

SEQ ID NO: 134657 - protein, 9 aa, Homo Sapiens
GFRVEFVDG

SEQ ID NO: 134658 - protein, 9 aa, Homo Sapiens
TMACDRYVA

SEQ ID NO: 134659 - protein, 9 aa, Homo Sapiens
AHCRPAQNN

SEQ ID NO: 134660 - protein, 9 aa, Homo Sapiens
TSLMKVHQE

SEQ ID NO: 134661 - protein, 9 aa, Homo Sapiens
IPPCRRPPP

SEQ ID NO: 134662 - protein, 9 aa, Homo Sapiens
QPGKKKTSE

SEQ ID NO: 134663 - protein, 9 aa, Homo Sapiens
GRESVLQKM

SEQ ID NO: 134664 - protein, 9 aa, Homo Sapiens
CVGNVKQTQ

SEQ ID NO: 134665 - protein, 9 aa, Homo Sapiens
TCTRPWSSL

SEQ ID NO: 134666 - protein, 9 aa, Homo Sapiens
ARKICCKTF

SEQ ID NO: 134667 - protein, 9 aa, Homo Sapiens
VPDPGCNYD

SEQ ID NO: 134668 - protein, 9 aa, Homo Sapiens
PLVGEDDSF

SEQ ID NO: 134669 - protein, 9 aa, Homo Sapiens
TAAPGPRPG

SEQ ID NO: 134670 - protein, 9 aa, Homo Sapiens
AVPERVVKD

SEQ ID NO: 134671 - protein, 9 aa, Homo Sapiens
ICLKCTSVG

SEQ ID NO: 134672 - protein, 9 aa, Homo Sapiens
CIRKHTQGR

SEQ ID NO: 134673 - protein, 9 aa, Homo Sapiens
VQGENCLTN

SEQ ID NO: 134674 - protein, 9 aa, Homo Sapiens
IDRERAAQT

SEQ ID NO: 134675 - protein, 9 aa, Homo Sapiens
AWDDKKALE

SEQ ID NO: 134676 - protein, 9 aa, Homo Sapiens
VRLCGRSRA

SEQ ID NO: 134677 - protein, 9 aa, Homo Sapiens
SENQTSLNI

SEQ ID NO: 134678 - protein, 9 aa, Homo Sapiens
ILRQVHGAD

SEQ ID NO: 134679 - protein, 9 aa, Homo Sapiens
KGFPNVYIK

SEQ ID NO: 134680 - protein, 9 aa, Homo Sapiens
REASSLLKS

SEQ ID NO: 134681 - protein, 9 aa, Homo Sapiens
AKRCIVSHL

SEQ ID NO: 134682 - protein, 9 aa, Homo Sapiens
VGGMRRGNM

SEQ ID NO: 134683 - protein, 9 aa, Homo Sapiens
KQEDHSRRD

SEQ ID NO: 134684 - protein, 9 aa, Homo Sapiens
MENSHPPTT

SEQ ID NO: 134685 - protein, 9 aa, Homo Sapiens
PWENQEVEA

SEQ ID NO: 134686 - protein, 9 aa, Homo Sapiens
QCEPVFQNG

SEQ ID NO: 134687 - protein, 9 aa, Homo Sapiens
KDLYDVVWI

SEQ ID NO: 134688 - protein, 9 aa, Homo Sapiens
GPDDGAITP

SEQ ID NO: 134689 - protein, 9 aa, Homo Sapiens
GFPYGHLHV

SEQ ID NO: 134690 - protein, 9 aa, Homo Sapiens
APRPGAAAS

SEQ ID NO: 134691 - protein, 9 aa, Homo Sapiens
PEAKEAEAR

SEQ ID NO: 134692 - protein, 9 aa, Homo Sapiens
LEVLLSKGA

SEQ ID NO: 134693 - protein, 9 aa, Homo Sapiens
VLWSGAFYL

SEQ ID NO: 134694 - protein, 9 aa, Homo Sapiens
RALQSLTCG

SEQ ID NO: 134695 - protein, 9 aa, Homo Sapiens
VDFLRAQNS

SEQ ID NO: 134696 - protein, 9 aa, Homo Sapiens
SNVVNNFFV

SEQ ID NO: 134697 - protein, 9 aa, Homo Sapiens
KLIRPQPKF

SEQ ID NO: 134698 - protein, 9 aa, Homo Sapiens
QNRNPGIQS

SEQ ID NO: 134699 - protein, 9 aa, Homo Sapiens
MVGEKGLAL

SEQ ID NO: 134700 - protein, 9 aa, Homo Sapiens
ELLEETPIQ

SEQ ID NO: 134701 - protein, 9 aa, Homo Sapiens
REGHLTLLR

SEQ ID NO: 134702 - protein, 9 aa, Homo Sapiens
DAPPPTPPL

SEQ ID NO: 134703 - protein, 9 aa, Homo Sapiens
PQQHCAKET

SEQ ID NO: 134704 - protein, 9 aa, Homo Sapiens
FSSVEMLVD

SEQ ID NO: 134705 - protein, 9 aa, Homo Sapiens
ILFSGALIP

SEQ ID NO: 134706 - protein, 9 aa, Homo Sapiens
LYDRYLARH

SEQ ID NO: 134707 - protein, 9 aa, Homo Sapiens
MLESQGLYS

SEQ ID NO: 134708 - protein, 9 aa, Homo Sapiens
WFQNQRSKW

SEQ ID NO: 134709 - protein, 9 aa, Homo Sapiens
QYDIHILYG

SEQ ID NO: 134710 - protein, 9 aa, Homo Sapiens
ERRERSRSW

SEQ ID NO: 134711 - protein, 9 aa, Homo Sapiens
GPAPRVPLC

SEQ ID NO: 134712 - protein, 9 aa, Homo Sapiens
DGKQRSPKM

SEQ ID NO: 134713 - protein, 9 aa, Homo Sapiens
VLAAVAEVI

SEQ ID NO: 134714 - protein, 9 aa, Homo Sapiens
LRDDYKNND

SEQ ID NO: 134715 - protein, 9 aa, Homo Sapiens
VPGCARGPW

SEQ ID NO: 134716 - protein, 9 aa, Homo Sapiens
LGPRPQTEH

SEQ ID NO: 134717 - protein, 9 aa, Homo Sapiens
ANKHRADGG

SEQ ID NO: 134718 - protein, 9 aa, Homo Sapiens
DPNELQALI

SEQ ID NO: 134719 - protein, 9 aa, Homo Sapiens
CPTDSLLCS

SEQ ID NO: 134720 - protein, 9 aa, Homo Sapiens
VLLVVSVVA

SEQ ID NO: 134721 - protein, 9 aa, Homo Sapiens
QLAATKKLS

SEQ ID NO: 134722 - protein, 9 aa, Homo Sapiens
GGMRQGYSV

SEQ ID NO: 134723 - protein, 9 aa, Homo Sapiens
SKVKSLKSI

SEQ ID NO: 134724 - protein, 9 aa, Homo Sapiens
PSHAGIYLY

SEQ ID NO: 134725 - protein, 9 aa, Homo Sapiens
AETKRLERE

SEQ ID NO: 134726 - protein, 9 aa, Homo Sapiens
AKKKAQLHF

SEQ ID NO: 134727 - protein, 9 aa, Homo Sapiens
FACACGLGW

SEQ ID NO: 134728 - protein, 9 aa, Homo Sapiens
SPPSPGSSA

SEQ ID NO: 134729 - protein, 9 aa, Homo Sapiens
DAVKDCRGC

SEQ ID NO: 134730 - protein, 9 aa, Homo Sapiens
GQSPPPQQH

SEQ ID NO: 134731 - protein, 9 aa, Homo Sapiens
FWTERPVNS

SEQ ID NO: 134732 - protein, 9 aa, Homo Sapiens
TWRARSTST

SEQ ID NO: 134733 - protein, 9 aa, Homo Sapiens
TEKYKNLQY

SEQ ID NO: 134734 - protein, 9 aa, Homo Sapiens
KETHCYDPD

SEQ ID NO: 134735 - protein, 9 aa, Homo Sapiens
FRKHQIIHT

SEQ ID NO: 134736 - protein, 9 aa, Homo Sapiens
RKPRRGVPD

SEQ ID NO: 134737 - protein, 9 aa, Homo Sapiens
LADFLANRQ

SEQ ID NO: 134738 - protein, 9 aa, Homo Sapiens
ILSGEIKTF

SEQ ID NO: 134739 - protein, 9 aa, Homo Sapiens
EEPKMGAGW

SEQ ID NO: 134740 - protein, 9 aa, Homo Sapiens
EEEEDEEYV

SEQ ID NO: 134741 - protein, 9 aa, Homo Sapiens
LELLDLMFC

SEQ ID NO: 134742 - protein, 9 aa, Homo Sapiens
VHPVVVGGI

SEQ ID NO: 134743 - protein, 9 aa, Homo Sapiens
QNLMRTMGF

SEQ ID NO: 134744 - protein, 9 aa, Homo Sapiens
TNDKVNSMV

SEQ ID NO: 134745 - protein, 9 aa, Homo Sapiens
QTLENSHPN

SEQ ID NO: 134746 - protein, 9 aa, Homo Sapiens
KIRIQQLPM

SEQ ID NO: 134747 - protein, 9 aa, Homo Sapiens
GFYNVSPRR

SEQ ID NO: 134748 - protein, 9 aa, Homo Sapiens
ENCLLSPLV

SEQ ID NO: 134749 - protein, 9 aa, Homo Sapiens
NVAILFSGA

SEQ ID NO: 134750 - protein, 9 aa, Homo Sapiens
DPSRVKELI

SEQ ID NO: 134751 - protein, 9 aa, Homo Sapiens
DMIRMLQCD

SEQ ID NO: 134752 - protein, 9 aa, Homo Sapiens
FCGAANCAD

SEQ ID NO: 134753 - protein, 9 aa, Homo Sapiens
ERLNSHFSD

SEQ ID NO: 134754 - protein, 9 aa, Homo Sapiens
LQPLLTVIF

SEQ ID NO: 134755 - protein, 9 aa, Homo Sapiens
KDSQQSKLK

SEQ ID NO: 134756 - protein, 9 aa, Homo Sapiens
SFGKTSLMI

SEQ ID NO: 134757 - protein, 9 aa, Homo Sapiens
PSSPPSPGS

SEQ ID NO: 134758 - protein, 9 aa, Homo Sapiens
TKHCKKLEA

SEQ ID NO: 134759 - protein, 9 aa, Homo Sapiens
TTKKILCFK

SEQ ID NO: 134760 - protein, 9 aa, Homo Sapiens
IRASASRGD

SEQ ID NO: 134761 - protein, 9 aa, Homo Sapiens
RQLIPCKPS

SEQ ID NO: 134762 - protein, 9 aa, Homo Sapiens
AGFEYFEQN

SEQ ID NO: 134763 - protein, 9 aa, Homo Sapiens
VRQLLFFTN

SEQ ID NO: 134764 - protein, 9 aa, Homo Sapiens
TQGRSPMNA

SEQ ID NO: 134765 - protein, 9 aa, Homo Sapiens
SRHDPSRPH

SEQ ID NO: 134766 - protein, 9 aa, Homo Sapiens
SSAGQMPRK

SEQ ID NO: 134767 - protein, 9 aa, Homo Sapiens
EIIANDQDN

SEQ ID NO: 134768 - protein, 9 aa, Homo Sapiens
QCPPPSSAG

SEQ ID NO: 134769 - protein, 9 aa, Homo Sapiens
GILGVTSPS

SEQ ID NO: 134770 - protein, 9 aa, Homo Sapiens
EKRRLRAKL

SEQ ID NO: 134771 - protein, 9 aa, Homo Sapiens
SSPGRPTNL

SEQ ID NO: 134772 - protein, 9 aa, Homo Sapiens
PSEWPGWCL

SEQ ID NO: 134773 - protein, 9 aa, Homo Sapiens
KIRASASRG

SEQ ID NO: 134774 - protein, 9 aa, Homo Sapiens
ATVQNREPE

SEQ ID NO: 134775 - protein, 9 aa, Homo Sapiens
SLRIAGCRH

SEQ ID NO: 134776 - protein, 9 aa, Homo Sapiens
WKTTNRYVQ

SEQ ID NO: 134777 - protein, 9 aa, Homo Sapiens
LLVPDGDDR

SEQ ID NO: 134778 - protein, 9 aa, Homo Sapiens
EDVALLEDV

SEQ ID NO: 134779 - protein, 9 aa, Homo Sapiens
AESLVGSWQ

SEQ ID NO: 134780 - protein, 9 aa, Homo Sapiens
GEMVFLDGG

SEQ ID NO: 134781 - protein, 9 aa, Homo Sapiens
GPFRHLAQE

SEQ ID NO: 134782 - protein, 9 aa, Homo Sapiens
NSGLGVRFQ

SEQ ID NO: 134783 - protein, 9 aa, Homo Sapiens
LVICHPDSI

SEQ ID NO: 134784 - protein, 9 aa, Homo Sapiens
GEAEASTPG

SEQ ID NO: 134785 - protein, 9 aa, Homo Sapiens
QCILWTTVC

SEQ ID NO: 134786 - protein, 9 aa, Homo Sapiens
SCCKPSCCM

SEQ ID NO: 134787 - protein, 9 aa, Homo Sapiens
DDIDNLNPV

SEQ ID NO: 134788 - protein, 9 aa, Homo Sapiens
ESVLQKMKK

SEQ ID NO: 134789 - protein, 9 aa, Homo Sapiens
KVPQAQLTK

SEQ ID NO: 134790 - protein, 9 aa, Homo Sapiens
CYPPFPLGT

SEQ ID NO: 134791 - protein, 9 aa, Homo Sapiens
QQCILWTTV

SEQ ID NO: 134792 - protein, 9 aa, Homo Sapiens
VGNLCKSHI

SEQ ID NO: 134793 - protein, 9 aa, Homo Sapiens
KAILTRYRA

SEQ ID NO: 134794 - protein, 9 aa, Homo Sapiens
QQLGAWGSV

SEQ ID NO: 134795 - protein, 9 aa, Homo Sapiens
ATLLDTPDV

SEQ ID NO: 134796 - protein, 9 aa, Homo Sapiens
DNPTLTIMD

SEQ ID NO: 134797 - protein, 9 aa, Homo Sapiens
PGQTTSDRK

SEQ ID NO: 134798 - protein, 9 aa, Homo Sapiens
TSCSTMSCL

SEQ ID NO: 134799 - protein, 9 aa, Homo Sapiens
AAVDPDIGI

SEQ ID NO: 134800 - protein, 9 aa, Homo Sapiens
NNNSRPSTP

SEQ ID NO: 134801 - protein, 9 aa, Homo Sapiens
LKIRIQQLP

SEQ ID NO: 134802 - protein, 9 aa, Homo Sapiens
RLEKFTHFG

SEQ ID NO: 134803 - protein, 9 aa, Homo Sapiens
DGRPSSHLS

SEQ ID NO: 134804 - protein, 9 aa, Homo Sapiens
VNNFFVTEG

SEQ ID NO: 134805 - protein, 9 aa, Homo Sapiens
TSSQIYMNG

SEQ ID NO: 134806 - protein, 9 aa, Homo Sapiens
TGPPVLSSD

SEQ ID NO: 134807 - protein, 9 aa, Homo Sapiens
TNLQQMLKE

SEQ ID NO: 134808 - protein, 9 aa, Homo Sapiens
RGEAGRPVR

SEQ ID NO: 134809 - protein, 9 aa, Homo Sapiens
QHDQRPPEG

SEQ ID NO: 134810 - protein, 9 aa, Homo Sapiens
VNTDLLREG

SEQ ID NO: 134811 - protein, 9 aa, Homo Sapiens
VPLCPSGRR

SEQ ID NO: 134812 - protein, 9 aa, Homo Sapiens
VGYVERAVS

SEQ ID NO: 134813 - protein, 9 aa, Homo Sapiens
RESHITLAS

SEQ ID NO: 134814 - protein, 9 aa, Homo Sapiens
SFKAAVWRV

SEQ ID NO: 134815 - protein, 9 aa, Homo Sapiens
LMRLHPWWR

SEQ ID NO: 134816 - protein, 9 aa, Homo Sapiens
APQELSQLQ

SEQ ID NO: 134817 - protein, 9 aa, Homo Sapiens
ADASGHNTL

SEQ ID NO: 134818 - protein, 9 aa, Homo Sapiens
TKHLWNGTF

SEQ ID NO: 134819 - protein, 9 aa, Homo Sapiens
STLTSRRRT

SEQ ID NO: 134820 - protein, 9 aa, Homo Sapiens
PPQPAGVSC

SEQ ID NO: 134821 - protein, 9 aa, Homo Sapiens
CVGYNSQGE

SEQ ID NO: 134822 - protein, 9 aa, Homo Sapiens
SLSRLQKPH

SEQ ID NO: 134823 - protein, 9 aa, Homo Sapiens
LNIMKKSQR

SEQ ID NO: 134824 - protein, 9 aa, Homo Sapiens
PGPSGRLRD

SEQ ID NO: 134825 - protein, 9 aa, Homo Sapiens
RIIPYNSQY

SEQ ID NO: 134826 - protein, 9 aa, Homo Sapiens
LYPGLNPRI

SEQ ID NO: 134827 - protein, 9 aa, Homo Sapiens
TFLYHRMTQ

SEQ ID NO: 134828 - protein, 9 aa, Homo Sapiens
IKNSRNHQR

SEQ ID NO: 134829 - protein, 9 aa, Homo Sapiens
GPVGEMVPT

SEQ ID NO: 134830 - protein, 9 aa, Homo Sapiens
TQISFVVGE

SEQ ID NO: 134831 - protein, 9 aa, Homo Sapiens
WAIEVDSDW

SEQ ID NO: 134832 - protein, 9 aa, Homo Sapiens
NTVGGTSFQ

SEQ ID NO: 134833 - protein, 9 aa, Homo Sapiens
TPLEKDGFP

SEQ ID NO: 134834 - protein, 9 aa, Homo Sapiens
IPLTRWKPL

SEQ ID NO: 134835 - protein, 9 aa, Homo Sapiens
QVLESGGSK

SEQ ID NO: 134836 - protein, 9 aa, Homo Sapiens
GLFLQKTSI

SEQ ID NO: 134837 - protein, 9 aa, Homo Sapiens
MKKLNMLMN

SEQ ID NO: 134838 - protein, 9 aa, Homo Sapiens
PKMGAGWRD

SEQ ID NO: 134839 - protein, 9 aa, Homo Sapiens
MQCVTSRGS

SEQ ID NO: 134840 - protein, 9 aa, Homo Sapiens
NRNVASPTS

SEQ ID NO: 134841 - protein, 9 aa, Homo Sapiens
KGREERREV

SEQ ID NO: 134842 - protein, 9 aa, Homo Sapiens
STASAATSR

SEQ ID NO: 134843 - protein, 9 aa, Homo Sapiens
KCKAMEAAQ

SEQ ID NO: 134844 - protein, 9 aa, Homo Sapiens
HHPQQQLQP

SEQ ID NO: 134845 - protein, 9 aa, Homo Sapiens
LLKGVPLQF

SEQ ID NO: 134846 - protein, 9 aa, Homo Sapiens
VGGQLTTDQ

SEQ ID NO: 134847 - protein, 9 aa, Homo Sapiens
EKEMERVSE

SEQ ID NO: 134848 - protein, 9 aa, Homo Sapiens
RLGFEFNNE

SEQ ID NO: 134849 - protein, 9 aa, Homo Sapiens
MAHAGQPGK

SEQ ID NO: 134850 - protein, 9 aa, Homo Sapiens
GGTTCPPTS

SEQ ID NO: 134851 - protein, 9 aa, Homo Sapiens
EEDGEEKSL

SEQ ID NO: 134852 - protein, 9 aa, Homo Sapiens
INGGESAPA

SEQ ID NO: 134853 - protein, 9 aa, Homo Sapiens
VCGNVLRFL

SEQ ID NO: 134854 - protein, 9 aa, Homo Sapiens
PRSNSGLGV

SEQ ID NO: 134855 - protein, 9 aa, Homo Sapiens
GENTVLCLQ

SEQ ID NO: 134856 - protein, 9 aa, Homo Sapiens
KWDYVCEKC

SEQ ID NO: 134857 - protein, 9 aa, Homo Sapiens
EEEKHEESS

SEQ ID NO: 134858 - protein, 9 aa, Homo Sapiens
ISNVKHVVN

SEQ ID NO: 134859 - protein, 9 aa, Homo Sapiens
NDPKENKVV

SEQ ID NO: 134860 - protein, 9 aa, Homo Sapiens
KTTEEALAW

SEQ ID NO: 134861 - protein, 9 aa, Homo Sapiens
AKKSRRNNE

SEQ ID NO: 134862 - protein, 9 aa, Homo Sapiens
VPGRLCAPG

SEQ ID NO: 134863 - protein, 9 aa, Homo Sapiens
SIEPAILLL

SEQ ID NO: 134864 - protein, 9 aa, Homo Sapiens
GSPFTSANF

SEQ ID NO: 134865 - protein, 9 aa, Homo Sapiens
LLDFVLSAS

SEQ ID NO: 134866 - protein, 9 aa, Homo Sapiens
CEEFKEKCH

SEQ ID NO: 134867 - protein, 9 aa, Homo Sapiens
KTSGPEKNP

SEQ ID NO: 134868 - protein, 9 aa, Homo Sapiens
PPRSSTATL

SEQ ID NO: 134869 - protein, 9 aa, Homo Sapiens
DSGSHRRHW

SEQ ID NO: 134870 - protein, 9 aa, Homo Sapiens
LVCFPFSVV

SEQ ID NO: 134871 - protein, 9 aa, Homo Sapiens
HPPSVRSTR

SEQ ID NO: 134872 - protein, 9 aa, Homo Sapiens
TLNWKRGPS

SEQ ID NO: 134873 - protein, 9 aa, Homo Sapiens
LQIQALLQR

SEQ ID NO: 134874 - protein, 9 aa, Homo Sapiens
VLSVRTGND

SEQ ID NO: 134875 - protein, 9 aa, Homo Sapiens
YHPIRFYAR

SEQ ID NO: 134876 - protein, 9 aa, Homo Sapiens
EKKLEWERR

SEQ ID NO: 134877 - protein, 9 aa, Homo Sapiens
GFQMTRTVT

SEQ ID NO: 134878 - protein, 9 aa, Homo Sapiens
WAVKDEQGT

SEQ ID NO: 134879 - protein, 9 aa, Homo Sapiens
ISTTSNKCP

SEQ ID NO: 134880 - protein, 9 aa, Homo Sapiens
SVSFFVKGM

SEQ ID NO: 134881 - protein, 9 aa, Homo Sapiens
PHAEQYRID

SEQ ID NO: 134882 - protein, 9 aa, Homo Sapiens
SVKENLPII

SEQ ID NO: 134883 - protein, 9 aa, Homo Sapiens
ETPVDLAEF

SEQ ID NO: 134884 - protein, 9 aa, Homo Sapiens
TTATTGPTA

SEQ ID NO: 134885 - protein, 9 aa, Homo Sapiens
ALRLMNAAI

SEQ ID NO: 134886 - protein, 9 aa, Homo Sapiens
MKLIVEEKC

SEQ ID NO: 134887 - protein, 9 aa, Homo Sapiens
CRGCVLVHC

SEQ ID NO: 134888 - protein, 9 aa, Homo Sapiens
YNGGNANPH

SEQ ID NO: 134889 - protein, 9 aa, Homo Sapiens
GNPPVTYPG

SEQ ID NO: 134890 - protein, 9 aa, Homo Sapiens
RRGGPGQAA

SEQ ID NO: 134891 - protein, 9 aa, Homo Sapiens
APHVQICMP

SEQ ID NO: 134892 - protein, 9 aa, Homo Sapiens
MRLKMMTRN

SEQ ID NO: 134893 - protein, 9 aa, Homo Sapiens
GREYEGVGW

SEQ ID NO: 134894 - protein, 9 aa, Homo Sapiens
AQLMAPLSP

SEQ ID NO: 134895 - protein, 9 aa, Homo Sapiens
SLEPYAFNM

SEQ ID NO: 134896 - protein, 9 aa, Homo Sapiens
ILEKDLLYA

SEQ ID NO: 134897 - protein, 9 aa, Homo Sapiens
SGSYQDLDG

SEQ ID NO: 134898 - protein, 9 aa, Homo Sapiens
IAMPVPVIM

SEQ ID NO: 134899 - protein, 9 aa, Homo Sapiens
AGISSLILT

SEQ ID NO: 134900 - protein, 9 aa, Homo Sapiens
NNYRFQMKF

SEQ ID NO: 134901 - protein, 9 aa, Homo Sapiens
AAAGPDSTP

SEQ ID NO: 134902 - protein, 9 aa, Homo Sapiens
VKLQESAHR

SEQ ID NO: 134903 - protein, 9 aa, Homo Sapiens
WISRVEKMM

SEQ ID NO: 134904 - protein, 9 aa, Homo Sapiens
NPSLALMCF

SEQ ID NO: 134905 - protein, 9 aa, Homo Sapiens
IYDHYGREG

SEQ ID NO: 134906 - protein, 9 aa, Homo Sapiens
CVVPIAQKS

SEQ ID NO: 134907 - protein, 9 aa, Homo Sapiens
GHSWDKYGL

SEQ ID NO: 134908 - protein, 9 aa, Homo Sapiens
CAFWAGSVA

SEQ ID NO: 134909 - protein, 9 aa, Homo Sapiens
PLRDVLEVI

SEQ ID NO: 134910 - protein, 9 aa, Homo Sapiens
FLVGDDGRE

SEQ ID NO: 134911 - protein, 9 aa, Homo Sapiens
PGQAAGRGG

SEQ ID NO: 134912 - protein, 9 aa, Homo Sapiens
MGAGWRDSS

SEQ ID NO: 134913 - protein, 9 aa, Homo Sapiens
LGVCGNVLR

SEQ ID NO: 134914 - protein, 9 aa, Homo Sapiens
GDMVNSIKM

SEQ ID NO: 134915 - protein, 9 aa, Homo Sapiens
NNLIFQYSQ

SEQ ID NO: 134916 - protein, 9 aa, Homo Sapiens
LRNKDVNKV

SEQ ID NO: 134917 - protein, 9 aa, Homo Sapiens
QLGAWGSVS

SEQ ID NO: 134918 - protein, 9 aa, Homo Sapiens
PESIPNKCL

SEQ ID NO: 134919 - protein, 9 aa, Homo Sapiens
QPISNSRPS

SEQ ID NO: 134920 - protein, 9 aa, Homo Sapiens
TAVSSQPLL

SEQ ID NO: 134921 - protein, 9 aa, Homo Sapiens
QENEMKLYM

SEQ ID NO: 134922 - protein, 9 aa, Homo Sapiens
FSHRSAAAL

SEQ ID NO: 134923 - protein, 9 aa, Homo Sapiens
KDGEMVFLD

SEQ ID NO: 134924 - protein, 9 aa, Homo Sapiens
FPFSVVWRQ

SEQ ID NO: 134925 - protein, 9 aa, Homo Sapiens
VANIPVDRP

SEQ ID NO: 134926 - protein, 9 aa, Homo Sapiens
NKDVNKVLR

SEQ ID NO: 134927 - protein, 9 aa, Homo Sapiens
CVKLSKKNQ

SEQ ID NO: 134928 - protein, 9 aa, Homo Sapiens
EDKVCVWQL

SEQ ID NO: 134929 - protein, 9 aa, Homo Sapiens
VRQPYRVKA

SEQ ID NO: 134930 - protein, 9 aa, Homo Sapiens
PKPALHMVS

SEQ ID NO: 134931 - protein, 9 aa, Homo Sapiens
AAHRPLCQR

SEQ ID NO: 134932 - protein, 9 aa, Homo Sapiens
RLACDFLVR

SEQ ID NO: 134933 - protein, 9 aa, Homo Sapiens
TEVHVRYPK

SEQ ID NO: 134934 - protein, 9 aa, Homo Sapiens
MPRKMRHVY

SEQ ID NO: 134935 - protein, 9 aa, Homo Sapiens
NYTVDAPHG

SEQ ID NO: 134936 - protein, 9 aa, Homo Sapiens
NIDAFEEVL

SEQ ID NO: 134937 - protein, 9 aa, Homo Sapiens
TVQNREPES

SEQ ID NO: 134938 - protein, 9 aa, Homo Sapiens
LLEKQLELL

SEQ ID NO: 134939 - protein, 9 aa, Homo Sapiens
NYRFLTPFT

SEQ ID NO: 134940 - protein, 9 aa, Homo Sapiens
PAPGRPYGP

SEQ ID NO: 134941 - protein, 9 aa, Homo Sapiens
EKTTDFKTT

SEQ ID NO: 134942 - protein, 9 aa, Homo Sapiens
VEVWATIGE

SEQ ID NO: 134943 - protein, 9 aa, Homo Sapiens
LLCCSQSPL

SEQ ID NO: 134944 - protein, 9 aa, Homo Sapiens
RRWRPAARS

SEQ ID NO: 134945 - protein, 9 aa, Homo Sapiens
RRKCRTLQR

SEQ ID NO: 134946 - protein, 9 aa, Homo Sapiens
HGAPAAPGC

SEQ ID NO: 134947 - protein, 9 aa, Homo Sapiens
QEVVKKPRA

SEQ ID NO: 134948 - protein, 9 aa, Homo Sapiens
KLGEMHLKE

SEQ ID NO: 134949 - protein, 9 aa, Homo Sapiens
RASHVDDLP

SEQ ID NO: 134950 - protein, 9 aa, Homo Sapiens
GSWMSSVPV

SEQ ID NO: 134951 - protein, 9 aa, Homo Sapiens
SRLPPTYMH

SEQ ID NO: 134952 - protein, 9 aa, Homo Sapiens
HILQGFQQI

SEQ ID NO: 134953 - protein, 9 aa, Homo Sapiens
AEARSMTLP

SEQ ID NO: 134954 - protein, 9 aa, Homo Sapiens
EQRKKKYQK

SEQ ID NO: 134955 - protein, 9 aa, Homo Sapiens
ENEVMVLAA

SEQ ID NO: 134956 - protein, 9 aa, Homo Sapiens
LSGEIKTFT

SEQ ID NO: 134957 - protein, 9 aa, Homo Sapiens
GEEFFVDQL

SEQ ID NO: 134958 - protein, 9 aa, Homo Sapiens
TKDPPAMRR

SEQ ID NO: 134959 - protein, 9 aa, Homo Sapiens
LLMWQFPAH

SEQ ID NO: 134960 - protein, 9 aa, Homo Sapiens
ACARLPCAP

SEQ ID NO: 134961 - protein, 9 aa, Homo Sapiens
LDIDRLQDG

SEQ ID NO: 134962 - protein, 9 aa, Homo Sapiens
RPHLGLFLL

SEQ ID NO: 134963 - protein, 9 aa, Homo Sapiens
DAAAQELAR

SEQ ID NO: 134964 - protein, 9 aa, Homo Sapiens
LSPQRQSFG

SEQ ID NO: 134965 - protein, 9 aa, Homo Sapiens
SQNAGLFYH

SEQ ID NO: 134966 - protein, 9 aa, Homo Sapiens
APIISSKNW

SEQ ID NO: 134967 - protein, 9 aa, Homo Sapiens
YINASRRFS

SEQ ID NO: 134968 - protein, 9 aa, Homo Sapiens
DTSKLREEI

SEQ ID NO: 134969 - protein, 9 aa, Homo Sapiens
GAKTLPDDE

SEQ ID NO: 134970 - protein, 9 aa, Homo Sapiens
PAIRDIFGF

SEQ ID NO: 134971 - protein, 9 aa, Homo Sapiens
FVPAIRDIF

SEQ ID NO: 134972 - protein, 9 aa, Homo Sapiens
VTLLVSRKC

SEQ ID NO: 134973 - protein, 9 aa, Homo Sapiens
GEPSHPSEK

SEQ ID NO: 134974 - protein, 9 aa, Homo Sapiens
GQKLRAGNR

SEQ ID NO: 134975 - protein, 9 aa, Homo Sapiens
LVSKSQPVA

SEQ ID NO: 134976 - protein, 9 aa, Homo Sapiens
HSPEWSEGR

SEQ ID NO: 134977 - protein, 9 aa, Homo Sapiens
EAFAIVLVS

SEQ ID NO: 134978 - protein, 9 aa, Homo Sapiens
DLQGYVEAQ

SEQ ID NO: 134979 - protein, 9 aa, Homo Sapiens
DVVKKKKKK

SEQ ID NO: 134980 - protein, 9 aa, Homo Sapiens
MAICNPLHY

SEQ ID NO: 134981 - protein, 9 aa, Homo Sapiens
ILSLHMRMH

SEQ ID NO: 134982 - protein, 9 aa, Homo Sapiens
RKRYWCLAL

SEQ ID NO: 134983 - protein, 9 aa, Homo Sapiens
SSDFSLVET

SEQ ID NO: 134984 - protein, 9 aa, Homo Sapiens
QRQSFGGGC

SEQ ID NO: 134985 - protein, 9 aa, Homo Sapiens
LSDELNKHK

SEQ ID NO: 134986 - protein, 9 aa, Homo Sapiens
AFEDVVVGF

SEQ ID NO: 134987 - protein, 9 aa, Homo Sapiens
GMNDSSKTG

SEQ ID NO: 134988 - protein, 9 aa, Homo Sapiens
VQVVVVWKR

SEQ ID NO: 134989 - protein, 9 aa, Homo Sapiens
PASDMGEKP

SEQ ID NO: 134990 - protein, 9 aa, Homo Sapiens
VLVSPAEVR

SEQ ID NO: 134991 - protein, 9 aa, Homo Sapiens
KLRAGNRVR

SEQ ID NO: 134992 - protein, 9 aa, Homo Sapiens
TLLVSRKCQ

SEQ ID NO: 134993 - protein, 9 aa, Homo Sapiens
GMEFATRSI

SEQ ID NO: 134994 - protein, 9 aa, Homo Sapiens
IGFGDYVSG

SEQ ID NO: 134995 - protein, 9 aa, Homo Sapiens
GLTRLPVED

SEQ ID NO: 134996 - protein, 9 aa, Homo Sapiens
CLTDPGKVE

SEQ ID NO: 134997 - protein, 9 aa, Homo Sapiens
AGTTRTRPA

SEQ ID NO: 134998 - protein, 9 aa, Homo Sapiens
TEGFLINAS

SEQ ID NO: 134999 - protein, 9 aa, Homo Sapiens
DLPISVAST

SEQ ID NO: 135000 - protein, 9 aa, Homo Sapiens
KLPPVLNMQ

SEQ ID NO: 135001 - protein, 9 aa, Homo Sapiens
MHEKMSRME

SEQ ID NO: 135002 - protein, 9 aa, Homo Sapiens
AIRDIFGFI

SEQ ID NO: 135003 - protein, 9 aa, Homo Sapiens
LDNEDGLEE

SEQ ID NO: 135004 - protein, 9 aa, Homo Sapiens
LNRMPAEAK

SEQ ID NO: 135005 - protein, 9 aa, Homo Sapiens
CMLHDKFWQ

SEQ ID NO: 135006 - protein, 9 aa, Homo Sapiens
SSLASSQAK

SEQ ID NO: 135007 - protein, 9 aa, Homo Sapiens
MEVLLQNHQ

SEQ ID NO: 135008 - protein, 9 aa, Homo Sapiens
SSETTLESI

SEQ ID NO: 135009 - protein, 9 aa, Homo Sapiens
SHHERSLRM

SEQ ID NO: 135010 - protein, 9 aa, Homo Sapiens
GTSRTRPRH

SEQ ID NO: 135011 - protein, 9 aa, Homo Sapiens
TVLAVRFLV

SEQ ID NO: 135012 - protein, 9 aa, Homo Sapiens
EETRVWHRH

SEQ ID NO: 135013 - protein, 9 aa, Homo Sapiens
YVEAQCGLV

SEQ ID NO: 135014 - protein, 9 aa, Homo Sapiens
YLYSIWSPY

SEQ ID NO: 135015 - protein, 9 aa, Homo Sapiens
LKYAELRTR

SEQ ID NO: 135016 - protein, 9 aa, Homo Sapiens
KPEEKQKPE

SEQ ID NO: 135017 - protein, 9 aa, Homo Sapiens
IIRYFDKGK

SEQ ID NO: 135018 - protein, 9 aa, Homo Sapiens
YSQGGYPQG

SEQ ID NO: 135019 - protein, 9 aa, Homo Sapiens
HCTFGDDWH

SEQ ID NO: 135020 - protein, 9 aa, Homo Sapiens
ALKPRPGHK

SEQ ID NO: 135021 - protein, 9 aa, Homo Sapiens
AGVNLPKII

SEQ ID NO: 135022 - protein, 9 aa, Homo Sapiens
AGLFYHLRI

SEQ ID NO: 135023 - protein, 9 aa, Homo Sapiens
KLRTQFNLL

SEQ ID NO: 135024 - protein, 9 aa, Homo Sapiens
APPVALPPD

SEQ ID NO: 135025 - protein, 9 aa, Homo Sapiens
ELFMETKHQ

SEQ ID NO: 135026 - protein, 9 aa, Homo Sapiens
PPADWDGTG

SEQ ID NO: 135027 - protein, 9 aa, Homo Sapiens
KLVMWAADR

SEQ ID NO: 135028 - protein, 9 aa, Homo Sapiens
NKALDFIAR

SEQ ID NO: 135029 - protein, 9 aa, Homo Sapiens
YHLRIHTGE

SEQ ID NO: 135030 - protein, 9 aa, Homo Sapiens
ESAPPVALP

SEQ ID NO: 135031 - protein, 9 aa, Homo Sapiens
DSYRPSLTG

SEQ ID NO: 135032 - protein, 9 aa, Homo Sapiens
KNHHFDMIN

SEQ ID NO: 135033 - protein, 9 aa, Homo Sapiens
DWHLTNRML

SEQ ID NO: 135034 - protein, 9 aa, Homo Sapiens
TSRTRPRHC

SEQ ID NO: 135035 - protein, 9 aa, Homo Sapiens
TAVHGSSVN

SEQ ID NO: 135036 - protein, 9 aa, Homo Sapiens
SLPAPIISS

SEQ ID NO: 135037 - protein, 9 aa, Homo Sapiens
KENKKVYRL

SEQ ID NO: 135038 - protein, 9 aa, Homo Sapiens
HAATIWLIF

SEQ ID NO: 135039 - protein, 9 aa, Homo Sapiens
SRGPVITTI

SEQ ID NO: 135040 - protein, 9 aa, Homo Sapiens
ETKHQKRVK

SEQ ID NO: 135041 - protein, 9 aa, Homo Sapiens
DGLEEEEEE

SEQ ID NO: 135042 - protein, 9 aa, Homo Sapiens
KRICPSFKE

SEQ ID NO: 135043 - protein, 9 aa, Homo Sapiens
EPSHPSEKR

SEQ ID NO: 135044 - protein, 9 aa, Homo Sapiens
IDRLQDGYR

SEQ ID NO: 135045 - protein, 9 aa, Homo Sapiens
PPCTPPYQV

SEQ ID NO: 135046 - protein, 9 aa, Homo Sapiens
LPVEDHKRF

SEQ ID NO: 135047 - protein, 9 aa, Homo Sapiens
RDDRRERIM

SEQ ID NO: 135048 - protein, 9 aa, Homo Sapiens
RCVKLADFG

SEQ ID NO: 135049 - protein, 9 aa, Homo Sapiens
ASSNLIEYI

SEQ ID NO: 135050 - protein, 9 aa, Homo Sapiens
QQRKKAFPT

SEQ ID NO: 135051 - protein, 9 aa, Homo Sapiens
DVWHQTSQD

SEQ ID NO: 135052 - protein, 9 aa, Homo Sapiens
PPCTPPYQE

SEQ ID NO: 135053 - protein, 9 aa, Homo Sapiens
DLFFSFFFF

SEQ ID NO: 135054 - protein, 9 aa, Homo Sapiens
PPCTPPYQG

SEQ ID NO: 135055 - protein, 9 aa, Homo Sapiens
PCTPPYQVH

SEQ ID NO: 135056 - protein, 9 aa, Homo Sapiens
PQYVKTHPP

SEQ ID NO: 135057 - protein, 9 aa, Homo Sapiens
FNFDIMELP

SEQ ID NO: 135058 - protein, 9 aa, Homo Sapiens
AARSVTASR

SEQ ID NO: 135059 - protein, 9 aa, Homo Sapiens
PVLNMQELE

SEQ ID NO: 135060 - protein, 9 aa, Homo Sapiens
LAVRFLVPP

SEQ ID NO: 135061 - protein, 9 aa, Homo Sapiens
VESDGGDTY

SEQ ID NO: 135062 - protein, 9 aa, Homo Sapiens
SNLIEYISY

SEQ ID NO: 135063 - protein, 9 aa, Homo Sapiens
AMFFIGFTT

SEQ ID NO: 135064 - protein, 9 aa, Homo Sapiens
RLYETYLPE

SEQ ID NO: 135065 - protein, 9 aa, Homo Sapiens
IGFTTLVIM

SEQ ID NO: 135066 - protein, 9 aa, Homo Sapiens
EGQKLRAGN

SEQ ID NO: 135067 - protein, 9 aa, Homo Sapiens
DSQLRKPMY

SEQ ID NO: 135068 - protein, 9 aa, Homo Sapiens
EKSRWSGSH

SEQ ID NO: 135069 - protein, 9 aa, Homo Sapiens
CNLMERQVE

SEQ ID NO: 135070 - protein, 9 aa, Homo Sapiens
SVRIVGSSK

SEQ ID NO: 135071 - protein, 9 aa, Homo Sapiens
RTRPACVDA

SEQ ID NO: 135072 - protein, 9 aa, Homo Sapiens
SLSDELNKH

SEQ ID NO: 135073 - protein, 9 aa, Homo Sapiens
TVSVRAAES

SEQ ID NO: 135074 - protein, 9 aa, Homo Sapiens
ECRCVKLAD

SEQ ID NO: 135075 - protein, 9 aa, Homo Sapiens
VNEAPKEEK

SEQ ID NO: 135076 - protein, 9 aa, Homo Sapiens
AGAVAGPSG

SEQ ID NO: 135077 - protein, 9 aa, Homo Sapiens
ETISTLWYA

SEQ ID NO: 135078 - protein, 9 aa, Homo Sapiens
TTRTRPACV

SEQ ID NO: 135079 - protein, 9 aa, Homo Sapiens
SSSASSSGG

SEQ ID NO: 135080 - protein, 9 aa, Homo Sapiens
LVETDMEST

SEQ ID NO: 135081 - protein, 9 aa, Homo Sapiens
KESSINITN

SEQ ID NO: 135082 - protein, 9 aa, Homo Sapiens
SDGGDTYRR

SEQ ID NO: 135083 - protein, 9 aa, Homo Sapiens
SGEAYKDPS

SEQ ID NO: 135084 - protein, 9 aa, Homo Sapiens
LIVPMSKPT

SEQ ID NO: 135085 - protein, 9 aa, Homo Sapiens
SPEWSEGRF

SEQ ID NO: 135086 - protein, 9 aa, Homo Sapiens
AHGESSLAS

SEQ ID NO: 135087 - protein, 9 aa, Homo Sapiens
AKLVMWAAD

SEQ ID NO: 135088 - protein, 9 aa, Homo Sapiens
NILNRMPAE

SEQ ID NO: 135089 - protein, 9 aa, Homo Sapiens
NEAPKEEKV

SEQ ID NO: 135090 - protein, 9 aa, Homo Sapiens
DKFWQENRP

SEQ ID NO: 135091 - protein, 9 aa, Homo Sapiens
MSMCICQMR

SEQ ID NO: 135092 - protein, 9 aa, Homo Sapiens
GKANRLYET

SEQ ID NO: 135093 - protein, 9 aa, Homo Sapiens
SGRKHQQQK

SEQ ID NO: 135094 - protein, 9 aa, Homo Sapiens
GQIAGTTRT

SEQ ID NO: 135095 - protein, 9 aa, Homo Sapiens
RCCVSFILR

SEQ ID NO: 135096 - protein, 9 aa, Homo Sapiens
TQFNLLIAN

SEQ ID NO: 135097 - protein, 9 aa, Homo Sapiens
PCPCPYINA

SEQ ID NO: 135098 - protein, 9 aa, Homo Sapiens
ARGSRVWRR

SEQ ID NO: 135099 - protein, 9 aa, Homo Sapiens
EMHEKMSRM

SEQ ID NO: 135100 - protein, 9 aa, Homo Sapiens
FDRECRCVK

SEQ ID NO: 135101 - protein, 9 aa, Homo Sapiens
RENHNHSKE

SEQ ID NO: 135102 - protein, 9 aa, Homo Sapiens
SPNIYASSN

SEQ ID NO: 135103 - protein, 9 aa, Homo Sapiens
HEKMSRMER

SEQ ID NO: 135104 - protein, 9 aa, Homo Sapiens
NKHKEILAD

SEQ ID NO: 135105 - protein, 9 aa, Homo Sapiens
DLLPPCTPP

SEQ ID NO: 135106 - protein, 9 aa, Homo Sapiens
CCRCCVSFI

SEQ ID NO: 135107 - protein, 9 aa, Homo Sapiens
PHLGLFLLH

SEQ ID NO: 135108 - protein, 9 aa, Homo Sapiens
MAECNAVRQ

SEQ ID NO: 135109 - protein, 9 aa, Homo Sapiens
DPGKVEKPT

SEQ ID NO: 135110 - protein, 9 aa, Homo Sapiens
MVHQAAEQG

SEQ ID NO: 135111 - protein, 9 aa, Homo Sapiens
GSSETTLES

SEQ ID NO: 135112 - protein, 9 aa, Homo Sapiens
SGDLVSSEQ

SEQ ID NO: 135113 - protein, 9 aa, Homo Sapiens
QFNLLIANL

SEQ ID NO: 135114 - protein, 9 aa, Homo Sapiens
KHQQQKESS

SEQ ID NO: 135115 - protein, 9 aa, Homo Sapiens
PLPSSLIVP

SEQ ID NO: 135116 - protein, 9 aa, Homo Sapiens
GQPGLEGEQ

SEQ ID NO: 135117 - protein, 9 aa, Homo Sapiens
QDGYRPAAR

SEQ ID NO: 135118 - protein, 9 aa, Homo Sapiens
APTPCPKVL

SEQ ID NO: 135119 - protein, 9 aa, Homo Sapiens
VKTHPPTRP

SEQ ID NO: 135120 - protein, 9 aa, Homo Sapiens
PICGLHHLE

SEQ ID NO: 135121 - protein, 9 aa, Homo Sapiens
AEPMARMLE

SEQ ID NO: 135122 - protein, 9 aa, Homo Sapiens
HEKELEKEQ

SEQ ID NO: 135123 - protein, 9 aa, Homo Sapiens
QIDAVCCRC

SEQ ID NO: 135124 - protein, 9 aa, Homo Sapiens
TRNYLYSIW

SEQ ID NO: 135125 - protein, 9 aa, Homo Sapiens
SKSTIGMEF

SEQ ID NO: 135126 - protein, 9 aa, Homo Sapiens
IQRRMPGTD

SEQ ID NO: 135127 - protein, 9 aa, Homo Sapiens
SLEEPELHL

SEQ ID NO: 135128 - protein, 9 aa, Homo Sapiens
LLVIFVPAI

SEQ ID NO: 135129 - protein, 9 aa, Homo Sapiens
EQRWEQGRS

SEQ ID NO: 135130 - protein, 9 aa, Homo Sapiens
SLVETDMES

SEQ ID NO: 135131 - protein, 9 aa, Homo Sapiens
MVIGMSMCI

SEQ ID NO: 135132 - protein, 9 aa, Homo Sapiens
KSTVSVRAA

SEQ ID NO: 135133 - protein, 9 aa, Homo Sapiens
ASIPVGTVT

SEQ ID NO: 135134 - protein, 9 aa, Homo Sapiens
KEEEEKEVN

SEQ ID NO: 135135 - protein, 9 aa, Homo Sapiens
GFTTLVIMW

SEQ ID NO: 135136 - protein, 9 aa, Homo Sapiens
MPHMPTYLV

SEQ ID NO: 135137 - protein, 9 aa, Homo Sapiens
DDWHLTNRM

SEQ ID NO: 135138 - protein, 9 aa, Homo Sapiens
VSMACADLP

SEQ ID NO: 135139 - protein, 9 aa, Homo Sapiens
AVDFHQQLH

SEQ ID NO: 135140 - protein, 9 aa, Homo Sapiens
RNGCWNCSA

SEQ ID NO: 135141 - protein, 9 aa, Homo Sapiens
LNRRKRYWC

SEQ ID NO: 135142 - protein, 9 aa, Homo Sapiens
EKEREHEKE

SEQ ID NO: 135143 - protein, 9 aa, Homo Sapiens
LKDPYERCF

SEQ ID NO: 135144 - protein, 9 aa, Homo Sapiens
VEQRWEQGR

SEQ ID NO: 135145 - protein, 9 aa, Homo Sapiens
IYEWAGRVE

SEQ ID NO: 135146 - protein, 9 aa, Homo Sapiens
LTVMVHQAA

SEQ ID NO: 135147 - protein, 9 aa, Homo Sapiens
RRSLKDVVK

SEQ ID NO: 135148 - protein, 9 aa, Homo Sapiens
LKDVVKKKK

SEQ ID NO: 135149 - protein, 9 aa, Homo Sapiens
IFVPAIRDI

SEQ ID NO: 135150 - protein, 9 aa, Homo Sapiens
QVITLMSLE

SEQ ID NO: 135151 - protein, 9 aa, Homo Sapiens
RKHQQQKES

SEQ ID NO: 135152 - protein, 9 aa, Homo Sapiens
NKKVYRLEL

SEQ ID NO: 135153 - protein, 9 aa, Homo Sapiens
KNLAVDFHQ

SEQ ID NO: 135154 - protein, 9 aa, Homo Sapiens
QIAGTTRTR

SEQ ID NO: 135155 - protein, 9 aa, Homo Sapiens
ADLLCMLHD

SEQ ID NO: 135156 - protein, 9 aa, Homo Sapiens
CKKIQRRMP

SEQ ID NO: 135157 - protein, 9 aa, Homo Sapiens
LHGSVEQRW

SEQ ID NO: 135158 - protein, 9 aa, Homo Sapiens
IGIGEPSHP

SEQ ID NO: 135159 - protein, 9 aa, Homo Sapiens
LRATSFFVK

SEQ ID NO: 135160 - protein, 9 aa, Homo Sapiens
GSSKRGRAE

SEQ ID NO: 135161 - protein, 9 aa, Homo Sapiens
PPTRPSALP

SEQ ID NO: 135162 - protein, 9 aa, Homo Sapiens
TFATNLLTL

SEQ ID NO: 135163 - protein, 9 aa, Homo Sapiens
LYETYLPET

SEQ ID NO: 135164 - protein, 9 aa, Homo Sapiens
KGHTFCSSL

SEQ ID NO: 135165 - protein, 9 aa, Homo Sapiens
LTDPGKVEK

SEQ ID NO: 135166 - protein, 9 aa, Homo Sapiens
LPPCTPPYQ

SEQ ID NO: 135167 - protein, 9 aa, Homo Sapiens
AGNRVRLVC

SEQ ID NO: 135168 - protein, 9 aa, Homo Sapiens
LTVLAVRFL

SEQ ID NO: 135169 - protein, 9 aa, Homo Sapiens
HLVSKSQPV

SEQ ID NO: 135170 - protein, 9 aa, Homo Sapiens
VWHQTSQDQ

SEQ ID NO: 135171 - protein, 9 aa, Homo Sapiens
ADLPISVAS

SEQ ID NO: 135172 - protein, 9 aa, Homo Sapiens
KKCNLMERQ

SEQ ID NO: 135173 - protein, 9 aa, Homo Sapiens
TFCSSLSVR

SEQ ID NO: 135174 - protein, 9 aa, Homo Sapiens
TASDGSEPR

SEQ ID NO: 135175 - protein, 9 aa, Homo Sapiens
RHDGKWQNV

SEQ ID NO: 135176 - protein, 9 aa, Homo Sapiens
PMARMLEGV

SEQ ID NO: 135177 - protein, 9 aa, Homo Sapiens
MSRMERDIT

SEQ ID NO: 135178 - protein, 9 aa, Homo Sapiens
KSSPESREE

SEQ ID NO: 135179 - protein, 9 aa, Homo Sapiens
DGGDTYRRL

SEQ ID NO: 135180 - protein, 9 aa, Homo Sapiens
LLHLVSKSQ

SEQ ID NO: 135181 - protein, 9 aa, Homo Sapiens
SHQGSTISK

SEQ ID NO: 135182 - protein, 9 aa, Homo Sapiens
RGPVITTIV

SEQ ID NO: 135183 - protein, 9 aa, Homo Sapiens
LLCMLHDKF

SEQ ID NO: 135184 - protein, 9 aa, Homo Sapiens
QNILNRMPA

SEQ ID NO: 135185 - protein, 9 aa, Homo Sapiens
QLKYAELRT

SEQ ID NO: 135186 - protein, 9 aa, Homo Sapiens
VGSSKRGRA

SEQ ID NO: 135187 - protein, 9 aa, Homo Sapiens
PKNHHFDMI

SEQ ID NO: 135188 - protein, 9 aa, Homo Sapiens
VSGGSDIEY

SEQ ID NO: 135189 - protein, 9 aa, Homo Sapiens
PVEDHKRFH

SEQ ID NO: 135190 - protein, 9 aa, Homo Sapiens
KAFPTCSSH

SEQ ID NO: 135191 - protein, 9 aa, Homo Sapiens
VSVRAAESI

SEQ ID NO: 135192 - protein, 9 aa, Homo Sapiens
ASSSGGAGG

SEQ ID NO: 135193 - protein, 9 aa, Homo Sapiens
HLTQPICGL

SEQ ID NO: 135194 - protein, 9 aa, Homo Sapiens
QYVKTHPPT

SEQ ID NO: 135195 - protein, 9 aa, Homo Sapiens
AFNLLHLVS

SEQ ID NO: 135196 - protein, 9 aa, Homo Sapiens
ESIASARPV

SEQ ID NO: 135197 - protein, 9 aa, Homo Sapiens
FLINASNYK

SEQ ID NO: 135198 - protein, 9 aa, Homo Sapiens
ADLHGSVEQ

SEQ ID NO: 135199 - protein, 9 aa, Homo Sapiens
TLSLKDPYE

SEQ ID NO: 135200 - protein, 9 aa, Homo Sapiens
ICGLHHLEY

SEQ ID NO: 135201 - protein, 9 aa, Homo Sapiens
STIGMEFAT

SEQ ID NO: 135202 - protein, 9 aa, Homo Sapiens
TSFFVKDRV

SEQ ID NO: 135203 - protein, 9 aa, Homo Sapiens
LPISVASTP

SEQ ID NO: 135204 - protein, 9 aa, Homo Sapiens
ETTLESIAS

SEQ ID NO: 135205 - protein, 9 aa, Homo Sapiens
EAYKDPSGS

SEQ ID NO: 135206 - protein, 9 aa, Homo Sapiens
EKMSRMERD

SEQ ID NO: 135207 - protein, 9 aa, Homo Sapiens
QNAGLFYHL

SEQ ID NO: 135208 - protein, 9 aa, Homo Sapiens
GLEGEQGPP

SEQ ID NO: 135209 - protein, 9 aa, Homo Sapiens
KAEFRLAGV

SEQ ID NO: 135210 - protein, 9 aa, Homo Sapiens
GSGSGDLVS

SEQ ID NO: 135211 - protein, 9 aa, Homo Sapiens
LTQPICGLH

SEQ ID NO: 135212 - protein, 9 aa, Homo Sapiens
GHKDRRKKG

SEQ ID NO: 135213 - protein, 9 aa, Homo Sapiens
VSSEQLLRG

SEQ ID NO: 135214 - protein, 9 aa, Homo Sapiens
LYSIWSPYA

SEQ ID NO: 135215 - protein, 9 aa, Homo Sapiens
EREHEKELE

SEQ ID NO: 135216 - protein, 9 aa, Homo Sapiens
PSALPWARG

SEQ ID NO: 135217 - protein, 9 aa, Homo Sapiens
KHQKRVKEE

SEQ ID NO: 135218 - protein, 9 aa, Homo Sapiens
VRFLVPPKI

SEQ ID NO: 135219 - protein, 9 aa, Homo Sapiens
LFYHLRIHT

SEQ ID NO: 135220 - protein, 9 aa, Homo Sapiens
ATATQENPS

SEQ ID NO: 135221 - protein, 9 aa, Homo Sapiens
SWVLSMACL

SEQ ID NO: 135222 - protein, 9 aa, Homo Sapiens
PMAGLSDGP

SEQ ID NO: 135223 - protein, 9 aa, Homo Sapiens
QLLPQEELD

SEQ ID NO: 135224 - protein, 9 aa, Homo Sapiens
PRRPLPSTA

SEQ ID NO: 135225 - protein, 9 aa, Homo Sapiens
HDVWHQTSQ

SEQ ID NO: 135226 - protein, 9 aa, Homo Sapiens
TPCPKVLRC

SEQ ID NO: 135227 - protein, 9 aa, Homo Sapiens
CALAGAQFQ

SEQ ID NO: 135228 - protein, 9 aa, Homo Sapiens
FATNLLTLS

SEQ ID NO: 135229 - protein, 9 aa, Homo Sapiens
YEWAGRVEG

SEQ ID NO: 135230 - protein, 9 aa, Homo Sapiens
EQLYQEIIR

SEQ ID NO: 135231 - protein, 9 aa, Homo Sapiens
ARSVTASRC

SEQ ID NO: 135232 - protein, 9 aa, Homo Sapiens
AQFQEETET

SEQ ID NO: 135233 - protein, 9 aa, Homo Sapiens
EWSEGRFRV

SEQ ID NO: 135234 - protein, 9 aa, Homo Sapiens
SKRGRAEVY

SEQ ID NO: 135235 - protein, 9 aa, Homo Sapiens
QKLRVCVAT

SEQ ID NO: 135236 - protein, 9 aa, Homo Sapiens
VETDMESTV

SEQ ID NO: 135237 - protein, 9 aa, Homo Sapiens
ESKSTIGME

SEQ ID NO: 135238 - protein, 9 aa, Homo Sapiens
GAHGESSLA

SEQ ID NO: 135239 - protein, 9 aa, Homo Sapiens
PTPCPKVLR

SEQ ID NO: 135240 - protein, 9 aa, Homo Sapiens
AGVAGAVAG

SEQ ID NO: 135241 - protein, 9 aa, Homo Sapiens
LPKNHHFDM

SEQ ID NO: 135242 - protein, 9 aa, Homo Sapiens
ASDGSEPRR

SEQ ID NO: 135243 - protein, 9 aa, Homo Sapiens
YVSGGSDIE

SEQ ID NO: 135244 - protein, 9 aa, Homo Sapiens
LNSLTLSLK

SEQ ID NO: 135245 - protein, 9 aa, Homo Sapiens
GLTVLAVRF

SEQ ID NO: 135246 - protein, 9 aa, Homo Sapiens
GLFYHLRIH

SEQ ID NO: 135247 - protein, 9 aa, Homo Sapiens
GFGDYVSGG

SEQ ID NO: 135248 - protein, 9 aa, Homo Sapiens
GSEPRRSST

SEQ ID NO: 135249 - protein, 9 aa, Homo Sapiens
KEFRLPKNH

SEQ ID NO: 135250 - protein, 9 aa, Homo Sapiens
IFSNGHLGS

SEQ ID NO: 135251 - protein, 9 aa, Homo Sapiens
SDELNKHKE

SEQ ID NO: 135252 - protein, 9 aa, Homo Sapiens
EVLLQNHQL

SEQ ID NO: 135253 - protein, 9 aa, Homo Sapiens
FFVKDRVVH

SEQ ID NO: 135254 - protein, 9 aa, Homo Sapiens
LLPPCTPPY

SEQ ID NO: 135255 - protein, 9 aa, Homo Sapiens
VHQAAEQGQ

SEQ ID NO: 135256 - protein, 9 aa, Homo Sapiens
VTPRGLGAL

SEQ ID NO: 135257 - protein, 9 aa, Homo Sapiens
CINLNLTLF

SEQ ID NO: 135258 - protein, 9 aa, Homo Sapiens
WHLTNRMLS

SEQ ID NO: 135259 - protein, 9 aa, Homo Sapiens
VRREQVAFE

SEQ ID NO: 135260 - protein, 9 aa, Homo Sapiens
LPDDEETPE

SEQ ID NO: 135261 - protein, 9 aa, Homo Sapiens
PGKVEKPTL

SEQ ID NO: 135262 - protein, 9 aa, Homo Sapiens
LPPVLNMQE

SEQ ID NO: 135263 - protein, 9 aa, Homo Sapiens
AFQPCASNQ

SEQ ID NO: 135264 - protein, 9 aa, Homo Sapiens
QKESSINIT

SEQ ID NO: 135265 - protein, 9 aa, Homo Sapiens
IPVGTVTVN

SEQ ID NO: 135266 - protein, 9 aa, Homo Sapiens
LWYANRAKN

SEQ ID NO: 135267 - protein, 9 aa, Homo Sapiens
INVTLLQTE

SEQ ID NO: 135268 - protein, 9 aa, Homo Sapiens
NLLHLVSKS

SEQ ID NO: 135269 - protein, 9 aa, Homo Sapiens
EFRLPKNHH

SEQ ID NO: 135270 - protein, 9 aa, Homo Sapiens
VGTVTVNAA

SEQ ID NO: 135271 - protein, 9 aa, Homo Sapiens
DDRRERIMA

SEQ ID NO: 135272 - protein, 9 aa, Homo Sapiens
PEIGAKQVQ

SEQ ID NO: 135273 - protein, 9 aa, Homo Sapiens
EEEKEVNEA

SEQ ID NO: 135274 - protein, 9 aa, Homo Sapiens
ILNRMPAEA

SEQ ID NO: 135275 - protein, 9 aa, Homo Sapiens
VLNMQELEA

SEQ ID NO: 135276 - protein, 9 aa, Homo Sapiens
IRYFDKGKM

SEQ ID NO: 135277 - protein, 9 aa, Homo Sapiens
VPAIRDIFG

SEQ ID NO: 135278 - protein, 9 aa, Homo Sapiens
HLEHCIEFV

SEQ ID NO: 135279 - protein, 9 aa, Homo Sapiens
RAGNRVRLV

SEQ ID NO: 135280 - protein, 9 aa, Homo Sapiens
KEVNEAPKE

SEQ ID NO: 135281 - protein, 9 aa, Homo Sapiens
CPKVLRCKC

SEQ ID NO: 135282 - protein, 9 aa, Homo Sapiens
PRHCEGAGP

SEQ ID NO: 135283 - protein, 9 aa, Homo Sapiens
DYVSGGSDI

SEQ ID NO: 135284 - protein, 9 aa, Homo Sapiens
EPELHLEHC

SEQ ID NO: 135285 - protein, 9 aa, Homo Sapiens
VNPNTRKLI

SEQ ID NO: 135286 - protein, 9 aa, Homo Sapiens
NLAVDFHQQ

SEQ ID NO: 135287 - protein, 9 aa, Homo Sapiens
KRPASDMGE

SEQ ID NO: 135288 - protein, 9 aa, Homo Sapiens
SHPSEKRRT

SEQ ID NO: 135289 - protein, 9 aa, Homo Sapiens
SLIVPMSKP

SEQ ID NO: 135290 - protein, 9 aa, Homo Sapiens
TAAGVAGAV

SEQ ID NO: 135291 - protein, 9 aa, Homo Sapiens
DGSEPRRSS

SEQ ID NO: 135292 - protein, 9 aa, Homo Sapiens
RNYLYSIWS

SEQ ID NO: 135293 - protein, 9 aa, Homo Sapiens
CTPPYQGDV

SEQ ID NO: 135294 - protein, 9 aa, Homo Sapiens
PCTPPYQGD

SEQ ID NO: 135295 - protein, 9 aa, Homo Sapiens
INLNLTLFN

SEQ ID NO: 135296 - protein, 9 aa, Homo Sapiens
HQKRVKEEK

SEQ ID NO: 135297 - protein, 9 aa, Homo Sapiens
EEPELHLEH

SEQ ID NO: 135298 - protein, 9 aa, Homo Sapiens
KTGAVYVPE

SEQ ID NO: 135299 - protein, 9 aa, Homo Sapiens
LTRQWSLRL

SEQ ID NO: 135300 - protein, 9 aa, Homo Sapiens
IRDSQLRKP

SEQ ID NO: 135301 - protein, 9 aa, Homo Sapiens
PCTPPYQGT

SEQ ID NO: 135302 - protein, 9 aa, Homo Sapiens
YMAICNPLH

SEQ ID NO: 135303 - protein, 9 aa, Homo Sapiens
GAVAGPSGD

SEQ ID NO: 135304 - protein, 9 aa, Homo Sapiens
DNRCQGFKE

SEQ ID NO: 135305 - protein, 9 aa, Homo Sapiens
KEMHEKMSR

SEQ ID NO: 135306 - protein, 9 aa, Homo Sapiens
RKKAFPTCS

SEQ ID NO: 135307 - protein, 9 aa, Homo Sapiens
GHAATIWLI

SEQ ID NO: 135308 - protein, 9 aa, Homo Sapiens
DRLQDGYRP

SEQ ID NO: 135309 - protein, 9 aa, Homo Sapiens
QTSQDQLRA

SEQ ID NO: 135310 - protein, 9 aa, Homo Sapiens
VITTIVTVL

SEQ ID NO: 135311 - protein, 9 aa, Homo Sapiens
EKLPPVLNM

SEQ ID NO: 135312 - protein, 9 aa, Homo Sapiens
WLIFHWDRK

SEQ ID NO: 135313 - protein, 9 aa, Homo Sapiens
GPVITTIVT

SEQ ID NO: 135314 - protein, 9 aa, Homo Sapiens
AFAIVLVSP

SEQ ID NO: 135315 - protein, 9 aa, Homo Sapiens
VIFVPAIRD

SEQ ID NO: 135316 - protein, 9 aa, Homo Sapiens
RQWSLRLRG

SEQ ID NO: 135317 - protein, 9 aa, Homo Sapiens
FQFRNGCWN

SEQ ID NO: 135318 - protein, 9 aa, Homo Sapiens
IAKLVMWAA

SEQ ID NO: 135319 - protein, 9 aa, Homo Sapiens
QLKYSRHLL

SEQ ID NO: 135320 - protein, 9 aa, Homo Sapiens
FKLDNEDGL

SEQ ID NO: 135321 - protein, 9 aa, Homo Sapiens
GGELQCPPM

SEQ ID NO: 135322 - protein, 9 aa, Homo Sapiens
RTWWASAAR

SEQ ID NO: 135323 - protein, 9 aa, Homo Sapiens
LVMWAADRQ

SEQ ID NO: 135324 - protein, 9 aa, Homo Sapiens
VVKKKKKKD

SEQ ID NO: 135325 - protein, 9 aa, Homo Sapiens
VLTASDGSE

SEQ ID NO: 135326 - protein, 9 aa, Homo Sapiens
QKLRAGNRV

SEQ ID NO: 135327 - protein, 9 aa, Homo Sapiens
ALAGAQFQE

SEQ ID NO: 135328 - protein, 9 aa, Homo Sapiens
NLLVIFVPA

SEQ ID NO: 135329 - protein, 9 aa, Homo Sapiens
IASAASIPV

SEQ ID NO: 135330 - protein, 9 aa, Homo Sapiens
QVAFEDVVV

SEQ ID NO: 135331 - protein, 9 aa, Homo Sapiens
KKIQRRMPG

SEQ ID NO: 135332 - protein, 9 aa, Homo Sapiens
CTPPYQEPA

SEQ ID NO: 135333 - protein, 9 aa, Homo Sapiens
KLTVMVHQA

SEQ ID NO: 135334 - protein, 9 aa, Homo Sapiens
GSGEAYKDP

SEQ ID NO: 135335 - protein, 9 aa, Homo Sapiens
VEKPTLEPC

SEQ ID NO: 135336 - protein, 9 aa, Homo Sapiens
IISSKNWLR

SEQ ID NO: 135337 - protein, 9 aa, Homo Sapiens
ARKGVKLVS

SEQ ID NO: 135338 - protein, 9 aa, Homo Sapiens
LVLTASDGS

SEQ ID NO: 135339 - protein, 9 aa, Homo Sapiens
RVWHRHDGK

SEQ ID NO: 135340 - protein, 9 aa, Homo Sapiens
ANRLYETYL

SEQ ID NO: 135341 - protein, 9 aa, Homo Sapiens
PYSQGGYPQ

SEQ ID NO: 135342 - protein, 9 aa, Homo Sapiens
VLAVRFLVP

SEQ ID NO: 135343 - protein, 9 aa, Homo Sapiens
TFGDDWHLT

SEQ ID NO: 135344 - protein, 9 aa, Homo Sapiens
ASAARSVTA

SEQ ID NO: 135345 - protein, 9 aa, Homo Sapiens
GADDLQGYV

SEQ ID NO: 135346 - protein, 9 aa, Homo Sapiens
ETESCSVAQ

SEQ ID NO: 135347 - protein, 9 aa, Homo Sapiens
LECLVSHHE

SEQ ID NO: 135348 - protein, 9 aa, Homo Sapiens
SKTGFQDKF

SEQ ID NO: 135349 - protein, 9 aa, Homo Sapiens
MWAADRQAA

SEQ ID NO: 135350 - protein, 9 aa, Homo Sapiens
SRHLLVPLL

SEQ ID NO: 135351 - protein, 9 aa, Homo Sapiens
IVLVSPAEV

SEQ ID NO: 135352 - protein, 9 aa, Homo Sapiens
PIISSKNWL

SEQ ID NO: 135353 - protein, 9 aa, Homo Sapiens
LKPRPGHKD

SEQ ID NO: 135354 - protein, 9 aa, Homo Sapiens
LAVDFHQQL

SEQ ID NO: 135355 - protein, 9 aa, Homo Sapiens
VAGAVAGPS

SEQ ID NO: 135356 - protein, 9 aa, Homo Sapiens
STAPTPCPK

SEQ ID NO: 135357 - protein, 9 aa, Homo Sapiens
AQGPRRPLP

SEQ ID NO: 135358 - protein, 9 aa, Homo Sapiens
CTPPYQVHI

SEQ ID NO: 135359 - protein, 9 aa, Homo Sapiens
KDPYERCFS

SEQ ID NO: 135360 - protein, 9 aa, Homo Sapiens
DRRERIMAE

SEQ ID NO: 135361 - protein, 9 aa, Homo Sapiens
CPYINASRR

SEQ ID NO: 135362 - protein, 9 aa, Homo Sapiens
PVALPPDKK

SEQ ID NO: 135363 - protein, 9 aa, Homo Sapiens
AVCCRCCVS

SEQ ID NO: 135364 - protein, 9 aa, Homo Sapiens
NSLTLSLKD

SEQ ID NO: 135365 - protein, 9 aa, Homo Sapiens
YRPSLTGSV

SEQ ID NO: 135366 - protein, 9 aa, Homo Sapiens
LATEKSRWS

SEQ ID NO: 135367 - protein, 9 aa, Homo Sapiens
FSQNAGLFY

SEQ ID NO: 135368 - protein, 9 aa, Homo Sapiens
FFSFFFFFF

SEQ ID NO: 135369 - protein, 9 aa, Homo Sapiens
NYLYSIWSP

SEQ ID NO: 135370 - protein, 9 aa, Homo Sapiens
KLNRRKRYW

SEQ ID NO: 135371 - protein, 9 aa, Homo Sapiens
DLVSSEQLL

SEQ ID NO: 135372 - protein, 9 aa, Homo Sapiens
LEPVKENKK

SEQ ID NO: 135373 - protein, 9 aa, Homo Sapiens
QLARMSKSS

SEQ ID NO: 135374 - protein, 9 aa, Homo Sapiens
VIGMSMCIC

SEQ ID NO: 135375 - protein, 9 aa, Homo Sapiens
FLLHQVLRK

SEQ ID NO: 135376 - protein, 9 aa, Homo Sapiens
ESSLASSQA

SEQ ID NO: 135377 - protein, 9 aa, Homo Sapiens
HGESSLASS

SEQ ID NO: 135378 - protein, 9 aa, Homo Sapiens
ATIWLIFHW

SEQ ID NO: 135379 - protein, 9 aa, Homo Sapiens
TRPACVDAR

SEQ ID NO: 135380 - protein, 9 aa, Homo Sapiens
THPPTRPSA

SEQ ID NO: 135381 - protein, 9 aa, Homo Sapiens
FCKKIQRRM

SEQ ID NO: 135382 - protein, 9 aa, Homo Sapiens
LPSSLIVPM

SEQ ID NO: 135383 - protein, 9 aa, Homo Sapiens
VSKSQPVAL

SEQ ID NO: 135384 - protein, 9 aa, Homo Sapiens
SVVAQGPRR

SEQ ID NO: 135385 - protein, 9 aa, Homo Sapiens
GKTRNYLYS

SEQ ID NO: 135386 - protein, 9 aa, Homo Sapiens
LCMLHDKFW

SEQ ID NO: 135387 - protein, 9 aa, Homo Sapiens
GCALAGAQF

SEQ ID NO: 135388 - protein, 9 aa, Homo Sapiens
KGSGEAYKD

SEQ ID NO: 135389 - protein, 9 aa, Homo Sapiens
KLKQMLNNK

SEQ ID NO: 135390 - protein, 9 aa, Homo Sapiens
QNSPLPSSL

SEQ ID NO: 135391 - protein, 9 aa, Homo Sapiens
RCQGFKEKW

SEQ ID NO: 135392 - protein, 9 aa, Homo Sapiens
AYKDPSGSP

SEQ ID NO: 135393 - protein, 9 aa, Homo Sapiens
RPGHKDRRK

SEQ ID NO: 135394 - protein, 9 aa, Homo Sapiens
PGHGVYINV

SEQ ID NO: 135395 - protein, 9 aa, Homo Sapiens
ACADLPISV

SEQ ID NO: 135396 - protein, 9 aa, Homo Sapiens
AAFQPCASN

SEQ ID NO: 135397 - protein, 9 aa, Homo Sapiens
STMPHMPTY

SEQ ID NO: 135398 - protein, 9 aa, Homo Sapiens
TSQDQLRAL

SEQ ID NO: 135399 - protein, 9 aa, Homo Sapiens
VHGSSVNRR

SEQ ID NO: 135400 - protein, 9 aa, Homo Sapiens
GELQCPPMA

SEQ ID NO: 135401 - protein, 9 aa, Homo Sapiens
ERIMAECNA

SEQ ID NO: 135402 - protein, 9 aa, Homo Sapiens
RRERIMAEC

SEQ ID NO: 135403 - protein, 9 aa, Homo Sapiens
FRLPKNHHF

SEQ ID NO: 135404 - protein, 9 aa, Homo Sapiens
SVEQRWEQG

SEQ ID NO: 135405 - protein, 9 aa, Homo Sapiens
RPSALPWAR

SEQ ID NO: 135406 - protein, 9 aa, Homo Sapiens
AVRREQVAF

SEQ ID NO: 135407 - protein, 9 aa, Homo Sapiens
LAVRREQVA

SEQ ID NO: 135408 - protein, 9 aa, Homo Sapiens
IVTEKSTVS

SEQ ID NO: 135409 - protein, 9 aa, Homo Sapiens
TMPHMPTYL

SEQ ID NO: 135410 - protein, 9 aa, Homo Sapiens
GHGVYINVT

SEQ ID NO: 135411 - protein, 9 aa, Homo Sapiens
FSFFFFFFF

SEQ ID NO: 135412 - protein, 9 aa, Homo Sapiens
LPLEGAKIF

SEQ ID NO: 135413 - protein, 9 aa, Homo Sapiens
KHLTQPICG

SEQ ID NO: 135414 - protein, 9 aa, Homo Sapiens
FPQYVKTHP

SEQ ID NO: 135415 - protein, 9 aa, Homo Sapiens
PYINASRRF

SEQ ID NO: 135416 - protein, 9 aa, Homo Sapiens
KKKGSGEAY

SEQ ID NO: 135417 - protein, 9 aa, Homo Sapiens
PNIYASSNL

SEQ ID NO: 135418 - protein, 9 aa, Homo Sapiens
LVIFVPAIR

SEQ ID NO: 135419 - protein, 9 aa, Homo Sapiens
QDLFFSFFF

SEQ ID NO: 135420 - protein, 9 aa, Homo Sapiens
SFAALTKLE

SEQ ID NO: 135421 - protein, 9 aa, Homo Sapiens
VIGIGEPSH

SEQ ID NO: 135422 - protein, 9 aa, Homo Sapiens
TTLVIMWQK

SEQ ID NO: 135423 - protein, 9 aa, Homo Sapiens
GESSLASSQ

SEQ ID NO: 135424 - protein, 9 aa, Homo Sapiens
NDSSKTGFQ

SEQ ID NO: 135425 - protein, 9 aa, Homo Sapiens
WCLALKGFH

SEQ ID NO: 135426 - protein, 9 aa, Homo Sapiens
PPMAGLSDG

SEQ ID NO: 135427 - protein, 9 aa, Homo Sapiens
FTVDFWTIR

SEQ ID NO: 135428 - protein, 9 aa, Homo Sapiens
RILASDSYR

SEQ ID NO: 135429 - protein, 9 aa, Homo Sapiens
DETISTLWY

SEQ ID NO: 135430 - protein, 9 aa, Homo Sapiens
LHMRMHTGE

SEQ ID NO: 135431 - protein, 9 aa, Homo Sapiens
LNKHKEILA

SEQ ID NO: 135432 - protein, 9 aa, Homo Sapiens
TAPTPCPKV

SEQ ID NO: 135433 - protein, 9 aa, Homo Sapiens
RREQVAFED

SEQ ID NO: 135434 - protein, 9 aa, Homo Sapiens
CPSFKEAAL

SEQ ID NO: 135435 - protein, 9 aa, Homo Sapiens
RPASDMGEK

SEQ ID NO: 135436 - protein, 9 aa, Homo Sapiens
LHQVLRKLK

SEQ ID NO: 135437 - protein, 9 aa, Homo Sapiens
GLATEKSRW

SEQ ID NO: 135438 - protein, 9 aa, Homo Sapiens
TQRYSDTSK

SEQ ID NO: 135439 - protein, 9 aa, Homo Sapiens
RATATQENP

SEQ ID NO: 135440 - protein, 9 aa, Homo Sapiens
IVGSSKRGR

SEQ ID NO: 135441 - protein, 9 aa, Homo Sapiens
PVITTIVTV

SEQ ID NO: 135442 - protein, 9 aa, Homo Sapiens
RKPMYYFLS

SEQ ID NO: 135443 - protein, 9 aa, Homo Sapiens
LLTVMAYDC

SEQ ID NO: 135444 - protein, 9 aa, Homo Sapiens
NKLTVMVHQ

SEQ ID NO: 135445 - protein, 9 aa, Homo Sapiens
SNQFQCLSR

SEQ ID NO: 135446 - protein, 9 aa, Homo Sapiens
PCPYINASR

SEQ ID NO: 135447 - protein, 9 aa, Homo Sapiens
KVVTLLVSR

SEQ ID NO: 135448 - protein, 9 aa, Homo Sapiens
DLHGSVEQR

SEQ ID NO: 135449 - protein, 9 aa, Homo Sapiens
FYHLRIHTG

SEQ ID NO: 135450 - protein, 9 aa, Homo Sapiens
SSKRGRAEV

SEQ ID NO: 135451 - protein, 9 aa, Homo Sapiens
LKYSRHLLV

SEQ ID NO: 135452 - protein, 9 aa, Homo Sapiens
RAMAGLGQL

SEQ ID NO: 135453 - protein, 9 aa, Homo Sapiens
YDETISTLW

SEQ ID NO: 135454 - protein, 9 aa, Homo Sapiens
EIIRYFDKG

SEQ ID NO: 135455 - protein, 9 aa, Homo Sapiens
HQQLHPAQK

SEQ ID NO: 135456 - protein, 9 aa, Homo Sapiens
LNMQELEAY

SEQ ID NO: 135457 - protein, 9 aa, Homo Sapiens
RMPAEAKNP

SEQ ID NO: 135458 - protein, 9 aa, Homo Sapiens
VLRKLKQML

SEQ ID NO: 135459 - protein, 9 aa, Homo Sapiens
AKIFSNGHL

SEQ ID NO: 135460 - protein, 9 aa, Homo Sapiens
KLTTFATNL

SEQ ID NO: 135461 - protein, 9 aa, Homo Sapiens
KIQRRMPGT

SEQ ID NO: 135462 - protein, 9 aa, Homo Sapiens
YWCLALKGF

SEQ ID NO: 135463 - protein, 9 aa, Homo Sapiens
KQKPEEKQK

SEQ ID NO: 135464 - protein, 9 aa, Homo Sapiens
SMACADLPI

SEQ ID NO: 135465 - protein, 9 aa, Homo Sapiens
IRENHNHSK

SEQ ID NO: 135466 - protein, 9 aa, Homo Sapiens
DELNKHKEI

SEQ ID NO: 135467 - protein, 9 aa, Homo Sapiens
VMVHQAAEQ

SEQ ID NO: 135468 - protein, 9 aa, Homo Sapiens
QGLSHQGST

SEQ ID NO: 135469 - protein, 9 aa, Homo Sapiens
PADLDNRCQ

SEQ ID NO: 135470 - protein, 9 aa, Homo Sapiens
NANVGDAAA

SEQ ID NO: 135471 - protein, 9 aa, Homo Sapiens
SSSSASSSG

SEQ ID NO: 135472 - protein, 9 aa, Homo Sapiens
LFFSFFFFF

SEQ ID NO: 135473 - protein, 9 aa, Homo Sapiens
TKHQKRVKE

SEQ ID NO: 135474 - protein, 9 aa, Homo Sapiens
AQQRKKAFP

SEQ ID NO: 135475 - protein, 9 aa, Homo Sapiens
TPKPRPHLG

SEQ ID NO: 135476 - protein, 9 aa, Homo Sapiens
LSYDIIDGD

SEQ ID NO: 135477 - protein, 9 aa, Homo Sapiens
AHDVWHQTS

SEQ ID NO: 135478 - protein, 9 aa, Homo Sapiens
WKREGLLHS

SEQ ID NO: 135479 - protein, 9 aa, Homo Sapiens
LQLKYSRHL

SEQ ID NO: 135480 - protein, 9 aa, Homo Sapiens
GHTFCSSLS

SEQ ID NO: 135481 - protein, 9 aa, Homo Sapiens
RPSLTGSVG

SEQ ID NO: 135482 - protein, 9 aa, Homo Sapiens
NAQLSYDII

SEQ ID NO: 135483 - protein, 9 aa, Homo Sapiens
TVQVVVVWK

SEQ ID NO: 135484 - protein, 9 aa, Homo Sapiens
ILASDSYRP

SEQ ID NO: 135485 - protein, 9 aa, Homo Sapiens
SQGGYPQGP

SEQ ID NO: 135486 - protein, 9 aa, Homo Sapiens
HSSSSASSS

SEQ ID NO: 135487 - protein, 9 aa, Homo Sapiens
LADGSLCYP

SEQ ID NO: 135488 - protein, 9 aa, Homo Sapiens
LAKKCNLME

SEQ ID NO: 135489 - protein, 9 aa, Homo Sapiens
NGNNQKLRV

SEQ ID NO: 135490 - protein, 9 aa, Homo Sapiens
MACADLPIS

SEQ ID NO: 135491 - protein, 9 aa, Homo Sapiens
WVLSMACLM

SEQ ID NO: 135492 - protein, 9 aa, Homo Sapiens
GEKPKTPKK

SEQ ID NO: 135493 - protein, 9 aa, Homo Sapiens
TCLKLLTAV

SEQ ID NO: 135494 - protein, 9 aa, Homo Sapiens
NPLHYTVIM

SEQ ID NO: 135495 - protein, 9 aa, Homo Sapiens
ICPSFKEAA

SEQ ID NO: 135496 - protein, 9 aa, Homo Sapiens
LVSRKCQID

SEQ ID NO: 135497 - protein, 9 aa, Homo Sapiens
EHEKELEKE

SEQ ID NO: 135498 - protein, 9 aa, Homo Sapiens
LAGVNLPKI

SEQ ID NO: 135499 - protein, 9 aa, Homo Sapiens
SEGRFRVDR

SEQ ID NO: 135500 - protein, 9 aa, Homo Sapiens
SWGHAATIW

SEQ ID NO: 135501 - protein, 9 aa, Homo Sapiens
VTVQVVVVW

SEQ ID NO: 135502 - protein, 9 aa, Homo Sapiens
ASNQFQCLS

SEQ ID NO: 135503 - protein, 9 aa, Homo Sapiens
LLHQVLRKL

SEQ ID NO: 135504 - protein, 9 aa, Homo Sapiens
PQGAHGESS

SEQ ID NO: 135505 - protein, 9 aa, Homo Sapiens
FGLATEKSR

SEQ ID NO: 135506 - protein, 9 aa, Homo Sapiens
GDDWHLTNR

SEQ ID NO: 135507 - protein, 9 aa, Homo Sapiens
CWCVNPNTR

SEQ ID NO: 135508 - protein, 9 aa, Homo Sapiens
QDIGENAQL

SEQ ID NO: 135509 - protein, 9 aa, Homo Sapiens
GTTRTRPAC

SEQ ID NO: 135510 - protein, 9 aa, Homo Sapiens
TRQQMEQQQ

SEQ ID NO: 135511 - protein, 9 aa, Homo Sapiens
RDVEALSLL

SEQ ID NO: 135512 - protein, 9 aa, Homo Sapiens
SRVWRRTWW

SEQ ID NO: 135513 - protein, 9 aa, Homo Sapiens
VVVVWKREG

SEQ ID NO: 135514 - protein, 9 aa, Homo Sapiens
DIDRLQDGY

SEQ ID NO: 135515 - protein, 9 aa, Homo Sapiens
VSHHERSLR

SEQ ID NO: 135516 - protein, 9 aa, Homo Sapiens
PQGPYSQGG

SEQ ID NO: 135517 - protein, 9 aa, Homo Sapiens
VEALSLLIF

SEQ ID NO: 135518 - protein, 9 aa, Homo Sapiens
MVTPRGLGA

SEQ ID NO: 135519 - protein, 9 aa, Homo Sapiens
PQRQSFGGG

SEQ ID NO: 135520 - protein, 9 aa, Homo Sapiens
RPPVAAANF

SEQ ID NO: 135521 - protein, 9 aa, Homo Sapiens
NNQKLRVCV

SEQ ID NO: 135522 - protein, 9 aa, Homo Sapiens
TTASWVLSM

SEQ ID NO: 135523 - protein, 9 aa, Homo Sapiens
EKNGNNQKL

SEQ ID NO: 135524 - protein, 9 aa, Homo Sapiens
HPSEKRRTE

SEQ ID NO: 135525 - protein, 9 aa, Homo Sapiens
PPTPKPRPH

SEQ ID NO: 135526 - protein, 9 aa, Homo Sapiens
VLSPQRQSF

SEQ ID NO: 135527 - protein, 9 aa, Homo Sapiens
TVMAYDCYV

SEQ ID NO: 135528 - protein, 9 aa, Homo Sapiens
VGDAAAQEL

SEQ ID NO: 135529 - protein, 9 aa, Homo Sapiens
YPQGPYSQG

SEQ ID NO: 135530 - protein, 9 aa, Homo Sapiens
FSPNIYASS

SEQ ID NO: 135531 - protein, 9 aa, Homo Sapiens
FSLVETDME

SEQ ID NO: 135532 - protein, 9 aa, Homo Sapiens
GQLLPQEEL

SEQ ID NO: 135533 - protein, 9 aa, Homo Sapiens
LKLTTFATN

SEQ ID NO: 135534 - protein, 9 aa, Homo Sapiens
PGLEGEQGP

SEQ ID NO: 135535 - protein, 9 aa, Homo Sapiens
PSSLIVPMS

SEQ ID NO: 135536 - protein, 9 aa, Homo Sapiens
TSKLREEIE

SEQ ID NO: 135537 - protein, 9 aa, Homo Sapiens
TFSTMPHMP

SEQ ID NO: 135538 - protein, 9 aa, Homo Sapiens
KKAFPTCSS

SEQ ID NO: 135539 - protein, 9 aa, Homo Sapiens
WHRHDGKWQ

SEQ ID NO: 135540 - protein, 9 aa, Homo Sapiens
TESCSVAQA

SEQ ID NO: 135541 - protein, 9 aa, Homo Sapiens
GIGEPSHPS

SEQ ID NO: 135542 - protein, 9 aa, Homo Sapiens
GYVEAQCGL

SEQ ID NO: 135543 - protein, 9 aa, Homo Sapiens
ALSETSFAA

SEQ ID NO: 135544 - protein, 9 aa, Homo Sapiens
DGSLCYPIV

SEQ ID NO: 135545 - protein, 9 aa, Homo Sapiens
RTQFNLLIA

SEQ ID NO: 135546 - protein, 9 aa, Homo Sapiens
LDFIARKGV

SEQ ID NO: 135547 - protein, 9 aa, Homo Sapiens
FRNGCWNCS

SEQ ID NO: 135548 - protein, 9 aa, Homo Sapiens
LSHQGSTIS

SEQ ID NO: 135549 - protein, 9 aa, Homo Sapiens
GLFLLHQVL

SEQ ID NO: 135550 - protein, 9 aa, Homo Sapiens
GAVYVPEIG

SEQ ID NO: 135551 - protein, 9 aa, Homo Sapiens
DWDGTGGSY

SEQ ID NO: 135552 - protein, 9 aa, Homo Sapiens
FFIGFTTLV

SEQ ID NO: 135553 - protein, 9 aa, Homo Sapiens
VKRDLLPPC

SEQ ID NO: 135554 - protein, 9 aa, Homo Sapiens
VVTLLVSRK

SEQ ID NO: 135555 - protein, 9 aa, Homo Sapiens
RATSFFVKD

SEQ ID NO: 135556 - protein, 9 aa, Homo Sapiens
KLLTAVHGS

SEQ ID NO: 135557 - protein, 9 aa, Homo Sapiens
VRIVGSSKR

SEQ ID NO: 135558 - protein, 9 aa, Homo Sapiens
RKGVKLVSI

SEQ ID NO: 135559 - protein, 9 aa, Homo Sapiens
TIWLIFHWD

SEQ ID NO: 135560 - protein, 9 aa, Homo Sapiens
CQFQFRNGC

SEQ ID NO: 135561 - protein, 9 aa, Homo Sapiens
HHERSLRMT

SEQ ID NO: 135562 - protein, 9 aa, Homo Sapiens
TTIVTVLCL

SEQ ID NO: 135563 - protein, 9 aa, Homo Sapiens
AMAGLGQLL

SEQ ID NO: 135564 - protein, 9 aa, Homo Sapiens
VLLQNHQLR

SEQ ID NO: 135565 - protein, 9 aa, Homo Sapiens
EGFLINASN

SEQ ID NO: 135566 - protein, 9 aa, Homo Sapiens
RQLARMSKS

SEQ ID NO: 135567 - protein, 9 aa, Homo Sapiens
VVWKREGLL

SEQ ID NO: 135568 - protein, 9 aa, Homo Sapiens
GDAAAQELA

SEQ ID NO: 135569 - protein, 9 aa, Homo Sapiens
LHDKFWQEN

SEQ ID NO: 135570 - protein, 9 aa, Homo Sapiens
ETPESAPPV

SEQ ID NO: 135571 - protein, 9 aa, Homo Sapiens
QNHSSSSAS

SEQ ID NO: 135572 - protein, 9 aa, Homo Sapiens
LRAGNRVRL

SEQ ID NO: 135573 - protein, 9 aa, Homo Sapiens
NRLYETYLP

SEQ ID NO: 135574 - protein, 9 aa, Homo Sapiens
PCASNQFQC

SEQ ID NO: 135575 - protein, 9 aa, Homo Sapiens
QGSTISKGH

SEQ ID NO: 135576 - protein, 9 aa, Homo Sapiens
DKEAFAIVL

SEQ ID NO: 135577 - protein, 9 aa, Homo Sapiens
AKTLPDDEE

SEQ ID NO: 135578 - protein, 9 aa, Homo Sapiens
DLPLEGAKI

SEQ ID NO: 135579 - protein, 9 aa, Homo Sapiens
AFPTCSSHV

SEQ ID NO: 135580 - protein, 9 aa, Homo Sapiens
LRTQFNLLI

SEQ ID NO: 135581 - protein, 9 aa, Homo Sapiens
SSNLFQIRA

SEQ ID NO: 135582 - protein, 9 aa, Homo Sapiens
CLVSHHERS

SEQ ID NO: 135583 - protein, 9 aa, Homo Sapiens
WTVTTFSTM

SEQ ID NO: 135584 - protein, 9 aa, Homo Sapiens
QFRNGCWNC

SEQ ID NO: 135585 - protein, 9 aa, Homo Sapiens
QRRMPGTDA

SEQ ID NO: 135586 - protein, 9 aa, Homo Sapiens
WCVNPNTRK

SEQ ID NO: 135587 - protein, 9 aa, Homo Sapiens
IRATATQEN

SEQ ID NO: 135588 - protein, 9 aa, Homo Sapiens
TGGSYRLLR

SEQ ID NO: 135589 - protein, 9 aa, Homo Sapiens
IGDFGLATE

SEQ ID NO: 135590 - protein, 9 aa, Homo Sapiens
PELHLEHCI

SEQ ID NO: 135591 - protein, 9 aa, Homo Sapiens
SDFSLVETD

SEQ ID NO: 135592 - protein, 9 aa, Homo Sapiens
QGYVEAQCG

SEQ ID NO: 135593 - protein, 9 aa, Homo Sapiens
NLNLTLFNL

SEQ ID NO: 135594 - protein, 9 aa, Homo Sapiens
RIMAECNAV

SEQ ID NO: 135595 - protein, 9 aa, Homo Sapiens
PSHPSEKRR

SEQ ID NO: 135596 - protein, 9 aa, Homo Sapiens
STLWYANRA

SEQ ID NO: 135597 - protein, 9 aa, Homo Sapiens
WWASAARSV

SEQ ID NO: 135598 - protein, 9 aa, Homo Sapiens
HQQQKESSI

SEQ ID NO: 135599 - protein, 9 aa, Homo Sapiens
VVAQGPRRP

SEQ ID NO: 135600 - protein, 9 aa, Homo Sapiens
MSKSSPESR

SEQ ID NO: 135601 - protein, 9 aa, Homo Sapiens
QLSYDIIDG

SEQ ID NO: 135602 - protein, 9 aa, Homo Sapiens
PPVLNMQEL

SEQ ID NO: 135603 - protein, 9 aa, Homo Sapiens
HIKEMHEKM

SEQ ID NO: 135604 - protein, 9 aa, Homo Sapiens
VVLSPQRQS

SEQ ID NO: 135605 - protein, 9 aa, Homo Sapiens
SGSGDLVSS

SEQ ID NO: 135606 - protein, 9 aa, Homo Sapiens
KPRPGHKDR

SEQ ID NO: 135607 - protein, 9 aa, Homo Sapiens
ETRVWHRHD

SEQ ID NO: 135608 - protein, 9 aa, Homo Sapiens
DMGEKPKTP

SEQ ID NO: 135609 - protein, 9 aa, Homo Sapiens
LEEPELHLE

SEQ ID NO: 135610 - protein, 9 aa, Homo Sapiens
HSSDFSLVE

SEQ ID NO: 135611 - protein, 9 aa, Homo Sapiens
KNGNNQKLR

SEQ ID NO: 135612 - protein, 9 aa, Homo Sapiens
LTVMAYDCY

SEQ ID NO: 135613 - protein, 9 aa, Homo Sapiens
ASLPAPIIS

SEQ ID NO: 135614 - protein, 9 aa, Homo Sapiens
NRMPAEAKN

SEQ ID NO: 135615 - protein, 9 aa, Homo Sapiens
VITLMSLES

SEQ ID NO: 135616 - protein, 9 aa, Homo Sapiens
QFCKKIQRR

SEQ ID NO: 135617 - protein, 9 aa, Homo Sapiens
FIARKGVKL

SEQ ID NO: 135618 - protein, 9 aa, Homo Sapiens
CTFGDDWHL

SEQ ID NO: 135619 - protein, 9 aa, Homo Sapiens
TRLPVEDHK

SEQ ID NO: 135620 - protein, 9 aa, Homo Sapiens
REKEREHEK

SEQ ID NO: 135621 - protein, 9 aa, Homo Sapiens
DLLCMLHDK

SEQ ID NO: 135622 - protein, 9 aa, Homo Sapiens
DRECRCVKL

SEQ ID NO: 135623 - protein, 9 aa, Homo Sapiens
FPADLDNRC

SEQ ID NO: 135624 - protein, 9 aa, Homo Sapiens
DTYRRLHYN

SEQ ID NO: 135625 - protein, 9 aa, Homo Sapiens
GYPQGPYSQ

SEQ ID NO: 135626 - protein, 9 aa, Homo Sapiens
RSAKGHTFC

SEQ ID NO: 135627 - protein, 9 aa, Homo Sapiens
WAGRVEGRG

SEQ ID NO: 135628 - protein, 9 aa, Homo Sapiens
SETSFAALT

SEQ ID NO: 135629 - protein, 9 aa, Homo Sapiens
RFLVPPKIE

SEQ ID NO: 135630 - protein, 9 aa, Homo Sapiens
DLDNRCQGF

SEQ ID NO: 135631 - protein, 9 aa, Homo Sapiens
PLEGAKIFS

SEQ ID NO: 135632 - protein, 9 aa, Homo Sapiens
PWARGSRVW

SEQ ID NO: 135633 - protein, 9 aa, Homo Sapiens
NGCWNCSAL

SEQ ID NO: 135634 - protein, 9 aa, Homo Sapiens
LLPQEELDA

SEQ ID NO: 135635 - protein, 9 aa, Homo Sapiens
FFFFETESC

SEQ ID NO: 135636 - protein, 9 aa, Homo Sapiens
QQQKESSIN

SEQ ID NO: 135637 - protein, 9 aa, Homo Sapiens
SAKGHTFCS

SEQ ID NO: 135638 - protein, 9 aa, Homo Sapiens
AAGVAGAVA

SEQ ID NO: 135639 - protein, 9 aa, Homo Sapiens
HDGKWQNVH

SEQ ID NO: 135640 - protein, 9 aa, Homo Sapiens
THCTFGDDW

SEQ ID NO: 135641 - protein, 9 aa, Homo Sapiens
KRDLLPPCT

SEQ ID NO: 135642 - protein, 9 aa, Homo Sapiens
TTQRYSDTS

SEQ ID NO: 135643 - protein, 9 aa, Homo Sapiens
LRKLKQMLN

SEQ ID NO: 135644 - protein, 9 aa, Homo Sapiens
DDEETPEQE

SEQ ID NO: 135645 - protein, 9 aa, Homo Sapiens
KVEKPTLEP

SEQ ID NO: 135646 - protein, 9 aa, Homo Sapiens
RIVGSSKRG

SEQ ID NO: 135647 - protein, 9 aa, Homo Sapiens
GMSMCICQM

SEQ ID NO: 135648 - protein, 9 aa, Homo Sapiens
AKGHTFCSS

SEQ ID NO: 135649 - protein, 9 aa, Homo Sapiens
FNLLHLVSK

SEQ ID NO: 135650 - protein, 9 aa, Homo Sapiens
RALKPRPGH

SEQ ID NO: 135651 - protein, 9 aa, Homo Sapiens
LVSPAEVRD

SEQ ID NO: 135652 - protein, 9 aa, Homo Sapiens
FQIRATATQ

SEQ ID NO: 135653 - protein, 9 aa, Homo Sapiens
TTTQRYSDT

SEQ ID NO: 135654 - protein, 9 aa, Homo Sapiens
PTRPSALPW

SEQ ID NO: 135655 - protein, 9 aa, Homo Sapiens
KKVYRLELG

SEQ ID NO: 135656 - protein, 9 aa, Homo Sapiens
TDLATIYEW

SEQ ID NO: 135657 - protein, 9 aa, Homo Sapiens
GSGDLVSSE

SEQ ID NO: 135658 - protein, 9 aa, Homo Sapiens
GPYSQGGYP

SEQ ID NO: 135659 - protein, 9 aa, Homo Sapiens
WRRTWWASA

SEQ ID NO: 135660 - protein, 9 aa, Homo Sapiens
WYANRAKNI

SEQ ID NO: 135661 - protein, 9 aa, Homo Sapiens
NHHFDMINI

SEQ ID NO: 135662 - protein, 9 aa, Homo Sapiens
ITTIVTVLC

SEQ ID NO: 135663 - protein, 9 aa, Homo Sapiens
RLPVEDHKR

SEQ ID NO: 135664 - protein, 9 aa, Homo Sapiens
CICQMRNSS

SEQ ID NO: 135665 - protein, 9 aa, Homo Sapiens
ENAQLSYDI

SEQ ID NO: 135666 - protein, 9 aa, Homo Sapiens
FRLAGVNLP

SEQ ID NO: 135667 - protein, 9 aa, Homo Sapiens
NRVRLVCLA

SEQ ID NO: 135668 - protein, 9 aa, Homo Sapiens
IRQFCKKIQ

SEQ ID NO: 135669 - protein, 9 aa, Homo Sapiens
MCICQMRNS

SEQ ID NO: 135670 - protein, 9 aa, Homo Sapiens
SQAEPMARM

SEQ ID NO: 135671 - protein, 9 aa, Homo Sapiens
GAQFQEETE

SEQ ID NO: 135672 - protein, 9 aa, Homo Sapiens
AICNPLHYT

SEQ ID NO: 135673 - protein, 9 aa, Homo Sapiens
SVRAAESIR

SEQ ID NO: 135674 - protein, 9 aa, Homo Sapiens
AGAQFQEET

SEQ ID NO: 135675 - protein, 9 aa, Homo Sapiens
RQSFGGGCH

SEQ ID NO: 135676 - protein, 9 aa, Homo Sapiens
RYFDKGKMW

SEQ ID NO: 135677 - protein, 9 aa, Homo Sapiens
FCSSLSVRL

SEQ ID NO: 135678 - protein, 9 aa, Homo Sapiens
EGEQGPPGS

SEQ ID NO: 135679 - protein, 9 aa, Homo Sapiens
LVSSEQLLR

SEQ ID NO: 135680 - protein, 9 aa, Homo Sapiens
RRKRYWCLA

SEQ ID NO: 135681 - protein, 9 aa, Homo Sapiens
HPPTRPSAL

SEQ ID NO: 135682 - protein, 9 aa, Homo Sapiens
HGVYINVTL

SEQ ID NO: 135683 - protein, 9 aa, Homo Sapiens
QAEPMARML

SEQ ID NO: 135684 - protein, 9 aa, Homo Sapiens
HFNFDIMEL

SEQ ID NO: 135685 - protein, 9 aa, Homo Sapiens
FGDYVSGGS

SEQ ID NO: 135686 - protein, 9 aa, Homo Sapiens
KKKKKKDQN

SEQ ID NO: 135687 - protein, 9 aa, Homo Sapiens
REHEKELEK

SEQ ID NO: 135688 - protein, 9 aa, Homo Sapiens
GRKHQQQKE

SEQ ID NO: 135689 - protein, 9 aa, Homo Sapiens
SEPRRSSTV

SEQ ID NO: 135690 - protein, 9 aa, Homo Sapiens
YVKTHPPTR

SEQ ID NO: 135691 - protein, 9 aa, Homo Sapiens
RKLIQGAPT

SEQ ID NO: 135692 - protein, 9 aa, Homo Sapiens
WPQGAHGES

SEQ ID NO: 135693 - protein, 9 aa, Homo Sapiens
KYAELRTRQ

SEQ ID NO: 135694 - protein, 9 aa, Homo Sapiens
LDNRCQGFK

SEQ ID NO: 135695 - protein, 9 aa, Homo Sapiens
TIGMEFATR

SEQ ID NO: 135696 - protein, 9 aa, Homo Sapiens
TRQWSLRLR

SEQ ID NO: 135697 - protein, 9 aa, Homo Sapiens
PTPKPRPHL

SEQ ID NO: 135698 - protein, 9 aa, Homo Sapiens
KTHPPTRPS

SEQ ID NO: 135699 - protein, 9 aa, Homo Sapiens
FFETESCSV

SEQ ID NO: 135700 - protein, 9 aa, Homo Sapiens
TRVWHRHDG

SEQ ID NO: 135701 - protein, 9 aa, Homo Sapiens
IGMEFATRS

SEQ ID NO: 135702 - protein, 9 aa, Homo Sapiens
FMLRATSFF

SEQ ID NO: 135703 - protein, 9 aa, Homo Sapiens
NVGDAAAQE

SEQ ID NO: 135704 - protein, 9 aa, Homo Sapiens
TWWASAARS

SEQ ID NO: 135705 - protein, 9 aa, Homo Sapiens
ADWDGTGGS

SEQ ID NO: 135706 - protein, 9 aa, Homo Sapiens
VTLLQTEAV

SEQ ID NO: 135707 - protein, 9 aa, Homo Sapiens
YRRLHYNFK

SEQ ID NO: 135708 - protein, 9 aa, Homo Sapiens
ELHLEHCIE

SEQ ID NO: 135709 - protein, 9 aa, Homo Sapiens
QFQEETETV

SEQ ID NO: 135710 - protein, 9 aa, Homo Sapiens
LKLLTAVHG

SEQ ID NO: 135711 - protein, 9 aa, Homo Sapiens
NLFQIRATA

SEQ ID NO: 135712 - protein, 9 aa, Homo Sapiens
GESTAPTPC

SEQ ID NO: 135713 - protein, 9 aa, Homo Sapiens
SHFNFDIME

SEQ ID NO: 135714 - protein, 9 aa, Homo Sapiens
LQAQPRPPV

SEQ ID NO: 135715 - protein, 9 aa, Homo Sapiens
GNNQKLRVC

SEQ ID NO: 135716 - protein, 9 aa, Homo Sapiens
GGYPQGPYS

SEQ ID NO: 135717 - protein, 9 aa, Homo Sapiens
GSLCYPIVT

SEQ ID NO: 135718 - protein, 9 aa, Homo Sapiens
LITEGFLIN

SEQ ID NO: 135719 - protein, 9 aa, Homo Sapiens
QPCASNQFQ

SEQ ID NO: 135720 - protein, 9 aa, Homo Sapiens
ATSFFVKDR

SEQ ID NO: 135721 - protein, 9 aa, Homo Sapiens
LSLHMRMHT

SEQ ID NO: 135722 - protein, 9 aa, Homo Sapiens
CLKLTTFAT

SEQ ID NO: 135723 - protein, 9 aa, Homo Sapiens
PESAPPVAL

SEQ ID NO: 135724 - protein, 9 aa, Homo Sapiens
ESDGGDTYR

SEQ ID NO: 135725 - protein, 9 aa, Homo Sapiens
NFDIMELPE

SEQ ID NO: 135726 - protein, 9 aa, Homo Sapiens
RSVTASRCR

SEQ ID NO: 135727 - protein, 9 aa, Homo Sapiens
AQELARNCP

SEQ ID NO: 135728 - protein, 9 aa, Homo Sapiens
CSSLSVRLL

SEQ ID NO: 135729 - protein, 9 aa, Homo Sapiens
QGPPGSRGE

SEQ ID NO: 135730 - protein, 9 aa, Homo Sapiens
GFLINASNY

SEQ ID NO: 135731 - protein, 9 aa, Homo Sapiens
YASSNLIEY

SEQ ID NO: 135732 - protein, 9 aa, Homo Sapiens
AIVLVSPAE

SEQ ID NO: 135733 - protein, 9 aa, Homo Sapiens
MGEKPKTPK

SEQ ID NO: 135734 - protein, 9 aa, Homo Sapiens
FQEETETVS

SEQ ID NO: 135735 - protein, 9 aa, Homo Sapiens
AEAKNPDIK

SEQ ID NO: 135736 - protein, 9 aa, Homo Sapiens
QGPRRPLPS

SEQ ID NO: 135737 - protein, 9 aa, Homo Sapiens
RQFCKKIQR

SEQ ID NO: 135738 - protein, 9 aa, Homo Sapiens
PEEKQKPEE

SEQ ID NO: 135739 - protein, 9 aa, Homo Sapiens
CPCPYINAS

SEQ ID NO: 135740 - protein, 9 aa, Homo Sapiens
IKEMHEKMS

SEQ ID NO: 135741 - protein, 9 aa, Homo Sapiens
LSRGPVITT

SEQ ID NO: 135742 - protein, 9 aa, Homo Sapiens
AALTKLELL

SEQ ID NO: 135743 - protein, 9 aa, Homo Sapiens
TQPICGLHH

SEQ ID NO: 135744 - protein, 9 aa, Homo Sapiens
REQVAFEDV

SEQ ID NO: 135745 - protein, 9 aa, Homo Sapiens
IYASSNLIE

SEQ ID NO: 135746 - protein, 9 aa, Homo Sapiens
KRYWCLALK

SEQ ID NO: 135747 - protein, 9 aa, Homo Sapiens
LQDGYRPAA

SEQ ID NO: 135748 - protein, 9 aa, Homo Sapiens
RTRPRHCEG

SEQ ID NO: 135749 - protein, 9 aa, Homo Sapiens
RVWRRTWWA

SEQ ID NO: 135750 - protein, 9 aa, Homo Sapiens
CQGFKEKWY

SEQ ID NO: 135751 - protein, 9 aa, Homo Sapiens
PDDEETPEQ

SEQ ID NO: 135752 - protein, 9 aa, Homo Sapiens
LGQLLPQEE

SEQ ID NO: 135753 - protein, 9 aa, Homo Sapiens
TPESAPPVA

SEQ ID NO: 135754 - protein, 9 aa, Homo Sapiens
SDMGEKPKT

SEQ ID NO: 135755 - protein, 9 aa, Homo Sapiens
PPTTASWVL

SEQ ID NO: 135756 - protein, 9 aa, Homo Sapiens
LASDSYRPS

SEQ ID NO: 135757 - protein, 9 aa, Homo Sapiens
DFIARKGVK

SEQ ID NO: 135758 - protein, 9 aa, Homo Sapiens
GAGLTRLPV

SEQ ID NO: 135759 - protein, 9 aa, Homo Sapiens
NRCQGFKEK

SEQ ID NO: 135760 - protein, 9 aa, Homo Sapiens
CRCVKLADF

SEQ ID NO: 135761 - protein, 9 aa, Homo Sapiens
DFGLATEKS

SEQ ID NO: 135762 - protein, 9 aa, Homo Sapiens
VCCRCCVSF

SEQ ID NO: 135763 - protein, 9 aa, Homo Sapiens
SALPWARGS

SEQ ID NO: 135764 - protein, 9 aa, Homo Sapiens
SRKCQIDIY

SEQ ID NO: 135765 - protein, 9 aa, Homo Sapiens
SFMLRATSF

SEQ ID NO: 135766 - protein, 9 aa, Homo Sapiens
NHSSSSASS

SEQ ID NO: 135767 - protein, 9 aa, Homo Sapiens
RSQAEPMAR

SEQ ID NO: 135768 - protein, 9 aa, Homo Sapiens
LAGAQFQEE

SEQ ID NO: 135769 - protein, 9 aa, Homo Sapiens
PMIAKLVMW

SEQ ID NO: 135770 - protein, 9 aa, Homo Sapiens
GLGQLLPQE

SEQ ID NO: 135771 - protein, 9 aa, Homo Sapiens
PAPIISSKN

SEQ ID NO: 135772 - protein, 9 aa, Homo Sapiens
FSHFNFDIM

SEQ ID NO: 135773 - protein, 9 aa, Homo Sapiens
LPAPIISSK

SEQ ID NO: 135774 - protein, 9 aa, Homo Sapiens
CRCCVSFIL

SEQ ID NO: 135775 - protein, 9 aa, Homo Sapiens
ELQCPPMAG

SEQ ID NO: 135776 - protein, 9 aa, Homo Sapiens
DDLQGYVEA

SEQ ID NO: 135777 - protein, 9 aa, Homo Sapiens
TVTTFSTMP

SEQ ID NO: 135778 - protein, 9 aa, Homo Sapiens
QRYSDTSKL

SEQ ID NO: 135779 - protein, 9 aa, Homo Sapiens
PVGTVTVNA

SEQ ID NO: 135780 - protein, 9 aa, Homo Sapiens
LRTRQQMEQ

SEQ ID NO: 135781 - protein, 9 aa, Homo Sapiens
FWTIRENHN

SEQ ID NO: 135782 - protein, 9 aa, Homo Sapiens
GDYVSGGSD

SEQ ID NO: 135783 - protein, 9 aa, Homo Sapiens
RECRCVKLA

SEQ ID NO: 135784 - protein, 9 aa, Homo Sapiens
LMERQVERW

SEQ ID NO: 135785 - protein, 9 aa, Homo Sapiens
SKSQPVALR

SEQ ID NO: 135786 - protein, 9 aa, Homo Sapiens
SETTLESIA

SEQ ID NO: 135787 - protein, 9 aa, Homo Sapiens
IKNLAVDFH

SEQ ID NO: 135788 - protein, 9 aa, Homo Sapiens
YSIWSPYAY

SEQ ID NO: 135789 - protein, 9 aa, Homo Sapiens
SSEQLLRGP

SEQ ID NO: 135790 - protein, 9 aa, Homo Sapiens
WASAARSVT

SEQ ID NO: 135791 - protein, 9 aa, Homo Sapiens
PAEAKNPDI

SEQ ID NO: 135792 - protein, 9 aa, Homo Sapiens
ANVGDAAAQ

SEQ ID NO: 135793 - protein, 9 aa, Homo Sapiens
SSNLIEYIS

SEQ ID NO: 135794 - protein, 9 aa, Homo Sapiens
PGHKDRRKK

SEQ ID NO: 135795 - protein, 9 aa, Homo Sapiens
NAGLFYHLR

SEQ ID NO: 135796 - protein, 9 aa, Homo Sapiens
MEFATRSIQ

SEQ ID NO: 135797 - protein, 9 aa, Homo Sapiens
QLYQEIIRY

SEQ ID NO: 135798 - protein, 9 aa, Homo Sapiens
NIYASSNLI

SEQ ID NO: 135799 - protein, 9 aa, Homo Sapiens
ETSFAALTK

SEQ ID NO: 135800 - protein, 9 aa, Homo Sapiens
RERIMAECN

SEQ ID NO: 135801 - protein, 9 aa, Homo Sapiens
TTFATNLLT

SEQ ID NO: 135802 - protein, 9 aa, Homo Sapiens
GSRVWRRTW

SEQ ID NO: 135803 - protein, 9 aa, Homo Sapiens
SRTRPRHCE

SEQ ID NO: 135804 - protein, 9 aa, Homo Sapiens
TIYEWAGRV

SEQ ID NO: 135805 - protein, 9 aa, Homo Sapiens
SAPPVALPP

SEQ ID NO: 135806 - protein, 9 aa, Homo Sapiens
TSVVAQGPR

SEQ ID NO: 135807 - protein, 9 aa, Homo Sapiens
RDSQLRKPM

SEQ ID NO: 135808 - protein, 9 aa, Homo Sapiens
GLSHQGSTI

SEQ ID NO: 135809 - protein, 9 aa, Homo Sapiens
GRFRVDRKK

SEQ ID NO: 135810 - protein, 9 aa, Homo Sapiens
SSKTGFQDK

SEQ ID NO: 135811 - protein, 9 aa, Homo Sapiens
WHQTSQDQL

SEQ ID NO: 135812 - protein, 9 aa, Homo Sapiens
SLRLRGSLA

SEQ ID NO: 135813 - protein, 9 aa, Homo Sapiens
AELRTRQQM

SEQ ID NO: 135814 - protein, 9 aa, Homo Sapiens
GVAGAVAGP

SEQ ID NO: 135815 - protein, 9 aa, Homo Sapiens
NVTLLQTEA

SEQ ID NO: 135816 - protein, 9 aa, Homo Sapiens
YSDTSKLRE

SEQ ID NO: 135817 - protein, 9 aa, Homo Sapiens
VSLEEPELH

SEQ ID NO: 135818 - protein, 9 aa, Homo Sapiens
TNLLTLSCR

SEQ ID NO: 135819 - protein, 9 aa, Homo Sapiens
LRLRGSLAT

SEQ ID NO: 135820 - protein, 9 aa, Homo Sapiens
INASRRFSD

SEQ ID NO: 135821 - protein, 9 aa, Homo Sapiens
ETDMESTVD

SEQ ID NO: 135822 - protein, 9 aa, Homo Sapiens
DIGENAQLS

SEQ ID NO: 135823 - protein, 9 aa, Homo Sapiens
TLPDDEETP

SEQ ID NO: 135824 - protein, 9 aa, Homo Sapiens
TALDIDRLQ

SEQ ID NO: 135825 - protein, 9 aa, Homo Sapiens
RRTWWASAA

SEQ ID NO: 135826 - protein, 9 aa, Homo Sapiens
RLQDGYRPA

SEQ ID NO: 135827 - protein, 9 aa, Homo Sapiens
WARGSRVWR

SEQ ID NO: 135828 - protein, 9 aa, Homo Sapiens
LHSPEWSEG

SEQ ID NO: 135829 - protein, 9 aa, Homo Sapiens
SAARSVTAS

SEQ ID NO: 135830 - protein, 9 aa, Homo Sapiens
EALSLLIFL

SEQ ID NO: 135831 - protein, 9 aa, Homo Sapiens
TGAVYVPEI

SEQ ID NO: 135832 - protein, 9 aa, Homo Sapiens
MAGLGQLLP

SEQ ID NO: 135833 - protein, 9 aa, Homo Sapiens
GCWNCSALG

SEQ ID NO: 135834 - protein, 9 aa, Homo Sapiens
CIPPTTASW

SEQ ID NO: 135835 - protein, 9 aa, Homo Sapiens
LLIFLALSL

SEQ ID NO: 135836 - protein, 9 aa, Homo Sapiens
SLHMRMHTG

SEQ ID NO: 135837 - protein, 9 aa, Homo Sapiens
VMWAADRQA

SEQ ID NO: 135838 - protein, 9 aa, Homo Sapiens
SILSLHMRM

SEQ ID NO: 135839 - protein, 9 aa, Homo Sapiens
LFLLHQVLR

SEQ ID NO: 135840 - protein, 9 aa, Homo Sapiens
HKEILADVS

SEQ ID NO: 135841 - protein, 9 aa, Homo Sapiens
RLPKNHHFD

SEQ ID NO: 135842 - protein, 9 aa, Homo Sapiens
GWLADGSLC

SEQ ID NO: 135843 - protein, 9 aa, Homo Sapiens
TIGFGDYVS

SEQ ID NO: 135844 - protein, 9 aa, Homo Sapiens
VVVWKREGL

SEQ ID NO: 135845 - protein, 9 aa, Homo Sapiens
QIRATATQE

SEQ ID NO: 135846 - protein, 9 aa, Homo Sapiens
ADDLQGYVE

SEQ ID NO: 135847 - protein, 9 aa, Homo Sapiens
KMSRMERDI

SEQ ID NO: 135848 - protein, 9 aa, Homo Sapiens
EITKPKRIC

SEQ ID NO: 135849 - protein, 9 aa, Homo Sapiens
TKPKRICPS

SEQ ID NO: 135850 - protein, 9 aa, Homo Sapiens
TLVIMWQKH

SEQ ID NO: 135851 - protein, 9 aa, Homo Sapiens
CVNPNTRKL

SEQ ID NO: 135852 - protein, 9 aa, Homo Sapiens
ALDIDRLQD

SEQ ID NO: 135853 - protein, 9 aa, Homo Sapiens
AIQPKLRTQ

SEQ ID NO: 135854 - protein, 9 aa, Homo Sapiens
CGLHHLEYR

SEQ ID NO: 135855 - protein, 9 aa, Homo Sapiens
RGSRVWRRT

SEQ ID NO: 135856 - protein, 9 aa, Homo Sapiens
PQNHSSSSA

SEQ ID NO: 135857 - protein, 9 aa, Homo Sapiens
ARQLARMSK

SEQ ID NO: 135858 - protein, 9 aa, Homo Sapiens
AGLTRLPVE

SEQ ID NO: 135859 - protein, 9 aa, Homo Sapiens
PCTPPYQEP

SEQ ID NO: 135860 - protein, 9 aa, Homo Sapiens
ELRTRQQME

SEQ ID NO: 135861 - protein, 9 aa, Homo Sapiens
SIPVGTVTV

SEQ ID NO: 135862 - protein, 9 aa, Homo Sapiens
RTRQQMEQQ

SEQ ID NO: 135863 - protein, 9 aa, Homo Sapiens
EFRLAGVNL

SEQ ID NO: 135864 - protein, 9 aa, Homo Sapiens
DVEALSLLI

SEQ ID NO: 135865 - protein, 9 aa, Homo Sapiens
ASWVLSMAC

SEQ ID NO: 135866 - protein, 9 aa, Homo Sapiens
QWSLRLRGS

SEQ ID NO: 135867 - protein, 9 aa, Homo Sapiens
REREKEREH

SEQ ID NO: 135868 - protein, 9 aa, Homo Sapiens
GSVEQRWEQ

SEQ ID NO: 135869 - protein, 9 aa, Homo Sapiens
RLAGVNLPK

SEQ ID NO: 135870 - protein, 9 aa, Homo Sapiens
HLECLVSHH

SEQ ID NO: 135871 - protein, 9 aa, Homo Sapiens
HGSVEQRWE

SEQ ID NO: 135872 - protein, 9 aa, Homo Sapiens
LLVPLLDRP

SEQ ID NO: 135873 - protein, 9 aa, Homo Sapiens
VEDHKRFHP

SEQ ID NO: 135874 - protein, 9 aa, Homo Sapiens
IGEPSHPSE

SEQ ID NO: 135875 - protein, 9 aa, Homo Sapiens
NPNTRKLIQ

SEQ ID NO: 135876 - protein, 9 aa, Homo Sapiens
YQEIIRYFD

SEQ ID NO: 135877 - protein, 9 aa, Homo Sapiens
VYVPEIGAK

SEQ ID NO: 135878 - protein, 9 aa, Homo Sapiens
PADWDGTGG

SEQ ID NO: 135879 - protein, 9 aa, Homo Sapiens
GLSRGPVIT

SEQ ID NO: 135880 - protein, 9 aa, Homo Sapiens
KTGFQDKFD

SEQ ID NO: 135881 - protein, 9 aa, Homo Sapiens
EKEVNEAPK

SEQ ID NO: 135882 - protein, 9 aa, Homo Sapiens
SPLPSSLIV

SEQ ID NO: 135883 - protein, 9 aa, Homo Sapiens
QRKKAFPTC

SEQ ID NO: 135884 - protein, 9 aa, Homo Sapiens
NEDGLEEEE

SEQ ID NO: 135885 - protein, 9 aa, Homo Sapiens
ATEKSRWSG

SEQ ID NO: 135886 - protein, 9 aa, Homo Sapiens
ATIYEWAGR

SEQ ID NO: 135887 - protein, 9 aa, Homo Sapiens
VLQAQPRPP

SEQ ID NO: 135888 - protein, 9 aa, Homo Sapiens
TRTRPACVD

SEQ ID NO: 135889 - protein, 9 aa, Homo Sapiens
DFSLVETDM

SEQ ID NO: 135890 - protein, 9 aa, Homo Sapiens
TLESIASAR

SEQ ID NO: 135891 - protein, 9 aa, Homo Sapiens
SLKDVVKKK

SEQ ID NO: 135892 - protein, 9 aa, Homo Sapiens
YAELRTRQQ

SEQ ID NO: 135893 - protein, 9 aa, Homo Sapiens
QCPPMAGLS

SEQ ID NO: 135894 - protein, 9 aa, Homo Sapiens
TLWYANRAK

SEQ ID NO: 135895 - protein, 9 aa, Homo Sapiens
EREKEREHE

SEQ ID NO: 135896 - protein, 9 aa, Homo Sapiens
LEGAKIFSN

SEQ ID NO: 135897 - protein, 9 aa, Homo Sapiens
LVSHHERSL

SEQ ID NO: 135898 - protein, 9 aa, Homo Sapiens
KDVVKKKKK

SEQ ID NO: 135899 - protein, 9 aa, Homo Sapiens
ITKPKRICP

SEQ ID NO: 135900 - protein, 9 aa, Homo Sapiens
AFLCINLNL

SEQ ID NO: 135901 - protein, 9 aa, Homo Sapiens
IDAVCCRCC

SEQ ID NO: 135902 - protein, 9 aa, Homo Sapiens
HCEGAGPVL

SEQ ID NO: 135903 - protein, 9 aa, Homo Sapiens
FQGLSHQGS

SEQ ID NO: 135904 - protein, 9 aa, Homo Sapiens
AVLQAQPRP

SEQ ID NO: 135905 - protein, 9 aa, Homo Sapiens
LELFMETKH

SEQ ID NO: 135906 - protein, 9 aa, Homo Sapiens
CTPPYQGTG

SEQ ID NO: 135907 - protein, 9 aa, Homo Sapiens
GVYINVTLL

SEQ ID NO: 135908 - protein, 9 aa, Homo Sapiens
AQPRPPVAA

SEQ ID NO: 135909 - protein, 9 aa, Homo Sapiens
EQGPPGSRG

SEQ ID NO: 135910 - protein, 9 aa, Homo Sapiens
LIGMNDSSK

SEQ ID NO: 135911 - protein, 9 aa, Homo Sapiens
EDGLEEEEE

SEQ ID NO: 135912 - protein, 9 aa, Homo Sapiens
ESTAPTPCP

SEQ ID NO: 135913 - protein, 9 aa, Homo Sapiens
DFHQQLHPA

SEQ ID NO: 135914 - protein, 9 aa, Homo Sapiens
FDIMELPEQ

SEQ ID NO: 135915 - protein, 9 aa, Homo Sapiens
LSLKDPYER

SEQ ID NO: 135916 - protein, 9 aa, Homo Sapiens
SDTSKLREE

SEQ ID NO: 135917 - protein, 9 aa, Homo Sapiens
SIASARPVE

SEQ ID NO: 135918 - protein, 9 aa, Homo Sapiens
ETYLPETFR

SEQ ID NO: 135919 - protein, 9 aa, Homo Sapiens
AVYVPEIGA

SEQ ID NO: 135920 - protein, 9 aa, Homo Sapiens
ANKLTVMVH

SEQ ID NO: 135921 - protein, 9 aa, Homo Sapiens
CLKLLTAVH

SEQ ID NO: 135922 - protein, 9 aa, Homo Sapiens
HQTSQDQLR

SEQ ID NO: 135923 - protein, 9 aa, Homo Sapiens
DFWTIRENH

SEQ ID NO: 135924 - protein, 9 aa, Homo Sapiens
LTRLPVEDH

SEQ ID NO: 135925 - protein, 9 aa, Homo Sapiens
STVSVRAAE

SEQ ID NO: 135926 - protein, 9 aa, Homo Sapiens
SYRPSLTGS

SEQ ID NO: 135927 - protein, 9 aa, Homo Sapiens
VKKKKKKDQ

SEQ ID NO: 135928 - protein, 9 aa, Homo Sapiens
AAQELARNC

SEQ ID NO: 135929 - protein, 9 aa, Homo Sapiens
NRRKRYWCL

SEQ ID NO: 135930 - protein, 9 aa, Homo Sapiens
TRPSALPWA

SEQ ID NO: 135931 - protein, 9 aa, Homo Sapiens
EPVKENKKV

SEQ ID NO: 135932 - protein, 9 aa, Homo Sapiens
FFFETESCS

SEQ ID NO: 135933 - protein, 9 aa, Homo Sapiens
KYSRHLLVP

SEQ ID NO: 135934 - protein, 9 aa, Homo Sapiens
IPPTTASWV

SEQ ID NO: 135935 - protein, 9 aa, Homo Sapiens
TVMVHQAAE

SEQ ID NO: 135936 - protein, 9 aa, Homo Sapiens
IMELPEQDG

SEQ ID NO: 135937 - protein, 9 aa, Homo Sapiens
SDGSEPRRS

SEQ ID NO: 135938 - protein, 9 aa, Homo Sapiens
AAAQELARN

SEQ ID NO: 135939 - protein, 9 aa, Homo Sapiens
TVDFWTIRE

SEQ ID NO: 135940 - protein, 9 aa, Homo Sapiens
EEEEKEVNE

SEQ ID NO: 135941 - protein, 9 aa, Homo Sapiens
VPEIGAKQV

SEQ ID NO: 135942 - protein, 9 aa, Homo Sapiens
DSSKTGFQD

SEQ ID NO: 135943 - protein, 9 aa, Homo Sapiens
WTIRENHNH

SEQ ID NO: 135944 - protein, 9 aa, Homo Sapiens
LFMETKHQK

SEQ ID NO: 135945 - protein, 9 aa, Homo Sapiens
YETYLPETF

SEQ ID NO: 135946 - protein, 9 aa, Homo Sapiens
KSTIGMEFA

SEQ ID NO: 135947 - protein, 9 aa, Homo Sapiens
QEIIRYFDK

SEQ ID NO: 135948 - protein, 9 aa, Homo Sapiens
NQKLRVCVA

SEQ ID NO: 135949 - protein, 9 aa, Homo Sapiens
SASSSGGAG

SEQ ID NO: 135950 - protein, 9 aa, Homo Sapiens
VTTFSTMPH

SEQ ID NO: 135951 - protein, 9 aa, Homo Sapiens
RRPLPSTAN

SEQ ID NO: 135952 - protein, 9 aa, Homo Sapiens
PKEFRLPKN

SEQ ID NO: 135953 - protein, 9 aa, Homo Sapiens
EVNEAPKEE

SEQ ID NO: 135954 - protein, 9 aa, Homo Sapiens
GGDTYRRLH

SEQ ID NO: 135955 - protein, 9 aa, Homo Sapiens
AVHGSSVNR

SEQ ID NO: 135956 - protein, 9 aa, Homo Sapiens
MPAEAKNPD

SEQ ID NO: 135957 - protein, 9 aa, Homo Sapiens
AGADDLQGY

SEQ ID NO: 135958 - protein, 9 aa, Homo Sapiens
GTGGSYRLL

SEQ ID NO: 135959 - protein, 9 aa, Homo Sapiens
FAIVLVSPA

SEQ ID NO: 135960 - protein, 9 aa, Homo Sapiens
TEKSTVSVR

SEQ ID NO: 135961 - protein, 9 aa, Homo Sapiens
EQVAFEDVV

SEQ ID NO: 135962 - protein, 9 aa, Homo Sapiens
SMCICQMRN

SEQ ID NO: 135963 - protein, 9 aa, Homo Sapiens
TRPRHCEGA

SEQ ID NO: 135964 - protein, 9 aa, Homo Sapiens
DNEDGLEEE

SEQ ID NO: 135965 - protein, 9 aa, Homo Sapiens
SNLFQIRAT

SEQ ID NO: 135966 - protein, 9 aa, Homo Sapiens
QFQFRNGCW

SEQ ID NO: 135967 - protein, 9 aa, Homo Sapiens
GENAQLSYD

SEQ ID NO: 135968 - protein, 9 aa, Homo Sapiens
LRGSLATFK

SEQ ID NO: 135969 - protein, 9 aa, Homo Sapiens
TEKSRWSGS

SEQ ID NO: 135970 - protein, 9 aa, Homo Sapiens
PEWSEGRFR

SEQ ID NO: 135971 - protein, 9 aa, Homo Sapiens
CASNQFQCL

SEQ ID NO: 135972 - protein, 9 aa, Homo Sapiens
TDPGKVEKP

SEQ ID NO: 135973 - protein, 9 aa, Homo Sapiens
TASWVLSMA

SEQ ID NO: 135974 - protein, 9 aa, Homo Sapiens
LCYPIVTPR

SEQ ID NO: 135975 - protein, 9 aa, Homo Sapiens
NTRKLIQGA

SEQ ID NO: 135976 - protein, 9 aa, Homo Sapiens
LINASNYKQ

SEQ ID NO: 135977 - protein, 9 aa, Homo Sapiens
KTLPDDEET

SEQ ID NO: 135978 - protein, 9 aa, Homo Sapiens
PVKENKKVY

SEQ ID NO: 135979 - protein, 9 aa, Homo Sapiens
HTFCSSLSV

SEQ ID NO: 135980 - protein, 9 aa, Homo Sapiens
VTEKSTVSV

SEQ ID NO: 135981 - protein, 9 aa, Homo Sapiens
VWHRHDGKW

SEQ ID NO: 135982 - protein, 9 aa, Homo Sapiens
PRPPVAAAN

SEQ ID NO: 135983 - protein, 9 aa, Homo Sapiens
RYWCLALKG

SEQ ID NO: 135984 - protein, 9 aa, Homo Sapiens
SLEPVKENK

SEQ ID NO: 135985 - protein, 9 aa, Homo Sapiens
RICPSFKEA

SEQ ID NO: 135986 - protein, 9 aa, Homo Sapiens
FTTLVIMWQ

SEQ ID NO: 135987 - protein, 9 aa, Homo Sapiens
GDFGLATEK

SEQ ID NO: 135988 - protein, 9 aa, Homo Sapiens
FQPCASNQF

SEQ ID NO: 135989 - protein, 9 aa, Homo Sapiens
VVIRDSQLR

SEQ ID NO: 135990 - protein, 9 aa, Homo Sapiens
HQGSTISKG

SEQ ID NO: 135991 - protein, 9 aa, Homo Sapiens
NASRRFSDT

SEQ ID NO: 135992 - protein, 9 aa, Homo Sapiens
WKHLTQPIC

SEQ ID NO: 135993 - protein, 9 aa, Homo Sapiens
IGMNDSSKT

SEQ ID NO: 135994 - protein, 9 aa, Homo Sapiens
VKVVTLLVS

SEQ ID NO: 135995 - protein, 9 aa, Homo Sapiens
AAAFQPCAS

SEQ ID NO: 135996 - protein, 9 aa, Homo Sapiens
LGAKTLPDD

SEQ ID NO: 135997 - protein, 9 aa, Homo Sapiens
SRDVEALSL

SEQ ID NO: 135998 - protein, 9 aa, Homo Sapiens
DVVLSPQRQ

SEQ ID NO: 135999 - protein, 9 aa, Homo Sapiens
AVRFLVPPK

SEQ ID NO: 136000 - protein, 9 aa, Homo Sapiens
VAFEDVVVG

SEQ ID NO: 136001 - protein, 9 aa, Homo Sapiens
PISVASTPF

SEQ ID NO: 136002 - protein, 9 aa, Homo Sapiens
QSFGGGCHV

SEQ ID NO: 136003 - protein, 9 aa, Homo Sapiens
QKPEEKQKP

SEQ ID NO: 136004 - protein, 9 aa, Homo Sapiens
FHQQLHPAQ

SEQ ID NO: 136005 - protein, 9 aa, Homo Sapiens
GDTYRRLHY

SEQ ID NO: 136006 - protein, 9 aa, Homo Sapiens
KEAFAIVLV

SEQ ID NO: 136007 - protein, 9 aa, Homo Sapiens
LKQMLNNKL

SEQ ID NO: 136008 - protein, 9 aa, Homo Sapiens
TIRENHNHS

SEQ ID NO: 136009 - protein, 9 aa, Homo Sapiens
AQLSYDIID

SEQ ID NO: 136010 - protein, 9 aa, Homo Sapiens
ADGSLCYPI

SEQ ID NO: 136011 - protein, 9 aa, Homo Sapiens
ISTLWYANR

SEQ ID NO: 136012 - protein, 9 aa, Homo Sapiens
MEKNGNNQK

SEQ ID NO: 136013 - protein, 9 aa, Homo Sapiens
FETESCSVA

SEQ ID NO: 136014 - protein, 9 aa, Homo Sapiens
IMAECNAVR

SEQ ID NO: 136015 - protein, 9 aa, Homo Sapiens
SGGSDIEYL

SEQ ID NO: 136016 - protein, 9 aa, Homo Sapiens
FLCINLNLT

SEQ ID NO: 136017 - protein, 9 aa, Homo Sapiens
RYSDTSKLR

SEQ ID NO: 136018 - protein, 9 aa, Homo Sapiens
QPICGLHHL

SEQ ID NO: 136019 - protein, 9 aa, Homo Sapiens
RRSQAEPMA

SEQ ID NO: 136020 - protein, 9 aa, Homo Sapiens
SQLRKPMYY

SEQ ID NO: 136021 - protein, 9 aa, Homo Sapiens
ASAASIPVG

SEQ ID NO: 136022 - protein, 9 aa, Homo Sapiens
VWRRTWWAS

SEQ ID NO: 136023 - protein, 9 aa, Homo Sapiens
MAGLSDGPK

SEQ ID NO: 136024 - protein, 9 aa, Homo Sapiens
LTLSLKDPY

SEQ ID NO: 136025 - protein, 9 aa, Homo Sapiens
EGAKIFSNG

SEQ ID NO: 136026 - protein, 9 aa, Homo Sapiens
SQDQLRALT

SEQ ID NO: 136027 - protein, 9 aa, Homo Sapiens
QGAHGESSL

SEQ ID NO: 136028 - protein, 9 aa, Homo Sapiens
RPCPCPYIN

SEQ ID NO: 136029 - protein, 9 aa, Homo Sapiens
HLLVPLLDR

SEQ ID NO: 136030 - protein, 9 aa, Homo Sapiens
PLGAKTLPD

SEQ ID NO: 136031 - protein, 9 aa, Homo Sapiens
SPQRQSFGG

SEQ ID NO: 136032 - protein, 9 aa, Homo Sapiens
CVKLADFGM

SEQ ID NO: 136033 - protein, 9 aa, Homo Sapiens
SKSSPESRE

SEQ ID NO: 136034 - protein, 9 aa, Homo Sapiens
WLADGSLCY

SEQ ID NO: 136035 - protein, 9 aa, Homo Sapiens
ITEGFLINA

SEQ ID NO: 136036 - protein, 9 aa, Homo Sapiens
HQVLRKLKQ

SEQ ID NO: 136037 - protein, 9 aa, Homo Sapiens
LSLLIFLAL

SEQ ID NO: 136038 - protein, 9 aa, Homo Sapiens
EWAGRVEGR

SEQ ID NO: 136039 - protein, 9 aa, Homo Sapiens
GEAYKDPSG

SEQ ID NO: 136040 - protein, 9 aa, Homo Sapiens
HMVIGMSMC

SEQ ID NO: 136041 - protein, 9 aa, Homo Sapiens
EGRFRVDRK

SEQ ID NO: 136042 - protein, 9 aa, Homo Sapiens
LRKPMYYFL

SEQ ID NO: 136043 - protein, 9 aa, Homo Sapiens
CYPIVTPRP

SEQ ID NO: 136044 - protein, 9 aa, Homo Sapiens
PKPRPHLGL

SEQ ID NO: 136045 - protein, 9 aa, Homo Sapiens
FGDDWHLTN

SEQ ID NO: 136046 - protein, 9 aa, Homo Sapiens
FSTMPHMPT

SEQ ID NO: 136047 - protein, 9 aa, Homo Sapiens
RMSKSSPES

SEQ ID NO: 136048 - protein, 9 aa, Homo Sapiens
GEQGPPGSR

SEQ ID NO: 136049 - protein, 9 aa, Homo Sapiens
VSRKCQIDI

SEQ ID NO: 136050 - protein, 9 aa, Homo Sapiens
HQAAEQGQV

SEQ ID NO: 136051 - protein, 9 aa, Homo Sapiens
LLTAVHGSS

SEQ ID NO: 136052 - protein, 9 aa, Homo Sapiens
ASDMGEKPK

SEQ ID NO: 136053 - protein, 9 aa, Homo Sapiens
FPTCSSHVI

SEQ ID NO: 136054 - protein, 9 aa, Homo Sapiens
KANRLYETY

SEQ ID NO: 136055 - protein, 9 aa, Homo Sapiens
HKDRRKKGQ

SEQ ID NO: 136056 - protein, 9 aa, Homo Sapiens
HLGLFLLHQ

SEQ ID NO: 136057 - protein, 9 aa, Homo Sapiens
RDLLPPCTP

SEQ ID NO: 136058 - protein, 9 aa, Homo Sapiens
IAGTTRTRP

SEQ ID NO: 136059 - protein, 9 aa, Homo Sapiens
SLKDPYERC

SEQ ID NO: 136060 - protein, 9 aa, Homo Sapiens
WSEGRFRVD

SEQ ID NO: 136061 - protein, 9 aa, Homo Sapiens
VKENKKVYR

SEQ ID NO: 136062 - protein, 9 aa, Homo Sapiens
RPRHCEGAG

SEQ ID NO: 136063 - protein, 9 aa, Homo Sapiens
RKTGAVYVP

SEQ ID NO: 136064 - protein, 9 aa, Homo Sapiens
QPRPPVAAA

SEQ ID NO: 136065 - protein, 9 aa, Homo Sapiens
LARMSKSSP

SEQ ID NO: 136066 - protein, 9 aa, Homo Sapiens
METKHQKRV

SEQ ID NO: 136067 - protein, 9 aa, Homo Sapiens
LLVSRKCQI

SEQ ID NO: 136068 - protein, 9 aa, Homo Sapiens
RKLKQMLNN

SEQ ID NO: 136069 - protein, 9 aa, Homo Sapiens
EEKEVNEAP

SEQ ID NO: 136070 - protein, 9 aa, Homo Sapiens
KRGRAEVYY

SEQ ID NO: 136071 - protein, 9 aa, Homo Sapiens
LQGYVEAQC

SEQ ID NO: 136072 - protein, 9 aa, Homo Sapiens
IQPKLRTQF

SEQ ID NO: 136073 - protein, 9 aa, Homo Sapiens
RCLTDPGKV

SEQ ID NO: 136074 - protein, 9 aa, Homo Sapiens
LNLTLFNLG

SEQ ID NO: 136075 - protein, 9 aa, Homo Sapiens
QVLRKLKQM

SEQ ID NO: 136076 - protein, 9 aa, Homo Sapiens
ELNKHKEIL

SEQ ID NO: 136077 - protein, 9 aa, Homo Sapiens
ARMSKSSPE

SEQ ID NO: 136078 - protein, 9 aa, Homo Sapiens
QLRKPMYYF

SEQ ID NO: 136079 - protein, 9 aa, Homo Sapiens
EPPADWDGT

SEQ ID NO: 136080 - protein, 9 aa, Homo Sapiens
LFQIRATAT

SEQ ID NO: 136081 - protein, 9 aa, Homo Sapiens
LLFDRECRC

SEQ ID NO: 136082 - protein, 9 aa, Homo Sapiens
DAVCCRCCV

SEQ ID NO: 136083 - protein, 9 aa, Homo Sapiens
KLDNEDGLE

SEQ ID NO: 136084 - protein, 9 aa, Homo Sapiens
KALDFIARK

SEQ ID NO: 136085 - protein, 9 aa, Homo Sapiens
HDKFWQENR

SEQ ID NO: 136086 - protein, 9 aa, Homo Sapiens
SLTLSLKDP

SEQ ID NO: 136087 - protein, 9 aa, Homo Sapiens
PKLRTQFNL

SEQ ID NO: 136088 - protein, 9 aa, Homo Sapiens
AASIPVGTV

SEQ ID NO: 136089 - protein, 9 aa, Homo Sapiens
LESKSTIGM

SEQ ID NO: 136090 - protein, 9 aa, Homo Sapiens
EPMARMLEG

SEQ ID NO: 136091 - protein, 9 aa, Homo Sapiens
PTTASWVLS

SEQ ID NO: 136092 - protein, 9 aa, Homo Sapiens
PQDLFFSFF

SEQ ID NO: 136093 - protein, 9 aa, Homo Sapiens
SDSYRPSLT

SEQ ID NO: 136094 - protein, 9 aa, Homo Sapiens
WGHAATIWL

SEQ ID NO: 136095 - protein, 9 aa, Homo Sapiens
CPPMAGLSD

SEQ ID NO: 136096 - protein, 9 aa, Homo Sapiens
NPFQGLSHQ

SEQ ID NO: 136097 - protein, 9 aa, Homo Sapiens
AKKCNLMER

SEQ ID NO: 136098 - protein, 9 aa, Homo Sapiens
NMQELEAYR

SEQ ID NO: 136099 - protein, 9 aa, Homo Sapiens
CCVSFILRT

SEQ ID NO: 136100 - protein, 9 aa, Homo Sapiens
PRPHLGLFL

SEQ ID NO: 136101 - protein, 9 aa, Homo Sapiens
RHLLVPLLD

SEQ ID NO: 136102 - protein, 9 aa, Homo Sapiens
YKDPSGSPA

SEQ ID NO: 136103 - protein, 9 aa, Homo Sapiens
WDGTGGSYR

SEQ ID NO: 136104 - protein, 9 aa, Homo Sapiens
MLRATSFFV

SEQ ID NO: 136105 - protein, 9 aa, Homo Sapiens
LGLFLLHQV

SEQ ID NO: 136106 - protein, 9 aa, Homo Sapiens
GDLVSSEQL

SEQ ID NO: 136107 - protein, 9 aa, Homo Sapiens
LPWARGSRV

SEQ ID NO: 136108 - protein, 9 aa, Homo Sapiens
INASNYKQL

SEQ ID NO: 136109 - protein, 9 aa, Homo Sapiens
MLHDKFWQE

SEQ ID NO: 136110 - protein, 9 aa, Homo Sapiens
MQLGLCVVA

SEQ ID NO: 136111 - protein, 9 aa, Homo Sapiens
IGMSMCICQ

SEQ ID NO: 136112 - protein, 9 aa, Homo Sapiens
PRPGHKDRR

SEQ ID NO: 136113 - protein, 9 aa, Homo Sapiens
TISTLWYAN

SEQ ID NO: 136114 - protein, 9 aa, Homo Sapiens
SFFVKDRVV

SEQ ID NO: 136115 - protein, 9 aa, Homo Sapiens
ALPWARGSR

SEQ ID NO: 136116 - protein, 9 aa, Homo Sapiens
LESIASARP

SEQ ID NO: 136117 - protein, 9 aa, Homo Sapiens
RLRGSLATF

SEQ ID NO: 136118 - protein, 9 aa, Homo Sapiens
KEREHEKEL

SEQ ID NO: 136119 - protein, 9 aa, Homo Sapiens
LHLVSKSQP

SEQ ID NO: 136120 - protein, 9 aa, Homo Sapiens
LCINLNLTL

SEQ ID NO: 136121 - protein, 9 aa, Homo Sapiens
MFFIGFTTL

SEQ ID NO: 136122 - protein, 9 aa, Homo Sapiens
DLATIYEWA

SEQ ID NO: 136123 - protein, 9 aa, Homo Sapiens
IARKGVKLV

SEQ ID NO: 136124 - protein, 9 aa, Homo Sapiens
GASLPAPII

SEQ ID NO: 136125 - protein, 9 aa, Homo Sapiens
VIRDSQLRK

SEQ ID NO: 136126 - protein, 9 aa, Homo Sapiens
QPGLEGEQG

SEQ ID NO: 136127 - protein, 9 aa, Homo Sapiens
EEKQKPEEK

SEQ ID NO: 136128 - protein, 9 aa, Homo Sapiens
KIFSNGHLG

SEQ ID NO: 136129 - protein, 9 aa, Homo Sapiens
ALTKLELLM

SEQ ID NO: 136130 - protein, 9 aa, Homo Sapiens
NLTLFNLGL

SEQ ID NO: 136131 - protein, 9 aa, Homo Sapiens
KTRNYLYSI

SEQ ID NO: 136132 - protein, 9 aa, Homo Sapiens
SAASIPVGT

SEQ ID NO: 136133 - protein, 9 aa, Homo Sapiens
LATIYEWAG

SEQ ID NO: 136134 - protein, 9 aa, Homo Sapiens
MNDSSKTGF

SEQ ID NO: 136135 - protein, 9 aa, Homo Sapiens
SIWSPYAYY

SEQ ID NO: 136136 - protein, 9 aa, Homo Sapiens
IGENAQLSY

SEQ ID NO: 136137 - protein, 9 aa, Homo Sapiens
YVPEIGAKQ

SEQ ID NO: 136138 - protein, 9 aa, Homo Sapiens
CADLPISVA

SEQ ID NO: 136139 - protein, 9 aa, Homo Sapiens
LHLEHCIEF

SEQ ID NO: 136140 - protein, 9 aa, Homo Sapiens
GNRVRLVCL

SEQ ID NO: 136141 - protein, 9 aa, Homo Sapiens
SLLIFLALS

SEQ ID NO: 136142 - protein, 9 aa, Homo Sapiens
RHCEGAGPV

SEQ ID NO: 136143 - protein, 9 aa, Homo Sapiens
YINVTLLQT

SEQ ID NO: 136144 - protein, 9 aa, Homo Sapiens
IMEKNGNNQ

SEQ ID NO: 136145 - protein, 9 aa, Homo Sapiens
QAQPRPPVA

SEQ ID NO: 136146 - protein, 9 aa, Homo Sapiens
PKRICPSFK

SEQ ID NO: 136147 - protein, 9 aa, Homo Sapiens
QVVVVWKRE

SEQ ID NO: 136148 - protein, 9 aa, Homo Sapiens
LTAVHGSSV

SEQ ID NO: 136149 - protein, 9 aa, Homo Sapiens
CWNCSALGE

SEQ ID NO: 136150 - protein, 9 aa, Homo Sapiens
NSPLPSSLI

SEQ ID NO: 136151 - protein, 9 aa, Homo Sapiens
LQCPPMAGL

SEQ ID NO: 136152 - protein, 9 aa, Homo Sapiens
AATIWLIFH

SEQ ID NO: 136153 - protein, 9 aa, Homo Sapiens
QQKESSINI

SEQ ID NO: 136154 - protein, 9 aa, Homo Sapiens
LSETSFAAL

SEQ ID NO: 136155 - protein, 9 aa, Homo Sapiens
AEFRLAGVN

SEQ ID NO: 136156 - protein, 9 aa, Homo Sapiens
FFSHFNFDI

SEQ ID NO: 136157 - protein, 9 aa, Homo Sapiens
HRHDGKWQN

SEQ ID NO: 136158 - protein, 9 aa, Homo Sapiens
VYINVTLLQ

SEQ ID NO: 136159 - protein, 9 aa, Homo Sapiens
AGLGQLLPQ

SEQ ID NO: 136160 - protein, 9 aa, Homo Sapiens
FIGFTTLVI

SEQ ID NO: 136161 - protein, 9 aa, Homo Sapiens
LTTFATNLL

SEQ ID NO: 136162 - protein, 9 aa, Homo Sapiens
FAALTKLEL

SEQ ID NO: 136163 - protein, 9 aa, Homo Sapiens
VDFHQQLHP

SEQ ID NO: 136164 - protein, 9 aa, Homo Sapiens
QLGLCVVAL

SEQ ID NO: 136165 - protein, 9 aa, Homo Sapiens
ENKKVYRLE

SEQ ID NO: 136166 - protein, 9 aa, Homo Sapiens
VAQGPRRPL

SEQ ID NO: 136167 - protein, 9 aa, Homo Sapiens
ADLDNRCQG

SEQ ID NO: 136168 - protein, 9 aa, Homo Sapiens
ECLVSHHER

SEQ ID NO: 136169 - protein, 9 aa, Homo Sapiens
EKSTVSVRA

SEQ ID NO: 136170 - protein, 9 aa, Homo Sapiens
SVTASRCRT

SEQ ID NO: 136171 - protein, 9 aa, Homo Sapiens
KCNLMERQV

SEQ ID NO: 136172 - protein, 9 aa, Homo Sapiens
TRKLIQGAP

SEQ ID NO: 136173 - protein, 9 aa, Homo Sapiens
MIAKLVMWA

SEQ ID NO: 136174 - protein, 9 aa, Homo Sapiens
PAVLQAQPR

SEQ ID NO: 136175 - protein, 9 aa, Homo Sapiens
PTCSSHVIV

SEQ ID NO: 136176 - protein, 9 aa, Homo Sapiens
SFFFFFFFE

SEQ ID NO: 136177 - protein, 9 aa, Homo Sapiens
KHKEILADV

SEQ ID NO: 136178 - protein, 9 aa, Homo Sapiens
CNPLHYTVI

SEQ ID NO: 136179 - protein, 9 aa, Homo Sapiens
ASDSYRPSL

SEQ ID NO: 136180 - protein, 9 aa, Homo Sapiens
PCPKVLRCK

SEQ ID NO: 136181 - protein, 9 aa, Homo Sapiens
DGTGGSYRL

SEQ ID NO: 136182 - protein, 9 aa, Homo Sapiens
MARMLEGVR

SEQ ID NO: 136183 - protein, 9 aa, Homo Sapiens
RSLKDVVKK

SEQ ID NO: 136184 - protein, 9 aa, Homo Sapiens
KKGSGEAYK

SEQ ID NO: 136185 - protein, 9 aa, Homo Sapiens
MERQVERWF

SEQ ID NO: 136186 - protein, 9 aa, Homo Sapiens
PFQGLSHQG

SEQ ID NO: 136187 - protein, 9 aa, Homo Sapiens
AADLHGSVE

SEQ ID NO: 136188 - protein, 9 aa, Homo Sapiens
LYQEIIRYF

SEQ ID NO: 136189 - protein, 9 aa, Homo Sapiens
YSRHLLVPL

SEQ ID NO: 136190 - protein, 9 aa, Homo Sapiens
TSFAALTKL

SEQ ID NO: 136191 - protein, 9 aa, Homo Sapiens
DIMELPEQD

SEQ ID NO: 136192 - protein, 9 aa, Homo Sapiens
PNTRKLIQG

SEQ ID NO: 136193 - protein, 9 aa, Homo Sapiens
LFDRECRCV

SEQ ID NO: 136194 - protein, 9 aa, Homo Sapiens
TGASLPAPI

SEQ ID NO: 136195 - protein, 9 aa, Homo Sapiens
PPVALPPDK

SEQ ID NO: 136196 - protein, 9 aa, Homo Sapiens
SLITEGFLI

SEQ ID NO: 136197 - protein, 9 aa, Homo Sapiens
ICNPLHYTV

SEQ ID NO: 136198 - protein, 9 aa, Homo Sapiens
DPMIAKLVM

SEQ ID NO: 136199 - protein, 9 aa, Homo Sapiens
MQELEAYRD

SEQ ID NO: 136200 - protein, 9 aa, Homo Sapiens
GKVEKPTLE

SEQ ID NO: 136201 - protein, 9 aa, Homo Sapiens
QGPYSQGGY

SEQ ID NO: 136202 - protein, 9 aa, Homo Sapiens
NLMERQVER

SEQ ID NO: 136203 - protein, 9 aa, Homo Sapiens
FMETKHQKR

SEQ ID NO: 136204 - protein, 9 aa, Homo Sapiens
SSLIVPMSK

SEQ ID NO: 136205 - protein, 9 aa, Homo Sapiens
GLAKKCNLM

SEQ ID NO: 136206 - protein, 9 aa, Homo Sapiens
EHLECLVSH

SEQ ID NO: 136207 - protein, 9 aa, Homo Sapiens
EKPKTPKKK

SEQ ID NO: 136208 - protein, 9 aa, Homo Sapiens
TYLPETFRR

SEQ ID NO: 136209 - protein, 9 aa, Homo Sapiens
KPKRICPSF

SEQ ID NO: 136210 - protein, 9 aa, Homo Sapiens
VWKREGLLH

SEQ ID NO: 136211 - protein, 9 aa, Homo Sapiens
LGLTVLAVR

SEQ ID NO: 136212 - protein, 9 aa, Homo Sapiens
EKQKPEEKQ

SEQ ID NO: 136213 - protein, 9 aa, Homo Sapiens
KPRPHLGLF

SEQ ID NO: 136214 - protein, 9 aa, Homo Sapiens
ATNLLTLSC

SEQ ID NO: 136215 - protein, 9 aa, Homo Sapiens
QPKLRTQFN

SEQ ID NO: 136216 - protein, 9 aa, Homo Sapiens
WSLRLRGSL

SEQ ID NO: 136217 - protein, 9 aa, Homo Sapiens
VALPPDKKS

SEQ ID NO: 136218 - protein, 9 aa, Homo Sapiens
ALSLLIFLA

SEQ ID NO: 136219 - protein, 9 aa, Homo Sapiens
TTFSTMPHM

SEQ ID NO: 136220 - protein, 9 aa, Homo Sapiens
LEGEQGPPG

SEQ ID NO: 136221 - protein, 9 aa, Homo Sapiens
LTASDGSEP

SEQ ID NO: 136222 - protein, 9 aa, Homo Sapiens
TYRRLHYNF

SEQ ID NO: 136223 - protein, 9 aa, Homo Sapiens
ALDFIARKG

SEQ ID NO: 136224 - protein, 9 aa, Homo Sapiens
GPRRPLPST

SEQ ID NO: 136225 - protein, 9 aa, Homo Sapiens
SSASSSGGA

SEQ ID NO: 136226 - protein, 9 aa, Homo Sapiens
TTLESIASA

SEQ ID NO: 136227 - protein, 9 aa, Homo Sapiens
VDFWTIREN

SEQ ID NO: 136228 - protein, 9 aa, Homo Sapiens
IWLIFHWDR

SEQ ID NO: 136229 - protein, 9 aa, Homo Sapiens
LTLFNLGLT

SEQ ID NO: 136230 - protein, 9 aa, Homo Sapiens
QRRSQAEPM

SEQ ID NO: 136231 - protein, 9 aa, Homo Sapiens
GAKIFSNGH

SEQ ID NO: 136232 - protein, 9 aa, Homo Sapiens
SLCYPIVTP

SEQ ID NO: 136233 - protein, 9 aa, Homo Sapiens
ISLFVLLTT

SEQ ID NO: 136234 - protein, 9 aa, Homo Sapiens
MSFVKEMVD

SEQ ID NO: 136235 - protein, 9 aa, Homo Sapiens
CASAASTWT

SEQ ID NO: 136236 - protein, 9 aa, Homo Sapiens
RRTSIYHHL

SEQ ID NO: 136237 - protein, 9 aa, Homo Sapiens
SGHGQSTQK

SEQ ID NO: 136238 - protein, 9 aa, Homo Sapiens
EMLVKKKKK

SEQ ID NO: 136239 - protein, 9 aa, Homo Sapiens
KEMLQRTDP

SEQ ID NO: 136240 - protein, 9 aa, Homo Sapiens
EMLQRTDPP

SEQ ID NO: 136241 - protein, 9 aa, Homo Sapiens
APTGNHCVR

SEQ ID NO: 136242 - protein, 9 aa, Homo Sapiens
LNHDISSSI

SEQ ID NO: 136243 - protein, 9 aa, Homo Sapiens
QQTLQLQEG

SEQ ID NO: 136244 - protein, 9 aa, Homo Sapiens
LPDTTILIE

SEQ ID NO: 136245 - protein, 9 aa, Homo Sapiens
NIVLTAKGE

SEQ ID NO: 136246 - protein, 9 aa, Homo Sapiens
KELQDKFKH

SEQ ID NO: 136247 - protein, 9 aa, Homo Sapiens
LGRQQRKSE

SEQ ID NO: 136248 - protein, 9 aa, Homo Sapiens
LENSIISLF

SEQ ID NO: 136249 - protein, 9 aa, Homo Sapiens
DPLGRRSQP

SEQ ID NO: 136250 - protein, 9 aa, Homo Sapiens
NPKDTILYL

SEQ ID NO: 136251 - protein, 9 aa, Homo Sapiens
ELLTVLYPE

SEQ ID NO: 136252 - protein, 9 aa, Homo Sapiens
VWYGLRLNM

SEQ ID NO: 136253 - protein, 9 aa, Homo Sapiens
FGTSFTARV

SEQ ID NO: 136254 - protein, 9 aa, Homo Sapiens
LLSWIEMLE

SEQ ID NO: 136255 - protein, 9 aa, Homo Sapiens
MSRSASLNF

SEQ ID NO: 136256 - protein, 9 aa, Homo Sapiens
TISPLVVAK

SEQ ID NO: 136257 - protein, 9 aa, Homo Sapiens
FSTLENSII

SEQ ID NO: 136258 - protein, 9 aa, Homo Sapiens
HMCNSSCMG

SEQ ID NO: 136259 - protein, 9 aa, Homo Sapiens
ELLLQTQQC

SEQ ID NO: 136260 - protein, 9 aa, Homo Sapiens
KDTILYLLE

SEQ ID NO: 136261 - protein, 9 aa, Homo Sapiens
KHLKMIQQE

SEQ ID NO: 136262 - protein, 9 aa, Homo Sapiens
GLLKKPFLS

SEQ ID NO: 136263 - protein, 9 aa, Homo Sapiens
LHSTIPQAT

SEQ ID NO: 136264 - protein, 9 aa, Homo Sapiens
QQPQQQLQQ

SEQ ID NO: 136265 - protein, 9 aa, Homo Sapiens
QEQCPNLDR

SEQ ID NO: 136266 - protein, 9 aa, Homo Sapiens
PDTTGKAAL

SEQ ID NO: 136267 - protein, 9 aa, Homo Sapiens
SRSQQHPSV

SEQ ID NO: 136268 - protein, 9 aa, Homo Sapiens
QNLIMTLLS

SEQ ID NO: 136269 - protein, 9 aa, Homo Sapiens
WLVLAHLAR

SEQ ID NO: 136270 - protein, 9 aa, Homo Sapiens
EKGGVGSKS

SEQ ID NO: 136271 - protein, 9 aa, Homo Sapiens
QWLAAPTGN

SEQ ID NO: 136272 - protein, 9 aa, Homo Sapiens
CVIGMPPPV

SEQ ID NO: 136273 - protein, 9 aa, Homo Sapiens
SIISLFVLL

SEQ ID NO: 136274 - protein, 9 aa, Homo Sapiens
NHMCNSSCM

SEQ ID NO: 136275 - protein, 9 aa, Homo Sapiens
GVGVFGTSF

SEQ ID NO: 136276 - protein, 9 aa, Homo Sapiens
RGSKMKKLM

SEQ ID NO: 136277 - protein, 9 aa, Homo Sapiens
GNMSFVKEM

SEQ ID NO: 136278 - protein, 9 aa, Homo Sapiens
QDKFKHLKM

SEQ ID NO: 136279 - protein, 9 aa, Homo Sapiens
KLDGTTPVW

SEQ ID NO: 136280 - protein, 9 aa, Homo Sapiens
LQELLSWIE

SEQ ID NO: 136281 - protein, 9 aa, Homo Sapiens
YAEAEKLGD

SEQ ID NO: 136282 - protein, 9 aa, Homo Sapiens
GSQEAKADI

SEQ ID NO: 136283 - protein, 9 aa, Homo Sapiens
LSCGCLPTW

SEQ ID NO: 136284 - protein, 9 aa, Homo Sapiens
ITTHMPGSY

SEQ ID NO: 136285 - protein, 9 aa, Homo Sapiens
HCEKQSPGV

SEQ ID NO: 136286 - protein, 9 aa, Homo Sapiens
FTFELLVCF

SEQ ID NO: 136287 - protein, 9 aa, Homo Sapiens
FQLCSHQDC

SEQ ID NO: 136288 - protein, 9 aa, Homo Sapiens
SRSASLNFN

SEQ ID NO: 136289 - protein, 9 aa, Homo Sapiens
STSYKEVYI

SEQ ID NO: 136290 - protein, 9 aa, Homo Sapiens
QATSQRLLR

SEQ ID NO: 136291 - protein, 9 aa, Homo Sapiens
LALGLTFDQ

SEQ ID NO: 136292 - protein, 9 aa, Homo Sapiens
HMSHSGDNS

SEQ ID NO: 136293 - protein, 9 aa, Homo Sapiens
YNEYEKVCN

SEQ ID NO: 136294 - protein, 9 aa, Homo Sapiens
QRVCSADSP

SEQ ID NO: 136295 - protein, 9 aa, Homo Sapiens
MNDARHGGW

SEQ ID NO: 136296 - protein, 9 aa, Homo Sapiens
LAAPTGNHC

SEQ ID NO: 136297 - protein, 9 aa, Homo Sapiens
KSPQGPPGP

SEQ ID NO: 136298 - protein, 9 aa, Homo Sapiens
ISQNFSVAM

SEQ ID NO: 136299 - protein, 9 aa, Homo Sapiens
LVVAKGGTA

SEQ ID NO: 136300 - protein, 9 aa, Homo Sapiens
ISPLVVAKG

SEQ ID NO: 136301 - protein, 9 aa, Homo Sapiens
MLVKKKKKK

SEQ ID NO: 136302 - protein, 9 aa, Homo Sapiens
SVQWDQGSG

SEQ ID NO: 136303 - protein, 9 aa, Homo Sapiens
VATDSISQN

SEQ ID NO: 136304 - protein, 9 aa, Homo Sapiens
SGGHMSHSG

SEQ ID NO: 136305 - protein, 9 aa, Homo Sapiens
VQLTVSVPR

SEQ ID NO: 136306 - protein, 9 aa, Homo Sapiens
TCLPVFQVI

SEQ ID NO: 136307 - protein, 9 aa, Homo Sapiens
QDLDDLDVE

SEQ ID NO: 136308 - protein, 9 aa, Homo Sapiens
MKQMNDARH

SEQ ID NO: 136309 - protein, 9 aa, Homo Sapiens
WFTFELLVC

SEQ ID NO: 136310 - protein, 9 aa, Homo Sapiens
SQNLIMTLL

SEQ ID NO: 136311 - protein, 9 aa, Homo Sapiens
PKDTILYLL

SEQ ID NO: 136312 - protein, 9 aa, Homo Sapiens
GGHMSHSGD

SEQ ID NO: 136313 - protein, 9 aa, Homo Sapiens
EQLHSSVVD

SEQ ID NO: 136314 - protein, 9 aa, Homo Sapiens
EESIPKKSY

SEQ ID NO: 136315 - protein, 9 aa, Homo Sapiens
IYGLLKKPF

SEQ ID NO: 136316 - protein, 9 aa, Homo Sapiens
ELVWLVLAH

SEQ ID NO: 136317 - protein, 9 aa, Homo Sapiens
QEAKADISG

SEQ ID NO: 136318 - protein, 9 aa, Homo Sapiens
GRRSQPACQ

SEQ ID NO: 136319 - protein, 9 aa, Homo Sapiens
SGYGQQGSG

SEQ ID NO: 136320 - protein, 9 aa, Homo Sapiens
HPVRLECCV

SEQ ID NO: 136321 - protein, 9 aa, Homo Sapiens
GAEAWKESR

SEQ ID NO: 136322 - protein, 9 aa, Homo Sapiens
EMVDKLLKG

SEQ ID NO: 136323 - protein, 9 aa, Homo Sapiens
MNLPVPSGV

SEQ ID NO: 136324 - protein, 9 aa, Homo Sapiens
PLKNCDVIT

SEQ ID NO: 136325 - protein, 9 aa, Homo Sapiens
HSLDGACIL

SEQ ID NO: 136326 - protein, 9 aa, Homo Sapiens
WYPYYACLN

SEQ ID NO: 136327 - protein, 9 aa, Homo Sapiens
HSTIPQATS

SEQ ID NO: 136328 - protein, 9 aa, Homo Sapiens
SSSICDVAL

SEQ ID NO: 136329 - protein, 9 aa, Homo Sapiens
KKLMYLPGF

SEQ ID NO: 136330 - protein, 9 aa, Homo Sapiens
DQGSGRLQV

SEQ ID NO: 136331 - protein, 9 aa, Homo Sapiens
FLHHCEKQS

SEQ ID NO: 136332 - protein, 9 aa, Homo Sapiens
RRQRVCSAD

SEQ ID NO: 136333 - protein, 9 aa, Homo Sapiens
TIPQATSQR

SEQ ID NO: 136334 - protein, 9 aa, Homo Sapiens
AERGGQDLD

SEQ ID NO: 136335 - protein, 9 aa, Homo Sapiens
AWKESRGAH

SEQ ID NO: 136336 - protein, 9 aa, Homo Sapiens
SDTRYKMPS

SEQ ID NO: 136337 - protein, 9 aa, Homo Sapiens
QVVATDSIS

SEQ ID NO: 136338 - protein, 9 aa, Homo Sapiens
VLTAKGEEV

SEQ ID NO: 136339 - protein, 9 aa, Homo Sapiens
PAAATAAPP

SEQ ID NO: 136340 - protein, 9 aa, Homo Sapiens
IFEQLHSSV

SEQ ID NO: 136341 - protein, 9 aa, Homo Sapiens
LTVLYPEYW

SEQ ID NO: 136342 - protein, 9 aa, Homo Sapiens
TQSEIDEID

SEQ ID NO: 136343 - protein, 9 aa, Homo Sapiens
GKAFLTKSY

SEQ ID NO: 136344 - protein, 9 aa, Homo Sapiens
LIQWLAAPT

SEQ ID NO: 136345 - protein, 9 aa, Homo Sapiens
WFNPKDTIL

SEQ ID NO: 136346 - protein, 9 aa, Homo Sapiens
SKMKKLMYL

SEQ ID NO: 136347 - protein, 9 aa, Homo Sapiens
AVTDLLGRQ

SEQ ID NO: 136348 - protein, 9 aa, Homo Sapiens
KKSYALSNK

SEQ ID NO: 136349 - protein, 9 aa, Homo Sapiens
NGKEMLQRT

SEQ ID NO: 136350 - protein, 9 aa, Homo Sapiens
SHQDCPDSL

SEQ ID NO: 136351 - protein, 9 aa, Homo Sapiens
GPSSGGHMS

SEQ ID NO: 136352 - protein, 9 aa, Homo Sapiens
LLTGHTAPL

SEQ ID NO: 136353 - protein, 9 aa, Homo Sapiens
GRMIPVPLL

SEQ ID NO: 136354 - protein, 9 aa, Homo Sapiens
KLGDQSYLE

SEQ ID NO: 136355 - protein, 9 aa, Homo Sapiens
PYYACLNKK

SEQ ID NO: 136356 - protein, 9 aa, Homo Sapiens
VEVSESTPP

SEQ ID NO: 136357 - protein, 9 aa, Homo Sapiens
PKPLKNCDV

SEQ ID NO: 136358 - protein, 9 aa, Homo Sapiens
VHAPQEGPF

SEQ ID NO: 136359 - protein, 9 aa, Homo Sapiens
LLTVLYPEY

SEQ ID NO: 136360 - protein, 9 aa, Homo Sapiens
RVHAPQEGP

SEQ ID NO: 136361 - protein, 9 aa, Homo Sapiens
STWTRRARA

SEQ ID NO: 136362 - protein, 9 aa, Homo Sapiens
ATLEEMLVK

SEQ ID NO: 136363 - protein, 9 aa, Homo Sapiens
DARHGGWTT

SEQ ID NO: 136364 - protein, 9 aa, Homo Sapiens
TTHMPGSYC

SEQ ID NO: 136365 - protein, 9 aa, Homo Sapiens
ISTATLLSS

SEQ ID NO: 136366 - protein, 9 aa, Homo Sapiens
GERPDPLGR

SEQ ID NO: 136367 - protein, 9 aa, Homo Sapiens
TFDQVSAFA

SEQ ID NO: 136368 - protein, 9 aa, Homo Sapiens
MIPVPLLTG

SEQ ID NO: 136369 - protein, 9 aa, Homo Sapiens
QTQLEITTH

SEQ ID NO: 136370 - protein, 9 aa, Homo Sapiens
ERDTSSVAM

SEQ ID NO: 136371 - protein, 9 aa, Homo Sapiens
ILRSPWKPG

SEQ ID NO: 136372 - protein, 9 aa, Homo Sapiens
FSGITMLFT

SEQ ID NO: 136373 - protein, 9 aa, Homo Sapiens
TTPVWYGLR

SEQ ID NO: 136374 - protein, 9 aa, Homo Sapiens
SRDDHTSVQ

SEQ ID NO: 136375 - protein, 9 aa, Homo Sapiens
CLKCASAAS

SEQ ID NO: 136376 - protein, 9 aa, Homo Sapiens
LGSQEAKAD

SEQ ID NO: 136377 - protein, 9 aa, Homo Sapiens
QLLDEVPCR

SEQ ID NO: 136378 - protein, 9 aa, Homo Sapiens
PGPSSGGHM

SEQ ID NO: 136379 - protein, 9 aa, Homo Sapiens
ELVEVSEST

SEQ ID NO: 136380 - protein, 9 aa, Homo Sapiens
PQEGRPVQV

SEQ ID NO: 136381 - protein, 9 aa, Homo Sapiens
FPSVQWDQG

SEQ ID NO: 136382 - protein, 9 aa, Homo Sapiens
SICDVALNI

SEQ ID NO: 136383 - protein, 9 aa, Homo Sapiens
SIPKKSYAL

SEQ ID NO: 136384 - protein, 9 aa, Homo Sapiens
GKLCLARLL

SEQ ID NO: 136385 - protein, 9 aa, Homo Sapiens
YLICHQTVH

SEQ ID NO: 136386 - protein, 9 aa, Homo Sapiens
HWIRMRPQE

SEQ ID NO: 136387 - protein, 9 aa, Homo Sapiens
CILRSPWKP

SEQ ID NO: 136388 - protein, 9 aa, Homo Sapiens
PQEGPFTCP

SEQ ID NO: 136389 - protein, 9 aa, Homo Sapiens
QSSGYGQQG

SEQ ID NO: 136390 - protein, 9 aa, Homo Sapiens
QCRHRLRGL

SEQ ID NO: 136391 - protein, 9 aa, Homo Sapiens
QMNDARHGG

SEQ ID NO: 136392 - protein, 9 aa, Homo Sapiens
PCRLQTHNL

SEQ ID NO: 136393 - protein, 9 aa, Homo Sapiens
EQCPNLDRT

SEQ ID NO: 136394 - protein, 9 aa, Homo Sapiens
FKHLKMIQQ

SEQ ID NO: 136395 - protein, 9 aa, Homo Sapiens
REESIPKKS

SEQ ID NO: 136396 - protein, 9 aa, Homo Sapiens
TILYLLEAI

SEQ ID NO: 136397 - protein, 9 aa, Homo Sapiens
YNEWHRTNQ

SEQ ID NO: 136398 - protein, 9 aa, Homo Sapiens
SFVKEMVDK

SEQ ID NO: 136399 - protein, 9 aa, Homo Sapiens
CGCLPTWVR

SEQ ID NO: 136400 - protein, 9 aa, Homo Sapiens
SEFYSLQEQ

SEQ ID NO: 136401 - protein, 9 aa, Homo Sapiens
GVGSKSPQG

SEQ ID NO: 136402 - protein, 9 aa, Homo Sapiens
HHCEKQSPG

SEQ ID NO: 136403 - protein, 9 aa, Homo Sapiens
GEEVKSGRS

SEQ ID NO: 136404 - protein, 9 aa, Homo Sapiens
AAERGGQDL

SEQ ID NO: 136405 - protein, 9 aa, Homo Sapiens
ATDSISQNF

SEQ ID NO: 136406 - protein, 9 aa, Homo Sapiens
EGSKLLSQK

SEQ ID NO: 136407 - protein, 9 aa, Homo Sapiens
PLQRQGPLN

SEQ ID NO: 136408 - protein, 9 aa, Homo Sapiens
VCNNSAVIV

SEQ ID NO: 136409 - protein, 9 aa, Homo Sapiens
YRSEFYSLQ

SEQ ID NO: 136410 - protein, 9 aa, Homo Sapiens
LNLSSDTRY

SEQ ID NO: 136411 - protein, 9 aa, Homo Sapiens
EKVCNNSAV

SEQ ID NO: 136412 - protein, 9 aa, Homo Sapiens
TWTRRARAS

SEQ ID NO: 136413 - protein, 9 aa, Homo Sapiens
YIPEIVSGS

SEQ ID NO: 136414 - protein, 9 aa, Homo Sapiens
LVCFFACPS

SEQ ID NO: 136415 - protein, 9 aa, Homo Sapiens
KFKHLKMIQ

SEQ ID NO: 136416 - protein, 9 aa, Homo Sapiens
TTILIECQE

SEQ ID NO: 136417 - protein, 9 aa, Homo Sapiens
PLLWGLRHL

SEQ ID NO: 136418 - protein, 9 aa, Homo Sapiens
GRVHAPQEG

SEQ ID NO: 136419 - protein, 9 aa, Homo Sapiens
PKKSYALSN

SEQ ID NO: 136420 - protein, 9 aa, Homo Sapiens
SIYHHLFEI

SEQ ID NO: 136421 - protein, 9 aa, Homo Sapiens
TLENSIISL

SEQ ID NO: 136422 - protein, 9 aa, Homo Sapiens
LSWIEMLER

SEQ ID NO: 136423 - protein, 9 aa, Homo Sapiens
LQLQEGSKL

SEQ ID NO: 136424 - protein, 9 aa, Homo Sapiens
SAPAAATAA

SEQ ID NO: 136425 - protein, 9 aa, Homo Sapiens
EQTQLEITT

SEQ ID NO: 136426 - protein, 9 aa, Homo Sapiens
QWDQGSGRL

SEQ ID NO: 136427 - protein, 9 aa, Homo Sapiens
PRAGLCILP

SEQ ID NO: 136428 - protein, 9 aa, Homo Sapiens
KGGTAWLEW

SEQ ID NO: 136429 - protein, 9 aa, Homo Sapiens
VGQGKLCLA

SEQ ID NO: 136430 - protein, 9 aa, Homo Sapiens
KQMNDARHG

SEQ ID NO: 136431 - protein, 9 aa, Homo Sapiens
MRPQEGRPV

SEQ ID NO: 136432 - protein, 9 aa, Homo Sapiens
PLVVAKGGT

SEQ ID NO: 136433 - protein, 9 aa, Homo Sapiens
FQVIPMGPP

SEQ ID NO: 136434 - protein, 9 aa, Homo Sapiens
RMRPQEGRP

SEQ ID NO: 136435 - protein, 9 aa, Homo Sapiens
LLPLQRQGP

SEQ ID NO: 136436 - protein, 9 aa, Homo Sapiens
AKGEEVKSG

SEQ ID NO: 136437 - protein, 9 aa, Homo Sapiens
VPLHSTIPQ

SEQ ID NO: 136438 - protein, 9 aa, Homo Sapiens
HAACLKCAS

SEQ ID NO: 136439 - protein, 9 aa, Homo Sapiens
RLAAERGGQ

SEQ ID NO: 136440 - protein, 9 aa, Homo Sapiens
KSYLICHQT

SEQ ID NO: 136441 - protein, 9 aa, Homo Sapiens
VKEMVDKLL

SEQ ID NO: 136442 - protein, 9 aa, Homo Sapiens
KADISGVQG

SEQ ID NO: 136443 - protein, 9 aa, Homo Sapiens
LPLQRQGPL

SEQ ID NO: 136444 - protein, 9 aa, Homo Sapiens
IRHVDAHAM

SEQ ID NO: 136445 - protein, 9 aa, Homo Sapiens
GTSAPAAAT

SEQ ID NO: 136446 - protein, 9 aa, Homo Sapiens
TSSVAMNLP

SEQ ID NO: 136447 - protein, 9 aa, Homo Sapiens
AGLTAAGGE

SEQ ID NO: 136448 - protein, 9 aa, Homo Sapiens
KSYALSNKN

SEQ ID NO: 136449 - protein, 9 aa, Homo Sapiens
TAPLLWGLR

SEQ ID NO: 136450 - protein, 9 aa, Homo Sapiens
KSGFSGITM

SEQ ID NO: 136451 - protein, 9 aa, Homo Sapiens
SWIEMLERE

SEQ ID NO: 136452 - protein, 9 aa, Homo Sapiens
ARPPASRSQ

SEQ ID NO: 136453 - protein, 9 aa, Homo Sapiens
LQDKFKHLK

SEQ ID NO: 136454 - protein, 9 aa, Homo Sapiens
IHYNHMCNS

SEQ ID NO: 136455 - protein, 9 aa, Homo Sapiens
LQEGSKLLS

SEQ ID NO: 136456 - protein, 9 aa, Homo Sapiens
TSIYHHLFE

SEQ ID NO: 136457 - protein, 9 aa, Homo Sapiens
QILNLSSDT

SEQ ID NO: 136458 - protein, 9 aa, Homo Sapiens
LCILPIVRD

SEQ ID NO: 136459 - protein, 9 aa, Homo Sapiens
DQSYLEGCL

SEQ ID NO: 136460 - protein, 9 aa, Homo Sapiens
ISSSICDVA

SEQ ID NO: 136461 - protein, 9 aa, Homo Sapiens
LGELVWLVL

SEQ ID NO: 136462 - protein, 9 aa, Homo Sapiens
LDGTTPVWY

SEQ ID NO: 136463 - protein, 9 aa, Homo Sapiens
GPVCPPYLR

SEQ ID NO: 136464 - protein, 9 aa, Homo Sapiens
DSISQNFSV

SEQ ID NO: 136465 - protein, 9 aa, Homo Sapiens
GPDSAKGNR

SEQ ID NO: 136466 - protein, 9 aa, Homo Sapiens
VPCRLQTHN

SEQ ID NO: 136467 - protein, 9 aa, Homo Sapiens
DGPDSAKGN

SEQ ID NO: 136468 - protein, 9 aa, Homo Sapiens
PSVQWDQGS

SEQ ID NO: 136469 - protein, 9 aa, Homo Sapiens
YKEVYIPEI

SEQ ID NO: 136470 - protein, 9 aa, Homo Sapiens
RLECCVIGM

SEQ ID NO: 136471 - protein, 9 aa, Homo Sapiens
CSHQDCPDS

SEQ ID NO: 136472 - protein, 9 aa, Homo Sapiens
NEWHRTNQR

SEQ ID NO: 136473 - protein, 9 aa, Homo Sapiens
KPFLSVRFR

SEQ ID NO: 136474 - protein, 9 aa, Homo Sapiens
EVPCRLQTH

SEQ ID NO: 136475 - protein, 9 aa, Homo Sapiens
LGRRSQPAC

SEQ ID NO: 136476 - protein, 9 aa, Homo Sapiens
VWLVLAHLA

SEQ ID NO: 136477 - protein, 9 aa, Homo Sapiens
FNELVQEQC

SEQ ID NO: 136478 - protein, 9 aa, Homo Sapiens
ACILRSPWK

SEQ ID NO: 136479 - protein, 9 aa, Homo Sapiens
MLQRTDPPK

SEQ ID NO: 136480 - protein, 9 aa, Homo Sapiens
SSVDELLTV

SEQ ID NO: 136481 - protein, 9 aa, Homo Sapiens
HAPQEGPFT

SEQ ID NO: 136482 - protein, 9 aa, Homo Sapiens
ASLNFNTSG

SEQ ID NO: 136483 - protein, 9 aa, Homo Sapiens
PVWYGLRLN

SEQ ID NO: 136484 - protein, 9 aa, Homo Sapiens
LHSSVVDDD

SEQ ID NO: 136485 - protein, 9 aa, Homo Sapiens
TQQCRHRLR

SEQ ID NO: 136486 - protein, 9 aa, Homo Sapiens
SQFLNTYDA

SEQ ID NO: 136487 - protein, 9 aa, Homo Sapiens
VAMNLPVPS

SEQ ID NO: 136488 - protein, 9 aa, Homo Sapiens
RCGAGRTAG

SEQ ID NO: 136489 - protein, 9 aa, Homo Sapiens
GLPDTTILI

SEQ ID NO: 136490 - protein, 9 aa, Homo Sapiens
ADSPPKTDL

SEQ ID NO: 136491 - protein, 9 aa, Homo Sapiens
RDTSSVAMN

SEQ ID NO: 136492 - protein, 9 aa, Homo Sapiens
SVVDDDGFI

SEQ ID NO: 136493 - protein, 9 aa, Homo Sapiens
IISLFVLLT

SEQ ID NO: 136494 - protein, 9 aa, Homo Sapiens
ELVQEQCPN

SEQ ID NO: 136495 - protein, 9 aa, Homo Sapiens
GQDLDDLDV

SEQ ID NO: 136496 - protein, 9 aa, Homo Sapiens
DCTTIHYNH

SEQ ID NO: 136497 - protein, 9 aa, Homo Sapiens
HAMLNDGVV

SEQ ID NO: 136498 - protein, 9 aa, Homo Sapiens
LIMTLLSGV

SEQ ID NO: 136499 - protein, 9 aa, Homo Sapiens
HLFEIVEGC

SEQ ID NO: 136500 - protein, 9 aa, Homo Sapiens
IPMGPPTPL

SEQ ID NO: 136501 - protein, 9 aa, Homo Sapiens
SISQNFSVA

SEQ ID NO: 136502 - protein, 9 aa, Homo Sapiens
GYGQQGSGS

SEQ ID NO: 136503 - protein, 9 aa, Homo Sapiens
TPVWYGLRL

SEQ ID NO: 136504 - protein, 9 aa, Homo Sapiens
WIRMRPQEG

SEQ ID NO: 136505 - protein, 9 aa, Homo Sapiens
YYACLNKKG

SEQ ID NO: 136506 - protein, 9 aa, Homo Sapiens
SDHWIRMRP

SEQ ID NO: 136507 - protein, 9 aa, Homo Sapiens
RSASLNFNT

SEQ ID NO: 136508 - protein, 9 aa, Homo Sapiens
GFSGITMLF

SEQ ID NO: 136509 - protein, 9 aa, Homo Sapiens
ACLKCASAA

SEQ ID NO: 136510 - protein, 9 aa, Homo Sapiens
AMNLPVPSG

SEQ ID NO: 136511 - protein, 9 aa, Homo Sapiens
ELLVCFFAC

SEQ ID NO: 136512 - protein, 9 aa, Homo Sapiens
QLHSSVVDD

SEQ ID NO: 136513 - protein, 9 aa, Homo Sapiens
YGLLKKPFL

SEQ ID NO: 136514 - protein, 9 aa, Homo Sapiens
PASRSQQHP

SEQ ID NO: 136515 - protein, 9 aa, Homo Sapiens
DTTGKAALM

SEQ ID NO: 136516 - protein, 9 aa, Homo Sapiens
STIPQATSQ

SEQ ID NO: 136517 - protein, 9 aa, Homo Sapiens
CTTIHYNHM

SEQ ID NO: 136518 - protein, 9 aa, Homo Sapiens
YALSNKNLL

SEQ ID NO: 136519 - protein, 9 aa, Homo Sapiens
SSQFLNTYD

SEQ ID NO: 136520 - protein, 9 aa, Homo Sapiens
GGQDLDDLD

SEQ ID NO: 136521 - protein, 9 aa, Homo Sapiens
SVSSVDELL

SEQ ID NO: 136522 - protein, 9 aa, Homo Sapiens
TSAPAAATA

SEQ ID NO: 136523 - protein, 9 aa, Homo Sapiens
LKCASAAST

SEQ ID NO: 136524 - protein, 9 aa, Homo Sapiens
ALSNKNLLI

SEQ ID NO: 136525 - protein, 9 aa, Homo Sapiens
DATLEEMLV

SEQ ID NO: 136526 - protein, 9 aa, Homo Sapiens
GEWLRAGLT

SEQ ID NO: 136527 - protein, 9 aa, Homo Sapiens
TSVQLTVSV

SEQ ID NO: 136528 - protein, 9 aa, Homo Sapiens
EVYIPEIVS

SEQ ID NO: 136529 - protein, 9 aa, Homo Sapiens
FEQLHSSVV

SEQ ID NO: 136530 - protein, 9 aa, Homo Sapiens
HGRVHAPQE

SEQ ID NO: 136531 - protein, 9 aa, Homo Sapiens
SLIQWLAAP

SEQ ID NO: 136532 - protein, 9 aa, Homo Sapiens
GACILRSPW

SEQ ID NO: 136533 - protein, 9 aa, Homo Sapiens
SSVAMNLPV

SEQ ID NO: 136534 - protein, 9 aa, Homo Sapiens
DTSSVAMNL

SEQ ID NO: 136535 - protein, 9 aa, Homo Sapiens
ALQLLDEVP

SEQ ID NO: 136536 - protein, 9 aa, Homo Sapiens
AEAWKESRG

SEQ ID NO: 136537 - protein, 9 aa, Homo Sapiens
EITTHMPGS

SEQ ID NO: 136538 - protein, 9 aa, Homo Sapiens
TGKAALMFA

SEQ ID NO: 136539 - protein, 9 aa, Homo Sapiens
LTKSYLICH

SEQ ID NO: 136540 - protein, 9 aa, Homo Sapiens
QSTQKGSRT

SEQ ID NO: 136541 - protein, 9 aa, Homo Sapiens
QELLSWIEM

SEQ ID NO: 136542 - protein, 9 aa, Homo Sapiens
SASLNFNTS

SEQ ID NO: 136543 - protein, 9 aa, Homo Sapiens
WLAAPTGNH

SEQ ID NO: 136544 - protein, 9 aa, Homo Sapiens
QRQGPLNSW

SEQ ID NO: 136545 - protein, 9 aa, Homo Sapiens
TLQLQEGSK

SEQ ID NO: 136546 - protein, 9 aa, Homo Sapiens
SYKEVYIPE

SEQ ID NO: 136547 - protein, 9 aa, Homo Sapiens
TQKGSRTTG

SEQ ID NO: 136548 - protein, 9 aa, Homo Sapiens
RLYNEWHRT

SEQ ID NO: 136549 - protein, 9 aa, Homo Sapiens
RKLGFTQSE

SEQ ID NO: 136550 - protein, 9 aa, Homo Sapiens
EKELQDKFK

SEQ ID NO: 136551 - protein, 9 aa, Homo Sapiens
QLCSHQDCP

SEQ ID NO: 136552 - protein, 9 aa, Homo Sapiens
STQKGSRTT

SEQ ID NO: 136553 - protein, 9 aa, Homo Sapiens
ARHGGWTTK

SEQ ID NO: 136554 - protein, 9 aa, Homo Sapiens
STATLLSSM

SEQ ID NO: 136555 - protein, 9 aa, Homo Sapiens
ADISGVQGS

SEQ ID NO: 136556 - protein, 9 aa, Homo Sapiens
ASRSQQHPS

SEQ ID NO: 136557 - protein, 9 aa, Homo Sapiens
FLTKSYLIC

SEQ ID NO: 136558 - protein, 9 aa, Homo Sapiens
AKADISGVQ

SEQ ID NO: 136559 - protein, 9 aa, Homo Sapiens
HDISSSICD

SEQ ID NO: 136560 - protein, 9 aa, Homo Sapiens
RRAERARRC

SEQ ID NO: 136561 - protein, 9 aa, Homo Sapiens
NEYEKVCNN

SEQ ID NO: 136562 - protein, 9 aa, Homo Sapiens
GSKSPQGPP

SEQ ID NO: 136563 - protein, 9 aa, Homo Sapiens
YHHLFEIVE

SEQ ID NO: 136564 - protein, 9 aa, Homo Sapiens
LNFNTSGGA

SEQ ID NO: 136565 - protein, 9 aa, Homo Sapiens
QWMVPFLHH

SEQ ID NO: 136566 - protein, 9 aa, Homo Sapiens
RQGPLNSWI

SEQ ID NO: 136567 - protein, 9 aa, Homo Sapiens
IPKKSYALS

SEQ ID NO: 136568 - protein, 9 aa, Homo Sapiens
LMYLPGFMR

SEQ ID NO: 136569 - protein, 9 aa, Homo Sapiens
YGAEAWKES

SEQ ID NO: 136570 - protein, 9 aa, Homo Sapiens
QLLPLQRQG

SEQ ID NO: 136571 - protein, 9 aa, Homo Sapiens
TDPPKTHVT

SEQ ID NO: 136572 - protein, 9 aa, Homo Sapiens
IQWLAAPTG

SEQ ID NO: 136573 - protein, 9 aa, Homo Sapiens
RGEWLRAGL

SEQ ID NO: 136574 - protein, 9 aa, Homo Sapiens
SSDTRYKMP

SEQ ID NO: 136575 - protein, 9 aa, Homo Sapiens
QKWYPYYAC

SEQ ID NO: 136576 - protein, 9 aa, Homo Sapiens
ATAAPPPST

SEQ ID NO: 136577 - protein, 9 aa, Homo Sapiens
DGACILRSP

SEQ ID NO: 136578 - protein, 9 aa, Homo Sapiens
AKGNRTKQE

SEQ ID NO: 136579 - protein, 9 aa, Homo Sapiens
CCVIGMPPP

SEQ ID NO: 136580 - protein, 9 aa, Homo Sapiens
LGFTQSEID

SEQ ID NO: 136581 - protein, 9 aa, Homo Sapiens
YDFQLCSHQ

SEQ ID NO: 136582 - protein, 9 aa, Homo Sapiens
LVWLVLAHL

SEQ ID NO: 136583 - protein, 9 aa, Homo Sapiens
PLGRRSQPA

SEQ ID NO: 136584 - protein, 9 aa, Homo Sapiens
VQVVATDSI

SEQ ID NO: 136585 - protein, 9 aa, Homo Sapiens
GSKLLSQKT

SEQ ID NO: 136586 - protein, 9 aa, Homo Sapiens
PLLTGHTAP

SEQ ID NO: 136587 - protein, 9 aa, Homo Sapiens
NSIISLFVL

SEQ ID NO: 136588 - protein, 9 aa, Homo Sapiens
SGITMLFTG

SEQ ID NO: 136589 - protein, 9 aa, Homo Sapiens
KCASAASTW

SEQ ID NO: 136590 - protein, 9 aa, Homo Sapiens
GQGKLCLAR

SEQ ID NO: 136591 - protein, 9 aa, Homo Sapiens
SFTARVIIP

SEQ ID NO: 136592 - protein, 9 aa, Homo Sapiens
RDDHTSVQL

SEQ ID NO: 136593 - protein, 9 aa, Homo Sapiens
VGVFGTSFT

SEQ ID NO: 136594 - protein, 9 aa, Homo Sapiens
LLDEVPCRL

SEQ ID NO: 136595 - protein, 9 aa, Homo Sapiens
WIEMLEREV

SEQ ID NO: 136596 - protein, 9 aa, Homo Sapiens
SVQLTVSVP

SEQ ID NO: 136597 - protein, 9 aa, Homo Sapiens
LLQTQQCRH

SEQ ID NO: 136598 - protein, 9 aa, Homo Sapiens
NCDVITLRS

SEQ ID NO: 136599 - protein, 9 aa, Homo Sapiens
QTIYGAEAW

SEQ ID NO: 136600 - protein, 9 aa, Homo Sapiens
CLPVFQVIP

SEQ ID NO: 136601 - protein, 9 aa, Homo Sapiens
AMLNDGVVV

SEQ ID NO: 136602 - protein, 9 aa, Homo Sapiens
PGPRAGLCI

SEQ ID NO: 136603 - protein, 9 aa, Homo Sapiens
NLIMTLLSG

SEQ ID NO: 136604 - protein, 9 aa, Homo Sapiens
YEKVCNNSA

SEQ ID NO: 136605 - protein, 9 aa, Homo Sapiens
LIECQEKLV

SEQ ID NO: 136606 - protein, 9 aa, Homo Sapiens
AFLTKSYLI

SEQ ID NO: 136607 - protein, 9 aa, Homo Sapiens
DTRYKMPSD

SEQ ID NO: 136608 - protein, 9 aa, Homo Sapiens
AERARRCGA

SEQ ID NO: 136609 - protein, 9 aa, Homo Sapiens
RPPASRSQQ

SEQ ID NO: 136610 - protein, 9 aa, Homo Sapiens
ARRTSIYHH

SEQ ID NO: 136611 - protein, 9 aa, Homo Sapiens
GLYLGELVW

SEQ ID NO: 136612 - protein, 9 aa, Homo Sapiens
CSADSPPKT

SEQ ID NO: 136613 - protein, 9 aa, Homo Sapiens
RAGLCILPI

SEQ ID NO: 136614 - protein, 9 aa, Homo Sapiens
ALGLTFDQV

SEQ ID NO: 136615 - protein, 9 aa, Homo Sapiens
RMIPVPLLT

SEQ ID NO: 136616 - protein, 9 aa, Homo Sapiens
ERGGQDLDD

SEQ ID NO: 136617 - protein, 9 aa, Homo Sapiens
LEEMLVKKK

SEQ ID NO: 136618 - protein, 9 aa, Homo Sapiens
LNTYDAHNM

SEQ ID NO: 136619 - protein, 9 aa, Homo Sapiens
PDSAKGNRT

SEQ ID NO: 136620 - protein, 9 aa, Homo Sapiens
ILIECQEKL

SEQ ID NO: 136621 - protein, 9 aa, Homo Sapiens
EAEKLGDQS

SEQ ID NO: 136622 - protein, 9 aa, Homo Sapiens
DTILYLLEA

SEQ ID NO: 136623 - protein, 9 aa, Homo Sapiens
VLQELLSWI

SEQ ID NO: 136624 - protein, 9 aa, Homo Sapiens
TIYGAEAWK

SEQ ID NO: 136625 - protein, 9 aa, Homo Sapiens
HINARGPVC

SEQ ID NO: 136626 - protein, 9 aa, Homo Sapiens
DISGVQGSE

SEQ ID NO: 136627 - protein, 9 aa, Homo Sapiens
FMKQMNDAR

SEQ ID NO: 136628 - protein, 9 aa, Homo Sapiens
ESTPPGYVI

SEQ ID NO: 136629 - protein, 9 aa, Homo Sapiens
NLSSDTRYK

SEQ ID NO: 136630 - protein, 9 aa, Homo Sapiens
RCPKPLKNC

SEQ ID NO: 136631 - protein, 9 aa, Homo Sapiens
NARGPVCPP

SEQ ID NO: 136632 - protein, 9 aa, Homo Sapiens
LSSMLCIVR

SEQ ID NO: 136633 - protein, 9 aa, Homo Sapiens
AWFNPKDTI

SEQ ID NO: 136634 - protein, 9 aa, Homo Sapiens
DKFKHLKMI

SEQ ID NO: 136635 - protein, 9 aa, Homo Sapiens
SSVVDDDGF

SEQ ID NO: 136636 - protein, 9 aa, Homo Sapiens
FGIYGLLKK

SEQ ID NO: 136637 - protein, 9 aa, Homo Sapiens
AHAMLNDGV

SEQ ID NO: 136638 - protein, 9 aa, Homo Sapiens
LQRQGPLNS

SEQ ID NO: 136639 - protein, 9 aa, Homo Sapiens
CLPTWVRPR

SEQ ID NO: 136640 - protein, 9 aa, Homo Sapiens
KYNEYEKVC

SEQ ID NO: 136641 - protein, 9 aa, Homo Sapiens
ASTWTRRAR

SEQ ID NO: 136642 - protein, 9 aa, Homo Sapiens
SSICDVALN

SEQ ID NO: 136643 - protein, 9 aa, Homo Sapiens
FDQVSAFAR

SEQ ID NO: 136644 - protein, 9 aa, Homo Sapiens
APQEGPFTC

SEQ ID NO: 136645 - protein, 9 aa, Homo Sapiens
DHTSVQLTV

SEQ ID NO: 136646 - protein, 9 aa, Homo Sapiens
IRKSGFSGI

SEQ ID NO: 136647 - protein, 9 aa, Homo Sapiens
SYSSQFLNT

SEQ ID NO: 136648 - protein, 9 aa, Homo Sapiens
YNHMCNSSC

SEQ ID NO: 136649 - protein, 9 aa, Homo Sapiens
QEGPFTCPH

SEQ ID NO: 136650 - protein, 9 aa, Homo Sapiens
EWLRAGLTA

SEQ ID NO: 136651 - protein, 9 aa, Homo Sapiens
TDSISQNFS

SEQ ID NO: 136652 - protein, 9 aa, Homo Sapiens
VSSVDELLT

SEQ ID NO: 136653 - protein, 9 aa, Homo Sapiens
DFQLCSHQD

SEQ ID NO: 136654 - protein, 9 aa, Homo Sapiens
SQEAKADIS

SEQ ID NO: 136655 - protein, 9 aa, Homo Sapiens
VVATDSISQ

SEQ ID NO: 136656 - protein, 9 aa, Homo Sapiens
DSPPKTDLM

SEQ ID NO: 136657 - protein, 9 aa, Homo Sapiens
CFFACPSKA

SEQ ID NO: 136658 - protein, 9 aa, Homo Sapiens
VPFLHHCEK

SEQ ID NO: 136659 - protein, 9 aa, Homo Sapiens
RSEFYSLQE

SEQ ID NO: 136660 - protein, 9 aa, Homo Sapiens
KNCDVITLR

SEQ ID NO: 136661 - protein, 9 aa, Homo Sapiens
VIFEQLHSS

SEQ ID NO: 136662 - protein, 9 aa, Homo Sapiens
SQSSGYGQQ

SEQ ID NO: 136663 - protein, 9 aa, Homo Sapiens
ARRCGAGRT

SEQ ID NO: 136664 - protein, 9 aa, Homo Sapiens
LDGACILRS

SEQ ID NO: 136665 - protein, 9 aa, Homo Sapiens
QVIPMGPPT

SEQ ID NO: 136666 - protein, 9 aa, Homo Sapiens
MKKLMYLPG

SEQ ID NO: 136667 - protein, 9 aa, Homo Sapiens
SAASTWTRR

SEQ ID NO: 136668 - protein, 9 aa, Homo Sapiens
TKSYLICHQ

SEQ ID NO: 136669 - protein, 9 aa, Homo Sapiens
QTLQLQEGS

SEQ ID NO: 136670 - protein, 9 aa, Homo Sapiens
LFPSVQWDQ

SEQ ID NO: 136671 - protein, 9 aa, Homo Sapiens
FNPKDTILY

SEQ ID NO: 136672 - protein, 9 aa, Homo Sapiens
PVCPPYLRG

SEQ ID NO: 136673 - protein, 9 aa, Homo Sapiens
DGTTPVWYG

SEQ ID NO: 136674 - protein, 9 aa, Homo Sapiens
SPARPPASR

SEQ ID NO: 136675 - protein, 9 aa, Homo Sapiens
DLLGRQQRK

SEQ ID NO: 136676 - protein, 9 aa, Homo Sapiens
KLMYLPGFM

SEQ ID NO: 136677 - protein, 9 aa, Homo Sapiens
MLNDGVVVQ

SEQ ID NO: 136678 - protein, 9 aa, Homo Sapiens
EDATLEEML

SEQ ID NO: 136679 - protein, 9 aa, Homo Sapiens
VFQVIPMGP

SEQ ID NO: 136680 - protein, 9 aa, Homo Sapiens
TLLSGVMAI

SEQ ID NO: 136681 - protein, 9 aa, Homo Sapiens
CDVITLRSW

SEQ ID NO: 136682 - protein, 9 aa, Homo Sapiens
KLCLARLLL

SEQ ID NO: 136683 - protein, 9 aa, Homo Sapiens
GHGQSTQKG

SEQ ID NO: 136684 - protein, 9 aa, Homo Sapiens
VSESTPPGY

SEQ ID NO: 136685 - protein, 9 aa, Homo Sapiens
DEVPCRLQT

SEQ ID NO: 136686 - protein, 9 aa, Homo Sapiens
VLNHDISSS

SEQ ID NO: 136687 - protein, 9 aa, Homo Sapiens
LYNEWHRTN

SEQ ID NO: 136688 - protein, 9 aa, Homo Sapiens
GCLPTWVRP

SEQ ID NO: 136689 - protein, 9 aa, Homo Sapiens
ASAASTWTR

SEQ ID NO: 136690 - protein, 9 aa, Homo Sapiens
NHDISSSIC

SEQ ID NO: 136691 - protein, 9 aa, Homo Sapiens
FLNTYDAHN

SEQ ID NO: 136692 - protein, 9 aa, Homo Sapiens
TTGKAALMF

SEQ ID NO: 136693 - protein, 9 aa, Homo Sapiens
RTSIYHHLF

SEQ ID NO: 136694 - protein, 9 aa, Homo Sapiens
SVDELLTVL

SEQ ID NO: 136695 - protein, 9 aa, Homo Sapiens
HHLFEIVEG

SEQ ID NO: 136696 - protein, 9 aa, Homo Sapiens
GVFGTSFTA

SEQ ID NO: 136697 - protein, 9 aa, Homo Sapiens
LTFDQVSAF

SEQ ID NO: 136698 - protein, 9 aa, Homo Sapiens
GIYGLLKKP

SEQ ID NO: 136699 - protein, 9 aa, Homo Sapiens
DELLTVLYP

SEQ ID NO: 136700 - protein, 9 aa, Homo Sapiens
WMVPFLHHC

SEQ ID NO: 136701 - protein, 9 aa, Homo Sapiens
WLRAGLTAA

SEQ ID NO: 136702 - protein, 9 aa, Homo Sapiens
VRLECCVIG

SEQ ID NO: 136703 - protein, 9 aa, Homo Sapiens
AACLKCASA

SEQ ID NO: 136704 - protein, 9 aa, Homo Sapiens
ERARRCGAG

SEQ ID NO: 136705 - protein, 9 aa, Homo Sapiens
RGGQDLDDL

SEQ ID NO: 136706 - protein, 9 aa, Homo Sapiens
YLGELVWLV

SEQ ID NO: 136707 - protein, 9 aa, Homo Sapiens
QFLNTYDAH

SEQ ID NO: 136708 - protein, 9 aa, Homo Sapiens
ESRDDHTSV

SEQ ID NO: 136709 - protein, 9 aa, Homo Sapiens
IPQATSQRL

SEQ ID NO: 136710 - protein, 9 aa, Homo Sapiens
CPNLDRTSA

SEQ ID NO: 136711 - protein, 9 aa, Homo Sapiens
LLKKPFLSV

SEQ ID NO: 136712 - protein, 9 aa, Homo Sapiens
LGDQSYLEG

SEQ ID NO: 136713 - protein, 9 aa, Homo Sapiens
SESTPPGYV

SEQ ID NO: 136714 - protein, 9 aa, Homo Sapiens
VDELLTVLY

SEQ ID NO: 136715 - protein, 9 aa, Homo Sapiens
CRHRLRGLR

SEQ ID NO: 136716 - protein, 9 aa, Homo Sapiens
ASPARPPAS

SEQ ID NO: 136717 - protein, 9 aa, Homo Sapiens
GRQQRKSEK

SEQ ID NO: 136718 - protein, 9 aa, Homo Sapiens
GQLLPLQRQ

SEQ ID NO: 136719 - protein, 9 aa, Homo Sapiens
QPYRSEFYS

SEQ ID NO: 136720 - protein, 9 aa, Homo Sapiens
MSHSGDNSS

SEQ ID NO: 136721 - protein, 9 aa, Homo Sapiens
NGQLLPLQR

SEQ ID NO: 136722 - protein, 9 aa, Homo Sapiens
HRTNQRVIL

SEQ ID NO: 136723 - protein, 9 aa, Homo Sapiens
QVSAFARGD

SEQ ID NO: 136724 - protein, 9 aa, Homo Sapiens
KGNRTKQES

SEQ ID NO: 136725 - protein, 9 aa, Homo Sapiens
RGPVCPPYL

SEQ ID NO: 136726 - protein, 9 aa, Homo Sapiens
TIHYNHMCN

SEQ ID NO: 136727 - protein, 9 aa, Homo Sapiens
LGLPDTTIL

SEQ ID NO: 136728 - protein, 9 aa, Homo Sapiens
QVLQELLSW

SEQ ID NO: 136729 - protein, 9 aa, Homo Sapiens
VDAHAMLND

SEQ ID NO: 136730 - protein, 9 aa, Homo Sapiens
VPLLTGHTA

SEQ ID NO: 136731 - protein, 9 aa, Homo Sapiens
ATLLSSMLC

SEQ ID NO: 136732 - protein, 9 aa, Homo Sapiens
TSFTARVII

SEQ ID NO: 136733 - protein, 9 aa, Homo Sapiens
TATLLSSML

SEQ ID NO: 136734 - protein, 9 aa, Homo Sapiens
PTGNHCVRI

SEQ ID NO: 136735 - protein, 9 aa, Homo Sapiens
AASTWTRRA

SEQ ID NO: 136736 - protein, 9 aa, Homo Sapiens
QLQEGSKLL

SEQ ID NO: 136737 - protein, 9 aa, Homo Sapiens
TTIHYNHMC

SEQ ID NO: 136738 - protein, 9 aa, Homo Sapiens
APGPRAGLC

SEQ ID NO: 136739 - protein, 9 aa, Homo Sapiens
RRSQPACQV

SEQ ID NO: 136740 - protein, 9 aa, Homo Sapiens
IRMRPQEGR

SEQ ID NO: 136741 - protein, 9 aa, Homo Sapiens
CQPYRSEFY

SEQ ID NO: 136742 - protein, 9 aa, Homo Sapiens
FTARVIIPL

SEQ ID NO: 136743 - protein, 9 aa, Homo Sapiens
DAHAMLNDG

SEQ ID NO: 136744 - protein, 9 aa, Homo Sapiens
LLGRQQRKS

SEQ ID NO: 136745 - protein, 9 aa, Homo Sapiens
SGFSGITML

SEQ ID NO: 136746 - protein, 9 aa, Homo Sapiens
HYNHMCNSS

SEQ ID NO: 136747 - protein, 9 aa, Homo Sapiens
PVFQVIPMG

SEQ ID NO: 136748 - protein, 9 aa, Homo Sapiens
GKYNEYEKV

SEQ ID NO: 136749 - protein, 9 aa, Homo Sapiens
HMSRSASLN

SEQ ID NO: 136750 - protein, 9 aa, Homo Sapiens
KPLKNCDVI

SEQ ID NO: 136751 - protein, 9 aa, Homo Sapiens
TLLSSMLCI

SEQ ID NO: 136752 - protein, 9 aa, Homo Sapiens
LLLQTQQCR

SEQ ID NO: 136753 - protein, 9 aa, Homo Sapiens
RQQRKSEKR

SEQ ID NO: 136754 - protein, 9 aa, Homo Sapiens
QGDGPDSAK

SEQ ID NO: 136755 - protein, 9 aa, Homo Sapiens
VAKGGTAWL

SEQ ID NO: 136756 - protein, 9 aa, Homo Sapiens
LYLGELVWL

SEQ ID NO: 136757 - protein, 9 aa, Homo Sapiens
YSSQFLNTY

SEQ ID NO: 136758 - protein, 9 aa, Homo Sapiens
GSKMKKLMY

SEQ ID NO: 136759 - protein, 9 aa, Homo Sapiens
GRGEWLRAG

SEQ ID NO: 136760 - protein, 9 aa, Homo Sapiens
HCRLYNEWH

SEQ ID NO: 136761 - protein, 9 aa, Homo Sapiens
PDPLGRRSQ

SEQ ID NO: 136762 - protein, 9 aa, Homo Sapiens
LAAERGGQD

SEQ ID NO: 136763 - protein, 9 aa, Homo Sapiens
DTTILIECQ

SEQ ID NO: 136764 - protein, 9 aa, Homo Sapiens
QGSGRLQVY

SEQ ID NO: 136765 - protein, 9 aa, Homo Sapiens
PVPLLTGHT

SEQ ID NO: 136766 - protein, 9 aa, Homo Sapiens
QQCRHRLRG

SEQ ID NO: 136767 - protein, 9 aa, Homo Sapiens
GLCILPIVR

SEQ ID NO: 136768 - protein, 9 aa, Homo Sapiens
CPKPLKNCD

SEQ ID NO: 136769 - protein, 9 aa, Homo Sapiens
SYLICHQTV

SEQ ID NO: 136770 - protein, 9 aa, Homo Sapiens
ARGPVCPPY

SEQ ID NO: 136771 - protein, 9 aa, Homo Sapiens
LTGHTAPLL

SEQ ID NO: 136772 - protein, 9 aa, Homo Sapiens
KKPFLSVRF

SEQ ID NO: 136773 - protein, 9 aa, Homo Sapiens
GELVWLVLA

SEQ ID NO: 136774 - protein, 9 aa, Homo Sapiens
LEITTHMPG

SEQ ID NO: 136775 - protein, 9 aa, Homo Sapiens
LPVFQVIPM

SEQ ID NO: 136776 - protein, 9 aa, Homo Sapiens
VYIPEIVSG

SEQ ID NO: 136777 - protein, 9 aa, Homo Sapiens
RTDPPKTHV

SEQ ID NO: 136778 - protein, 9 aa, Homo Sapiens
PVRLECCVI

SEQ ID NO: 136779 - protein, 9 aa, Homo Sapiens
LLSGVMAIA

SEQ ID NO: 136780 - protein, 9 aa, Homo Sapiens
THMSRSASL

SEQ ID NO: 136781 - protein, 9 aa, Homo Sapiens
LECCVIGMP

SEQ ID NO: 136782 - protein, 9 aa, Homo Sapiens
AYDFQLCSH

SEQ ID NO: 136783 - protein, 9 aa, Homo Sapiens
PARPPASRS

SEQ ID NO: 136784 - protein, 9 aa, Homo Sapiens
SCGCLPTWV

SEQ ID NO: 136785 - protein, 9 aa, Homo Sapiens
SAKGNRTKQ

SEQ ID NO: 136786 - protein, 9 aa, Homo Sapiens
GHPVRLECC

SEQ ID NO: 136787 - protein, 9 aa, Homo Sapiens
SLDGACILR

SEQ ID NO: 136788 - protein, 9 aa, Homo Sapiens
AEKLGDQSY

SEQ ID NO: 136789 - protein, 9 aa, Homo Sapiens
QQRKSEKRR

SEQ ID NO: 136790 - protein, 9 aa, Homo Sapiens
MVPFLHHCE

SEQ ID NO: 136791 - protein, 9 aa, Homo Sapiens
QCPNLDRTS

SEQ ID NO: 136792 - protein, 9 aa, Homo Sapiens
RVCSADSPP

SEQ ID NO: 136793 - protein, 9 aa, Homo Sapiens
PFLHHCEKQ

SEQ ID NO: 136794 - protein, 9 aa, Homo Sapiens
YACLNKKGL

SEQ ID NO: 136795 - protein, 9 aa, Homo Sapiens
PLHSTIPQA

SEQ ID NO: 136796 - protein, 9 aa, Homo Sapiens
LVEVSESTP

SEQ ID NO: 136797 - protein, 9 aa, Homo Sapiens
DSAKGNRTK

SEQ ID NO: 136798 - protein, 9 aa, Homo Sapiens
AVGQGKLCL

SEQ ID NO: 136799 - protein, 9 aa, Homo Sapiens
LRAGLTAAG

SEQ ID NO: 136800 - protein, 9 aa, Homo Sapiens
DDHTSVQLT

SEQ ID NO: 136801 - protein, 9 aa, Homo Sapiens
QEGSKLLSQ

SEQ ID NO: 136802 - protein, 9 aa, Homo Sapiens
TFELLVCFF

SEQ ID NO: 136803 - protein, 9 aa, Homo Sapiens
NDARHGGWT

SEQ ID NO: 136804 - protein, 9 aa, Homo Sapiens
LCSHQDCPD

SEQ ID NO: 136805 - protein, 9 aa, Homo Sapiens
PQATSQRLL

SEQ ID NO: 136806 - protein, 9 aa, Homo Sapiens
LLWGLRHLS

SEQ ID NO: 136807 - protein, 9 aa, Homo Sapiens
RKSGFSGIT

SEQ ID NO: 136808 - protein, 9 aa, Homo Sapiens
RHVDAHAML

SEQ ID NO: 136809 - protein, 9 aa, Homo Sapiens
INARGPVCP

SEQ ID NO: 136810 - protein, 9 aa, Homo Sapiens
RARRCGAGR

SEQ ID NO: 136811 - protein, 9 aa, Homo Sapiens
PPASRSQQH

SEQ ID NO: 136812 - protein, 9 aa, Homo Sapiens
RAGLTAAGG

SEQ ID NO: 136813 - protein, 9 aa, Homo Sapiens
DHWIRMRPQ

SEQ ID NO: 136814 - protein, 9 aa, Homo Sapiens
KVCNNSAVI

SEQ ID NO: 136815 - protein, 9 aa, Homo Sapiens
GLTFDQVSA

SEQ ID NO: 136816 - protein, 9 aa, Homo Sapiens
VFGTSFTAR

SEQ ID NO: 136817 - protein, 9 aa, Homo Sapiens
RPQEGRPVQ

SEQ ID NO: 136818 - protein, 9 aa, Homo Sapiens
SSGYGQQGS

SEQ ID NO: 136819 - protein, 9 aa, Homo Sapiens
VQWDQGSGR

SEQ ID NO: 136820 - protein, 9 aa, Homo Sapiens
AEDATLEEM

SEQ ID NO: 136821 - protein, 9 aa, Homo Sapiens
SPLVVAKGG

SEQ ID NO: 136822 - protein, 9 aa, Homo Sapiens
TILIECQEK

SEQ ID NO: 136823 - protein, 9 aa, Homo Sapiens
VGSKSPQGP

SEQ ID NO: 136824 - protein, 9 aa, Homo Sapiens
STLENSIIS

SEQ ID NO: 136825 - protein, 9 aa, Homo Sapiens
GQSTQKGSR

SEQ ID NO: 136826 - protein, 9 aa, Homo Sapiens
RPDPLGRRS

SEQ ID NO: 136827 - protein, 9 aa, Homo Sapiens
LKKPFLSVR

SEQ ID NO: 136828 - protein, 9 aa, Homo Sapiens
KSYSSQFLN

SEQ ID NO: 136829 - protein, 9 aa, Homo Sapiens
CLNKKGLIN

SEQ ID NO: 136830 - protein, 9 aa, Homo Sapiens
TDLLGRQQR

SEQ ID NO: 136831 - protein, 9 aa, Homo Sapiens
CGAGRTAGS

SEQ ID NO: 136832 - protein, 9 aa, Homo Sapiens
CLARLLLEG

SEQ ID NO: 136833 - protein, 9 aa, Homo Sapiens
SLNFNTSGG

SEQ ID NO: 136834 - protein, 9 aa, Homo Sapiens
SYALSNKNL

SEQ ID NO: 136835 - protein, 9 aa, Homo Sapiens
QGKLCLARL

SEQ ID NO: 136836 - protein, 9 aa, Homo Sapiens
GHTAPLLWG

SEQ ID NO: 136837 - protein, 9 aa, Homo Sapiens
TPPGYVIAL

SEQ ID NO: 136838 - protein, 9 aa, Homo Sapiens
QKGSRTTGR

SEQ ID NO: 136839 - protein, 9 aa, Homo Sapiens
LVQEQCPNL

SEQ ID NO: 136840 - protein, 9 aa, Homo Sapiens
VCFFACPSK

SEQ ID NO: 136841 - protein, 9 aa, Homo Sapiens
GKEMLQRTD

SEQ ID NO: 136842 - protein, 9 aa, Homo Sapiens
ECCVIGMPP

SEQ ID NO: 136843 - protein, 9 aa, Homo Sapiens
PSSGGHMSH

SEQ ID NO: 136844 - protein, 9 aa, Homo Sapiens
WYGLRLNMD

SEQ ID NO: 136845 - protein, 9 aa, Homo Sapiens
VCSADSPPK

SEQ ID NO: 136846 - protein, 9 aa, Homo Sapiens
FELLVCFFA

SEQ ID NO: 136847 - protein, 9 aa, Homo Sapiens
TAKGEEVKS

SEQ ID NO: 136848 - protein, 9 aa, Homo Sapiens
TIRKSGFSG

SEQ ID NO: 136849 - protein, 9 aa, Homo Sapiens
AAPTGNHCV

SEQ ID NO: 136850 - protein, 9 aa, Homo Sapiens
NELVQEQCP

SEQ ID NO: 136851 - protein, 9 aa, Homo Sapiens
AGLCILPIV

SEQ ID NO: 136852 - protein, 9 aa, Homo Sapiens
RRCGAGRTA

SEQ ID NO: 136853 - protein, 9 aa, Homo Sapiens
TLEEMLVKK

SEQ ID NO: 136854 - protein, 9 aa, Homo Sapiens
KAALMFAKR

SEQ ID NO: 136855 - protein, 9 aa, Homo Sapiens
LQTQQCRHR

SEQ ID NO: 136856 - protein, 9 aa, Homo Sapiens
WKESRGAHA

SEQ ID NO: 136857 - protein, 9 aa, Homo Sapiens
LLVCFFACP

SEQ ID NO: 136858 - protein, 9 aa, Homo Sapiens
TRYKMPSDD

SEQ ID NO: 136859 - protein, 9 aa, Homo Sapiens
MYLPGFMRL

SEQ ID NO: 136860 - protein, 9 aa, Homo Sapiens
MVDKLLKGY

SEQ ID NO: 136861 - protein, 9 aa, Homo Sapiens
AATAAPPPS

SEQ ID NO: 136862 - protein, 9 aa, Homo Sapiens
PDTTILIEC

SEQ ID NO: 136863 - protein, 9 aa, Homo Sapiens
KMKKLMYLP

SEQ ID NO: 136864 - protein, 9 aa, Homo Sapiens
GGVGSKSPQ

SEQ ID NO: 136865 - protein, 9 aa, Homo Sapiens
SMLCIVRAP

SEQ ID NO: 136866 - protein, 9 aa, Homo Sapiens
FVKEMVDKL

SEQ ID NO: 136867 - protein, 9 aa, Homo Sapiens
GPRAGLCIL

SEQ ID NO: 136868 - protein, 9 aa, Homo Sapiens
GFTQSEIDE

SEQ ID NO: 136869 - protein, 9 aa, Homo Sapiens
TAAPPPSTL

SEQ ID NO: 136870 - protein, 9 aa, Homo Sapiens
TTIRKSGFS

SEQ ID NO: 136871 - protein, 9 aa, Homo Sapiens
DISSSICDV

SEQ ID NO: 136872 - protein, 9 aa, Homo Sapiens
YPYYACLNK

SEQ ID NO: 136873 - protein, 9 aa, Homo Sapiens
WHRTNQRVI

SEQ ID NO: 136874 - protein, 9 aa, Homo Sapiens
QLEITTHMP

SEQ ID NO: 136875 - protein, 9 aa, Homo Sapiens
QSEIDEIDH

SEQ ID NO: 136876 - protein, 9 aa, Homo Sapiens
EVSESTPPG

SEQ ID NO: 136877 - protein, 9 aa, Homo Sapiens
RQRVCSADS

SEQ ID NO: 136878 - protein, 9 aa, Homo Sapiens
FTQSEIDEI

SEQ ID NO: 136879 - protein, 9 aa, Homo Sapiens
STPPGYVIA

SEQ ID NO: 136880 - protein, 9 aa, Homo Sapiens
HSSVVDDDG

SEQ ID NO: 136881 - protein, 9 aa, Homo Sapiens
KLGFTQSEI

SEQ ID NO: 136882 - protein, 9 aa, Homo Sapiens
ENSIISLFV

SEQ ID NO: 136883 - protein, 9 aa, Homo Sapiens
HVDAHAMLN

SEQ ID NO: 136884 - protein, 9 aa, Homo Sapiens
RAERARRCG

SEQ ID NO: 136885 - protein, 9 aa, Homo Sapiens
IMTLLSGVM

SEQ ID NO: 136886 - protein, 9 aa, Homo Sapiens
EEMLVKKKK

SEQ ID NO: 136887 - protein, 9 aa, Homo Sapiens
RHGGWTTKM

SEQ ID NO: 136888 - protein, 9 aa, Homo Sapiens
ACLNKKGLI

SEQ ID NO: 136889 - protein, 9 aa, Homo Sapiens
APLLWGLRH

SEQ ID NO: 136890 - protein, 9 aa, Homo Sapiens
KWYPYYACL

SEQ ID NO: 136891 - protein, 9 aa, Homo Sapiens
DLCQPYRSE

SEQ ID NO: 136892 - protein, 9 aa, Homo Sapiens
VTDLLGRQQ

SEQ ID NO: 136893 - protein, 9 aa, Homo Sapiens
IYGAEAWKE

SEQ ID NO: 136894 - protein, 9 aa, Homo Sapiens
LQLLDEVPC

SEQ ID NO: 136895 - protein, 9 aa, Homo Sapiens
KGSRTTGRQ

SEQ ID NO: 136896 - protein, 9 aa, Homo Sapiens
IVLTAKGEE

SEQ ID NO: 136897 - protein, 9 aa, Homo Sapiens
GDQSYLEGC

SEQ ID NO: 136898 - protein, 9 aa, Homo Sapiens
GTTPVWYGL

SEQ ID NO: 136899 - protein, 9 aa, Homo Sapiens
LTAKGEEVK

SEQ ID NO: 136900 - protein, 9 aa, Homo Sapiens
WDQGSGRLQ

SEQ ID NO: 136901 - protein, 9 aa, Homo Sapiens
EIDEIDHDY

SEQ ID NO: 136902 - protein, 9 aa, Homo Sapiens
GHGRVHAPQ

SEQ ID NO: 136903 - protein, 9 aa, Homo Sapiens
QTQQCRHRL

SEQ ID NO: 136904 - protein, 9 aa, Homo Sapiens
HAWFNPKDT

SEQ ID NO: 136905 - protein, 9 aa, Homo Sapiens
SSMLCIVRA

SEQ ID NO: 136906 - protein, 9 aa, Homo Sapiens
VIPMGPPTP

SEQ ID NO: 136907 - protein, 9 aa, Homo Sapiens
SEIDEIDHD

SEQ ID NO: 136908 - protein, 9 aa, Homo Sapiens
GEQTQLEIT

SEQ ID NO: 136909 - protein, 9 aa, Homo Sapiens
LSSDTRYKM

SEQ ID NO: 136910 - protein, 9 aa, Homo Sapiens
ELQDKFKHL

SEQ ID NO: 136911 - protein, 9 aa, Homo Sapiens
AEAEKLGDQ

SEQ ID NO: 136912 - protein, 9 aa, Homo Sapiens
TQLEITTHM

SEQ ID NO: 136913 - protein, 9 aa, Homo Sapiens
IYHHLFEIV

SEQ ID NO: 136914 - protein, 9 aa, Homo Sapiens
DQVSAFARG

SEQ ID NO: 136915 - protein, 9 aa, Homo Sapiens
HGQSTQKGS

SEQ ID NO: 136916 - protein, 9 aa, Homo Sapiens
MLPDTTGKA

SEQ ID NO: 136917 - protein, 9 aa, Homo Sapiens
KAFLTKSYL

SEQ ID NO: 136918 - protein, 9 aa, Homo Sapiens
RAVGQGKLC

SEQ ID NO: 136919 - protein, 9 aa, Homo Sapiens
LKNCDVITL

SEQ ID NO: 136920 - protein, 9 aa, Homo Sapiens
VQEQCPNLD

SEQ ID NO: 136921 - protein, 9 aa, Homo Sapiens
MTLLSGVMA

SEQ ID NO: 136922 - protein, 9 aa, Homo Sapiens
EAKADISGV

SEQ ID NO: 136923 - protein, 9 aa, Homo Sapiens
KEMVDKLLK

SEQ ID NO: 136924 - protein, 9 aa, Homo Sapiens
KGGVGSKSP

SEQ ID NO: 136925 - protein, 9 aa, Homo Sapiens
HTSVQLTVS

SEQ ID NO: 136926 - protein, 9 aa, Homo Sapiens
ESIPKKSYA

SEQ ID NO: 136927 - protein, 9 aa, Homo Sapiens
QSQNLIMTL

SEQ ID NO: 136928 - protein, 9 aa, Homo Sapiens
AALMFAKRR

SEQ ID NO: 136929 - protein, 9 aa, Homo Sapiens
EKLGDQSYL

SEQ ID NO: 136930 - protein, 9 aa, Homo Sapiens
LDEVPCRLQ

SEQ ID NO: 136931 - protein, 9 aa, Homo Sapiens
HQDCPDSLA

SEQ ID NO: 136932 - protein, 9 aa, Homo Sapiens
SVAMNLPVP

SEQ ID NO: 136933 - protein, 9 aa, Homo Sapiens
TGHTAPLLW

SEQ ID NO: 136934 - protein, 9 aa, Homo Sapiens
VVAKGGTAW

SEQ ID NO: 136935 - protein, 9 aa, Homo Sapiens
LLSSMLCIV

SEQ ID NO: 136936 - protein, 9 aa, Homo Sapiens
ERPDPLGRR

SEQ ID NO: 136937 - protein, 9 aa, Homo Sapiens
EEVKSGRSK

SEQ ID NO: 136938 - protein, 9 aa, Homo Sapiens
IPVPLLTGH

SEQ ID NO: 136939 - protein, 9 aa, Homo Sapiens
QQQQPQQQL

SEQ ID NO: 136940 - protein, 9 aa, Homo Sapiens
GTSFTARVI

SEQ ID NO: 136941 - protein, 9 aa, Homo Sapiens
KEVYIPEIV

SEQ ID NO: 136942 - protein, 9 aa, Homo Sapiens
SPQGPPGPG

SEQ ID NO: 136943 - protein, 9 aa, Homo Sapiens
SADSPPKTD

SEQ ID NO: 136944 - protein, 9 aa, Homo Sapiens
QAPGPRAGL

SEQ ID NO: 136945 - protein, 9 aa, Homo Sapiens
NTYDAHNMS

SEQ ID NO: 136946 - protein, 9 aa, Homo Sapiens
LHHCEKQSP

SEQ ID NO: 136947 - protein, 9 aa, Homo Sapiens
ELLSWIEML

SEQ ID NO: 136948 - protein, 9 aa, Homo Sapiens
QPQQQLQQQ

SEQ ID NO: 136949 - protein, 9 aa, Homo Sapiens
NMSFVKEMV

SEQ ID NO: 136950 - protein, 9 aa, Homo Sapiens
GDGPDSAKG

SEQ ID NO: 136951 - protein, 9 aa, Homo Sapiens
SSTSYKEVY

SEQ ID NO: 136952 - protein, 9 aa, Homo Sapiens
SSGGHMSHS

SEQ ID NO: 136953 - protein, 9 aa, Homo Sapiens
LCQPYRSEF

SEQ ID NO: 136954 - protein, 9 aa, Homo Sapiens
HTAPLLWGL

SEQ ID NO: 136955 - protein, 9 aa, Homo Sapiens
GKAALMFAK

SEQ ID NO: 136956 - protein, 9 aa, Homo Sapiens
GHMSHSGDN

SEQ ID NO: 136957 - protein, 9 aa, Homo Sapiens
LRSPWKPGT

SEQ ID NO: 136958 - protein, 9 aa, Homo Sapiens
LPDTTGKAA

SEQ ID NO: 136959 - protein, 9 aa, Homo Sapiens
LGLTFDQVS

SEQ ID NO: 136960 - protein, 9 aa, Homo Sapiens
EAWKESRGA

SEQ ID NO: 136961 - protein, 9 aa, Homo Sapiens
LCLARLLLE

SEQ ID NO: 136962 - protein, 9 aa, Homo Sapiens
PYRSEFYSL

SEQ ID NO: 136963 - protein, 9 aa, Homo Sapiens
EWHRTNQRV

SEQ ID NO: 136964 - protein, 9 aa, Homo Sapiens
KGEEVKSGR

SEQ ID NO: 136965 - protein, 9 aa, Homo Sapiens
EYEKVCNNS

SEQ ID NO: 136966 - protein, 9 aa, Homo Sapiens
TSYKEVYIP

SEQ ID NO: 136967 - protein, 9 aa, Homo Sapiens
EFYSLQEQH

SEQ ID NO: 136968 - protein, 9 aa, Homo Sapiens
ILNLSSDTR

SEQ ID NO: 136969 - protein, 9 aa, Homo Sapiens
WGRGEWLRA

SEQ ID NO: 136970 - protein, 9 aa, Homo Sapiens
CRLYNEWHR

SEQ ID NO: 136971 - protein, 9 aa, Homo Sapiens
AKGGTAWLE

SEQ ID NO: 136972 - protein, 9 aa, Homo Sapiens
SKSPQGPPG

SEQ ID NO: 136973 - protein, 9 aa, Homo Sapiens
FQNSFGFNI

SEQ ID NO: 136974 - protein, 9 aa, Homo Sapiens
VAKRKHSSF

SEQ ID NO: 136975 - protein, 9 aa, Homo Sapiens
PSQSHPQST

SEQ ID NO: 136976 - protein, 9 aa, Homo Sapiens
EIAKHMGYS

SEQ ID NO: 136977 - protein, 9 aa, Homo Sapiens
SIWIYIQTI

SEQ ID NO: 136978 - protein, 9 aa, Homo Sapiens
SASHEMDCI

SEQ ID NO: 136979 - protein, 9 aa, Homo Sapiens
GQGTIFWVD

SEQ ID NO: 136980 - protein, 9 aa, Homo Sapiens
PKKAKLDLQ

SEQ ID NO: 136981 - protein, 9 aa, Homo Sapiens
GNAASFGSV

SEQ ID NO: 136982 - protein, 9 aa, Homo Sapiens
TATTTPRKK

SEQ ID NO: 136983 - protein, 9 aa, Homo Sapiens
DDDDPDNDK

SEQ ID NO: 136984 - protein, 9 aa, Homo Sapiens
SRSNKLPKA

SEQ ID NO: 136985 - protein, 9 aa, Homo Sapiens
PIDNGNITS

SEQ ID NO: 136986 - protein, 9 aa, Homo Sapiens
GIMRYHPFL

SEQ ID NO: 136987 - protein, 9 aa, Homo Sapiens
KLWGLHIPY

SEQ ID NO: 136988 - protein, 9 aa, Homo Sapiens
QVSFNTSDK

SEQ ID NO: 136989 - protein, 9 aa, Homo Sapiens
EPDRNALQR

SEQ ID NO: 136990 - protein, 9 aa, Homo Sapiens
GAGRSRSNK

SEQ ID NO: 136991 - protein, 9 aa, Homo Sapiens
AGRSRSNKL

SEQ ID NO: 136992 - protein, 9 aa, Homo Sapiens
VVGAVGVGK

SEQ ID NO: 136993 - protein, 9 aa, Homo Sapiens
WKLLSSFPN

SEQ ID NO: 136994 - protein, 9 aa, Homo Sapiens
LVAKRKHSS

SEQ ID NO: 136995 - protein, 9 aa, Homo Sapiens
PDNDKKRHK

SEQ ID NO: 136996 - protein, 9 aa, Homo Sapiens
NAASFGSVH

SEQ ID NO: 136997 - protein, 9 aa, Homo Sapiens
CEYHYVSKE

SEQ ID NO: 136998 - protein, 9 aa, Homo Sapiens
DEWQLVSSA

SEQ ID NO: 136999 - protein, 9 aa, Homo Sapiens
PKMSTCRKK

SEQ ID NO: 137000 - protein, 9 aa, Homo Sapiens
VVTQKHFYF

SEQ ID NO: 137001 - protein, 9 aa, Homo Sapiens
ERHKHQNDV

SEQ ID NO: 137002 - protein, 9 aa, Homo Sapiens
NITSFPLSV

SEQ ID NO: 137003 - protein, 9 aa, Homo Sapiens
GDEWQLVSS

SEQ ID NO: 137004 - protein, 9 aa, Homo Sapiens
ILRIHQKPE

SEQ ID NO: 137005 - protein, 9 aa, Homo Sapiens
VAKIMSPIV

SEQ ID NO: 137006 - protein, 9 aa, Homo Sapiens
EQKAVWKLL

SEQ ID NO: 137007 - protein, 9 aa, Homo Sapiens
LQKIKPKMS

SEQ ID NO: 137008 - protein, 9 aa, Homo Sapiens
EVVYKFSTT

SEQ ID NO: 137009 - protein, 9 aa, Homo Sapiens
GKVPFALLG

SEQ ID NO: 137010 - protein, 9 aa, Homo Sapiens
QRKERERRN

SEQ ID NO: 137011 - protein, 9 aa, Homo Sapiens
RLKEATTIC

SEQ ID NO: 137012 - protein, 9 aa, Homo Sapiens
LVKGRDNLR

SEQ ID NO: 137013 - protein, 9 aa, Homo Sapiens
IILLCTCVA

SEQ ID NO: 137014 - protein, 9 aa, Homo Sapiens
VTIFHGTIL

SEQ ID NO: 137015 - protein, 9 aa, Homo Sapiens
VNEAKRQIK

SEQ ID NO: 137016 - protein, 9 aa, Homo Sapiens
RVRSLPNSQ

SEQ ID NO: 137017 - protein, 9 aa, Homo Sapiens
MGGTFCIIL

SEQ ID NO: 137018 - protein, 9 aa, Homo Sapiens
EMDCISYKS

SEQ ID NO: 137019 - protein, 9 aa, Homo Sapiens
KDDDSFDQK

SEQ ID NO: 137020 - protein, 9 aa, Homo Sapiens
KMQLWELAR

SEQ ID NO: 137021 - protein, 9 aa, Homo Sapiens
AHSIVKATR

SEQ ID NO: 137022 - protein, 9 aa, Homo Sapiens
HLSYTDKEC

SEQ ID NO: 137023 - protein, 9 aa, Homo Sapiens
NSTFQNSFG

SEQ ID NO: 137024 - protein, 9 aa, Homo Sapiens
VIRELIVIA

SEQ ID NO: 137025 - protein, 9 aa, Homo Sapiens
KRVEKDVNE

SEQ ID NO: 137026 - protein, 9 aa, Homo Sapiens
RDANHLFCE

SEQ ID NO: 137027 - protein, 9 aa, Homo Sapiens
YFQIHINKY

SEQ ID NO: 137028 - protein, 9 aa, Homo Sapiens
PPPPIDNGN

SEQ ID NO: 137029 - protein, 9 aa, Homo Sapiens
IFWVDCGDA

SEQ ID NO: 137030 - protein, 9 aa, Homo Sapiens
LQRKERERR

SEQ ID NO: 137031 - protein, 9 aa, Homo Sapiens
VVYKFSTTK

SEQ ID NO: 137032 - protein, 9 aa, Homo Sapiens
GIIDTEREA

SEQ ID NO: 137033 - protein, 9 aa, Homo Sapiens
DNGNITSFP

SEQ ID NO: 137034 - protein, 9 aa, Homo Sapiens
VIAWTPLQK

SEQ ID NO: 137035 - protein, 9 aa, Homo Sapiens
DRNALQRKE

SEQ ID NO: 137036 - protein, 9 aa, Homo Sapiens
QEKEDIAVL

SEQ ID NO: 137037 - protein, 9 aa, Homo Sapiens
CSLTKAQWD

SEQ ID NO: 137038 - protein, 9 aa, Homo Sapiens
LVKNRYKNQ

SEQ ID NO: 137039 - protein, 9 aa, Homo Sapiens
EKDVNEAKR

SEQ ID NO: 137040 - protein, 9 aa, Homo Sapiens
DNLRQDAVM

SEQ ID NO: 137041 - protein, 9 aa, Homo Sapiens
VYKFSTTKK

SEQ ID NO: 137042 - protein, 9 aa, Homo Sapiens
HPGFQICDS

SEQ ID NO: 137043 - protein, 9 aa, Homo Sapiens
EENSTFQNS

SEQ ID NO: 137044 - protein, 9 aa, Homo Sapiens
LQNHPNKIK

SEQ ID NO: 137045 - protein, 9 aa, Homo Sapiens
GRDNLRQDA

SEQ ID NO: 137046 - protein, 9 aa, Homo Sapiens
NQDQNARQR

SEQ ID NO: 137047 - protein, 9 aa, Homo Sapiens
IDGFLLTPI

SEQ ID NO: 137048 - protein, 9 aa, Homo Sapiens
FLQNHPNKI

SEQ ID NO: 137049 - protein, 9 aa, Homo Sapiens
LITFSILRI

SEQ ID NO: 137050 - protein, 9 aa, Homo Sapiens
GTYFQIHIN

SEQ ID NO: 137051 - protein, 9 aa, Homo Sapiens
DTVHKCTEA

SEQ ID NO: 137052 - protein, 9 aa, Homo Sapiens
EAKRQIKKR

SEQ ID NO: 137053 - protein, 9 aa, Homo Sapiens
KSMEWFIGS

SEQ ID NO: 137054 - protein, 9 aa, Homo Sapiens
VKGQGTIFW

SEQ ID NO: 137055 - protein, 9 aa, Homo Sapiens
VDAAVQRSA

SEQ ID NO: 137056 - protein, 9 aa, Homo Sapiens
IMRYHPFLY

SEQ ID NO: 137057 - protein, 9 aa, Homo Sapiens
DKSQTVTDL

SEQ ID NO: 137058 - protein, 9 aa, Homo Sapiens
DDDPDNDKK

SEQ ID NO: 137059 - protein, 9 aa, Homo Sapiens
GRSRSNKLP

SEQ ID NO: 137060 - protein, 9 aa, Homo Sapiens
GVPQSQQVE

SEQ ID NO: 137061 - protein, 9 aa, Homo Sapiens
WTPLQKIKP

SEQ ID NO: 137062 - protein, 9 aa, Homo Sapiens
YIQTIHCEP

SEQ ID NO: 137063 - protein, 9 aa, Homo Sapiens
ELEQHFLQN

SEQ ID NO: 137064 - protein, 9 aa, Homo Sapiens
WDSIEVCLL

SEQ ID NO: 137065 - protein, 9 aa, Homo Sapiens
IEMAFTLLE

SEQ ID NO: 137066 - protein, 9 aa, Homo Sapiens
HFLQNHPNK

SEQ ID NO: 137067 - protein, 9 aa, Homo Sapiens
RVVTQKHFY

SEQ ID NO: 137068 - protein, 9 aa, Homo Sapiens
LSEITKQEK

SEQ ID NO: 137069 - protein, 9 aa, Homo Sapiens
KAQWDSIEV

SEQ ID NO: 137070 - protein, 9 aa, Homo Sapiens
VRSLPNSQI

SEQ ID NO: 137071 - protein, 9 aa, Homo Sapiens
PFCGPRDAN

SEQ ID NO: 137072 - protein, 9 aa, Homo Sapiens
AKLDLQNLS

SEQ ID NO: 137073 - protein, 9 aa, Homo Sapiens
LKEKCLYCK

SEQ ID NO: 137074 - protein, 9 aa, Homo Sapiens
AAEIAKHMG

SEQ ID NO: 137075 - protein, 9 aa, Homo Sapiens
GFQICDSKG

SEQ ID NO: 137076 - protein, 9 aa, Homo Sapiens
RKHSSFLSA

SEQ ID NO: 137077 - protein, 9 aa, Homo Sapiens
AFTLLETCG

SEQ ID NO: 137078 - protein, 9 aa, Homo Sapiens
GNMVAKIMS

SEQ ID NO: 137079 - protein, 9 aa, Homo Sapiens
EHNSIITGM

SEQ ID NO: 137080 - protein, 9 aa, Homo Sapiens
LRTSVGSSS

SEQ ID NO: 137081 - protein, 9 aa, Homo Sapiens
TTATTTPRK

SEQ ID NO: 137082 - protein, 9 aa, Homo Sapiens
KAVWKLLSS

SEQ ID NO: 137083 - protein, 9 aa, Homo Sapiens
FIERHKHQN

SEQ ID NO: 137084 - protein, 9 aa, Homo Sapiens
ITMQFPFCA

SEQ ID NO: 137085 - protein, 9 aa, Homo Sapiens
GDDDDPDND

SEQ ID NO: 137086 - protein, 9 aa, Homo Sapiens
CRFAKEQTM

SEQ ID NO: 137087 - protein, 9 aa, Homo Sapiens
ILLCTCVAG

SEQ ID NO: 137088 - protein, 9 aa, Homo Sapiens
QNHPNKIKA

SEQ ID NO: 137089 - protein, 9 aa, Homo Sapiens
QKAVWKLLS

SEQ ID NO: 137090 - protein, 9 aa, Homo Sapiens
SGKVPFALL

SEQ ID NO: 137091 - protein, 9 aa, Homo Sapiens
SRDYRNIIK

SEQ ID NO: 137092 - protein, 9 aa, Homo Sapiens
VGAVGVGKS

SEQ ID NO: 137093 - protein, 9 aa, Homo Sapiens
HIEHNSIIT

SEQ ID NO: 137094 - protein, 9 aa, Homo Sapiens
GKDDDSFDQ

SEQ ID NO: 137095 - protein, 9 aa, Homo Sapiens
LTAVTIFHG

SEQ ID NO: 137096 - protein, 9 aa, Homo Sapiens
KGDTANGPR

SEQ ID NO: 137097 - protein, 9 aa, Homo Sapiens
MNGCEYHYV

SEQ ID NO: 137098 - protein, 9 aa, Homo Sapiens
QLWELARLN

SEQ ID NO: 137099 - protein, 9 aa, Homo Sapiens
RDNLRQDAV

SEQ ID NO: 137100 - protein, 9 aa, Homo Sapiens
ASCQFLKEK

SEQ ID NO: 137101 - protein, 9 aa, Homo Sapiens
EAKEGDEWQ

SEQ ID NO: 137102 - protein, 9 aa, Homo Sapiens
IPEKKQRLK

SEQ ID NO: 137103 - protein, 9 aa, Homo Sapiens
EITKQEKDF

SEQ ID NO: 137104 - protein, 9 aa, Homo Sapiens
FDQKSVYRG

SEQ ID NO: 137105 - protein, 9 aa, Homo Sapiens
EVIRELIVI

SEQ ID NO: 137106 - protein, 9 aa, Homo Sapiens
FCIILLCTC

SEQ ID NO: 137107 - protein, 9 aa, Homo Sapiens
STFQNSFGF

SEQ ID NO: 137108 - protein, 9 aa, Homo Sapiens
RVEKDVNEA

SEQ ID NO: 137109 - protein, 9 aa, Homo Sapiens
KQEKDFLWS

SEQ ID NO: 137110 - protein, 9 aa, Homo Sapiens
MDCISYKSG

SEQ ID NO: 137111 - protein, 9 aa, Homo Sapiens
HSIHSVKCN

SEQ ID NO: 137112 - protein, 9 aa, Homo Sapiens
ECYENEERP

SEQ ID NO: 137113 - protein, 9 aa, Homo Sapiens
ELIVIAWTP

SEQ ID NO: 137114 - protein, 9 aa, Homo Sapiens
AASFGSVHQ

SEQ ID NO: 137115 - protein, 9 aa, Homo Sapiens
KKQRLKEAT

SEQ ID NO: 137116 - protein, 9 aa, Homo Sapiens
KLLSSFPNV

SEQ ID NO: 137117 - protein, 9 aa, Homo Sapiens
TAHSIVKAT

SEQ ID NO: 137118 - protein, 9 aa, Homo Sapiens
SFNTSDKSQ

SEQ ID NO: 137119 - protein, 9 aa, Homo Sapiens
NSQDIQRVM

SEQ ID NO: 137120 - protein, 9 aa, Homo Sapiens
DSFDQKSVY

SEQ ID NO: 137121 - protein, 9 aa, Homo Sapiens
VKATRTSLP

SEQ ID NO: 137122 - protein, 9 aa, Homo Sapiens
TKQEKDFLW

SEQ ID NO: 137123 - protein, 9 aa, Homo Sapiens
NDKKRHKKR

SEQ ID NO: 137124 - protein, 9 aa, Homo Sapiens
DEEEALAIP

SEQ ID NO: 137125 - protein, 9 aa, Homo Sapiens
WLVKNRYKN

SEQ ID NO: 137126 - protein, 9 aa, Homo Sapiens
GEIIMSALD

SEQ ID NO: 137127 - protein, 9 aa, Homo Sapiens
MGYSYRLEI

SEQ ID NO: 137128 - protein, 9 aa, Homo Sapiens
LWGLHIPYD

SEQ ID NO: 137129 - protein, 9 aa, Homo Sapiens
DQNARQRKK

SEQ ID NO: 137130 - protein, 9 aa, Homo Sapiens
QSQQVEHAL

SEQ ID NO: 137131 - protein, 9 aa, Homo Sapiens
VGVGKSALT

SEQ ID NO: 137132 - protein, 9 aa, Homo Sapiens
TDKECYENE

SEQ ID NO: 137133 - protein, 9 aa, Homo Sapiens
PPPIDNGNI

SEQ ID NO: 137134 - protein, 9 aa, Homo Sapiens
STPSQSQPP

SEQ ID NO: 137135 - protein, 9 aa, Homo Sapiens
RSRSNKLPK

SEQ ID NO: 137136 - protein, 9 aa, Homo Sapiens
PWGWEMKHD

SEQ ID NO: 137137 - protein, 9 aa, Homo Sapiens
DPSGKVPFA

SEQ ID NO: 137138 - protein, 9 aa, Homo Sapiens
WGLHIPYDQ

SEQ ID NO: 137139 - protein, 9 aa, Homo Sapiens
YQAEVEALH

SEQ ID NO: 137140 - protein, 9 aa, Homo Sapiens
PITMQFPFC

SEQ ID NO: 137141 - protein, 9 aa, Homo Sapiens
QEKEVVYKF

SEQ ID NO: 137142 - protein, 9 aa, Homo Sapiens
LLCTCVAGI

SEQ ID NO: 137143 - protein, 9 aa, Homo Sapiens
SHHHIEMAF

SEQ ID NO: 137144 - protein, 9 aa, Homo Sapiens
ARQRKKKER

SEQ ID NO: 137145 - protein, 9 aa, Homo Sapiens
TGDDDDPDN

SEQ ID NO: 137146 - protein, 9 aa, Homo Sapiens
NGLRYGVPQ

SEQ ID NO: 137147 - protein, 9 aa, Homo Sapiens
WEDNKFYQA

SEQ ID NO: 137148 - protein, 9 aa, Homo Sapiens
EQHFLQNHP

SEQ ID NO: 137149 - protein, 9 aa, Homo Sapiens
PPIDNGNIT

SEQ ID NO: 137150 - protein, 9 aa, Homo Sapiens
EIQNLGGEI

SEQ ID NO: 137151 - protein, 9 aa, Homo Sapiens
CQFLKEKCL

SEQ ID NO: 137152 - protein, 9 aa, Homo Sapiens
DNKFYQAEV

SEQ ID NO: 137153 - protein, 9 aa, Homo Sapiens
GRTGKIRLQ

SEQ ID NO: 137154 - protein, 9 aa, Homo Sapiens
LTKAQWDSI

SEQ ID NO: 137155 - protein, 9 aa, Homo Sapiens
LKNRVPDSC

SEQ ID NO: 137156 - protein, 9 aa, Homo Sapiens
TQKHFYFNK

SEQ ID NO: 137157 - protein, 9 aa, Homo Sapiens
CYENEERPE

SEQ ID NO: 137158 - protein, 9 aa, Homo Sapiens
EIIMSALDS

SEQ ID NO: 137159 - protein, 9 aa, Homo Sapiens
KEGDEWQLV

SEQ ID NO: 137160 - protein, 9 aa, Homo Sapiens
IERHKHQND

SEQ ID NO: 137161 - protein, 9 aa, Homo Sapiens
GTFCIILLC

SEQ ID NO: 137162 - protein, 9 aa, Homo Sapiens
TGKIRLQSL

SEQ ID NO: 137163 - protein, 9 aa, Homo Sapiens
RFAKEQTMW

SEQ ID NO: 137164 - protein, 9 aa, Homo Sapiens
AVQRSAELE

SEQ ID NO: 137165 - protein, 9 aa, Homo Sapiens
KLPKAAWIP

SEQ ID NO: 137166 - protein, 9 aa, Homo Sapiens
SQSHPQSTP

SEQ ID NO: 137167 - protein, 9 aa, Homo Sapiens
HHHIEMAFT

SEQ ID NO: 137168 - protein, 9 aa, Homo Sapiens
ALAIPRPLR

SEQ ID NO: 137169 - protein, 9 aa, Homo Sapiens
YTDKECYEN

SEQ ID NO: 137170 - protein, 9 aa, Homo Sapiens
KPKMSTCRK

SEQ ID NO: 137171 - protein, 9 aa, Homo Sapiens
DYRNIIKRL

SEQ ID NO: 137172 - protein, 9 aa, Homo Sapiens
GLGNAASFG

SEQ ID NO: 137173 - protein, 9 aa, Homo Sapiens
QTGGIIDTE

SEQ ID NO: 137174 - protein, 9 aa, Homo Sapiens
FYQAEVEAL

SEQ ID NO: 137175 - protein, 9 aa, Homo Sapiens
KPGEQEKED

SEQ ID NO: 137176 - protein, 9 aa, Homo Sapiens
PVPQRKLRT

SEQ ID NO: 137177 - protein, 9 aa, Homo Sapiens
NSIITGMDV

SEQ ID NO: 137178 - protein, 9 aa, Homo Sapiens
VEGIMRYHP

SEQ ID NO: 137179 - protein, 9 aa, Homo Sapiens
SAELELEKK

SEQ ID NO: 137180 - protein, 9 aa, Homo Sapiens
DQEKEVVYK

SEQ ID NO: 137181 - protein, 9 aa, Homo Sapiens
WIYIQTIHC

SEQ ID NO: 137182 - protein, 9 aa, Homo Sapiens
EKCEAKEGD

SEQ ID NO: 137183 - protein, 9 aa, Homo Sapiens
PNQDQNARQ

SEQ ID NO: 137184 - protein, 9 aa, Homo Sapiens
PTAHSIVKA

SEQ ID NO: 137185 - protein, 9 aa, Homo Sapiens
DLRKMQLWE

SEQ ID NO: 137186 - protein, 9 aa, Homo Sapiens
LAAEIAKHM

SEQ ID NO: 137187 - protein, 9 aa, Homo Sapiens
NNFPKKAKL

SEQ ID NO: 137188 - protein, 9 aa, Homo Sapiens
DVNEAKRQI

SEQ ID NO: 137189 - protein, 9 aa, Homo Sapiens
DDPDNDKKR

SEQ ID NO: 137190 - protein, 9 aa, Homo Sapiens
SIHSVKCNS

SEQ ID NO: 137191 - protein, 9 aa, Homo Sapiens
CISYKSGNI

SEQ ID NO: 137192 - protein, 9 aa, Homo Sapiens
LKEATTICL

SEQ ID NO: 137193 - protein, 9 aa, Homo Sapiens
SSLSSRVRS

SEQ ID NO: 137194 - protein, 9 aa, Homo Sapiens
GPDTVHKCT

SEQ ID NO: 137195 - protein, 9 aa, Homo Sapiens
AVRLCRFAK

SEQ ID NO: 137196 - protein, 9 aa, Homo Sapiens
AIPRPLRAL

SEQ ID NO: 137197 - protein, 9 aa, Homo Sapiens
WEKIPSMLK

SEQ ID NO: 137198 - protein, 9 aa, Homo Sapiens
SCQFLKEKC

SEQ ID NO: 137199 - protein, 9 aa, Homo Sapiens
KHMGYSYRL

SEQ ID NO: 137200 - protein, 9 aa, Homo Sapiens
IVKATRTSL

SEQ ID NO: 137201 - protein, 9 aa, Homo Sapiens
IQTIHCEPC

SEQ ID NO: 137202 - protein, 9 aa, Homo Sapiens
LGNAASFGS

SEQ ID NO: 137203 - protein, 9 aa, Homo Sapiens
PSMLKNRVP

SEQ ID NO: 137204 - protein, 9 aa, Homo Sapiens
KAKLDLQNL

SEQ ID NO: 137205 - protein, 9 aa, Homo Sapiens
ICDSKGLHN

SEQ ID NO: 137206 - protein, 9 aa, Homo Sapiens
ITFSILRIH

SEQ ID NO: 137207 - protein, 9 aa, Homo Sapiens
NLRQDAVMQ

SEQ ID NO: 137208 - protein, 9 aa, Homo Sapiens
KECYENEER

SEQ ID NO: 137209 - protein, 9 aa, Homo Sapiens
KKSYEMNGC

SEQ ID NO: 137210 - protein, 9 aa, Homo Sapiens
FNTSDKSQT

SEQ ID NO: 137211 - protein, 9 aa, Homo Sapiens
LRKMQLWEL

SEQ ID NO: 137212 - protein, 9 aa, Homo Sapiens
PGFQICDSK

SEQ ID NO: 137213 - protein, 9 aa, Homo Sapiens
DDKGDTANG

SEQ ID NO: 137214 - protein, 9 aa, Homo Sapiens
HEMDCISYK

SEQ ID NO: 137215 - protein, 9 aa, Homo Sapiens
NDLRKMQLW

SEQ ID NO: 137216 - protein, 9 aa, Homo Sapiens
TISADDKGD

SEQ ID NO: 137217 - protein, 9 aa, Homo Sapiens
LCRFAKEQT

SEQ ID NO: 137218 - protein, 9 aa, Homo Sapiens
PRDANHLFC

SEQ ID NO: 137219 - protein, 9 aa, Homo Sapiens
IHSIHSVKC

SEQ ID NO: 137220 - protein, 9 aa, Homo Sapiens
MLKNRVPDS

SEQ ID NO: 137221 - protein, 9 aa, Homo Sapiens
QLELPWGWE

SEQ ID NO: 137222 - protein, 9 aa, Homo Sapiens
CEAKEGDEW

SEQ ID NO: 137223 - protein, 9 aa, Homo Sapiens
HKHQNDVRP

SEQ ID NO: 137224 - protein, 9 aa, Homo Sapiens
DDEEEALAI

SEQ ID NO: 137225 - protein, 9 aa, Homo Sapiens
IAWTPLQKI

SEQ ID NO: 137226 - protein, 9 aa, Homo Sapiens
KGRDNLRQD

SEQ ID NO: 137227 - protein, 9 aa, Homo Sapiens
HLTAVTIFH

SEQ ID NO: 137228 - protein, 9 aa, Homo Sapiens
ADDEEEALA

SEQ ID NO: 137229 - protein, 9 aa, Homo Sapiens
IIKRLQDIV

SEQ ID NO: 137230 - protein, 9 aa, Homo Sapiens
RDYRNIIKR

SEQ ID NO: 137231 - protein, 9 aa, Homo Sapiens
GLRYGVPQS

SEQ ID NO: 137232 - protein, 9 aa, Homo Sapiens
MAFTLLETC

SEQ ID NO: 137233 - protein, 9 aa, Homo Sapiens
KFYQAEVEA

SEQ ID NO: 137234 - protein, 9 aa, Homo Sapiens
NALQRKERE

SEQ ID NO: 137235 - protein, 9 aa, Homo Sapiens
SYTDKECYE

SEQ ID NO: 137236 - protein, 9 aa, Homo Sapiens
TGRTGKIRL

SEQ ID NO: 137237 - protein, 9 aa, Homo Sapiens
RKMQLWELA

SEQ ID NO: 137238 - protein, 9 aa, Homo Sapiens
GAVGVGKSA

SEQ ID NO: 137239 - protein, 9 aa, Homo Sapiens
TKAQWDSIE

SEQ ID NO: 137240 - protein, 9 aa, Homo Sapiens
AKHMGYSYR

SEQ ID NO: 137241 - protein, 9 aa, Homo Sapiens
RELIVIAWT

SEQ ID NO: 137242 - protein, 9 aa, Homo Sapiens
SDKSQTVTD

SEQ ID NO: 137243 - protein, 9 aa, Homo Sapiens
PSGKVPFAL

SEQ ID NO: 137244 - protein, 9 aa, Homo Sapiens
TSFIERHKH

SEQ ID NO: 137245 - protein, 9 aa, Homo Sapiens
QSHPQSTPS

SEQ ID NO: 137246 - protein, 9 aa, Homo Sapiens
VKGRDNLRQ

SEQ ID NO: 137247 - protein, 9 aa, Homo Sapiens
PEKKQRLKE

SEQ ID NO: 137248 - protein, 9 aa, Homo Sapiens
QDQNARQRK

SEQ ID NO: 137249 - protein, 9 aa, Homo Sapiens
PFALLGTWD

SEQ ID NO: 137250 - protein, 9 aa, Homo Sapiens
YEPDRNALQ

SEQ ID NO: 137251 - protein, 9 aa, Homo Sapiens
SYEMNGCEY

SEQ ID NO: 137252 - protein, 9 aa, Homo Sapiens
KKAKLDLQN

SEQ ID NO: 137253 - protein, 9 aa, Homo Sapiens
HSIVKATRT

SEQ ID NO: 137254 - protein, 9 aa, Homo Sapiens
TFQNSFGFN

SEQ ID NO: 137255 - protein, 9 aa, Homo Sapiens
TVHKCTEAG

SEQ ID NO: 137256 - protein, 9 aa, Homo Sapiens
PQSQQVEHA

SEQ ID NO: 137257 - protein, 9 aa, Homo Sapiens
LGLKRVVTQ

SEQ ID NO: 137258 - protein, 9 aa, Homo Sapiens
GDSIWIYIQ

SEQ ID NO: 137259 - protein, 9 aa, Homo Sapiens
VWKLLSSFP

SEQ ID NO: 137260 - protein, 9 aa, Homo Sapiens
LVVVGAVGV

SEQ ID NO: 137261 - protein, 9 aa, Homo Sapiens
LELPWGWEM

SEQ ID NO: 137262 - protein, 9 aa, Homo Sapiens
SLVAKRKHS

SEQ ID NO: 137263 - protein, 9 aa, Homo Sapiens
VRLCRFAKE

SEQ ID NO: 137264 - protein, 9 aa, Homo Sapiens
IITGMDVYY

SEQ ID NO: 137265 - protein, 9 aa, Homo Sapiens
DHPGFQICD

SEQ ID NO: 137266 - protein, 9 aa, Homo Sapiens
SFDQKSVYR

SEQ ID NO: 137267 - protein, 9 aa, Homo Sapiens
QRSAELELE

SEQ ID NO: 137268 - protein, 9 aa, Homo Sapiens
WELARLNGT

SEQ ID NO: 137269 - protein, 9 aa, Homo Sapiens
IIDTEREAK

SEQ ID NO: 137270 - protein, 9 aa, Homo Sapiens
KCEAKEGDE

SEQ ID NO: 137271 - protein, 9 aa, Homo Sapiens
DNDKKRHKK

SEQ ID NO: 137272 - protein, 9 aa, Homo Sapiens
MRYHPFLYD

SEQ ID NO: 137273 - protein, 9 aa, Homo Sapiens
SSFLSATPR

SEQ ID NO: 137274 - protein, 9 aa, Homo Sapiens
IIMSALDSV

SEQ ID NO: 137275 - protein, 9 aa, Homo Sapiens
NIIKRLQDI

SEQ ID NO: 137276 - protein, 9 aa, Homo Sapiens
HIEMAFTLL

SEQ ID NO: 137277 - protein, 9 aa, Homo Sapiens
IMSPIVSVV

SEQ ID NO: 137278 - protein, 9 aa, Homo Sapiens
EKKQRLKEA

SEQ ID NO: 137279 - protein, 9 aa, Homo Sapiens
QKHFYFNKT

SEQ ID NO: 137280 - protein, 9 aa, Homo Sapiens
NGNITSFPL

SEQ ID NO: 137281 - protein, 9 aa, Homo Sapiens
PLQKIKPKM

SEQ ID NO: 137282 - protein, 9 aa, Homo Sapiens
DCISYKSGN

SEQ ID NO: 137283 - protein, 9 aa, Homo Sapiens
GDTANGPRF

SEQ ID NO: 137284 - protein, 9 aa, Homo Sapiens
KEATTICLL

SEQ ID NO: 137285 - protein, 9 aa, Homo Sapiens
ATTTPRKKV

SEQ ID NO: 137286 - protein, 9 aa, Homo Sapiens
QEQKAVWKL

SEQ ID NO: 137287 - protein, 9 aa, Homo Sapiens
QKSVYRGSL

SEQ ID NO: 137288 - protein, 9 aa, Homo Sapiens
IEHNSIITG

SEQ ID NO: 137289 - protein, 9 aa, Homo Sapiens
FAKEQTMWA

SEQ ID NO: 137290 - protein, 9 aa, Homo Sapiens
HIPYDQEVT

SEQ ID NO: 137291 - protein, 9 aa, Homo Sapiens
LWELARLNG

SEQ ID NO: 137292 - protein, 9 aa, Homo Sapiens
LLTPITMQF

SEQ ID NO: 137293 - protein, 9 aa, Homo Sapiens
LDHPGFQIC

SEQ ID NO: 137294 - protein, 9 aa, Homo Sapiens
RSLPNSQIH

SEQ ID NO: 137295 - protein, 9 aa, Homo Sapiens
NMVAKIMSP

SEQ ID NO: 137296 - protein, 9 aa, Homo Sapiens
SRVRSLPNS

SEQ ID NO: 137297 - protein, 9 aa, Homo Sapiens
QGTIFWVDC

SEQ ID NO: 137298 - protein, 9 aa, Homo Sapiens
ENSTFQNSF

SEQ ID NO: 137299 - protein, 9 aa, Homo Sapiens
RYGVPQSQQ

SEQ ID NO: 137300 - protein, 9 aa, Homo Sapiens
TEAGANMIV

SEQ ID NO: 137301 - protein, 9 aa, Homo Sapiens
KSQTVTDLL

SEQ ID NO: 137302 - protein, 9 aa, Homo Sapiens
KSYEMNGCE

SEQ ID NO: 137303 - protein, 9 aa, Homo Sapiens
DAAVQRSAE

SEQ ID NO: 137304 - protein, 9 aa, Homo Sapiens
AQWDSIEVC

SEQ ID NO: 137305 - protein, 9 aa, Homo Sapiens
KQRLKEATT

SEQ ID NO: 137306 - protein, 9 aa, Homo Sapiens
AKEQTMWAC

SEQ ID NO: 137307 - protein, 9 aa, Homo Sapiens
VQRSAELEL

SEQ ID NO: 137308 - protein, 9 aa, Homo Sapiens
LKRVVTQKH

SEQ ID NO: 137309 - protein, 9 aa, Homo Sapiens
DDDSFDQKS

SEQ ID NO: 137310 - protein, 9 aa, Homo Sapiens
SADDKGDTA

SEQ ID NO: 137311 - protein, 9 aa, Homo Sapiens
GEQEKEDIA

SEQ ID NO: 137312 - protein, 9 aa, Homo Sapiens
PRKKVAPSS

SEQ ID NO: 137313 - protein, 9 aa, Homo Sapiens
AKRKHSSFL

SEQ ID NO: 137314 - protein, 9 aa, Homo Sapiens
HKCTEAGAN

SEQ ID NO: 137315 - protein, 9 aa, Homo Sapiens
VPQSQQVEH

SEQ ID NO: 137316 - protein, 9 aa, Homo Sapiens
QRKKKERRP

SEQ ID NO: 137317 - protein, 9 aa, Homo Sapiens
FQIHINKYK

SEQ ID NO: 137318 - protein, 9 aa, Homo Sapiens
EEALAIPRP

SEQ ID NO: 137319 - protein, 9 aa, Homo Sapiens
SHIEHNSII

SEQ ID NO: 137320 - protein, 9 aa, Homo Sapiens
QAEVEALHS

SEQ ID NO: 137321 - protein, 9 aa, Homo Sapiens
QHFLQNHPN

SEQ ID NO: 137322 - protein, 9 aa, Homo Sapiens
YRNIIKRLQ

SEQ ID NO: 137323 - protein, 9 aa, Homo Sapiens
QRLKEATTI

SEQ ID NO: 137324 - protein, 9 aa, Homo Sapiens
KIPSMLKNR

SEQ ID NO: 137325 - protein, 9 aa, Homo Sapiens
SMEWFIGSE

SEQ ID NO: 137326 - protein, 9 aa, Homo Sapiens
VTDPSGKVP

SEQ ID NO: 137327 - protein, 9 aa, Homo Sapiens
RKKVAPSST

SEQ ID NO: 137328 - protein, 9 aa, Homo Sapiens
AEVIRELIV

SEQ ID NO: 137329 - protein, 9 aa, Homo Sapiens
QLVKGRDNL

SEQ ID NO: 137330 - protein, 9 aa, Homo Sapiens
EGDEWQLVS

SEQ ID NO: 137331 - protein, 9 aa, Homo Sapiens
KIRLQSLKI

SEQ ID NO: 137332 - protein, 9 aa, Homo Sapiens
FWVDCGDAE

SEQ ID NO: 137333 - protein, 9 aa, Homo Sapiens
SPVPQRKLR

SEQ ID NO: 137334 - protein, 9 aa, Homo Sapiens
GCSLTKAQW

SEQ ID NO: 137335 - protein, 9 aa, Homo Sapiens
LRYGVPQSQ

SEQ ID NO: 137336 - protein, 9 aa, Homo Sapiens
YEMNGCEYH

SEQ ID NO: 137337 - protein, 9 aa, Homo Sapiens
RDPLSEITK

SEQ ID NO: 137338 - protein, 9 aa, Homo Sapiens
DGVVEGIMR

SEQ ID NO: 137339 - protein, 9 aa, Homo Sapiens
LPFCGPRDA

SEQ ID NO: 137340 - protein, 9 aa, Homo Sapiens
SIITGMDVY

SEQ ID NO: 137341 - protein, 9 aa, Homo Sapiens
AAVQRSAEL

SEQ ID NO: 137342 - protein, 9 aa, Homo Sapiens
PDTVHKCTE

SEQ ID NO: 137343 - protein, 9 aa, Homo Sapiens
DKGDTANGP

SEQ ID NO: 137344 - protein, 9 aa, Homo Sapiens
WGWEMKHDH

SEQ ID NO: 137345 - protein, 9 aa, Homo Sapiens
DKSMEWFIG

SEQ ID NO: 137346 - protein, 9 aa, Homo Sapiens
VPFALLGTW

SEQ ID NO: 137347 - protein, 9 aa, Homo Sapiens
VPTAHSIVK

SEQ ID NO: 137348 - protein, 9 aa, Homo Sapiens
QIHINKYKM

SEQ ID NO: 137349 - protein, 9 aa, Homo Sapiens
AKIMSPIVS

SEQ ID NO: 137350 - protein, 9 aa, Homo Sapiens
SLTKAQWDS

SEQ ID NO: 137351 - protein, 9 aa, Homo Sapiens
KDKSMEWFI

SEQ ID NO: 137352 - protein, 9 aa, Homo Sapiens
EGIMRYHPF

SEQ ID NO: 137353 - protein, 9 aa, Homo Sapiens
KATRTSLPT

SEQ ID NO: 137354 - protein, 9 aa, Homo Sapiens
KEDIAVLAE

SEQ ID NO: 137355 - protein, 9 aa, Homo Sapiens
NKLPKAAWI

SEQ ID NO: 137356 - protein, 9 aa, Homo Sapiens
GTIFWVDCG

SEQ ID NO: 137357 - protein, 9 aa, Homo Sapiens
SLITFSILR

SEQ ID NO: 137358 - protein, 9 aa, Homo Sapiens
SEITKQEKD

SEQ ID NO: 137359 - protein, 9 aa, Homo Sapiens
KNGTYFQIH

SEQ ID NO: 137360 - protein, 9 aa, Homo Sapiens
SQDIQRVMW

SEQ ID NO: 137361 - protein, 9 aa, Homo Sapiens
AVTIFHGTI

SEQ ID NO: 137362 - protein, 9 aa, Homo Sapiens
RLQSLKIGL

SEQ ID NO: 137363 - protein, 9 aa, Homo Sapiens
ELPWGWEMK

SEQ ID NO: 137364 - protein, 9 aa, Homo Sapiens
RQLVKGRDN

SEQ ID NO: 137365 - protein, 9 aa, Homo Sapiens
QNARQRKKK

SEQ ID NO: 137366 - protein, 9 aa, Homo Sapiens
VHKCTEAGA

SEQ ID NO: 137367 - protein, 9 aa, Homo Sapiens
LPWGWEMKH

SEQ ID NO: 137368 - protein, 9 aa, Homo Sapiens
RSAELELEK

SEQ ID NO: 137369 - protein, 9 aa, Homo Sapiens
EDNKFYQAE

SEQ ID NO: 137370 - protein, 9 aa, Homo Sapiens
LQSLKIGLM

SEQ ID NO: 137371 - protein, 9 aa, Homo Sapiens
KMSTCRKKM

SEQ ID NO: 137372 - protein, 9 aa, Homo Sapiens
HSSFLSATP

SEQ ID NO: 137373 - protein, 9 aa, Homo Sapiens
DDSFDQKSV

SEQ ID NO: 137374 - protein, 9 aa, Homo Sapiens
ANKQLELPW

SEQ ID NO: 137375 - protein, 9 aa, Homo Sapiens
TEREAKAQE

SEQ ID NO: 137376 - protein, 9 aa, Homo Sapiens
QRKLRTSVG

SEQ ID NO: 137377 - protein, 9 aa, Homo Sapiens
SMLKNRVPD

SEQ ID NO: 137378 - protein, 9 aa, Homo Sapiens
TIFWVDCGD

SEQ ID NO: 137379 - protein, 9 aa, Homo Sapiens
AVWKLLSSF

SEQ ID NO: 137380 - protein, 9 aa, Homo Sapiens
GPRDANHLF

SEQ ID NO: 137381 - protein, 9 aa, Homo Sapiens
IPYDQEVTQ

SEQ ID NO: 137382 - protein, 9 aa, Homo Sapiens
EEEALAIPR

SEQ ID NO: 137383 - protein, 9 aa, Homo Sapiens
QNSFGFNIQ

SEQ ID NO: 137384 - protein, 9 aa, Homo Sapiens
GGIIDTERE

SEQ ID NO: 137385 - protein, 9 aa, Homo Sapiens
DSIWIYIQT

SEQ ID NO: 137386 - protein, 9 aa, Homo Sapiens
SHPQSTPSQ

SEQ ID NO: 137387 - protein, 9 aa, Homo Sapiens
VLSLITFSI

SEQ ID NO: 137388 - protein, 9 aa, Homo Sapiens
KGEENSTFQ

SEQ ID NO: 137389 - protein, 9 aa, Homo Sapiens
IRLQSLKIG

SEQ ID NO: 137390 - protein, 9 aa, Homo Sapiens
KRLQDIVSA

SEQ ID NO: 137391 - protein, 9 aa, Homo Sapiens
GVVEGIMRY

SEQ ID NO: 137392 - protein, 9 aa, Homo Sapiens
SILRIHQKP

SEQ ID NO: 137393 - protein, 9 aa, Homo Sapiens
TFSILRIHQ

SEQ ID NO: 137394 - protein, 9 aa, Homo Sapiens
EQEKEDIAV

SEQ ID NO: 137395 - protein, 9 aa, Homo Sapiens
LSLITFSIL

SEQ ID NO: 137396 - protein, 9 aa, Homo Sapiens
RLCRFAKEQ

SEQ ID NO: 137397 - protein, 9 aa, Homo Sapiens
DPDNDKKRH

SEQ ID NO: 137398 - protein, 9 aa, Homo Sapiens
NSPVPQRKL

SEQ ID NO: 137399 - protein, 9 aa, Homo Sapiens
KIKPKMSTC

SEQ ID NO: 137400 - protein, 9 aa, Homo Sapiens
KKVAPSSTM

SEQ ID NO: 137401 - protein, 9 aa, Homo Sapiens
EKIPSMLKN

SEQ ID NO: 137402 - protein, 9 aa, Homo Sapiens
MSTCRKKMK

SEQ ID NO: 137403 - protein, 9 aa, Homo Sapiens
HHIEMAFTL

SEQ ID NO: 137404 - protein, 9 aa, Homo Sapiens
RSNKLPKAA

SEQ ID NO: 137405 - protein, 9 aa, Homo Sapiens
QSTPSQSQP

SEQ ID NO: 137406 - protein, 9 aa, Homo Sapiens
TYFQIHINK

SEQ ID NO: 137407 - protein, 9 aa, Homo Sapiens
EKEVVYKFS

SEQ ID NO: 137408 - protein, 9 aa, Homo Sapiens
PQRKLRTSV

SEQ ID NO: 137409 - protein, 9 aa, Homo Sapiens
VTISADDKG

SEQ ID NO: 137410 - protein, 9 aa, Homo Sapiens
IKRLQDIVS

SEQ ID NO: 137411 - protein, 9 aa, Homo Sapiens
KQLELPWGW

SEQ ID NO: 137412 - protein, 9 aa, Homo Sapiens
FQICDSKGL

SEQ ID NO: 137413 - protein, 9 aa, Homo Sapiens
FCGPRDANH

SEQ ID NO: 137414 - protein, 9 aa, Homo Sapiens
QWDSIEVCL

SEQ ID NO: 137415 - protein, 9 aa, Homo Sapiens
LTPITMQFP

SEQ ID NO: 137416 - protein, 9 aa, Homo Sapiens
LSASCQFLK

SEQ ID NO: 137417 - protein, 9 aa, Homo Sapiens
SIVKATRTS

SEQ ID NO: 137418 - protein, 9 aa, Homo Sapiens
LGGEIIMSA

SEQ ID NO: 137419 - protein, 9 aa, Homo Sapiens
EGNMVAKIM

SEQ ID NO: 137420 - protein, 9 aa, Homo Sapiens
IYIQTIHCE

SEQ ID NO: 137421 - protein, 9 aa, Homo Sapiens
FTLLETCGR

SEQ ID NO: 137422 - protein, 9 aa, Homo Sapiens
IRELIVIAW

SEQ ID NO: 137423 - protein, 9 aa, Homo Sapiens
HMGYSYRLE

SEQ ID NO: 137424 - protein, 9 aa, Homo Sapiens
CIILLCTCV

SEQ ID NO: 137425 - protein, 9 aa, Homo Sapiens
TSSLSSRVR

SEQ ID NO: 137426 - protein, 9 aa, Homo Sapiens
ISADDKGDT

SEQ ID NO: 137427 - protein, 9 aa, Homo Sapiens
VSFNTSDKS

SEQ ID NO: 137428 - protein, 9 aa, Homo Sapiens
ITKQEKDFL

SEQ ID NO: 137429 - protein, 9 aa, Homo Sapiens
RTGKIRLQS

SEQ ID NO: 137430 - protein, 9 aa, Homo Sapiens
SASCQFLKE

SEQ ID NO: 137431 - protein, 9 aa, Homo Sapiens
KEVVYKFST

SEQ ID NO: 137432 - protein, 9 aa, Homo Sapiens
TSDKSQTVT

SEQ ID NO: 137433 - protein, 9 aa, Homo Sapiens
MSPIVSVVV

SEQ ID NO: 137434 - protein, 9 aa, Homo Sapiens
DWEKIPSML

SEQ ID NO: 137435 - protein, 9 aa, Homo Sapiens
KHSSFLSAT

SEQ ID NO: 137436 - protein, 9 aa, Homo Sapiens
NEAKRQIKK

SEQ ID NO: 137437 - protein, 9 aa, Homo Sapiens
FPKKAKLDL

SEQ ID NO: 137438 - protein, 9 aa, Homo Sapiens
SSRVRSLPN

SEQ ID NO: 137439 - protein, 9 aa, Homo Sapiens
RHKHQNDVR

SEQ ID NO: 137440 - protein, 9 aa, Homo Sapiens
KRKHSSFLS

SEQ ID NO: 137441 - protein, 9 aa, Homo Sapiens
TGGIIDTER

SEQ ID NO: 137442 - protein, 9 aa, Homo Sapiens
VVEGIMRYH

SEQ ID NO: 137443 - protein, 9 aa, Homo Sapiens
EALAIPRPL

SEQ ID NO: 137444 - protein, 9 aa, Homo Sapiens
TTPRKKVAP

SEQ ID NO: 137445 - protein, 9 aa, Homo Sapiens
DKECYENEE

SEQ ID NO: 137446 - protein, 9 aa, Homo Sapiens
NKFYQAEVE

SEQ ID NO: 137447 - protein, 9 aa, Homo Sapiens
RKLRTSVGS

SEQ ID NO: 137448 - protein, 9 aa, Homo Sapiens
VTQKHFYFN

SEQ ID NO: 137449 - protein, 9 aa, Homo Sapiens
IWIYIQTIH

SEQ ID NO: 137450 - protein, 9 aa, Homo Sapiens
RNALQRKER

SEQ ID NO: 137451 - protein, 9 aa, Homo Sapiens
NLGGEIIMS

SEQ ID NO: 137452 - protein, 9 aa, Homo Sapiens
HPQSTPSQS

SEQ ID NO: 137453 - protein, 9 aa, Homo Sapiens
MPSQSHPQS

SEQ ID NO: 137454 - protein, 9 aa, Homo Sapiens
GCEYHYVSK

SEQ ID NO: 137455 - protein, 9 aa, Homo Sapiens
DANHLFCEI

SEQ ID NO: 137456 - protein, 9 aa, Homo Sapiens
ASASHEMDC

SEQ ID NO: 137457 - protein, 9 aa, Homo Sapiens
FLLTPITMQ

SEQ ID NO: 137458 - protein, 9 aa, Homo Sapiens
YGVPQSQQV

SEQ ID NO: 137459 - protein, 9 aa, Homo Sapiens
GNITSFPLS

SEQ ID NO: 137460 - protein, 9 aa, Homo Sapiens
QNLGGEIIM

SEQ ID NO: 137461 - protein, 9 aa, Homo Sapiens
TPRKKVAPS

SEQ ID NO: 137462 - protein, 9 aa, Homo Sapiens
KLVVVGAVG

SEQ ID NO: 137463 - protein, 9 aa, Homo Sapiens
SNKLPKAAW

SEQ ID NO: 137464 - protein, 9 aa, Homo Sapiens
LHIPYDQEV

SEQ ID NO: 137465 - protein, 9 aa, Homo Sapiens
VVVGAVGVG

SEQ ID NO: 137466 - protein, 9 aa, Homo Sapiens
AVGVGKSAL

SEQ ID NO: 137467 - protein, 9 aa, Homo Sapiens
PGEQEKEDI

SEQ ID NO: 137468 - protein, 9 aa, Homo Sapiens
NFPKKAKLD

SEQ ID NO: 137469 - protein, 9 aa, Homo Sapiens
KRVVTQKHF

SEQ ID NO: 137470 - protein, 9 aa, Homo Sapiens
ISHIEHNSI

SEQ ID NO: 137471 - protein, 9 aa, Homo Sapiens
DAVRLCRFA

SEQ ID NO: 137472 - protein, 9 aa, Homo Sapiens
GGEIIMSAL

SEQ ID NO: 137473 - protein, 9 aa, Homo Sapiens
KIMSPIVSV

SEQ ID NO: 137474 - protein, 9 aa, Homo Sapiens
FSILRIHQK

SEQ ID NO: 137475 - protein, 9 aa, Homo Sapiens
GDGVVEGIM

SEQ ID NO: 137476 - protein, 9 aa, Homo Sapiens
TPITMQFPF

SEQ ID NO: 137477 - protein, 9 aa, Homo Sapiens
NKQLELPWG

SEQ ID NO: 137478 - protein, 9 aa, Homo Sapiens
KFSTTKKHL

SEQ ID NO: 137479 - protein, 9 aa, Homo Sapiens
AKNGTYFQI

SEQ ID NO: 137480 - protein, 9 aa, Homo Sapiens
HLSASCQFL

SEQ ID NO: 137481 - protein, 9 aa, Homo Sapiens
TDPSGKVPF

SEQ ID NO: 137482 - protein, 9 aa, Homo Sapiens
SFGSVHQDY

SEQ ID NO: 137483 - protein, 9 aa, Homo Sapiens
FLKEKCLYC

SEQ ID NO: 137484 - protein, 9 aa, Homo Sapiens
LVDAAVQRS

SEQ ID NO: 137485 - protein, 9 aa, Homo Sapiens
LTSFIERHK

SEQ ID NO: 137486 - protein, 9 aa, Homo Sapiens
LIVIAWTPL

SEQ ID NO: 137487 - protein, 9 aa, Homo Sapiens
TTTPRKKVA

SEQ ID NO: 137488 - protein, 9 aa, Homo Sapiens
TFCIILLCT

SEQ ID NO: 137489 - protein, 9 aa, Homo Sapiens
EQTGGIIDT

SEQ ID NO: 137490 - protein, 9 aa, Homo Sapiens
NARQRKKKE

SEQ ID NO: 137491 - protein, 9 aa, Homo Sapiens
TCRKKMKGF

SEQ ID NO: 137492 - protein, 9 aa, Homo Sapiens
VKNRYKNQN

SEQ ID NO: 137493 - protein, 9 aa, Homo Sapiens
LAIPRPLRA

SEQ ID NO: 137494 - protein, 9 aa, Homo Sapiens
RNIIKRLQD

SEQ ID NO: 137495 - protein, 9 aa, Homo Sapiens
NHPNKIKAS

SEQ ID NO: 137496 - protein, 9 aa, Homo Sapiens
SAKNGTYFQ

SEQ ID NO: 137497 - protein, 9 aa, Homo Sapiens
IPSMLKNRV

SEQ ID NO: 137498 - protein, 9 aa, Homo Sapiens
TPLQKIKPK

SEQ ID NO: 137499 - protein, 9 aa, Homo Sapiens
IDTEREAKA

SEQ ID NO: 137500 - protein, 9 aa, Homo Sapiens
MEWFIGSEE

SEQ ID NO: 137501 - protein, 9 aa, Homo Sapiens
STCRKKMKG

SEQ ID NO: 137502 - protein, 9 aa, Homo Sapiens
KVPFALLGT

SEQ ID NO: 137503 - protein, 9 aa, Homo Sapiens
IKPKMSTCR

SEQ ID NO: 137504 - protein, 9 aa, Homo Sapiens
HNSIITGMD

SEQ ID NO: 137505 - protein, 9 aa, Homo Sapiens
PNNFPKKAK

SEQ ID NO: 137506 - protein, 9 aa, Homo Sapiens
QICDSKGLH

SEQ ID NO: 137507 - protein, 9 aa, Homo Sapiens
AGDSIWIYI

SEQ ID NO: 137508 - protein, 9 aa, Homo Sapiens
PQSTPSQSQ

SEQ ID NO: 137509 - protein, 9 aa, Homo Sapiens
AVKGQGTIF

SEQ ID NO: 137510 - protein, 9 aa, Homo Sapiens
NGLGNAASF

SEQ ID NO: 137511 - protein, 9 aa, Homo Sapiens
MVAKIMSPI

SEQ ID NO: 137512 - protein, 9 aa, Homo Sapiens
MQLWELARL

SEQ ID NO: 137513 - protein, 9 aa, Homo Sapiens
EMNGCEYHY

SEQ ID NO: 137514 - protein, 9 aa, Homo Sapiens
KCTEAGANM

SEQ ID NO: 137515 - protein, 9 aa, Homo Sapiens
GKIRLQSLK

SEQ ID NO: 137516 - protein, 9 aa, Homo Sapiens
KLRTSVGSS

SEQ ID NO: 137517 - protein, 9 aa, Homo Sapiens
NTSDKSQTV

SEQ ID NO: 137518 - protein, 9 aa, Homo Sapiens
YWEDNKFYQ

SEQ ID NO: 137519 - protein, 9 aa, Homo Sapiens
VQEQKAVWK

SEQ ID NO: 137520 - protein, 9 aa, Homo Sapiens
YKFSTTKKH

SEQ ID NO: 137521 - protein, 9 aa, Homo Sapiens
CTEAGANMI

SEQ ID NO: 137522 - protein, 9 aa, Homo Sapiens
PLSEITKQE

SEQ ID NO: 137523 - protein, 9 aa, Homo Sapiens
GNGLGNAAS

SEQ ID NO: 137524 - protein, 9 aa, Homo Sapiens
CGPRDANHL

SEQ ID NO: 137525 - protein, 9 aa, Homo Sapiens
IDNGNITSF

SEQ ID NO: 137526 - protein, 9 aa, Homo Sapiens
ANHLFCEIL

SEQ ID NO: 137527 - protein, 9 aa, Homo Sapiens
ALQRKERER

SEQ ID NO: 137528 - protein, 9 aa, Homo Sapiens
PYDQEVTQF

SEQ ID NO: 137529 - protein, 9 aa, Homo Sapiens
DTEREAKAQ

SEQ ID NO: 137530 - protein, 9 aa, Homo Sapiens
PDRNALQRK

SEQ ID NO: 137531 - protein, 9 aa, Homo Sapiens
LSSRVRSLP

SEQ ID NO: 137532 - protein, 9 aa, Homo Sapiens
DPLSEITKQ

SEQ ID NO: 137533 - protein, 9 aa, Homo Sapiens
GLHIPYDQE

SEQ ID NO: 137534 - protein, 9 aa, Homo Sapiens
AKEGDEWQL

SEQ ID NO: 137535 - protein, 9 aa, Homo Sapiens
AEIAKHMGY

SEQ ID NO: 137536 - protein, 9 aa, Homo Sapiens
QKIKPKMST

SEQ ID NO: 137537 - protein, 9 aa, Homo Sapiens
ADDKGDTAN

SEQ ID NO: 137538 - protein, 9 aa, Homo Sapiens
VPQRKLRTS

SEQ ID NO: 137539 - protein, 9 aa, Homo Sapiens
RLTSFIERH

SEQ ID NO: 137540 - protein, 9 aa, Homo Sapiens
GEENSTFQN

SEQ ID NO: 137541 - protein, 9 aa, Homo Sapiens
TAVTIFHGT

SEQ ID NO: 137542 - protein, 9 aa, Homo Sapiens
YDQEVTQFD

SEQ ID NO: 137543 - protein, 9 aa, Homo Sapiens
GGTFCIILL

SEQ ID NO: 137544 - protein, 9 aa, Homo Sapiens
GLKRVVTQK

SEQ ID NO: 137545 - protein, 9 aa, Homo Sapiens
AWTPLQKIK

SEQ ID NO: 137546 - protein, 9 aa, Homo Sapiens
SFIERHKHQ

SEQ ID NO: 137547 - protein, 9 aa, Homo Sapiens
EPNNFPKKA

SEQ ID NO: 137548 - protein, 9 aa, Homo Sapiens
CDSKGLHNV

SEQ ID NO: 137549 - protein, 9 aa, Homo Sapiens
IQNLGGEII

SEQ ID NO: 137550 - protein, 9 aa, Homo Sapiens
IAKHMGYSY

SEQ ID NO: 137551 - protein, 9 aa, Homo Sapiens
SHEMDCISY

SEQ ID NO: 137552 - protein, 9 aa, Homo Sapiens
RQRKKKERR

SEQ ID NO: 137553 - protein, 9 aa, Homo Sapiens
EKEDIAVLA

SEQ ID NO: 137554 - protein, 9 aa, Homo Sapiens
KDVNEAKRQ

SEQ ID NO: 137555 - protein, 9 aa, Homo Sapiens
QFLKEKCLY

SEQ ID NO: 137556 - protein, 9 aa, Homo Sapiens
LEQHFLQNH

SEQ ID NO: 137557 - protein, 9 aa, Homo Sapiens
ASHEMDCIS

SEQ ID NO: 137558 - protein, 9 aa, Homo Sapiens
VEKDVNEAK

SEQ ID NO: 137559 - protein, 9 aa, Homo Sapiens
SLSSRVRSL

SEQ ID NO: 137560 - protein, 9 aa, Homo Sapiens
IVIAWTPLQ

SEQ ID NO: 137561 - protein, 9 aa, Homo Sapiens
EMAFTLLET

SEQ ID NO: 137562 - protein, 9 aa, Homo Sapiens
ASFGSVHQD

SEQ ID NO: 137563 - protein, 9 aa, Homo Sapiens
KGQGTIFWV

SEQ ID NO: 137564 - protein, 9 aa, Homo Sapiens
PNSQDIQRV

SEQ ID NO: 137565 - protein, 9 aa, Homo Sapiens
LSYTDKECY

SEQ ID NO: 137566 - protein, 9 aa, Homo Sapiens
YKLVVVGAV

SEQ ID NO: 137567 - protein, 9 aa, Homo Sapiens
NGCEYHYVS

SEQ ID NO: 137568 - protein, 9 aa, Homo Sapiens
NGTYFQIHI

SEQ ID NO: 137569 - protein, 9 aa, Homo Sapiens
DQKSVYRGS

SEQ ID NO: 137570 - protein, 9 aa, Homo Sapiens
NGGKDPIGY

SEQ ID NO: 137571 - protein, 9 aa, Homo Sapiens
KNAIRKRGL

SEQ ID NO: 137572 - protein, 9 aa, Homo Sapiens
LPDSPGQTC

SEQ ID NO: 137573 - protein, 9 aa, Homo Sapiens
VEKPYDCGD

SEQ ID NO: 137574 - protein, 9 aa, Homo Sapiens
FRQQVHAMA

SEQ ID NO: 137575 - protein, 9 aa, Homo Sapiens
EAELKANIL

SEQ ID NO: 137576 - protein, 9 aa, Homo Sapiens
HSTNGRHKA

SEQ ID NO: 137577 - protein, 9 aa, Homo Sapiens
MHSTNGRHK

SEQ ID NO: 137578 - protein, 9 aa, Homo Sapiens
NEYFKVFME

SEQ ID NO: 137579 - protein, 9 aa, Homo Sapiens
PDSPGQTCH

SEQ ID NO: 137580 - protein, 9 aa, Homo Sapiens
RCNNMGYEI

SEQ ID NO: 137581 - protein, 9 aa, Homo Sapiens
EVKHLHHLL

SEQ ID NO: 137582 - protein, 9 aa, Homo Sapiens
NKIHYEILI

SEQ ID NO: 137583 - protein, 9 aa, Homo Sapiens
MASEDEYST

SEQ ID NO: 137584 - protein, 9 aa, Homo Sapiens
HTKGADIDV

SEQ ID NO: 137585 - protein, 9 aa, Homo Sapiens
AGSEAPKRV

SEQ ID NO: 137586 - protein, 9 aa, Homo Sapiens
SSPWVGISA

SEQ ID NO: 137587 - protein, 9 aa, Homo Sapiens
SVVESVVKL

SEQ ID NO: 137588 - protein, 9 aa, Homo Sapiens
WDLKMGEFI

SEQ ID NO: 137589 - protein, 9 aa, Homo Sapiens
FLLRHPPQA

SEQ ID NO: 137590 - protein, 9 aa, Homo Sapiens
VQRWKKRLR

SEQ ID NO: 137591 - protein, 9 aa, Homo Sapiens
DAQGKKVMC

SEQ ID NO: 137592 - protein, 9 aa, Homo Sapiens
FNVSSDTVF

SEQ ID NO: 137593 - protein, 9 aa, Homo Sapiens
VNRELTKGL

SEQ ID NO: 137594 - protein, 9 aa, Homo Sapiens
NLSEVELGD

SEQ ID NO: 137595 - protein, 9 aa, Homo Sapiens
KQVSGPEHT

SEQ ID NO: 137596 - protein, 9 aa, Homo Sapiens
VHAMAVSEA

SEQ ID NO: 137597 - protein, 9 aa, Homo Sapiens
GIFPGNFTF

SEQ ID NO: 137598 - protein, 9 aa, Homo Sapiens
QMRLAYVCC

SEQ ID NO: 137599 - protein, 9 aa, Homo Sapiens
MGYVDDPDK

SEQ ID NO: 137600 - protein, 9 aa, Homo Sapiens
TDVVPDTRH

SEQ ID NO: 137601 - protein, 9 aa, Homo Sapiens
LLPHSGISS

SEQ ID NO: 137602 - protein, 9 aa, Homo Sapiens
CEGTHREKG

SEQ ID NO: 137603 - protein, 9 aa, Homo Sapiens
SEGLSVVFA

SEQ ID NO: 137604 - protein, 9 aa, Homo Sapiens
IHVIDFLNP

SEQ ID NO: 137605 - protein, 9 aa, Homo Sapiens
EVELGDVQG

SEQ ID NO: 137606 - protein, 9 aa, Homo Sapiens
NMYRNMLIN

SEQ ID NO: 137607 - protein, 9 aa, Homo Sapiens
NIFLTPMHW

SEQ ID NO: 137608 - protein, 9 aa, Homo Sapiens
DSEVTVWGF

SEQ ID NO: 137609 - protein, 9 aa, Homo Sapiens
QQVHAMAVS

SEQ ID NO: 137610 - protein, 9 aa, Homo Sapiens
LEGYLSLAD

SEQ ID NO: 137611 - protein, 9 aa, Homo Sapiens
QGKAPWMVN

SEQ ID NO: 137612 - protein, 9 aa, Homo Sapiens
NVSSDTVFL

SEQ ID NO: 137613 - protein, 9 aa, Homo Sapiens
IIRLFDMQQ

SEQ ID NO: 137614 - protein, 9 aa, Homo Sapiens
SSESTGHAT

SEQ ID NO: 137615 - protein, 9 aa, Homo Sapiens
KQRLLEKDP

SEQ ID NO: 137616 - protein, 9 aa, Homo Sapiens
ARDTLWVRG

SEQ ID NO: 137617 - protein, 9 aa, Homo Sapiens
GIIMGYVDD

SEQ ID NO: 137618 - protein, 9 aa, Homo Sapiens
IFPGNFTFN

SEQ ID NO: 137619 - protein, 9 aa, Homo Sapiens
TEKSTIPPE

SEQ ID NO: 137620 - protein, 9 aa, Homo Sapiens
SVVKLNEAQ

SEQ ID NO: 137621 - protein, 9 aa, Homo Sapiens
EPLQEEIKR

SEQ ID NO: 137622 - protein, 9 aa, Homo Sapiens
DPCNAELII

SEQ ID NO: 137623 - protein, 9 aa, Homo Sapiens
VGACGVGKS

SEQ ID NO: 137624 - protein, 9 aa, Homo Sapiens
VRGQAGLAG

SEQ ID NO: 137625 - protein, 9 aa, Homo Sapiens
IISDKQWST

SEQ ID NO: 137626 - protein, 9 aa, Homo Sapiens
QAEVKHLHH

SEQ ID NO: 137627 - protein, 9 aa, Homo Sapiens
LYQMWTFST

SEQ ID NO: 137628 - protein, 9 aa, Homo Sapiens
VSSDTVFLL

SEQ ID NO: 137629 - protein, 9 aa, Homo Sapiens
TQRRLCLYR

SEQ ID NO: 137630 - protein, 9 aa, Homo Sapiens
TGAADGIIR

SEQ ID NO: 137631 - protein, 9 aa, Homo Sapiens
PRLVVPATQ

SEQ ID NO: 137632 - protein, 9 aa, Homo Sapiens
ECSPLPFLN

SEQ ID NO: 137633 - protein, 9 aa, Homo Sapiens
VQYGIFPGN

SEQ ID NO: 137634 - protein, 9 aa, Homo Sapiens
TSRSSAQSP

SEQ ID NO: 137635 - protein, 9 aa, Homo Sapiens
IEAELKANI

SEQ ID NO: 137636 - protein, 9 aa, Homo Sapiens
YHFLGFTEC

SEQ ID NO: 137637 - protein, 9 aa, Homo Sapiens
QIHMAYRYE

SEQ ID NO: 137638 - protein, 9 aa, Homo Sapiens
KSFSHGSQL

SEQ ID NO: 137639 - protein, 9 aa, Homo Sapiens
WLFSSDPQK

SEQ ID NO: 137640 - protein, 9 aa, Homo Sapiens
GAADGIIRL

SEQ ID NO: 137641 - protein, 9 aa, Homo Sapiens
ASVFQDFDV

SEQ ID NO: 137642 - protein, 9 aa, Homo Sapiens
NFSSPWVGI

SEQ ID NO: 137643 - protein, 9 aa, Homo Sapiens
MVVRHGGPD

SEQ ID NO: 137644 - protein, 9 aa, Homo Sapiens
AEVKHLHHL

SEQ ID NO: 137645 - protein, 9 aa, Homo Sapiens
LNMAEIQMR

SEQ ID NO: 137646 - protein, 9 aa, Homo Sapiens
SKLWFKEDD

SEQ ID NO: 137647 - protein, 9 aa, Homo Sapiens
QDSEVTVWG

SEQ ID NO: 137648 - protein, 9 aa, Homo Sapiens
QNKIHYEIL

SEQ ID NO: 137649 - protein, 9 aa, Homo Sapiens
AHRVNLTEA

SEQ ID NO: 137650 - protein, 9 aa, Homo Sapiens
VLNMAEIQM

SEQ ID NO: 137651 - protein, 9 aa, Homo Sapiens
LEALPQFSS

SEQ ID NO: 137652 - protein, 9 aa, Homo Sapiens
GITDINDNC

SEQ ID NO: 137653 - protein, 9 aa, Homo Sapiens
LDLLVGNQK

SEQ ID NO: 137654 - protein, 9 aa, Homo Sapiens
IYSLSNKDM

SEQ ID NO: 137655 - protein, 9 aa, Homo Sapiens
LPSYNPNPA

SEQ ID NO: 137656 - protein, 9 aa, Homo Sapiens
PEDKPEDGH

SEQ ID NO: 137657 - protein, 9 aa, Homo Sapiens
HSGISSLRR

SEQ ID NO: 137658 - protein, 9 aa, Homo Sapiens
PGNFTFNLL

SEQ ID NO: 137659 - protein, 9 aa, Homo Sapiens
DASSESTGH

SEQ ID NO: 137660 - protein, 9 aa, Homo Sapiens
TRPGVFYIS

SEQ ID NO: 137661 - protein, 9 aa, Homo Sapiens
DIHVIDFLN

SEQ ID NO: 137662 - protein, 9 aa, Homo Sapiens
LIDRFCLNG

SEQ ID NO: 137663 - protein, 9 aa, Homo Sapiens
STWPNGSCI

SEQ ID NO: 137664 - protein, 9 aa, Homo Sapiens
EAALPAVVV

SEQ ID NO: 137665 - protein, 9 aa, Homo Sapiens
ILTRNFEAH

SEQ ID NO: 137666 - protein, 9 aa, Homo Sapiens
VSYSSATPV

SEQ ID NO: 137667 - protein, 9 aa, Homo Sapiens
TRNFEAHNA

SEQ ID NO: 137668 - protein, 9 aa, Homo Sapiens
WPLQQYARC

SEQ ID NO: 137669 - protein, 9 aa, Homo Sapiens
LKVFLLRHP

SEQ ID NO: 137670 - protein, 9 aa, Homo Sapiens
SASLEVDVF

SEQ ID NO: 137671 - protein, 9 aa, Homo Sapiens
GIIRLFDMQ

SEQ ID NO: 137672 - protein, 9 aa, Homo Sapiens
LCEGTHREK

SEQ ID NO: 137673 - protein, 9 aa, Homo Sapiens
QFSSGADKK

SEQ ID NO: 137674 - protein, 9 aa, Homo Sapiens
MSKLWFKED

SEQ ID NO: 137675 - protein, 9 aa, Homo Sapiens
FHKIGMGAM

SEQ ID NO: 137676 - protein, 9 aa, Homo Sapiens
WSASLEVDV

SEQ ID NO: 137677 - protein, 9 aa, Homo Sapiens
FYISREDGY

SEQ ID NO: 137678 - protein, 9 aa, Homo Sapiens
WAGEMTDVL

SEQ ID NO: 137679 - protein, 9 aa, Homo Sapiens
NMAEIQMRL

SEQ ID NO: 137680 - protein, 9 aa, Homo Sapiens
DECSPLPFL

SEQ ID NO: 137681 - protein, 9 aa, Homo Sapiens
SPWVGISAV

SEQ ID NO: 137682 - protein, 9 aa, Homo Sapiens
ITDTSFLSG

SEQ ID NO: 137683 - protein, 9 aa, Homo Sapiens
RLLERGQVD

SEQ ID NO: 137684 - protein, 9 aa, Homo Sapiens
WCFYSYLTG

SEQ ID NO: 137685 - protein, 9 aa, Homo Sapiens
AAIITDTSF

SEQ ID NO: 137686 - protein, 9 aa, Homo Sapiens
PTSYYSSPG

SEQ ID NO: 137687 - protein, 9 aa, Homo Sapiens
RQQVHAMAV

SEQ ID NO: 137688 - protein, 9 aa, Homo Sapiens
EDKPEDGHT

SEQ ID NO: 137689 - protein, 9 aa, Homo Sapiens
PSEKYLKIK

SEQ ID NO: 137690 - protein, 9 aa, Homo Sapiens
IFLTPMHWS

SEQ ID NO: 137691 - protein, 9 aa, Homo Sapiens
EKEPETQKD

SEQ ID NO: 137692 - protein, 9 aa, Homo Sapiens
NMLINCENQ

SEQ ID NO: 137693 - protein, 9 aa, Homo Sapiens
YGIVPSIPT

SEQ ID NO: 137694 - protein, 9 aa, Homo Sapiens
KKDSAVKPE

SEQ ID NO: 137695 - protein, 9 aa, Homo Sapiens
NQRWGRHPS

SEQ ID NO: 137696 - protein, 9 aa, Homo Sapiens
SEKYLKIKH

SEQ ID NO: 137697 - protein, 9 aa, Homo Sapiens
LCRWLCRRC

SEQ ID NO: 137698 - protein, 9 aa, Homo Sapiens
VVFALELNK

SEQ ID NO: 137699 - protein, 9 aa, Homo Sapiens
KDFNCTPGS

SEQ ID NO: 137700 - protein, 9 aa, Homo Sapiens
ENEYFKVFM

SEQ ID NO: 137701 - protein, 9 aa, Homo Sapiens
EGLSVVFAL

SEQ ID NO: 137702 - protein, 9 aa, Homo Sapiens
PERAATPHH

SEQ ID NO: 137703 - protein, 9 aa, Homo Sapiens
VSNVRLLPL

SEQ ID NO: 137704 - protein, 9 aa, Homo Sapiens
DGIIRLFDM

SEQ ID NO: 137705 - protein, 9 aa, Homo Sapiens
IPEQDRPLF

SEQ ID NO: 137706 - protein, 9 aa, Homo Sapiens
VVPDTRHLD

SEQ ID NO: 137707 - protein, 9 aa, Homo Sapiens
YYSSPGSTA

SEQ ID NO: 137708 - protein, 9 aa, Homo Sapiens
NGRHKAFST

SEQ ID NO: 137709 - protein, 9 aa, Homo Sapiens
MKDGCIQLA

SEQ ID NO: 137710 - protein, 9 aa, Homo Sapiens
KQWSTMPNR

SEQ ID NO: 137711 - protein, 9 aa, Homo Sapiens
HRGCPLLCR

SEQ ID NO: 137712 - protein, 9 aa, Homo Sapiens
AGLQVPQPV

SEQ ID NO: 137713 - protein, 9 aa, Homo Sapiens
QNLIERRRR

SEQ ID NO: 137714 - protein, 9 aa, Homo Sapiens
GDWSASLEV

SEQ ID NO: 137715 - protein, 9 aa, Homo Sapiens
AVDGGTPAH

SEQ ID NO: 137716 - protein, 9 aa, Homo Sapiens
GDDYQVVTI

SEQ ID NO: 137717 - protein, 9 aa, Homo Sapiens
KLVVVGACG

SEQ ID NO: 137718 - protein, 9 aa, Homo Sapiens
HLLPHSGIS

SEQ ID NO: 137719 - protein, 9 aa, Homo Sapiens
ASLEVDVFL

SEQ ID NO: 137720 - protein, 9 aa, Homo Sapiens
RLCLYRPCP

SEQ ID NO: 137721 - protein, 9 aa, Homo Sapiens
EIQMRLAYV

SEQ ID NO: 137722 - protein, 9 aa, Homo Sapiens
KTKMGERQW

SEQ ID NO: 137723 - protein, 9 aa, Homo Sapiens
ITPAFREAL

SEQ ID NO: 137724 - protein, 9 aa, Homo Sapiens
FSSGADKKL

SEQ ID NO: 137725 - protein, 9 aa, Homo Sapiens
DVQGAAQSS

SEQ ID NO: 137726 - protein, 9 aa, Homo Sapiens
KPSEKYLKI

SEQ ID NO: 137727 - protein, 9 aa, Homo Sapiens
GQTCHQAEV

SEQ ID NO: 137728 - protein, 9 aa, Homo Sapiens
GSTQSEFLV

SEQ ID NO: 137729 - protein, 9 aa, Homo Sapiens
PPVTPRLVV

SEQ ID NO: 137730 - protein, 9 aa, Homo Sapiens
EWPLQQYAR

SEQ ID NO: 137731 - protein, 9 aa, Homo Sapiens
KHLLLKRER

SEQ ID NO: 137732 - protein, 9 aa, Homo Sapiens
ATPVHDSVG

SEQ ID NO: 137733 - protein, 9 aa, Homo Sapiens
VWGFRIYGS

SEQ ID NO: 137734 - protein, 9 aa, Homo Sapiens
VLCVAPRHV

SEQ ID NO: 137735 - protein, 9 aa, Homo Sapiens
DTRHLDKFS

SEQ ID NO: 137736 - protein, 9 aa, Homo Sapiens
VNYSKIMNG

SEQ ID NO: 137737 - protein, 9 aa, Homo Sapiens
GFTECFLYT

SEQ ID NO: 137738 - protein, 9 aa, Homo Sapiens
GACGVGKSA

SEQ ID NO: 137739 - protein, 9 aa, Homo Sapiens
KNRCNNMGY

SEQ ID NO: 137740 - protein, 9 aa, Homo Sapiens
QGKKVMCIL

SEQ ID NO: 137741 - protein, 9 aa, Homo Sapiens
WMVNRELTK

SEQ ID NO: 137742 - protein, 9 aa, Homo Sapiens
RQKKDNQNL

SEQ ID NO: 137743 - protein, 9 aa, Homo Sapiens
YILVHLAIR

SEQ ID NO: 137744 - protein, 9 aa, Homo Sapiens
TLHKEDSQL

SEQ ID NO: 137745 - protein, 9 aa, Homo Sapiens
QKDEKMSKA

SEQ ID NO: 137746 - protein, 9 aa, Homo Sapiens
NAELIILGR

SEQ ID NO: 137747 - protein, 9 aa, Homo Sapiens
ESTGHATPL

SEQ ID NO: 137748 - protein, 9 aa, Homo Sapiens
HVRTLMILH

SEQ ID NO: 137749 - protein, 9 aa, Homo Sapiens
SIVVQKTTS

SEQ ID NO: 137750 - protein, 9 aa, Homo Sapiens
KMHSTNGRH

SEQ ID NO: 137751 - protein, 9 aa, Homo Sapiens
EKSTIPPEK

SEQ ID NO: 137752 - protein, 9 aa, Homo Sapiens
VKLNEAQPS

SEQ ID NO: 137753 - protein, 9 aa, Homo Sapiens
LHHLLKQLK

SEQ ID NO: 137754 - protein, 9 aa, Homo Sapiens
YKLVVVGAC

SEQ ID NO: 137755 - protein, 9 aa, Homo Sapiens
NRELTKGLC

SEQ ID NO: 137756 - protein, 9 aa, Homo Sapiens
HVIDFLNPS

SEQ ID NO: 137757 - protein, 9 aa, Homo Sapiens
GPEHTIPIT

SEQ ID NO: 137758 - protein, 9 aa, Homo Sapiens
KSLMASEDE

SEQ ID NO: 137759 - protein, 9 aa, Homo Sapiens
KEFLASVFQ

SEQ ID NO: 137760 - protein, 9 aa, Homo Sapiens
NDAVLGILQ

SEQ ID NO: 137761 - protein, 9 aa, Homo Sapiens
AAEWPLQQY

SEQ ID NO: 137762 - protein, 9 aa, Homo Sapiens
IVSSFGRTH

SEQ ID NO: 137763 - protein, 9 aa, Homo Sapiens
MIQIFSSHV

SEQ ID NO: 137764 - protein, 9 aa, Homo Sapiens
PQFSSGADK

SEQ ID NO: 137765 - protein, 9 aa, Homo Sapiens
VSIVVQKTT

SEQ ID NO: 137766 - protein, 9 aa, Homo Sapiens
DFNCTPGSR

SEQ ID NO: 137767 - protein, 9 aa, Homo Sapiens
NYSKIMNGN

SEQ ID NO: 137768 - protein, 9 aa, Homo Sapiens
KAPWMVNRE

SEQ ID NO: 137769 - protein, 9 aa, Homo Sapiens
YSSATPVHD

SEQ ID NO: 137770 - protein, 9 aa, Homo Sapiens
QALEALPQF

SEQ ID NO: 137771 - protein, 9 aa, Homo Sapiens
KEEEREIKS

SEQ ID NO: 137772 - protein, 9 aa, Homo Sapiens
TLFSTWPNG

SEQ ID NO: 137773 - protein, 9 aa, Homo Sapiens
VVVLHGLFG

SEQ ID NO: 137774 - protein, 9 aa, Homo Sapiens
VLAIIVFIS

SEQ ID NO: 137775 - protein, 9 aa, Homo Sapiens
PFFLRRIKT

SEQ ID NO: 137776 - protein, 9 aa, Homo Sapiens
DNIFLTPMH

SEQ ID NO: 137777 - protein, 9 aa, Homo Sapiens
LTPMHWSNV

SEQ ID NO: 137778 - protein, 9 aa, Homo Sapiens
TDASSESTG

SEQ ID NO: 137779 - protein, 9 aa, Homo Sapiens
QTYSFSPFK

SEQ ID NO: 137780 - protein, 9 aa, Homo Sapiens
TVSYSSATP

SEQ ID NO: 137781 - protein, 9 aa, Homo Sapiens
SGKYPNSVS

SEQ ID NO: 137782 - protein, 9 aa, Homo Sapiens
IDFLNPSDS

SEQ ID NO: 137783 - protein, 9 aa, Homo Sapiens
TPWIIFNVS

SEQ ID NO: 137784 - protein, 9 aa, Homo Sapiens
PLLCEGTHR

SEQ ID NO: 137785 - protein, 9 aa, Homo Sapiens
PSGLPRHVR

SEQ ID NO: 137786 - protein, 9 aa, Homo Sapiens
PGQTCHQAE

SEQ ID NO: 137787 - protein, 9 aa, Homo Sapiens
RAMRGQVNY

SEQ ID NO: 137788 - protein, 9 aa, Homo Sapiens
PEPLFIPPL

SEQ ID NO: 137789 - protein, 9 aa, Homo Sapiens
VVESVVKLN

SEQ ID NO: 137790 - protein, 9 aa, Homo Sapiens
GCPLLCRWL

SEQ ID NO: 137791 - protein, 9 aa, Homo Sapiens
DYIQMILEL

SEQ ID NO: 137792 - protein, 9 aa, Homo Sapiens
ARLPSPRSE

SEQ ID NO: 137793 - protein, 9 aa, Homo Sapiens
FVREDLAHR

SEQ ID NO: 137794 - protein, 9 aa, Homo Sapiens
MITPAFREA

SEQ ID NO: 137795 - protein, 9 aa, Homo Sapiens
AMSKLWFKE

SEQ ID NO: 137796 - protein, 9 aa, Homo Sapiens
FKSYSRQSS

SEQ ID NO: 137797 - protein, 9 aa, Homo Sapiens
TIPPEKPTT

SEQ ID NO: 137798 - protein, 9 aa, Homo Sapiens
QMILELFDQ

SEQ ID NO: 137799 - protein, 9 aa, Homo Sapiens
SFGRTHEKG

SEQ ID NO: 137800 - protein, 9 aa, Homo Sapiens
LNLFHNKLG

SEQ ID NO: 137801 - protein, 9 aa, Homo Sapiens
ECRMSGKYP

SEQ ID NO: 137802 - protein, 9 aa, Homo Sapiens
KIHYEILIH

SEQ ID NO: 137803 - protein, 9 aa, Homo Sapiens
NMGYEINKV

SEQ ID NO: 137804 - protein, 9 aa, Homo Sapiens
GQVNYSKIM

SEQ ID NO: 137805 - protein, 9 aa, Homo Sapiens
PDPACRELG

SEQ ID NO: 137806 - protein, 9 aa, Homo Sapiens
TPEIPARLP

SEQ ID NO: 137807 - protein, 9 aa, Homo Sapiens
FDIHVIDFL

SEQ ID NO: 137808 - protein, 9 aa, Homo Sapiens
WTFSTFLEL

SEQ ID NO: 137809 - protein, 9 aa, Homo Sapiens
CIEAELKAN

SEQ ID NO: 137810 - protein, 9 aa, Homo Sapiens
TNGRHKAFS

SEQ ID NO: 137811 - protein, 9 aa, Homo Sapiens
QMWTFSTFL

SEQ ID NO: 137812 - protein, 9 aa, Homo Sapiens
AVLKPFFLR

SEQ ID NO: 137813 - protein, 9 aa, Homo Sapiens
YSSPGSTAT

SEQ ID NO: 137814 - protein, 9 aa, Homo Sapiens
HKEDSQLIT

SEQ ID NO: 137815 - protein, 9 aa, Homo Sapiens
AQLEGYLSL

SEQ ID NO: 137816 - protein, 9 aa, Homo Sapiens
KIGMGAMTW

SEQ ID NO: 137817 - protein, 9 aa, Homo Sapiens
GLMGPLWPP

SEQ ID NO: 137818 - protein, 9 aa, Homo Sapiens
YKVVFRQQV

SEQ ID NO: 137819 - protein, 9 aa, Homo Sapiens
LHKEDSQLI

SEQ ID NO: 137820 - protein, 9 aa, Homo Sapiens
SREDGYIDI

SEQ ID NO: 137821 - protein, 9 aa, Homo Sapiens
FKVFMENLM

SEQ ID NO: 137822 - protein, 9 aa, Homo Sapiens
FYHFLGFTE

SEQ ID NO: 137823 - protein, 9 aa, Homo Sapiens
HLDKFSQIT

SEQ ID NO: 137824 - protein, 9 aa, Homo Sapiens
ERQREDQEP

SEQ ID NO: 137825 - protein, 9 aa, Homo Sapiens
DIDVLCVAP

SEQ ID NO: 137826 - protein, 9 aa, Homo Sapiens
SPGQTCHQA

SEQ ID NO: 137827 - protein, 9 aa, Homo Sapiens
SPYGIVPSI

SEQ ID NO: 137828 - protein, 9 aa, Homo Sapiens
TQSEFLVEE

SEQ ID NO: 137829 - protein, 9 aa, Homo Sapiens
VIDFLNPSD

SEQ ID NO: 137830 - protein, 9 aa, Homo Sapiens
QYGIFPGNF

SEQ ID NO: 137831 - protein, 9 aa, Homo Sapiens
AFDVGYILV

SEQ ID NO: 137832 - protein, 9 aa, Homo Sapiens
IMGYVDDPD

SEQ ID NO: 137833 - protein, 9 aa, Homo Sapiens
ISSLRRVPR

SEQ ID NO: 137834 - protein, 9 aa, Homo Sapiens
LKIKHLLLK

SEQ ID NO: 137835 - protein, 9 aa, Homo Sapiens
FKEDDKFFL

SEQ ID NO: 137836 - protein, 9 aa, Homo Sapiens
RERVDLSKL

SEQ ID NO: 137837 - protein, 9 aa, Homo Sapiens
GTPAHSGTT

SEQ ID NO: 137838 - protein, 9 aa, Homo Sapiens
AVKPERAAT

SEQ ID NO: 137839 - protein, 9 aa, Homo Sapiens
TYSFSPFKS

SEQ ID NO: 137840 - protein, 9 aa, Homo Sapiens
VSGPEHTIP

SEQ ID NO: 137841 - protein, 9 aa, Homo Sapiens
IQMILELFD

SEQ ID NO: 137842 - protein, 9 aa, Homo Sapiens
PWIIFNVSS

SEQ ID NO: 137843 - protein, 9 aa, Homo Sapiens
SEVELGDVQ

SEQ ID NO: 137844 - protein, 9 aa, Homo Sapiens
PLQQYARCI

SEQ ID NO: 137845 - protein, 9 aa, Homo Sapiens
SPPEERSFS

SEQ ID NO: 137846 - protein, 9 aa, Homo Sapiens
PCNAELIIL

SEQ ID NO: 137847 - protein, 9 aa, Homo Sapiens
SATLTIGIT

SEQ ID NO: 137848 - protein, 9 aa, Homo Sapiens
LLRHPPQAP

SEQ ID NO: 137849 - protein, 9 aa, Homo Sapiens
SGLPRHVRT

SEQ ID NO: 137850 - protein, 9 aa, Homo Sapiens
YLSLADKDV

SEQ ID NO: 137851 - protein, 9 aa, Homo Sapiens
VFYISREDG

SEQ ID NO: 137852 - protein, 9 aa, Homo Sapiens
TPEILYPAF

SEQ ID NO: 137853 - protein, 9 aa, Homo Sapiens
LTIHRLTLH

SEQ ID NO: 137854 - protein, 9 aa, Homo Sapiens
RGMQQPPLP

SEQ ID NO: 137855 - protein, 9 aa, Homo Sapiens
QRRLCLYRP

SEQ ID NO: 137856 - protein, 9 aa, Homo Sapiens
LTRNFEAHN

SEQ ID NO: 137857 - protein, 9 aa, Homo Sapiens
LNFSSPWVG

SEQ ID NO: 137858 - protein, 9 aa, Homo Sapiens
LVDLKSAKE

SEQ ID NO: 137859 - protein, 9 aa, Homo Sapiens
ISDKQWSTM

SEQ ID NO: 137860 - protein, 9 aa, Homo Sapiens
LDNIFLTPM

SEQ ID NO: 137861 - protein, 9 aa, Homo Sapiens
TISSSGSGL

SEQ ID NO: 137862 - protein, 9 aa, Homo Sapiens
IITDTSFLS

SEQ ID NO: 137863 - protein, 9 aa, Homo Sapiens
FLNNGVCKD

SEQ ID NO: 137864 - protein, 9 aa, Homo Sapiens
LMKDGCIQL

SEQ ID NO: 137865 - protein, 9 aa, Homo Sapiens
PPEDKPEDG

SEQ ID NO: 137866 - protein, 9 aa, Homo Sapiens
GTHREKGDL

SEQ ID NO: 137867 - protein, 9 aa, Homo Sapiens
TVKLWDLKM

SEQ ID NO: 137868 - protein, 9 aa, Homo Sapiens
LPRHVRTLM

SEQ ID NO: 137869 - protein, 9 aa, Homo Sapiens
MGSERALIL

SEQ ID NO: 137870 - protein, 9 aa, Homo Sapiens
WMVVRHGGP

SEQ ID NO: 137871 - protein, 9 aa, Homo Sapiens
AIRKRGLTP

SEQ ID NO: 137872 - protein, 9 aa, Homo Sapiens
QDRPLFRVP

SEQ ID NO: 137873 - protein, 9 aa, Homo Sapiens
CRKNRCNNM

SEQ ID NO: 137874 - protein, 9 aa, Homo Sapiens
GYLSLADKD

SEQ ID NO: 137875 - protein, 9 aa, Homo Sapiens
IRHSPPEER

SEQ ID NO: 137876 - protein, 9 aa, Homo Sapiens
PLWPPGQKG

SEQ ID NO: 137877 - protein, 9 aa, Homo Sapiens
PPEKPTTPT

SEQ ID NO: 137878 - protein, 9 aa, Homo Sapiens
KYLKIKHLL

SEQ ID NO: 137879 - protein, 9 aa, Homo Sapiens
LTIGITDIN

SEQ ID NO: 137880 - protein, 9 aa, Homo Sapiens
VDDPDKYHQ

SEQ ID NO: 137881 - protein, 9 aa, Homo Sapiens
ETQRRLCLY

SEQ ID NO: 137882 - protein, 9 aa, Homo Sapiens
ALPLEREDS

SEQ ID NO: 137883 - protein, 9 aa, Homo Sapiens
HGNQRQEAV

SEQ ID NO: 137884 - protein, 9 aa, Homo Sapiens
CRWLCRRCV

SEQ ID NO: 137885 - protein, 9 aa, Homo Sapiens
EEDTEDGIS

SEQ ID NO: 137886 - protein, 9 aa, Homo Sapiens
NCFLLYQMW

SEQ ID NO: 137887 - protein, 9 aa, Homo Sapiens
VRGMWCFYS

SEQ ID NO: 137888 - protein, 9 aa, Homo Sapiens
RDTLWVRGQ

SEQ ID NO: 137889 - protein, 9 aa, Homo Sapiens
IRKRGLTPI

SEQ ID NO: 137890 - protein, 9 aa, Homo Sapiens
QRLLERGQV

SEQ ID NO: 137891 - protein, 9 aa, Homo Sapiens
LKEEEREIK

SEQ ID NO: 137892 - protein, 9 aa, Homo Sapiens
EPETQKDEK

SEQ ID NO: 137893 - protein, 9 aa, Homo Sapiens
IHEQVRDWQ

SEQ ID NO: 137894 - protein, 9 aa, Homo Sapiens
ERVDLSKLQ

SEQ ID NO: 137895 - protein, 9 aa, Homo Sapiens
TLNHGLVLV

SEQ ID NO: 137896 - protein, 9 aa, Homo Sapiens
VTVWGFRIY

SEQ ID NO: 137897 - protein, 9 aa, Homo Sapiens
LMASEDEYS

SEQ ID NO: 137898 - protein, 9 aa, Homo Sapiens
SEVTVWGFR

SEQ ID NO: 137899 - protein, 9 aa, Homo Sapiens
LKANILPAT

SEQ ID NO: 137900 - protein, 9 aa, Homo Sapiens
MSGKYPNSV

SEQ ID NO: 137901 - protein, 9 aa, Homo Sapiens
SYYSSPGST

SEQ ID NO: 137902 - protein, 9 aa, Homo Sapiens
KQLKPSEKY

SEQ ID NO: 137903 - protein, 9 aa, Homo Sapiens
EQGLMGPLW

SEQ ID NO: 137904 - protein, 9 aa, Homo Sapiens
TSFLSGLSA

SEQ ID NO: 137905 - protein, 9 aa, Homo Sapiens
KERQKKDNQ

SEQ ID NO: 137906 - protein, 9 aa, Homo Sapiens
PARLPSPRS

SEQ ID NO: 137907 - protein, 9 aa, Homo Sapiens
QSEFLVEES

SEQ ID NO: 137908 - protein, 9 aa, Homo Sapiens
EAAEWPLQQ

SEQ ID NO: 137909 - protein, 9 aa, Homo Sapiens
QYARCIPSN

SEQ ID NO: 137910 - protein, 9 aa, Homo Sapiens
VVTISSSGS

SEQ ID NO: 137911 - protein, 9 aa, Homo Sapiens
VTGAADGII

SEQ ID NO: 137912 - protein, 9 aa, Homo Sapiens
LENLVQRWK

SEQ ID NO: 137913 - protein, 9 aa, Homo Sapiens
TIGITDIND

SEQ ID NO: 137914 - protein, 9 aa, Homo Sapiens
KKDNQNLIE

SEQ ID NO: 137915 - protein, 9 aa, Homo Sapiens
VFLLRHPPQ

SEQ ID NO: 137916 - protein, 9 aa, Homo Sapiens
QIFSSHVFG

SEQ ID NO: 137917 - protein, 9 aa, Homo Sapiens
RIHEQVRDW

SEQ ID NO: 137918 - protein, 9 aa, Homo Sapiens
GRHPSNRSA

SEQ ID NO: 137919 - protein, 9 aa, Homo Sapiens
QWSTMPNRH

SEQ ID NO: 137920 - protein, 9 aa, Homo Sapiens
SEECRMSGK

SEQ ID NO: 137921 - protein, 9 aa, Homo Sapiens
TIHRLTLHK

SEQ ID NO: 137922 - protein, 9 aa, Homo Sapiens
AADGIIRLF

SEQ ID NO: 137923 - protein, 9 aa, Homo Sapiens
VFHALMKDG

SEQ ID NO: 137924 - protein, 9 aa, Homo Sapiens
PKRVSILSK

SEQ ID NO: 137925 - protein, 9 aa, Homo Sapiens
RGCPLLCRW

SEQ ID NO: 137926 - protein, 9 aa, Homo Sapiens
DCKDFNCTP

SEQ ID NO: 137927 - protein, 9 aa, Homo Sapiens
MGPLWPPGQ

SEQ ID NO: 137928 - protein, 9 aa, Homo Sapiens
VVVGACGVG

SEQ ID NO: 137929 - protein, 9 aa, Homo Sapiens
RNMLINCEN

SEQ ID NO: 137930 - protein, 9 aa, Homo Sapiens
ALELNKVNP

SEQ ID NO: 137931 - protein, 9 aa, Homo Sapiens
CNLMVADLF

SEQ ID NO: 137932 - protein, 9 aa, Homo Sapiens
LGFTECFLY

SEQ ID NO: 137933 - protein, 9 aa, Homo Sapiens
QGDWSASLE

SEQ ID NO: 137934 - protein, 9 aa, Homo Sapiens
WGRHPSNRS

SEQ ID NO: 137935 - protein, 9 aa, Homo Sapiens
WPPGQKGSI

SEQ ID NO: 137936 - protein, 9 aa, Homo Sapiens
ERAATPHHR

SEQ ID NO: 137937 - protein, 9 aa, Homo Sapiens
DIYPCPNTV

SEQ ID NO: 137938 - protein, 9 aa, Homo Sapiens
TEYVYMRPP

SEQ ID NO: 137939 - protein, 9 aa, Homo Sapiens
LHAVLKPFF

SEQ ID NO: 137940 - protein, 9 aa, Homo Sapiens
EYFKVFMEN

SEQ ID NO: 137941 - protein, 9 aa, Homo Sapiens
AVNESNTRV

SEQ ID NO: 137942 - protein, 9 aa, Homo Sapiens
SFSPFKSYS

SEQ ID NO: 137943 - protein, 9 aa, Homo Sapiens
RSWLFSSDP

SEQ ID NO: 137944 - protein, 9 aa, Homo Sapiens
RKRGLTPIH

SEQ ID NO: 137945 - protein, 9 aa, Homo Sapiens
NPGDQFHPT

SEQ ID NO: 137946 - protein, 9 aa, Homo Sapiens
SPPDPACRE

SEQ ID NO: 137947 - protein, 9 aa, Homo Sapiens
TPRLVVPAT

SEQ ID NO: 137948 - protein, 9 aa, Homo Sapiens
AHNARGGGN

SEQ ID NO: 137949 - protein, 9 aa, Homo Sapiens
PFKSYSRQS

SEQ ID NO: 137950 - protein, 9 aa, Homo Sapiens
PDCVSIVVQ

SEQ ID NO: 137951 - protein, 9 aa, Homo Sapiens
LASVFQDFD

SEQ ID NO: 137952 - protein, 9 aa, Homo Sapiens
ERGQVDDRD

SEQ ID NO: 137953 - protein, 9 aa, Homo Sapiens
VVGACGVGK

SEQ ID NO: 137954 - protein, 9 aa, Homo Sapiens
PELFHKIGM

SEQ ID NO: 137955 - protein, 9 aa, Homo Sapiens
GERQWAGEM

SEQ ID NO: 137956 - protein, 9 aa, Homo Sapiens
KMGERQWAG

SEQ ID NO: 137957 - protein, 9 aa, Homo Sapiens
LFSSDPQKA

SEQ ID NO: 137958 - protein, 9 aa, Homo Sapiens
ADGIIRLFD

SEQ ID NO: 137959 - protein, 9 aa, Homo Sapiens
SNIRHSPPE

SEQ ID NO: 137960 - protein, 9 aa, Homo Sapiens
PLFRVPREK

SEQ ID NO: 137961 - protein, 9 aa, Homo Sapiens
PQKASCRIS

SEQ ID NO: 137962 - protein, 9 aa, Homo Sapiens
SECMIQIFS

SEQ ID NO: 137963 - protein, 9 aa, Homo Sapiens
SPFKSYSRQ

SEQ ID NO: 137964 - protein, 9 aa, Homo Sapiens
PGVFYISRE

SEQ ID NO: 137965 - protein, 9 aa, Homo Sapiens
LNPFIYSLS

SEQ ID NO: 137966 - protein, 9 aa, Homo Sapiens
RRTNVAQIH

SEQ ID NO: 137967 - protein, 9 aa, Homo Sapiens
PGKAGPQER

SEQ ID NO: 137968 - protein, 9 aa, Homo Sapiens
PRGMQQPPL

SEQ ID NO: 137969 - protein, 9 aa, Homo Sapiens
DVLCVAPRH

SEQ ID NO: 137970 - protein, 9 aa, Homo Sapiens
EVNRHSANN

SEQ ID NO: 137971 - protein, 9 aa, Homo Sapiens
KTTSPLKEE

SEQ ID NO: 137972 - protein, 9 aa, Homo Sapiens
IDVLCVAPR

SEQ ID NO: 137973 - protein, 9 aa, Homo Sapiens
LLLKRERVD

SEQ ID NO: 137974 - protein, 9 aa, Homo Sapiens
STQSEFLVE

SEQ ID NO: 137975 - protein, 9 aa, Homo Sapiens
NFEAHNARG

SEQ ID NO: 137976 - protein, 9 aa, Homo Sapiens
PLTSRSSAQ

SEQ ID NO: 137977 - protein, 9 aa, Homo Sapiens
LQVPQPVLP

SEQ ID NO: 137978 - protein, 9 aa, Homo Sapiens
LKMGEFIRN

SEQ ID NO: 137979 - protein, 9 aa, Homo Sapiens
ECMIQIFSS

SEQ ID NO: 137980 - protein, 9 aa, Homo Sapiens
IPPEKPTTP

SEQ ID NO: 137981 - protein, 9 aa, Homo Sapiens
LQDSEVTVW

SEQ ID NO: 137982 - protein, 9 aa, Homo Sapiens
SQLKGLNLF

SEQ ID NO: 137983 - protein, 9 aa, Homo Sapiens
ERQWAGEMT

SEQ ID NO: 137984 - protein, 9 aa, Homo Sapiens
LKEKEPETQ

SEQ ID NO: 137985 - protein, 9 aa, Homo Sapiens
LDQNKIHYE

SEQ ID NO: 137986 - protein, 9 aa, Homo Sapiens
LPFLNNGVC

SEQ ID NO: 137987 - protein, 9 aa, Homo Sapiens
RGMWCFYSY

SEQ ID NO: 137988 - protein, 9 aa, Homo Sapiens
PLKEEEREI

SEQ ID NO: 137989 - protein, 9 aa, Homo Sapiens
KRGLTPIHS

SEQ ID NO: 137990 - protein, 9 aa, Homo Sapiens
CFLLYQMWT

SEQ ID NO: 137991 - protein, 9 aa, Homo Sapiens
RGLTPIHSA

SEQ ID NO: 137992 - protein, 9 aa, Homo Sapiens
DEEDTEDGI

SEQ ID NO: 137993 - protein, 9 aa, Homo Sapiens
DWSASLEVD

SEQ ID NO: 137994 - protein, 9 aa, Homo Sapiens
IPTEKSTIP

SEQ ID NO: 137995 - protein, 9 aa, Homo Sapiens
PGARDTLWV

SEQ ID NO: 137996 - protein, 9 aa, Homo Sapiens
HPLLCEGTH

SEQ ID NO: 137997 - protein, 9 aa, Homo Sapiens
WFQLYRSMN

SEQ ID NO: 137998 - protein, 9 aa, Homo Sapiens
LFIPPLPSY

SEQ ID NO: 137999 - protein, 9 aa, Homo Sapiens
VESVVKLNE

SEQ ID NO: 138000 - protein, 9 aa, Homo Sapiens
YYPDCVSIV

SEQ ID NO: 138001 - protein, 9 aa, Homo Sapiens
EERSFSFTT

SEQ ID NO: 138002 - protein, 9 aa, Homo Sapiens
LGILQLRRK

SEQ ID NO: 138003 - protein, 9 aa, Homo Sapiens
RLVKCDIYP

SEQ ID NO: 138004 - protein, 9 aa, Homo Sapiens
VTISSSGSG

SEQ ID NO: 138005 - protein, 9 aa, Homo Sapiens
VKHLHHLLK

SEQ ID NO: 138006 - protein, 9 aa, Homo Sapiens
RNFEAHNAR

SEQ ID NO: 138007 - protein, 9 aa, Homo Sapiens
GLSVVFALE

SEQ ID NO: 138008 - protein, 9 aa, Homo Sapiens
ELSVVESVV

SEQ ID NO: 138009 - protein, 9 aa, Homo Sapiens
TGIVSSFGR

SEQ ID NO: 138010 - protein, 9 aa, Homo Sapiens
VVKLNEAQP

SEQ ID NO: 138011 - protein, 9 aa, Homo Sapiens
RKRWFQLYR

SEQ ID NO: 138012 - protein, 9 aa, Homo Sapiens
YVDDPDKYH

SEQ ID NO: 138013 - protein, 9 aa, Homo Sapiens
QKKDNQNLI

SEQ ID NO: 138014 - protein, 9 aa, Homo Sapiens
RPGVFYISR

SEQ ID NO: 138015 - protein, 9 aa, Homo Sapiens
QEPLQEEIK

SEQ ID NO: 138016 - protein, 9 aa, Homo Sapiens
CLNGGKDPI

SEQ ID NO: 138017 - protein, 9 aa, Homo Sapiens
VREDLAHRV

SEQ ID NO: 138018 - protein, 9 aa, Homo Sapiens
RWGRHPSNR

SEQ ID NO: 138019 - protein, 9 aa, Homo Sapiens
MKTTSPLKE

SEQ ID NO: 138020 - protein, 9 aa, Homo Sapiens
HFLGFTECF

SEQ ID NO: 138021 - protein, 9 aa, Homo Sapiens
LDSAQLEGY

SEQ ID NO: 138022 - protein, 9 aa, Homo Sapiens
RHRAEALPL

SEQ ID NO: 138023 - protein, 9 aa, Homo Sapiens
PLPFLNNGV

SEQ ID NO: 138024 - protein, 9 aa, Homo Sapiens
EDGHTSHPL

SEQ ID NO: 138025 - protein, 9 aa, Homo Sapiens
IDGQRLLER

SEQ ID NO: 138026 - protein, 9 aa, Homo Sapiens
LPHSGISSL

SEQ ID NO: 138027 - protein, 9 aa, Homo Sapiens
NLFHNKLGL

SEQ ID NO: 138028 - protein, 9 aa, Homo Sapiens
RRLCLYRPC

SEQ ID NO: 138029 - protein, 9 aa, Homo Sapiens
LSNKDMKQG

SEQ ID NO: 138030 - protein, 9 aa, Homo Sapiens
RTNVAQIHM

SEQ ID NO: 138031 - protein, 9 aa, Homo Sapiens
GIVPSIPTM

SEQ ID NO: 138032 - protein, 9 aa, Homo Sapiens
CGVGKSALT

SEQ ID NO: 138033 - protein, 9 aa, Homo Sapiens
KAGPQERGG

SEQ ID NO: 138034 - protein, 9 aa, Homo Sapiens
SIPTMAASS

SEQ ID NO: 138035 - protein, 9 aa, Homo Sapiens
FNCTPGSRQ

SEQ ID NO: 138036 - protein, 9 aa, Homo Sapiens
PEDGHTSHP

SEQ ID NO: 138037 - protein, 9 aa, Homo Sapiens
FREALTKQG

SEQ ID NO: 138038 - protein, 9 aa, Homo Sapiens
LVLVDLKSA

SEQ ID NO: 138039 - protein, 9 aa, Homo Sapiens
QRWGRHPSN

SEQ ID NO: 138040 - protein, 9 aa, Homo Sapiens
CPLLCRWLC

SEQ ID NO: 138041 - protein, 9 aa, Homo Sapiens
RVTPEIPAR

SEQ ID NO: 138042 - protein, 9 aa, Homo Sapiens
IHMAYRYET

SEQ ID NO: 138043 - protein, 9 aa, Homo Sapiens
GVYLCNLMV

SEQ ID NO: 138044 - protein, 9 aa, Homo Sapiens
ADSAWMVVR

SEQ ID NO: 138045 - protein, 9 aa, Homo Sapiens
VRLVKCDIY

SEQ ID NO: 138046 - protein, 9 aa, Homo Sapiens
WVGISAVAL

SEQ ID NO: 138047 - protein, 9 aa, Homo Sapiens
SKLGSTQSE

SEQ ID NO: 138048 - protein, 9 aa, Homo Sapiens
VFALELNKV

SEQ ID NO: 138049 - protein, 9 aa, Homo Sapiens
AEALPLERE

SEQ ID NO: 138050 - protein, 9 aa, Homo Sapiens
IQIFSSHVF

SEQ ID NO: 138051 - protein, 9 aa, Homo Sapiens
PHSGISSLR

SEQ ID NO: 138052 - protein, 9 aa, Homo Sapiens
SFSECMIQI

SEQ ID NO: 138053 - protein, 9 aa, Homo Sapiens
CGKSFSHGS

SEQ ID NO: 138054 - protein, 9 aa, Homo Sapiens
TVPLMNPGD

SEQ ID NO: 138055 - protein, 9 aa, Homo Sapiens
ILELFDQLH

SEQ ID NO: 138056 - protein, 9 aa, Homo Sapiens
WNQRWGRHP

SEQ ID NO: 138057 - protein, 9 aa, Homo Sapiens
NLVQRWKKR

SEQ ID NO: 138058 - protein, 9 aa, Homo Sapiens
ADIDVLCVA

SEQ ID NO: 138059 - protein, 9 aa, Homo Sapiens
VFISAVVGM

SEQ ID NO: 138060 - protein, 9 aa, Homo Sapiens
TPMHWSNVG

SEQ ID NO: 138061 - protein, 9 aa, Homo Sapiens
IHRLTLHKE

SEQ ID NO: 138062 - protein, 9 aa, Homo Sapiens
DLENLVQRW

SEQ ID NO: 138063 - protein, 9 aa, Homo Sapiens
CMIQIFSSH

SEQ ID NO: 138064 - protein, 9 aa, Homo Sapiens
TDTSFLSGL

SEQ ID NO: 138065 - protein, 9 aa, Homo Sapiens
VKCDIYPCP

SEQ ID NO: 138066 - protein, 9 aa, Homo Sapiens
KLGSTQSEF

SEQ ID NO: 138067 - protein, 9 aa, Homo Sapiens
LPLEREDSG

SEQ ID NO: 138068 - protein, 9 aa, Homo Sapiens
EAHNARGGG

SEQ ID NO: 138069 - protein, 9 aa, Homo Sapiens
NNMGYEINK

SEQ ID NO: 138070 - protein, 9 aa, Homo Sapiens
QVRDWQLEK

SEQ ID NO: 138071 - protein, 9 aa, Homo Sapiens
LIILGRNTQ

SEQ ID NO: 138072 - protein, 9 aa, Homo Sapiens
LLCEGTHRE

SEQ ID NO: 138073 - protein, 9 aa, Homo Sapiens
VRTEYVYMR

SEQ ID NO: 138074 - protein, 9 aa, Homo Sapiens
EPTSYYSSP

SEQ ID NO: 138075 - protein, 9 aa, Homo Sapiens
EAVNESNTR

SEQ ID NO: 138076 - protein, 9 aa, Homo Sapiens
LVTGAADGI

SEQ ID NO: 138077 - protein, 9 aa, Homo Sapiens
LNPSDSISI

SEQ ID NO: 138078 - protein, 9 aa, Homo Sapiens
LSEVELGDV

SEQ ID NO: 138079 - protein, 9 aa, Homo Sapiens
CILVHGDAA

SEQ ID NO: 138080 - protein, 9 aa, Homo Sapiens
SVFQDFDVS

SEQ ID NO: 138081 - protein, 9 aa, Homo Sapiens
SGPEHTIPI

SEQ ID NO: 138082 - protein, 9 aa, Homo Sapiens
LKPSEKYLK

SEQ ID NO: 138083 - protein, 9 aa, Homo Sapiens
AVLGILQLR

SEQ ID NO: 138084 - protein, 9 aa, Homo Sapiens
PETQKDEKM

SEQ ID NO: 138085 - protein, 9 aa, Homo Sapiens
ELRKKIGGL

SEQ ID NO: 138086 - protein, 9 aa, Homo Sapiens
RALILDRLA

SEQ ID NO: 138087 - protein, 9 aa, Homo Sapiens
QSALDQNKI

SEQ ID NO: 138088 - protein, 9 aa, Homo Sapiens
QLKPSEKYL

SEQ ID NO: 138089 - protein, 9 aa, Homo Sapiens
PACRELGYR

SEQ ID NO: 138090 - protein, 9 aa, Homo Sapiens
ELGDVQGAA

SEQ ID NO: 138091 - protein, 9 aa, Homo Sapiens
EKYLKIKHL

SEQ ID NO: 138092 - protein, 9 aa, Homo Sapiens
GLNLFHNKL

SEQ ID NO: 138093 - protein, 9 aa, Homo Sapiens
FFLRRIKTD

SEQ ID NO: 138094 - protein, 9 aa, Homo Sapiens
ASPPDPACR

SEQ ID NO: 138095 - protein, 9 aa, Homo Sapiens
LNHGLVLVD

SEQ ID NO: 138096 - protein, 9 aa, Homo Sapiens
YLCNLMVAD

SEQ ID NO: 138097 - protein, 9 aa, Homo Sapiens
PFIYSLSNK

SEQ ID NO: 138098 - protein, 9 aa, Homo Sapiens
MNPGDQFHP

SEQ ID NO: 138099 - protein, 9 aa, Homo Sapiens
RHLDKFSQI

SEQ ID NO: 138100 - protein, 9 aa, Homo Sapiens
YISREDGYI

SEQ ID NO: 138101 - protein, 9 aa, Homo Sapiens
IQMRLAYVC

SEQ ID NO: 138102 - protein, 9 aa, Homo Sapiens
ALDQNKIHY

SEQ ID NO: 138103 - protein, 9 aa, Homo Sapiens
IDECSPLPF

SEQ ID NO: 138104 - protein, 9 aa, Homo Sapiens
GENEYFKVF

SEQ ID NO: 138105 - protein, 9 aa, Homo Sapiens
IPTMAASSV

SEQ ID NO: 138106 - protein, 9 aa, Homo Sapiens
PAAPPAGLQ

SEQ ID NO: 138107 - protein, 9 aa, Homo Sapiens
AMITPAFRE

SEQ ID NO: 138108 - protein, 9 aa, Homo Sapiens
LLIDRFCLN

SEQ ID NO: 138109 - protein, 9 aa, Homo Sapiens
SFFVYLVEK

SEQ ID NO: 138110 - protein, 9 aa, Homo Sapiens
SGISSLRRV

SEQ ID NO: 138111 - protein, 9 aa, Homo Sapiens
YMRPPPWSD

SEQ ID NO: 138112 - protein, 9 aa, Homo Sapiens
RHPSNRSAR

SEQ ID NO: 138113 - protein, 9 aa, Homo Sapiens
KEDDKFFLP

SEQ ID NO: 138114 - protein, 9 aa, Homo Sapiens
VNESNTRVP

SEQ ID NO: 138115 - protein, 9 aa, Homo Sapiens
DGISFQPYI

SEQ ID NO: 138116 - protein, 9 aa, Homo Sapiens
YCLDLLVGN

SEQ ID NO: 138117 - protein, 9 aa, Homo Sapiens
SRPPVTPRL

SEQ ID NO: 138118 - protein, 9 aa, Homo Sapiens
LILSSFFVY

SEQ ID NO: 138119 - protein, 9 aa, Homo Sapiens
CDIYPCPNT

SEQ ID NO: 138120 - protein, 9 aa, Homo Sapiens
NVAQIHMAY

SEQ ID NO: 138121 - protein, 9 aa, Homo Sapiens
KGADIDVLC

SEQ ID NO: 138122 - protein, 9 aa, Homo Sapiens
TDINDNCPL

SEQ ID NO: 138123 - protein, 9 aa, Homo Sapiens
RWKKRLRHR

SEQ ID NO: 138124 - protein, 9 aa, Homo Sapiens
PFLNNGVCK

SEQ ID NO: 138125 - protein, 9 aa, Homo Sapiens
SAVVGMQLF

SEQ ID NO: 138126 - protein, 9 aa, Homo Sapiens
GKYPNSVSI

SEQ ID NO: 138127 - protein, 9 aa, Homo Sapiens
LPLTSRSSA

SEQ ID NO: 138128 - protein, 9 aa, Homo Sapiens
IILGRNTQI

SEQ ID NO: 138129 - protein, 9 aa, Homo Sapiens
EQVRDWQLE

SEQ ID NO: 138130 - protein, 9 aa, Homo Sapiens
TRHLDKFSQ

SEQ ID NO: 138131 - protein, 9 aa, Homo Sapiens
ESVVKLNEA

SEQ ID NO: 138132 - protein, 9 aa, Homo Sapiens
VLVDLKSAK

SEQ ID NO: 138133 - protein, 9 aa, Homo Sapiens
LGSTQSEFL

SEQ ID NO: 138134 - protein, 9 aa, Homo Sapiens
LWFKEDDKF

SEQ ID NO: 138135 - protein, 9 aa, Homo Sapiens
QLRRKFERI

SEQ ID NO: 138136 - protein, 9 aa, Homo Sapiens
SSAQSPLQP

SEQ ID NO: 138137 - protein, 9 aa, Homo Sapiens
SSFFVYLVE

SEQ ID NO: 138138 - protein, 9 aa, Homo Sapiens
FALELNKVN

SEQ ID NO: 138139 - protein, 9 aa, Homo Sapiens
LRKRWFQLY

SEQ ID NO: 138140 - protein, 9 aa, Homo Sapiens
QEAVNESNT

SEQ ID NO: 138141 - protein, 9 aa, Homo Sapiens
HLLKQLKPS

SEQ ID NO: 138142 - protein, 9 aa, Homo Sapiens
PRIISDKQW

SEQ ID NO: 138143 - protein, 9 aa, Homo Sapiens
IEKQRLLEK

SEQ ID NO: 138144 - protein, 9 aa, Homo Sapiens
APKRVSILS

SEQ ID NO: 138145 - protein, 9 aa, Homo Sapiens
DQNKIHYEI

SEQ ID NO: 138146 - protein, 9 aa, Homo Sapiens
SRHRAEALP

SEQ ID NO: 138147 - protein, 9 aa, Homo Sapiens
KVFMENLMK

SEQ ID NO: 138148 - protein, 9 aa, Homo Sapiens
SSDPQKASC

SEQ ID NO: 138149 - protein, 9 aa, Homo Sapiens
FLRRIKTDV

SEQ ID NO: 138150 - protein, 9 aa, Homo Sapiens
QVSGPEHTI

SEQ ID NO: 138151 - protein, 9 aa, Homo Sapiens
RAEALPLER

SEQ ID NO: 138152 - protein, 9 aa, Homo Sapiens
YRNMLINCE

SEQ ID NO: 138153 - protein, 9 aa, Homo Sapiens
VVFRQQVHA

SEQ ID NO: 138154 - protein, 9 aa, Homo Sapiens
GISFQPYIE

SEQ ID NO: 138155 - protein, 9 aa, Homo Sapiens
YLKIKHLLL

SEQ ID NO: 138156 - protein, 9 aa, Homo Sapiens
IKHLLLKRE

SEQ ID NO: 138157 - protein, 9 aa, Homo Sapiens
EKQRLLEKD

SEQ ID NO: 138158 - protein, 9 aa, Homo Sapiens
ALILDRLAS

SEQ ID NO: 138159 - protein, 9 aa, Homo Sapiens
DQFHPTPPP

SEQ ID NO: 138160 - protein, 9 aa, Homo Sapiens
AQGKKVMCI

SEQ ID NO: 138161 - protein, 9 aa, Homo Sapiens
VPSIPTMAA

SEQ ID NO: 138162 - protein, 9 aa, Homo Sapiens
EECRMSGKY

SEQ ID NO: 138163 - protein, 9 aa, Homo Sapiens
NQNLIERRR

SEQ ID NO: 138164 - protein, 9 aa, Homo Sapiens
KVFHALMKD

SEQ ID NO: 138165 - protein, 9 aa, Homo Sapiens
MWCFYSYLT

SEQ ID NO: 138166 - protein, 9 aa, Homo Sapiens
VVQKTTSHI

SEQ ID NO: 138167 - protein, 9 aa, Homo Sapiens
DTEDGISFQ

SEQ ID NO: 138168 - protein, 9 aa, Homo Sapiens
PLMNPGDQF

SEQ ID NO: 138169 - protein, 9 aa, Homo Sapiens
MLINCENQC

SEQ ID NO: 138170 - protein, 9 aa, Homo Sapiens
SWLFSSDPQ

SEQ ID NO: 138171 - protein, 9 aa, Homo Sapiens
VKLWDLKMG

SEQ ID NO: 138172 - protein, 9 aa, Homo Sapiens
LKSLMASED

SEQ ID NO: 138173 - protein, 9 aa, Homo Sapiens
PAGLQVPQP

SEQ ID NO: 138174 - protein, 9 aa, Homo Sapiens
SFSHGSQLT

SEQ ID NO: 138175 - protein, 9 aa, Homo Sapiens
SPLPFLNNG

SEQ ID NO: 138176 - protein, 9 aa, Homo Sapiens
LLNFSSPWV

SEQ ID NO: 138177 - protein, 9 aa, Homo Sapiens
LMVADLFYI

SEQ ID NO: 138178 - protein, 9 aa, Homo Sapiens
KDGCIQLAL

SEQ ID NO: 138179 - protein, 9 aa, Homo Sapiens
AIIVFISAV

SEQ ID NO: 138180 - protein, 9 aa, Homo Sapiens
PYGIVPSIP

SEQ ID NO: 138181 - protein, 9 aa, Homo Sapiens
RHPPQAPLP

SEQ ID NO: 138182 - protein, 9 aa, Homo Sapiens
PWMVNRELT

SEQ ID NO: 138183 - protein, 9 aa, Homo Sapiens
RMSGKYPNS

SEQ ID NO: 138184 - protein, 9 aa, Homo Sapiens
MGAMTWSPL

SEQ ID NO: 138185 - protein, 9 aa, Homo Sapiens
DGGTPAHSG

SEQ ID NO: 138186 - protein, 9 aa, Homo Sapiens
KVQYGIFPG

SEQ ID NO: 138187 - protein, 9 aa, Homo Sapiens
AWMVVRHGG

SEQ ID NO: 138188 - protein, 9 aa, Homo Sapiens
EMGSERALI

SEQ ID NO: 138189 - protein, 9 aa, Homo Sapiens
TLWVRGQAG

SEQ ID NO: 138190 - protein, 9 aa, Homo Sapiens
MQQPPLPPQ

SEQ ID NO: 138191 - protein, 9 aa, Homo Sapiens
GSEAPKRVS

SEQ ID NO: 138192 - protein, 9 aa, Homo Sapiens
ETQKDEKMS

SEQ ID NO: 138193 - protein, 9 aa, Homo Sapiens
DPQKASCRI

SEQ ID NO: 138194 - protein, 9 aa, Homo Sapiens
ILSSFFVYL

SEQ ID NO: 138195 - protein, 9 aa, Homo Sapiens
EDEYSTKED

SEQ ID NO: 138196 - protein, 9 aa, Homo Sapiens
VVRTEYVYM

SEQ ID NO: 138197 - protein, 9 aa, Homo Sapiens
DTSFLSGLS

SEQ ID NO: 138198 - protein, 9 aa, Homo Sapiens
LERGQVDDR

SEQ ID NO: 138199 - protein, 9 aa, Homo Sapiens
REDQEPLQE

SEQ ID NO: 138200 - protein, 9 aa, Homo Sapiens
DEYSTKEDK

SEQ ID NO: 138201 - protein, 9 aa, Homo Sapiens
MGYEINKVR

SEQ ID NO: 138202 - protein, 9 aa, Homo Sapiens
MVNRELTKG

SEQ ID NO: 138203 - protein, 9 aa, Homo Sapiens
TVEKPYDCG

SEQ ID NO: 138204 - protein, 9 aa, Homo Sapiens
NRCNNMGYE

SEQ ID NO: 138205 - protein, 9 aa, Homo Sapiens
DNQNLIERR

SEQ ID NO: 138206 - protein, 9 aa, Homo Sapiens
RLLPLTSRS

SEQ ID NO: 138207 - protein, 9 aa, Homo Sapiens
FVYLVEKDV

SEQ ID NO: 138208 - protein, 9 aa, Homo Sapiens
LRHPPQAPL

SEQ ID NO: 138209 - protein, 9 aa, Homo Sapiens
RQEAVNESN

SEQ ID NO: 138210 - protein, 9 aa, Homo Sapiens
STNGRHKAF

SEQ ID NO: 138211 - protein, 9 aa, Homo Sapiens
SNKDMKQGL

SEQ ID NO: 138212 - protein, 9 aa, Homo Sapiens
WTLFSTWPN

SEQ ID NO: 138213 - protein, 9 aa, Homo Sapiens
TCHQAEVKH

SEQ ID NO: 138214 - protein, 9 aa, Homo Sapiens
LGDVQGAAQ

SEQ ID NO: 138215 - protein, 9 aa, Homo Sapiens
LYRPCPPSR

SEQ ID NO: 138216 - protein, 9 aa, Homo Sapiens
AGPQERGGV

SEQ ID NO: 138217 - protein, 9 aa, Homo Sapiens
GIVSSFGRT

SEQ ID NO: 138218 - protein, 9 aa, Homo Sapiens
KIKHLLLKR

SEQ ID NO: 138219 - protein, 9 aa, Homo Sapiens
YVYCLDLLV

SEQ ID NO: 138220 - protein, 9 aa, Homo Sapiens
IFSSHVFGC

SEQ ID NO: 138221 - protein, 9 aa, Homo Sapiens
VPDTRHLDK

SEQ ID NO: 138222 - protein, 9 aa, Homo Sapiens
EPLFIPPLP

SEQ ID NO: 138223 - protein, 9 aa, Homo Sapiens
LTLILSSFF

SEQ ID NO: 138224 - protein, 9 aa, Homo Sapiens
QVNYSKIMN

SEQ ID NO: 138225 - protein, 9 aa, Homo Sapiens
EQDRPLFRV

SEQ ID NO: 138226 - protein, 9 aa, Homo Sapiens
MCILVHGDA

SEQ ID NO: 138227 - protein, 9 aa, Homo Sapiens
DGHTSHPLK

SEQ ID NO: 138228 - protein, 9 aa, Homo Sapiens
ITDINDNCP

SEQ ID NO: 138229 - protein, 9 aa, Homo Sapiens
MQHLPAATR

SEQ ID NO: 138230 - protein, 9 aa, Homo Sapiens
YSLSNKDMK

SEQ ID NO: 138231 - protein, 9 aa, Homo Sapiens
PLQEEIKRL

SEQ ID NO: 138232 - protein, 9 aa, Homo Sapiens
EIPARLPSP

SEQ ID NO: 138233 - protein, 9 aa, Homo Sapiens
QDYIQMILE

SEQ ID NO: 138234 - protein, 9 aa, Homo Sapiens
GMWCFYSYL

SEQ ID NO: 138235 - protein, 9 aa, Homo Sapiens
QVVTISSSG

SEQ ID NO: 138236 - protein, 9 aa, Homo Sapiens
GADIDVLCV

SEQ ID NO: 138237 - protein, 9 aa, Homo Sapiens
MILELFDQL

SEQ ID NO: 138238 - protein, 9 aa, Homo Sapiens
IERGEVNRH

SEQ ID NO: 138239 - protein, 9 aa, Homo Sapiens
APGKAGPQE

SEQ ID NO: 138240 - protein, 9 aa, Homo Sapiens
LVQRWKKRL

SEQ ID NO: 138241 - protein, 9 aa, Homo Sapiens
AFREALTKQ

SEQ ID NO: 138242 - protein, 9 aa, Homo Sapiens
GKSFSHGSQ

SEQ ID NO: 138243 - protein, 9 aa, Homo Sapiens
TILKMHSTN

SEQ ID NO: 138244 - protein, 9 aa, Homo Sapiens
TQKTGIVSS

SEQ ID NO: 138245 - protein, 9 aa, Homo Sapiens
AHSGTTLIS

SEQ ID NO: 138246 - protein, 9 aa, Homo Sapiens
RSSAQSPLQ

SEQ ID NO: 138247 - protein, 9 aa, Homo Sapiens
GGTPAHSGT

SEQ ID NO: 138248 - protein, 9 aa, Homo Sapiens
ENLVQRWKK

SEQ ID NO: 138249 - protein, 9 aa, Homo Sapiens
IIMGYVDDP

SEQ ID NO: 138250 - protein, 9 aa, Homo Sapiens
PLPSYNPNP

SEQ ID NO: 138251 - protein, 9 aa, Homo Sapiens
EDQEPLQEE

SEQ ID NO: 138252 - protein, 9 aa, Homo Sapiens
LKQLKPSEK

SEQ ID NO: 138253 - protein, 9 aa, Homo Sapiens
LINCENQCV

SEQ ID NO: 138254 - protein, 9 aa, Homo Sapiens
DADCKDFNC

SEQ ID NO: 138255 - protein, 9 aa, Homo Sapiens
CVSIVVQKT

SEQ ID NO: 138256 - protein, 9 aa, Homo Sapiens
ISSSGSGLQ

SEQ ID NO: 138257 - protein, 9 aa, Homo Sapiens
EFLVEESLP

SEQ ID NO: 138258 - protein, 9 aa, Homo Sapiens
RHVRTLMIL

SEQ ID NO: 138259 - protein, 9 aa, Homo Sapiens
NHGLVLVDL

SEQ ID NO: 138260 - protein, 9 aa, Homo Sapiens
KPFFLRRIK

SEQ ID NO: 138261 - protein, 9 aa, Homo Sapiens
LKPFFLRRI

SEQ ID NO: 138262 - protein, 9 aa, Homo Sapiens
THREKGDLA

SEQ ID NO: 138263 - protein, 9 aa, Homo Sapiens
PEHTIPITR

SEQ ID NO: 138264 - protein, 9 aa, Homo Sapiens
LTLHKEDSQ

SEQ ID NO: 138265 - protein, 9 aa, Homo Sapiens
SAQSPLQPC

SEQ ID NO: 138266 - protein, 9 aa, Homo Sapiens
QGLMGPLWP

SEQ ID NO: 138267 - protein, 9 aa, Homo Sapiens
NLMVADLFY

SEQ ID NO: 138268 - protein, 9 aa, Homo Sapiens
CTPGSRQAS

SEQ ID NO: 138269 - protein, 9 aa, Homo Sapiens
LHVTDASSE

SEQ ID NO: 138270 - protein, 9 aa, Homo Sapiens
DSPGQTCHQ

SEQ ID NO: 138271 - protein, 9 aa, Homo Sapiens
MVRLVKCDI

SEQ ID NO: 138272 - protein, 9 aa, Homo Sapiens
GYVDDPDKY

SEQ ID NO: 138273 - protein, 9 aa, Homo Sapiens
LPQFSSGAD

SEQ ID NO: 138274 - protein, 9 aa, Homo Sapiens
DRFCLNGGK

SEQ ID NO: 138275 - protein, 9 aa, Homo Sapiens
GLQVPQPVL

SEQ ID NO: 138276 - protein, 9 aa, Homo Sapiens
GKAPWMVNR

SEQ ID NO: 138277 - protein, 9 aa, Homo Sapiens
LSSFFVYLV

SEQ ID NO: 138278 - protein, 9 aa, Homo Sapiens
FSTWPNGSC

SEQ ID NO: 138279 - protein, 9 aa, Homo Sapiens
GQRLLERGQ

SEQ ID NO: 138280 - protein, 9 aa, Homo Sapiens
KEPETQKDE

SEQ ID NO: 138281 - protein, 9 aa, Homo Sapiens
DDYQVVTIS

SEQ ID NO: 138282 - protein, 9 aa, Homo Sapiens
CHQAEVKHL

SEQ ID NO: 138283 - protein, 9 aa, Homo Sapiens
EDLAHRVNL

SEQ ID NO: 138284 - protein, 9 aa, Homo Sapiens
SALDQNKIH

SEQ ID NO: 138285 - protein, 9 aa, Homo Sapiens
PRHVRTLMI

SEQ ID NO: 138286 - protein, 9 aa, Homo Sapiens
SESTGHATP

SEQ ID NO: 138287 - protein, 9 aa, Homo Sapiens
SAVKPERAA

SEQ ID NO: 138288 - protein, 9 aa, Homo Sapiens
AQIHMAYRY

SEQ ID NO: 138289 - protein, 9 aa, Homo Sapiens
QERGGVSAV

SEQ ID NO: 138290 - protein, 9 aa, Homo Sapiens
PLFIPPLPS

SEQ ID NO: 138291 - protein, 9 aa, Homo Sapiens
RIISDKQWS

SEQ ID NO: 138292 - protein, 9 aa, Homo Sapiens
QRLLEKDPV

SEQ ID NO: 138293 - protein, 9 aa, Homo Sapiens
KAAWTLFST

SEQ ID NO: 138294 - protein, 9 aa, Homo Sapiens
TLGENEYFK

SEQ ID NO: 138295 - protein, 9 aa, Homo Sapiens
YFKVFMENL

SEQ ID NO: 138296 - protein, 9 aa, Homo Sapiens
ILDRLASNV

SEQ ID NO: 138297 - protein, 9 aa, Homo Sapiens
IVVQKTTSH

SEQ ID NO: 138298 - protein, 9 aa, Homo Sapiens
FPGNFTFNL

SEQ ID NO: 138299 - protein, 9 aa, Homo Sapiens
RKKIGGLYG

SEQ ID NO: 138300 - protein, 9 aa, Homo Sapiens
GDVQGAAQS

SEQ ID NO: 138301 - protein, 9 aa, Homo Sapiens
PTLNHGLVL

SEQ ID NO: 138302 - protein, 9 aa, Homo Sapiens
YIQMILELF

SEQ ID NO: 138303 - protein, 9 aa, Homo Sapiens
HLPAATRAT

SEQ ID NO: 138304 - protein, 9 aa, Homo Sapiens
FRVPREKEA

SEQ ID NO: 138305 - protein, 9 aa, Homo Sapiens
NAIRKRGLT

SEQ ID NO: 138306 - protein, 9 aa, Homo Sapiens
AEWPLQQYA

SEQ ID NO: 138307 - protein, 9 aa, Homo Sapiens
DTLWVRGQA

SEQ ID NO: 138308 - protein, 9 aa, Homo Sapiens
LKGLNLFHN

SEQ ID NO: 138309 - protein, 9 aa, Homo Sapiens
LWDLKMGEF

SEQ ID NO: 138310 - protein, 9 aa, Homo Sapiens
IIVFISAVV

SEQ ID NO: 138311 - protein, 9 aa, Homo Sapiens
VYCLDLLVG
